United States Patent 7,341,835 (METHODS OF ANALYSIS OF ALTERNATIVE SPLICING IN MOUSE) - sequence listing, part 18

SEQ ID NO: 678647 - DNA, 25 bp, Mus musculus
gcatgcactgactgggtggatacca

SEQ ID NO: 678648 - DNA, 25 bp, Mus musculus
gcatgcagaatcatttatcatcctg

SEQ ID NO: 678649 - DNA, 25 bp, Mus musculus
gcatgcagaatcttttatcatcctg

SEQ ID NO: 678650 - DNA, 25 bp, Mus musculus
gcatgcagcttgatgattgagcaca

SEQ ID NO: 678651 - DNA, 25 bp, Mus musculus
gcatgcagcttgttgattgagcaca

SEQ ID NO: 678652 - DNA, 25 bp, Mus musculus
gcatgcagtgccagccgggaatact

SEQ ID NO: 678653 - DNA, 25 bp, Mus musculus
gcatgcagtgcctgccgggaatact

SEQ ID NO: 678654 - DNA, 25 bp, Mus musculus
gcatgcatgtcaagccactggtcta

SEQ ID NO: 678655 - DNA, 25 bp, Mus musculus
gcatgcatgtcatgccactggtcta

SEQ ID NO: 678656 - DNA, 25 bp, Mus musculus
gcatgcatgttaaaagactcctgaa

SEQ ID NO: 678657 - DNA, 25 bp, Mus musculus
gcatgcatgttataagactcctgaa

SEQ ID NO: 678658 - DNA, 25 bp, Mus musculus
gcatgcatttatcgctcaggccttg

SEQ ID NO: 678659 - DNA, 25 bp, Mus musculus
gcatgcatttatggctcaggccttg

SEQ ID NO: 678660 - DNA, 25 bp, Mus musculus
gcatgccacatccttggctctatgg

SEQ ID NO: 678661 - DNA, 25 bp, Mus musculus
gcatgccacatcgttggctctatgg

SEQ ID NO: 678662 - DNA, 25 bp, Mus musculus
gcatgccaccgcaggagatattggg

SEQ ID NO: 678663 - DNA, 25 bp, Mus musculus
gcatgccaccgctggagatattggg

SEQ ID NO: 678664 - DNA, 25 bp, Mus musculus
gcatgccatgaacatacttccaaga

SEQ ID NO: 678665 - DNA, 25 bp, Mus musculus
gcatgccatgaagatacttccaaga

SEQ ID NO: 678666 - DNA, 25 bp, Mus musculus
gcatgccattatagtgtccatcatc

SEQ ID NO: 678667 - DNA, 25 bp, Mus musculus
gcatgccattattgtgtccatcatc

SEQ ID NO: 678668 - DNA, 25 bp, Mus musculus
gcatgcccaagacaatagttaatgc

SEQ ID NO: 678669 - DNA, 25 bp, Mus musculus
gcatgcccaagagaatagttaatgc

SEQ ID NO: 678670 - DNA, 25 bp, Mus musculus
gcatgcccagagcaagggtatacaa

SEQ ID NO: 678671 - DNA, 25 bp, Mus musculus
gcatgcccagagctcaatatcacac

SEQ ID NO: 678672 - DNA, 25 bp, Mus musculus
gcatgcccagaggaagggtatacaa

SEQ ID NO: 678673 - DNA, 25 bp, Mus musculus
gcatgcccagaggtcaatatcacac

SEQ ID NO: 678674 - DNA, 25 bp, Mus musculus
gcatgcccagccattcccaagaaaa

SEQ ID NO: 678675 - DNA, 25 bp, Mus musculus
gcatgcccagcctttcccaagaaaa

SEQ ID NO: 678676 - DNA, 25 bp, Mus musculus
gcatgccctacacaaacgcggtcat

SEQ ID NO: 678677 - DNA, 25 bp, Mus musculus
gcatgccctacagaaacgcggtcat

SEQ ID NO: 678678 - DNA, 25 bp, Mus musculus
gcatgcccttccattcttttgtaaa

SEQ ID NO: 678679 - DNA, 25 bp, Mus musculus
gcatgcccttcctttcttttgtaaa

SEQ ID NO: 678680 - DNA, 25 bp, Mus musculus
gcatgcctagaactggtccgataaa

SEQ ID NO: 678681 - DNA, 25 bp, Mus musculus
gcatgcctagaagtggtccgataaa

SEQ ID NO: 678682 - DNA, 25 bp, Mus musculus
gcatgcctcagccaaatgtcacctg

SEQ ID NO: 678683 - DNA, 25 bp, Mus musculus
gcatgcctcagcgaaatgtcacctg

SEQ ID NO: 678684 - DNA, 25 bp, Mus musculus
gcatgcctcatgagccttatgtgct

SEQ ID NO: 678685 - DNA, 25 bp, Mus musculus
gcatgcctcatgtgccttatgtgct

SEQ ID NO: 678686 - DNA, 25 bp, Mus musculus
gcatgcctgatccttgccaataagt

SEQ ID NO: 678687 - DNA, 25 bp, Mus musculus
gcatgcctgatcgttgccaataagt

SEQ ID NO: 678688 - DNA, 25 bp, Mus musculus
gcatgcctgcagcaatgtctgaagc

SEQ ID NO: 678689 - DNA, 25 bp, Mus musculus
gcatgcctgcaggaatgtctgaagc

SEQ ID NO: 678690 - DNA, 25 bp, Mus musculus
gcatgccttcagatgtaagtggcca

SEQ ID NO: 678691 - DNA, 25 bp, Mus musculus
gcatgccttcagttgtaagtggcca

SEQ ID NO: 678692 - DNA, 25 bp, Mus musculus
gcatgccttgaaccactacacgaca

SEQ ID NO: 678693 - DNA, 25 bp, Mus musculus
gcatgccttgaagcactacacgaca

SEQ ID NO: 678694 - DNA, 25 bp, Mus musculus
gcatgcctttcaccagtttaactgg

SEQ ID NO: 678695 - DNA, 25 bp, Mus musculus
gcatgcctttcagcagtttaactgg

SEQ ID NO: 678696 - DNA, 25 bp, Mus musculus
gcatgcgacagcattccagggcaca

SEQ ID NO: 678697 - DNA, 25 bp, Mus musculus
gcatgcgacagctttccagggcaca

SEQ ID NO: 678698 - DNA, 25 bp, Mus musculus
gcatgcgaggtcatccgggagatca

SEQ ID NO: 678699 - DNA, 25 bp, Mus musculus
gcatgcgaggtcttccgggagatca

SEQ ID NO: 678700 - DNA, 25 bp, Mus musculus
gcatgcgcaccaagggctacatgcc

SEQ ID NO: 678701 - DNA, 25 bp, Mus musculus
gcatgcgcaccatgggctacatgcc

SEQ ID NO: 678702 - DNA, 25 bp, Mus musculus
gcatgcgcccctcaagctctgtgtt

SEQ ID NO: 678703 - DNA, 25 bp, Mus musculus
gcatgcgcccctgaagctctgtgtt

SEQ ID NO: 678704 - DNA, 25 bp, Mus musculus
gcatgcgccttcatgccgcgcaggg

SEQ ID NO: 678705 - DNA, 25 bp, Mus musculus
gcatgcgccttcttgccgcgcaggg

SEQ ID NO: 678706 - DNA, 25 bp, Mus musculus
gcatgcgctactagaacggacttga

SEQ ID NO: 678707 - DNA, 25 bp, Mus musculus
gcatgcgctacttgaacggacttga

SEQ ID NO: 678708 - DNA, 25 bp, Mus musculus
gcatgcgtcttaagctcatcgccag

SEQ ID NO: 678709 - DNA, 25 bp, Mus musculus
gcatgcgtcttatgctcatcgccag

SEQ ID NO: 678710 - DNA, 25 bp, Mus musculus
gcatgctagcgcagcgtatggctaa

SEQ ID NO: 678711 - DNA, 25 bp, Mus musculus
gcatgctagcgctgcgtatggctaa

SEQ ID NO: 678712 - DNA, 25 bp, Mus musculus
gcatgctagtgaatcaagttcatcc

SEQ ID NO: 678713 - DNA, 25 bp, Mus musculus
gcatgctagtgattcaagttcatcc

SEQ ID NO: 678714 - DNA, 25 bp, Mus musculus
gcatgctatcaaaagcatgggccag

SEQ ID NO: 678715 - DNA, 25 bp, Mus musculus
gcatgctatcaatagcatgggccag

SEQ ID NO: 678716 - DNA, 25 bp, Mus musculus
gcatgctattctagtgctctccgtg

SEQ ID NO: 678717 - DNA, 25 bp, Mus musculus
gcatgctattcttgtgctctccgtg

SEQ ID NO: 678718 - DNA, 25 bp, Mus musculus
gcatgctcaggactcacaacttgcc

SEQ ID NO: 678719 - DNA, 25 bp, Mus musculus
gcatgctcaggagtcacaacttgcc

SEQ ID NO: 678720 - DNA, 25 bp, Mus musculus
gcatgctcattgacttgaagctagg

SEQ ID NO: 678721 - DNA, 25 bp, Mus musculus
gcatgctcattgtcttgaagctagg

SEQ ID NO: 678722 - DNA, 25 bp, Mus musculus
gcatgctccacaaacatgtttccaa

SEQ ID NO: 678723 - DNA, 25 bp, Mus musculus
gcatgctccacatacatgtttccaa

SEQ ID NO: 678724 - DNA, 25 bp, Mus musculus
gcatgctccgtgatgttcagtgggc

SEQ ID NO: 678725 - DNA, 25 bp, Mus musculus
gcatgctccgtgttgttcagtgggc

SEQ ID NO: 678726 - DNA, 25 bp, Mus musculus
gcatgctcctctaacacgtttccga

SEQ ID NO: 678727 - DNA, 25 bp, Mus musculus
gcatgctcctcttacacgtttccga

SEQ ID NO: 678728 - DNA, 25 bp, Mus musculus
gcatgctcgactagaagggtctaca

SEQ ID NO: 678729 - DNA, 25 bp, Mus musculus
gcatgctcgacttgaagggtctaca

SEQ ID NO: 678730 - DNA, 25 bp, Mus musculus
gcatgctctggaaggacatggccat

SEQ ID NO: 678731 - DNA, 25 bp, Mus musculus
gcatgctctggatggacatggccat

SEQ ID NO: 678732 - DNA, 25 bp, Mus musculus
gcatgctgaagaccttgccgcctgt

SEQ ID NO: 678733 - DNA, 25 bp, Mus musculus
gcatgctgaagagcttgccgcctgt

SEQ ID NO: 678734 - DNA, 25 bp, Mus musculus
gcatgctgattccagcccttcctga

SEQ ID NO: 678735 - DNA, 25 bp, Mus musculus
gcatgctgattcgagcccttcctga

SEQ ID NO: 678736 - DNA, 25 bp, Mus musculus
gcatgctgcagacccaggacatcat

SEQ ID NO: 678737 - DNA, 25 bp, Mus musculus
gcatgctgcagagccaggacatcat

SEQ ID NO: 678738 - DNA, 25 bp, Mus musculus
gcatgctgccatctattcaacacgc

SEQ ID NO: 678739 - DNA, 25 bp, Mus musculus
gcatgctgccatgtattcaacacgc

SEQ ID NO: 678740 - DNA, 25 bp, Mus musculus
gcatgctgctacaataaggctcatt

SEQ ID NO: 678741 - DNA, 25 bp, Mus musculus
gcatgctgctactataaggctcatt

SEQ ID NO: 678742 - DNA, 25 bp, Mus musculus
gcatgctgggaaagctctgacctcc

SEQ ID NO: 678743 - DNA, 25 bp, Mus musculus
gcatgctgggaatgctctgacctcc

SEQ ID NO: 678744 - DNA, 25 bp, Mus musculus
gcatgctgggcccagacctttggcc

SEQ ID NO: 678745 - DNA, 25 bp, Mus musculus
gcatgctgggccgagacctttggcc

SEQ ID NO: 678746 - DNA, 25 bp, Mus musculus
gcatgctgtcaacgaagtgttcaag

SEQ ID NO: 678747 - DNA, 25 bp, Mus musculus
gcatgctgtcaaggaagtgttcaag

SEQ ID NO: 678748 - DNA, 25 bp, Mus musculus
gcatgctttgctacagcgctgactt

SEQ ID NO: 678749 - DNA, 25 bp, Mus musculus
gcatgctttgcttcagcgctgactt

SEQ ID NO: 678750 - DNA, 25 bp, Mus musculus
gcatggaacaatacatcgtgagcca

SEQ ID NO: 678751 - DNA, 25 bp, Mus musculus
gcatggaacaattcatcgtgagcca

SEQ ID NO: 678752 - DNA, 25 bp, Mus musculus
gcatggaatcacaggaattgcttta

SEQ ID NO: 678753 - DNA, 25 bp, Mus musculus
gcatggaatcactggaattgcttta

SEQ ID NO: 678754 - DNA, 25 bp, Mus musculus
gcatggacagcaaccagatccacag

SEQ ID NO: 678755 - DNA, 25 bp, Mus musculus
gcatggacagcatccagatccacag

SEQ ID NO: 678756 - DNA, 25 bp, Mus musculus
gcatggacatataaaagtatcactg

SEQ ID NO: 678757 - DNA, 25 bp, Mus musculus
gcatggacatattaaagtatcactg

SEQ ID NO: 678758 - DNA, 25 bp, Mus musculus
gcatggacccaactgcgcggcgatt

SEQ ID NO: 678759 - DNA, 25 bp, Mus musculus
gcatggacccaagtgcgcggcgatt

SEQ ID NO: 678760 - DNA, 25 bp, Mus musculus
gcatggacgactagctcctcttcct

SEQ ID NO: 678761 - DNA, 25 bp, Mus musculus
gcatggacgacttgctcctcttcct

SEQ ID NO: 678762 - DNA, 25 bp, Mus musculus
gcatggactcttagataatgttttc

SEQ ID NO: 678763 - DNA, 25 bp, Mus musculus
gcatggactctttgataatgttttc

SEQ ID NO: 678764 - DNA, 25 bp, Mus musculus
gcatggagaggaaggacctactgaa

SEQ ID NO: 678765 - DNA, 25 bp, Mus musculus
gcatggagaggatggacctactgaa

SEQ ID NO: 678766 - DNA, 25 bp, Mus musculus
gcatggagctacacacctgtaaacc

SEQ ID NO: 678767 - DNA, 25 bp, Mus musculus
gcatggagctactcacctgtaaacc

SEQ ID NO: 678768 - DNA, 25 bp, Mus musculus
gcatggagtatcatgcctctaagaa

SEQ ID NO: 678769 - DNA, 25 bp, Mus musculus
gcatggagtatcttgcctctaagaa

SEQ ID NO: 678770 - DNA, 25 bp, Mus musculus
gcatggagtctgcactgctgctgtt

SEQ ID NO: 678771 - DNA, 25 bp, Mus musculus
gcatggagtctggactgctgctgtt

SEQ ID NO: 678772 - DNA, 25 bp, Mus musculus
gcatggataaacagtacagtacctg

SEQ ID NO: 678773 - DNA, 25 bp, Mus musculus
gcatggataaactgtacagtacctg

SEQ ID NO: 678774 - DNA, 25 bp, Mus musculus
gcatggatgatgatggaactggcca

SEQ ID NO: 678775 - DNA, 25 bp, Mus musculus
gcatggatgatgttggaactggcca

SEQ ID NO: 678776 - DNA, 25 bp, Mus musculus
gcatggatgctgagtccccaagagt

SEQ ID NO: 678777 - DNA, 25 bp, Mus musculus
gcatggatgctgtgtccccaagagt

SEQ ID NO: 678778 - DNA, 25 bp, Mus musculus
gcatggattatgaggcgtaccgcca

SEQ ID NO: 678779 - DNA, 25 bp, Mus musculus
gcatggattatgtggcgtaccgcca

SEQ ID NO: 678780 - DNA, 25 bp, Mus musculus
gcatggcaaaggagtattaattaga

SEQ ID NO: 678781 - DNA, 25 bp, Mus musculus
gcatggcaaaggtgtattaattaga

SEQ ID NO: 678782 - DNA, 25 bp, Mus musculus
gcatggcactctcgcgagcatacca

SEQ ID NO: 678783 - DNA, 25 bp, Mus musculus
gcatggcactctggcgagcatacca

SEQ ID NO: 678784 - DNA, 25 bp, Mus musculus
gcatggcagactctgcacaggtgcc

SEQ ID NO: 678785 - DNA, 25 bp, Mus musculus
gcatggcagactgtgcacaggtgcc

SEQ ID NO: 678786 - DNA, 25 bp, Mus musculus
gcatggcagcatacgggccttcgga

SEQ ID NO: 678787 - DNA, 25 bp, Mus musculus
gcatggcagcattcgggccttcgga

SEQ ID NO: 678788 - DNA, 25 bp, Mus musculus
gcatggcagcccctgagatgtagca

SEQ ID NO: 678789 - DNA, 25 bp, Mus musculus
gcatggcagcccgtgagatgtagca

SEQ ID NO: 678790 - DNA, 25 bp, Mus musculus
gcatggcagcttcctcgttcgagag

SEQ ID NO: 678791 - DNA, 25 bp, Mus musculus
gcatggcagcttgctcgttcgagag

SEQ ID NO: 678792 - DNA, 25 bp, Mus musculus
gcatggcagggcaagaccttgctca

SEQ ID NO: 678793 - DNA, 25 bp, Mus musculus
gcatggcagggctagaccttgctca

SEQ ID NO: 678794 - DNA, 25 bp, Mus musculus
gcatggcagtttcttggtataaccc

SEQ ID NO: 678795 - DNA, 25 bp, Mus musculus
gcatggcagtttgttggtataaccc

SEQ ID NO: 678796 - DNA, 25 bp, Mus musculus
gcatggccaactatacaaatctgac

SEQ ID NO: 678797 - DNA, 25 bp, Mus musculus
gcatggccaactttacaaatctgac

SEQ ID NO: 678798 - DNA, 25 bp, Mus musculus
gcatggcccaagacatagctgccta

SEQ ID NO: 678799 - DNA, 25 bp, Mus musculus
gcatggcccaagtcatagctgccta

SEQ ID NO: 678800 - DNA, 25 bp, Mus musculus
gcatggccgagcctgcaaggttcac

SEQ ID NO: 678801 - DNA, 25 bp, Mus musculus
gcatggccgagcgtgcaaggttcac

SEQ ID NO: 678802 - DNA, 25 bp, Mus musculus
gcatggccgcccagattaagctgct

SEQ ID NO: 678803 - DNA, 25 bp, Mus musculus
gcatggccgccctgattaagctgct

SEQ ID NO: 678804 - DNA, 25 bp, Mus musculus
gcatggcctaccattcagagcgcaa

SEQ ID NO: 678805 - DNA, 25 bp, Mus musculus
gcatggcctacctttcagagcgcaa

SEQ ID NO: 678806 - DNA, 25 bp, Mus musculus
gcatggcctcatcacctgatgcctg

SEQ ID NO: 678807 - DNA, 25 bp, Mus musculus
gcatggcctcatgacctgatgcctg

SEQ ID NO: 678808 - DNA, 25 bp, Mus musculus
gcatggcctcttcatggcaagcgaa

SEQ ID NO: 678809 - DNA, 25 bp, Mus musculus
gcatggcctcttgatggcaagcgaa

SEQ ID NO: 678810 - DNA, 25 bp, Mus musculus
gcatggcgctgcacacggttcttat

SEQ ID NO: 678811 - DNA, 25 bp, Mus musculus
gcatggcgctgctcacggttcttat

SEQ ID NO: 678812 - DNA, 25 bp, Mus musculus
gcatggcggagaactttggcacaga

SEQ ID NO: 678813 - DNA, 25 bp, Mus musculus
gcatggcggagatctttggcacaga

SEQ ID NO: 678814 - DNA, 25 bp, Mus musculus
gcatggcggtgtctgctcggctctg

SEQ ID NO: 678815 - DNA, 25 bp, Mus musculus
gcatggcggtgtgtgctcggctctg

SEQ ID NO: 678816 - DNA, 25 bp, Mus musculus
gcatggctagacacagacttctggt

SEQ ID NO: 678817 - DNA, 25 bp, Mus musculus
gcatggctagactcagacttctggt

SEQ ID NO: 678818 - DNA, 25 bp, Mus musculus
gcatggctccaaatgttagtgtgaa

SEQ ID NO: 678819 - DNA, 25 bp, Mus musculus
gcatggctccaattgttagtgtgaa

SEQ ID NO: 678820 - DNA, 25 bp, Mus musculus
gcatggctccatcccagtgaaggag

SEQ ID NO: 678821 - DNA, 25 bp, Mus musculus
gcatggctccatgccagtgaaggag

SEQ ID NO: 678822 - DNA, 25 bp, Mus musculus
gcatggctcccacaaacaagatcag

SEQ ID NO: 678823 - DNA, 25 bp, Mus musculus
gcatggctcccagaaacaagatcag

SEQ ID NO: 678824 - DNA, 25 bp, Mus musculus
gcatggctcggaacgcatctccttg

SEQ ID NO: 678825 - DNA, 25 bp, Mus musculus
gcatggctcggatcgcatctccttg

SEQ ID NO: 678826 - DNA, 25 bp, Mus musculus
gcatggctctgtcgctttcaggact

SEQ ID NO: 678827 - DNA, 25 bp, Mus musculus
gcatggctctgtggctttcaggact

SEQ ID NO: 678828 - DNA, 25 bp, Mus musculus
gcatggctggaaagaacacctggtt

SEQ ID NO: 678829 - DNA, 25 bp, Mus musculus
gcatggctggaatgaacacctggtt

SEQ ID NO: 678830 - DNA, 25 bp, Mus musculus
gcatggctggacatggccccaataa

SEQ ID NO: 678831 - DNA, 25 bp, Mus musculus
gcatggctggacttggccccaataa

SEQ ID NO: 678832 - DNA, 25 bp, Mus musculus
gcatgggacagacttgatattgcca

SEQ ID NO: 678833 - DNA, 25 bp, Mus musculus
gcatgggacagagttgatattgcca

SEQ ID NO: 678834 - DNA, 25 bp, Mus musculus
gcatgggacctgcaccaccgctgga

SEQ ID NO: 678835 - DNA, 25 bp, Mus musculus
gcatgggacctggaccaccgctgga

SEQ ID NO: 678836 - DNA, 25 bp, Mus musculus
gcatgggagacgacaagcacgcact

SEQ ID NO: 678837 - DNA, 25 bp, Mus musculus
gcatgggagacgtcaagcacgcact

SEQ ID NO: 678838 - DNA, 25 bp, Mus musculus
gcatgggatatacttttcaggaaat

SEQ ID NO: 678839 - DNA, 25 bp, Mus musculus
gcatgggatatagttttcaggaaat

SEQ ID NO: 678840 - DNA, 25 bp, Mus musculus
gcatgggcacatcaactcctaccta

SEQ ID NO: 678841 - DNA, 25 bp, Mus musculus
gcatgggcacatgaactcctaccta

SEQ ID NO: 678842 - DNA, 25 bp, Mus musculus
gcatgggcctgtctcctgataacag

SEQ ID NO: 678843 - DNA, 25 bp, Mus musculus
gcatgggcctgtgtcctgataacag

SEQ ID NO: 678844 - DNA, 25 bp, Mus musculus
gcatgggccttgctaagaccctcca

SEQ ID NO: 678845 - DNA, 25 bp, Mus musculus
gcatgggccttggtaagaccctcca

SEQ ID NO: 678846 - DNA, 25 bp, Mus musculus
gcatgggctactctccccagtctga

SEQ ID NO: 678847 - DNA, 25 bp, Mus musculus
gcatgggctactgtccccagtctga

SEQ ID NO: 678848 - DNA, 25 bp, Mus musculus
gcatgggtaactagcacacctggga

SEQ ID NO: 678849 - DNA, 25 bp, Mus musculus
gcatgggtaacttgcacacctggga

SEQ ID NO: 678850 - DNA, 25 bp, Mus musculus
gcatgggttctcactctcgagcaaa

SEQ ID NO: 678851 - DNA, 25 bp, Mus musculus
gcatgggttctcaggacgccatgga

SEQ ID NO: 678852 - DNA, 25 bp, Mus musculus
gcatgggttctctctctcgagcaaa

SEQ ID NO: 678853 - DNA, 25 bp, Mus musculus
gcatgggttctctggacgccatgga

SEQ ID NO: 678854 - DNA, 25 bp, Mus musculus
gcatgggtttcaccgagttctctgt

SEQ ID NO: 678855 - DNA, 25 bp, Mus musculus
gcatgggtttcagcgagttctctgt

SEQ ID NO: 678856 - DNA, 25 bp, Mus musculus
gcatggtaatgcagaatcctaaaaa

SEQ ID NO: 678857 - DNA, 25 bp, Mus musculus
gcatggtaatgctgaatcctaaaaa

SEQ ID NO: 678858 - DNA, 25 bp, Mus musculus
gcatggtacatcaggaagtcaacac

SEQ ID NO: 678859 - DNA, 25 bp, Mus musculus
gcatggtacatctggaagtcaacac

SEQ ID NO: 678860 - DNA, 25 bp, Mus musculus
gcatggtaccaaaagccttggattt

SEQ ID NO: 678861 - DNA, 25 bp, Mus musculus
gcatggtaccaatagccttggattt

SEQ ID NO: 678862 - DNA, 25 bp, Mus musculus
gcatggtagaatcaattaaacactg

SEQ ID NO: 678863 - DNA, 25 bp, Mus musculus
gcatggtagaatgaattaaacactg

SEQ ID NO: 678864 - DNA, 25 bp, Mus musculus
gcatggtagagcatttggacttgta

SEQ ID NO: 678865 - DNA, 25 bp, Mus musculus
gcatggtagagcttttggacttgta

SEQ ID NO: 678866 - DNA, 25 bp, Mus musculus
gcatggtcaataccaagcctgagaa

SEQ ID NO: 678867 - DNA, 25 bp, Mus musculus
gcatggtcaatagcaagcctgagaa

SEQ ID NO: 678868 - DNA, 25 bp, Mus musculus
gcatggtcacacactacgacaatga

SEQ ID NO: 678869 - DNA, 25 bp, Mus musculus
gcatggtcacactctacgacaatga

SEQ ID NO: 678870 - DNA, 25 bp, Mus musculus
gcatggtcagcaaggtttacaacaa

SEQ ID NO: 678871 - DNA, 25 bp, Mus musculus
gcatggtcagcatggtttacaacaa

SEQ ID NO: 678872 - DNA, 25 bp, Mus musculus
gcatggtccccccaaaaaggtcctg

SEQ ID NO: 678873 - DNA, 25 bp, Mus musculus
gcatggtcccccgaaaaaggtcctg

SEQ ID NO: 678874 - DNA, 25 bp, Mus musculus
gcatggtccctcctgactactgcag

SEQ ID NO: 678875 - DNA, 25 bp, Mus musculus
gcatggtccctcgtgactactgcag

SEQ ID NO: 678876 - DNA, 25 bp, Mus musculus
gcatggtcgcccagggtgacaccgt

SEQ ID NO: 678877 - DNA, 25 bp, Mus musculus
gcatggtcgccctgggtgacaccgt

SEQ ID NO: 678878 - DNA, 25 bp, Mus musculus
gcatggtcgtttcccggtttctgga

SEQ ID NO: 678879 - DNA, 25 bp, Mus musculus
gcatggtcgtttgccggtttctgga

SEQ ID NO: 678880 - DNA, 25 bp, Mus musculus
gcatggtctttcaggcgctctacgt

SEQ ID NO: 678881 - DNA, 25 bp, Mus musculus
gcatggtctttctggcgctctacgt

SEQ ID NO: 678882 - DNA, 25 bp, Mus musculus
gcatggtgaataattgggacctcac

SEQ ID NO: 678883 - DNA, 25 bp, Mus musculus
gcatggtgaatatttgggacctcac

SEQ ID NO: 678884 - DNA, 25 bp, Mus musculus
gcatggtggctcatggcgagaccct

SEQ ID NO: 678885 - DNA, 25 bp, Mus musculus
gcatggtggctcttggcgagaccct

SEQ ID NO: 678886 - DNA, 25 bp, Mus musculus
gcatggtggtgaatgttctcagtct

SEQ ID NO: 678887 - DNA, 25 bp, Mus musculus
gcatggtggtgacgactacgtattt

SEQ ID NO: 678888 - DNA, 25 bp, Mus musculus
gcatggtggtgaggactacgtattt

SEQ ID NO: 678889 - DNA, 25 bp, Mus musculus
gcatggtggtgattgttctcagtct

SEQ ID NO: 678890 - DNA, 25 bp, Mus musculus
gcatggtggtggcagcagcaaagct

SEQ ID NO: 678891 - DNA, 25 bp, Mus musculus
gcatggtggtgggagcagcaaagct

SEQ ID NO: 678892 - DNA, 25 bp, Mus musculus
gcatggtgtgcactctgtggctcct

SEQ ID NO: 678893 - DNA, 25 bp, Mus musculus
gcatggtgtgcagtctgtggctcct

SEQ ID NO: 678894 - DNA, 25 bp, Mus musculus
gcatggtgttcaccggccggtacat

SEQ ID NO: 678895 - DNA, 25 bp, Mus musculus
gcatggtgttcagcggccggtacat

SEQ ID NO: 678896 - DNA, 25 bp, Mus musculus
gcatggttaactatatcaaggaaaa

SEQ ID NO: 678897 - DNA, 25 bp, Mus musculus
gcatggttaactttatcaaggaaaa

SEQ ID NO: 678898 - DNA, 25 bp, Mus musculus
gcatggttatgtccccaaagaaaga

SEQ ID NO: 678899 - DNA, 25 bp, Mus musculus
gcatggttatgtgcccaaagaaaga

SEQ ID NO: 678900 - DNA, 25 bp, Mus musculus
gcatggtttcaccatggaaatgaat

SEQ ID NO: 678901 - DNA, 25 bp, Mus musculus
gcatggtttcacgatggaaatgaat

SEQ ID NO: 678902 - DNA, 25 bp, Mus musculus
gcatggtttttaagaaggaaactga

SEQ ID NO: 678903 - DNA, 25 bp, Mus musculus
gcatggtttttatgaaggaaactga

SEQ ID NO: 678904 - DNA, 25 bp, Mus musculus
gcatgtacatggatcgccgatgtgt

SEQ ID NO: 678905 - DNA, 25 bp, Mus musculus
gcatgtacatggttcgccgatgtgt

SEQ ID NO: 678906 - DNA, 25 bp, Mus musculus
gcatgtagctctccaaatgtttata

SEQ ID NO: 678907 - DNA, 25 bp, Mus musculus
gcatgtagctctgcaaatgtttata

SEQ ID NO: 678908 - DNA, 25 bp, Mus musculus
gcatgtatcccactggcacctttgg

SEQ ID NO: 678909 - DNA, 25 bp, Mus musculus
gcatgtatcccagtggcacctttgg

SEQ ID NO: 678910 - DNA, 25 bp, Mus musculus
gcatgtatgattagtgtaatgttcc

SEQ ID NO: 678911 - DNA, 25 bp, Mus musculus
gcatgtatgatttgtgtaatgttcc

SEQ ID NO: 678912 - DNA, 25 bp, Mus musculus
gcatgtattgaaagccaccagtttc

SEQ ID NO: 678913 - DNA, 25 bp, Mus musculus
gcatgtattgaatgccaccagtttc

SEQ ID NO: 678914 - DNA, 25 bp, Mus musculus
gcatgtattgcaagttgttcctggc

SEQ ID NO: 678915 - DNA, 25 bp, Mus musculus
gcatgtattgcatgttgttcctggc

SEQ ID NO: 678916 - DNA, 25 bp, Mus musculus
gcatgtcaggacagtgcaaagagga

SEQ ID NO: 678917 - DNA, 25 bp, Mus musculus
gcatgtcaggactgtgcaaagagga

SEQ ID NO: 678918 - DNA, 25 bp, Mus musculus
gcatgtcatccacaaatacttcctg

SEQ ID NO: 678919 - DNA, 25 bp, Mus musculus
gcatgtcatccagaaatacttcctg

SEQ ID NO: 678920 - DNA, 25 bp, Mus musculus
gcatgtcatgttccccaaggacata

SEQ ID NO: 678921 - DNA, 25 bp, Mus musculus
gcatgtcatgttgcccaaggacata

SEQ ID NO: 678922 - DNA, 25 bp, Mus musculus
gcatgtccgacgagtacctccgcag

SEQ ID NO: 678923 - DNA, 25 bp, Mus musculus
gcatgtccgacgtgtacctccgcag

SEQ ID NO: 678924 - DNA, 25 bp, Mus musculus
gcatgtcctgaccttctttgaatta

SEQ ID NO: 678925 - DNA, 25 bp, Mus musculus
gcatgtcctgacgttctttgaatta

SEQ ID NO: 678926 - DNA, 25 bp, Mus musculus
gcatgtccttccaagagagcctagg

SEQ ID NO: 678927 - DNA, 25 bp, Mus musculus
gcatgtccttcctagagagcctagg

SEQ ID NO: 678928 - DNA, 25 bp, Mus musculus
gcatgtctcagactgcacctgccag

SEQ ID NO: 678929 - DNA, 25 bp, Mus musculus
gcatgtctcagagtgcacctgccag

SEQ ID NO: 678930 - DNA, 25 bp, Mus musculus
gcatgtctggccaagcaccaggatg

SEQ ID NO: 678931 - DNA, 25 bp, Mus musculus
gcatgtctggcctagcaccaggatg

SEQ ID NO: 678932 - DNA, 25 bp, Mus musculus
gcatgtcttctaaaacagcaagaga

SEQ ID NO: 678933 - DNA, 25 bp, Mus musculus
gcatgtcttctataacagcaagaga

SEQ ID NO: 678934 - DNA, 25 bp, Mus musculus
gcatgtcttctgaatagcaataaat

SEQ ID NO: 678935 - DNA, 25 bp, Mus musculus
gcatgtcttctgtatagcaataaat

SEQ ID NO: 678936 - DNA, 25 bp, Mus musculus
gcatgtgaaatcaagatcatggctg

SEQ ID NO: 678937 - DNA, 25 bp, Mus musculus
gcatgtgaaatctagatcatggctg

SEQ ID NO: 678938 - DNA, 25 bp, Mus musculus
gcatgtgagatcagatggacttgaa

SEQ ID NO: 678939 - DNA, 25 bp, Mus musculus
gcatgtgagatctgatggacttgaa

SEQ ID NO: 678940 - DNA, 25 bp, Mus musculus
gcatgtgatggtcaggacgtccccc

SEQ ID NO: 678941 - DNA, 25 bp, Mus musculus
gcatgtgatggtgaggacgtccccc

SEQ ID NO: 678942 - DNA, 25 bp, Mus musculus
gcatgtgcagacacatacctggaga

SEQ ID NO: 678943 - DNA, 25 bp, Mus musculus
gcatgtgcagactcatacctggaga

SEQ ID NO: 678944 - DNA, 25 bp, Mus musculus
gcatgtgccgcaatatcagtctcag

SEQ ID NO: 678945 - DNA, 25 bp, Mus musculus
gcatgtgccgcattatcagtctcag

SEQ ID NO: 678946 - DNA, 25 bp, Mus musculus
gcatgtgctatgctgctacaggcca

SEQ ID NO: 678947 - DNA, 25 bp, Mus musculus
gcatgtgctatggtgctacaggcca

SEQ ID NO: 678948 - DNA, 25 bp, Mus musculus
gcatgtggagtcagaccggtctcct

SEQ ID NO: 678949 - DNA, 25 bp, Mus musculus
gcatgtggagtctgaccggtctcct

SEQ ID NO: 678950 - DNA, 25 bp, Mus musculus
gcatgtggcacccagtgatcctggc

SEQ ID NO: 678951 - DNA, 25 bp, Mus musculus
gcatgtggcaccgagtgatcctggc

SEQ ID NO: 678952 - DNA, 25 bp, Mus musculus
gcatgtggcctgacggcgccagaat

SEQ ID NO: 678953 - DNA, 25 bp, Mus musculus
gcatgtggcctgtcggcgccagaat

SEQ ID NO: 678954 - DNA, 25 bp, Mus musculus
gcatgtggcgtcatttgccccagag

SEQ ID NO: 678955 - DNA, 25 bp, Mus musculus
gcatgtggcgtcttttgccccagag

SEQ ID NO: 678956 - DNA, 25 bp, Mus musculus
gcatgtgggaccatctgcaggagca

SEQ ID NO: 678957 - DNA, 25 bp, Mus musculus
gcatgtgggaccttctgcaggagca

SEQ ID NO: 678958 - DNA, 25 bp, Mus musculus
gcatgtggtgtcaccagcctcaatg

SEQ ID NO: 678959 - DNA, 25 bp, Mus musculus
gcatgtggtgtctccagcctcaatg

SEQ ID NO: 678960 - DNA, 25 bp, Mus musculus
gcatgtgtaccccatccgtctggtc

SEQ ID NO: 678961 - DNA, 25 bp, Mus musculus
gcatgtgtacccgatccgtctggtc

SEQ ID NO: 678962 - DNA, 25 bp, Mus musculus
gcatgtgtacgcaatgaaaatcctg

SEQ ID NO: 678963 - DNA, 25 bp, Mus musculus
gcatgtgtacgctatgaaaatcctg

SEQ ID NO: 678964 - DNA, 25 bp, Mus musculus
gcatgtgtcagactgccgggctcaa

SEQ ID NO: 678965 - DNA, 25 bp, Mus musculus
gcatgtgtcagagtgccgggctcaa

SEQ ID NO: 678966 - DNA, 25 bp, Mus musculus
gcatgtgtccgcagacatgatctac

SEQ ID NO: 678967 - DNA, 25 bp, Mus musculus
gcatgtgtccgctgacatgatctac

SEQ ID NO: 678968 - DNA, 25 bp, Mus musculus
gcatgtgtgggcacagaagcccacc

SEQ ID NO: 678969 - DNA, 25 bp, Mus musculus
gcatgtgtgggctcagaagcccacc

SEQ ID NO: 678970 - DNA, 25 bp, Mus musculus
gcatgtgtgttgcagagtcacttaa

SEQ ID NO: 678971 - DNA, 25 bp, Mus musculus
gcatgtgtgttggagagtcacttaa

SEQ ID NO: 678972 - DNA, 25 bp, Mus musculus
gcatgtgttcgcatcttatttgtta

SEQ ID NO: 678973 - DNA, 25 bp, Mus musculus
gcatgtgttcgcttcttatttgtta

SEQ ID NO: 678974 - DNA, 25 bp, Mus musculus
gcatgttaaaagactcctgaataaa

SEQ ID NO: 678975 - DNA, 25 bp, Mus musculus
gcatgttaaaagtctcctgaataaa

SEQ ID NO: 678976 - DNA, 25 bp, Mus musculus
gcatgttaaggacactcagcctcca

SEQ ID NO: 678977 - DNA, 25 bp, Mus musculus
gcatgttaaggagactcagcctcca

SEQ ID NO: 678978 - DNA, 25 bp, Mus musculus
gcatgttagccacgcagtttggtca

SEQ ID NO: 678979 - DNA, 25 bp, Mus musculus
gcatgttagccaggcagtttggtca

SEQ ID NO: 678980 - DNA, 25 bp, Mus musculus
gcatgttccacaacgtcattatcca

SEQ ID NO: 678981 - DNA, 25 bp, Mus musculus
gcatgttccacatcgtcattatcca

SEQ ID NO: 678982 - DNA, 25 bp, Mus musculus
gcatgttcttggagaagtcggccag

SEQ ID NO: 678983 - DNA, 25 bp, Mus musculus
gcatgttcttggtgaagtcggccag

SEQ ID NO: 678984 - DNA, 25 bp, Mus musculus
gcatgttgcaggaccatatcccggg

SEQ ID NO: 678985 - DNA, 25 bp, Mus musculus
gcatgttgcaggtccatatcccggg

SEQ ID NO: 678986 - DNA, 25 bp, Mus musculus
gcatgttggtttaaagatctcttgg

SEQ ID NO: 678987 - DNA, 25 bp, Mus musculus
gcatgttggttttaagatctcttgg

SEQ ID NO: 678988 - DNA, 25 bp, Mus musculus
gcatgttgtcttctacccaactctg

SEQ ID NO: 678989 - DNA, 25 bp, Mus musculus
gcatgttgtcttgtacccaactctg

SEQ ID NO: 678990 - DNA, 25 bp, Mus musculus
gcattaaaggagaggcccagagcag

SEQ ID NO: 678991 - DNA, 25 bp, Mus musculus
gcattaaaggagtggcccagagcag

SEQ ID NO: 678992 - DNA, 25 bp, Mus musculus
gcattaagaatgatggcctggatat

SEQ ID NO: 678993 - DNA, 25 bp, Mus musculus
gcattaagaatgttggcctggatat

SEQ ID NO: 678994 - DNA, 25 bp, Mus musculus
gcattaagccaaacccacttcaggg

SEQ ID NO: 678995 - DNA, 25 bp, Mus musculus
gcattaagccaatcccacttcaggg

SEQ ID NO: 678996 - DNA, 25 bp, Mus musculus
gcattaaggtgccttctcgtttccg

SEQ ID NO: 678997 - DNA, 25 bp, Mus musculus
gcattaaggtgcgttctcgtttccg

SEQ ID NO: 678998 - DNA, 25 bp, Mus musculus
gcattaagtgtgcaggaacccgagc

SEQ ID NO: 678999 - DNA, 25 bp, Mus musculus
gcattaagtgtggaggaacccgagc

SEQ ID NO: 679000 - DNA, 25 bp, Mus musculus
gcattaatagctctacacacttgct

SEQ ID NO: 679001 - DNA, 25 bp, Mus musculus
gcattaatagctgtacacacttgct

SEQ ID NO: 679002 - DNA, 25 bp, Mus musculus
gcattaatggagatccactcttgga

SEQ ID NO: 679003 - DNA, 25 bp, Mus musculus
gcattaatggagttccactcttgga

SEQ ID NO: 679004 - DNA, 25 bp, Mus musculus
gcattaatggccaagaggccggtca

SEQ ID NO: 679005 - DNA, 25 bp, Mus musculus
gcattaatggcctagaggccggtca

SEQ ID NO: 679006 - DNA, 25 bp, Mus musculus
gcattacacccactggtatcaccta

SEQ ID NO: 679007 - DNA, 25 bp, Mus musculus
gcattacacccagtggtatcaccta

SEQ ID NO: 679008 - DNA, 25 bp, Mus musculus
gcattacactgcctatgcgaaggag

SEQ ID NO: 679009 - DNA, 25 bp, Mus musculus
gcattacactgcgtatgcgaaggag

SEQ ID NO: 679010 - DNA, 25 bp, Mus musculus
gcattacagacaacagccctgtggg

SEQ ID NO: 679011 - DNA, 25 bp, Mus musculus
gcattacagacaccagcctgtattt

SEQ ID NO: 679012 - DNA, 25 bp, Mus musculus
gcattacagacagcagcctgtattt

SEQ ID NO: 679013 - DNA, 25 bp, Mus musculus
gcattacagacatcagccctgtggg

SEQ ID NO: 679014 - DNA, 25 bp, Mus musculus
gcattacctcctatataagacagga

SEQ ID NO: 679015 - DNA, 25 bp, Mus musculus
gcattacctcctttataagacagga

SEQ ID NO: 679016 - DNA, 25 bp, Mus musculus
gcattacctggacctgctggcaatg

SEQ ID NO: 679017 - DNA, 25 bp, Mus musculus
gcattacctggagctgctggcaatg

SEQ ID NO: 679018 - DNA, 25 bp, Mus musculus
gcattaccttctatgtcgtgatcgg

SEQ ID NO: 679019 - DNA, 25 bp, Mus musculus
gcattaccttctttgtcgtgatcgg

SEQ ID NO: 679020 - DNA, 25 bp, Mus musculus
gcattacgtcaccaagtgagaagcc

SEQ ID NO: 679021 - DNA, 25 bp, Mus musculus
gcattacgtcacgaagtgagaagcc

SEQ ID NO: 679022 - DNA, 25 bp, Mus musculus
gcattacgtgatacataagagaaca

SEQ ID NO: 679023 - DNA, 25 bp, Mus musculus
gcattacgtgattcataagagaaca

SEQ ID NO: 679024 - DNA, 25 bp, Mus musculus
gcattactacaacgaagcagattct

SEQ ID NO: 679025 - DNA, 25 bp, Mus musculus
gcattactacaaggaagcagattct

SEQ ID NO: 679026 - DNA, 25 bp, Mus musculus
gcattactcatcagtctcaagtact

SEQ ID NO: 679027 - DNA, 25 bp, Mus musculus
gcattactcatctgtctcaagtact

SEQ ID NO: 679028 - DNA, 25 bp, Mus musculus
gcattactggatccagacgaccctg

SEQ ID NO: 679029 - DNA, 25 bp, Mus musculus
gcattactggatgcagacgaccctg

SEQ ID NO: 679030 - DNA, 25 bp, Mus musculus
gcattagaactaaagagaacagact

SEQ ID NO: 679031 - DNA, 25 bp, Mus musculus
gcattagaactatagagaacagact

SEQ ID NO: 679032 - DNA, 25 bp, Mus musculus
gcattagagcagaagtgactgaacc

SEQ ID NO: 679033 - DNA, 25 bp, Mus musculus
gcattagagcagtagtgactgaacc

SEQ ID NO: 679034 - DNA, 25 bp, Mus musculus
gcattagatgccctgaaatggagtt

SEQ ID NO: 679035 - DNA, 25 bp, Mus musculus
gcattagatgccgtgaaatggagtt

SEQ ID NO: 679036 - DNA, 25 bp, Mus musculus
gcattagtgacaaagccaaggagag

SEQ ID NO: 679037 - DNA, 25 bp, Mus musculus
gcattagtgacatagccaaggagag

SEQ ID NO: 679038 - DNA, 25 bp, Mus musculus
gcattataatgacgagacgctgaag

SEQ ID NO: 679039 - DNA, 25 bp, Mus musculus
gcattataatgaggagacgctgaag

SEQ ID NO: 679040 - DNA, 25 bp, Mus musculus
gcattatagagcaggaaagaccatt

SEQ ID NO: 679041 - DNA, 25 bp, Mus musculus
gcattatagagctggaaagaccatt

SEQ ID NO: 679042 - DNA, 25 bp, Mus musculus
gcattatctaacagtgaacctcacc

SEQ ID NO: 679043 - DNA, 25 bp, Mus musculus
gcattatctaactgtgaacctcacc

SEQ ID NO: 679044 - DNA, 25 bp, Mus musculus
gcattatctgtaaggagaaactggc

SEQ ID NO: 679045 - DNA, 25 bp, Mus musculus
gcattatctgtatggagaaactggc

SEQ ID NO: 679046 - DNA, 25 bp, Mus musculus
gcattatgaaatccccaatggctac

SEQ ID NO: 679047 - DNA, 25 bp, Mus musculus
gcattatgaaatgcccaatggctac

SEQ ID NO: 679048 - DNA, 25 bp, Mus musculus
gcattatgcaagactggatttcctg

SEQ ID NO: 679049 - DNA, 25 bp, Mus musculus
gcattatgcaagtctggatttcctg

SEQ ID NO: 679050 - DNA, 25 bp, Mus musculus
gcattatgtcagaagctcagaggcg

SEQ ID NO: 679051 - DNA, 25 bp, Mus musculus
gcattatgtcagtagctcagaggcg

SEQ ID NO: 679052 - DNA, 25 bp, Mus musculus
gcattcaaaactcctgaatcagtgg

SEQ ID NO: 679053 - DNA, 25 bp, Mus musculus
gcattcaaaactgctgaatcagtgg

SEQ ID NO: 679054 - DNA, 25 bp, Mus musculus
gcattcaaaaggcatcgtccagatc

SEQ ID NO: 679055 - DNA, 25 bp, Mus musculus
gcattcaaaagggatcgtccagatc

SEQ ID NO: 679056 - DNA, 25 bp, Mus musculus
gcattcaacttccttgatgcccctg

SEQ ID NO: 679057 - DNA, 25 bp, Mus musculus
gcattcaacttcgttgatgcccctg

SEQ ID NO: 679058 - DNA, 25 bp, Mus musculus
gcattcaaggacagtaccgaggcta

SEQ ID NO: 679059 - DNA, 25 bp, Mus musculus
gcattcaaggactgtaccgaggcta

SEQ ID NO: 679060 - DNA, 25 bp, Mus musculus
gcattcaggaggagacccatcacct

SEQ ID NO: 679061 - DNA, 25 bp, Mus musculus
gcattcaggaggtgacccatcacct

SEQ ID NO: 679062 - DNA, 25 bp, Mus musculus
gcattcaggcctatgagttgggaga

SEQ ID NO: 679063 - DNA, 25 bp, Mus musculus
gcattcaggcctttgagttgggaga

SEQ ID NO: 679064 - DNA, 25 bp, Mus musculus
gcattcagtgggagtctacttttga

SEQ ID NO: 679065 - DNA, 25 bp, Mus musculus
gcattcagtgggtgtctacttttga

SEQ ID NO: 679066 - DNA, 25 bp, Mus musculus
gcattcattcgtcagggaccccaag

SEQ ID NO: 679067 - DNA, 25 bp, Mus musculus
gcattcattcgtgagggaccccaag

SEQ ID NO: 679068 - DNA, 25 bp, Mus musculus
gcattccaataacaaggccatgaca

SEQ ID NO: 679069 - DNA, 25 bp, Mus musculus
gcattccaataagaaggccatgaca

SEQ ID NO: 679070 - DNA, 25 bp, Mus musculus
gcattccaccatctcagaacagaga

SEQ ID NO: 679071 - DNA, 25 bp, Mus musculus
gcattccaccatgtcagaacagaga

SEQ ID NO: 679072 - DNA, 25 bp, Mus musculus
gcattccacctaagagtagcaccaa

SEQ ID NO: 679073 - DNA, 25 bp, Mus musculus
gcattccacctatgagtagcaccaa

SEQ ID NO: 679074 - DNA, 25 bp, Mus musculus
gcattccagggaagctagctcctcc

SEQ ID NO: 679075 - DNA, 25 bp, Mus musculus
gcattccagggatgctagctcctcc

SEQ ID NO: 679076 - DNA, 25 bp, Mus musculus
gcattcccaaatcaacaaataccag

SEQ ID NO: 679077 - DNA, 25 bp, Mus musculus
gcattcccaaatgaacaaataccag

SEQ ID NO: 679078 - DNA, 25 bp, Mus musculus
gcattccccaagatctccggaagag

SEQ ID NO: 679079 - DNA, 25 bp, Mus musculus
gcattccccaagttctccggaagag

SEQ ID NO: 679080 - DNA, 25 bp, Mus musculus
gcattccccagtacacctggatctg

SEQ ID NO: 679081 - DNA, 25 bp, Mus musculus
gcattccccagttcacctggatctg

SEQ ID NO: 679082 - DNA, 25 bp, Mus musculus
gcattccgcaggctctccctgttga

SEQ ID NO: 679083 - DNA, 25 bp, Mus musculus
gcattccgcagggtctccctgttga

SEQ ID NO: 679084 - DNA, 25 bp, Mus musculus
gcattcctattgctgtgcctacgcc

SEQ ID NO: 679085 - DNA, 25 bp, Mus musculus
gcattcctattggtgtgcctacgcc

SEQ ID NO: 679086 - DNA, 25 bp, Mus musculus
gcattcctgttgatgtagtagtcaa

SEQ ID NO: 679087 - DNA, 25 bp, Mus musculus
gcattcctgttgttgtagtagtcaa

SEQ ID NO: 679088 - DNA, 25 bp, Mus musculus
gcattccttaacaactaccttctca

SEQ ID NO: 679089 - DNA, 25 bp, Mus musculus
gcattccttaactactaccttctca

SEQ ID NO: 679090 - DNA, 25 bp, Mus musculus
gcattcgacacgcaccacaatggag

SEQ ID NO: 679091 - DNA, 25 bp, Mus musculus
gcattcgacacggaccacaatggag

SEQ ID NO: 679092 - DNA, 25 bp, Mus musculus
gcattcgagaatacttcatgaaacg

SEQ ID NO: 679093 - DNA, 25 bp, Mus musculus
gcattcgagaattcttcatgaaacg

SEQ ID NO: 679094 - DNA, 25 bp, Mus musculus
gcattcgagagaaacctaaagtctc

SEQ ID NO: 679095 - DNA, 25 bp, Mus musculus
gcattcgagagatacctaaagtctc

SEQ ID NO: 679096 - DNA, 25 bp, Mus musculus
gcattcgccgtactctagagccttt

SEQ ID NO: 679097 - DNA, 25 bp, Mus musculus
gcattcgccgtagtctagagccttt

SEQ ID NO: 679098 - DNA, 25 bp, Mus musculus
gcattcgctacacctatctcctgga

SEQ ID NO: 679099 - DNA, 25 bp, Mus musculus
gcattcgctacagctatctcctgga

SEQ ID NO: 679100 - DNA, 25 bp, Mus musculus
gcattcggatgaagtcctgccctcc

SEQ ID NO: 679101 - DNA, 25 bp, Mus musculus
gcattcggatgatgtcctgccctcc

SEQ ID NO: 679102 - DNA, 25 bp, Mus musculus
gcattcggtggaattactaaaacaa

SEQ ID NO: 679103 - DNA, 25 bp, Mus musculus
gcattcggtggatttactaaaacaa

SEQ ID NO: 679104 - DNA, 25 bp, Mus musculus
gcattcgtgactcggatgctgcagc

SEQ ID NO: 679105 - DNA, 25 bp, Mus musculus
gcattcgtgactgggatgctgcagc

SEQ ID NO: 679106 - DNA, 25 bp, Mus musculus
gcattctagccaacgactctttaga

SEQ ID NO: 679107 - DNA, 25 bp, Mus musculus
gcattctagccatcgactctttaga

SEQ ID NO: 679108 - DNA, 25 bp, Mus musculus
gcattctctactacctggttttcgg

SEQ ID NO: 679109 - DNA, 25 bp, Mus musculus
gcattctctacttcctggttttcgg

SEQ ID NO: 679110 - DNA, 25 bp, Mus musculus
gcattctcttgcattggtgggctca

SEQ ID NO: 679111 - DNA, 25 bp, Mus musculus
gcattctcttgctttggtgggctca

SEQ ID NO: 679112 - DNA, 25 bp, Mus musculus
gcattctgacgcaaaacaaccccaa

SEQ ID NO: 679113 - DNA, 25 bp, Mus musculus
gcattctgacgctaaacaaccccaa

SEQ ID NO: 679114 - DNA, 25 bp, Mus musculus
gcattctgagacatctgactgctgg

SEQ ID NO: 679115 - DNA, 25 bp, Mus musculus
gcattctgagacttctgactgctgg

SEQ ID NO: 679116 - DNA, 25 bp, Mus musculus
gcattctgagtacccatctactctg

SEQ ID NO: 679117 - DNA, 25 bp, Mus musculus
gcattctgagtagccatctactctg

SEQ ID NO: 679118 - DNA, 25 bp, Mus musculus
gcattctgcaatccttataggacag

SEQ ID NO: 679119 - DNA, 25 bp, Mus musculus
gcattctgcaatgcttataggacag

SEQ ID NO: 679120 - DNA, 25 bp, Mus musculus
gcattctgcattaggctttacttac

SEQ ID NO: 679121 - DNA, 25 bp, Mus musculus
gcattctgcatttggctttacttac

SEQ ID NO: 679122 - DNA, 25 bp, Mus musculus
gcattctgccctctgtacccaaaga

SEQ ID NO: 679123 - DNA, 25 bp, Mus musculus
gcattctgccctgtgtacccaaaga

SEQ ID NO: 679124 - DNA, 25 bp, Mus musculus
gcattctgggcaataaaccctacag

SEQ ID NO: 679125 - DNA, 25 bp, Mus musculus
gcattctgggcattaaaccctacag

SEQ ID NO: 679126 - DNA, 25 bp, Mus musculus
gcattctgtatcaaccttagcaaag

SEQ ID NO: 679127 - DNA, 25 bp, Mus musculus
gcattctgtatctaccttagcaaag

SEQ ID NO: 679128 - DNA, 25 bp, Mus musculus
gcattctgtgacatctgtcagaagt

SEQ ID NO: 679129 - DNA, 25 bp, Mus musculus
gcattctgtgacttctgtcagaagt

SEQ ID NO: 679130 - DNA, 25 bp, Mus musculus
gcattcttagcacctcagaagagct

SEQ ID NO: 679131 - DNA, 25 bp, Mus musculus
gcattcttagcagctcagaagagct

SEQ ID NO: 679132 - DNA, 25 bp, Mus musculus
gcattcttagctagccagtggcccc

SEQ ID NO: 679133 - DNA, 25 bp, Mus musculus
gcattcttagcttgccagtggcccc

SEQ ID NO: 679134 - DNA, 25 bp, Mus musculus
gcattcttgagcaggcagcttgttg

SEQ ID NO: 679135 - DNA, 25 bp, Mus musculus
gcattcttgagctggcagcttgttg

SEQ ID NO: 679136 - DNA, 25 bp, Mus musculus
gcattgaaccagctgaaactcttga

SEQ ID NO: 679137 - DNA, 25 bp, Mus musculus
gcattgaaccaggtgaaactcttga

SEQ ID NO: 679138 - DNA, 25 bp, Mus musculus
gcattgaaggataccattgcttggg

SEQ ID NO: 679139 - DNA, 25 bp, Mus musculus
gcattgaaggattccattgcttggg

SEQ ID NO: 679140 - DNA, 25 bp, Mus musculus
gcattgaaggtgaagtcctgcgaga

SEQ ID NO: 679141 - DNA, 25 bp, Mus musculus
gcattgaaggtgtagtcctgcgaga

SEQ ID NO: 679142 - DNA, 25 bp, Mus musculus
gcattgaagtggaggacagcgtcca

SEQ ID NO: 679143 - DNA, 25 bp, Mus musculus
gcattgaagtggtggacagcgtcca

SEQ ID NO: 679144 - DNA, 25 bp, Mus musculus
gcattgaataccaggagaagccgtt

SEQ ID NO: 679145 - DNA, 25 bp, Mus musculus
gcattgaatacctggagaagccgtt

SEQ ID NO: 679146 - DNA, 25 bp, Mus musculus
gcattgacagctactcaacaaaggg

SEQ ID NO: 679147 - DNA, 25 bp, Mus musculus
gcattgacagcttctcaacaaaggg

SEQ ID NO: 679148 - DNA, 25 bp, Mus musculus
gcattgacatcacccctgccatgtt

SEQ ID NO: 679149 - DNA, 25 bp, Mus musculus
gcattgacatcagccctgccatgtt

SEQ ID NO: 679150 - DNA, 25 bp, Mus musculus
gcattgacgtcactctcctgtgcca

SEQ ID NO: 679151 - DNA, 25 bp, Mus musculus
gcattgacgtcagtctcctgtgcca

SEQ ID NO: 679152 - DNA, 25 bp, Mus musculus
gcattgacttgcacatcaacacata

SEQ ID NO: 679153 - DNA, 25 bp, Mus musculus
gcattgacttgctcatcaacacata

SEQ ID NO: 679154 - DNA, 25 bp, Mus musculus
gcattgagcagccacagctctatcc

SEQ ID NO: 679155 - DNA, 25 bp, Mus musculus
gcattgagcagcgacagctctatcc

SEQ ID NO: 679156 - DNA, 25 bp, Mus musculus
gcattgaggattacacagcatacgg

SEQ ID NO: 679157 - DNA, 25 bp, Mus musculus
gcattgaggatttcacagcatacgg

SEQ ID NO: 679158 - DNA, 25 bp, Mus musculus
gcattgaggcaaaggtgtgagtcct

SEQ ID NO: 679159 - DNA, 25 bp, Mus musculus
gcattgaggcaatggtgtgagtcct

SEQ ID NO: 679160 - DNA, 25 bp, Mus musculus
gcattgaggcccatgagaaggacat

SEQ ID NO: 679161 - DNA, 25 bp, Mus musculus
gcattgaggcccttgagaaggacat

SEQ ID NO: 679162 - DNA, 25 bp, Mus musculus
gcattgatctgaagtactttcccta

SEQ ID NO: 679163 - DNA, 25 bp, Mus musculus
gcattgatctgatgtactttcccta

SEQ ID NO: 679164 - DNA, 25 bp, Mus musculus
gcattgatgaaaacgaactgaacat

SEQ ID NO: 679165 - DNA, 25 bp, Mus musculus
gcattgatgaaatcgaactgaacat

SEQ ID NO: 679166 - DNA, 25 bp, Mus musculus
gcattgatgaccagagtaagttctg

SEQ ID NO: 679167 - DNA, 25 bp, Mus musculus
gcattgatgacctgagtaagttctg

SEQ ID NO: 679168 - DNA, 25 bp, Mus musculus
gcattgatgatgacgctggatacaa

SEQ ID NO: 679169 - DNA, 25 bp, Mus musculus
gcattgatgatgtcgctggatacaa

SEQ ID NO: 679170 - DNA, 25 bp, Mus musculus
gcattgcaaagcagtaccacaaagt

SEQ ID NO: 679171 - DNA, 25 bp, Mus musculus
gcattgcaaagctgtaccacaaagt

SEQ ID NO: 679172 - DNA, 25 bp, Mus musculus
gcattgcaatcaactgcatgacact

SEQ ID NO: 679173 - DNA, 25 bp, Mus musculus
gcattgcaatcatctgcatgacact

SEQ ID NO: 679174 - DNA, 25 bp, Mus musculus
gcattgcacaccacaggctatggaa

SEQ ID NO: 679175 - DNA, 25 bp, Mus musculus
gcattgcacacctcaggctatggaa

SEQ ID NO: 679176 - DNA, 25 bp, Mus musculus
gcattgcactggctaatttaactta

SEQ ID NO: 679177 - DNA, 25 bp, Mus musculus
gcattgcactgggtaatttaactta

SEQ ID NO: 679178 - DNA, 25 bp, Mus musculus
gcattgcagaatcatggatgaattt

SEQ ID NO: 679179 - DNA, 25 bp, Mus musculus
gcattgcagaatgatggatgaattt

SEQ ID NO: 679180 - DNA, 25 bp, Mus musculus
gcattgcagctgcttacctgtcaga

SEQ ID NO: 679181 - DNA, 25 bp, Mus musculus
gcattgcagctggttacctgtcaga

SEQ ID NO: 679182 - DNA, 25 bp, Mus musculus
gcattgccaaatatgtagatggaga

SEQ ID NO: 679183 - DNA, 25 bp, Mus musculus
gcattgccaaatttgtagatggaga

SEQ ID NO: 679184 - DNA, 25 bp, Mus musculus
gcattgccatacctgaggcctcgaa

SEQ ID NO: 679185 - DNA, 25 bp, Mus musculus
gcattgccatacgtgaggcctcgaa

SEQ ID NO: 679186 - DNA, 25 bp, Mus musculus
gcattgccccagctaagaatatcca

SEQ ID NO: 679187 - DNA, 25 bp, Mus musculus
gcattgccccaggtaagaatatcca

SEQ ID NO: 679188 - DNA, 25 bp, Mus musculus
gcattgccttccaagccactttagg

SEQ ID NO: 679189 - DNA, 25 bp, Mus musculus
gcattgccttcctagccactttagg

SEQ ID NO: 679190 - DNA, 25 bp, Mus musculus
gcattgcgctccctccaacggtacc

SEQ ID NO: 679191 - DNA, 25 bp, Mus musculus
gcattgcgctccgtccaacggtacc

SEQ ID NO: 679192 - DNA, 25 bp, Mus musculus
gcattgctagctaggtggtctcgtt

SEQ ID NO: 679193 - DNA, 25 bp, Mus musculus
gcattgctagcttggtggtctcgtt

SEQ ID NO: 679194 - DNA, 25 bp, Mus musculus
gcattgctcctgactatatcctgtg

SEQ ID NO: 679195 - DNA, 25 bp, Mus musculus
gcattgctcctgtctatatcctgtg

SEQ ID NO: 679196 - DNA, 25 bp, Mus musculus
gcattgctgttcactggtatatgga

SEQ ID NO: 679197 - DNA, 25 bp, Mus musculus
gcattgctgttctctggtatatgga

SEQ ID NO: 679198 - DNA, 25 bp, Mus musculus
gcattgcttaagcaggaactggcca

SEQ ID NO: 679199 - DNA, 25 bp, Mus musculus
gcattgcttaaggaggaactggcca

SEQ ID NO: 679200 - DNA, 25 bp, Mus musculus
gcattgcttccgcacaggttggccc

SEQ ID NO: 679201 - DNA, 25 bp, Mus musculus
gcattgcttccggacaggttggccc

SEQ ID NO: 679202 - DNA, 25 bp, Mus musculus
gcattgcttctactcaccctgcagt

SEQ ID NO: 679203 - DNA, 25 bp, Mus musculus
gcattgcttctagtcaccctgcagt

SEQ ID NO: 679204 - DNA, 25 bp, Mus musculus
gcattggaaccaacagcttgagacc

SEQ ID NO: 679205 - DNA, 25 bp, Mus musculus
gcattggaaccatcagcttgagacc

SEQ ID NO: 679206 - DNA, 25 bp, Mus musculus
gcattggaatgaacttggcttctta

SEQ ID NO: 679207 - DNA, 25 bp, Mus musculus
gcattggaatgatcttggcttctta

SEQ ID NO: 679208 - DNA, 25 bp, Mus musculus
gcattggagattactccggaccgaa

SEQ ID NO: 679209 - DNA, 25 bp, Mus musculus
gcattggagatttctccggaccgaa

SEQ ID NO: 679210 - DNA, 25 bp, Mus musculus
gcattggagccgcagcctccttgcg

SEQ ID NO: 679211 - DNA, 25 bp, Mus musculus
gcattggagccgcagtccatcgcct

SEQ ID NO: 679212 - DNA, 25 bp, Mus musculus
gcattggagccggagcctccttgcg

SEQ ID NO: 679213 - DNA, 25 bp, Mus musculus
gcattggagccggagtccatcgcct

SEQ ID NO: 679214 - DNA, 25 bp, Mus musculus
gcattggaggacagccatggtcaca

SEQ ID NO: 679215 - DNA, 25 bp, Mus musculus
gcattggaggactgccatggtcaca

SEQ ID NO: 679216 - DNA, 25 bp, Mus musculus
gcattggcaagcattcccgaaccag

SEQ ID NO: 679217 - DNA, 25 bp, Mus musculus
gcattggcaagctttcccgaaccag

SEQ ID NO: 679218 - DNA, 25 bp, Mus musculus
gcattggcattcctattgctgtgcc

SEQ ID NO: 679219 - DNA, 25 bp, Mus musculus
gcattggcattcgtattgctgtgcc

SEQ ID NO: 679220 - DNA, 25 bp, Mus musculus
gcattggccaggagcatttcttcaa

SEQ ID NO: 679221 - DNA, 25 bp, Mus musculus
gcattggccaggtgcatttcttcaa

SEQ ID NO: 679222 - DNA, 25 bp, Mus musculus
gcattggctactcgcatgatccgta

SEQ ID NO: 679223 - DNA, 25 bp, Mus musculus
gcattggctactggcatgatccgta

SEQ ID NO: 679224 - DNA, 25 bp, Mus musculus
gcattggtcagcaccagaacaaggg

SEQ ID NO: 679225 - DNA, 25 bp, Mus musculus
gcattggtcagctccagaacaaggg

SEQ ID NO: 679226 - DNA, 25 bp, Mus musculus
gcattggtctttcggatcaacactt

SEQ ID NO: 679227 - DNA, 25 bp, Mus musculus
gcattggtctttgggatcaacactt

SEQ ID NO: 679228 - DNA, 25 bp, Mus musculus
gcattggtttctcgagatacaggct

SEQ ID NO: 679229 - DNA, 25 bp, Mus musculus
gcattggtttctggagatacaggct

SEQ ID NO: 679230 - DNA, 25 bp, Mus musculus
gcattgtaaggaacttacttcagaa

SEQ ID NO: 679231 - DNA, 25 bp, Mus musculus
gcattgtaaggatcttacttcagaa

SEQ ID NO: 679232 - DNA, 25 bp, Mus musculus
gcattgtatcaaagactcttgacaa

SEQ ID NO: 679233 - DNA, 25 bp, Mus musculus
gcattgtatcaatgactcttgacaa

SEQ ID NO: 679234 - DNA, 25 bp, Mus musculus
gcattgtcaacaacggccactcctt

SEQ ID NO: 679235 - DNA, 25 bp, Mus musculus
gcattgtcaacatcggccactcctt

SEQ ID NO: 679236 - DNA, 25 bp, Mus musculus
gcattgtgacagcagagaacctttg

SEQ ID NO: 679237 - DNA, 25 bp, Mus musculus
gcattgtgacaggagagaacctttg

SEQ ID NO: 679238 - DNA, 25 bp, Mus musculus
gcattgtgacgacaagggacttgcc

SEQ ID NO: 679239 - DNA, 25 bp, Mus musculus
gcattgtgacgagaagggacttgcc

SEQ ID NO: 679240 - DNA, 25 bp, Mus musculus
gcattgtgctccacacggcgagtgc

SEQ ID NO: 679241 - DNA, 25 bp, Mus musculus
gcattgtgctcctcacggcgagtgc

SEQ ID NO: 679242 - DNA, 25 bp, Mus musculus
gcattgtggcctagacctccaacca

SEQ ID NO: 679243 - DNA, 25 bp, Mus musculus
gcattgtggccttgacctccaacca

SEQ ID NO: 679244 - DNA, 25 bp, Mus musculus
gcattgttcgctaccggcgtcgctc

SEQ ID NO: 679245 - DNA, 25 bp, Mus musculus
gcattgttcgcttccggcgtcgctc

SEQ ID NO: 679246 - DNA, 25 bp, Mus musculus
gcattgttctttctgatgacacgtg

SEQ ID NO: 679247 - DNA, 25 bp, Mus musculus
gcattgttctttgtgatgacacgtg

SEQ ID NO: 679248 - DNA, 25 bp, Mus musculus
gcatttaatcccatcctgctaatga

SEQ ID NO: 679249 - DNA, 25 bp, Mus musculus
gcatttaatcccttcctgctaatga

SEQ ID NO: 679250 - DNA, 25 bp, Mus musculus
gcatttacctgccaaagtctctttc

SEQ ID NO: 679251 - DNA, 25 bp, Mus musculus
gcatttacctgcgaaagtctctttc

SEQ ID NO: 679252 - DNA, 25 bp, Mus musculus
gcatttacggccctggtgccgcaaa

SEQ ID NO: 679253 - DNA, 25 bp, Mus musculus
gcatttacggccgtggtgccgcaaa

SEQ ID NO: 679254 - DNA, 25 bp, Mus musculus
gcatttagaagcaccacgcctgagt

SEQ ID NO: 679255 - DNA, 25 bp, Mus musculus
gcatttagaagctccacgcctgagt

SEQ ID NO: 679256 - DNA, 25 bp, Mus musculus
gcatttaggattctcagttgacgac

SEQ ID NO: 679257 - DNA, 25 bp, Mus musculus
gcatttaggattgtcagttgacgac

SEQ ID NO: 679258 - DNA, 25 bp, Mus musculus
gcatttatcttcactctgatgagag

SEQ ID NO: 679259 - DNA, 25 bp, Mus musculus
gcatttatcttctctctgatgagag

SEQ ID NO: 679260 - DNA, 25 bp, Mus musculus
gcatttattggtacagatggagcac

SEQ ID NO: 679261 - DNA, 25 bp, Mus musculus
gcatttattggttcagatggagcac

SEQ ID NO: 679262 - DNA, 25 bp, Mus musculus
gcatttcaatctcattctgcagtgt

SEQ ID NO: 679263 - DNA, 25 bp, Mus musculus
gcatttcaatctgattctgcagtgt

SEQ ID NO: 679264 - DNA, 25 bp, Mus musculus
gcatttcacctgagcaagccatata

SEQ ID NO: 679265 - DNA, 25 bp, Mus musculus
gcatttcacctgtgcaagccatata

SEQ ID NO: 679266 - DNA, 25 bp, Mus musculus
gcatttcagatgcaacttgtgtgaa

SEQ ID NO: 679267 - DNA, 25 bp, Mus musculus
gcatttcagatggaacttgtgtgaa

SEQ ID NO: 679268 - DNA, 25 bp, Mus musculus
gcatttcagccaagtctcgtggaga

SEQ ID NO: 679269 - DNA, 25 bp, Mus musculus
gcatttcagccatgtctcgtggaga

SEQ ID NO: 679270 - DNA, 25 bp, Mus musculus
gcatttcatcccaggagctaggtca

SEQ ID NO: 679271 - DNA, 25 bp, Mus musculus
gcatttcatccctggagctaggtca

SEQ ID NO: 679272 - DNA, 25 bp, Mus musculus
gcatttccaagactctggaatcagt

SEQ ID NO: 679273 - DNA, 25 bp, Mus musculus
gcatttccaagagtctggaatcagt

SEQ ID NO: 679274 - DNA, 25 bp, Mus musculus
gcatttccacccactttttgagtac

SEQ ID NO: 679275 - DNA, 25 bp, Mus musculus
gcatttccaccctctttttgagtac

SEQ ID NO: 679276 - DNA, 25 bp, Mus musculus
gcatttccatgccaatcgtcaccat

SEQ ID NO: 679277 - DNA, 25 bp, Mus musculus
gcatttccatgcgaatcgtcaccat

SEQ ID NO: 679278 - DNA, 25 bp, Mus musculus
gcatttcccaggagcgccagtgtga

SEQ ID NO: 679279 - DNA, 25 bp, Mus musculus
gcatttcccaggtgcgccagtgtga

SEQ ID NO: 679280 - DNA, 25 bp, Mus musculus
gcatttcccttaactcgccctggtg

SEQ ID NO: 679281 - DNA, 25 bp, Mus musculus
gcatttcccttatctcgccctggtg

SEQ ID NO: 679282 - DNA, 25 bp, Mus musculus
gcatttcgtacaccagaaagtgaag

SEQ ID NO: 679283 - DNA, 25 bp, Mus musculus
gcatttcgtacagcagaaagtgaag

SEQ ID NO: 679284 - DNA, 25 bp, Mus musculus
gcatttctcatcaacattagctcag

SEQ ID NO: 679285 - DNA, 25 bp, Mus musculus
gcatttctcatctacattagctcag

SEQ ID NO: 679286 - DNA, 25 bp, Mus musculus
gcatttctcccgacctgaggagggt

SEQ ID NO: 679287 - DNA, 25 bp, Mus musculus
gcatttctcccgtcctgaggagggt

SEQ ID NO: 679288 - DNA, 25 bp, Mus musculus
gcatttctgcctcgtgtgcactggg

SEQ ID NO: 679289 - DNA, 25 bp, Mus musculus
gcatttctgcctggtgtgcactggg

SEQ ID NO: 679290 - DNA, 25 bp, Mus musculus
gcatttgaagcaccttggagccaga

SEQ ID NO: 679291 - DNA, 25 bp, Mus musculus
gcatttgaagcagcttggagccaga

SEQ ID NO: 679292 - DNA, 25 bp, Mus musculus
gcatttgaggacatcgcccacgtca

SEQ ID NO: 679293 - DNA, 25 bp, Mus musculus
gcatttgaggacttcgcccacgtca

SEQ ID NO: 679294 - DNA, 25 bp, Mus musculus
gcatttgagggtcagacgaacacag

SEQ ID NO: 679295 - DNA, 25 bp, Mus musculus
gcatttgagggtgagacgaacacag

SEQ ID NO: 679296 - DNA, 25 bp, Mus musculus
gcatttgagttaacgtgtgaagcca

SEQ ID NO: 679297 - DNA, 25 bp, Mus musculus
gcatttgagttatcgtgtgaagcca

SEQ ID NO: 679298 - DNA, 25 bp, Mus musculus
gcatttgatgagagaagtggatgcc

SEQ ID NO: 679299 - DNA, 25 bp, Mus musculus
gcatttgatgagtgaagtggatgcc

SEQ ID NO: 679300 - DNA, 25 bp, Mus musculus
gcatttgattgcctagagtggatca

SEQ ID NO: 679301 - DNA, 25 bp, Mus musculus
gcatttgattgcgtagagtggatca

SEQ ID NO: 679302 - DNA, 25 bp, Mus musculus
gcatttgcaaatcatcagactgcat

SEQ ID NO: 679303 - DNA, 25 bp, Mus musculus
gcatttgcaaatgatcagactgcat

SEQ ID NO: 679304 - DNA, 25 bp, Mus musculus
gcatttgcactgaaagccagagttg

SEQ ID NO: 679305 - DNA, 25 bp, Mus musculus
gcatttgcactgtaagccagagttg

SEQ ID NO: 679306 - DNA, 25 bp, Mus musculus
gcatttgccgtcagcgtcctggact

SEQ ID NO: 679307 - DNA, 25 bp, Mus musculus
gcatttgccgtctgcgtcctggact

SEQ ID NO: 679308 - DNA, 25 bp, Mus musculus
gcatttgctacgacatgccttctga

SEQ ID NO: 679309 - DNA, 25 bp, Mus musculus
gcatttgctacgtcatgccttctga

SEQ ID NO: 679310 - DNA, 25 bp, Mus musculus
gcatttgcttcaaccggaccagccg

SEQ ID NO: 679311 - DNA, 25 bp, Mus musculus
gcatttgcttcatccggaccagccg

SEQ ID NO: 679312 - DNA, 25 bp, Mus musculus
gcatttggacttcttaaggacgtta

SEQ ID NO: 679313 - DNA, 25 bp, Mus musculus
gcatttggacttgttaaggacgtta

SEQ ID NO: 679314 - DNA, 25 bp, Mus musculus
gcatttggaggcagacgatttcctg

SEQ ID NO: 679315 - DNA, 25 bp, Mus musculus
gcatttggaggctgacgatttcctg

SEQ ID NO: 679316 - DNA, 25 bp, Mus musculus
gcatttggagtcctcagcgagacct

SEQ ID NO: 679317 - DNA, 25 bp, Mus musculus
gcatttggagtcgtcagcgagacct

SEQ ID NO: 679318 - DNA, 25 bp, Mus musculus
gcatttggcacaagaattattgtcc

SEQ ID NO: 679319 - DNA, 25 bp, Mus musculus
gcatttggcacatgaattattgtcc

SEQ ID NO: 679320 - DNA, 25 bp, Mus musculus
gcatttgggaggatggctgctttcc

SEQ ID NO: 679321 - DNA, 25 bp, Mus musculus
gcatttgggaggttggctgctttcc

SEQ ID NO: 679322 - DNA, 25 bp, Mus musculus
gcatttggtaagagcttggttccta

SEQ ID NO: 679323 - DNA, 25 bp, Mus musculus
gcatttggtaagtgcttggttccta

SEQ ID NO: 679324 - DNA, 25 bp, Mus musculus
gcatttggtaatcacatttccctta

SEQ ID NO: 679325 - DNA, 25 bp, Mus musculus
gcatttggtaatgacatttccctta

SEQ ID NO: 679326 - DNA, 25 bp, Mus musculus
gcatttgtccggacgaggttttatt

SEQ ID NO: 679327 - DNA, 25 bp, Mus musculus
gcatttgtccggtcgaggttttatt

SEQ ID NO: 679328 - DNA, 25 bp, Mus musculus
gcatttgtctcacctgctggttgag

SEQ ID NO: 679329 - DNA, 25 bp, Mus musculus
gcatttgtctcagctgctggttgag

SEQ ID NO: 679330 - DNA, 25 bp, Mus musculus
gcatttgttgcacccaggaccttcg

SEQ ID NO: 679331 - DNA, 25 bp, Mus musculus
gcatttgttgcagccaggaccttcg

SEQ ID NO: 679332 - DNA, 25 bp, Mus musculus
gcattttactgactctctcaggagc

SEQ ID NO: 679333 - DNA, 25 bp, Mus musculus
gcattttactgagtctctcaggagc

SEQ ID NO: 679334 - DNA, 25 bp, Mus musculus
gcattttataagattgaggagcaga

SEQ ID NO: 679335 - DNA, 25 bp, Mus musculus
gcattttataagtttgaggagcaga

SEQ ID NO: 679336 - DNA, 25 bp, Mus musculus
gcattttcccacataactctgaggc

SEQ ID NO: 679337 - DNA, 25 bp, Mus musculus
gcattttcccacttaactctgaggc

SEQ ID NO: 679338 - DNA, 25 bp, Mus musculus
gcattttccggcacctctcgggcat

SEQ ID NO: 679339 - DNA, 25 bp, Mus musculus
gcattttccggctcctctcgggcat

SEQ ID NO: 679340 - DNA, 25 bp, Mus musculus
gcattttgaataactgaacagttgg

SEQ ID NO: 679341 - DNA, 25 bp, Mus musculus
gcattttgaatatctgaacagttgg

SEQ ID NO: 679342 - DNA, 25 bp, Mus musculus
gcattttgatgacgctgtttgctgt

SEQ ID NO: 679343 - DNA, 25 bp, Mus musculus
gcattttgatgaggctgtttgctgt

SEQ ID NO: 679344 - DNA, 25 bp, Mus musculus
gcattttgatggcaaatggagctcc

SEQ ID NO: 679345 - DNA, 25 bp, Mus musculus
gcattttgatgggaaatggagctcc

SEQ ID NO: 679346 - DNA, 25 bp, Mus musculus
gcattttggagcaggttcggagctg

SEQ ID NO: 679347 - DNA, 25 bp, Mus musculus
gcattttggagctggttcggagctg

SEQ ID NO: 679348 - DNA, 25 bp, Mus musculus
gcattttggcccaggagaaagttcg

SEQ ID NO: 679349 - DNA, 25 bp, Mus musculus
gcattttggccctggagaaagttcg

SEQ ID NO: 679350 - DNA, 25 bp, Mus musculus
gcattttgtgttcacccctccttgg

SEQ ID NO: 679351 - DNA, 25 bp, Mus musculus
gcattttgtgttgacccctccttgg

SEQ ID NO: 679352 - DNA, 25 bp, Mus musculus
gcattttgttgacggagtatcgagt

SEQ ID NO: 679353 - DNA, 25 bp, Mus musculus
gcattttgttgagggagtatcgagt

SEQ ID NO: 679354 - DNA, 25 bp, Mus musculus
gcatttttatctctgagaacaaccg

SEQ ID NO: 679355 - DNA, 25 bp, Mus musculus
gcatttttatctgtgagaacaaccg

SEQ ID NO: 679356 - DNA, 25 bp, Mus musculus
gcatttttcatccagtcggtctgtg

SEQ ID NO: 679357 - DNA, 25 bp, Mus musculus
gcatttttcatcgagtcggtctgtg

SEQ ID NO: 679358 - DNA, 25 bp, Mus musculus
gcatttttggacactgtacccatct

SEQ ID NO: 679359 - DNA, 25 bp, Mus musculus
gcatttttggactctgtacccatct

SEQ ID NO: 679360 - DNA, 25 bp, Mus musculus
gcattttttgttcaagagactgaca

SEQ ID NO: 679361 - DNA, 25 bp, Mus musculus
gcattttttgttgaagagactgaca

SEQ ID NO: 679362 - DNA, 25 bp, Mus musculus
gccaaaaaacagaagtctaagcgta

SEQ ID NO: 679363 - DNA, 25 bp, Mus musculus
gccaaaaaacagtagtctaagcgta

SEQ ID NO: 679364 - DNA, 25 bp, Mus musculus
gccaaaaaagctccctcaaagatgc

SEQ ID NO: 679365 - DNA, 25 bp, Mus musculus
gccaaaaaagctgcctcaaagatgc

SEQ ID NO: 679366 - DNA, 25 bp, Mus musculus
gccaaaaaagtgcatgcagctgcca

SEQ ID NO: 679367 - DNA, 25 bp, Mus musculus
gccaaaaaagtggatgcagctgcca

SEQ ID NO: 679368 - DNA, 25 bp, Mus musculus
gccaaaaacaaactgggccgtgagg

SEQ ID NO: 679369 - DNA, 25 bp, Mus musculus
gccaaaaacaaagtgggccgtgagg

SEQ ID NO: 679370 - DNA, 25 bp, Mus musculus
gccaaaaaccttcgagatgttgatg

SEQ ID NO: 679371 - DNA, 25 bp, Mus musculus
gccaaaaaccttggagatgttgatg

SEQ ID NO: 679372 - DNA, 25 bp, Mus musculus
gccaaaaagcctcacgataagaaag

SEQ ID NO: 679373 - DNA, 25 bp, Mus musculus
gccaaaaagcctgacgataagaaag

SEQ ID NO: 679374 - DNA, 25 bp, Mus musculus
gccaaaaccacaagtctgcctgacg

SEQ ID NO: 679375 - DNA, 25 bp, Mus musculus
gccaaaaccacatgtctgcctgacg

SEQ ID NO: 679376 - DNA, 25 bp, Mus musculus
gccaaaacctttcgagggaactcat

SEQ ID NO: 679377 - DNA, 25 bp, Mus musculus
gccaaaacctttggagggaactcat

SEQ ID NO: 679378 - DNA, 25 bp, Mus musculus
gccaaaacgcctccaagagaattct

SEQ ID NO: 679379 - DNA, 25 bp, Mus musculus
gccaaaacgcctgcaagagaattct

SEQ ID NO: 679380 - DNA, 25 bp, Mus musculus
gccaaaactcgaagtccgagaaggg

SEQ ID NO: 679381 - DNA, 25 bp, Mus musculus
gccaaaactcgatgtccgagaaggg

SEQ ID NO: 679382 - DNA, 25 bp, Mus musculus
gccaaaagttatcctccagagctgg

SEQ ID NO: 679383 - DNA, 25 bp, Mus musculus
gccaaaagttatgctccagagctgg

SEQ ID NO: 679384 - DNA, 25 bp, Mus musculus
gccaaaagtttgcatgatgccttaa

SEQ ID NO: 679385 - DNA, 25 bp, Mus musculus
gccaaaagtttggatgatgccttaa

SEQ ID NO: 679386 - DNA, 25 bp, Mus musculus
gccaaaatgcataatcttcacggag

SEQ ID NO: 679387 - DNA, 25 bp, Mus musculus
gccaaaatgcattatcttcacggag

SEQ ID NO: 679388 - DNA, 25 bp, Mus musculus
gccaaaatgcccagccgtgtgtact

SEQ ID NO: 679389 - DNA, 25 bp, Mus musculus
gccaaaatgccctgccgtgtgtact

SEQ ID NO: 679390 - DNA, 25 bp, Mus musculus
gccaaaatggtgatgttctttaaca

SEQ ID NO: 679391 - DNA, 25 bp, Mus musculus
gccaaaatggtgttgttctttaaca

SEQ ID NO: 679392 - DNA, 25 bp, Mus musculus
gccaaaatggttccagcaccgcaag

SEQ ID NO: 679393 - DNA, 25 bp, Mus musculus
gccaaaatggttgcagcaccgcaag

SEQ ID NO: 679394 - DNA, 25 bp, Mus musculus
gccaaaatgtctctccaagggaatg

SEQ ID NO: 679395 - DNA, 25 bp, Mus musculus
gccaaaatgtctgtccaagggaatg

SEQ ID NO: 679396 - DNA, 25 bp, Mus musculus
gccaaaattagacatcggagcaaga

SEQ ID NO: 679397 - DNA, 25 bp, Mus musculus
gccaaaattagagatcggagcaaga

SEQ ID NO: 679398 - DNA, 25 bp, Mus musculus
gccaaaattctacgatgagtgactg

SEQ ID NO: 679399 - DNA, 25 bp, Mus musculus
gccaaaattctaggatgagtgactg

SEQ ID NO: 679400 - DNA, 25 bp, Mus musculus
gccaaaattgaaagaggtccaggtg

SEQ ID NO: 679401 - DNA, 25 bp, Mus musculus
gccaaaattgaatgaggtccaggtg

SEQ ID NO: 679402 - DNA, 25 bp, Mus musculus
gccaaacaaagtctaccgagtccgg

SEQ ID NO: 679403 - DNA, 25 bp, Mus musculus
gccaaacaaagtgtaccgagtccgg

SEQ ID NO: 679404 - DNA, 25 bp, Mus musculus
gccaaacactcaaggtcctgtactg

SEQ ID NO: 679405 - DNA, 25 bp, Mus musculus
gccaaacactcatggtcctgtactg

SEQ ID NO: 679406 - DNA, 25 bp, Mus musculus
gccaaacactctcgtgattggatac

SEQ ID NO: 679407 - DNA, 25 bp, Mus musculus
gccaaacactctggtgattggatac

SEQ ID NO: 679408 - DNA, 25 bp, Mus musculus
gccaaacatgtgatgactctgcatg

SEQ ID NO: 679409 - DNA, 25 bp, Mus musculus
gccaaacatgtgttgactctgcatg

SEQ ID NO: 679410 - DNA, 25 bp, Mus musculus
gccaaaccaactcagacttcagctt

SEQ ID NO: 679411 - DNA, 25 bp, Mus musculus
gccaaaccaactgagacttcagctt

SEQ ID NO: 679412 - DNA, 25 bp, Mus musculus
gccaaaccagccctatgagtggatt

SEQ ID NO: 679413 - DNA, 25 bp, Mus musculus
gccaaaccagccgtatgagtggatt

SEQ ID NO: 679414 - DNA, 25 bp, Mus musculus
gccaaacctggcaccagacagaacg

SEQ ID NO: 679415 - DNA, 25 bp, Mus musculus
gccaaacctggctccagacagaacg

SEQ ID NO: 679416 - DNA, 25 bp, Mus musculus
gccaaacggagacccaaggaagcag

SEQ ID NO: 679417 - DNA, 25 bp, Mus musculus
gccaaacggagagccaaggaagcag

SEQ ID NO: 679418 - DNA, 25 bp, Mus musculus
gccaaactcttaatagaaggtgtag

SEQ ID NO: 679419 - DNA, 25 bp, Mus musculus
gccaaactcttattagaaggtgtag

SEQ ID NO: 679420 - DNA, 25 bp, Mus musculus
gccaaacttggaaggagctggactg

SEQ ID NO: 679421 - DNA, 25 bp, Mus musculus
gccaaacttggatggagctggactg

SEQ ID NO: 679422 - DNA, 25 bp, Mus musculus
gccaaactttgtcgcatgcatatga

SEQ ID NO: 679423 - DNA, 25 bp, Mus musculus
gccaaactttgtggcatgcatatga

SEQ ID NO: 679424 - DNA, 25 bp, Mus musculus
gccaaagaagtgaacccactcctgt

SEQ ID NO: 679425 - DNA, 25 bp, Mus musculus
gccaaagaagtgtacccactcctgt

SEQ ID NO: 679426 - DNA, 25 bp, Mus musculus
gccaaagaatttcgagcctctgaat

SEQ ID NO: 679427 - DNA, 25 bp, Mus musculus
gccaaagaatttggagcctctgaat

SEQ ID NO: 679428 - DNA, 25 bp, Mus musculus
gccaaagacagaagcttcagtctca

SEQ ID NO: 679429 - DNA, 25 bp, Mus musculus
gccaaagacagatgcttcagtctca

SEQ ID NO: 679430 - DNA, 25 bp, Mus musculus
gccaaagacgttaccttctccctgg

SEQ ID NO: 679431 - DNA, 25 bp, Mus musculus
gccaaagacgtttccttctccctgg

SEQ ID NO: 679432 - DNA, 25 bp, Mus musculus
gccaaagactgtagaagccgcagtc

SEQ ID NO: 679433 - DNA, 25 bp, Mus musculus
gccaaagactgttgaagccgcagtc

SEQ ID NO: 679434 - DNA, 25 bp, Mus musculus
gccaaagagaaacagctacagacaa

SEQ ID NO: 679435 - DNA, 25 bp, Mus musculus
gccaaagagaaagagctacagacaa

SEQ ID NO: 679436 - DNA, 25 bp, Mus musculus
gccaaagagtccaaggcctaggttt

SEQ ID NO: 679437 - DNA, 25 bp, Mus musculus
gccaaagagtcctaggcctaggttt

SEQ ID NO: 679438 - DNA, 25 bp, Mus musculus
gccaaagagttaactgtgtcagaca

SEQ ID NO: 679439 - DNA, 25 bp, Mus musculus
gccaaagagttatctgtgtcagaca

SEQ ID NO: 679440 - DNA, 25 bp, Mus musculus
gccaaagatgtcaagtccaaactga

SEQ ID NO: 679441 - DNA, 25 bp, Mus musculus
gccaaagatgtctagtccaaactga

SEQ ID NO: 679442 - DNA, 25 bp, Mus musculus
gccaaagcctatcctatagcggcgc

SEQ ID NO: 679443 - DNA, 25 bp, Mus musculus
gccaaagcctatgctatagcggcgc

SEQ ID NO: 679444 - DNA, 25 bp, Mus musculus
gccaaagcgtgacaagattaggaag

SEQ ID NO: 679445 - DNA, 25 bp, Mus musculus
gccaaagcgtgagaagattaggaag

SEQ ID NO: 679446 - DNA, 25 bp, Mus musculus
gccaaagctttgagctagctcccaa

SEQ ID NO: 679447 - DNA, 25 bp, Mus musculus
gccaaagctttgtgctagctcccaa

SEQ ID NO: 679448 - DNA, 25 bp, Mus musculus
gccaaaggttgtatcagcaggtccc

SEQ ID NO: 679449 - DNA, 25 bp, Mus musculus
gccaaaggttgtttcagcaggtccc

SEQ ID NO: 679450 - DNA, 25 bp, Mus musculus
gccaaagtatcccagagagaagagg

SEQ ID NO: 679451 - DNA, 25 bp, Mus musculus
gccaaagtatccgagagagaagagg

SEQ ID NO: 679452 - DNA, 25 bp, Mus musculus
gccaaagtcgctaccacttccgcaa

SEQ ID NO: 679453 - DNA, 25 bp, Mus musculus
gccaaagtcgcttccacttccgcaa

SEQ ID NO: 679454 - DNA, 25 bp, Mus musculus
gccaaagtgcatctcttctacatcg

SEQ ID NO: 679455 - DNA, 25 bp, Mus musculus
gccaaagtgcatgtcttctacatcg

SEQ ID NO: 679456 - DNA, 25 bp, Mus musculus
gccaaagttgagagtgcgatccaga

SEQ ID NO: 679457 - DNA, 25 bp, Mus musculus
gccaaagttgagtgtgcgatccaga

SEQ ID NO: 679458 - DNA, 25 bp, Mus musculus
gccaaatacatcattggcaagttct

SEQ ID NO: 679459 - DNA, 25 bp, Mus musculus
gccaaatacatctttggcaagttct

SEQ ID NO: 679460 - DNA, 25 bp, Mus musculus
gccaaatacgtcagggcagccacgg

SEQ ID NO: 679461 - DNA, 25 bp, Mus musculus
gccaaatacgtctgggcagccacgg

SEQ ID NO: 679462 - DNA, 25 bp, Mus musculus
gccaaatcaccaacatgtcctgtta

SEQ ID NO: 679463 - DNA, 25 bp, Mus musculus
gccaaatcaccatcatgtcctgtta

SEQ ID NO: 679464 - DNA, 25 bp, Mus musculus
gccaaatcagcaatgtgattagcaa

SEQ ID NO: 679465 - DNA, 25 bp, Mus musculus
gccaaatcagcattgtgattagcaa

SEQ ID NO: 679466 - DNA, 25 bp, Mus musculus
gccaaatcatacaggtgtatatcag

SEQ ID NO: 679467 - DNA, 25 bp, Mus musculus
gccaaatcatactggtgtatatcag

SEQ ID NO: 679468 - DNA, 25 bp, Mus musculus
gccaaatgataaaaaggcagctcac

SEQ ID NO: 679469 - DNA, 25 bp, Mus musculus
gccaaatgataataaggcagctcac

SEQ ID NO: 679470 - DNA, 25 bp, Mus musculus
gccaaatgcaacctgctggcagaga

SEQ ID NO: 679471 - DNA, 25 bp, Mus musculus
gccaaatgcaacgtgctggcagaga

SEQ ID NO: 679472 - DNA, 25 bp, Mus musculus
gccaaatgccagatactgatcacca

SEQ ID NO: 679473 - DNA, 25 bp, Mus musculus
gccaaatgccagttactgatcacca

SEQ ID NO: 679474 - DNA, 25 bp, Mus musculus
gccaaatgctgcctgtggtttctgc

SEQ ID NO: 679475 - DNA, 25 bp, Mus musculus
gccaaatgctgcgtgtggtttctgc

SEQ ID NO: 679476 - DNA, 25 bp, Mus musculus
gccaaatggtgacaaagagctctca

SEQ ID NO: 679477 - DNA, 25 bp, Mus musculus
gccaaatggtgagaaagagctctca

SEQ ID NO: 679478 - DNA, 25 bp, Mus musculus
gccaaattcctcaagcaaggagact

SEQ ID NO: 679479 - DNA, 25 bp, Mus musculus
gccaaattcctctagcaaggagact

SEQ ID NO: 679480 - DNA, 25 bp, Mus musculus
gccaaatttctcctgatggtccgag

SEQ ID NO: 679481 - DNA, 25 bp, Mus musculus
gccaaatttctcgtgatggtccgag

SEQ ID NO: 679482 - DNA, 25 bp, Mus musculus
gccaaatttgaaattcatcacggtg

SEQ ID NO: 679483 - DNA, 25 bp, Mus musculus
gccaaatttgaatttcatcacggtg

SEQ ID NO: 679484 - DNA, 25 bp, Mus musculus
gccaaatttgccacctgtttctacg

SEQ ID NO: 679485 - DNA, 25 bp, Mus musculus
gccaaatttgcctcctgtttctacg

SEQ ID NO: 679486 - DNA, 25 bp, Mus musculus
gccaacaaacatctaagcagcctta

SEQ ID NO: 679487 - DNA, 25 bp, Mus musculus
gccaacaaacatgtaagcagcctta

SEQ ID NO: 679488 - DNA, 25 bp, Mus musculus
gccaacaagaagacggacgtccctg

SEQ ID NO: 679489 - DNA, 25 bp, Mus musculus
gccaacaagaagtcggacgtccctg

SEQ ID NO: 679490 - DNA, 25 bp, Mus musculus
gccaacaagcatcgagaatcagcca

SEQ ID NO: 679491 - DNA, 25 bp, Mus musculus
gccaacaagcatggagaatcagcca

SEQ ID NO: 679492 - DNA, 25 bp, Mus musculus
gccaacaaggtgcatctgatgcacc

SEQ ID NO: 679493 - DNA, 25 bp, Mus musculus
gccaacaaggtggatctgatgcacc

SEQ ID NO: 679494 - DNA, 25 bp, Mus musculus
gccaacaagtaccacgaggcagcca

SEQ ID NO: 679495 - DNA, 25 bp, Mus musculus
gccaacaagtacgacgaggcagcca

SEQ ID NO: 679496 - DNA, 25 bp, Mus musculus
gccaacactggtatacctggtcaca

SEQ ID NO: 679497 - DNA, 25 bp, Mus musculus
gccaacactggtttacctggtcaca

SEQ ID NO: 679498 - DNA, 25 bp, Mus musculus
gccaacagaagtctggagtttccat

SEQ ID NO: 679499 - DNA, 25 bp, Mus musculus
gccaacagaagtgtggagtttccat

SEQ ID NO: 679500 - DNA, 25 bp, Mus musculus
gccaacagtgagacgtcagccagtc

SEQ ID NO: 679501 - DNA, 25 bp, Mus musculus
gccaacagtgagtcgtcagccagtc

SEQ ID NO: 679502 - DNA, 25 bp, Mus musculus
gccaacagttcccatgatgtgaagc

SEQ ID NO: 679503 - DNA, 25 bp, Mus musculus
gccaacagttccgatgatgtgaagc

SEQ ID NO: 679504 - DNA, 25 bp, Mus musculus
gccaacatcaacaagtctttgacca

SEQ ID NO: 679505 - DNA, 25 bp, Mus musculus
gccaacatcaactagtctttgacca

SEQ ID NO: 679506 - DNA, 25 bp, Mus musculus
gccaacatccgtacacctgtcttca

SEQ ID NO: 679507 - DNA, 25 bp, Mus musculus
gccaacatccgttcacctgtcttca

SEQ ID NO: 679508 - DNA, 25 bp, Mus musculus
gccaacatcgtgatgcttcacgaca

SEQ ID NO: 679509 - DNA, 25 bp, Mus musculus
gccaacatcgtgttgcttcacgaca

SEQ ID NO: 679510 - DNA, 25 bp, Mus musculus
gccaacatgatgagcagactgatgg

SEQ ID NO: 679511 - DNA, 25 bp, Mus musculus
gccaacatgatgtgcagactgatgg

SEQ ID NO: 679512 - DNA, 25 bp, Mus musculus
gccaacatgcacaagaaagagaagt

SEQ ID NO: 679513 - DNA, 25 bp, Mus musculus
gccaacatgcactagaaagagaagt

SEQ ID NO: 679514 - DNA, 25 bp, Mus musculus
gccaacatgggtcagaaggtcacag

SEQ ID NO: 679515 - DNA, 25 bp, Mus musculus
gccaacatgggtgagaaggtcacag

SEQ ID NO: 679516 - DNA, 25 bp, Mus musculus
gccaacattgacctggactctcaga

SEQ ID NO: 679517 - DNA, 25 bp, Mus musculus
gccaacattgacgtggactctcaga

SEQ ID NO: 679518 - DNA, 25 bp, Mus musculus
gccaaccaagtcaaaagggtccatt

SEQ ID NO: 679519 - DNA, 25 bp, Mus musculus
gccaaccaagtctaaagggtccatt

SEQ ID NO: 679520 - DNA, 25 bp, Mus musculus
gccaaccaggtcacagcctcttgtg

SEQ ID NO: 679521 - DNA, 25 bp, Mus musculus
gccaaccaggtctcagcctcttgtg

SEQ ID NO: 679522 - DNA, 25 bp, Mus musculus
gccaaccagtggatcaagtttaagt

SEQ ID NO: 679523 - DNA, 25 bp, Mus musculus
gccaaccagtggttcaagtttaagt

SEQ ID NO: 679524 - DNA, 25 bp, Mus musculus
gccaaccatcacatgcaatctatct

SEQ ID NO: 679525 - DNA, 25 bp, Mus musculus
gccaaccatcacttgcaatctatct

SEQ ID NO: 679526 - DNA, 25 bp, Mus musculus
gccaaccatttcagtagtgacttac

SEQ ID NO: 679527 - DNA, 25 bp, Mus musculus
gccaaccatttctgtagtgacttac

SEQ ID NO: 679528 - DNA, 25 bp, Mus musculus
gccaacccactgatgattacgttct

SEQ ID NO: 679529 - DNA, 25 bp, Mus musculus
gccaacccactgttgattacgttct

SEQ ID NO: 679530 - DNA, 25 bp, Mus musculus
gccaaccccgagatggacaacttgc

SEQ ID NO: 679531 - DNA, 25 bp, Mus musculus
gccaaccccgagttggacaacttgc

SEQ ID NO: 679532 - DNA, 25 bp, Mus musculus
gccaaccctgacagaggagcctatg

SEQ ID NO: 679533 - DNA, 25 bp, Mus musculus
gccaaccctgactgaggagcctatg

SEQ ID NO: 679534 - DNA, 25 bp, Mus musculus
gccaaccgaaggctggccaagctct

SEQ ID NO: 679535 - DNA, 25 bp, Mus musculus
gccaaccgaagggtggccaagctct

SEQ ID NO: 679536 - DNA, 25 bp, Mus musculus
gccaaccggaagcacagaaaactag

SEQ ID NO: 679537 - DNA, 25 bp, Mus musculus
gccaaccggaaggacagaaaactag

SEQ ID NO: 679538 - DNA, 25 bp, Mus musculus
gccaacctgtgtcgtatcaaccaaa

SEQ ID NO: 679539 - DNA, 25 bp, Mus musculus
gccaacctgtgtggtatcaaccaaa

SEQ ID NO: 679540 - DNA, 25 bp, Mus musculus
gccaacgagaggaacgtgtccacgc

SEQ ID NO: 679541 - DNA, 25 bp, Mus musculus
gccaacgagaggtacgtgtccacgc

SEQ ID NO: 679542 - DNA, 25 bp, Mus musculus
gccaacgagctcagtgaagtgaacc

SEQ ID NO: 679543 - DNA, 25 bp, Mus musculus
gccaacgagctctgtgaagtgaacc

SEQ ID NO: 679544 - DNA, 25 bp, Mus musculus
gccaacgaggtcatccactacggct

SEQ ID NO: 679545 - DNA, 25 bp, Mus musculus
gccaacgaggtcttccactacggct

SEQ ID NO: 679546 - DNA, 25 bp, Mus musculus
gccaacgctcatcaaacaaaccaga

SEQ ID NO: 679547 - DNA, 25 bp, Mus musculus
gccaacgctcatgaaacaaaccaga

SEQ ID NO: 679548 - DNA, 25 bp, Mus musculus
gccaacggtggacatggattccaga

SEQ ID NO: 679549 - DNA, 25 bp, Mus musculus
gccaacggtggagatggattccaga

SEQ ID NO: 679550 - DNA, 25 bp, Mus musculus
gccaacgtagtccacgtgaagtcac

SEQ ID NO: 679551 - DNA, 25 bp, Mus musculus
gccaacgtagtcgacgtgaagtcac

SEQ ID NO: 679552 - DNA, 25 bp, Mus musculus
gccaacgtcaagcatctgaaaatcc

SEQ ID NO: 679553 - DNA, 25 bp, Mus musculus
gccaacgtcaaggatctgaaaatcc

SEQ ID NO: 679554 - DNA, 25 bp, Mus musculus
gccaacgtgttcatcacagctacgg

SEQ ID NO: 679555 - DNA, 25 bp, Mus musculus
gccaacgtgttcttcacagctacgg

SEQ ID NO: 679556 - DNA, 25 bp, Mus musculus
gccaactacagccagtgcctcaagt

SEQ ID NO: 679557 - DNA, 25 bp, Mus musculus
gccaactacagcgagtgcctcaagt

SEQ ID NO: 679558 - DNA, 25 bp, Mus musculus
gccaactacggtcgagacaaagaag

SEQ ID NO: 679559 - DNA, 25 bp, Mus musculus
gccaactacggtggagacaaagaag

SEQ ID NO: 679560 - DNA, 25 bp, Mus musculus
gccaactactgtatgctcctcttgt

SEQ ID NO: 679561 - DNA, 25 bp, Mus musculus
gccaactactgtttgctcctcttgt

SEQ ID NO: 679562 - DNA, 25 bp, Mus musculus
gccaactatacaaatctgacacaag

SEQ ID NO: 679563 - DNA, 25 bp, Mus musculus
gccaactatacatatctgacacaag

SEQ ID NO: 679564 - DNA, 25 bp, Mus musculus
gccaactatgtccagaagcgtgagg

SEQ ID NO: 679565 - DNA, 25 bp, Mus musculus
gccaactatgtcgagaagcgtgagg

SEQ ID NO: 679566 - DNA, 25 bp, Mus musculus
gccaactccatcatcgtgaacatca

SEQ ID NO: 679567 - DNA, 25 bp, Mus musculus
gccaactccatcttcgtgaacatca

SEQ ID NO: 679568 - DNA, 25 bp, Mus musculus
gccaactcggatacccctatgtgcg

SEQ ID NO: 679569 - DNA, 25 bp, Mus musculus
gccaactcggattcccctatgtgcg

SEQ ID NO: 679570 - DNA, 25 bp, Mus musculus
gccaactgaaggatcatctgcggaa

SEQ ID NO: 679571 - DNA, 25 bp, Mus musculus
gccaactgaaggttcatctgcggaa

SEQ ID NO: 679572 - DNA, 25 bp, Mus musculus
gccaactgattaacatgaatgatct

SEQ ID NO: 679573 - DNA, 25 bp, Mus musculus
gccaactgattatcatgaatgatct

SEQ ID NO: 679574 - DNA, 25 bp, Mus musculus
gccaactggctcagcgtttccaata

SEQ ID NO: 679575 - DNA, 25 bp, Mus musculus
gccaactggctctgcgtttccaata

SEQ ID NO: 679576 - DNA, 25 bp, Mus musculus
gccaactggttgacgctggacaaag

SEQ ID NO: 679577 - DNA, 25 bp, Mus musculus
gccaactggttgtcgctggacaaag

SEQ ID NO: 679578 - DNA, 25 bp, Mus musculus
gccaacttcaccataggcgaaccta

SEQ ID NO: 679579 - DNA, 25 bp, Mus musculus
gccaacttcaccttaggcgaaccta

SEQ ID NO: 679580 - DNA, 25 bp, Mus musculus
gccaacttccctactctgataaaaa

SEQ ID NO: 679581 - DNA, 25 bp, Mus musculus
gccaacttcccttctctgataaaaa

SEQ ID NO: 679582 - DNA, 25 bp, Mus musculus
gccaacttcctgaatgatgcctcca

SEQ ID NO: 679583 - DNA, 25 bp, Mus musculus
gccaacttcctgtatgatgcctcca

SEQ ID NO: 679584 - DNA, 25 bp, Mus musculus
gccaagaaagccaacctcagaaata

SEQ ID NO: 679585 - DNA, 25 bp, Mus musculus
gccaagaaagcctacctcagaaata

SEQ ID NO: 679586 - DNA, 25 bp, Mus musculus
gccaagaaatatccaatggagcaga

SEQ ID NO: 679587 - DNA, 25 bp, Mus musculus
gccaagaaatatgcaatggagcaga

SEQ ID NO: 679588 - DNA, 25 bp, Mus musculus
gccaagaaattcagccaagagttga

SEQ ID NO: 679589 - DNA, 25 bp, Mus musculus
gccaagaaattctgccaagagttga

SEQ ID NO: 679590 - DNA, 25 bp, Mus musculus
gccaagaacgcacatctggtgacca

SEQ ID NO: 679591 - DNA, 25 bp, Mus musculus
gccaagaacgcagatctggtgacca

SEQ ID NO: 679592 - DNA, 25 bp, Mus musculus
gccaagaactacatggaaggcctcc

SEQ ID NO: 679593 - DNA, 25 bp, Mus musculus
gccaagaactacttggaaggcctcc

SEQ ID NO: 679594 - DNA, 25 bp, Mus musculus
gccaagaagagtactctacttacct

SEQ ID NO: 679595 - DNA, 25 bp, Mus musculus
gccaagaagagtctgtgtcgccgcc

SEQ ID NO: 679596 - DNA, 25 bp, Mus musculus
gccaagaagagtgtgtgtcgccgcc

SEQ ID NO: 679597 - DNA, 25 bp, Mus musculus
gccaagaagagttctctacttacct

SEQ ID NO: 679598 - DNA, 25 bp, Mus musculus
gccaagaagctcaccatgtatggag

SEQ ID NO: 679599 - DNA, 25 bp, Mus musculus
gccaagaagctctccatgtatggag

SEQ ID NO: 679600 - DNA, 25 bp, Mus musculus
gccaagaatcttctaaacagacatg

SEQ ID NO: 679601 - DNA, 25 bp, Mus musculus
gccaagaatcttgtaaacagacatg

SEQ ID NO: 679602 - DNA, 25 bp, Mus musculus
gccaagaattctatgggcactctac

SEQ ID NO: 679603 - DNA, 25 bp, Mus musculus
gccaagaattctttgggcactctac

SEQ ID NO: 679604 - DNA, 25 bp, Mus musculus
gccaagaatttgacagccaagttca

SEQ ID NO: 679605 - DNA, 25 bp, Mus musculus
gccaagaatttgtcagccaagttca

SEQ ID NO: 679606 - DNA, 25 bp, Mus musculus
gccaagacatccctaggacggattt

SEQ ID NO: 679607 - DNA, 25 bp, Mus musculus
gccaagacatccgtaggacggattt

SEQ ID NO: 679608 - DNA, 25 bp, Mus musculus
gccaagacatctcgaagacagggca

SEQ ID NO: 679609 - DNA, 25 bp, Mus musculus
gccaagacatctggaagacagggca

SEQ ID NO: 679610 - DNA, 25 bp, Mus musculus
gccaagacccctagaatcaagtcag

SEQ ID NO: 679611 - DNA, 25 bp, Mus musculus
gccaagaccccttgaatcaagtcag

SEQ ID NO: 679612 - DNA, 25 bp, Mus musculus
gccaagactgggagagcctttgatc

SEQ ID NO: 679613 - DNA, 25 bp, Mus musculus
gccaagactgggtgagcctttgatc

SEQ ID NO: 679614 - DNA, 25 bp, Mus musculus
gccaagagaggtcgatccattggtt

SEQ ID NO: 679615 - DNA, 25 bp, Mus musculus
gccaagagaggtggatccattggtt

SEQ ID NO: 679616 - DNA, 25 bp, Mus musculus
gccaagagccaaccggaggcctgca

SEQ ID NO: 679617 - DNA, 25 bp, Mus musculus
gccaagagccaagcggaggcctgca

SEQ ID NO: 679618 - DNA, 25 bp, Mus musculus
gccaagaggaccatgctcggtgacc

SEQ ID NO: 679619 - DNA, 25 bp, Mus musculus
gccaagaggaccttgctcggtgacc

SEQ ID NO: 679620 - DNA, 25 bp, Mus musculus
gccaagaggccacattgatgcggat

SEQ ID NO: 679621 - DNA, 25 bp, Mus musculus
gccaagaggccagattgatgcggat

SEQ ID NO: 679622 - DNA, 25 bp, Mus musculus
gccaagaggtgacagacaacataga

SEQ ID NO: 679623 - DNA, 25 bp, Mus musculus
gccaagaggtgagagacaacataga

SEQ ID NO: 679624 - DNA, 25 bp, Mus musculus
gccaagagtcagctatttgacgttg

SEQ ID NO: 679625 - DNA, 25 bp, Mus musculus
gccaagagtcaggtatttgacgttg

SEQ ID NO: 679626 - DNA, 25 bp, Mus musculus
gccaagatcaagcaacaaaccagga

SEQ ID NO: 679627 - DNA, 25 bp, Mus musculus
gccaagatcaaggaacaaaccagga

SEQ ID NO: 679628 - DNA, 25 bp, Mus musculus
gccaagatgaagaagttcattgcct

SEQ ID NO: 679629 - DNA, 25 bp, Mus musculus
gccaagatgaagctgtatggaagta

SEQ ID NO: 679630 - DNA, 25 bp, Mus musculus
gccaagatgaaggtgtatggaagta

SEQ ID NO: 679631 - DNA, 25 bp, Mus musculus
gccaagatgaagtagttcattgcct

SEQ ID NO: 679632 - DNA, 25 bp, Mus musculus
gccaagatgatacattcatgtcaga

SEQ ID NO: 679633 - DNA, 25 bp, Mus musculus
gccaagatgatacgtggaaagcccc

SEQ ID NO: 679634 - DNA, 25 bp, Mus musculus
gccaagatgatagattcatgtcaga

SEQ ID NO: 679635 - DNA, 25 bp, Mus musculus
gccaagatgataggtggaaagcccc

SEQ ID NO: 679636 - DNA, 25 bp, Mus musculus
gccaagatggcgacgcccagctggc

SEQ ID NO: 679637 - DNA, 25 bp, Mus musculus
gccaagatggcgatgcaagcggcta

SEQ ID NO: 679638 - DNA, 25 bp, Mus musculus
gccaagatggcgctgatagaatata

SEQ ID NO: 679639 - DNA, 25 bp, Mus musculus
gccaagatggcggtgatagaatata

SEQ ID NO: 679640 - DNA, 25 bp, Mus musculus
gccaagatggcgtcgcccagctggc

SEQ ID NO: 679641 - DNA, 25 bp, Mus musculus
gccaagatggcgttgcaagcggcta

SEQ ID NO: 679642 - DNA, 25 bp, Mus musculus
gccaagatggtgactcgcaggaaga

SEQ ID NO: 679643 - DNA, 25 bp, Mus musculus
gccaagatggtgtctcgcaggaaga

SEQ ID NO: 679644 - DNA, 25 bp, Mus musculus
gccaagattcatctatgggagtcac

SEQ ID NO: 679645 - DNA, 25 bp, Mus musculus
gccaagattcatgtatgggagtcac

SEQ ID NO: 679646 - DNA, 25 bp, Mus musculus
gccaagatttctcacttcagctgga

SEQ ID NO: 679647 - DNA, 25 bp, Mus musculus
gccaagatttctgacttcagctgga

SEQ ID NO: 679648 - DNA, 25 bp, Mus musculus
gccaagcaaggccttttcacatgta

SEQ ID NO: 679649 - DNA, 25 bp, Mus musculus
gccaagcaaggcgttttcacatgta

SEQ ID NO: 679650 - DNA, 25 bp, Mus musculus
gccaagcaagtccttcccaggaaag

SEQ ID NO: 679651 - DNA, 25 bp, Mus musculus
gccaagcaagtcgttcccaggaaag

SEQ ID NO: 679652 - DNA, 25 bp, Mus musculus
gccaagcaccatagagctcattccg

SEQ ID NO: 679653 - DNA, 25 bp, Mus musculus
gccaagcaccattgagctcattccg

SEQ ID NO: 679654 - DNA, 25 bp, Mus musculus
gccaagcactatagctggagcacag

SEQ ID NO: 679655 - DNA, 25 bp, Mus musculus
gccaagcactattgctggagcacag

SEQ ID NO: 679656 - DNA, 25 bp, Mus musculus
gccaagcagaggaaagtctttgctg

SEQ ID NO: 679657 - DNA, 25 bp, Mus musculus
gccaagcagaggtaagtctttgctg

SEQ ID NO: 679658 - DNA, 25 bp, Mus musculus
gccaagcagatgattggaccacaag

SEQ ID NO: 679659 - DNA, 25 bp, Mus musculus
gccaagcagatgtttggaccacaag

SEQ ID NO: 679660 - DNA, 25 bp, Mus musculus
gccaagcagtgcatcggcacaatga

SEQ ID NO: 679661 - DNA, 25 bp, Mus musculus
gccaagcagtgcttcggcacaatga

SEQ ID NO: 679662 - DNA, 25 bp, Mus musculus
gccaagcataataagatgatgaaag

SEQ ID NO: 679663 - DNA, 25 bp, Mus musculus
gccaagcataattagatgatgaaag

SEQ ID NO: 679664 - DNA, 25 bp, Mus musculus
gccaagcatgaccagcagttcctta

SEQ ID NO: 679665 - DNA, 25 bp, Mus musculus
gccaagcatgacgagcagttcctta

SEQ ID NO: 679666 - DNA, 25 bp, Mus musculus
gccaagcatttgatctggtggatgc

SEQ ID NO: 679667 - DNA, 25 bp, Mus musculus
gccaagcatttgttctggtggatgc

SEQ ID NO: 679668 - DNA, 25 bp, Mus musculus
gccaagccaacactggaggagtcca

SEQ ID NO: 679669 - DNA, 25 bp, Mus musculus
gccaagccaacagtggaggagtcca

SEQ ID NO: 679670 - DNA, 25 bp, Mus musculus
gccaagccaaggatgagctgtagag

SEQ ID NO: 679671 - DNA, 25 bp, Mus musculus
gccaagccaaggttgagctgtagag

SEQ ID NO: 679672 - DNA, 25 bp, Mus musculus
gccaagccagccattcccggagaag

SEQ ID NO: 679673 - DNA, 25 bp, Mus musculus
gccaagccagcctttcccggagaag

SEQ ID NO: 679674 - DNA, 25 bp, Mus musculus
gccaagcctaggagcttacagacgg

SEQ ID NO: 679675 - DNA, 25 bp, Mus musculus
gccaagcctaggtgcttacagacgg

SEQ ID NO: 679676 - DNA, 25 bp, Mus musculus
gccaagcgcaagacggacggagcct

SEQ ID NO: 679677 - DNA, 25 bp, Mus musculus
gccaagcgcaagtcggacggagcct

SEQ ID NO: 679678 - DNA, 25 bp, Mus musculus
gccaagcgcttgagctgtcactgaa

SEQ ID NO: 679679 - DNA, 25 bp, Mus musculus
gccaagcgcttgtgctgtcactgaa

SEQ ID NO: 679680 - DNA, 25 bp, Mus musculus
gccaagctaaggaaaccattcccct

SEQ ID NO: 679681 - DNA, 25 bp, Mus musculus
gccaagctaaggtaaccattcccct

SEQ ID NO: 679682 - DNA, 25 bp, Mus musculus
gccaagctgaaacagggcatttcac

SEQ ID NO: 679683 - DNA, 25 bp, Mus musculus
gccaagctgaaagagggcatttcac

SEQ ID NO: 679684 - DNA, 25 bp, Mus musculus
gccaagctgaagaaattagccatca

SEQ ID NO: 679685 - DNA, 25 bp, Mus musculus
gccaagctgaagtaattagccatca

SEQ ID NO: 679686 - DNA, 25 bp, Mus musculus
gccaagctgcaaaatccctgattat

SEQ ID NO: 679687 - DNA, 25 bp, Mus musculus
gccaagctgcaatatccctgattat

SEQ ID NO: 679688 - DNA, 25 bp, Mus musculus
gccaagctgtgaccaaatatgtccc

SEQ ID NO: 679689 - DNA, 25 bp, Mus musculus
gccaagctgtgagcaaatatgtccc

SEQ ID NO: 679690 - DNA, 25 bp, Mus musculus
gccaagcttaggaacatgagccgcg

SEQ ID NO: 679691 - DNA, 25 bp, Mus musculus
gccaagcttaggtacatgagccgcg

SEQ ID NO: 679692 - DNA, 25 bp, Mus musculus
gccaagcttcccaaatggccgtggg

SEQ ID NO: 679693 - DNA, 25 bp, Mus musculus
gccaagcttccctaatggccgtggg

SEQ ID NO: 679694 - DNA, 25 bp, Mus musculus
gccaagcttcttagtatgtacagag

SEQ ID NO: 679695 - DNA, 25 bp, Mus musculus
gccaagcttctttgtatgtacagag

SEQ ID NO: 679696 - DNA, 25 bp, Mus musculus
gccaaggaaaggcagtctgccgaac

SEQ ID NO: 679697 - DNA, 25 bp, Mus musculus
gccaaggaaagggagtctgccgaac

SEQ ID NO: 679698 - DNA, 25 bp, Mus musculus
gccaaggaattcaccaatgtttata

SEQ ID NO: 679699 - DNA, 25 bp, Mus musculus
gccaaggaattctccaatgtttata

SEQ ID NO: 679700 - DNA, 25 bp, Mus musculus
gccaaggaccgacgcagcacgctga

SEQ ID NO: 679701 - DNA, 25 bp, Mus musculus
gccaaggaccgaggcagcacgctga

SEQ ID NO: 679702 - DNA, 25 bp, Mus musculus
gccaaggagcagataccctagcctt

SEQ ID NO: 679703 - DNA, 25 bp, Mus musculus
gccaaggagcagttaccctagcctt

SEQ ID NO: 679704 - DNA, 25 bp, Mus musculus
gccaaggagcgcaggctgagaatat

SEQ ID NO: 679705 - DNA, 25 bp, Mus musculus
gccaaggagcgctggctgagaatat

SEQ ID NO: 679706 - DNA, 25 bp, Mus musculus
gccaaggagcttcagaaatactcca

SEQ ID NO: 679707 - DNA, 25 bp, Mus musculus
gccaaggagcttgagaaatactcca

SEQ ID NO: 679708 - DNA, 25 bp, Mus musculus
gccaaggagtggagcttcaaaccat

SEQ ID NO: 679709 - DNA, 25 bp, Mus musculus
gccaaggagtggtgcttcaaaccat

SEQ ID NO: 679710 - DNA, 25 bp, Mus musculus
gccaaggatgcaaacacctgactca

SEQ ID NO: 679711 - DNA, 25 bp, Mus musculus
gccaaggatgcatacacctgactca

SEQ ID NO: 679712 - DNA, 25 bp, Mus musculus
gccaaggcaaagcaaatgcaccaat

SEQ ID NO: 679713 - DNA, 25 bp, Mus musculus
gccaaggcaaaggaaatgcaccaat

SEQ ID NO: 679714 - DNA, 25 bp, Mus musculus
gccaaggcaacaattcctacgtgtt

SEQ ID NO: 679715 - DNA, 25 bp, Mus musculus
gccaaggcaacatttcctacgtgtt

SEQ ID NO: 679716 - DNA, 25 bp, Mus musculus
gccaaggcatatacagctccacgac

SEQ ID NO: 679717 - DNA, 25 bp, Mus musculus
gccaaggcatattcagctccacgac

SEQ ID NO: 679718 - DNA, 25 bp, Mus musculus
gccaaggcatcaaggaacaccgctc

SEQ ID NO: 679719 - DNA, 25 bp, Mus musculus
gccaaggcatcatggaacaccgctc

SEQ ID NO: 679720 - DNA, 25 bp, Mus musculus
gccaaggccaagcaattcaccaatg

SEQ ID NO: 679721 - DNA, 25 bp, Mus musculus
gccaaggccaaggaattcaccaatg

SEQ ID NO: 679722 - DNA, 25 bp, Mus musculus
gccaaggccaggaatgtgcccctaa

SEQ ID NO: 679723 - DNA, 25 bp, Mus musculus
gccaaggccaggtatgtgcccctaa

SEQ ID NO: 679724 - DNA, 25 bp, Mus musculus
gccaaggccctgcagattattccac

SEQ ID NO: 679725 - DNA, 25 bp, Mus musculus
gccaaggccctggagattattccac

SEQ ID NO: 679726 - DNA, 25 bp, Mus musculus
gccaaggcggacagaggcagataca

SEQ ID NO: 679727 - DNA, 25 bp, Mus musculus
gccaaggcggactgaggcagataca

SEQ ID NO: 679728 - DNA, 25 bp, Mus musculus
gccaaggctgtgctgaagactttcc

SEQ ID NO: 679729 - DNA, 25 bp, Mus musculus
gccaaggctgtggtgaagactttcc

SEQ ID NO: 679730 - DNA, 25 bp, Mus musculus
gccaagggactcaggtcactgtctc

SEQ ID NO: 679731 - DNA, 25 bp, Mus musculus
gccaagggactctggtcactgtctc

SEQ ID NO: 679732 - DNA, 25 bp, Mus musculus
gccaagggaggcagcaactctgtga

SEQ ID NO: 679733 - DNA, 25 bp, Mus musculus
gccaagggaggctgcaactctgtga

SEQ ID NO: 679734 - DNA, 25 bp, Mus musculus
gccaagggcacacccggagttgcca

SEQ ID NO: 679735 - DNA, 25 bp, Mus musculus
gccaagggcacagccggagttgcca

SEQ ID NO: 679736 - DNA, 25 bp, Mus musculus
gccaagggctatacctcagagcagg

SEQ ID NO: 679737 - DNA, 25 bp, Mus musculus
gccaagggctatcaactagagctaa

SEQ ID NO: 679738 - DNA, 25 bp, Mus musculus
gccaagggctatgaactagagctaa

SEQ ID NO: 679739 - DNA, 25 bp, Mus musculus
gccaagggctattcctcagagcagg

SEQ ID NO: 679740 - DNA, 25 bp, Mus musculus
gccaagggtactctcatccatgaag

SEQ ID NO: 679741 - DNA, 25 bp, Mus musculus
gccaagggtactgtcatccatgaag

SEQ ID NO: 679742 - DNA, 25 bp, Mus musculus
gccaaggtcattcctgagtgcacac

SEQ ID NO: 679743 - DNA, 25 bp, Mus musculus
gccaaggtcattgctgagtgcacac

SEQ ID NO: 679744 - DNA, 25 bp, Mus musculus
gccaaggtcctgcattcaaatgaca

SEQ ID NO: 679745 - DNA, 25 bp, Mus musculus
gccaaggtcctggattcaaatgaca

SEQ ID NO: 679746 - DNA, 25 bp, Mus musculus
gccaaggtgtgaaggcccagcacat

SEQ ID NO: 679747 - DNA, 25 bp, Mus musculus
gccaaggtgtgatggcccagcacat

SEQ ID NO: 679748 - DNA, 25 bp, Mus musculus
gccaaggttgaacaattaaagtttg

SEQ ID NO: 679749 - DNA, 25 bp, Mus musculus
gccaaggttgaagaattaaagtttg

SEQ ID NO: 679750 - DNA, 25 bp, Mus musculus
gccaagtaaaacatacccagccttt

SEQ ID NO: 679751 - DNA, 25 bp, Mus musculus
gccaagtaaaacttacccagccttt

SEQ ID NO: 679752 - DNA, 25 bp, Mus musculus
gccaagtacattctggatgccacct

SEQ ID NO: 679753 - DNA, 25 bp, Mus musculus
gccaagtacattgtggatgccacct

SEQ ID NO: 679754 - DNA, 25 bp, Mus musculus
gccaagtacctgagtgtattgctaa

SEQ ID NO: 679755 - DNA, 25 bp, Mus musculus
gccaagtacctgtgtgtattgctaa

SEQ ID NO: 679756 - DNA, 25 bp, Mus musculus
gccaagtagagcaccgggaacaaat

SEQ ID NO: 679757 - DNA, 25 bp, Mus musculus
gccaagtagagcctgcaaacaagtt

SEQ ID NO: 679758 - DNA, 25 bp, Mus musculus
gccaagtagagcgtgcaaacaagtt

SEQ ID NO: 679759 - DNA, 25 bp, Mus musculus
gccaagtagagctccgggaacaaat

SEQ ID NO: 679760 - DNA, 25 bp, Mus musculus
gccaagtagccaagggatcccagag

SEQ ID NO: 679761 - DNA, 25 bp, Mus musculus
gccaagtagccatgggatcccagag

SEQ ID NO: 679762 - DNA, 25 bp, Mus musculus
gccaagtattttcaaggagatctga

SEQ ID NO: 679763 - DNA, 25 bp, Mus musculus
gccaagtattttgaaggagatctga

SEQ ID NO: 679764 - DNA, 25 bp, Mus musculus
gccaagtcagaacttagagaagccc

SEQ ID NO: 679765 - DNA, 25 bp, Mus musculus
gccaagtcagaagttagagaagccc

SEQ ID NO: 679766 - DNA, 25 bp, Mus musculus
gccaagtcctggagaagccatatgt

SEQ ID NO: 679767 - DNA, 25 bp, Mus musculus
gccaagtcctggtgaagccatatgt

SEQ ID NO: 679768 - DNA, 25 bp, Mus musculus
gccaagtgaagcagacattaaggac

SEQ ID NO: 679769 - DNA, 25 bp, Mus musculus
gccaagtgaagctgacattaaggac

SEQ ID NO: 679770 - DNA, 25 bp, Mus musculus
gccaagtgagtacccgggtacagca

SEQ ID NO: 679771 - DNA, 25 bp, Mus musculus
gccaagtgagtagccgggtacagca

SEQ ID NO: 679772 - DNA, 25 bp, Mus musculus
gccaagtgagtcatcgtcagggcac

SEQ ID NO: 679773 - DNA, 25 bp, Mus musculus
gccaagtgagtcttcgtcagggcac

SEQ ID NO: 679774 - DNA, 25 bp, Mus musculus
gccaagtgatagcatggtttcaaag

SEQ ID NO: 679775 - DNA, 25 bp, Mus musculus
gccaagtgataggatggtttcaaag

SEQ ID NO: 679776 - DNA, 25 bp, Mus musculus
gccaagtgcaatcgcatgtcccact

SEQ ID NO: 679777 - DNA, 25 bp, Mus musculus
gccaagtgcaatggcatgtcccact

SEQ ID NO: 679778 - DNA, 25 bp, Mus musculus
gccaagtgcacaacggacaccgtgt

SEQ ID NO: 679779 - DNA, 25 bp, Mus musculus
gccaagtgcacatcggacaccgtgt

SEQ ID NO: 679780 - DNA, 25 bp, Mus musculus
gccaagtgcccaaggatgataagaa

SEQ ID NO: 679781 - DNA, 25 bp, Mus musculus
gccaagtgcccatggatgataagaa

SEQ ID NO: 679782 - DNA, 25 bp, Mus musculus
gccaagtgctcacagttctgcacta

SEQ ID NO: 679783 - DNA, 25 bp, Mus musculus
gccaagtgctcagagttctgcacta

SEQ ID NO: 679784 - DNA, 25 bp, Mus musculus
gccaagtggaaaactaatgaagatg

SEQ ID NO: 679785 - DNA, 25 bp, Mus musculus
gccaagtggaaatctaatgaagatg

SEQ ID NO: 679786 - DNA, 25 bp, Mus musculus
gccaagtggagaccatatgactgag

SEQ ID NO: 679787 - DNA, 25 bp, Mus musculus
gccaagtggagagcatatgactgag

SEQ ID NO: 679788 - DNA, 25 bp, Mus musculus
gccaagtggcacaagctctccttag

SEQ ID NO: 679789 - DNA, 25 bp, Mus musculus
gccaagtggcactagctctccttag

SEQ ID NO: 679790 - DNA, 25 bp, Mus musculus
gccaagtggcagcagacctttaaaa

SEQ ID NO: 679791 - DNA, 25 bp, Mus musculus
gccaagtggcaggagacctttaaaa

SEQ ID NO: 679792 - DNA, 25 bp, Mus musculus
gccaagtgttctctcctgctaggag

SEQ ID NO: 679793 - DNA, 25 bp, Mus musculus
gccaagtgttctgtcctgctaggag

SEQ ID NO: 679794 - DNA, 25 bp, Mus musculus
gccaagttagagaccagcatcgcag

SEQ ID NO: 679795 - DNA, 25 bp, Mus musculus
gccaagttagagtccagcatcgcag

SEQ ID NO: 679796 - DNA, 25 bp, Mus musculus
gccaagttcaagctggctatcctca

SEQ ID NO: 679797 - DNA, 25 bp, Mus musculus
gccaagttcaaggtggctatcctca

SEQ ID NO: 679798 - DNA, 25 bp, Mus musculus
gccaagttcatcaccgtcctgtgta

SEQ ID NO: 679799 - DNA, 25 bp, Mus musculus
gccaagttcatctccgtcctgtgta

SEQ ID NO: 679800 - DNA, 25 bp, Mus musculus
gccaagttgcccaagatcttccatg

SEQ ID NO: 679801 - DNA, 25 bp, Mus musculus
gccaagttgccctagatcttccatg

SEQ ID NO: 679802 - DNA, 25 bp, Mus musculus
gccaagtttcaacaggaacttcctc

SEQ ID NO: 679803 - DNA, 25 bp, Mus musculus
gccaagtttcaagaggaacttcctc

SEQ ID NO: 679804 - DNA, 25 bp, Mus musculus
gccaagtttttcaccgagtctcgac

SEQ ID NO: 679805 - DNA, 25 bp, Mus musculus
gccaagtttttctccgagtctcgac

SEQ ID NO: 679806 - DNA, 25 bp, Mus musculus
gccaataaaaagcagccgcacttat

SEQ ID NO: 679807 - DNA, 25 bp, Mus musculus
gccaataaaaaggagccgcacttat

SEQ ID NO: 679808 - DNA, 25 bp, Mus musculus
gccaataagatcacgctggtgtcta

SEQ ID NO: 679809 - DNA, 25 bp, Mus musculus
gccaataagatctcgctggtgtcta

SEQ ID NO: 679810 - DNA, 25 bp, Mus musculus
gccaatacaagcagtttcccacaag

SEQ ID NO: 679811 - DNA, 25 bp, Mus musculus
gccaatacaagctgtttcccacaag

SEQ ID NO: 679812 - DNA, 25 bp, Mus musculus
gccaatacatatcaaaagtactggc

SEQ ID NO: 679813 - DNA, 25 bp, Mus musculus
gccaatacatatgaaaagtactggc

SEQ ID NO: 679814 - DNA, 25 bp, Mus musculus
gccaataccaccatgttcaacaact

SEQ ID NO: 679815 - DNA, 25 bp, Mus musculus
gccaataccaccttgttcaacaact

SEQ ID NO: 679816 - DNA, 25 bp, Mus musculus
gccaatacccagcagacacttactt

SEQ ID NO: 679817 - DNA, 25 bp, Mus musculus
gccaatacccaggagacacttactt

SEQ ID NO: 679818 - DNA, 25 bp, Mus musculus
gccaatacgaacagcctgacagcct

SEQ ID NO: 679819 - DNA, 25 bp, Mus musculus
gccaatacgaactgcctgacagcct

SEQ ID NO: 679820 - DNA, 25 bp, Mus musculus
gccaatactgtaaggtagaatttca

SEQ ID NO: 679821 - DNA, 25 bp, Mus musculus
gccaatactgtatggtagaatttca

SEQ ID NO: 679822 - DNA, 25 bp, Mus musculus
gccaatagcggcatcggaaagatga

SEQ ID NO: 679823 - DNA, 25 bp, Mus musculus
gccaatagcggcttcggaaagatga

SEQ ID NO: 679824 - DNA, 25 bp, Mus musculus
gccaatagtggaagacatgcatcgc

SEQ ID NO: 679825 - DNA, 25 bp, Mus musculus
gccaatagtggatgacatgcatcgc

SEQ ID NO: 679826 - DNA, 25 bp, Mus musculus
gccaatagtgtgatcagttttccta

SEQ ID NO: 679827 - DNA, 25 bp, Mus musculus
gccaatagtgtgttcagttttccta

SEQ ID NO: 679828 - DNA, 25 bp, Mus musculus
gccaatatcaccacaaagattgcag

SEQ ID NO: 679829 - DNA, 25 bp, Mus musculus
gccaatatcacctcaaagattgcag

SEQ ID NO: 679830 - DNA, 25 bp, Mus musculus
gccaatatggataccgtgggcactt

SEQ ID NO: 679831 - DNA, 25 bp, Mus musculus
gccaatatggattccgtgggcactt

SEQ ID NO: 679832 - DNA, 25 bp, Mus musculus
gccaatcagtatcagatggtgtaaa

SEQ ID NO: 679833 - DNA, 25 bp, Mus musculus
gccaatcagtatgagatggtgtaaa

SEQ ID NO: 679834 - DNA, 25 bp, Mus musculus
gccaatcagtgacttctgagaccct

SEQ ID NO: 679835 - DNA, 25 bp, Mus musculus
gccaatcagtgagttctgagaccct

SEQ ID NO: 679836 - DNA, 25 bp, Mus musculus
gccaatcatcacagaaggttcccca

SEQ ID NO: 679837 - DNA, 25 bp, Mus musculus
gccaatcatcactgaaggttcccca

SEQ ID NO: 679838 - DNA, 25 bp, Mus musculus
gccaatctggagctcaaaggcaggc

SEQ ID NO: 679839 - DNA, 25 bp, Mus musculus
gccaatctggaggtcaaaggcaggc

SEQ ID NO: 679840 - DNA, 25 bp, Mus musculus
gccaatcttgtcatacatcatatga

SEQ ID NO: 679841 - DNA, 25 bp, Mus musculus
gccaatcttgtcttacatcatatga

SEQ ID NO: 679842 - DNA, 25 bp, Mus musculus
gccaatctttcgaaagaaggccaaa

SEQ ID NO: 679843 - DNA, 25 bp, Mus musculus
gccaatctttcgtaagaaggccaaa

SEQ ID NO: 679844 - DNA, 25 bp, Mus musculus
gccaatgaagccaggcatggctcct

SEQ ID NO: 679845 - DNA, 25 bp, Mus musculus
gccaatgaagcctggcatggctcct

SEQ ID NO: 679846 - DNA, 25 bp, Mus musculus
gccaatgaccaaccaattgcctatg

SEQ ID NO: 679847 - DNA, 25 bp, Mus musculus
gccaatgaccaagcaattgcctatg

SEQ ID NO: 679848 - DNA, 25 bp, Mus musculus
gccaatgccaatattgacgttatag

SEQ ID NO: 679849 - DNA, 25 bp, Mus musculus
gccaatgccaattttgacgttatag

SEQ ID NO: 679850 - DNA, 25 bp, Mus musculus
gccaatgccatcataggccactatg

SEQ ID NO: 679851 - DNA, 25 bp, Mus musculus
gccaatgccatcttaggccactatg

SEQ ID NO: 679852 - DNA, 25 bp, Mus musculus
gccaatgcggttatggatgaccaga

SEQ ID NO: 679853 - DNA, 25 bp, Mus musculus
gccaatgcggttttggatgaccaga

SEQ ID NO: 679854 - DNA, 25 bp, Mus musculus
gccaatggaagcacagcgtggccac

SEQ ID NO: 679855 - DNA, 25 bp, Mus musculus
gccaatggaagctcagcgtggccac

SEQ ID NO: 679856 - DNA, 25 bp, Mus musculus
gccaatggaataaggagaaccgatt

SEQ ID NO: 679857 - DNA, 25 bp, Mus musculus
gccaatggaatatggagaaccgatt

SEQ ID NO: 679858 - DNA, 25 bp, Mus musculus
gccaatggatcacctttggctctct

SEQ ID NO: 679859 - DNA, 25 bp, Mus musculus
gccaatggatcagctttggctctct

SEQ ID NO: 679860 - DNA, 25 bp, Mus musculus
gccaattacataactgggatccaga

SEQ ID NO: 679861 - DNA, 25 bp, Mus musculus
gccaattacatatctgggatccaga

SEQ ID NO: 679862 - DNA, 25 bp, Mus musculus
gccaattacttaagccaggtgtatt

SEQ ID NO: 679863 - DNA, 25 bp, Mus musculus
gccaattacttatgccaggtgtatt

SEQ ID NO: 679864 - DNA, 25 bp, Mus musculus
gccaattccattactaatggtggaa

SEQ ID NO: 679865 - DNA, 25 bp, Mus musculus
gccaattccatttctaatggtggaa

SEQ ID NO: 679866 - DNA, 25 bp, Mus musculus
gccaattctgatctgaggcagacag

SEQ ID NO: 679867 - DNA, 25 bp, Mus musculus
gccaattctgatgtgaggcagacag

SEQ ID NO: 679868 - DNA, 25 bp, Mus musculus
gccaattgacaactctgctgtcttc

SEQ ID NO: 679869 - DNA, 25 bp, Mus musculus
gccaattgacaagtctgctgtcttc

SEQ ID NO: 679870 - DNA, 25 bp, Mus musculus
gccaattgattaaaatcgccatgca

SEQ ID NO: 679871 - DNA, 25 bp, Mus musculus
gccaattgattataatcgccatgca

SEQ ID NO: 679872 - DNA, 25 bp, Mus musculus
gccaatttatccctagagatgggta

SEQ ID NO: 679873 - DNA, 25 bp, Mus musculus
gccaatttatccgtagagatgggta

SEQ ID NO: 679874 - DNA, 25 bp, Mus musculus
gccaatttcctaacctggtgccgag

SEQ ID NO: 679875 - DNA, 25 bp, Mus musculus
gccaatttcctatcctggtgccgag

SEQ ID NO: 679876 - DNA, 25 bp, Mus musculus
gccaatttcctgaacgtccaggata

SEQ ID NO: 679877 - DNA, 25 bp, Mus musculus
gccaatttcctgtacgtccaggata

SEQ ID NO: 679878 - DNA, 25 bp, Mus musculus
gccaatttcggtaggccggctacgt

SEQ ID NO: 679879 - DNA, 25 bp, Mus musculus
gccaatttcggttggccggctacgt

SEQ ID NO: 679880 - DNA, 25 bp, Mus musculus
gccaatttctcgactctacgccaag

SEQ ID NO: 679881 - DNA, 25 bp, Mus musculus
gccaatttctcgtctctacgccaag

SEQ ID NO: 679882 - DNA, 25 bp, Mus musculus
gccaatttggctcgcacactgagtg

SEQ ID NO: 679883 - DNA, 25 bp, Mus musculus
gccaatttggctggcacactgagtg

SEQ ID NO: 679884 - DNA, 25 bp, Mus musculus
gccaattttcctcgaattaacatga

SEQ ID NO: 679885 - DNA, 25 bp, Mus musculus
gccaattttcctggaattaacatga

SEQ ID NO: 679886 - DNA, 25 bp, Mus musculus
gccaattttctaaaaagcatgagat

SEQ ID NO: 679887 - DNA, 25 bp, Mus musculus
gccaattttctataaagcatgagat

SEQ ID NO: 679888 - DNA, 25 bp, Mus musculus
gccaattttgaacaacgtctagagg

SEQ ID NO: 679889 - DNA, 25 bp, Mus musculus
gccaattttgaagaacgtctagagg

SEQ ID NO: 679890 - DNA, 25 bp, Mus musculus
gccaattttgctcaagaagatcacc

SEQ ID NO: 679891 - DNA, 25 bp, Mus musculus
gccaattttgctgaagaagatcacc

SEQ ID NO: 679892 - DNA, 25 bp, Mus musculus
gccacaaaaacaccatcttctgatg

SEQ ID NO: 679893 - DNA, 25 bp, Mus musculus
gccacaaaaacagcatcttctgatg

SEQ ID NO: 679894 - DNA, 25 bp, Mus musculus
gccacaaacagtcgcggcgggacca

SEQ ID NO: 679895 - DNA, 25 bp, Mus musculus
gccacaaacagtggcggcgggacca

SEQ ID NO: 679896 - DNA, 25 bp, Mus musculus
gccacaaaccgaatgatcactcaaa

SEQ ID NO: 679897 - DNA, 25 bp, Mus musculus
gccacaaaccgattgatcactcaaa

SEQ ID NO: 679898 - DNA, 25 bp, Mus musculus
gccacaaacggaaatgtcagaggag

SEQ ID NO: 679899 - DNA, 25 bp, Mus musculus
gccacaaacggatatgtcagaggag

SEQ ID NO: 679900 - DNA, 25 bp, Mus musculus
gccacaaagaggagatgacaaagca

SEQ ID NO: 679901 - DNA, 25 bp, Mus musculus
gccacaaagaggtgatgacaaagca

SEQ ID NO: 679902 - DNA, 25 bp, Mus musculus
gccacaaagctactttctgtctaga

SEQ ID NO: 679903 - DNA, 25 bp, Mus musculus
gccacaaagctagtttctgtctaga

SEQ ID NO: 679904 - DNA, 25 bp, Mus musculus
gccacaaagcttcttctcatttaaa

SEQ ID NO: 679905 - DNA, 25 bp, Mus musculus
gccacaaagcttgttctcatttaaa

SEQ ID NO: 679906 - DNA, 25 bp, Mus musculus
gccacaaataacaataacgctgctg

SEQ ID NO: 679907 - DNA, 25 bp, Mus musculus
gccacaaataactataacgctgctg

SEQ ID NO: 679908 - DNA, 25 bp, Mus musculus
gccacaaatacaagctgctgagtgt

SEQ ID NO: 679909 - DNA, 25 bp, Mus musculus
gccacaaatacatgctgctgagtgt

SEQ ID NO: 679910 - DNA, 25 bp, Mus musculus
gccacaacacacataaagaagccag

SEQ ID NO: 679911 - DNA, 25 bp, Mus musculus
gccacaacacacttaaagaagccag

SEQ ID NO: 679912 - DNA, 25 bp, Mus musculus
gccacaacagatctggtgcccatgc

SEQ ID NO: 679913 - DNA, 25 bp, Mus musculus
gccacaacagatgtggtgcccatgc

SEQ ID NO: 679914 - DNA, 25 bp, Mus musculus
gccacaacgaggaggtgctggcacc

SEQ ID NO: 679915 - DNA, 25 bp, Mus musculus
gccacaacgaggtggtgctggcacc

SEQ ID NO: 679916 - DNA, 25 bp, Mus musculus
gccacaactactagggcggctacta

SEQ ID NO: 679917 - DNA, 25 bp, Mus musculus
gccacaactacttgggcggctacta

SEQ ID NO: 679918 - DNA, 25 bp, Mus musculus
gccacaactttaaatccttggaaga

SEQ ID NO: 679919 - DNA, 25 bp, Mus musculus
gccacaactttatatccttggaaga

SEQ ID NO: 679920 - DNA, 25 bp, Mus musculus
gccacaagaaatccgtgcacaagat

SEQ ID NO: 679921 - DNA, 25 bp, Mus musculus
gccacaagaaatgcgtgcacaagat

SEQ ID NO: 679922 - DNA, 25 bp, Mus musculus
gccacaagcaatccaaagagcgcct

SEQ ID NO: 679923 - DNA, 25 bp, Mus musculus
gccacaagcaatgcaaagagcgcct

SEQ ID NO: 679924 - DNA, 25 bp, Mus musculus
gccacaaggactactgggccaagtt

SEQ ID NO: 679925 - DNA, 25 bp, Mus musculus
gccacaaggacttctgggccaagtt

SEQ ID NO: 679926 - DNA, 25 bp, Mus musculus
gccacaagggatcaggctccatata

SEQ ID NO: 679927 - DNA, 25 bp, Mus musculus
gccacaagggatgaggctccatata

SEQ ID NO: 679928 - DNA, 25 bp, Mus musculus
gccacaagtctgcaaggacaaatat

SEQ ID NO: 679929 - DNA, 25 bp, Mus musculus
gccacaagtctggaaggacaaatat

SEQ ID NO: 679930 - DNA, 25 bp, Mus musculus
gccacaatcatgaccctggaagact

SEQ ID NO: 679931 - DNA, 25 bp, Mus musculus
gccacaatcatgtccctggaagact

SEQ ID NO: 679932 - DNA, 25 bp, Mus musculus
gccacaatgaagcactttacaagcc

SEQ ID NO: 679933 - DNA, 25 bp, Mus musculus
gccacaatgaaggactttacaagcc

SEQ ID NO: 679934 - DNA, 25 bp, Mus musculus
gccacaatgagacgtaagactcgcc

SEQ ID NO: 679935 - DNA, 25 bp, Mus musculus
gccacaatgagaggtaagactcgcc

SEQ ID NO: 679936 - DNA, 25 bp, Mus musculus
gccacaatggctcaaaatggagata

SEQ ID NO: 679937 - DNA, 25 bp, Mus musculus
gccacaatggctgaaaatggagata

SEQ ID NO: 679938 - DNA, 25 bp, Mus musculus
gccacaattgttcatgtgaaagaag

SEQ ID NO: 679939 - DNA, 25 bp, Mus musculus
gccacaattgttgatgtgaaagaag

SEQ ID NO: 679940 - DNA, 25 bp, Mus musculus
gccacacaatggaaagacagccgac

SEQ ID NO: 679941 - DNA, 25 bp, Mus musculus
gccacacaatggtaagacagccgac

SEQ ID NO: 679942 - DNA, 25 bp, Mus musculus
gccacacaatgtagcccatccgatg

SEQ ID NO: 679943 - DNA, 25 bp, Mus musculus
gccacacaatgttgcccatccgatg

SEQ ID NO: 679944 - DNA, 25 bp, Mus musculus
gccacacagagaaagtccacactgg

SEQ ID NO: 679945 - DNA, 25 bp, Mus musculus
gccacacagagatagtccacactgg

SEQ ID NO: 679946 - DNA, 25 bp, Mus musculus
gccacacagtgtattctagataacg

SEQ ID NO: 679947 - DNA, 25 bp, Mus musculus
gccacacagtgttttctagataacg

SEQ ID NO: 679948 - DNA, 25 bp, Mus musculus
gccacacatgggatactgtgaagaa

SEQ ID NO: 679949 - DNA, 25 bp, Mus musculus
gccacacatgggttactgtgaagaa

SEQ ID NO: 679950 - DNA, 25 bp, Mus musculus
gccacaccaagacggttggcatcgt

SEQ ID NO: 679951 - DNA, 25 bp, Mus musculus
gccacaccaagagggttggcatcgt

SEQ ID NO: 679952 - DNA, 25 bp, Mus musculus
gccacacccaaaagttattgaacta

SEQ ID NO: 679953 - DNA, 25 bp, Mus musculus
gccacacccaaatgttattgaacta

SEQ ID NO: 679954 - DNA, 25 bp, Mus musculus
gccacacccctaaacggacagaagg

SEQ ID NO: 679955 - DNA, 25 bp, Mus musculus
gccacacccctatacggacagaagg

SEQ ID NO: 679956 - DNA, 25 bp, Mus musculus
gccacaccgagaacccggccgagtt

SEQ ID NO: 679957 - DNA, 25 bp, Mus musculus
gccacaccgagatcccggccgagtt

SEQ ID NO: 679958 - DNA, 25 bp, Mus musculus
gccacacctgccaaattgagttaga

SEQ ID NO: 679959 - DNA, 25 bp, Mus musculus
gccacacctgcctaattgagttaga

SEQ ID NO: 679960 - DNA, 25 bp, Mus musculus
gccacacctgggatttctgactaac

SEQ ID NO: 679961 - DNA, 25 bp, Mus musculus
gccacacctgggttttctgactaac

SEQ ID NO: 679962 - DNA, 25 bp, Mus musculus
gccacacgatgactctgaccgcaga

SEQ ID NO: 679963 - DNA, 25 bp, Mus musculus
gccacacgatgagtctgaccgcaga

SEQ ID NO: 679964 - DNA, 25 bp, Mus musculus
gccacacgctgccagttgctttgga

SEQ ID NO: 679965 - DNA, 25 bp, Mus musculus
gccacacgctgcgagttgctttgga

SEQ ID NO: 679966 - DNA, 25 bp, Mus musculus
gccacacgtgcaattcctgagctga

SEQ ID NO: 679967 - DNA, 25 bp, Mus musculus
gccacacgtgcatttcctgagctga

SEQ ID NO: 679968 - DNA, 25 bp, Mus musculus
gccacacgtggcatactttgtaccc

SEQ ID NO: 679969 - DNA, 25 bp, Mus musculus
gccacacgtggcttactttgtaccc

SEQ ID NO: 679970 - DNA, 25 bp, Mus musculus
gccacactaaagctgctagattata

SEQ ID NO: 679971 - DNA, 25 bp, Mus musculus
gccacactaaaggtgctagattata

SEQ ID NO: 679972 - DNA, 25 bp, Mus musculus
gccacactagacagagcaccggtga

SEQ ID NO: 679973 - DNA, 25 bp, Mus musculus
gccacactagactgagcaccggtga

SEQ ID NO: 679974 - DNA, 25 bp, Mus musculus
gccacactgacccacatcaatgagg

SEQ ID NO: 679975 - DNA, 25 bp, Mus musculus
gccacactgaccgacatcaatgagg

SEQ ID NO: 679976 - DNA, 25 bp, Mus musculus
gccacactggatcaaatccagaccg

SEQ ID NO: 679977 - DNA, 25 bp, Mus musculus
gccacactggatgaaatccagaccg

SEQ ID NO: 679978 - DNA, 25 bp, Mus musculus
gccacagaacatattaaagttaaag

SEQ ID NO: 679979 - DNA, 25 bp, Mus musculus
gccacagaacattttaaagttaaag

SEQ ID NO: 679980 - DNA, 25 bp, Mus musculus
gccacagaatgaagctggtttccat

SEQ ID NO: 679981 - DNA, 25 bp, Mus musculus
gccacagaatgatgctggtttccat

SEQ ID NO: 679982 - DNA, 25 bp, Mus musculus
gccacagacaccagcagaaaacaag

SEQ ID NO: 679983 - DNA, 25 bp, Mus musculus
gccacagacacctgcagaaaacaag

SEQ ID NO: 679984 - DNA, 25 bp, Mus musculus
gccacagacacgaataatatccagg

SEQ ID NO: 679985 - DNA, 25 bp, Mus musculus
gccacagacacgtataatatccagg

SEQ ID NO: 679986 - DNA, 25 bp, Mus musculus
gccacagacagcactttgttggaga

SEQ ID NO: 679987 - DNA, 25 bp, Mus musculus
gccacagacagctctttgttggaga

SEQ ID NO: 679988 - DNA, 25 bp, Mus musculus
gccacagactacatgcagcaggtgt

SEQ ID NO: 679989 - DNA, 25 bp, Mus musculus
gccacagactacttgcagcaggtgt

SEQ ID NO: 679990 - DNA, 25 bp, Mus musculus
gccacagagcttacaaaatgcaagg

SEQ ID NO: 679991 - DNA, 25 bp, Mus musculus
gccacagagctttcaaaatgcaagg

SEQ ID NO: 679992 - DNA, 25 bp, Mus musculus
gccacagagggaaaggtacagtcac

SEQ ID NO: 679993 - DNA, 25 bp, Mus musculus
gccacagagggataggtacagtcac

SEQ ID NO: 679994 - DNA, 25 bp, Mus musculus
gccacagagtctacagccgctgctg

SEQ ID NO: 679995 - DNA, 25 bp, Mus musculus
gccacagagtcttcagccgctgctg

SEQ ID NO: 679996 - DNA, 25 bp, Mus musculus
gccacagcacatcgatttcagaact

SEQ ID NO: 679997 - DNA, 25 bp, Mus musculus
gccacagcacatggatttcagaact

SEQ ID NO: 679998 - DNA, 25 bp, Mus musculus
gccacagcagtgaagttcctacaga

SEQ ID NO: 679999 - DNA, 25 bp, Mus musculus
gccacagcagtgtagttcctacaga

SEQ ID NO: 680000 - DNA, 25 bp, Mus musculus
gccacagccaccatcgtgatcgatg

SEQ ID NO: 680001 - DNA, 25 bp, Mus musculus
gccacagccaccttcgtgatcgatg

SEQ ID NO: 680002 - DNA, 25 bp, Mus musculus
gccacagccagtattgcaggagccc

SEQ ID NO: 680003 - DNA, 25 bp, Mus musculus
gccacagccagttttgcaggagccc

SEQ ID NO: 680004 - DNA, 25 bp, Mus musculus
gccacagcccagagtgtggagagct

SEQ ID NO: 680005 - DNA, 25 bp, Mus musculus
gccacagcccagtgtgtggagagct

SEQ ID NO: 680006 - DNA, 25 bp, Mus musculus
gccacagccttcacattctagatca

SEQ ID NO: 680007 - DNA, 25 bp, Mus musculus
gccacagccttctcattctagatca

SEQ ID NO: 680008 - DNA, 25 bp, Mus musculus
gccacagctaacattgagaactcct

SEQ ID NO: 680009 - DNA, 25 bp, Mus musculus
gccacagctaactttgagaactcct

SEQ ID NO: 680010 - DNA, 25 bp, Mus musculus
gccacagctgctcacagagtccagg

SEQ ID NO: 680011 - DNA, 25 bp, Mus musculus
gccacagctgctgacagagtccagg

SEQ ID NO: 680012 - DNA, 25 bp, Mus musculus
gccacagctggaccggccatttgta

SEQ ID NO: 680013 - DNA, 25 bp, Mus musculus
gccacagctggagcggccatttgta

SEQ ID NO: 680014 - DNA, 25 bp, Mus musculus
gccacagcttccaaaccaaagagga

SEQ ID NO: 680015 - DNA, 25 bp, Mus musculus
gccacagcttcctaaccaaagagga

SEQ ID NO: 680016 - DNA, 25 bp, Mus musculus
gccacagctttacgaaacacctcta

SEQ ID NO: 680017 - DNA, 25 bp, Mus musculus
gccacagctttaggaaacacctcta

SEQ ID NO: 680018 - DNA, 25 bp, Mus musculus
gccacaggaatcagtcgcacagatg

SEQ ID NO: 680019 - DNA, 25 bp, Mus musculus
gccacaggaatctgtcgcacagatg

SEQ ID NO: 680020 - DNA, 25 bp, Mus musculus
gccacaggacatcggcagcagccag

SEQ ID NO: 680021 - DNA, 25 bp, Mus musculus
gccacaggacatgggcagcagccag

SEQ ID NO: 680022 - DNA, 25 bp, Mus musculus
gccacaggattcaaaggagccattc

SEQ ID NO: 680023 - DNA, 25 bp, Mus musculus
gccacaggattctaaggagccattc

SEQ ID NO: 680024 - DNA, 25 bp, Mus musculus
gccacaggcaaactgatggtcatga

SEQ ID NO: 680025 - DNA, 25 bp, Mus musculus
gccacaggcaaagtgatggtcatga

SEQ ID NO: 680026 - DNA, 25 bp, Mus musculus
gccacaggccaaagaccggttatat

SEQ ID NO: 680027 - DNA, 25 bp, Mus musculus
gccacaggccaatgaccggttatat

SEQ ID NO: 680028 - DNA, 25 bp, Mus musculus
gccacaggccagacacaagctgctt

SEQ ID NO: 680029 - DNA, 25 bp, Mus musculus
gccacaggccagtcacaagctgctt

SEQ ID NO: 680030 - DNA, 25 bp, Mus musculus
gccacaggccttattaaatgctacc

SEQ ID NO: 680031 - DNA, 25 bp, Mus musculus
gccacaggcctttttaaatgctacc

SEQ ID NO: 680032 - DNA, 25 bp, Mus musculus
gccacagggagacctccatggtgca

SEQ ID NO: 680033 - DNA, 25 bp, Mus musculus
gccacagggagagctccatggtgca

SEQ ID NO: 680034 - DNA, 25 bp, Mus musculus
gccacagggcttcatgccatatggt

SEQ ID NO: 680035 - DNA, 25 bp, Mus musculus
gccacagggcttgatgccatatggt

SEQ ID NO: 680036 - DNA, 25 bp, Mus musculus
gccacaggtaagcagggcctctctt

SEQ ID NO: 680037 - DNA, 25 bp, Mus musculus
gccacaggtaaggagggcctctctt

SEQ ID NO: 680038 - DNA, 25 bp, Mus musculus
gccacaggtaccaagcttgtcgtta

SEQ ID NO: 680039 - DNA, 25 bp, Mus musculus
gccacaggtacctagcttgtcgtta

SEQ ID NO: 680040 - DNA, 25 bp, Mus musculus
gccacaggtgttccttgcgccactt

SEQ ID NO: 680041 - DNA, 25 bp, Mus musculus
gccacaggtgttgcttgcgccactt

SEQ ID NO: 680042 - DNA, 25 bp, Mus musculus
gccacaggttctccgatcgtgttca

SEQ ID NO: 680043 - DNA, 25 bp, Mus musculus
gccacaggttctgcgatcgtgttca

SEQ ID NO: 680044 - DNA, 25 bp, Mus musculus
gccacagtcaacagggcccgggcag

SEQ ID NO: 680045 - DNA, 25 bp, Mus musculus
gccacagtcaactgggcccgggcag

SEQ ID NO: 680046 - DNA, 25 bp, Mus musculus
gccacagtcagtcggaactacaaga

SEQ ID NO: 680047 - DNA, 25 bp, Mus musculus
gccacagtcagtgggaactacaaga

SEQ ID NO: 680048 - DNA, 25 bp, Mus musculus
gccacagtgccaagccggtagagga

SEQ ID NO: 680049 - DNA, 25 bp, Mus musculus
gccacagtgccatgccggtagagga

SEQ ID NO: 680050 - DNA, 25 bp, Mus musculus
gccacagtgcttcaatctgtatata

SEQ ID NO: 680051 - DNA, 25 bp, Mus musculus
gccacagtgcttgaatctgtatata

SEQ ID NO: 680052 - DNA, 25 bp, Mus musculus
gccacagtggaacagacagtagtgc

SEQ ID NO: 680053 - DNA, 25 bp, Mus musculus
gccacagtggaagagacagtagtgc

SEQ ID NO: 680054 - DNA, 25 bp, Mus musculus
gccacagtgtgaccgctggaaatca

SEQ ID NO: 680055 - DNA, 25 bp, Mus musculus
gccacagtgtgagcgctggaaatca

SEQ ID NO: 680056 - DNA, 25 bp, Mus musculus
gccacagttcatctcctaccaggag

SEQ ID NO: 680057 - DNA, 25 bp, Mus musculus
gccacagttcatgtcctaccaggag

SEQ ID NO: 680058 - DNA, 25 bp, Mus musculus
gccacagttcggagacgagtatgat

SEQ ID NO: 680059 - DNA, 25 bp, Mus musculus
gccacagttcggtgacgagtatgat

SEQ ID NO: 680060 - DNA, 25 bp, Mus musculus
gccacatactggaatccgagtctgg

SEQ ID NO: 680061 - DNA, 25 bp, Mus musculus
gccacatactggtatccgagtctgg

SEQ ID NO: 680062 - DNA, 25 bp, Mus musculus
gccacatcagggacctacagaagga

SEQ ID NO: 680063 - DNA, 25 bp, Mus musculus
gccacatcagggtcctacagaagga

SEQ ID NO: 680064 - DNA, 25 bp, Mus musculus
gccacatccgggacatcacagacag

SEQ ID NO: 680065 - DNA, 25 bp, Mus musculus
gccacatccgggtcatcacagacag

SEQ ID NO: 680066 - DNA, 25 bp, Mus musculus
gccacatcgcgcatcgtggctgaag

SEQ ID NO: 680067 - DNA, 25 bp, Mus musculus
gccacatcgcgcttcgtggctgaag

SEQ ID NO: 680068 - DNA, 25 bp, Mus musculus
gccacatcggctcgaaagatttcac

SEQ ID NO: 680069 - DNA, 25 bp, Mus musculus
gccacatcggctggaaagatttcac

SEQ ID NO: 680070 - DNA, 25 bp, Mus musculus
gccacatctcttagaagttgatgct

SEQ ID NO: 680071 - DNA, 25 bp, Mus musculus
gccacatctctttgaagttgatgct

SEQ ID NO: 680072 - DNA, 25 bp, Mus musculus
gccacatgaggacttgctggtgctc

SEQ ID NO: 680073 - DNA, 25 bp, Mus musculus
gccacatgaggagttgctggtgctc

SEQ ID NO: 680074 - DNA, 25 bp, Mus musculus
gccacatgatcaagctgcacggagc

SEQ ID NO: 680075 - DNA, 25 bp, Mus musculus
gccacatgatcatgctgcacggagc

SEQ ID NO: 680076 - DNA, 25 bp, Mus musculus
gccacatgatctaggcctacagtaa

SEQ ID NO: 680077 - DNA, 25 bp, Mus musculus
gccacatgatcttggcctacagtaa

SEQ ID NO: 680078 - DNA, 25 bp, Mus musculus
gccacatggtatcaggttcctgtcc

SEQ ID NO: 680079 - DNA, 25 bp, Mus musculus
gccacatggtatgaggttcctgtcc

SEQ ID NO: 680080 - DNA, 25 bp, Mus musculus
gccacatggtcaagcaaaagctact

SEQ ID NO: 680081 - DNA, 25 bp, Mus musculus
gccacatggtcatgcaaaagctact

SEQ ID NO: 680082 - DNA, 25 bp, Mus musculus
gccacatgtcatcacttcactgaag

SEQ ID NO: 680083 - DNA, 25 bp, Mus musculus
gccacatgtcatgacttcactgaag

SEQ ID NO: 680084 - DNA, 25 bp, Mus musculus
gccacattggaactatcgacccaaa

SEQ ID NO: 680085 - DNA, 25 bp, Mus musculus
gccacattggaagtatcgacccaaa

SEQ ID NO: 680086 - DNA, 25 bp, Mus musculus
gccacattttccaaggccaaggcga

SEQ ID NO: 680087 - DNA, 25 bp, Mus musculus
gccacattttcctaggccaaggcga

SEQ ID NO: 680088 - DNA, 25 bp, Mus musculus
gccaccaaaggaaagcatctgcatt

SEQ ID NO: 680089 - DNA, 25 bp, Mus musculus
gccaccaaaggatagcatctgcatt

SEQ ID NO: 680090 - DNA, 25 bp, Mus musculus
gccaccaacagacgacgagatctat

SEQ ID NO: 680091 - DNA, 25 bp, Mus musculus
gccaccaacagaggacgagatctat

SEQ ID NO: 680092 - DNA, 25 bp, Mus musculus
gccaccaagaggaccatggtgttta

SEQ ID NO: 680093 - DNA, 25 bp, Mus musculus
gccaccaagaggtccatggtgttta

SEQ ID NO: 680094 - DNA, 25 bp, Mus musculus
gccaccaaggacagaagatctgtac

SEQ ID NO: 680095 - DNA, 25 bp, Mus musculus
gccaccaaggactgaagatctgtac

SEQ ID NO: 680096 - DNA, 25 bp, Mus musculus
gccaccaaggatcggcaagctttag

SEQ ID NO: 680097 - DNA, 25 bp, Mus musculus
gccaccaaggatgggcaagctttag

SEQ ID NO: 680098 - DNA, 25 bp, Mus musculus
gccaccaatggcctgatgtacatgt

SEQ ID NO: 680099 - DNA, 25 bp, Mus musculus
gccaccaatggcgtgatgtacatgt

SEQ ID NO: 680100 - DNA, 25 bp, Mus musculus
gccaccaatgtcctgggcagcatta

SEQ ID NO: 680101 - DNA, 25 bp, Mus musculus
gccaccaatgtcgtgggcagcatta

SEQ ID NO: 680102 - DNA, 25 bp, Mus musculus
gccaccacaatgcagagtgtccttg

SEQ ID NO: 680103 - DNA, 25 bp, Mus musculus
gccaccacaatggagagtgtccttg

SEQ ID NO: 680104 - DNA, 25 bp, Mus musculus
gccaccacagccctaggatcataga

SEQ ID NO: 680105 - DNA, 25 bp, Mus musculus
gccaccacagccgtaggatcataga

SEQ ID NO: 680106 - DNA, 25 bp, Mus musculus
gccaccaccaccagtcatgggaatg

SEQ ID NO: 680107 - DNA, 25 bp, Mus musculus
gccaccaccacctgtcatgggaatg

SEQ ID NO: 680108 - DNA, 25 bp, Mus musculus
gccaccacccatagcggaggagatt

SEQ ID NO: 680109 - DNA, 25 bp, Mus musculus
gccaccacccattgcggaggagatt

SEQ ID NO: 680110 - DNA, 25 bp, Mus musculus
gccaccagcaaccttaagaaattag

SEQ ID NO: 680111 - DNA, 25 bp, Mus musculus
gccaccagcaacgttaagaaattag

SEQ ID NO: 680112 - DNA, 25 bp, Mus musculus
gccaccagccgaatcatcaaataca

SEQ ID NO: 680113 - DNA, 25 bp, Mus musculus
gccaccagccgattcatcaaataca

SEQ ID NO: 680114 - DNA, 25 bp, Mus musculus
gccaccaggagtacctgaagatgct

SEQ ID NO: 680115 - DNA, 25 bp, Mus musculus
gccaccaggagttcctgaagatgct

SEQ ID NO: 680116 - DNA, 25 bp, Mus musculus
gccaccaggctcagagctggctctg

SEQ ID NO: 680117 - DNA, 25 bp, Mus musculus
gccaccaggctctgagctggctctg

SEQ ID NO: 680118 - DNA, 25 bp, Mus musculus
gccaccagtgagagagactttgtgg

SEQ ID NO: 680119 - DNA, 25 bp, Mus musculus
gccaccagtgagtgagactttgtgg

SEQ ID NO: 680120 - DNA, 25 bp, Mus musculus
gccaccagtgccctgacagaggaag

SEQ ID NO: 680121 - DNA, 25 bp, Mus musculus
gccaccagtgccgtgacagaggaag

SEQ ID NO: 680122 - DNA, 25 bp, Mus musculus
gccaccagtgcgctagatgcagaat

SEQ ID NO: 680123 - DNA, 25 bp, Mus musculus
gccaccagtgcggtagatgcagaat

SEQ ID NO: 680124 - DNA, 25 bp, Mus musculus
gccaccatatacagactatgtgtct

SEQ ID NO: 680125 - DNA, 25 bp, Mus musculus
gccaccatatactgactatgtgtct

SEQ ID NO: 680126 - DNA, 25 bp, Mus musculus
gccaccatcgtgatcgatgacaaaa

SEQ ID NO: 680127 - DNA, 25 bp, Mus musculus
gccaccatcgtgttcgatgacaaaa

SEQ ID NO: 680128 - DNA, 25 bp, Mus musculus
gccaccatgtttcaggcacgcctga

SEQ ID NO: 680129 - DNA, 25 bp, Mus musculus
gccaccatgtttgaggcacgcctga

SEQ ID NO: 680130 - DNA, 25 bp, Mus musculus
gccaccattgtaaacatgaagcctg

SEQ ID NO: 680131 - DNA, 25 bp, Mus musculus
gccaccattgtatacatgaagcctg

SEQ ID NO: 680132 - DNA, 25 bp, Mus musculus
gccacccagcaaattcattctacta

SEQ ID NO: 680133 - DNA, 25 bp, Mus musculus
gccacccagcaatttcattctacta

SEQ ID NO: 680134 - DNA, 25 bp, Mus musculus
gccacccagtttcccgatggtgtgg

SEQ ID NO: 680135 - DNA, 25 bp, Mus musculus
gccacccagtttgccgatggtgtgg

SEQ ID NO: 680136 - DNA, 25 bp, Mus musculus
gccacccataagaccaagtccatgt

SEQ ID NO: 680137 - DNA, 25 bp, Mus musculus
gccacccataagtccaagtccatgt

SEQ ID NO: 680138 - DNA, 25 bp, Mus musculus
gccacccgtgccagatagactatga

SEQ ID NO: 680139 - DNA, 25 bp, Mus musculus
gccacccgtgcctgatagactatga

SEQ ID NO: 680140 - DNA, 25 bp, Mus musculus
gccaccctgggtacctgtagccaag

SEQ ID NO: 680141 - DNA, 25 bp, Mus musculus
gccaccctgggttcctgtagccaag

SEQ ID NO: 680142 - DNA, 25 bp, Mus musculus
gccaccgaagcacagtgaggatctc

SEQ ID NO: 680143 - DNA, 25 bp, Mus musculus
gccaccgaagcagagtgaggatctc

SEQ ID NO: 680144 - DNA, 25 bp, Mus musculus
gccaccgactgcctctttagctttt

SEQ ID NO: 680145 - DNA, 25 bp, Mus musculus
gccaccgactgcgtctttagctttt

SEQ ID NO: 680146 - DNA, 25 bp, Mus musculus
gccaccggcgccagcatcgtgggaa

SEQ ID NO: 680147 - DNA, 25 bp, Mus musculus
gccaccggcgcctgcatcgtgggaa

SEQ ID NO: 680148 - DNA, 25 bp, Mus musculus
gccaccgggtcaacaatgaaataaa

SEQ ID NO: 680149 - DNA, 25 bp, Mus musculus
gccaccgggtcatcaatgaaataaa

SEQ ID NO: 680150 - DNA, 25 bp, Mus musculus
gccaccgtgggccttaattgccata

SEQ ID NO: 680151 - DNA, 25 bp, Mus musculus
gccaccgtgggcgttaattgccata

SEQ ID NO: 680152 - DNA, 25 bp, Mus musculus
gccacctaccataactgatgtaaaa

SEQ ID NO: 680153 - DNA, 25 bp, Mus musculus
gccacctaccattactgatgtaaaa

SEQ ID NO: 680154 - DNA, 25 bp, Mus musculus
gccacctacgccatagctactgagg

SEQ ID NO: 680155 - DNA, 25 bp, Mus musculus
gccacctacgccttagctactgagg

SEQ ID NO: 680156 - DNA, 25 bp, Mus musculus
gccacctatgaacaggctctgacag

SEQ ID NO: 680157 - DNA, 25 bp, Mus musculus
gccacctatgaagaggctctgacag

SEQ ID NO: 680158 - DNA, 25 bp, Mus musculus
gccacctatgtcagggcgggccttc

SEQ ID NO: 680159 - DNA, 25 bp, Mus musculus
gccacctatgtctgggcgggccttc

SEQ ID NO: 680160 - DNA, 25 bp, Mus musculus
gccacctattttctcggcaggctct

SEQ ID NO: 680161 - DNA, 25 bp, Mus musculus
gccacctattttgtcggcaggctct

SEQ ID NO: 680162 - DNA, 25 bp, Mus musculus
gccacctccgccagggaggctttga

SEQ ID NO: 680163 - DNA, 25 bp, Mus musculus
gccacctccgcctgggaggctttga

SEQ ID NO: 680164 - DNA, 25 bp, Mus musculus
gccacctgagcaagtccaggactct

SEQ ID NO: 680165 - DNA, 25 bp, Mus musculus
gccacctgagcatgtccaggactct

SEQ ID NO: 680166 - DNA, 25 bp, Mus musculus
gccacctgcagcatgcggtctctgt

SEQ ID NO: 680167 - DNA, 25 bp, Mus musculus
gccacctgcagcttgcggtctctgt

SEQ ID NO: 680168 - DNA, 25 bp, Mus musculus
gccacctgctggactatatcaatga

SEQ ID NO: 680169 - DNA, 25 bp, Mus musculus
gccacctgctggtctatatcaatga

SEQ ID NO: 680170 - DNA, 25 bp, Mus musculus
gccacctggcatcgagtactcctat

SEQ ID NO: 680171 - DNA, 25 bp, Mus musculus
gccacctggcatggagtactcctat

SEQ ID NO: 680172 - DNA, 25 bp, Mus musculus
gccacctggccgcagggaagctcaa

SEQ ID NO: 680173 - DNA, 25 bp, Mus musculus
gccacctggccggagggaagctcaa

SEQ ID NO: 680174 - DNA, 25 bp, Mus musculus
gccacctggtggagttggtcccaag

SEQ ID NO: 680175 - DNA, 25 bp, Mus musculus
gccacctggtggtgttggtcccaag

SEQ ID NO: 680176 - DNA, 25 bp, Mus musculus
gccacctttgacaaacacggagagc

SEQ ID NO: 680177 - DNA, 25 bp, Mus musculus
gccacctttgactaacacggagagc

SEQ ID NO: 680178 - DNA, 25 bp, Mus musculus
gccacctttggtatttgcagcttac

SEQ ID NO: 680179 - DNA, 25 bp, Mus musculus
gccacctttggtttttgcagcttac

SEQ ID NO: 680180 - DNA, 25 bp, Mus musculus
gccacgaaagtcatctctgccaaga

SEQ ID NO: 680181 - DNA, 25 bp, Mus musculus
gccacgaaagtcttctctgccaaga

SEQ ID NO: 680182 - DNA, 25 bp, Mus musculus
gccacgaacagtatgacggcagtga

SEQ ID NO: 680183 - DNA, 25 bp, Mus musculus
gccacgaacagtttgacggcagtga

SEQ ID NO: 680184 - DNA, 25 bp, Mus musculus
gccacgaactgcagctgtgctctgc

SEQ ID NO: 680185 - DNA, 25 bp, Mus musculus
gccacgaactgctgctgtgctctgc

SEQ ID NO: 680186 - DNA, 25 bp, Mus musculus
gccacgacggcgattgctcgggttc

SEQ ID NO: 680187 - DNA, 25 bp, Mus musculus
gccacgacggcgtttgctcgggttc

SEQ ID NO: 680188 - DNA, 25 bp, Mus musculus
gccacgagggacacccagattacag

SEQ ID NO: 680189 - DNA, 25 bp, Mus musculus
gccacgagggactcccagattacag

SEQ ID NO: 680190 - DNA, 25 bp, Mus musculus
gccacgatccaccatatttctaact

SEQ ID NO: 680191 - DNA, 25 bp, Mus musculus
gccacgatccacgatatttctaact

SEQ ID NO: 680192 - DNA, 25 bp, Mus musculus
gccacgatcggcactttccagtttg

SEQ ID NO: 680193 - DNA, 25 bp, Mus musculus
gccacgatcggctctttccagtttg

SEQ ID NO: 680194 - DNA, 25 bp, Mus musculus
gccacgatgcagaaggctcccagag

SEQ ID NO: 680195 - DNA, 25 bp, Mus musculus
gccacgatgcagtaggctcccagag

SEQ ID NO: 680196 - DNA, 25 bp, Mus musculus
gccacgatgtggaagcctactgcct

SEQ ID NO: 680197 - DNA, 25 bp, Mus musculus
gccacgatgtggtagcctactgcct

SEQ ID NO: 680198 - DNA, 25 bp, Mus musculus
gccacgcaactaagacctgtcagag

SEQ ID NO: 680199 - DNA, 25 bp, Mus musculus
gccacgcaactatgacctgtcagag

SEQ ID NO: 680200 - DNA, 25 bp, Mus musculus
gccacgctgatgagaaacctgcaga

SEQ ID NO: 680201 - DNA, 25 bp, Mus musculus
gccacgctgatgtgaaacctgcaga

SEQ ID NO: 680202 - DNA, 25 bp, Mus musculus
gccacggaacatcctttactattga

SEQ ID NO: 680203 - DNA, 25 bp, Mus musculus
gccacggaacatgctttactattga

SEQ ID NO: 680204 - DNA, 25 bp, Mus musculus
gccacggagaaaccacctgaagaca

SEQ ID NO: 680205 - DNA, 25 bp, Mus musculus
gccacggagaaagcacctgaagaca

SEQ ID NO: 680206 - DNA, 25 bp, Mus musculus
gccacggagtcgcttgcaaagttca

SEQ ID NO: 680207 - DNA, 25 bp, Mus musculus
gccacggagtcggttgcaaagttca

SEQ ID NO: 680208 - DNA, 25 bp, Mus musculus
gccacggcacaaaggcctgctcggt

SEQ ID NO: 680209 - DNA, 25 bp, Mus musculus
gccacggcacaatggcctgctcggt

SEQ ID NO: 680210 - DNA, 25 bp, Mus musculus
gccacggcgcctcgaatggacttgt

SEQ ID NO: 680211 - DNA, 25 bp, Mus musculus
gccacggcgcctggaatggacttgt

SEQ ID NO: 680212 - DNA, 25 bp, Mus musculus
gccacgggaacacgaggaattacag

SEQ ID NO: 680213 - DNA, 25 bp, Mus musculus
gccacgggaacaggaggaattacag

SEQ ID NO: 680214 - DNA, 25 bp, Mus musculus
gccacgggaaccctatcagacagtg

SEQ ID NO: 680215 - DNA, 25 bp, Mus musculus
gccacgggaaccgtatcagacagtg

SEQ ID NO: 680216 - DNA, 25 bp, Mus musculus
gccacgggtaccatggtgagcacag

SEQ ID NO: 680217 - DNA, 25 bp, Mus musculus
gccacgggtaccttggtgagcacag

SEQ ID NO: 680218 - DNA, 25 bp, Mus musculus
gccacggtcagaacctggcacagtc

SEQ ID NO: 680219 - DNA, 25 bp, Mus musculus
gccacggtcagatcctggcacagtc

SEQ ID NO: 680220 - DNA, 25 bp, Mus musculus
gccacggtcgcgctgctgagtttca

SEQ ID NO: 680221 - DNA, 25 bp, Mus musculus
gccacggtcgcggtgctgagtttca

SEQ ID NO: 680222 - DNA, 25 bp, Mus musculus
gccacggtgaaccagatggacatgt

SEQ ID NO: 680223 - DNA, 25 bp, Mus musculus
gccacggtgaacgagatggacatgt

SEQ ID NO: 680224 - DNA, 25 bp, Mus musculus
gccacggtgtgtacgccgagcgcta

SEQ ID NO: 680225 - DNA, 25 bp, Mus musculus
gccacggtgtgttcgccgagcgcta

SEQ ID NO: 680226 - DNA, 25 bp, Mus musculus
gccacgtactatcgtgctttcatta

SEQ ID NO: 680227 - DNA, 25 bp, Mus musculus
gccacgtactatggtgctttcatta

SEQ ID NO: 680228 - DNA, 25 bp, Mus musculus
gccacgtactcgcagtgtacagctc

SEQ ID NO: 680229 - DNA, 25 bp, Mus musculus
gccacgtactcggagtgtacagctc

SEQ ID NO: 680230 - DNA, 25 bp, Mus musculus
gccacgtgacttatgtgaccctcaa

SEQ ID NO: 680231 - DNA, 25 bp, Mus musculus
gccacgtgacttttgtgaccctcaa

SEQ ID NO: 680232 - DNA, 25 bp, Mus musculus
gccacgtgccttagggttgtctaac

SEQ ID NO: 680233 - DNA, 25 bp, Mus musculus
gccacgtgcctttgggttgtctaac

SEQ ID NO: 680234 - DNA, 25 bp, Mus musculus
gccacgtggatgcacaagtctcagc

SEQ ID NO: 680235 - DNA, 25 bp, Mus musculus
gccacgtggatggacaagtctcagc

SEQ ID NO: 680236 - DNA, 25 bp, Mus musculus
gccacgtggattatgatgactttgt

SEQ ID NO: 680237 - DNA, 25 bp, Mus musculus
gccacgtggattttgatgactttgt

SEQ ID NO: 680238 - DNA, 25 bp, Mus musculus
gccacgtggtgactaaggattatcc

SEQ ID NO: 680239 - DNA, 25 bp, Mus musculus
gccacgtggtgagtaaggattatcc

SEQ ID NO: 680240 - DNA, 25 bp, Mus musculus
gccacgttcagaaagcttgaaggat

SEQ ID NO: 680241 - DNA, 25 bp, Mus musculus
gccacgttcagatagcttgaaggat

SEQ ID NO: 680242 - DNA, 25 bp, Mus musculus
gccacgttcaggaaactacaaaagg

SEQ ID NO: 680243 - DNA, 25 bp, Mus musculus
gccacgttcaggtaactacaaaagg

SEQ ID NO: 680244 - DNA, 25 bp, Mus musculus
gccacgttggcacaactggatgtta

SEQ ID NO: 680245 - DNA, 25 bp, Mus musculus
gccacgttggcagaactggatgtta

SEQ ID NO: 680246 - DNA, 25 bp, Mus musculus
gccactaaacctcggccggctgtct

SEQ ID NO: 680247 - DNA, 25 bp, Mus musculus
gccactaaacctgggccggctgtct

SEQ ID NO: 680248 - DNA, 25 bp, Mus musculus
gccactaaagcacttacagagatga

SEQ ID NO: 680249 - DNA, 25 bp, Mus musculus
gccactaaagcagttacagagatga

SEQ ID NO: 680250 - DNA, 25 bp, Mus musculus
gccactaagaaacctctcaagaaag

SEQ ID NO: 680251 - DNA, 25 bp, Mus musculus
gccactaagaaagctctcaagaaag

SEQ ID NO: 680252 - DNA, 25 bp, Mus musculus
gccactaataacagggaccctcaag

SEQ ID NO: 680253 - DNA, 25 bp, Mus musculus
gccactaataactgggaccctcaag

SEQ ID NO: 680254 - DNA, 25 bp, Mus musculus
gccactacatttaatccagatcaga

SEQ ID NO: 680255 - DNA, 25 bp, Mus musculus
gccactacattttatccagatcaga

SEQ ID NO: 680256 - DNA, 25 bp, Mus musculus
gccactacttgaactatcaggacag

SEQ ID NO: 680257 - DNA, 25 bp, Mus musculus
gccactacttgatctatcaggacag

SEQ ID NO: 680258 - DNA, 25 bp, Mus musculus
gccactagaagaaaattgttggtag

SEQ ID NO: 680259 - DNA, 25 bp, Mus musculus
gccactagaagataattgttggtag

SEQ ID NO: 680260 - DNA, 25 bp, Mus musculus
gccactagtattcgcattgaggaag

SEQ ID NO: 680261 - DNA, 25 bp, Mus musculus
gccactagtattggcattgaggaag

SEQ ID NO: 680262 - DNA, 25 bp, Mus musculus
gccactatgaccagcttgatgccaa

SEQ ID NO: 680263 - DNA, 25 bp, Mus musculus
gccactatgacctgcttgatgccaa

SEQ ID NO: 680264 - DNA, 25 bp, Mus musculus
gccactatgcctatcatgaagagat

SEQ ID NO: 680265 - DNA, 25 bp, Mus musculus
gccactatgcctttcatgaagagat

SEQ ID NO: 680266 - DNA, 25 bp, Mus musculus
gccactcagaatctccattttagat

SEQ ID NO: 680267 - DNA, 25 bp, Mus musculus
gccactcagaatgtccattttagat

SEQ ID NO: 680268 - DNA, 25 bp, Mus musculus
gccactcagcacagggccgctggga

SEQ ID NO: 680269 - DNA, 25 bp, Mus musculus
gccactcagcactgggccgctggga

SEQ ID NO: 680270 - DNA, 25 bp, Mus musculus
gccactcctcctatgtgattctgga

SEQ ID NO: 680271 - DNA, 25 bp, Mus musculus
gccactcctcctttgtgattctgga

SEQ ID NO: 680272 - DNA, 25 bp, Mus musculus
gccactcctgctaatcttggatgat

SEQ ID NO: 680273 - DNA, 25 bp, Mus musculus
gccactcctgcttatcttggatgat

SEQ ID NO: 680274 - DNA, 25 bp, Mus musculus
gccactcgataactatgcctgtcat

SEQ ID NO: 680275 - DNA, 25 bp, Mus musculus
gccactcgataagtatgcctgtcat

SEQ ID NO: 680276 - DNA, 25 bp, Mus musculus
gccactcgatatcaacccgtggctg

SEQ ID NO: 680277 - DNA, 25 bp, Mus musculus
gccactcgatatgaacccgtggctg

SEQ ID NO: 680278 - DNA, 25 bp, Mus musculus
gccactcggcagaagatgcgcgagt

SEQ ID NO: 680279 - DNA, 25 bp, Mus musculus
gccactcggcagtagatgcgcgagt

SEQ ID NO: 680280 - DNA, 25 bp, Mus musculus
gccactctagtgaataatctcaatg

SEQ ID NO: 680281 - DNA, 25 bp, Mus musculus
gccactctagtgtataatctcaatg

SEQ ID NO: 680282 - DNA, 25 bp, Mus musculus
gccactctgaacacagacctttgta

SEQ ID NO: 680283 - DNA, 25 bp, Mus musculus
gccactctgaactcagacctttgta

SEQ ID NO: 680284 - DNA, 25 bp, Mus musculus
gccactctggatcggcagctccgag

SEQ ID NO: 680285 - DNA, 25 bp, Mus musculus
gccactctggatgggcagctccgag

SEQ ID NO: 680286 - DNA, 25 bp, Mus musculus
gccactctgtggacaagaaaacaag

SEQ ID NO: 680287 - DNA, 25 bp, Mus musculus
gccactctgtggtcaagaaaacaag

SEQ ID NO: 680288 - DNA, 25 bp, Mus musculus
gccactctttgcagcttgagacgga

SEQ ID NO: 680289 - DNA, 25 bp, Mus musculus
gccactctttgctgcttgagacgga

SEQ ID NO: 680290 - DNA, 25 bp, Mus musculus
gccactgagattactgctaagtgat

SEQ ID NO: 680291 - DNA, 25 bp, Mus musculus
gccactgagatttctgctaagtgat

SEQ ID NO: 680292 - DNA, 25 bp, Mus musculus
gccactgcagaactgtgatgactaa

SEQ ID NO: 680293 - DNA, 25 bp, Mus musculus
gccactgcagaagtgtgatgactaa

SEQ ID NO: 680294 - DNA, 25 bp, Mus musculus
gccactgccaagagagcgacaggag

SEQ ID NO: 680295 - DNA, 25 bp, Mus musculus
gccactgccaagtgagcgacaggag

SEQ ID NO: 680296 - DNA, 25 bp, Mus musculus
gccactgctcagatctgctgcagaa

SEQ ID NO: 680297 - DNA, 25 bp, Mus musculus
gccactgctcagttctgctgcagaa

SEQ ID NO: 680298 - DNA, 25 bp, Mus musculus
gccactgctgcacctagacctgaag

SEQ ID NO: 680299 - DNA, 25 bp, Mus musculus
gccactgctgcagctagacctgaag

SEQ ID NO: 680300 - DNA, 25 bp, Mus musculus
gccactggacgaagggactcagaga

SEQ ID NO: 680301 - DNA, 25 bp, Mus musculus
gccactggacgatgggactcagaga

SEQ ID NO: 680302 - DNA, 25 bp, Mus musculus
gccactggagcaccggatagatatc

SEQ ID NO: 680303 - DNA, 25 bp, Mus musculus
gccactggagcagcggatagatatc

SEQ ID NO: 680304 - DNA, 25 bp, Mus musculus
gccactggcgagacatgcacttcca

SEQ ID NO: 680305 - DNA, 25 bp, Mus musculus
gccactggcgagtcatgcacttcca

SEQ ID NO: 680306 - DNA, 25 bp, Mus musculus
gccactgtactgcagccattctaat

SEQ ID NO: 680307 - DNA, 25 bp, Mus musculus
gccactgtactggagccattctaat

SEQ ID NO: 680308 - DNA, 25 bp, Mus musculus
gccactgtagatattgttcagaaaa

SEQ ID NO: 680309 - DNA, 25 bp, Mus musculus
gccactgtagattttgttcagaaaa

SEQ ID NO: 680310 - DNA, 25 bp, Mus musculus
gccactgtccccatgtttccaaagg

SEQ ID NO: 680311 - DNA, 25 bp, Mus musculus
gccactgtccccttgtttccaaagg

SEQ ID NO: 680312 - DNA, 25 bp, Mus musculus
gccactgtcctacaagacgttctta

SEQ ID NO: 680313 - DNA, 25 bp, Mus musculus
gccactgtcctagaagacgttctta

SEQ ID NO: 680314 - DNA, 25 bp, Mus musculus
gccactgtcctgcttccagaggcag

SEQ ID NO: 680315 - DNA, 25 bp, Mus musculus
gccactgtcctggttccagaggcag

SEQ ID NO: 680316 - DNA, 25 bp, Mus musculus
gccactgtgacacggttgagccctg

SEQ ID NO: 680317 - DNA, 25 bp, Mus musculus
gccactgtgacagggttgagccctg

SEQ ID NO: 680318 - DNA, 25 bp, Mus musculus
gccactgtgagaaccgcatgcgcta

SEQ ID NO: 680319 - DNA, 25 bp, Mus musculus
gccactgtgagatccgcatgcgcta

SEQ ID NO: 680320 - DNA, 25 bp, Mus musculus
gccactgtgcccatagagcatgctg

SEQ ID NO: 680321 - DNA, 25 bp, Mus musculus
gccactgtgcccttagagcatgctg

SEQ ID NO: 680322 - DNA, 25 bp, Mus musculus
gccactgtggaaaccatcatgagag

SEQ ID NO: 680323 - DNA, 25 bp, Mus musculus
gccactgtggaatccatcatgagag

SEQ ID NO: 680324 - DNA, 25 bp, Mus musculus
gccactgtgtcaacgatgagcggac

SEQ ID NO: 680325 - DNA, 25 bp, Mus musculus
gccactgtgtcatcgatgagcggac

SEQ ID NO: 680326 - DNA, 25 bp, Mus musculus
gccacttaagcgcagatttcctgag

SEQ ID NO: 680327 - DNA, 25 bp, Mus musculus
gccacttaagcggagatttcctgag

SEQ ID NO: 680328 - DNA, 25 bp, Mus musculus
gccacttagaatcttgatacctgaa

SEQ ID NO: 680329 - DNA, 25 bp, Mus musculus
gccacttagaatgttgatacctgaa

SEQ ID NO: 680330 - DNA, 25 bp, Mus musculus
gccacttccagaaacggccattcag

SEQ ID NO: 680331 - DNA, 25 bp, Mus musculus
gccacttccagatacggccattcag

SEQ ID NO: 680332 - DNA, 25 bp, Mus musculus
gccacttctacaacagggctcaagg

SEQ ID NO: 680333 - DNA, 25 bp, Mus musculus
gccacttctacatcagggctcaagg

SEQ ID NO: 680334 - DNA, 25 bp, Mus musculus
gccacttctcgtaaacggaaagaag

SEQ ID NO: 680335 - DNA, 25 bp, Mus musculus
gccacttctcgttaacggaaagaag

SEQ ID NO: 680336 - DNA, 25 bp, Mus musculus
gccacttgaattcgtcttgccagca

SEQ ID NO: 680337 - DNA, 25 bp, Mus musculus
gccacttgaattggtcttgccagca

SEQ ID NO: 680338 - DNA, 25 bp, Mus musculus
gccacttgatacaggtgtccttcac

SEQ ID NO: 680339 - DNA, 25 bp, Mus musculus
gccacttgatactggtgtccttcac

SEQ ID NO: 680340 - DNA, 25 bp, Mus musculus
gccacttgcaaaactctggaagaga

SEQ ID NO: 680341 - DNA, 25 bp, Mus musculus
gccacttgcaaatctctggaagaga

SEQ ID NO: 680342 - DNA, 25 bp, Mus musculus
gccacttggctcagggtagccaatg

SEQ ID NO: 680343 - DNA, 25 bp, Mus musculus
gccacttggctctgggtagccaatg

SEQ ID NO: 680344 - DNA, 25 bp, Mus musculus
gccacttggtgtcgtccctggatga

SEQ ID NO: 680345 - DNA, 25 bp, Mus musculus
gccacttggtgtggtccctggatga

SEQ ID NO: 680346 - DNA, 25 bp, Mus musculus
gccactttcagaagaggacctagca

SEQ ID NO: 680347 - DNA, 25 bp, Mus musculus
gccactttcagatgaggacctagca

SEQ ID NO: 680348 - DNA, 25 bp, Mus musculus
gccactttgaggacattttgtcaga

SEQ ID NO: 680349 - DNA, 25 bp, Mus musculus
gccactttgaggtcattttgtcaga

SEQ ID NO: 680350 - DNA, 25 bp, Mus musculus
gccactttgccaacgccatggacaa

SEQ ID NO: 680351 - DNA, 25 bp, Mus musculus
gccactttgccatcgccatggacaa

SEQ ID NO: 680352 - DNA, 25 bp, Mus musculus
gccactttgtgcagaagccccagag

SEQ ID NO: 680353 - DNA, 25 bp, Mus musculus
gccactttgtgctgaagccccagag

SEQ ID NO: 680354 - DNA, 25 bp, Mus musculus
gccacttttgctagagagcaaggct

SEQ ID NO: 680355 - DNA, 25 bp, Mus musculus
gccacttttgcttgagagcaaggct

SEQ ID NO: 680356 - DNA, 25 bp, Mus musculus
gccacttttgtgaagtggtccccac

SEQ ID NO: 680357 - DNA, 25 bp, Mus musculus
gccacttttgtgtagtggtccccac

SEQ ID NO: 680358 - DNA, 25 bp, Mus musculus
gccagaaaacatactcttggactgc

SEQ ID NO: 680359 - DNA, 25 bp, Mus musculus
gccagaaaacattctcttggactgc

SEQ ID NO: 680360 - DNA, 25 bp, Mus musculus
gccagaaaaccgaatatcataaact

SEQ ID NO: 680361 - DNA, 25 bp, Mus musculus
gccagaaaaccgtatatcataaact

SEQ ID NO: 680362 - DNA, 25 bp, Mus musculus
gccagaaacgtgatggtaacagaaa

SEQ ID NO: 680363 - DNA, 25 bp, Mus musculus
gccagaaacgtgttggtaacagaaa

SEQ ID NO: 680364 - DNA, 25 bp, Mus musculus
gccagaaactttccctcagctgggc

SEQ ID NO: 680365 - DNA, 25 bp, Mus musculus
gccagaaactttgcctcagctgggc

SEQ ID NO: 680366 - DNA, 25 bp, Mus musculus
gccagaaagcagatgagtacctgcg

SEQ ID NO: 680367 - DNA, 25 bp, Mus musculus
gccagaaagcagttgagtacctgcg

SEQ ID NO: 680368 - DNA, 25 bp, Mus musculus
gccagaaataccagtcggacaacgt

SEQ ID NO: 680369 - DNA, 25 bp, Mus musculus
gccagaaatacctgtcggacaacgt

SEQ ID NO: 680370 - DNA, 25 bp, Mus musculus
gccagaaatactagctgaattgact

SEQ ID NO: 680371 - DNA, 25 bp, Mus musculus
gccagaaatacttgctgaattgact

SEQ ID NO: 680372 - DNA, 25 bp, Mus musculus
gccagaacaagaactacaattgtgg

SEQ ID NO: 680373 - DNA, 25 bp, Mus musculus
gccagaacaagatctacaattgtgg

SEQ ID NO: 680374 - DNA, 25 bp, Mus musculus
gccagaacaatccatcttgactcgg

SEQ ID NO: 680375 - DNA, 25 bp, Mus musculus
gccagaacaatcgatcttgactcgg

SEQ ID NO: 680376 - DNA, 25 bp, Mus musculus
gccagaacactgctagtaagccagc

SEQ ID NO: 680377 - DNA, 25 bp, Mus musculus
gccagaacactggtagtaagccagc

SEQ ID NO: 680378 - DNA, 25 bp, Mus musculus
gccagaacatccataagtctctaca

SEQ ID NO: 680379 - DNA, 25 bp, Mus musculus
gccagaacatccttaagtctctaca

SEQ ID NO: 680380 - DNA, 25 bp, Mus musculus
gccagaacccttaaggaggaggcag

SEQ ID NO: 680381 - DNA, 25 bp, Mus musculus
gccagaaccctttaggaggaggcag

SEQ ID NO: 680382 - DNA, 25 bp, Mus musculus
gccagaaccttcaatggctccattg

SEQ ID NO: 680383 - DNA, 25 bp, Mus musculus
gccagaaccttctatggctccattg

SEQ ID NO: 680384 - DNA, 25 bp, Mus musculus
gccagaacggctagtgtaactgcaa

SEQ ID NO: 680385 - DNA, 25 bp, Mus musculus
gccagaacggcttgtgtaactgcaa

SEQ ID NO: 680386 - DNA, 25 bp, Mus musculus
gccagaactctgctaatgaagtgga

SEQ ID NO: 680387 - DNA, 25 bp, Mus musculus
gccagaactctggtaatgaagtgga

SEQ ID NO: 680388 - DNA, 25 bp, Mus musculus
gccagaagcagcctgaattccaaga

SEQ ID NO: 680389 - DNA, 25 bp, Mus musculus
gccagaagcagcgtgaattccaaga

SEQ ID NO: 680390 - DNA, 25 bp, Mus musculus
gccagaagcttacggattccgcagg

SEQ ID NO: 680391 - DNA, 25 bp, Mus musculus
gccagaagcttagggattccgcagg

SEQ ID NO: 680392 - DNA, 25 bp, Mus musculus
gccagaaggagtctacgataccatt

SEQ ID NO: 680393 - DNA, 25 bp, Mus musculus
gccagaaggagtgtacgataccatt

SEQ ID NO: 680394 - DNA, 25 bp, Mus musculus
gccagaaggcgaaggtctccttctc

SEQ ID NO: 680395 - DNA, 25 bp, Mus musculus
gccagaaggcgatggtctccttctc

SEQ ID NO: 680396 - DNA, 25 bp, Mus musculus
gccagaaggctgacgaacccttgta

SEQ ID NO: 680397 - DNA, 25 bp, Mus musculus
gccagaaggctgtcgaacccttgta

SEQ ID NO: 680398 - DNA, 25 bp, Mus musculus
gccagaagtcaccatagagaagtcc

SEQ ID NO: 680399 - DNA, 25 bp, Mus musculus
gccagaagtcacgatagagaagtcc

SEQ ID NO: 680400 - DNA, 25 bp, Mus musculus
gccagaatacacattttggaacctg

SEQ ID NO: 680401 - DNA, 25 bp, Mus musculus
gccagaatacactttttggaacctg

SEQ ID NO: 680402 - DNA, 25 bp, Mus musculus
gccagaatacgcatgcgtacagtgc

SEQ ID NO: 680403 - DNA, 25 bp, Mus musculus
gccagaatacgcttgcgtacagtgc

SEQ ID NO: 680404 - DNA, 25 bp, Mus musculus
gccagaatcctgagccttaataata

SEQ ID NO: 680405 - DNA, 25 bp, Mus musculus
gccagaatcctgtgccttaataata

SEQ ID NO: 680406 - DNA, 25 bp, Mus musculus
gccagaatgaacaagcgagatcagt

SEQ ID NO: 680407 - DNA, 25 bp, Mus musculus
gccagaatgaactagcgagatcagt

SEQ ID NO: 680408 - DNA, 25 bp, Mus musculus
gccagaatggcccatgcctcaacat

SEQ ID NO: 680409 - DNA, 25 bp, Mus musculus
gccagaatggccgatgcctcaacat

SEQ ID NO: 680410 - DNA, 25 bp, Mus musculus
gccagaatttgtcttatacaaggac

SEQ ID NO: 680411 - DNA, 25 bp, Mus musculus
gccagaatttgtgttatacaaggac

SEQ ID NO: 680412 - DNA, 25 bp, Mus musculus
gccagacacctcatctctatgctgt

SEQ ID NO: 680413 - DNA, 25 bp, Mus musculus
gccagacacctcttctctatgctgt

SEQ ID NO: 680414 - DNA, 25 bp, Mus musculus
gccagacactttcgacactttgcaa

SEQ ID NO: 680415 - DNA, 25 bp, Mus musculus
gccagacactttggacactttgcaa

SEQ ID NO: 680416 - DNA, 25 bp, Mus musculus
gccagacagacgctactcaaacatt

SEQ ID NO: 680417 - DNA, 25 bp, Mus musculus
gccagacagacggtactcaaacatt

SEQ ID NO: 680418 - DNA, 25 bp, Mus musculus
gccagacagcaaagctaccagaaca

SEQ ID NO: 680419 - DNA, 25 bp, Mus musculus
gccagacagcaatgctaccagaaca

SEQ ID NO: 680420 - DNA, 25 bp, Mus musculus
gccagacagggcacgatattccttt

SEQ ID NO: 680421 - DNA, 25 bp, Mus musculus
gccagacagggctcgatattccttt

SEQ ID NO: 680422 - DNA, 25 bp, Mus musculus
gccagacagtggcatagttaccgcc

SEQ ID NO: 680423 - DNA, 25 bp, Mus musculus
gccagacagtgggatagttaccgcc

SEQ ID NO: 680424 - DNA, 25 bp, Mus musculus
gccagacatcagaacaccctagaag

SEQ ID NO: 680425 - DNA, 25 bp, Mus musculus
gccagacatcagtacaccctagaag

SEQ ID NO: 680426 - DNA, 25 bp, Mus musculus
gccagacatgcaaaagagtctgctc

SEQ ID NO: 680427 - DNA, 25 bp, Mus musculus
gccagacatgcataagagtctgctc

SEQ ID NO: 680428 - DNA, 25 bp, Mus musculus
gccagaccaacaacaacgaatgtgc

SEQ ID NO: 680429 - DNA, 25 bp, Mus musculus
gccagaccaacatcaacgaatgtgc

SEQ ID NO: 680430 - DNA, 25 bp, Mus musculus
gccagaccatggatactggagtaga

SEQ ID NO: 680431 - DNA, 25 bp, Mus musculus
gccagaccatggttactggagtaga

SEQ ID NO: 680432 - DNA, 25 bp, Mus musculus
gccagacccgggataccacttatgt

SEQ ID NO: 680433 - DNA, 25 bp, Mus musculus
gccagacccgggttaccacttatgt

SEQ ID NO: 680434 - DNA, 25 bp, Mus musculus
gccagacctcctaccagtgtggcta

SEQ ID NO: 680435 - DNA, 25 bp, Mus musculus
gccagacctccttccagtgtggcta

SEQ ID NO: 680436 - DNA, 25 bp, Mus musculus
gccagacctctccatgttctagata

SEQ ID NO: 680437 - DNA, 25 bp, Mus musculus
gccagacctctcgatgttctagata

SEQ ID NO: 680438 - DNA, 25 bp, Mus musculus
gccagacctgctccactctatgagt

SEQ ID NO: 680439 - DNA, 25 bp, Mus musculus
gccagacctgctgcactctatgagt

SEQ ID NO: 680440 - DNA, 25 bp, Mus musculus
gccagacggcgtaagagggtcctat

SEQ ID NO: 680441 - DNA, 25 bp, Mus musculus
gccagacggcgttagagggtcctat

SEQ ID NO: 680442 - DNA, 25 bp, Mus musculus
gccagacgtcttatgggtccatgta

SEQ ID NO: 680443 - DNA, 25 bp, Mus musculus
gccagacgtcttttgggtccatgta

SEQ ID NO: 680444 - DNA, 25 bp, Mus musculus
gccagacgtgttatcaacagagagc

SEQ ID NO: 680445 - DNA, 25 bp, Mus musculus
gccagacgtgttttcaacagagagc

SEQ ID NO: 680446 - DNA, 25 bp, Mus musculus
gccagactcaagaagccagtgcccg

SEQ ID NO: 680447 - DNA, 25 bp, Mus musculus
gccagactcaagtagccagtgcccg

SEQ ID NO: 680448 - DNA, 25 bp, Mus musculus
gccagactctgcagttgaccttgtc

SEQ ID NO: 680449 - DNA, 25 bp, Mus musculus
gccagactctgctgttgaccttgtc

SEQ ID NO: 680450 - DNA, 25 bp, Mus musculus
gccagactgataatcagtaaaatga

SEQ ID NO: 680451 - DNA, 25 bp, Mus musculus
gccagactgatattcagtaaaatga

SEQ ID NO: 680452 - DNA, 25 bp, Mus musculus
gccagactgccgaggaccactgtgt

SEQ ID NO: 680453 - DNA, 25 bp, Mus musculus
gccagactgccgtggaccactgtgt

SEQ ID NO: 680454 - DNA, 25 bp, Mus musculus
gccagactggttacctatctcccag

SEQ ID NO: 680455 - DNA, 25 bp, Mus musculus
gccagactggtttcctatctcccag

SEQ ID NO: 680456 - DNA, 25 bp, Mus musculus
gccagacttactagatgacccgaat

SEQ ID NO: 680457 - DNA, 25 bp, Mus musculus
gccagacttacttgatgacccgaat

SEQ ID NO: 680458 - DNA, 25 bp, Mus musculus
gccagactttatactttgggattcc

SEQ ID NO: 680459 - DNA, 25 bp, Mus musculus
gccagactttattctttgggattcc

SEQ ID NO: 680460 - DNA, 25 bp, Mus musculus
gccagagaacatcctatgtgagcac

SEQ ID NO: 680461 - DNA, 25 bp, Mus musculus
gccagagaacatgctatgtgagcac

SEQ ID NO: 680462 - DNA, 25 bp, Mus musculus
gccagagaacctcggcaaattgcag

SEQ ID NO: 680463 - DNA, 25 bp, Mus musculus
gccagagaacctgggcaaattgcag

SEQ ID NO: 680464 - DNA, 25 bp, Mus musculus
gccagagactctacgacatctccaa

SEQ ID NO: 680465 - DNA, 25 bp, Mus musculus
gccagagactcttcgacatctccaa

SEQ ID NO: 680466 - DNA, 25 bp, Mus musculus
gccagagagaaaccactcgggatga

SEQ ID NO: 680467 - DNA, 25 bp, Mus musculus
gccagagagaaagcactcgggatga

SEQ ID NO: 680468 - DNA, 25 bp, Mus musculus
gccagagagactcggtgcctctttt

SEQ ID NO: 680469 - DNA, 25 bp, Mus musculus
gccagagagactgggtgcctctttt

SEQ ID NO: 680470 - DNA, 25 bp, Mus musculus
gccagagcagccattcatatgatga

SEQ ID NO: 680471 - DNA, 25 bp, Mus musculus
gccagagcagcctttcatatgatga

SEQ ID NO: 680472 - DNA, 25 bp, Mus musculus
gccagagcaggaagccgtttcaagg

SEQ ID NO: 680473 - DNA, 25 bp, Mus musculus
gccagagcaggatgccgtttcaagg

SEQ ID NO: 680474 - DNA, 25 bp, Mus musculus
gccagagcatgtccaaacatcttac

SEQ ID NO: 680475 - DNA, 25 bp, Mus musculus
gccagagcatgtgcaaacatcttac

SEQ ID NO: 680476 - DNA, 25 bp, Mus musculus
gccagagccaacctcaagcatctga

SEQ ID NO: 680477 - DNA, 25 bp, Mus musculus
gccagagccaacgtcaagcatctga

SEQ ID NO: 680478 - DNA, 25 bp, Mus musculus
gccagagcccttagccttccatatt

SEQ ID NO: 680479 - DNA, 25 bp, Mus musculus
gccagagccctttgccttccatatt

SEQ ID NO: 680480 - DNA, 25 bp, Mus musculus
gccagagcgtgcacagccggatgtt

SEQ ID NO: 680481 - DNA, 25 bp, Mus musculus
gccagagcgtgctcagccggatgtt

SEQ ID NO: 680482 - DNA, 25 bp, Mus musculus
gccagagctacacatcagtgagcga

SEQ ID NO: 680483 - DNA, 25 bp, Mus musculus
gccagagctacagatcagtgagcga

SEQ ID NO: 680484 - DNA, 25 bp, Mus musculus
gccagagctcatccatgctgtcaag

SEQ ID NO: 680485 - DNA, 25 bp, Mus musculus
gccagagctcatgcatgctgtcaag

SEQ ID NO: 680486 - DNA, 25 bp, Mus musculus
gccagagctcttatacctgcaagag

SEQ ID NO: 680487 - DNA, 25 bp, Mus musculus
gccagagctcttttacctgcaagag

SEQ ID NO: 680488 - DNA, 25 bp, Mus musculus
gccagaggaagacattattgctgaa

SEQ ID NO: 680489 - DNA, 25 bp, Mus musculus
gccagaggaagagattattgctgaa

SEQ ID NO: 680490 - DNA, 25 bp, Mus musculus
gccagaggcagccttcgacaaactt

SEQ ID NO: 680491 - DNA, 25 bp, Mus musculus
gccagaggcagcgttcgacaaactt

SEQ ID NO: 680492 - DNA, 25 bp, Mus musculus
gccagaggccatagctttaaccaga

SEQ ID NO: 680493 - DNA, 25 bp, Mus musculus
gccagaggccattgctttaaccaga

SEQ ID NO: 680494 - DNA, 25 bp, Mus musculus
gccagaggccctcccgaaaaaaggg

SEQ ID NO: 680495 - DNA, 25 bp, Mus musculus
gccagaggccctgccgaaaaaaggg

SEQ ID NO: 680496 - DNA, 25 bp, Mus musculus
gccagaggctctataggactgccaa

SEQ ID NO: 680497 - DNA, 25 bp, Mus musculus
gccagaggctctttaggactgccaa

SEQ ID NO: 680498 - DNA, 25 bp, Mus musculus
gccagagggaacctcaaaccaaggc

SEQ ID NO: 680499 - DNA, 25 bp, Mus musculus
gccagagggaacgtcaaaccaaggc

SEQ ID NO: 680500 - DNA, 25 bp, Mus musculus
gccagagggagtacccaccggttga

SEQ ID NO: 680501 - DNA, 25 bp, Mus musculus
gccagagggagttcccaccggttga

SEQ ID NO: 680502 - DNA, 25 bp, Mus musculus
gccagagggataaagcacacggtta

SEQ ID NO: 680503 - DNA, 25 bp, Mus musculus
gccagagggatatagcacacggtta

SEQ ID NO: 680504 - DNA, 25 bp, Mus musculus
gccagagggcccatcatctctgaca

SEQ ID NO: 680505 - DNA, 25 bp, Mus musculus
gccagagggcccttcatctctgaca

SEQ ID NO: 680506 - DNA, 25 bp, Mus musculus
gccagaggtaccaggcgctgaagat

SEQ ID NO: 680507 - DNA, 25 bp, Mus musculus
gccagaggtacctggcgctgaagat

SEQ ID NO: 680508 - DNA, 25 bp, Mus musculus
gccagaggtggcaccgagtccgctt

SEQ ID NO: 680509 - DNA, 25 bp, Mus musculus
gccagaggtggctccgagtccgctt

SEQ ID NO: 680510 - DNA, 25 bp, Mus musculus
gccagagtatgcagtcaattctatt

SEQ ID NO: 680511 - DNA, 25 bp, Mus musculus
gccagagtatgctgtcaattctatt

SEQ ID NO: 680512 - DNA, 25 bp, Mus musculus
gccagagtgatcagaaacgcacata

SEQ ID NO: 680513 - DNA, 25 bp, Mus musculus
gccagagtgatctgaaacgcacata

SEQ ID NO: 680514 - DNA, 25 bp, Mus musculus
gccagagtgctgagcagtgttcaga

SEQ ID NO: 680515 - DNA, 25 bp, Mus musculus
gccagagtgctgtgcagtgttcaga

SEQ ID NO: 680516 - DNA, 25 bp, Mus musculus
gccagagttctgagatccctgaccg

SEQ ID NO: 680517 - DNA, 25 bp, Mus musculus
gccagagttctgtgatccctgaccg

SEQ ID NO: 680518 - DNA, 25 bp, Mus musculus
gccagatactgacaagtttctggag

SEQ ID NO: 680519 - DNA, 25 bp, Mus musculus
gccagatactgagaagtttctggag

SEQ ID NO: 680520 - DNA, 25 bp, Mus musculus
gccagatactttacaagaataagaa

SEQ ID NO: 680521 - DNA, 25 bp, Mus musculus
gccagatacttttcaagaataagaa

SEQ ID NO: 680522 - DNA, 25 bp, Mus musculus
gccagatagcccacagggccgcaag

SEQ ID NO: 680523 - DNA, 25 bp, Mus musculus
gccagatagccctcagggccgcaag

SEQ ID NO: 680524 - DNA, 25 bp, Mus musculus
gccagatattctcaagacagagtcg

SEQ ID NO: 680525 - DNA, 25 bp, Mus musculus
gccagatattctgaagacagagtcg

SEQ ID NO: 680526 - DNA, 25 bp, Mus musculus
gccagatgaggaacccaattacaac

SEQ ID NO: 680527 - DNA, 25 bp, Mus musculus
gccagatgaggatcccaattacaac

SEQ ID NO: 680528 - DNA, 25 bp, Mus musculus
gccagatgctaccaggtaagacaac

SEQ ID NO: 680529 - DNA, 25 bp, Mus musculus
gccagatgctacgaggtaagacaac

SEQ ID NO: 680530 - DNA, 25 bp, Mus musculus
gccagatgctgcagacagacatgtg

SEQ ID NO: 680531 - DNA, 25 bp, Mus musculus
gccagatgctgctgacagacatgtg

SEQ ID NO: 680532 - DNA, 25 bp, Mus musculus
gccagatgggtccagcttcaacatg

SEQ ID NO: 680533 - DNA, 25 bp, Mus musculus
gccagatgggtcgagcttcaacatg

SEQ ID NO: 680534 - DNA, 25 bp, Mus musculus
gccagatgtacaaagcacctgcatg

SEQ ID NO: 680535 - DNA, 25 bp, Mus musculus
gccagatgtacatagcacctgcatg

SEQ ID NO: 680536 - DNA, 25 bp, Mus musculus
gccagattatgcacaaatacccaga

SEQ ID NO: 680537 - DNA, 25 bp, Mus musculus
gccagattatgctcaaatacccaga

SEQ ID NO: 680538 - DNA, 25 bp, Mus musculus
gccagattggcgaacacagaaatgt

SEQ ID NO: 680539 - DNA, 25 bp, Mus musculus
gccagattggcgtacacagaaatgt

SEQ ID NO: 680540 - DNA, 25 bp, Mus musculus
gccagcaaatataacagattcattg

SEQ ID NO: 680541 - DNA, 25 bp, Mus musculus
gccagcaaatattacagattcattg

SEQ ID NO: 680542 - DNA, 25 bp, Mus musculus
gccagcaacaaactaccaagtatgg

SEQ ID NO: 680543 - DNA, 25 bp, Mus musculus
gccagcaacaaagtaccaagtatgg

SEQ ID NO: 680544 - DNA, 25 bp, Mus musculus
gccagcaacatcattttctccaacg

SEQ ID NO: 680545 - DNA, 25 bp, Mus musculus
gccagcaacatctttttctccaacg

SEQ ID NO: 680546 - DNA, 25 bp, Mus musculus
gccagcaaccacatcggaggtaggg

SEQ ID NO: 680547 - DNA, 25 bp, Mus musculus
gccagcaaccacttcggaggtaggg

SEQ ID NO: 680548 - DNA, 25 bp, Mus musculus
gccagcaaccagatgggcagtgcct

SEQ ID NO: 680549 - DNA, 25 bp, Mus musculus
gccagcaaccagttgggcagtgcct

SEQ ID NO: 680550 - DNA, 25 bp, Mus musculus
gccagcaagaagagtcagtgtgacg

SEQ ID NO: 680551 - DNA, 25 bp, Mus musculus
gccagcaagaagtgtcagtgtgacg

SEQ ID NO: 680552 - DNA, 25 bp, Mus musculus
gccagcaagagaaaaagcgcttact

SEQ ID NO: 680553 - DNA, 25 bp, Mus musculus
gccagcaagagataaagcgcttact

SEQ ID NO: 680554 - DNA, 25 bp, Mus musculus
gccagcaatcaaccagaggcagcca

SEQ ID NO: 680555 - DNA, 25 bp, Mus musculus
gccagcaatcaagcagaggcagcca

SEQ ID NO: 680556 - DNA, 25 bp, Mus musculus
gccagcaatgctctagcccgtgtga

SEQ ID NO: 680557 - DNA, 25 bp, Mus musculus
gccagcaatgctgtagcccgtgtga

SEQ ID NO: 680558 - DNA, 25 bp, Mus musculus
gccagcaatggaactcgtttttcaa

SEQ ID NO: 680559 - DNA, 25 bp, Mus musculus
gccagcaatggatctcgtttttcaa

SEQ ID NO: 680560 - DNA, 25 bp, Mus musculus
gccagcacacacagaggcaggaatg

SEQ ID NO: 680561 - DNA, 25 bp, Mus musculus
gccagcacacactgaggcaggaatg

SEQ ID NO: 680562 - DNA, 25 bp, Mus musculus
gccagcacaccaagcaagaacggtg

SEQ ID NO: 680563 - DNA, 25 bp, Mus musculus
gccagcacaccatgcaagaacggtg

SEQ ID NO: 680564 - DNA, 25 bp, Mus musculus
gccagcaccaaactagaagtagaca

SEQ ID NO: 680565 - DNA, 25 bp, Mus musculus
gccagcaccaaagtagaagtagaca

SEQ ID NO: 680566 - DNA, 25 bp, Mus musculus
gccagcaccagaaatccatgtctgc

SEQ ID NO: 680567 - DNA, 25 bp, Mus musculus
gccagcaccagatatccatgtctgc

SEQ ID NO: 680568 - DNA, 25 bp, Mus musculus
gccagcacggataactcagtcataa

SEQ ID NO: 680569 - DNA, 25 bp, Mus musculus
gccagcacggattactcagtcataa

SEQ ID NO: 680570 - DNA, 25 bp, Mus musculus
gccagcactggaccatgaccaaaat

SEQ ID NO: 680571 - DNA, 25 bp, Mus musculus
gccagcactggagcatgaccaaaat

SEQ ID NO: 680572 - DNA, 25 bp, Mus musculus
gccagcactttcctctcggagatga

SEQ ID NO: 680573 - DNA, 25 bp, Mus musculus
gccagcactttcgtctcggagatga

SEQ ID NO: 680574 - DNA, 25 bp, Mus musculus
gccagcagaaataagcagaatgaaa

SEQ ID NO: 680575 - DNA, 25 bp, Mus musculus
gccagcagaaattagcagaatgaaa

SEQ ID NO: 680576 - DNA, 25 bp, Mus musculus
gccagcagacagactacggtggacg

SEQ ID NO: 680577 - DNA, 25 bp, Mus musculus
gccagcagacagtctacggtggacg

SEQ ID NO: 680578 - DNA, 25 bp, Mus musculus
gccagcagcaggatttctccattgg

SEQ ID NO: 680579 - DNA, 25 bp, Mus musculus
gccagcagcaggttttctccattgg

SEQ ID NO: 680580 - DNA, 25 bp, Mus musculus
gccagcagctaaaaagccgccagca

SEQ ID NO: 680581 - DNA, 25 bp, Mus musculus
gccagcagctaataagccgccagca

SEQ ID NO: 680582 - DNA, 25 bp, Mus musculus
gccagcaggaccaggatatgctgcc

SEQ ID NO: 680583 - DNA, 25 bp, Mus musculus
gccagcaggacctggatatgctgcc

SEQ ID NO: 680584 - DNA, 25 bp, Mus musculus
gccagcaggccaagctgaaggaact

SEQ ID NO: 680585 - DNA, 25 bp, Mus musculus
gccagcaggccatgctgaaggaact

SEQ ID NO: 680586 - DNA, 25 bp, Mus musculus
gccagcagtggccaatgtccaggaa

SEQ ID NO: 680587 - DNA, 25 bp, Mus musculus
gccagcagtggcgaatgtccaggaa

SEQ ID NO: 680588 - DNA, 25 bp, Mus musculus
gccagcagtgggacttccccaatgc

SEQ ID NO: 680589 - DNA, 25 bp, Mus musculus
gccagcagtgggtcttccccaatgc

SEQ ID NO: 680590 - DNA, 25 bp, Mus musculus
gccagcatcaatcaaatcaagagga

SEQ ID NO: 680591 - DNA, 25 bp, Mus musculus
gccagcatcaatgaaatcaagagga

SEQ ID NO: 680592 - DNA, 25 bp, Mus musculus
gccagcatcagacggaagccgctga

SEQ ID NO: 680593 - DNA, 25 bp, Mus musculus
gccagcatcagagggaagccgctga

SEQ ID NO: 680594 - DNA, 25 bp, Mus musculus
gccagcatcctaacgatccacagag

SEQ ID NO: 680595 - DNA, 25 bp, Mus musculus
gccagcatcctatcgatccacagag

SEQ ID NO: 680596 - DNA, 25 bp, Mus musculus
gccagcatgaccattgttgtccaga

SEQ ID NO: 680597 - DNA, 25 bp, Mus musculus
gccagcatgacctttgttgtccaga

SEQ ID NO: 680598 - DNA, 25 bp, Mus musculus
gccagcatgtcaaccacaaatactt

SEQ ID NO: 680599 - DNA, 25 bp, Mus musculus
gccagcatgtcatccacaaatactt

SEQ ID NO: 680600 - DNA, 25 bp, Mus musculus
gccagcatttcgataggcattgcct

SEQ ID NO: 680601 - DNA, 25 bp, Mus musculus
gccagcatttcgttaggcattgcct

SEQ ID NO: 680602 - DNA, 25 bp, Mus musculus
gccagcatttttccgccagcagtga

SEQ ID NO: 680603 - DNA, 25 bp, Mus musculus
gccagcatttttgcgccagcagtga

SEQ ID NO: 680604 - DNA, 25 bp, Mus musculus
gccagccaagtgaagctgacattaa

SEQ ID NO: 680605 - DNA, 25 bp, Mus musculus
gccagccaagtgtagctgacattaa

SEQ ID NO: 680606 - DNA, 25 bp, Mus musculus
gccagccaatctcaaaggatatttt

SEQ ID NO: 680607 - DNA, 25 bp, Mus musculus
gccagccaatctgaaaggatatttt

SEQ ID NO: 680608 - DNA, 25 bp, Mus musculus
gccagccacattctagaagtggtag

SEQ ID NO: 680609 - DNA, 25 bp, Mus musculus
gccagccacattgtagaagtggtag

SEQ ID NO: 680610 - DNA, 25 bp, Mus musculus
gccagccagcaaatagttgactctt

SEQ ID NO: 680611 - DNA, 25 bp, Mus musculus
gccagccagcaattagttgactctt

SEQ ID NO: 680612 - DNA, 25 bp, Mus musculus
gccagccagcgtcggcaactgcagt

SEQ ID NO: 680613 - DNA, 25 bp, Mus musculus
gccagccagcgtgggcaactgcagt

SEQ ID NO: 680614 - DNA, 25 bp, Mus musculus
gccagccagctaaaccagagaatcc

SEQ ID NO: 680615 - DNA, 25 bp, Mus musculus
gccagccagctataccagagaatcc

SEQ ID NO: 680616 - DNA, 25 bp, Mus musculus
gccagccagctcacctatcatggag

SEQ ID NO: 680617 - DNA, 25 bp, Mus musculus
gccagccagctctcctatcatggag

SEQ ID NO: 680618 - DNA, 25 bp, Mus musculus
gccagccagctgagcacaagctgac

SEQ ID NO: 680619 - DNA, 25 bp, Mus musculus
gccagccagctgtgcacaagctgac

SEQ ID NO: 680620 - DNA, 25 bp, Mus musculus
gccagcccatcgaggaatggagaga

SEQ ID NO: 680621 - DNA, 25 bp, Mus musculus
gccagcccatcgtggaatggagaga

SEQ ID NO: 680622 - DNA, 25 bp, Mus musculus
gccagcccattgagttcgaggtctt

SEQ ID NO: 680623 - DNA, 25 bp, Mus musculus
gccagcccattgtgttcgaggtctt

SEQ ID NO: 680624 - DNA, 25 bp, Mus musculus
gccagcccgccaacgttgggtctgt

SEQ ID NO: 680625 - DNA, 25 bp, Mus musculus
gccagcccgccatcgttgggtctgt

SEQ ID NO: 680626 - DNA, 25 bp, Mus musculus
gccagccctacacatttgatatcaa

SEQ ID NO: 680627 - DNA, 25 bp, Mus musculus
gccagccctacagatttgatatcaa

SEQ ID NO: 680628 - DNA, 25 bp, Mus musculus
gccagccgacttatgtggtcttccc

SEQ ID NO: 680629 - DNA, 25 bp, Mus musculus
gccagccgacttttgtggtcttccc

SEQ ID NO: 680630 - DNA, 25 bp, Mus musculus
gccagccgcttaagaatcagatcag

SEQ ID NO: 680631 - DNA, 25 bp, Mus musculus
gccagccgcttatgaatcagatcag

SEQ ID NO: 680632 - DNA, 25 bp, Mus musculus
gccagccgcttcagggatgactgtg

SEQ ID NO: 680633 - DNA, 25 bp, Mus musculus
gccagccgcttctgggatgactgtg

SEQ ID NO: 680634 - DNA, 25 bp, Mus musculus
gccagccggagtacctggagcaaaa

SEQ ID NO: 680635 - DNA, 25 bp, Mus musculus
gccagccggagttcctggagcaaaa

SEQ ID NO: 680636 - DNA, 25 bp, Mus musculus
gccagccggtggatttggtgctcca

SEQ ID NO: 680637 - DNA, 25 bp, Mus musculus
gccagccggtggttttggtgctcca

SEQ ID NO: 680638 - DNA, 25 bp, Mus musculus
gccagccgttggcattgcacatcca

SEQ ID NO: 680639 - DNA, 25 bp, Mus musculus
gccagccgttgggattgcacatcca

SEQ ID NO: 680640 - DNA, 25 bp, Mus musculus
gccagcctcaggacgaggaaccaaa

SEQ ID NO: 680641 - DNA, 25 bp, Mus musculus
gccagcctcaggtcgaggaaccaaa

SEQ ID NO: 680642 - DNA, 25 bp, Mus musculus
gccagcctctgtagggctcagtcca

SEQ ID NO: 680643 - DNA, 25 bp, Mus musculus
gccagcctctgttgggctcagtcca

SEQ ID NO: 680644 - DNA, 25 bp, Mus musculus
gccagcctgatacggctcatgcaac

SEQ ID NO: 680645 - DNA, 25 bp, Mus musculus
gccagcctgatagggctcatgcaac

SEQ ID NO: 680646 - DNA, 25 bp, Mus musculus
gccagcctggacattttgatagtct

SEQ ID NO: 680647 - DNA, 25 bp, Mus musculus
gccagcctggactttttgatagtct

SEQ ID NO: 680648 - DNA, 25 bp, Mus musculus
gccagcctggccagtgttgtgcctt

SEQ ID NO: 680649 - DNA, 25 bp, Mus musculus
gccagcctggcctgtgttgtgcctt

SEQ ID NO: 680650 - DNA, 25 bp, Mus musculus
gccagcctgttgacggtcagaaaga

SEQ ID NO: 680651 - DNA, 25 bp, Mus musculus
gccagcctgttgtcggtcagaaaga

SEQ ID NO: 680652 - DNA, 25 bp, Mus musculus
gccagccttgaaaatagaacaatat

SEQ ID NO: 680653 - DNA, 25 bp, Mus musculus
gccagccttgaatatagaacaatat

SEQ ID NO: 680654 - DNA, 25 bp, Mus musculus
gccagcgaacatcctgctggatgcc

SEQ ID NO: 680655 - DNA, 25 bp, Mus musculus
gccagcgaacatgctgctggatgcc

SEQ ID NO: 680656 - DNA, 25 bp, Mus musculus
gccagcgacgtgctggtcatcagaa

SEQ ID NO: 680657 - DNA, 25 bp, Mus musculus
gccagcgacgtggtggtcatcagaa

SEQ ID NO: 680658 - DNA, 25 bp, Mus musculus
gccagcgaggaacagctgataacga

SEQ ID NO: 680659 - DNA, 25 bp, Mus musculus
gccagcgaggaagagctgataacga

SEQ ID NO: 680660 - DNA, 25 bp, Mus musculus
gccagcgagtgactcgctcgcagaa

SEQ ID NO: 680661 - DNA, 25 bp, Mus musculus
gccagcgagtgagtcgctcgcagaa

SEQ ID NO: 680662 - DNA, 25 bp, Mus musculus
gccagcgcaaaaatctccggtgttt

SEQ ID NO: 680663 - DNA, 25 bp, Mus musculus
gccagcgcaaaattctccggtgttt

SEQ ID NO: 680664 - DNA, 25 bp, Mus musculus
gccagcgcggaacaaacatgcagcg

SEQ ID NO: 680665 - DNA, 25 bp, Mus musculus
gccagcgcggaagaaacatgcagcg

SEQ ID NO: 680666 - DNA, 25 bp, Mus musculus
gccagcgtgatcctccgagacattg

SEQ ID NO: 680667 - DNA, 25 bp, Mus musculus
gccagcgtgatcgtccgagacattg

SEQ ID NO: 680668 - DNA, 25 bp, Mus musculus
gccagcgtgcccatacaagtgctga

SEQ ID NO: 680669 - DNA, 25 bp, Mus musculus
gccagcgtgcccttacaagtgctga

SEQ ID NO: 680670 - DNA, 25 bp, Mus musculus
gccagctaagctatcttaaccctgc

SEQ ID NO: 680671 - DNA, 25 bp, Mus musculus
gccagctaagctttcttaaccctgc

SEQ ID NO: 680672 - DNA, 25 bp, Mus musculus
gccagctaatgtatctaagactctg

SEQ ID NO: 680673 - DNA, 25 bp, Mus musculus
gccagctaatgtttctaagactctg

SEQ ID NO: 680674 - DNA, 25 bp, Mus musculus
gccagctacatccagagcaagtttg

SEQ ID NO: 680675 - DNA, 25 bp, Mus musculus
gccagctacatcgagagcaagtttg

SEQ ID NO: 680676 - DNA, 25 bp, Mus musculus
gccagctagaggctgccaagcaagt

SEQ ID NO: 680677 - DNA, 25 bp, Mus musculus
gccagctagagggtgccaagcaagt

SEQ ID NO: 680678 - DNA, 25 bp, Mus musculus
gccagctagggccagacaaccctaa

SEQ ID NO: 680679 - DNA, 25 bp, Mus musculus
gccagctagggcgagacaaccctaa

SEQ ID NO: 680680 - DNA, 25 bp, Mus musculus
gccagctcaagcagcattgcctgag

SEQ ID NO: 680681 - DNA, 25 bp, Mus musculus
gccagctcaagctgcattgcctgag

SEQ ID NO: 680682 - DNA, 25 bp, Mus musculus
gccagctcagaactcaggtgctcga

SEQ ID NO: 680683 - DNA, 25 bp, Mus musculus
gccagctcagaagtcaggtgctcga

SEQ ID NO: 680684 - DNA, 25 bp, Mus musculus
gccagctccaagatcaaggtcaaca

SEQ ID NO: 680685 - DNA, 25 bp, Mus musculus
gccagctccaagttcaaggtcaaca

SEQ ID NO: 680686 - DNA, 25 bp, Mus musculus
gccagctcccttaggaatgacagca

SEQ ID NO: 680687 - DNA, 25 bp, Mus musculus
gccagctccctttggaatgacagca

SEQ ID NO: 680688 - DNA, 25 bp, Mus musculus
gccagctctcttcaaaggattctaa

SEQ ID NO: 680689 - DNA, 25 bp, Mus musculus
gccagctctcttgaaaggattctaa

SEQ ID NO: 680690 - DNA, 25 bp, Mus musculus
gccagctctgccagaaggtaccgag

SEQ ID NO: 680691 - DNA, 25 bp, Mus musculus
gccagctctgcctgaaggtaccgag

SEQ ID NO: 680692 - DNA, 25 bp, Mus musculus
gccagctctgtgagaacctggaagg

SEQ ID NO: 680693 - DNA, 25 bp, Mus musculus
gccagctctgtgtgaacctggaagg

SEQ ID NO: 680694 - DNA, 25 bp, Mus musculus
gccagctgaggccggagaaaaacat

SEQ ID NO: 680695 - DNA, 25 bp, Mus musculus
gccagctgaggcgggagaaaaacat

SEQ ID NO: 680696 - DNA, 25 bp, Mus musculus
gccagctggagaagagctgctccaa

SEQ ID NO: 680697 - DNA, 25 bp, Mus musculus
gccagctggagatgagctgctccaa

SEQ ID NO: 680698 - DNA, 25 bp, Mus musculus
gccagctggctcactaatgcctcag

SEQ ID NO: 680699 - DNA, 25 bp, Mus musculus
gccagctggctctctaatgcctcag

SEQ ID NO: 680700 - DNA, 25 bp, Mus musculus
gccagctggtctcagaatcctgcaa

SEQ ID NO: 680701 - DNA, 25 bp, Mus musculus
gccagctggtctgagaatcctgcaa

SEQ ID NO: 680702 - DNA, 25 bp, Mus musculus
gccagctgtactagacatggactgt

SEQ ID NO: 680703 - DNA, 25 bp, Mus musculus
gccagctgtacttgacatggactgt

SEQ ID NO: 680704 - DNA, 25 bp, Mus musculus
gccagcttccttaccaggatgaagg

SEQ ID NO: 680705 - DNA, 25 bp, Mus musculus
gccagcttcctttccaggatgaagg

SEQ ID NO: 680706 - DNA, 25 bp, Mus musculus
gccagcttgcctagttgaatttaaa

SEQ ID NO: 680707 - DNA, 25 bp, Mus musculus
gccagcttgccttgttgaatttaaa

SEQ ID NO: 680708 - DNA, 25 bp, Mus musculus
gccagcttggagaccgcctcaacgt

SEQ ID NO: 680709 - DNA, 25 bp, Mus musculus
gccagcttggagtccgcctcaacgt

SEQ ID NO: 680710 - DNA, 25 bp, Mus musculus
gccagcttggcgactgcgccatgga

SEQ ID NO: 680711 - DNA, 25 bp, Mus musculus
gccagcttggcgtctgcgccatgga

SEQ ID NO: 680712 - DNA, 25 bp, Mus musculus
gccagctttaccctggtcctcatag

SEQ ID NO: 680713 - DNA, 25 bp, Mus musculus
gccagctttaccgtggtcctcatag

SEQ ID NO: 680714 - DNA, 25 bp, Mus musculus
gccagctttaggaaagaccccgtgg

SEQ ID NO: 680715 - DNA, 25 bp, Mus musculus
gccagctttaggtaagaccccgtgg

SEQ ID NO: 680716 - DNA, 25 bp, Mus musculus
gccagctttcaaatccgaacctgga

SEQ ID NO: 680717 - DNA, 25 bp, Mus musculus
gccagctttcaattccgaacctgga

SEQ ID NO: 680718 - DNA, 25 bp, Mus musculus
gccaggaaaaacatgactgtcaaga

SEQ ID NO: 680719 - DNA, 25 bp, Mus musculus
gccaggaaaaacttgactgtcaaga

SEQ ID NO: 680720 - DNA, 25 bp, Mus musculus
gccaggaaaggcacaatgagagcag

SEQ ID NO: 680721 - DNA, 25 bp, Mus musculus
gccaggaaaggctcaatgagagcag

SEQ ID NO: 680722 - DNA, 25 bp, Mus musculus
gccaggaaagtgactcgtgacattc

SEQ ID NO: 680723 - DNA, 25 bp, Mus musculus
gccaggaaagtgtctcgtgacattc

SEQ ID NO: 680724 - DNA, 25 bp, Mus musculus
gccaggaacagcctcatgcagctga

SEQ ID NO: 680725 - DNA, 25 bp, Mus musculus
gccaggaacagcgtcatgcagctga

SEQ ID NO: 680726 - DNA, 25 bp, Mus musculus
gccaggaagcccaccgtgtgtgagt

SEQ ID NO: 680727 - DNA, 25 bp, Mus musculus
gccaggaagccctccgtgtgtgagt

SEQ ID NO: 680728 - DNA, 25 bp, Mus musculus
gccaggaagctgctgtgtaacatca

SEQ ID NO: 680729 - DNA, 25 bp, Mus musculus
gccaggaagctggtgtgtaacatca

SEQ ID NO: 680730 - DNA, 25 bp, Mus musculus
gccaggaagtagcatagaactgcca

SEQ ID NO: 680731 - DNA, 25 bp, Mus musculus
gccaggaagtaggatagaactgcca

SEQ ID NO: 680732 - DNA, 25 bp, Mus musculus
gccaggaatgctcactctcagccat

SEQ ID NO: 680733 - DNA, 25 bp, Mus musculus
gccaggaatgctgactctcagccat

SEQ ID NO: 680734 - DNA, 25 bp, Mus musculus
gccaggaattgcatgaaccgctcag

SEQ ID NO: 680735 - DNA, 25 bp, Mus musculus
gccaggaattgcttgaaccgctcag

SEQ ID NO: 680736 - DNA, 25 bp, Mus musculus
gccaggaccattctgttacaagaaa

SEQ ID NO: 680737 - DNA, 25 bp, Mus musculus
gccaggaccattgtgttacaagaaa

SEQ ID NO: 680738 - DNA, 25 bp, Mus musculus
gccaggacgcttaccggagcagagc

SEQ ID NO: 680739 - DNA, 25 bp, Mus musculus
gccaggacgctttccggagcagagc

SEQ ID NO: 680740 - DNA, 25 bp, Mus musculus
gccaggacgtccactaatgtgagaa

SEQ ID NO: 680741 - DNA, 25 bp, Mus musculus
gccaggacgtcctctaatgtgagaa

SEQ ID NO: 680742 - DNA, 25 bp, Mus musculus
gccaggactctacacatgcatagct

SEQ ID NO: 680743 - DNA, 25 bp, Mus musculus
gccaggactctagacatgcatagct

SEQ ID NO: 680744 - DNA, 25 bp, Mus musculus
gccaggactgttcttccctgggcag

SEQ ID NO: 680745 - DNA, 25 bp, Mus musculus
gccaggactgttgttccctgggcag

SEQ ID NO: 680746 - DNA, 25 bp, Mus musculus
gccaggacttgtagcttttaattcc

SEQ ID NO: 680747 - DNA, 25 bp, Mus musculus
gccaggacttgttgcttttaattcc

SEQ ID NO: 680748 - DNA, 25 bp, Mus musculus
gccaggagatcacaaccccaggagc

SEQ ID NO: 680749 - DNA, 25 bp, Mus musculus
gccaggagatcagaaccccaggagc

SEQ ID NO: 680750 - DNA, 25 bp, Mus musculus
gccaggagattcagcaccacgtcag

SEQ ID NO: 680751 - DNA, 25 bp, Mus musculus
gccaggagattctgcaccacgtcag

SEQ ID NO: 680752 - DNA, 25 bp, Mus musculus
gccaggagcaagaccgtgtttacga

SEQ ID NO: 680753 - DNA, 25 bp, Mus musculus
gccaggagcaagtccgtgtttacga

SEQ ID NO: 680754 - DNA, 25 bp, Mus musculus
gccaggagcgccaggacttcaaccg

SEQ ID NO: 680755 - DNA, 25 bp, Mus musculus
gccaggagcgcctggacttcaaccg

SEQ ID NO: 680756 - DNA, 25 bp, Mus musculus
gccaggagctgtcaaagtcccagct

SEQ ID NO: 680757 - DNA, 25 bp, Mus musculus
gccaggagctgtgaaagtcccagct

SEQ ID NO: 680758 - DNA, 25 bp, Mus musculus
gccaggaggagtccgaaggcagctc

SEQ ID NO: 680759 - DNA, 25 bp, Mus musculus
gccaggaggagtgcgaaggcagctc

SEQ ID NO: 680760 - DNA, 25 bp, Mus musculus
gccaggagtgtcatcttggaacaga

SEQ ID NO: 680761 - DNA, 25 bp, Mus musculus
gccaggagtgtcttcttggaacaga

SEQ ID NO: 680762 - DNA, 25 bp, Mus musculus
gccaggataacaccaccaactatgg

SEQ ID NO: 680763 - DNA, 25 bp, Mus musculus
gccaggataacagcaccaactatgg

SEQ ID NO: 680764 - DNA, 25 bp, Mus musculus
gccaggatatcacggaatgtcaaac

SEQ ID NO: 680765 - DNA, 25 bp, Mus musculus
gccaggatatcagggaatgtcaaac

SEQ ID NO: 680766 - DNA, 25 bp, Mus musculus
gccaggatatgaagcaagggccctt

SEQ ID NO: 680767 - DNA, 25 bp, Mus musculus
gccaggatatgatgcaagggccctt

SEQ ID NO: 680768 - DNA, 25 bp, Mus musculus
gccaggatcatgattcctccgactc

SEQ ID NO: 680769 - DNA, 25 bp, Mus musculus
gccaggatcatgtttcctccgactc

SEQ ID NO: 680770 - DNA, 25 bp, Mus musculus
gccaggatcctacagagtgcattcc

SEQ ID NO: 680771 - DNA, 25 bp, Mus musculus
gccaggatcctagagagtgcattcc

SEQ ID NO: 680772 - DNA, 25 bp, Mus musculus
gccaggatggatacactgctcattg

SEQ ID NO: 680773 - DNA, 25 bp, Mus musculus
gccaggatggattcactgctcattg

SEQ ID NO: 680774 - DNA, 25 bp, Mus musculus
gccaggatttgaccggcagctgcct

SEQ ID NO: 680775 - DNA, 25 bp, Mus musculus
gccaggatttgagcggcagctgcct

SEQ ID NO: 680776 - DNA, 25 bp, Mus musculus
gccaggcaatatcaagcccaaactg

SEQ ID NO: 680777 - DNA, 25 bp, Mus musculus
gccaggcaatatgaagcccaaactg

SEQ ID NO: 680778 - DNA, 25 bp, Mus musculus
gccaggcactgacatccttcatctt

SEQ ID NO: 680779 - DNA, 25 bp, Mus musculus
gccaggcactgagatccttcatctt

SEQ ID NO: 680780 - DNA, 25 bp, Mus musculus
gccaggcagagaaggacactgcact

SEQ ID NO: 680781 - DNA, 25 bp, Mus musculus
gccaggcagagatggacactgcact

SEQ ID NO: 680782 - DNA, 25 bp, Mus musculus
gccaggcagcaccaatgtctcagat

SEQ ID NO: 680783 - DNA, 25 bp, Mus musculus
gccaggcagcacgaatgtctcagat

SEQ ID NO: 680784 - DNA, 25 bp, Mus musculus
gccaggcagcctattgagatctacg

SEQ ID NO: 680785 - DNA, 25 bp, Mus musculus
gccaggcagccttttgagatctacg

SEQ ID NO: 680786 - DNA, 25 bp, Mus musculus
gccaggcaggctactcatgccagaa

SEQ ID NO: 680787 - DNA, 25 bp, Mus musculus
gccaggcaggcttctcatgccagaa

SEQ ID NO: 680788 - DNA, 25 bp, Mus musculus
gccaggcagtctcctgagaggaaca

SEQ ID NO: 680789 - DNA, 25 bp, Mus musculus
gccaggcagtctgctgagaggaaca

SEQ ID NO: 680790 - DNA, 25 bp, Mus musculus
gccaggcatgtcatcacaggtgaga

SEQ ID NO: 680791 - DNA, 25 bp, Mus musculus
gccaggcatgtcttcacaggtgaga

SEQ ID NO: 680792 - DNA, 25 bp, Mus musculus
gccaggcatttcactgagtacaaag

SEQ ID NO: 680793 - DNA, 25 bp, Mus musculus
gccaggcatttctctgagtacaaag

SEQ ID NO: 680794 - DNA, 25 bp, Mus musculus
gccaggcccacgaggcctcagggaa

SEQ ID NO: 680795 - DNA, 25 bp, Mus musculus
gccaggcccacgtggcctcagggaa

SEQ ID NO: 680796 - DNA, 25 bp, Mus musculus
gccaggcccggaactgccatggcgt

SEQ ID NO: 680797 - DNA, 25 bp, Mus musculus
gccaggcccggatctgccatggcgt

SEQ ID NO: 680798 - DNA, 25 bp, Mus musculus
gccaggcccttcagctaagatggga

SEQ ID NO: 680799 - DNA, 25 bp, Mus musculus
gccaggcccttctgctaagatggga

SEQ ID NO: 680800 - DNA, 25 bp, Mus musculus
gccaggcctatgcagctgcctgtgc

SEQ ID NO: 680801 - DNA, 25 bp, Mus musculus
gccaggcctatggagctgcctgtgc

SEQ ID NO: 680802 - DNA, 25 bp, Mus musculus
gccaggccttcgaccccgggaggag

SEQ ID NO: 680803 - DNA, 25 bp, Mus musculus
gccaggccttcgtccccgggaggag

SEQ ID NO: 680804 - DNA, 25 bp, Mus musculus
gccaggcgagaaaagctctctagag

SEQ ID NO: 680805 - DNA, 25 bp, Mus musculus
gccaggcgagaatagctctctagag

SEQ ID NO: 680806 - DNA, 25 bp, Mus musculus
gccaggctacacaggccatcactgt

SEQ ID NO: 680807 - DNA, 25 bp, Mus musculus
gccaggctacactggccatcactgt

SEQ ID NO: 680808 - DNA, 25 bp, Mus musculus
gccaggctgaccacttcattggaaa

SEQ ID NO: 680809 - DNA, 25 bp, Mus musculus
gccaggctgacctcttcattggaaa

SEQ ID NO: 680810 - DNA, 25 bp, Mus musculus
gccaggctgactcctacccttgtag

SEQ ID NO: 680811 - DNA, 25 bp, Mus musculus
gccaggctgactgctacccttgtag

SEQ ID NO: 680812 - DNA, 25 bp, Mus musculus
gccaggctgagaaaacccgggcctc

SEQ ID NO: 680813 - DNA, 25 bp, Mus musculus
gccaggctgagataacccgggcctc

SEQ ID NO: 680814 - DNA, 25 bp, Mus musculus
gccaggctgcggagcacttctttga

SEQ ID NO: 680815 - DNA, 25 bp, Mus musculus
gccaggctgcggtgcacttctttga

SEQ ID NO: 680816 - DNA, 25 bp, Mus musculus
gccaggcttataccagagaagccaa

SEQ ID NO: 680817 - DNA, 25 bp, Mus musculus
gccaggcttatagcagagaagccaa

SEQ ID NO: 680818 - DNA, 25 bp, Mus musculus
gccaggcttgctctagttacccaga

SEQ ID NO: 680819 - DNA, 25 bp, Mus musculus
gccaggcttgctgtagttacccaga

SEQ ID NO: 680820 - DNA, 25 bp, Mus musculus
gccaggctttgcataaaccaagaga

SEQ ID NO: 680821 - DNA, 25 bp, Mus musculus
gccaggctttgcttaaaccaagaga

SEQ ID NO: 680822 - DNA, 25 bp, Mus musculus
gccagggaagttcatttccatttgg

SEQ ID NO: 680823 - DNA, 25 bp, Mus musculus
gccagggaagttgatttccatttgg

SEQ ID NO: 680824 - DNA, 25 bp, Mus musculus
gccagggactggacattcttcaatg

SEQ ID NO: 680825 - DNA, 25 bp, Mus musculus
gccagggactggtcattcttcaatg

SEQ ID NO: 680826 - DNA, 25 bp, Mus musculus
gccagggacttaacttcagcaggaa

SEQ ID NO: 680827 - DNA, 25 bp, Mus musculus
gccagggacttatcttcagcaggaa

SEQ ID NO: 680828 - DNA, 25 bp, Mus musculus
gccagggatatcctgagaggcttca

SEQ ID NO: 680829 - DNA, 25 bp, Mus musculus
gccagggatatcgtgagaggcttca

SEQ ID NO: 680830 - DNA, 25 bp, Mus musculus
gccagggatctgaaagcctcagaag

SEQ ID NO: 680831 - DNA, 25 bp, Mus musculus
gccagggatctgtaagcctcagaag

SEQ ID NO: 680832 - DNA, 25 bp, Mus musculus
gccagggcaaagcagttcaccaatg

SEQ ID NO: 680833 - DNA, 25 bp, Mus musculus
gccagggcaaaggagttcaccaatg

SEQ ID NO: 680834 - DNA, 25 bp, Mus musculus
gccagggccctgagggaccctcaag

SEQ ID NO: 680835 - DNA, 25 bp, Mus musculus
gccagggccctgtgggaccctcaag

SEQ ID NO: 680836 - DNA, 25 bp, Mus musculus
gccagggccgggaccgacttttcag

SEQ ID NO: 680837 - DNA, 25 bp, Mus musculus
gccagggccgggtccgacttttcag

SEQ ID NO: 680838 - DNA, 25 bp, Mus musculus
gccagggccttgagcggctctcacg

SEQ ID NO: 680839 - DNA, 25 bp, Mus musculus
gccagggccttgtgcggctctcacg

SEQ ID NO: 680840 - DNA, 25 bp, Mus musculus
gccagggctagtcgtctgcacacat

SEQ ID NO: 680841 - DNA, 25 bp, Mus musculus
gccagggctagtggtctgcacacat

SEQ ID NO: 680842 - DNA, 25 bp, Mus musculus
gccagggctttgaccgacacttgtt

SEQ ID NO: 680843 - DNA, 25 bp, Mus musculus
gccagggctttgtccgacacttgtt

SEQ ID NO: 680844 - DNA, 25 bp, Mus musculus
gccagggtcgaacatcagcaaacaa

SEQ ID NO: 680845 - DNA, 25 bp, Mus musculus
gccagggtcgaagatcagcaaacaa

SEQ ID NO: 680846 - DNA, 25 bp, Mus musculus
gccagggtctctcgtctgacttcaa

SEQ ID NO: 680847 - DNA, 25 bp, Mus musculus
gccagggtctctggtctgacttcaa

SEQ ID NO: 680848 - DNA, 25 bp, Mus musculus
gccagggtgagaaaactatcggact

SEQ ID NO: 680849 - DNA, 25 bp, Mus musculus
gccagggtgagataactatcggact

SEQ ID NO: 680850 - DNA, 25 bp, Mus musculus
gccagggtgcaacaacgtctgctat

SEQ ID NO: 680851 - DNA, 25 bp, Mus musculus
gccagggtgcaagaacgtctgctat

SEQ ID NO: 680852 - DNA, 25 bp, Mus musculus
gccaggtacggcagaaacaccggaa

SEQ ID NO: 680853 - DNA, 25 bp, Mus musculus
gccaggtacggctgaaacaccggaa

SEQ ID NO: 680854 - DNA, 25 bp, Mus musculus
gccaggtactgaagaaggttgccca

SEQ ID NO: 680855 - DNA, 25 bp, Mus musculus
gccaggtactgatgaaggttgccca

SEQ ID NO: 680856 - DNA, 25 bp, Mus musculus
gccaggtcagctcatacagaaatgg

SEQ ID NO: 680857 - DNA, 25 bp, Mus musculus
gccaggtcagctgatacagaaatgg

SEQ ID NO: 680858 - DNA, 25 bp, Mus musculus
gccaggtcaggccattttcctgggt

SEQ ID NO: 680859 - DNA, 25 bp, Mus musculus
gccaggtcaggcgattttcctgggt

SEQ ID NO: 680860 - DNA, 25 bp, Mus musculus
gccaggtcgcacagagacatctcat

SEQ ID NO: 680861 - DNA, 25 bp, Mus musculus
gccaggtcgcactgagacatctcat

SEQ ID NO: 680862 - DNA, 25 bp, Mus musculus
gccaggtgagcaaggcctgctgaat

SEQ ID NO: 680863 - DNA, 25 bp, Mus musculus
gccaggtgagcatggcctgctgaat

SEQ ID NO: 680864 - DNA, 25 bp, Mus musculus
gccaggtgatcccagtccttcctga

SEQ ID NO: 680865 - DNA, 25 bp, Mus musculus
gccaggtgatccgagtccttcctga

SEQ ID NO: 680866 - DNA, 25 bp, Mus musculus
gccaggtgcttactattcctcagtc

SEQ ID NO: 680867 - DNA, 25 bp, Mus musculus
gccaggtgcttagtattcctcagtc

SEQ ID NO: 680868 - DNA, 25 bp, Mus musculus
gccaggtgctttccggatggaaccc

SEQ ID NO: 680869 - DNA, 25 bp, Mus musculus
gccaggtgctttgcggatggaaccc

SEQ ID NO: 680870 - DNA, 25 bp, Mus musculus
gccaggtggtggacttctaccagcc

SEQ ID NO: 680871 - DNA, 25 bp, Mus musculus
gccaggtggtggtcttctaccagcc

SEQ ID NO: 680872 - DNA, 25 bp, Mus musculus
gccaggtgtggcattttcagtcgac

SEQ ID NO: 680873 - DNA, 25 bp, Mus musculus
gccaggtgtggctttttcagtcgac

SEQ ID NO: 680874 - DNA, 25 bp, Mus musculus
gccaggtgtgtaccccttttgatca

SEQ ID NO: 680875 - DNA, 25 bp, Mus musculus
gccaggtgtgtagcccttttgatca

SEQ ID NO: 680876 - DNA, 25 bp, Mus musculus
gccaggtgtttgatttgtctgagaa

SEQ ID NO: 680877 - DNA, 25 bp, Mus musculus
gccaggtgtttgttttgtctgagaa

SEQ ID NO: 680878 - DNA, 25 bp, Mus musculus
gccaggttcccacggtgcatgaaag

SEQ ID NO: 680879 - DNA, 25 bp, Mus musculus
gccaggttcccagggtgcatgaaag

SEQ ID NO: 680880 - DNA, 25 bp, Mus musculus
gccaggttccttccaatgctacaag

SEQ ID NO: 680881 - DNA, 25 bp, Mus musculus
gccaggttccttgcaatgctacaag

SEQ ID NO: 680882 - DNA, 25 bp, Mus musculus
gccaggttctacaggtcaaggaaaa

SEQ ID NO: 680883 - DNA, 25 bp, Mus musculus
gccaggttctactggtcaaggaaaa

SEQ ID NO: 680884 - DNA, 25 bp, Mus musculus
gccaggtttcctccagaaggcgatc

SEQ ID NO: 680885 - DNA, 25 bp, Mus musculus
gccaggtttcctgcagaaggcgatc

SEQ ID NO: 680886 - DNA, 25 bp, Mus musculus
gccaggtttgccaggaaaagcaggt

SEQ ID NO: 680887 - DNA, 25 bp, Mus musculus
gccaggtttgcctggaaaagcaggt

SEQ ID NO: 680888 - DNA, 25 bp, Mus musculus
gccaggttttctcggctttttcctg

SEQ ID NO: 680889 - DNA, 25 bp, Mus musculus
gccaggttttctgggctttttcctg

SEQ ID NO: 680890 - DNA, 25 bp, Mus musculus
gccagtaactaaaatggcattctgc

SEQ ID NO: 680891 - DNA, 25 bp, Mus musculus
gccagtaactaatatggcattctgc

SEQ ID NO: 680892 - DNA, 25 bp, Mus musculus
gccagtaagagcaccacaggtatat

SEQ ID NO: 680893 - DNA, 25 bp, Mus musculus
gccagtaagagctccacaggtatat

SEQ ID NO: 680894 - DNA, 25 bp, Mus musculus
gccagtaatcttcaagccagacctc

SEQ ID NO: 680895 - DNA, 25 bp, Mus musculus
gccagtaatcttgaagccagacctc

SEQ ID NO: 680896 - DNA, 25 bp, Mus musculus
gccagtaccgagaccctggtgctta

SEQ ID NO: 680897 - DNA, 25 bp, Mus musculus
gccagtaccgagtccctggtgctta

SEQ ID NO: 680898 - DNA, 25 bp, Mus musculus
gccagtactcgcatctctgatggtt

SEQ ID NO: 680899 - DNA, 25 bp, Mus musculus
gccagtactcgcttctctgatggtt

SEQ ID NO: 680900 - DNA, 25 bp, Mus musculus
gccagtatccgcatggcgagccgat

SEQ ID NO: 680901 - DNA, 25 bp, Mus musculus
gccagtatccgcttggcgagccgat

SEQ ID NO: 680902 - DNA, 25 bp, Mus musculus
gccagtatggaaaccctgaaccatg

SEQ ID NO: 680903 - DNA, 25 bp, Mus musculus
gccagtatggaatccctgaaccatg

SEQ ID NO: 680904 - DNA, 25 bp, Mus musculus
gccagtattgggagacttcagctac

SEQ ID NO: 680905 - DNA, 25 bp, Mus musculus
gccagtattgggtgacttcagctac

SEQ ID NO: 680906 - DNA, 25 bp, Mus musculus
gccagtcaaatgcacagcgcctgaa

SEQ ID NO: 680907 - DNA, 25 bp, Mus musculus
gccagtcaaatggacagcgcctgaa

SEQ ID NO: 680908 - DNA, 25 bp, Mus musculus
gccagtcacacacagccctttggat

SEQ ID NO: 680909 - DNA, 25 bp, Mus musculus
gccagtcacacagagccctttggat

SEQ ID NO: 680910 - DNA, 25 bp, Mus musculus
gccagtcagtaacaagatgagttct

SEQ ID NO: 680911 - DNA, 25 bp, Mus musculus
gccagtcagtaagaagatgagttct

SEQ ID NO: 680912 - DNA, 25 bp, Mus musculus
gccagtccactcacagggatagcag

SEQ ID NO: 680913 - DNA, 25 bp, Mus musculus
gccagtccactctcagggatagcag

SEQ ID NO: 680914 - DNA, 25 bp, Mus musculus
gccagtcccctgactccgggtaaag

SEQ ID NO: 680915 - DNA, 25 bp, Mus musculus
gccagtcccctgtctccgggtaaag

SEQ ID NO: 680916 - DNA, 25 bp, Mus musculus
gccagtccctggatcagcatgtaga

SEQ ID NO: 680917 - DNA, 25 bp, Mus musculus
gccagtccctggttcagcatgtaga

SEQ ID NO: 680918 - DNA, 25 bp, Mus musculus
gccagtcctagacgccacctatgga

SEQ ID NO: 680919 - DNA, 25 bp, Mus musculus
gccagtcctagaggccacctatgga

SEQ ID NO: 680920 - DNA, 25 bp, Mus musculus
gccagtcgaagcagatgtactttga

SEQ ID NO: 680921 - DNA, 25 bp, Mus musculus
gccagtcgaagctgatgtactttga

SEQ ID NO: 680922 - DNA, 25 bp, Mus musculus
gccagtcggcagcaaaggttcaaca

SEQ ID NO: 680923 - DNA, 25 bp, Mus musculus
gccagtcggcaggaaaggttcaaca

SEQ ID NO: 680924 - DNA, 25 bp, Mus musculus
gccagtctaattcaagccaacggag

SEQ ID NO: 680925 - DNA, 25 bp, Mus musculus
gccagtctaattgaagccaacggag

SEQ ID NO: 680926 - DNA, 25 bp, Mus musculus
gccagtctgaccaagctgcacagag

SEQ ID NO: 680927 - DNA, 25 bp, Mus musculus
gccagtctgacctagctgcacagag

SEQ ID NO: 680928 - DNA, 25 bp, Mus musculus
gccagtctggccaccgtgcaggcct

SEQ ID NO: 680929 - DNA, 25 bp, Mus musculus
gccagtctggcctccgtgcaggcct

SEQ ID NO: 680930 - DNA, 25 bp, Mus musculus
gccagtgaagaacaatatgggccga

SEQ ID NO: 680931 - DNA, 25 bp, Mus musculus
gccagtgaagaagaatatgggccga

SEQ ID NO: 680932 - DNA, 25 bp, Mus musculus
gccagtgataaacctgggacacacc

SEQ ID NO: 680933 - DNA, 25 bp, Mus musculus
gccagtgataaagctgggacacacc

SEQ ID NO: 680934 - DNA, 25 bp, Mus musculus
gccagtgatattcctaagtcattac

SEQ ID NO: 680935 - DNA, 25 bp, Mus musculus
gccagtgatattgctaagtcattac

SEQ ID NO: 680936 - DNA, 25 bp, Mus musculus
gccagtgatgagatcgcccagcatg

SEQ ID NO: 680937 - DNA, 25 bp, Mus musculus
gccagtgatgagttcgcccagcatg

SEQ ID NO: 680938 - DNA, 25 bp, Mus musculus
gccagtgccgaacaggtctttacta

SEQ ID NO: 680939 - DNA, 25 bp, Mus musculus
gccagtgccgaagaggtctttacta

SEQ ID NO: 680940 - DNA, 25 bp, Mus musculus
gccagtgctggcagacaggagataa

SEQ ID NO: 680941 - DNA, 25 bp, Mus musculus
gccagtgctggctgacaggagataa

SEQ ID NO: 680942 - DNA, 25 bp, Mus musculus
gccagtggagccaagtgtatggaaa

SEQ ID NO: 680943 - DNA, 25 bp, Mus musculus
gccagtggagcctagtgtatggaaa

SEQ ID NO: 680944 - DNA, 25 bp, Mus musculus
gccagtggattaagagtatcgagaa

SEQ ID NO: 680945 - DNA, 25 bp, Mus musculus
gccagtggattatgagtatcgagaa

SEQ ID NO: 680946 - DNA, 25 bp, Mus musculus
gccagtggccgactatttcctgtga

SEQ ID NO: 680947 - DNA, 25 bp, Mus musculus
gccagtggccgagtatttcctgtga

SEQ ID NO: 680948 - DNA, 25 bp, Mus musculus
gccagtggccttccaacctacgtag

SEQ ID NO: 680949 - DNA, 25 bp, Mus musculus
gccagtggccttgcaacctacgtag

SEQ ID NO: 680950 - DNA, 25 bp, Mus musculus
gccagtggctctcaggactgcacag

SEQ ID NO: 680951 - DNA, 25 bp, Mus musculus
gccagtggctctgaggactgcacag

SEQ ID NO: 680952 - DNA, 25 bp, Mus musculus
gccagtggcttacaagtgttggatc

SEQ ID NO: 680953 - DNA, 25 bp, Mus musculus
gccagtggcttagaagtgttggatc

SEQ ID NO: 680954 - DNA, 25 bp, Mus musculus
gccagtggcttgctggaagacaaat

SEQ ID NO: 680955 - DNA, 25 bp, Mus musculus
gccagtggcttggtggaagacaaat

SEQ ID NO: 680956 - DNA, 25 bp, Mus musculus
gccagtggctttagagcatggtgcc

SEQ ID NO: 680957 - DNA, 25 bp, Mus musculus
gccagtggcttttgagcatggtgcc

SEQ ID NO: 680958 - DNA, 25 bp, Mus musculus
gccagtgggacaagatgaggcccca

SEQ ID NO: 680959 - DNA, 25 bp, Mus musculus
gccagtgggacatgatgaggcccca

SEQ ID NO: 680960 - DNA, 25 bp, Mus musculus
gccagtgggcgcaagtgtctcttca

SEQ ID NO: 680961 - DNA, 25 bp, Mus musculus
gccagtgggcgctagtgtctcttca

SEQ ID NO: 680962 - DNA, 25 bp, Mus musculus
gccagtggtatgcaaatgcacaaca

SEQ ID NO: 680963 - DNA, 25 bp, Mus musculus
gccagtggtatggaaatgcacaaca

SEQ ID NO: 680964 - DNA, 25 bp, Mus musculus
gccagtggtctcagggtgataataa

SEQ ID NO: 680965 - DNA, 25 bp, Mus musculus
gccagtggtctctgggtgataataa

SEQ ID NO: 680966 - DNA, 25 bp, Mus musculus
gccagtggtgatcccaagactgacc

SEQ ID NO: 680967 - DNA, 25 bp, Mus musculus
gccagtggtgatgccaagactgacc

SEQ ID NO: 680968 - DNA, 25 bp, Mus musculus
gccagtggtgtcaaacccagcacaa

SEQ ID NO: 680969 - DNA, 25 bp, Mus musculus
gccagtggtgtctaacccagcacaa

SEQ ID NO: 680970 - DNA, 25 bp, Mus musculus
gccagtgtccttccatgagcgaggt

SEQ ID NO: 680971 - DNA, 25 bp, Mus musculus
gccagtgtccttgcatgagcgaggt

SEQ ID NO: 680972 - DNA, 25 bp, Mus musculus
gccagtgtcgggacagctgtcagca

SEQ ID NO: 680973 - DNA, 25 bp, Mus musculus
gccagtgtcgggtcagctgtcagca

SEQ ID NO: 680974 - DNA, 25 bp, Mus musculus
gccagtgtcttccttttgtatgcca

SEQ ID NO: 680975 - DNA, 25 bp, Mus musculus
gccagtgtcttcgttttgtatgcca

SEQ ID NO: 680976 - DNA, 25 bp, Mus musculus
gccagtgtgtctatgcaatcgccac

SEQ ID NO: 680977 - DNA, 25 bp, Mus musculus
gccagtgtgtctttgcaatcgccac

SEQ ID NO: 680978 - DNA, 25 bp, Mus musculus
gccagtgttgtgctctccttcttcc

SEQ ID NO: 680979 - DNA, 25 bp, Mus musculus
gccagtgttgtggtctccttcttcc

SEQ ID NO: 680980 - DNA, 25 bp, Mus musculus
gccagttacaagaacctcacactga

SEQ ID NO: 680981 - DNA, 25 bp, Mus musculus
gccagttacaagtacctcacactga

SEQ ID NO: 680982 - DNA, 25 bp, Mus musculus
gccagttacactaagattgtcgtga

SEQ ID NO: 680983 - DNA, 25 bp, Mus musculus
gccagttacacttagattgtcgtga

SEQ ID NO: 680984 - DNA, 25 bp, Mus musculus
gccagttagaccatatcaacatgaa

SEQ ID NO: 680985 - DNA, 25 bp, Mus musculus
gccagttagaccttatcaacatgaa

SEQ ID NO: 680986 - DNA, 25 bp, Mus musculus
gccagttcaactcaatcgaagatga

SEQ ID NO: 680987 - DNA, 25 bp, Mus musculus
gccagttcaactgaatcgaagatga

SEQ ID NO: 680988 - DNA, 25 bp, Mus musculus
gccagttcacttactgatcctgtgg

SEQ ID NO: 680989 - DNA, 25 bp, Mus musculus
gccagttcactttctgatcctgtgg

SEQ ID NO: 680990 - DNA, 25 bp, Mus musculus
gccagttcagggagatgcacaccca

SEQ ID NO: 680991 - DNA, 25 bp, Mus musculus
gccagttcagggtgatgcacaccca

SEQ ID NO: 680992 - DNA, 25 bp, Mus musculus
gccagttcagtaccctgcagctggt

SEQ ID NO: 680993 - DNA, 25 bp, Mus musculus
gccagttcagtagcctgcagctggt

SEQ ID NO: 680994 - DNA, 25 bp, Mus musculus
gccagttccaggcacggagctactt

SEQ ID NO: 680995 - DNA, 25 bp, Mus musculus
gccagttccagggacggagctactt

SEQ ID NO: 680996 - DNA, 25 bp, Mus musculus
gccagttccgggatgactcgtcgaa

SEQ ID NO: 680997 - DNA, 25 bp, Mus musculus
gccagttccgggttgactcgtcgaa

SEQ ID NO: 680998 - DNA, 25 bp, Mus musculus
gccagttcgcgtcgactgaccagag

SEQ ID NO: 680999 - DNA, 25 bp, Mus musculus
gccagttcgcgtggactgaccagag

SEQ ID NO: 681000 - DNA, 25 bp, Mus musculus
gccagttgctgacccagaaacatgt

SEQ ID NO: 681001 - DNA, 25 bp, Mus musculus
gccagttgctgagccagaaacatgt

SEQ ID NO: 681002 - DNA, 25 bp, Mus musculus
gccagttggaccctaactcaatgta

SEQ ID NO: 681003 - DNA, 25 bp, Mus musculus
gccagttggaccgtaactcaatgta

SEQ ID NO: 681004 - DNA, 25 bp, Mus musculus
gccagttgtcccagctcataaagat

SEQ ID NO: 681005 - DNA, 25 bp, Mus musculus
gccagttgtccctgctcataaagat

SEQ ID NO: 681006 - DNA, 25 bp, Mus musculus
gccagtttactgacagctcattcag

SEQ ID NO: 681007 - DNA, 25 bp, Mus musculus
gccagtttactgtcagctcattcag

SEQ ID NO: 681008 - DNA, 25 bp, Mus musculus
gccagtttcagaacacgctgtacat

SEQ ID NO: 681009 - DNA, 25 bp, Mus musculus
gccagtttcagatcacgctgtacat

SEQ ID NO: 681010 - DNA, 25 bp, Mus musculus
gccagtttcagcatttcaggactgt

SEQ ID NO: 681011 - DNA, 25 bp, Mus musculus
gccagtttcagcttttcaggactgt

SEQ ID NO: 681012 - DNA, 25 bp, Mus musculus
gccagtttcccccaagctgtggtgg

SEQ ID NO: 681013 - DNA, 25 bp, Mus musculus
gccagtttccccgaagctgtggtgg

SEQ ID NO: 681014 - DNA, 25 bp, Mus musculus
gccagtttggacattagcttccaca

SEQ ID NO: 681015 - DNA, 25 bp, Mus musculus
gccagtttggactttagcttccaca

SEQ ID NO: 681016 - DNA, 25 bp, Mus musculus
gccagtttgtggcttggaacattat

SEQ ID NO: 681017 - DNA, 25 bp, Mus musculus
gccagtttgtgggttggaacattat

SEQ ID NO: 681018 - DNA, 25 bp, Mus musculus
gccagttttctgacttatactgagg

SEQ ID NO: 681019 - DNA, 25 bp, Mus musculus
gccagttttctgtcttatactgagg

SEQ ID NO: 681020 - DNA, 25 bp, Mus musculus
gccataaacgctctgcatccaaagt

SEQ ID NO: 681021 - DNA, 25 bp, Mus musculus
gccataaacgctgtgcatccaaagt

SEQ ID NO: 681022 - DNA, 25 bp, Mus musculus
gccataaatttcataaatgaccgtg

SEQ ID NO: 681023 - DNA, 25 bp, Mus musculus
gccataaatttcttaaatgaccgtg

SEQ ID NO: 681024 - DNA, 25 bp, Mus musculus
gccataactgcacgagactccatgg

SEQ ID NO: 681025 - DNA, 25 bp, Mus musculus
gccataactgcaggagactccatgg

SEQ ID NO: 681026 - DNA, 25 bp, Mus musculus
gccataagcttgactccctggtctt

SEQ ID NO: 681027 - DNA, 25 bp, Mus musculus
gccataagcttgtctccctggtctt

SEQ ID NO: 681028 - DNA, 25 bp, Mus musculus
gccataaggcaacatcctactcgga

SEQ ID NO: 681029 - DNA, 25 bp, Mus musculus
gccataaggcaagatcctactcgga

SEQ ID NO: 681030 - DNA, 25 bp, Mus musculus
gccataaggttgatggagatgtcga

SEQ ID NO: 681031 - DNA, 25 bp, Mus musculus
gccataaggttgttggagatgtcga

SEQ ID NO: 681032 - DNA, 25 bp, Mus musculus
gccataagtattcgagagcctctcc

SEQ ID NO: 681033 - DNA, 25 bp, Mus musculus
gccataagtattggagagcctctcc

SEQ ID NO: 681034 - DNA, 25 bp, Mus musculus
gccataattagtcacagccatgact

SEQ ID NO: 681035 - DNA, 25 bp, Mus musculus
gccataattagtgacagccatgact

SEQ ID NO: 681036 - DNA, 25 bp, Mus musculus
gccatacacagaagacggcctggaa

SEQ ID NO: 681037 - DNA, 25 bp, Mus musculus
gccatacacagatgacggcctggaa

SEQ ID NO: 681038 - DNA, 25 bp, Mus musculus
gccataccatcgagatggcatctcg

SEQ ID NO: 681039 - DNA, 25 bp, Mus musculus
gccataccatcgtgatggcatctcg

SEQ ID NO: 681040 - DNA, 25 bp, Mus musculus
gccatactcactccactgctgaaag

SEQ ID NO: 681041 - DNA, 25 bp, Mus musculus
gccatactcactgcactgctgaaag

SEQ ID NO: 681042 - DNA, 25 bp, Mus musculus
gccatactggggcttggcttaccca

SEQ ID NO: 681043 - DNA, 25 bp, Mus musculus
gccatactgggggttggcttaccca

SEQ ID NO: 681044 - DNA, 25 bp, Mus musculus
gccatactgtttcttccaatgtctg

SEQ ID NO: 681045 - DNA, 25 bp, Mus musculus
gccatactgtttgttccaatgtctg

SEQ ID NO: 681046 - DNA, 25 bp, Mus musculus
gccatagaattaaatacagaagctg

SEQ ID NO: 681047 - DNA, 25 bp, Mus musculus
gccatagaattatatacagaagctg

SEQ ID NO: 681048 - DNA, 25 bp, Mus musculus
gccatagagatgatggatcagatca

SEQ ID NO: 681049 - DNA, 25 bp, Mus musculus
gccatagagatgttggatcagatca

SEQ ID NO: 681050 - DNA, 25 bp, Mus musculus
gccatagaggaaccggcggaaccct

SEQ ID NO: 681051 - DNA, 25 bp, Mus musculus
gccatagaggaagcggcggaaccct

SEQ ID NO: 681052 - DNA, 25 bp, Mus musculus
gccatagaggccatcaacgagacca

SEQ ID NO: 681053 - DNA, 25 bp, Mus musculus
gccatagaggccttcaacgagacca

SEQ ID NO: 681054 - DNA, 25 bp, Mus musculus
gccatagagtttctactgcacagac

SEQ ID NO: 681055 - DNA, 25 bp, Mus musculus
gccatagagtttgtactgcacagac

SEQ ID NO: 681056 - DNA, 25 bp, Mus musculus
gccatagcaaatcccgaggcagtat

SEQ ID NO: 681057 - DNA, 25 bp, Mus musculus
gccatagcaaatgccgaggcagtat

SEQ ID NO: 681058 - DNA, 25 bp, Mus musculus
gccatagcgaacatggaaccctcgg

SEQ ID NO: 681059 - DNA, 25 bp, Mus musculus
gccatagcgaacttggaaccctcgg

SEQ ID NO: 681060 - DNA, 25 bp, Mus musculus
gccatatatgtcctgaaggacaggt

SEQ ID NO: 681061 - DNA, 25 bp, Mus musculus
gccatatatgtcgtgaaggacaggt

SEQ ID NO: 681062 - DNA, 25 bp, Mus musculus
gccatatcagagcaattggttcaga

SEQ ID NO: 681063 - DNA, 25 bp, Mus musculus
gccatatcagaggaattggttcaga

SEQ ID NO: 681064 - DNA, 25 bp, Mus musculus
gccatatccagcctgggatgccaga

SEQ ID NO: 681065 - DNA, 25 bp, Mus musculus
gccatatccagcgtgggatgccaga

SEQ ID NO: 681066 - DNA, 25 bp, Mus musculus
gccatatccttccaggtgatgctcc

SEQ ID NO: 681067 - DNA, 25 bp, Mus musculus
gccatatccttcgaggtgatgctcc

SEQ ID NO: 681068 - DNA, 25 bp, Mus musculus
gccatatctctacgaatttgtcaaa

SEQ ID NO: 681069 - DNA, 25 bp, Mus musculus
gccatatctctaggaatttgtcaaa

SEQ ID NO: 681070 - DNA, 25 bp, Mus musculus
gccatatctgcactgacaacgtgaa

SEQ ID NO: 681071 - DNA, 25 bp, Mus musculus
gccatatctgcagtgacaacgtgaa

SEQ ID NO: 681072 - DNA, 25 bp, Mus musculus
gccatatgaacaaactaaagctgcc

SEQ ID NO: 681073 - DNA, 25 bp, Mus musculus
gccatatgaacatactaaagctgcc

SEQ ID NO: 681074 - DNA, 25 bp, Mus musculus
gccatatgcaccatctccgtgggct

SEQ ID NO: 681075 - DNA, 25 bp, Mus musculus
gccatatgcaccttctccgtgggct

SEQ ID NO: 681076 - DNA, 25 bp, Mus musculus
gccatatggtgaataagacgaaaat

SEQ ID NO: 681077 - DNA, 25 bp, Mus musculus
gccatatggtgattaagacgaaaat

SEQ ID NO: 681078 - DNA, 25 bp, Mus musculus
gccatatgttgtagtgagacgagac

SEQ ID NO: 681079 - DNA, 25 bp, Mus musculus
gccatatgttgttgtgagacgagac

SEQ ID NO: 681080 - DNA, 25 bp, Mus musculus
gccatattaagtatggagttcttca

SEQ ID NO: 681081 - DNA, 25 bp, Mus musculus
gccatattaagtttggagttcttca

SEQ ID NO: 681082 - DNA, 25 bp, Mus musculus
gccatattctaaaaaatgaagcatc

SEQ ID NO: 681083 - DNA, 25 bp, Mus musculus
gccatattctaataaatgaagcatc

SEQ ID NO: 681084 - DNA, 25 bp, Mus musculus
gccatatttaatatctttgctgtaa

SEQ ID NO: 681085 - DNA, 25 bp, Mus musculus
gccatatttaatttctttgctgtaa

SEQ ID NO: 681086 - DNA, 25 bp, Mus musculus
gccatattttccagtattgtcacct

SEQ ID NO: 681087 - DNA, 25 bp, Mus musculus
gccatattttcctgtattgtcacct

SEQ ID NO: 681088 - DNA, 25 bp, Mus musculus
gccatcaaggttatggacgtcaccg

SEQ ID NO: 681089 - DNA, 25 bp, Mus musculus
gccatcaaggttttggacgtcaccg

SEQ ID NO: 681090 - DNA, 25 bp, Mus musculus
gccatcaagttcctaaccaaggaag

SEQ ID NO: 681091 - DNA, 25 bp, Mus musculus
gccatcaagttcgtaaccaaggaag

SEQ ID NO: 681092 - DNA, 25 bp, Mus musculus
gccatcacaggtatgtccacctctg

SEQ ID NO: 681093 - DNA, 25 bp, Mus musculus
gccatcacaggtttgtccacctctg

SEQ ID NO: 681094 - DNA, 25 bp, Mus musculus
gccatcacatttctgtcagatgaga

SEQ ID NO: 681095 - DNA, 25 bp, Mus musculus
gccatcacatttgtgtcagatgaga

SEQ ID NO: 681096 - DNA, 25 bp, Mus musculus
gccatcacctacatagtgaacaaag

SEQ ID NO: 681097 - DNA, 25 bp, Mus musculus
gccatcacctacttagtgaacaaag

SEQ ID NO: 681098 - DNA, 25 bp, Mus musculus
gccatcacgggacattttgctctgg

SEQ ID NO: 681099 - DNA, 25 bp, Mus musculus
gccatcacgggagattttgctctgg

SEQ ID NO: 681100 - DNA, 25 bp, Mus musculus
gccatcactctcaacagcatggatg

SEQ ID NO: 681101 - DNA, 25 bp, Mus musculus
gccatcactctctacagcatggatg

SEQ ID NO: 681102 - DNA, 25 bp, Mus musculus
gccatcagacacaggtaagttggag

SEQ ID NO: 681103 - DNA, 25 bp, Mus musculus
gccatcagacactggtaagttggag

SEQ ID NO: 681104 - DNA, 25 bp, Mus musculus
gccatcagagggaaactgtaaatcc

SEQ ID NO: 681105 - DNA, 25 bp, Mus musculus
gccatcagagggtaactgtaaatcc

SEQ ID NO: 681106 - DNA, 25 bp, Mus musculus
gccatcagccaactcatctgatgtc

SEQ ID NO: 681107 - DNA, 25 bp, Mus musculus
gccatcagccaagtcatctgatgtc

SEQ ID NO: 681108 - DNA, 25 bp, Mus musculus
gccatcagctctcggacgtggagtc

SEQ ID NO: 681109 - DNA, 25 bp, Mus musculus
gccatcagctctgggacgtggagtc

SEQ ID NO: 681110 - DNA, 25 bp, Mus musculus
gccatcagggcaaagaacttgtcca

SEQ ID NO: 681111 - DNA, 25 bp, Mus musculus
gccatcagggcatagaacttgtcca

SEQ ID NO: 681112 - DNA, 25 bp, Mus musculus
gccatcagggtcctggatgtcaatg

SEQ ID NO: 681113 - DNA, 25 bp, Mus musculus
gccatcagggtcgtggatgtcaatg

SEQ ID NO: 681114 - DNA, 25 bp, Mus musculus
gccatcagtatgacgggcttgtaga

SEQ ID NO: 681115 - DNA, 25 bp, Mus musculus
gccatcagtatgtcgggcttgtaga

SEQ ID NO: 681116 - DNA, 25 bp, Mus musculus
gccatcagtgctctctgtcacaagt

SEQ ID NO: 681117 - DNA, 25 bp, Mus musculus
gccatcagtgctgtctgtcacaagt

SEQ ID NO: 681118 - DNA, 25 bp, Mus musculus
gccatcagtttgctgtgtgaagctg

SEQ ID NO: 681119 - DNA, 25 bp, Mus musculus
gccatcagtttggtgtgtgaagctg

SEQ ID NO: 681120 - DNA, 25 bp, Mus musculus
gccatcatcgatcagtggatctgcg

SEQ ID NO: 681121 - DNA, 25 bp, Mus musculus
gccatcatcgatgagtggatctgcg

SEQ ID NO: 681122 - DNA, 25 bp, Mus musculus
gccatcatctgcctgtggaagaaag

SEQ ID NO: 681123 - DNA, 25 bp, Mus musculus
gccatcatctgcgtgtggaagaaag

SEQ ID NO: 681124 - DNA, 25 bp, Mus musculus
gccatcatgagcagaagcaaacgtg

SEQ ID NO: 681125 - DNA, 25 bp, Mus musculus
gccatcatgagctgaagcaaacgtg

SEQ ID NO: 681126 - DNA, 25 bp, Mus musculus
gccatcatgattctgaggagggcca

SEQ ID NO: 681127 - DNA, 25 bp, Mus musculus
gccatcatgattgtgaggagggcca

SEQ ID NO: 681128 - DNA, 25 bp, Mus musculus
gccatcattcgtcggcccgagcgat

SEQ ID NO: 681129 - DNA, 25 bp, Mus musculus
gccatcattcgtgggcccgagcgat

SEQ ID NO: 681130 - DNA, 25 bp, Mus musculus
gccatcattgccaagaccttcaagg

SEQ ID NO: 681131 - DNA, 25 bp, Mus musculus
gccatcattgcctagaccttcaagg

SEQ ID NO: 681132 - DNA, 25 bp, Mus musculus
gccatcattggcaagtttcagttca

SEQ ID NO: 681133 - DNA, 25 bp, Mus musculus
gccatcattggctagtttcagttca

SEQ ID NO: 681134 - DNA, 25 bp, Mus musculus
gccatccaaaaacaccgtgggagtg

SEQ ID NO: 681135 - DNA, 25 bp, Mus musculus
gccatccaaaaagaccgtgggagtg

SEQ ID NO: 681136 - DNA, 25 bp, Mus musculus
gccatccacaagaaatgcattgaca

SEQ ID NO: 681137 - DNA, 25 bp, Mus musculus
gccatccacaagtaatgcattgaca

SEQ ID NO: 681138 - DNA, 25 bp, Mus musculus
gccatccaggcacaggaaatcatga

SEQ ID NO: 681139 - DNA, 25 bp, Mus musculus
gccatccaggcagaggaaatcatga

SEQ ID NO: 681140 - DNA, 25 bp, Mus musculus
gccatccatttaaagcagtcggcca

SEQ ID NO: 681141 - DNA, 25 bp, Mus musculus
gccatccatttatagcagtcggcca

SEQ ID NO: 681142 - DNA, 25 bp, Mus musculus
gccatcccaatgaagatccgaaatg

SEQ ID NO: 681143 - DNA, 25 bp, Mus musculus
gccatcccaatgtagatccgaaatg

SEQ ID NO: 681144 - DNA, 25 bp, Mus musculus
gccatccccaggatagaggcacagg

SEQ ID NO: 681145 - DNA, 25 bp, Mus musculus
gccatccccaggttagaggcacagg

SEQ ID NO: 681146 - DNA, 25 bp, Mus musculus
gccatcccttatccaagatcacagg

SEQ ID NO: 681147 - DNA, 25 bp, Mus musculus
gccatcccttatgcaagatcacagg

SEQ ID NO: 681148 - DNA, 25 bp, Mus musculus
gccatccggaccagaaaaagccagg

SEQ ID NO: 681149 - DNA, 25 bp, Mus musculus
gccatccggacctgaaaaagccagg

SEQ ID NO: 681150 - DNA, 25 bp, Mus musculus
gccatcctcatgcatgaacttcagg

SEQ ID NO: 681151 - DNA, 25 bp, Mus musculus
gccatcctcatggatgaacttcagg

SEQ ID NO: 681152 - DNA, 25 bp, Mus musculus
gccatcctgagtatcccacttgact

SEQ ID NO: 681153 - DNA, 25 bp, Mus musculus
gccatcctgagtttcccacttgact

SEQ ID NO: 681154 - DNA, 25 bp, Mus musculus
gccatcctggatcatacctacagca

SEQ ID NO: 681155 - DNA, 25 bp, Mus musculus
gccatcctggatgatacctacagca

SEQ ID NO: 681156 - DNA, 25 bp, Mus musculus
gccatcctggccatagtggtcctta

SEQ ID NO: 681157 - DNA, 25 bp, Mus musculus
gccatcctggccttagtggtcctta

SEQ ID NO: 681158 - DNA, 25 bp, Mus musculus
gccatccttattaatagaatcgaga

SEQ ID NO: 681159 - DNA, 25 bp, Mus musculus
gccatccttatttatagaatcgaga

SEQ ID NO: 681160 - DNA, 25 bp, Mus musculus
gccatccttcgccttaatctcaggg

SEQ ID NO: 681161 - DNA, 25 bp, Mus musculus
gccatccttcgcgttaatctcaggg

SEQ ID NO: 681162 - DNA, 25 bp, Mus musculus
gccatccttgctatactgttgggca

SEQ ID NO: 681163 - DNA, 25 bp, Mus musculus
gccatccttgctttactgttgggca

SEQ ID NO: 681164 - DNA, 25 bp, Mus musculus
gccatccttggtagaagccttttga

SEQ ID NO: 681165 - DNA, 25 bp, Mus musculus
gccatccttggttgaagccttttga

SEQ ID NO: 681166 - DNA, 25 bp, Mus musculus
gccatccttgtcctggacctaaggg

SEQ ID NO: 681167 - DNA, 25 bp, Mus musculus
gccatccttgtcgtggacctaaggg

SEQ ID NO: 681168 - DNA, 25 bp, Mus musculus
gccatcgacaatcatgagtgccagg

SEQ ID NO: 681169 - DNA, 25 bp, Mus musculus
gccatcgacaatgatgagtgccagg

SEQ ID NO: 681170 - DNA, 25 bp, Mus musculus
gccatcgccactaacggagtggtgc

SEQ ID NO: 681171 - DNA, 25 bp, Mus musculus
gccatcgccacttacggagtggtgc

SEQ ID NO: 681172 - DNA, 25 bp, Mus musculus
gccatcgcccacaatgagcaatctg

SEQ ID NO: 681173 - DNA, 25 bp, Mus musculus
gccatcgcccactatgagcaatctg

SEQ ID NO: 681174 - DNA, 25 bp, Mus musculus
gccatcggcagacgccatgacggct

SEQ ID NO: 681175 - DNA, 25 bp, Mus musculus
gccatcggcagaggccatgacggct

SEQ ID NO: 681176 - DNA, 25 bp, Mus musculus
gccatcgtaggacgaatgggctcct

SEQ ID NO: 681177 - DNA, 25 bp, Mus musculus
gccatcgtaggaggaatgggctcct

SEQ ID NO: 681178 - DNA, 25 bp, Mus musculus
gccatcgtagtgcaccctgtgcatg

SEQ ID NO: 681179 - DNA, 25 bp, Mus musculus
gccatcgtagtggaccctgtgcatg

SEQ ID NO: 681180 - DNA, 25 bp, Mus musculus
gccatcgtgactacatctttcattt

SEQ ID NO: 681181 - DNA, 25 bp, Mus musculus
gccatcgtgacttcatctttcattt

SEQ ID NO: 681182 - DNA, 25 bp, Mus musculus
gccatcgttaatcccatcgggtatt

SEQ ID NO: 681183 - DNA, 25 bp, Mus musculus
gccatcgttaatgccatcgggtatt

SEQ ID NO: 681184 - DNA, 25 bp, Mus musculus
gccatctacaacaacatgaagcagt

SEQ ID NO: 681185 - DNA, 25 bp, Mus musculus
gccatctacaactacatgaagcagt

SEQ ID NO: 681186 - DNA, 25 bp, Mus musculus
gccatctatgctcgtgtcatcaaga

SEQ ID NO: 681187 - DNA, 25 bp, Mus musculus
gccatctatgctggtgtcatcaaga

SEQ ID NO: 681188 - DNA, 25 bp, Mus musculus
gccatctatttcaaagagcagttct

SEQ ID NO: 681189 - DNA, 25 bp, Mus musculus
gccatctatttctaagagcagttct

SEQ ID NO: 681190 - DNA, 25 bp, Mus musculus
gccatctcactcagaatccatgcat

SEQ ID NO: 681191 - DNA, 25 bp, Mus musculus
gccatctcactctgaatccatgcat

SEQ ID NO: 681192 - DNA, 25 bp, Mus musculus
gccatctcatgaaaaccaaccttag

SEQ ID NO: 681193 - DNA, 25 bp, Mus musculus
gccatctcatgataaccaaccttag

SEQ ID NO: 681194 - DNA, 25 bp, Mus musculus
gccatctccgcacgatgagttcggg

SEQ ID NO: 681195 - DNA, 25 bp, Mus musculus
gccatctccgcaggatgagttcggg

SEQ ID NO: 681196 - DNA, 25 bp, Mus musculus
gccatctccgggaacatctgggccg

SEQ ID NO: 681197 - DNA, 25 bp, Mus musculus
gccatctccgggtacatctgggccg

SEQ ID NO: 681198 - DNA, 25 bp, Mus musculus
gccatctcctatcaagagtggaatg

SEQ ID NO: 681199 - DNA, 25 bp, Mus musculus
gccatctcctatgaagagtggaatg

SEQ ID NO: 681200 - DNA, 25 bp, Mus musculus
gccatctctcttaggcgcttgctgc

SEQ ID NO: 681201 - DNA, 25 bp, Mus musculus
gccatctctctttggcgcttgctgc

SEQ ID NO: 681202 - DNA, 25 bp, Mus musculus
gccatctctgacacttccatcggtg

SEQ ID NO: 681203 - DNA, 25 bp, Mus musculus
gccatctctgactcttccatcggtg

SEQ ID NO: 681204 - DNA, 25 bp, Mus musculus
gccatctctgctatggtacccagaa

SEQ ID NO: 681205 - DNA, 25 bp, Mus musculus
gccatctctgctttggtacccagaa

SEQ ID NO: 681206 - DNA, 25 bp, Mus musculus
gccatctctgtaacaggcttctgga

SEQ ID NO: 681207 - DNA, 25 bp, Mus musculus
gccatctctgtatcaggcttctgga

SEQ ID NO: 681208 - DNA, 25 bp, Mus musculus
gccatctcttctccgacatcgtttt

SEQ ID NO: 681209 - DNA, 25 bp, Mus musculus
gccatctcttctgcgacatcgtttt

SEQ ID NO: 681210 - DNA, 25 bp, Mus musculus
gccatctgaaggaggaacattaaat

SEQ ID NO: 681211 - DNA, 25 bp, Mus musculus
gccatctgaaggtggaacattaaat

SEQ ID NO: 681212 - DNA, 25 bp, Mus musculus
gccatctgcaggaaccacattatgg

SEQ ID NO: 681213 - DNA, 25 bp, Mus musculus
gccatctgcaggtaccacattatgg

SEQ ID NO: 681214 - DNA, 25 bp, Mus musculus
gccatctggaagattttctggataa

SEQ ID NO: 681215 - DNA, 25 bp, Mus musculus
gccatctggaagtttttctggataa

SEQ ID NO: 681216 - DNA, 25 bp, Mus musculus
gccatctggatgcagtaagttaaaa

SEQ ID NO: 681217 - DNA, 25 bp, Mus musculus
gccatctggatggagtaagttaaaa

SEQ ID NO: 681218 - DNA, 25 bp, Mus musculus
gccatctggcagaggaacttcagga

SEQ ID NO: 681219 - DNA, 25 bp, Mus musculus
gccatctggcagtggaacttcagga

SEQ ID NO: 681220 - DNA, 25 bp, Mus musculus
gccatctgggaacgatcctcaggaa

SEQ ID NO: 681221 - DNA, 25 bp, Mus musculus
gccatctgggaaggatcctcaggaa

SEQ ID NO: 681222 - DNA, 25 bp, Mus musculus
gccatctgtatgcttcatgttgaac

SEQ ID NO: 681223 - DNA, 25 bp, Mus musculus
gccatctgtatggttcatgttgaac

SEQ ID NO: 681224 - DNA, 25 bp, Mus musculus
gccatcttccttactttgctcctaa

SEQ ID NO: 681225 - DNA, 25 bp, Mus musculus
gccatcttccttcgttagtcgcggg

SEQ ID NO: 681226 - DNA, 25 bp, Mus musculus
gccatcttccttggttagtcgcggg

SEQ ID NO: 681227 - DNA, 25 bp, Mus musculus
gccatcttcctttctttgctcctaa

SEQ ID NO: 681228 - DNA, 25 bp, Mus musculus
gccatcttgcagctttccttactac

SEQ ID NO: 681229 - DNA, 25 bp, Mus musculus
gccatcttgcaggtttccttactac

SEQ ID NO: 681230 - DNA, 25 bp, Mus musculus
gccatcttggagaacacaagccgtg

SEQ ID NO: 681231 - DNA, 25 bp, Mus musculus
gccatcttggagtacacaagccgtg

SEQ ID NO: 681232 - DNA, 25 bp, Mus musculus
gccatcttgggcacggtgttcctgc

SEQ ID NO: 681233 - DNA, 25 bp, Mus musculus
gccatcttgggctcggtgttcctgc

SEQ ID NO: 681234 - DNA, 25 bp, Mus musculus
gccatcttgtcactcaccaaagaat

SEQ ID NO: 681235 - DNA, 25 bp, Mus musculus
gccatcttgtcagtcaccaaagaat

SEQ ID NO: 681236 - DNA, 25 bp, Mus musculus
gccatcttgtggcagcgaaaccaac

SEQ ID NO: 681237 - DNA, 25 bp, Mus musculus
gccatcttgtgggagcgaaaccaac

SEQ ID NO: 681238 - DNA, 25 bp, Mus musculus
gccatcttgttcagggcctttccca

SEQ ID NO: 681239 - DNA, 25 bp, Mus musculus
gccatcttgttctgggcctttccca

SEQ ID NO: 681240 - DNA, 25 bp, Mus musculus
gccatgaaatggcagcaggcatttt

SEQ ID NO: 681241 - DNA, 25 bp, Mus musculus
gccatgaaatgggagcaggcatttt

SEQ ID NO: 681242 - DNA, 25 bp, Mus musculus
gccatgaaccgactccaggatgact

SEQ ID NO: 681243 - DNA, 25 bp, Mus musculus
gccatgaaccgagtccaggatgact

SEQ ID NO: 681244 - DNA, 25 bp, Mus musculus
gccatgaagaagaactcaggaggtg

SEQ ID NO: 681245 - DNA, 25 bp, Mus musculus
gccatgaagaagtactcaggaggtg

SEQ ID NO: 681246 - DNA, 25 bp, Mus musculus
gccatgaagaatcggtttctggtgc

SEQ ID NO: 681247 - DNA, 25 bp, Mus musculus
gccatgaagaatgggtttctggtgc

SEQ ID NO: 681248 - DNA, 25 bp, Mus musculus
gccatgaagactacctagataactc

SEQ ID NO: 681249 - DNA, 25 bp, Mus musculus
gccatgaagacttcctagataactc

SEQ ID NO: 681250 - DNA, 25 bp, Mus musculus
gccatgaagatgctagtcactgacc

SEQ ID NO: 681251 - DNA, 25 bp, Mus musculus
gccatgaagatggtagtcactgacc

SEQ ID NO: 681252 - DNA, 25 bp, Mus musculus
gccatgaaggccatgttgatccgta

SEQ ID NO: 681253 - DNA, 25 bp, Mus musculus
gccatgaaggccttgttgatccgta

SEQ ID NO: 681254 - DNA, 25 bp, Mus musculus
gccatgaagtgccaaggataaggcc

SEQ ID NO: 681255 - DNA, 25 bp, Mus musculus
gccatgaagtgcgaaggataaggcc

SEQ ID NO: 681256 - DNA, 25 bp, Mus musculus
gccatgaccacgatgctcctagaga

SEQ ID NO: 681257 - DNA, 25 bp, Mus musculus
gccatgaccacgttgctcctagaga

SEQ ID NO: 681258 - DNA, 25 bp, Mus musculus
gccatgaccccgaccaaggagggca

SEQ ID NO: 681259 - DNA, 25 bp, Mus musculus
gccatgaccccgtccaaggagggca

SEQ ID NO: 681260 - DNA, 25 bp, Mus musculus
gccatgacgattcagatcctcctca

SEQ ID NO: 681261 - DNA, 25 bp, Mus musculus
gccatgacgattgagatcctcctca

SEQ ID NO: 681262 - DNA, 25 bp, Mus musculus
gccatgacttcacaaatgtttatta

SEQ ID NO: 681263 - DNA, 25 bp, Mus musculus
gccatgacttcagaaatgtttatta

SEQ ID NO: 681264 - DNA, 25 bp, Mus musculus
gccatgagcagaatctattaccggg

SEQ ID NO: 681265 - DNA, 25 bp, Mus musculus
gccatgagcagattctattaccggg

SEQ ID NO: 681266 - DNA, 25 bp, Mus musculus
gccatgagcagcacgagcagctggc

SEQ ID NO: 681267 - DNA, 25 bp, Mus musculus
gccatgagcagctcgagcagctggc

SEQ ID NO: 681268 - DNA, 25 bp, Mus musculus
gccatgagcggtccatcacgcagat

SEQ ID NO: 681269 - DNA, 25 bp, Mus musculus
gccatgagcggtgcatcacgcagat

SEQ ID NO: 681270 - DNA, 25 bp, Mus musculus
gccatgagctccacgcagttcaaca

SEQ ID NO: 681271 - DNA, 25 bp, Mus musculus
gccatgagctcctcgcagttcaaca

SEQ ID NO: 681272 - DNA, 25 bp, Mus musculus
gccatgaggagtaggtacgctgcat

SEQ ID NO: 681273 - DNA, 25 bp, Mus musculus
gccatgaggagttggtacgctgcat

SEQ ID NO: 681274 - DNA, 25 bp, Mus musculus
gccatgaggcaaagaaaatgctcca

SEQ ID NO: 681275 - DNA, 25 bp, Mus musculus
gccatgaggcaatgaaaatgctcca

SEQ ID NO: 681276 - DNA, 25 bp, Mus musculus
gccatgaggcttcgtatccccattt

SEQ ID NO: 681277 - DNA, 25 bp, Mus musculus
gccatgaggcttggtatccccattt

SEQ ID NO: 681278 - DNA, 25 bp, Mus musculus
gccatgaggttgcatgcctcatctt

SEQ ID NO: 681279 - DNA, 25 bp, Mus musculus
gccatgaggttggatgcctcatctt

SEQ ID NO: 681280 - DNA, 25 bp, Mus musculus
gccatgatggcccagggacctctgt

SEQ ID NO: 681281 - DNA, 25 bp, Mus musculus
gccatgatggccgagggacctctgt

SEQ ID NO: 681282 - DNA, 25 bp, Mus musculus
gccatgcaaaaaatcttcgcccggg

SEQ ID NO: 681283 - DNA, 25 bp, Mus musculus
gccatgcaaaaattcttcgcccggg

SEQ ID NO: 681284 - DNA, 25 bp, Mus musculus
gccatgcaaaacacggtcagatcta

SEQ ID NO: 681285 - DNA, 25 bp, Mus musculus
gccatgcaaaactcggtcagatcta

SEQ ID NO: 681286 - DNA, 25 bp, Mus musculus
gccatgcaagtcctagccaaggagt

SEQ ID NO: 681287 - DNA, 25 bp, Mus musculus
gccatgcaagtcgtagccaaggagt

SEQ ID NO: 681288 - DNA, 25 bp, Mus musculus
gccatgcacggcacacagaaggaca

SEQ ID NO: 681289 - DNA, 25 bp, Mus musculus
gccatgcacggctcacagaaggaca

SEQ ID NO: 681290 - DNA, 25 bp, Mus musculus
gccatgcaggatcaagatgggtata

SEQ ID NO: 681291 - DNA, 25 bp, Mus musculus
gccatgcaggatgaagatgggtata

SEQ ID NO: 681292 - DNA, 25 bp, Mus musculus
gccatgcaggttactaagtatggtg

SEQ ID NO: 681293 - DNA, 25 bp, Mus musculus
gccatgcaggtttctaagtatggtg

SEQ ID NO: 681294 - DNA, 25 bp, Mus musculus
gccatgcatatcataaggaatggtt

SEQ ID NO: 681295 - DNA, 25 bp, Mus musculus
gccatgcatatcttaaggaatggtt

SEQ ID NO: 681296 - DNA, 25 bp, Mus musculus
gccatgcatcatatttatggatgaa

SEQ ID NO: 681297 - DNA, 25 bp, Mus musculus
gccatgcatcatttttatggatgaa

SEQ ID NO: 681298 - DNA, 25 bp, Mus musculus
gccatgcatgagcaaagcatttaca

SEQ ID NO: 681299 - DNA, 25 bp, Mus musculus
gccatgcatgaggaaagcatttaca

SEQ ID NO: 681300 - DNA, 25 bp, Mus musculus
gccatgcattcacatagccagacgt

SEQ ID NO: 681301 - DNA, 25 bp, Mus musculus
gccatgcattcagatagccagacgt

SEQ ID NO: 681302 - DNA, 25 bp, Mus musculus
gccatgccactaagcctttcatgaa

SEQ ID NO: 681303 - DNA, 25 bp, Mus musculus
gccatgccactatgcctttcatgaa

SEQ ID NO: 681304 - DNA, 25 bp, Mus musculus
gccatgcctacaaatgaaaatcagg

SEQ ID NO: 681305 - DNA, 25 bp, Mus musculus
gccatgcctacatatgaaaatcagg

SEQ ID NO: 681306 - DNA, 25 bp, Mus musculus
gccatgcgaaccctgcaaagatttc

SEQ ID NO: 681307 - DNA, 25 bp, Mus musculus
gccatgcgaaccgtgcaaagatttc

SEQ ID NO: 681308 - DNA, 25 bp, Mus musculus
gccatgcgttcacatctagcgggat

SEQ ID NO: 681309 - DNA, 25 bp, Mus musculus
gccatgcgttcagatctagcgggat

SEQ ID NO: 681310 - DNA, 25 bp, Mus musculus
gccatgctaccacgctatctaagaa

SEQ ID NO: 681311 - DNA, 25 bp, Mus musculus
gccatgctaccaggctatctaagaa

SEQ ID NO: 681312 - DNA, 25 bp, Mus musculus
gccatgctgatgcactgtgtcagaa

SEQ ID NO: 681313 - DNA, 25 bp, Mus musculus
gccatgctgatggactgtgtcagaa

SEQ ID NO: 681314 - DNA, 25 bp, Mus musculus
gccatgctgcgcaggacctgtggac

SEQ ID NO: 681315 - DNA, 25 bp, Mus musculus
gccatgctgcgctggacctgtggac

SEQ ID NO: 681316 - DNA, 25 bp, Mus musculus
gccatgctggtcattgcttctagta

SEQ ID NO: 681317 - DNA, 25 bp, Mus musculus
gccatgctggtctttgcttctagta

SEQ ID NO: 681318 - DNA, 25 bp, Mus musculus
gccatgcttcataacatcgaccaag

SEQ ID NO: 681319 - DNA, 25 bp, Mus musculus
gccatgcttcattacatcgaccaag

SEQ ID NO: 681320 - DNA, 25 bp, Mus musculus
gccatgcttttgacgaaactgaagg

SEQ ID NO: 681321 - DNA, 25 bp, Mus musculus
gccatgcttttgtcgaaactgaagg

SEQ ID NO: 681322 - DNA, 25 bp, Mus musculus
gccatggaaattctacttcaaactt

SEQ ID NO: 681323 - DNA, 25 bp, Mus musculus
gccatggaaattgtacttcaaactt

SEQ ID NO: 681324 - DNA, 25 bp, Mus musculus
gccatggacaggaagtcctcatcgg

SEQ ID NO: 681325 - DNA, 25 bp, Mus musculus
gccatggacaggtagtcctcatcgg

SEQ ID NO: 681326 - DNA, 25 bp, Mus musculus
gccatggacgccaaggtcgtcgccg

SEQ ID NO: 681327 - DNA, 25 bp, Mus musculus
gccatggacgcctaggtcgtcgccg

SEQ ID NO: 681328 - DNA, 25 bp, Mus musculus
gccatggactccaggcaggatttca

SEQ ID NO: 681329 - DNA, 25 bp, Mus musculus
gccatggactcctggcaggatttca

SEQ ID NO: 681330 - DNA, 25 bp, Mus musculus
gccatggactgtcaccctttgggaa

SEQ ID NO: 681331 - DNA, 25 bp, Mus musculus
gccatggactgtgaccctttgggaa

SEQ ID NO: 681332 - DNA, 25 bp, Mus musculus
gccatggagaggatcggttcttaca

SEQ ID NO: 681333 - DNA, 25 bp, Mus musculus
gccatggagaggttcggttcttaca

SEQ ID NO: 681334 - DNA, 25 bp, Mus musculus
gccatggagtggctaattgaacact

SEQ ID NO: 681335 - DNA, 25 bp, Mus musculus
gccatggagtgggtaattgaacact

SEQ ID NO: 681336 - DNA, 25 bp, Mus musculus
gccatggatatcagagaaagaaatc

SEQ ID NO: 681337 - DNA, 25 bp, Mus musculus
gccatggatatctgagaaagaaatc

SEQ ID NO: 681338 - DNA, 25 bp, Mus musculus
gccatggatcgccatgaggaacctc

SEQ ID NO: 681339 - DNA, 25 bp, Mus musculus
gccatggatcgcgatgaggaacctc

SEQ ID NO: 681340 - DNA, 25 bp, Mus musculus
gccatggatgtgaccacaacctcca

SEQ ID NO: 681341 - DNA, 25 bp, Mus musculus
gccatggatgtgtccacaacctcca

SEQ ID NO: 681342 - DNA, 25 bp, Mus musculus
gccatggcagctcggaatactagtt

SEQ ID NO: 681343 - DNA, 25 bp, Mus musculus
gccatggcagctgggaatactagtt

SEQ ID NO: 681344 - DNA, 25 bp, Mus musculus
gccatggcccgaaagatccgaatga

SEQ ID NO: 681345 - DNA, 25 bp, Mus musculus
gccatggcccgatagatccgaatga

SEQ ID NO: 681346 - DNA, 25 bp, Mus musculus
gccatggcctttcctggaatttaca

SEQ ID NO: 681347 - DNA, 25 bp, Mus musculus
gccatggcctttgctggaatttaca

SEQ ID NO: 681348 - DNA, 25 bp, Mus musculus
gccatggcggccctatttgatttag

SEQ ID NO: 681349 - DNA, 25 bp, Mus musculus
gccatggcggccgtatttgatttag

SEQ ID NO: 681350 - DNA, 25 bp, Mus musculus
gccatggcgggcaacttcgactcgg

SEQ ID NO: 681351 - DNA, 25 bp, Mus musculus
gccatggcgggctacttcgactcgg

SEQ ID NO: 681352 - DNA, 25 bp, Mus musculus
gccatggctccaatccgctgtcaaa

SEQ ID NO: 681353 - DNA, 25 bp, Mus musculus
gccatggctccattccgctgtcaaa

SEQ ID NO: 681354 - DNA, 25 bp, Mus musculus
gccatggctctcaagcgcgtcttct

SEQ ID NO: 681355 - DNA, 25 bp, Mus musculus
gccatggctctctagcgcgtcttct

SEQ ID NO: 681356 - DNA, 25 bp, Mus musculus
gccatggctgaacagatcaggcgcc

SEQ ID NO: 681357 - DNA, 25 bp, Mus musculus
gccatggctgaagagatcaggcgcc

SEQ ID NO: 681358 - DNA, 25 bp, Mus musculus
gccatggctggacgcaaacccagat

SEQ ID NO: 681359 - DNA, 25 bp, Mus musculus
gccatggctggaggcaaacccagat

SEQ ID NO: 681360 - DNA, 25 bp, Mus musculus
gccatggctgttaggagagttttaa

SEQ ID NO: 681361 - DNA, 25 bp, Mus musculus
gccatggctgttatcttctcgaatt

SEQ ID NO: 681362 - DNA, 25 bp, Mus musculus
gccatggctgtttggagagttttaa

SEQ ID NO: 681363 - DNA, 25 bp, Mus musculus
gccatggctgttttcttctcgaatt

SEQ ID NO: 681364 - DNA, 25 bp, Mus musculus
gccatggcttacagcctgtcagaga

SEQ ID NO: 681365 - DNA, 25 bp, Mus musculus
gccatggcttactgcctgtcagaga

SEQ ID NO: 681366 - DNA, 25 bp, Mus musculus
gccatgggacctaacaatgtagcag

SEQ ID NO: 681367 - DNA, 25 bp, Mus musculus
gccatgggaccttacaatgtagcag

SEQ ID NO: 681368 - DNA, 25 bp, Mus musculus
gccatgggcagcaatgaatgccagt

SEQ ID NO: 681369 - DNA, 25 bp, Mus musculus
gccatgggcagctatgaatgccagt

SEQ ID NO: 681370 - DNA, 25 bp, Mus musculus
gccatgggcatgaccccaagtctgg

SEQ ID NO: 681371 - DNA, 25 bp, Mus musculus
gccatgggcatgtccccaagtctgg

SEQ ID NO: 681372 - DNA, 25 bp, Mus musculus
gccatgggccctcgtgctatacctt

SEQ ID NO: 681373 - DNA, 25 bp, Mus musculus
gccatgggccctggtgctatacctt

SEQ ID NO: 681374 - DNA, 25 bp, Mus musculus
gccatgggccgacatctacagagtg

SEQ ID NO: 681375 - DNA, 25 bp, Mus musculus
gccatgggccgagatctacagagtg

SEQ ID NO: 681376 - DNA, 25 bp, Mus musculus
gccatgggtgctccctgctgatgac

SEQ ID NO: 681377 - DNA, 25 bp, Mus musculus
gccatgggtgctgcctgctgatgac

SEQ ID NO: 681378 - DNA, 25 bp, Mus musculus
gccatggtacccatgatcgagccct

SEQ ID NO: 681379 - DNA, 25 bp, Mus musculus
gccatggtacccttgatcgagccct

SEQ ID NO: 681380 - DNA, 25 bp, Mus musculus
gccatggtccatcaactactgggca

SEQ ID NO: 681381 - DNA, 25 bp, Mus musculus
gccatggtccatgaactactgggca

SEQ ID NO: 681382 - DNA, 25 bp, Mus musculus
gccatggtggatacatcaactgttc

SEQ ID NO: 681383 - DNA, 25 bp, Mus musculus
gccatggtggattcatcaactgttc

SEQ ID NO: 681384 - DNA, 25 bp, Mus musculus
gccatggtggttagaacagtatatt

SEQ ID NO: 681385 - DNA, 25 bp, Mus musculus
gccatggtggtttgaacagtatatt

SEQ ID NO: 681386 - DNA, 25 bp, Mus musculus
gccatggttaccatcagccacgtct

SEQ ID NO: 681387 - DNA, 25 bp, Mus musculus
gccatggttaccttcagccacgtct

SEQ ID NO: 681388 - DNA, 25 bp, Mus musculus
gccatggttctcactaaaatgaagg

SEQ ID NO: 681389 - DNA, 25 bp, Mus musculus
gccatggttctctctaaaatgaagg

SEQ ID NO: 681390 - DNA, 25 bp, Mus musculus
gccatggttgccagctgctgccgtg

SEQ ID NO: 681391 - DNA, 25 bp, Mus musculus
gccatggttgcctgctgctgccgtg

SEQ ID NO: 681392 - DNA, 25 bp, Mus musculus
gccatggttttgaatgaagtcgaca

SEQ ID NO: 681393 - DNA, 25 bp, Mus musculus
gccatggttttgtatgaagtcgaca

SEQ ID NO: 681394 - DNA, 25 bp, Mus musculus
gccatgtaagtaagcccctcttcac

SEQ ID NO: 681395 - DNA, 25 bp, Mus musculus
gccatgtaagtatgcccctcttcac

SEQ ID NO: 681396 - DNA, 25 bp, Mus musculus
gccatgtacagcacagaagacccca

SEQ ID NO: 681397 - DNA, 25 bp, Mus musculus
gccatgtacagctcagaagacccca

SEQ ID NO: 681398 - DNA, 25 bp, Mus musculus
gccatgtactacctccgcttgctga

SEQ ID NO: 681399 - DNA, 25 bp, Mus musculus
gccatgtactacgtccgcttgctga

SEQ ID NO: 681400 - DNA, 25 bp, Mus musculus
gccatgtagaagacgtgctgctcat

SEQ ID NO: 681401 - DNA, 25 bp, Mus musculus
gccatgtagaagtcgtgctgctcat

SEQ ID NO: 681402 - DNA, 25 bp, Mus musculus
gccatgtataccaaccttcgcacgg

SEQ ID NO: 681403 - DNA, 25 bp, Mus musculus
gccatgtatacctaccttcgcacgg

SEQ ID NO: 681404 - DNA, 25 bp, Mus musculus
gccatgtcactcacaactgggatga

SEQ ID NO: 681405 - DNA, 25 bp, Mus musculus
gccatgtcactctcaactgggatga

SEQ ID NO: 681406 - DNA, 25 bp, Mus musculus
gccatgtcactgcagacatttcctt

SEQ ID NO: 681407 - DNA, 25 bp, Mus musculus
gccatgtcactggagacatttcctt

SEQ ID NO: 681408 - DNA, 25 bp, Mus musculus
gccatgtcccatcaaaagagtttct

SEQ ID NO: 681409 - DNA, 25 bp, Mus musculus
gccatgtcccatgaaaagagtttct

SEQ ID NO: 681410 - DNA, 25 bp, Mus musculus
gccatgtcccgcagttctgtaaata

SEQ ID NO: 681411 - DNA, 25 bp, Mus musculus
gccatgtcccgctgttctgtaaata

SEQ ID NO: 681412 - DNA, 25 bp, Mus musculus
gccatgtccttcctgaaggatcatg

SEQ ID NO: 681413 - DNA, 25 bp, Mus musculus
gccatgtccttcgtgaaggatcatg

SEQ ID NO: 681414 - DNA, 25 bp, Mus musculus
gccatgtctccgagccaattggctg

SEQ ID NO: 681415 - DNA, 25 bp, Mus musculus
gccatgtctccgtgccaattggctg

SEQ ID NO: 681416 - DNA, 25 bp, Mus musculus
gccatgtctggacatgttagtcagt

SEQ ID NO: 681417 - DNA, 25 bp, Mus musculus
gccatgtctggagatgttagtcagt

SEQ ID NO: 681418 - DNA, 25 bp, Mus musculus
gccatgtgagtacccctctgacctg

SEQ ID NO: 681419 - DNA, 25 bp, Mus musculus
gccatgtgagtagccctctgacctg

SEQ ID NO: 681420 - DNA, 25 bp, Mus musculus
gccatgtgatccactattctttgca

SEQ ID NO: 681421 - DNA, 25 bp, Mus musculus
gccatgtgatcctctattctttgca

SEQ ID NO: 681422 - DNA, 25 bp, Mus musculus
gccatgtgcatcatggaaggattta

SEQ ID NO: 681423 - DNA, 25 bp, Mus musculus
gccatgtgcatcttggaaggattta

SEQ ID NO: 681424 - DNA, 25 bp, Mus musculus
gccatgtgcctgcagaggatccaga

SEQ ID NO: 681425 - DNA, 25 bp, Mus musculus
gccatgtgcctggagaggatccaga

SEQ ID NO: 681426 - DNA, 25 bp, Mus musculus
gccatgtgctcaataaaggtcccga

SEQ ID NO: 681427 - DNA, 25 bp, Mus musculus
gccatgtgctcattaaaggtcccga

SEQ ID NO: 681428 - DNA, 25 bp, Mus musculus
gccatgtgctcccatagtgtgagga

SEQ ID NO: 681429 - DNA, 25 bp, Mus musculus
gccatgtgctccgatagtgtgagga

SEQ ID NO: 681430 - DNA, 25 bp, Mus musculus
gccatgtggacccagccaatgatac

SEQ ID NO: 681431 - DNA, 25 bp, Mus musculus
gccatgtggaccgagccaatgatac

SEQ ID NO: 681432 - DNA, 25 bp, Mus musculus
gccatgtggagtaccagatcctagt

SEQ ID NO: 681433 - DNA, 25 bp, Mus musculus
gccatgtggagttccagatcctagt

SEQ ID NO: 681434 - DNA, 25 bp, Mus musculus
gccatgttccggacagtccccatgt

SEQ ID NO: 681435 - DNA, 25 bp, Mus musculus
gccatgttccggtcagtccccatgt

SEQ ID NO: 681436 - DNA, 25 bp, Mus musculus
gccatgttgctactgttgctgatct

SEQ ID NO: 681437 - DNA, 25 bp, Mus musculus
gccatgttgctagtgttgctgatct

SEQ ID NO: 681438 - DNA, 25 bp, Mus musculus
gccatgttgtggaaaataacagata

SEQ ID NO: 681439 - DNA, 25 bp, Mus musculus
gccatgttgtggtaaataacagata

SEQ ID NO: 681440 - DNA, 25 bp, Mus musculus
gccatgtttctaccaagacttcgag

SEQ ID NO: 681441 - DNA, 25 bp, Mus musculus
gccatgtttctagcaagacttcgag

SEQ ID NO: 681442 - DNA, 25 bp, Mus musculus
gccattaaaacgagcaaggaagacc

SEQ ID NO: 681443 - DNA, 25 bp, Mus musculus
gccattaaaacgtgcaaggaagacc

SEQ ID NO: 681444 - DNA, 25 bp, Mus musculus
gccattaaacatccccttagcgcag

SEQ ID NO: 681445 - DNA, 25 bp, Mus musculus
gccattaaacatgcccttagcgcag

SEQ ID NO: 681446 - DNA, 25 bp, Mus musculus
gccattaacatgaaagacgtgaaag

SEQ ID NO: 681447 - DNA, 25 bp, Mus musculus
gccattaacatgtaagacgtgaaag

SEQ ID NO: 681448 - DNA, 25 bp, Mus musculus
gccattaagatgatggagctccagt

SEQ ID NO: 681449 - DNA, 25 bp, Mus musculus
gccattaagatgttggagctccagt

SEQ ID NO: 681450 - DNA, 25 bp, Mus musculus
gccattaagttcaccaaccatgaaa

SEQ ID NO: 681451 - DNA, 25 bp, Mus musculus
gccattaagttctccaaccatgaaa

SEQ ID NO: 681452 - DNA, 25 bp, Mus musculus
gccattacaccactgagtaagaaag

SEQ ID NO: 681453 - DNA, 25 bp, Mus musculus
gccattacaccagtgagtaagaaag

SEQ ID NO: 681454 - DNA, 25 bp, Mus musculus
gccattacaggacccgtcgccatta

SEQ ID NO: 681455 - DNA, 25 bp, Mus musculus
gccattacaggagccgtcgccatta

SEQ ID NO: 681456 - DNA, 25 bp, Mus musculus
gccattactgttcaggttgcatcct

SEQ ID NO: 681457 - DNA, 25 bp, Mus musculus
gccattactgttgaggttgcatcct

SEQ ID NO: 681458 - DNA, 25 bp, Mus musculus
gccattacttcaatctgacggacca

SEQ ID NO: 681459 - DNA, 25 bp, Mus musculus
gccattacttcattctgacggacca

SEQ ID NO: 681460 - DNA, 25 bp, Mus musculus
gccattagcccgagtgtccagaact

SEQ ID NO: 681461 - DNA, 25 bp, Mus musculus
gccattagcccgtgtgtccagaact

SEQ ID NO: 681462 - DNA, 25 bp, Mus musculus
gccattatcggaatcttagcctaca

SEQ ID NO: 681463 - DNA, 25 bp, Mus musculus
gccattatcggattcttagcctaca

SEQ ID NO: 681464 - DNA, 25 bp, Mus musculus
gccattatgaggagtgatgacccca

SEQ ID NO: 681465 - DNA, 25 bp, Mus musculus
gccattatgaggtgtgatgacccca

SEQ ID NO: 681466 - DNA, 25 bp, Mus musculus
gccattattgtgaccatcatcaaca

SEQ ID NO: 681467 - DNA, 25 bp, Mus musculus
gccattattgtgtccatcatcaaca

SEQ ID NO: 681468 - DNA, 25 bp, Mus musculus
gccattcacggacgctgcattggcg

SEQ ID NO: 681469 - DNA, 25 bp, Mus musculus
gccattcacggaggctgcattggcg

SEQ ID NO: 681470 - DNA, 25 bp, Mus musculus
gccattcagagacccgatgacatct

SEQ ID NO: 681471 - DNA, 25 bp, Mus musculus
gccattcagagagccgatgacatct

SEQ ID NO: 681472 - DNA, 25 bp, Mus musculus
gccattcagatcagtactgagagtg

SEQ ID NO: 681473 - DNA, 25 bp, Mus musculus
gccattcagatctgtactgagagtg

SEQ ID NO: 681474 - DNA, 25 bp, Mus musculus
gccattcatatgatgatagcactct

SEQ ID NO: 681475 - DNA, 25 bp, Mus musculus
gccattcatatgttgatagcactct

SEQ ID NO: 681476 - DNA, 25 bp, Mus musculus
gccattcatttcagagaacacgcca

SEQ ID NO: 681477 - DNA, 25 bp, Mus musculus
gccattcatttctgagaacacgcca

SEQ ID NO: 681478 - DNA, 25 bp, Mus musculus
gccattccataactatgcctgccat

SEQ ID NO: 681479 - DNA, 25 bp, Mus musculus
gccattccataagtatgcctgccat

SEQ ID NO: 681480 - DNA, 25 bp, Mus musculus
gccattccggatccgctgagtgaga

SEQ ID NO: 681481 - DNA, 25 bp, Mus musculus
gccattccggatgcgctgagtgaga

SEQ ID NO: 681482 - DNA, 25 bp, Mus musculus
gccattcctaatcgacaatgtacct

SEQ ID NO: 681483 - DNA, 25 bp, Mus musculus
gccattcctaatggacaatgtacct

SEQ ID NO: 681484 - DNA, 25 bp, Mus musculus
gccattcctcaccatgtgcattaag

SEQ ID NO: 681485 - DNA, 25 bp, Mus musculus
gccattcctcacgatgtgcattaag

SEQ ID NO: 681486 - DNA, 25 bp, Mus musculus
gccattcctgatcaagtgtgtaata

SEQ ID NO: 681487 - DNA, 25 bp, Mus musculus
gccattcctgatgaagtgtgtaata

SEQ ID NO: 681488 - DNA, 25 bp, Mus musculus
gccattccttttcgcctgggtgctg

SEQ ID NO: 681489 - DNA, 25 bp, Mus musculus
gccattccttttggcctgggtgctg

SEQ ID NO: 681490 - DNA, 25 bp, Mus musculus
gccattcgaagacccggtctcgatc

SEQ ID NO: 681491 - DNA, 25 bp, Mus musculus
gccattcgaagagccggtctcgatc

SEQ ID NO: 681492 - DNA, 25 bp, Mus musculus
gccattctccaacaagcgaggactt

SEQ ID NO: 681493 - DNA, 25 bp, Mus musculus
gccattctccaagaagcgaggactt

SEQ ID NO: 681494 - DNA, 25 bp, Mus musculus
gccattctcttactgatgggttgga

SEQ ID NO: 681495 - DNA, 25 bp, Mus musculus
gccattctcttagtgatgggttgga

SEQ ID NO: 681496 - DNA, 25 bp, Mus musculus
gccattctgtgtcatcttgccggaa

SEQ ID NO: 681497 - DNA, 25 bp, Mus musculus
gccattctgtgtgatcttgccggaa

SEQ ID NO: 681498 - DNA, 25 bp, Mus musculus
gccattcttcacagatgggacactt

SEQ ID NO: 681499 - DNA, 25 bp, Mus musculus
gccattcttcactgatgggacactt

SEQ ID NO: 681500 - DNA, 25 bp, Mus musculus
gccattgaaattcctcggaaccggg

SEQ ID NO: 681501 - DNA, 25 bp, Mus musculus
gccattgaaattgctcggaaccggg

SEQ ID NO: 681502 - DNA, 25 bp, Mus musculus
gccattgaagagactgtcgtcctca

SEQ ID NO: 681503 - DNA, 25 bp, Mus musculus
gccattgaagagtctgtcgtcctca

SEQ ID NO: 681504 - DNA, 25 bp, Mus musculus
gccattgaaggactggatgccactg

SEQ ID NO: 681505 - DNA, 25 bp, Mus musculus
gccattgaaggagtggatgccactg

SEQ ID NO: 681506 - DNA, 25 bp, Mus musculus
gccattgaccagcttgagaagcgga

SEQ ID NO: 681507 - DNA, 25 bp, Mus musculus
gccattgaccaggttgagaagcgga

SEQ ID NO: 681508 - DNA, 25 bp, Mus musculus
gccattgagaagctgctgtccagtg

SEQ ID NO: 681509 - DNA, 25 bp, Mus musculus
gccattgagaaggtgctgtccagtg

SEQ ID NO: 681510 - DNA, 25 bp, Mus musculus
gccattgagcttccaatagatccca

SEQ ID NO: 681511 - DNA, 25 bp, Mus musculus
gccattgagcttgcaatagatccca

SEQ ID NO: 681512 - DNA, 25 bp, Mus musculus
gccattgagtacaagtctgccaaca

SEQ ID NO: 681513 - DNA, 25 bp, Mus musculus
gccattgagtactagtctgccaaca

SEQ ID NO: 681514 - DNA, 25 bp, Mus musculus
gccattgataccaactgctcagaga

SEQ ID NO: 681515 - DNA, 25 bp, Mus musculus
gccattgatacctactgctcagaga

SEQ ID NO: 681516 - DNA, 25 bp, Mus musculus
gccattgcaaacatcttcattggaa

SEQ ID NO: 681517 - DNA, 25 bp, Mus musculus
gccattgcaaacttcttcattggaa

SEQ ID NO: 681518 - DNA, 25 bp, Mus musculus
gccattgcactcagccacaacgtga

SEQ ID NO: 681519 - DNA, 25 bp, Mus musculus
gccattgcactcctggagcaatttg

SEQ ID NO: 681520 - DNA, 25 bp, Mus musculus
gccattgcactcgtggagcaatttg

SEQ ID NO: 681521 - DNA, 25 bp, Mus musculus
gccattgcactctgccacaacgtga

SEQ ID NO: 681522 - DNA, 25 bp, Mus musculus
gccattgcaggcaaccctctgggtg

SEQ ID NO: 681523 - DNA, 25 bp, Mus musculus
gccattgcaggctaccctctgggtg

SEQ ID NO: 681524 - DNA, 25 bp, Mus musculus
gccattgccagtacactgcagacta

SEQ ID NO: 681525 - DNA, 25 bp, Mus musculus
gccattgccagttcactgcagacta

SEQ ID NO: 681526 - DNA, 25 bp, Mus musculus
gccattgccatacagagacctcagc

SEQ ID NO: 681527 - DNA, 25 bp, Mus musculus
gccattgccatagagagacctcagc

SEQ ID NO: 681528 - DNA, 25 bp, Mus musculus
gccattgccgaacgcctgggctgca

SEQ ID NO: 681529 - DNA, 25 bp, Mus musculus
gccattgccgaaggcctgggctgca

SEQ ID NO: 681530 - DNA, 25 bp, Mus musculus
gccattgctcgtcttggacattttt

SEQ ID NO: 681531 - DNA, 25 bp, Mus musculus
gccattgctcgtgttggacattttt

SEQ ID NO: 681532 - DNA, 25 bp, Mus musculus
gccattgctgaacttgatacattaa

SEQ ID NO: 681533 - DNA, 25 bp, Mus musculus
gccattgctgaagttgatacattaa

SEQ ID NO: 681534 - DNA, 25 bp, Mus musculus
gccattgctttaccaactgattaca

SEQ ID NO: 681535 - DNA, 25 bp, Mus musculus
gccattgctttagcaactgattaca

SEQ ID NO: 681536 - DNA, 25 bp, Mus musculus
gccattggcctgcagattaagctct

SEQ ID NO: 681537 - DNA, 25 bp, Mus musculus
gccattggcctggagattaagctct

SEQ ID NO: 681538 - DNA, 25 bp, Mus musculus
gccattggctctctgatggacgact

SEQ ID NO: 681539 - DNA, 25 bp, Mus musculus
gccattggctctgtgatggacgact

SEQ ID NO: 681540 - DNA, 25 bp, Mus musculus
gccattgggtgccacgtggttaata

SEQ ID NO: 681541 - DNA, 25 bp, Mus musculus
gccattgggtgcgacgtggttaata

SEQ ID NO: 681542 - DNA, 25 bp, Mus musculus
gccattgtcaccaggacaaacaacg

SEQ ID NO: 681543 - DNA, 25 bp, Mus musculus
gccattgtcacctggacaaacaacg

SEQ ID NO: 681544 - DNA, 25 bp, Mus musculus
gccattgtgagcattgtcaaccaga

SEQ ID NO: 681545 - DNA, 25 bp, Mus musculus
gccattgtgagctttgtcaaccaga

SEQ ID NO: 681546 - DNA, 25 bp, Mus musculus
gccattgtggagaatctccgcacct

SEQ ID NO: 681547 - DNA, 25 bp, Mus musculus
gccattgtggagtatctccgcacct

SEQ ID NO: 681548 - DNA, 25 bp, Mus musculus
gccattgttgctaactcggaacgtg

SEQ ID NO: 681549 - DNA, 25 bp, Mus musculus
gccattgttgcttactcggaacgtg

SEQ ID NO: 681550 - DNA, 25 bp, Mus musculus
gccattgttttgaagaacacctggc

SEQ ID NO: 681551 - DNA, 25 bp, Mus musculus
gccattgttttgtagaacacctggc

SEQ ID NO: 681552 - DNA, 25 bp, Mus musculus
gccatttaccgaagggacccagaca

SEQ ID NO: 681553 - DNA, 25 bp, Mus musculus
gccatttaccgatgggacccagaca

SEQ ID NO: 681554 - DNA, 25 bp, Mus musculus
gccatttattgaaactcgccaggat

SEQ ID NO: 681555 - DNA, 25 bp, Mus musculus
gccatttattgatactcgccaggat

SEQ ID NO: 681556 - DNA, 25 bp, Mus musculus
gccatttccagcagggtagggtaac

SEQ ID NO: 681557 - DNA, 25 bp, Mus musculus
gccatttccagctgggtagggtaac

SEQ ID NO: 681558 - DNA, 25 bp, Mus musculus
gccatttcctgtctgaagcctagca

SEQ ID NO: 681559 - DNA, 25 bp, Mus musculus
gccatttcctgtgtgaagcctagca

SEQ ID NO: 681560 - DNA, 25 bp, Mus musculus
gccatttctccaacgcatcctggag

SEQ ID NO: 681561 - DNA, 25 bp, Mus musculus
gccatttctccatcgcatcctggag

SEQ ID NO: 681562 - DNA, 25 bp, Mus musculus
gccatttctctcagcactggccggg

SEQ ID NO: 681563 - DNA, 25 bp, Mus musculus
gccatttctctctgcactggccggg

SEQ ID NO: 681564 - DNA, 25 bp, Mus musculus
gccatttgatatcggagatttgcag

SEQ ID NO: 681565 - DNA, 25 bp, Mus musculus
gccatttgatatgggagatttgcag

SEQ ID NO: 681566 - DNA, 25 bp, Mus musculus
gccatttgccctaaatcatcaaaaa

SEQ ID NO: 681567 - DNA, 25 bp, Mus musculus
gccatttgcccttaatcatcaaaaa

SEQ ID NO: 681568 - DNA, 25 bp, Mus musculus
gccatttgcgagaataaagtcctcc

SEQ ID NO: 681569 - DNA, 25 bp, Mus musculus
gccatttgcgagtataaagtcctcc

SEQ ID NO: 681570 - DNA, 25 bp, Mus musculus
gccatttggtgaagccaggctagag

SEQ ID NO: 681571 - DNA, 25 bp, Mus musculus
gccatttggtgatgccaggctagag

SEQ ID NO: 681572 - DNA, 25 bp, Mus musculus
gccatttgtcttccctgagtcttga

SEQ ID NO: 681573 - DNA, 25 bp, Mus musculus
gccatttgtcttgcctgagtcttga

SEQ ID NO: 681574 - DNA, 25 bp, Mus musculus
gccattttaaatctagctccataca

SEQ ID NO: 681575 - DNA, 25 bp, Mus musculus
gccattttaaatgtagctccataca

SEQ ID NO: 681576 - DNA, 25 bp, Mus musculus
gccattttcagcagaagacgctgcg

SEQ ID NO: 681577 - DNA, 25 bp, Mus musculus
gccattttcagctgaagacgctgcg

SEQ ID NO: 681578 - DNA, 25 bp, Mus musculus
gccattttcctcaagccacagacag

SEQ ID NO: 681579 - DNA, 25 bp, Mus musculus
gccattttcctctagccacagacag

SEQ ID NO: 681580 - DNA, 25 bp, Mus musculus
gccattttcgtgatcactgtctgga

SEQ ID NO: 681581 - DNA, 25 bp, Mus musculus
gccattttcgtgttcactgtctgga

SEQ ID NO: 681582 - DNA, 25 bp, Mus musculus
gcccaaaacagaagtgctaggtgtt

SEQ ID NO: 681583 - DNA, 25 bp, Mus musculus
gcccaaaacagatgtgctaggtgtt

SEQ ID NO: 681584 - DNA, 25 bp, Mus musculus
gcccaaaaccagaaggactgcacac

SEQ ID NO: 681585 - DNA, 25 bp, Mus musculus
gcccaaaaccagtaggactgcacac

SEQ ID NO: 681586 - DNA, 25 bp, Mus musculus
gcccaaaatcacagtcatcaccagg

SEQ ID NO: 681587 - DNA, 25 bp, Mus musculus
gcccaaaatcactgtcatcaccagg

SEQ ID NO: 681588 - DNA, 25 bp, Mus musculus
gcccaaacaaccagagtccaacagg

SEQ ID NO: 681589 - DNA, 25 bp, Mus musculus
gcccaaacaacctgagtccaacagg

SEQ ID NO: 681590 - DNA, 25 bp, Mus musculus
gcccaaactggtctgcgtcttcttg

SEQ ID NO: 681591 - DNA, 25 bp, Mus musculus
gcccaaactggtgtgcgtcttcttg

SEQ ID NO: 681592 - DNA, 25 bp, Mus musculus
gcccaaatccggaaggaagagaagg

SEQ ID NO: 681593 - DNA, 25 bp, Mus musculus
gcccaaatccggtaggaagagaagg

SEQ ID NO: 681594 - DNA, 25 bp, Mus musculus
gcccaaatcgtaattcaaaagtatc

SEQ ID NO: 681595 - DNA, 25 bp, Mus musculus
gcccaaatcgtatttcaaaagtatc

SEQ ID NO: 681596 - DNA, 25 bp, Mus musculus
gcccaaatgtttcggttacatctgg

SEQ ID NO: 681597 - DNA, 25 bp, Mus musculus
gcccaaatgtttgggttacatctgg

SEQ ID NO: 681598 - DNA, 25 bp, Mus musculus
gcccaaattggcagccgtcatccgt

SEQ ID NO: 681599 - DNA, 25 bp, Mus musculus
gcccaaattggctgccgtcatccgt

SEQ ID NO: 681600 - DNA, 25 bp, Mus musculus
gcccaacaaatgatcagccttgcaa

SEQ ID NO: 681601 - DNA, 25 bp, Mus musculus
gcccaacaaatgttcagccttgcaa

SEQ ID NO: 681602 - DNA, 25 bp, Mus musculus
gcccaactgcacattggcttccaag

SEQ ID NO: 681603 - DNA, 25 bp, Mus musculus
gcccaactgcactttggcttccaag

SEQ ID NO: 681604 - DNA, 25 bp, Mus musculus
gcccaactgggacgtggcagtttca

SEQ ID NO: 681605 - DNA, 25 bp, Mus musculus
gcccaactgggaggtggcagtttca

SEQ ID NO: 681606 - DNA, 25 bp, Mus musculus
gcccaagaacctcaataaatctaag

SEQ ID NO: 681607 - DNA, 25 bp, Mus musculus
gcccaagaacctgaataaatctaag

SEQ ID NO: 681608 - DNA, 25 bp, Mus musculus
gcccaagaatgtcgtggcagccact

SEQ ID NO: 681609 - DNA, 25 bp, Mus musculus
gcccaagaatgtggtggcagccact

SEQ ID NO: 681610 - DNA, 25 bp, Mus musculus
gcccaagactacctagatgagctca

SEQ ID NO: 681611 - DNA, 25 bp, Mus musculus
gcccaagactacgtagatgagctca

SEQ ID NO: 681612 - DNA, 25 bp, Mus musculus
gcccaagagaagaggcatcttctat

SEQ ID NO: 681613 - DNA, 25 bp, Mus musculus
gcccaagagaagtggcatcttctat

SEQ ID NO: 681614 - DNA, 25 bp, Mus musculus
gcccaagagaatagttaatgcaaaa

SEQ ID NO: 681615 - DNA, 25 bp, Mus musculus
gcccaagagaattgttaatgcaaaa

SEQ ID NO: 681616 - DNA, 25 bp, Mus musculus
gcccaagatagaagaattcacgccc

SEQ ID NO: 681617 - DNA, 25 bp, Mus musculus
gcccaagatagatgaattcacgccc

SEQ ID NO: 681618 - DNA, 25 bp, Mus musculus
gcccaagcccggaggctacagcgta

SEQ ID NO: 681619 - DNA, 25 bp, Mus musculus
gcccaagcccggtggctacagcgta

SEQ ID NO: 681620 - DNA, 25 bp, Mus musculus
gcccaagctcacacttcatacaaag

SEQ ID NO: 681621 - DNA, 25 bp, Mus musculus
gcccaagctcactcttcatacaaag

SEQ ID NO: 681622 - DNA, 25 bp, Mus musculus
gcccaagctgctcctgaggtctctg

SEQ ID NO: 681623 - DNA, 25 bp, Mus musculus
gcccaagctgctgctgaggtctctg

SEQ ID NO: 681624 - DNA, 25 bp, Mus musculus
gcccaagcttcgagtctgacaagag

SEQ ID NO: 681625 - DNA, 25 bp, Mus musculus
gcccaagcttcgtgtctgacaagag

SEQ ID NO: 681626 - DNA, 25 bp, Mus musculus
gcccaagctttaatttatgctgaga

SEQ ID NO: 681627 - DNA, 25 bp, Mus musculus
gcccaagctttattttatgctgaga

SEQ ID NO: 681628 - DNA, 25 bp, Mus musculus
gcccaaggaatcaacagagtcatgt

SEQ ID NO: 681629 - DNA, 25 bp, Mus musculus
gcccaaggaatctacagagtcatgt

SEQ ID NO: 681630 - DNA, 25 bp, Mus musculus
gcccaaggagctctggtggcctgct

SEQ ID NO: 681631 - DNA, 25 bp, Mus musculus
gcccaaggagctgtggtggcctgct

SEQ ID NO: 681632 - DNA, 25 bp, Mus musculus
gcccaaggatgtcctcaccattact

SEQ ID NO: 681633 - DNA, 25 bp, Mus musculus
gcccaaggatgtgctcaccattact

SEQ ID NO: 681634 - DNA, 25 bp, Mus musculus
gcccaaggcaacctgtatcatctca

SEQ ID NO: 681635 - DNA, 25 bp, Mus musculus
gcccaaggcaacgtgtatcatctca

SEQ ID NO: 681636 - DNA, 25 bp, Mus musculus
gcccaaggtgatcattattcaggca

SEQ ID NO: 681637 - DNA, 25 bp, Mus musculus
gcccaaggtgatccgcctgaaggat

SEQ ID NO: 681638 - DNA, 25 bp, Mus musculus
gcccaaggtgatgattattcaggca

SEQ ID NO: 681639 - DNA, 25 bp, Mus musculus
gcccaaggtgatgcgcctgaaggat

SEQ ID NO: 681640 - DNA, 25 bp, Mus musculus
gcccaagtacttctctccagtgagt

SEQ ID NO: 681641 - DNA, 25 bp, Mus musculus
gcccaagtacttgtctccagtgagt

SEQ ID NO: 681642 - DNA, 25 bp, Mus musculus
gcccaagtggtccagtgtatctcgg

SEQ ID NO: 681643 - DNA, 25 bp, Mus musculus
gcccaagtggtcgagtgtatctcgg

SEQ ID NO: 681644 - DNA, 25 bp, Mus musculus
gcccaatgaaatctgcgtcattcag

SEQ ID NO: 681645 - DNA, 25 bp, Mus musculus
gcccaatgaaatgtgcgtcattcag

SEQ ID NO: 681646 - DNA, 25 bp, Mus musculus
gcccaatgagagagacaatgactac

SEQ ID NO: 681647 - DNA, 25 bp, Mus musculus
gcccaatgagagtgacaatgactac

SEQ ID NO: 681648 - DNA, 25 bp, Mus musculus
gcccaatgaggacgataaattcact

SEQ ID NO: 681649 - DNA, 25 bp, Mus musculus
gcccaatgaggaggataaattcact

SEQ ID NO: 681650 - DNA, 25 bp, Mus musculus
gcccaatgagttagccagtcagatc

SEQ ID NO: 681651 - DNA, 25 bp, Mus musculus
gcccaatgagtttgccagtcagatc

SEQ ID NO: 681652 - DNA, 25 bp, Mus musculus
gcccaatggacgcttcctggatgga

SEQ ID NO: 681653 - DNA, 25 bp, Mus musculus
gcccaatggacggttcctggatgga

SEQ ID NO: 681654 - DNA, 25 bp, Mus musculus
gcccaatgtggaacgaccgtcagtg

SEQ ID NO: 681655 - DNA, 25 bp, Mus musculus
gcccaatgtggatcgaccgtcagtg

SEQ ID NO: 681656 - DNA, 25 bp, Mus musculus
gcccacaaattcagaccaggcctgt

SEQ ID NO: 681657 - DNA, 25 bp, Mus musculus
gcccacaaattctgaccaggcctgt

SEQ ID NO: 681658 - DNA, 25 bp, Mus musculus
gcccacaagcggcaatggaatcttt

SEQ ID NO: 681659 - DNA, 25 bp, Mus musculus
gcccacaagcgggaatggaatcttt

SEQ ID NO: 681660 - DNA, 25 bp, Mus musculus
gcccacaatgaccttgttgacaagg

SEQ ID NO: 681661 - DNA, 25 bp, Mus musculus
gcccacaatgacgttgttgacaagg

SEQ ID NO: 681662 - DNA, 25 bp, Mus musculus
gcccacaatggcagacgaactgtat

SEQ ID NO: 681663 - DNA, 25 bp, Mus musculus
gcccacaatggctgacgaactgtat

SEQ ID NO: 681664 - DNA, 25 bp, Mus musculus
gcccacacaggtacatctggtccat

SEQ ID NO: 681665 - DNA, 25 bp, Mus musculus
gcccacacaggttcatctggtccat

SEQ ID NO: 681666 - DNA, 25 bp, Mus musculus
gcccacagacggaggccacggaaat

SEQ ID NO: 681667 - DNA, 25 bp, Mus musculus
gcccacagacggtggccacggaaat

SEQ ID NO: 681668 - DNA, 25 bp, Mus musculus
gcccacagacttagatttcctcaaa

SEQ ID NO: 681669 - DNA, 25 bp, Mus musculus
gcccacagactttgatttcctcaaa

SEQ ID NO: 681670 - DNA, 25 bp, Mus musculus
gcccacagcatccaatatcagtgag

SEQ ID NO: 681671 - DNA, 25 bp, Mus musculus
gcccacagcatcgaatatcagtgag

SEQ ID NO: 681672 - DNA, 25 bp, Mus musculus
gcccacagggacattggtcctgcat

SEQ ID NO: 681673 - DNA, 25 bp, Mus musculus
gcccacagggactttggtcctgcat

SEQ ID NO: 681674 - DNA, 25 bp, Mus musculus
gcccacagtaaaactagcaaggata

SEQ ID NO: 681675 - DNA, 25 bp, Mus musculus
gcccacagtaaatctagcaaggata

SEQ ID NO: 681676 - DNA, 25 bp, Mus musculus
gcccacagtctgcaagaagcacggt

SEQ ID NO: 681677 - DNA, 25 bp, Mus musculus
gcccacagtctggaagaagcacggt

SEQ ID NO: 681678 - DNA, 25 bp, Mus musculus
gcccacagtgccagaatctctggct

SEQ ID NO: 681679 - DNA, 25 bp, Mus musculus
gcccacagtgcctgaatctctggct

SEQ ID NO: 681680 - DNA, 25 bp, Mus musculus
gcccacagttctacgtatggcaggg

SEQ ID NO: 681681 - DNA, 25 bp, Mus musculus
gcccacagttcttcgtatggcaggg

SEQ ID NO: 681682 - DNA, 25 bp, Mus musculus
gcccacatggtaaccctggactaca

SEQ ID NO: 681683 - DNA, 25 bp, Mus musculus
gcccacatggtatccctggactaca

SEQ ID NO: 681684 - DNA, 25 bp, Mus musculus
gcccaccagaagctgtctaaagaga

SEQ ID NO: 681685 - DNA, 25 bp, Mus musculus
gcccaccagaaggtgtctaaagaga

SEQ ID NO: 681686 - DNA, 25 bp, Mus musculus
gcccaccatgacagggtatctctgg

SEQ ID NO: 681687 - DNA, 25 bp, Mus musculus
gcccaccatgactgggtatctctgg

SEQ ID NO: 681688 - DNA, 25 bp, Mus musculus
gcccacccagtacaagggtctgtat

SEQ ID NO: 681689 - DNA, 25 bp, Mus musculus
gcccacccagtagaagggtctgtat

SEQ ID NO: 681690 - DNA, 25 bp, Mus musculus
gcccaccccactcttaagtatagga

SEQ ID NO: 681691 - DNA, 25 bp, Mus musculus
gcccaccccactgttaagtatagga

SEQ ID NO: 681692 - DNA, 25 bp, Mus musculus
gcccacctagtgatgccctagagct

SEQ ID NO: 681693 - DNA, 25 bp, Mus musculus
gcccacctagtgttgccctagagct

SEQ ID NO: 681694 - DNA, 25 bp, Mus musculus
gcccacctcgggaagtctgtgctgt

SEQ ID NO: 681695 - DNA, 25 bp, Mus musculus
gcccacctcgggtagtctgtgctgt

SEQ ID NO: 681696 - DNA, 25 bp, Mus musculus
gcccacctctgcaagcgagggcatg

SEQ ID NO: 681697 - DNA, 25 bp, Mus musculus
gcccacctctgctagcgagggcatg

SEQ ID NO: 681698 - DNA, 25 bp, Mus musculus
gcccacctgccgattgctgttgttg

SEQ ID NO: 681699 - DNA, 25 bp, Mus musculus
gcccacctgccgtttgctgttgttg

SEQ ID NO: 681700 - DNA, 25 bp, Mus musculus
gcccaccttagcatgtatcactctg

SEQ ID NO: 681701 - DNA, 25 bp, Mus musculus
gcccaccttagcttgtatcactctg

SEQ ID NO: 681702 - DNA, 25 bp, Mus musculus
gcccaccttcatcgctgtagttcag

SEQ ID NO: 681703 - DNA, 25 bp, Mus musculus
gcccaccttcatggctgtagttcag

SEQ ID NO: 681704 - DNA, 25 bp, Mus musculus
gcccacgaacttaacggtggtgccg

SEQ ID NO: 681705 - DNA, 25 bp, Mus musculus
gcccacgaactttacggtggtgccg

SEQ ID NO: 681706 - DNA, 25 bp, Mus musculus
gcccacgaaggccatcaggtttaga

SEQ ID NO: 681707 - DNA, 25 bp, Mus musculus
gcccacgaaggcgatcaggtttaga

SEQ ID NO: 681708 - DNA, 25 bp, Mus musculus
gcccacgatacacgagatcaagcag

SEQ ID NO: 681709 - DNA, 25 bp, Mus musculus
gcccacgatacaggagatcaagcag

SEQ ID NO: 681710 - DNA, 25 bp, Mus musculus
gcccacgatgtgcaaagtcggtata

SEQ ID NO: 681711 - DNA, 25 bp, Mus musculus
gcccacgatgtggaaagtcggtata

SEQ ID NO: 681712 - DNA, 25 bp, Mus musculus
gcccacgcgcttcgctaagtacagg

SEQ ID NO: 681713 - DNA, 25 bp, Mus musculus
gcccacgcgcttggctaagtacagg

SEQ ID NO: 681714 - DNA, 25 bp, Mus musculus
gcccacggcctcatccggatgagga

SEQ ID NO: 681715 - DNA, 25 bp, Mus musculus
gcccacggcctcttccggatgagga

SEQ ID NO: 681716 - DNA, 25 bp, Mus musculus
gcccacggtctacctgaagctagga

SEQ ID NO: 681717 - DNA, 25 bp, Mus musculus
gcccacggtctagctgaagctagga

SEQ ID NO: 681718 - DNA, 25 bp, Mus musculus
gcccacggttttctggaaatctgaa

SEQ ID NO: 681719 - DNA, 25 bp, Mus musculus
gcccacggttttgtggaaatctgaa

SEQ ID NO: 681720 - DNA, 25 bp, Mus musculus
gcccacgtactgcaaatctaggaat

SEQ ID NO: 681721 - DNA, 25 bp, Mus musculus
gcccacgtactggaaatctaggaat

SEQ ID NO: 681722 - DNA, 25 bp, Mus musculus
gcccacgtcagtcggattaaagaac

SEQ ID NO: 681723 - DNA, 25 bp, Mus musculus
gcccacgtcagtgggattaaagaac

SEQ ID NO: 681724 - DNA, 25 bp, Mus musculus
gcccactatacgacaccaaggtgat

SEQ ID NO: 681725 - DNA, 25 bp, Mus musculus
gcccactatacgtcaccaaggtgat

SEQ ID NO: 681726 - DNA, 25 bp, Mus musculus
gcccactctcggaccttatcagatg

SEQ ID NO: 681727 - DNA, 25 bp, Mus musculus
gcccactctcggtccttatcagatg

SEQ ID NO: 681728 - DNA, 25 bp, Mus musculus
gcccactgaatactaatcacacagg

SEQ ID NO: 681729 - DNA, 25 bp, Mus musculus
gcccactgaatagtaatcacacagg

SEQ ID NO: 681730 - DNA, 25 bp, Mus musculus
gcccactgacatacctgttccggag

SEQ ID NO: 681731 - DNA, 25 bp, Mus musculus
gcccactgacattcctgttccggag

SEQ ID NO: 681732 - DNA, 25 bp, Mus musculus
gcccactgataaccatgactgccga

SEQ ID NO: 681733 - DNA, 25 bp, Mus musculus
gcccactgataagcatgactgccga

SEQ ID NO: 681734 - DNA, 25 bp, Mus musculus
gcccactgcggcacgtccttaggga

SEQ ID NO: 681735 - DNA, 25 bp, Mus musculus
gcccactgcggctcgtccttaggga

SEQ ID NO: 681736 - DNA, 25 bp, Mus musculus
gcccactggattaacgggcataaag

SEQ ID NO: 681737 - DNA, 25 bp, Mus musculus
gcccactggatttacgggcataaag

SEQ ID NO: 681738 - DNA, 25 bp, Mus musculus
gcccactgggcaactatctctaaat

SEQ ID NO: 681739 - DNA, 25 bp, Mus musculus
gcccactgggcatctatctctaaat

SEQ ID NO: 681740 - DNA, 25 bp, Mus musculus
gcccactgtagtcacgctcttcgat

SEQ ID NO: 681741 - DNA, 25 bp, Mus musculus
gcccactgtagtgacgctcttcgat

SEQ ID NO: 681742 - DNA, 25 bp, Mus musculus
gcccacttcatcatgactgacgatg

SEQ ID NO: 681743 - DNA, 25 bp, Mus musculus
gcccacttcatcttgactgacgatg

SEQ ID NO: 681744 - DNA, 25 bp, Mus musculus
gcccacttgctaaggagaggatcaa

SEQ ID NO: 681745 - DNA, 25 bp, Mus musculus
gcccacttgctatggagaggatcaa

SEQ ID NO: 681746 - DNA, 25 bp, Mus musculus
gcccacttggtgaatgccctcaact

SEQ ID NO: 681747 - DNA, 25 bp, Mus musculus
gcccacttggtgtatgccctcaact

SEQ ID NO: 681748 - DNA, 25 bp, Mus musculus
gcccactttagccacaatgagtgtt

SEQ ID NO: 681749 - DNA, 25 bp, Mus musculus
gcccactttagcgacaatgagtgtt

SEQ ID NO: 681750 - DNA, 25 bp, Mus musculus
gcccagaaagccattcagcaactct

SEQ ID NO: 681751 - DNA, 25 bp, Mus musculus
gcccagaaagcctttcagcaactct

SEQ ID NO: 681752 - DNA, 25 bp, Mus musculus
gcccagaaagtgagcatggctccag

SEQ ID NO: 681753 - DNA, 25 bp, Mus musculus
gcccagaaagtgtgcatggctccag

SEQ ID NO: 681754 - DNA, 25 bp, Mus musculus
gcccagaacataatgcagtcctttg

SEQ ID NO: 681755 - DNA, 25 bp, Mus musculus
gcccagaacatattgcagtcctttg

SEQ ID NO: 681756 - DNA, 25 bp, Mus musculus
gcccagaactcgaggcgtctgctta

SEQ ID NO: 681757 - DNA, 25 bp, Mus musculus
gcccagaactcgtggcgtctgctta

SEQ ID NO: 681758 - DNA, 25 bp, Mus musculus
gcccagaactgtccggtcatgcaca

SEQ ID NO: 681759 - DNA, 25 bp, Mus musculus
gcccagaactgtgcggtcatgcaca

SEQ ID NO: 681760 - DNA, 25 bp, Mus musculus
gcccagaagaccagaaagccctgtc

SEQ ID NO: 681761 - DNA, 25 bp, Mus musculus
gcccagaagacctgaaagccctgtc

SEQ ID NO: 681762 - DNA, 25 bp, Mus musculus
gcccagaagactcggagccacattc

SEQ ID NO: 681763 - DNA, 25 bp, Mus musculus
gcccagaagactgggagccacattc

SEQ ID NO: 681764 - DNA, 25 bp, Mus musculus
gcccagaaggcaccactgcgcatgt

SEQ ID NO: 681765 - DNA, 25 bp, Mus musculus
gcccagaaggcagcactgcgcatgt

SEQ ID NO: 681766 - DNA, 25 bp, Mus musculus
gcccagaaggttccctcatcattgc

SEQ ID NO: 681767 - DNA, 25 bp, Mus musculus
gcccagaaggttgcctcatcattgc

SEQ ID NO: 681768 - DNA, 25 bp, Mus musculus
gcccagaatcgtccctctctatgga

SEQ ID NO: 681769 - DNA, 25 bp, Mus musculus
gcccagaatcgtgcctctctatgga

SEQ ID NO: 681770 - DNA, 25 bp, Mus musculus
gcccagaccatgatgactgctttgg

SEQ ID NO: 681771 - DNA, 25 bp, Mus musculus
gcccagaccatgttgactgctttgg

SEQ ID NO: 681772 - DNA, 25 bp, Mus musculus
gcccagacctcgcttaataagacgt

SEQ ID NO: 681773 - DNA, 25 bp, Mus musculus
gcccagacctcggttaataagacgt

SEQ ID NO: 681774 - DNA, 25 bp, Mus musculus
gcccagacctggatacaaagcccag

SEQ ID NO: 681775 - DNA, 25 bp, Mus musculus
gcccagacctggttacaaagcccag

SEQ ID NO: 681776 - DNA, 25 bp, Mus musculus
gcccagacgaagaggagagagctcc

SEQ ID NO: 681777 - DNA, 25 bp, Mus musculus
gcccagacgaagtggagagagctcc

SEQ ID NO: 681778 - DNA, 25 bp, Mus musculus
gcccagagcaggctaaccacatttg

SEQ ID NO: 681779 - DNA, 25 bp, Mus musculus
gcccagagcagggtaaccacatttg

SEQ ID NO: 681780 - DNA, 25 bp, Mus musculus
gcccagagcggtagtttctacagta

SEQ ID NO: 681781 - DNA, 25 bp, Mus musculus
gcccagagcggttgtttctacagta

SEQ ID NO: 681782 - DNA, 25 bp, Mus musculus
gcccagagctggcatgggaccattc

SEQ ID NO: 681783 - DNA, 25 bp, Mus musculus
gcccagagctgggatgggaccattc

SEQ ID NO: 681784 - DNA, 25 bp, Mus musculus
gcccagaggaaacaggcctgataca

SEQ ID NO: 681785 - DNA, 25 bp, Mus musculus
gcccagaggaaagaggcctgataca

SEQ ID NO: 681786 - DNA, 25 bp, Mus musculus
gcccagaggagaagaaacaattaga

SEQ ID NO: 681787 - DNA, 25 bp, Mus musculus
gcccagaggagatgaaacaattaga

SEQ ID NO: 681788 - DNA, 25 bp, Mus musculus
gcccagaggagcatatacagggatg

SEQ ID NO: 681789 - DNA, 25 bp, Mus musculus
gcccagaggagcatctggaagcaaa

SEQ ID NO: 681790 - DNA, 25 bp, Mus musculus
gcccagaggagcttatacagggatg

SEQ ID NO: 681791 - DNA, 25 bp, Mus musculus
gcccagaggagcttctggaagcaaa

SEQ ID NO: 681792 - DNA, 25 bp, Mus musculus
gcccagaggtaaatgtgcctaaagc

SEQ ID NO: 681793 - DNA, 25 bp, Mus musculus
gcccagaggtaattgtgcctaaagc

SEQ ID NO: 681794 - DNA, 25 bp, Mus musculus
gcccagaggtcaatatcacactatg

SEQ ID NO: 681795 - DNA, 25 bp, Mus musculus
gcccagaggtcattatcacactatg

SEQ ID NO: 681796 - DNA, 25 bp, Mus musculus
gcccagaggttgcttcctgctgtga

SEQ ID NO: 681797 - DNA, 25 bp, Mus musculus
gcccagaggttggttcctgctgtga

SEQ ID NO: 681798 - DNA, 25 bp, Mus musculus
gcccagagtgcccataacacagaac

SEQ ID NO: 681799 - DNA, 25 bp, Mus musculus
gcccagagtgccgataacacagaac

SEQ ID NO: 681800 - DNA, 25 bp, Mus musculus
gcccagataccacagagtctctgaa

SEQ ID NO: 681801 - DNA, 25 bp, Mus musculus
gcccagataccagagagtctctgaa

SEQ ID NO: 681802 - DNA, 25 bp, Mus musculus
gcccagatggatctcactgacaaca

SEQ ID NO: 681803 - DNA, 25 bp, Mus musculus
gcccagatggatgtcactgacaaca

SEQ ID NO: 681804 - DNA, 25 bp, Mus musculus
gcccagattaagctgctgctggaga

SEQ ID NO: 681805 - DNA, 25 bp, Mus musculus
gcccagattaaggtgctgctggaga

SEQ ID NO: 681806 - DNA, 25 bp, Mus musculus
gcccagattgctatgcatcgctgca

SEQ ID NO: 681807 - DNA, 25 bp, Mus musculus
gcccagattgctttgcatcgctgca

SEQ ID NO: 681808 - DNA, 25 bp, Mus musculus
gcccagattgtgaaagacatccagg

SEQ ID NO: 681809 - DNA, 25 bp, Mus musculus
gcccagattgtgtaagacatccagg

SEQ ID NO: 681810 - DNA, 25 bp, Mus musculus
gcccagcaacacagcctctaagtta

SEQ ID NO: 681811 - DNA, 25 bp, Mus musculus
gcccagcaacactgcctctaagtta

SEQ ID NO: 681812 - DNA, 25 bp, Mus musculus
gcccagcaacctagctgtgaacgaa

SEQ ID NO: 681813 - DNA, 25 bp, Mus musculus
gcccagcaaccttgctgtgaacgaa

SEQ ID NO: 681814 - DNA, 25 bp, Mus musculus
gcccagcaagaaagtcaaaccacta

SEQ ID NO: 681815 - DNA, 25 bp, Mus musculus
gcccagcaagaatgtcaaaccacta

SEQ ID NO: 681816 - DNA, 25 bp, Mus musculus
gcccagcacggcctatgtggtgctc

SEQ ID NO: 681817 - DNA, 25 bp, Mus musculus
gcccagcacggcgtatgtggtgctc

SEQ ID NO: 681818 - DNA, 25 bp, Mus musculus
gcccagcagagtagtgttttcctga

SEQ ID NO: 681819 - DNA, 25 bp, Mus musculus
gcccagcagagttgtgttttcctga

SEQ ID NO: 681820 - DNA, 25 bp, Mus musculus
gcccagcagcgtatccagtgtgtga

SEQ ID NO: 681821 - DNA, 25 bp, Mus musculus
gcccagcagcgtttccagtgtgtga

SEQ ID NO: 681822 - DNA, 25 bp, Mus musculus
gcccagcaggccagcattgaggcca

SEQ ID NO: 681823 - DNA, 25 bp, Mus musculus
gcccagcaggcctgcattgaggcca

SEQ ID NO: 681824 - DNA, 25 bp, Mus musculus
gcccagcataatcagatcaggatcc

SEQ ID NO: 681825 - DNA, 25 bp, Mus musculus
gcccagcataatgagatcaggatcc

SEQ ID NO: 681826 - DNA, 25 bp, Mus musculus
gcccagccctgacaaaatgcttcag

SEQ ID NO: 681827 - DNA, 25 bp, Mus musculus
gcccagccctgagaaaatgcttcag

SEQ ID NO: 681828 - DNA, 25 bp, Mus musculus
gcccagccgtgtcatagccatggag

SEQ ID NO: 681829 - DNA, 25 bp, Mus musculus
gcccagccgtgtgatagccatggag

SEQ ID NO: 681830 - DNA, 25 bp, Mus musculus
gcccagcctgagactctatgtattg

SEQ ID NO: 681831 - DNA, 25 bp, Mus musculus
gcccagcctgagtctctatgtattg

SEQ ID NO: 681832 - DNA, 25 bp, Mus musculus
gcccagcctgcaaacaagagaagga

SEQ ID NO: 681833 - DNA, 25 bp, Mus musculus
gcccagcctgcatacaagagaagga

SEQ ID NO: 681834 - DNA, 25 bp, Mus musculus
gcccagcgacaaccaaccaaagatg

SEQ ID NO: 681835 - DNA, 25 bp, Mus musculus
gcccagcgacaagcaaccaaagatg

SEQ ID NO: 681836 - DNA, 25 bp, Mus musculus
gcccagcgacaccaagtcagaagct

SEQ ID NO: 681837 - DNA, 25 bp, Mus musculus
gcccagcgacacgaagtcagaagct

SEQ ID NO: 681838 - DNA, 25 bp, Mus musculus
gcccagcgccgaccaaagactatta

SEQ ID NO: 681839 - DNA, 25 bp, Mus musculus
gcccagcgccgagcaaagactatta

SEQ ID NO: 681840 - DNA, 25 bp, Mus musculus
gcccagcgcggtagttaatgcacaa

SEQ ID NO: 681841 - DNA, 25 bp, Mus musculus
gcccagcgcggttgttaatgcacaa

SEQ ID NO: 681842 - DNA, 25 bp, Mus musculus
gcccagcggtacagtcagtgcaata

SEQ ID NO: 681843 - DNA, 25 bp, Mus musculus
gcccagcggtactgtcagtgcaata

SEQ ID NO: 681844 - DNA, 25 bp, Mus musculus
gcccagcgtcctccaggtggtgaac

SEQ ID NO: 681845 - DNA, 25 bp, Mus musculus
gcccagcgtcctgcaggtggtgaac

SEQ ID NO: 681846 - DNA, 25 bp, Mus musculus
gcccagctatttctacagtctgaag

SEQ ID NO: 681847 - DNA, 25 bp, Mus musculus
gcccagctatttgtacagtctgaag

SEQ ID NO: 681848 - DNA, 25 bp, Mus musculus
gcccagctcagaatgtgacatatga

SEQ ID NO: 681849 - DNA, 25 bp, Mus musculus
gcccagctcagattgtgacatatga

SEQ ID NO: 681850 - DNA, 25 bp, Mus musculus
gcccagctcatgaattcaagcggct

SEQ ID NO: 681851 - DNA, 25 bp, Mus musculus
gcccagctcatgtattcaagcggct

SEQ ID NO: 681852 - DNA, 25 bp, Mus musculus
gcccagctctaccaagatgacaagc

SEQ ID NO: 681853 - DNA, 25 bp, Mus musculus
gcccagctctacgaagatgacaagc

SEQ ID NO: 681854 - DNA, 25 bp, Mus musculus
gcccagctctggctaaggaacctga

SEQ ID NO: 681855 - DNA, 25 bp, Mus musculus
gcccagctctgggtaaggaacctga

SEQ ID NO: 681856 - DNA, 25 bp, Mus musculus
gcccagctgatcatgcaggcagaag

SEQ ID NO: 681857 - DNA, 25 bp, Mus musculus
gcccagctgatcttgcaggcagaag

SEQ ID NO: 681858 - DNA, 25 bp, Mus musculus
gcccagctgattcatgacaggaaca

SEQ ID NO: 681859 - DNA, 25 bp, Mus musculus
gcccagctgattgatgacaggaaca

SEQ ID NO: 681860 - DNA, 25 bp, Mus musculus
gcccagctgcagacgagcgtcatgg

SEQ ID NO: 681861 - DNA, 25 bp, Mus musculus
gcccagctgcagtcgagcgtcatgg

SEQ ID NO: 681862 - DNA, 25 bp, Mus musculus
gcccagctggagacaaccctgaaat

SEQ ID NO: 681863 - DNA, 25 bp, Mus musculus
gcccagctggagtcaaccctgaaat

SEQ ID NO: 681864 - DNA, 25 bp, Mus musculus
gcccagctgttgatcttacagtctg

SEQ ID NO: 681865 - DNA, 25 bp, Mus musculus
gcccagctgttgttcttacagtctg

SEQ ID NO: 681866 - DNA, 25 bp, Mus musculus
gcccagcttcggacatcagcaacga

SEQ ID NO: 681867 - DNA, 25 bp, Mus musculus
gcccagcttcggtcatcagcaacga

SEQ ID NO: 681868 - DNA, 25 bp, Mus musculus
gcccagcttgctatgcctctgagct

SEQ ID NO: 681869 - DNA, 25 bp, Mus musculus
gcccagcttgctttgcctctgagct

SEQ ID NO: 681870 - DNA, 25 bp, Mus musculus
gcccaggaactcactccgggagagc

SEQ ID NO: 681871 - DNA, 25 bp, Mus musculus
gcccaggaactcctggatgatggcc

SEQ ID NO: 681872 - DNA, 25 bp, Mus musculus
gcccaggaactcgtggatgatggcc

SEQ ID NO: 681873 - DNA, 25 bp, Mus musculus
gcccaggaactctctccgggagagc

SEQ ID NO: 681874 - DNA, 25 bp, Mus musculus
gcccaggaatcacccaagagtgcca

SEQ ID NO: 681875 - DNA, 25 bp, Mus musculus
gcccaggaatcagccaagagtgcca

SEQ ID NO: 681876 - DNA, 25 bp, Mus musculus
gcccaggaatggattgaaaggttgc

SEQ ID NO: 681877 - DNA, 25 bp, Mus musculus
gcccaggaatggtttgaaaggttgc

SEQ ID NO: 681878 - DNA, 25 bp, Mus musculus
gcccaggacagtccctgggtgggat

SEQ ID NO: 681879 - DNA, 25 bp, Mus musculus
gcccaggacagtgcctgggtgggat

SEQ ID NO: 681880 - DNA, 25 bp, Mus musculus
gcccaggacttacctgaagaggttg

SEQ ID NO: 681881 - DNA, 25 bp, Mus musculus
gcccaggacttagctgaagaggttg

SEQ ID NO: 681882 - DNA, 25 bp, Mus musculus
gcccaggacttgcatcaacgccttt

SEQ ID NO: 681883 - DNA, 25 bp, Mus musculus
gcccaggacttggatcaacgccttt

SEQ ID NO: 681884 - DNA, 25 bp, Mus musculus
gcccaggagaccatcatgcagtggg

SEQ ID NO: 681885 - DNA, 25 bp, Mus musculus
gcccaggagaccttcatgcagtggg

SEQ ID NO: 681886 - DNA, 25 bp, Mus musculus
gcccaggagagtatgagtccttcat

SEQ ID NO: 681887 - DNA, 25 bp, Mus musculus
gcccaggagagtttgagtccttcat

SEQ ID NO: 681888 - DNA, 25 bp, Mus musculus
gcccaggatcctagccttttatcaa

SEQ ID NO: 681889 - DNA, 25 bp, Mus musculus
gcccaggatccttgccttttatcaa

SEQ ID NO: 681890 - DNA, 25 bp, Mus musculus
gcccaggatgggagaattcaatgag

SEQ ID NO: 681891 - DNA, 25 bp, Mus musculus
gcccaggatgggtgaattcaatgag

SEQ ID NO: 681892 - DNA, 25 bp, Mus musculus
gcccaggcagagactctacgctaca

SEQ ID NO: 681893 - DNA, 25 bp, Mus musculus
gcccaggcagagtctctacgctaca

SEQ ID NO: 681894 - DNA, 25 bp, Mus musculus
gcccaggccccgaactgtctggttg

SEQ ID NO: 681895 - DNA, 25 bp, Mus musculus
gcccaggccccgtactgtctggttg

SEQ ID NO: 681896 - DNA, 25 bp, Mus musculus
gcccaggcgcaaagtgacaagctgc

SEQ ID NO: 681897 - DNA, 25 bp, Mus musculus
gcccaggcgcaatgtgacaagctgc

SEQ ID NO: 681898 - DNA, 25 bp, Mus musculus
gcccaggctattcctgacctcagat

SEQ ID NO: 681899 - DNA, 25 bp, Mus musculus
gcccaggctattgctgacctcagat

SEQ ID NO: 681900 - DNA, 25 bp, Mus musculus
gcccaggcttggacagagcagtcag

SEQ ID NO: 681901 - DNA, 25 bp, Mus musculus
gcccaggcttggtcagagcagtcag

SEQ ID NO: 681902 - DNA, 25 bp, Mus musculus
gcccagggacctatagaaatgcaga

SEQ ID NO: 681903 - DNA, 25 bp, Mus musculus
gcccagggacctttagaaatgcaga

SEQ ID NO: 681904 - DNA, 25 bp, Mus musculus
gcccagggacgcatactggctctta

SEQ ID NO: 681905 - DNA, 25 bp, Mus musculus
gcccagggacgcttactggctctta

SEQ ID NO: 681906 - DNA, 25 bp, Mus musculus
gcccagggagagatgctctacctgg

SEQ ID NO: 681907 - DNA, 25 bp, Mus musculus
gcccagggagagttgctctacctgg

SEQ ID NO: 681908 - DNA, 25 bp, Mus musculus
gcccagggaggtcctcacaggtaac

SEQ ID NO: 681909 - DNA, 25 bp, Mus musculus
gcccagggaggtgctcacaggtaac

SEQ ID NO: 681910 - DNA, 25 bp, Mus musculus
gcccagggattgaggttgtaagcct

SEQ ID NO: 681911 - DNA, 25 bp, Mus musculus
gcccagggattgtggttgtaagcct

SEQ ID NO: 681912 - DNA, 25 bp, Mus musculus
gcccagggcttgcaagagtccttct

SEQ ID NO: 681913 - DNA, 25 bp, Mus musculus
gcccagggcttggaagagtccttct

SEQ ID NO: 681914 - DNA, 25 bp, Mus musculus
gcccagggtatcagcctggaactaa

SEQ ID NO: 681915 - DNA, 25 bp, Mus musculus
gcccagggtatctgcctggaactaa

SEQ ID NO: 681916 - DNA, 25 bp, Mus musculus
gcccagggtctcagcagtgaagcct

SEQ ID NO: 681917 - DNA, 25 bp, Mus musculus
gcccagggtctctgcagtgaagcct

SEQ ID NO: 681918 - DNA, 25 bp, Mus musculus
gcccaggtccgcatggtggacatgc

SEQ ID NO: 681919 - DNA, 25 bp, Mus musculus
gcccaggtccgcttggtggacatgc

SEQ ID NO: 681920 - DNA, 25 bp, Mus musculus
gcccaggtgcatagccaagcttgcc

SEQ ID NO: 681921 - DNA, 25 bp, Mus musculus
gcccaggtgcattgccaagcttgcc

SEQ ID NO: 681922 - DNA, 25 bp, Mus musculus
gcccaggtgcccatcgatggcatgt

SEQ ID NO: 681923 - DNA, 25 bp, Mus musculus
gcccaggtgcccttcgatggcatgt

SEQ ID NO: 681924 - DNA, 25 bp, Mus musculus
gcccaggtggacagcaacaacagcc

SEQ ID NO: 681925 - DNA, 25 bp, Mus musculus
gcccaggtggactgcaacaacagcc

SEQ ID NO: 681926 - DNA, 25 bp, Mus musculus
gcccagtactatcgcgatatcggca

SEQ ID NO: 681927 - DNA, 25 bp, Mus musculus
gcccagtactatggcgatatcggca

SEQ ID NO: 681928 - DNA, 25 bp, Mus musculus
gcccagtagagtcaggtgcagccta

SEQ ID NO: 681929 - DNA, 25 bp, Mus musculus
gcccagtagagtgaggtgcagccta

SEQ ID NO: 681930 - DNA, 25 bp, Mus musculus
gcccagtataaaatgtgaagatgca

SEQ ID NO: 681931 - DNA, 25 bp, Mus musculus
gcccagtataaattgtgaagatgca

SEQ ID NO: 681932 - DNA, 25 bp, Mus musculus
gcccagtccacaagttggtgatgcc

SEQ ID NO: 681933 - DNA, 25 bp, Mus musculus
gcccagtccacatgttggtgatgcc

SEQ ID NO: 681934 - DNA, 25 bp, Mus musculus
gcccagtccagcactggtctctgta

SEQ ID NO: 681935 - DNA, 25 bp, Mus musculus
gcccagtccagctctggtctctgta

SEQ ID NO: 681936 - DNA, 25 bp, Mus musculus
gcccagtccctgatcatggtgggag

SEQ ID NO: 681937 - DNA, 25 bp, Mus musculus
gcccagtccctgttcatggtgggag

SEQ ID NO: 681938 - DNA, 25 bp, Mus musculus
gcccagtcgctgagagtacctcatg

SEQ ID NO: 681939 - DNA, 25 bp, Mus musculus
gcccagtcgctgtgagtacctcatg

SEQ ID NO: 681940 - DNA, 25 bp, Mus musculus
gcccagtctacccaggatgaggttg

SEQ ID NO: 681941 - DNA, 25 bp, Mus musculus
gcccagtctaccgaggatgaggttg

SEQ ID NO: 681942 - DNA, 25 bp, Mus musculus
gcccagtctcagcaaacatcattcg

SEQ ID NO: 681943 - DNA, 25 bp, Mus musculus
gcccagtctcaggaaacatcattcg

SEQ ID NO: 681944 - DNA, 25 bp, Mus musculus
gcccagtcttcacaggattttctaa

SEQ ID NO: 681945 - DNA, 25 bp, Mus musculus
gcccagtcttcagaggattttctaa

SEQ ID NO: 681946 - DNA, 25 bp, Mus musculus
gcccagtcttgtctgagctctagta

SEQ ID NO: 681947 - DNA, 25 bp, Mus musculus
gcccagtcttgtgtgagctctagta

SEQ ID NO: 681948 - DNA, 25 bp, Mus musculus
gcccagtggacgaggtgttcctctt

SEQ ID NO: 681949 - DNA, 25 bp, Mus musculus
gcccagtggacgtggtgttcctctt

SEQ ID NO: 681950 - DNA, 25 bp, Mus musculus
gcccagtgtcatccgtttctgctgc

SEQ ID NO: 681951 - DNA, 25 bp, Mus musculus
gcccagtgtcatgcgtttctgctgc

SEQ ID NO: 681952 - DNA, 25 bp, Mus musculus
gcccagtgttaccaccaagaaggtc

SEQ ID NO: 681953 - DNA, 25 bp, Mus musculus
gcccagtgttacgaccaagaaggtc

SEQ ID NO: 681954 - DNA, 25 bp, Mus musculus
gcccagtgttccagtggagtggaat

SEQ ID NO: 681955 - DNA, 25 bp, Mus musculus
gcccagtgttcctgtggagtggaat

SEQ ID NO: 681956 - DNA, 25 bp, Mus musculus
gcccagttaaaaactgagagtgaag

SEQ ID NO: 681957 - DNA, 25 bp, Mus musculus
gcccagttaaaatctgagagtgaag

SEQ ID NO: 681958 - DNA, 25 bp, Mus musculus
gcccagttcccactggataaagccg

SEQ ID NO: 681959 - DNA, 25 bp, Mus musculus
gcccagttcccagtggataaagccg

SEQ ID NO: 681960 - DNA, 25 bp, Mus musculus
gcccagttggagagacctttgccca

SEQ ID NO: 681961 - DNA, 25 bp, Mus musculus
gcccagttggagatcctagcccaca

SEQ ID NO: 681962 - DNA, 25 bp, Mus musculus
gcccagttggagtgacctttgccca

SEQ ID NO: 681963 - DNA, 25 bp, Mus musculus
gcccagttggagttcctagcccaca

SEQ ID NO: 681964 - DNA, 25 bp, Mus musculus
gcccagttggccaatgagctgcaag

SEQ ID NO: 681965 - DNA, 25 bp, Mus musculus
gcccagttggcctatgagctgcaag

SEQ ID NO: 681966 - DNA, 25 bp, Mus musculus
gcccagtttgatctagccttcgtcg

SEQ ID NO: 681967 - DNA, 25 bp, Mus musculus
gcccagtttgatgtagccttcgtcg

SEQ ID NO: 681968 - DNA, 25 bp, Mus musculus
gcccagtttgctccccttgtgttga

SEQ ID NO: 681969 - DNA, 25 bp, Mus musculus
gcccagtttgctgcccttgtgttga

SEQ ID NO: 681970 - DNA, 25 bp, Mus musculus
gcccagtttggcagagtcttttcat

SEQ ID NO: 681971 - DNA, 25 bp, Mus musculus
gcccagtttggctgagtcttttcat

SEQ ID NO: 681972 - DNA, 25 bp, Mus musculus
gcccataaagatattaagaaagcag

SEQ ID NO: 681973 - DNA, 25 bp, Mus musculus
gcccataaagattttaagaaagcag

SEQ ID NO: 681974 - DNA, 25 bp, Mus musculus
gcccatatctacagctgggcccagg

SEQ ID NO: 681975 - DNA, 25 bp, Mus musculus
gcccatatctactgctgggcccagg

SEQ ID NO: 681976 - DNA, 25 bp, Mus musculus
gcccatattggcactagaggaggat

SEQ ID NO: 681977 - DNA, 25 bp, Mus musculus
gcccatattggctctagaggaggat

SEQ ID NO: 681978 - DNA, 25 bp, Mus musculus
gcccatcactccctaggcaggagta

SEQ ID NO: 681979 - DNA, 25 bp, Mus musculus
gcccatcactccgtaggcaggagta

SEQ ID NO: 681980 - DNA, 25 bp, Mus musculus
gcccatcagtataaatgccacgtca

SEQ ID NO: 681981 - DNA, 25 bp, Mus musculus
gcccatcagtattaatgccacgtca

SEQ ID NO: 681982 - DNA, 25 bp, Mus musculus
gcccatcagtctcacagtggccaag

SEQ ID NO: 681983 - DNA, 25 bp, Mus musculus
gcccatcagtctgacagtggccaag

SEQ ID NO: 681984 - DNA, 25 bp, Mus musculus
gcccatcagtgcaatggctgcagca

SEQ ID NO: 681985 - DNA, 25 bp, Mus musculus
gcccatcagtgcagacattgctgat

SEQ ID NO: 681986 - DNA, 25 bp, Mus musculus
gcccatcagtgctatggctgcagca

SEQ ID NO: 681987 - DNA, 25 bp, Mus musculus
gcccatcagtgctgacattgctgat

SEQ ID NO: 681988 - DNA, 25 bp, Mus musculus
gcccatcatctcagcgggcagcgaa

SEQ ID NO: 681989 - DNA, 25 bp, Mus musculus
gcccatcatctctgcgggcagcgaa

SEQ ID NO: 681990 - DNA, 25 bp, Mus musculus
gcccatccaccgagttgcagacatt

SEQ ID NO: 681991 - DNA, 25 bp, Mus musculus
gcccatccaccgtgttgcagacatt

SEQ ID NO: 681992 - DNA, 25 bp, Mus musculus
gcccatccaggaactgctaatcaac

SEQ ID NO: 681993 - DNA, 25 bp, Mus musculus
gcccatccaggatctgctaatcaac

SEQ ID NO: 681994 - DNA, 25 bp, Mus musculus
gcccatcgtggtcacaatacctcgt

SEQ ID NO: 681995 - DNA, 25 bp, Mus musculus
gcccatcgtggtgacaatacctcgt

SEQ ID NO: 681996 - DNA, 25 bp, Mus musculus
gcccatgaacacattttcgggatgg

SEQ ID NO: 681997 - DNA, 25 bp, Mus musculus
gcccatgaacactttttcgggatgg

SEQ ID NO: 681998 - DNA, 25 bp, Mus musculus
gcccatgaagagcttgactatactg

SEQ ID NO: 681999 - DNA, 25 bp, Mus musculus
gcccatgaagaggttgactatactg

SEQ ID NO: 682000 - DNA, 25 bp, Mus musculus
gcccatgaagctcccacagatacgt

SEQ ID NO: 682001 - DNA, 25 bp, Mus musculus
gcccatgaagctgccacagatacgt

SEQ ID NO: 682002 - DNA, 25 bp, Mus musculus
gcccatgaaggccagcccagtgagt

SEQ ID NO: 682003 - DNA, 25 bp, Mus musculus
gcccatgaaggcgagcccagtgagt

SEQ ID NO: 682004 - DNA, 25 bp, Mus musculus
gcccatgagaggaactactagatct

SEQ ID NO: 682005 - DNA, 25 bp, Mus musculus
gcccatgagaggtactactagatct

SEQ ID NO: 682006 - DNA, 25 bp, Mus musculus
gcccatgatcacaggtgcctgcaga

SEQ ID NO: 682007 - DNA, 25 bp, Mus musculus
gcccatgatcactggtgcctgcaga

SEQ ID NO: 682008 - DNA, 25 bp, Mus musculus
gcccatgattgcaggccttgggaag

SEQ ID NO: 682009 - DNA, 25 bp, Mus musculus
gcccatgattgctggccttgggaag

SEQ ID NO: 682010 - DNA, 25 bp, Mus musculus
gcccatgctaaactaagattttcaa

SEQ ID NO: 682011 - DNA, 25 bp, Mus musculus
gcccatgctaaagtaagattttcaa

SEQ ID NO: 682012 - DNA, 25 bp, Mus musculus
gcccatgcttacaggtgctgtgcag

SEQ ID NO: 682013 - DNA, 25 bp, Mus musculus
gcccatgcttactggtgctgtgcag

SEQ ID NO: 682014 - DNA, 25 bp, Mus musculus
gcccatggacagcagtgcatattcc

SEQ ID NO: 682015 - DNA, 25 bp, Mus musculus
gcccatggacaggagtgcatattcc

SEQ ID NO: 682016 - DNA, 25 bp, Mus musculus
gcccatggatatagacagtagtgat

SEQ ID NO: 682017 - DNA, 25 bp, Mus musculus
gcccatggatattgacagtagtgat

SEQ ID NO: 682018 - DNA, 25 bp, Mus musculus
gcccatggctctagtggtatgccga

SEQ ID NO: 682019 - DNA, 25 bp, Mus musculus
gcccatggctcttgtggtatgccga

SEQ ID NO: 682020 - DNA, 25 bp, Mus musculus
gcccatgtcacgatgctgtctgcca

SEQ ID NO: 682021 - DNA, 25 bp, Mus musculus
gcccatgtcacgttgctgtctgcca

SEQ ID NO: 682022 - DNA, 25 bp, Mus musculus
gcccatgtcctcagccgggagctgg

SEQ ID NO: 682023 - DNA, 25 bp, Mus musculus
gcccatgtcctctgccgggagctgg

SEQ ID NO: 682024 - DNA, 25 bp, Mus musculus
gcccatgtctgaacggaggcacctg

SEQ ID NO: 682025 - DNA, 25 bp, Mus musculus
gcccatgtctgatcggaggcacctg

SEQ ID NO: 682026 - DNA, 25 bp, Mus musculus
gcccattactgtcagcagcgagcag

SEQ ID NO: 682027 - DNA, 25 bp, Mus musculus
gcccattactgtgagcagcgagcag

SEQ ID NO: 682028 - DNA, 25 bp, Mus musculus
gcccattcaagtcctcgaaggctga

SEQ ID NO: 682029 - DNA, 25 bp, Mus musculus
gcccattcaagtgctcgaaggctga

SEQ ID NO: 682030 - DNA, 25 bp, Mus musculus
gcccattccccgaagagtcactgga

SEQ ID NO: 682031 - DNA, 25 bp, Mus musculus
gcccattccccgtagagtcactgga

SEQ ID NO: 682032 - DNA, 25 bp, Mus musculus
gcccattcgcagcaagagaagtatt

SEQ ID NO: 682033 - DNA, 25 bp, Mus musculus
gcccattcgcaggaagagaagtatt

SEQ ID NO: 682034 - DNA, 25 bp, Mus musculus
gcccattctatgatcaccagtggtt

SEQ ID NO: 682035 - DNA, 25 bp, Mus musculus
gcccattctatgttcaccagtggtt

SEQ ID NO: 682036 - DNA, 25 bp, Mus musculus
gcccattgccatcacagtgcctaga

SEQ ID NO: 682037 - DNA, 25 bp, Mus musculus
gcccattgccatgacagtgcctaga

SEQ ID NO: 682038 - DNA, 25 bp, Mus musculus
gcccattggaatattaagcccggga

SEQ ID NO: 682039 - DNA, 25 bp, Mus musculus
gcccattggaattttaagcccggga

SEQ ID NO: 682040 - DNA, 25 bp, Mus musculus
gcccattgtctccaaggatactgaa

SEQ ID NO: 682041 - DNA, 25 bp, Mus musculus
gcccattgtctcgaaggatactgaa

SEQ ID NO: 682042 - DNA, 25 bp, Mus musculus
gcccatttcaatctttcccaagtca

SEQ ID NO: 682043 - DNA, 25 bp, Mus musculus
gcccatttcaatgtttcccaagtca

SEQ ID NO: 682044 - DNA, 25 bp, Mus musculus
gcccatttgaggagtcactgaacta

SEQ ID NO: 682045 - DNA, 25 bp, Mus musculus
gcccatttgaggtgtcactgaacta

SEQ ID NO: 682046 - DNA, 25 bp, Mus musculus
gcccatttgtccaggtcagtatatt

SEQ ID NO: 682047 - DNA, 25 bp, Mus musculus
gcccatttgtcctggtcagtatatt

SEQ ID NO: 682048 - DNA, 25 bp, Mus musculus
gcccattttcaaaggagctctccct

SEQ ID NO: 682049 - DNA, 25 bp, Mus musculus
gcccattttcaatggagctctccct

SEQ ID NO: 682050 - DNA, 25 bp, Mus musculus
gccccaaaatggataaggttgcaag

SEQ ID NO: 682051 - DNA, 25 bp, Mus musculus
gccccaaaatggttaaggttgcaag

SEQ ID NO: 682052 - DNA, 25 bp, Mus musculus
gccccaaacgagagtgacttctgcg

SEQ ID NO: 682053 - DNA, 25 bp, Mus musculus
gccccaaacgagtgtgacttctgcg

SEQ ID NO: 682054 - DNA, 25 bp, Mus musculus
gccccaaactacagcactgtcatgg

SEQ ID NO: 682055 - DNA, 25 bp, Mus musculus
gccccaaactactgcactgtcatgg

SEQ ID NO: 682056 - DNA, 25 bp, Mus musculus
gccccaagagcgcacgctggttgct

SEQ ID NO: 682057 - DNA, 25 bp, Mus musculus
gccccaagagcggacgctggttgct

SEQ ID NO: 682058 - DNA, 25 bp, Mus musculus
gccccaagccagagattgctgccat

SEQ ID NO: 682059 - DNA, 25 bp, Mus musculus
gccccaagccagtgattgctgccat

SEQ ID NO: 682060 - DNA, 25 bp, Mus musculus
gccccaaggaggaaaatgtggacgt

SEQ ID NO: 682061 - DNA, 25 bp, Mus musculus
gccccaaggaggtaaatgtggacgt

SEQ ID NO: 682062 - DNA, 25 bp, Mus musculus
gccccaaggcagacagaagcgatgg

SEQ ID NO: 682063 - DNA, 25 bp, Mus musculus
gccccaaggcagtcagaagcgatgg

SEQ ID NO: 682064 - DNA, 25 bp, Mus musculus
gccccaagggtcctaaataccagat

SEQ ID NO: 682065 - DNA, 25 bp, Mus musculus
gccccaagggtcgtaaataccagat

SEQ ID NO: 682066 - DNA, 25 bp, Mus musculus
gccccaagggtgaacgtggagctcc

SEQ ID NO: 682067 - DNA, 25 bp, Mus musculus
gccccaagggtgtacgtggagctcc

SEQ ID NO: 682068 - DNA, 25 bp, Mus musculus
gccccaaggttcagctactgttgct

SEQ ID NO: 682069 - DNA, 25 bp, Mus musculus
gccccaaggttctgctactgttgct

SEQ ID NO: 682070 - DNA, 25 bp, Mus musculus
gccccaagtgtcaagctcttctgct

SEQ ID NO: 682071 - DNA, 25 bp, Mus musculus
gccccaagtgtctagctcttctgct

SEQ ID NO: 682072 - DNA, 25 bp, Mus musculus
gccccactgaagatacacaagacca

SEQ ID NO: 682073 - DNA, 25 bp, Mus musculus
gccccactgaagttacacaagacca

SEQ ID NO: 682074 - DNA, 25 bp, Mus musculus
gccccactgaggcaaaagctgctgg

SEQ ID NO: 682075 - DNA, 25 bp, Mus musculus
gccccactgagggaaaagctgctgg

SEQ ID NO: 682076 - DNA, 25 bp, Mus musculus
gccccactgcttagagctactgagt

SEQ ID NO: 682077 - DNA, 25 bp, Mus musculus
gccccactgctttgagctactgagt

SEQ ID NO: 682078 - DNA, 25 bp, Mus musculus
gccccactggtgaagtctctctgcg

SEQ ID NO: 682079 - DNA, 25 bp, Mus musculus
gccccactggtgtagtctctctgcg

SEQ ID NO: 682080 - DNA, 25 bp, Mus musculus
gccccagaacataggcgatgtgtat

SEQ ID NO: 682081 - DNA, 25 bp, Mus musculus
gccccagaacattggcgatgtgtat

SEQ ID NO: 682082 - DNA, 25 bp, Mus musculus
gccccagaagtaatccggatgcagg

SEQ ID NO: 682083 - DNA, 25 bp, Mus musculus
gccccagaagtattccggatgcagg

SEQ ID NO: 682084 - DNA, 25 bp, Mus musculus
gccccagacatgaaagacaagtgat

SEQ ID NO: 682085 - DNA, 25 bp, Mus musculus
gccccagacatgtaagacaagtgat

SEQ ID NO: 682086 - DNA, 25 bp, Mus musculus
gccccagagccacgcgattaaaaaa

SEQ ID NO: 682087 - DNA, 25 bp, Mus musculus
gccccagagccaggcgattaaaaaa

SEQ ID NO: 682088 - DNA, 25 bp, Mus musculus
gccccagaggaaccaactattcaag

SEQ ID NO: 682089 - DNA, 25 bp, Mus musculus
gccccagaggaagcaactattcaag

SEQ ID NO: 682090 - DNA, 25 bp, Mus musculus
gccccagataatacccagcctatgg

SEQ ID NO: 682091 - DNA, 25 bp, Mus musculus
gccccagataattcccagcctatgg

SEQ ID NO: 682092 - DNA, 25 bp, Mus musculus
gccccagatccgctcagagctggat

SEQ ID NO: 682093 - DNA, 25 bp, Mus musculus
gccccagatccggtcagagctggat

SEQ ID NO: 682094 - DNA, 25 bp, Mus musculus
gccccagattatagccctgaaacaa

SEQ ID NO: 682095 - DNA, 25 bp, Mus musculus
gccccagattattgccctgaaacaa

SEQ ID NO: 682096 - DNA, 25 bp, Mus musculus
gccccagcaactaagacccaaggaa

SEQ ID NO: 682097 - DNA, 25 bp, Mus musculus
gccccagcaacttagacccaaggaa

SEQ ID NO: 682098 - DNA, 25 bp, Mus musculus
gccccagcctgtcagagttgcaact

SEQ ID NO: 682099 - DNA, 25 bp, Mus musculus
gccccagcctgtgagagttgcaact

SEQ ID NO: 682100 - DNA, 25 bp, Mus musculus
gccccagcctttcgtggatctgttg

SEQ ID NO: 682101 - DNA, 25 bp, Mus musculus
gccccagcctttggtggatctgttg

SEQ ID NO: 682102 - DNA, 25 bp, Mus musculus
gccccagctcacatgtgtagatgaa

SEQ ID NO: 682103 - DNA, 25 bp, Mus musculus
gccccagctcacttgtgtagatgaa

SEQ ID NO: 682104 - DNA, 25 bp, Mus musculus
gccccagctttgcaaattgatggca

SEQ ID NO: 682105 - DNA, 25 bp, Mus musculus
gccccagctttggaaattgatggca

SEQ ID NO: 682106 - DNA, 25 bp, Mus musculus
gccccaggacccagaagaaggtggc

SEQ ID NO: 682107 - DNA, 25 bp, Mus musculus
gccccaggaccctgaagaaggtggc

SEQ ID NO: 682108 - DNA, 25 bp, Mus musculus
gccccaggagagcaccgaggtctaa

SEQ ID NO: 682109 - DNA, 25 bp, Mus musculus
gccccaggagaggaccgaggtctaa

SEQ ID NO: 682110 - DNA, 25 bp, Mus musculus
gccccaggagatacagcttcgagtc

SEQ ID NO: 682111 - DNA, 25 bp, Mus musculus
gccccaggagattcagcttcgagtc

SEQ ID NO: 682112 - DNA, 25 bp, Mus musculus
gccccaggccccacggttggatagt

SEQ ID NO: 682113 - DNA, 25 bp, Mus musculus
gccccaggcccctcggttggatagt

SEQ ID NO: 682114 - DNA, 25 bp, Mus musculus
gccccaggcggcaggtcaagtctgc

SEQ ID NO: 682115 - DNA, 25 bp, Mus musculus
gccccaggcggctggtcaagtctgc

SEQ ID NO: 682116 - DNA, 25 bp, Mus musculus
gccccaggtggaccgattcttcaag

SEQ ID NO: 682117 - DNA, 25 bp, Mus musculus
gccccaggtggagcgattcttcaag

SEQ ID NO: 682118 - DNA, 25 bp, Mus musculus
gccccaggtgtcctccagtgcagaa

SEQ ID NO: 682119 - DNA, 25 bp, Mus musculus
gccccaggtgtcgtccagtgcagaa

SEQ ID NO: 682120 - DNA, 25 bp, Mus musculus
gccccaggtgttcgtgatgctgaac

SEQ ID NO: 682121 - DNA, 25 bp, Mus musculus
gccccaggtgttggtgatgctgaac

SEQ ID NO: 682122 - DNA, 25 bp, Mus musculus
gccccagtggccaccagagatgaat

SEQ ID NO: 682123 - DNA, 25 bp, Mus musculus
gccccagtggcctccagagatgaat

SEQ ID NO: 682124 - DNA, 25 bp, Mus musculus
gccccagtttgtcttctaccatgga

SEQ ID NO: 682125 - DNA, 25 bp, Mus musculus
gccccagtttgtgttctaccatgga

SEQ ID NO: 682126 - DNA, 25 bp, Mus musculus
gccccatacatgaggagcatgctgc

SEQ ID NO: 682127 - DNA, 25 bp, Mus musculus
gccccatacatgtggagcatgctgc

SEQ ID NO: 682128 - DNA, 25 bp, Mus musculus
gccccatccgcaacttggaggtcaa

SEQ ID NO: 682129 - DNA, 25 bp, Mus musculus
gccccatccgcatcttggaggtcaa

SEQ ID NO: 682130 - DNA, 25 bp, Mus musculus
gccccatgggctagaaaaggtacca

SEQ ID NO: 682131 - DNA, 25 bp, Mus musculus
gccccatgggcttgaaaaggtacca

SEQ ID NO: 682132 - DNA, 25 bp, Mus musculus
gccccatgggtcatccacctagaag

SEQ ID NO: 682133 - DNA, 25 bp, Mus musculus
gccccatgggtcttccacctagaag

SEQ ID NO: 682134 - DNA, 25 bp, Mus musculus
gccccatgtcggcaagtatgtgcaa

SEQ ID NO: 682135 - DNA, 25 bp, Mus musculus
gccccatgtcgggaagtatgtgcaa

SEQ ID NO: 682136 - DNA, 25 bp, Mus musculus
gccccatgtgggagaaaagagttca

SEQ ID NO: 682137 - DNA, 25 bp, Mus musculus
gccccatgtgggtgaaaagagttca

SEQ ID NO: 682138 - DNA, 25 bp, Mus musculus
gccccatgttggagcgaatccactt

SEQ ID NO: 682139 - DNA, 25 bp, Mus musculus
gccccatgttggtgcgaatccactt

SEQ ID NO: 682140 - DNA, 25 bp, Mus musculus
gccccatgtttgaccagtttgtgca

SEQ ID NO: 682141 - DNA, 25 bp, Mus musculus
gccccatgtttgtccagtttgtgca

SEQ ID NO: 682142 - DNA, 25 bp, Mus musculus
gccccattcggtcacggtgctgtac

SEQ ID NO: 682143 - DNA, 25 bp, Mus musculus
gccccattcggtgacggtgctgtac

SEQ ID NO: 682144 - DNA, 25 bp, Mus musculus
gccccattggtaccagctgtagcag

SEQ ID NO: 682145 - DNA, 25 bp, Mus musculus
gccccattggtagcagctgtagcag

SEQ ID NO: 682146 - DNA, 25 bp, Mus musculus
gccccctcctggcaaagtggtagag

SEQ ID NO: 682147 - DNA, 25 bp, Mus musculus
gccccctcctgggaaagtggtagag

SEQ ID NO: 682148 - DNA, 25 bp, Mus musculus
gcccccttgtctaggtgctgaagga

SEQ ID NO: 682149 - DNA, 25 bp, Mus musculus
gcccccttgtcttggtgctgaagga

SEQ ID NO: 682150 - DNA, 25 bp, Mus musculus
gccccgaagtgacagcctgatccta

SEQ ID NO: 682151 - DNA, 25 bp, Mus musculus
gccccgaagtgagagcctgatccta

SEQ ID NO: 682152 - DNA, 25 bp, Mus musculus
gccccgaatcacagagagatgcaag

SEQ ID NO: 682153 - DNA, 25 bp, Mus musculus
gccccgaatcactgagagatgcaag

SEQ ID NO: 682154 - DNA, 25 bp, Mus musculus
gccccgaggacaagctgcatgacca

SEQ ID NO: 682155 - DNA, 25 bp, Mus musculus
gccccgaggacatgctgcatgacca

SEQ ID NO: 682156 - DNA, 25 bp, Mus musculus
gccccgaggccgcattctgggtggc

SEQ ID NO: 682157 - DNA, 25 bp, Mus musculus
gccccgaggccggattctgggtggc

SEQ ID NO: 682158 - DNA, 25 bp, Mus musculus
gccccgagggtcagctggttctctg

SEQ ID NO: 682159 - DNA, 25 bp, Mus musculus
gccccgagggtctgctggttctctg

SEQ ID NO: 682160 - DNA, 25 bp, Mus musculus
gccccgagtagtagacactcttggg

SEQ ID NO: 682161 - DNA, 25 bp, Mus musculus
gccccgagtagttgacactcttggg

SEQ ID NO: 682162 - DNA, 25 bp, Mus musculus
gccccgatgccgaggcatggataga

SEQ ID NO: 682163 - DNA, 25 bp, Mus musculus
gccccgatgccgtggcatggataga

SEQ ID NO: 682164 - DNA, 25 bp, Mus musculus
gccccgcagaggatggacctagaag

SEQ ID NO: 682165 - DNA, 25 bp, Mus musculus
gccccgcagaggttggacctagaag

SEQ ID NO: 682166 - DNA, 25 bp, Mus musculus
gccccgccaaggcatgggaaacagc

SEQ ID NO: 682167 - DNA, 25 bp, Mus musculus
gccccgccaagggatgggaaacagc

SEQ ID NO: 682168 - DNA, 25 bp, Mus musculus
gccccgcctgacaggatgagcagtt

SEQ ID NO: 682169 - DNA, 25 bp, Mus musculus
gccccgcctgactggatgagcagtt

SEQ ID NO: 682170 - DNA, 25 bp, Mus musculus
gccccgcgcctgagaattaacaagc

SEQ ID NO: 682171 - DNA, 25 bp, Mus musculus
gccccgcgcctgtgaattaacaagc

SEQ ID NO: 682172 - DNA, 25 bp, Mus musculus
gccccgctacgacttggctttgatt

SEQ ID NO: 682173 - DNA, 25 bp, Mus musculus
gccccgctacgagttggctttgatt

SEQ ID NO: 682174 - DNA, 25 bp, Mus musculus
gccccgctcggtcttaggtgtctga

SEQ ID NO: 682175 - DNA, 25 bp, Mus musculus
gccccgctcggtgttaggtgtctga

SEQ ID NO: 682176 - DNA, 25 bp, Mus musculus
gccccgctctgcagagatgctgcgg

SEQ ID NO: 682177 - DNA, 25 bp, Mus musculus
gccccgctctgctgagatgctgcgg

SEQ ID NO: 682178 - DNA, 25 bp, Mus musculus
gccccggaagtcaactgaaatgaac

SEQ ID NO: 682179 - DNA, 25 bp, Mus musculus
gccccggaagtctactgaaatgaac

SEQ ID NO: 682180 - DNA, 25 bp, Mus musculus
gccccggaagtgctttgtctgagac

SEQ ID NO: 682181 - DNA, 25 bp, Mus musculus
gccccggaagtggtttgtctgagac

SEQ ID NO: 682182 - DNA, 25 bp, Mus musculus
gccccggacgttcgtgagcaccaag

SEQ ID NO: 682183 - DNA, 25 bp, Mus musculus
gccccggacgttggtgagcaccaag

SEQ ID NO: 682184 - DNA, 25 bp, Mus musculus
gccccggaggcacattccgagtgca

SEQ ID NO: 682185 - DNA, 25 bp, Mus musculus
gccccggaggcagattccgagtgca

SEQ ID NO: 682186 - DNA, 25 bp, Mus musculus
gccccgggacgcatcttgtatagtg

SEQ ID NO: 682187 - DNA, 25 bp, Mus musculus
gccccgggacgcttcttgtatagtg

SEQ ID NO: 682188 - DNA, 25 bp, Mus musculus
gccccgggactcatattgtgacagg

SEQ ID NO: 682189 - DNA, 25 bp, Mus musculus
gccccgggactcttattgtgacagg

SEQ ID NO: 682190 - DNA, 25 bp, Mus musculus
gccccgggtcgcagccatcagtgtt

SEQ ID NO: 682191 - DNA, 25 bp, Mus musculus
gccccgggtcgctgccatcagtgtt

SEQ ID NO: 682192 - DNA, 25 bp, Mus musculus
gccccgggtgctctatggaaaacct

SEQ ID NO: 682193 - DNA, 25 bp, Mus musculus
gccccgggtgctgtatggaaaacct

SEQ ID NO: 682194 - DNA, 25 bp, Mus musculus
gccccgtattcgagccccgtgggat

SEQ ID NO: 682195 - DNA, 25 bp, Mus musculus
gccccgtattcgtgccccgtgggat

SEQ ID NO: 682196 - DNA, 25 bp, Mus musculus
gccccgtcgcgaagtttccagttca

SEQ ID NO: 682197 - DNA, 25 bp, Mus musculus
gccccgtcgcgatgtttccagttca

SEQ ID NO: 682198 - DNA, 25 bp, Mus musculus
gccccgtcggtgctattctgttgct

SEQ ID NO: 682199 - DNA, 25 bp, Mus musculus
gccccgtcggtggtattctgttgct

SEQ ID NO: 682200 - DNA, 25 bp, Mus musculus
gccccgtctacaaaggagtctgtaa

SEQ ID NO: 682201 - DNA, 25 bp, Mus musculus
gccccgtctacataggagtctgtaa

SEQ ID NO: 682202 - DNA, 25 bp, Mus musculus
gccccgtgccagagactggtcagct

SEQ ID NO: 682203 - DNA, 25 bp, Mus musculus
gccccgtgccagtgactggtcagct

SEQ ID NO: 682204 - DNA, 25 bp, Mus musculus
gccccgtggtgcattggcttaacgg

SEQ ID NO: 682205 - DNA, 25 bp, Mus musculus
gccccgtggtgctttggcttaacgg

SEQ ID NO: 682206 - DNA, 25 bp, Mus musculus
gccccgtgtgctccaggaactgaac

SEQ ID NO: 682207 - DNA, 25 bp, Mus musculus
gccccgtgtgctgcaggaactgaac

SEQ ID NO: 682208 - DNA, 25 bp, Mus musculus
gcccctaaggaaatgtttatcacgg

SEQ ID NO: 682209 - DNA, 25 bp, Mus musculus
gcccctaaggaattgtttatcacgg

SEQ ID NO: 682210 - DNA, 25 bp, Mus musculus
gcccctagtggaagagagagctccc

SEQ ID NO: 682211 - DNA, 25 bp, Mus musculus
gcccctagtggatgagagagctccc

SEQ ID NO: 682212 - DNA, 25 bp, Mus musculus
gcccctattaagctcgctttggatg

SEQ ID NO: 682213 - DNA, 25 bp, Mus musculus
gcccctattaaggtcgctttggatg

SEQ ID NO: 682214 - DNA, 25 bp, Mus musculus
gcccctcaaaaaagtatgaactcgt

SEQ ID NO: 682215 - DNA, 25 bp, Mus musculus
gcccctcaaaaatgtatgaactcgt

SEQ ID NO: 682216 - DNA, 25 bp, Mus musculus
gcccctcaaacaagactcgcgattt

SEQ ID NO: 682217 - DNA, 25 bp, Mus musculus
gcccctcaaacatgactcgcgattt

SEQ ID NO: 682218 - DNA, 25 bp, Mus musculus
gcccctcatcacagcagggatcttt

SEQ ID NO: 682219 - DNA, 25 bp, Mus musculus
gcccctcatcactgcagggatcttt

SEQ ID NO: 682220 - DNA, 25 bp, Mus musculus
gcccctcatgaaccgttggtggtat

SEQ ID NO: 682221 - DNA, 25 bp, Mus musculus
gcccctcatgaagcgttggtggtat

SEQ ID NO: 682222 - DNA, 25 bp, Mus musculus
gcccctcccaaaagaccagtgtgta

SEQ ID NO: 682223 - DNA, 25 bp, Mus musculus
gcccctcccaaatgaccagtgtgta

SEQ ID NO: 682224 - DNA, 25 bp, Mus musculus
gcccctcggatgacagtatatattc

SEQ ID NO: 682225 - DNA, 25 bp, Mus musculus
gcccctcggatgtcagtatatattc

SEQ ID NO: 682226 - DNA, 25 bp, Mus musculus
gcccctcggtaccagtctatgagaa

SEQ ID NO: 682227 - DNA, 25 bp, Mus musculus
gcccctcggtacgagtctatgagaa

SEQ ID NO: 682228 - DNA, 25 bp, Mus musculus
gcccctctttggattggctaggtca

SEQ ID NO: 682229 - DNA, 25 bp, Mus musculus
gcccctctttggtttggctaggtca

SEQ ID NO: 682230 - DNA, 25 bp, Mus musculus
gcccctgaaaacaataaaacacttg

SEQ ID NO: 682231 - DNA, 25 bp, Mus musculus
gcccctgaaaactataaaacacttg

SEQ ID NO: 682232 - DNA, 25 bp, Mus musculus
gcccctgaaactctggagcccgtgg

SEQ ID NO: 682233 - DNA, 25 bp, Mus musculus
gcccctgaaactgtggagcccgtgg

SEQ ID NO: 682234 - DNA, 25 bp, Mus musculus
gcccctgaacccaacaagcgatggt

SEQ ID NO: 682235 - DNA, 25 bp, Mus musculus
gcccctgaaccctacaagcgatggt

SEQ ID NO: 682236 - DNA, 25 bp, Mus musculus
gcccctgaagaaagcctcagatggt

SEQ ID NO: 682237 - DNA, 25 bp, Mus musculus
gcccctgaagaaccgtgatgtcatc

SEQ ID NO: 682238 - DNA, 25 bp, Mus musculus
gcccctgaagaagcgtgatgtcatc

SEQ ID NO: 682239 - DNA, 25 bp, Mus musculus
gcccctgaagaatgcctcagatggt

SEQ ID NO: 682240 - DNA, 25 bp, Mus musculus
gcccctgaagacacgggcctacaat

SEQ ID NO: 682241 - DNA, 25 bp, Mus musculus
gcccctgaagactcgggcctacaat

SEQ ID NO: 682242 - DNA, 25 bp, Mus musculus
gcccctgacgttcgaaacacctgta

SEQ ID NO: 682243 - DNA, 25 bp, Mus musculus
gcccctgacgttggaaacacctgta

SEQ ID NO: 682244 - DNA, 25 bp, Mus musculus
gcccctgagctgattggagaagtgc

SEQ ID NO: 682245 - DNA, 25 bp, Mus musculus
gcccctgagctgtttggagaagtgc

SEQ ID NO: 682246 - DNA, 25 bp, Mus musculus
gcccctgaggaactgacaacaggag

SEQ ID NO: 682247 - DNA, 25 bp, Mus musculus
gcccctgaggaagtgacaacaggag

SEQ ID NO: 682248 - DNA, 25 bp, Mus musculus
gcccctgaggcgatgtttgaccgga

SEQ ID NO: 682249 - DNA, 25 bp, Mus musculus
gcccctgaggcgttgtttgaccgga

SEQ ID NO: 682250 - DNA, 25 bp, Mus musculus
gcccctgagtccctttgaggatgtg

SEQ ID NO: 682251 - DNA, 25 bp, Mus musculus
gcccctgagtccgtttgaggatgtg

SEQ ID NO: 682252 - DNA, 25 bp, Mus musculus
gcccctgatttgatcaagacctcca

SEQ ID NO: 682253 - DNA, 25 bp, Mus musculus
gcccctgatttgttcaagacctcca

SEQ ID NO: 682254 - DNA, 25 bp, Mus musculus
gcccctgcctaaagaaaattgtgcc

SEQ ID NO: 682255 - DNA, 25 bp, Mus musculus
gcccctgcctaatgaaaattgtgcc

SEQ ID NO: 682256 - DNA, 25 bp, Mus musculus
gcccctgcgccacgaagtggagata

SEQ ID NO: 682257 - DNA, 25 bp, Mus musculus
gcccctgcgccaggaagtggagata

SEQ ID NO: 682258 - DNA, 25 bp, Mus musculus
gcccctgctctaccagaacggagga

SEQ ID NO: 682259 - DNA, 25 bp, Mus musculus
gcccctgctctagcagaacggagga

SEQ ID NO: 682260 - DNA, 25 bp, Mus musculus
gcccctgctgggaaagtgcccgact

SEQ ID NO: 682261 - DNA, 25 bp, Mus musculus
gcccctgctgggtaagtgcccgact

SEQ ID NO: 682262 - DNA, 25 bp, Mus musculus
gcccctgctttgagcgagttccggc

SEQ ID NO: 682263 - DNA, 25 bp, Mus musculus
gcccctgctttgtgcgagttccggc

SEQ ID NO: 682264 - DNA, 25 bp, Mus musculus
gcccctggaactatgccttcacagt

SEQ ID NO: 682265 - DNA, 25 bp, Mus musculus
gcccctggaactttgccttcacagt

SEQ ID NO: 682266 - DNA, 25 bp, Mus musculus
gcccctggaagacgaattcctgctg

SEQ ID NO: 682267 - DNA, 25 bp, Mus musculus
gcccctggaagaggaattcctgctg

SEQ ID NO: 682268 - DNA, 25 bp, Mus musculus
gcccctggaagtcaatccaacagtg

SEQ ID NO: 682269 - DNA, 25 bp, Mus musculus
gcccctggaagtgaatccaacagtg

SEQ ID NO: 682270 - DNA, 25 bp, Mus musculus
gcccctggccgtcttggtcagctgt

SEQ ID NO: 682271 - DNA, 25 bp, Mus musculus
gcccctggccgtgttggtcagctgt

SEQ ID NO: 682272 - DNA, 25 bp, Mus musculus
gcccctggctctctacgtattttct

SEQ ID NO: 682273 - DNA, 25 bp, Mus musculus
gcccctggctctgtacgtattttct

SEQ ID NO: 682274 - DNA, 25 bp, Mus musculus
gcccctggctgaccactgtgttgga

SEQ ID NO: 682275 - DNA, 25 bp, Mus musculus
gcccctggctgagcactgtgttgga

SEQ ID NO: 682276 - DNA, 25 bp, Mus musculus
gcccctggcttaacagtcagatgag

SEQ ID NO: 682277 - DNA, 25 bp, Mus musculus
gcccctggcttatcagtcagatgag

SEQ ID NO: 682278 - DNA, 25 bp, Mus musculus
gcccctgggaagagcttccaacagt

SEQ ID NO: 682279 - DNA, 25 bp, Mus musculus
gcccctgggaagtgcttccaacagt

SEQ ID NO: 682280 - DNA, 25 bp, Mus musculus
gcccctgggtggagtggaacaaact

SEQ ID NO: 682281 - DNA, 25 bp, Mus musculus
gcccctgggtggtgtggaacaaact

SEQ ID NO: 682282 - DNA, 25 bp, Mus musculus
gcccctgtatgtcctggtggagtac

SEQ ID NO: 682283 - DNA, 25 bp, Mus musculus
gcccctgtatgtgctggtggagtac

SEQ ID NO: 682284 - DNA, 25 bp, Mus musculus
gcccctgtcactatgcaggaaggta

SEQ ID NO: 682285 - DNA, 25 bp, Mus musculus
gcccctgtcactttgcaggaaggta

SEQ ID NO: 682286 - DNA, 25 bp, Mus musculus
gcccctgtctgcacaatggccactg

SEQ ID NO: 682287 - DNA, 25 bp, Mus musculus
gcccctgtctgctcaatggccactg

SEQ ID NO: 682288 - DNA, 25 bp, Mus musculus
gcccctgtcttgaggaaagaactga

SEQ ID NO: 682289 - DNA, 25 bp, Mus musculus
gcccctgtcttgtggaaagaactga

SEQ ID NO: 682290 - DNA, 25 bp, Mus musculus
gcccctgtggagctcacagtctcag

SEQ ID NO: 682291 - DNA, 25 bp, Mus musculus
gcccctgtggaggtcacagtctcag

SEQ ID NO: 682292 - DNA, 25 bp, Mus musculus
gcccctgtggctagagtttaagtgt

SEQ ID NO: 682293 - DNA, 25 bp, Mus musculus
gcccctgtggcttgagtttaagtgt

SEQ ID NO: 682294 - DNA, 25 bp, Mus musculus
gccccttaacggagcttgtatttga

SEQ ID NO: 682295 - DNA, 25 bp, Mus musculus
gccccttaacggtgcttgtatttga

SEQ ID NO: 682296 - DNA, 25 bp, Mus musculus
gccccttaagggagcagacagagca

SEQ ID NO: 682297 - DNA, 25 bp, Mus musculus
gccccttaagggtgcagacagagca

SEQ ID NO: 682298 - DNA, 25 bp, Mus musculus
gccccttatggtagacttaaatact

SEQ ID NO: 682299 - DNA, 25 bp, Mus musculus
gccccttatggttgacttaaatact

SEQ ID NO: 682300 - DNA, 25 bp, Mus musculus
gccccttcaactcccgggaaatgag

SEQ ID NO: 682301 - DNA, 25 bp, Mus musculus
gccccttcaactgccgggaaatgag

SEQ ID NO: 682302 - DNA, 25 bp, Mus musculus
gccccttcacagatgtagtcactac

SEQ ID NO: 682303 - DNA, 25 bp, Mus musculus
gccccttcacagttgtagtcactac

SEQ ID NO: 682304 - DNA, 25 bp, Mus musculus
gccccttccgtcacagtgatgcaga

SEQ ID NO: 682305 - DNA, 25 bp, Mus musculus
gccccttccgtctcagtgatgcaga

SEQ ID NO: 682306 - DNA, 25 bp, Mus musculus
gccccttctatgcagataagatgaa

SEQ ID NO: 682307 - DNA, 25 bp, Mus musculus
gccccttctatggagataagatgaa

SEQ ID NO: 682308 - DNA, 25 bp, Mus musculus
gccccttctcaaaggtagtacctta

SEQ ID NO: 682309 - DNA, 25 bp, Mus musculus
gccccttctcaatggtagtacctta

SEQ ID NO: 682310 - DNA, 25 bp, Mus musculus
gccccttgaagtcagggagtttgaa

SEQ ID NO: 682311 - DNA, 25 bp, Mus musculus
gccccttgaagtgagggagtttgaa

SEQ ID NO: 682312 - DNA, 25 bp, Mus musculus
gccccttgaggcctgagggattctc

SEQ ID NO: 682313 - DNA, 25 bp, Mus musculus
gccccttgaggcgtgagggattctc

SEQ ID NO: 682314 - DNA, 25 bp, Mus musculus
gccccttgcaacagaatggtcttgg

SEQ ID NO: 682315 - DNA, 25 bp, Mus musculus
gccccttgcaactgaatggtcttgg

SEQ ID NO: 682316 - DNA, 25 bp, Mus musculus
gccccttgcaccagcgatcggaaag

SEQ ID NO: 682317 - DNA, 25 bp, Mus musculus
gccccttgcacctgcgatcggaaag

SEQ ID NO: 682318 - DNA, 25 bp, Mus musculus
gccccttgccccagaaggagagtct

SEQ ID NO: 682319 - DNA, 25 bp, Mus musculus
gccccttgcccctgaaggagagtct

SEQ ID NO: 682320 - DNA, 25 bp, Mus musculus
gccccttgggaacatgcactgctgt

SEQ ID NO: 682321 - DNA, 25 bp, Mus musculus
gccccttgggaagatgcactgctgt

SEQ ID NO: 682322 - DNA, 25 bp, Mus musculus
gccccttgtctaaggaatcctggaa

SEQ ID NO: 682323 - DNA, 25 bp, Mus musculus
gccccttgtctatggaatcctggaa

SEQ ID NO: 682324 - DNA, 25 bp, Mus musculus
gcccctttcaagctgttcgcgtgaa

SEQ ID NO: 682325 - DNA, 25 bp, Mus musculus
gcccctttcaaggtgttcgcgtgaa

SEQ ID NO: 682326 - DNA, 25 bp, Mus musculus
gcccctttctacagaggaggtggac

SEQ ID NO: 682327 - DNA, 25 bp, Mus musculus
gcccctttctactgaggaggtggac

SEQ ID NO: 682328 - DNA, 25 bp, Mus musculus
gccccttttctgagtgctccttcga

SEQ ID NO: 682329 - DNA, 25 bp, Mus musculus
gccccttttctgtgtgctccttcga

SEQ ID NO: 682330 - DNA, 25 bp, Mus musculus
gccccttttggacaaagtgagacct

SEQ ID NO: 682331 - DNA, 25 bp, Mus musculus
gccccttttggagaaagtgagacct

SEQ ID NO: 682332 - DNA, 25 bp, Mus musculus
gcccgaaacgtaaccgaatgtggag

SEQ ID NO: 682333 - DNA, 25 bp, Mus musculus
gcccgaaacgtatccgaatgtggag

SEQ ID NO: 682334 - DNA, 25 bp, Mus musculus
gcccgaaatgctaatctcaataatt

SEQ ID NO: 682335 - DNA, 25 bp, Mus musculus
gcccgaaatgcttatctcaataatt

SEQ ID NO: 682336 - DNA, 25 bp, Mus musculus
gcccgaacaccgagtacctgcaggt

SEQ ID NO: 682337 - DNA, 25 bp, Mus musculus
gcccgaacaccgtgtacctgcaggt

SEQ ID NO: 682338 - DNA, 25 bp, Mus musculus
gcccgaagccttatctgccgatgaa

SEQ ID NO: 682339 - DNA, 25 bp, Mus musculus
gcccgaagccttttctgccgatgaa

SEQ ID NO: 682340 - DNA, 25 bp, Mus musculus
gcccgaatgtctcgatgcctacaac

SEQ ID NO: 682341 - DNA, 25 bp, Mus musculus
gcccgaatgtctggatgcctacaac

SEQ ID NO: 682342 - DNA, 25 bp, Mus musculus
gcccgacctgttagattggaatagt

SEQ ID NO: 682343 - DNA, 25 bp, Mus musculus
gcccgacctgtttgattggaatagt

SEQ ID NO: 682344 - DNA, 25 bp, Mus musculus
gcccgacgagaacgccataatgaca

SEQ ID NO: 682345 - DNA, 25 bp, Mus musculus
gcccgacgagaaggccataatgaca

SEQ ID NO: 682346 - DNA, 25 bp, Mus musculus
gcccgacgtcgaaaccgcgatgagg

SEQ ID NO: 682347 - DNA, 25 bp, Mus musculus
gcccgacgtcgataccgcgatgagg

SEQ ID NO: 682348 - DNA, 25 bp, Mus musculus
gcccgactagaaatcaacgtgctgg

SEQ ID NO: 682349 - DNA, 25 bp, Mus musculus
gcccgactagaattcaacgtgctgg

SEQ ID NO: 682350 - DNA, 25 bp, Mus musculus
gcccgactcattatccatttccgag

SEQ ID NO: 682351 - DNA, 25 bp, Mus musculus
gcccgactcattttccatttccgag

SEQ ID NO: 682352 - DNA, 25 bp, Mus musculus
gcccgagaacagctcggtccagcag

SEQ ID NO: 682353 - DNA, 25 bp, Mus musculus
gcccgagaacaggtcggtccagcag

SEQ ID NO: 682354 - DNA, 25 bp, Mus musculus
gcccgagaacggaggaactttgact

SEQ ID NO: 682355 - DNA, 25 bp, Mus musculus
gcccgagaacggtggaactttgact

SEQ ID NO: 682356 - DNA, 25 bp, Mus musculus
gcccgagacaatctgtatcaccttg

SEQ ID NO: 682357 - DNA, 25 bp, Mus musculus
gcccgagacaatgtgtatcaccttg

SEQ ID NO: 682358 - DNA, 25 bp, Mus musculus
gcccgagcagacctagctgctcagt

SEQ ID NO: 682359 - DNA, 25 bp, Mus musculus
gcccgagcagacgtagctgctcagt

SEQ ID NO: 682360 - DNA, 25 bp, Mus musculus
gcccgagcaggtaaattcaggaggt

SEQ ID NO: 682361 - DNA, 25 bp, Mus musculus
gcccgagcaggttaattcaggaggt

SEQ ID NO: 682362 - DNA, 25 bp, Mus musculus
gcccgagccgtgatcttcccggatt

SEQ ID NO: 682363 - DNA, 25 bp, Mus musculus
gcccgagccgtgttcttcccggatt

SEQ ID NO: 682364 - DNA, 25 bp, Mus musculus
gcccgagcgggaacctcggctgctg

SEQ ID NO: 682365 - DNA, 25 bp, Mus musculus
gcccgagcgggatcctcggctgctg

SEQ ID NO: 682366 - DNA, 25 bp, Mus musculus
gcccgaggcaaaccggaggagtggg

SEQ ID NO: 682367 - DNA, 25 bp, Mus musculus
gcccgaggcaaagcggaggagtggg

SEQ ID NO: 682368 - DNA, 25 bp, Mus musculus
gcccgaggccctcgtgaaattctag

SEQ ID NO: 682369 - DNA, 25 bp, Mus musculus
gcccgaggccctggtgaaattctag

SEQ ID NO: 682370 - DNA, 25 bp, Mus musculus
gcccgagtacagactacctggacta

SEQ ID NO: 682371 - DNA, 25 bp, Mus musculus
gcccgagtacagtctacctggacta

SEQ ID NO: 682372 - DNA, 25 bp, Mus musculus
gcccgagtgcacagctgctgatgtg

SEQ ID NO: 682373 - DNA, 25 bp, Mus musculus
gcccgagtgcactgctgctgatgtg

SEQ ID NO: 682374 - DNA, 25 bp, Mus musculus
gcccgagtgtatcggacaggttctt

SEQ ID NO: 682375 - DNA, 25 bp, Mus musculus
gcccgagtgtatgggacaggttctt

SEQ ID NO: 682376 - DNA, 25 bp, Mus musculus
gcccgagttccactacatcgcaggg

SEQ ID NO: 682377 - DNA, 25 bp, Mus musculus
gcccgagttccagtacatcgcaggg

SEQ ID NO: 682378 - DNA, 25 bp, Mus musculus
gcccgagttggacgaggttcttatc

SEQ ID NO: 682379 - DNA, 25 bp, Mus musculus
gcccgagttggaggaggttcttatc

SEQ ID NO: 682380 - DNA, 25 bp, Mus musculus
gcccgataagcaagaagctgctgtg

SEQ ID NO: 682381 - DNA, 25 bp, Mus musculus
gcccgataagcatgaagctgctgtg

SEQ ID NO: 682382 - DNA, 25 bp, Mus musculus
gcccgatatcccacaactctgagga

SEQ ID NO: 682383 - DNA, 25 bp, Mus musculus
gcccgatatccctcaactctgagga

SEQ ID NO: 682384 - DNA, 25 bp, Mus musculus
gcccgatgacgtactgcagctggtg

SEQ ID NO: 682385 - DNA, 25 bp, Mus musculus
gcccgatgacgttctgcagctggtg

SEQ ID NO: 682386 - DNA, 25 bp, Mus musculus
gcccgatgagcacccttccttgatg

SEQ ID NO: 682387 - DNA, 25 bp, Mus musculus
gcccgatgagcagccttccttgatg

SEQ ID NO: 682388 - DNA, 25 bp, Mus musculus
gcccgatgtctcagaggcctgttct

SEQ ID NO: 682389 - DNA, 25 bp, Mus musculus
gcccgatgtctctgaggcctgttct

SEQ ID NO: 682390 - DNA, 25 bp, Mus musculus
gcccgattaaagacagactgacagt

SEQ ID NO: 682391 - DNA, 25 bp, Mus musculus
gcccgattaaagtcagactgacagt

SEQ ID NO: 682392 - DNA, 25 bp, Mus musculus
gcccgatttgtgaagggagatgccc

SEQ ID NO: 682393 - DNA, 25 bp, Mus musculus
gcccgatttgtgtagggagatgccc

SEQ ID NO: 682394 - DNA, 25 bp, Mus musculus
gcccgcaaggtcctcctggaagtac

SEQ ID NO: 682395 - DNA, 25 bp, Mus musculus
gcccgcaaggtcgtcctggaagtac

SEQ ID NO: 682396 - DNA, 25 bp, Mus musculus
gcccgcagcgaaaacaagaataaag

SEQ ID NO: 682397 - DNA, 25 bp, Mus musculus
gcccgcagcgaatacaagaataaag

SEQ ID NO: 682398 - DNA, 25 bp, Mus musculus
gcccgcagtacaatgtgctgtttga

SEQ ID NO: 682399 - DNA, 25 bp, Mus musculus
gcccgcagtacattgtgctgtttga

SEQ ID NO: 682400 - DNA, 25 bp, Mus musculus
gcccgccgacgcacgattgggtgct

SEQ ID NO: 682401 - DNA, 25 bp, Mus musculus
gcccgccgacgctcgattgggtgct

SEQ ID NO: 682402 - DNA, 25 bp, Mus musculus
gcccgccggtaacaggcttctcgaa

SEQ ID NO: 682403 - DNA, 25 bp, Mus musculus
gcccgccggtaagaggcttctcgaa

SEQ ID NO: 682404 - DNA, 25 bp, Mus musculus
gcccgccttctaacttttcagtagg

SEQ ID NO: 682405 - DNA, 25 bp, Mus musculus
gcccgccttctatcttttcagtagg

SEQ ID NO: 682406 - DNA, 25 bp, Mus musculus
gcccgcgaagtgaaagagagccatc

SEQ ID NO: 682407 - DNA, 25 bp, Mus musculus
gcccgcgaagtgtaagagagccatc

SEQ ID NO: 682408 - DNA, 25 bp, Mus musculus
gcccgctcaaccaggcttacttgta

SEQ ID NO: 682409 - DNA, 25 bp, Mus musculus
gcccgctcaacctggcttacttgta

SEQ ID NO: 682410 - DNA, 25 bp, Mus musculus
gcccgctctggacggacatcctgga

SEQ ID NO: 682411 - DNA, 25 bp, Mus musculus
gcccgctctggagggacatcctgga

SEQ ID NO: 682412 - DNA, 25 bp, Mus musculus
gcccgctgtcatcccgtgaagcgaa

SEQ ID NO: 682413 - DNA, 25 bp, Mus musculus
gcccgctgtcatgccgtgaagcgaa

SEQ ID NO: 682414 - DNA, 25 bp, Mus musculus
gcccgctgtgtgcactggtcaattg

SEQ ID NO: 682415 - DNA, 25 bp, Mus musculus
gcccgctgtgtggactggtcaattg

SEQ ID NO: 682416 - DNA, 25 bp, Mus musculus
gcccgcttcaagatcagagatgcca

SEQ ID NO: 682417 - DNA, 25 bp, Mus musculus
gcccgcttcaagttcagagatgcca

SEQ ID NO: 682418 - DNA, 25 bp, Mus musculus
gcccggaaagccataagcaaagacg

SEQ ID NO: 682419 - DNA, 25 bp, Mus musculus
gcccggaaagccttaagcaaagacg

SEQ ID NO: 682420 - DNA, 25 bp, Mus musculus
gcccggaagtggagcaccaacggcc

SEQ ID NO: 682421 - DNA, 25 bp, Mus musculus
gcccggaagtggtgcaccaacggcc

SEQ ID NO: 682422 - DNA, 25 bp, Mus musculus
gcccggagggcccaatggcctcaat

SEQ ID NO: 682423 - DNA, 25 bp, Mus musculus
gcccggagggccgaatggcctcaat

SEQ ID NO: 682424 - DNA, 25 bp, Mus musculus
gcccggattacaaagactgcaactc

SEQ ID NO: 682425 - DNA, 25 bp, Mus musculus
gcccggattacatagactgcaactc

SEQ ID NO: 682426 - DNA, 25 bp, Mus musculus
gcccggcaacgcagcatggatggct

SEQ ID NO: 682427 - DNA, 25 bp, Mus musculus
gcccggcaacgctgcatggatggct

SEQ ID NO: 682428 - DNA, 25 bp, Mus musculus
gcccggcaagatccagaggcacctg

SEQ ID NO: 682429 - DNA, 25 bp, Mus musculus
gcccggcaagatgcagaggcacctg

SEQ ID NO: 682430 - DNA, 25 bp, Mus musculus
gcccggcaggctacaaggaaaaaag

SEQ ID NO: 682431 - DNA, 25 bp, Mus musculus
gcccggcaggcttcaaggaaaaaag

SEQ ID NO: 682432 - DNA, 25 bp, Mus musculus
gcccggcatgtgctaagcgagatcc

SEQ ID NO: 682433 - DNA, 25 bp, Mus musculus
gcccggcatgtggtaagcgagatcc

SEQ ID NO: 682434 - DNA, 25 bp, Mus musculus
gcccggccccaacgaggaaaatgtg

SEQ ID NO: 682435 - DNA, 25 bp, Mus musculus
gcccggccccaaggaggaaaatgtg

SEQ ID NO: 682436 - DNA, 25 bp, Mus musculus
gcccggcgatatacacctaccatga

SEQ ID NO: 682437 - DNA, 25 bp, Mus musculus
gcccggcgatattcacctaccatga

SEQ ID NO: 682438 - DNA, 25 bp, Mus musculus
gcccggctctagcatgaagttcaag

SEQ ID NO: 682439 - DNA, 25 bp, Mus musculus
gcccggctctaggatgaagttcaag

SEQ ID NO: 682440 - DNA, 25 bp, Mus musculus
gcccggctgagtcccaggacatgct

SEQ ID NO: 682441 - DNA, 25 bp, Mus musculus
gcccggctgagtgccaggacatgct

SEQ ID NO: 682442 - DNA, 25 bp, Mus musculus
gcccggctgggaaagggtaccatat

SEQ ID NO: 682443 - DNA, 25 bp, Mus musculus
gcccggctgggatagggtaccatat

SEQ ID NO: 682444 - DNA, 25 bp, Mus musculus
gcccggcttcccagcttgaataaac

SEQ ID NO: 682445 - DNA, 25 bp, Mus musculus
gcccggcttccctgcttgaataaac

SEQ ID NO: 682446 - DNA, 25 bp, Mus musculus
gcccggcttcggagatcccgagtgt

SEQ ID NO: 682447 - DNA, 25 bp, Mus musculus
gcccggcttcggtgatcccgagtgt

SEQ ID NO: 682448 - DNA, 25 bp, Mus musculus
gcccgggaacctcaggccttgcaag

SEQ ID NO: 682449 - DNA, 25 bp, Mus musculus
gcccgggaacctgaggccttgcaag

SEQ ID NO: 682450 - DNA, 25 bp, Mus musculus
gcccgggaagggactctgagttcac

SEQ ID NO: 682451 - DNA, 25 bp, Mus musculus
gcccgggaagggtctctgagttcac

SEQ ID NO: 682452 - DNA, 25 bp, Mus musculus
gcccgggagaaaatttacactgtca

SEQ ID NO: 682453 - DNA, 25 bp, Mus musculus
gcccgggagaaattttacactgtca

SEQ ID NO: 682454 - DNA, 25 bp, Mus musculus
gcccgggagaagctatccgcgctct

SEQ ID NO: 682455 - DNA, 25 bp, Mus musculus
gcccgggagaaggtatccgcgctct

SEQ ID NO: 682456 - DNA, 25 bp, Mus musculus
gcccgggatacactggagcagctca

SEQ ID NO: 682457 - DNA, 25 bp, Mus musculus
gcccgggatacagtggagcagctca

SEQ ID NO: 682458 - DNA, 25 bp, Mus musculus
gcccgggatgaaattgaaggccttt

SEQ ID NO: 682459 - DNA, 25 bp, Mus musculus
gcccgggatgaatttgaaggccttt

SEQ ID NO: 682460 - DNA, 25 bp, Mus musculus
gcccgggcagcgacaagcagcagca

SEQ ID NO: 682461 - DNA, 25 bp, Mus musculus
gcccgggcagcgtcaagcagcagca

SEQ ID NO: 682462 - DNA, 25 bp, Mus musculus
gcccgggccagaataagtaacttag

SEQ ID NO: 682463 - DNA, 25 bp, Mus musculus
gcccgggccagattaagtaacttag

SEQ ID NO: 682464 - DNA, 25 bp, Mus musculus
gcccgggccatcaacagcttctgct

SEQ ID NO: 682465 - DNA, 25 bp, Mus musculus
gcccgggccatctacagcttctgct

SEQ ID NO: 682466 - DNA, 25 bp, Mus musculus
gcccgggccttgaatgactaccagg

SEQ ID NO: 682467 - DNA, 25 bp, Mus musculus
gcccgggccttgtatgactaccagg

SEQ ID NO: 682468 - DNA, 25 bp, Mus musculus
gcccgggcgacaatcgacatgaacg

SEQ ID NO: 682469 - DNA, 25 bp, Mus musculus
gcccgggcgacattcgacatgaacg

SEQ ID NO: 682470 - DNA, 25 bp, Mus musculus
gcccgggctctgctgttgcagctct

SEQ ID NO: 682471 - DNA, 25 bp, Mus musculus
gcccgggctctggtgttgcagctct

SEQ ID NO: 682472 - DNA, 25 bp, Mus musculus
gcccgggtagttaaagacatggcaa

SEQ ID NO: 682473 - DNA, 25 bp, Mus musculus
gcccgggtagtttaagacatggcaa

SEQ ID NO: 682474 - DNA, 25 bp, Mus musculus
gcccgggtgtggaagcactttcaga

SEQ ID NO: 682475 - DNA, 25 bp, Mus musculus
gcccgggtgtggtagcactttcaga

SEQ ID NO: 682476 - DNA, 25 bp, Mus musculus
gcccggtctttcagctcaatgtgaa

SEQ ID NO: 682477 - DNA, 25 bp, Mus musculus
gcccggtctttctgctcaatgtgaa

SEQ ID NO: 682478 - DNA, 25 bp, Mus musculus
gcccggtggcgaatgctgatccagc

SEQ ID NO: 682479 - DNA, 25 bp, Mus musculus
gcccggtggcgattgctgatccagc

SEQ ID NO: 682480 - DNA, 25 bp, Mus musculus
gcccggttaaccaagactctgcact

SEQ ID NO: 682481 - DNA, 25 bp, Mus musculus
gcccggttaacctagactctgcact

SEQ ID NO: 682482 - DNA, 25 bp, Mus musculus
gcccggttgctacgacttggataag

SEQ ID NO: 682483 - DNA, 25 bp, Mus musculus
gcccggttgctaggacttggataag

SEQ ID NO: 682484 - DNA, 25 bp, Mus musculus
gcccgtaaagccctggacaagtaca

SEQ ID NO: 682485 - DNA, 25 bp, Mus musculus
gcccgtaaagccgtggacaagtaca

SEQ ID NO: 682486 - DNA, 25 bp, Mus musculus
gcccgtaagctgctcatcatcgaga

SEQ ID NO: 682487 - DNA, 25 bp, Mus musculus
gcccgtaagctggtcatcatcgaga

SEQ ID NO: 682488 - DNA, 25 bp, Mus musculus
gcccgtagtctgcagaaactaggtt

SEQ ID NO: 682489 - DNA, 25 bp, Mus musculus
gcccgtagtctggagaaactaggtt

SEQ ID NO: 682490 - DNA, 25 bp, Mus musculus
gcccgtatggatatcacacagccag

SEQ ID NO: 682491 - DNA, 25 bp, Mus musculus
gcccgtatggatttcacacagccag

SEQ ID NO: 682492 - DNA, 25 bp, Mus musculus
gcccgtccagggaggactttcctct

SEQ ID NO: 682493 - DNA, 25 bp, Mus musculus
gcccgtccagggtggactttcctct

SEQ ID NO: 682494 - DNA, 25 bp, Mus musculus
gcccgtcctgtcagcggagcagtga

SEQ ID NO: 682495 - DNA, 25 bp, Mus musculus
gcccgtcctgtctgcggagcagtga

SEQ ID NO: 682496 - DNA, 25 bp, Mus musculus
gcccgtcttgaacgctaatggcgga

SEQ ID NO: 682497 - DNA, 25 bp, Mus musculus
gcccgtcttgaaggctaatggcgga

SEQ ID NO: 682498 - DNA, 25 bp, Mus musculus
gcccgtgccagcaccaggatttcag

SEQ ID NO: 682499 - DNA, 25 bp, Mus musculus
gcccgtgccagctccaggatttcag

SEQ ID NO: 682500 - DNA, 25 bp, Mus musculus
gcccgtgggcgtcgttgcctttctc

SEQ ID NO: 682501 - DNA, 25 bp, Mus musculus
gcccgtgggcgtggttgcctttctc

SEQ ID NO: 682502 - DNA, 25 bp, Mus musculus
gcccgtggttcactatgatatctga

SEQ ID NO: 682503 - DNA, 25 bp, Mus musculus
gcccgtggttcagtatgatatctga

SEQ ID NO: 682504 - DNA, 25 bp, Mus musculus
gcccgtgtcagactgtgaagaccag

SEQ ID NO: 682505 - DNA, 25 bp, Mus musculus
gcccgtgtcagagtgtgaagaccag

SEQ ID NO: 682506 - DNA, 25 bp, Mus musculus
gcccgttaaactaccctgagtggag

SEQ ID NO: 682507 - DNA, 25 bp, Mus musculus
gcccgttaaacttccctgagtggag

SEQ ID NO: 682508 - DNA, 25 bp, Mus musculus
gcccgttctcttctgcagatcattt

SEQ ID NO: 682509 - DNA, 25 bp, Mus musculus
gcccgttctcttgtgcagatcattt

SEQ ID NO: 682510 - DNA, 25 bp, Mus musculus
gcccgttgcttgagaaaccatctga

SEQ ID NO: 682511 - DNA, 25 bp, Mus musculus
gcccgttgcttgtgaaaccatctga

SEQ ID NO: 682512 - DNA, 25 bp, Mus musculus
gcccgttggaggagcgatctccaca

SEQ ID NO: 682513 - DNA, 25 bp, Mus musculus
gcccgttggaggtgcgatctccaca

SEQ ID NO: 682514 - DNA, 25 bp, Mus musculus
gcccgtttctaaagagagtgccaag

SEQ ID NO: 682515 - DNA, 25 bp, Mus musculus
gcccgtttctaatgagagtgccaag

SEQ ID NO: 682516 - DNA, 25 bp, Mus musculus
gcccgtttgcagcaaacagtgtagg

SEQ ID NO: 682517 - DNA, 25 bp, Mus musculus
gcccgtttgcaggaaacagtgtagg

SEQ ID NO: 682518 - DNA, 25 bp, Mus musculus
gcccgttttggaaacaaattactat

SEQ ID NO: 682519 - DNA, 25 bp, Mus musculus
gcccgttttggatacaaattactat

SEQ ID NO: 682520 - DNA, 25 bp, Mus musculus
gccctaaactccaggcggagacggc

SEQ ID NO: 682521 - DNA, 25 bp, Mus musculus
gccctaaactcctggcggagacggc

SEQ ID NO: 682522 - DNA, 25 bp, Mus musculus
gccctaaagagcaaaacagaacagg

SEQ ID NO: 682523 - DNA, 25 bp, Mus musculus
gccctaaagagctaaacagaacagg

SEQ ID NO: 682524 - DNA, 25 bp, Mus musculus
gccctaaatgcgcagcgactggaga

SEQ ID NO: 682525 - DNA, 25 bp, Mus musculus
gccctaaatgcggagcgactggaga

SEQ ID NO: 682526 - DNA, 25 bp, Mus musculus
gccctaaccatgagctgagccgtga

SEQ ID NO: 682527 - DNA, 25 bp, Mus musculus
gccctaaccatgtgctgagccgtga

SEQ ID NO: 682528 - DNA, 25 bp, Mus musculus
gccctaataaataaagtgagggaga

SEQ ID NO: 682529 - DNA, 25 bp, Mus musculus
gccctaataaattaagtgagggaga

SEQ ID NO: 682530 - DNA, 25 bp, Mus musculus
gccctaatgagcaacagtacactgg

SEQ ID NO: 682531 - DNA, 25 bp, Mus musculus
gccctaatgagctacagtacactgg

SEQ ID NO: 682532 - DNA, 25 bp, Mus musculus
gccctacaagtgcaagacgtgcgac

SEQ ID NO: 682533 - DNA, 25 bp, Mus musculus
gccctacaagtggaagacgtgcgac

SEQ ID NO: 682534 - DNA, 25 bp, Mus musculus
gccctacacatgctaagtcatatct

SEQ ID NO: 682535 - DNA, 25 bp, Mus musculus
gccctacacatggtaagtcatatct

SEQ ID NO: 682536 - DNA, 25 bp, Mus musculus
gccctacacattagatatcaacctg

SEQ ID NO: 682537 - DNA, 25 bp, Mus musculus
gccctacacatttgatatcaacctg

SEQ ID NO: 682538 - DNA, 25 bp, Mus musculus
gccctacagaaacagatggactcca

SEQ ID NO: 682539 - DNA, 25 bp, Mus musculus
gccctacagaaagagatggactcca

SEQ ID NO: 682540 - DNA, 25 bp, Mus musculus
gccctacagcatagaagagcccgag

SEQ ID NO: 682541 - DNA, 25 bp, Mus musculus
gccctacagcattgaagagcccgag

SEQ ID NO: 682542 - DNA, 25 bp, Mus musculus
gccctacccaggatgacgactgaag

SEQ ID NO: 682543 - DNA, 25 bp, Mus musculus
gccctacccaggttgacgactgaag

SEQ ID NO: 682544 - DNA, 25 bp, Mus musculus
gccctaccgtggacccagatgcagg

SEQ ID NO: 682545 - DNA, 25 bp, Mus musculus
gccctaccgtggtcccagatgcagg

SEQ ID NO: 682546 - DNA, 25 bp, Mus musculus
gccctacgctcgaatggaagagtat

SEQ ID NO: 682547 - DNA, 25 bp, Mus musculus
gccctacgctcgtatggaagagtat

SEQ ID NO: 682548 - DNA, 25 bp, Mus musculus
gccctactaaagcaggacgctggga

SEQ ID NO: 682549 - DNA, 25 bp, Mus musculus
gccctactaaaggaggacgctggga

SEQ ID NO: 682550 - DNA, 25 bp, Mus musculus
gccctactgaaactcctgctagtct

SEQ ID NO: 682551 - DNA, 25 bp, Mus musculus
gccctactgaaagtcctgctagtct

SEQ ID NO: 682552 - DNA, 25 bp, Mus musculus
gccctactgtgtcgatgagaacaca

SEQ ID NO: 682553 - DNA, 25 bp, Mus musculus
gccctactgtgtggatgagaacaca

SEQ ID NO: 682554 - DNA, 25 bp, Mus musculus
gccctagacaacaagattgagcagg

SEQ ID NO: 682555 - DNA, 25 bp, Mus musculus
gccctagacaactagattgagcagg

SEQ ID NO: 682556 - DNA, 25 bp, Mus musculus
gccctagatgtgactctgagcttca

SEQ ID NO: 682557 - DNA, 25 bp, Mus musculus
gccctagatgtgtctctgagcttca

SEQ ID NO: 682558 - DNA, 25 bp, Mus musculus
gccctagccttcagcatattccagg

SEQ ID NO: 682559 - DNA, 25 bp, Mus musculus
gccctagccttctgcatattccagg

SEQ ID NO: 682560 - DNA, 25 bp, Mus musculus
gccctagctttgcacatgatggagt

SEQ ID NO: 682561 - DNA, 25 bp, Mus musculus
gccctagctttggacatgatggagt

SEQ ID NO: 682562 - DNA, 25 bp, Mus musculus
gccctaggaaccatatgaaacttat

SEQ ID NO: 682563 - DNA, 25 bp, Mus musculus
gccctaggaaccttatgaaacttat

SEQ ID NO: 682564 - DNA, 25 bp, Mus musculus
gccctaggacgcctcgagagcctgt

SEQ ID NO: 682565 - DNA, 25 bp, Mus musculus
gccctaggacgcgtcgagagcctgt

SEQ ID NO: 682566 - DNA, 25 bp, Mus musculus
gccctaggacggaaaaatggcgcct

SEQ ID NO: 682567 - DNA, 25 bp, Mus musculus
gccctaggacggtaaaatggcgcct

SEQ ID NO: 682568 - DNA, 25 bp, Mus musculus
gccctaggactactgaaggagttgt

SEQ ID NO: 682569 - DNA, 25 bp, Mus musculus
gccctaggactagtgaaggagttgt

SEQ ID NO: 682570 - DNA, 25 bp, Mus musculus
gccctaggatcaaagacaagatgaa

SEQ ID NO: 682571 - DNA, 25 bp, Mus musculus
gccctaggatcatagacaagatgaa

SEQ ID NO: 682572 - DNA, 25 bp, Mus musculus
gccctataaactcggccgccagtgg

SEQ ID NO: 682573 - DNA, 25 bp, Mus musculus
gccctataaactgggccgccagtgg

SEQ ID NO: 682574 - DNA, 25 bp, Mus musculus
gccctataagatcgccgtcctggtg

SEQ ID NO: 682575 - DNA, 25 bp, Mus musculus
gccctataagatggccgtcctggtg

SEQ ID NO: 682576 - DNA, 25 bp, Mus musculus
gccctatcacagacagaggctgagg

SEQ ID NO: 682577 - DNA, 25 bp, Mus musculus
gccctatcacagtcagaggctgagg

SEQ ID NO: 682578 - DNA, 25 bp, Mus musculus
gccctatcagaacgtgagtgcaccc

SEQ ID NO: 682579 - DNA, 25 bp, Mus musculus
gccctatcagaaggtgagtgcaccc

SEQ ID NO: 682580 - DNA, 25 bp, Mus musculus
gccctatcagtcaacagcagtgcca

SEQ ID NO: 682581 - DNA, 25 bp, Mus musculus
gccctatcagtctacagcagtgcca

SEQ ID NO: 682582 - DNA, 25 bp, Mus musculus
gccctatctatgctaccagctggag

SEQ ID NO: 682583 - DNA, 25 bp, Mus musculus
gccctatctatggtaccagctggag

SEQ ID NO: 682584 - DNA, 25 bp, Mus musculus
gccctatctggacgccttcattctg

SEQ ID NO: 682585 - DNA, 25 bp, Mus musculus
gccctatctggaggccttcattctg

SEQ ID NO: 682586 - DNA, 25 bp, Mus musculus
gccctatgagtgcatttcctacaaa

SEQ ID NO: 682587 - DNA, 25 bp, Mus musculus
gccctatgagtggatttcctacaaa

SEQ ID NO: 682588 - DNA, 25 bp, Mus musculus
gccctatgcactcgtgagaagggct

SEQ ID NO: 682589 - DNA, 25 bp, Mus musculus
gccctatgcactggtgagaagggct

SEQ ID NO: 682590 - DNA, 25 bp, Mus musculus
gccctatgctagctactttggaggt

SEQ ID NO: 682591 - DNA, 25 bp, Mus musculus
gccctatgctaggtactttggaggt

SEQ ID NO: 682592 - DNA, 25 bp, Mus musculus
gccctatggctaagctcactcttaa

SEQ ID NO: 682593 - DNA, 25 bp, Mus musculus
gccctatggctatgctcactcttaa

SEQ ID NO: 682594 - DNA, 25 bp, Mus musculus
gccctattgcttctctctaggataa

SEQ ID NO: 682595 - DNA, 25 bp, Mus musculus
gccctattgcttgtctctaggataa

SEQ ID NO: 682596 - DNA, 25 bp, Mus musculus
gccctatttctactgacgttccctt

SEQ ID NO: 682597 - DNA, 25 bp, Mus musculus
gccctatttctagtgacgttccctt

SEQ ID NO: 682598 - DNA, 25 bp, Mus musculus
gccctatttgacaggattgtgctaa

SEQ ID NO: 682599 - DNA, 25 bp, Mus musculus
gccctatttgactggattgtgctaa

SEQ ID NO: 682600 - DNA, 25 bp, Mus musculus
gccctattttacctcagtgcctcag

SEQ ID NO: 682601 - DNA, 25 bp, Mus musculus
gccctattttacgtcagtgcctcag

SEQ ID NO: 682602 - DNA, 25 bp, Mus musculus
gccctcaagctgcatgggaagaatg

SEQ ID NO: 682603 - DNA, 25 bp, Mus musculus
gccctcaagctggatgggaagaatg

SEQ ID NO: 682604 - DNA, 25 bp, Mus musculus
gccctcaccatcaagggaggtcctt

SEQ ID NO: 682605 - DNA, 25 bp, Mus musculus
gccctcaccatctagggaggtcctt

SEQ ID NO: 682606 - DNA, 25 bp, Mus musculus
gccctcactggacgaggtcctgcag

SEQ ID NO: 682607 - DNA, 25 bp, Mus musculus
gccctcactggaggaggtcctgcag

SEQ ID NO: 682608 - DNA, 25 bp, Mus musculus
gccctcagaactcagtgaaaacacg

SEQ ID NO: 682609 - DNA, 25 bp, Mus musculus
gccctcagaactgagtgaaaacacg

SEQ ID NO: 682610 - DNA, 25 bp, Mus musculus
gccctcagaggtcggcagtgtcttc

SEQ ID NO: 682611 - DNA, 25 bp, Mus musculus
gccctcagaggtgggcagtgtcttc

SEQ ID NO: 682612 - DNA, 25 bp, Mus musculus
gccctcagcaccaggcaggatctga

SEQ ID NO: 682613 - DNA, 25 bp, Mus musculus
gccctcagcacctggcaggatctga

SEQ ID NO: 682614 - DNA, 25 bp, Mus musculus
gccctcagcaggcaacagtttctca

SEQ ID NO: 682615 - DNA, 25 bp, Mus musculus
gccctcagcagggaacagtttctca

SEQ ID NO: 682616 - DNA, 25 bp, Mus musculus
gccctcaggagaaccatggaaatct

SEQ ID NO: 682617 - DNA, 25 bp, Mus musculus
gccctcaggagatccatggaaatct

SEQ ID NO: 682618 - DNA, 25 bp, Mus musculus
gccctcagggccaattccatcaaga

SEQ ID NO: 682619 - DNA, 25 bp, Mus musculus
gccctcagggcctattccatcaaga

SEQ ID NO: 682620 - DNA, 25 bp, Mus musculus
gccctcagtcagattgtgatccaca

SEQ ID NO: 682621 - DNA, 25 bp, Mus musculus
gccctcagtcagtttgtgatccaca

SEQ ID NO: 682622 - DNA, 25 bp, Mus musculus
gccctcagtgagctgaataaccata

SEQ ID NO: 682623 - DNA, 25 bp, Mus musculus
gccctcagtgaggtgaataaccata

SEQ ID NO: 682624 - DNA, 25 bp, Mus musculus
gccctcagtgccaacgacatggtgc

SEQ ID NO: 682625 - DNA, 25 bp, Mus musculus
gccctcagtgcctacgacatggtgc

SEQ ID NO: 682626 - DNA, 25 bp, Mus musculus
gccctcagtgggagttatgtcaact

SEQ ID NO: 682627 - DNA, 25 bp, Mus musculus
gccctcagtgggtgttatgtcaact

SEQ ID NO: 682628 - DNA, 25 bp, Mus musculus
gccctcagtgttcccgtgtggcctg

SEQ ID NO: 682629 - DNA, 25 bp, Mus musculus
gccctcagtgttgccgtgtggcctg

SEQ ID NO: 682630 - DNA, 25 bp, Mus musculus
gccctcatacacacggaagcatttc

SEQ ID NO: 682631 - DNA, 25 bp, Mus musculus
gccctcatacactcggaagcatttc

SEQ ID NO: 682632 - DNA, 25 bp, Mus musculus
gccctcatgaggatgctggacaatt

SEQ ID NO: 682633 - DNA, 25 bp, Mus musculus
gccctcatgaggttgctggacaatt

SEQ ID NO: 682634 - DNA, 25 bp, Mus musculus
gccctcatgctcagttaccttggtc

SEQ ID NO: 682635 - DNA, 25 bp, Mus musculus
gccctcatgctctgttaccttggtc

SEQ ID NO: 682636 - DNA, 25 bp, Mus musculus
gccctccagctactcttgaaactaa

SEQ ID NO: 682637 - DNA, 25 bp, Mus musculus
gccctccagctagtcttgaaactaa

SEQ ID NO: 682638 - DNA, 25 bp, Mus musculus
gccctcccacagacgattgtgatct

SEQ ID NO: 682639 - DNA, 25 bp, Mus musculus
gccctcccacagtcgattgtgatct

SEQ ID NO: 682640 - DNA, 25 bp, Mus musculus
gccctcccagaacacctggttgaag

SEQ ID NO: 682641 - DNA, 25 bp, Mus musculus
gccctcccagaagacctggttgaag

SEQ ID NO: 682642 - DNA, 25 bp, Mus musculus
gccctccgtcgacaacaaataagga

SEQ ID NO: 682643 - DNA, 25 bp, Mus musculus
gccctccgtcgagaacaaataagga

SEQ ID NO: 682644 - DNA, 25 bp, Mus musculus
gccctccgtggtactaaatgaatga

SEQ ID NO: 682645 - DNA, 25 bp, Mus musculus
gccctccgtggttctaaatgaatga

SEQ ID NO: 682646 - DNA, 25 bp, Mus musculus
gccctccgtgtgctggaattgaatg

SEQ ID NO: 682647 - DNA, 25 bp, Mus musculus
gccctccgtgtggtggaattgaatg

SEQ ID NO: 682648 - DNA, 25 bp, Mus musculus
gccctcctaattctgaagacctgtc

SEQ ID NO: 682649 - DNA, 25 bp, Mus musculus
gccctcctaattgtgaagacctgtc

SEQ ID NO: 682650 - DNA, 25 bp, Mus musculus
gccctcctcaaactgcctggagcag

SEQ ID NO: 682651 - DNA, 25 bp, Mus musculus
gccctcctcaaagtgcctggagcag

SEQ ID NO: 682652 - DNA, 25 bp, Mus musculus
gccctccttcatctggtcctgtgag

SEQ ID NO: 682653 - DNA, 25 bp, Mus musculus
gccctccttcatgtggtcctgtgag

SEQ ID NO: 682654 - DNA, 25 bp, Mus musculus
gccctccttgtgcaagaactctgag

SEQ ID NO: 682655 - DNA, 25 bp, Mus musculus
gccctccttgtggaagaactctgag

SEQ ID NO: 682656 - DNA, 25 bp, Mus musculus
gccctcgaaagtaaactttgccact

SEQ ID NO: 682657 - DNA, 25 bp, Mus musculus
gccctcgaaagttaactttgccact

SEQ ID NO: 682658 - DNA, 25 bp, Mus musculus
gccctcgaggctatgggttcagcct

SEQ ID NO: 682659 - DNA, 25 bp, Mus musculus
gccctcgaggctttgggttcagcct

SEQ ID NO: 682660 - DNA, 25 bp, Mus musculus
gccctcgatgggatcttcttcgttg

SEQ ID NO: 682661 - DNA, 25 bp, Mus musculus
gccctcgatgggttcttcttcgttg

SEQ ID NO: 682662 - DNA, 25 bp, Mus musculus
gccctcgcacgcctggcttattgaa

SEQ ID NO: 682663 - DNA, 25 bp, Mus musculus
gccctcgcacgcgtggcttattgaa

SEQ ID NO: 682664 - DNA, 25 bp, Mus musculus
gccctcgcttttccctggaagatga

SEQ ID NO: 682665 - DNA, 25 bp, Mus musculus
gccctcgcttttgcctggaagatga

SEQ ID NO: 682666 - DNA, 25 bp, Mus musculus
gccctcgtctagagcccgttctgtg

SEQ ID NO: 682667 - DNA, 25 bp, Mus musculus
gccctcgtctagtgcccgttctgtg

SEQ ID NO: 682668 - DNA, 25 bp, Mus musculus
gccctctaaaggactgctgctgttt

SEQ ID NO: 682669 - DNA, 25 bp, Mus musculus
gccctctaaaggtctgctgctgttt

SEQ ID NO: 682670 - DNA, 25 bp, Mus musculus
gccctctaagcaagcaaggttctgg

SEQ ID NO: 682671 - DNA, 25 bp, Mus musculus
gccctctaagcatgcaaggttctgg

SEQ ID NO: 682672 - DNA, 25 bp, Mus musculus
gccctctacgatctttacctagatg

SEQ ID NO: 682673 - DNA, 25 bp, Mus musculus
gccctctacgatgtttacctagatg

SEQ ID NO: 682674 - DNA, 25 bp, Mus musculus
gccctctattgtcgtagaggcctca

SEQ ID NO: 682675 - DNA, 25 bp, Mus musculus
gccctctattgtggtagaggcctca

SEQ ID NO: 682676 - DNA, 25 bp, Mus musculus
gccctctcagagacctacgttcaag

SEQ ID NO: 682677 - DNA, 25 bp, Mus musculus
gccctctcagagtcctacgttcaag

SEQ ID NO: 682678 - DNA, 25 bp, Mus musculus
gccctctctgagatgcttccattgg

SEQ ID NO: 682679 - DNA, 25 bp, Mus musculus
gccctctctgagttgcttccattgg

SEQ ID NO: 682680 - DNA, 25 bp, Mus musculus
gccctctgaaatcgataccctgtgg

SEQ ID NO: 682681 - DNA, 25 bp, Mus musculus
gccctctgaaatggataccctgtgg

SEQ ID NO: 682682 - DNA, 25 bp, Mus musculus
gccctctgcagacacatttgtgaag

SEQ ID NO: 682683 - DNA, 25 bp, Mus musculus
gccctctgcagagacatttgtgaag

SEQ ID NO: 682684 - DNA, 25 bp, Mus musculus
gccctctgccagagaggaccaggga

SEQ ID NO: 682685 - DNA, 25 bp, Mus musculus
gccctctgccagtgaggaccaggga

SEQ ID NO: 682686 - DNA, 25 bp, Mus musculus
gccctctgctccataatgctcttgg

SEQ ID NO: 682687 - DNA, 25 bp, Mus musculus
gccctctgctccttaatgctcttgg

SEQ ID NO: 682688 - DNA, 25 bp, Mus musculus
gccctctggaaacagcgccaaacgg

SEQ ID NO: 682689 - DNA, 25 bp, Mus musculus
gccctctggaaagagcgccaaacgg

SEQ ID NO: 682690 - DNA, 25 bp, Mus musculus
gccctctgggagactggagacatga

SEQ ID NO: 682691 - DNA, 25 bp, Mus musculus
gccctctgggagtctggagacatga

SEQ ID NO: 682692 - DNA, 25 bp, Mus musculus
gccctctggtccaacaggactctga

SEQ ID NO: 682693 - DNA, 25 bp, Mus musculus
gccctctggtcctacaggactctga

SEQ ID NO: 682694 - DNA, 25 bp, Mus musculus
gccctcttcatcagcattgtaagga

SEQ ID NO: 682695 - DNA, 25 bp, Mus musculus
gccctcttcatctgcattgtaagga

SEQ ID NO: 682696 - DNA, 25 bp, Mus musculus
gccctgaacaaaaggtcaaggcttt

SEQ ID NO: 682697 - DNA, 25 bp, Mus musculus
gccctgaacaaatggtcaaggcttt

SEQ ID NO: 682698 - DNA, 25 bp, Mus musculus
gccctgaacggtcggaaaagctatc

SEQ ID NO: 682699 - DNA, 25 bp, Mus musculus
gccctgaacggtgggaaaagctatc

SEQ ID NO: 682700 - DNA, 25 bp, Mus musculus
gccctgaagaaaccgagacaagcat

SEQ ID NO: 682701 - DNA, 25 bp, Mus musculus
gccctgaagaaagcgagacaagcat

SEQ ID NO: 682702 - DNA, 25 bp, Mus musculus
gccctgaagcatcgacttggctact

SEQ ID NO: 682703 - DNA, 25 bp, Mus musculus
gccctgaagcatggacttggctact

SEQ ID NO: 682704 - DNA, 25 bp, Mus musculus
gccctgaaggacatttcttggcagc

SEQ ID NO: 682705 - DNA, 25 bp, Mus musculus
gccctgaaggacttttcttggcagc

SEQ ID NO: 682706 - DNA, 25 bp, Mus musculus
gccctgaagtggagctggcactcca

SEQ ID NO: 682707 - DNA, 25 bp, Mus musculus
gccctgaagtggtgctggcactcca

SEQ ID NO: 682708 - DNA, 25 bp, Mus musculus
gccctgaatactatggttgcaatca

SEQ ID NO: 682709 - DNA, 25 bp, Mus musculus
gccctgaatactttggttgcaatca

SEQ ID NO: 682710 - DNA, 25 bp, Mus musculus
gccctgacattacagtcaattgaga

SEQ ID NO: 682711 - DNA, 25 bp, Mus musculus
gccctgacattagagtcaattgaga

SEQ ID NO: 682712 - DNA, 25 bp, Mus musculus
gccctgacccggaagatcacactga

SEQ ID NO: 682713 - DNA, 25 bp, Mus musculus
gccctgacccggtagatcacactga

SEQ ID NO: 682714 - DNA, 25 bp, Mus musculus
gccctgaccgcccaggatgagagca

SEQ ID NO: 682715 - DNA, 25 bp, Mus musculus
gccctgaccgccgaggatgagagca

SEQ ID NO: 682716 - DNA, 25 bp, Mus musculus
gccctgacctcaaagtaccactgtg

SEQ ID NO: 682717 - DNA, 25 bp, Mus musculus
gccctgacctcatagtaccactgtg

SEQ ID NO: 682718 - DNA, 25 bp, Mus musculus
gccctgactgtaatctaggaaatga

SEQ ID NO: 682719 - DNA, 25 bp, Mus musculus
gccctgactgtattctaggaaatga

SEQ ID NO: 682720 - DNA, 25 bp, Mus musculus
gccctgagactccacaggaaaggaa

SEQ ID NO: 682721 - DNA, 25 bp, Mus musculus
gccctgagactcgacaggaaaggaa

SEQ ID NO: 682722 - DNA, 25 bp, Mus musculus
gccctgagagacaacaagccctatg

SEQ ID NO: 682723 - DNA, 25 bp, Mus musculus
gccctgagagactacaagccctatg

SEQ ID NO: 682724 - DNA, 25 bp, Mus musculus
gccctgagatctcaggactgcttca

SEQ ID NO: 682725 - DNA, 25 bp, Mus musculus
gccctgagatctgaggactgcttca

SEQ ID NO: 682726 - DNA, 25 bp, Mus musculus
gccctgagcactcctctcagtgaga

SEQ ID NO: 682727 - DNA, 25 bp, Mus musculus
gccctgagcactgctctcagtgaga

SEQ ID NO: 682728 - DNA, 25 bp, Mus musculus
gccctgagccccaataaccatgagg

SEQ ID NO: 682729 - DNA, 25 bp, Mus musculus
gccctgagcccctataaccatgagg

SEQ ID NO: 682730 - DNA, 25 bp, Mus musculus
gccctgagccctctcatcccattga

SEQ ID NO: 682731 - DNA, 25 bp, Mus musculus
gccctgagccctgtcatcccattga

SEQ ID NO: 682732 - DNA, 25 bp, Mus musculus
gccctgagcctgaacatggttctgt

SEQ ID NO: 682733 - DNA, 25 bp, Mus musculus
gccctgagcctgtacatggttctgt

SEQ ID NO: 682734 - DNA, 25 bp, Mus musculus
gccctgagtgtacttgccatccacg

SEQ ID NO: 682735 - DNA, 25 bp, Mus musculus
gccctgagtgtagttgccatccacg

SEQ ID NO: 682736 - DNA, 25 bp, Mus musculus
gccctgagtgttctgccactctgat

SEQ ID NO: 682737 - DNA, 25 bp, Mus musculus
gccctgagtgttgtgccactctgat

SEQ ID NO: 682738 - DNA, 25 bp, Mus musculus
gccctgataagaccccgagtgcgca

SEQ ID NO: 682739 - DNA, 25 bp, Mus musculus
gccctgataagagcccgagtgcgca

SEQ ID NO: 682740 - DNA, 25 bp, Mus musculus
gccctgatgtaccacatgctcactg

SEQ ID NO: 682741 - DNA, 25 bp, Mus musculus
gccctgatgtacgacatgctcactg

SEQ ID NO: 682742 - DNA, 25 bp, Mus musculus
gccctgcaaggactcaaccttgact

SEQ ID NO: 682743 - DNA, 25 bp, Mus musculus
gccctgcaaggagtcaaccttgact

SEQ ID NO: 682744 - DNA, 25 bp, Mus musculus
gccctgcaccgaattattgaagttg

SEQ ID NO: 682745 - DNA, 25 bp, Mus musculus
gccctgcaccgatttattgaagttg

SEQ ID NO: 682746 - DNA, 25 bp, Mus musculus
gccctgcaccgcattatggaggtca

SEQ ID NO: 682747 - DNA, 25 bp, Mus musculus
gccctgcaccgctttatggaggtca

SEQ ID NO: 682748 - DNA, 25 bp, Mus musculus
gccctgcagcaaccccgaaaagatg

SEQ ID NO: 682749 - DNA, 25 bp, Mus musculus
gccctgcagcaagcccgaaaagatg

SEQ ID NO: 682750 - DNA, 25 bp, Mus musculus
gccctgcagtgacaggactggctca

SEQ ID NO: 682751 - DNA, 25 bp, Mus musculus
gccctgcagtgagaggactggctca

SEQ ID NO: 682752 - DNA, 25 bp, Mus musculus
gccctgcagttcagagaactccaag

SEQ ID NO: 682753 - DNA, 25 bp, Mus musculus
gccctgcagttctgagaactccaag

SEQ ID NO: 682754 - DNA, 25 bp, Mus musculus
gccctgcagtttctcaactatccaa

SEQ ID NO: 682755 - DNA, 25 bp, Mus musculus
gccctgcagtttgtcaactatccaa

SEQ ID NO: 682756 - DNA, 25 bp, Mus musculus
gccctgcatccaacagagcactgac

SEQ ID NO: 682757 - DNA, 25 bp, Mus musculus
gccctgcatccatcagagcactgac

SEQ ID NO: 682758 - DNA, 25 bp, Mus musculus
gccctgccacgaagagcttccttta

SEQ ID NO: 682759 - DNA, 25 bp, Mus musculus
gccctgccacgatgagcttccttta

SEQ ID NO: 682760 - DNA, 25 bp, Mus musculus
gccctgcccggtaaagttgacatat

SEQ ID NO: 682761 - DNA, 25 bp, Mus musculus
gccctgcccggttaagttgacatat

SEQ ID NO: 682762 - DNA, 25 bp, Mus musculus
gccctgccgtcacgtgtgtcgtgtt

SEQ ID NO: 682763 - DNA, 25 bp, Mus musculus
gccctgccgtcaggtgtgtcgtgtt

SEQ ID NO: 682764 - DNA, 25 bp, Mus musculus
gccctgcctaggacagtacaagtga

SEQ ID NO: 682765 - DNA, 25 bp, Mus musculus
gccctgcctaggtcagtacaagtga

SEQ ID NO: 682766 - DNA, 25 bp, Mus musculus
gccctgcctgtcacccattgtctgg

SEQ ID NO: 682767 - DNA, 25 bp, Mus musculus
gccctgcctgtctcccattgtctgg

SEQ ID NO: 682768 - DNA, 25 bp, Mus musculus
gccctgccttgtctcaaagagaaga

SEQ ID NO: 682769 - DNA, 25 bp, Mus musculus
gccctgccttgtgtcaaagagaaga

SEQ ID NO: 682770 - DNA, 25 bp, Mus musculus
gccctgcgatcgacttctaactttt

SEQ ID NO: 682771 - DNA, 25 bp, Mus musculus
gccctgcgatcgtcttctaactttt

SEQ ID NO: 682772 - DNA, 25 bp, Mus musculus
gccctgcggacaacaactatgatga

SEQ ID NO: 682773 - DNA, 25 bp, Mus musculus
gccctgcggacatcaactatgatga

SEQ ID NO: 682774 - DNA, 25 bp, Mus musculus
gccctgcgggaacttctgtgcaaaa

SEQ ID NO: 682775 - DNA, 25 bp, Mus musculus
gccctgcgggaagttctgtgcaaaa

SEQ ID NO: 682776 - DNA, 25 bp, Mus musculus
gccctgctaaaacatggacttggca

SEQ ID NO: 682777 - DNA, 25 bp, Mus musculus
gccctgctaaaagatggacttggca

SEQ ID NO: 682778 - DNA, 25 bp, Mus musculus
gccctgctaggaccagaagagctgg

SEQ ID NO: 682779 - DNA, 25 bp, Mus musculus
gccctgctaggagcagaagagctgg

SEQ ID NO: 682780 - DNA, 25 bp, Mus musculus
gccctgctatgtatggccctcaggt

SEQ ID NO: 682781 - DNA, 25 bp, Mus musculus
gccctgctatgtttggccctcaggt

SEQ ID NO: 682782 - DNA, 25 bp, Mus musculus
gccctgctcaagatgagtgtgggcc

SEQ ID NO: 682783 - DNA, 25 bp, Mus musculus
gccctgctcaagttgagtgtgggcc

SEQ ID NO: 682784 - DNA, 25 bp, Mus musculus
gccctgctcattcattgtaggagct

SEQ ID NO: 682785 - DNA, 25 bp, Mus musculus
gccctgctcattcggaaatcttcat

SEQ ID NO: 682786 - DNA, 25 bp, Mus musculus
gccctgctcattgattgtaggagct

SEQ ID NO: 682787 - DNA, 25 bp, Mus musculus
gccctgctcattgggaaatcttcat

SEQ ID NO: 682788 - DNA, 25 bp, Mus musculus
gccctgctcccaatggcgagtttga

SEQ ID NO: 682789 - DNA, 25 bp, Mus musculus
gccctgctcccattggcgagtttga

SEQ ID NO: 682790 - DNA, 25 bp, Mus musculus
gccctgctgataatgatgcttctga

SEQ ID NO: 682791 - DNA, 25 bp, Mus musculus
gccctgctgatattgatgcttctga

SEQ ID NO: 682792 - DNA, 25 bp, Mus musculus
gccctgctggacatgtcccgaaaat

SEQ ID NO: 682793 - DNA, 25 bp, Mus musculus
gccctgctggacttgtcccgaaaat

SEQ ID NO: 682794 - DNA, 25 bp, Mus musculus
gccctgctgggacttacaggcccta

SEQ ID NO: 682795 - DNA, 25 bp, Mus musculus
gccctgctgggagttacaggcccta

SEQ ID NO: 682796 - DNA, 25 bp, Mus musculus
gccctgcttatcaccacaggataca

SEQ ID NO: 682797 - DNA, 25 bp, Mus musculus
gccctgcttatctccacaggataca

SEQ ID NO: 682798 - DNA, 25 bp, Mus musculus
gccctgcttttaaggcggcccagct

SEQ ID NO: 682799 - DNA, 25 bp, Mus musculus
gccctgcttttatggcggcccagct

SEQ ID NO: 682800 - DNA, 25 bp, Mus musculus
gccctggaattacggtacaggcagt

SEQ ID NO: 682801 - DNA, 25 bp, Mus musculus
gccctggaattagggtacaggcagt

SEQ ID NO: 682802 - DNA, 25 bp, Mus musculus
gccctggacaagaacaaaacggata

SEQ ID NO: 682803 - DNA, 25 bp, Mus musculus
gccctggacaagtacaaaacggata

SEQ ID NO: 682804 - DNA, 25 bp, Mus musculus
gccctggacactcaggatagtatat

SEQ ID NO: 682805 - DNA, 25 bp, Mus musculus
gccctggacactgaggatagtatat

SEQ ID NO: 682806 - DNA, 25 bp, Mus musculus
gccctggaccacacatctgtgggac

SEQ ID NO: 682807 - DNA, 25 bp, Mus musculus
gccctggaccactcatctgtgggac

SEQ ID NO: 682808 - DNA, 25 bp, Mus musculus
gccctggacggcattcagtgtctag

SEQ ID NO: 682809 - DNA, 25 bp, Mus musculus
gccctggacggctttcagtgtctag

SEQ ID NO: 682810 - DNA, 25 bp, Mus musculus
gccctggagtccaagctagcatcat

SEQ ID NO: 682811 - DNA, 25 bp, Mus musculus
gccctggagtccaagtgagtgcttc

SEQ ID NO: 682812 - DNA, 25 bp, Mus musculus
gccctggagtccatggtgagacgct

SEQ ID NO: 682813 - DNA, 25 bp, Mus musculus
gccctggagtcctagctagcatcat

SEQ ID NO: 682814 - DNA, 25 bp, Mus musculus
gccctggagtcctagtgagtgcttc

SEQ ID NO: 682815 - DNA, 25 bp, Mus musculus
gccctggagtccttggtgagacgct

SEQ ID NO: 682816 - DNA, 25 bp, Mus musculus
gccctggataaaagatcgcttcatg

SEQ ID NO: 682817 - DNA, 25 bp, Mus musculus
gccctggataaatgatcgcttcatg

SEQ ID NO: 682818 - DNA, 25 bp, Mus musculus
gccctggatcatctggacccaaggg

SEQ ID NO: 682819 - DNA, 25 bp, Mus musculus
gccctggatcatgtggacccaaggg

SEQ ID NO: 682820 - DNA, 25 bp, Mus musculus
gccctggcaagcaagtcccgggagc

SEQ ID NO: 682821 - DNA, 25 bp, Mus musculus
gccctggcaagctagtcccgggagc

SEQ ID NO: 682822 - DNA, 25 bp, Mus musculus
gccctggcaccaacagaagagatca

SEQ ID NO: 682823 - DNA, 25 bp, Mus musculus
gccctggcaccatcagaagagatca

SEQ ID NO: 682824 - DNA, 25 bp, Mus musculus
gccctggcagcccagaatctgtcaa

SEQ ID NO: 682825 - DNA, 25 bp, Mus musculus
gccctggcagccgagaatctgtcaa

SEQ ID NO: 682826 - DNA, 25 bp, Mus musculus
gccctggccaacaatgtgtttctct

SEQ ID NO: 682827 - DNA, 25 bp, Mus musculus
gccctggccaactatgtgtttctct

SEQ ID NO: 682828 - DNA, 25 bp, Mus musculus
gccctggccaagatcacagctattg

SEQ ID NO: 682829 - DNA, 25 bp, Mus musculus
gccctggccaagttcacagctattg

SEQ ID NO: 682830 - DNA, 25 bp, Mus musculus
gccctggcccggctggaacagaaac

SEQ ID NO: 682831 - DNA, 25 bp, Mus musculus
gccctggcccgggtggaacagaaac

SEQ ID NO: 682832 - DNA, 25 bp, Mus musculus
gccctggcctaccttgactataaga

SEQ ID NO: 682833 - DNA, 25 bp, Mus musculus
gccctggcctacgttgactataaga

SEQ ID NO: 682834 - DNA, 25 bp, Mus musculus
gccctggctataaccgacagggtag

SEQ ID NO: 682835 - DNA, 25 bp, Mus musculus
gccctggctatacaggaagcagctg

SEQ ID NO: 682836 - DNA, 25 bp, Mus musculus
gccctggctatagaggaagcagctg

SEQ ID NO: 682837 - DNA, 25 bp, Mus musculus
gccctggctatatccgacagggtag

SEQ ID NO: 682838 - DNA, 25 bp, Mus musculus
gccctggctgggaccagatcaagtg

SEQ ID NO: 682839 - DNA, 25 bp, Mus musculus
gccctggctgggtccagatcaagtg

SEQ ID NO: 682840 - DNA, 25 bp, Mus musculus
gccctgggaacacgcgctgagacca

SEQ ID NO: 682841 - DNA, 25 bp, Mus musculus
gccctgggaacaggcgctgagacca

SEQ ID NO: 682842 - DNA, 25 bp, Mus musculus
gccctgggaaggacctcggtgccca

SEQ ID NO: 682843 - DNA, 25 bp, Mus musculus
gccctgggaaggtcctcggtgccca

SEQ ID NO: 682844 - DNA, 25 bp, Mus musculus
gccctgggagacaagaagctaagcc

SEQ ID NO: 682845 - DNA, 25 bp, Mus musculus
gccctgggagactagaagctaagcc

SEQ ID NO: 682846 - DNA, 25 bp, Mus musculus
gccctgggcataccaaccgtgaact

SEQ ID NO: 682847 - DNA, 25 bp, Mus musculus
gccctgggcatagcaaccgtgaact

SEQ ID NO: 682848 - DNA, 25 bp, Mus musculus
gccctgggcattatagtccttatga

SEQ ID NO: 682849 - DNA, 25 bp, Mus musculus
gccctgggcattttagtccttatga

SEQ ID NO: 682850 - DNA, 25 bp, Mus musculus
gccctgggcccacaagaatgaccaa

SEQ ID NO: 682851 - DNA, 25 bp, Mus musculus
gccctgggcccagaagaatgaccaa

SEQ ID NO: 682852 - DNA, 25 bp, Mus musculus
gccctgggccttaagaggtggtcta

SEQ ID NO: 682853 - DNA, 25 bp, Mus musculus
gccctgggcctttagaggtggtcta

SEQ ID NO: 682854 - DNA, 25 bp, Mus musculus
gccctgggtgccctaaccatgtggc

SEQ ID NO: 682855 - DNA, 25 bp, Mus musculus
gccctgggtgccgtaaccatgtggc

SEQ ID NO: 682856 - DNA, 25 bp, Mus musculus
gccctggtagccaaacaggaattga

SEQ ID NO: 682857 - DNA, 25 bp, Mus musculus
gccctggtagcctaacaggaattga

SEQ ID NO: 682858 - DNA, 25 bp, Mus musculus
gccctggtagtgatttcattcaaga

SEQ ID NO: 682859 - DNA, 25 bp, Mus musculus
gccctggtagtgttttcattcaaga

SEQ ID NO: 682860 - DNA, 25 bp, Mus musculus
gccctggtgctcctattttgttctc

SEQ ID NO: 682861 - DNA, 25 bp, Mus musculus
gccctggtgctcgtattttgttctc

SEQ ID NO: 682862 - DNA, 25 bp, Mus musculus
gccctggtggaacaaatcaggaaaa

SEQ ID NO: 682863 - DNA, 25 bp, Mus musculus
gccctggtggaagaaatcaggaaaa

SEQ ID NO: 682864 - DNA, 25 bp, Mus musculus
gccctggtggtacctacatgccttg

SEQ ID NO: 682865 - DNA, 25 bp, Mus musculus
gccctggtggtagctacatgccttg

SEQ ID NO: 682866 - DNA, 25 bp, Mus musculus
gccctggtgtgcctgagcatgctat

SEQ ID NO: 682867 - DNA, 25 bp, Mus musculus
gccctggtgtgcgtgagcatgctat

SEQ ID NO: 682868 - DNA, 25 bp, Mus musculus
gccctggttctaaccaactagtgaa

SEQ ID NO: 682869 - DNA, 25 bp, Mus musculus
gccctggttctatccaactagtgaa

SEQ ID NO: 682870 - DNA, 25 bp, Mus musculus
gccctggttctgcttaacaccattt

SEQ ID NO: 682871 - DNA, 25 bp, Mus musculus
gccctggttctggttaacaccattt

SEQ ID NO: 682872 - DNA, 25 bp, Mus musculus
gccctggttgaacgaagcacaaact

SEQ ID NO: 682873 - DNA, 25 bp, Mus musculus
gccctggttgaaggaagcacaaact

SEQ ID NO: 682874 - DNA, 25 bp, Mus musculus
gccctgtagggacgccattgctgcc

SEQ ID NO: 682875 - DNA, 25 bp, Mus musculus
gccctgtagggaggccattgctgcc

SEQ ID NO: 682876 - DNA, 25 bp, Mus musculus
gccctgtcccagaactttttagatt

SEQ ID NO: 682877 - DNA, 25 bp, Mus musculus
gccctgtcccagcatccataggagt

SEQ ID NO: 682878 - DNA, 25 bp, Mus musculus
gccctgtcccaggatccataggagt

SEQ ID NO: 682879 - DNA, 25 bp, Mus musculus
gccctgtcccagtactttttagatt

SEQ ID NO: 682880 - DNA, 25 bp, Mus musculus
gccctgtcctggaggaagatacctg

SEQ ID NO: 682881 - DNA, 25 bp, Mus musculus
gccctgtcctggtggaagatacctg

SEQ ID NO: 682882 - DNA, 25 bp, Mus musculus
gccctgtcgctgaaaaactgcttta

SEQ ID NO: 682883 - DNA, 25 bp, Mus musculus
gccctgtcgctgtaaaactgcttta

SEQ ID NO: 682884 - DNA, 25 bp, Mus musculus
gccctgtgaagaatggccagctggt

SEQ ID NO: 682885 - DNA, 25 bp, Mus musculus
gccctgtgaagattggccagctggt

SEQ ID NO: 682886 - DNA, 25 bp, Mus musculus
gccctgtgcactagaatccttaata

SEQ ID NO: 682887 - DNA, 25 bp, Mus musculus
gccctgtgcacttgaatccttaata

SEQ ID NO: 682888 - DNA, 25 bp, Mus musculus
gccctgtgcagcagcggttttcgcc

SEQ ID NO: 682889 - DNA, 25 bp, Mus musculus
gccctgtgcagctgcggttttcgcc

SEQ ID NO: 682890 - DNA, 25 bp, Mus musculus
gccctgtggcttcggcttgtctcca

SEQ ID NO: 682891 - DNA, 25 bp, Mus musculus
gccctgtggcttgggcttgtctcca

SEQ ID NO: 682892 - DNA, 25 bp, Mus musculus
gccctgtgtctgcagtcactgacat

SEQ ID NO: 682893 - DNA, 25 bp, Mus musculus
gccctgtgtctggagtcactgacat

SEQ ID NO: 682894 - DNA, 25 bp, Mus musculus
gccctgttcttcaaccagggccagt

SEQ ID NO: 682895 - DNA, 25 bp, Mus musculus
gccctgttcttctaccagggccagt

SEQ ID NO: 682896 - DNA, 25 bp, Mus musculus
gccctgttggaaaggaactaacaat

SEQ ID NO: 682897 - DNA, 25 bp, Mus musculus
gccctgttggaatggaactaacaat

SEQ ID NO: 682898 - DNA, 25 bp, Mus musculus
gccctgttttctcatgcagaatcga

SEQ ID NO: 682899 - DNA, 25 bp, Mus musculus
gccctgttttctgatgcagaatcga

SEQ ID NO: 682900 - DNA, 25 bp, Mus musculus
gccctgtttttccagctggtagatg

SEQ ID NO: 682901 - DNA, 25 bp, Mus musculus
gccctgtttttcgagctggtagatg

SEQ ID NO: 682902 - DNA, 25 bp, Mus musculus
gcccttaaggctacaagttggttgg

SEQ ID NO: 682903 - DNA, 25 bp, Mus musculus
gcccttaaggcttcaagttggttgg

SEQ ID NO: 682904 - DNA, 25 bp, Mus musculus
gcccttacaagtcctgacgcgcggg

SEQ ID NO: 682905 - DNA, 25 bp, Mus musculus
gcccttacaagtgctgacgcgcggg

SEQ ID NO: 682906 - DNA, 25 bp, Mus musculus
gcccttacatggcacgtgtgaggtt

SEQ ID NO: 682907 - DNA, 25 bp, Mus musculus
gcccttacatgggacgtgtgaggtt

SEQ ID NO: 682908 - DNA, 25 bp, Mus musculus
gcccttacatttcgattggaccaga

SEQ ID NO: 682909 - DNA, 25 bp, Mus musculus
gcccttacatttggattggaccaga

SEQ ID NO: 682910 - DNA, 25 bp, Mus musculus
gcccttacctgccttcggaaggtga

SEQ ID NO: 682911 - DNA, 25 bp, Mus musculus
gcccttacctgcgttcggaaggtga

SEQ ID NO: 682912 - DNA, 25 bp, Mus musculus
gcccttactgtaatgttgctccaga

SEQ ID NO: 682913 - DNA, 25 bp, Mus musculus
gcccttactgtattgttgctccaga

SEQ ID NO: 682914 - DNA, 25 bp, Mus musculus
gcccttagcgatcggacccggtaga

SEQ ID NO: 682915 - DNA, 25 bp, Mus musculus
gcccttagcgatgggacccggtaga

SEQ ID NO: 682916 - DNA, 25 bp, Mus musculus
gcccttagttttccacagcagacca

SEQ ID NO: 682917 - DNA, 25 bp, Mus musculus
gcccttagttttgcacagcagacca

SEQ ID NO: 682918 - DNA, 25 bp, Mus musculus
gcccttatgttacctatgggatatc

SEQ ID NO: 682919 - DNA, 25 bp, Mus musculus
gcccttatgttagctatgggatatc

SEQ ID NO: 682920 - DNA, 25 bp, Mus musculus
gcccttcaaagtcgtggtgatctca

SEQ ID NO: 682921 - DNA, 25 bp, Mus musculus
gcccttcaaagtggtggtgatctca

SEQ ID NO: 682922 - DNA, 25 bp, Mus musculus
gcccttcaagagagaggtactggga

SEQ ID NO: 682923 - DNA, 25 bp, Mus musculus
gcccttcaagagtgaggtactggga

SEQ ID NO: 682924 - DNA, 25 bp, Mus musculus
gcccttcacagtagtcacgacatcg

SEQ ID NO: 682925 - DNA, 25 bp, Mus musculus
gcccttcacagttgtcacgacatcg

SEQ ID NO: 682926 - DNA, 25 bp, Mus musculus
gcccttcaccagatgcaggccttgt

SEQ ID NO: 682927 - DNA, 25 bp, Mus musculus
gcccttcaccagttgcaggccttgt

SEQ ID NO: 682928 - DNA, 25 bp, Mus musculus
gcccttcacggccatcctatatggt

SEQ ID NO: 682929 - DNA, 25 bp, Mus musculus
gcccttcacggcgatcctatatggt

SEQ ID NO: 682930 - DNA, 25 bp, Mus musculus
gcccttcactgcagagaaccggaag

SEQ ID NO: 682931 - DNA, 25 bp, Mus musculus
gcccttcactgctgagaaccggaag

SEQ ID NO: 682932 - DNA, 25 bp, Mus musculus
gcccttcagtcgaggccagagcttc

SEQ ID NO: 682933 - DNA, 25 bp, Mus musculus
gcccttcagtcgtggccagagcttc

SEQ ID NO: 682934 - DNA, 25 bp, Mus musculus
gcccttccagatcttgactcccagg

SEQ ID NO: 682935 - DNA, 25 bp, Mus musculus
gcccttccagatgttgactcccagg

SEQ ID NO: 682936 - DNA, 25 bp, Mus musculus
gcccttcctaggagcagagagccag

SEQ ID NO: 682937 - DNA, 25 bp, Mus musculus
gcccttcctaggtgcagagagccag

SEQ ID NO: 682938 - DNA, 25 bp, Mus musculus
gcccttcctggacaggtaccacttg

SEQ ID NO: 682939 - DNA, 25 bp, Mus musculus
gcccttcctggagaggtaccacttg

SEQ ID NO: 682940 - DNA, 25 bp, Mus musculus
gcccttcggtgtaggtaagcactgt

SEQ ID NO: 682941 - DNA, 25 bp, Mus musculus
gcccttcggtgttggtaagcactgt

SEQ ID NO: 682942 - DNA, 25 bp, Mus musculus
gcccttctataacccagtggacgct

SEQ ID NO: 682943 - DNA, 25 bp, Mus musculus
gcccttctataagccagtggacgct

SEQ ID NO: 682944 - DNA, 25 bp, Mus musculus
gcccttctattcatgcaggatcgga

SEQ ID NO: 682945 - DNA, 25 bp, Mus musculus
gcccttctattcttgcaggatcgga

SEQ ID NO: 682946 - DNA, 25 bp, Mus musculus
gcccttctcagtcgagacacacaga

SEQ ID NO: 682947 - DNA, 25 bp, Mus musculus
gcccttctcagtggagacacacaga

SEQ ID NO: 682948 - DNA, 25 bp, Mus musculus
gcccttgaaagacgccaggcagaga

SEQ ID NO: 682949 - DNA, 25 bp, Mus musculus
gcccttgaaagaggccaggcagaga

SEQ ID NO: 682950 - DNA, 25 bp, Mus musculus
gcccttgaatgaaatcgaggcatgg

SEQ ID NO: 682951 - DNA, 25 bp, Mus musculus
gcccttgaatgatatcgaggcatgg

SEQ ID NO: 682952 - DNA, 25 bp, Mus musculus
gcccttgaggccatatcggcgatgc

SEQ ID NO: 682953 - DNA, 25 bp, Mus musculus
gcccttgaggccttatcggcgatgc

SEQ ID NO: 682954 - DNA, 25 bp, Mus musculus
gcccttgattgtcattggtggttct

SEQ ID NO: 682955 - DNA, 25 bp, Mus musculus
gcccttgattgtgattggtggttct

SEQ ID NO: 682956 - DNA, 25 bp, Mus musculus
gcccttgcattgctgcttcctgtga

SEQ ID NO: 682957 - DNA, 25 bp, Mus musculus
gcccttgcattggtgcttcctgtga

SEQ ID NO: 682958 - DNA, 25 bp, Mus musculus
gcccttggacgaatgtgtactatta

SEQ ID NO: 682959 - DNA, 25 bp, Mus musculus
gcccttggacgattgtgtactatta

SEQ ID NO: 682960 - DNA, 25 bp, Mus musculus
gcccttggacttaacatttatgaga

SEQ ID NO: 682961 - DNA, 25 bp, Mus musculus
gcccttggactttacatttatgaga

SEQ ID NO: 682962 - DNA, 25 bp, Mus musculus
gcccttggcaccagagacggatgaa

SEQ ID NO: 682963 - DNA, 25 bp, Mus musculus
gcccttggcacctgagacggatgaa

SEQ ID NO: 682964 - DNA, 25 bp, Mus musculus
gcccttgggagccattatgcccatt

SEQ ID NO: 682965 - DNA, 25 bp, Mus musculus
gcccttgggagcgattatgcccatt

SEQ ID NO: 682966 - DNA, 25 bp, Mus musculus
gcccttggtctgagagaagaatggt

SEQ ID NO: 682967 - DNA, 25 bp, Mus musculus
gcccttggtctgtgagaagaatggt

SEQ ID NO: 682968 - DNA, 25 bp, Mus musculus
gcccttggtgccagccattcattga

SEQ ID NO: 682969 - DNA, 25 bp, Mus musculus
gcccttggtgcctgccattcattga

SEQ ID NO: 682970 - DNA, 25 bp, Mus musculus
gcccttggtggccacacctagccag

SEQ ID NO: 682971 - DNA, 25 bp, Mus musculus
gcccttggtggcgacacctagccag

SEQ ID NO: 682972 - DNA, 25 bp, Mus musculus
gcccttgtagctatacccacagtta

SEQ ID NO: 682973 - DNA, 25 bp, Mus musculus
gcccttgtagctttacccacagtta

SEQ ID NO: 682974 - DNA, 25 bp, Mus musculus
gcccttgtcaccatgagctatgtcg

SEQ ID NO: 682975 - DNA, 25 bp, Mus musculus
gcccttgtcaccttgagctatgtcg

SEQ ID NO: 682976 - DNA, 25 bp, Mus musculus
gcccttgtgtgtacagtagcaggct

SEQ ID NO: 682977 - DNA, 25 bp, Mus musculus
gcccttgtgtgttcagtagcaggct

SEQ ID NO: 682978 - DNA, 25 bp, Mus musculus
gcccttgttattcctagcatagcag

SEQ ID NO: 682979 - DNA, 25 bp, Mus musculus
gcccttgttattgctagcatagcag

SEQ ID NO: 682980 - DNA, 25 bp, Mus musculus
gccctttaaaatccccgaagatgat

SEQ ID NO: 682981 - DNA, 25 bp, Mus musculus
gccctttaaaatgcccgaagatgat

SEQ ID NO: 682982 - DNA, 25 bp, Mus musculus
gccctttagtggagaagattataca

SEQ ID NO: 682983 - DNA, 25 bp, Mus musculus
gccctttagtggtgaagattataca

SEQ ID NO: 682984 - DNA, 25 bp, Mus musculus
gccctttatattcatcgagatgaga

SEQ ID NO: 682985 - DNA, 25 bp, Mus musculus
gccctttatattgatcgagatgaga

SEQ ID NO: 682986 - DNA, 25 bp, Mus musculus
gccctttatgggactacatcagaaa

SEQ ID NO: 682987 - DNA, 25 bp, Mus musculus
gccctttatgggtctacatcagaaa

SEQ ID NO: 682988 - DNA, 25 bp, Mus musculus
gccctttcatcaataatgtggaggt

SEQ ID NO: 682989 - DNA, 25 bp, Mus musculus
gccctttcatcattaatgtggaggt

SEQ ID NO: 682990 - DNA, 25 bp, Mus musculus
gccctttccactcgacagattatta

SEQ ID NO: 682991 - DNA, 25 bp, Mus musculus
gccctttccactggacagattatta

SEQ ID NO: 682992 - DNA, 25 bp, Mus musculus
gccctttccagcacatgggtgagaa

SEQ ID NO: 682993 - DNA, 25 bp, Mus musculus
gccctttccagctcatgggtgagaa

SEQ ID NO: 682994 - DNA, 25 bp, Mus musculus
gccctttctgcacagctggtgttgt

SEQ ID NO: 682995 - DNA, 25 bp, Mus musculus
gccctttctgcagagctggtgttgt

SEQ ID NO: 682996 - DNA, 25 bp, Mus musculus
gccctttgaacgcacagttactatg

SEQ ID NO: 682997 - DNA, 25 bp, Mus musculus
gccctttgaacggacagttactatg

SEQ ID NO: 682998 - DNA, 25 bp, Mus musculus
gccctttgagatccgtttgccagaa

SEQ ID NO: 682999 - DNA, 25 bp, Mus musculus
gccctttgagatgcgtttgccagaa

SEQ ID NO: 683000 - DNA, 25 bp, Mus musculus
gccctttgccacaccggaagagttt

SEQ ID NO: 683001 - DNA, 25 bp, Mus musculus
gccctttgccacagaggctgatgta

SEQ ID NO: 683002 - DNA, 25 bp, Mus musculus
gccctttgccactccggaagagttt

SEQ ID NO: 683003 - DNA, 25 bp, Mus musculus
gccctttgccactgaggctgatgta

SEQ ID NO: 683004 - DNA, 25 bp, Mus musculus
gccctttgcggtcggcagcatctga

SEQ ID NO: 683005 - DNA, 25 bp, Mus musculus
gccctttgcggtgggcagcatctga

SEQ ID NO: 683006 - DNA, 25 bp, Mus musculus
gcccttttagctacccattactgga

SEQ ID NO: 683007 - DNA, 25 bp, Mus musculus
gcccttttagcttcccattactgga

SEQ ID NO: 683008 - DNA, 25 bp, Mus musculus
gcccttttcctgcaccaaagaggag

SEQ ID NO: 683009 - DNA, 25 bp, Mus musculus
gcccttttcctggaccaaagaggag

SEQ ID NO: 683010 - DNA, 25 bp, Mus musculus
gccctttttgatagagtttacactc

SEQ ID NO: 683011 - DNA, 25 bp, Mus musculus
gccctttttgattgagtttacactc

SEQ ID NO: 683012 - DNA, 25 bp, Mus musculus
gccctttttggaagaggatcgtctg

SEQ ID NO: 683013 - DNA, 25 bp, Mus musculus
gccctttttggatgaggatcgtctg

SEQ ID NO: 683014 - DNA, 25 bp, Mus musculus
gccctttttggtcagtcaatttcat

SEQ ID NO: 683015 - DNA, 25 bp, Mus musculus
gccctttttggtgagtcaatttcat

SEQ ID NO: 683016 - DNA, 25 bp, Mus musculus
gccgaaaacttcaccgtactcatca

SEQ ID NO: 683017 - DNA, 25 bp, Mus musculus
gccgaaaacttctccgtactcatca

SEQ ID NO: 683018 - DNA, 25 bp, Mus musculus
gccgaaaattttacaaggatcctca

SEQ ID NO: 683019 - DNA, 25 bp, Mus musculus
gccgaaaatttttcaaggatcctca

SEQ ID NO: 683020 - DNA, 25 bp, Mus musculus
gccgaaactacaaggagtccagaaa

SEQ ID NO: 683021 - DNA, 25 bp, Mus musculus
gccgaaactacatggagtccagaaa

SEQ ID NO: 683022 - DNA, 25 bp, Mus musculus
gccgaaagaagtcatccccaacgtt

SEQ ID NO: 683023 - DNA, 25 bp, Mus musculus
gccgaaagaagtgatccccaacgtt

SEQ ID NO: 683024 - DNA, 25 bp, Mus musculus
gccgaaagagttaccagcctggctc

SEQ ID NO: 683025 - DNA, 25 bp, Mus musculus
gccgaaagagtttccagcctggctc

SEQ ID NO: 683026 - DNA, 25 bp, Mus musculus
gccgaaagccttatccctcatgtta

SEQ ID NO: 683027 - DNA, 25 bp, Mus musculus
gccgaaagccttttccctcatgtta

SEQ ID NO: 683028 - DNA, 25 bp, Mus musculus
gccgaaagcttgactcaactttgaa

SEQ ID NO: 683029 - DNA, 25 bp, Mus musculus
gccgaaagcttgtctcaactttgaa

SEQ ID NO: 683030 - DNA, 25 bp, Mus musculus
gccgaaagggtgacaggttgatctc

SEQ ID NO: 683031 - DNA, 25 bp, Mus musculus
gccgaaagggtgtcaggttgatctc

SEQ ID NO: 683032 - DNA, 25 bp, Mus musculus
gccgaaaggtgaagctgtcagcgtt

SEQ ID NO: 683033 - DNA, 25 bp, Mus musculus
gccgaaaggtgatgctgtcagcgtt

SEQ ID NO: 683034 - DNA, 25 bp, Mus musculus
gccgaacagcatatgagacgccctc

SEQ ID NO: 683035 - DNA, 25 bp, Mus musculus
gccgaacagcatttgagacgccctc

SEQ ID NO: 683036 - DNA, 25 bp, Mus musculus
gccgaacatacgctggaatgatgta

SEQ ID NO: 683037 - DNA, 25 bp, Mus musculus
gccgaacatacggtggaatgatgta

SEQ ID NO: 683038 - DNA, 25 bp, Mus musculus
gccgaacatggcagcgctgagcaat

SEQ ID NO: 683039 - DNA, 25 bp, Mus musculus
gccgaacatggctgcgctgagcaat

SEQ ID NO: 683040 - DNA, 25 bp, Mus musculus
gccgaacccaggcatgatgctagac

SEQ ID NO: 683041 - DNA, 25 bp, Mus musculus
gccgaacccagggatgatgctagac

SEQ ID NO: 683042 - DNA, 25 bp, Mus musculus
gccgaaccccacatagaagacagga

SEQ ID NO: 683043 - DNA, 25 bp, Mus musculus
gccgaaccccacttagaagacagga

SEQ ID NO: 683044 - DNA, 25 bp, Mus musculus
gccgaacggcgtctaggcgccatct

SEQ ID NO: 683045 - DNA, 25 bp, Mus musculus
gccgaacggcgtgtaggcgccatct

SEQ ID NO: 683046 - DNA, 25 bp, Mus musculus
gccgaactggaacgttgttgctcgc

SEQ ID NO: 683047 - DNA, 25 bp, Mus musculus
gccgaactggaaggttgttgctcgc

SEQ ID NO: 683048 - DNA, 25 bp, Mus musculus
gccgaactgtaacatctgcagagtg

SEQ ID NO: 683049 - DNA, 25 bp, Mus musculus
gccgaactgtaagatctgcagagtg

SEQ ID NO: 683050 - DNA, 25 bp, Mus musculus
gccgaagacggtaccagcaaatgga

SEQ ID NO: 683051 - DNA, 25 bp, Mus musculus
gccgaagacggttccagcaaatgga

SEQ ID NO: 683052 - DNA, 25 bp, Mus musculus
gccgaagactgtactatggaagtta

SEQ ID NO: 683053 - DNA, 25 bp, Mus musculus
gccgaagactgttctatggaagtta

SEQ ID NO: 683054 - DNA, 25 bp, Mus musculus
gccgaagatgaacttcgcaaatgta

SEQ ID NO: 683055 - DNA, 25 bp, Mus musculus
gccgaagatgaagttcgcaaatgta

SEQ ID NO: 683056 - DNA, 25 bp, Mus musculus
gccgaagcagcaagaatgacccaaa

SEQ ID NO: 683057 - DNA, 25 bp, Mus musculus
gccgaagcagcatgaatgacccaaa

SEQ ID NO: 683058 - DNA, 25 bp, Mus musculus
gccgaagccaggagggctaccacca

SEQ ID NO: 683059 - DNA, 25 bp, Mus musculus
gccgaagccaggtgggctaccacca

SEQ ID NO: 683060 - DNA, 25 bp, Mus musculus
gccgaagcctttcctcaatgaaaaa

SEQ ID NO: 683061 - DNA, 25 bp, Mus musculus
gccgaagcctttgctcaatgaaaaa

SEQ ID NO: 683062 - DNA, 25 bp, Mus musculus
gccgaagcgccgagcagcgctgcgg

SEQ ID NO: 683063 - DNA, 25 bp, Mus musculus
gccgaagcgccgtgcagcgctgcgg

SEQ ID NO: 683064 - DNA, 25 bp, Mus musculus
gccgaaggctgacgaatcaaaatgt

SEQ ID NO: 683065 - DNA, 25 bp, Mus musculus
gccgaaggctgaggaatcaaaatgt

SEQ ID NO: 683066 - DNA, 25 bp, Mus musculus
gccgaataagtaatttcgggacaca

SEQ ID NO: 683067 - DNA, 25 bp, Mus musculus
gccgaataagtattttcgggacaca

SEQ ID NO: 683068 - DNA, 25 bp, Mus musculus
gccgaatacagcaacgaagatgccg

SEQ ID NO: 683069 - DNA, 25 bp, Mus musculus
gccgaatacagctacgaagatgccg

SEQ ID NO: 683070 - DNA, 25 bp, Mus musculus
gccgaatcaatgcacgattggttta

SEQ ID NO: 683071 - DNA, 25 bp, Mus musculus
gccgaatcaatggacgattggttta

SEQ ID NO: 683072 - DNA, 25 bp, Mus musculus
gccgaatctggtaggacaatctgag

SEQ ID NO: 683073 - DNA, 25 bp, Mus musculus
gccgaatctggttggacaatctgag

SEQ ID NO: 683074 - DNA, 25 bp, Mus musculus
gccgaatgatacagaagagaacgca

SEQ ID NO: 683075 - DNA, 25 bp, Mus musculus
gccgaatgatactgaagagaacgca

SEQ ID NO: 683076 - DNA, 25 bp, Mus musculus
gccgaattcatccaggaccagcctg

SEQ ID NO: 683077 - DNA, 25 bp, Mus musculus
gccgaattcatcgaggaccagcctg

SEQ ID NO: 683078 - DNA, 25 bp, Mus musculus
gccgaattgtatactacctgatgaa

SEQ ID NO: 683079 - DNA, 25 bp, Mus musculus
gccgaattgtattctacctgatgaa

SEQ ID NO: 683080 - DNA, 25 bp, Mus musculus
gccgacaatgtgaggtagacaaaga

SEQ ID NO: 683081 - DNA, 25 bp, Mus musculus
gccgacaatgtgtggtagacaaaga

SEQ ID NO: 683082 - DNA, 25 bp, Mus musculus
gccgacagagcgaagtatgcgccct

SEQ ID NO: 683083 - DNA, 25 bp, Mus musculus
gccgacagagcgtagtatgcgccct

SEQ ID NO: 683084 - DNA, 25 bp, Mus musculus
gccgacagatctcacctcaggaatt

SEQ ID NO: 683085 - DNA, 25 bp, Mus musculus
gccgacagatctgacctcaggaatt

SEQ ID NO: 683086 - DNA, 25 bp, Mus musculus
gccgacaggattcgttggctaccgt

SEQ ID NO: 683087 - DNA, 25 bp, Mus musculus
gccgacaggattggttggctaccgt

SEQ ID NO: 683088 - DNA, 25 bp, Mus musculus
gccgacatcctgaccgtgagccagt

SEQ ID NO: 683089 - DNA, 25 bp, Mus musculus
gccgacatcctgtccgtgagccagt

SEQ ID NO: 683090 - DNA, 25 bp, Mus musculus
gccgaccaattgcttgtttatctca

SEQ ID NO: 683091 - DNA, 25 bp, Mus musculus
gccgaccaattggttgtttatctca

SEQ ID NO: 683092 - DNA, 25 bp, Mus musculus
gccgaccccggaaggctcgaaggct

SEQ ID NO: 683093 - DNA, 25 bp, Mus musculus
gccgaccccggatggctcgaaggct

SEQ ID NO: 683094 - DNA, 25 bp, Mus musculus
gccgaccgcagcagcaatgacctgt

SEQ ID NO: 683095 - DNA, 25 bp, Mus musculus
gccgaccgcagctgcaatgacctgt

SEQ ID NO: 683096 - DNA, 25 bp, Mus musculus
gccgacctaattctgaaggacttct

SEQ ID NO: 683097 - DNA, 25 bp, Mus musculus
gccgacctaattgtgaaggacttct

SEQ ID NO: 683098 - DNA, 25 bp, Mus musculus
gccgaccttgctctagatgccatgt

SEQ ID NO: 683099 - DNA, 25 bp, Mus musculus
gccgaccttgctgtagatgccatgt

SEQ ID NO: 683100 - DNA, 25 bp, Mus musculus
gccgacgatggtcagaagacactgt

SEQ ID NO: 683101 - DNA, 25 bp, Mus musculus
gccgacgatggtgagaagacactgt

SEQ ID NO: 683102 - DNA, 25 bp, Mus musculus
gccgactacatgcagcagtgcaagc

SEQ ID NO: 683103 - DNA, 25 bp, Mus musculus
gccgactacatggagcagtgcaagc

SEQ ID NO: 683104 - DNA, 25 bp, Mus musculus
gccgactcagaaacgccaaaatcca

SEQ ID NO: 683105 - DNA, 25 bp, Mus musculus
gccgactcagaatcgccaaaatcca

SEQ ID NO: 683106 - DNA, 25 bp, Mus musculus
gccgactccaccacaagaatggttc

SEQ ID NO: 683107 - DNA, 25 bp, Mus musculus
gccgactccacctcaagaatggttc

SEQ ID NO: 683108 - DNA, 25 bp, Mus musculus
gccgactgggtgatccttccggagt

SEQ ID NO: 683109 - DNA, 25 bp, Mus musculus
gccgactgggtgttccttccggagt

SEQ ID NO: 683110 - DNA, 25 bp, Mus musculus
gccgactttgtcaacctctcaacaa

SEQ ID NO: 683111 - DNA, 25 bp, Mus musculus
gccgactttgtctacctctcaacaa

SEQ ID NO: 683112 - DNA, 25 bp, Mus musculus
gccgagaaagatcctacttcagagc

SEQ ID NO: 683113 - DNA, 25 bp, Mus musculus
gccgagaaagatgctacttcagagc

SEQ ID NO: 683114 - DNA, 25 bp, Mus musculus
gccgagaaccacctgcctggaaatt

SEQ ID NO: 683115 - DNA, 25 bp, Mus musculus
gccgagaaccacgtgcctggaaatt

SEQ ID NO: 683116 - DNA, 25 bp, Mus musculus
gccgagaacgcaattcaggtaccaa

SEQ ID NO: 683117 - DNA, 25 bp, Mus musculus
gccgagaacgcatttcaggtaccaa

SEQ ID NO: 683118 - DNA, 25 bp, Mus musculus
gccgagacaacaaggactgcctgat

SEQ ID NO: 683119 - DNA, 25 bp, Mus musculus
gccgagacaacatggactgcctgat

SEQ ID NO: 683120 - DNA, 25 bp, Mus musculus
gccgagacacctatgaggaagtgaa

SEQ ID NO: 683121 - DNA, 25 bp, Mus musculus
gccgagacacctttgaggaagtgaa

SEQ ID NO: 683122 - DNA, 25 bp, Mus musculus
gccgagacactaagagcaaaaccaa

SEQ ID NO: 683123 - DNA, 25 bp, Mus musculus
gccgagacactatgagcaaaaccaa

SEQ ID NO: 683124 - DNA, 25 bp, Mus musculus
gccgagacccatagttggatgtgta

SEQ ID NO: 683125 - DNA, 25 bp, Mus musculus
gccgagacccattgttggatgtgta

SEQ ID NO: 683126 - DNA, 25 bp, Mus musculus
gccgagacctccattcgcaggtggc

SEQ ID NO: 683127 - DNA, 25 bp, Mus musculus
gccgagacctcctttcgcaggtggc

SEQ ID NO: 683128 - DNA, 25 bp, Mus musculus
gccgagacctgaactttgagcgagg

SEQ ID NO: 683129 - DNA, 25 bp, Mus musculus
gccgagacctgatctttgagcgagg

SEQ ID NO: 683130 - DNA, 25 bp, Mus musculus
gccgagacctgcaattggaaggaca

SEQ ID NO: 683131 - DNA, 25 bp, Mus musculus
gccgagacctgctattggaaggaca

SEQ ID NO: 683132 - DNA, 25 bp, Mus musculus
gccgagaccttacccacattggaga

SEQ ID NO: 683133 - DNA, 25 bp, Mus musculus
gccgagaccttagccacattggaga

SEQ ID NO: 683134 - DNA, 25 bp, Mus musculus
gccgagactgtgagcgccatggccc

SEQ ID NO: 683135 - DNA, 25 bp, Mus musculus
gccgagactgtgtgcgccatggccc

SEQ ID NO: 683136 - DNA, 25 bp, Mus musculus
gccgagagagaacccaccagccaag

SEQ ID NO: 683137 - DNA, 25 bp, Mus musculus
gccgagagagaagccaccagccaag

SEQ ID NO: 683138 - DNA, 25 bp, Mus musculus
gccgagagcaccacacggatgagtt

SEQ ID NO: 683139 - DNA, 25 bp, Mus musculus
gccgagagcacctcacggatgagtt

SEQ ID NO: 683140 - DNA, 25 bp, Mus musculus
gccgagatcggcatttagggcatgt

SEQ ID NO: 683141 - DNA, 25 bp, Mus musculus
gccgagatcggcttttagggcatgt

SEQ ID NO: 683142 - DNA, 25 bp, Mus musculus
gccgagatggaaaaccaggaatgcc

SEQ ID NO: 683143 - DNA, 25 bp, Mus musculus
gccgagatggaataccaggaatgcc

SEQ ID NO: 683144 - DNA, 25 bp, Mus musculus
gccgagatggagaactgagtcccag

SEQ ID NO: 683145 - DNA, 25 bp, Mus musculus
gccgagatggagtactgagtcccag

SEQ ID NO: 683146 - DNA, 25 bp, Mus musculus
gccgagatttcacagccgcgagata

SEQ ID NO: 683147 - DNA, 25 bp, Mus musculus
gccgagatttcagagccgcgagata

SEQ ID NO: 683148 - DNA, 25 bp, Mus musculus
gccgagcacacacactgaggccttt

SEQ ID NO: 683149 - DNA, 25 bp, Mus musculus
gccgagcacacagactgaggccttt

SEQ ID NO: 683150 - DNA, 25 bp, Mus musculus
gccgagcagcgcctgtcctatgagt

SEQ ID NO: 683151 - DNA, 25 bp, Mus musculus
gccgagcagcgcgtgtcctatgagt

SEQ ID NO: 683152 - DNA, 25 bp, Mus musculus
gccgagcagtgtccacatatttgaa

SEQ ID NO: 683153 - DNA, 25 bp, Mus musculus
gccgagcagtgtgcacatatttgaa

SEQ ID NO: 683154 - DNA, 25 bp, Mus musculus
gccgagcgactgagaagcccagtct

SEQ ID NO: 683155 - DNA, 25 bp, Mus musculus
gccgagcgactgtgaagcccagtct

SEQ ID NO: 683156 - DNA, 25 bp, Mus musculus
gccgagcgctctccgccggttatat

SEQ ID NO: 683157 - DNA, 25 bp, Mus musculus
gccgagcgctctgcgccggttatat

SEQ ID NO: 683158 - DNA, 25 bp, Mus musculus
gccgagctgatcatcgcaaacttta

SEQ ID NO: 683159 - DNA, 25 bp, Mus musculus
gccgagctgatcttcgcaaacttta

SEQ ID NO: 683160 - DNA, 25 bp, Mus musculus
gccgagcttgtccagagaagagcat

SEQ ID NO: 683161 - DNA, 25 bp, Mus musculus
gccgagcttgtcgagagaagagcat

SEQ ID NO: 683162 - DNA, 25 bp, Mus musculus
gccgaggaccagaaaagctatgatt

SEQ ID NO: 683163 - DNA, 25 bp, Mus musculus
gccgaggaccagtaaagctatgatt

SEQ ID NO: 683164 - DNA, 25 bp, Mus musculus
gccgaggatgagagcgccaagctct

SEQ ID NO: 683165 - DNA, 25 bp, Mus musculus
gccgaggatgagtgcgccaagctct

SEQ ID NO: 683166 - DNA, 25 bp, Mus musculus
gccgaggcatttccctgagcccagg

SEQ ID NO: 683167 - DNA, 25 bp, Mus musculus
gccgaggcatttgcctgagcccagg

SEQ ID NO: 683168 - DNA, 25 bp, Mus musculus
gccgaggcccagaaatagccgcctt

SEQ ID NO: 683169 - DNA, 25 bp, Mus musculus
gccgaggcccagtaatagccgcctt

SEQ ID NO: 683170 - DNA, 25 bp, Mus musculus
gccgaggcccctacggaaggctctg

SEQ ID NO: 683171 - DNA, 25 bp, Mus musculus
gccgaggccccttcggaaggctctg

SEQ ID NO: 683172 - DNA, 25 bp, Mus musculus
gccgaggcctggactgaagtgccca

SEQ ID NO: 683173 - DNA, 25 bp, Mus musculus
gccgaggcctggtctgaagtgccca

SEQ ID NO: 683174 - DNA, 25 bp, Mus musculus
gccgaggcgcataccccgtcttttt

SEQ ID NO: 683175 - DNA, 25 bp, Mus musculus
gccgaggcgcattccccgtcttttt

SEQ ID NO: 683176 - DNA, 25 bp, Mus musculus
gccgagggaacccagccggtcatct

SEQ ID NO: 683177 - DNA, 25 bp, Mus musculus
gccgagggaaccgagccggtcatct

SEQ ID NO: 683178 - DNA, 25 bp, Mus musculus
gccgagggagttctctctagctctt

SEQ ID NO: 683179 - DNA, 25 bp, Mus musculus
gccgagggagttgtctctagctctt

SEQ ID NO: 683180 - DNA, 25 bp, Mus musculus
gccgagggctccaggtgctgacctt

SEQ ID NO: 683181 - DNA, 25 bp, Mus musculus
gccgagggctcctggtgctgacctt

SEQ ID NO: 683182 - DNA, 25 bp, Mus musculus
gccgaggttccactaatctttttag

SEQ ID NO: 683183 - DNA, 25 bp, Mus musculus
gccgaggttccagtaatctttttag

SEQ ID NO: 683184 - DNA, 25 bp, Mus musculus
gccgagtattgtctggctaccaccc

SEQ ID NO: 683185 - DNA, 25 bp, Mus musculus
gccgagtattgtgtggctaccaccc

SEQ ID NO: 683186 - DNA, 25 bp, Mus musculus
gccgagtctgatcttcactaatcga

SEQ ID NO: 683187 - DNA, 25 bp, Mus musculus
gccgagtctgatgttcactaatcga

SEQ ID NO: 683188 - DNA, 25 bp, Mus musculus
gccgagtgaatgaaaggaccttgaa

SEQ ID NO: 683189 - DNA, 25 bp, Mus musculus
gccgagtgaatgtaaggaccttgaa

SEQ ID NO: 683190 - DNA, 25 bp, Mus musculus
gccgagtgctggatgcttcccgtaa

SEQ ID NO: 683191 - DNA, 25 bp, Mus musculus
gccgagtgctggttgcttcccgtaa

SEQ ID NO: 683192 - DNA, 25 bp, Mus musculus
gccgagtgtttgacctaccctgcat

SEQ ID NO: 683193 - DNA, 25 bp, Mus musculus
gccgagtgtttgtcctaccctgcat

SEQ ID NO: 683194 - DNA, 25 bp, Mus musculus
gccgagttcctcattgtcttatgtt

SEQ ID NO: 683195 - DNA, 25 bp, Mus musculus
gccgagttcctctttgtcttatgtt

SEQ ID NO: 683196 - DNA, 25 bp, Mus musculus
gccgataaatatatgcagctcttgt

SEQ ID NO: 683197 - DNA, 25 bp, Mus musculus
gccgataaatatttgcagctcttgt

SEQ ID NO: 683198 - DNA, 25 bp, Mus musculus
gccgatacaaagcaggagaaaaaga

SEQ ID NO: 683199 - DNA, 25 bp, Mus musculus
gccgatacaaaggaggagaaaaaga

SEQ ID NO: 683200 - DNA, 25 bp, Mus musculus
gccgatacccagagatccggtgtct

SEQ ID NO: 683201 - DNA, 25 bp, Mus musculus
gccgatacccagtgatccggtgtct

SEQ ID NO: 683202 - DNA, 25 bp, Mus musculus
gccgatccccagataacagcatcgt

SEQ ID NO: 683203 - DNA, 25 bp, Mus musculus
gccgatccccagttaacagcatcgt

SEQ ID NO: 683204 - DNA, 25 bp, Mus musculus
gccgatccttcaccagaagaaagaa

SEQ ID NO: 683205 - DNA, 25 bp, Mus musculus
gccgatccttcagcagaagaaagaa

SEQ ID NO: 683206 - DNA, 25 bp, Mus musculus
gccgatctggatccatgctgaggaa

SEQ ID NO: 683207 - DNA, 25 bp, Mus musculus
gccgatctggatgcatgctgaggaa

SEQ ID NO: 683208 - DNA, 25 bp, Mus musculus
gccgatgaaccaccaacaagctttg

SEQ ID NO: 683209 - DNA, 25 bp, Mus musculus
gccgatgaaccagcaacaagctttg

SEQ ID NO: 683210 - DNA, 25 bp, Mus musculus
gccgatgcactgaactaaggaagca

SEQ ID NO: 683211 - DNA, 25 bp, Mus musculus
gccgatgcactgtactaaggaagca

SEQ ID NO: 683212 - DNA, 25 bp, Mus musculus
gccgatgcccagacctggttacaaa

SEQ ID NO: 683213 - DNA, 25 bp, Mus musculus
gccgatgcccagtcctggttacaaa

SEQ ID NO: 683214 - DNA, 25 bp, Mus musculus
gccgatggaactctcagatatgact

SEQ ID NO: 683215 - DNA, 25 bp, Mus musculus
gccgatggaactgtcagatatgact

SEQ ID NO: 683216 - DNA, 25 bp, Mus musculus
gccgatggatctaccccaatcgtgg

SEQ ID NO: 683217 - DNA, 25 bp, Mus musculus
gccgatggatcttccccaatcgtgg

SEQ ID NO: 683218 - DNA, 25 bp, Mus musculus
gccgatggcgtacccaatgttgaac

SEQ ID NO: 683219 - DNA, 25 bp, Mus musculus
gccgatggcgtagccaatgttgaac

SEQ ID NO: 683220 - DNA, 25 bp, Mus musculus
gccgatgggtccagaagaagttcca

SEQ ID NO: 683221 - DNA, 25 bp, Mus musculus
gccgatgggtcctgaagaagttcca

SEQ ID NO: 683222 - DNA, 25 bp, Mus musculus
gccgatgtggttccaaatgatgcag

SEQ ID NO: 683223 - DNA, 25 bp, Mus musculus
gccgatgtggttgcaaatgatgcag

SEQ ID NO: 683224 - DNA, 25 bp, Mus musculus
gccgatgtgtgcaagctagctggaa

SEQ ID NO: 683225 - DNA, 25 bp, Mus musculus
gccgatgtgtgctagctagctggaa

SEQ ID NO: 683226 - DNA, 25 bp, Mus musculus
gccgattcgccaaagacccagagtt

SEQ ID NO: 683227 - DNA, 25 bp, Mus musculus
gccgattcgccatagacccagagtt

SEQ ID NO: 683228 - DNA, 25 bp, Mus musculus
gccgattggcccacactcaggagtg

SEQ ID NO: 683229 - DNA, 25 bp, Mus musculus
gccgattggccctcactcaggagtg

SEQ ID NO: 683230 - DNA, 25 bp, Mus musculus
gccgatttgatcagcgcttcgtagt

SEQ ID NO: 683231 - DNA, 25 bp, Mus musculus
gccgatttgatctgcgcttcgtagt

SEQ ID NO: 683232 - DNA, 25 bp, Mus musculus
gccgcaaagatgaagaattagaccc

SEQ ID NO: 683233 - DNA, 25 bp, Mus musculus
gccgcaaagatgtagaattagaccc

SEQ ID NO: 683234 - DNA, 25 bp, Mus musculus
gccgcaaccatcaagtaggagcccg

SEQ ID NO: 683235 - DNA, 25 bp, Mus musculus
gccgcaaccatctagtaggagcccg

SEQ ID NO: 683236 - DNA, 25 bp, Mus musculus
gccgcaagaccaagatcatcgaaat

SEQ ID NO: 683237 - DNA, 25 bp, Mus musculus
gccgcaagaccatgatcatcgaaat

SEQ ID NO: 683238 - DNA, 25 bp, Mus musculus
gccgcaagagctacgaggactgtac

SEQ ID NO: 683239 - DNA, 25 bp, Mus musculus
gccgcaagagcttcgaggactgtac

SEQ ID NO: 683240 - DNA, 25 bp, Mus musculus
gccgcaagataaatcagctcagcaa

SEQ ID NO: 683241 - DNA, 25 bp, Mus musculus
gccgcaagataattcagctcagcaa

SEQ ID NO: 683242 - DNA, 25 bp, Mus musculus
gccgcaagtctaagcgtcagtctac

SEQ ID NO: 683243 - DNA, 25 bp, Mus musculus
gccgcaagtctatgcgtcagtctac

SEQ ID NO: 683244 - DNA, 25 bp, Mus musculus
gccgcaatggcactggagccaactc

SEQ ID NO: 683245 - DNA, 25 bp, Mus musculus
gccgcaatggcagtggagccaactc

SEQ ID NO: 683246 - DNA, 25 bp, Mus musculus
gccgcaatttggagtcgggtgcaaa

SEQ ID NO: 683247 - DNA, 25 bp, Mus musculus
gccgcaatttggtgtcgggtgcaaa

SEQ ID NO: 683248 - DNA, 25 bp, Mus musculus
gccgcacagacaccaggcatagctg

SEQ ID NO: 683249 - DNA, 25 bp, Mus musculus
gccgcacagacagcaggcatagctg

SEQ ID NO: 683250 - DNA, 25 bp, Mus musculus
gccgcacagcctcgtacgtggtgct

SEQ ID NO: 683251 - DNA, 25 bp, Mus musculus
gccgcacagcctggtacgtggtgct

SEQ ID NO: 683252 - DNA, 25 bp, Mus musculus
gccgcacattcgcatggtggaccag

SEQ ID NO: 683253 - DNA, 25 bp, Mus musculus
gccgcacattcggatggtggaccag

SEQ ID NO: 683254 - DNA, 25 bp, Mus musculus
gccgcaccatgtatgtcatcccatt

SEQ ID NO: 683255 - DNA, 25 bp, Mus musculus
gccgcaccatgtttgtcatcccatt

SEQ ID NO: 683256 - DNA, 25 bp, Mus musculus
gccgcaccgctcagagatttcacag

SEQ ID NO: 683257 - DNA, 25 bp, Mus musculus
gccgcaccgctctgagatttcacag

SEQ ID NO: 683258 - DNA, 25 bp, Mus musculus
gccgcacctgcaatgtgatcgctca

SEQ ID NO: 683259 - DNA, 25 bp, Mus musculus
gccgcacctgcattgtgatcgctca

SEQ ID NO: 683260 - DNA, 25 bp, Mus musculus
gccgcacgtgtgaggcagctgtaca

SEQ ID NO: 683261 - DNA, 25 bp, Mus musculus
gccgcacgtgtgtggcagctgtaca

SEQ ID NO: 683262 - DNA, 25 bp, Mus musculus
gccgcactgcagaactcggatgagg

SEQ ID NO: 683263 - DNA, 25 bp, Mus musculus
gccgcactgcagtactcggatgagg

SEQ ID NO: 683264 - DNA, 25 bp, Mus musculus
gccgcactggcaacaaggtggccat

SEQ ID NO: 683265 - DNA, 25 bp, Mus musculus
gccgcactggcatcaaggtggccat

SEQ ID NO: 683266 - DNA, 25 bp, Mus musculus
gccgcagaacgtattcactagctga

SEQ ID NO: 683267 - DNA, 25 bp, Mus musculus
gccgcagaacgttttcactagctga

SEQ ID NO: 683268 - DNA, 25 bp, Mus musculus
gccgcagaagcgctactaccggcag

SEQ ID NO: 683269 - DNA, 25 bp, Mus musculus
gccgcagaagcggtactaccggcag

SEQ ID NO: 683270 - DNA, 25 bp, Mus musculus
gccgcagagaccaataggaagtgcg

SEQ ID NO: 683271 - DNA, 25 bp, Mus musculus
gccgcagagacctataggaagtgcg

SEQ ID NO: 683272 - DNA, 25 bp, Mus musculus
gccgcagatggcaaacattgtgaag

SEQ ID NO: 683273 - DNA, 25 bp, Mus musculus
gccgcagatggctaacattgtgaag

SEQ ID NO: 683274 - DNA, 25 bp, Mus musculus
gccgcagattcgacggccaacgcag

SEQ ID NO: 683275 - DNA, 25 bp, Mus musculus
gccgcagattcgtcggccaacgcag

SEQ ID NO: 683276 - DNA, 25 bp, Mus musculus
gccgcagcaccgagtctgaagtcta

SEQ ID NO: 683277 - DNA, 25 bp, Mus musculus
gccgcagcaccgtgtctgaagtcta

SEQ ID NO: 683278 - DNA, 25 bp, Mus musculus
gccgcagccgcactaagaaggagaa

SEQ ID NO: 683279 - DNA, 25 bp, Mus musculus
gccgcagccgcagtaagaaggagaa

SEQ ID NO: 683280 - DNA, 25 bp, Mus musculus
gccgcagcgacccaatggaacgcta

SEQ ID NO: 683281 - DNA, 25 bp, Mus musculus
gccgcagcgaccgaatggaacgcta

SEQ ID NO: 683282 - DNA, 25 bp, Mus musculus
gccgcagctgagatctcggagccca

SEQ ID NO: 683283 - DNA, 25 bp, Mus musculus
gccgcagctgagttctcggagccca

SEQ ID NO: 683284 - DNA, 25 bp, Mus musculus
gccgcaggttccctggatcaggaaa

SEQ ID NO: 683285 - DNA, 25 bp, Mus musculus
gccgcaggttccgtggatcaggaaa

SEQ ID NO: 683286 - DNA, 25 bp, Mus musculus
gccgcagtacaaaaagcaatcccta

SEQ ID NO: 683287 - DNA, 25 bp, Mus musculus
gccgcagtacaataagcaatcccta

SEQ ID NO: 683288 - DNA, 25 bp, Mus musculus
gccgcagttggacaagacttcgctt

SEQ ID NO: 683289 - DNA, 25 bp, Mus musculus
gccgcagttggagaagacttcgctt

SEQ ID NO: 683290 - DNA, 25 bp, Mus musculus
gccgcatccacgacgaactgagtcg

SEQ ID NO: 683291 - DNA, 25 bp, Mus musculus
gccgcatccacgtcgaactgagtcg

SEQ ID NO: 683292 - DNA, 25 bp, Mus musculus
gccgcatccatgagtgctgctcaaa

SEQ ID NO: 683293 - DNA, 25 bp, Mus musculus
gccgcatccatgtgtgctgctcaaa

SEQ ID NO: 683294 - DNA, 25 bp, Mus musculus
gccgcatccctcaggctgagtggga

SEQ ID NO: 683295 - DNA, 25 bp, Mus musculus
gccgcatccctctggctgagtggga

SEQ ID NO: 683296 - DNA, 25 bp, Mus musculus
gccgcatgggcaacgagatcctcag

SEQ ID NO: 683297 - DNA, 25 bp, Mus musculus
gccgcatgggcatcgagatcctcag

SEQ ID NO: 683298 - DNA, 25 bp, Mus musculus
gccgcatgggctacgtacacaactt

SEQ ID NO: 683299 - DNA, 25 bp, Mus musculus
gccgcatgggcttcgtacacaactt

SEQ ID NO: 683300 - DNA, 25 bp, Mus musculus
gccgcattaaggacaagatgagcgt

SEQ ID NO: 683301 - DNA, 25 bp, Mus musculus
gccgcattaaggtcaagatgagcgt

SEQ ID NO: 683302 - DNA, 25 bp, Mus musculus
gccgcattgagcagccacagctcta

SEQ ID NO: 683303 - DNA, 25 bp, Mus musculus
gccgcattgagctgccacagctcta

SEQ ID NO: 683304 - DNA, 25 bp, Mus musculus
gccgccaagggaaggtgcttcaaga

SEQ ID NO: 683305 - DNA, 25 bp, Mus musculus
gccgccaagggactgcaaaatcaac

SEQ ID NO: 683306 - DNA, 25 bp, Mus musculus
gccgccaagggagtgcaaaatcaac

SEQ ID NO: 683307 - DNA, 25 bp, Mus musculus
gccgccaagggatggtgcttcaaga

SEQ ID NO: 683308 - DNA, 25 bp, Mus musculus
gccgccaatggaaaagctgcaaatg

SEQ ID NO: 683309 - DNA, 25 bp, Mus musculus
gccgccaatggataagctgcaaatg

SEQ ID NO: 683310 - DNA, 25 bp, Mus musculus
gccgccaattgtaacaagaaagaga

SEQ ID NO: 683311 - DNA, 25 bp, Mus musculus
gccgccaattgttacaagaaagaga

SEQ ID NO: 683312 - DNA, 25 bp, Mus musculus
gccgccaccgggacaacaatgaaat

SEQ ID NO: 683313 - DNA, 25 bp, Mus musculus
gccgccaccgggtcaacaatgaaat

SEQ ID NO: 683314 - DNA, 25 bp, Mus musculus
gccgccacttcgaagcgtcttggag

SEQ ID NO: 683315 - DNA, 25 bp, Mus musculus
gccgccacttcgtagcgtcttggag

SEQ ID NO: 683316 - DNA, 25 bp, Mus musculus
gccgccactttgaacccagattcga

SEQ ID NO: 683317 - DNA, 25 bp, Mus musculus
gccgccactttgtacccagattcga

SEQ ID NO: 683318 - DNA, 25 bp, Mus musculus
gccgccagcaacagcaaggagagcg

SEQ ID NO: 683319 - DNA, 25 bp, Mus musculus
gccgccagcaactgcaaggagagcg

SEQ ID NO: 683320 - DNA, 25 bp, Mus musculus
gccgccagtgtgactttgcaatcgc

SEQ ID NO: 683321 - DNA, 25 bp, Mus musculus
gccgccagtgtgtctttgcaatcgc

SEQ ID NO: 683322 - DNA, 25 bp, Mus musculus
gccgccagttctctgatgtggagtt

SEQ ID NO: 683323 - DNA, 25 bp, Mus musculus
gccgccagttctgtgatgtggagtt

SEQ ID NO: 683324 - DNA, 25 bp, Mus musculus
gccgccatcaagcttatggacgtca

SEQ ID NO: 683325 - DNA, 25 bp, Mus musculus
gccgccatcaaggttatggacgtca

SEQ ID NO: 683326 - DNA, 25 bp, Mus musculus
gccgccatcttgagggagcgaaacc

SEQ ID NO: 683327 - DNA, 25 bp, Mus musculus
gccgccatcttgtgggagcgaaacc

SEQ ID NO: 683328 - DNA, 25 bp, Mus musculus
gccgccatgaggcttggtatcccca

SEQ ID NO: 683329 - DNA, 25 bp, Mus musculus
gccgccatgagggttggtatcccca

SEQ ID NO: 683330 - DNA, 25 bp, Mus musculus
gccgcccaactcaggtgtggtacca

SEQ ID NO: 683331 - DNA, 25 bp, Mus musculus
gccgcccaactctggtgtggtacca

SEQ ID NO: 683332 - DNA, 25 bp, Mus musculus
gccgcccacttgctagcagacatag

SEQ ID NO: 683333 - DNA, 25 bp, Mus musculus
gccgcccacttggtagcagacatag

SEQ ID NO: 683334 - DNA, 25 bp, Mus musculus
gccgcccagatgagcgacctcattg

SEQ ID NO: 683335 - DNA, 25 bp, Mus musculus
gccgcccagatgtgcgacctcattg

SEQ ID NO: 683336 - DNA, 25 bp, Mus musculus
gccgcccagcagagttgtgttttcc

SEQ ID NO: 683337 - DNA, 25 bp, Mus musculus
gccgcccagcagtgttgtgttttcc

SEQ ID NO: 683338 - DNA, 25 bp, Mus musculus
gccgcccagtggcttcacaagctgt

SEQ ID NO: 683339 - DNA, 25 bp, Mus musculus
gccgcccagtgggttcacaagctgt

SEQ ID NO: 683340 - DNA, 25 bp, Mus musculus
gccgccctggaaagtactgagtgac

SEQ ID NO: 683341 - DNA, 25 bp, Mus musculus
gccgccctggaatgtactgagtgac

SEQ ID NO: 683342 - DNA, 25 bp, Mus musculus
gccgccgacttgagaatgggactcg

SEQ ID NO: 683343 - DNA, 25 bp, Mus musculus
gccgccgacttgtgaatgggactcg

SEQ ID NO: 683344 - DNA, 25 bp, Mus musculus
gccgccgccgacatgtgaatgggac

SEQ ID NO: 683345 - DNA, 25 bp, Mus musculus
gccgccgccgacttgtgaatgggac

SEQ ID NO: 683346 - DNA, 25 bp, Mus musculus
gccgccgccgggagctagctctatg

SEQ ID NO: 683347 - DNA, 25 bp, Mus musculus
gccgccgccgggtgctagctctatg

SEQ ID NO: 683348 - DNA, 25 bp, Mus musculus
gccgccgcctcaagtacttctttat

SEQ ID NO: 683349 - DNA, 25 bp, Mus musculus
gccgccgcctcatgtacttctttat

SEQ ID NO: 683350 - DNA, 25 bp, Mus musculus
gccgccgcctttaacttgtgcgtgg

SEQ ID NO: 683351 - DNA, 25 bp, Mus musculus
gccgccgccttttacttgtgcgtgg

SEQ ID NO: 683352 - DNA, 25 bp, Mus musculus
gccgccgcggtaactgcagagtctg

SEQ ID NO: 683353 - DNA, 25 bp, Mus musculus
gccgccgcggtatctgcagagtctg

SEQ ID NO: 683354 - DNA, 25 bp, Mus musculus
gccgccgctgcaacattgtaggcaa

SEQ ID NO: 683355 - DNA, 25 bp, Mus musculus
gccgccgctgcatcattgtaggcaa

SEQ ID NO: 683356 - DNA, 25 bp, Mus musculus
gccgccgggaagcactttgttcagt

SEQ ID NO: 683357 - DNA, 25 bp, Mus musculus
gccgccgggaaggactttgttcagt

SEQ ID NO: 683358 - DNA, 25 bp, Mus musculus
gccgccgggttgagtgtgactccac

SEQ ID NO: 683359 - DNA, 25 bp, Mus musculus
gccgccgggttgtgtgtgactccac

SEQ ID NO: 683360 - DNA, 25 bp, Mus musculus
gccgccggtgttaacaccacggaca

SEQ ID NO: 683361 - DNA, 25 bp, Mus musculus
gccgccggtgtttacaccacggaca

SEQ ID NO: 683362 - DNA, 25 bp, Mus musculus
gccgccgtctttaccggcagttggg

SEQ ID NO: 683363 - DNA, 25 bp, Mus musculus
gccgccgtcttttccggcagttggg

SEQ ID NO: 683364 - DNA, 25 bp, Mus musculus
gccgccgttaggagaaccctgcgtt

SEQ ID NO: 683365 - DNA, 25 bp, Mus musculus
gccgccgttaggtgaaccctgcgtt

SEQ ID NO: 683366 - DNA, 25 bp, Mus musculus
gccgcctaaggaacggaaatttgca

SEQ ID NO: 683367 - DNA, 25 bp, Mus musculus
gccgcctaaggatcggaaatttgca

SEQ ID NO: 683368 - DNA, 25 bp, Mus musculus
gccgcctaatccaatggaaggcatg

SEQ ID NO: 683369 - DNA, 25 bp, Mus musculus
gccgcctaatcctatggaaggcatg

SEQ ID NO: 683370 - DNA, 25 bp, Mus musculus
gccgcctacacgaacaaggtggagt

SEQ ID NO: 683371 - DNA, 25 bp, Mus musculus
gccgcctacacgtacaaggtggagt

SEQ ID NO: 683372 - DNA, 25 bp, Mus musculus
gccgcctacctgacagcagggtggt

SEQ ID NO: 683373 - DNA, 25 bp, Mus musculus
gccgcctacctgtcagcagggtggt

SEQ ID NO: 683374 - DNA, 25 bp, Mus musculus
gccgcctactatcagcctgaattct

SEQ ID NO: 683375 - DNA, 25 bp, Mus musculus
gccgcctactatgagcctgaattct

SEQ ID NO: 683376 - DNA, 25 bp, Mus musculus
gccgcctcctccatgctgggtatga

SEQ ID NO: 683377 - DNA, 25 bp, Mus musculus
gccgcctcctccttgctgggtatga

SEQ ID NO: 683378 - DNA, 25 bp, Mus musculus
gccgcctctcagcaagcaaagatgt

SEQ ID NO: 683379 - DNA, 25 bp, Mus musculus
gccgcctctcaggaagcaaagatgt

SEQ ID NO: 683380 - DNA, 25 bp, Mus musculus
gccgcctctgtactccagaaggatg

SEQ ID NO: 683381 - DNA, 25 bp, Mus musculus
gccgcctctgtagtccagaaggatg

SEQ ID NO: 683382 - DNA, 25 bp, Mus musculus
gccgccttatgtcattttacctcca

SEQ ID NO: 683383 - DNA, 25 bp, Mus musculus
gccgccttatgtgattttacctcca

SEQ ID NO: 683384 - DNA, 25 bp, Mus musculus
gccgccttgagccatgagtatttca

SEQ ID NO: 683385 - DNA, 25 bp, Mus musculus
gccgccttgagcgatgagtatttca

SEQ ID NO: 683386 - DNA, 25 bp, Mus musculus
gccgccttgccaagcctggctgtta

SEQ ID NO: 683387 - DNA, 25 bp, Mus musculus
gccgccttgccatgcctggctgtta

SEQ ID NO: 683388 - DNA, 25 bp, Mus musculus
gccgcctttcggcagaagctggtca

SEQ ID NO: 683389 - DNA, 25 bp, Mus musculus
gccgcctttcgggagaagctggtca

SEQ ID NO: 683390 - DNA, 25 bp, Mus musculus
gccgccttttgacatctacttatgc

SEQ ID NO: 683391 - DNA, 25 bp, Mus musculus
gccgccttttgagatctacttatgc

SEQ ID NO: 683392 - DNA, 25 bp, Mus musculus
gccgcgaatatgaccagctgtatga

SEQ ID NO: 683393 - DNA, 25 bp, Mus musculus
gccgcgaatatgtccagctgtatga

SEQ ID NO: 683394 - DNA, 25 bp, Mus musculus
gccgcgacacggacctggacggttt

SEQ ID NO: 683395 - DNA, 25 bp, Mus musculus
gccgcgacacggtcctggacggttt

SEQ ID NO: 683396 - DNA, 25 bp, Mus musculus
gccgcgagctttcttggatttcttt

SEQ ID NO: 683397 - DNA, 25 bp, Mus musculus
gccgcgagctttgttggatttcttt

SEQ ID NO: 683398 - DNA, 25 bp, Mus musculus
gccgcgaggaaaaaatcactttcat

SEQ ID NO: 683399 - DNA, 25 bp, Mus musculus
gccgcgaggaaataatcactttcat

SEQ ID NO: 683400 - DNA, 25 bp, Mus musculus
gccgcgagtcgtccttgaccgtagc

SEQ ID NO: 683401 - DNA, 25 bp, Mus musculus
gccgcgagtcgtgcttgaccgtagc

SEQ ID NO: 683402 - DNA, 25 bp, Mus musculus
gccgcgatgactacagagttctgac

SEQ ID NO: 683403 - DNA, 25 bp, Mus musculus
gccgcgatgacttcagagttctgac

SEQ ID NO: 683404 - DNA, 25 bp, Mus musculus
gccgcgcactatatgacacgctgcg

SEQ ID NO: 683405 - DNA, 25 bp, Mus musculus
gccgcgcactatttgacacgctgcg

SEQ ID NO: 683406 - DNA, 25 bp, Mus musculus
gccgcgccaagcagcgaatagagaa

SEQ ID NO: 683407 - DNA, 25 bp, Mus musculus
gccgcgccaagctgcgaatagagaa

SEQ ID NO: 683408 - DNA, 25 bp, Mus musculus
gccgcgcctctgatggattctgcat

SEQ ID NO: 683409 - DNA, 25 bp, Mus musculus
gccgcgcctctgttggattctgcat

SEQ ID NO: 683410 - DNA, 25 bp, Mus musculus
gccgcgctccctcagggatggtact

SEQ ID NO: 683411 - DNA, 25 bp, Mus musculus
gccgcgctccctgagggatggtact

SEQ ID NO: 683412 - DNA, 25 bp, Mus musculus
gccgcgctccttcctggtcaggaag

SEQ ID NO: 683413 - DNA, 25 bp, Mus musculus
gccgcgctccttgctggtcaggaag

SEQ ID NO: 683414 - DNA, 25 bp, Mus musculus
gccgcggacagtacttaaagggcca

SEQ ID NO: 683415 - DNA, 25 bp, Mus musculus
gccgcggacagttcttaaagggcca

SEQ ID NO: 683416 - DNA, 25 bp, Mus musculus
gccgcggagtgtagccatggcacct

SEQ ID NO: 683417 - DNA, 25 bp, Mus musculus
gccgcggagtgttgccatggcacct

SEQ ID NO: 683418 - DNA, 25 bp, Mus musculus
gccgcggcacaaaatcagcgtgaga

SEQ ID NO: 683419 - DNA, 25 bp, Mus musculus
gccgcggcacaatatcagcgtgaga

SEQ ID NO: 683420 - DNA, 25 bp, Mus musculus
gccgcggcccatagtgccttgcgat

SEQ ID NO: 683421 - DNA, 25 bp, Mus musculus
gccgcggcccattgtgccttgcgat

SEQ ID NO: 683422 - DNA, 25 bp, Mus musculus
gccgcggcctccaatgagatactca

SEQ ID NO: 683423 - DNA, 25 bp, Mus musculus
gccgcggcctcctatgagatactca

SEQ ID NO: 683424 - DNA, 25 bp, Mus musculus
gccgcggtccttagacacccgatat

SEQ ID NO: 683425 - DNA, 25 bp, Mus musculus
gccgcggtcctttgacacccgatat

SEQ ID NO: 683426 - DNA, 25 bp, Mus musculus
gccgcggtgactcagctacagaact

SEQ ID NO: 683427 - DNA, 25 bp, Mus musculus
gccgcggtgactgagctacagaact

SEQ ID NO: 683428 - DNA, 25 bp, Mus musculus
gccgcggttcttcttaagtgagcga

SEQ ID NO: 683429 - DNA, 25 bp, Mus musculus
gccgcggttcttgttaagtgagcga

SEQ ID NO: 683430 - DNA, 25 bp, Mus musculus
gccgcgtcagctcgtgtcctgtgaa

SEQ ID NO: 683431 - DNA, 25 bp, Mus musculus
gccgcgtcagctggtgtcctgtgaa

SEQ ID NO: 683432 - DNA, 25 bp, Mus musculus
gccgcgtccacacgaatgtttgcag

SEQ ID NO: 683433 - DNA, 25 bp, Mus musculus
gccgcgtccacaggaatgtttgcag

SEQ ID NO: 683434 - DNA, 25 bp, Mus musculus
gccgcgtctcagctcccgggaaagt

SEQ ID NO: 683435 - DNA, 25 bp, Mus musculus
gccgcgtctcaggtcccgggaaagt

SEQ ID NO: 683436 - DNA, 25 bp, Mus musculus
gccgcgtgcctgagccagcctgata

SEQ ID NO: 683437 - DNA, 25 bp, Mus musculus
gccgcgtgcctgtgccagcctgata

SEQ ID NO: 683438 - DNA, 25 bp, Mus musculus
gccgcgtgctctacatcaaggatgt

SEQ ID NO: 683439 - DNA, 25 bp, Mus musculus
gccgcgtgctcttcatcaaggatgt

SEQ ID NO: 683440 - DNA, 25 bp, Mus musculus
gccgcgtggagaacatagccaacga

SEQ ID NO: 683441 - DNA, 25 bp, Mus musculus
gccgcgtggagatcatagccaacga

SEQ ID NO: 683442 - DNA, 25 bp, Mus musculus
gccgcgtttatgcagtacttcacct

SEQ ID NO: 683443 - DNA, 25 bp, Mus musculus
gccgcgtttatggagtacttcacct

SEQ ID NO: 683444 - DNA, 25 bp, Mus musculus
gccgcgtttcttacctgtgcgaggc

SEQ ID NO: 683445 - DNA, 25 bp, Mus musculus
gccgcgtttctttcctgtgcgaggc

SEQ ID NO: 683446 - DNA, 25 bp, Mus musculus
gccgctaaggtacccaagtggctgc

SEQ ID NO: 683447 - DNA, 25 bp, Mus musculus
gccgctaaggtagccaagtggctgc

SEQ ID NO: 683448 - DNA, 25 bp, Mus musculus
gccgctaatcttcgccgctggaatc

SEQ ID NO: 683449 - DNA, 25 bp, Mus musculus
gccgctaatcttggccgctggaatc

SEQ ID NO: 683450 - DNA, 25 bp, Mus musculus
gccgctacccagcttccagttgagt

SEQ ID NO: 683451 - DNA, 25 bp, Mus musculus
gccgctacccaggttccagttgagt

SEQ ID NO: 683452 - DNA, 25 bp, Mus musculus
gccgctaccgcaagatcaagcacga

SEQ ID NO: 683453 - DNA, 25 bp, Mus musculus
gccgctaccgcatgatcaagcacga

SEQ ID NO: 683454 - DNA, 25 bp, Mus musculus
gccgctacgcagctgtattccatgt

SEQ ID NO: 683455 - DNA, 25 bp, Mus musculus
gccgctacgcaggtgtattccatgt

SEQ ID NO: 683456 - DNA, 25 bp, Mus musculus
gccgctacgtgtccatgctatgtca

SEQ ID NO: 683457 - DNA, 25 bp, Mus musculus
gccgctacgtgtgcatgctatgtca

SEQ ID NO: 683458 - DNA, 25 bp, Mus musculus
gccgctagtggccttacgtaagctc

SEQ ID NO: 683459 - DNA, 25 bp, Mus musculus
gccgctagtggcgttacgtaagctc

SEQ ID NO: 683460 - DNA, 25 bp, Mus musculus
gccgctatccgtatgagtacctggg

SEQ ID NO: 683461 - DNA, 25 bp, Mus musculus
gccgctatccgtttgagtacctggg

SEQ ID NO: 683462 - DNA, 25 bp, Mus musculus
gccgctcaccgtctccaagaagata

SEQ ID NO: 683463 - DNA, 25 bp, Mus musculus
gccgctcaccgtgtccaagaagata

SEQ ID NO: 683464 - DNA, 25 bp, Mus musculus
gccgctcacgagaataccagctcaa

SEQ ID NO: 683465 - DNA, 25 bp, Mus musculus
gccgctcacgagtataccagctcaa

SEQ ID NO: 683466 - DNA, 25 bp, Mus musculus
gccgctcagagcatgagcgccagta

SEQ ID NO: 683467 - DNA, 25 bp, Mus musculus
gccgctcagagcttgagcgccagta

SEQ ID NO: 683468 - DNA, 25 bp, Mus musculus
gccgctcaggatcggaaaattgcac

SEQ ID NO: 683469 - DNA, 25 bp, Mus musculus
gccgctcaggatgggaaaattgcac

SEQ ID NO: 683470 - DNA, 25 bp, Mus musculus
gccgctcatcttcagtgagtgccag

SEQ ID NO: 683471 - DNA, 25 bp, Mus musculus
gccgctcatcttgagtgagtgccag

SEQ ID NO: 683472 - DNA, 25 bp, Mus musculus
gccgctccttcgaggttgaccatca

SEQ ID NO: 683473 - DNA, 25 bp, Mus musculus
gccgctccttcgtggttgaccatca

SEQ ID NO: 683474 - DNA, 25 bp, Mus musculus
gccgctcgacctagaggaccatgtt

SEQ ID NO: 683475 - DNA, 25 bp, Mus musculus
gccgctcgaccttgaggaccatgtt

SEQ ID NO: 683476 - DNA, 25 bp, Mus musculus
gccgctcgctgccatactattatga

SEQ ID NO: 683477 - DNA, 25 bp, Mus musculus
gccgctcgctgcgatactattatga

SEQ ID NO: 683478 - DNA, 25 bp, Mus musculus
gccgctcgtaggatcaaaacagagt

SEQ ID NO: 683479 - DNA, 25 bp, Mus musculus
gccgctcgtaggttcaaaacagagt

SEQ ID NO: 683480 - DNA, 25 bp, Mus musculus
gccgctcgttgcagtagccgctgcg

SEQ ID NO: 683481 - DNA, 25 bp, Mus musculus
gccgctcgttgctgtagccgctgcg

SEQ ID NO: 683482 - DNA, 25 bp, Mus musculus
gccgctctatctcgctagcaaggaa

SEQ ID NO: 683483 - DNA, 25 bp, Mus musculus
gccgctctatctggctagcaaggaa

SEQ ID NO: 683484 - DNA, 25 bp, Mus musculus
gccgctctgtccagaatgtgagact

SEQ ID NO: 683485 - DNA, 25 bp, Mus musculus
gccgctctgtcctgaatgtgagact

SEQ ID NO: 683486 - DNA, 25 bp, Mus musculus
gccgctctgtgtccaacattatctg

SEQ ID NO: 683487 - DNA, 25 bp, Mus musculus
gccgctctgtgtgcaacattatctg

SEQ ID NO: 683488 - DNA, 25 bp, Mus musculus
gccgctgatcttaatgtgtctcttg

SEQ ID NO: 683489 - DNA, 25 bp, Mus musculus
gccgctgatctttatgtgtctcttg

SEQ ID NO: 683490 - DNA, 25 bp, Mus musculus
gccgctgccagcaggaatttcctgg

SEQ ID NO: 683491 - DNA, 25 bp, Mus musculus
gccgctgccagctggaatttcctgg

SEQ ID NO: 683492 - DNA, 25 bp, Mus musculus
gccgctgcccaccttttggtctatt

SEQ ID NO: 683493 - DNA, 25 bp, Mus musculus
gccgctgcccacgttttggtctatt

SEQ ID NO: 683494 - DNA, 25 bp, Mus musculus
gccgctgctcagagtgtcatttgtc

SEQ ID NO: 683495 - DNA, 25 bp, Mus musculus
gccgctgctcagtgtgtcatttgtc

SEQ ID NO: 683496 - DNA, 25 bp, Mus musculus
gccgctgctggcactgtgtctctgt

SEQ ID NO: 683497 - DNA, 25 bp, Mus musculus
gccgctgctggctctgtgtctctgt

SEQ ID NO: 683498 - DNA, 25 bp, Mus musculus
gccgctggcctcaagctgaaatgat

SEQ ID NO: 683499 - DNA, 25 bp, Mus musculus
gccgctggcctctagctgaaatgat

SEQ ID NO: 683500 - DNA, 25 bp, Mus musculus
gccgctggtaccagcagatcatccg

SEQ ID NO: 683501 - DNA, 25 bp, Mus musculus
gccgctggtacctgcagatcatccg

SEQ ID NO: 683502 - DNA, 25 bp, Mus musculus
gccgctggtgcaaagaattctggga

SEQ ID NO: 683503 - DNA, 25 bp, Mus musculus
gccgctggtgcatagaattctggga

SEQ ID NO: 683504 - DNA, 25 bp, Mus musculus
gccgctgtagaacctatgacagaat

SEQ ID NO: 683505 - DNA, 25 bp, Mus musculus
gccgctgtagaagctatgacagaat

SEQ ID NO: 683506 - DNA, 25 bp, Mus musculus
gccgctgtcattcgatgactctgat

SEQ ID NO: 683507 - DNA, 25 bp, Mus musculus
gccgctgtcattggatgactctgat

SEQ ID NO: 683508 - DNA, 25 bp, Mus musculus
gccgctgtgacccaggatatgaact

SEQ ID NO: 683509 - DNA, 25 bp, Mus musculus
gccgctgtgaccgaggatatgaact

SEQ ID NO: 683510 - DNA, 25 bp, Mus musculus
gccgctgtgatgacggtggtttcac

SEQ ID NO: 683511 - DNA, 25 bp, Mus musculus
gccgctgtgatgtcggtggtttcac

SEQ ID NO: 683512 - DNA, 25 bp, Mus musculus
gccgctgttatcattcgtccggtag

SEQ ID NO: 683513 - DNA, 25 bp, Mus musculus
gccgctgttatctttcgtccggtag

SEQ ID NO: 683514 - DNA, 25 bp, Mus musculus
gccgctgttgctcggtatcagcaga

SEQ ID NO: 683515 - DNA, 25 bp, Mus musculus
gccgctgttgctgggtatcagcaga

SEQ ID NO: 683516 - DNA, 25 bp, Mus musculus
gccgcttatgaaacagatcagcagt

SEQ ID NO: 683517 - DNA, 25 bp, Mus musculus
gccgcttatgaatcagatcagcagt

SEQ ID NO: 683518 - DNA, 25 bp, Mus musculus
gccgcttcaagccttcagctcagtt

SEQ ID NO: 683519 - DNA, 25 bp, Mus musculus
gccgcttcaagcgttcagctcagtt

SEQ ID NO: 683520 - DNA, 25 bp, Mus musculus
gccgcttccatgacagcttgtagag

SEQ ID NO: 683521 - DNA, 25 bp, Mus musculus
gccgcttccatgtcagcttgtagag

SEQ ID NO: 683522 - DNA, 25 bp, Mus musculus
gccgcttccgggatcattcaggaga

SEQ ID NO: 683523 - DNA, 25 bp, Mus musculus
gccgcttccgggttcattcaggaga

SEQ ID NO: 683524 - DNA, 25 bp, Mus musculus
gccgcttccttccaagtcctgtgta

SEQ ID NO: 683525 - DNA, 25 bp, Mus musculus
gccgcttccttcgaagtcctgtgta

SEQ ID NO: 683526 - DNA, 25 bp, Mus musculus
gccgcttcgccaaggaagtgctgcc

SEQ ID NO: 683527 - DNA, 25 bp, Mus musculus
gccgcttcgccatggaagtgctgcc

SEQ ID NO: 683528 - DNA, 25 bp, Mus musculus
gccgctttgacgacggcggaaactg

SEQ ID NO: 683529 - DNA, 25 bp, Mus musculus
gccgctttgacgtcggcggaaactg

SEQ ID NO: 683530 - DNA, 25 bp, Mus musculus
gccgctttgttgaagaatgatgaga

SEQ ID NO: 683531 - DNA, 25 bp, Mus musculus
gccgctttgttgtagaatgatgaga

SEQ ID NO: 683532 - DNA, 25 bp, Mus musculus
gccgcttttattcagacccatcatg

SEQ ID NO: 683533 - DNA, 25 bp, Mus musculus
gccgcttttattgagacccatcatg

SEQ ID NO: 683534 - DNA, 25 bp, Mus musculus
gccggaaagataccttcttgtgcta

SEQ ID NO: 683535 - DNA, 25 bp, Mus musculus
gccggaaagatagcttcttgtgcta

SEQ ID NO: 683536 - DNA, 25 bp, Mus musculus
gccggaaccgctagcttgtgagtct

SEQ ID NO: 683537 - DNA, 25 bp, Mus musculus
gccggaaccgcttgcttgtgagtct

SEQ ID NO: 683538 - DNA, 25 bp, Mus musculus
gccggaagaagacgaaaaccatcca

SEQ ID NO: 683539 - DNA, 25 bp, Mus musculus
gccggaagaagaggaaaaccatcca

SEQ ID NO: 683540 - DNA, 25 bp, Mus musculus
gccggaagaggcattagatgccctg

SEQ ID NO: 683541 - DNA, 25 bp, Mus musculus
gccggaagaggctttagatgccctg

SEQ ID NO: 683542 - DNA, 25 bp, Mus musculus
gccggaagatccacgggcgtcgcct

SEQ ID NO: 683543 - DNA, 25 bp, Mus musculus
gccggaagatccctgtcctggtgca

SEQ ID NO: 683544 - DNA, 25 bp, Mus musculus
gccggaagatccgtgtcctggtgca

SEQ ID NO: 683545 - DNA, 25 bp, Mus musculus
gccggaagatcctcgggcgtcgcct

SEQ ID NO: 683546 - DNA, 25 bp, Mus musculus
gccggaagatctctaagcaaaggaa

SEQ ID NO: 683547 - DNA, 25 bp, Mus musculus
gccggaagatctgtaagcaaaggaa

SEQ ID NO: 683548 - DNA, 25 bp, Mus musculus
gccggaagcccaactatagcgagct

SEQ ID NO: 683549 - DNA, 25 bp, Mus musculus
gccggaagcccatctatagcgagct

SEQ ID NO: 683550 - DNA, 25 bp, Mus musculus
gccggaagctggataaaatctcttt

SEQ ID NO: 683551 - DNA, 25 bp, Mus musculus
gccggaagctggttaaaatctcttt

SEQ ID NO: 683552 - DNA, 25 bp, Mus musculus
gccggaagttccaatccgtgggtct

SEQ ID NO: 683553 - DNA, 25 bp, Mus musculus
gccggaagttcctatccgtgggtct

SEQ ID NO: 683554 - DNA, 25 bp, Mus musculus
gccggacacagactatatagtgcgt

SEQ ID NO: 683555 - DNA, 25 bp, Mus musculus
gccggacacagagtatatagtgcgt

SEQ ID NO: 683556 - DNA, 25 bp, Mus musculus
gccggacaggccactagaaaattca

SEQ ID NO: 683557 - DNA, 25 bp, Mus musculus
gccggacaggcctctagaaaattca

SEQ ID NO: 683558 - DNA, 25 bp, Mus musculus
gccggaccccgacatcgggaattgt

SEQ ID NO: 683559 - DNA, 25 bp, Mus musculus
gccggaccccgagatcgggaattgt

SEQ ID NO: 683560 - DNA, 25 bp, Mus musculus
gccggaccctcaaagtgggcaactt

SEQ ID NO: 683561 - DNA, 25 bp, Mus musculus
gccggaccctcatagtgggcaactt

SEQ ID NO: 683562 - DNA, 25 bp, Mus musculus
gccggactttgcatctcgccaggaa

SEQ ID NO: 683563 - DNA, 25 bp, Mus musculus
gccggactttgcttctcgccaggaa

SEQ ID NO: 683564 - DNA, 25 bp, Mus musculus
gccggagactctctttgaaattgta

SEQ ID NO: 683565 - DNA, 25 bp, Mus musculus
gccggagactctgtttgaaattgta

SEQ ID NO: 683566 - DNA, 25 bp, Mus musculus
gccggagatgccagacgcttggttc

SEQ ID NO: 683567 - DNA, 25 bp, Mus musculus
gccggagatgcctgacgcttggttc

SEQ ID NO: 683568 - DNA, 25 bp, Mus musculus
gccggagcatcacaatttgagagca

SEQ ID NO: 683569 - DNA, 25 bp, Mus musculus
gccggagcatcagaatttgagagca

SEQ ID NO: 683570 - DNA, 25 bp, Mus musculus
gccggagccagtacgcgtcgactga

SEQ ID NO: 683571 - DNA, 25 bp, Mus musculus
gccggagccagttcgcgtcgactga

SEQ ID NO: 683572 - DNA, 25 bp, Mus musculus
gccggagcctacattctgtcgcgat

SEQ ID NO: 683573 - DNA, 25 bp, Mus musculus
gccggagcctactttctgtcgcgat

SEQ ID NO: 683574 - DNA, 25 bp, Mus musculus
gccggagctcttctcgccttcaatg

SEQ ID NO: 683575 - DNA, 25 bp, Mus musculus
gccggagctcttgtcgccttcaatg

SEQ ID NO: 683576 - DNA, 25 bp, Mus musculus
gccggagctggacctcaccagcaag

SEQ ID NO: 683577 - DNA, 25 bp, Mus musculus
gccggagctggagctcaccagcaag

SEQ ID NO: 683578 - DNA, 25 bp, Mus musculus
gccggaggccgactgtttgtcctac

SEQ ID NO: 683579 - DNA, 25 bp, Mus musculus
gccggaggccgagtgtttgtcctac

SEQ ID NO: 683580 - DNA, 25 bp, Mus musculus
gccggagtatatccacatctgcgat

SEQ ID NO: 683581 - DNA, 25 bp, Mus musculus
gccggagtatatgcacatctgcgat

SEQ ID NO: 683582 - DNA, 25 bp, Mus musculus
gccggagtcaccaacccgaagttct

SEQ ID NO: 683583 - DNA, 25 bp, Mus musculus
gccggagtcacctacccgaagttct

SEQ ID NO: 683584 - DNA, 25 bp, Mus musculus
gccggatcacatctaactttgtcat

SEQ ID NO: 683585 - DNA, 25 bp, Mus musculus
gccggatcacatgtaactttgtcat

SEQ ID NO: 683586 - DNA, 25 bp, Mus musculus
gccggatcatagatcatttcatgtg

SEQ ID NO: 683587 - DNA, 25 bp, Mus musculus
gccggatcatagttcatttcatgtg

SEQ ID NO: 683588 - DNA, 25 bp, Mus musculus
gccggatcctctacagtacctggaa

SEQ ID NO: 683589 - DNA, 25 bp, Mus musculus
gccggatcctcttcagtacctggaa

SEQ ID NO: 683590 - DNA, 25 bp, Mus musculus
gccggatctacaacagcttcagaga

SEQ ID NO: 683591 - DNA, 25 bp, Mus musculus
gccggatctacatcagcttcagaga

SEQ ID NO: 683592 - DNA, 25 bp, Mus musculus
gccggattgcctcggtgagtaatct

SEQ ID NO: 683593 - DNA, 25 bp, Mus musculus
gccggattgcctgggtgagtaatct

SEQ ID NO: 683594 - DNA, 25 bp, Mus musculus
gccggcaaccagaacttccgcaatg

SEQ ID NO: 683595 - DNA, 25 bp, Mus musculus
gccggcaaccagtacttccgcaatg

SEQ ID NO: 683596 - DNA, 25 bp, Mus musculus
gccggcaacttcatggatccctctg

SEQ ID NO: 683597 - DNA, 25 bp, Mus musculus
gccggcaacttcttggatccctctg

SEQ ID NO: 683598 - DNA, 25 bp, Mus musculus
gccggcaagacaagggctccactgt

SEQ ID NO: 683599 - DNA, 25 bp, Mus musculus
gccggcaagacatgggctccactgt

SEQ ID NO: 683600 - DNA, 25 bp, Mus musculus
gccggcaagatgaccgccacgggaa

SEQ ID NO: 683601 - DNA, 25 bp, Mus musculus
gccggcaagatgtccgccacgggaa

SEQ ID NO: 683602 - DNA, 25 bp, Mus musculus
gccggcaagctgactgttgtcattc

SEQ ID NO: 683603 - DNA, 25 bp, Mus musculus
gccggcaagctgtctgttgtcattc

SEQ ID NO: 683604 - DNA, 25 bp, Mus musculus
gccggcagagtacagtcccgcacag

SEQ ID NO: 683605 - DNA, 25 bp, Mus musculus
gccggcagagtagagtcccgcacag

SEQ ID NO: 683606 - DNA, 25 bp, Mus musculus
gccggcatataccagtgtgaatcta

SEQ ID NO: 683607 - DNA, 25 bp, Mus musculus
gccggcatatacgagtgtgaatcta

SEQ ID NO: 683608 - DNA, 25 bp, Mus musculus
gccggcatcctcactggtggttgtg

SEQ ID NO: 683609 - DNA, 25 bp, Mus musculus
gccggcatcctctctggtggttgtg

SEQ ID NO: 683610 - DNA, 25 bp, Mus musculus
gccggcatggcgcattacaacttca

SEQ ID NO: 683611 - DNA, 25 bp, Mus musculus
gccggcatggcggattacaacttca

SEQ ID NO: 683612 - DNA, 25 bp, Mus musculus
gccggccacattacactatcttcaa

SEQ ID NO: 683613 - DNA, 25 bp, Mus musculus
gccggccacatttcactatcttcaa

SEQ ID NO: 683614 - DNA, 25 bp, Mus musculus
gccggccgagatatcagagccgcga

SEQ ID NO: 683615 - DNA, 25 bp, Mus musculus
gccggccgagatttcagagccgcga

SEQ ID NO: 683616 - DNA, 25 bp, Mus musculus
gccggcctcgtgctttccaggagct

SEQ ID NO: 683617 - DNA, 25 bp, Mus musculus
gccggcctcgtggtttccaggagct

SEQ ID NO: 683618 - DNA, 25 bp, Mus musculus
gccggccttctacagtgcacagctg

SEQ ID NO: 683619 - DNA, 25 bp, Mus musculus
gccggccttctagagtgcacagctg

SEQ ID NO: 683620 - DNA, 25 bp, Mus musculus
gccggcgcaacgagagactcttctc

SEQ ID NO: 683621 - DNA, 25 bp, Mus musculus
gccggcgcaacgtgagactcttctc

SEQ ID NO: 683622 - DNA, 25 bp, Mus musculus
gccggcggcatccagacgatcgcta

SEQ ID NO: 683623 - DNA, 25 bp, Mus musculus
gccggcggcatcgagacgatcgcta

SEQ ID NO: 683624 - DNA, 25 bp, Mus musculus
gccggcgtcatgagactgcccagag

SEQ ID NO: 683625 - DNA, 25 bp, Mus musculus
gccggcgtcatgtgactgcccagag

SEQ ID NO: 683626 - DNA, 25 bp, Mus musculus
gccggctaatctcttccaaggaatt

SEQ ID NO: 683627 - DNA, 25 bp, Mus musculus
gccggctaatctgttccaaggaatt

SEQ ID NO: 683628 - DNA, 25 bp, Mus musculus
gccggctatgatatcgccctggtgc

SEQ ID NO: 683629 - DNA, 25 bp, Mus musculus
gccggctatgatttcgccctggtgc

SEQ ID NO: 683630 - DNA, 25 bp, Mus musculus
gccggctcaacaatacctatcctat

SEQ ID NO: 683631 - DNA, 25 bp, Mus musculus
gccggctcaacattacctatcctat

SEQ ID NO: 683632 - DNA, 25 bp, Mus musculus
gccggctggaccagatagcccagca

SEQ ID NO: 683633 - DNA, 25 bp, Mus musculus
gccggctggacctgatagcccagca

SEQ ID NO: 683634 - DNA, 25 bp, Mus musculus
gccggcttcaagcagacgacttcct

SEQ ID NO: 683635 - DNA, 25 bp, Mus musculus
gccggcttcaaggagacgacttcct

SEQ ID NO: 683636 - DNA, 25 bp, Mus musculus
gccgggaacatcaggaactgtttgc

SEQ ID NO: 683637 - DNA, 25 bp, Mus musculus
gccgggaacatctggaactgtttgc

SEQ ID NO: 683638 - DNA, 25 bp, Mus musculus
gccgggaaccatccttggaaatcct

SEQ ID NO: 683639 - DNA, 25 bp, Mus musculus
gccgggaaccatgcttggaaatcct

SEQ ID NO: 683640 - DNA, 25 bp, Mus musculus
gccgggaatatgacgacttagagag

SEQ ID NO: 683641 - DNA, 25 bp, Mus musculus
gccgggaatatgtcgacttagagag

SEQ ID NO: 683642 - DNA, 25 bp, Mus musculus
gccgggaatgccaacgaactcttca

SEQ ID NO: 683643 - DNA, 25 bp, Mus musculus
gccgggaatgcctacgaactcttca

SEQ ID NO: 683644 - DNA, 25 bp, Mus musculus
gccgggacataacccgctcagaatc

SEQ ID NO: 683645 - DNA, 25 bp, Mus musculus
gccgggacataagccgctcagaatc

SEQ ID NO: 683646 - DNA, 25 bp, Mus musculus
gccgggagaatgagatcatgactca

SEQ ID NO: 683647 - DNA, 25 bp, Mus musculus
gccgggagaatgtgatcatgactca

SEQ ID NO: 683648 - DNA, 25 bp, Mus musculus
gccgggagacaccactgtcataagt

SEQ ID NO: 683649 - DNA, 25 bp, Mus musculus
gccgggagacacgactgtcataagt

SEQ ID NO: 683650 - DNA, 25 bp, Mus musculus
gccgggaggagaagatttcctactt

SEQ ID NO: 683651 - DNA, 25 bp, Mus musculus
gccgggaggagatgatttcctactt

SEQ ID NO: 683652 - DNA, 25 bp, Mus musculus
gccgggatgagaatgtaaaagccct

SEQ ID NO: 683653 - DNA, 25 bp, Mus musculus
gccgggatgagattgtaaaagccct

SEQ ID NO: 683654 - DNA, 25 bp, Mus musculus
gccgggatggtgcatatgatttcaa

SEQ ID NO: 683655 - DNA, 25 bp, Mus musculus
gccgggatggtggatatgatttcaa

SEQ ID NO: 683656 - DNA, 25 bp, Mus musculus
gccgggattgccctacctggacatg

SEQ ID NO: 683657 - DNA, 25 bp, Mus musculus
gccgggattgccgtacctggacatg

SEQ ID NO: 683658 - DNA, 25 bp, Mus musculus
gccgggcaagttccctttggtatca

SEQ ID NO: 683659 - DNA, 25 bp, Mus musculus
gccgggcaagttgcctttggtatca

SEQ ID NO: 683660 - DNA, 25 bp, Mus musculus
gccgggcacaaacgagccatgccaa

SEQ ID NO: 683661 - DNA, 25 bp, Mus musculus
gccgggcacaaaggagccatgccaa

SEQ ID NO: 683662 - DNA, 25 bp, Mus musculus
gccgggcacaggagaaacatcgctg

SEQ ID NO: 683663 - DNA, 25 bp, Mus musculus
gccgggcacaggtgaaacatcgctg

SEQ ID NO: 683664 - DNA, 25 bp, Mus musculus
gccgggcagggtcttggagggccta

SEQ ID NO: 683665 - DNA, 25 bp, Mus musculus
gccgggcagggtgttggagggccta

SEQ ID NO: 683666 - DNA, 25 bp, Mus musculus
gccgggcagttgaatctgtgagcca

SEQ ID NO: 683667 - DNA, 25 bp, Mus musculus
gccgggcagttgtatctgtgagcca

SEQ ID NO: 683668 - DNA, 25 bp, Mus musculus
gccgggccatgtagctagtgttgct

SEQ ID NO: 683669 - DNA, 25 bp, Mus musculus
gccgggccatgttgctagtgttgct

SEQ ID NO: 683670 - DNA, 25 bp, Mus musculus
gccgggccgctcaaaggtcttcaat

SEQ ID NO: 683671 - DNA, 25 bp, Mus musculus
gccgggccgctctaaggtcttcaat

SEQ ID NO: 683672 - DNA, 25 bp, Mus musculus
gccgggccttgcaaggctacagtga

SEQ ID NO: 683673 - DNA, 25 bp, Mus musculus
gccgggccttgctaggctacagtga

SEQ ID NO: 683674 - DNA, 25 bp, Mus musculus
gccgggcgctaccttcgtgagaact

SEQ ID NO: 683675 - DNA, 25 bp, Mus musculus
gccgggcgctacgttcgtgagaact

SEQ ID NO: 683676 - DNA, 25 bp, Mus musculus
gccgggctatcactgacgtgtctct

SEQ ID NO: 683677 - DNA, 25 bp, Mus musculus
gccgggctatcagtgacgtgtctct

SEQ ID NO: 683678 - DNA, 25 bp, Mus musculus
gccgggctcaccagcatcttgtgga

SEQ ID NO: 683679 - DNA, 25 bp, Mus musculus
gccgggctcacctgcatcttgtgga

SEQ ID NO: 683680 - DNA, 25 bp, Mus musculus
gccgggtactttcagagcatcactg

SEQ ID NO: 683681 - DNA, 25 bp, Mus musculus
gccgggtactttgagagcatcactg

SEQ ID NO: 683682 - DNA, 25 bp, Mus musculus
gccgggtatctacaccagagtttta

SEQ ID NO: 683683 - DNA, 25 bp, Mus musculus
gccgggtatctagaccagagtttta

SEQ ID NO: 683684 - DNA, 25 bp, Mus musculus
gccgggtcatctctacttggatcct

SEQ ID NO: 683685 - DNA, 25 bp, Mus musculus
gccgggtcatctgtacttggatcct

SEQ ID NO: 683686 - DNA, 25 bp, Mus musculus
gccgggtctatgagggctccatcta

SEQ ID NO: 683687 - DNA, 25 bp, Mus musculus
gccgggtctatgtgggctccatcta

SEQ ID NO: 683688 - DNA, 25 bp, Mus musculus
gccgggtggagtccatttacttgaa

SEQ ID NO: 683689 - DNA, 25 bp, Mus musculus
gccgggtggagtgcatttacttgaa

SEQ ID NO: 683690 - DNA, 25 bp, Mus musculus
gccgggtggtcaccagctttctcaa

SEQ ID NO: 683691 - DNA, 25 bp, Mus musculus
gccgggtggtcagcagctttctcaa

SEQ ID NO: 683692 - DNA, 25 bp, Mus musculus
gccgggtgttcaacattgagaccat

SEQ ID NO: 683693 - DNA, 25 bp, Mus musculus
gccgggtgttcatcattgagaccat

SEQ ID NO: 683694 - DNA, 25 bp, Mus musculus
gccgggttccgaattcagcatcggg

SEQ ID NO: 683695 - DNA, 25 bp, Mus musculus
gccgggttccgatttcagcatcggg

SEQ ID NO: 683696 - DNA, 25 bp, Mus musculus
gccgggttcttgattgctgttccta

SEQ ID NO: 683697 - DNA, 25 bp, Mus musculus
gccgggttcttgtttgctgttccta

SEQ ID NO: 683698 - DNA, 25 bp, Mus musculus
gccggtaacggtcgtgcgggcgagg

SEQ ID NO: 683699 - DNA, 25 bp, Mus musculus
gccggtaacggtggtgcgggcgagg

SEQ ID NO: 683700 - DNA, 25 bp, Mus musculus
gccggtacattcattctgaagacta

SEQ ID NO: 683701 - DNA, 25 bp, Mus musculus
gccggtacattctttctgaagacta

SEQ ID NO: 683702 - DNA, 25 bp, Mus musculus
gccggtcactgaaccccaatagggt

SEQ ID NO: 683703 - DNA, 25 bp, Mus musculus
gccggtcactgatccccaatagggt

SEQ ID NO: 683704 - DNA, 25 bp, Mus musculus
gccggtccacaacctgctcatgggt

SEQ ID NO: 683705 - DNA, 25 bp, Mus musculus
gccggtccacaagctgctcatgggt

SEQ ID NO: 683706 - DNA, 25 bp, Mus musculus
gccggtctcggcatcaggagaagaa

SEQ ID NO: 683707 - DNA, 25 bp, Mus musculus
gccggtctcggcttcaggagaagaa

SEQ ID NO: 683708 - DNA, 25 bp, Mus musculus
gccggtcttgggaaagctgccttct

SEQ ID NO: 683709 - DNA, 25 bp, Mus musculus
gccggtcttgggtaagctgccttct

SEQ ID NO: 683710 - DNA, 25 bp, Mus musculus
gccggtgcacgcctacaaattcttc

SEQ ID NO: 683711 - DNA, 25 bp, Mus musculus
gccggtgcacgcgtacaaattcttc

SEQ ID NO: 683712 - DNA, 25 bp, Mus musculus
gccggtgccgcgctacttaacttcg

SEQ ID NO: 683713 - DNA, 25 bp, Mus musculus
gccggtgccgcggtacttaacttcg

SEQ ID NO: 683714 - DNA, 25 bp, Mus musculus
gccggtgcggaaacgctccttcaac

SEQ ID NO: 683715 - DNA, 25 bp, Mus musculus
gccggtgcggaatcgctccttcaac

SEQ ID NO: 683716 - DNA, 25 bp, Mus musculus
gccggtgctatgatataatacctga

SEQ ID NO: 683717 - DNA, 25 bp, Mus musculus
gccggtgctatgttataatacctga

SEQ ID NO: 683718 - DNA, 25 bp, Mus musculus
gccggtggatgtccggcaacaacat

SEQ ID NO: 683719 - DNA, 25 bp, Mus musculus
gccggtggatgtgcggcaacaacat

SEQ ID NO: 683720 - DNA, 25 bp, Mus musculus
gccggtgtcaggaccctttctcttc

SEQ ID NO: 683721 - DNA, 25 bp, Mus musculus
gccggtgtcaggtccctttctcttc

SEQ ID NO: 683722 - DNA, 25 bp, Mus musculus
gccggtgtttgtcaccgagatcaca

SEQ ID NO: 683723 - DNA, 25 bp, Mus musculus
gccggtgtttgtgaccgagatcaca

SEQ ID NO: 683724 - DNA, 25 bp, Mus musculus
gccggttcctggatgacaatcagat

SEQ ID NO: 683725 - DNA, 25 bp, Mus musculus
gccggttcctggttgacaatcagat

SEQ ID NO: 683726 - DNA, 25 bp, Mus musculus
gccggttcctgtcgagaaacaaact

SEQ ID NO: 683727 - DNA, 25 bp, Mus musculus
gccggttcctgtggagaaacaaact

SEQ ID NO: 683728 - DNA, 25 bp, Mus musculus
gccggtttctggagatgagaactta

SEQ ID NO: 683729 - DNA, 25 bp, Mus musculus
gccggtttctggtgatgagaactta

SEQ ID NO: 683730 - DNA, 25 bp, Mus musculus
gccggttttatcataggatttataa

SEQ ID NO: 683731 - DNA, 25 bp, Mus musculus
gccggttttatcttaggatttataa

SEQ ID NO: 683732 - DNA, 25 bp, Mus musculus
gccgtacaatccaattttgggtgag

SEQ ID NO: 683733 - DNA, 25 bp, Mus musculus
gccgtacaatcctattttgggtgag

SEQ ID NO: 683734 - DNA, 25 bp, Mus musculus
gccgtacacattatctgctcatgaa

SEQ ID NO: 683735 - DNA, 25 bp, Mus musculus
gccgtacacattttctgctcatgaa

SEQ ID NO: 683736 - DNA, 25 bp, Mus musculus
gccgtacagccgaatagccgaggac

SEQ ID NO: 683737 - DNA, 25 bp, Mus musculus
gccgtacagccgtatagccgaggac

SEQ ID NO: 683738 - DNA, 25 bp, Mus musculus
gccgtacggaggattgctgaacgtc

SEQ ID NO: 683739 - DNA, 25 bp, Mus musculus
gccgtacggaggtttgctgaacgtc

SEQ ID NO: 683740 - DNA, 25 bp, Mus musculus
gccgtactgtctcggccaaacctgt

SEQ ID NO: 683741 - DNA, 25 bp, Mus musculus
gccgtactgtctgggccaaacctgt

SEQ ID NO: 683742 - DNA, 25 bp, Mus musculus
gccgtaggtggactgtttgtcattc

SEQ ID NO: 683743 - DNA, 25 bp, Mus musculus
gccgtaggtggagtgtttgtcattc

SEQ ID NO: 683744 - DNA, 25 bp, Mus musculus
gccgtagtagttaacgatatcacaa

SEQ ID NO: 683745 - DNA, 25 bp, Mus musculus
gccgtagtagtttacgatatcacaa

SEQ ID NO: 683746 - DNA, 25 bp, Mus musculus
gccgtatccagccttatgaaacaaa

SEQ ID NO: 683747 - DNA, 25 bp, Mus musculus
gccgtatccagcgttatgaaacaaa

SEQ ID NO: 683748 - DNA, 25 bp, Mus musculus
gccgtatgagccctttgaaacacag

SEQ ID NO: 683749 - DNA, 25 bp, Mus musculus
gccgtatgagccgtttgaaacacag

SEQ ID NO: 683750 - DNA, 25 bp, Mus musculus
gccgtattcctcaaggctacaacta

SEQ ID NO: 683751 - DNA, 25 bp, Mus musculus
gccgtattcctctaggctacaacta

SEQ ID NO: 683752 - DNA, 25 bp, Mus musculus
gccgtattctcacctacatgggtga

SEQ ID NO: 683753 - DNA, 25 bp, Mus musculus
gccgtattctcagctacatgggtga

SEQ ID NO: 683754 - DNA, 25 bp, Mus musculus
gccgtcagcaagagccaggcgtgat

SEQ ID NO: 683755 - DNA, 25 bp, Mus musculus
gccgtcagcaagtgccaggcgtgat

SEQ ID NO: 683756 - DNA, 25 bp, Mus musculus
gccgtcatcaccaggatcatcaagg

SEQ ID NO: 683757 - DNA, 25 bp, Mus musculus
gccgtcatcacctggatcatcaagg

SEQ ID NO: 683758 - DNA, 25 bp, Mus musculus
gccgtcatccgtcaattacctacat

SEQ ID NO: 683759 - DNA, 25 bp, Mus musculus
gccgtcatccgtgaattacctacat

SEQ ID NO: 683760 - DNA, 25 bp, Mus musculus
gccgtcatctgcagtgctctggcca

SEQ ID NO: 683761 - DNA, 25 bp, Mus musculus
gccgtcatctgctgtgctctggcca

SEQ ID NO: 683762 - DNA, 25 bp, Mus musculus
gccgtcatgccgatcccatttggca

SEQ ID NO: 683763 - DNA, 25 bp, Mus musculus
gccgtcatgccgttcccatttggca

SEQ ID NO: 683764 - DNA, 25 bp, Mus musculus
gccgtcattacgcacagcaaataga

SEQ ID NO: 683765 - DNA, 25 bp, Mus musculus
gccgtcattacggacagcaaataga

SEQ ID NO: 683766 - DNA, 25 bp, Mus musculus
gccgtccattgcatctttcaataaa

SEQ ID NO: 683767 - DNA, 25 bp, Mus musculus
gccgtccattgcttctttcaataaa

SEQ ID NO: 683768 - DNA, 25 bp, Mus musculus
gccgtcccagttcgaaacgagaaag

SEQ ID NO: 683769 - DNA, 25 bp, Mus musculus
gccgtcccagttggaaacgagaaag

SEQ ID NO: 683770 - DNA, 25 bp, Mus musculus
gccgtccgaaacatccataagctga

SEQ ID NO: 683771 - DNA, 25 bp, Mus musculus
gccgtccgaaacttccataagctga

SEQ ID NO: 683772 - DNA, 25 bp, Mus musculus
gccgtccgtgttagtccaggtgtac

SEQ ID NO: 683773 - DNA, 25 bp, Mus musculus
gccgtccgtgtttgtccaggtgtac

SEQ ID NO: 683774 - DNA, 25 bp, Mus musculus
gccgtcctcgctcaacaagaacaat

SEQ ID NO: 683775 - DNA, 25 bp, Mus musculus
gccgtcctcgctgaacaagaacaat

SEQ ID NO: 683776 - DNA, 25 bp, Mus musculus
gccgtcctggacaaaggcagagtgc

SEQ ID NO: 683777 - DNA, 25 bp, Mus musculus
gccgtcctggactaaggcagagtgc

SEQ ID NO: 683778 - DNA, 25 bp, Mus musculus
gccgtcggaaggagctgatcttgaa

SEQ ID NO: 683779 - DNA, 25 bp, Mus musculus
gccgtcggaaggtgctgatcttgaa

SEQ ID NO: 683780 - DNA, 25 bp, Mus musculus
gccgtcgtctgtacagaggcccgca

SEQ ID NO: 683781 - DNA, 25 bp, Mus musculus
gccgtcgtctgttcagaggcccgca

SEQ ID NO: 683782 - DNA, 25 bp, Mus musculus
gccgtctaacggaacagaaagcgag

SEQ ID NO: 683783 - DNA, 25 bp, Mus musculus
gccgtctaacggtacagaaagcgag

SEQ ID NO: 683784 - DNA, 25 bp, Mus musculus
gccgtctactttaaacctctttgtg

SEQ ID NO: 683785 - DNA, 25 bp, Mus musculus
gccgtctacttttaacctctttgtg

SEQ ID NO: 683786 - DNA, 25 bp, Mus musculus
gccgtctagtgcatgacttcactga

SEQ ID NO: 683787 - DNA, 25 bp, Mus musculus
gccgtctagtgcttgacttcactga

SEQ ID NO: 683788 - DNA, 25 bp, Mus musculus
gccgtctctattcggttgattccaa

SEQ ID NO: 683789 - DNA, 25 bp, Mus musculus
gccgtctctattgggttgattccaa

SEQ ID NO: 683790 - DNA, 25 bp, Mus musculus
gccgtcttagggacagagcatgctc

SEQ ID NO: 683791 - DNA, 25 bp, Mus musculus
gccgtcttagggtcagagcatgctc

SEQ ID NO: 683792 - DNA, 25 bp, Mus musculus
gccgtcttcacaaaggacctggata

SEQ ID NO: 683793 - DNA, 25 bp, Mus musculus
gccgtcttcacataggacctggata

SEQ ID NO: 683794 - DNA, 25 bp, Mus musculus
gccgtgaagccgaccggtttgactt

SEQ ID NO: 683795 - DNA, 25 bp, Mus musculus
gccgtgaagccgtccggtttgactt

SEQ ID NO: 683796 - DNA, 25 bp, Mus musculus
gccgtgaatgctaaatctgatcttc

SEQ ID NO: 683797 - DNA, 25 bp, Mus musculus
gccgtgaatgcttaatctgatcttc

SEQ ID NO: 683798 - DNA, 25 bp, Mus musculus
gccgtgacagtgctaaagccagccg

SEQ ID NO: 683799 - DNA, 25 bp, Mus musculus
gccgtgacagtggtaaagccagccg

SEQ ID NO: 683800 - DNA, 25 bp, Mus musculus
gccgtgactcccagactggcagcag

SEQ ID NO: 683801 - DNA, 25 bp, Mus musculus
gccgtgactccctgactggcagcag

SEQ ID NO: 683802 - DNA, 25 bp, Mus musculus
gccgtgagcactattgtcaaccgca

SEQ ID NO: 683803 - DNA, 25 bp, Mus musculus
gccgtgagcacttttgtcaaccgca

SEQ ID NO: 683804 - DNA, 25 bp, Mus musculus
gccgtgatcctcagctgttgctgca

SEQ ID NO: 683805 - DNA, 25 bp, Mus musculus
gccgtgatcctctgctgttgctgca

SEQ ID NO: 683806 - DNA, 25 bp, Mus musculus
gccgtgatgactatcccctccgtaa

SEQ ID NO: 683807 - DNA, 25 bp, Mus musculus
gccgtgatgactttcccctccgtaa

SEQ ID NO: 683808 - DNA, 25 bp, Mus musculus
gccgtgatggcacagatggcactcc

SEQ ID NO: 683809 - DNA, 25 bp, Mus musculus
gccgtgatggcagagatggcactcc

SEQ ID NO: 683810 - DNA, 25 bp, Mus musculus
gccgtgatgggaaggtatatgatca

SEQ ID NO: 683811 - DNA, 25 bp, Mus musculus
gccgtgatgggatggtatatgatca

SEQ ID NO: 683812 - DNA, 25 bp, Mus musculus
gccgtgattattcccctggtcaaca

SEQ ID NO: 683813 - DNA, 25 bp, Mus musculus
gccgtgattattgccctggtcaaca

SEQ ID NO: 683814 - DNA, 25 bp, Mus musculus
gccgtgcgctctcctgttcgagtcg

SEQ ID NO: 683815 - DNA, 25 bp, Mus musculus
gccgtgcgctctgctgttcgagtcg

SEQ ID NO: 683816 - DNA, 25 bp, Mus musculus
gccgtgctccccaggatcaggcgtt

SEQ ID NO: 683817 - DNA, 25 bp, Mus musculus
gccgtgctcccctggatcaggcgtt

SEQ ID NO: 683818 - DNA, 25 bp, Mus musculus
gccgtgctgttgctcacattgctga

SEQ ID NO: 683819 - DNA, 25 bp, Mus musculus
gccgtgctgttggtcacattgctga

SEQ ID NO: 683820 - DNA, 25 bp, Mus musculus
gccgtggaacttacaaggcgacaca

SEQ ID NO: 683821 - DNA, 25 bp, Mus musculus
gccgtggaactttcaaggcgacaca

SEQ ID NO: 683822 - DNA, 25 bp, Mus musculus
gccgtggacaacatactgcattcaa

SEQ ID NO: 683823 - DNA, 25 bp, Mus musculus
gccgtggacaacttactgcattcaa

SEQ ID NO: 683824 - DNA, 25 bp, Mus musculus
gccgtggagaagagccccgtgttct

SEQ ID NO: 683825 - DNA, 25 bp, Mus musculus
gccgtggagaagtgccccgtgttct

SEQ ID NO: 683826 - DNA, 25 bp, Mus musculus
gccgtggagcgccactcaggttcac

SEQ ID NO: 683827 - DNA, 25 bp, Mus musculus
gccgtggagcgcgactcaggttcac

SEQ ID NO: 683828 - DNA, 25 bp, Mus musculus
gccgtggagtctcgagcccacgatt

SEQ ID NO: 683829 - DNA, 25 bp, Mus musculus
gccgtggagtctggagcccacgatt

SEQ ID NO: 683830 - DNA, 25 bp, Mus musculus
gccgtggcacatacctttgatgtta

SEQ ID NO: 683831 - DNA, 25 bp, Mus musculus
gccgtggcacattcctttgatgtta

SEQ ID NO: 683832 - DNA, 25 bp, Mus musculus
gccgtggcagtgaacagctatagct

SEQ ID NO: 683833 - DNA, 25 bp, Mus musculus
gccgtggcagtgtacagctatagct

SEQ ID NO: 683834 - DNA, 25 bp, Mus musculus
gccgtggcatttcggaattgctact

SEQ ID NO: 683835 - DNA, 25 bp, Mus musculus
gccgtggcatttgggaattgctact

SEQ ID NO: 683836 - DNA, 25 bp, Mus musculus
gccgtggccatgatcttcctcatca

SEQ ID NO: 683837 - DNA, 25 bp, Mus musculus
gccgtggccatgttcttcctcatca

SEQ ID NO: 683838 - DNA, 25 bp, Mus musculus
gccgtggcccgaagcctctgaaatt

SEQ ID NO: 683839 - DNA, 25 bp, Mus musculus
gccgtggcccgatgcctctgaaatt

SEQ ID NO: 683840 - DNA, 25 bp, Mus musculus
gccgtggctattaccgctctggccg

SEQ ID NO: 683841 - DNA, 25 bp, Mus musculus
gccgtggctatttccgctctggccg

SEQ ID NO: 683842 - DNA, 25 bp, Mus musculus
gccgtggctcctacccattcattga

SEQ ID NO: 683843 - DNA, 25 bp, Mus musculus
gccgtggctccttcccattcattga

SEQ ID NO: 683844 - DNA, 25 bp, Mus musculus
gccgtggtccagattgatactgctc

SEQ ID NO: 683845 - DNA, 25 bp, Mus musculus
gccgtggtccagtttgatactgctc

SEQ ID NO: 683846 - DNA, 25 bp, Mus musculus
gccgtggtgaagcaccgcttcccga

SEQ ID NO: 683847 - DNA, 25 bp, Mus musculus
gccgtggtgaaggaccgcttcccga

SEQ ID NO: 683848 - DNA, 25 bp, Mus musculus
gccgtggtgagaagaatgacatagt

SEQ ID NO: 683849 - DNA, 25 bp, Mus musculus
gccgtggtgagatgaatgacatagt

SEQ ID NO: 683850 - DNA, 25 bp, Mus musculus
gccgtgtccaccaggaaatcgacga

SEQ ID NO: 683851 - DNA, 25 bp, Mus musculus
gccgtgtccacctggaaatcgacga

SEQ ID NO: 683852 - DNA, 25 bp, Mus musculus
gccgtgtgatatcagagtttgtaat

SEQ ID NO: 683853 - DNA, 25 bp, Mus musculus
gccgtgtgatatgagagtttgtaat

SEQ ID NO: 683854 - DNA, 25 bp, Mus musculus
gccgtgtgattgctccgcagagtcc

SEQ ID NO: 683855 - DNA, 25 bp, Mus musculus
gccgtgtgattggtccgcagagtcc

SEQ ID NO: 683856 - DNA, 25 bp, Mus musculus
gccgtgtgctatcggataaagtctc

SEQ ID NO: 683857 - DNA, 25 bp, Mus musculus
gccgtgtgctatgggataaagtctc

SEQ ID NO: 683858 - DNA, 25 bp, Mus musculus
gccgtgtgctctacctggaccaaca

SEQ ID NO: 683859 - DNA, 25 bp, Mus musculus
gccgtgtgctcttcctggaccaaca

SEQ ID NO: 683860 - DNA, 25 bp, Mus musculus
gccgtgtggccccaaacatattcac

SEQ ID NO: 683861 - DNA, 25 bp, Mus musculus
gccgtgtggcccgaaacatattcac

SEQ ID NO: 683862 - DNA, 25 bp, Mus musculus
gccgtgtggccgagaccttcttcct

SEQ ID NO: 683863 - DNA, 25 bp, Mus musculus
gccgtgtggccgtgaccttcttcct

SEQ ID NO: 683864 - DNA, 25 bp, Mus musculus
gccgtgtggcgcaacttccgagact

SEQ ID NO: 683865 - DNA, 25 bp, Mus musculus
gccgtgtggcgctacttccgagact

SEQ ID NO: 683866 - DNA, 25 bp, Mus musculus
gccgtgttattcaaaaggcgttaga

SEQ ID NO: 683867 - DNA, 25 bp, Mus musculus
gccgtgttattctaaaggcgttaga

SEQ ID NO: 683868 - DNA, 25 bp, Mus musculus
gccgtgtttaatcatgacaagcctg

SEQ ID NO: 683869 - DNA, 25 bp, Mus musculus
gccgtgtttaatgatgacaagcctg

SEQ ID NO: 683870 - DNA, 25 bp, Mus musculus
gccgtgtttgcactacaggtgctga

SEQ ID NO: 683871 - DNA, 25 bp, Mus musculus
gccgtgtttgcagtacaggtgctga

SEQ ID NO: 683872 - DNA, 25 bp, Mus musculus
gccgttaagcagaagaactagtttc

SEQ ID NO: 683873 - DNA, 25 bp, Mus musculus
gccgttaagcagtagaactagtttc

SEQ ID NO: 683874 - DNA, 25 bp, Mus musculus
gccgttcaagccagcgagtgtgcgt

SEQ ID NO: 683875 - DNA, 25 bp, Mus musculus
gccgttcaagcctgcgagtgtgcgt

SEQ ID NO: 683876 - DNA, 25 bp, Mus musculus
gccgttcacctgcatcagccagatg

SEQ ID NO: 683877 - DNA, 25 bp, Mus musculus
gccgttcacctggatcagccagatg

SEQ ID NO: 683878 - DNA, 25 bp, Mus musculus
gccgttcagagcctctggcaaaata

SEQ ID NO: 683879 - DNA, 25 bp, Mus musculus
gccgttcagagcgtctggcaaaata

SEQ ID NO: 683880 - DNA, 25 bp, Mus musculus
gccgttcaggccaagttcggagatt

SEQ ID NO: 683881 - DNA, 25 bp, Mus musculus
gccgttcaggcctagttcggagatt

SEQ ID NO: 683882 - DNA, 25 bp, Mus musculus
gccgttcgccagctccgaggcagaa

SEQ ID NO: 683883 - DNA, 25 bp, Mus musculus
gccgttcgccaggtccgaggcagaa

SEQ ID NO: 683884 - DNA, 25 bp, Mus musculus
gccgttcgcgttagatcttccctta

SEQ ID NO: 683885 - DNA, 25 bp, Mus musculus
gccgttcgcgtttgatcttccctta

SEQ ID NO: 683886 - DNA, 25 bp, Mus musculus
gccgttctcacgcagtcttcaacat

SEQ ID NO: 683887 - DNA, 25 bp, Mus musculus
gccgttctcacggagtcttcaacat

SEQ ID NO: 683888 - DNA, 25 bp, Mus musculus
gccgttctcctgaggcaccttgcgt

SEQ ID NO: 683889 - DNA, 25 bp, Mus musculus
gccgttctcctgtggcaccttgcgt

SEQ ID NO: 683890 - DNA, 25 bp, Mus musculus
gccgttgaccatagctagacagaaa

SEQ ID NO: 683891 - DNA, 25 bp, Mus musculus
gccgttgaccattgctagacagaaa

SEQ ID NO: 683892 - DNA, 25 bp, Mus musculus
gccgttgcagacatggcggcgtccc

SEQ ID NO: 683893 - DNA, 25 bp, Mus musculus
gccgttgcagacttggcggcgtccc

SEQ ID NO: 683894 - DNA, 25 bp, Mus musculus
gccgttggtcataatcagcagagtt

SEQ ID NO: 683895 - DNA, 25 bp, Mus musculus
gccgttggtcattatcagcagagtt

SEQ ID NO: 683896 - DNA, 25 bp, Mus musculus
gccgttggtgcaattcaatctgatt

SEQ ID NO: 683897 - DNA, 25 bp, Mus musculus
gccgttggtgcatttcaatctgatt

SEQ ID NO: 683898 - DNA, 25 bp, Mus musculus
gccgttgtctttccccaaacgagca

SEQ ID NO: 683899 - DNA, 25 bp, Mus musculus
gccgttgtctttgcccaaacgagca

SEQ ID NO: 683900 - DNA, 25 bp, Mus musculus
gccgtttatgacacttggaataagt

SEQ ID NO: 683901 - DNA, 25 bp, Mus musculus
gccgtttatgactcttggaataagt

SEQ ID NO: 683902 - DNA, 25 bp, Mus musculus
gccgtttgctgtagttggcagcaca

SEQ ID NO: 683903 - DNA, 25 bp, Mus musculus
gccgtttgctgttgttggcagcaca

SEQ ID NO: 683904 - DNA, 25 bp, Mus musculus
gccgtttggagtcgattttccgccg

SEQ ID NO: 683905 - DNA, 25 bp, Mus musculus
gccgtttggagtggattttccgccg

SEQ ID NO: 683906 - DNA, 25 bp, Mus musculus
gccgtttgggtcatgtctacttcct

SEQ ID NO: 683907 - DNA, 25 bp, Mus musculus
gccgtttgggtcttgtctacttcct

SEQ ID NO: 683908 - DNA, 25 bp, Mus musculus
gccgttttggccatggaaaggattg

SEQ ID NO: 683909 - DNA, 25 bp, Mus musculus
gccgttttggccttggaaaggattg

SEQ ID NO: 683910 - DNA, 25 bp, Mus musculus
gcctaaaaagtgaggcccatacatt

SEQ ID NO: 683911 - DNA, 25 bp, Mus musculus
gcctaaaaagtgtggcccatacatt

SEQ ID NO: 683912 - DNA, 25 bp, Mus musculus
gcctaaaccacgaaatgaaatataa

SEQ ID NO: 683913 - DNA, 25 bp, Mus musculus
gcctaaaccacgtaatgaaatataa

SEQ ID NO: 683914 - DNA, 25 bp, Mus musculus
gcctaaacctggaggactgggtgct

SEQ ID NO: 683915 - DNA, 25 bp, Mus musculus
gcctaaacctggtggactgggtgct

SEQ ID NO: 683916 - DNA, 25 bp, Mus musculus
gcctaaactcttctgtcggtctgta

SEQ ID NO: 683917 - DNA, 25 bp, Mus musculus
gcctaaactcttgtgtcggtctgta

SEQ ID NO: 683918 - DNA, 25 bp, Mus musculus
gcctaaagaaggcactaaaaatagc

SEQ ID NO: 683919 - DNA, 25 bp, Mus musculus
gcctaaagaagggactaaaaatagc

SEQ ID NO: 683920 - DNA, 25 bp, Mus musculus
gcctaaaggaaccatcaccttggag

SEQ ID NO: 683921 - DNA, 25 bp, Mus musculus
gcctaaaggaacgatcaccttggag

SEQ ID NO: 683922 - DNA, 25 bp, Mus musculus
gcctaaagtacaagacaacacagag

SEQ ID NO: 683923 - DNA, 25 bp, Mus musculus
gcctaaagtacatgacaacacagag

SEQ ID NO: 683924 - DNA, 25 bp, Mus musculus
gcctaaatacatctcccagtataag

SEQ ID NO: 683925 - DNA, 25 bp, Mus musculus
gcctaaatacatgtcccagtataag

SEQ ID NO: 683926 - DNA, 25 bp, Mus musculus
gcctaaatgtttctgtcaggagaga

SEQ ID NO: 683927 - DNA, 25 bp, Mus musculus
gcctaaatgtttgtgtcaggagaga

SEQ ID NO: 683928 - DNA, 25 bp, Mus musculus
gcctaaccagctatgggagtactga

SEQ ID NO: 683929 - DNA, 25 bp, Mus musculus
gcctaaccagctttgggagtactga

SEQ ID NO: 683930 - DNA, 25 bp, Mus musculus
gcctaaccccatatgtgaccaagat

SEQ ID NO: 683931 - DNA, 25 bp, Mus musculus
gcctaaccccatttgtgaccaagat

SEQ ID NO: 683932 - DNA, 25 bp, Mus musculus
gcctaacccgggaaggggatgcatt

SEQ ID NO: 683933 - DNA, 25 bp, Mus musculus
gcctaacccgggtaggggatgcatt

SEQ ID NO: 683934 - DNA, 25 bp, Mus musculus
gcctaactgaaaacatgtgacttga

SEQ ID NO: 683935 - DNA, 25 bp, Mus musculus
gcctaactgaaatcatgtgacttga

SEQ ID NO: 683936 - DNA, 25 bp, Mus musculus
gcctaagaacggacaccaacgcctt

SEQ ID NO: 683937 - DNA, 25 bp, Mus musculus
gcctaagaacggtcaccaacgcctt

SEQ ID NO: 683938 - DNA, 25 bp, Mus musculus
gcctaagaagcccagaccctatatt

SEQ ID NO: 683939 - DNA, 25 bp, Mus musculus
gcctaagaagccgagaccctatatt

SEQ ID NO: 683940 - DNA, 25 bp, Mus musculus
gcctaagacaaccagcgtctgagga

SEQ ID NO: 683941 - DNA, 25 bp, Mus musculus
gcctaagacaacgagcgtctgagga

SEQ ID NO: 683942 - DNA, 25 bp, Mus musculus
gcctaagcccgccatattaataaag

SEQ ID NO: 683943 - DNA, 25 bp, Mus musculus
gcctaagcccgcgatattaataaag

SEQ ID NO: 683944 - DNA, 25 bp, Mus musculus
gcctaagctgcgcaagtggtacaca

SEQ ID NO: 683945 - DNA, 25 bp, Mus musculus
gcctaagctgcggaagtggtacaca

SEQ ID NO: 683946 - DNA, 25 bp, Mus musculus
gcctaagctggaccaagccttggtg

SEQ ID NO: 683947 - DNA, 25 bp, Mus musculus
gcctaagctggagcaagccttggtg

SEQ ID NO: 683948 - DNA, 25 bp, Mus musculus
gcctaaggcacccagacaccatggg

SEQ ID NO: 683949 - DNA, 25 bp, Mus musculus
gcctaaggcaccgagacaccatggg

SEQ ID NO: 683950 - DNA, 25 bp, Mus musculus
gcctaagtctgcatttgcactggca

SEQ ID NO: 683951 - DNA, 25 bp, Mus musculus
gcctaagtctgcttttgcactggca

SEQ ID NO: 683952 - DNA, 25 bp, Mus musculus
gcctaagttagaccacaaagagaac

SEQ ID NO: 683953 - DNA, 25 bp, Mus musculus
gcctaagttagagcacaaagagaac

SEQ ID NO: 683954 - DNA, 25 bp, Mus musculus
gcctaagttggtaccagagtcacat

SEQ ID NO: 683955 - DNA, 25 bp, Mus musculus
gcctaagttggttccagagtcacat

SEQ ID NO: 683956 - DNA, 25 bp, Mus musculus
gcctaagtttggcattgaccccaat

SEQ ID NO: 683957 - DNA, 25 bp, Mus musculus
gcctaagtttgggattgaccccaat

SEQ ID NO: 683958 - DNA, 25 bp, Mus musculus
gcctaatagcaaacagtctatttcg

SEQ ID NO: 683959 - DNA, 25 bp, Mus musculus
gcctaatagcaatcagtctatttcg

SEQ ID NO: 683960 - DNA, 25 bp, Mus musculus
gcctaatcaatgattaatcacacaa

SEQ ID NO: 683961 - DNA, 25 bp, Mus musculus
gcctaatcaatgtttaatcacacaa

SEQ ID NO: 683962 - DNA, 25 bp, Mus musculus
gcctaatctggcagattgagaagct

SEQ ID NO: 683963 - DNA, 25 bp, Mus musculus
gcctaatctggctgattgagaagct

SEQ ID NO: 683964 - DNA, 25 bp, Mus musculus
gcctaatggaaaccaatcctctgga

SEQ ID NO: 683965 - DNA, 25 bp, Mus musculus
gcctaatggaaagcaatcctctgga

SEQ ID NO: 683966 - DNA, 25 bp, Mus musculus
gcctacaagtcacggtataactcaa

SEQ ID NO: 683967 - DNA, 25 bp, Mus musculus
gcctacaagtcagggtataactcaa

SEQ ID NO: 683968 - DNA, 25 bp, Mus musculus
gcctacacctgcattctataaaacc

SEQ ID NO: 683969 - DNA, 25 bp, Mus musculus
gcctacacctgctttctataaaacc

SEQ ID NO: 683970 - DNA, 25 bp, Mus musculus
gcctacagtgacaacagcctggatc

SEQ ID NO: 683971 - DNA, 25 bp, Mus musculus
gcctacagtgactacagcctggatc

SEQ ID NO: 683972 - DNA, 25 bp, Mus musculus
gcctacataggtcttgctatttgcg

SEQ ID NO: 683973 - DNA, 25 bp, Mus musculus
gcctacataggtgttgctatttgcg

SEQ ID NO: 683974 - DNA, 25 bp, Mus musculus
gcctacatcattctgatatacccag

SEQ ID NO: 683975 - DNA, 25 bp, Mus musculus
gcctacatcattgtgatatacccag

SEQ ID NO: 683976 - DNA, 25 bp, Mus musculus
gcctacatcttccagcctgatatgc

SEQ ID NO: 683977 - DNA, 25 bp, Mus musculus
gcctacatcttcgagcctgatatgc

SEQ ID NO: 683978 - DNA, 25 bp, Mus musculus
gcctacatctttcaagagccatttg

SEQ ID NO: 683979 - DNA, 25 bp, Mus musculus
gcctacatctttgaagagccatttg

SEQ ID NO: 683980 - DNA, 25 bp, Mus musculus
gcctacatggaaatagtcaacaata

SEQ ID NO: 683981 - DNA, 25 bp, Mus musculus
gcctacatggaattagtcaacaata

SEQ ID NO: 683982 - DNA, 25 bp, Mus musculus
gcctacattcatcgaatcaaacacg

SEQ ID NO: 683983 - DNA, 25 bp, Mus musculus
gcctacattcatggaatcaaacacg

SEQ ID NO: 683984 - DNA, 25 bp, Mus musculus
gcctaccatgacattaatgttacag

SEQ ID NO: 683985 - DNA, 25 bp, Mus musculus
gcctaccatgactttaatgttacag

SEQ ID NO: 683986 - DNA, 25 bp, Mus musculus
gcctacccagatccttcaaagcaga

SEQ ID NO: 683987 - DNA, 25 bp, Mus musculus
gcctacccagatgcttcaaagcaga

SEQ ID NO: 683988 - DNA, 25 bp, Mus musculus
gcctacccgacactgtgtgggcaca

SEQ ID NO: 683989 - DNA, 25 bp, Mus musculus
gcctacccgacagtgtgtgggcaca

SEQ ID NO: 683990 - DNA, 25 bp, Mus musculus
gcctaccgcaaaagtactttttcag

SEQ ID NO: 683991 - DNA, 25 bp, Mus musculus
gcctaccgcaaatgtactttttcag

SEQ ID NO: 683992 - DNA, 25 bp, Mus musculus
gcctacctacaacaggagctgaaga

SEQ ID NO: 683993 - DNA, 25 bp, Mus musculus
gcctacctacaagaggagctgaaga

SEQ ID NO: 683994 - DNA, 25 bp, Mus musculus
gcctacctcggaagacatcaccttg

SEQ ID NO: 683995 - DNA, 25 bp, Mus musculus
gcctacctcggatgacatcaccttg

SEQ ID NO: 683996 - DNA, 25 bp, Mus musculus
gcctacctgacaccagggtggtcct

SEQ ID NO: 683997 - DNA, 25 bp, Mus musculus
gcctacctgacagcagggtggtcct

SEQ ID NO: 683998 - DNA, 25 bp, Mus musculus
gcctacgacaagacagccttggctt

SEQ ID NO: 683999 - DNA, 25 bp, Mus musculus
gcctacgacaagtcagccttggctt

SEQ ID NO: 684000 - DNA, 25 bp, Mus musculus
gcctacgaccggcaaaagaatccca

SEQ ID NO: 684001 - DNA, 25 bp, Mus musculus
gcctacgaccgggaaaagaatccca

SEQ ID NO: 684002 - DNA, 25 bp, Mus musculus
gcctacgacgagctgggcaattccg

SEQ ID NO: 684003 - DNA, 25 bp, Mus musculus
gcctacgacgaggtgggcaattccg

SEQ ID NO: 684004 - DNA, 25 bp, Mus musculus
gcctacgataatcgcatcaacctgt

SEQ ID NO: 684005 - DNA, 25 bp, Mus musculus
gcctacgataatggcatcaacctgt

SEQ ID NO: 684006 - DNA, 25 bp, Mus musculus
gcctacggaccaagtgatgctcaaa

SEQ ID NO: 684007 - DNA, 25 bp, Mus musculus
gcctacggaccatgtgatgctcaaa

SEQ ID NO: 684008 - DNA, 25 bp, Mus musculus
gcctacgggcctccgatggaaacgt

SEQ ID NO: 684009 - DNA, 25 bp, Mus musculus
gcctacgggcctgcgatggaaacgt

SEQ ID NO: 684010 - DNA, 25 bp, Mus musculus
gcctacggtcttaccatgagactag

SEQ ID NO: 684011 - DNA, 25 bp, Mus musculus
gcctacggtctttccatgagactag

SEQ ID NO: 684012 - DNA, 25 bp, Mus musculus
gcctacgtctttcaggaccctttca

SEQ ID NO: 684013 - DNA, 25 bp, Mus musculus
gcctacgtctttgaggaccctttca

SEQ ID NO: 684014 - DNA, 25 bp, Mus musculus
gcctacgtgaagatccagcttatgt

SEQ ID NO: 684015 - DNA, 25 bp, Mus musculus
gcctacgtgaagttccagcttatgt

SEQ ID NO: 684016 - DNA, 25 bp, Mus musculus
gcctacgtgcttctcctgcggagct

SEQ ID NO: 684017 - DNA, 25 bp, Mus musculus
gcctacgtgcttgtcctgcggagct

SEQ ID NO: 684018 - DNA, 25 bp, Mus musculus
gcctacgtggcacccgctagagcag

SEQ ID NO: 684019 - DNA, 25 bp, Mus musculus
gcctacgtggcagccgctagagcag

SEQ ID NO: 684020 - DNA, 25 bp, Mus musculus
gcctacgtgtcccagaagaaggttg

SEQ ID NO: 684021 - DNA, 25 bp, Mus musculus
gcctacgtgtccgagaagaaggttg

SEQ ID NO: 684022 - DNA, 25 bp, Mus musculus
gcctactagtgaaggaagtctttca

SEQ ID NO: 684023 - DNA, 25 bp, Mus musculus
gcctactagtgatggaagtctttca

SEQ ID NO: 684024 - DNA, 25 bp, Mus musculus
gcctactgcggaataggaaaagtgt

SEQ ID NO: 684025 - DNA, 25 bp, Mus musculus
gcctactgcggattaggaaaagtgt

SEQ ID NO: 684026 - DNA, 25 bp, Mus musculus
gcctactggaccattcctgaagtct

SEQ ID NO: 684027 - DNA, 25 bp, Mus musculus
gcctactggacctttcctgaagtct

SEQ ID NO: 684028 - DNA, 25 bp, Mus musculus
gcctactggttcaggaagggccaaa

SEQ ID NO: 684029 - DNA, 25 bp, Mus musculus
gcctactggttctggaagggccaaa

SEQ ID NO: 684030 - DNA, 25 bp, Mus musculus
gcctactgtgtgacctgtaatcgga

SEQ ID NO: 684031 - DNA, 25 bp, Mus musculus
gcctactgtgtgtcctgtaatcgga

SEQ ID NO: 684032 - DNA, 25 bp, Mus musculus
gcctacttcctccacaagagtgcag

SEQ ID NO: 684033 - DNA, 25 bp, Mus musculus
gcctacttcctcgacaagagtgcag

SEQ ID NO: 684034 - DNA, 25 bp, Mus musculus
gcctacttcggaccctgtatggcac

SEQ ID NO: 684035 - DNA, 25 bp, Mus musculus
gcctacttcggagcctgtatggcac

SEQ ID NO: 684036 - DNA, 25 bp, Mus musculus
gcctacttgccacagtatacacaca

SEQ ID NO: 684037 - DNA, 25 bp, Mus musculus
gcctacttgccagagtatacacaca

SEQ ID NO: 684038 - DNA, 25 bp, Mus musculus
gcctactttggaagccaatgaccct

SEQ ID NO: 684039 - DNA, 25 bp, Mus musculus
gcctactttggatgccaatgaccct

SEQ ID NO: 684040 - DNA, 25 bp, Mus musculus
gcctacttttatcttcgaacacatt

SEQ ID NO: 684041 - DNA, 25 bp, Mus musculus
gcctacttttatgttcgaacacatt

SEQ ID NO: 684042 - DNA, 25 bp, Mus musculus
gcctagaaaggaaccaagagaagat

SEQ ID NO: 684043 - DNA, 25 bp, Mus musculus
gcctagaaaggatccaagagaagat

SEQ ID NO: 684044 - DNA, 25 bp, Mus musculus
gcctagaagccaccgtagaccttga

SEQ ID NO: 684045 - DNA, 25 bp, Mus musculus
gcctagaagccagcgtagaccttga

SEQ ID NO: 684046 - DNA, 25 bp, Mus musculus
gcctagaccgcaagattgagtttcc

SEQ ID NO: 684047 - DNA, 25 bp, Mus musculus
gcctagaccgcatgattgagtttcc

SEQ ID NO: 684048 - DNA, 25 bp, Mus musculus
gcctagaggctgatctgtccctgaa

SEQ ID NO: 684049 - DNA, 25 bp, Mus musculus
gcctagaggctgttctgtccctgaa

SEQ ID NO: 684050 - DNA, 25 bp, Mus musculus
gcctagatgtgtcccaaccttgtaa

SEQ ID NO: 684051 - DNA, 25 bp, Mus musculus
gcctagatgtgtgccaaccttgtaa

SEQ ID NO: 684052 - DNA, 25 bp, Mus musculus
gcctagcaagctcctttacagatga

SEQ ID NO: 684053 - DNA, 25 bp, Mus musculus
gcctagcaagctgctttacagatga

SEQ ID NO: 684054 - DNA, 25 bp, Mus musculus
gcctagcaagttcagctgccgaaag

SEQ ID NO: 684055 - DNA, 25 bp, Mus musculus
gcctagcaagttgagctgccgaaag

SEQ ID NO: 684056 - DNA, 25 bp, Mus musculus
gcctagcacccaaagggcaaccatt

SEQ ID NO: 684057 - DNA, 25 bp, Mus musculus
gcctagcacccatagggcaaccatt

SEQ ID NO: 684058 - DNA, 25 bp, Mus musculus
gcctagcagggacggctcattctga

SEQ ID NO: 684059 - DNA, 25 bp, Mus musculus
gcctagcagggagggctcattctga

SEQ ID NO: 684060 - DNA, 25 bp, Mus musculus
gcctagcatctccaagtcctgtgga

SEQ ID NO: 684061 - DNA, 25 bp, Mus musculus
gcctagcatctcgaagtcctgtgga

SEQ ID NO: 684062 - DNA, 25 bp, Mus musculus
gcctagccctgaccatcctgagtgt

SEQ ID NO: 684063 - DNA, 25 bp, Mus musculus
gcctagccctgagcatcctgagtgt

SEQ ID NO: 684064 - DNA, 25 bp, Mus musculus
gcctaggaaacgcaaggatctgctt

SEQ ID NO: 684065 - DNA, 25 bp, Mus musculus
gcctaggaaacggaaggatctgctt

SEQ ID NO: 684066 - DNA, 25 bp, Mus musculus
gcctaggatctactgagtgctttga

SEQ ID NO: 684067 - DNA, 25 bp, Mus musculus
gcctaggatctagtgagtgctttga

SEQ ID NO: 684068 - DNA, 25 bp, Mus musculus
gcctaggcagcgcaatccaatttct

SEQ ID NO: 684069 - DNA, 25 bp, Mus musculus
gcctaggcagcggaatccaatttct

SEQ ID NO: 684070 - DNA, 25 bp, Mus musculus
gcctaggcagtgacaacagctagga

SEQ ID NO: 684071 - DNA, 25 bp, Mus musculus
gcctaggcagtgtcaacagctagga

SEQ ID NO: 684072 - DNA, 25 bp, Mus musculus
gcctaggcccatcgagatgcattgt

SEQ ID NO: 684073 - DNA, 25 bp, Mus musculus
gcctaggcccatggagatgcattgt

SEQ ID NO: 684074 - DNA, 25 bp, Mus musculus
gcctaggccttgctttgggcctgaa

SEQ ID NO: 684075 - DNA, 25 bp, Mus musculus
gcctaggccttggtttgggcctgaa

SEQ ID NO: 684076 - DNA, 25 bp, Mus musculus
gcctaggctgctctcagaacttttg

SEQ ID NO: 684077 - DNA, 25 bp, Mus musculus
gcctaggctgctgtcagaacttttg

SEQ ID NO: 684078 - DNA, 25 bp, Mus musculus
gcctaggtggcaccattatccagaa

SEQ ID NO: 684079 - DNA, 25 bp, Mus musculus
gcctaggtggcagcattatccagaa

SEQ ID NO: 684080 - DNA, 25 bp, Mus musculus
gcctagtccaggctttcactgaaga

SEQ ID NO: 684081 - DNA, 25 bp, Mus musculus
gcctagtccagggtttcactgaaga

SEQ ID NO: 684082 - DNA, 25 bp, Mus musculus
gcctagtcctgcattatggtctcta

SEQ ID NO: 684083 - DNA, 25 bp, Mus musculus
gcctagtcctgctttatggtctcta

SEQ ID NO: 684084 - DNA, 25 bp, Mus musculus
gcctagtggccaatggcaggctgca

SEQ ID NO: 684085 - DNA, 25 bp, Mus musculus
gcctagtggccattggcaggctgca

SEQ ID NO: 684086 - DNA, 25 bp, Mus musculus
gcctagtggtagaaggtggtcctaa

SEQ ID NO: 684087 - DNA, 25 bp, Mus musculus
gcctagtggtagtaggtggtcctaa

SEQ ID NO: 684088 - DNA, 25 bp, Mus musculus
gcctagtggtcgcagacactttaaa

SEQ ID NO: 684089 - DNA, 25 bp, Mus musculus
gcctagtggtcggagacactttaaa

SEQ ID NO: 684090 - DNA, 25 bp, Mus musculus
gcctagtgtttgctttcttagctga

SEQ ID NO: 684091 - DNA, 25 bp, Mus musculus
gcctagtgtttggtttcttagctga

SEQ ID NO: 684092 - DNA, 25 bp, Mus musculus
gcctagttgtttctgggagtttcct

SEQ ID NO: 684093 - DNA, 25 bp, Mus musculus
gcctagttgtttgtgggagtttcct

SEQ ID NO: 684094 - DNA, 25 bp, Mus musculus
gcctataatcaacaaaaaggtgagg

SEQ ID NO: 684095 - DNA, 25 bp, Mus musculus
gcctataatcaagaaaaaggtgagg

SEQ ID NO: 684096 - DNA, 25 bp, Mus musculus
gcctatacatatcagcgcaccctga

SEQ ID NO: 684097 - DNA, 25 bp, Mus musculus
gcctatacatatgagcgcaccctga

SEQ ID NO: 684098 - DNA, 25 bp, Mus musculus
gcctatagagatcacatatcgagcg

SEQ ID NO: 684099 - DNA, 25 bp, Mus musculus
gcctatagagatgacatatcgagcg

SEQ ID NO: 684100 - DNA, 25 bp, Mus musculus
gcctatagcattatgtgggacttga

SEQ ID NO: 684101 - DNA, 25 bp, Mus musculus
gcctatagcattttgtgggacttga

SEQ ID NO: 684102 - DNA, 25 bp, Mus musculus
gcctataggttgcaatctcagcccc

SEQ ID NO: 684103 - DNA, 25 bp, Mus musculus
gcctataggttggaatctcagcccc

SEQ ID NO: 684104 - DNA, 25 bp, Mus musculus
gcctatatgtacagcttcatccact

SEQ ID NO: 684105 - DNA, 25 bp, Mus musculus
gcctatatgtactgcttcatccact

SEQ ID NO: 684106 - DNA, 25 bp, Mus musculus
gcctatatttgcaccgtattctcca

SEQ ID NO: 684107 - DNA, 25 bp, Mus musculus
gcctatatttgctccgtattctcca

SEQ ID NO: 684108 - DNA, 25 bp, Mus musculus
gcctatcaagttactgtatgtgcat

SEQ ID NO: 684109 - DNA, 25 bp, Mus musculus
gcctatcaagtttctgtatgtgcat

SEQ ID NO: 684110 - DNA, 25 bp, Mus musculus
gcctatcaattaatgacagatgttt

SEQ ID NO: 684111 - DNA, 25 bp, Mus musculus
gcctatcaattattgacagatgttt

SEQ ID NO: 684112 - DNA, 25 bp, Mus musculus
gcctatccctaaacttgaagacacc

SEQ ID NO: 684113 - DNA, 25 bp, Mus musculus
gcctatccctaatcttgaagacacc

SEQ ID NO: 684114 - DNA, 25 bp, Mus musculus
gcctatcgaacaccaaacactgaca

SEQ ID NO: 684115 - DNA, 25 bp, Mus musculus
gcctatcgaacagcaaacactgaca

SEQ ID NO: 684116 - DNA, 25 bp, Mus musculus
gcctatcgagaacagcaggagtttg

SEQ ID NO: 684117 - DNA, 25 bp, Mus musculus
gcctatcgagaagagcaggagtttg

SEQ ID NO: 684118 - DNA, 25 bp, Mus musculus
gcctatcgctggatgatcgactcca

SEQ ID NO: 684119 - DNA, 25 bp, Mus musculus
gcctatcgctggttgatcgactcca

SEQ ID NO: 684120 - DNA, 25 bp, Mus musculus
gcctatctaagaagtactactctgg

SEQ ID NO: 684121 - DNA, 25 bp, Mus musculus
gcctatctaagatgtactactctgg

SEQ ID NO: 684122 - DNA, 25 bp, Mus musculus
gcctatctaatgataatactccagt

SEQ ID NO: 684123 - DNA, 25 bp, Mus musculus
gcctatctaatgttaatactccagt

SEQ ID NO: 684124 - DNA, 25 bp, Mus musculus
gcctatctcagaaggacaagctctt

SEQ ID NO: 684125 - DNA, 25 bp, Mus musculus
gcctatctcagatggacaagctctt

SEQ ID NO: 684126 - DNA, 25 bp, Mus musculus
gcctatctcatccagctacgtgaag

SEQ ID NO: 684127 - DNA, 25 bp, Mus musculus
gcctatctcatcgagctacgtgaag

SEQ ID NO: 684128 - DNA, 25 bp, Mus musculus
gcctatctccagcacatcgagaatg

SEQ ID NO: 684129 - DNA, 25 bp, Mus musculus
gcctatctccaggacatcgagaatg

SEQ ID NO: 684130 - DNA, 25 bp, Mus musculus
gcctatcttcagctttggctccaag

SEQ ID NO: 684131 - DNA, 25 bp, Mus musculus
gcctatcttcaggtttggctccaag

SEQ ID NO: 684132 - DNA, 25 bp, Mus musculus
gcctatcttctcagatgaatctttc

SEQ ID NO: 684133 - DNA, 25 bp, Mus musculus
gcctatcttctctgatgaatctttc

SEQ ID NO: 684134 - DNA, 25 bp, Mus musculus
gcctatgaaccacaaagagaagttt

SEQ ID NO: 684135 - DNA, 25 bp, Mus musculus
gcctatgaaccagaaagagaagttt

SEQ ID NO: 684136 - DNA, 25 bp, Mus musculus
gcctatgaacctagcctggaaagat

SEQ ID NO: 684137 - DNA, 25 bp, Mus musculus
gcctatgaaccttgcctggaaagat

SEQ ID NO: 684138 - DNA, 25 bp, Mus musculus
gcctatgaagatctcaacaactgcc

SEQ ID NO: 684139 - DNA, 25 bp, Mus musculus
gcctatgaagatgtcaacaactgcc

SEQ ID NO: 684140 - DNA, 25 bp, Mus musculus
gcctatgactgcatcatcttcagtg

SEQ ID NO: 684141 - DNA, 25 bp, Mus musculus
gcctatgactgcttcatcttcagtg

SEQ ID NO: 684142 - DNA, 25 bp, Mus musculus
gcctatgagcatcacctctgtgtgc

SEQ ID NO: 684143 - DNA, 25 bp, Mus musculus
gcctatgagcatgacctctgtgtgc

SEQ ID NO: 684144 - DNA, 25 bp, Mus musculus
gcctatgaggttcgcagcttcctga

SEQ ID NO: 684145 - DNA, 25 bp, Mus musculus
gcctatgaggttggcagcttcctga

SEQ ID NO: 684146 - DNA, 25 bp, Mus musculus
gcctatgatagccaggatctcccca

SEQ ID NO: 684147 - DNA, 25 bp, Mus musculus
gcctatgatagcgaggatctcccca

SEQ ID NO: 684148 - DNA, 25 bp, Mus musculus
gcctatgatgccaacggaccaagtg

SEQ ID NO: 684149 - DNA, 25 bp, Mus musculus
gcctatgatgcctacggaccaagtg

SEQ ID NO: 684150 - DNA, 25 bp, Mus musculus
gcctatgatttaccccactgggatc

SEQ ID NO: 684151 - DNA, 25 bp, Mus musculus
gcctatgatttagcccactgggatc

SEQ ID NO: 684152 - DNA, 25 bp, Mus musculus
gcctatgcaaccctgaagcaggcgc

SEQ ID NO: 684153 - DNA, 25 bp, Mus musculus
gcctatgcaaccgtgaagcaggcgc

SEQ ID NO: 684154 - DNA, 25 bp, Mus musculus
gcctatgcacccaactatactgtct

SEQ ID NO: 684155 - DNA, 25 bp, Mus musculus
gcctatgcaccctactatactgtct

SEQ ID NO: 684156 - DNA, 25 bp, Mus musculus
gcctatgcacggagctgtggcacct

SEQ ID NO: 684157 - DNA, 25 bp, Mus musculus
gcctatgcacggtgctgtggcacct

SEQ ID NO: 684158 - DNA, 25 bp, Mus musculus
gcctatgcaggaccattctgctcca

SEQ ID NO: 684159 - DNA, 25 bp, Mus musculus
gcctatgcaggagcattctgctcca

SEQ ID NO: 684160 - DNA, 25 bp, Mus musculus
gcctatgccagacacagggctgcga

SEQ ID NO: 684161 - DNA, 25 bp, Mus musculus
gcctatgccagagacagggctgcga

SEQ ID NO: 684162 - DNA, 25 bp, Mus musculus
gcctatgcggttatggatattagag

SEQ ID NO: 684163 - DNA, 25 bp, Mus musculus
gcctatgcggttttggatattagag

SEQ ID NO: 684164 - DNA, 25 bp, Mus musculus
gcctatggaggtccctatgatgtca

SEQ ID NO: 684165 - DNA, 25 bp, Mus musculus
gcctatggaggtgcctatgatgtca

SEQ ID NO: 684166 - DNA, 25 bp, Mus musculus
gcctatggttcaaggtttgatcatg

SEQ ID NO: 684167 - DNA, 25 bp, Mus musculus
gcctatggttcatggtttgatcatg

SEQ ID NO: 684168 - DNA, 25 bp, Mus musculus
gcctatgtacatctagctggtccac

SEQ ID NO: 684169 - DNA, 25 bp, Mus musculus
gcctatgtacatgtagctggtccac

SEQ ID NO: 684170 - DNA, 25 bp, Mus musculus
gcctatgtcttgcttcatctctcga

SEQ ID NO: 684171 - DNA, 25 bp, Mus musculus
gcctatgtcttggttcatctctcga

SEQ ID NO: 684172 - DNA, 25 bp, Mus musculus
gcctatgtgcagagggtgcctacca

SEQ ID NO: 684173 - DNA, 25 bp, Mus musculus
gcctatgtgcagtgggtgcctacca

SEQ ID NO: 684174 - DNA, 25 bp, Mus musculus
gcctatgttatcaaggagcattttg

SEQ ID NO: 684175 - DNA, 25 bp, Mus musculus
gcctatgttatctaggagcattttg

SEQ ID NO: 684176 - DNA, 25 bp, Mus musculus
gcctatgtttggcttgcgtgaatcc

SEQ ID NO: 684177 - DNA, 25 bp, Mus musculus
gcctatgtttgggttgcgtgaatcc

SEQ ID NO: 684178 - DNA, 25 bp, Mus musculus
gcctattgctacacatgatggctgg

SEQ ID NO: 684179 - DNA, 25 bp, Mus musculus
gcctattgctactcatgatggctgg

SEQ ID NO: 684180 - DNA, 25 bp, Mus musculus
gcctattgtggaagtgctgaagtac

SEQ ID NO: 684181 - DNA, 25 bp, Mus musculus
gcctattgtggatgtgctgaagtac

SEQ ID NO: 684182 - DNA, 25 bp, Mus musculus
gcctattgttttctatgctacaaaa

SEQ ID NO: 684183 - DNA, 25 bp, Mus musculus
gcctattgttttgtatgctacaaaa

SEQ ID NO: 684184 - DNA, 25 bp, Mus musculus
gcctatttacacaccatgtgcatca

SEQ ID NO: 684185 - DNA, 25 bp, Mus musculus
gcctatttacactccatgtgcatca

SEQ ID NO: 684186 - DNA, 25 bp, Mus musculus
gcctatttataaacatgtcacatcc

SEQ ID NO: 684187 - DNA, 25 bp, Mus musculus
gcctatttataatcatgtcacatcc

SEQ ID NO: 684188 - DNA, 25 bp, Mus musculus
gcctatttcagtacaagcctggtga

SEQ ID NO: 684189 - DNA, 25 bp, Mus musculus
gcctatttcagttcaagcctggtga

SEQ ID NO: 684190 - DNA, 25 bp, Mus musculus
gcctatttcctgctggtcattggtg

SEQ ID NO: 684191 - DNA, 25 bp, Mus musculus
gcctatttcctggtggtcattggtg

SEQ ID NO: 684192 - DNA, 25 bp, Mus musculus
gcctatttgaacatgtttgaacaca

SEQ ID NO: 684193 - DNA, 25 bp, Mus musculus
gcctatttgaacttgtttgaacaca

SEQ ID NO: 684194 - DNA, 25 bp, Mus musculus
gcctatttgggaaaaaggaaatgcg

SEQ ID NO: 684195 - DNA, 25 bp, Mus musculus
gcctatttgggataaaggaaatgcg

SEQ ID NO: 684196 - DNA, 25 bp, Mus musculus
gcctattttcatcaccggcagatat

SEQ ID NO: 684197 - DNA, 25 bp, Mus musculus
gcctattttcatgaccggcagatat

SEQ ID NO: 684198 - DNA, 25 bp, Mus musculus
gcctcaaaacagaggaacggaatgt

SEQ ID NO: 684199 - DNA, 25 bp, Mus musculus
gcctcaaaacagtggaacggaatgt

SEQ ID NO: 684200 - DNA, 25 bp, Mus musculus
gcctcaaacttactagagctaaaaa

SEQ ID NO: 684201 - DNA, 25 bp, Mus musculus
gcctcaaacttagtagagctaaaaa

SEQ ID NO: 684202 - DNA, 25 bp, Mus musculus
gcctcaaagccaaatggacactgtg

SEQ ID NO: 684203 - DNA, 25 bp, Mus musculus
gcctcaaagccatatggacactgtg

SEQ ID NO: 684204 - DNA, 25 bp, Mus musculus
gcctcaaagggtcagtggcctcgcc

SEQ ID NO: 684205 - DNA, 25 bp, Mus musculus
gcctcaaagggtgagtggcctcgcc

SEQ ID NO: 684206 - DNA, 25 bp, Mus musculus
gcctcaaagtccaaccggcttaaca

SEQ ID NO: 684207 - DNA, 25 bp, Mus musculus
gcctcaaagtcctaccggcttaaca

SEQ ID NO: 684208 - DNA, 25 bp, Mus musculus
gcctcaaatctcagctgacagccag

SEQ ID NO: 684209 - DNA, 25 bp, Mus musculus
gcctcaaatctctgctgacagccag

SEQ ID NO: 684210 - DNA, 25 bp, Mus musculus
gcctcaaatgagactagctgtctag

SEQ ID NO: 684211 - DNA, 25 bp, Mus musculus
gcctcaaatgagtctagctgtctag

SEQ ID NO: 684212 - DNA, 25 bp, Mus musculus
gcctcaacaagcaaggctacaaatg

SEQ ID NO: 684213 - DNA, 25 bp, Mus musculus
gcctcaacaagctaggctacaaatg

SEQ ID NO: 684214 - DNA, 25 bp, Mus musculus
gcctcaacagatacaggcttcctgt

SEQ ID NO: 684215 - DNA, 25 bp, Mus musculus
gcctcaacagattcaggcttcctgt

SEQ ID NO: 684216 - DNA, 25 bp, Mus musculus
gcctcaacatagagcctggctacat

SEQ ID NO: 684217 - DNA, 25 bp, Mus musculus
gcctcaacatagtgcctggctacat

SEQ ID NO: 684218 - DNA, 25 bp, Mus musculus
gcctcaactcgtatctgcatcagcg

SEQ ID NO: 684219 - DNA, 25 bp, Mus musculus
gcctcaactcgtttctgcatcagcg

SEQ ID NO: 684220 - DNA, 25 bp, Mus musculus
gcctcaagacagagatgatctctat

SEQ ID NO: 684221 - DNA, 25 bp, Mus musculus
gcctcaagacagtgatgatctctat

SEQ ID NO: 684222 - DNA, 25 bp, Mus musculus
gcctcaagacatctgagtagcttct

SEQ ID NO: 684223 - DNA, 25 bp, Mus musculus
gcctcaagacatgtgagtagcttct

SEQ ID NO: 684224 - DNA, 25 bp, Mus musculus
gcctcaagatggagtctcctgattg

SEQ ID NO: 684225 - DNA, 25 bp, Mus musculus
gcctcaagatggtgtctcctgattg

SEQ ID NO: 684226 - DNA, 25 bp, Mus musculus
gcctcaagattgcttggaattcgaa

SEQ ID NO: 684227 - DNA, 25 bp, Mus musculus
gcctcaagattggttggaattcgaa

SEQ ID NO: 684228 - DNA, 25 bp, Mus musculus
gcctcaagcaggaagcaccagtgtt

SEQ ID NO: 684229 - DNA, 25 bp, Mus musculus
gcctcaagcaggtagcaccagtgtt

SEQ ID NO: 684230 - DNA, 25 bp, Mus musculus
gcctcaagcattaataagtccacag

SEQ ID NO: 684231 - DNA, 25 bp, Mus musculus
gcctcaagcatttataagtccacag

SEQ ID NO: 684232 - DNA, 25 bp, Mus musculus
gcctcaaggcataacgtcaccaagt

SEQ ID NO: 684233 - DNA, 25 bp, Mus musculus
gcctcaaggcattacgtcaccaagt

SEQ ID NO: 684234 - DNA, 25 bp, Mus musculus
gcctcaagtattatgatactgtgcc

SEQ ID NO: 684235 - DNA, 25 bp, Mus musculus
gcctcaagtattttgatactgtgcc

SEQ ID NO: 684236 - DNA, 25 bp, Mus musculus
gcctcaatgagaagatcaatccaaa

SEQ ID NO: 684237 - DNA, 25 bp, Mus musculus
gcctcaatgagaccagcaagaacat

SEQ ID NO: 684238 - DNA, 25 bp, Mus musculus
gcctcaatgagagcagcaagaacat

SEQ ID NO: 684239 - DNA, 25 bp, Mus musculus
gcctcaatgagatgatcaatccaaa

SEQ ID NO: 684240 - DNA, 25 bp, Mus musculus
gcctcaatgcctctggaaaacatgt

SEQ ID NO: 684241 - DNA, 25 bp, Mus musculus
gcctcaatgcctgtggaaaacatgt

SEQ ID NO: 684242 - DNA, 25 bp, Mus musculus
gcctcaatggagatcatccagaagt

SEQ ID NO: 684243 - DNA, 25 bp, Mus musculus
gcctcaatggagttcatccagaagt

SEQ ID NO: 684244 - DNA, 25 bp, Mus musculus
gcctcaatgttaaagacctcccaaa

SEQ ID NO: 684245 - DNA, 25 bp, Mus musculus
gcctcaatgttatagacctcccaaa

SEQ ID NO: 684246 - DNA, 25 bp, Mus musculus
gcctcacacacgattgactttgcga

SEQ ID NO: 684247 - DNA, 25 bp, Mus musculus
gcctcacacacgtttgactttgcga

SEQ ID NO: 684248 - DNA, 25 bp, Mus musculus
gcctcacacgggaagcatagactct

SEQ ID NO: 684249 - DNA, 25 bp, Mus musculus
gcctcacacgggtagcatagactct

SEQ ID NO: 684250 - DNA, 25 bp, Mus musculus
gcctcacatcggaaactacagactg

SEQ ID NO: 684251 - DNA, 25 bp, Mus musculus
gcctcacatcggtaactacagactg

SEQ ID NO: 684252 - DNA, 25 bp, Mus musculus
gcctcacattttacttctggacgaa

SEQ ID NO: 684253 - DNA, 25 bp, Mus musculus
gcctcacatttttcttctggacgaa

SEQ ID NO: 684254 - DNA, 25 bp, Mus musculus
gcctcaccagtgaagacgaagacta

SEQ ID NO: 684255 - DNA, 25 bp, Mus musculus
gcctcaccagtgtagacgaagacta

SEQ ID NO: 684256 - DNA, 25 bp, Mus musculus
gcctcaccgattcaaggtttataac

SEQ ID NO: 684257 - DNA, 25 bp, Mus musculus
gcctcaccgattgaaggtttataac

SEQ ID NO: 684258 - DNA, 25 bp, Mus musculus
gcctcaccgcctatgtgatgaaaga

SEQ ID NO: 684259 - DNA, 25 bp, Mus musculus
gcctcaccgcctttgtgatgaaaga

SEQ ID NO: 684260 - DNA, 25 bp, Mus musculus
gcctcacctgcgagtgacctgcatg

SEQ ID NO: 684261 - DNA, 25 bp, Mus musculus
gcctcacctgcgtgtgacctgcatg

SEQ ID NO: 684262 - DNA, 25 bp, Mus musculus
gcctcacctggaccgagctgttcgt

SEQ ID NO: 684263 - DNA, 25 bp, Mus musculus
gcctcacctggagcgagctgttcgt

SEQ ID NO: 684264 - DNA, 25 bp, Mus musculus
gcctcacgctatagatcaggtgtca

SEQ ID NO: 684265 - DNA, 25 bp, Mus musculus
gcctcacgctattgatcaggtgtca

SEQ ID NO: 684266 - DNA, 25 bp, Mus musculus
gcctcacggtgaaaattggagattt

SEQ ID NO: 684267 - DNA, 25 bp, Mus musculus
gcctcacggtgataattggagattt

SEQ ID NO: 684268 - DNA, 25 bp, Mus musculus
gcctcactatcgctgggatcctctt

SEQ ID NO: 684269 - DNA, 25 bp, Mus musculus
gcctcactatcggtgggatcctctt

SEQ ID NO: 684270 - DNA, 25 bp, Mus musculus
gcctcactatgaccctgctgacaga

SEQ ID NO: 684271 - DNA, 25 bp, Mus musculus
gcctcactatgagcctgctgacaga

SEQ ID NO: 684272 - DNA, 25 bp, Mus musculus
gcctcactctgcaccagaatacaag

SEQ ID NO: 684273 - DNA, 25 bp, Mus musculus
gcctcactctgctccagaatacaag

SEQ ID NO: 684274 - DNA, 25 bp, Mus musculus
gcctcactgtggactagagaacgtc

SEQ ID NO: 684275 - DNA, 25 bp, Mus musculus
gcctcactgtggtctagagaacgtc

SEQ ID NO: 684276 - DNA, 25 bp, Mus musculus
gcctcagaaaaaccgagttcggaaa

SEQ ID NO: 684277 - DNA, 25 bp, Mus musculus
gcctcagaaaaagcgagttcggaaa

SEQ ID NO: 684278 - DNA, 25 bp, Mus musculus
gcctcagaacatatgggataacctc

SEQ ID NO: 684279 - DNA, 25 bp, Mus musculus
gcctcagaacatttgggataacctc

SEQ ID NO: 684280 - DNA, 25 bp, Mus musculus
gcctcagaatttcgtatccttaatg

SEQ ID NO: 684281 - DNA, 25 bp, Mus musculus
gcctcagaatttggtatccttaatg

SEQ ID NO: 684282 - DNA, 25 bp, Mus musculus
gcctcagactttcactacgataaat

SEQ ID NO: 684283 - DNA, 25 bp, Mus musculus
gcctcagactttgactacgataaat

SEQ ID NO: 684284 - DNA, 25 bp, Mus musculus
gcctcagagctcatccaaataaatg

SEQ ID NO: 684285 - DNA, 25 bp, Mus musculus
gcctcagagctcttccaaataaatg

SEQ ID NO: 684286 - DNA, 25 bp, Mus musculus
gcctcagagtgtccccgaaggagaa

SEQ ID NO: 684287 - DNA, 25 bp, Mus musculus
gcctcagagtgtgcccgaaggagaa

SEQ ID NO: 684288 - DNA, 25 bp, Mus musculus
gcctcagattatcacgggcatcgca

SEQ ID NO: 684289 - DNA, 25 bp, Mus musculus
gcctcagattatgacgggcatcgca

SEQ ID NO: 684290 - DNA, 25 bp, Mus musculus
gcctcagcacatcgtgagggccacg

SEQ ID NO: 684291 - DNA, 25 bp, Mus musculus
gcctcagcacatggtgagggccacg

SEQ ID NO: 684292 - DNA, 25 bp, Mus musculus
gcctcagccaaaagtcacctggtct

SEQ ID NO: 684293 - DNA, 25 bp, Mus musculus
gcctcagccaaatgtcacctggtct

SEQ ID NO: 684294 - DNA, 25 bp, Mus musculus
gcctcagccagcagggccgctggat

SEQ ID NO: 684295 - DNA, 25 bp, Mus musculus
gcctcagccagctgggccgctggat

SEQ ID NO: 684296 - DNA, 25 bp, Mus musculus
gcctcagccgtacattctgcagcat

SEQ ID NO: 684297 - DNA, 25 bp, Mus musculus
gcctcagccgtagattctgcagcat

SEQ ID NO: 684298 - DNA, 25 bp, Mus musculus
gcctcagcggtgaccatcaatttcc

SEQ ID NO: 684299 - DNA, 25 bp, Mus musculus
gcctcagcggtgtccatcaatttcc

SEQ ID NO: 684300 - DNA, 25 bp, Mus musculus
gcctcagcttcccagtgcggagatt

SEQ ID NO: 684301 - DNA, 25 bp, Mus musculus
gcctcagcttccgagtgcggagatt

SEQ ID NO: 684302 - DNA, 25 bp, Mus musculus
gcctcaggagctacgagaggtcatt

SEQ ID NO: 684303 - DNA, 25 bp, Mus musculus
gcctcaggagcttcgagaggtcatt

SEQ ID NO: 684304 - DNA, 25 bp, Mus musculus
gcctcaggatatcatcgtgtttatt

SEQ ID NO: 684305 - DNA, 25 bp, Mus musculus
gcctcaggatatgatcgtgtttatt

SEQ ID NO: 684306 - DNA, 25 bp, Mus musculus
gcctcaggattcaggagttcattga

SEQ ID NO: 684307 - DNA, 25 bp, Mus musculus
gcctcaggattctggagttcattga

SEQ ID NO: 684308 - DNA, 25 bp, Mus musculus
gcctcaggcaacatcagccaagtgg

SEQ ID NO: 684309 - DNA, 25 bp, Mus musculus
gcctcaggcaacttcagccaagtgg

SEQ ID NO: 684310 - DNA, 25 bp, Mus musculus
gcctcaggcacaatatagtcaaacc

SEQ ID NO: 684311 - DNA, 25 bp, Mus musculus
gcctcaggcacattatagtcaaacc

SEQ ID NO: 684312 - DNA, 25 bp, Mus musculus
gcctcaggccatcgagtggctaatt

SEQ ID NO: 684313 - DNA, 25 bp, Mus musculus
gcctcaggccatggagtggctaatt

SEQ ID NO: 684314 - DNA, 25 bp, Mus musculus
gcctcaggctctccgaggcttcaga

SEQ ID NO: 684315 - DNA, 25 bp, Mus musculus
gcctcaggctctgcgaggcttcaga

SEQ ID NO: 684316 - DNA, 25 bp, Mus musculus
gcctcagggaataatacaagaccag

SEQ ID NO: 684317 - DNA, 25 bp, Mus musculus
gcctcagggaattatacaagaccag

SEQ ID NO: 684318 - DNA, 25 bp, Mus musculus
gcctcagggtaccactacggagttc

SEQ ID NO: 684319 - DNA, 25 bp, Mus musculus
gcctcagggtacgactacggagttc

SEQ ID NO: 684320 - DNA, 25 bp, Mus musculus
gcctcaggtcacacggagaacatca

SEQ ID NO: 684321 - DNA, 25 bp, Mus musculus
gcctcaggtcactcggagaacatca

SEQ ID NO: 684322 - DNA, 25 bp, Mus musculus
gcctcaggtctgattcagcagattt

SEQ ID NO: 684323 - DNA, 25 bp, Mus musculus
gcctcaggtctgtttcagcagattt

SEQ ID NO: 684324 - DNA, 25 bp, Mus musculus
gcctcaggttaacggtccctgaggt

SEQ ID NO: 684325 - DNA, 25 bp, Mus musculus
gcctcaggttaagggtccctgaggt

SEQ ID NO: 684326 - DNA, 25 bp, Mus musculus
gcctcagtacctcggaagagtggct

SEQ ID NO: 684327 - DNA, 25 bp, Mus musculus
gcctcagtacctgggaagagtggct

SEQ ID NO: 684328 - DNA, 25 bp, Mus musculus
gcctcagtacgtcggtatccggctc

SEQ ID NO: 684329 - DNA, 25 bp, Mus musculus
gcctcagtacgtgggtatccggctc

SEQ ID NO: 684330 - DNA, 25 bp, Mus musculus
gcctcagtccccacttccatcaggg

SEQ ID NO: 684331 - DNA, 25 bp, Mus musculus
gcctcagtcccctcttccatcaggg

SEQ ID NO: 684332 - DNA, 25 bp, Mus musculus
gcctcagtccggagatccctattta

SEQ ID NO: 684333 - DNA, 25 bp, Mus musculus
gcctcagtccggtgatccctattta

SEQ ID NO: 684334 - DNA, 25 bp, Mus musculus
gcctcagtcgttcagaagagaagcc

SEQ ID NO: 684335 - DNA, 25 bp, Mus musculus
gcctcagtcgttgagaagagaagcc

SEQ ID NO: 684336 - DNA, 25 bp, Mus musculus
gcctcagtcttgacacacagcagct

SEQ ID NO: 684337 - DNA, 25 bp, Mus musculus
gcctcagtcttgtcacacagcagct

SEQ ID NO: 684338 - DNA, 25 bp, Mus musculus
gcctcagtgagcacaatctggcctc

SEQ ID NO: 684339 - DNA, 25 bp, Mus musculus
gcctcagtgagcaccactgtgacaa

SEQ ID NO: 684340 - DNA, 25 bp, Mus musculus
gcctcagtgagctcaatctggcctc

SEQ ID NO: 684341 - DNA, 25 bp, Mus musculus
gcctcagtgagctccactgtgacaa

SEQ ID NO: 684342 - DNA, 25 bp, Mus musculus
gcctcagtggtgacgagaataatgg

SEQ ID NO: 684343 - DNA, 25 bp, Mus musculus
gcctcagtggtgtcgagaataatgg

SEQ ID NO: 684344 - DNA, 25 bp, Mus musculus
gcctcagttccacaacatgcggcaa

SEQ ID NO: 684345 - DNA, 25 bp, Mus musculus
gcctcagttccagaacatgcggcaa

SEQ ID NO: 684346 - DNA, 25 bp, Mus musculus
gcctcatagctgagaacattggatt

SEQ ID NO: 684347 - DNA, 25 bp, Mus musculus
gcctcatagctgtgaacattggatt

SEQ ID NO: 684348 - DNA, 25 bp, Mus musculus
gcctcatatgcgcttattaatttct

SEQ ID NO: 684349 - DNA, 25 bp, Mus musculus
gcctcatatgcggttattaatttct

SEQ ID NO: 684350 - DNA, 25 bp, Mus musculus
gcctcatcaactctgctgttggcat

SEQ ID NO: 684351 - DNA, 25 bp, Mus musculus
gcctcatcaactgtgctgttggcat

SEQ ID NO: 684352 - DNA, 25 bp, Mus musculus
gcctcatcaataacatccatgtgca

SEQ ID NO: 684353 - DNA, 25 bp, Mus musculus
gcctcatcaatatcatccatgtgca

SEQ ID NO: 684354 - DNA, 25 bp, Mus musculus
gcctcatcattgctgggcacctgtt

SEQ ID NO: 684355 - DNA, 25 bp, Mus musculus
gcctcatcattggtgggcacctgtt

SEQ ID NO: 684356 - DNA, 25 bp, Mus musculus
gcctcatctacacagcgggcggtta

SEQ ID NO: 684357 - DNA, 25 bp, Mus musculus
gcctcatctacagagcgggcggtta

SEQ ID NO: 684358 - DNA, 25 bp, Mus musculus
gcctcatcttaaaagtcattttcat

SEQ ID NO: 684359 - DNA, 25 bp, Mus musculus
gcctcatcttaatagtcattttcat

SEQ ID NO: 684360 - DNA, 25 bp, Mus musculus
gcctcatgacagaaccttctactgc

SEQ ID NO: 684361 - DNA, 25 bp, Mus musculus
gcctcatgacagtaccttctactgc

SEQ ID NO: 684362 - DNA, 25 bp, Mus musculus
gcctcatggcaactcgacagtacgt

SEQ ID NO: 684363 - DNA, 25 bp, Mus musculus
gcctcatggcaagtcgacagtacgt

SEQ ID NO: 684364 - DNA, 25 bp, Mus musculus
gcctcatgtaccatgatgccagccg

SEQ ID NO: 684365 - DNA, 25 bp, Mus musculus
gcctcatgtaccttgatgccagccg

SEQ ID NO: 684366 - DNA, 25 bp, Mus musculus
gcctcatgtataactactggactca

SEQ ID NO: 684367 - DNA, 25 bp, Mus musculus
gcctcatgtatatctactggactca

SEQ ID NO: 684368 - DNA, 25 bp, Mus musculus
gcctcattgagaatatcttgaagca

SEQ ID NO: 684369 - DNA, 25 bp, Mus musculus
gcctcattgagattatcttgaagca

SEQ ID NO: 684370 - DNA, 25 bp, Mus musculus
gcctcattgtggcaatcatccgctg

SEQ ID NO: 684371 - DNA, 25 bp, Mus musculus
gcctcattgtgggaatcatccgctg

SEQ ID NO: 684372 - DNA, 25 bp, Mus musculus
gcctcatttgccaatcagagtgaga

SEQ ID NO: 684373 - DNA, 25 bp, Mus musculus
gcctcatttgcctatcagagtgaga

SEQ ID NO: 684374 - DNA, 25 bp, Mus musculus
gcctccaaaaccaagaagaagcatt

SEQ ID NO: 684375 - DNA, 25 bp, Mus musculus
gcctccaaaacctagaagaagcatt

SEQ ID NO: 684376 - DNA, 25 bp, Mus musculus
gcctccaaattacaatgtgtcttcc

SEQ ID NO: 684377 - DNA, 25 bp, Mus musculus
gcctccaaattagaatgtgtcttcc

SEQ ID NO: 684378 - DNA, 25 bp, Mus musculus
gcctccaagacacaaaggaaaacaa

SEQ ID NO: 684379 - DNA, 25 bp, Mus musculus
gcctccaagacagaaaggaaaacaa

SEQ ID NO: 684380 - DNA, 25 bp, Mus musculus
gcctccaagggcagtgcctatttga

SEQ ID NO: 684381 - DNA, 25 bp, Mus musculus
gcctccaagggctgtgcctatttga

SEQ ID NO: 684382 - DNA, 25 bp, Mus musculus
gcctccaagtgaatttcttttccct

SEQ ID NO: 684383 - DNA, 25 bp, Mus musculus
gcctccaagtgattttcttttccct

SEQ ID NO: 684384 - DNA, 25 bp, Mus musculus
gcctccaatccaatatgtccgttgt

SEQ ID NO: 684385 - DNA, 25 bp, Mus musculus
gcctccaatccattatgtccgttgt

SEQ ID NO: 684386 - DNA, 25 bp, Mus musculus
gcctccagaaaacaagatggcccta

SEQ ID NO: 684387 - DNA, 25 bp, Mus musculus
gcctccagaaaagaagatggcccta

SEQ ID NO: 684388 - DNA, 25 bp, Mus musculus
gcctccagactgctaagagcagaga

SEQ ID NO: 684389 - DNA, 25 bp, Mus musculus
gcctccagactggtaagagcagaga

SEQ ID NO: 684390 - DNA, 25 bp, Mus musculus
gcctccagagggacgggctccatct

SEQ ID NO: 684391 - DNA, 25 bp, Mus musculus
gcctccagagggtcgggctccatct

SEQ ID NO: 684392 - DNA, 25 bp, Mus musculus
gcctccaggagcacatagaccagct

SEQ ID NO: 684393 - DNA, 25 bp, Mus musculus
gcctccaggagcattgcctgcacat

SEQ ID NO: 684394 - DNA, 25 bp, Mus musculus
gcctccaggagctcatagaccagct

SEQ ID NO: 684395 - DNA, 25 bp, Mus musculus
gcctccaggagctttgcctgcacat

SEQ ID NO: 684396 - DNA, 25 bp, Mus musculus
gcctccagggacagactgggacgcc

SEQ ID NO: 684397 - DNA, 25 bp, Mus musculus
gcctccagggacagattattttctg

SEQ ID NO: 684398 - DNA, 25 bp, Mus musculus
gcctccagggactgactgggacgcc

SEQ ID NO: 684399 - DNA, 25 bp, Mus musculus
gcctccagggactgattattttctg

SEQ ID NO: 684400 - DNA, 25 bp, Mus musculus
gcctccagggtccagaaatcatgtt

SEQ ID NO: 684401 - DNA, 25 bp, Mus musculus
gcctccagggtcgagaaatcatgtt

SEQ ID NO: 684402 - DNA, 25 bp, Mus musculus
gcctccaggtcaagtccagggaaat

SEQ ID NO: 684403 - DNA, 25 bp, Mus musculus
gcctccaggtcatgtccagggaaat

SEQ ID NO: 684404 - DNA, 25 bp, Mus musculus
gcctccagtattacaggagtgaccc

SEQ ID NO: 684405 - DNA, 25 bp, Mus musculus
gcctccagtatttcaggagtgaccc

SEQ ID NO: 684406 - DNA, 25 bp, Mus musculus
gcctccagtgcgcagactgagcaag

SEQ ID NO: 684407 - DNA, 25 bp, Mus musculus
gcctccagtgcggagactgagcaag

SEQ ID NO: 684408 - DNA, 25 bp, Mus musculus
gcctccatgcagaacgtggtctttg

SEQ ID NO: 684409 - DNA, 25 bp, Mus musculus
gcctccatgcagtacgtggtctttg

SEQ ID NO: 684410 - DNA, 25 bp, Mus musculus
gcctccatggatcacattctgtttg

SEQ ID NO: 684411 - DNA, 25 bp, Mus musculus
gcctccatggatgacattctgtttg

SEQ ID NO: 684412 - DNA, 25 bp, Mus musculus
gcctccatgtgcaggagatcatctc

SEQ ID NO: 684413 - DNA, 25 bp, Mus musculus
gcctccatgtgctggagatcatctc

SEQ ID NO: 684414 - DNA, 25 bp, Mus musculus
gcctccattcctatgaaggaattgg

SEQ ID NO: 684415 - DNA, 25 bp, Mus musculus
gcctccattcctttgaaggaattgg

SEQ ID NO: 684416 - DNA, 25 bp, Mus musculus
gcctccatttggcatgacataaaca

SEQ ID NO: 684417 - DNA, 25 bp, Mus musculus
gcctccatttgggatgacataaaca

SEQ ID NO: 684418 - DNA, 25 bp, Mus musculus
gcctcccaaacgaaactggatcttg

SEQ ID NO: 684419 - DNA, 25 bp, Mus musculus
gcctcccaaacgtaactggatcttg

SEQ ID NO: 684420 - DNA, 25 bp, Mus musculus
gcctcccaaccgaattagtcacgga

SEQ ID NO: 684421 - DNA, 25 bp, Mus musculus
gcctcccaaccgtattagtcacgga

SEQ ID NO: 684422 - DNA, 25 bp, Mus musculus
gcctcccacacgatgaacaagaact

SEQ ID NO: 684423 - DNA, 25 bp, Mus musculus
gcctcccacacgttgaacaagaact

SEQ ID NO: 684424 - DNA, 25 bp, Mus musculus
gcctcccacagtacagaccaagaat

SEQ ID NO: 684425 - DNA, 25 bp, Mus musculus
gcctcccacagttcagaccaagaat

SEQ ID NO: 684426 - DNA, 25 bp, Mus musculus
gcctcccacctgaagtaaatcggat

SEQ ID NO: 684427 - DNA, 25 bp, Mus musculus
gcctcccacctgtagtaaatcggat

SEQ ID NO: 684428 - DNA, 25 bp, Mus musculus
gcctcccacgcgaagggcctctgag

SEQ ID NO: 684429 - DNA, 25 bp, Mus musculus
gcctcccacgcgtagggcctctgag

SEQ ID NO: 684430 - DNA, 25 bp, Mus musculus
gcctcccagatcagctgaaactcta

SEQ ID NO: 684431 - DNA, 25 bp, Mus musculus
gcctcccagatctgctgaaactcta

SEQ ID NO: 684432 - DNA, 25 bp, Mus musculus
gcctcccagtgactagggtctgagc

SEQ ID NO: 684433 - DNA, 25 bp, Mus musculus
gcctcccagtgagtagggtctgagc

SEQ ID NO: 684434 - DNA, 25 bp, Mus musculus
gcctcccatgaaatcagaacagaca

SEQ ID NO: 684435 - DNA, 25 bp, Mus musculus
gcctcccatgaattcagaacagaca

SEQ ID NO: 684436 - DNA, 25 bp, Mus musculus
gcctccccggctcgtgggagataaa

SEQ ID NO: 684437 - DNA, 25 bp, Mus musculus
gcctccccggctggtgggagataaa

SEQ ID NO: 684438 - DNA, 25 bp, Mus musculus
gcctcccggagcaacctgaagaggg

SEQ ID NO: 684439 - DNA, 25 bp, Mus musculus
gcctcccggagctacctgaagaggg

SEQ ID NO: 684440 - DNA, 25 bp, Mus musculus
gcctccctgagtaagaaaagaagga

SEQ ID NO: 684441 - DNA, 25 bp, Mus musculus
gcctccctgagtagtcaggagccct

SEQ ID NO: 684442 - DNA, 25 bp, Mus musculus
gcctccctgagttagaaaagaagga

SEQ ID NO: 684443 - DNA, 25 bp, Mus musculus
gcctccctgagttgtcaggagccct

SEQ ID NO: 684444 - DNA, 25 bp, Mus musculus
gcctccctgcatcgatagttctggg

SEQ ID NO: 684445 - DNA, 25 bp, Mus musculus
gcctccctgcatggatagttctggg

SEQ ID NO: 684446 - DNA, 25 bp, Mus musculus
gcctccctgggaatacagtcccttg

SEQ ID NO: 684447 - DNA, 25 bp, Mus musculus
gcctccctgggattacagtcccttg

SEQ ID NO: 684448 - DNA, 25 bp, Mus musculus
gcctccgaaagcagtctcgccagtg

SEQ ID NO: 684449 - DNA, 25 bp, Mus musculus
gcctccgaaagctgtctcgccagtg

SEQ ID NO: 684450 - DNA, 25 bp, Mus musculus
gcctccgatgatcatgtcgccatgg

SEQ ID NO: 684451 - DNA, 25 bp, Mus musculus
gcctccgatgatgatgtcgccatgg

SEQ ID NO: 684452 - DNA, 25 bp, Mus musculus
gcctccggagatataagcgagaact

SEQ ID NO: 684453 - DNA, 25 bp, Mus musculus
gcctccggagatttaagcgagaact

SEQ ID NO: 684454 - DNA, 25 bp, Mus musculus
gcctccggcaaccaatagagaagaa

SEQ ID NO: 684455 - DNA, 25 bp, Mus musculus
gcctccggcaacgaatagagaagaa

SEQ ID NO: 684456 - DNA, 25 bp, Mus musculus
gcctccgggcttagcatgtctatga

SEQ ID NO: 684457 - DNA, 25 bp, Mus musculus
gcctccgggctttgcatgtctatga

SEQ ID NO: 684458 - DNA, 25 bp, Mus musculus
gcctccggtggtatgctagcttgca

SEQ ID NO: 684459 - DNA, 25 bp, Mus musculus
gcctccggtggtttgctagcttgca

SEQ ID NO: 684460 - DNA, 25 bp, Mus musculus
gcctccgtactgcaggtgtctgatt

SEQ ID NO: 684461 - DNA, 25 bp, Mus musculus
gcctccgtactggaggtgtctgatt

SEQ ID NO: 684462 - DNA, 25 bp, Mus musculus
gcctccgtggaacggcattgtgttc

SEQ ID NO: 684463 - DNA, 25 bp, Mus musculus
gcctccgtggaagggcattgtgttc

SEQ ID NO: 684464 - DNA, 25 bp, Mus musculus
gcctccgtggagcaaggcttcccag

SEQ ID NO: 684465 - DNA, 25 bp, Mus musculus
gcctccgtggaggaaggcttcccag

SEQ ID NO: 684466 - DNA, 25 bp, Mus musculus
gcctcctaagtgcaagggccatcac

SEQ ID NO: 684467 - DNA, 25 bp, Mus musculus
gcctcctaagtggaagggccatcac

SEQ ID NO: 684468 - DNA, 25 bp, Mus musculus
gcctcctaatcaatgtcatttcctg

SEQ ID NO: 684469 - DNA, 25 bp, Mus musculus
gcctcctaatcattgtcatttcctg

SEQ ID NO: 684470 - DNA, 25 bp, Mus musculus
gcctcctacatcctcatggagaaga

SEQ ID NO: 684471 - DNA, 25 bp, Mus musculus
gcctcctacatcgtcatggagaaga

SEQ ID NO: 684472 - DNA, 25 bp, Mus musculus
gcctcctagggaagctggcaaggct

SEQ ID NO: 684473 - DNA, 25 bp, Mus musculus
gcctcctagggatgctggcaaggct

SEQ ID NO: 684474 - DNA, 25 bp, Mus musculus
gcctcctagtggagcgggcaaatct

SEQ ID NO: 684475 - DNA, 25 bp, Mus musculus
gcctcctagtggtgcgggcaaatct

SEQ ID NO: 684476 - DNA, 25 bp, Mus musculus
gcctcctatatgcagaaggtgaggc

SEQ ID NO: 684477 - DNA, 25 bp, Mus musculus
gcctcctatatggagaaggtgaggc

SEQ ID NO: 684478 - DNA, 25 bp, Mus musculus
gcctcctcagccagtggtcctgatg

SEQ ID NO: 684479 - DNA, 25 bp, Mus musculus
gcctcctcagcctgtggtcctgatg

SEQ ID NO: 684480 - DNA, 25 bp, Mus musculus
gcctcctcgcctagatcaatgaaga

SEQ ID NO: 684481 - DNA, 25 bp, Mus musculus
gcctcctcgccttgatcaatgaaga

SEQ ID NO: 684482 - DNA, 25 bp, Mus musculus
gcctcctctgctctagtgggaagtg

SEQ ID NO: 684483 - DNA, 25 bp, Mus musculus
gcctcctctgctgtagtgggaagtg

SEQ ID NO: 684484 - DNA, 25 bp, Mus musculus
gcctcctgaagaacatgagctgctt

SEQ ID NO: 684485 - DNA, 25 bp, Mus musculus
gcctcctgaagatcatgagctgctt

SEQ ID NO: 684486 - DNA, 25 bp, Mus musculus
gcctcctgaaggaaaaatagacctc

SEQ ID NO: 684487 - DNA, 25 bp, Mus musculus
gcctcctgaaggtaaaatagacctc

SEQ ID NO: 684488 - DNA, 25 bp, Mus musculus
gcctcctgagtcattgctgtgccaa

SEQ ID NO: 684489 - DNA, 25 bp, Mus musculus
gcctcctgagtctttgctgtgccaa

SEQ ID NO: 684490 - DNA, 25 bp, Mus musculus
gcctcctgccgcagctctgagagga

SEQ ID NO: 684491 - DNA, 25 bp, Mus musculus
gcctcctgccgctgctctgagagga

SEQ ID NO: 684492 - DNA, 25 bp, Mus musculus
gcctcctgctagagcgagttggaat

SEQ ID NO: 684493 - DNA, 25 bp, Mus musculus
gcctcctgctagtgcgagttggaat

SEQ ID NO: 684494 - DNA, 25 bp, Mus musculus
gcctcctgctgtcaccgtggcagag

SEQ ID NO: 684495 - DNA, 25 bp, Mus musculus
gcctcctgctgtgaccgtggcagag

SEQ ID NO: 684496 - DNA, 25 bp, Mus musculus
gcctcctggagcaataaaactggga

SEQ ID NO: 684497 - DNA, 25 bp, Mus musculus
gcctcctggagctataaaactggga

SEQ ID NO: 684498 - DNA, 25 bp, Mus musculus
gcctcctgggatccagactatgtta

SEQ ID NO: 684499 - DNA, 25 bp, Mus musculus
gcctcctgggatgcagactatgtta

SEQ ID NO: 684500 - DNA, 25 bp, Mus musculus
gcctcctggtggctgagactaatta

SEQ ID NO: 684501 - DNA, 25 bp, Mus musculus
gcctcctggtgggtgagactaatta

SEQ ID NO: 684502 - DNA, 25 bp, Mus musculus
gcctcctggttacttgaccttcttc

SEQ ID NO: 684503 - DNA, 25 bp, Mus musculus
gcctcctggttagttgaccttcttc

SEQ ID NO: 684504 - DNA, 25 bp, Mus musculus
gcctccttaaacatcgtgacaccta

SEQ ID NO: 684505 - DNA, 25 bp, Mus musculus
gcctccttaaacttcgtgacaccta

SEQ ID NO: 684506 - DNA, 25 bp, Mus musculus
gcctccttctttatgtctgcagagc

SEQ ID NO: 684507 - DNA, 25 bp, Mus musculus
gcctccttctttttgtctgcagagc

SEQ ID NO: 684508 - DNA, 25 bp, Mus musculus
gcctccttggccatcaagcctgtgt

SEQ ID NO: 684509 - DNA, 25 bp, Mus musculus
gcctccttggccttcaagcctgtgt

SEQ ID NO: 684510 - DNA, 25 bp, Mus musculus
gcctccttggttcgactgagatttg

SEQ ID NO: 684511 - DNA, 25 bp, Mus musculus
gcctccttggttggactgagatttg

SEQ ID NO: 684512 - DNA, 25 bp, Mus musculus
gcctcctttcctcagggagtgaagt

SEQ ID NO: 684513 - DNA, 25 bp, Mus musculus
gcctcctttcctgagggagtgaagt

SEQ ID NO: 684514 - DNA, 25 bp, Mus musculus
gcctcctttgcgacactttaagcgt

SEQ ID NO: 684515 - DNA, 25 bp, Mus musculus
gcctcctttgcgtcactttaagcgt

SEQ ID NO: 684516 - DNA, 25 bp, Mus musculus
gcctcgaaagagctaaggtctcctc

SEQ ID NO: 684517 - DNA, 25 bp, Mus musculus
gcctcgaaagaggtaaggtctcctc

SEQ ID NO: 684518 - DNA, 25 bp, Mus musculus
gcctcgacactgattggatcccaaa

SEQ ID NO: 684519 - DNA, 25 bp, Mus musculus
gcctcgacactgtttggatcccaaa

SEQ ID NO: 684520 - DNA, 25 bp, Mus musculus
gcctcgaccctaaaaatacaacttt

SEQ ID NO: 684521 - DNA, 25 bp, Mus musculus
gcctcgaccctataaatacaacttt

SEQ ID NO: 684522 - DNA, 25 bp, Mus musculus
gcctcgagaagacacggaccagctt

SEQ ID NO: 684523 - DNA, 25 bp, Mus musculus
gcctcgagaagagacggaccagctt

SEQ ID NO: 684524 - DNA, 25 bp, Mus musculus
gcctcgagatcgagccctggtaacg

SEQ ID NO: 684525 - DNA, 25 bp, Mus musculus
gcctcgagatcgtgccctggtaacg

SEQ ID NO: 684526 - DNA, 25 bp, Mus musculus
gcctcgaggattctgtttattcccc

SEQ ID NO: 684527 - DNA, 25 bp, Mus musculus
gcctcgaggattgtgtttattcccc

SEQ ID NO: 684528 - DNA, 25 bp, Mus musculus
gcctcgattaacaacgtattccttc

SEQ ID NO: 684529 - DNA, 25 bp, Mus musculus
gcctcgattaactacgtattccttc

SEQ ID NO: 684530 - DNA, 25 bp, Mus musculus
gcctcgcaaaggcactgttgtggct

SEQ ID NO: 684531 - DNA, 25 bp, Mus musculus
gcctcgcaaagggactgttgtggct

SEQ ID NO: 684532 - DNA, 25 bp, Mus musculus
gcctcgcccgggatacactggagca

SEQ ID NO: 684533 - DNA, 25 bp, Mus musculus
gcctcgcccgggttacactggagca

SEQ ID NO: 684534 - DNA, 25 bp, Mus musculus
gcctcgccgtccaggactaaggcag

SEQ ID NO: 684535 - DNA, 25 bp, Mus musculus
gcctcgccgtcctggactaaggcag

SEQ ID NO: 684536 - DNA, 25 bp, Mus musculus
gcctcgcgagcgcagttgactaccg

SEQ ID NO: 684537 - DNA, 25 bp, Mus musculus
gcctcgcgagcggagttgactaccg

SEQ ID NO: 684538 - DNA, 25 bp, Mus musculus
gcctcggaaaaacagaccgtcctat

SEQ ID NO: 684539 - DNA, 25 bp, Mus musculus
gcctcggaaaaagagaccgtcctat

SEQ ID NO: 684540 - DNA, 25 bp, Mus musculus
gcctcggaatcaatttactggaaat

SEQ ID NO: 684541 - DNA, 25 bp, Mus musculus
gcctcggaatcattttactggaaat

SEQ ID NO: 684542 - DNA, 25 bp, Mus musculus
gcctcggaatgccattaccacggga

SEQ ID NO: 684543 - DNA, 25 bp, Mus musculus
gcctcggaatgcgattaccacggga

SEQ ID NO: 684544 - DNA, 25 bp, Mus musculus
gcctcggagaaccatcaggagattt

SEQ ID NO: 684545 - DNA, 25 bp, Mus musculus
gcctcggagaacgatcaggagattt

SEQ ID NO: 684546 - DNA, 25 bp, Mus musculus
gcctcggatcctaggatctcttgca

SEQ ID NO: 684547 - DNA, 25 bp, Mus musculus
gcctcggatccttggatctcttgca

SEQ ID NO: 684548 - DNA, 25 bp, Mus musculus
gcctcggattacaaaggtgcacttc

SEQ ID NO: 684549 - DNA, 25 bp, Mus musculus
gcctcggattactaaggtgcacttc

SEQ ID NO: 684550 - DNA, 25 bp, Mus musculus
gcctcggcagctaccccaaaagaaa

SEQ ID NO: 684551 - DNA, 25 bp, Mus musculus
gcctcggcagcttccccaaaagaaa

SEQ ID NO: 684552 - DNA, 25 bp, Mus musculus
gcctcggcccaacaaaatggcgtcg

SEQ ID NO: 684553 - DNA, 25 bp, Mus musculus
gcctcggcccaagaaaatggcgtcg

SEQ ID NO: 684554 - DNA, 25 bp, Mus musculus
gcctcggccgcgcagtatggtttcc

SEQ ID NO: 684555 - DNA, 25 bp, Mus musculus
gcctcggccgcggagtatggtttcc

SEQ ID NO: 684556 - DNA, 25 bp, Mus musculus
gcctcggctcgcaggaaccatgtgt

SEQ ID NO: 684557 - DNA, 25 bp, Mus musculus
gcctcggctcgctggaaccatgtgt

SEQ ID NO: 684558 - DNA, 25 bp, Mus musculus
gcctcgggctacattgtcagcatcg

SEQ ID NO: 684559 - DNA, 25 bp, Mus musculus
gcctcgggctactttgtcagcatcg

SEQ ID NO: 684560 - DNA, 25 bp, Mus musculus
gcctcgggctcaagggattatactc

SEQ ID NO: 684561 - DNA, 25 bp, Mus musculus
gcctcgggctcatgggattatactc

SEQ ID NO: 684562 - DNA, 25 bp, Mus musculus
gcctcggtacagactcttcacacag

SEQ ID NO: 684563 - DNA, 25 bp, Mus musculus
gcctcggtacagtctcttcacacag

SEQ ID NO: 684564 - DNA, 25 bp, Mus musculus
gcctcggtgtggagtctagcattca

SEQ ID NO: 684565 - DNA, 25 bp, Mus musculus
gcctcggtgtggtgtctagcattca

SEQ ID NO: 684566 - DNA, 25 bp, Mus musculus
gcctcggttcttccttctggagaac

SEQ ID NO: 684567 - DNA, 25 bp, Mus musculus
gcctcggttcttgcttctggagaac

SEQ ID NO: 684568 - DNA, 25 bp, Mus musculus
gcctcggtttagatccactcaccgt

SEQ ID NO: 684569 - DNA, 25 bp, Mus musculus
gcctcggtttagttccactcaccgt

SEQ ID NO: 684570 - DNA, 25 bp, Mus musculus
gcctcgtaaagtcgctcattgagaa

SEQ ID NO: 684571 - DNA, 25 bp, Mus musculus
gcctcgtaaagtggctcattgagaa

SEQ ID NO: 684572 - DNA, 25 bp, Mus musculus
gcctcgtacagtatgtgcccaaaga

SEQ ID NO: 684573 - DNA, 25 bp, Mus musculus
gcctcgtacagtttgtgcccaaaga

SEQ ID NO: 684574 - DNA, 25 bp, Mus musculus
gcctcgtagtccagcccagatcttg

SEQ ID NO: 684575 - DNA, 25 bp, Mus musculus
gcctcgtagtcctgcccagatcttg

SEQ ID NO: 684576 - DNA, 25 bp, Mus musculus
gcctcgtcacaaagaattcaatcca

SEQ ID NO: 684577 - DNA, 25 bp, Mus musculus
gcctcgtcacaatgaattcaatcca

SEQ ID NO: 684578 - DNA, 25 bp, Mus musculus
gcctcgtcatgtatgtcatcctcag

SEQ ID NO: 684579 - DNA, 25 bp, Mus musculus
gcctcgtcatgtttgtcatcctcag

SEQ ID NO: 684580 - DNA, 25 bp, Mus musculus
gcctcgtgatttcggaccagcacct

SEQ ID NO: 684581 - DNA, 25 bp, Mus musculus
gcctcgtgatttgggaccagcacct

SEQ ID NO: 684582 - DNA, 25 bp, Mus musculus
gcctcgtggcctacgctgatagcta

SEQ ID NO: 684583 - DNA, 25 bp, Mus musculus
gcctcgtggccttcgctgatagcta

SEQ ID NO: 684584 - DNA, 25 bp, Mus musculus
gcctcgtggctgctgcttttgctat

SEQ ID NO: 684585 - DNA, 25 bp, Mus musculus
gcctcgtggctggtgcttttgctat

SEQ ID NO: 684586 - DNA, 25 bp, Mus musculus
gcctcgtgtaccaccagtcattgtc

SEQ ID NO: 684587 - DNA, 25 bp, Mus musculus
gcctcgtgtacctccagtcattgtc

SEQ ID NO: 684588 - DNA, 25 bp, Mus musculus
gcctcgtgttccagcctgtcctgtg

SEQ ID NO: 684589 - DNA, 25 bp, Mus musculus
gcctcgtgttcctgcctgtcctgtg

SEQ ID NO: 684590 - DNA, 25 bp, Mus musculus
gcctcgtttcccacctgtggcagga

SEQ ID NO: 684591 - DNA, 25 bp, Mus musculus
gcctcgtttccctcctgtggcagga

SEQ ID NO: 684592 - DNA, 25 bp, Mus musculus
gcctcgttttctccagtgtgtcctg

SEQ ID NO: 684593 - DNA, 25 bp, Mus musculus
gcctcgttttctgcagtgtgtcctg

SEQ ID NO: 684594 - DNA, 25 bp, Mus musculus
gcctctaatgcactgtctgagtcca

SEQ ID NO: 684595 - DNA, 25 bp, Mus musculus
gcctctaatgcagtgtctgagtcca

SEQ ID NO: 684596 - DNA, 25 bp, Mus musculus
gcctctacaactccagaggaggtct

SEQ ID NO: 684597 - DNA, 25 bp, Mus musculus
gcctctacaactgcagaggaggtct

SEQ ID NO: 684598 - DNA, 25 bp, Mus musculus
gcctctacaccactttgagtgatgt

SEQ ID NO: 684599 - DNA, 25 bp, Mus musculus
gcctctacaccagtttgagtgatgt

SEQ ID NO: 684600 - DNA, 25 bp, Mus musculus
gcctctacggtcacagtgcggtgca

SEQ ID NO: 684601 - DNA, 25 bp, Mus musculus
gcctctacggtctcagtgcggtgca

SEQ ID NO: 684602 - DNA, 25 bp, Mus musculus
gcctctagctttctgttcctgctct

SEQ ID NO: 684603 - DNA, 25 bp, Mus musculus
gcctctagctttgtgttcctgctct

SEQ ID NO: 684604 - DNA, 25 bp, Mus musculus
gcctctatgggtatgctagaagcaa

SEQ ID NO: 684605 - DNA, 25 bp, Mus musculus
gcctctatgggtttgctagaagcaa

SEQ ID NO: 684606 - DNA, 25 bp, Mus musculus
gcctctcaaactccaggtgctgtga

SEQ ID NO: 684607 - DNA, 25 bp, Mus musculus
gcctctcaaactgcaggtgctgtga

SEQ ID NO: 684608 - DNA, 25 bp, Mus musculus
gcctctcaacgtcgataaaaccttc

SEQ ID NO: 684609 - DNA, 25 bp, Mus musculus
gcctctcaacgtggataaaaccttc

SEQ ID NO: 684610 - DNA, 25 bp, Mus musculus
gcctctcaatggcacggacagctga

SEQ ID NO: 684611 - DNA, 25 bp, Mus musculus
gcctctcaatgggacggacagctga

SEQ ID NO: 684612 - DNA, 25 bp, Mus musculus
gcctctcatactaaatgaaagacga

SEQ ID NO: 684613 - DNA, 25 bp, Mus musculus
gcctctcatacttaatgaaagacga

SEQ ID NO: 684614 - DNA, 25 bp, Mus musculus
gcctctcatccccactgattgtaga

SEQ ID NO: 684615 - DNA, 25 bp, Mus musculus
gcctctcatcccgactgattgtaga

SEQ ID NO: 684616 - DNA, 25 bp, Mus musculus
gcctctccaggacggaatgtgacac

SEQ ID NO: 684617 - DNA, 25 bp, Mus musculus
gcctctccaggagggaatgtgacac

SEQ ID NO: 684618 - DNA, 25 bp, Mus musculus
gcctctccgtacaggtgaatgactg

SEQ ID NO: 684619 - DNA, 25 bp, Mus musculus
gcctctccgtactggtgaatgactg

SEQ ID NO: 684620 - DNA, 25 bp, Mus musculus
gcctctcgagacaagacagtcctga

SEQ ID NO: 684621 - DNA, 25 bp, Mus musculus
gcctctcgagactagacagtcctga

SEQ ID NO: 684622 - DNA, 25 bp, Mus musculus
gcctctcgcggtatctgggtttcag

SEQ ID NO: 684623 - DNA, 25 bp, Mus musculus
gcctctcgcggtttctgggtttcag

SEQ ID NO: 684624 - DNA, 25 bp, Mus musculus
gcctctcggcccagcattcagttag

SEQ ID NO: 684625 - DNA, 25 bp, Mus musculus
gcctctcggccctgcattcagttag

SEQ ID NO: 684626 - DNA, 25 bp, Mus musculus
gcctctcggtagaggtctgcctgga

SEQ ID NO: 684627 - DNA, 25 bp, Mus musculus
gcctctcggtagtggtctgcctgga

SEQ ID NO: 684628 - DNA, 25 bp, Mus musculus
gcctctcgtggcctcggcatgttcg

SEQ ID NO: 684629 - DNA, 25 bp, Mus musculus
gcctctcgtggcgtcggcatgttcg

SEQ ID NO: 684630 - DNA, 25 bp, Mus musculus
gcctctcgtttccttcagagtcagt

SEQ ID NO: 684631 - DNA, 25 bp, Mus musculus
gcctctcgtttcgttcagagtcagt

SEQ ID NO: 684632 - DNA, 25 bp, Mus musculus
gcctctctccatagaggagatagaa

SEQ ID NO: 684633 - DNA, 25 bp, Mus musculus
gcctctctccattgaggagatagaa

SEQ ID NO: 684634 - DNA, 25 bp, Mus musculus
gcctctctctgcaagaatgtctgag

SEQ ID NO: 684635 - DNA, 25 bp, Mus musculus
gcctctctctgctagaatgtctgag

SEQ ID NO: 684636 - DNA, 25 bp, Mus musculus
gcctctctgaagctctggacttgat

SEQ ID NO: 684637 - DNA, 25 bp, Mus musculus
gcctctctgaaggtctggacttgat

SEQ ID NO: 684638 - DNA, 25 bp, Mus musculus
gcctctctggcacctggtcacatgg

SEQ ID NO: 684639 - DNA, 25 bp, Mus musculus
gcctctctggcagctggtcacatgg

SEQ ID NO: 684640 - DNA, 25 bp, Mus musculus
gcctctcttgagagctaagccagga

SEQ ID NO: 684641 - DNA, 25 bp, Mus musculus
gcctctcttgagtgctaagccagga

SEQ ID NO: 684642 - DNA, 25 bp, Mus musculus
gcctctgaaactcgacacgagcttc

SEQ ID NO: 684643 - DNA, 25 bp, Mus musculus
gcctctgaaactggacacgagcttc

SEQ ID NO: 684644 - DNA, 25 bp, Mus musculus
gcctctgaaccacattttggcctat

SEQ ID NO: 684645 - DNA, 25 bp, Mus musculus
gcctctgaaccagattttggcctat

SEQ ID NO: 684646 - DNA, 25 bp, Mus musculus
gcctctgaagggaccaagaccaagt

SEQ ID NO: 684647 - DNA, 25 bp, Mus musculus
gcctctgaagggtccaagaccaagt

SEQ ID NO: 684648 - DNA, 25 bp, Mus musculus
gcctctgactttactgagccccagg

SEQ ID NO: 684649 - DNA, 25 bp, Mus musculus
gcctctgacttttctgagccccagg

SEQ ID NO: 684650 - DNA, 25 bp, Mus musculus
gcctctgagctccttcggctttttc

SEQ ID NO: 684651 - DNA, 25 bp, Mus musculus
gcctctgagctcgttcggctttttc

SEQ ID NO: 684652 - DNA, 25 bp, Mus musculus
gcctctgatcatcgcagtggtgctg

SEQ ID NO: 684653 - DNA, 25 bp, Mus musculus
gcctctgatcatggcagtggtgctg

SEQ ID NO: 684654 - DNA, 25 bp, Mus musculus
gcctctgatctaatgcctgtagcaa

SEQ ID NO: 684655 - DNA, 25 bp, Mus musculus
gcctctgatctattgcctgtagcaa

SEQ ID NO: 684656 - DNA, 25 bp, Mus musculus
gcctctgatcttctctccacgtggg

SEQ ID NO: 684657 - DNA, 25 bp, Mus musculus
gcctctgatcttgtctccacgtggg

SEQ ID NO: 684658 - DNA, 25 bp, Mus musculus
gcctctgatgccagtaaagaagtcg

SEQ ID NO: 684659 - DNA, 25 bp, Mus musculus
gcctctgatgcctgtaaagaagtcg

SEQ ID NO: 684660 - DNA, 25 bp, Mus musculus
gcctctgatgtaaccagaagatgtg

SEQ ID NO: 684661 - DNA, 25 bp, Mus musculus
gcctctgatgtatccagaagatgtg

SEQ ID NO: 684662 - DNA, 25 bp, Mus musculus
gcctctgcaaggactcggagtgcgt

SEQ ID NO: 684663 - DNA, 25 bp, Mus musculus
gcctctgcaaggtctcggagtgcgt

SEQ ID NO: 684664 - DNA, 25 bp, Mus musculus
gcctctgcacttaggagacggagga

SEQ ID NO: 684665 - DNA, 25 bp, Mus musculus
gcctctgcactttggagacggagga

SEQ ID NO: 684666 - DNA, 25 bp, Mus musculus
gcctctgcctgaagactattacacg

SEQ ID NO: 684667 - DNA, 25 bp, Mus musculus
gcctctgcctgatgactattacacg

SEQ ID NO: 684668 - DNA, 25 bp, Mus musculus
gcctctgcctgcctggttacacggg

SEQ ID NO: 684669 - DNA, 25 bp, Mus musculus
gcctctgcctgcgtggttacacggg

SEQ ID NO: 684670 - DNA, 25 bp, Mus musculus
gcctctgcttgtagttgtctgtgca

SEQ ID NO: 684671 - DNA, 25 bp, Mus musculus
gcctctgcttgttgttgtctgtgca

SEQ ID NO: 684672 - DNA, 25 bp, Mus musculus
gcctctggaaaacatgtccccaact

SEQ ID NO: 684673 - DNA, 25 bp, Mus musculus
gcctctggaaaagatgtccccaact

SEQ ID NO: 684674 - DNA, 25 bp, Mus musculus
gcctctggaggtcctgtcataacag

SEQ ID NO: 684675 - DNA, 25 bp, Mus musculus
gcctctggaggtgctgtcataacag

SEQ ID NO: 684676 - DNA, 25 bp, Mus musculus
gcctctggagtgagggataacaaaa

SEQ ID NO: 684677 - DNA, 25 bp, Mus musculus
gcctctggagtgtgggataacaaaa

SEQ ID NO: 684678 - DNA, 25 bp, Mus musculus
gcctctggagttctgcctagtcgaa

SEQ ID NO: 684679 - DNA, 25 bp, Mus musculus
gcctctggagttgtgcctagtcgaa

SEQ ID NO: 684680 - DNA, 25 bp, Mus musculus
gcctctggatacctttagaaggata

SEQ ID NO: 684681 - DNA, 25 bp, Mus musculus
gcctctggatacgtttagaaggata

SEQ ID NO: 684682 - DNA, 25 bp, Mus musculus
gcctctggccttcaaaatcgctggg

SEQ ID NO: 684683 - DNA, 25 bp, Mus musculus
gcctctggccttgaaaatcgctggg

SEQ ID NO: 684684 - DNA, 25 bp, Mus musculus
gcctctggtgcgctcctcttggtga

SEQ ID NO: 684685 - DNA, 25 bp, Mus musculus
gcctctggtgcggtcctcttggtga

SEQ ID NO: 684686 - DNA, 25 bp, Mus musculus
gcctctgtacatcaagacctgtctg

SEQ ID NO: 684687 - DNA, 25 bp, Mus musculus
gcctctgtacatgaagacctgtctg

SEQ ID NO: 684688 - DNA, 25 bp, Mus musculus
gcctctgtccaacagctactgagac

SEQ ID NO: 684689 - DNA, 25 bp, Mus musculus
gcctctgtccaagagctactgagac

SEQ ID NO: 684690 - DNA, 25 bp, Mus musculus
gcctctgtggccaggacctcaacaa

SEQ ID NO: 684691 - DNA, 25 bp, Mus musculus
gcctctgtggcctggacctcaacaa

SEQ ID NO: 684692 - DNA, 25 bp, Mus musculus
gcctctgtggtgctgttgctctttc

SEQ ID NO: 684693 - DNA, 25 bp, Mus musculus
gcctctgtggtggtgttgctctttc

SEQ ID NO: 684694 - DNA, 25 bp, Mus musculus
gcctctgttaacactgagcctttga

SEQ ID NO: 684695 - DNA, 25 bp, Mus musculus
gcctctgttaactctgagcctttga

SEQ ID NO: 684696 - DNA, 25 bp, Mus musculus
gcctctgtttatcatgaagcctgtg

SEQ ID NO: 684697 - DNA, 25 bp, Mus musculus
gcctctgtttatgatgaagcctgtg

SEQ ID NO: 684698 - DNA, 25 bp, Mus musculus
gcctctgttttgaggctaaaagctg

SEQ ID NO: 684699 - DNA, 25 bp, Mus musculus
gcctctgttttgtggctaaaagctg

SEQ ID NO: 684700 - DNA, 25 bp, Mus musculus
gcctcttacaaacccgtagttgcag

SEQ ID NO: 684701 - DNA, 25 bp, Mus musculus
gcctcttacaaagccgtagttgcag

SEQ ID NO: 684702 - DNA, 25 bp, Mus musculus
gcctcttcaagaccctgcagtgtgg

SEQ ID NO: 684703 - DNA, 25 bp, Mus musculus
gcctcttcaagagcctgcagtgtgg

SEQ ID NO: 684704 - DNA, 25 bp, Mus musculus
gcctcttcatatctagacagtgcac

SEQ ID NO: 684705 - DNA, 25 bp, Mus musculus
gcctcttcatatgtagacagtgcac

SEQ ID NO: 684706 - DNA, 25 bp, Mus musculus
gcctcttccgccaagggatgcagtg

SEQ ID NO: 684707 - DNA, 25 bp, Mus musculus
gcctcttccgcctagggatgcagtg

SEQ ID NO: 684708 - DNA, 25 bp, Mus musculus
gcctcttcgggcctgtagaccacga

SEQ ID NO: 684709 - DNA, 25 bp, Mus musculus
gcctcttcgggcgtgtagaccacga

SEQ ID NO: 684710 - DNA, 25 bp, Mus musculus
gcctcttctacgagtccatgctcaa

SEQ ID NO: 684711 - DNA, 25 bp, Mus musculus
gcctcttctacgatgttctttatag

SEQ ID NO: 684712 - DNA, 25 bp, Mus musculus
gcctcttctacgtgtccatgctcaa

SEQ ID NO: 684713 - DNA, 25 bp, Mus musculus
gcctcttctacgttgttctttatag

SEQ ID NO: 684714 - DNA, 25 bp, Mus musculus
gcctcttgacctacatggtacgaga

SEQ ID NO: 684715 - DNA, 25 bp, Mus musculus
gcctcttgaccttcatggtacgaga

SEQ ID NO: 684716 - DNA, 25 bp, Mus musculus
gcctcttgatgactactggtgacaa

SEQ ID NO: 684717 - DNA, 25 bp, Mus musculus
gcctcttgatgagtactggtgacaa

SEQ ID NO: 684718 - DNA, 25 bp, Mus musculus
gcctcttgcagtagagcctggcaca

SEQ ID NO: 684719 - DNA, 25 bp, Mus musculus
gcctcttgcagttgagcctggcaca

SEQ ID NO: 684720 - DNA, 25 bp, Mus musculus
gcctcttgctctcgactgttaatgg

SEQ ID NO: 684721 - DNA, 25 bp, Mus musculus
gcctcttgctctggactgttaatgg

SEQ ID NO: 684722 - DNA, 25 bp, Mus musculus
gcctcttggagaaggctgctttgga

SEQ ID NO: 684723 - DNA, 25 bp, Mus musculus
gcctcttggagatggctgctttgga

SEQ ID NO: 684724 - DNA, 25 bp, Mus musculus
gcctcttggtccacaggctgctcag

SEQ ID NO: 684725 - DNA, 25 bp, Mus musculus
gcctcttggtcctcaggctgctcag

SEQ ID NO: 684726 - DNA, 25 bp, Mus musculus
gcctcttgtccaagcaggcatattt

SEQ ID NO: 684727 - DNA, 25 bp, Mus musculus
gcctcttgtccatgcaggcatattt

SEQ ID NO: 684728 - DNA, 25 bp, Mus musculus
gcctctttattactatccatgacaa

SEQ ID NO: 684729 - DNA, 25 bp, Mus musculus
gcctctttattagtatccatgacaa

SEQ ID NO: 684730 - DNA, 25 bp, Mus musculus
gcctctttccggaatacaaggacaa

SEQ ID NO: 684731 - DNA, 25 bp, Mus musculus
gcctctttccggtatacaaggacaa

SEQ ID NO: 684732 - DNA, 25 bp, Mus musculus
gcctctttcgaaatagtgctgggat

SEQ ID NO: 684733 - DNA, 25 bp, Mus musculus
gcctctttcgaattagtgctgggat

SEQ ID NO: 684734 - DNA, 25 bp, Mus musculus
gcctctttcttcaccagcgatgagt

SEQ ID NO: 684735 - DNA, 25 bp, Mus musculus
gcctctttcttctccagcgatgagt

SEQ ID NO: 684736 - DNA, 25 bp, Mus musculus
gcctctttgcagcatcagtttttga

SEQ ID NO: 684737 - DNA, 25 bp, Mus musculus
gcctctttgcaggatcagtttttga

SEQ ID NO: 684738 - DNA, 25 bp, Mus musculus
gcctgaaaatgccaccttgtatcag

SEQ ID NO: 684739 - DNA, 25 bp, Mus musculus
gcctgaaaatgcgaccttgtatcag

SEQ ID NO: 684740 - DNA, 25 bp, Mus musculus
gcctgaaagcccaccgtgaaacaaa

SEQ ID NO: 684741 - DNA, 25 bp, Mus musculus
gcctgaaagccctccgtgaaacaaa

SEQ ID NO: 684742 - DNA, 25 bp, Mus musculus
gcctgaaagtatccgtaagtggaga

SEQ ID NO: 684743 - DNA, 25 bp, Mus musculus
gcctgaaagtatgcgtaagtggaga

SEQ ID NO: 684744 - DNA, 25 bp, Mus musculus
gcctgaacaaggcatggctggctcc

SEQ ID NO: 684745 - DNA, 25 bp, Mus musculus
gcctgaacaagggatggctggctcc

SEQ ID NO: 684746 - DNA, 25 bp, Mus musculus
gcctgaacaggcacttgctgactgc

SEQ ID NO: 684747 - DNA, 25 bp, Mus musculus
gcctgaacaggctcttgctgactgc

SEQ ID NO: 684748 - DNA, 25 bp, Mus musculus
gcctgaacatctatcagaacctgaa

SEQ ID NO: 684749 - DNA, 25 bp, Mus musculus
gcctgaacatctttcagaacctgaa

SEQ ID NO: 684750 - DNA, 25 bp, Mus musculus
gcctgaacatggatctgtccaggaa

SEQ ID NO: 684751 - DNA, 25 bp, Mus musculus
gcctgaacatggttctgtccaggaa

SEQ ID NO: 684752 - DNA, 25 bp, Mus musculus
gcctgaaccaagctgcctgccatga

SEQ ID NO: 684753 - DNA, 25 bp, Mus musculus
gcctgaaccaaggtgcctgccatga

SEQ ID NO: 684754 - DNA, 25 bp, Mus musculus
gcctgaacctcaaacacattaaaca

SEQ ID NO: 684755 - DNA, 25 bp, Mus musculus
gcctgaacctcatacacattaaaca

SEQ ID NO: 684756 - DNA, 25 bp, Mus musculus
gcctgaacgtctccagtctatttca

SEQ ID NO: 684757 - DNA, 25 bp, Mus musculus
gcctgaacgtctgcagtctatttca

SEQ ID NO: 684758 - DNA, 25 bp, Mus musculus
gcctgaagaaggcatgccatccctg

SEQ ID NO: 684759 - DNA, 25 bp, Mus musculus
gcctgaagaagggatgccatccctg

SEQ ID NO: 684760 - DNA, 25 bp, Mus musculus
gcctgaagaccaagagcaacggtgc

SEQ ID NO: 684761 - DNA, 25 bp, Mus musculus
gcctgaagaccatgagcaacggtgc

SEQ ID NO: 684762 - DNA, 25 bp, Mus musculus
gcctgaagaccccaaaagctgccag

SEQ ID NO: 684763 - DNA, 25 bp, Mus musculus
gcctgaagacccgaaaagctgccag

SEQ ID NO: 684764 - DNA, 25 bp, Mus musculus
gcctgaagagatctcatcactgaca

SEQ ID NO: 684765 - DNA, 25 bp, Mus musculus
gcctgaagagatgtcatcactgaca

SEQ ID NO: 684766 - DNA, 25 bp, Mus musculus
gcctgaagctcaattacctgcgcat

SEQ ID NO: 684767 - DNA, 25 bp, Mus musculus
gcctgaagctcatttacctgcgcat

SEQ ID NO: 684768 - DNA, 25 bp, Mus musculus
gcctgaagctgacaccaatggtgga

SEQ ID NO: 684769 - DNA, 25 bp, Mus musculus
gcctgaagctgagaccaatggtgga

SEQ ID NO: 684770 - DNA, 25 bp, Mus musculus
gcctgaaggaatcagagggcttcct

SEQ ID NO: 684771 - DNA, 25 bp, Mus musculus
gcctgaaggaatcgattccgacctc

SEQ ID NO: 684772 - DNA, 25 bp, Mus musculus
gcctgaaggaatgagagggcttcct

SEQ ID NO: 684773 - DNA, 25 bp, Mus musculus
gcctgaaggaatggattccgacctc

SEQ ID NO: 684774 - DNA, 25 bp, Mus musculus
gcctgaaggtccagcagtctgaggt

SEQ ID NO: 684775 - DNA, 25 bp, Mus musculus
gcctgaaggtcctgcagtctgaggt

SEQ ID NO: 684776 - DNA, 25 bp, Mus musculus
gcctgaaggtggagttaggactccc

SEQ ID NO: 684777 - DNA, 25 bp, Mus musculus
gcctgaaggtggtgttaggactccc

SEQ ID NO: 684778 - DNA, 25 bp, Mus musculus
gcctgaagtgaaattccagaagcag

SEQ ID NO: 684779 - DNA, 25 bp, Mus musculus
gcctgaagtgaatttccagaagcag

SEQ ID NO: 684780 - DNA, 25 bp, Mus musculus
gcctgaatccatcattgcagctgca

SEQ ID NO: 684781 - DNA, 25 bp, Mus musculus
gcctgaatccatgattgcagctgca

SEQ ID NO: 684782 - DNA, 25 bp, Mus musculus
gcctgaatgagcagaggcacaggca

SEQ ID NO: 684783 - DNA, 25 bp, Mus musculus
gcctgaatgagctgaggcacaggca

SEQ ID NO: 684784 - DNA, 25 bp, Mus musculus
gcctgaatgcttctcccagggcgtg

SEQ ID NO: 684785 - DNA, 25 bp, Mus musculus
gcctgaatgcttgtcccagggcgtg

SEQ ID NO: 684786 - DNA, 25 bp, Mus musculus
gcctgacaagggacacttcgggcca

SEQ ID NO: 684787 - DNA, 25 bp, Mus musculus
gcctgacaagggtcacttcgggcca

SEQ ID NO: 684788 - DNA, 25 bp, Mus musculus
gcctgacagagtaagatatgactcc

SEQ ID NO: 684789 - DNA, 25 bp, Mus musculus
gcctgacagagttagatatgactcc

SEQ ID NO: 684790 - DNA, 25 bp, Mus musculus
gcctgacatcgtcgcactgctaagg

SEQ ID NO: 684791 - DNA, 25 bp, Mus musculus
gcctgacatcgtggcactgctaagg

SEQ ID NO: 684792 - DNA, 25 bp, Mus musculus
gcctgaccaggtctctattctggac

SEQ ID NO: 684793 - DNA, 25 bp, Mus musculus
gcctgaccaggtgtctattctggac

SEQ ID NO: 684794 - DNA, 25 bp, Mus musculus
gcctgaccccagcagaagtatccag

SEQ ID NO: 684795 - DNA, 25 bp, Mus musculus
gcctgaccccaggagaagtatccag

SEQ ID NO: 684796 - DNA, 25 bp, Mus musculus
gcctgacccggtaatcagaatgggt

SEQ ID NO: 684797 - DNA, 25 bp, Mus musculus
gcctgacccggttatcagaatgggt

SEQ ID NO: 684798 - DNA, 25 bp, Mus musculus
gcctgaccctgaccttggatagcaa

SEQ ID NO: 684799 - DNA, 25 bp, Mus musculus
gcctgaccctgagcttggatagcaa

SEQ ID NO: 684800 - DNA, 25 bp, Mus musculus
gcctgacgcggacatggtactgcct

SEQ ID NO: 684801 - DNA, 25 bp, Mus musculus
gcctgacgcggagatggtactgcct

SEQ ID NO: 684802 - DNA, 25 bp, Mus musculus
gcctgacggagccacagcttggcct

SEQ ID NO: 684803 - DNA, 25 bp, Mus musculus
gcctgacggagcgacagcttggcct

SEQ ID NO: 684804 - DNA, 25 bp, Mus musculus
gcctgacggctcagtgcagtaccta

SEQ ID NO: 684805 - DNA, 25 bp, Mus musculus
gcctgacggctctgtgcagtaccta

SEQ ID NO: 684806 - DNA, 25 bp, Mus musculus
gcctgacggtgacaagcgggaagat

SEQ ID NO: 684807 - DNA, 25 bp, Mus musculus
gcctgacggtgagaagcgggaagat

SEQ ID NO: 684808 - DNA, 25 bp, Mus musculus
gcctgacggttcatacaggaaccca

SEQ ID NO: 684809 - DNA, 25 bp, Mus musculus
gcctgacggttcttacaggaaccca

SEQ ID NO: 684810 - DNA, 25 bp, Mus musculus
gcctgactatgacgccactagtcgg

SEQ ID NO: 684811 - DNA, 25 bp, Mus musculus
gcctgactatgaggccactagtcgg

SEQ ID NO: 684812 - DNA, 25 bp, Mus musculus
gcctgactgaaccaattaatctcac

SEQ ID NO: 684813 - DNA, 25 bp, Mus musculus
gcctgactgaacgaattaatctcac

SEQ ID NO: 684814 - DNA, 25 bp, Mus musculus
gcctgactgcttacaggttgtcaga

SEQ ID NO: 684815 - DNA, 25 bp, Mus musculus
gcctgactgctttcaggttgtcaga

SEQ ID NO: 684816 - DNA, 25 bp, Mus musculus
gcctgactttgccttcttggtctat

SEQ ID NO: 684817 - DNA, 25 bp, Mus musculus
gcctgactttgcgttcttggtctat

SEQ ID NO: 684818 - DNA, 25 bp, Mus musculus
gcctgagaaacaagattcaagaagg

SEQ ID NO: 684819 - DNA, 25 bp, Mus musculus
gcctgagaaacatgattcaagaagg

SEQ ID NO: 684820 - DNA, 25 bp, Mus musculus
gcctgagaattaacaagcggatcct

SEQ ID NO: 684821 - DNA, 25 bp, Mus musculus
gcctgagaattatcaagcggatcct

SEQ ID NO: 684822 - DNA, 25 bp, Mus musculus
gcctgagagtatctacgagacttgg

SEQ ID NO: 684823 - DNA, 25 bp, Mus musculus
gcctgagagtatgtacgagacttgg

SEQ ID NO: 684824 - DNA, 25 bp, Mus musculus
gcctgagagtgtagagcctctggca

SEQ ID NO: 684825 - DNA, 25 bp, Mus musculus
gcctgagagtgttgagcctctggca

SEQ ID NO: 684826 - DNA, 25 bp, Mus musculus
gcctgagatcctctggttcagaagg

SEQ ID NO: 684827 - DNA, 25 bp, Mus musculus
gcctgagatcctgtggttcagaagg

SEQ ID NO: 684828 - DNA, 25 bp, Mus musculus
gcctgagcaagcctgagacctagtt

SEQ ID NO: 684829 - DNA, 25 bp, Mus musculus
gcctgagcaagcgtgagacctagtt

SEQ ID NO: 684830 - DNA, 25 bp, Mus musculus
gcctgagcaatgcacaggtgctgaa

SEQ ID NO: 684831 - DNA, 25 bp, Mus musculus
gcctgagcaatggacaggtgctgaa

SEQ ID NO: 684832 - DNA, 25 bp, Mus musculus
gcctgagcaccaaggagacaccaag

SEQ ID NO: 684833 - DNA, 25 bp, Mus musculus
gcctgagcaccatggagacaccaag

SEQ ID NO: 684834 - DNA, 25 bp, Mus musculus
gcctgagccgaactggaacgttgtt

SEQ ID NO: 684835 - DNA, 25 bp, Mus musculus
gcctgagccgaagtggaacgttgtt

SEQ ID NO: 684836 - DNA, 25 bp, Mus musculus
gcctgagctcagactttgccaaagt

SEQ ID NO: 684837 - DNA, 25 bp, Mus musculus
gcctgagctcagtctttgccaaagt

SEQ ID NO: 684838 - DNA, 25 bp, Mus musculus
gcctgagctctcagccatatctggg

SEQ ID NO: 684839 - DNA, 25 bp, Mus musculus
gcctgagctctctgccatatctggg

SEQ ID NO: 684840 - DNA, 25 bp, Mus musculus
gcctgagctgtaagaacaaggatca

SEQ ID NO: 684841 - DNA, 25 bp, Mus musculus
gcctgagctgtatgaacaaggatca

SEQ ID NO: 684842 - DNA, 25 bp, Mus musculus
gcctgagctgtgactactttgctgt

SEQ ID NO: 684843 - DNA, 25 bp, Mus musculus
gcctgagctgtgtctactttgctgt

SEQ ID NO: 684844 - DNA, 25 bp, Mus musculus
gcctgaggactgaggatgtagaatc

SEQ ID NO: 684845 - DNA, 25 bp, Mus musculus
gcctgaggactgtggatgtagaatc

SEQ ID NO: 684846 - DNA, 25 bp, Mus musculus
gcctgaggatgtcgttgaacccttt

SEQ ID NO: 684847 - DNA, 25 bp, Mus musculus
gcctgaggatgtggttgaacccttt

SEQ ID NO: 684848 - DNA, 25 bp, Mus musculus
gcctgagggcctcctttctaaggga

SEQ ID NO: 684849 - DNA, 25 bp, Mus musculus
gcctgagggcctgctttctaaggga

SEQ ID NO: 684850 - DNA, 25 bp, Mus musculus
gcctgagggcggcaagatgccgcgc

SEQ ID NO: 684851 - DNA, 25 bp, Mus musculus
gcctgagggcgggaagatgccgcgc

SEQ ID NO: 684852 - DNA, 25 bp, Mus musculus
gcctgaggtctaagctcagtgagct

SEQ ID NO: 684853 - DNA, 25 bp, Mus musculus
gcctgaggtctatgctcagtgagct

SEQ ID NO: 684854 - DNA, 25 bp, Mus musculus
gcctgaggttttcccactgtagact

SEQ ID NO: 684855 - DNA, 25 bp, Mus musculus
gcctgaggttttgccactgtagact

SEQ ID NO: 684856 - DNA, 25 bp, Mus musculus
gcctgagtacatcgcaacgctgcct

SEQ ID NO: 684857 - DNA, 25 bp, Mus musculus
gcctgagtacatggcaacgctgcct

SEQ ID NO: 684858 - DNA, 25 bp, Mus musculus
gcctgagtatgtccactgtctgctg

SEQ ID NO: 684859 - DNA, 25 bp, Mus musculus
gcctgagtatgtgcactgtctgctg

SEQ ID NO: 684860 - DNA, 25 bp, Mus musculus
gcctgagtcctgacagcatcatgga

SEQ ID NO: 684861 - DNA, 25 bp, Mus musculus
gcctgagtcctgtcagcatcatgga

SEQ ID NO: 684862 - DNA, 25 bp, Mus musculus
gcctgagtcgcaccagcttggagct

SEQ ID NO: 684863 - DNA, 25 bp, Mus musculus
gcctgagtcgcagcagcttggagct

SEQ ID NO: 684864 - DNA, 25 bp, Mus musculus
gcctgagtcttcctaactagggaag

SEQ ID NO: 684865 - DNA, 25 bp, Mus musculus
gcctgagtcttcgtaactagggaag

SEQ ID NO: 684866 - DNA, 25 bp, Mus musculus
gcctgagtgagaagcaacgttccca

SEQ ID NO: 684867 - DNA, 25 bp, Mus musculus
gcctgagtgagatgcaacgttccca

SEQ ID NO: 684868 - DNA, 25 bp, Mus musculus
gcctgagtgagccaagacccttaat

SEQ ID NO: 684869 - DNA, 25 bp, Mus musculus
gcctgagtgagcgaagacccttaat

SEQ ID NO: 684870 - DNA, 25 bp, Mus musculus
gcctgagttcctcgcagagcaccgg

SEQ ID NO: 684871 - DNA, 25 bp, Mus musculus
gcctgagttcctggcagagcaccgg

SEQ ID NO: 684872 - DNA, 25 bp, Mus musculus
gcctgagttttcagcctaccctgag

SEQ ID NO: 684873 - DNA, 25 bp, Mus musculus
gcctgagttttctgcctaccctgag

SEQ ID NO: 684874 - DNA, 25 bp, Mus musculus
gcctgataagccaaccgtgagccag

SEQ ID NO: 684875 - DNA, 25 bp, Mus musculus
gcctgataagcctaccgtgagccag

SEQ ID NO: 684876 - DNA, 25 bp, Mus musculus
gcctgatattggagatctggaaagt

SEQ ID NO: 684877 - DNA, 25 bp, Mus musculus
gcctgatattggtgatctggaaagt

SEQ ID NO: 684878 - DNA, 25 bp, Mus musculus
gcctgatcatgcagagctgggctcg

SEQ ID NO: 684879 - DNA, 25 bp, Mus musculus
gcctgatcatgctgagctgggctcg

SEQ ID NO: 684880 - DNA, 25 bp, Mus musculus
gcctgatctaccagtttactcccaa

SEQ ID NO: 684881 - DNA, 25 bp, Mus musculus
gcctgatctacctgtttactcccaa

SEQ ID NO: 684882 - DNA, 25 bp, Mus musculus
gcctgatctgaccatgctttgagtg

SEQ ID NO: 684883 - DNA, 25 bp, Mus musculus
gcctgatctgacgatgctttgagtg

SEQ ID NO: 684884 - DNA, 25 bp, Mus musculus
gcctgatgaatgaagatgtcatgcc

SEQ ID NO: 684885 - DNA, 25 bp, Mus musculus
gcctgatgaatgtagatgtcatgcc

SEQ ID NO: 684886 - DNA, 25 bp, Mus musculus
gcctgatgaggcagcccttcacctt

SEQ ID NO: 684887 - DNA, 25 bp, Mus musculus
gcctgatgaggctgcccttcacctt

SEQ ID NO: 684888 - DNA, 25 bp, Mus musculus
gcctgatgcacaccatctacgaggt

SEQ ID NO: 684889 - DNA, 25 bp, Mus musculus
gcctgatgcacagcatctacgaggt

SEQ ID NO: 684890 - DNA, 25 bp, Mus musculus
gcctgatgcagtccataattcttat

SEQ ID NO: 684891 - DNA, 25 bp, Mus musculus
gcctgatgcagtccctcatggtgag

SEQ ID NO: 684892 - DNA, 25 bp, Mus musculus
gcctgatgcagtgcataattcttat

SEQ ID NO: 684893 - DNA, 25 bp, Mus musculus
gcctgatgcagtgcctcatggtgag

SEQ ID NO: 684894 - DNA, 25 bp, Mus musculus
gcctgatgccaaccaatgcctgcga

SEQ ID NO: 684895 - DNA, 25 bp, Mus musculus
gcctgatgccaagcaatgcctgcga

SEQ ID NO: 684896 - DNA, 25 bp, Mus musculus
gcctgatgcccaagctgatagactt

SEQ ID NO: 684897 - DNA, 25 bp, Mus musculus
gcctgatgcccatgctgatagactt

SEQ ID NO: 684898 - DNA, 25 bp, Mus musculus
gcctgatggtatcactgtggaagtc

SEQ ID NO: 684899 - DNA, 25 bp, Mus musculus
gcctgatggtatgactgtggaagtc

SEQ ID NO: 684900 - DNA, 25 bp, Mus musculus
gcctgatgtgttatgctacgtgagt

SEQ ID NO: 684901 - DNA, 25 bp, Mus musculus
gcctgatgtgttttgctacgtgagt

SEQ ID NO: 684902 - DNA, 25 bp, Mus musculus
gcctgattcaggaaacccggattct

SEQ ID NO: 684903 - DNA, 25 bp, Mus musculus
gcctgattcaggtaacccggattct

SEQ ID NO: 684904 - DNA, 25 bp, Mus musculus
gcctgattcgcccaggagtgcgcct

SEQ ID NO: 684905 - DNA, 25 bp, Mus musculus
gcctgattcgccgaggagtgcgcct

SEQ ID NO: 684906 - DNA, 25 bp, Mus musculus
gcctgattggtgatcaataaacaag

SEQ ID NO: 684907 - DNA, 25 bp, Mus musculus
gcctgattggtgttcaataaacaag

SEQ ID NO: 684908 - DNA, 25 bp, Mus musculus
gcctgcaaaacaatggcactaggag

SEQ ID NO: 684909 - DNA, 25 bp, Mus musculus
gcctgcaaaacattggcactaggag

SEQ ID NO: 684910 - DNA, 25 bp, Mus musculus
gcctgcaaccccaacctgggaagaa

SEQ ID NO: 684911 - DNA, 25 bp, Mus musculus
gcctgcaacccctacctgggaagaa

SEQ ID NO: 684912 - DNA, 25 bp, Mus musculus
gcctgcaactctcgctacaagctag

SEQ ID NO: 684913 - DNA, 25 bp, Mus musculus
gcctgcaactctggctacaagctag

SEQ ID NO: 684914 - DNA, 25 bp, Mus musculus
gcctgcaagaaacacgcctgcccaa

SEQ ID NO: 684915 - DNA, 25 bp, Mus musculus
gcctgcaagaaagacgcctgcccaa

SEQ ID NO: 684916 - DNA, 25 bp, Mus musculus
gcctgcaaggaaacagcacttacac

SEQ ID NO: 684917 - DNA, 25 bp, Mus musculus
gcctgcaaggaatcagcacttacac

SEQ ID NO: 684918 - DNA, 25 bp, Mus musculus
gcctgcaatgagaagtggatttata

SEQ ID NO: 684919 - DNA, 25 bp, Mus musculus
gcctgcaatgagtagtggatttata

SEQ ID NO: 684920 - DNA, 25 bp, Mus musculus
gcctgcaatgatcccacgctggttc

SEQ ID NO: 684921 - DNA, 25 bp, Mus musculus
gcctgcaatgatgccacgctggttc

SEQ ID NO: 684922 - DNA, 25 bp, Mus musculus
gcctgcaattccacacaataattat

SEQ ID NO: 684923 - DNA, 25 bp, Mus musculus
gcctgcaattcctcacaataattat

SEQ ID NO: 684924 - DNA, 25 bp, Mus musculus
gcctgcacaactctgtatttctaga

SEQ ID NO: 684925 - DNA, 25 bp, Mus musculus
gcctgcacaactgtgtatttctaga

SEQ ID NO: 684926 - DNA, 25 bp, Mus musculus
gcctgcaccagtcattcttcttcta

SEQ ID NO: 684927 - DNA, 25 bp, Mus musculus
gcctgcaccagtgattcttcttcta

SEQ ID NO: 684928 - DNA, 25 bp, Mus musculus
gcctgcacccagagtctgagcaagc

SEQ ID NO: 684929 - DNA, 25 bp, Mus musculus
gcctgcacccagtgtctgagcaagc

SEQ ID NO: 684930 - DNA, 25 bp, Mus musculus
gcctgcactaaacagcagaaccgag

SEQ ID NO: 684931 - DNA, 25 bp, Mus musculus
gcctgcactaaagagcagaaccgag

SEQ ID NO: 684932 - DNA, 25 bp, Mus musculus
gcctgcagaattctcagacccagtg

SEQ ID NO: 684933 - DNA, 25 bp, Mus musculus
gcctgcagaattgtcagacccagtg

SEQ ID NO: 684934 - DNA, 25 bp, Mus musculus
gcctgcagagcacgagaccaagttg

SEQ ID NO: 684935 - DNA, 25 bp, Mus musculus
gcctgcagagcaggagaccaagttg

SEQ ID NO: 684936 - DNA, 25 bp, Mus musculus
gcctgcagatgccaggacaagaagc

SEQ ID NO: 684937 - DNA, 25 bp, Mus musculus
gcctgcagatgcgaggacaagaagc

SEQ ID NO: 684938 - DNA, 25 bp, Mus musculus
gcctgcagctttactttttcgaaga

SEQ ID NO: 684939 - DNA, 25 bp, Mus musculus
gcctgcagcttttctttttcgaaga

SEQ ID NO: 684940 - DNA, 25 bp, Mus musculus
gcctgcaggaaaccaaaaccaacag

SEQ ID NO: 684941 - DNA, 25 bp, Mus musculus
gcctgcaggaaagcaaaaccaacag

SEQ ID NO: 684942 - DNA, 25 bp, Mus musculus
gcctgcaggaacaccagaagacgtt

SEQ ID NO: 684943 - DNA, 25 bp, Mus musculus
gcctgcaggaactccagaagacgtt

SEQ ID NO: 684944 - DNA, 25 bp, Mus musculus
gcctgcaggagaagacatccagcgt

SEQ ID NO: 684945 - DNA, 25 bp, Mus musculus
gcctgcaggagatgacatccagcgt

SEQ ID NO: 684946 - DNA, 25 bp, Mus musculus
gcctgcaggcctacagggacaaacc

SEQ ID NO: 684947 - DNA, 25 bp, Mus musculus
gcctgcaggccttcagggacaaacc

SEQ ID NO: 684948 - DNA, 25 bp, Mus musculus
gcctgcaggcgtacacagaagtgaa

SEQ ID NO: 684949 - DNA, 25 bp, Mus musculus
gcctgcaggcgttcacagaagtgaa

SEQ ID NO: 684950 - DNA, 25 bp, Mus musculus
gcctgcagggagacgcgtcgttctc

SEQ ID NO: 684951 - DNA, 25 bp, Mus musculus
gcctgcagggagtcgcgtcgttctc

SEQ ID NO: 684952 - DNA, 25 bp, Mus musculus
gcctgcagtaaaacctacagcattt

SEQ ID NO: 684953 - DNA, 25 bp, Mus musculus
gcctgcagtaaatcctacagcattt

SEQ ID NO: 684954 - DNA, 25 bp, Mus musculus
gcctgcagtgtgagtgtgaacacaa

SEQ ID NO: 684955 - DNA, 25 bp, Mus musculus
gcctgcagtgtgtgtgtgaacacaa

SEQ ID NO: 684956 - DNA, 25 bp, Mus musculus
gcctgcatacataccctgggaaaag

SEQ ID NO: 684957 - DNA, 25 bp, Mus musculus
gcctgcatacattccctgggaaaag

SEQ ID NO: 684958 - DNA, 25 bp, Mus musculus
gcctgcatcaggcaaaaggcagaag

SEQ ID NO: 684959 - DNA, 25 bp, Mus musculus
gcctgcatcagggaaaaggcagaag

SEQ ID NO: 684960 - DNA, 25 bp, Mus musculus
gcctgcatctccaacgccgtgggtt

SEQ ID NO: 684961 - DNA, 25 bp, Mus musculus
gcctgcatctcctacgccgtgggtt

SEQ ID NO: 684962 - DNA, 25 bp, Mus musculus
gcctgcatctgtcggcttcccagtg

SEQ ID NO: 684963 - DNA, 25 bp, Mus musculus
gcctgcatctgtgggcttcccagtg

SEQ ID NO: 684964 - DNA, 25 bp, Mus musculus
gcctgcatgaggcttatgacagcta

SEQ ID NO: 684965 - DNA, 25 bp, Mus musculus
gcctgcatgagggttatgacagcta

SEQ ID NO: 684966 - DNA, 25 bp, Mus musculus
gcctgcatggtaccaaaagccttgg

SEQ ID NO: 684967 - DNA, 25 bp, Mus musculus
gcctgcatggtagcaaaagccttgg

SEQ ID NO: 684968 - DNA, 25 bp, Mus musculus
gcctgcatggtgctgacagtcatct

SEQ ID NO: 684969 - DNA, 25 bp, Mus musculus
gcctgcatggtggtgacagtcatct

SEQ ID NO: 684970 - DNA, 25 bp, Mus musculus
gcctgcattgaacgtgtagtcctgc

SEQ ID NO: 684971 - DNA, 25 bp, Mus musculus
gcctgcattgaaggtgtagtcctgc

SEQ ID NO: 684972 - DNA, 25 bp, Mus musculus
gcctgccactcaactttgacttgta

SEQ ID NO: 684973 - DNA, 25 bp, Mus musculus
gcctgccactcatctttgacttgta

SEQ ID NO: 684974 - DNA, 25 bp, Mus musculus
gcctgccactggagaccggatatgc

SEQ ID NO: 684975 - DNA, 25 bp, Mus musculus
gcctgccactggtgaccggatatgc

SEQ ID NO: 684976 - DNA, 25 bp, Mus musculus
gcctgccagaaaacagatcacttcc

SEQ ID NO: 684977 - DNA, 25 bp, Mus musculus
gcctgccagaaatcagatcacttcc

SEQ ID NO: 684978 - DNA, 25 bp, Mus musculus
gcctgccagaacagagtgtggctca

SEQ ID NO: 684979 - DNA, 25 bp, Mus musculus
gcctgccagaactgagtgtggctca

SEQ ID NO: 684980 - DNA, 25 bp, Mus musculus
gcctgccatctaaaaatgtttctga

SEQ ID NO: 684981 - DNA, 25 bp, Mus musculus
gcctgccatctataaatgtttctga

SEQ ID NO: 684982 - DNA, 25 bp, Mus musculus
gcctgccccagtaggtcggagtctc

SEQ ID NO: 684983 - DNA, 25 bp, Mus musculus
gcctgccccagttggtcggagtctc

SEQ ID NO: 684984 - DNA, 25 bp, Mus musculus
gcctgccctgatcgcatgctgctgg

SEQ ID NO: 684985 - DNA, 25 bp, Mus musculus
gcctgccctgatggcatgctgctgg

SEQ ID NO: 684986 - DNA, 25 bp, Mus musculus
gcctgccctgggacttcgaggtcct

SEQ ID NO: 684987 - DNA, 25 bp, Mus musculus
gcctgccctgggtcttcgaggtcct

SEQ ID NO: 684988 - DNA, 25 bp, Mus musculus
gcctgccgattcatgaaatgcctca

SEQ ID NO: 684989 - DNA, 25 bp, Mus musculus
gcctgccgattcttgaaatgcctca

SEQ ID NO: 684990 - DNA, 25 bp, Mus musculus
gcctgccgcttcatcactggatact

SEQ ID NO: 684991 - DNA, 25 bp, Mus musculus
gcctgccgcttcttcactggatact

SEQ ID NO: 684992 - DNA, 25 bp, Mus musculus
gcctgccggaagacggctgcctgac

SEQ ID NO: 684993 - DNA, 25 bp, Mus musculus
gcctgccggaagtcggctgcctgac

SEQ ID NO: 684994 - DNA, 25 bp, Mus musculus
gcctgccgggccacgtgggtcacaa

SEQ ID NO: 684995 - DNA, 25 bp, Mus musculus
gcctgccgggcctcgtgggtcacaa

SEQ ID NO: 684996 - DNA, 25 bp, Mus musculus
gcctgccgggttcgagcattcatac

SEQ ID NO: 684997 - DNA, 25 bp, Mus musculus
gcctgccgggttggagcattcatac

SEQ ID NO: 684998 - DNA, 25 bp, Mus musculus
gcctgcctcaataaggacccacgat

SEQ ID NO: 684999 - DNA, 25 bp, Mus musculus
gcctgcctcaattaggacccacgat

SEQ ID NO: 685000 - DNA, 25 bp, Mus musculus
gcctgcctccatatgggatgacata

SEQ ID NO: 685001 - DNA, 25 bp, Mus musculus
gcctgcctccatttgggatgacata

SEQ ID NO: 685002 - DNA, 25 bp, Mus musculus
gcctgcctgaatcggactgtcctca

SEQ ID NO: 685003 - DNA, 25 bp, Mus musculus
gcctgcctgaatgggactgtcctca

SEQ ID NO: 685004 - DNA, 25 bp, Mus musculus
gcctgcctgactatgaagcccgtgt

SEQ ID NO: 685005 - DNA, 25 bp, Mus musculus
gcctgcctgactttgaagcccgtgt

SEQ ID NO: 685006 - DNA, 25 bp, Mus musculus
gcctgcctgctaaagagcctgatat

SEQ ID NO: 685007 - DNA, 25 bp, Mus musculus
gcctgcctgctacgctttttactga

SEQ ID NO: 685008 - DNA, 25 bp, Mus musculus
gcctgcctgctaggctttttactga

SEQ ID NO: 685009 - DNA, 25 bp, Mus musculus
gcctgcctgctatagagcctgatat

SEQ ID NO: 685010 - DNA, 25 bp, Mus musculus
gcctgcctgtacatcctggatcgga

SEQ ID NO: 685011 - DNA, 25 bp, Mus musculus
gcctgcctgtacttcctggatcgga

SEQ ID NO: 685012 - DNA, 25 bp, Mus musculus
gcctgccttcccaggcgaggacttg

SEQ ID NO: 685013 - DNA, 25 bp, Mus musculus
gcctgccttccctggcgaggacttg

SEQ ID NO: 685014 - DNA, 25 bp, Mus musculus
gcctgccttcctcgtggctgaagga

SEQ ID NO: 685015 - DNA, 25 bp, Mus musculus
gcctgccttcctggtggctgaagga

SEQ ID NO: 685016 - DNA, 25 bp, Mus musculus
gcctgcctttagctaagataattcc

SEQ ID NO: 685017 - DNA, 25 bp, Mus musculus
gcctgcctttaggtaagataattcc

SEQ ID NO: 685018 - DNA, 25 bp, Mus musculus
gcctgcctttctcctaagcattagg

SEQ ID NO: 685019 - DNA, 25 bp, Mus musculus
gcctgcctttctgctaagcattagg

SEQ ID NO: 685020 - DNA, 25 bp, Mus musculus
gcctgcgaatcacttcaaaagggaa

SEQ ID NO: 685021 - DNA, 25 bp, Mus musculus
gcctgcgaatcagttcaaaagggaa

SEQ ID NO: 685022 - DNA, 25 bp, Mus musculus
gcctgcgacaacagccggtccaaga

SEQ ID NO: 685023 - DNA, 25 bp, Mus musculus
gcctgcgacaactgccggtccaaga

SEQ ID NO: 685024 - DNA, 25 bp, Mus musculus
gcctgcgagccaatgtcctgttcaa

SEQ ID NO: 685025 - DNA, 25 bp, Mus musculus
gcctgcgagccattgtcctgttcaa

SEQ ID NO: 685026 - DNA, 25 bp, Mus musculus
gcctgcgcaccccatttagggaata

SEQ ID NO: 685027 - DNA, 25 bp, Mus musculus
gcctgcgcacccgatttagggaata

SEQ ID NO: 685028 - DNA, 25 bp, Mus musculus
gcctgcgcgcatacagcttgctctt

SEQ ID NO: 685029 - DNA, 25 bp, Mus musculus
gcctgcgcgcattcagcttgctctt

SEQ ID NO: 685030 - DNA, 25 bp, Mus musculus
gcctgcgctaccagaagtggagaag

SEQ ID NO: 685031 - DNA, 25 bp, Mus musculus
gcctgcgctacctgaagtggagaag

SEQ ID NO: 685032 - DNA, 25 bp, Mus musculus
gcctgcgctttgattgtccacccaa

SEQ ID NO: 685033 - DNA, 25 bp, Mus musculus
gcctgcgctttgtttgtccacccaa

SEQ ID NO: 685034 - DNA, 25 bp, Mus musculus
gcctgcggactcaaccataaaatga

SEQ ID NO: 685035 - DNA, 25 bp, Mus musculus
gcctgcggactctaccataaaatga

SEQ ID NO: 685036 - DNA, 25 bp, Mus musculus
gcctgcggcaatcggaattccagcc

SEQ ID NO: 685037 - DNA, 25 bp, Mus musculus
gcctgcggcaatgggaattccagcc

SEQ ID NO: 685038 - DNA, 25 bp, Mus musculus
gcctgcggccagctctgtacaagga

SEQ ID NO: 685039 - DNA, 25 bp, Mus musculus
gcctgcggccaggtctgtacaagga

SEQ ID NO: 685040 - DNA, 25 bp, Mus musculus
gcctgcggcctgacttggccattct

SEQ ID NO: 685041 - DNA, 25 bp, Mus musculus
gcctgcggcctgtcttggccattct

SEQ ID NO: 685042 - DNA, 25 bp, Mus musculus
gcctgcggtcgtaggcctcattcga

SEQ ID NO: 685043 - DNA, 25 bp, Mus musculus
gcctgcggtcgttggcctcattcga

SEQ ID NO: 685044 - DNA, 25 bp, Mus musculus
gcctgcgtacctagcagcacgtgct

SEQ ID NO: 685045 - DNA, 25 bp, Mus musculus
gcctgcgtaccttgcagcacgtgct

SEQ ID NO: 685046 - DNA, 25 bp, Mus musculus
gcctgcgtcctgattccttgagata

SEQ ID NO: 685047 - DNA, 25 bp, Mus musculus
gcctgcgtcctgtttccttgagata

SEQ ID NO: 685048 - DNA, 25 bp, Mus musculus
gcctgctaaaggatgccctccgtga

SEQ ID NO: 685049 - DNA, 25 bp, Mus musculus
gcctgctaaaggttgccctccgtga

SEQ ID NO: 685050 - DNA, 25 bp, Mus musculus
gcctgctaacaaagggactccctgt

SEQ ID NO: 685051 - DNA, 25 bp, Mus musculus
gcctgctaacaatgggactccctgt

SEQ ID NO: 685052 - DNA, 25 bp, Mus musculus
gcctgctaaccactggaagtggcca

SEQ ID NO: 685053 - DNA, 25 bp, Mus musculus
gcctgctaaccagtggaagtggcca

SEQ ID NO: 685054 - DNA, 25 bp, Mus musculus
gcctgctatggtctgcttcggttca

SEQ ID NO: 685055 - DNA, 25 bp, Mus musculus
gcctgctatggtgtgcttcggttca

SEQ ID NO: 685056 - DNA, 25 bp, Mus musculus
gcctgctccaatcatttccaagtag

SEQ ID NO: 685057 - DNA, 25 bp, Mus musculus
gcctgctccaatgatttccaagtag

SEQ ID NO: 685058 - DNA, 25 bp, Mus musculus
gcctgctcctgcaactctgtggaca

SEQ ID NO: 685059 - DNA, 25 bp, Mus musculus
gcctgctcctgctactctgtggaca

SEQ ID NO: 685060 - DNA, 25 bp, Mus musculus
gcctgctctcaacaaggcagatgtg

SEQ ID NO: 685061 - DNA, 25 bp, Mus musculus
gcctgctctcaagaaggcagatgtg

SEQ ID NO: 685062 - DNA, 25 bp, Mus musculus
gcctgctctcttactcttgcttctg

SEQ ID NO: 685063 - DNA, 25 bp, Mus musculus
gcctgctctctttctcttgcttctg

SEQ ID NO: 685064 - DNA, 25 bp, Mus musculus
gcctgctctgcgagtgtaggtacga

SEQ ID NO: 685065 - DNA, 25 bp, Mus musculus
gcctgctctgcgtgtgtaggtacga

SEQ ID NO: 685066 - DNA, 25 bp, Mus musculus
gcctgctgaaggagttcaatgacca

SEQ ID NO: 685067 - DNA, 25 bp, Mus musculus
gcctgctgaaggtgttcaatgacca

SEQ ID NO: 685068 - DNA, 25 bp, Mus musculus
gcctgctgctgcaatatgaggatat

SEQ ID NO: 685069 - DNA, 25 bp, Mus musculus
gcctgctgctgctatatgaggatat

SEQ ID NO: 685070 - DNA, 25 bp, Mus musculus
gcctgctggaaaagaaatgatccag

SEQ ID NO: 685071 - DNA, 25 bp, Mus musculus
gcctgctggaaatgaaatgatccag

SEQ ID NO: 685072 - DNA, 25 bp, Mus musculus
gcctgctggtgtccaacagccgtat

SEQ ID NO: 685073 - DNA, 25 bp, Mus musculus
gcctgctggtgtgcaacagccgtat

SEQ ID NO: 685074 - DNA, 25 bp, Mus musculus
gcctgctgtaccaggaactgggaaa

SEQ ID NO: 685075 - DNA, 25 bp, Mus musculus
gcctgctgtacctggaactgggaaa

SEQ ID NO: 685076 - DNA, 25 bp, Mus musculus
gcctgctgtcctcgagatagaccta

SEQ ID NO: 685077 - DNA, 25 bp, Mus musculus
gcctgctgtcctggagatagaccta

SEQ ID NO: 685078 - DNA, 25 bp, Mus musculus
gcctgctgtgcacacgcttgcaaag

SEQ ID NO: 685079 - DNA, 25 bp, Mus musculus
gcctgctgtgcagacgcttgcaaag

SEQ ID NO: 685080 - DNA, 25 bp, Mus musculus
gcctgctgtgctcgacaagcaggac

SEQ ID NO: 685081 - DNA, 25 bp, Mus musculus
gcctgctgtgctggacaagcaggac

SEQ ID NO: 685082 - DNA, 25 bp, Mus musculus
gcctgcttttgcctgtacactggct

SEQ ID NO: 685083 - DNA, 25 bp, Mus musculus
gcctgcttttgcgtgtacactggct

SEQ ID NO: 685084 - DNA, 25 bp, Mus musculus
gcctggaaacagacaccactcttgc

SEQ ID NO: 685085 - DNA, 25 bp, Mus musculus
gcctggaaacagtcaccactcttgc

SEQ ID NO: 685086 - DNA, 25 bp, Mus musculus
gcctggaaaccaccagttcagttca

SEQ ID NO: 685087 - DNA, 25 bp, Mus musculus
gcctggaaaccagcagttcagttca

SEQ ID NO: 685088 - DNA, 25 bp, Mus musculus
gcctggaacagcaggaatgccttga

SEQ ID NO: 685089 - DNA, 25 bp, Mus musculus
gcctggaacagcagtgacctcgggc

SEQ ID NO: 685090 - DNA, 25 bp, Mus musculus
gcctggaacagctggaatgccttga

SEQ ID NO: 685091 - DNA, 25 bp, Mus musculus
gcctggaacagctgtgacctcgggc

SEQ ID NO: 685092 - DNA, 25 bp, Mus musculus
gcctggaacccgaaccgatcgctgg

SEQ ID NO: 685093 - DNA, 25 bp, Mus musculus
gcctggaacccgtaccgatcgctgg

SEQ ID NO: 685094 - DNA, 25 bp, Mus musculus
gcctggaactcaagtaaaagggaga

SEQ ID NO: 685095 - DNA, 25 bp, Mus musculus
gcctggaactcatgtaaaagggaga

SEQ ID NO: 685096 - DNA, 25 bp, Mus musculus
gcctggaagggaaccctgtgtcctg

SEQ ID NO: 685097 - DNA, 25 bp, Mus musculus
gcctggaagggatccctgtgtcctg

SEQ ID NO: 685098 - DNA, 25 bp, Mus musculus
gcctggaagtgaataagtgtgagat

SEQ ID NO: 685099 - DNA, 25 bp, Mus musculus
gcctggaagtgattaagtgtgagat

SEQ ID NO: 685100 - DNA, 25 bp, Mus musculus
gcctggaatgaccttgatgccctgt

SEQ ID NO: 685101 - DNA, 25 bp, Mus musculus
gcctggaatgacgttgatgccctgt

SEQ ID NO: 685102 - DNA, 25 bp, Mus musculus
gcctggacaagaaggtccccgagga

SEQ ID NO: 685103 - DNA, 25 bp, Mus musculus
gcctggacaagatggtccccgagga

SEQ ID NO: 685104 - DNA, 25 bp, Mus musculus
gcctggacaaggaggtaacttggac

SEQ ID NO: 685105 - DNA, 25 bp, Mus musculus
gcctggacaaggtggtaacttggac

SEQ ID NO: 685106 - DNA, 25 bp, Mus musculus
gcctggacacagcaagaagatcgcc

SEQ ID NO: 685107 - DNA, 25 bp, Mus musculus
gcctggacacaggaagaagatcgcc

SEQ ID NO: 685108 - DNA, 25 bp, Mus musculus
gcctggacacctagctagcctgctt

SEQ ID NO: 685109 - DNA, 25 bp, Mus musculus
gcctggacaccttgctagcctgctt

SEQ ID NO: 685110 - DNA, 25 bp, Mus musculus
gcctggacatttcgacaaaccatgt

SEQ ID NO: 685111 - DNA, 25 bp, Mus musculus
gcctggacatttggacaaaccatgt

SEQ ID NO: 685112 - DNA, 25 bp, Mus musculus
gcctggaccccgaggaggtctacga

SEQ ID NO: 685113 - DNA, 25 bp, Mus musculus
gcctggaccccgtggaggtctacga

SEQ ID NO: 685114 - DNA, 25 bp, Mus musculus
gcctggacctccacttactttgggt

SEQ ID NO: 685115 - DNA, 25 bp, Mus musculus
gcctggacctcctcttactttgggt

SEQ ID NO: 685116 - DNA, 25 bp, Mus musculus
gcctggacgagccatcagtgaagac

SEQ ID NO: 685117 - DNA, 25 bp, Mus musculus
gcctggacgagcgatcagtgaagac

SEQ ID NO: 685118 - DNA, 25 bp, Mus musculus
gcctggacgagtatcaagtggccca

SEQ ID NO: 685119 - DNA, 25 bp, Mus musculus
gcctggacgagtttcaagtggccca

SEQ ID NO: 685120 - DNA, 25 bp, Mus musculus
gcctggacgatcagcctgaaaacct

SEQ ID NO: 685121 - DNA, 25 bp, Mus musculus
gcctggacgatctgcctgaaaacct

SEQ ID NO: 685122 - DNA, 25 bp, Mus musculus
gcctggactaaacatgagctaaaag

SEQ ID NO: 685123 - DNA, 25 bp, Mus musculus
gcctggactaaagatgagctaaaag

SEQ ID NO: 685124 - DNA, 25 bp, Mus musculus
gcctggactattacacgacccaggg

SEQ ID NO: 685125 - DNA, 25 bp, Mus musculus
gcctggactatttcacgacccaggg

SEQ ID NO: 685126 - DNA, 25 bp, Mus musculus
gcctggagactcatccagctggaaa

SEQ ID NO: 685127 - DNA, 25 bp, Mus musculus
gcctggagactcttccagctggaaa

SEQ ID NO: 685128 - DNA, 25 bp, Mus musculus
gcctggagatgcctgacaacctcta

SEQ ID NO: 685129 - DNA, 25 bp, Mus musculus
gcctggagatgcgtgacaacctcta

SEQ ID NO: 685130 - DNA, 25 bp, Mus musculus
gcctggagcattacacggtgacgtc

SEQ ID NO: 685131 - DNA, 25 bp, Mus musculus
gcctggagcatttcacggtgacgtc

SEQ ID NO: 685132 - DNA, 25 bp, Mus musculus
gcctggagccatcaagaacttcgtg

SEQ ID NO: 685133 - DNA, 25 bp, Mus musculus
gcctggagccatgaagaacttcgtg

SEQ ID NO: 685134 - DNA, 25 bp, Mus musculus
gcctggagcccaatgtcattggcct

SEQ ID NO: 685135 - DNA, 25 bp, Mus musculus
gcctggagcccattgtcattggcct

SEQ ID NO: 685136 - DNA, 25 bp, Mus musculus
gcctggagccttctactgcgagtgt

SEQ ID NO: 685137 - DNA, 25 bp, Mus musculus
gcctggagccttgtactgcgagtgt

SEQ ID NO: 685138 - DNA, 25 bp, Mus musculus
gcctggaggagcatcaatggcagct

SEQ ID NO: 685139 - DNA, 25 bp, Mus musculus
gcctggaggagcttcaatggcagct

SEQ ID NO: 685140 - DNA, 25 bp, Mus musculus
gcctggaggatgacaaacgtgagct

SEQ ID NO: 685141 - DNA, 25 bp, Mus musculus
gcctggaggatgtcaaacgtgagct

SEQ ID NO: 685142 - DNA, 25 bp, Mus musculus
gcctggagggcgcaagacctccctt

SEQ ID NO: 685143 - DNA, 25 bp, Mus musculus
gcctggagggcggaagacctccctt

SEQ ID NO: 685144 - DNA, 25 bp, Mus musculus
gcctggaggtctcccgcctgctgct

SEQ ID NO: 685145 - DNA, 25 bp, Mus musculus
gcctggaggtctgccgcctgctgct

SEQ ID NO: 685146 - DNA, 25 bp, Mus musculus
gcctggagtccaagcctcagctcta

SEQ ID NO: 685147 - DNA, 25 bp, Mus musculus
gcctggagtccatgcctcagctcta

SEQ ID NO: 685148 - DNA, 25 bp, Mus musculus
gcctggagtctacaaatgtcactga

SEQ ID NO: 685149 - DNA, 25 bp, Mus musculus
gcctggagtctagaaatgtcactga

SEQ ID NO: 685150 - DNA, 25 bp, Mus musculus
gcctggataaccaactgaaaccttg

SEQ ID NO: 685151 - DNA, 25 bp, Mus musculus
gcctggataaccactgaggcaggag

SEQ ID NO: 685152 - DNA, 25 bp, Mus musculus
gcctggataacctactgaaaccttg

SEQ ID NO: 685153 - DNA, 25 bp, Mus musculus
gcctggataacctctgaggcaggag

SEQ ID NO: 685154 - DNA, 25 bp, Mus musculus
gcctggatgaagattgatgcccaag

SEQ ID NO: 685155 - DNA, 25 bp, Mus musculus
gcctggatgaagtttgatgcccaag

SEQ ID NO: 685156 - DNA, 25 bp, Mus musculus
gcctggatgaccaaaaagctttaga

SEQ ID NO: 685157 - DNA, 25 bp, Mus musculus
gcctggatgacctaaaagctttaga

SEQ ID NO: 685158 - DNA, 25 bp, Mus musculus
gcctggatgaggcacccgtctctct

SEQ ID NO: 685159 - DNA, 25 bp, Mus musculus
gcctggatgagggacccgtctctct

SEQ ID NO: 685160 - DNA, 25 bp, Mus musculus
gcctggatgtctcggccataactgt

SEQ ID NO: 685161 - DNA, 25 bp, Mus musculus
gcctggatgtctgggccataactgt

SEQ ID NO: 685162 - DNA, 25 bp, Mus musculus
gcctggcaagtgattgcaacagaga

SEQ ID NO: 685163 - DNA, 25 bp, Mus musculus
gcctggcaagtgtttgcaacagaga

SEQ ID NO: 685164 - DNA, 25 bp, Mus musculus
gcctggcacatccacatcagcagat

SEQ ID NO: 685165 - DNA, 25 bp, Mus musculus
gcctggcacatcgacatcagcagat

SEQ ID NO: 685166 - DNA, 25 bp, Mus musculus
gcctggcaccctcaaatctgatgct

SEQ ID NO: 685167 - DNA, 25 bp, Mus musculus
gcctggcaccctgaaatctgatgct

SEQ ID NO: 685168 - DNA, 25 bp, Mus musculus
gcctggcactcaacaatgggacaca

SEQ ID NO: 685169 - DNA, 25 bp, Mus musculus
gcctggcactcatcaatgggacaca

SEQ ID NO: 685170 - DNA, 25 bp, Mus musculus
gcctggcagacaactatatccctat

SEQ ID NO: 685171 - DNA, 25 bp, Mus musculus
gcctggcagacatctatatccctat

SEQ ID NO: 685172 - DNA, 25 bp, Mus musculus
gcctggcagtatcggccttgtacag

SEQ ID NO: 685173 - DNA, 25 bp, Mus musculus
gcctggcagtatgggccttgtacag

SEQ ID NO: 685174 - DNA, 25 bp, Mus musculus
gcctggcagtcccagcaagactgta

SEQ ID NO: 685175 - DNA, 25 bp, Mus musculus
gcctggcagtccgagcaagactgta

SEQ ID NO: 685176 - DNA, 25 bp, Mus musculus
gcctggcagtgcagctccagacatc

SEQ ID NO: 685177 - DNA, 25 bp, Mus musculus
gcctggcagtgctgctccagacatc

SEQ ID NO: 685178 - DNA, 25 bp, Mus musculus
gcctggcattgactcatagcctagt

SEQ ID NO: 685179 - DNA, 25 bp, Mus musculus
gcctggcattgagtcatagcctagt

SEQ ID NO: 685180 - DNA, 25 bp, Mus musculus
gcctggccacagagatcagataccg

SEQ ID NO: 685181 - DNA, 25 bp, Mus musculus
gcctggccacagtgatcagataccg

SEQ ID NO: 685182 - DNA, 25 bp, Mus musculus
gcctggccaggacctaacgaagcag

SEQ ID NO: 685183 - DNA, 25 bp, Mus musculus
gcctggccaggagctaacgaagcag

SEQ ID NO: 685184 - DNA, 25 bp, Mus musculus
gcctggccagggatatcaacaacat

SEQ ID NO: 685185 - DNA, 25 bp, Mus musculus
gcctggccagggttatcaacaacat

SEQ ID NO: 685186 - DNA, 25 bp, Mus musculus
gcctggccagtacatccgctctgtg

SEQ ID NO: 685187 - DNA, 25 bp, Mus musculus
gcctggccagtagatccgctctgtg

SEQ ID NO: 685188 - DNA, 25 bp, Mus musculus
gcctggcccaacaagagaatctgtg

SEQ ID NO: 685189 - DNA, 25 bp, Mus musculus
gcctggcccaactagagaatctgtg

SEQ ID NO: 685190 - DNA, 25 bp, Mus musculus
gcctggccccagagctgtcattatg

SEQ ID NO: 685191 - DNA, 25 bp, Mus musculus
gcctggccccagtgctgtcattatg

SEQ ID NO: 685192 - DNA, 25 bp, Mus musculus
gcctggcccgagcaaatctttatac

SEQ ID NO: 685193 - DNA, 25 bp, Mus musculus
gcctggcccgaggaaatctttatac

SEQ ID NO: 685194 - DNA, 25 bp, Mus musculus
gcctggcccgccagaaggctgacta

SEQ ID NO: 685195 - DNA, 25 bp, Mus musculus
gcctggcccgcctgaaggctgacta

SEQ ID NO: 685196 - DNA, 25 bp, Mus musculus
gcctggcccggaaggcctgggaacg

SEQ ID NO: 685197 - DNA, 25 bp, Mus musculus
gcctggcccggatggcctgggaacg

SEQ ID NO: 685198 - DNA, 25 bp, Mus musculus
gcctggcccgtgattccctttgtat

SEQ ID NO: 685199 - DNA, 25 bp, Mus musculus
gcctggcccgtgtttccctttgtat

SEQ ID NO: 685200 - DNA, 25 bp, Mus musculus
gcctggccctcaaacagcttcaagt

SEQ ID NO: 685201 - DNA, 25 bp, Mus musculus
gcctggccctcatacagcttcaagt

SEQ ID NO: 685202 - DNA, 25 bp, Mus musculus
gcctggccgacaccgtcaaggagtt

SEQ ID NO: 685203 - DNA, 25 bp, Mus musculus
gcctggccgacagcgtcaaggagtt

SEQ ID NO: 685204 - DNA, 25 bp, Mus musculus
gcctggccgaggacagcttccatct

SEQ ID NO: 685205 - DNA, 25 bp, Mus musculus
gcctggccgaggtcagcttccatct

SEQ ID NO: 685206 - DNA, 25 bp, Mus musculus
gcctggccgcgtacttccatttgtg

SEQ ID NO: 685207 - DNA, 25 bp, Mus musculus
gcctggccgcgttcttccatttgtg

SEQ ID NO: 685208 - DNA, 25 bp, Mus musculus
gcctggccgggaagcttccaaagat

SEQ ID NO: 685209 - DNA, 25 bp, Mus musculus
gcctggccgggatgcttccaaagat

SEQ ID NO: 685210 - DNA, 25 bp, Mus musculus
gcctggccgtgtacatcgatcgcgt

SEQ ID NO: 685211 - DNA, 25 bp, Mus musculus
gcctggccgtgttcatcgatcgcgt

SEQ ID NO: 685212 - DNA, 25 bp, Mus musculus
gcctggcctctcagacgtctaggac

SEQ ID NO: 685213 - DNA, 25 bp, Mus musculus
gcctggcctctctgacgtctaggac

SEQ ID NO: 685214 - DNA, 25 bp, Mus musculus
gcctggccttctctgctattttaca

SEQ ID NO: 685215 - DNA, 25 bp, Mus musculus
gcctggccttctgtgctattttaca

SEQ ID NO: 685216 - DNA, 25 bp, Mus musculus
gcctggcgccgtcttgatagtttca

SEQ ID NO: 685217 - DNA, 25 bp, Mus musculus
gcctggcgccgtgttgatagtttca

SEQ ID NO: 685218 - DNA, 25 bp, Mus musculus
gcctggcggtcaagagcttctctcg

SEQ ID NO: 685219 - DNA, 25 bp, Mus musculus
gcctggcggtcatgagcttctctcg

SEQ ID NO: 685220 - DNA, 25 bp, Mus musculus
gcctggctacccaggaagtagcact

SEQ ID NO: 685221 - DNA, 25 bp, Mus musculus
gcctggctacccctttatggcagcg

SEQ ID NO: 685222 - DNA, 25 bp, Mus musculus
gcctggctacccgtttatggcagcg

SEQ ID NO: 685223 - DNA, 25 bp, Mus musculus
gcctggctaccctggaagtagcact

SEQ ID NO: 685224 - DNA, 25 bp, Mus musculus
gcctggctagggattttaggccctg

SEQ ID NO: 685225 - DNA, 25 bp, Mus musculus
gcctggctagggtttttaggccctg

SEQ ID NO: 685226 - DNA, 25 bp, Mus musculus
gcctggctccatctaacacatttgt

SEQ ID NO: 685227 - DNA, 25 bp, Mus musculus
gcctggctccatgtaacacatttgt

SEQ ID NO: 685228 - DNA, 25 bp, Mus musculus
gcctggctcgagatgtgcacaacct

SEQ ID NO: 685229 - DNA, 25 bp, Mus musculus
gcctggctcgagttgtgcacaacct

SEQ ID NO: 685230 - DNA, 25 bp, Mus musculus
gcctggctctggaaccttttaagaa

SEQ ID NO: 685231 - DNA, 25 bp, Mus musculus
gcctggctctggtaccttttaagaa

SEQ ID NO: 685232 - DNA, 25 bp, Mus musculus
gcctggctcttcatgctttccaagg

SEQ ID NO: 685233 - DNA, 25 bp, Mus musculus
gcctggctcttcttgctttccaagg

SEQ ID NO: 685234 - DNA, 25 bp, Mus musculus
gcctggctgatgctctatctgtgca

SEQ ID NO: 685235 - DNA, 25 bp, Mus musculus
gcctggctgatggtctatctgtgca

SEQ ID NO: 685236 - DNA, 25 bp, Mus musculus
gcctggctgctcattatctggagcc

SEQ ID NO: 685237 - DNA, 25 bp, Mus musculus
gcctggctgctctttatctggagcc

SEQ ID NO: 685238 - DNA, 25 bp, Mus musculus
gcctggcttcataacctcaggatat

SEQ ID NO: 685239 - DNA, 25 bp, Mus musculus
gcctggcttcattacctcaggatat

SEQ ID NO: 685240 - DNA, 25 bp, Mus musculus
gcctggcttcgtcattacctacaga

SEQ ID NO: 685241 - DNA, 25 bp, Mus musculus
gcctggcttcgtgattacctacaga

SEQ ID NO: 685242 - DNA, 25 bp, Mus musculus
gcctggctttcacccattggactag

SEQ ID NO: 685243 - DNA, 25 bp, Mus musculus
gcctggctttcagccattggactag

SEQ ID NO: 685244 - DNA, 25 bp, Mus musculus
gcctgggaaaagcagctgcatcatt

SEQ ID NO: 685245 - DNA, 25 bp, Mus musculus
gcctgggaaaaggagctgcatcatt

SEQ ID NO: 685246 - DNA, 25 bp, Mus musculus
gcctgggaacatcggtttccttgct

SEQ ID NO: 685247 - DNA, 25 bp, Mus musculus
gcctgggaacatgggtttccttgct

SEQ ID NO: 685248 - DNA, 25 bp, Mus musculus
gcctgggacccaactatctgcagat

SEQ ID NO: 685249 - DNA, 25 bp, Mus musculus
gcctgggacccaattcggactgcaa

SEQ ID NO: 685250 - DNA, 25 bp, Mus musculus
gcctgggacccatctatctgcagat

SEQ ID NO: 685251 - DNA, 25 bp, Mus musculus
gcctgggacccatttcggactgcaa

SEQ ID NO: 685252 - DNA, 25 bp, Mus musculus
gcctgggacgggagaaaacaatgat

SEQ ID NO: 685253 - DNA, 25 bp, Mus musculus
gcctgggacgggtgaaaacaatgat

SEQ ID NO: 685254 - DNA, 25 bp, Mus musculus
gcctgggactgaactcagggtgaca

SEQ ID NO: 685255 - DNA, 25 bp, Mus musculus
gcctgggactgatctcagggtgaca

SEQ ID NO: 685256 - DNA, 25 bp, Mus musculus
gcctgggagagacccagatgttccc

SEQ ID NO: 685257 - DNA, 25 bp, Mus musculus
gcctgggagagagccagatgttccc

SEQ ID NO: 685258 - DNA, 25 bp, Mus musculus
gcctgggatcttatgtgtcagagga

SEQ ID NO: 685259 - DNA, 25 bp, Mus musculus
gcctgggatcttttgtgtcagagga

SEQ ID NO: 685260 - DNA, 25 bp, Mus musculus
gcctgggcaaggagtggaccaccac

SEQ ID NO: 685261 - DNA, 25 bp, Mus musculus
gcctgggcaaggtgtggaccaccac

SEQ ID NO: 685262 - DNA, 25 bp, Mus musculus
gcctgggcactgatggctcacacta

SEQ ID NO: 685263 - DNA, 25 bp, Mus musculus
gcctgggcactgttggctcacacta

SEQ ID NO: 685264 - DNA, 25 bp, Mus musculus
gcctgggcagctacacccttttctt

SEQ ID NO: 685265 - DNA, 25 bp, Mus musculus
gcctgggcagcttcacccttttctt

SEQ ID NO: 685266 - DNA, 25 bp, Mus musculus
gcctgggcccagacttttgataacc

SEQ ID NO: 685267 - DNA, 25 bp, Mus musculus
gcctgggcccagtcttttgataacc

SEQ ID NO: 685268 - DNA, 25 bp, Mus musculus
gcctgggcctgaagctacacacagt

SEQ ID NO: 685269 - DNA, 25 bp, Mus musculus
gcctgggcctgatgctacacacagt

SEQ ID NO: 685270 - DNA, 25 bp, Mus musculus
gcctgggcctgcagtgccattttat

SEQ ID NO: 685271 - DNA, 25 bp, Mus musculus
gcctgggcctgctgtgccattttat

SEQ ID NO: 685272 - DNA, 25 bp, Mus musculus
gcctgggccttcctagctatgcaga

SEQ ID NO: 685273 - DNA, 25 bp, Mus musculus
gcctgggccttcgtagctatgcaga

SEQ ID NO: 685274 - DNA, 25 bp, Mus musculus
gcctgggcgtacagggcatcacagc

SEQ ID NO: 685275 - DNA, 25 bp, Mus musculus
gcctgggcgtactgggcatcacagc

SEQ ID NO: 685276 - DNA, 25 bp, Mus musculus
gcctgggctatacatggagatacta

SEQ ID NO: 685277 - DNA, 25 bp, Mus musculus
gcctgggctatagatggagatacta

SEQ ID NO: 685278 - DNA, 25 bp, Mus musculus
gcctgggctcaacgccttgtcactg

SEQ ID NO: 685279 - DNA, 25 bp, Mus musculus
gcctgggctcaaggccttgtcactg

SEQ ID NO: 685280 - DNA, 25 bp, Mus musculus
gcctgggtctggcaggagggcacaa

SEQ ID NO: 685281 - DNA, 25 bp, Mus musculus
gcctgggtctgggaggagggcacaa

SEQ ID NO: 685282 - DNA, 25 bp, Mus musculus
gcctgggtgccaacatgataatgga

SEQ ID NO: 685283 - DNA, 25 bp, Mus musculus
gcctgggtgccatcatgataatgga

SEQ ID NO: 685284 - DNA, 25 bp, Mus musculus
gcctgggtttctaggccgctgcgct

SEQ ID NO: 685285 - DNA, 25 bp, Mus musculus
gcctgggtttcttggccgctgcgct

SEQ ID NO: 685286 - DNA, 25 bp, Mus musculus
gcctggtacggcactgcaagcatgc

SEQ ID NO: 685287 - DNA, 25 bp, Mus musculus
gcctggtacggctctgcaagcatgc

SEQ ID NO: 685288 - DNA, 25 bp, Mus musculus
gcctggtactatacccacagatagg

SEQ ID NO: 685289 - DNA, 25 bp, Mus musculus
gcctggtactattcccacagatagg

SEQ ID NO: 685290 - DNA, 25 bp, Mus musculus
gcctggtagattcccagaggactcc

SEQ ID NO: 685291 - DNA, 25 bp, Mus musculus
gcctggtagattgccagaggactcc

SEQ ID NO: 685292 - DNA, 25 bp, Mus musculus
gcctggtattctccactattgacaa

SEQ ID NO: 685293 - DNA, 25 bp, Mus musculus
gcctggtattctgcactattgacaa

SEQ ID NO: 685294 - DNA, 25 bp, Mus musculus
gcctggtcaacaagtggagcacatt

SEQ ID NO: 685295 - DNA, 25 bp, Mus musculus
gcctggtcaacatgtggagcacatt

SEQ ID NO: 685296 - DNA, 25 bp, Mus musculus
gcctggtcctgtactctatgagtag

SEQ ID NO: 685297 - DNA, 25 bp, Mus musculus
gcctggtcctgttctctatgagtag

SEQ ID NO: 685298 - DNA, 25 bp, Mus musculus
gcctggtcgaccaggttccccagga

SEQ ID NO: 685299 - DNA, 25 bp, Mus musculus
gcctggtcgacctggttccccagga

SEQ ID NO: 685300 - DNA, 25 bp, Mus musculus
gcctggtctcaacgacactgcgtgg

SEQ ID NO: 685301 - DNA, 25 bp, Mus musculus
gcctggtctcaaggacactgcgtgg

SEQ ID NO: 685302 - DNA, 25 bp, Mus musculus
gcctggtctccaagctagcccgaga

SEQ ID NO: 685303 - DNA, 25 bp, Mus musculus
gcctggtctccatgctagcccgaga

SEQ ID NO: 685304 - DNA, 25 bp, Mus musculus
gcctggtctccgatatgactgtgaa

SEQ ID NO: 685305 - DNA, 25 bp, Mus musculus
gcctggtctccgttatgactgtgaa

SEQ ID NO: 685306 - DNA, 25 bp, Mus musculus
gcctggtgaaagaagggctggtcat

SEQ ID NO: 685307 - DNA, 25 bp, Mus musculus
gcctggtgaaagtagggctggtcat

SEQ ID NO: 685308 - DNA, 25 bp, Mus musculus
gcctggtgactgagaagccctgtta

SEQ ID NO: 685309 - DNA, 25 bp, Mus musculus
gcctggtgactgtgaagccctgtta

SEQ ID NO: 685310 - DNA, 25 bp, Mus musculus
gcctggtgatacacacataaccact

SEQ ID NO: 685311 - DNA, 25 bp, Mus musculus
gcctggtgatactcacataaccact

SEQ ID NO: 685312 - DNA, 25 bp, Mus musculus
gcctggtgcgagcacttgccgaaaa

SEQ ID NO: 685313 - DNA, 25 bp, Mus musculus
gcctggtgcgaggacttgccgaaaa

SEQ ID NO: 685314 - DNA, 25 bp, Mus musculus
gcctggtgcgccagggccttcctag

SEQ ID NO: 685315 - DNA, 25 bp, Mus musculus
gcctggtgcgcctgggccttcctag

SEQ ID NO: 685316 - DNA, 25 bp, Mus musculus
gcctggtgctctctaagacatacag

SEQ ID NO: 685317 - DNA, 25 bp, Mus musculus
gcctggtgctctgtaagacatacag

SEQ ID NO: 685318 - DNA, 25 bp, Mus musculus
gcctggtgctgaccatccgggaaaa

SEQ ID NO: 685319 - DNA, 25 bp, Mus musculus
gcctggtgctgagcatccgggaaaa

SEQ ID NO: 685320 - DNA, 25 bp, Mus musculus
gcctggtgctggctcttcgcaaaac

SEQ ID NO: 685321 - DNA, 25 bp, Mus musculus
gcctggtgctgggtcttcgcaaaac

SEQ ID NO: 685322 - DNA, 25 bp, Mus musculus
gcctggtggaccctctggagaccat

SEQ ID NO: 685323 - DNA, 25 bp, Mus musculus
gcctggtggaccgtctggagaccat

SEQ ID NO: 685324 - DNA, 25 bp, Mus musculus
gcctggtgggctctgtctcaatgat

SEQ ID NO: 685325 - DNA, 25 bp, Mus musculus
gcctggtgggctgtgtctcaatgat

SEQ ID NO: 685326 - DNA, 25 bp, Mus musculus
gcctggtggtgtatctcggacactc

SEQ ID NO: 685327 - DNA, 25 bp, Mus musculus
gcctggtggtgtttctcggacactc

SEQ ID NO: 685328 - DNA, 25 bp, Mus musculus
gcctggtgtacaccgtcaccgacgt

SEQ ID NO: 685329 - DNA, 25 bp, Mus musculus
gcctggtgtacagcgtcaccgacgt

SEQ ID NO: 685330 - DNA, 25 bp, Mus musculus
gcctggtgtccacacaatgacaatg

SEQ ID NO: 685331 - DNA, 25 bp, Mus musculus
gcctggtgtccagacaatgacaatg

SEQ ID NO: 685332 - DNA, 25 bp, Mus musculus
gcctggtgtcccagtctatgctgtc

SEQ ID NO: 685333 - DNA, 25 bp, Mus musculus
gcctggtgtccctgtctatgctgtc

SEQ ID NO: 685334 - DNA, 25 bp, Mus musculus
gcctggtgtggaacctgattgcctc

SEQ ID NO: 685335 - DNA, 25 bp, Mus musculus
gcctggtgtggatcctgattgcctc

SEQ ID NO: 685336 - DNA, 25 bp, Mus musculus
gcctggtgtgttaaactttgtcaac

SEQ ID NO: 685337 - DNA, 25 bp, Mus musculus
gcctggtgtgtttaactttgtcaac

SEQ ID NO: 685338 - DNA, 25 bp, Mus musculus
gcctggttgaggacaacggcgtcaa

SEQ ID NO: 685339 - DNA, 25 bp, Mus musculus
gcctggttgaggtcaacggcgtcaa

SEQ ID NO: 685340 - DNA, 25 bp, Mus musculus
gcctggttgcagaagtgcctaaaga

SEQ ID NO: 685341 - DNA, 25 bp, Mus musculus
gcctggttgcagtagtgcctaaaga

SEQ ID NO: 685342 - DNA, 25 bp, Mus musculus
gcctggttgttgcaaacagtcaagt

SEQ ID NO: 685343 - DNA, 25 bp, Mus musculus
gcctggttgttggaaacagtcaagt

SEQ ID NO: 685344 - DNA, 25 bp, Mus musculus
gcctggttttagaacctccaagaag

SEQ ID NO: 685345 - DNA, 25 bp, Mus musculus
gcctggttttagtacctccaagaag

SEQ ID NO: 685346 - DNA, 25 bp, Mus musculus
gcctgtaaaatcaatcgttcaatgg

SEQ ID NO: 685347 - DNA, 25 bp, Mus musculus
gcctgtaaaatctatcgttcaatgg

SEQ ID NO: 685348 - DNA, 25 bp, Mus musculus
gcctgtaaacctcataaccaatatg

SEQ ID NO: 685349 - DNA, 25 bp, Mus musculus
gcctgtaaacctgataaccaatatg

SEQ ID NO: 685350 - DNA, 25 bp, Mus musculus
gcctgtacggagatcaatctgacct

SEQ ID NO: 685351 - DNA, 25 bp, Mus musculus
gcctgtacggagttcaatctgacct

SEQ ID NO: 685352 - DNA, 25 bp, Mus musculus
gcctgtactgtgatctagagataag

SEQ ID NO: 685353 - DNA, 25 bp, Mus musculus
gcctgtactgtgttctagagataag

SEQ ID NO: 685354 - DNA, 25 bp, Mus musculus
gcctgtagacagaggtgctcctcac

SEQ ID NO: 685355 - DNA, 25 bp, Mus musculus
gcctgtagacagtggtgctcctcac

SEQ ID NO: 685356 - DNA, 25 bp, Mus musculus
gcctgtagctggacgatttgccctg

SEQ ID NO: 685357 - DNA, 25 bp, Mus musculus
gcctgtagctggtcgatttgccctg

SEQ ID NO: 685358 - DNA, 25 bp, Mus musculus
gcctgtagctttcctgatgaagaaa

SEQ ID NO: 685359 - DNA, 25 bp, Mus musculus
gcctgtagctttgctgatgaagaaa

SEQ ID NO: 685360 - DNA, 25 bp, Mus musculus
gcctgtagtgatagttgaagcatct

SEQ ID NO: 685361 - DNA, 25 bp, Mus musculus
gcctgtagtgattgttgaagcatct

SEQ ID NO: 685362 - DNA, 25 bp, Mus musculus
gcctgtatatggatacactcctttg

SEQ ID NO: 685363 - DNA, 25 bp, Mus musculus
gcctgtatatggttacactcctttg

SEQ ID NO: 685364 - DNA, 25 bp, Mus musculus
gcctgtatcaggcttggcttcccct

SEQ ID NO: 685365 - DNA, 25 bp, Mus musculus
gcctgtatcagggttggcttcccct

SEQ ID NO: 685366 - DNA, 25 bp, Mus musculus
gcctgtatcctcacttccaaatgaa

SEQ ID NO: 685367 - DNA, 25 bp, Mus musculus
gcctgtatcctctcttccaaatgaa

SEQ ID NO: 685368 - DNA, 25 bp, Mus musculus
gcctgtatctaccttgctgcccgga

SEQ ID NO: 685369 - DNA, 25 bp, Mus musculus
gcctgtatctacgttgctgcccgga

SEQ ID NO: 685370 - DNA, 25 bp, Mus musculus
gcctgtatcttcacactactttgca

SEQ ID NO: 685371 - DNA, 25 bp, Mus musculus
gcctgtatcttctcactactttgca

SEQ ID NO: 685372 - DNA, 25 bp, Mus musculus
gcctgtatgagaaggacaacaccta

SEQ ID NO: 685373 - DNA, 25 bp, Mus musculus
gcctgtatgagatggacaacaccta

SEQ ID NO: 685374 - DNA, 25 bp, Mus musculus
gcctgtatgtaaagcctgcggcctc

SEQ ID NO: 685375 - DNA, 25 bp, Mus musculus
gcctgtatgtaatgcctgcggcctc

SEQ ID NO: 685376 - DNA, 25 bp, Mus musculus
gcctgtatgtgcatgcttctctgga

SEQ ID NO: 685377 - DNA, 25 bp, Mus musculus
gcctgtatgtgcttgcttctctgga

SEQ ID NO: 685378 - DNA, 25 bp, Mus musculus
gcctgtatgtggcagaataccacag

SEQ ID NO: 685379 - DNA, 25 bp, Mus musculus
gcctgtatgtgggagaataccacag

SEQ ID NO: 685380 - DNA, 25 bp, Mus musculus
gcctgtattatgagtccctgtgtgg

SEQ ID NO: 685381 - DNA, 25 bp, Mus musculus
gcctgtattatgtgtccctgtgtgg

SEQ ID NO: 685382 - DNA, 25 bp, Mus musculus
gcctgtcaatggaccgcgcggccgt

SEQ ID NO: 685383 - DNA, 25 bp, Mus musculus
gcctgtcaatggtccgcgcggccgt

SEQ ID NO: 685384 - DNA, 25 bp, Mus musculus
gcctgtcaccgtcgccgtgaagatg

SEQ ID NO: 685385 - DNA, 25 bp, Mus musculus
gcctgtcaccgtggccgtgaagatg

SEQ ID NO: 685386 - DNA, 25 bp, Mus musculus
gcctgtcagaacatatcgatatcag

SEQ ID NO: 685387 - DNA, 25 bp, Mus musculus
gcctgtcagaacttatcgatatcag

SEQ ID NO: 685388 - DNA, 25 bp, Mus musculus
gcctgtcagaagaacttcgagatga

SEQ ID NO: 685389 - DNA, 25 bp, Mus musculus
gcctgtcagaagtacttcgagatga

SEQ ID NO: 685390 - DNA, 25 bp, Mus musculus
gcctgtcagcttattctcctcgaga

SEQ ID NO: 685391 - DNA, 25 bp, Mus musculus
gcctgtcagctttttctcctcgaga

SEQ ID NO: 685392 - DNA, 25 bp, Mus musculus
gcctgtcagtcaacatgggctgtaa

SEQ ID NO: 685393 - DNA, 25 bp, Mus musculus
gcctgtcagtcatcatgggctgtaa

SEQ ID NO: 685394 - DNA, 25 bp, Mus musculus
gcctgtcccagaaaaggtccctgag

SEQ ID NO: 685395 - DNA, 25 bp, Mus musculus
gcctgtcccagataaggtccctgag

SEQ ID NO: 685396 - DNA, 25 bp, Mus musculus
gcctgtccccagacatctatgacag

SEQ ID NO: 685397 - DNA, 25 bp, Mus musculus
gcctgtccccagtcatctatgacag

SEQ ID NO: 685398 - DNA, 25 bp, Mus musculus
gcctgtccgagaagcatccgcggcg

SEQ ID NO: 685399 - DNA, 25 bp, Mus musculus
gcctgtccgagatgcatccgcggcg

SEQ ID NO: 685400 - DNA, 25 bp, Mus musculus
gcctgtcctatgagtgtgtcactgg

SEQ ID NO: 685401 - DNA, 25 bp, Mus musculus
gcctgtcctatgtgtgtgtcactgg

SEQ ID NO: 685402 - DNA, 25 bp, Mus musculus
gcctgtcctcttaaaaaacacatct

SEQ ID NO: 685403 - DNA, 25 bp, Mus musculus
gcctgtcctctttaaaaacacatct

SEQ ID NO: 685404 - DNA, 25 bp, Mus musculus
gcctgtccttgtcgataccagagga

SEQ ID NO: 685405 - DNA, 25 bp, Mus musculus
gcctgtccttgtggataccagagga

SEQ ID NO: 685406 - DNA, 25 bp, Mus musculus
gcctgtcgagctacatttcccggcg

SEQ ID NO: 685407 - DNA, 25 bp, Mus musculus
gcctgtcgagcttcatttcccggcg

SEQ ID NO: 685408 - DNA, 25 bp, Mus musculus
gcctgtctacatcattatggaactg

SEQ ID NO: 685409 - DNA, 25 bp, Mus musculus
gcctgtctacatgattatggaactg

SEQ ID NO: 685410 - DNA, 25 bp, Mus musculus
gcctgtctccgaagtaacgccatga

SEQ ID NO: 685411 - DNA, 25 bp, Mus musculus
gcctgtctccgatgtaacgccatga

SEQ ID NO: 685412 - DNA, 25 bp, Mus musculus
gcctgtctcgctagtgcagaaaaca

SEQ ID NO: 685413 - DNA, 25 bp, Mus musculus
gcctgtctcgcttgtgcagaaaaca

SEQ ID NO: 685414 - DNA, 25 bp, Mus musculus
gcctgtctgacgactggagatgtga

SEQ ID NO: 685415 - DNA, 25 bp, Mus musculus
gcctgtctgacgtctggagatgtga

SEQ ID NO: 685416 - DNA, 25 bp, Mus musculus
gcctgtctgtgcagagtctggatac

SEQ ID NO: 685417 - DNA, 25 bp, Mus musculus
gcctgtctgtgctgagtctggatac

SEQ ID NO: 685418 - DNA, 25 bp, Mus musculus
gcctgtctgtgtacccgtccatgca

SEQ ID NO: 685419 - DNA, 25 bp, Mus musculus
gcctgtctgtgttcccgtccatgca

SEQ ID NO: 685420 - DNA, 25 bp, Mus musculus
gcctgtcttaacctgcatcatgaag

SEQ ID NO: 685421 - DNA, 25 bp, Mus musculus
gcctgtcttaacgtgcatcatgaag

SEQ ID NO: 685422 - DNA, 25 bp, Mus musculus
gcctgtgaacacaccagtgaggcca

SEQ ID NO: 685423 - DNA, 25 bp, Mus musculus
gcctgtgaacactccagtgaggcca

SEQ ID NO: 685424 - DNA, 25 bp, Mus musculus
gcctgtgaattaccacgtgcaggag

SEQ ID NO: 685425 - DNA, 25 bp, Mus musculus
gcctgtgaattagcacgtgcaggag

SEQ ID NO: 685426 - DNA, 25 bp, Mus musculus
gcctgtgacaacagtccccagaaag

SEQ ID NO: 685427 - DNA, 25 bp, Mus musculus
gcctgtgacaactgtccccagaaag

SEQ ID NO: 685428 - DNA, 25 bp, Mus musculus
gcctgtgactgtctggaggtctatc

SEQ ID NO: 685429 - DNA, 25 bp, Mus musculus
gcctgtgactgtgtggaggtctatc

SEQ ID NO: 685430 - DNA, 25 bp, Mus musculus
gcctgtgagaaaatctccaacaaca

SEQ ID NO: 685431 - DNA, 25 bp, Mus musculus
gcctgtgagaaattctccaacaaca

SEQ ID NO: 685432 - DNA, 25 bp, Mus musculus
gcctgtgagaccatgggcaatgcca

SEQ ID NO: 685433 - DNA, 25 bp, Mus musculus
gcctgtgagaccttgggcaatgcca

SEQ ID NO: 685434 - DNA, 25 bp, Mus musculus
gcctgtgagacgagaatagaccatt

SEQ ID NO: 685435 - DNA, 25 bp, Mus musculus
gcctgtgagacgtgaatagaccatt

SEQ ID NO: 685436 - DNA, 25 bp, Mus musculus
gcctgtgagcatctttggatatttc

SEQ ID NO: 685437 - DNA, 25 bp, Mus musculus
gcctgtgagcatgtttggatatttc

SEQ ID NO: 685438 - DNA, 25 bp, Mus musculus
gcctgtgagggcacacgttgcatca

SEQ ID NO: 685439 - DNA, 25 bp, Mus musculus
gcctgtgagggctcacgttgcatca

SEQ ID NO: 685440 - DNA, 25 bp, Mus musculus
gcctgtgagtccatcacggagatca

SEQ ID NO: 685441 - DNA, 25 bp, Mus musculus
gcctgtgagtccttcacggagatca

SEQ ID NO: 685442 - DNA, 25 bp, Mus musculus
gcctgtgatggtaacttgggtgaga

SEQ ID NO: 685443 - DNA, 25 bp, Mus musculus
gcctgtgatggttacttgggtgaga

SEQ ID NO: 685444 - DNA, 25 bp, Mus musculus
gcctgtgcagctaacagaagcagag

SEQ ID NO: 685445 - DNA, 25 bp, Mus musculus
gcctgtgcagcttacagaagcagag

SEQ ID NO: 685446 - DNA, 25 bp, Mus musculus
gcctgtgcaggtcactgccatccag

SEQ ID NO: 685447 - DNA, 25 bp, Mus musculus
gcctgtgcaggtcgaagccaacttg

SEQ ID NO: 685448 - DNA, 25 bp, Mus musculus
gcctgtgcaggtgactgccatccag

SEQ ID NO: 685449 - DNA, 25 bp, Mus musculus
gcctgtgcaggtggaagccaacttg

SEQ ID NO: 685450 - DNA, 25 bp, Mus musculus
gcctgtgccagaatcccattcctgt

SEQ ID NO: 685451 - DNA, 25 bp, Mus musculus
gcctgtgccagattcccattcctgt

SEQ ID NO: 685452 - DNA, 25 bp, Mus musculus
gcctgtgcccacacagtctgtggct

SEQ ID NO: 685453 - DNA, 25 bp, Mus musculus
gcctgtgcccactcagtctgtggct

SEQ ID NO: 685454 - DNA, 25 bp, Mus musculus
gcctgtgcccatacgcaggaagaga

SEQ ID NO: 685455 - DNA, 25 bp, Mus musculus
gcctgtgcccattcgcaggaagaga

SEQ ID NO: 685456 - DNA, 25 bp, Mus musculus
gcctgtgccgctcttacgaagagaa

SEQ ID NO: 685457 - DNA, 25 bp, Mus musculus
gcctgtgccgctgttacgaagagaa

SEQ ID NO: 685458 - DNA, 25 bp, Mus musculus
gcctgtgccggtatgtctacccttc

SEQ ID NO: 685459 - DNA, 25 bp, Mus musculus
gcctgtgccggtttgtctacccttc

SEQ ID NO: 685460 - DNA, 25 bp, Mus musculus
gcctgtgcggacacgcctgcgtgac

SEQ ID NO: 685461 - DNA, 25 bp, Mus musculus
gcctgtgcggactcgcctgcgtgac

SEQ ID NO: 685462 - DNA, 25 bp, Mus musculus
gcctgtgcttatcccgtgatgtcac

SEQ ID NO: 685463 - DNA, 25 bp, Mus musculus
gcctgtgcttatgccgtgatgtcac

SEQ ID NO: 685464 - DNA, 25 bp, Mus musculus
gcctgtggaagaaatacggtgacaa

SEQ ID NO: 685465 - DNA, 25 bp, Mus musculus
gcctgtggaagatatacggtgacaa

SEQ ID NO: 685466 - DNA, 25 bp, Mus musculus
gcctgtggccagattcatgccagga

SEQ ID NO: 685467 - DNA, 25 bp, Mus musculus
gcctgtggccagtttcatgccagga

SEQ ID NO: 685468 - DNA, 25 bp, Mus musculus
gcctgtgggcgtctgtggacagatc

SEQ ID NO: 685469 - DNA, 25 bp, Mus musculus
gcctgtgggcgtgtgtggacagatc

SEQ ID NO: 685470 - DNA, 25 bp, Mus musculus
gcctgtgggctgaactacaagcttc

SEQ ID NO: 685471 - DNA, 25 bp, Mus musculus
gcctgtgggctgtactacaagcttc

SEQ ID NO: 685472 - DNA, 25 bp, Mus musculus
gcctgtgggcttacgttttcagtct

SEQ ID NO: 685473 - DNA, 25 bp, Mus musculus
gcctgtgggcttctgtagtgatcct

SEQ ID NO: 685474 - DNA, 25 bp, Mus musculus
gcctgtgggcttgtgtagtgatcct

SEQ ID NO: 685475 - DNA, 25 bp, Mus musculus
gcctgtgggctttcgttttcagtct

SEQ ID NO: 685476 - DNA, 25 bp, Mus musculus
gcctgtgtctagctcttcctgggag

SEQ ID NO: 685477 - DNA, 25 bp, Mus musculus
gcctgtgtctaggtcttcctgggag

SEQ ID NO: 685478 - DNA, 25 bp, Mus musculus
gcctgtgtctatcgtctggcccgaa

SEQ ID NO: 685479 - DNA, 25 bp, Mus musculus
gcctgtgtctatggtctggcccgaa

SEQ ID NO: 685480 - DNA, 25 bp, Mus musculus
gcctgtgtctccacactattgtcgc

SEQ ID NO: 685481 - DNA, 25 bp, Mus musculus
gcctgtgtctcctcactattgtcgc

SEQ ID NO: 685482 - DNA, 25 bp, Mus musculus
gcctgtgtggtcagcctctccggga

SEQ ID NO: 685483 - DNA, 25 bp, Mus musculus
gcctgtgtggtctgcctctccggga

SEQ ID NO: 685484 - DNA, 25 bp, Mus musculus
gcctgtgtgtctacccagcggcgcg

SEQ ID NO: 685485 - DNA, 25 bp, Mus musculus
gcctgtgtgtcttcccagcggcgcg

SEQ ID NO: 685486 - DNA, 25 bp, Mus musculus
gcctgttaaagcctgagtctgacct

SEQ ID NO: 685487 - DNA, 25 bp, Mus musculus
gcctgttaaagcgtgagtctgacct

SEQ ID NO: 685488 - DNA, 25 bp, Mus musculus
gcctgttccacgctatggatataaa

SEQ ID NO: 685489 - DNA, 25 bp, Mus musculus
gcctgttccacggtatggatataaa

SEQ ID NO: 685490 - DNA, 25 bp, Mus musculus
gcctgttcctggaggcagcgcacga

SEQ ID NO: 685491 - DNA, 25 bp, Mus musculus
gcctgttcctggtggcagcgcacga

SEQ ID NO: 685492 - DNA, 25 bp, Mus musculus
gcctgttctcaaagtttgtaaccat

SEQ ID NO: 685493 - DNA, 25 bp, Mus musculus
gcctgttctcaatgtttgtaaccat

SEQ ID NO: 685494 - DNA, 25 bp, Mus musculus
gcctgttctgccataaataagtgag

SEQ ID NO: 685495 - DNA, 25 bp, Mus musculus
gcctgttctgccttaaataagtgag

SEQ ID NO: 685496 - DNA, 25 bp, Mus musculus
gcctgttctgtaagcaagtttcgta

SEQ ID NO: 685497 - DNA, 25 bp, Mus musculus
gcctgttctgtatgcaagtttcgta

SEQ ID NO: 685498 - DNA, 25 bp, Mus musculus
gcctgttcttaccaggaggagaaag

SEQ ID NO: 685499 - DNA, 25 bp, Mus musculus
gcctgttcttacgaggaggagaaag

SEQ ID NO: 685500 - DNA, 25 bp, Mus musculus
gcctgttcttttctcccctgtagga

SEQ ID NO: 685501 - DNA, 25 bp, Mus musculus
gcctgttcttttgtcccctgtagga

SEQ ID NO: 685502 - DNA, 25 bp, Mus musculus
gcctgttgaaacctatcgatgtgga

SEQ ID NO: 685503 - DNA, 25 bp, Mus musculus
gcctgttgaaacgtatcgatgtgga

SEQ ID NO: 685504 - DNA, 25 bp, Mus musculus
gcctgttgaagacaaggtcggtccc

SEQ ID NO: 685505 - DNA, 25 bp, Mus musculus
gcctgttgaagagaaggtcggtccc

SEQ ID NO: 685506 - DNA, 25 bp, Mus musculus
gcctgttgacaacgacttctactca

SEQ ID NO: 685507 - DNA, 25 bp, Mus musculus
gcctgttgacaaggacttctactca

SEQ ID NO: 685508 - DNA, 25 bp, Mus musculus
gcctgttgaccgactgccagtgaga

SEQ ID NO: 685509 - DNA, 25 bp, Mus musculus
gcctgttgaccgtctgccagtgaga

SEQ ID NO: 685510 - DNA, 25 bp, Mus musculus
gcctgttggtcaatggtgaccccaa

SEQ ID NO: 685511 - DNA, 25 bp, Mus musculus
gcctgttggtcattggtgaccccaa

SEQ ID NO: 685512 - DNA, 25 bp, Mus musculus
gcctgtttatctcctgtgggaagaa

SEQ ID NO: 685513 - DNA, 25 bp, Mus musculus
gcctgtttatctgctgtgggaagaa

SEQ ID NO: 685514 - DNA, 25 bp, Mus musculus
gcctgtttccttcccttgtcttcat

SEQ ID NO: 685515 - DNA, 25 bp, Mus musculus
gcctgtttccttgccttgtcttcat

SEQ ID NO: 685516 - DNA, 25 bp, Mus musculus
gcctgtttctgaatacattaatgca

SEQ ID NO: 685517 - DNA, 25 bp, Mus musculus
gcctgtttctgattacattaatgca

SEQ ID NO: 685518 - DNA, 25 bp, Mus musculus
gcctgtttgcctaccgcgaaaagaa

SEQ ID NO: 685519 - DNA, 25 bp, Mus musculus
gcctgtttgccttccgcgaaaagaa

SEQ ID NO: 685520 - DNA, 25 bp, Mus musculus
gcctgttttagacgctgactgggaa

SEQ ID NO: 685521 - DNA, 25 bp, Mus musculus
gcctgttttagaggctgactgggaa

SEQ ID NO: 685522 - DNA, 25 bp, Mus musculus
gcctgttttgccaaaagtgtctata

SEQ ID NO: 685523 - DNA, 25 bp, Mus musculus
gcctgttttgcctaaagtgtctata

SEQ ID NO: 685524 - DNA, 25 bp, Mus musculus
gccttaaacacgacaaagaccagat

SEQ ID NO: 685525 - DNA, 25 bp, Mus musculus
gccttaaacacgtcaaagaccagat

SEQ ID NO: 685526 - DNA, 25 bp, Mus musculus
gccttaaacataaggcaagccctca

SEQ ID NO: 685527 - DNA, 25 bp, Mus musculus
gccttaaacatatggcaagccctca

SEQ ID NO: 685528 - DNA, 25 bp, Mus musculus
gccttaaaccagatataaattccat

SEQ ID NO: 685529 - DNA, 25 bp, Mus musculus
gccttaaaccagttataaattccat

SEQ ID NO: 685530 - DNA, 25 bp, Mus musculus
gccttaaacctgcacagtcagaagg

SEQ ID NO: 685531 - DNA, 25 bp, Mus musculus
gccttaaacctggacagtcagaagg

SEQ ID NO: 685532 - DNA, 25 bp, Mus musculus
gccttaaatcagcagacatagttca

SEQ ID NO: 685533 - DNA, 25 bp, Mus musculus
gccttaaatcaggagacatagttca

SEQ ID NO: 685534 - DNA, 25 bp, Mus musculus
gccttaacagagctcaccatttgaa

SEQ ID NO: 685535 - DNA, 25 bp, Mus musculus
gccttaacagaggtcaccatttgaa

SEQ ID NO: 685536 - DNA, 25 bp, Mus musculus
gccttaaccgacaaggtcactgact

SEQ ID NO: 685537 - DNA, 25 bp, Mus musculus
gccttaaccgactaggtcactgact

SEQ ID NO: 685538 - DNA, 25 bp, Mus musculus
gccttaagtgtgaaagtaatgacag

SEQ ID NO: 685539 - DNA, 25 bp, Mus musculus
gccttaagtgtgtaagtaatgacag

SEQ ID NO: 685540 - DNA, 25 bp, Mus musculus
gccttaatctcacggcgctaatcct

SEQ ID NO: 685541 - DNA, 25 bp, Mus musculus
gccttaatctcagggcgctaatcct

SEQ ID NO: 685542 - DNA, 25 bp, Mus musculus
gccttacagaatcaatgcatacagc

SEQ ID NO: 685543 - DNA, 25 bp, Mus musculus
gccttacagaatgaatgcatacagc

SEQ ID NO: 685544 - DNA, 25 bp, Mus musculus
gccttacctgagagtgtcacttccg

SEQ ID NO: 685545 - DNA, 25 bp, Mus musculus
gccttacctgagtgtgtcacttccg

SEQ ID NO: 685546 - DNA, 25 bp, Mus musculus
gccttacgatcgagcagtggactgg

SEQ ID NO: 685547 - DNA, 25 bp, Mus musculus
gccttacgatcgtgcagtggactgg

SEQ ID NO: 685548 - DNA, 25 bp, Mus musculus
gccttacggcacaggacttactcca

SEQ ID NO: 685549 - DNA, 25 bp, Mus musculus
gccttacggcactggacttactcca

SEQ ID NO: 685550 - DNA, 25 bp, Mus musculus
gccttacggtgtatataagaatcac

SEQ ID NO: 685551 - DNA, 25 bp, Mus musculus
gccttacggtgtttataagaatcac

SEQ ID NO: 685552 - DNA, 25 bp, Mus musculus
gccttactcatgcattataatgagg

SEQ ID NO: 685553 - DNA, 25 bp, Mus musculus
gccttactcatggattataatgagg

SEQ ID NO: 685554 - DNA, 25 bp, Mus musculus
gccttacttagacattgcgaaccag

SEQ ID NO: 685555 - DNA, 25 bp, Mus musculus
gccttacttagagattgcgaaccag

SEQ ID NO: 685556 - DNA, 25 bp, Mus musculus
gccttagagaagcaacaaggctctc

SEQ ID NO: 685557 - DNA, 25 bp, Mus musculus
gccttagagaaggaacaaggctctc

SEQ ID NO: 685558 - DNA, 25 bp, Mus musculus
gccttagagatgaccttatttggag

SEQ ID NO: 685559 - DNA, 25 bp, Mus musculus
gccttagagatgtccttatttggag

SEQ ID NO: 685560 - DNA, 25 bp, Mus musculus
gccttagagctccaaccggcagtgg

SEQ ID NO: 685561 - DNA, 25 bp, Mus musculus
gccttagagctcgaaccggcagtgg

SEQ ID NO: 685562 - DNA, 25 bp, Mus musculus
gccttagctactccaaaatttgatc

SEQ ID NO: 685563 - DNA, 25 bp, Mus musculus
gccttagctactgcaaaatttgatc

SEQ ID NO: 685564 - DNA, 25 bp, Mus musculus
gccttagctggaacaattattgtgg

SEQ ID NO: 685565 - DNA, 25 bp, Mus musculus
gccttagctggatcaattattgtgg

SEQ ID NO: 685566 - DNA, 25 bp, Mus musculus
gccttagggaccatggccgatcctc

SEQ ID NO: 685567 - DNA, 25 bp, Mus musculus
gccttagggaccttggccgatcctc

SEQ ID NO: 685568 - DNA, 25 bp, Mus musculus
gccttaggtcccacgaggtaggtgc

SEQ ID NO: 685569 - DNA, 25 bp, Mus musculus
gccttaggtccctcgaggtaggtgc

SEQ ID NO: 685570 - DNA, 25 bp, Mus musculus
gccttagtagcacccgttgcctttg

SEQ ID NO: 685571 - DNA, 25 bp, Mus musculus
gccttagtagcagccgttgcctttg

SEQ ID NO: 685572 - DNA, 25 bp, Mus musculus
gccttagtcatcatccagctctatg

SEQ ID NO: 685573 - DNA, 25 bp, Mus musculus
gccttagtcatcttccagctctatg

SEQ ID NO: 685574 - DNA, 25 bp, Mus musculus
gccttagtgaccagatccgtgtggg

SEQ ID NO: 685575 - DNA, 25 bp, Mus musculus
gccttagtgacctgatccgtgtggg

SEQ ID NO: 685576 - DNA, 25 bp, Mus musculus
gccttagttcttaagatgatgcgtg

SEQ ID NO: 685577 - DNA, 25 bp, Mus musculus
gccttagttctttagatgatgcgtg

SEQ ID NO: 685578 - DNA, 25 bp, Mus musculus
gccttagttgtgacctgaatccaga

SEQ ID NO: 685579 - DNA, 25 bp, Mus musculus
gccttagttgtgtcctgaatccaga

SEQ ID NO: 685580 - DNA, 25 bp, Mus musculus
gccttatacaccatgatgaaggatc

SEQ ID NO: 685581 - DNA, 25 bp, Mus musculus
gccttatacaccttgatgaaggatc

SEQ ID NO: 685582 - DNA, 25 bp, Mus musculus
gccttatacccgctgtgttttgctg

SEQ ID NO: 685583 - DNA, 25 bp, Mus musculus
gccttatacccggtgtgttttgctg

SEQ ID NO: 685584 - DNA, 25 bp, Mus musculus
gccttatagatacccgactcctgat

SEQ ID NO: 685585 - DNA, 25 bp, Mus musculus
gccttatagatagccgactcctgat

SEQ ID NO: 685586 - DNA, 25 bp, Mus musculus
gccttatcataaacccttgcaacaa

SEQ ID NO: 685587 - DNA, 25 bp, Mus musculus
gccttatcataatcccttgcaacaa

SEQ ID NO: 685588 - DNA, 25 bp, Mus musculus
gccttatccctcatgttacacacag

SEQ ID NO: 685589 - DNA, 25 bp, Mus musculus
gccttatccctcttgttacacacag

SEQ ID NO: 685590 - DNA, 25 bp, Mus musculus
gccttatctaaaacagtgcctgcca

SEQ ID NO: 685591 - DNA, 25 bp, Mus musculus
gccttatctaaatcagtgcctgcca

SEQ ID NO: 685592 - DNA, 25 bp, Mus musculus
gccttatctgacatcttggtggtga

SEQ ID NO: 685593 - DNA, 25 bp, Mus musculus
gccttatctgacttcttggtggtga

SEQ ID NO: 685594 - DNA, 25 bp, Mus musculus
gccttatgaggtagtttgagccagt

SEQ ID NO: 685595 - DNA, 25 bp, Mus musculus
gccttatgaggttgtttgagccagt

SEQ ID NO: 685596 - DNA, 25 bp, Mus musculus
gccttatggactaaggaattactgg

SEQ ID NO: 685597 - DNA, 25 bp, Mus musculus
gccttatggacttaggaattactgg

SEQ ID NO: 685598 - DNA, 25 bp, Mus musculus
gccttatggagtcagcacgtagccc

SEQ ID NO: 685599 - DNA, 25 bp, Mus musculus
gccttatggagtgagcacgtagccc

SEQ ID NO: 685600 - DNA, 25 bp, Mus musculus
gccttatgggttcgctcactgtgga

SEQ ID NO: 685601 - DNA, 25 bp, Mus musculus
gccttatgggttggctcactgtgga

SEQ ID NO: 685602 - DNA, 25 bp, Mus musculus
gccttatgtgctcatcggaacccag

SEQ ID NO: 685603 - DNA, 25 bp, Mus musculus
gccttatgtgctgatcggaacccag

SEQ ID NO: 685604 - DNA, 25 bp, Mus musculus
gccttattctataggatttttgtcc

SEQ ID NO: 685605 - DNA, 25 bp, Mus musculus
gccttattctattggatttttgtcc

SEQ ID NO: 685606 - DNA, 25 bp, Mus musculus
gccttattctggcaaccttgggccg

SEQ ID NO: 685607 - DNA, 25 bp, Mus musculus
gccttattctgggaaccttgggccg

SEQ ID NO: 685608 - DNA, 25 bp, Mus musculus
gccttattcttcattgtcaacaaca

SEQ ID NO: 685609 - DNA, 25 bp, Mus musculus
gccttattcttctttgtcaacaaca

SEQ ID NO: 685610 - DNA, 25 bp, Mus musculus
gccttcaagaacatggtgcagagaa

SEQ ID NO: 685611 - DNA, 25 bp, Mus musculus
gccttcaagaacttggtgcagagaa

SEQ ID NO: 685612 - DNA, 25 bp, Mus musculus
gccttcaagaggcagatgtcgtcca

SEQ ID NO: 685613 - DNA, 25 bp, Mus musculus
gccttcaagagggagatgtcgtcca

SEQ ID NO: 685614 - DNA, 25 bp, Mus musculus
gccttcaagagtacccacaatctgg

SEQ ID NO: 685615 - DNA, 25 bp, Mus musculus
gccttcaagagttcccacaatctgg

SEQ ID NO: 685616 - DNA, 25 bp, Mus musculus
gccttcaaggatcgaggctctacca

SEQ ID NO: 685617 - DNA, 25 bp, Mus musculus
gccttcaaggatggaggctctacca

SEQ ID NO: 685618 - DNA, 25 bp, Mus musculus
gccttcaagtaactggaacattgag

SEQ ID NO: 685619 - DNA, 25 bp, Mus musculus
gccttcaagtaagtggaacattgag

SEQ ID NO: 685620 - DNA, 25 bp, Mus musculus
gccttcaatgccaagaccagtttca

SEQ ID NO: 685621 - DNA, 25 bp, Mus musculus
gccttcaatgcctagaccagtttca

SEQ ID NO: 685622 - DNA, 25 bp, Mus musculus
gccttcacagacctaatcaagaaat

SEQ ID NO: 685623 - DNA, 25 bp, Mus musculus
gccttcacagacgtaatcaagaaat

SEQ ID NO: 685624 - DNA, 25 bp, Mus musculus
gccttcaccatcacctatgtgtaca

SEQ ID NO: 685625 - DNA, 25 bp, Mus musculus
gccttcaccatctcctatgtgtaca

SEQ ID NO: 685626 - DNA, 25 bp, Mus musculus
gccttcaccgaacgctctgggcttt

SEQ ID NO: 685627 - DNA, 25 bp, Mus musculus
gccttcaccgaaggctctgggcttt

SEQ ID NO: 685628 - DNA, 25 bp, Mus musculus
gccttcacgttcaccttgttaaatg

SEQ ID NO: 685629 - DNA, 25 bp, Mus musculus
gccttcacgttctccttgttaaatg

SEQ ID NO: 685630 - DNA, 25 bp, Mus musculus
gccttcagaaagaccttgaagcact

SEQ ID NO: 685631 - DNA, 25 bp, Mus musculus
gccttcagaaagtccttgaagcact

SEQ ID NO: 685632 - DNA, 25 bp, Mus musculus
gccttcagcggcacggccgtgcatg

SEQ ID NO: 685633 - DNA, 25 bp, Mus musculus
gccttcagcggctcggccgtgcatg

SEQ ID NO: 685634 - DNA, 25 bp, Mus musculus
gccttcaggaaccaggtggctgttt

SEQ ID NO: 685635 - DNA, 25 bp, Mus musculus
gccttcaggaacgaggtggctgttt

SEQ ID NO: 685636 - DNA, 25 bp, Mus musculus
gccttcaggatcctcacgggttgga

SEQ ID NO: 685637 - DNA, 25 bp, Mus musculus
gccttcaggatcgtcacgggttgga

SEQ ID NO: 685638 - DNA, 25 bp, Mus musculus
gccttcaggttactctctccagaaa

SEQ ID NO: 685639 - DNA, 25 bp, Mus musculus
gccttcaggttagtctctccagaaa

SEQ ID NO: 685640 - DNA, 25 bp, Mus musculus
gccttcagtggtagcagtcttctgg

SEQ ID NO: 685641 - DNA, 25 bp, Mus musculus
gccttcagtggttgcagtcttctgg

SEQ ID NO: 685642 - DNA, 25 bp, Mus musculus
gccttcatcattatcgtaagtactc

SEQ ID NO: 685643 - DNA, 25 bp, Mus musculus
gccttcatcattttcgtaagtactc

SEQ ID NO: 685644 - DNA, 25 bp, Mus musculus
gccttcatcgttatcacagaagctg

SEQ ID NO: 685645 - DNA, 25 bp, Mus musculus
gccttcatcgttttcacagaagctg

SEQ ID NO: 685646 - DNA, 25 bp, Mus musculus
gccttcatggaacgccttcaaagaa

SEQ ID NO: 685647 - DNA, 25 bp, Mus musculus
gccttcatggaaggccttcaaagaa

SEQ ID NO: 685648 - DNA, 25 bp, Mus musculus
gccttcatgtgccaggtaacaggaa

SEQ ID NO: 685649 - DNA, 25 bp, Mus musculus
gccttcatgtgcgaggtaacaggaa

SEQ ID NO: 685650 - DNA, 25 bp, Mus musculus
gccttcattgctatactcattgcaa

SEQ ID NO: 685651 - DNA, 25 bp, Mus musculus
gccttcattgctttactcattgcaa

SEQ ID NO: 685652 - DNA, 25 bp, Mus musculus
gccttccaacctacgtagcagaaag

SEQ ID NO: 685653 - DNA, 25 bp, Mus musculus
gccttccaaccttcgtagcagaaag

SEQ ID NO: 685654 - DNA, 25 bp, Mus musculus
gccttccactcacagaggacgagct

SEQ ID NO: 685655 - DNA, 25 bp, Mus musculus
gccttccactcagagaggacgagct

SEQ ID NO: 685656 - DNA, 25 bp, Mus musculus
gccttccactttcatatcctgaagc

SEQ ID NO: 685657 - DNA, 25 bp, Mus musculus
gccttccactttgatatcctgaagc

SEQ ID NO: 685658 - DNA, 25 bp, Mus musculus
gccttccagaacctgatgaaggact

SEQ ID NO: 685659 - DNA, 25 bp, Mus musculus
gccttccagaacgtgatgaaggact

SEQ ID NO: 685660 - DNA, 25 bp, Mus musculus
gccttccaggcaatctgtgagacac

SEQ ID NO: 685661 - DNA, 25 bp, Mus musculus
gccttccaggcattctgtgagacac

SEQ ID NO: 685662 - DNA, 25 bp, Mus musculus
gccttcccagtaatgcaggactgaa

SEQ ID NO: 685663 - DNA, 25 bp, Mus musculus
gccttcccagtattgcaggactgaa

SEQ ID NO: 685664 - DNA, 25 bp, Mus musculus
gccttccccggacctggtgtgtgat

SEQ ID NO: 685665 - DNA, 25 bp, Mus musculus
gccttccccggagctggtgtgtgat

SEQ ID NO: 685666 - DNA, 25 bp, Mus musculus
gccttccctgccatctgagagctag

SEQ ID NO: 685667 - DNA, 25 bp, Mus musculus
gccttccctgccttctgagagctag

SEQ ID NO: 685668 - DNA, 25 bp, Mus musculus
gccttcccttcacttccgaaggaat

SEQ ID NO: 685669 - DNA, 25 bp, Mus musculus
gccttcccttcagttccgaaggaat

SEQ ID NO: 685670 - DNA, 25 bp, Mus musculus
gccttcctagagaaacgtctgcacc

SEQ ID NO: 685671 - DNA, 25 bp, Mus musculus
gccttcctagagtaacgtctgcacc

SEQ ID NO: 685672 - DNA, 25 bp, Mus musculus
gccttcctagatcctgaggaacagc

SEQ ID NO: 685673 - DNA, 25 bp, Mus musculus
gccttcctagatgctgaggaacagc

SEQ ID NO: 685674 - DNA, 25 bp, Mus musculus
gccttcctccgcctaaggcaggtgg

SEQ ID NO: 685675 - DNA, 25 bp, Mus musculus
gccttcctccgcgtaaggcaggtgg

SEQ ID NO: 685676 - DNA, 25 bp, Mus musculus
gccttcctgccccttggactcaagg

SEQ ID NO: 685677 - DNA, 25 bp, Mus musculus
gccttcctgcccgttggactcaagg

SEQ ID NO: 685678 - DNA, 25 bp, Mus musculus
gccttcctggtgcatctgaatgcat

SEQ ID NO: 685679 - DNA, 25 bp, Mus musculus
gccttcctggtgctcagcacgggca

SEQ ID NO: 685680 - DNA, 25 bp, Mus musculus
gccttcctggtggatctgaatgcat

SEQ ID NO: 685681 - DNA, 25 bp, Mus musculus
gccttcctggtggtcagcacgggca

SEQ ID NO: 685682 - DNA, 25 bp, Mus musculus
gccttccttgagcagtttgggactt

SEQ ID NO: 685683 - DNA, 25 bp, Mus musculus
gccttccttgaggagtttgggactt

SEQ ID NO: 685684 - DNA, 25 bp, Mus musculus
gccttccttgcccatgacgtcttgg

SEQ ID NO: 685685 - DNA, 25 bp, Mus musculus
gccttccttgccgatgacgtcttgg

SEQ ID NO: 685686 - DNA, 25 bp, Mus musculus
gccttccttggcacatttgtcaatg

SEQ ID NO: 685687 - DNA, 25 bp, Mus musculus
gccttccttggctcatttgtcaatg

SEQ ID NO: 685688 - DNA, 25 bp, Mus musculus
gccttccttgtgctgggtaacagat

SEQ ID NO: 685689 - DNA, 25 bp, Mus musculus
gccttccttgtggtgggtaacagat

SEQ ID NO: 685690 - DNA, 25 bp, Mus musculus
gccttcgaatatagcacgtcaacac

SEQ ID NO: 685691 - DNA, 25 bp, Mus musculus
gccttcgaatattgcacgtcaacac

SEQ ID NO: 685692 - DNA, 25 bp, Mus musculus
gccttcgaccagattcgcatggccg

SEQ ID NO: 685693 - DNA, 25 bp, Mus musculus
gccttcgaccagtttcgcatggccg

SEQ ID NO: 685694 - DNA, 25 bp, Mus musculus
gccttcgaccgcatagatttcttcc

SEQ ID NO: 685695 - DNA, 25 bp, Mus musculus
gccttcgaccgcttagatttcttcc

SEQ ID NO: 685696 - DNA, 25 bp, Mus musculus
gccttcgagtccatgctacgctaca

SEQ ID NO: 685697 - DNA, 25 bp, Mus musculus
gccttcgagtccttgctacgctaca

SEQ ID NO: 685698 - DNA, 25 bp, Mus musculus
gccttcgcaggcaacaaggaacgcg

SEQ ID NO: 685699 - DNA, 25 bp, Mus musculus
gccttcgcaggctacaaggaacgcg

SEQ ID NO: 685700 - DNA, 25 bp, Mus musculus
gccttcgctggcactgccttccttg

SEQ ID NO: 685701 - DNA, 25 bp, Mus musculus
gccttcgctggctctgccttccttg

SEQ ID NO: 685702 - DNA, 25 bp, Mus musculus
gccttcggacctacagctggatcgc

SEQ ID NO: 685703 - DNA, 25 bp, Mus musculus
gccttcggacctaggctcagttttt

SEQ ID NO: 685704 - DNA, 25 bp, Mus musculus
gccttcggaccttcagctggatcgc

SEQ ID NO: 685705 - DNA, 25 bp, Mus musculus
gccttcggaccttggctcagttttt

SEQ ID NO: 685706 - DNA, 25 bp, Mus musculus
gccttcgtgggacctggctatcctg

SEQ ID NO: 685707 - DNA, 25 bp, Mus musculus
gccttcgtgggagctggctatcctg

SEQ ID NO: 685708 - DNA, 25 bp, Mus musculus
gccttcgtgggtctgtccttcccta

SEQ ID NO: 685709 - DNA, 25 bp, Mus musculus
gccttcgtgggtgtgtccttcccta

SEQ ID NO: 685710 - DNA, 25 bp, Mus musculus
gccttcgttccaaattgccagaatt

SEQ ID NO: 685711 - DNA, 25 bp, Mus musculus
gccttcgttccatattgccagaatt

SEQ ID NO: 685712 - DNA, 25 bp, Mus musculus
gccttctaaccaatccaaagtctct

SEQ ID NO: 685713 - DNA, 25 bp, Mus musculus
gccttctaaccattccaaagtctct

SEQ ID NO: 685714 - DNA, 25 bp, Mus musculus
gccttctacatgatccgattccact

SEQ ID NO: 685715 - DNA, 25 bp, Mus musculus
gccttctacatgttccgattccact

SEQ ID NO: 685716 - DNA, 25 bp, Mus musculus
gccttctacttaattgaccgagatc

SEQ ID NO: 685717 - DNA, 25 bp, Mus musculus
gccttctacttatttgaccgagatc

SEQ ID NO: 685718 - DNA, 25 bp, Mus musculus
gccttctagggaaccgcacgctggc

SEQ ID NO: 685719 - DNA, 25 bp, Mus musculus
gccttctagggatccgcacgctggc

SEQ ID NO: 685720 - DNA, 25 bp, Mus musculus
gccttctagtcccagagccacagtt

SEQ ID NO: 685721 - DNA, 25 bp, Mus musculus
gccttctagtccgagagccacagtt

SEQ ID NO: 685722 - DNA, 25 bp, Mus musculus
gccttctcctgtcaggccgggataa

SEQ ID NO: 685723 - DNA, 25 bp, Mus musculus
gccttctcctgtgaggccgggataa

SEQ ID NO: 685724 - DNA, 25 bp, Mus musculus
gccttctcgtctccctctgatgtgt

SEQ ID NO: 685725 - DNA, 25 bp, Mus musculus
gccttctcgtctgcctctgatgtgt

SEQ ID NO: 685726 - DNA, 25 bp, Mus musculus
gccttctcgtttccgccctagagag

SEQ ID NO: 685727 - DNA, 25 bp, Mus musculus
gccttctcgtttgcgccctagagag

SEQ ID NO: 685728 - DNA, 25 bp, Mus musculus
gccttctctggtactgggaatagac

SEQ ID NO: 685729 - DNA, 25 bp, Mus musculus
gccttctctggttctgggaatagac

SEQ ID NO: 685730 - DNA, 25 bp, Mus musculus
gccttctgaagcctgctaagatgca

SEQ ID NO: 685731 - DNA, 25 bp, Mus musculus
gccttctgaagcgtgctaagatgca

SEQ ID NO: 685732 - DNA, 25 bp, Mus musculus
gccttctgaccaagctttctcttga

SEQ ID NO: 685733 - DNA, 25 bp, Mus musculus
gccttctgaccatgctttctcttga

SEQ ID NO: 685734 - DNA, 25 bp, Mus musculus
gccttctgatctcaacgttaatgtg

SEQ ID NO: 685735 - DNA, 25 bp, Mus musculus
gccttctgatctgaacgttaatgtg

SEQ ID NO: 685736 - DNA, 25 bp, Mus musculus
gccttctgcaggctgaaggacccca

SEQ ID NO: 685737 - DNA, 25 bp, Mus musculus
gccttctgcagggtgaaggacccca

SEQ ID NO: 685738 - DNA, 25 bp, Mus musculus
gccttctggagaatctacaacccca

SEQ ID NO: 685739 - DNA, 25 bp, Mus musculus
gccttctggagattctacaacccca

SEQ ID NO: 685740 - DNA, 25 bp, Mus musculus
gccttctggattcctgaagatacag

SEQ ID NO: 685741 - DNA, 25 bp, Mus musculus
gccttctggattgctgaagatacag

SEQ ID NO: 685742 - DNA, 25 bp, Mus musculus
gccttctgtaccatatgcagactga

SEQ ID NO: 685743 - DNA, 25 bp, Mus musculus
gccttctgtaccttatgcagactga

SEQ ID NO: 685744 - DNA, 25 bp, Mus musculus
gccttcttatccaggtattgggaaa

SEQ ID NO: 685745 - DNA, 25 bp, Mus musculus
gccttcttatcctggtattgggaaa

SEQ ID NO: 685746 - DNA, 25 bp, Mus musculus
gccttcttcactagaaatggcccat

SEQ ID NO: 685747 - DNA, 25 bp, Mus musculus
gccttcttcacttgaaatggcccat

SEQ ID NO: 685748 - DNA, 25 bp, Mus musculus
gccttcttcgccagagatgaactta

SEQ ID NO: 685749 - DNA, 25 bp, Mus musculus
gccttcttcgcctgagatgaactta

SEQ ID NO: 685750 - DNA, 25 bp, Mus musculus
gccttcttgggaccttttgctcaca

SEQ ID NO: 685751 - DNA, 25 bp, Mus musculus
gccttcttgggagcttttgctcaca

SEQ ID NO: 685752 - DNA, 25 bp, Mus musculus
gccttctttgaacggcagggatgcc

SEQ ID NO: 685753 - DNA, 25 bp, Mus musculus
gccttctttgaagggcagggatgcc

SEQ ID NO: 685754 - DNA, 25 bp, Mus musculus
gccttctttgcaatgactcgattgt

SEQ ID NO: 685755 - DNA, 25 bp, Mus musculus
gccttctttgcattgactcgattgt

SEQ ID NO: 685756 - DNA, 25 bp, Mus musculus
gccttcttttccaagagctcctgtg

SEQ ID NO: 685757 - DNA, 25 bp, Mus musculus
gccttcttttccctgctttagctgc

SEQ ID NO: 685758 - DNA, 25 bp, Mus musculus
gccttcttttccgtgctttagctgc

SEQ ID NO: 685759 - DNA, 25 bp, Mus musculus
gccttcttttcctagagctcctgtg

SEQ ID NO: 685760 - DNA, 25 bp, Mus musculus
gccttgaagaacatcgagaagccag

SEQ ID NO: 685761 - DNA, 25 bp, Mus musculus
gccttgaagaacttcgagaagccag

SEQ ID NO: 685762 - DNA, 25 bp, Mus musculus
gccttgaagaggacatctgctctga

SEQ ID NO: 685763 - DNA, 25 bp, Mus musculus
gccttgaagaggtcatctgctctga

SEQ ID NO: 685764 - DNA, 25 bp, Mus musculus
gccttgaagcaactaaactcaatga

SEQ ID NO: 685765 - DNA, 25 bp, Mus musculus
gccttgaagcaagtaaactcaatga

SEQ ID NO: 685766 - DNA, 25 bp, Mus musculus
gccttgaagcgaatcagcatccgtc

SEQ ID NO: 685767 - DNA, 25 bp, Mus musculus
gccttgaagcgattcagcatccgtc

SEQ ID NO: 685768 - DNA, 25 bp, Mus musculus
gccttgaagcgccagcgactagaga

SEQ ID NO: 685769 - DNA, 25 bp, Mus musculus
gccttgaagcgcgagcgactagaga

SEQ ID NO: 685770 - DNA, 25 bp, Mus musculus
gccttgaaggatattactcttgaaa

SEQ ID NO: 685771 - DNA, 25 bp, Mus musculus
gccttgaaggattttactcttgaaa

SEQ ID NO: 685772 - DNA, 25 bp, Mus musculus
gccttgaaggctatccccgtgtcct

SEQ ID NO: 685773 - DNA, 25 bp, Mus musculus
gccttgaaggctttccccgtgtcct

SEQ ID NO: 685774 - DNA, 25 bp, Mus musculus
gccttgacagtaccacacctttgat

SEQ ID NO: 685775 - DNA, 25 bp, Mus musculus
gccttgacagtagcacacctttgat

SEQ ID NO: 685776 - DNA, 25 bp, Mus musculus
gccttgaccatcacagacggttgcc

SEQ ID NO: 685777 - DNA, 25 bp, Mus musculus
gccttgaccatctcagacggttgcc

SEQ ID NO: 685778 - DNA, 25 bp, Mus musculus
gccttgacctttcgaatcttagcag

SEQ ID NO: 685779 - DNA, 25 bp, Mus musculus
gccttgacctttggaatcttagcag

SEQ ID NO: 685780 - DNA, 25 bp, Mus musculus
gccttgagaatgcaatcggttggta

SEQ ID NO: 685781 - DNA, 25 bp, Mus musculus
gccttgagaatggaatcggttggta

SEQ ID NO: 685782 - DNA, 25 bp, Mus musculus
gccttgagcaatagtagagccccag

SEQ ID NO: 685783 - DNA, 25 bp, Mus musculus
gccttgagcaattgtagagccccag

SEQ ID NO: 685784 - DNA, 25 bp, Mus musculus
gccttgagcgctaatgacttggtgc

SEQ ID NO: 685785 - DNA, 25 bp, Mus musculus
gccttgagcgcttatgacttggtgc

SEQ ID NO: 685786 - DNA, 25 bp, Mus musculus
gccttgaggacgaactgagacccga

SEQ ID NO: 685787 - DNA, 25 bp, Mus musculus
gccttgaggacgtactgagacccga

SEQ ID NO: 685788 - DNA, 25 bp, Mus musculus
gccttgaggactcagtagctaccac

SEQ ID NO: 685789 - DNA, 25 bp, Mus musculus
gccttgaggactgagtagctaccac

SEQ ID NO: 685790 - DNA, 25 bp, Mus musculus
gccttgagtagaagttcaccagcat

SEQ ID NO: 685791 - DNA, 25 bp, Mus musculus
gccttgagtagatgttcaccagcat

SEQ ID NO: 685792 - DNA, 25 bp, Mus musculus
gccttgagtgctcgtgtctcggaaa

SEQ ID NO: 685793 - DNA, 25 bp, Mus musculus
gccttgagtgctggtgtctcggaaa

SEQ ID NO: 685794 - DNA, 25 bp, Mus musculus
gccttgataaacatggtgaccaaat

SEQ ID NO: 685795 - DNA, 25 bp, Mus musculus
gccttgataaacttggtgaccaaat

SEQ ID NO: 685796 - DNA, 25 bp, Mus musculus
gccttgatagatcaagaagtgaaga

SEQ ID NO: 685797 - DNA, 25 bp, Mus musculus
gccttgatagatgaagaagtgaaga

SEQ ID NO: 685798 - DNA, 25 bp, Mus musculus
gccttgatctccaactttggcttct

SEQ ID NO: 685799 - DNA, 25 bp, Mus musculus
gccttgatctcctactttggcttct

SEQ ID NO: 685800 - DNA, 25 bp, Mus musculus
gccttgatttctcccgttggtcata

SEQ ID NO: 685801 - DNA, 25 bp, Mus musculus
gccttgatttctgccgttggtcata

SEQ ID NO: 685802 - DNA, 25 bp, Mus musculus
gccttgcaaggacacgctgtccctg

SEQ ID NO: 685803 - DNA, 25 bp, Mus musculus
gccttgcaaggagacgctgtccctg

SEQ ID NO: 685804 - DNA, 25 bp, Mus musculus
gccttgcaattaagtaaagcttgtg

SEQ ID NO: 685805 - DNA, 25 bp, Mus musculus
gccttgcaattatgtaaagcttgtg

SEQ ID NO: 685806 - DNA, 25 bp, Mus musculus
gccttgcacactattttcatctacc

SEQ ID NO: 685807 - DNA, 25 bp, Mus musculus
gccttgcacacttttttcatctacc

SEQ ID NO: 685808 - DNA, 25 bp, Mus musculus
gccttgcaccaacagttaactaaga

SEQ ID NO: 685809 - DNA, 25 bp, Mus musculus
gccttgcaccaagagttaactaaga

SEQ ID NO: 685810 - DNA, 25 bp, Mus musculus
gccttgcactacagaccacgatgat

SEQ ID NO: 685811 - DNA, 25 bp, Mus musculus
gccttgcactactgaccacgatgat

SEQ ID NO: 685812 - DNA, 25 bp, Mus musculus
gccttgcccatgctgaagcagagca

SEQ ID NO: 685813 - DNA, 25 bp, Mus musculus
gccttgcccatggtgaagcagagca

SEQ ID NO: 685814 - DNA, 25 bp, Mus musculus
gccttgcccgctcataaactggttt

SEQ ID NO: 685815 - DNA, 25 bp, Mus musculus
gccttgcccgctgataaactggttt

SEQ ID NO: 685816 - DNA, 25 bp, Mus musculus
gccttgccgtcgagtgacagcggcc

SEQ ID NO: 685817 - DNA, 25 bp, Mus musculus
gccttgccgtcgtgtgacagcggcc

SEQ ID NO: 685818 - DNA, 25 bp, Mus musculus
gccttgcctgatcaatgtagatgtc

SEQ ID NO: 685819 - DNA, 25 bp, Mus musculus
gccttgcctgatgaatgtagatgtc

SEQ ID NO: 685820 - DNA, 25 bp, Mus musculus
gccttgcctggtacatcctctcgta

SEQ ID NO: 685821 - DNA, 25 bp, Mus musculus
gccttgcctggttcatcctctcgta

SEQ ID NO: 685822 - DNA, 25 bp, Mus musculus
gccttgcgcaggaagtacactctca

SEQ ID NO: 685823 - DNA, 25 bp, Mus musculus
gccttgcgcaggtagtacactctca

SEQ ID NO: 685824 - DNA, 25 bp, Mus musculus
gccttgcggagaccactgggctact

SEQ ID NO: 685825 - DNA, 25 bp, Mus musculus
gccttgcggagagcactgggctact

SEQ ID NO: 685826 - DNA, 25 bp, Mus musculus
gccttgcggagcagccgtgacttca

SEQ ID NO: 685827 - DNA, 25 bp, Mus musculus
gccttgcggagctgccgtgacttca

SEQ ID NO: 685828 - DNA, 25 bp, Mus musculus
gccttgctccccatcagaactggtg

SEQ ID NO: 685829 - DNA, 25 bp, Mus musculus
gccttgctccccttcagaactggtg

SEQ ID NO: 685830 - DNA, 25 bp, Mus musculus
gccttgctgtatcctatgtaaataa

SEQ ID NO: 685831 - DNA, 25 bp, Mus musculus
gccttgctgtatgctatgtaaataa

SEQ ID NO: 685832 - DNA, 25 bp, Mus musculus
gccttgcttggtctggaacagtgcc

SEQ ID NO: 685833 - DNA, 25 bp, Mus musculus
gccttgcttggtgtggaacagtgcc

SEQ ID NO: 685834 - DNA, 25 bp, Mus musculus
gccttggaaaagactgcttacaaat

SEQ ID NO: 685835 - DNA, 25 bp, Mus musculus
gccttggaaaagtctgcttacaaat

SEQ ID NO: 685836 - DNA, 25 bp, Mus musculus
gccttggaaatcctcgccttcgtag

SEQ ID NO: 685837 - DNA, 25 bp, Mus musculus
gccttggaaatcgtcgccttcgtag

SEQ ID NO: 685838 - DNA, 25 bp, Mus musculus
gccttggaaccgaacacacctgtat

SEQ ID NO: 685839 - DNA, 25 bp, Mus musculus
gccttggaaccgtacacacctgtat

SEQ ID NO: 685840 - DNA, 25 bp, Mus musculus
gccttggaagtcacgaacatattca

SEQ ID NO: 685841 - DNA, 25 bp, Mus musculus
gccttggaagtctcgaacatattca

SEQ ID NO: 685842 - DNA, 25 bp, Mus musculus
gccttggacctgatgaggcgcctgc

SEQ ID NO: 685843 - DNA, 25 bp, Mus musculus
gccttggacctgttgaggcgcctgc

SEQ ID NO: 685844 - DNA, 25 bp, Mus musculus
gccttggactgacctgtgcgccttt

SEQ ID NO: 685845 - DNA, 25 bp, Mus musculus
gccttggactgagctgtgcgccttt

SEQ ID NO: 685846 - DNA, 25 bp, Mus musculus
gccttggagcacaatgttaattgcc

SEQ ID NO: 685847 - DNA, 25 bp, Mus musculus
gccttggagcactatgttaattgcc

SEQ ID NO: 685848 - DNA, 25 bp, Mus musculus
gccttggagctcactggtttaaaag

SEQ ID NO: 685849 - DNA, 25 bp, Mus musculus
gccttggagctccagtacgattaat

SEQ ID NO: 685850 - DNA, 25 bp, Mus musculus
gccttggagctcgagtacgattaat

SEQ ID NO: 685851 - DNA, 25 bp, Mus musculus
gccttggagctctctggtttaaaag

SEQ ID NO: 685852 - DNA, 25 bp, Mus musculus
gccttggagcttctctgttgcatga

SEQ ID NO: 685853 - DNA, 25 bp, Mus musculus
gccttggagcttgtctgttgcatga

SEQ ID NO: 685854 - DNA, 25 bp, Mus musculus
gccttggagtataatttaatcttcc

SEQ ID NO: 685855 - DNA, 25 bp, Mus musculus
gccttggagtattatttaatcttcc

SEQ ID NO: 685856 - DNA, 25 bp, Mus musculus
gccttggattccaggcgctggtcca

SEQ ID NO: 685857 - DNA, 25 bp, Mus musculus
gccttggattcctggcgctggtcca

SEQ ID NO: 685858 - DNA, 25 bp, Mus musculus
gccttggcaagacataagcattatt

SEQ ID NO: 685859 - DNA, 25 bp, Mus musculus
gccttggcaagagataagcattatt

SEQ ID NO: 685860 - DNA, 25 bp, Mus musculus
gccttggcaattaaagaaaggattg

SEQ ID NO: 685861 - DNA, 25 bp, Mus musculus
gccttggcaatttaagaaaggattg

SEQ ID NO: 685862 - DNA, 25 bp, Mus musculus
gccttggcatagcttaaagaaactg

SEQ ID NO: 685863 - DNA, 25 bp, Mus musculus
gccttggcataggttaaagaaactg

SEQ ID NO: 685864 - DNA, 25 bp, Mus musculus
gccttggcccttctgttgctgctca

SEQ ID NO: 685865 - DNA, 25 bp, Mus musculus
gccttggcccttgtgttgctgctca

SEQ ID NO: 685866 - DNA, 25 bp, Mus musculus
gccttggccgatcttctgcttgtca

SEQ ID NO: 685867 - DNA, 25 bp, Mus musculus
gccttggccgatgttctgcttgtca

SEQ ID NO: 685868 - DNA, 25 bp, Mus musculus
gccttggcctccagacctagtaaag

SEQ ID NO: 685869 - DNA, 25 bp, Mus musculus
gccttggcctcctgacctagtaaag

SEQ ID NO: 685870 - DNA, 25 bp, Mus musculus
gccttggccttccttctactggcag

SEQ ID NO: 685871 - DNA, 25 bp, Mus musculus
gccttggccttcgttctactggcag

SEQ ID NO: 685872 - DNA, 25 bp, Mus musculus
gccttggctcggacactggccagaa

SEQ ID NO: 685873 - DNA, 25 bp, Mus musculus
gccttggctcggtcactggccagaa

SEQ ID NO: 685874 - DNA, 25 bp, Mus musculus
gccttggctgtcagcatgtgctcca

SEQ ID NO: 685875 - DNA, 25 bp, Mus musculus
gccttggctgtctgcatgtgctcca

SEQ ID NO: 685876 - DNA, 25 bp, Mus musculus
gccttggctttgcaggtacataatg

SEQ ID NO: 685877 - DNA, 25 bp, Mus musculus
gccttggctttggaggtacataatg

SEQ ID NO: 685878 - DNA, 25 bp, Mus musculus
gccttgggagaaaactcctgcaccc

SEQ ID NO: 685879 - DNA, 25 bp, Mus musculus
gccttgggagaatactcctgcaccc

SEQ ID NO: 685880 - DNA, 25 bp, Mus musculus
gccttgggcggcatggcaaatgcaa

SEQ ID NO: 685881 - DNA, 25 bp, Mus musculus
gccttgggcggcttggcaaatgcaa

SEQ ID NO: 685882 - DNA, 25 bp, Mus musculus
gccttgggcttccttataattgctg

SEQ ID NO: 685883 - DNA, 25 bp, Mus musculus
gccttgggcttcgttataattgctg

SEQ ID NO: 685884 - DNA, 25 bp, Mus musculus
gccttggtaatgaccgtagaacctg

SEQ ID NO: 685885 - DNA, 25 bp, Mus musculus
gccttggtaatgtccgtagaacctg

SEQ ID NO: 685886 - DNA, 25 bp, Mus musculus
gccttggtagctcgactcttggcct

SEQ ID NO: 685887 - DNA, 25 bp, Mus musculus
gccttggtagctggactcttggcct

SEQ ID NO: 685888 - DNA, 25 bp, Mus musculus
gccttggtgctcaccggttccgtgg

SEQ ID NO: 685889 - DNA, 25 bp, Mus musculus
gccttggtgctctccggttccgtgg

SEQ ID NO: 685890 - DNA, 25 bp, Mus musculus
gccttggtggctcaagtgatcccca

SEQ ID NO: 685891 - DNA, 25 bp, Mus musculus
gccttggtggctgaagtgatcccca

SEQ ID NO: 685892 - DNA, 25 bp, Mus musculus
gccttggtgtgaccatggtagaata

SEQ ID NO: 685893 - DNA, 25 bp, Mus musculus
gccttggtgtgagcatggtagaata

SEQ ID NO: 685894 - DNA, 25 bp, Mus musculus
gccttgtaacgtcattgcttgttca

SEQ ID NO: 685895 - DNA, 25 bp, Mus musculus
gccttgtaacgtgattgcttgttca

SEQ ID NO: 685896 - DNA, 25 bp, Mus musculus
gccttgtatctgatggactgtccag

SEQ ID NO: 685897 - DNA, 25 bp, Mus musculus
gccttgtatctgttggactgtccag

SEQ ID NO: 685898 - DNA, 25 bp, Mus musculus
gccttgtattctcgactgaaaccca

SEQ ID NO: 685899 - DNA, 25 bp, Mus musculus
gccttgtattctggactgaaaccca

SEQ ID NO: 685900 - DNA, 25 bp, Mus musculus
gccttgtcactgaagttttccctga

SEQ ID NO: 685901 - DNA, 25 bp, Mus musculus
gccttgtcactgtagttttccctga

SEQ ID NO: 685902 - DNA, 25 bp, Mus musculus
gccttgtcagccaagagtgtgaaca

SEQ ID NO: 685903 - DNA, 25 bp, Mus musculus
gccttgtcagcctagagtgtgaaca

SEQ ID NO: 685904 - DNA, 25 bp, Mus musculus
gccttgtcctcaatgtccaaaggag

SEQ ID NO: 685905 - DNA, 25 bp, Mus musculus
gccttgtcctcattgtccaaaggag

SEQ ID NO: 685906 - DNA, 25 bp, Mus musculus
gccttgtcttcaattaggtaataaa

SEQ ID NO: 685907 - DNA, 25 bp, Mus musculus
gccttgtcttcatttaggtaataaa

SEQ ID NO: 685908 - DNA, 25 bp, Mus musculus
gccttgtctttaaacactgctctca

SEQ ID NO: 685909 - DNA, 25 bp, Mus musculus
gccttgtctttatacactgctctca

SEQ ID NO: 685910 - DNA, 25 bp, Mus musculus
gccttgtgacaaccagtacggcaac

SEQ ID NO: 685911 - DNA, 25 bp, Mus musculus
gccttgtgacaagcagtacggcaac

SEQ ID NO: 685912 - DNA, 25 bp, Mus musculus
gccttgtgaccaacatgctggccaa

SEQ ID NO: 685913 - DNA, 25 bp, Mus musculus
gccttgtgaccatcatgctggccaa

SEQ ID NO: 685914 - DNA, 25 bp, Mus musculus
gccttgtgagcaccgaacaccagtg

SEQ ID NO: 685915 - DNA, 25 bp, Mus musculus
gccttgtgagcagcgaacaccagtg

SEQ ID NO: 685916 - DNA, 25 bp, Mus musculus
gccttgtgatccagtttgcctgtga

SEQ ID NO: 685917 - DNA, 25 bp, Mus musculus
gccttgtgatcctgtttgcctgtga

SEQ ID NO: 685918 - DNA, 25 bp, Mus musculus
gccttgtgcaaacgcaaagactgaa

SEQ ID NO: 685919 - DNA, 25 bp, Mus musculus
gccttgtgcaaaggcaaagactgaa

SEQ ID NO: 685920 - DNA, 25 bp, Mus musculus
gccttgtgccaccagttcaggagga

SEQ ID NO: 685921 - DNA, 25 bp, Mus musculus
gccttgtgccacgagttcaggagga

SEQ ID NO: 685922 - DNA, 25 bp, Mus musculus
gccttgtgcctccaaggaaaatcaa

SEQ ID NO: 685923 - DNA, 25 bp, Mus musculus
gccttgtgcctcgaaggaaaatcaa

SEQ ID NO: 685924 - DNA, 25 bp, Mus musculus
gccttgtgcctgctcatcttctcga

SEQ ID NO: 685925 - DNA, 25 bp, Mus musculus
gccttgtgcctggtcatcttctcga

SEQ ID NO: 685926 - DNA, 25 bp, Mus musculus
gccttgtggagtaccaagatgtctc

SEQ ID NO: 685927 - DNA, 25 bp, Mus musculus
gccttgtggagttccaagatgtctc

SEQ ID NO: 685928 - DNA, 25 bp, Mus musculus
gccttgtggtcaatgcccctgatac

SEQ ID NO: 685929 - DNA, 25 bp, Mus musculus
gccttgtggtcattgcccctgatac

SEQ ID NO: 685930 - DNA, 25 bp, Mus musculus
gccttgtggttaaccaatctattag

SEQ ID NO: 685931 - DNA, 25 bp, Mus musculus
gccttgtggttatccaatctattag

SEQ ID NO: 685932 - DNA, 25 bp, Mus musculus
gccttgttagaactcctcctggcgg

SEQ ID NO: 685933 - DNA, 25 bp, Mus musculus
gccttgttagaagtcctcctggcgg

SEQ ID NO: 685934 - DNA, 25 bp, Mus musculus
gccttgttcaatcgtttgacactac

SEQ ID NO: 685935 - DNA, 25 bp, Mus musculus
gccttgttcaatggtttgacactac

SEQ ID NO: 685936 - DNA, 25 bp, Mus musculus
gccttgttgcaacagtaagtatact

SEQ ID NO: 685937 - DNA, 25 bp, Mus musculus
gccttgttgcaagagtaagtatact

SEQ ID NO: 685938 - DNA, 25 bp, Mus musculus
gcctttaagaacagatcctgaatgt

SEQ ID NO: 685939 - DNA, 25 bp, Mus musculus
gcctttaagaactgatcctgaatgt

SEQ ID NO: 685940 - DNA, 25 bp, Mus musculus
gcctttacaataatgctggtctacg

SEQ ID NO: 685941 - DNA, 25 bp, Mus musculus
gcctttacaatattgctggtctacg

SEQ ID NO: 685942 - DNA, 25 bp, Mus musculus
gcctttaccccgatagcctgtggat

SEQ ID NO: 685943 - DNA, 25 bp, Mus musculus
gcctttaccccgttagcctgtggat

SEQ ID NO: 685944 - DNA, 25 bp, Mus musculus
gcctttacgtaacctctcctgaaag

SEQ ID NO: 685945 - DNA, 25 bp, Mus musculus
gcctttacgtaagctctcctgaaag

SEQ ID NO: 685946 - DNA, 25 bp, Mus musculus
gcctttactttcaggtgttttcacg

SEQ ID NO: 685947 - DNA, 25 bp, Mus musculus
gcctttactttctggtgttttcacg

SEQ ID NO: 685948 - DNA, 25 bp, Mus musculus
gcctttagcaaaagccacctccaga

SEQ ID NO: 685949 - DNA, 25 bp, Mus musculus
gcctttagcaaatgccacctccaga

SEQ ID NO: 685950 - DNA, 25 bp, Mus musculus
gcctttagccccagtggatgatgca

SEQ ID NO: 685951 - DNA, 25 bp, Mus musculus
gcctttagcccctgtggatgatgca

SEQ ID NO: 685952 - DNA, 25 bp, Mus musculus
gcctttagcgctacatccttggtta

SEQ ID NO: 685953 - DNA, 25 bp, Mus musculus
gcctttagcgcttcatccttggtta

SEQ ID NO: 685954 - DNA, 25 bp, Mus musculus
gcctttagctaacataattcccata

SEQ ID NO: 685955 - DNA, 25 bp, Mus musculus
gcctttagctaagataattcccata

SEQ ID NO: 685956 - DNA, 25 bp, Mus musculus
gcctttatcgtgagagattcgagac

SEQ ID NO: 685957 - DNA, 25 bp, Mus musculus
gcctttatcgtgtgagattcgagac

SEQ ID NO: 685958 - DNA, 25 bp, Mus musculus
gcctttatgcaaagcacggaacgag

SEQ ID NO: 685959 - DNA, 25 bp, Mus musculus
gcctttatgcaatgcacggaacgag

SEQ ID NO: 685960 - DNA, 25 bp, Mus musculus
gcctttcaacctatgcagaacaacg

SEQ ID NO: 685961 - DNA, 25 bp, Mus musculus
gcctttcaacctttgcagaacaacg

SEQ ID NO: 685962 - DNA, 25 bp, Mus musculus
gcctttcagaaacatggatagaaga

SEQ ID NO: 685963 - DNA, 25 bp, Mus musculus
gcctttcagaaagatggatagaaga

SEQ ID NO: 685964 - DNA, 25 bp, Mus musculus
gcctttcatccacaagctgttccgg

SEQ ID NO: 685965 - DNA, 25 bp, Mus musculus
gcctttcatccagaagctgttccgg

SEQ ID NO: 685966 - DNA, 25 bp, Mus musculus
gcctttccaggaagcacataattga

SEQ ID NO: 685967 - DNA, 25 bp, Mus musculus
gcctttccaggaataccgaaagctg

SEQ ID NO: 685968 - DNA, 25 bp, Mus musculus
gcctttccaggatgcacataattga

SEQ ID NO: 685969 - DNA, 25 bp, Mus musculus
gcctttccaggattaccgaaagctg

SEQ ID NO: 685970 - DNA, 25 bp, Mus musculus
gcctttccaggcagcgcaaggacaa

SEQ ID NO: 685971 - DNA, 25 bp, Mus musculus
gcctttccaggctgcgcaaggacaa

SEQ ID NO: 685972 - DNA, 25 bp, Mus musculus
gcctttccgatcctgtactccaggg

SEQ ID NO: 685973 - DNA, 25 bp, Mus musculus
gcctttccgatcgtgtactccaggg

SEQ ID NO: 685974 - DNA, 25 bp, Mus musculus
gcctttcctgccaatcaagtaagag

SEQ ID NO: 685975 - DNA, 25 bp, Mus musculus
gcctttcctgcctatcaagtaagag

SEQ ID NO: 685976 - DNA, 25 bp, Mus musculus
gcctttcctgtacgctgttccggga

SEQ ID NO: 685977 - DNA, 25 bp, Mus musculus
gcctttcctgtaggctgttccggga

SEQ ID NO: 685978 - DNA, 25 bp, Mus musculus
gcctttcctttcaaaaatgtctgcc

SEQ ID NO: 685979 - DNA, 25 bp, Mus musculus
gcctttcctttctaaaatgtctgcc

SEQ ID NO: 685980 - DNA, 25 bp, Mus musculus
gcctttcgaagcatgctgaggcagg

SEQ ID NO: 685981 - DNA, 25 bp, Mus musculus
gcctttcgaagcttgctgaggcagg

SEQ ID NO: 685982 - DNA, 25 bp, Mus musculus
gcctttcgagggacctgccaggcgt

SEQ ID NO: 685983 - DNA, 25 bp, Mus musculus
gcctttcgagggtcctgccaggcgt

SEQ ID NO: 685984 - DNA, 25 bp, Mus musculus
gcctttcggtttccctatgccaaga

SEQ ID NO: 685985 - DNA, 25 bp, Mus musculus
gcctttcggtttgcctatgccaaga

SEQ ID NO: 685986 - DNA, 25 bp, Mus musculus
gcctttctcagtcgtgttgctcatc

SEQ ID NO: 685987 - DNA, 25 bp, Mus musculus
gcctttctcagtggtgttgctcatc

SEQ ID NO: 685988 - DNA, 25 bp, Mus musculus
gcctttctcataccagttgtggtac

SEQ ID NO: 685989 - DNA, 25 bp, Mus musculus
gcctttctcatagcagttgtggtac

SEQ ID NO: 685990 - DNA, 25 bp, Mus musculus
gcctttctcattacaccaagataat

SEQ ID NO: 685991 - DNA, 25 bp, Mus musculus
gcctttctcatttcaccaagataat

SEQ ID NO: 685992 - DNA, 25 bp, Mus musculus
gcctttctccatagaggaaatcgag

SEQ ID NO: 685993 - DNA, 25 bp, Mus musculus
gcctttctccattgaggaaatcgag

SEQ ID NO: 685994 - DNA, 25 bp, Mus musculus
gcctttctcgagagtctgactacaa

SEQ ID NO: 685995 - DNA, 25 bp, Mus musculus
gcctttctcgagtgtctgactacaa

SEQ ID NO: 685996 - DNA, 25 bp, Mus musculus
gcctttctgggtagcccacagggcc

SEQ ID NO: 685997 - DNA, 25 bp, Mus musculus
gcctttctgggttgcccacagggcc

SEQ ID NO: 685998 - DNA, 25 bp, Mus musculus
gcctttcttgcactttctttggtga

SEQ ID NO: 685999 - DNA, 25 bp, Mus musculus
gcctttcttgcagtttctttggtga

SEQ ID NO: 686000 - DNA, 25 bp, Mus musculus
gcctttcttgccatcccaaggatcg

SEQ ID NO: 686001 - DNA, 25 bp, Mus musculus
gcctttcttgccttcccaaggatcg

SEQ ID NO: 686002 - DNA, 25 bp, Mus musculus
gcctttgacagcatgcagccatcag

SEQ ID NO: 686003 - DNA, 25 bp, Mus musculus
gcctttgacagcttgcagccatcag

SEQ ID NO: 686004 - DNA, 25 bp, Mus musculus
gcctttgacctgctggaccggagtc

SEQ ID NO: 686005 - DNA, 25 bp, Mus musculus
gcctttgacctggtggaccggagtc

SEQ ID NO: 686006 - DNA, 25 bp, Mus musculus
gcctttgatagtaaagaaaggaagc

SEQ ID NO: 686007 - DNA, 25 bp, Mus musculus
gcctttgatagttaagaaaggaagc

SEQ ID NO: 686008 - DNA, 25 bp, Mus musculus
gcctttgatctgatgcactcgggag

SEQ ID NO: 686009 - DNA, 25 bp, Mus musculus
gcctttgatctgttgcactcgggag

SEQ ID NO: 686010 - DNA, 25 bp, Mus musculus
gcctttgcaaggaatgtgtagagcc

SEQ ID NO: 686011 - DNA, 25 bp, Mus musculus
gcctttgcaaggtatgtgtagagcc

SEQ ID NO: 686012 - DNA, 25 bp, Mus musculus
gcctttgcagacacagttcaaggag

SEQ ID NO: 686013 - DNA, 25 bp, Mus musculus
gcctttgcagactcagttcaaggag

SEQ ID NO: 686014 - DNA, 25 bp, Mus musculus
gcctttgccacgaggccgacgcagg

SEQ ID NO: 686015 - DNA, 25 bp, Mus musculus
gcctttgccacgtggccgacgcagg

SEQ ID NO: 686016 - DNA, 25 bp, Mus musculus
gcctttgccactcgttctgatgatg

SEQ ID NO: 686017 - DNA, 25 bp, Mus musculus
gcctttgccactggttctgatgatg

SEQ ID NO: 686018 - DNA, 25 bp, Mus musculus
gcctttgccagaatcagaagaggaa

SEQ ID NO: 686019 - DNA, 25 bp, Mus musculus
gcctttgccagattcagaagaggaa

SEQ ID NO: 686020 - DNA, 25 bp, Mus musculus
gcctttgccgacaccttttatgctg

SEQ ID NO: 686021 - DNA, 25 bp, Mus musculus
gcctttgccgactccttttatgctg

SEQ ID NO: 686022 - DNA, 25 bp, Mus musculus
gcctttgctcttcactgcagagaca

SEQ ID NO: 686023 - DNA, 25 bp, Mus musculus
gcctttgctcttgactgcagagaca

SEQ ID NO: 686024 - DNA, 25 bp, Mus musculus
gcctttgctgagacaccccggaata

SEQ ID NO: 686025 - DNA, 25 bp, Mus musculus
gcctttgctgagtcaccccggaata

SEQ ID NO: 686026 - DNA, 25 bp, Mus musculus
gcctttggaaacatcttgtcctgta

SEQ ID NO: 686027 - DNA, 25 bp, Mus musculus
gcctttggaaacttcttgtcctgta

SEQ ID NO: 686028 - DNA, 25 bp, Mus musculus
gcctttggaattctatctgagcatt

SEQ ID NO: 686029 - DNA, 25 bp, Mus musculus
gcctttggaattgtatctgagcatt

SEQ ID NO: 686030 - DNA, 25 bp, Mus musculus
gcctttggacaacgattggctgcag

SEQ ID NO: 686031 - DNA, 25 bp, Mus musculus
gcctttggacaaggattggctgcag

SEQ ID NO: 686032 - DNA, 25 bp, Mus musculus
gcctttggccagaagatcggccaat

SEQ ID NO: 686033 - DNA, 25 bp, Mus musculus
gcctttggccagtagatcggccaat

SEQ ID NO: 686034 - DNA, 25 bp, Mus musculus
gcctttggctggctgcaacttccat

SEQ ID NO: 686035 - DNA, 25 bp, Mus musculus
gcctttggctgggtgcaacttccat

SEQ ID NO: 686036 - DNA, 25 bp, Mus musculus
gcctttggtcatcggcagggccatc

SEQ ID NO: 686037 - DNA, 25 bp, Mus musculus
gcctttggtcatgggcagggccatc

SEQ ID NO: 686038 - DNA, 25 bp, Mus musculus
gcctttggtccaccatgtgccgcat

SEQ ID NO: 686039 - DNA, 25 bp, Mus musculus
gcctttggtccagcatgtgccgcat

SEQ ID NO: 686040 - DNA, 25 bp, Mus musculus
gcctttggtgatcctccaggaccta

SEQ ID NO: 686041 - DNA, 25 bp, Mus musculus
gcctttggtgatgctccaggaccta

SEQ ID NO: 686042 - DNA, 25 bp, Mus musculus
gcctttgtagacaagaattagtgag

SEQ ID NO: 686043 - DNA, 25 bp, Mus musculus
gcctttgtagactagaattagtgag

SEQ ID NO: 686044 - DNA, 25 bp, Mus musculus
gcctttgtcacgaggcacaggtacc

SEQ ID NO: 686045 - DNA, 25 bp, Mus musculus
gcctttgtcacgtggcacaggtacc

SEQ ID NO: 686046 - DNA, 25 bp, Mus musculus
gcctttgtgtgcatctacctcatca

SEQ ID NO: 686047 - DNA, 25 bp, Mus musculus
gcctttgtgtgcttctacctcatca

SEQ ID NO: 686048 - DNA, 25 bp, Mus musculus
gcctttgttgaaaattatccacagt

SEQ ID NO: 686049 - DNA, 25 bp, Mus musculus
gcctttgttgaatattatccacagt

SEQ ID NO: 686050 - DNA, 25 bp, Mus musculus
gccttttaaaagaagagtgacatga

SEQ ID NO: 686051 - DNA, 25 bp, Mus musculus
gccttttaaaagtagagtgacatga

SEQ ID NO: 686052 - DNA, 25 bp, Mus musculus
gccttttaccacaagagacttctct

SEQ ID NO: 686053 - DNA, 25 bp, Mus musculus
gccttttaccactagagacttctct

SEQ ID NO: 686054 - DNA, 25 bp, Mus musculus
gccttttaggctcccctgctgtggg

SEQ ID NO: 686055 - DNA, 25 bp, Mus musculus
gccttttaggctgccctgctgtggg

SEQ ID NO: 686056 - DNA, 25 bp, Mus musculus
gccttttatcatccaccaattgtaa

SEQ ID NO: 686057 - DNA, 25 bp, Mus musculus
gccttttatcatgcaccaattgtaa

SEQ ID NO: 686058 - DNA, 25 bp, Mus musculus
gccttttcacacagccagagcatgt

SEQ ID NO: 686059 - DNA, 25 bp, Mus musculus
gccttttcacactgccagagcatgt

SEQ ID NO: 686060 - DNA, 25 bp, Mus musculus
gccttttccgccaaagtgctggaat

SEQ ID NO: 686061 - DNA, 25 bp, Mus musculus
gccttttccgcccagcataatcaga

SEQ ID NO: 686062 - DNA, 25 bp, Mus musculus
gccttttccgccgagcataatcaga

SEQ ID NO: 686063 - DNA, 25 bp, Mus musculus
gccttttccgcctaagtgctggaat

SEQ ID NO: 686064 - DNA, 25 bp, Mus musculus
gccttttccgtcatgagtcctttga

SEQ ID NO: 686065 - DNA, 25 bp, Mus musculus
gccttttccgtcttgagtcctttga

SEQ ID NO: 686066 - DNA, 25 bp, Mus musculus
gccttttccttgattaacgtagcaa

SEQ ID NO: 686067 - DNA, 25 bp, Mus musculus
gccttttccttgtttaacgtagcaa

SEQ ID NO: 686068 - DNA, 25 bp, Mus musculus
gccttttctcagacatgaaagttgg

SEQ ID NO: 686069 - DNA, 25 bp, Mus musculus
gccttttctcagactcgaagcagca

SEQ ID NO: 686070 - DNA, 25 bp, Mus musculus
gccttttctcagtcatgaaagttgg

SEQ ID NO: 686071 - DNA, 25 bp, Mus musculus
gccttttctcagtctcgaagcagca

SEQ ID NO: 686072 - DNA, 25 bp, Mus musculus
gccttttctcgtccattgagtcgga

SEQ ID NO: 686073 - DNA, 25 bp, Mus musculus
gccttttctcgtgcattgagtcgga

SEQ ID NO: 686074 - DNA, 25 bp, Mus musculus
gccttttctgttagagcttaaccta

SEQ ID NO: 686075 - DNA, 25 bp, Mus musculus
gccttttctgtttgagcttaaccta

SEQ ID NO: 686076 - DNA, 25 bp, Mus musculus
gccttttggaaaaaggtgacatgag

SEQ ID NO: 686077 - DNA, 25 bp, Mus musculus
gccttttggaaataggtgacatgag

SEQ ID NO: 686078 - DNA, 25 bp, Mus musculus
gccttttgtgggatgcattctttga

SEQ ID NO: 686079 - DNA, 25 bp, Mus musculus
gccttttgtgggttgcattctttga

SEQ ID NO: 686080 - DNA, 25 bp, Mus musculus
gccttttgttttcacaccagagctt

SEQ ID NO: 686081 - DNA, 25 bp, Mus musculus
gccttttgttttgacaccagagctt

SEQ ID NO: 686082 - DNA, 25 bp, Mus musculus
gcctttttagtacatggctttcaga

SEQ ID NO: 686083 - DNA, 25 bp, Mus musculus
gcctttttagtagatggctttcaga

SEQ ID NO: 686084 - DNA, 25 bp, Mus musculus
gcctttttattcagcaagtctgatc

SEQ ID NO: 686085 - DNA, 25 bp, Mus musculus
gcctttttattctgcaagtctgatc

SEQ ID NO: 686086 - DNA, 25 bp, Mus musculus
gcctttttctcacagaagaagtatc

SEQ ID NO: 686087 - DNA, 25 bp, Mus musculus
gcctttttctcagagaagaagtatc

SEQ ID NO: 686088 - DNA, 25 bp, Mus musculus
gcctttttgcctacccggacactca

SEQ ID NO: 686089 - DNA, 25 bp, Mus musculus
gcctttttgccttcccggacactca

SEQ ID NO: 686090 - DNA, 25 bp, Mus musculus
gcgaaaacgccgcaagtcggtgaca

SEQ ID NO: 686091 - DNA, 25 bp, Mus musculus
gcgaaaacgccggaagtcggtgaca

SEQ ID NO: 686092 - DNA, 25 bp, Mus musculus
gcgaaaactccaattacctagagga

SEQ ID NO: 686093 - DNA, 25 bp, Mus musculus
gcgaaaactccatttacctagagga

SEQ ID NO: 686094 - DNA, 25 bp, Mus musculus
gcgaaaactctcaagttggcagcat

SEQ ID NO: 686095 - DNA, 25 bp, Mus musculus
gcgaaaactctctagttggcagcat

SEQ ID NO: 686096 - DNA, 25 bp, Mus musculus
gcgaaaagatgacaaaagtccgcgg

SEQ ID NO: 686097 - DNA, 25 bp, Mus musculus
gcgaaaagatgagaaaagtccgcgg

SEQ ID NO: 686098 - DNA, 25 bp, Mus musculus
gcgaaaccggagattgcaggcagca

SEQ ID NO: 686099 - DNA, 25 bp, Mus musculus
gcgaaaccggagtttgcaggcagca

SEQ ID NO: 686100 - DNA, 25 bp, Mus musculus
gcgaaactgagaatccctgtgttca

SEQ ID NO: 686101 - DNA, 25 bp, Mus musculus
gcgaaactgagattccctgtgttca

SEQ ID NO: 686102 - DNA, 25 bp, Mus musculus
gcgaaagacgctagaaccagaagga

SEQ ID NO: 686103 - DNA, 25 bp, Mus musculus
gcgaaagacgcttgaaccagaagga

SEQ ID NO: 686104 - DNA, 25 bp, Mus musculus
gcgaaagcaggacggtgcaaacatt

SEQ ID NO: 686105 - DNA, 25 bp, Mus musculus
gcgaaagcaggagggtgcaaacatt

SEQ ID NO: 686106 - DNA, 25 bp, Mus musculus
gcgaaagccaaactatcagcatctc

SEQ ID NO: 686107 - DNA, 25 bp, Mus musculus
gcgaaagccaaagtatcagcatctc

SEQ ID NO: 686108 - DNA, 25 bp, Mus musculus
gcgaaagccagtcttcccagatagt

SEQ ID NO: 686109 - DNA, 25 bp, Mus musculus
gcgaaagccagtgttcccagatagt

SEQ ID NO: 686110 - DNA, 25 bp, Mus musculus
gcgaaagcgtaaccgcctgcgtcga

SEQ ID NO: 686111 - DNA, 25 bp, Mus musculus
gcgaaagcgtaagcgcctgcgtcga

SEQ ID NO: 686112 - DNA, 25 bp, Mus musculus
gcgaaagggtgaaccgttctgaaga

SEQ ID NO: 686113 - DNA, 25 bp, Mus musculus
gcgaaagggtgatccgttctgaaga

SEQ ID NO: 686114 - DNA, 25 bp, Mus musculus
gcgaacaatacacgtacgactcgca

SEQ ID NO: 686115 - DNA, 25 bp, Mus musculus
gcgaacaatacaggtacgactcgca

SEQ ID NO: 686116 - DNA, 25 bp, Mus musculus
gcgaaccctgctagagtgtcccggg

SEQ ID NO: 686117 - DNA, 25 bp, Mus musculus
gcgaaccctgcttgagtgtcccggg

SEQ ID NO: 686118 - DNA, 25 bp, Mus musculus
gcgaacctcgctcgatttgtctttc

SEQ ID NO: 686119 - DNA, 25 bp, Mus musculus
gcgaacctcgctggatttgtctttc

SEQ ID NO: 686120 - DNA, 25 bp, Mus musculus
gcgaacctgcagatacccaattgtg

SEQ ID NO: 686121 - DNA, 25 bp, Mus musculus
gcgaacctgcagttacccaattgtg

SEQ ID NO: 686122 - DNA, 25 bp, Mus musculus
gcgaacgaacctcgaactatggtca

SEQ ID NO: 686123 - DNA, 25 bp, Mus musculus
gcgaacgaacctggaactatggtca

SEQ ID NO: 686124 - DNA, 25 bp, Mus musculus
gcgaacggtgcgatcaagaagctgt

SEQ ID NO: 686125 - DNA, 25 bp, Mus musculus
gcgaacggtgcgttcaagaagctgt

SEQ ID NO: 686126 - DNA, 25 bp, Mus musculus
gcgaactccggtccatggcacgcag

SEQ ID NO: 686127 - DNA, 25 bp, Mus musculus
gcgaactccggtgcatggcacgcag

SEQ ID NO: 686128 - DNA, 25 bp, Mus musculus
gcgaactctctgcaacaaacacacg

SEQ ID NO: 686129 - DNA, 25 bp, Mus musculus
gcgaactctctggaacaaacacacg

SEQ ID NO: 686130 - DNA, 25 bp, Mus musculus
gcgaagaaattacatgcctttggct

SEQ ID NO: 686131 - DNA, 25 bp, Mus musculus
gcgaagaaattagatgcctttggct

SEQ ID NO: 686132 - DNA, 25 bp, Mus musculus
gcgaagaacggcagtgaagcagaca

SEQ ID NO: 686133 - DNA, 25 bp, Mus musculus
gcgaagaacggctgtgaagcagaca

SEQ ID NO: 686134 - DNA, 25 bp, Mus musculus
gcgaagaagagaaccgcgaggcctt

SEQ ID NO: 686135 - DNA, 25 bp, Mus musculus
gcgaagaagagatccgcgaggcctt

SEQ ID NO: 686136 - DNA, 25 bp, Mus musculus
gcgaagaaggtgaaggcgactatct

SEQ ID NO: 686137 - DNA, 25 bp, Mus musculus
gcgaagaaggtgtaggcgactatct

SEQ ID NO: 686138 - DNA, 25 bp, Mus musculus
gcgaagaatgccaacacgatttcat

SEQ ID NO: 686139 - DNA, 25 bp, Mus musculus
gcgaagaatgcctacacgatttcat

SEQ ID NO: 686140 - DNA, 25 bp, Mus musculus
gcgaagacagtaaacaacaacaact

SEQ ID NO: 686141 - DNA, 25 bp, Mus musculus
gcgaagacagtatacaacaacaact

SEQ ID NO: 686142 - DNA, 25 bp, Mus musculus
gcgaagaccgagaccccaaggacta

SEQ ID NO: 686143 - DNA, 25 bp, Mus musculus
gcgaagaccgagtccccaaggacta

SEQ ID NO: 686144 - DNA, 25 bp, Mus musculus
gcgaagatggttacgtccgcatcca

SEQ ID NO: 686145 - DNA, 25 bp, Mus musculus
gcgaagatggtttcgtccgcatcca

SEQ ID NO: 686146 - DNA, 25 bp, Mus musculus
gcgaagattcttccaccggagagct

SEQ ID NO: 686147 - DNA, 25 bp, Mus musculus
gcgaagattcttgcaccggagagct

SEQ ID NO: 686148 - DNA, 25 bp, Mus musculus
gcgaagcacagtacccatgccagta

SEQ ID NO: 686149 - DNA, 25 bp, Mus musculus
gcgaagcacagttcccatgccagta

SEQ ID NO: 686150 - DNA, 25 bp, Mus musculus
gcgaagcatattataccaaggcctt

SEQ ID NO: 686151 - DNA, 25 bp, Mus musculus
gcgaagcatattttaccaaggcctt

SEQ ID NO: 686152 - DNA, 25 bp, Mus musculus
gcgaagctactcatcaagcacgact

SEQ ID NO: 686153 - DNA, 25 bp, Mus musculus
gcgaagctactcttcaagcacgact

SEQ ID NO: 686154 - DNA, 25 bp, Mus musculus
gcgaagctgggaacgatactgaaag

SEQ ID NO: 686155 - DNA, 25 bp, Mus musculus
gcgaagctgggatcgatactgaaag

SEQ ID NO: 686156 - DNA, 25 bp, Mus musculus
gcgaaggacttgatgaccgaccata

SEQ ID NO: 686157 - DNA, 25 bp, Mus musculus
gcgaaggacttgttgaccgaccata

SEQ ID NO: 686158 - DNA, 25 bp, Mus musculus
gcgaaggatgtgctgacgactacca

SEQ ID NO: 686159 - DNA, 25 bp, Mus musculus
gcgaaggatgtggtgacgactacca

SEQ ID NO: 686160 - DNA, 25 bp, Mus musculus
gcgaaggcaatgaagtgaacaaacc

SEQ ID NO: 686161 - DNA, 25 bp, Mus musculus
gcgaaggcaatgtagtgaacaaacc

SEQ ID NO: 686162 - DNA, 25 bp, Mus musculus
gcgaaggcggctatagtagcagcat

SEQ ID NO: 686163 - DNA, 25 bp, Mus musculus
gcgaaggcggctttagtagcagcat

SEQ ID NO: 686164 - DNA, 25 bp, Mus musculus
gcgaagtcttgtatgagagccctga

SEQ ID NO: 686165 - DNA, 25 bp, Mus musculus
gcgaagtcttgtttgagagccctga

SEQ ID NO: 686166 - DNA, 25 bp, Mus musculus
gcgaagtgcttcactcctgaatgta

SEQ ID NO: 686167 - DNA, 25 bp, Mus musculus
gcgaagtgcttctctcctgaatgta

SEQ ID NO: 686168 - DNA, 25 bp, Mus musculus
gcgaagtggccaacggcactgaagc

SEQ ID NO: 686169 - DNA, 25 bp, Mus musculus
gcgaagtggccatcggcactgaagc

SEQ ID NO: 686170 - DNA, 25 bp, Mus musculus
gcgaagtgtgggacatgagcatcca

SEQ ID NO: 686171 - DNA, 25 bp, Mus musculus
gcgaagtgtgggtcatgagcatcca

SEQ ID NO: 686172 - DNA, 25 bp, Mus musculus
gcgaagttctggatgggaagacacc

SEQ ID NO: 686173 - DNA, 25 bp, Mus musculus
gcgaagttctggttgggaagacacc

SEQ ID NO: 686174 - DNA, 25 bp, Mus musculus
gcgaatatccaacctatctttgctg

SEQ ID NO: 686175 - DNA, 25 bp, Mus musculus
gcgaatatccaagctatctttgctg

SEQ ID NO: 686176 - DNA, 25 bp, Mus musculus
gcgaatgactgtagactggcacccc

SEQ ID NO: 686177 - DNA, 25 bp, Mus musculus
gcgaatgactgttgactggcacccc

SEQ ID NO: 686178 - DNA, 25 bp, Mus musculus
gcgaatgatcctcgccgaggcttca

SEQ ID NO: 686179 - DNA, 25 bp, Mus musculus
gcgaatgatcctggccgaggcttca

SEQ ID NO: 686180 - DNA, 25 bp, Mus musculus
gcgaattacccgctttccatccgat

SEQ ID NO: 686181 - DNA, 25 bp, Mus musculus
gcgaattacccggtttccatccgat

SEQ ID NO: 686182 - DNA, 25 bp, Mus musculus
gcgaatttatatcccattgccagag

SEQ ID NO: 686183 - DNA, 25 bp, Mus musculus
gcgaatttatatgccattgccagag

SEQ ID NO: 686184 - DNA, 25 bp, Mus musculus
gcgacaagccacacaagtgtgagtt

SEQ ID NO: 686185 - DNA, 25 bp, Mus musculus
gcgacaagccactcaagtgtgagtt

SEQ ID NO: 686186 - DNA, 25 bp, Mus musculus
gcgacacaacaccaatatcgccgag

SEQ ID NO: 686187 - DNA, 25 bp, Mus musculus
gcgacacaacacgaatatcgccgag

SEQ ID NO: 686188 - DNA, 25 bp, Mus musculus
gcgacacagaagaaaccgtccatca

SEQ ID NO: 686189 - DNA, 25 bp, Mus musculus
gcgacacagaagtaaccgtccatca

SEQ ID NO: 686190 - DNA, 25 bp, Mus musculus
gcgacacagcttctttggaattatg

SEQ ID NO: 686191 - DNA, 25 bp, Mus musculus
gcgacacagcttgtttggaattatg

SEQ ID NO: 686192 - DNA, 25 bp, Mus musculus
gcgacactggtgactccgtggcacg

SEQ ID NO: 686193 - DNA, 25 bp, Mus musculus
gcgacactggtgtctccgtggcacg

SEQ ID NO: 686194 - DNA, 25 bp, Mus musculus
gcgacactttcaatatgatatgaag

SEQ ID NO: 686195 - DNA, 25 bp, Mus musculus
gcgacactttcattatgatatgaag

SEQ ID NO: 686196 - DNA, 25 bp, Mus musculus
gcgacagacccgaagggtccaagtt

SEQ ID NO: 686197 - DNA, 25 bp, Mus musculus
gcgacagacccgtagggtccaagtt

SEQ ID NO: 686198 - DNA, 25 bp, Mus musculus
gcgacagccatgaataccgggtgtg

SEQ ID NO: 686199 - DNA, 25 bp, Mus musculus
gcgacagccatgtataccgggtgtg

SEQ ID NO: 686200 - DNA, 25 bp, Mus musculus
gcgacagcgtccagcagcgagtgaa

SEQ ID NO: 686201 - DNA, 25 bp, Mus musculus
gcgacagcgtcctgcagcgagtgaa

SEQ ID NO: 686202 - DNA, 25 bp, Mus musculus
gcgacagctaccagacgcactgctt

SEQ ID NO: 686203 - DNA, 25 bp, Mus musculus
gcgacagctacctgacgcactgctt

SEQ ID NO: 686204 - DNA, 25 bp, Mus musculus
gcgacaggatttcgcccagctcatg

SEQ ID NO: 686205 - DNA, 25 bp, Mus musculus
gcgacaggatttggcccagctcatg

SEQ ID NO: 686206 - DNA, 25 bp, Mus musculus
gcgacaggctctactcgggcgtgct

SEQ ID NO: 686207 - DNA, 25 bp, Mus musculus
gcgacaggctcttctcgggcgtgct

SEQ ID NO: 686208 - DNA, 25 bp, Mus musculus
gcgacagttccacggcccagggaca

SEQ ID NO: 686209 - DNA, 25 bp, Mus musculus
gcgacagttccagggcccagggaca

SEQ ID NO: 686210 - DNA, 25 bp, Mus musculus
gcgacagttttgagaatccagtcct

SEQ ID NO: 686211 - DNA, 25 bp, Mus musculus
gcgacagttttgtgaatccagtcct

SEQ ID NO: 686212 - DNA, 25 bp, Mus musculus
gcgacataagccagagcatcgttct

SEQ ID NO: 686213 - DNA, 25 bp, Mus musculus
gcgacataagcctgagcatcgttct

SEQ ID NO: 686214 - DNA, 25 bp, Mus musculus
gcgacatgacggacagcatcccgct

SEQ ID NO: 686215 - DNA, 25 bp, Mus musculus
gcgacatgacggtcagcatcccgct

SEQ ID NO: 686216 - DNA, 25 bp, Mus musculus
gcgacatgttttccaccttgtgtgc

SEQ ID NO: 686217 - DNA, 25 bp, Mus musculus
gcgacatgttttgcaccttgtgtgc

SEQ ID NO: 686218 - DNA, 25 bp, Mus musculus
gcgacatttaaaccggcagcagcgg

SEQ ID NO: 686219 - DNA, 25 bp, Mus musculus
gcgacatttaaagcggcagcagcgg

SEQ ID NO: 686220 - DNA, 25 bp, Mus musculus
gcgaccaagcaactacagcccgaat

SEQ ID NO: 686221 - DNA, 25 bp, Mus musculus
gcgaccaagcaagtacagcccgaat

SEQ ID NO: 686222 - DNA, 25 bp, Mus musculus
gcgaccaagtctcaattcctggagg

SEQ ID NO: 686223 - DNA, 25 bp, Mus musculus
gcgaccaagtctgaattcctggagg

SEQ ID NO: 686224 - DNA, 25 bp, Mus musculus
gcgaccagtgcgaccaagcctgacg

SEQ ID NO: 686225 - DNA, 25 bp, Mus musculus
gcgaccagtgcgtccaagcctgacg

SEQ ID NO: 686226 - DNA, 25 bp, Mus musculus
gcgaccagttcgagacaagtgtgct

SEQ ID NO: 686227 - DNA, 25 bp, Mus musculus
gcgaccagttcgtgacaagtgtgct

SEQ ID NO: 686228 - DNA, 25 bp, Mus musculus
gcgaccatcacaagacaacacagag

SEQ ID NO: 686229 - DNA, 25 bp, Mus musculus
gcgaccatcacatgacaacacagag

SEQ ID NO: 686230 - DNA, 25 bp, Mus musculus
gcgaccatgtgcaatgtgggctcat

SEQ ID NO: 686231 - DNA, 25 bp, Mus musculus
gcgaccatgtgctatgtgggctcat

SEQ ID NO: 686232 - DNA, 25 bp, Mus musculus
gcgacccagtggaatcccagagaaa

SEQ ID NO: 686233 - DNA, 25 bp, Mus musculus
gcgacccagtggtatcccagagaaa

SEQ ID NO: 686234 - DNA, 25 bp, Mus musculus
gcgaccccagccagggcctggtttg

SEQ ID NO: 686235 - DNA, 25 bp, Mus musculus
gcgaccccagcctgggcctggtttg

SEQ ID NO: 686236 - DNA, 25 bp, Mus musculus
gcgacccctggaatgcgtgctcttg

SEQ ID NO: 686237 - DNA, 25 bp, Mus musculus
gcgacccctggattgcgtgctcttg

SEQ ID NO: 686238 - DNA, 25 bp, Mus musculus
gcgaccgagtccactggaagtctta

SEQ ID NO: 686239 - DNA, 25 bp, Mus musculus
gcgaccgagtcctctggaagtctta

SEQ ID NO: 686240 - DNA, 25 bp, Mus musculus
gcgaccgcagccaaagtctgtctct

SEQ ID NO: 686241 - DNA, 25 bp, Mus musculus
gcgaccgcagcctaagtctgtctct

SEQ ID NO: 686242 - DNA, 25 bp, Mus musculus
gcgaccgccgccaaaaaagcttgct

SEQ ID NO: 686243 - DNA, 25 bp, Mus musculus
gcgaccgccgcctaaaaagcttgct

SEQ ID NO: 686244 - DNA, 25 bp, Mus musculus
gcgaccggtgctactcttgaaacga

SEQ ID NO: 686245 - DNA, 25 bp, Mus musculus
gcgaccggtgcttctcttgaaacga

SEQ ID NO: 686246 - DNA, 25 bp, Mus musculus
gcgacctgctggagctactgctcca

SEQ ID NO: 686247 - DNA, 25 bp, Mus musculus
gcgacctgctggtgctactgctcca

SEQ ID NO: 686248 - DNA, 25 bp, Mus musculus
gcgacctgctttaatgccttcgtgg

SEQ ID NO: 686249 - DNA, 25 bp, Mus musculus
gcgacctgcttttatgccttcgtgg

SEQ ID NO: 686250 - DNA, 25 bp, Mus musculus
gcgacctggtgtaactctacgagct

SEQ ID NO: 686251 - DNA, 25 bp, Mus musculus
gcgacctggtgttactctacgagct

SEQ ID NO: 686252 - DNA, 25 bp, Mus musculus
gcgaccttggtgaagccctggctta

SEQ ID NO: 686253 - DNA, 25 bp, Mus musculus
gcgaccttggtgtagccctggctta

SEQ ID NO: 686254 - DNA, 25 bp, Mus musculus
gcgaccttgtatcagcaactgagag

SEQ ID NO: 686255 - DNA, 25 bp, Mus musculus
gcgaccttgtatgagcaactgagag

SEQ ID NO: 686256 - DNA, 25 bp, Mus musculus
gcgacgacgagtacgactacctctt

SEQ ID NO: 686257 - DNA, 25 bp, Mus musculus
gcgacgacgagttcgactacctctt

SEQ ID NO: 686258 - DNA, 25 bp, Mus musculus
gcgacgactgatcttcctttaaata

SEQ ID NO: 686259 - DNA, 25 bp, Mus musculus
gcgacgactgatgttcctttaaata

SEQ ID NO: 686260 - DNA, 25 bp, Mus musculus
gcgacgagatttatctcacaaggag

SEQ ID NO: 686261 - DNA, 25 bp, Mus musculus
gcgacgagatttttctcacaaggag

SEQ ID NO: 686262 - DNA, 25 bp, Mus musculus
gcgacgaggacaagaggaaacagat

SEQ ID NO: 686263 - DNA, 25 bp, Mus musculus
gcgacgaggacatgaggaaacagat

SEQ ID NO: 686264 - DNA, 25 bp, Mus musculus
gcgacgagttgtcttggtcaacaat

SEQ ID NO: 686265 - DNA, 25 bp, Mus musculus
gcgacgagttgtgttggtcaacaat

SEQ ID NO: 686266 - DNA, 25 bp, Mus musculus
gcgacgatgccactatcaaagcctg

SEQ ID NO: 686267 - DNA, 25 bp, Mus musculus
gcgacgatgccagtatcaaagcctg

SEQ ID NO: 686268 - DNA, 25 bp, Mus musculus
gcgacgatttgaagggacccgagtc

SEQ ID NO: 686269 - DNA, 25 bp, Mus musculus
gcgacgatttgatgggacccgagtc

SEQ ID NO: 686270 - DNA, 25 bp, Mus musculus
gcgacgctcctcagcggcaagatgg

SEQ ID NO: 686271 - DNA, 25 bp, Mus musculus
gcgacgctcctctgcggcaagatgg

SEQ ID NO: 686272 - DNA, 25 bp, Mus musculus
gcgacgctgggaacaagtccccaga

SEQ ID NO: 686273 - DNA, 25 bp, Mus musculus
gcgacgctgggatcaagtccccaga

SEQ ID NO: 686274 - DNA, 25 bp, Mus musculus
gcgacgcttcgaaagtacacctatg

SEQ ID NO: 686275 - DNA, 25 bp, Mus musculus
gcgacgcttcgatagtacacctatg

SEQ ID NO: 686276 - DNA, 25 bp, Mus musculus
gcgacgggcgtccaacctttcacgg

SEQ ID NO: 686277 - DNA, 25 bp, Mus musculus
gcgacgggcgtcgaacctttcacgg

SEQ ID NO: 686278 - DNA, 25 bp, Mus musculus
gcgacgtgatttcctgagactgcag

SEQ ID NO: 686279 - DNA, 25 bp, Mus musculus
gcgacgtgatttgctgagactgcag

SEQ ID NO: 686280 - DNA, 25 bp, Mus musculus
gcgactacctttctgcagccgagcg

SEQ ID NO: 686281 - DNA, 25 bp, Mus musculus
gcgactacctttgtgcagccgagcg

SEQ ID NO: 686282 - DNA, 25 bp, Mus musculus
gcgactactcgtcacaatgtcccag

SEQ ID NO: 686283 - DNA, 25 bp, Mus musculus
gcgactactcgtgacaatgtcccag

SEQ ID NO: 686284 - DNA, 25 bp, Mus musculus
gcgactaggaccatgtgcacgcgga

SEQ ID NO: 686285 - DNA, 25 bp, Mus musculus
gcgactaggaccttgtgcacgcgga

SEQ ID NO: 686286 - DNA, 25 bp, Mus musculus
gcgactagttgtaccccgagacgac

SEQ ID NO: 686287 - DNA, 25 bp, Mus musculus
gcgactagttgttccccgagacgac

SEQ ID NO: 686288 - DNA, 25 bp, Mus musculus
gcgactatctggatgactggacagt

SEQ ID NO: 686289 - DNA, 25 bp, Mus musculus
gcgactatctggttgactggacagt

SEQ ID NO: 686290 - DNA, 25 bp, Mus musculus
gcgactatgactatgaccaggacga

SEQ ID NO: 686291 - DNA, 25 bp, Mus musculus
gcgactatgactttgaccaggacga

SEQ ID NO: 686292 - DNA, 25 bp, Mus musculus
gcgactcaatctatccagtaaccag

SEQ ID NO: 686293 - DNA, 25 bp, Mus musculus
gcgactcaatctttccagtaaccag

SEQ ID NO: 686294 - DNA, 25 bp, Mus musculus
gcgactcggcgtcgttctcctcggt

SEQ ID NO: 686295 - DNA, 25 bp, Mus musculus
gcgactcggcgtggttctcctcggt

SEQ ID NO: 686296 - DNA, 25 bp, Mus musculus
gcgactctgcaacaattggccaaga

SEQ ID NO: 686297 - DNA, 25 bp, Mus musculus
gcgactctgcaagaattggccaaga

SEQ ID NO: 686298 - DNA, 25 bp, Mus musculus
gcgactcttggacatagactccgta

SEQ ID NO: 686299 - DNA, 25 bp, Mus musculus
gcgactcttggagatagactccgta

SEQ ID NO: 686300 - DNA, 25 bp, Mus musculus
gcgactgaccttagccgggagccca

SEQ ID NO: 686301 - DNA, 25 bp, Mus musculus
gcgactgacctttgccgggagccca

SEQ ID NO: 686302 - DNA, 25 bp, Mus musculus
gcgactggagatcattgataaggac

SEQ ID NO: 686303 - DNA, 25 bp, Mus musculus
gcgactggagatgattgataaggac

SEQ ID NO: 686304 - DNA, 25 bp, Mus musculus
gcgactgtaactctggtgatgccca

SEQ ID NO: 686305 - DNA, 25 bp, Mus musculus
gcgactgtaactgtggtgatgccca

SEQ ID NO: 686306 - DNA, 25 bp, Mus musculus
gcgactgtcctaactgcatttgcac

SEQ ID NO: 686307 - DNA, 25 bp, Mus musculus
gcgactgtcctatctgcatttgcac

SEQ ID NO: 686308 - DNA, 25 bp, Mus musculus
gcgacttactgtacaggataaagat

SEQ ID NO: 686309 - DNA, 25 bp, Mus musculus
gcgacttactgttcaggataaagat

SEQ ID NO: 686310 - DNA, 25 bp, Mus musculus
gcgacttcagtgatcacatcagcag

SEQ ID NO: 686311 - DNA, 25 bp, Mus musculus
gcgacttcagtgttcacatcagcag

SEQ ID NO: 686312 - DNA, 25 bp, Mus musculus
gcgacttcgctcactgcagcgggcg

SEQ ID NO: 686313 - DNA, 25 bp, Mus musculus
gcgacttcgctctctgcagcgggcg

SEQ ID NO: 686314 - DNA, 25 bp, Mus musculus
gcgacttgagcacagtccggcacaa

SEQ ID NO: 686315 - DNA, 25 bp, Mus musculus
gcgacttgagcagagtccggcacaa

SEQ ID NO: 686316 - DNA, 25 bp, Mus musculus
gcgagaaaccgacctcgagccttgg

SEQ ID NO: 686317 - DNA, 25 bp, Mus musculus
gcgagaaaccgagctcgagccttgg

SEQ ID NO: 686318 - DNA, 25 bp, Mus musculus
gcgagaagattccatcagatcacat

SEQ ID NO: 686319 - DNA, 25 bp, Mus musculus
gcgagaagattcgatcagatcacat

SEQ ID NO: 686320 - DNA, 25 bp, Mus musculus
gcgagaagccttacaatatgcgaaa

SEQ ID NO: 686321 - DNA, 25 bp, Mus musculus
gcgagaagcctttcaatatgcgaaa

SEQ ID NO: 686322 - DNA, 25 bp, Mus musculus
gcgagaagtgaacgttgcccagtta

SEQ ID NO: 686323 - DNA, 25 bp, Mus musculus
gcgagaagtgaaggttgcccagtta

SEQ ID NO: 686324 - DNA, 25 bp, Mus musculus
gcgagaatatgtacaccatcatgaa

SEQ ID NO: 686325 - DNA, 25 bp, Mus musculus
gcgagaatatgttcaccatcatgaa

SEQ ID NO: 686326 - DNA, 25 bp, Mus musculus
gcgagaatggcaccagcttgaccga

SEQ ID NO: 686327 - DNA, 25 bp, Mus musculus
gcgagaatggcagcagcttgaccga

SEQ ID NO: 686328 - DNA, 25 bp, Mus musculus
gcgagaattttcaggcccgaggcaa

SEQ ID NO: 686329 - DNA, 25 bp, Mus musculus
gcgagaattttctggcccgaggcaa

SEQ ID NO: 686330 - DNA, 25 bp, Mus musculus
gcgagacccaccagatgcactcttt

SEQ ID NO: 686331 - DNA, 25 bp, Mus musculus
gcgagacccacctgatgcactcttt

SEQ ID NO: 686332 - DNA, 25 bp, Mus musculus
gcgagacccagcaccggagtggcct

SEQ ID NO: 686333 - DNA, 25 bp, Mus musculus
gcgagacccagctccggagtggcct

SEQ ID NO: 686334 - DNA, 25 bp, Mus musculus
gcgagacccagtacgagagcaaggt

SEQ ID NO: 686335 - DNA, 25 bp, Mus musculus
gcgagacccagttcgagagcaaggt

SEQ ID NO: 686336 - DNA, 25 bp, Mus musculus
gcgagaccttgtatgaattgctaca

SEQ ID NO: 686337 - DNA, 25 bp, Mus musculus
gcgagaccttgtttgaattgctaca

SEQ ID NO: 686338 - DNA, 25 bp, Mus musculus
gcgagactgctactcataaagttaa

SEQ ID NO: 686339 - DNA, 25 bp, Mus musculus
gcgagactgctagtcataaagttaa

SEQ ID NO: 686340 - DNA, 25 bp, Mus musculus
gcgagactggtaaccttagtgcact

SEQ ID NO: 686341 - DNA, 25 bp, Mus musculus
gcgagactggtatccttagtgcact

SEQ ID NO: 686342 - DNA, 25 bp, Mus musculus
gcgagagaagtgcatccatgcctta

SEQ ID NO: 686343 - DNA, 25 bp, Mus musculus
gcgagagaagtggatccatgcctta

SEQ ID NO: 686344 - DNA, 25 bp, Mus musculus
gcgagagaccggctcacagctttct

SEQ ID NO: 686345 - DNA, 25 bp, Mus musculus
gcgagagaccgggtcacagctttct

SEQ ID NO: 686346 - DNA, 25 bp, Mus musculus
gcgagagactgaacccaggagcgta

SEQ ID NO: 686347 - DNA, 25 bp, Mus musculus
gcgagagactgatcccaggagcgta

SEQ ID NO: 686348 - DNA, 25 bp, Mus musculus
gcgagagagctacggagaaatcaaa

SEQ ID NO: 686349 - DNA, 25 bp, Mus musculus
gcgagagagctagggagaaatcaaa

SEQ ID NO: 686350 - DNA, 25 bp, Mus musculus
gcgagagcaggcactggaagccacc

SEQ ID NO: 686351 - DNA, 25 bp, Mus musculus
gcgagagcaggctctggaagccacc

SEQ ID NO: 686352 - DNA, 25 bp, Mus musculus
gcgagagcattacataacatggcca

SEQ ID NO: 686353 - DNA, 25 bp, Mus musculus
gcgagagcattagataacatggcca

SEQ ID NO: 686354 - DNA, 25 bp, Mus musculus
gcgagagccacgctccaagtcgtcg

SEQ ID NO: 686355 - DNA, 25 bp, Mus musculus
gcgagagccacggtccaagtcgtcg

SEQ ID NO: 686356 - DNA, 25 bp, Mus musculus
gcgagagcttgccacttactctttt

SEQ ID NO: 686357 - DNA, 25 bp, Mus musculus
gcgagagcttgcgacttactctttt

SEQ ID NO: 686358 - DNA, 25 bp, Mus musculus
gcgagaggaactagacaccagcatc

SEQ ID NO: 686359 - DNA, 25 bp, Mus musculus
gcgagaggaacttgacaccagcatc

SEQ ID NO: 686360 - DNA, 25 bp, Mus musculus
gcgagaggaagacgcagcttccaca

SEQ ID NO: 686361 - DNA, 25 bp, Mus musculus
gcgagaggaagaggcagcttccaca

SEQ ID NO: 686362 - DNA, 25 bp, Mus musculus
gcgagagtgacaacagcgcagactc

SEQ ID NO: 686363 - DNA, 25 bp, Mus musculus
gcgagagtgacatcagcgcagactc

SEQ ID NO: 686364 - DNA, 25 bp, Mus musculus
gcgagagtgcctagaagtaacttta

SEQ ID NO: 686365 - DNA, 25 bp, Mus musculus
gcgagagtgccttgaagtaacttta

SEQ ID NO: 686366 - DNA, 25 bp, Mus musculus
gcgagatcaccaacaatcagagctt

SEQ ID NO: 686367 - DNA, 25 bp, Mus musculus
gcgagatcaccatcaatcagagctt

SEQ ID NO: 686368 - DNA, 25 bp, Mus musculus
gcgagatgacaccatagtggctgca

SEQ ID NO: 686369 - DNA, 25 bp, Mus musculus
gcgagatgacacgatagtggctgca

SEQ ID NO: 686370 - DNA, 25 bp, Mus musculus
gcgagatgcatacatcctcacttgc

SEQ ID NO: 686371 - DNA, 25 bp, Mus musculus
gcgagatgcatagatcctcacttgc

SEQ ID NO: 686372 - DNA, 25 bp, Mus musculus
gcgagatgccctactgatgaattat

SEQ ID NO: 686373 - DNA, 25 bp, Mus musculus
gcgagatgcccttctgatgaattat

SEQ ID NO: 686374 - DNA, 25 bp, Mus musculus
gcgagatgctcgctcccacggtgct

SEQ ID NO: 686375 - DNA, 25 bp, Mus musculus
gcgagatgctcggtcccacggtgct

SEQ ID NO: 686376 - DNA, 25 bp, Mus musculus
gcgagatgtagtaacagagacgaaa

SEQ ID NO: 686377 - DNA, 25 bp, Mus musculus
gcgagatgtagttacagagacgaaa

SEQ ID NO: 686378 - DNA, 25 bp, Mus musculus
gcgagatgttctcccacctacggcg

SEQ ID NO: 686379 - DNA, 25 bp, Mus musculus
gcgagatgttctgccacctacggcg

SEQ ID NO: 686380 - DNA, 25 bp, Mus musculus
gcgagattatggagccttggctatc

SEQ ID NO: 686381 - DNA, 25 bp, Mus musculus
gcgagattatggtgccttggctatc

SEQ ID NO: 686382 - DNA, 25 bp, Mus musculus
gcgagcaactccagttggaggagct

SEQ ID NO: 686383 - DNA, 25 bp, Mus musculus
gcgagcaactcctgttggaggagct

SEQ ID NO: 686384 - DNA, 25 bp, Mus musculus
gcgagcacatacactacggcgcggg

SEQ ID NO: 686385 - DNA, 25 bp, Mus musculus
gcgagcacatactctacggcgcggg

SEQ ID NO: 686386 - DNA, 25 bp, Mus musculus
gcgagcaccgagcttctgtcgccat

SEQ ID NO: 686387 - DNA, 25 bp, Mus musculus
gcgagcaccgaggttctgtcgccat

SEQ ID NO: 686388 - DNA, 25 bp, Mus musculus
gcgagcagagaaagagcgacttgaa

SEQ ID NO: 686389 - DNA, 25 bp, Mus musculus
gcgagcagagaatgagcgacttgaa

SEQ ID NO: 686390 - DNA, 25 bp, Mus musculus
gcgagcagcaaaagagaccctgcct

SEQ ID NO: 686391 - DNA, 25 bp, Mus musculus
gcgagcagcaaatgagaccctgcct

SEQ ID NO: 686392 - DNA, 25 bp, Mus musculus
gcgagcaggcccatgtcaagctgct

SEQ ID NO: 686393 - DNA, 25 bp, Mus musculus
gcgagcaggcccttgtcaagctgct

SEQ ID NO: 686394 - DNA, 25 bp, Mus musculus
gcgagcaggctaaaaacaaggacct

SEQ ID NO: 686395 - DNA, 25 bp, Mus musculus
gcgagcaggctataaacaaggacct

SEQ ID NO: 686396 - DNA, 25 bp, Mus musculus
gcgagcagttaaccttccaaggaat

SEQ ID NO: 686397 - DNA, 25 bp, Mus musculus
gcgagcagttaagcttccaaggaat

SEQ ID NO: 686398 - DNA, 25 bp, Mus musculus
gcgagcagttcgactcggcgacctg

SEQ ID NO: 686399 - DNA, 25 bp, Mus musculus
gcgagcagttcgtctcggcgacctg

SEQ ID NO: 686400 - DNA, 25 bp, Mus musculus
gcgagccaatgacctgcagcagatt

SEQ ID NO: 686401 - DNA, 25 bp, Mus musculus
gcgagccaatgagctgcagcagatt

SEQ ID NO: 686402 - DNA, 25 bp, Mus musculus
gcgagccgatccagcactgtttcgt

SEQ ID NO: 686403 - DNA, 25 bp, Mus musculus
gcgagccgatcctgcactgtttcgt

SEQ ID NO: 686404 - DNA, 25 bp, Mus musculus
gcgagcctccggagctccaagagct

SEQ ID NO: 686405 - DNA, 25 bp, Mus musculus
gcgagcctccggtgctccaagagct

SEQ ID NO: 686406 - DNA, 25 bp, Mus musculus
gcgagcgaacgacgaaatgtcttca

SEQ ID NO: 686407 - DNA, 25 bp, Mus musculus
gcgagcgaacgaggaaatgtcttca

SEQ ID NO: 686408 - DNA, 25 bp, Mus musculus
gcgagcgcaacgactttgacgggat

SEQ ID NO: 686409 - DNA, 25 bp, Mus musculus
gcgagcgcaacgtctttgacgggat

SEQ ID NO: 686410 - DNA, 25 bp, Mus musculus
gcgagcgccttgaaaagagtccaca

SEQ ID NO: 686411 - DNA, 25 bp, Mus musculus
gcgagcgccttgtaaagagtccaca

SEQ ID NO: 686412 - DNA, 25 bp, Mus musculus
gcgagcggagttcactaccgacctt

SEQ ID NO: 686413 - DNA, 25 bp, Mus musculus
gcgagcggagttgactaccgacctt

SEQ ID NO: 686414 - DNA, 25 bp, Mus musculus
gcgagcgtcgatatcgtcctgcgct

SEQ ID NO: 686415 - DNA, 25 bp, Mus musculus
gcgagcgtcgatttcgtcctgcgct

SEQ ID NO: 686416 - DNA, 25 bp, Mus musculus
gcgagctatagaaattgtggagtcg

SEQ ID NO: 686417 - DNA, 25 bp, Mus musculus
gcgagctatagatattgtggagtcg

SEQ ID NO: 686418 - DNA, 25 bp, Mus musculus
gcgagctatctgacaagcaccgaga

SEQ ID NO: 686419 - DNA, 25 bp, Mus musculus
gcgagctatctgtcaagcaccgaga

SEQ ID NO: 686420 - DNA, 25 bp, Mus musculus
gcgagctcgcgaccgcggaggaggc

SEQ ID NO: 686421 - DNA, 25 bp, Mus musculus
gcgagctcgcgagcgcggaggaggc

SEQ ID NO: 686422 - DNA, 25 bp, Mus musculus
gcgagctctgcgaaagaacaagact

SEQ ID NO: 686423 - DNA, 25 bp, Mus musculus
gcgagctctgcgtaagaacaagact

SEQ ID NO: 686424 - DNA, 25 bp, Mus musculus
gcgagctgcgcacggaccagttcca

SEQ ID NO: 686425 - DNA, 25 bp, Mus musculus
gcgagctgcgcagggaccagttcca

SEQ ID NO: 686426 - DNA, 25 bp, Mus musculus
gcgagctgtcaacaagcatgccaaa

SEQ ID NO: 686427 - DNA, 25 bp, Mus musculus
gcgagctgtcaagaagcatgccaaa

SEQ ID NO: 686428 - DNA, 25 bp, Mus musculus
gcgagcttggcgactaggaccttgt

SEQ ID NO: 686429 - DNA, 25 bp, Mus musculus
gcgagcttggcgtctaggaccttgt

SEQ ID NO: 686430 - DNA, 25 bp, Mus musculus
gcgagctttgttcgccaactcaaca

SEQ ID NO: 686431 - DNA, 25 bp, Mus musculus
gcgagctttgttggccaactcaaca

SEQ ID NO: 686432 - DNA, 25 bp, Mus musculus
gcgaggaaagcacgaaagcgtcatc

SEQ ID NO: 686433 - DNA, 25 bp, Mus musculus
gcgaggaaagcaggaaagcgtcatc

SEQ ID NO: 686434 - DNA, 25 bp, Mus musculus
gcgaggaaataccaacgccgagaat

SEQ ID NO: 686435 - DNA, 25 bp, Mus musculus
gcgaggaaatacgaacgccgagaat

SEQ ID NO: 686436 - DNA, 25 bp, Mus musculus
gcgaggaacagcacacgaatcagct

SEQ ID NO: 686437 - DNA, 25 bp, Mus musculus
gcgaggaacagctcacgaatcagct

SEQ ID NO: 686438 - DNA, 25 bp, Mus musculus
gcgaggacccgacgaggcttctcca

SEQ ID NO: 686439 - DNA, 25 bp, Mus musculus
gcgaggacccgaggaggcttctcca

SEQ ID NO: 686440 - DNA, 25 bp, Mus musculus
gcgaggaccctgaatcatttggagc

SEQ ID NO: 686441 - DNA, 25 bp, Mus musculus
gcgaggaccctgtatcatttggagc

SEQ ID NO: 686442 - DNA, 25 bp, Mus musculus
gcgaggactcctcatgctgaagaca

SEQ ID NO: 686443 - DNA, 25 bp, Mus musculus
gcgaggactcctgatgctgaagaca

SEQ ID NO: 686444 - DNA, 25 bp, Mus musculus
gcgaggactgcacgaacgagtttta

SEQ ID NO: 686445 - DNA, 25 bp, Mus musculus
gcgaggactgcaggaacgagtttta

SEQ ID NO: 686446 - DNA, 25 bp, Mus musculus
gcgaggatgacgacattgctaccag

SEQ ID NO: 686447 - DNA, 25 bp, Mus musculus
gcgaggatgacgtcattgctaccag

SEQ ID NO: 686448 - DNA, 25 bp, Mus musculus
gcgaggatgatgacatcttcaaccg

SEQ ID NO: 686449 - DNA, 25 bp, Mus musculus
gcgaggatgatgtcatcttcaaccg

SEQ ID NO: 686450 - DNA, 25 bp, Mus musculus
gcgaggatggcaagcctctgctcac

SEQ ID NO: 686451 - DNA, 25 bp, Mus musculus
gcgaggatggcatgcctctgctcac

SEQ ID NO: 686452 - DNA, 25 bp, Mus musculus
gcgaggcagagaaccacttcctgga

SEQ ID NO: 686453 - DNA, 25 bp, Mus musculus
gcgaggcagagatccacttcctgga

SEQ ID NO: 686454 - DNA, 25 bp, Mus musculus
gcgaggcagttgagatggacattca

SEQ ID NO: 686455 - DNA, 25 bp, Mus musculus
gcgaggcagttgtgatggacattca

SEQ ID NO: 686456 - DNA, 25 bp, Mus musculus
gcgaggcatactcctctttgggccc

SEQ ID NO: 686457 - DNA, 25 bp, Mus musculus
gcgaggcatactgctctttgggccc

SEQ ID NO: 686458 - DNA, 25 bp, Mus musculus
gcgaggcgctacagaacgactggct

SEQ ID NO: 686459 - DNA, 25 bp, Mus musculus
gcgaggcgctactgaacgactggct

SEQ ID NO: 686460 - DNA, 25 bp, Mus musculus
gcgaggcgggcaattcttcacttcc

SEQ ID NO: 686461 - DNA, 25 bp, Mus musculus
gcgaggcgggcatttcttcacttcc

SEQ ID NO: 686462 - DNA, 25 bp, Mus musculus
gcgaggctaccgacgcttcctcaag

SEQ ID NO: 686463 - DNA, 25 bp, Mus musculus
gcgaggctaccgtcgcttcctcaag

SEQ ID NO: 686464 - DNA, 25 bp, Mus musculus
gcgaggctggcccaaaggcaaaaaa

SEQ ID NO: 686465 - DNA, 25 bp, Mus musculus
gcgaggctggccgaaaggcaaaaaa

SEQ ID NO: 686466 - DNA, 25 bp, Mus musculus
gcgagggccggaaaataaagctgtt

SEQ ID NO: 686467 - DNA, 25 bp, Mus musculus
gcgagggccggataataaagctgtt

SEQ ID NO: 686468 - DNA, 25 bp, Mus musculus
gcgagggctgctattttcagcacca

SEQ ID NO: 686469 - DNA, 25 bp, Mus musculus
gcgagggctgcttttttcagcacca

SEQ ID NO: 686470 - DNA, 25 bp, Mus musculus
gcgagggtctaccagctcctgagat

SEQ ID NO: 686471 - DNA, 25 bp, Mus musculus
gcgagggtctacgagctcctgagat

SEQ ID NO: 686472 - DNA, 25 bp, Mus musculus
gcgaggtatgtaacttaggctggca

SEQ ID NO: 686473 - DNA, 25 bp, Mus musculus
gcgaggtatgtatcttaggctggca

SEQ ID NO: 686474 - DNA, 25 bp, Mus musculus
gcgaggtccgggagtgacgtgcggg

SEQ ID NO: 686475 - DNA, 25 bp, Mus musculus
gcgaggtccgggtgtgacgtgcggg

SEQ ID NO: 686476 - DNA, 25 bp, Mus musculus
gcgaggtcttgtccaggagttcctt

SEQ ID NO: 686477 - DNA, 25 bp, Mus musculus
gcgaggtcttgtgcaggagttcctt

SEQ ID NO: 686478 - DNA, 25 bp, Mus musculus
gcgaggttgtttagagtagcagcac

SEQ ID NO: 686479 - DNA, 25 bp, Mus musculus
gcgaggttgttttgagtagcagcac

SEQ ID NO: 686480 - DNA, 25 bp, Mus musculus
gcgagtaaaccccaaagggctagat

SEQ ID NO: 686481 - DNA, 25 bp, Mus musculus
gcgagtaaacccgaaagggctagat

SEQ ID NO: 686482 - DNA, 25 bp, Mus musculus
gcgagtaaagggaaccctggagcct

SEQ ID NO: 686483 - DNA, 25 bp, Mus musculus
gcgagtaaagggtaccctggagcct

SEQ ID NO: 686484 - DNA, 25 bp, Mus musculus
gcgagtactacacctggttcctctt

SEQ ID NO: 686485 - DNA, 25 bp, Mus musculus
gcgagtactacagctggttcctctt

SEQ ID NO: 686486 - DNA, 25 bp, Mus musculus
gcgagtatggccagcaggcgtacac

SEQ ID NO: 686487 - DNA, 25 bp, Mus musculus
gcgagtatggcctgcaggcgtacac

SEQ ID NO: 686488 - DNA, 25 bp, Mus musculus
gcgagtccaggcatttgcggtgcct

SEQ ID NO: 686489 - DNA, 25 bp, Mus musculus
gcgagtccaggcttttgcggtgcct

SEQ ID NO: 686490 - DNA, 25 bp, Mus musculus
gcgagtccagttaaacataattggt

SEQ ID NO: 686491 - DNA, 25 bp, Mus musculus
gcgagtccagtttaacataattggt

SEQ ID NO: 686492 - DNA, 25 bp, Mus musculus
gcgagtcgtgatagacaacaccaac

SEQ ID NO: 686493 - DNA, 25 bp, Mus musculus
gcgagtcgtgattgacaacaccaac

SEQ ID NO: 686494 - DNA, 25 bp, Mus musculus
gcgagtctctacaaggcttagcagc

SEQ ID NO: 686495 - DNA, 25 bp, Mus musculus
gcgagtctctactaggcttagcagc

SEQ ID NO: 686496 - DNA, 25 bp, Mus musculus
gcgagtcttgaacaggctccatcag

SEQ ID NO: 686497 - DNA, 25 bp, Mus musculus
gcgagtcttgaagaggctccatcag

SEQ ID NO: 686498 - DNA, 25 bp, Mus musculus
gcgagtgattctcgcctctaacaga

SEQ ID NO: 686499 - DNA, 25 bp, Mus musculus
gcgagtgattctggcctctaacaga

SEQ ID NO: 686500 - DNA, 25 bp, Mus musculus
gcgagtgctggcactttgactgtgg

SEQ ID NO: 686501 - DNA, 25 bp, Mus musculus
gcgagtgctggctctttgactgtgg

SEQ ID NO: 686502 - DNA, 25 bp, Mus musculus
gcgagtggaaaccacgtcaaattga

SEQ ID NO: 686503 - DNA, 25 bp, Mus musculus
gcgagtggaaacgacgtcaaattga

SEQ ID NO: 686504 - DNA, 25 bp, Mus musculus
gcgagtggacagcaccaccttactg

SEQ ID NO: 686505 - DNA, 25 bp, Mus musculus
gcgagtggacaggaccaccttactg

SEQ ID NO: 686506 - DNA, 25 bp, Mus musculus
gcgagtgtgaggctgggaacagccc

SEQ ID NO: 686507 - DNA, 25 bp, Mus musculus
gcgagtgtgagggtgggaacagccc

SEQ ID NO: 686508 - DNA, 25 bp, Mus musculus
gcgagttcaccaccacattccagga

SEQ ID NO: 686509 - DNA, 25 bp, Mus musculus
gcgagttcaccagcacattccagga

SEQ ID NO: 686510 - DNA, 25 bp, Mus musculus
gcgagttgcactctgttggtgtcct

SEQ ID NO: 686511 - DNA, 25 bp, Mus musculus
gcgagttgcactgtgttggtgtcct

SEQ ID NO: 686512 - DNA, 25 bp, Mus musculus
gcgagtttgtctatgcggtatgcag

SEQ ID NO: 686513 - DNA, 25 bp, Mus musculus
gcgagtttgtctttgcggtatgcag

SEQ ID NO: 686514 - DNA, 25 bp, Mus musculus
gcgataacaaacaccccactggcat

SEQ ID NO: 686515 - DNA, 25 bp, Mus musculus
gcgataacaaactccccactggcat

SEQ ID NO: 686516 - DNA, 25 bp, Mus musculus
gcgataagctgtaccagcggaaaga

SEQ ID NO: 686517 - DNA, 25 bp, Mus musculus
gcgataagctgttccagcggaaaga

SEQ ID NO: 686518 - DNA, 25 bp, Mus musculus
gcgatactattaagagaaaggcatc

SEQ ID NO: 686519 - DNA, 25 bp, Mus musculus
gcgatactattatgagaaaggcatc

SEQ ID NO: 686520 - DNA, 25 bp, Mus musculus
gcgatagacccaccacccagtgaat

SEQ ID NO: 686521 - DNA, 25 bp, Mus musculus
gcgatagacccagcacccagtgaat

SEQ ID NO: 686522 - DNA, 25 bp, Mus musculus
gcgatagcatatcctatccaaccat

SEQ ID NO: 686523 - DNA, 25 bp, Mus musculus
gcgatagcatatgctatccaaccat

SEQ ID NO: 686524 - DNA, 25 bp, Mus musculus
gcgatatgttttatcctgccttcga

SEQ ID NO: 686525 - DNA, 25 bp, Mus musculus
gcgatatgttttttcctgccttcga

SEQ ID NO: 686526 - DNA, 25 bp, Mus musculus
gcgatattacagagcccctgaggtc

SEQ ID NO: 686527 - DNA, 25 bp, Mus musculus
gcgatattacagtgcccctgaggtc

SEQ ID NO: 686528 - DNA, 25 bp, Mus musculus
gcgatccatcctcctgtgagttaca

SEQ ID NO: 686529 - DNA, 25 bp, Mus musculus
gcgatccatcctgctgtgagttaca

SEQ ID NO: 686530 - DNA, 25 bp, Mus musculus
gcgatcgacttcaaacttttgcatc

SEQ ID NO: 686531 - DNA, 25 bp, Mus musculus
gcgatcgacttctaacttttgcatc

SEQ ID NO: 686532 - DNA, 25 bp, Mus musculus
gcgatcgcgcccaggcttttggtga

SEQ ID NO: 686533 - DNA, 25 bp, Mus musculus
gcgatcgcgccctggcttttggtga

SEQ ID NO: 686534 - DNA, 25 bp, Mus musculus
gcgatcggtgagacggctcttttct

SEQ ID NO: 686535 - DNA, 25 bp, Mus musculus
gcgatcggtgagtcggctcttttct

SEQ ID NO: 686536 - DNA, 25 bp, Mus musculus
gcgatcgtgcctcgagcactctggt

SEQ ID NO: 686537 - DNA, 25 bp, Mus musculus
gcgatcgtgcctggagcactctggt

SEQ ID NO: 686538 - DNA, 25 bp, Mus musculus
gcgatcgtttaccaaaattcttggt

SEQ ID NO: 686539 - DNA, 25 bp, Mus musculus
gcgatcgtttacgaaaattcttggt

SEQ ID NO: 686540 - DNA, 25 bp, Mus musculus
gcgatctaggcccacaagctgcctt

SEQ ID NO: 686541 - DNA, 25 bp, Mus musculus
gcgatctaggccgacaagctgcctt

SEQ ID NO: 686542 - DNA, 25 bp, Mus musculus
gcgatctctgatccagaccttccaa

SEQ ID NO: 686543 - DNA, 25 bp, Mus musculus
gcgatctctgatgcagaccttccaa

SEQ ID NO: 686544 - DNA, 25 bp, Mus musculus
gcgatctgcctccacggctatggga

SEQ ID NO: 686545 - DNA, 25 bp, Mus musculus
gcgatctgcctcgacggctatggga

SEQ ID NO: 686546 - DNA, 25 bp, Mus musculus
gcgatgaagagaacttaagagtgtt

SEQ ID NO: 686547 - DNA, 25 bp, Mus musculus
gcgatgaagagatcttaagagtgtt

SEQ ID NO: 686548 - DNA, 25 bp, Mus musculus
gcgatgaagcaaatcgtctgagcat

SEQ ID NO: 686549 - DNA, 25 bp, Mus musculus
gcgatgaagcaattcgtctgagcat

SEQ ID NO: 686550 - DNA, 25 bp, Mus musculus
gcgatgacagttaccagtaaactcc

SEQ ID NO: 686551 - DNA, 25 bp, Mus musculus
gcgatgacagtttccagtaaactcc

SEQ ID NO: 686552 - DNA, 25 bp, Mus musculus
gcgatgactccaccaagtgcctcaa

SEQ ID NO: 686553 - DNA, 25 bp, Mus musculus
gcgatgactccagcaagtgcctcaa

SEQ ID NO: 686554 - DNA, 25 bp, Mus musculus
gcgatgagatgacattagcagactg

SEQ ID NO: 686555 - DNA, 25 bp, Mus musculus
gcgatgagatgagattagcagactg

SEQ ID NO: 686556 - DNA, 25 bp, Mus musculus
gcgatgaggtcaccaagtacgagaa

SEQ ID NO: 686557 - DNA, 25 bp, Mus musculus
gcgatgaggtcagcaagtacgagaa

SEQ ID NO: 686558 - DNA, 25 bp, Mus musculus
gcgatgatgaaacctcagtttatga

SEQ ID NO: 686559 - DNA, 25 bp, Mus musculus
gcgatgatgaaagctcagtttatga

SEQ ID NO: 686560 - DNA, 25 bp, Mus musculus
gcgatgatggcaaaccaggcctgaa

SEQ ID NO: 686561 - DNA, 25 bp, Mus musculus
gcgatgatggcataccaggcctgaa

SEQ ID NO: 686562 - DNA, 25 bp, Mus musculus
gcgatgcaactaagttaaggccaaa

SEQ ID NO: 686563 - DNA, 25 bp, Mus musculus
gcgatgcaactatgttaaggccaaa

SEQ ID NO: 686564 - DNA, 25 bp, Mus musculus
gcgatgccccgcaacgagttggctt

SEQ ID NO: 686565 - DNA, 25 bp, Mus musculus
gcgatgccccgctacgagttggctt

SEQ ID NO: 686566 - DNA, 25 bp, Mus musculus
gcgatgcccggcctgaagctgacta

SEQ ID NO: 686567 - DNA, 25 bp, Mus musculus
gcgatgcccggcgtgaagctgacta

SEQ ID NO: 686568 - DNA, 25 bp, Mus musculus
gcgatgctccggagtggttgtctct

SEQ ID NO: 686569 - DNA, 25 bp, Mus musculus
gcgatgctccggtgtggttgtctct

SEQ ID NO: 686570 - DNA, 25 bp, Mus musculus
gcgatgctgggcctcatgtatatct

SEQ ID NO: 686571 - DNA, 25 bp, Mus musculus
gcgatgctgggcgtcatgtatatct

SEQ ID NO: 686572 - DNA, 25 bp, Mus musculus
gcgatggaaaacataaactgactct

SEQ ID NO: 686573 - DNA, 25 bp, Mus musculus
gcgatggaaaacttaaactgactct

SEQ ID NO: 686574 - DNA, 25 bp, Mus musculus
gcgatggcagtcaccagtgactaaa

SEQ ID NO: 686575 - DNA, 25 bp, Mus musculus
gcgatggcagtctccagtgactaaa

SEQ ID NO: 686576 - DNA, 25 bp, Mus musculus
gcgatgggcgctccatcacctgtat

SEQ ID NO: 686577 - DNA, 25 bp, Mus musculus
gcgatgggcgctgcatcacctgtat

SEQ ID NO: 686578 - DNA, 25 bp, Mus musculus
gcgatgtagtggcttgtgaacctcc

SEQ ID NO: 686579 - DNA, 25 bp, Mus musculus
gcgatgtagtgggttgtgaacctcc

SEQ ID NO: 686580 - DNA, 25 bp, Mus musculus
gcgatgtgagggaacggatcatcaa

SEQ ID NO: 686581 - DNA, 25 bp, Mus musculus
gcgatgtgagggtacggatcatcaa

SEQ ID NO: 686582 - DNA, 25 bp, Mus musculus
gcgatgtgtgcaatcctgagctaat

SEQ ID NO: 686583 - DNA, 25 bp, Mus musculus
gcgatgtgtgcattcctgagctaat

SEQ ID NO: 686584 - DNA, 25 bp, Mus musculus
gcgattacgggcagcccgcctggaa

SEQ ID NO: 686585 - DNA, 25 bp, Mus musculus
gcgattacgggctgcccgcctggaa

SEQ ID NO: 686586 - DNA, 25 bp, Mus musculus
gcgattatgacccttcccgggaaag

SEQ ID NO: 686587 - DNA, 25 bp, Mus musculus
gcgattatgaccgttcccgggaaag

SEQ ID NO: 686588 - DNA, 25 bp, Mus musculus
gcgattcaaatgcaaaccatggcag

SEQ ID NO: 686589 - DNA, 25 bp, Mus musculus
gcgattcaaatggaaaccatggcag

SEQ ID NO: 686590 - DNA, 25 bp, Mus musculus
gcgattcagcgtcgatgtctttgag

SEQ ID NO: 686591 - DNA, 25 bp, Mus musculus
gcgattcagcgtggatgtctttgag

SEQ ID NO: 686592 - DNA, 25 bp, Mus musculus
gcgattccgcagagcgcctgcgtac

SEQ ID NO: 686593 - DNA, 25 bp, Mus musculus
gcgattccgcagtgcgcctgcgtac

SEQ ID NO: 686594 - DNA, 25 bp, Mus musculus
gcgattcgacagatcagttgaaaaa

SEQ ID NO: 686595 - DNA, 25 bp, Mus musculus
gcgattcgacagttcagttgaaaaa

SEQ ID NO: 686596 - DNA, 25 bp, Mus musculus
gcgattctggttctgcgcatagcca

SEQ ID NO: 686597 - DNA, 25 bp, Mus musculus
gcgattctggttgtgcgcatagcca

SEQ ID NO: 686598 - DNA, 25 bp, Mus musculus
gcgattgcaattatgggacacagca

SEQ ID NO: 686599 - DNA, 25 bp, Mus musculus
gcgattgcaattttgggacacagca

SEQ ID NO: 686600 - DNA, 25 bp, Mus musculus
gcgattgctgagatggacaccctga

SEQ ID NO: 686601 - DNA, 25 bp, Mus musculus
gcgattgctgagttggacaccctga

SEQ ID NO: 686602 - DNA, 25 bp, Mus musculus
gcgattgtccaacaattcctcacag

SEQ ID NO: 686603 - DNA, 25 bp, Mus musculus
gcgattgtccaagaattcctcacag

SEQ ID NO: 686604 - DNA, 25 bp, Mus musculus
gcgatttatgtacccggcctggccc

SEQ ID NO: 686605 - DNA, 25 bp, Mus musculus
gcgatttatgtagccggcctggccc

SEQ ID NO: 686606 - DNA, 25 bp, Mus musculus
gcgatttctccgaaactttcccaag

SEQ ID NO: 686607 - DNA, 25 bp, Mus musculus
gcgatttctccgtaactttcccaag

SEQ ID NO: 686608 - DNA, 25 bp, Mus musculus
gcgatttgaaggaaattggcatcac

SEQ ID NO: 686609 - DNA, 25 bp, Mus musculus
gcgatttgaaggtaattggcatcac

SEQ ID NO: 686610 - DNA, 25 bp, Mus musculus
gcgatttgccacaaacttctaccag

SEQ ID NO: 686611 - DNA, 25 bp, Mus musculus
gcgatttgccactaacttctaccag

SEQ ID NO: 686612 - DNA, 25 bp, Mus musculus
gcgattttctcgacctgaagagtac

SEQ ID NO: 686613 - DNA, 25 bp, Mus musculus
gcgattttctcgtcctgaagagtac

SEQ ID NO: 686614 - DNA, 25 bp, Mus musculus
gcgattttggataaggccaccaaca

SEQ ID NO: 686615 - DNA, 25 bp, Mus musculus
gcgattttggattaggccaccaaca

SEQ ID NO: 686616 - DNA, 25 bp, Mus musculus
gcgcaaaaatctccggtgtttctct

SEQ ID NO: 686617 - DNA, 25 bp, Mus musculus
gcgcaaaaatctgcggtgtttctct

SEQ ID NO: 686618 - DNA, 25 bp, Mus musculus
gcgcaaaggaggctcacggtcaccc

SEQ ID NO: 686619 - DNA, 25 bp, Mus musculus
gcgcaaaggagggtcacggtcaccc

SEQ ID NO: 686620 - DNA, 25 bp, Mus musculus
gcgcaaaggtgaatggtgagcacaa

SEQ ID NO: 686621 - DNA, 25 bp, Mus musculus
gcgcaaaggtgattggtgagcacaa

SEQ ID NO: 686622 - DNA, 25 bp, Mus musculus
gcgcaaagtctgcaaattgccctga

SEQ ID NO: 686623 - DNA, 25 bp, Mus musculus
gcgcaaagtctggaaattgccctga

SEQ ID NO: 686624 - DNA, 25 bp, Mus musculus
gcgcaaagttaacaaacacataaag

SEQ ID NO: 686625 - DNA, 25 bp, Mus musculus
gcgcaaagttaagaaacacataaag

SEQ ID NO: 686626 - DNA, 25 bp, Mus musculus
gcgcaagatccaccgagatatcaaa

SEQ ID NO: 686627 - DNA, 25 bp, Mus musculus
gcgcaagatccagcgagatatcaaa

SEQ ID NO: 686628 - DNA, 25 bp, Mus musculus
gcgcaagggcctcaattaccgctac

SEQ ID NO: 686629 - DNA, 25 bp, Mus musculus
gcgcaagggcctgaattaccgctac

SEQ ID NO: 686630 - DNA, 25 bp, Mus musculus
gcgcaatggctcagtagccgcgacc

SEQ ID NO: 686631 - DNA, 25 bp, Mus musculus
gcgcaatggctctgtagccgcgacc

SEQ ID NO: 686632 - DNA, 25 bp, Mus musculus
gcgcaattaaaacgagcacatgaaa

SEQ ID NO: 686633 - DNA, 25 bp, Mus musculus
gcgcaattaaaaggagcacatgaaa

SEQ ID NO: 686634 - DNA, 25 bp, Mus musculus
gcgcacagacagcactggctctgct

SEQ ID NO: 686635 - DNA, 25 bp, Mus musculus
gcgcacagacaggactggctctgct

SEQ ID NO: 686636 - DNA, 25 bp, Mus musculus
gcgcacagatcgaggcccagagcca

SEQ ID NO: 686637 - DNA, 25 bp, Mus musculus
gcgcacagatcgtggcccagagcca

SEQ ID NO: 686638 - DNA, 25 bp, Mus musculus
gcgcacaggcaaaaccaagggctat

SEQ ID NO: 686639 - DNA, 25 bp, Mus musculus
gcgcacaggcaataccaagggctat

SEQ ID NO: 686640 - DNA, 25 bp, Mus musculus
gcgcacagtgcccttgtcaccatga

SEQ ID NO: 686641 - DNA, 25 bp, Mus musculus
gcgcacagtgccgttgtcaccatga

SEQ ID NO: 686642 - DNA, 25 bp, Mus musculus
gcgcaccacagaaggcgcgtcgagt

SEQ ID NO: 686643 - DNA, 25 bp, Mus musculus
gcgcaccacagatggcgcgtcgagt

SEQ ID NO: 686644 - DNA, 25 bp, Mus musculus
gcgcaccagggcctcataggctgaa

SEQ ID NO: 686645 - DNA, 25 bp, Mus musculus
gcgcaccagggcgtcataggctgaa

SEQ ID NO: 686646 - DNA, 25 bp, Mus musculus
gcgcacctatgccaccattgataag

SEQ ID NO: 686647 - DNA, 25 bp, Mus musculus
gcgcacctatgcgaccattgataag

SEQ ID NO: 686648 - DNA, 25 bp, Mus musculus
gcgcacgcagtaaagcagccaaggt

SEQ ID NO: 686649 - DNA, 25 bp, Mus musculus
gcgcacgcagtatagcagccaaggt

SEQ ID NO: 686650 - DNA, 25 bp, Mus musculus
gcgcactatttgacacgctgcgacc

SEQ ID NO: 686651 - DNA, 25 bp, Mus musculus
gcgcactatttgtcacgctgcgacc

SEQ ID NO: 686652 - DNA, 25 bp, Mus musculus
gcgcactcgcgcaacgtgctactga

SEQ ID NO: 686653 - DNA, 25 bp, Mus musculus
gcgcactcgcgctacgtgctactga

SEQ ID NO: 686654 - DNA, 25 bp, Mus musculus
gcgcactggacaaggagctccgagc

SEQ ID NO: 686655 - DNA, 25 bp, Mus musculus
gcgcactggacatggagctccgagc

SEQ ID NO: 686656 - DNA, 25 bp, Mus musculus
gcgcactggctgcttaatcttctaa

SEQ ID NO: 686657 - DNA, 25 bp, Mus musculus
gcgcactggctggttaatcttctaa

SEQ ID NO: 686658 - DNA, 25 bp, Mus musculus
gcgcacttgctcctacacgatcaga

SEQ ID NO: 686659 - DNA, 25 bp, Mus musculus
gcgcacttgctcgtacacgatcaga

SEQ ID NO: 686660 - DNA, 25 bp, Mus musculus
gcgcagaaatctcaacggtaccctc

SEQ ID NO: 686661 - DNA, 25 bp, Mus musculus
gcgcagaaatctgaacggtaccctc

SEQ ID NO: 686662 - DNA, 25 bp, Mus musculus
gcgcagaacaaaagggccccttgaa

SEQ ID NO: 686663 - DNA, 25 bp, Mus musculus
gcgcagaacaaatgggccccttgaa

SEQ ID NO: 686664 - DNA, 25 bp, Mus musculus
gcgcagaataggaaataccacaaca

SEQ ID NO: 686665 - DNA, 25 bp, Mus musculus
gcgcagaataggtaataccacaaca

SEQ ID NO: 686666 - DNA, 25 bp, Mus musculus
gcgcagacccctattcagtctggag

SEQ ID NO: 686667 - DNA, 25 bp, Mus musculus
gcgcagaccccttttcagtctggag

SEQ ID NO: 686668 - DNA, 25 bp, Mus musculus
gcgcagacggcgaagtcatggcctt

SEQ ID NO: 686669 - DNA, 25 bp, Mus musculus
gcgcagacggcgtagtcatggcctt

SEQ ID NO: 686670 - DNA, 25 bp, Mus musculus
gcgcagacttatcgaacagccttga

SEQ ID NO: 686671 - DNA, 25 bp, Mus musculus
gcgcagacttatggaacagccttga

SEQ ID NO: 686672 - DNA, 25 bp, Mus musculus
gcgcagactttaaaactcaagtggt

SEQ ID NO: 686673 - DNA, 25 bp, Mus musculus
gcgcagactttataactcaagtggt

SEQ ID NO: 686674 - DNA, 25 bp, Mus musculus
gcgcagagtgtgaacatcccaagag

SEQ ID NO: 686675 - DNA, 25 bp, Mus musculus
gcgcagagtgtgtacatcccaagag

SEQ ID NO: 686676 - DNA, 25 bp, Mus musculus
gcgcagatagatcattatctaggac

SEQ ID NO: 686677 - DNA, 25 bp, Mus musculus
gcgcagatagatgattatctaggac

SEQ ID NO: 686678 - DNA, 25 bp, Mus musculus
gcgcagatcagcagaagacgcaggc

SEQ ID NO: 686679 - DNA, 25 bp, Mus musculus
gcgcagatcagctgaagacgcaggc

SEQ ID NO: 686680 - DNA, 25 bp, Mus musculus
gcgcagatccacagcgatatccaga

SEQ ID NO: 686681 - DNA, 25 bp, Mus musculus
gcgcagatccactgcgatatccaga

SEQ ID NO: 686682 - DNA, 25 bp, Mus musculus
gcgcagcaagcacacagtcgtggca

SEQ ID NO: 686683 - DNA, 25 bp, Mus musculus
gcgcagcaagcagacagtcgtggca

SEQ ID NO: 686684 - DNA, 25 bp, Mus musculus
gcgcagcagcatcacgagacttact

SEQ ID NO: 686685 - DNA, 25 bp, Mus musculus
gcgcagcagcatgacgagacttact

SEQ ID NO: 686686 - DNA, 25 bp, Mus musculus
gcgcagccagccagtagattacttc

SEQ ID NO: 686687 - DNA, 25 bp, Mus musculus
gcgcagccagcctgtagattacttc

SEQ ID NO: 686688 - DNA, 25 bp, Mus musculus
gcgcagccggcaaccagagtttccg

SEQ ID NO: 686689 - DNA, 25 bp, Mus musculus
gcgcagccggcatccagagtttccg

SEQ ID NO: 686690 - DNA, 25 bp, Mus musculus
gcgcagcgcagtcgcccagattgct

SEQ ID NO: 686691 - DNA, 25 bp, Mus musculus
gcgcagcgcagtggcccagattgct

SEQ ID NO: 686692 - DNA, 25 bp, Mus musculus
gcgcagcgcgacaacctttctgcag

SEQ ID NO: 686693 - DNA, 25 bp, Mus musculus
gcgcagcgcgactacctttctgcag

SEQ ID NO: 686694 - DNA, 25 bp, Mus musculus
gcgcagcgcgttaattggcatcggc

SEQ ID NO: 686695 - DNA, 25 bp, Mus musculus
gcgcagcgcgtttattggcatcggc

SEQ ID NO: 686696 - DNA, 25 bp, Mus musculus
gcgcagcttggtagctccgtagtac

SEQ ID NO: 686697 - DNA, 25 bp, Mus musculus
gcgcagcttggttgctccgtagtac

SEQ ID NO: 686698 - DNA, 25 bp, Mus musculus
gcgcaggcgtagagcgtcacgggcg

SEQ ID NO: 686699 - DNA, 25 bp, Mus musculus
gcgcaggcgtagtgcgtcacgggcg

SEQ ID NO: 686700 - DNA, 25 bp, Mus musculus
gcgcaggctgcaaccgcaagatcaa

SEQ ID NO: 686701 - DNA, 25 bp, Mus musculus
gcgcaggctgcatccgcaagatcaa

SEQ ID NO: 686702 - DNA, 25 bp, Mus musculus
gcgcagggacggagccatctcgacc

SEQ ID NO: 686703 - DNA, 25 bp, Mus musculus
gcgcagggacggtgccatctcgacc

SEQ ID NO: 686704 - DNA, 25 bp, Mus musculus
gcgcaggtaacgctctgggctcctt

SEQ ID NO: 686705 - DNA, 25 bp, Mus musculus
gcgcaggtaacggtctgggctcctt

SEQ ID NO: 686706 - DNA, 25 bp, Mus musculus
gcgcaggtacgtataatttttcaag

SEQ ID NO: 686707 - DNA, 25 bp, Mus musculus
gcgcaggtacgtttaatttttcaag

SEQ ID NO: 686708 - DNA, 25 bp, Mus musculus
gcgcagtaacagcatctccaagtct

SEQ ID NO: 686709 - DNA, 25 bp, Mus musculus
gcgcagtaacaggatctccaagtct

SEQ ID NO: 686710 - DNA, 25 bp, Mus musculus
gcgcagtatcacaggtgagcccgga

SEQ ID NO: 686711 - DNA, 25 bp, Mus musculus
gcgcagtatcactggtgagcccgga

SEQ ID NO: 686712 - DNA, 25 bp, Mus musculus
gcgcagtggcccagattgctttgca

SEQ ID NO: 686713 - DNA, 25 bp, Mus musculus
gcgcagtggccctgattgctttgca

SEQ ID NO: 686714 - DNA, 25 bp, Mus musculus
gcgcagttcaagagctgcccggcgc

SEQ ID NO: 686715 - DNA, 25 bp, Mus musculus
gcgcagttcaagtgctgcccggcgc

SEQ ID NO: 686716 - DNA, 25 bp, Mus musculus
gcgcagttgctactatcctcaagag

SEQ ID NO: 686717 - DNA, 25 bp, Mus musculus
gcgcagttgctagtatcctcaagag

SEQ ID NO: 686718 - DNA, 25 bp, Mus musculus
gcgcataccccgactttttcaactt

SEQ ID NO: 686719 - DNA, 25 bp, Mus musculus
gcgcataccccgtctttttcaactt

SEQ ID NO: 686720 - DNA, 25 bp, Mus musculus
gcgcatacgctccttctgggaatta

SEQ ID NO: 686721 - DNA, 25 bp, Mus musculus
gcgcatacgctcgttctgggaatta

SEQ ID NO: 686722 - DNA, 25 bp, Mus musculus
gcgcatagacttccgcaatgaggat

SEQ ID NO: 686723 - DNA, 25 bp, Mus musculus
gcgcatagacttgcgcaatgaggat

SEQ ID NO: 686724 - DNA, 25 bp, Mus musculus
gcgcatccaccacgagagtgagctg

SEQ ID NO: 686725 - DNA, 25 bp, Mus musculus
gcgcatccaccaggagagtgagctg

SEQ ID NO: 686726 - DNA, 25 bp, Mus musculus
gcgcatccctttcaggccacgaaat

SEQ ID NO: 686727 - DNA, 25 bp, Mus musculus
gcgcatccctttgaggccacgaaat

SEQ ID NO: 686728 - DNA, 25 bp, Mus musculus
gcgcatccttggcttgggagacctt

SEQ ID NO: 686729 - DNA, 25 bp, Mus musculus
gcgcatccttgggttgggagacctt

SEQ ID NO: 686730 - DNA, 25 bp, Mus musculus
gcgcatcgggttccctagaaggaca

SEQ ID NO: 686731 - DNA, 25 bp, Mus musculus
gcgcatcgggttgcctagaaggaca

SEQ ID NO: 686732 - DNA, 25 bp, Mus musculus
gcgcatcgtggacggctgggacgct

SEQ ID NO: 686733 - DNA, 25 bp, Mus musculus
gcgcatcgtggagggctgggacgct

SEQ ID NO: 686734 - DNA, 25 bp, Mus musculus
gcgcatctcccaatttcagagaccg

SEQ ID NO: 686735 - DNA, 25 bp, Mus musculus
gcgcatctcccattttcagagaccg

SEQ ID NO: 686736 - DNA, 25 bp, Mus musculus
gcgcatctctgcaaggagcaacaca

SEQ ID NO: 686737 - DNA, 25 bp, Mus musculus
gcgcatctctgctaggagcaacaca

SEQ ID NO: 686738 - DNA, 25 bp, Mus musculus
gcgcatcttacgcatcatgtgtcac

SEQ ID NO: 686739 - DNA, 25 bp, Mus musculus
gcgcatcttacggatcatgtgtcac

SEQ ID NO: 686740 - DNA, 25 bp, Mus musculus
gcgcattaaggtacaagaggattcc

SEQ ID NO: 686741 - DNA, 25 bp, Mus musculus
gcgcattaaggttcaagaggattcc

SEQ ID NO: 686742 - DNA, 25 bp, Mus musculus
gcgcattgaggactgcatactgtca

SEQ ID NO: 686743 - DNA, 25 bp, Mus musculus
gcgcattgaggagtgcatactgtca

SEQ ID NO: 686744 - DNA, 25 bp, Mus musculus
gcgccaaacaggcagagcccattac

SEQ ID NO: 686745 - DNA, 25 bp, Mus musculus
gcgccaaacagggagagcccattac

SEQ ID NO: 686746 - DNA, 25 bp, Mus musculus
gcgccaaattcacaagagggaagct

SEQ ID NO: 686747 - DNA, 25 bp, Mus musculus
gcgccaaattcagaagagggaagct

SEQ ID NO: 686748 - DNA, 25 bp, Mus musculus
gcgccaagtagcctcacggctctga

SEQ ID NO: 686749 - DNA, 25 bp, Mus musculus
gcgccaagtagcgtcacggctctga

SEQ ID NO: 686750 - DNA, 25 bp, Mus musculus
gcgccaagtgcaccataggcttcag

SEQ ID NO: 686751 - DNA, 25 bp, Mus musculus
gcgccaagtgcagcataggcttcag

SEQ ID NO: 686752 - DNA, 25 bp, Mus musculus
gcgccaatgatgctaatgacgacac

SEQ ID NO: 686753 - DNA, 25 bp, Mus musculus
gcgccaatgatggtaatgacgacac

SEQ ID NO: 686754 - DNA, 25 bp, Mus musculus
gcgccaatgttgacacggaggattg

SEQ ID NO: 686755 - DNA, 25 bp, Mus musculus
gcgccaatgttgtcacggaggattg

SEQ ID NO: 686756 - DNA, 25 bp, Mus musculus
gcgccaatttcgcttggccggctac

SEQ ID NO: 686757 - DNA, 25 bp, Mus musculus
gcgccaatttcggttggccggctac

SEQ ID NO: 686758 - DNA, 25 bp, Mus musculus
gcgccaccaagaactttccctggag

SEQ ID NO: 686759 - DNA, 25 bp, Mus musculus
gcgccaccaagatctttccctggag

SEQ ID NO: 686760 - DNA, 25 bp, Mus musculus
gcgccaccgagaacggacacgaggc

SEQ ID NO: 686761 - DNA, 25 bp, Mus musculus
gcgccaccgagatcggacacgaggc

SEQ ID NO: 686762 - DNA, 25 bp, Mus musculus
gcgccacgttatcgccatcgacaga

SEQ ID NO: 686763 - DNA, 25 bp, Mus musculus
gcgccacgttatggccatcgacaga

SEQ ID NO: 686764 - DNA, 25 bp, Mus musculus
gcgccagcacctatcagctttcggg

SEQ ID NO: 686765 - DNA, 25 bp, Mus musculus
gcgccagcacctttcagctttcggg

SEQ ID NO: 686766 - DNA, 25 bp, Mus musculus
gcgccagcagctagcgtacggcatt

SEQ ID NO: 686767 - DNA, 25 bp, Mus musculus
gcgccagcagcttgcgtacggcatt

SEQ ID NO: 686768 - DNA, 25 bp, Mus musculus
gcgccagccgacatttgtggtcttc

SEQ ID NO: 686769 - DNA, 25 bp, Mus musculus
gcgccagccgacttttgtggtcttc

SEQ ID NO: 686770 - DNA, 25 bp, Mus musculus
gcgccagctgacaagtaaccacgga

SEQ ID NO: 686771 - DNA, 25 bp, Mus musculus
gcgccagctgactagtaaccacgga

SEQ ID NO: 686772 - DNA, 25 bp, Mus musculus
gcgccaggagctcacgtgctactta

SEQ ID NO: 686773 - DNA, 25 bp, Mus musculus
gcgccaggagctgacgtgctactta

SEQ ID NO: 686774 - DNA, 25 bp, Mus musculus
gcgccaggagggaacagtagcaact

SEQ ID NO: 686775 - DNA, 25 bp, Mus musculus
gcgccaggagggtacagtagcaact

SEQ ID NO: 686776 - DNA, 25 bp, Mus musculus
gcgccaggatctaactaagctttga

SEQ ID NO: 686777 - DNA, 25 bp, Mus musculus
gcgccaggatcttactaagctttga

SEQ ID NO: 686778 - DNA, 25 bp, Mus musculus
gcgccagtgaccatgaggagtacga

SEQ ID NO: 686779 - DNA, 25 bp, Mus musculus
gcgccagtgaccttgaggagtacga

SEQ ID NO: 686780 - DNA, 25 bp, Mus musculus
gcgccagttacaagaacctcacact

SEQ ID NO: 686781 - DNA, 25 bp, Mus musculus
gcgccagttacatgaacctcacact

SEQ ID NO: 686782 - DNA, 25 bp, Mus musculus
gcgccatcgcacacggtccaaaggg

SEQ ID NO: 686783 - DNA, 25 bp, Mus musculus
gcgccatcgcactcggtccaaaggg

SEQ ID NO: 686784 - DNA, 25 bp, Mus musculus
gcgccatcgccactaacggagtggt

SEQ ID NO: 686785 - DNA, 25 bp, Mus musculus
gcgccatcgccagtaacggagtggt

SEQ ID NO: 686786 - DNA, 25 bp, Mus musculus
gcgccatgagctccacgcagttcaa

SEQ ID NO: 686787 - DNA, 25 bp, Mus musculus
gcgccatgagctgcacgcagttcaa

SEQ ID NO: 686788 - DNA, 25 bp, Mus musculus
gcgccatgatgcagagaccaacatc

SEQ ID NO: 686789 - DNA, 25 bp, Mus musculus
gcgccatgatgctgagaccaacatc

SEQ ID NO: 686790 - DNA, 25 bp, Mus musculus
gcgccatgcaaacctacaagtacga

SEQ ID NO: 686791 - DNA, 25 bp, Mus musculus
gcgccatgcaaagctacaagtacga

SEQ ID NO: 686792 - DNA, 25 bp, Mus musculus
gcgccatgcagccacctgagcaata

SEQ ID NO: 686793 - DNA, 25 bp, Mus musculus
gcgccatgcagcgacctgagcaata

SEQ ID NO: 686794 - DNA, 25 bp, Mus musculus
gcgccatgcggaatgtccctaacat

SEQ ID NO: 686795 - DNA, 25 bp, Mus musculus
gcgccatgcggattgtccctaacat

SEQ ID NO: 686796 - DNA, 25 bp, Mus musculus
gcgccatgggcaactgccacacggt

SEQ ID NO: 686797 - DNA, 25 bp, Mus musculus
gcgccatgggcatctgccacacggt

SEQ ID NO: 686798 - DNA, 25 bp, Mus musculus
gcgccatttataacttcgccaagaa

SEQ ID NO: 686799 - DNA, 25 bp, Mus musculus
gcgccatttataagcaagactgatg

SEQ ID NO: 686800 - DNA, 25 bp, Mus musculus
gcgccatttatatcttcgccaagaa

SEQ ID NO: 686801 - DNA, 25 bp, Mus musculus
gcgccatttatatgcaagactgatg

SEQ ID NO: 686802 - DNA, 25 bp, Mus musculus
gcgcccaactagaaactcccttgga

SEQ ID NO: 686803 - DNA, 25 bp, Mus musculus
gcgcccaactagtaactcccttgga

SEQ ID NO: 686804 - DNA, 25 bp, Mus musculus
gcgcccaggaagattagatagaaaa

SEQ ID NO: 686805 - DNA, 25 bp, Mus musculus
gcgcccaggaagtttagatagaaaa

SEQ ID NO: 686806 - DNA, 25 bp, Mus musculus
gcgcccaggcgcagtgtataccctg

SEQ ID NO: 686807 - DNA, 25 bp, Mus musculus
gcgcccaggcgctgtgtataccctg

SEQ ID NO: 686808 - DNA, 25 bp, Mus musculus
gcgcccagggagctcctcacaggta

SEQ ID NO: 686809 - DNA, 25 bp, Mus musculus
gcgcccagggaggtcctcacaggta

SEQ ID NO: 686810 - DNA, 25 bp, Mus musculus
gcgccccaaaaaagctcagctcgat

SEQ ID NO: 686811 - DNA, 25 bp, Mus musculus
gcgccccaaaaatgctcagctcgat

SEQ ID NO: 686812 - DNA, 25 bp, Mus musculus
gcgccccactgaagatacacaagac

SEQ ID NO: 686813 - DNA, 25 bp, Mus musculus
gcgccccactgatgatacacaagac

SEQ ID NO: 686814 - DNA, 25 bp, Mus musculus
gcgccccaggctccatttgtttgat

SEQ ID NO: 686815 - DNA, 25 bp, Mus musculus
gcgccccaggctgcatttgtttgat

SEQ ID NO: 686816 - DNA, 25 bp, Mus musculus
gcgccccgccgcattgtgtctggga

SEQ ID NO: 686817 - DNA, 25 bp, Mus musculus
gcgccccgccgctttgtgtctggga

SEQ ID NO: 686818 - DNA, 25 bp, Mus musculus
gcgccccgtgccagagactggtcag

SEQ ID NO: 686819 - DNA, 25 bp, Mus musculus
gcgccccgtgcctgagactggtcag

SEQ ID NO: 686820 - DNA, 25 bp, Mus musculus
gcgcccggctcacaatcaagcatga

SEQ ID NO: 686821 - DNA, 25 bp, Mus musculus
gcgcccggctcagaatcaagcatga

SEQ ID NO: 686822 - DNA, 25 bp, Mus musculus
gcgcccgggcctagtatgactacca

SEQ ID NO: 686823 - DNA, 25 bp, Mus musculus
gcgcccgggccttgtatgactacca

SEQ ID NO: 686824 - DNA, 25 bp, Mus musculus
gcgccctatttcaagtgacgttccc

SEQ ID NO: 686825 - DNA, 25 bp, Mus musculus
gcgccctatttctagtgacgttccc

SEQ ID NO: 686826 - DNA, 25 bp, Mus musculus
gcgccctcagttcatgcgactaaaa

SEQ ID NO: 686827 - DNA, 25 bp, Mus musculus
gcgccctcagttgatgcgactaaaa

SEQ ID NO: 686828 - DNA, 25 bp, Mus musculus
gcgccctggtgccagaccatcataa

SEQ ID NO: 686829 - DNA, 25 bp, Mus musculus
gcgccctggtgcgagaccatcataa

SEQ ID NO: 686830 - DNA, 25 bp, Mus musculus
gcgccgaaaactacaccgtactcat

SEQ ID NO: 686831 - DNA, 25 bp, Mus musculus
gcgccgaaaacttcaccgtactcat

SEQ ID NO: 686832 - DNA, 25 bp, Mus musculus
gcgccgaagggaccggactcctaca

SEQ ID NO: 686833 - DNA, 25 bp, Mus musculus
gcgccgaagggagcggactcctaca

SEQ ID NO: 686834 - DNA, 25 bp, Mus musculus
gcgccgacacttcggctgcggttac

SEQ ID NO: 686835 - DNA, 25 bp, Mus musculus
gcgccgacacttgggctgcggttac

SEQ ID NO: 686836 - DNA, 25 bp, Mus musculus
gcgccgagacccagagcaggttctg

SEQ ID NO: 686837 - DNA, 25 bp, Mus musculus
gcgccgagaccctgagcaggttctg

SEQ ID NO: 686838 - DNA, 25 bp, Mus musculus
gcgccgagcaaacactattaccagt

SEQ ID NO: 686839 - DNA, 25 bp, Mus musculus
gcgccgagcaaagactattaccagt

SEQ ID NO: 686840 - DNA, 25 bp, Mus musculus
gcgccgccaaagacgtgaaattact

SEQ ID NO: 686841 - DNA, 25 bp, Mus musculus
gcgccgccaaagtcgtgaaattact

SEQ ID NO: 686842 - DNA, 25 bp, Mus musculus
gcgccgccagtgacttcgttttgta

SEQ ID NO: 686843 - DNA, 25 bp, Mus musculus
gcgccgccagtgtcttcgttttgta

SEQ ID NO: 686844 - DNA, 25 bp, Mus musculus
gcgccgcgcactatttgacacgctg

SEQ ID NO: 686845 - DNA, 25 bp, Mus musculus
gcgccgcgcactttttgacacgctg

SEQ ID NO: 686846 - DNA, 25 bp, Mus musculus
gcgccggcggttcctgtcacctgat

SEQ ID NO: 686847 - DNA, 25 bp, Mus musculus
gcgccggcggttgctgtcacctgat

SEQ ID NO: 686848 - DNA, 25 bp, Mus musculus
gcgccgtgaagaagatccgcagcct

SEQ ID NO: 686849 - DNA, 25 bp, Mus musculus
gcgccgtgaagatgatccgcagcct

SEQ ID NO: 686850 - DNA, 25 bp, Mus musculus
gcgccgtgtgaccttctgtctctct

SEQ ID NO: 686851 - DNA, 25 bp, Mus musculus
gcgccgtgtgacgttctgtctctct

SEQ ID NO: 686852 - DNA, 25 bp, Mus musculus
gcgccgttggcacgcagaactacat

SEQ ID NO: 686853 - DNA, 25 bp, Mus musculus
gcgccgttggcaggcagaactacat

SEQ ID NO: 686854 - DNA, 25 bp, Mus musculus
gcgcctacatgtacccaacaggtgc

SEQ ID NO: 686855 - DNA, 25 bp, Mus musculus
gcgcctacatgttcccaacaggtgc

SEQ ID NO: 686856 - DNA, 25 bp, Mus musculus
gcgcctacgtgcatgtctactacaa

SEQ ID NO: 686857 - DNA, 25 bp, Mus musculus
gcgcctacgtgcttgtctactacaa

SEQ ID NO: 686858 - DNA, 25 bp, Mus musculus
gcgcctactactagtcggtgggcct

SEQ ID NO: 686859 - DNA, 25 bp, Mus musculus
gcgcctactacttgtcggtgggcct

SEQ ID NO: 686860 - DNA, 25 bp, Mus musculus
gcgcctatgattaaccccactggga

SEQ ID NO: 686861 - DNA, 25 bp, Mus musculus
gcgcctatgatttaccccactggga

SEQ ID NO: 686862 - DNA, 25 bp, Mus musculus
gcgcctcagggtaggagtctcacta

SEQ ID NO: 686863 - DNA, 25 bp, Mus musculus
gcgcctcagggttggagtctcacta

SEQ ID NO: 686864 - DNA, 25 bp, Mus musculus
gcgcctcatcggacgcacttggaat

SEQ ID NO: 686865 - DNA, 25 bp, Mus musculus
gcgcctcatcggtcgcacttggaat

SEQ ID NO: 686866 - DNA, 25 bp, Mus musculus
gcgcctcatctaaggccaagacagt

SEQ ID NO: 686867 - DNA, 25 bp, Mus musculus
gcgcctcatctatggccaagacagt

SEQ ID NO: 686868 - DNA, 25 bp, Mus musculus
gcgcctcctacaaagaacaatggac

SEQ ID NO: 686869 - DNA, 25 bp, Mus musculus
gcgcctcctacatagaacaatggac

SEQ ID NO: 686870 - DNA, 25 bp, Mus musculus
gcgcctcgttctcagaagctccgga

SEQ ID NO: 686871 - DNA, 25 bp, Mus musculus
gcgcctcgttctgagaagctccgga

SEQ ID NO: 686872 - DNA, 25 bp, Mus musculus
gcgcctctccggaggacccttgggt

SEQ ID NO: 686873 - DNA, 25 bp, Mus musculus
gcgcctctccggtggacccttgggt

SEQ ID NO: 686874 - DNA, 25 bp, Mus musculus
gcgcctcttgctctcgactgttaat

SEQ ID NO: 686875 - DNA, 25 bp, Mus musculus
gcgcctcttgctgtcgactgttaat

SEQ ID NO: 686876 - DNA, 25 bp, Mus musculus
gcgcctgacttcacggctggccagg

SEQ ID NO: 686877 - DNA, 25 bp, Mus musculus
gcgcctgacttctcggctggccagg

SEQ ID NO: 686878 - DNA, 25 bp, Mus musculus
gcgcctgcgcagagcggctgcttct

SEQ ID NO: 686879 - DNA, 25 bp, Mus musculus
gcgcctgcgcagtgcggctgcttct

SEQ ID NO: 686880 - DNA, 25 bp, Mus musculus
gcgcctgcgtaccttgcagcacgtg

SEQ ID NO: 686881 - DNA, 25 bp, Mus musculus
gcgcctgcgtacgttgcagcacgtg

SEQ ID NO: 686882 - DNA, 25 bp, Mus musculus
gcgcctgctttcaatagccaggctc

SEQ ID NO: 686883 - DNA, 25 bp, Mus musculus
gcgcctgctttctatagccaggctc

SEQ ID NO: 686884 - DNA, 25 bp, Mus musculus
gcgcctggaatgcacttgtgtgcta

SEQ ID NO: 686885 - DNA, 25 bp, Mus musculus
gcgcctggaatggacttgtgtgcta

SEQ ID NO: 686886 - DNA, 25 bp, Mus musculus
gcgcctggaccacctacggctagat

SEQ ID NO: 686887 - DNA, 25 bp, Mus musculus
gcgcctggaccagctacggctagat

SEQ ID NO: 686888 - DNA, 25 bp, Mus musculus
gcgcctggacttcaaccgcaactta

SEQ ID NO: 686889 - DNA, 25 bp, Mus musculus
gcgcctggacttgaaccgcaactta

SEQ ID NO: 686890 - DNA, 25 bp, Mus musculus
gcgcctggagatattgtcaagcaag

SEQ ID NO: 686891 - DNA, 25 bp, Mus musculus
gcgcctggagattttgtcaagcaag

SEQ ID NO: 686892 - DNA, 25 bp, Mus musculus
gcgcctggataacaggaccctggac

SEQ ID NO: 686893 - DNA, 25 bp, Mus musculus
gcgcctggataagaggaccctggac

SEQ ID NO: 686894 - DNA, 25 bp, Mus musculus
gcgcctggcgcacggccgttcgggt

SEQ ID NO: 686895 - DNA, 25 bp, Mus musculus
gcgcctggcgcagggccgttcgggt

SEQ ID NO: 686896 - DNA, 25 bp, Mus musculus
gcgcctggcgtcctctttcttcgag

SEQ ID NO: 686897 - DNA, 25 bp, Mus musculus
gcgcctggcgtcgtctttcttcgag

SEQ ID NO: 686898 - DNA, 25 bp, Mus musculus
gcgcctgtcatgaacacatggtttt

SEQ ID NO: 686899 - DNA, 25 bp, Mus musculus
gcgcctgtcatgtacacatggtttt

SEQ ID NO: 686900 - DNA, 25 bp, Mus musculus
gcgcctgtcctcataaaaaacacat

SEQ ID NO: 686901 - DNA, 25 bp, Mus musculus
gcgcctgtcctcttaaaaaacacat

SEQ ID NO: 686902 - DNA, 25 bp, Mus musculus
gcgcctgttcagcatctgccaaatt

SEQ ID NO: 686903 - DNA, 25 bp, Mus musculus
gcgcctgttcaggatctgccaaatt

SEQ ID NO: 686904 - DNA, 25 bp, Mus musculus
gcgccttactaactccatgatgatg

SEQ ID NO: 686905 - DNA, 25 bp, Mus musculus
gcgccttactaagtccatgatgatg

SEQ ID NO: 686906 - DNA, 25 bp, Mus musculus
gcgccttatggaagatggacttgaa

SEQ ID NO: 686907 - DNA, 25 bp, Mus musculus
gcgccttatggatgatggacttgaa

SEQ ID NO: 686908 - DNA, 25 bp, Mus musculus
gcgccttccaagatctgagagtgca

SEQ ID NO: 686909 - DNA, 25 bp, Mus musculus
gcgccttccaagttctgagagtgca

SEQ ID NO: 686910 - DNA, 25 bp, Mus musculus
gcgccttctccaaggatgaccgcat

SEQ ID NO: 686911 - DNA, 25 bp, Mus musculus
gcgccttctccatggatgaccgcat

SEQ ID NO: 686912 - DNA, 25 bp, Mus musculus
gcgccttctggtctcatgattttca

SEQ ID NO: 686913 - DNA, 25 bp, Mus musculus
gcgccttctggtgtcatgattttca

SEQ ID NO: 686914 - DNA, 25 bp, Mus musculus
gcgccttgccttaaacgcgagccga

SEQ ID NO: 686915 - DNA, 25 bp, Mus musculus
gcgccttgcctttaacgcgagccga

SEQ ID NO: 686916 - DNA, 25 bp, Mus musculus
gcgccttgggcgaactactttgctt

SEQ ID NO: 686917 - DNA, 25 bp, Mus musculus
gcgccttgggcgtactactttgctt

SEQ ID NO: 686918 - DNA, 25 bp, Mus musculus
gcgcgaataattactgggaggtgat

SEQ ID NO: 686919 - DNA, 25 bp, Mus musculus
gcgcgaataatttctgggaggtgat

SEQ ID NO: 686920 - DNA, 25 bp, Mus musculus
gcgcgaatcccgaacatcttaagct

SEQ ID NO: 686921 - DNA, 25 bp, Mus musculus
gcgcgaatcccgtacatcttaagct

SEQ ID NO: 686922 - DNA, 25 bp, Mus musculus
gcgcgacgctaaacgagggccgctc

SEQ ID NO: 686923 - DNA, 25 bp, Mus musculus
gcgcgacgctaatcgagggccgctc

SEQ ID NO: 686924 - DNA, 25 bp, Mus musculus
gcgcgactacctatctgcagccgag

SEQ ID NO: 686925 - DNA, 25 bp, Mus musculus
gcgcgactacctttctgcagccgag

SEQ ID NO: 686926 - DNA, 25 bp, Mus musculus
gcgcgaggaaataccaacgccgaga

SEQ ID NO: 686927 - DNA, 25 bp, Mus musculus
gcgcgaggaaattccaacgccgaga

SEQ ID NO: 686928 - DNA, 25 bp, Mus musculus
gcgcgatgttcgagcaggaggagaa

SEQ ID NO: 686929 - DNA, 25 bp, Mus musculus
gcgcgatgttcgtgcaggaggagaa

SEQ ID NO: 686930 - DNA, 25 bp, Mus musculus
gcgcgcacttttcgcggtcgcagct

SEQ ID NO: 686931 - DNA, 25 bp, Mus musculus
gcgcgcacttttggcggtcgcagct

SEQ ID NO: 686932 - DNA, 25 bp, Mus musculus
gcgcgcagcttgcttgctccgtagt

SEQ ID NO: 686933 - DNA, 25 bp, Mus musculus
gcgcgcagcttggttgctccgtagt

SEQ ID NO: 686934 - DNA, 25 bp, Mus musculus
gcgcgcctccgcaatttccagggat

SEQ ID NO: 686935 - DNA, 25 bp, Mus musculus
gcgcgcctccgctatttccagggat

SEQ ID NO: 686936 - DNA, 25 bp, Mus musculus
gcgcgcgagcaaagtatttacccaa

SEQ ID NO: 686937 - DNA, 25 bp, Mus musculus
gcgcgcgagcaatgtatttacccaa

SEQ ID NO: 686938 - DNA, 25 bp, Mus musculus
gcgcgctagagtacttgactctgga

SEQ ID NO: 686939 - DNA, 25 bp, Mus musculus
gcgcgctagagttcttgactctgga

SEQ ID NO: 686940 - DNA, 25 bp, Mus musculus
gcgcgctggcgcctcgttctcagaa

SEQ ID NO: 686941 - DNA, 25 bp, Mus musculus
gcgcgctggcgcgtcgttctcagaa

SEQ ID NO: 686942 - DNA, 25 bp, Mus musculus
gcgcgcttgctgcaggaaccagctc

SEQ ID NO: 686943 - DNA, 25 bp, Mus musculus
gcgcgcttgctggaggaaccagctc

SEQ ID NO: 686944 - DNA, 25 bp, Mus musculus
gcgcgcttgggcataaccaatctgt

SEQ ID NO: 686945 - DNA, 25 bp, Mus musculus
gcgcgcttgggcttaaccaatctgt

SEQ ID NO: 686946 - DNA, 25 bp, Mus musculus
gcgcggactccgaactgaacctcaa

SEQ ID NO: 686947 - DNA, 25 bp, Mus musculus
gcgcggactccgtactgaacctcaa

SEQ ID NO: 686948 - DNA, 25 bp, Mus musculus
gcgcggagtcgcagttgttctagaa

SEQ ID NO: 686949 - DNA, 25 bp, Mus musculus
gcgcggagtcgctgttgttctagaa

SEQ ID NO: 686950 - DNA, 25 bp, Mus musculus
gcgcggcactggcaatgaacactac

SEQ ID NO: 686951 - DNA, 25 bp, Mus musculus
gcgcggcactgggaatgaacactac

SEQ ID NO: 686952 - DNA, 25 bp, Mus musculus
gcgcggcgggcaagataacaagccc

SEQ ID NO: 686953 - DNA, 25 bp, Mus musculus
gcgcggcgggcatgataacaagccc

SEQ ID NO: 686954 - DNA, 25 bp, Mus musculus
gcgcgggtgctgagactgctcctcc

SEQ ID NO: 686955 - DNA, 25 bp, Mus musculus
gcgcgggtgctgtgactgctcctcc

SEQ ID NO: 686956 - DNA, 25 bp, Mus musculus
gcgcgggttgaaaagtctcgttcca

SEQ ID NO: 686957 - DNA, 25 bp, Mus musculus
gcgcgggttgaatagtctcgttcca

SEQ ID NO: 686958 - DNA, 25 bp, Mus musculus
gcgcggtcccttaaaggcttggcct

SEQ ID NO: 686959 - DNA, 25 bp, Mus musculus
gcgcggtccctttaaggcttggcct

SEQ ID NO: 686960 - DNA, 25 bp, Mus musculus
gcgcggttaaaacaagccacaggtg

SEQ ID NO: 686961 - DNA, 25 bp, Mus musculus
gcgcggttaaaagaagccacaggtg

SEQ ID NO: 686962 - DNA, 25 bp, Mus musculus
gcgcggttccttaaatctgagcaga

SEQ ID NO: 686963 - DNA, 25 bp, Mus musculus
gcgcggttcctttaatctgagcaga

SEQ ID NO: 686964 - DNA, 25 bp, Mus musculus
gcgcgtccttgcatcaaagagatag

SEQ ID NO: 686965 - DNA, 25 bp, Mus musculus
gcgcgtccttgcttcaaagagatag

SEQ ID NO: 686966 - DNA, 25 bp, Mus musculus
gcgcgtcggtgcagttgcgccatct

SEQ ID NO: 686967 - DNA, 25 bp, Mus musculus
gcgcgtcggtgctgttgcgccatct

SEQ ID NO: 686968 - DNA, 25 bp, Mus musculus
gcgcgtgaagccacgctggctcctg

SEQ ID NO: 686969 - DNA, 25 bp, Mus musculus
gcgcgtgaagccacggaaccttggc

SEQ ID NO: 686970 - DNA, 25 bp, Mus musculus
gcgcgtgaagcctcgctggctcctg

SEQ ID NO: 686971 - DNA, 25 bp, Mus musculus
gcgcgtgaagcctcggaaccttggc

SEQ ID NO: 686972 - DNA, 25 bp, Mus musculus
gcgcgtgatctcacacacaagtgtg

SEQ ID NO: 686973 - DNA, 25 bp, Mus musculus
gcgcgtgatctctcacacaagtgtg

SEQ ID NO: 686974 - DNA, 25 bp, Mus musculus
gcgcgtgtatgaaggcaagatgtac

SEQ ID NO: 686975 - DNA, 25 bp, Mus musculus
gcgcgtgtatgatggcaagatgtac

SEQ ID NO: 686976 - DNA, 25 bp, Mus musculus
gcgctaaacagcaggacacgggact

SEQ ID NO: 686977 - DNA, 25 bp, Mus musculus
gcgctaaacagctggacacgggact

SEQ ID NO: 686978 - DNA, 25 bp, Mus musculus
gcgctaatgcccagttcttgcctgg

SEQ ID NO: 686979 - DNA, 25 bp, Mus musculus
gcgctaatgccctgttcttgcctgg

SEQ ID NO: 686980 - DNA, 25 bp, Mus musculus
gcgctacaacacacaactatgaccg

SEQ ID NO: 686981 - DNA, 25 bp, Mus musculus
gcgctacaacactcaactatgaccg

SEQ ID NO: 686982 - DNA, 25 bp, Mus musculus
gcgctacacaggcatgctagagact

SEQ ID NO: 686983 - DNA, 25 bp, Mus musculus
gcgctacacagggatgctagagact

SEQ ID NO: 686984 - DNA, 25 bp, Mus musculus
gcgctacagaatatcaccgcgggcg

SEQ ID NO: 686985 - DNA, 25 bp, Mus musculus
gcgctacagaatttcaccgcgggcg

SEQ ID NO: 686986 - DNA, 25 bp, Mus musculus
gcgctaccatatattgaccaaggct

SEQ ID NO: 686987 - DNA, 25 bp, Mus musculus
gcgctaccatattttgaccaaggct

SEQ ID NO: 686988 - DNA, 25 bp, Mus musculus
gcgctacgagctatcatcgaggaga

SEQ ID NO: 686989 - DNA, 25 bp, Mus musculus
gcgctacgagctttcatcgaggaga

SEQ ID NO: 686990 - DNA, 25 bp, Mus musculus
gcgctagctacgcaggcgtttgtaa

SEQ ID NO: 686991 - DNA, 25 bp, Mus musculus
gcgctagctacggaggcgtttgtaa

SEQ ID NO: 686992 - DNA, 25 bp, Mus musculus
gcgctaggtggtatccaggaactca

SEQ ID NO: 686993 - DNA, 25 bp, Mus musculus
gcgctaggtggtttccaggaactca

SEQ ID NO: 686994 - DNA, 25 bp, Mus musculus
gcgctatgacaaactggtagcccag

SEQ ID NO: 686995 - DNA, 25 bp, Mus musculus
gcgctatgacaaagctacaatgaag

SEQ ID NO: 686996 - DNA, 25 bp, Mus musculus
gcgctatgacaatctggtagcccag

SEQ ID NO: 686997 - DNA, 25 bp, Mus musculus
gcgctatgacaatgctacaatgaag

SEQ ID NO: 686998 - DNA, 25 bp, Mus musculus
gcgctcaacggccagccggagctgg

SEQ ID NO: 686999 - DNA, 25 bp, Mus musculus
gcgctcaacggcgagccggagctgg

SEQ ID NO: 687000 - DNA, 25 bp, Mus musculus
gcgctcaactccactaatggagagc

SEQ ID NO: 687001 - DNA, 25 bp, Mus musculus
gcgctcaactcctctaatggagagc

SEQ ID NO: 687002 - DNA, 25 bp, Mus musculus
gcgctcaaggtccaggtcccgaagc

SEQ ID NO: 687003 - DNA, 25 bp, Mus musculus
gcgctcaaggtcgaggtcccgaagc

SEQ ID NO: 687004 - DNA, 25 bp, Mus musculus
gcgctcacagaacccatgtatacca

SEQ ID NO: 687005 - DNA, 25 bp, Mus musculus
gcgctcacagaagccatgtatacca

SEQ ID NO: 687006 - DNA, 25 bp, Mus musculus
gcgctcactcggatgcagggtccca

SEQ ID NO: 687007 - DNA, 25 bp, Mus musculus
gcgctcactcggttgcagggtccca

SEQ ID NO: 687008 - DNA, 25 bp, Mus musculus
gcgctcagaacaagtgtaacttcta

SEQ ID NO: 687009 - DNA, 25 bp, Mus musculus
gcgctcagaacatgtgtaacttcta

SEQ ID NO: 687010 - DNA, 25 bp, Mus musculus
gcgctcatccatccggaaaggcatg

SEQ ID NO: 687011 - DNA, 25 bp, Mus musculus
gcgctcatccatgcggaaaggcatg

SEQ ID NO: 687012 - DNA, 25 bp, Mus musculus
gcgctcatcgacatcccatgtgcag

SEQ ID NO: 687013 - DNA, 25 bp, Mus musculus
gcgctcatcgacttcccatgtgcag

SEQ ID NO: 687014 - DNA, 25 bp, Mus musculus
gcgctccaaactcattctggtgcag

SEQ ID NO: 687015 - DNA, 25 bp, Mus musculus
gcgctccaaactgattctggtgcag

SEQ ID NO: 687016 - DNA, 25 bp, Mus musculus
gcgctccattctcgtggctctgaag

SEQ ID NO: 687017 - DNA, 25 bp, Mus musculus
gcgctccattctggtggctctgaag

SEQ ID NO: 687018 - DNA, 25 bp, Mus musculus
gcgctcgaaagccagcagttcgtct

SEQ ID NO: 687019 - DNA, 25 bp, Mus musculus
gcgctcgaaagcgagcagttcgtct

SEQ ID NO: 687020 - DNA, 25 bp, Mus musculus
gcgctcgcagaacagctacaccaga

SEQ ID NO: 687021 - DNA, 25 bp, Mus musculus
gcgctcgcagaagagctacaccaga

SEQ ID NO: 687022 - DNA, 25 bp, Mus musculus
gcgctcgtctttcacattggctctt

SEQ ID NO: 687023 - DNA, 25 bp, Mus musculus
gcgctcgtctttgacattggctctt

SEQ ID NO: 687024 - DNA, 25 bp, Mus musculus
gcgctctaaaatcatcgacaagaac

SEQ ID NO: 687025 - DNA, 25 bp, Mus musculus
gcgctctaaaatgatcgacaagaac

SEQ ID NO: 687026 - DNA, 25 bp, Mus musculus
gcgctctctcttagaaagcagaata

SEQ ID NO: 687027 - DNA, 25 bp, Mus musculus
gcgctctctctttgaaagcagaata

SEQ ID NO: 687028 - DNA, 25 bp, Mus musculus
gcgctctggagcacggtgtagaaac

SEQ ID NO: 687029 - DNA, 25 bp, Mus musculus
gcgctctggagctcggtgtagaaac

SEQ ID NO: 687030 - DNA, 25 bp, Mus musculus
gcgctcttcagcctcttgtgtgaga

SEQ ID NO: 687031 - DNA, 25 bp, Mus musculus
gcgctcttcagcgtcttgtgtgaga

SEQ ID NO: 687032 - DNA, 25 bp, Mus musculus
gcgctgaaacatccaaagtgctccg

SEQ ID NO: 687033 - DNA, 25 bp, Mus musculus
gcgctgaaacatgcaaagtgctccg

SEQ ID NO: 687034 - DNA, 25 bp, Mus musculus
gcgctgaaacgtcgaggcctccagt

SEQ ID NO: 687035 - DNA, 25 bp, Mus musculus
gcgctgaaacgtggaggcctccagt

SEQ ID NO: 687036 - DNA, 25 bp, Mus musculus
gcgctgacctgtaggaagagcattt

SEQ ID NO: 687037 - DNA, 25 bp, Mus musculus
gcgctgacctgttggaagagcattt

SEQ ID NO: 687038 - DNA, 25 bp, Mus musculus
gcgctgactcccagggctgtgatcg

SEQ ID NO: 687039 - DNA, 25 bp, Mus musculus
gcgctgactccctgggctgtgatcg

SEQ ID NO: 687040 - DNA, 25 bp, Mus musculus
gcgctgagacagacttactgcagaa

SEQ ID NO: 687041 - DNA, 25 bp, Mus musculus
gcgctgagacagtcttactgcagaa

SEQ ID NO: 687042 - DNA, 25 bp, Mus musculus
gcgctgaggaaaagtcactaccgga

SEQ ID NO: 687043 - DNA, 25 bp, Mus musculus
gcgctgaggaaatgtcactaccgga

SEQ ID NO: 687044 - DNA, 25 bp, Mus musculus
gcgctgcagccacgaatgtgccaac

SEQ ID NO: 687045 - DNA, 25 bp, Mus musculus
gcgctgcagccaggaatgtgccaac

SEQ ID NO: 687046 - DNA, 25 bp, Mus musculus
gcgctgccacaccagtgtgaagcca

SEQ ID NO: 687047 - DNA, 25 bp, Mus musculus
gcgctgccacacgagtgtgaagcca

SEQ ID NO: 687048 - DNA, 25 bp, Mus musculus
gcgctgccgagcagcgtcacgtcat

SEQ ID NO: 687049 - DNA, 25 bp, Mus musculus
gcgctgccgagctgcgtcacgtcat

SEQ ID NO: 687050 - DNA, 25 bp, Mus musculus
gcgctgcctattcccacgcagagga

SEQ ID NO: 687051 - DNA, 25 bp, Mus musculus
gcgctgcctattgccacgcagagga

SEQ ID NO: 687052 - DNA, 25 bp, Mus musculus
gcgctgccttgtcaagaacttgcga

SEQ ID NO: 687053 - DNA, 25 bp, Mus musculus
gcgctgccttgtgaagaacttgcga

SEQ ID NO: 687054 - DNA, 25 bp, Mus musculus
gcgctgcgttgcaggtattagtgct

SEQ ID NO: 687055 - DNA, 25 bp, Mus musculus
gcgctgcgttgctggtattagtgct

SEQ ID NO: 687056 - DNA, 25 bp, Mus musculus
gcgctgctgagtaggcctctctctg

SEQ ID NO: 687057 - DNA, 25 bp, Mus musculus
gcgctgctgagttggcctctctctg

SEQ ID NO: 687058 - DNA, 25 bp, Mus musculus
gcgctgctgcccagaatgagtatga

SEQ ID NO: 687059 - DNA, 25 bp, Mus musculus
gcgctgctgccctgaatgagtatga

SEQ ID NO: 687060 - DNA, 25 bp, Mus musculus
gcgctgctttgtacacacccatttt

SEQ ID NO: 687061 - DNA, 25 bp, Mus musculus
gcgctgctttgttcacacccatttt

SEQ ID NO: 687062 - DNA, 25 bp, Mus musculus
gcgctggaacccatggacacttcat

SEQ ID NO: 687063 - DNA, 25 bp, Mus musculus
gcgctggaacccttggacacttcat

SEQ ID NO: 687064 - DNA, 25 bp, Mus musculus
gcgctggcctacagacaaaatattc

SEQ ID NO: 687065 - DNA, 25 bp, Mus musculus
gcgctggcctactgacaaaatattc

SEQ ID NO: 687066 - DNA, 25 bp, Mus musculus
gcgctgggtccacctcagagttctc

SEQ ID NO: 687067 - DNA, 25 bp, Mus musculus
gcgctgggtccagctcagagttctc

SEQ ID NO: 687068 - DNA, 25 bp, Mus musculus
gcgctgggtgctatggcccatgctt

SEQ ID NO: 687069 - DNA, 25 bp, Mus musculus
gcgctgggtgctttggcccatgctt

SEQ ID NO: 687070 - DNA, 25 bp, Mus musculus
gcgctgtacagtacatgctgaacaa

SEQ ID NO: 687071 - DNA, 25 bp, Mus musculus
gcgctgtacagttcatgctgaacaa

SEQ ID NO: 687072 - DNA, 25 bp, Mus musculus
gcgctgtaccccattgaatccagaa

SEQ ID NO: 687073 - DNA, 25 bp, Mus musculus
gcgctgtacccctttgaatccagaa

SEQ ID NO: 687074 - DNA, 25 bp, Mus musculus
gcgctgtacgagctgcgttcgccac

SEQ ID NO: 687075 - DNA, 25 bp, Mus musculus
gcgctgtacgaggtgcgttcgccac

SEQ ID NO: 687076 - DNA, 25 bp, Mus musculus
gcgctgtatcagcatcgccctcaag

SEQ ID NO: 687077 - DNA, 25 bp, Mus musculus
gcgctgtatcaggatcgccctcaag

SEQ ID NO: 687078 - DNA, 25 bp, Mus musculus
gcgctgtcgacaagctgcagcaaga

SEQ ID NO: 687079 - DNA, 25 bp, Mus musculus
gcgctgtcgacatgctgcagcaaga

SEQ ID NO: 687080 - DNA, 25 bp, Mus musculus
gcgctgtcgcggacacccagacttg

SEQ ID NO: 687081 - DNA, 25 bp, Mus musculus
gcgctgtcgcggtcacccagacttg

SEQ ID NO: 687082 - DNA, 25 bp, Mus musculus
gcgctgtgaactcccctttatacgt

SEQ ID NO: 687083 - DNA, 25 bp, Mus musculus
gcgctgtgaactgccctttatacgt

SEQ ID NO: 687084 - DNA, 25 bp, Mus musculus
gcgctgtgaccccatagacttttcc

SEQ ID NO: 687085 - DNA, 25 bp, Mus musculus
gcgctgtgacccgatagacttttcc

SEQ ID NO: 687086 - DNA, 25 bp, Mus musculus
gcgctgtgtgaacagcaccagcagc

SEQ ID NO: 687087 - DNA, 25 bp, Mus musculus
gcgctgtgtgaagagcaccagcagc

SEQ ID NO: 687088 - DNA, 25 bp, Mus musculus
gcgctgtgtgtcagggcttcctctg

SEQ ID NO: 687089 - DNA, 25 bp, Mus musculus
gcgctgtgtgtctgggcttcctctg

SEQ ID NO: 687090 - DNA, 25 bp, Mus musculus
gcgctgttataaatgggtgcataca

SEQ ID NO: 687091 - DNA, 25 bp, Mus musculus
gcgctgttataattgggtgcataca

SEQ ID NO: 687092 - DNA, 25 bp, Mus musculus
gcgctgttgagtaccccagaggaca

SEQ ID NO: 687093 - DNA, 25 bp, Mus musculus
gcgctgttgagttccccagaggaca

SEQ ID NO: 687094 - DNA, 25 bp, Mus musculus
gcgcttaaggacaacgcgatcgaaa

SEQ ID NO: 687095 - DNA, 25 bp, Mus musculus
gcgcttaaggactacgcgatcgaaa

SEQ ID NO: 687096 - DNA, 25 bp, Mus musculus
gcgcttacattcagaattacttaat

SEQ ID NO: 687097 - DNA, 25 bp, Mus musculus
gcgcttacattctgaattacttaat

SEQ ID NO: 687098 - DNA, 25 bp, Mus musculus
gcgcttagttagcactggagtgctt

SEQ ID NO: 687099 - DNA, 25 bp, Mus musculus
gcgcttagttaggactggagtgctt

SEQ ID NO: 687100 - DNA, 25 bp, Mus musculus
gcgcttatgactaggtgctggctga

SEQ ID NO: 687101 - DNA, 25 bp, Mus musculus
gcgcttatgacttggtgctggctga

SEQ ID NO: 687102 - DNA, 25 bp, Mus musculus
gcgcttcacctgcagcatgaagacc

SEQ ID NO: 687103 - DNA, 25 bp, Mus musculus
gcgcttcacctggagcatgaagacc

SEQ ID NO: 687104 - DNA, 25 bp, Mus musculus
gcgcttcatgtaaggaccattggat

SEQ ID NO: 687105 - DNA, 25 bp, Mus musculus
gcgcttcatgtatggaccattggat

SEQ ID NO: 687106 - DNA, 25 bp, Mus musculus
gcgcttccgcagagtgacccatgct

SEQ ID NO: 687107 - DNA, 25 bp, Mus musculus
gcgcttccgcagtgtgacccatgct

SEQ ID NO: 687108 - DNA, 25 bp, Mus musculus
gcgcttcctgtacccaataataaaa

SEQ ID NO: 687109 - DNA, 25 bp, Mus musculus
gcgcttcctgtagccaataataaaa

SEQ ID NO: 687110 - DNA, 25 bp, Mus musculus
gcgcttccttgcagcaatggcagca

SEQ ID NO: 687111 - DNA, 25 bp, Mus musculus
gcgcttccttgctgcaatggcagca

SEQ ID NO: 687112 - DNA, 25 bp, Mus musculus
gcgcttcgaccacaatgagatatat

SEQ ID NO: 687113 - DNA, 25 bp, Mus musculus
gcgcttcgaccagaatgagatatat

SEQ ID NO: 687114 - DNA, 25 bp, Mus musculus
gcgcttcgtggacaatcacatgggt

SEQ ID NO: 687115 - DNA, 25 bp, Mus musculus
gcgcttcgtggagaatcacatgggt

SEQ ID NO: 687116 - DNA, 25 bp, Mus musculus
gcgcttcgtggcaggttccctggcc

SEQ ID NO: 687117 - DNA, 25 bp, Mus musculus
gcgcttcgtggctggttccctggcc

SEQ ID NO: 687118 - DNA, 25 bp, Mus musculus
gcgcttctgagtcctcctggttttc

SEQ ID NO: 687119 - DNA, 25 bp, Mus musculus
gcgcttctgagtgctcctggttttc

SEQ ID NO: 687120 - DNA, 25 bp, Mus musculus
gcgcttctttaacggctacgggaag

SEQ ID NO: 687121 - DNA, 25 bp, Mus musculus
gcgcttctttaagggctacgggaag

SEQ ID NO: 687122 - DNA, 25 bp, Mus musculus
gcgcttgcgctccacagtgaacgta

SEQ ID NO: 687123 - DNA, 25 bp, Mus musculus
gcgcttgcgctcgacagtgaacgta

SEQ ID NO: 687124 - DNA, 25 bp, Mus musculus
gcgcttggaatgcttgctctgccca

SEQ ID NO: 687125 - DNA, 25 bp, Mus musculus
gcgcttggaatggttgctctgccca

SEQ ID NO: 687126 - DNA, 25 bp, Mus musculus
gcgcttggagcccagatcttccgga

SEQ ID NO: 687127 - DNA, 25 bp, Mus musculus
gcgcttggagccgagatcttccgga

SEQ ID NO: 687128 - DNA, 25 bp, Mus musculus
gcgcttggtgctacaaccggactga

SEQ ID NO: 687129 - DNA, 25 bp, Mus musculus
gcgcttggtgcttcaaccggactga

SEQ ID NO: 687130 - DNA, 25 bp, Mus musculus
gcgctttacgttaacagcgctcggg

SEQ ID NO: 687131 - DNA, 25 bp, Mus musculus
gcgctttacgtttacagcgctcggg

SEQ ID NO: 687132 - DNA, 25 bp, Mus musculus
gcgctttatcctaaaatcatacaag

SEQ ID NO: 687133 - DNA, 25 bp, Mus musculus
gcgctttatccttaaatcatacaag

SEQ ID NO: 687134 - DNA, 25 bp, Mus musculus
gcgctttcacccacgggatgctgct

SEQ ID NO: 687135 - DNA, 25 bp, Mus musculus
gcgctttcaccctcgggatgctgct

SEQ ID NO: 687136 - DNA, 25 bp, Mus musculus
gcgctttcgttgctgcttgtctagg

SEQ ID NO: 687137 - DNA, 25 bp, Mus musculus
gcgctttcgttggtgcttgtctagg

SEQ ID NO: 687138 - DNA, 25 bp, Mus musculus
gcgctttgaattctctccagatccc

SEQ ID NO: 687139 - DNA, 25 bp, Mus musculus
gcgctttgaattgtctccagatccc

SEQ ID NO: 687140 - DNA, 25 bp, Mus musculus
gcgctttgactcactgacagacctg

SEQ ID NO: 687141 - DNA, 25 bp, Mus musculus
gcgctttgactctctgacagacctg

SEQ ID NO: 687142 - DNA, 25 bp, Mus musculus
gcgctttgcgtgcactgcacacaca

SEQ ID NO: 687143 - DNA, 25 bp, Mus musculus
gcgctttgcgtggactgcacacaca

SEQ ID NO: 687144 - DNA, 25 bp, Mus musculus
gcgctttggattcctgcttcccatc

SEQ ID NO: 687145 - DNA, 25 bp, Mus musculus
gcgctttggattgctgcttcccatc

SEQ ID NO: 687146 - DNA, 25 bp, Mus musculus
gcgctttgttcgctaccagttcaca

SEQ ID NO: 687147 - DNA, 25 bp, Mus musculus
gcgctttgttcggtaccagttcaca

SEQ ID NO: 687148 - DNA, 25 bp, Mus musculus
gcgcttttgacaaagggcctggaaa

SEQ ID NO: 687149 - DNA, 25 bp, Mus musculus
gcgcttttgacatagggcctggaaa

SEQ ID NO: 687150 - DNA, 25 bp, Mus musculus
gcgcttttggcacgctcacagtgga

SEQ ID NO: 687151 - DNA, 25 bp, Mus musculus
gcgcttttggcaggctcacagtgga

SEQ ID NO: 687152 - DNA, 25 bp, Mus musculus
gcggaaaaactgatgaagcaaattg

SEQ ID NO: 687153 - DNA, 25 bp, Mus musculus
gcggaaaaactgttgaagcaaattg

SEQ ID NO: 687154 - DNA, 25 bp, Mus musculus
gcggaaaactttcggccaagcttca

SEQ ID NO: 687155 - DNA, 25 bp, Mus musculus
gcggaaaactttgggccaagcttca

SEQ ID NO: 687156 - DNA, 25 bp, Mus musculus
gcggaaaagaggaacaacagtgtcc

SEQ ID NO: 687157 - DNA, 25 bp, Mus musculus
gcggaaaagaggtacaacagtgtcc

SEQ ID NO: 687158 - DNA, 25 bp, Mus musculus
gcggaaagtgatctgcatccccaaa

SEQ ID NO: 687159 - DNA, 25 bp, Mus musculus
gcggaaagtgatgtgcatccccaaa

SEQ ID NO: 687160 - DNA, 25 bp, Mus musculus
gcggaaatgtaactacgagcggtac

SEQ ID NO: 687161 - DNA, 25 bp, Mus musculus
gcggaaatgtaagtacgagcggtac

SEQ ID NO: 687162 - DNA, 25 bp, Mus musculus
gcggaacatcgtaggctgcaggatc

SEQ ID NO: 687163 - DNA, 25 bp, Mus musculus
gcggaacatcgttggctgcaggatc

SEQ ID NO: 687164 - DNA, 25 bp, Mus musculus
gcggaaccacgacggtcatgaagat

SEQ ID NO: 687165 - DNA, 25 bp, Mus musculus
gcggaaccacgagggtcatgaagat

SEQ ID NO: 687166 - DNA, 25 bp, Mus musculus
gcggaaccccacacagcgaattggg

SEQ ID NO: 687167 - DNA, 25 bp, Mus musculus
gcggaaccccactcagcgaattggg

SEQ ID NO: 687168 - DNA, 25 bp, Mus musculus
gcggaaccgaagcatctgctccaag

SEQ ID NO: 687169 - DNA, 25 bp, Mus musculus
gcggaaccgaaggatctgctccaag

SEQ ID NO: 687170 - DNA, 25 bp, Mus musculus
gcggaacgaagcctccagacacaga

SEQ ID NO: 687171 - DNA, 25 bp, Mus musculus
gcggaacgaagcgtccagacacaga

SEQ ID NO: 687172 - DNA, 25 bp, Mus musculus
gcggaacttgctcacgggcctagtt

SEQ ID NO: 687173 - DNA, 25 bp, Mus musculus
gcggaacttgctgacgggcctagtt

SEQ ID NO: 687174 - DNA, 25 bp, Mus musculus
gcggaagaagcaaatctggaactca

SEQ ID NO: 687175 - DNA, 25 bp, Mus musculus
gcggaagaagcatatctggaactca

SEQ ID NO: 687176 - DNA, 25 bp, Mus musculus
gcggaagctcaaccagctgctcctg

SEQ ID NO: 687177 - DNA, 25 bp, Mus musculus
gcggaagctcaagcagctgctcctg

SEQ ID NO: 687178 - DNA, 25 bp, Mus musculus
gcggaagtcttcagctagccgaccg

SEQ ID NO: 687179 - DNA, 25 bp, Mus musculus
gcggaagtcttctgctagccgaccg

SEQ ID NO: 687180 - DNA, 25 bp, Mus musculus
gcggaagtgcccctgaagttgcccc

SEQ ID NO: 687181 - DNA, 25 bp, Mus musculus
gcggaagtgcccgtgaagttgcccc

SEQ ID NO: 687182 - DNA, 25 bp, Mus musculus
gcggaagtgtgaccccattgccatg

SEQ ID NO: 687183 - DNA, 25 bp, Mus musculus
gcggaagtgtgagcccattgccatg

SEQ ID NO: 687184 - DNA, 25 bp, Mus musculus
gcggaagttagacgcagaaatcgtt

SEQ ID NO: 687185 - DNA, 25 bp, Mus musculus
gcggaagttagaggcagaaatcgtt

SEQ ID NO: 687186 - DNA, 25 bp, Mus musculus
gcggacaaaagcattcgaagtatgc

SEQ ID NO: 687187 - DNA, 25 bp, Mus musculus
gcggacaaaagctttcgaagtatgc

SEQ ID NO: 687188 - DNA, 25 bp, Mus musculus
gcggacacaatgatcggcaaagcag

SEQ ID NO: 687189 - DNA, 25 bp, Mus musculus
gcggacacaatgttcggcaaagcag

SEQ ID NO: 687190 - DNA, 25 bp, Mus musculus
gcggacacacgtactgccacaagtg

SEQ ID NO: 687191 - DNA, 25 bp, Mus musculus
gcggacacacgttctgccacaagtg

SEQ ID NO: 687192 - DNA, 25 bp, Mus musculus
gcggacagcagcagccttaacaagc

SEQ ID NO: 687193 - DNA, 25 bp, Mus musculus
gcggacagcagctgccttaacaagc

SEQ ID NO: 687194 - DNA, 25 bp, Mus musculus
gcggacatatccagacagccttgta

SEQ ID NO: 687195 - DNA, 25 bp, Mus musculus
gcggacatatcctgacagccttgta

SEQ ID NO: 687196 - DNA, 25 bp, Mus musculus
gcggacatgcacagtgaagggaacc

SEQ ID NO: 687197 - DNA, 25 bp, Mus musculus
gcggacatgcactgtgaagggaacc

SEQ ID NO: 687198 - DNA, 25 bp, Mus musculus
gcggacattctacacaaaggtgttg

SEQ ID NO: 687199 - DNA, 25 bp, Mus musculus
gcggacattctagacaaaggtgttg

SEQ ID NO: 687200 - DNA, 25 bp, Mus musculus
gcggaccacatacaaggcagcagga

SEQ ID NO: 687201 - DNA, 25 bp, Mus musculus
gcggaccacatagaaggcagcagga

SEQ ID NO: 687202 - DNA, 25 bp, Mus musculus
gcggaccaggtgaagtgaaacactg

SEQ ID NO: 687203 - DNA, 25 bp, Mus musculus
gcggaccaggtgtagtgaaacactg

SEQ ID NO: 687204 - DNA, 25 bp, Mus musculus
gcggacctgagaccttcccgcagag

SEQ ID NO: 687205 - DNA, 25 bp, Mus musculus
gcggacctgagagcttcccgcagag

SEQ ID NO: 687206 - DNA, 25 bp, Mus musculus
gcggacctgcataatggacaatggg

SEQ ID NO: 687207 - DNA, 25 bp, Mus musculus
gcggacctgcattatggacaatggg

SEQ ID NO: 687208 - DNA, 25 bp, Mus musculus
gcggacctgctgaggctgccgcttc

SEQ ID NO: 687209 - DNA, 25 bp, Mus musculus
gcggacctgctgtggctgccgcttc

SEQ ID NO: 687210 - DNA, 25 bp, Mus musculus
gcggacctggcaaggagttgtccaa

SEQ ID NO: 687211 - DNA, 25 bp, Mus musculus
gcggacctggcatggagttgtccaa

SEQ ID NO: 687212 - DNA, 25 bp, Mus musculus
gcggacctggccagtctgatatgca

SEQ ID NO: 687213 - DNA, 25 bp, Mus musculus
gcggacctggcctgtctgatatgca

SEQ ID NO: 687214 - DNA, 25 bp, Mus musculus
gcggactctcagagtgctggcctgc

SEQ ID NO: 687215 - DNA, 25 bp, Mus musculus
gcggactctcagtgtgctggcctgc

SEQ ID NO: 687216 - DNA, 25 bp, Mus musculus
gcggactggacaagcttattctaaa

SEQ ID NO: 687217 - DNA, 25 bp, Mus musculus
gcggactggacatgcttattctaaa

SEQ ID NO: 687218 - DNA, 25 bp, Mus musculus
gcggacttaaaacgcaccgtcttgc

SEQ ID NO: 687219 - DNA, 25 bp, Mus musculus
gcggacttaaaaggcaccgtcttgc

SEQ ID NO: 687220 - DNA, 25 bp, Mus musculus
gcggacttgtacacttcccgggtga

SEQ ID NO: 687221 - DNA, 25 bp, Mus musculus
gcggacttgtactcttcccgggtga

SEQ ID NO: 687222 - DNA, 25 bp, Mus musculus
gcggagaactcacagctcacagaga

SEQ ID NO: 687223 - DNA, 25 bp, Mus musculus
gcggagaactcagagctcacagaga

SEQ ID NO: 687224 - DNA, 25 bp, Mus musculus
gcggagaaggaaaatctctcagcga

SEQ ID NO: 687225 - DNA, 25 bp, Mus musculus
gcggagaaggaatatctctcagcga

SEQ ID NO: 687226 - DNA, 25 bp, Mus musculus
gcggagaagtcgctcaccactccga

SEQ ID NO: 687227 - DNA, 25 bp, Mus musculus
gcggagaagtcggtcaccactccga

SEQ ID NO: 687228 - DNA, 25 bp, Mus musculus
gcggagagttcacctgctcttaaag

SEQ ID NO: 687229 - DNA, 25 bp, Mus musculus
gcggagagttcagctgctcttaaag

SEQ ID NO: 687230 - DNA, 25 bp, Mus musculus
gcggagatgatgcaatttgagatat

SEQ ID NO: 687231 - DNA, 25 bp, Mus musculus
gcggagatgatggaatttgagatat

SEQ ID NO: 687232 - DNA, 25 bp, Mus musculus
gcggagatgattactgggaagatcc

SEQ ID NO: 687233 - DNA, 25 bp, Mus musculus
gcggagatgatttctgggaagatcc

SEQ ID NO: 687234 - DNA, 25 bp, Mus musculus
gcggagattactagtggcaccttac

SEQ ID NO: 687235 - DNA, 25 bp, Mus musculus
gcggagattacttgtggcaccttac

SEQ ID NO: 687236 - DNA, 25 bp, Mus musculus
gcggagccagcgagggagggccgcg

SEQ ID NO: 687237 - DNA, 25 bp, Mus musculus
gcggagccagcgtgggagggccgcg

SEQ ID NO: 687238 - DNA, 25 bp, Mus musculus
gcggagccatagacggaatcatcaa

SEQ ID NO: 687239 - DNA, 25 bp, Mus musculus
gcggagccatagtcggaatcatcaa

SEQ ID NO: 687240 - DNA, 25 bp, Mus musculus
gcggagctcaacagttcagcagtca

SEQ ID NO: 687241 - DNA, 25 bp, Mus musculus
gcggagctcaactgttcagcagtca

SEQ ID NO: 687242 - DNA, 25 bp, Mus musculus
gcggagctcagacagtccttacact

SEQ ID NO: 687243 - DNA, 25 bp, Mus musculus
gcggagctcagagagtccttacact

SEQ ID NO: 687244 - DNA, 25 bp, Mus musculus
gcggagctggccctcatttcagcga

SEQ ID NO: 687245 - DNA, 25 bp, Mus musculus
gcggagctggccgtcatttcagcga

SEQ ID NO: 687246 - DNA, 25 bp, Mus musculus
gcggagctgtccagagagaagcccc

SEQ ID NO: 687247 - DNA, 25 bp, Mus musculus
gcggagctgtcctgagagaagcccc

SEQ ID NO: 687248 - DNA, 25 bp, Mus musculus
gcggaggctcctacatcatcgtcct

SEQ ID NO: 687249 - DNA, 25 bp, Mus musculus
gcggaggctccttcatcatcgtcct

SEQ ID NO: 687250 - DNA, 25 bp, Mus musculus
gcggaggctttcaaccttcccagga

SEQ ID NO: 687251 - DNA, 25 bp, Mus musculus
gcggaggctttctaccttcccagga

SEQ ID NO: 687252 - DNA, 25 bp, Mus musculus
gcggagggtcccagcacgctacgta

SEQ ID NO: 687253 - DNA, 25 bp, Mus musculus
gcggagggtccctgcacgctacgta

SEQ ID NO: 687254 - DNA, 25 bp, Mus musculus
gcggaggtatcccagccccgacttg

SEQ ID NO: 687255 - DNA, 25 bp, Mus musculus
gcggaggtatccgagccccgacttg

SEQ ID NO: 687256 - DNA, 25 bp, Mus musculus
gcggagtacggcagcctcaaggcca

SEQ ID NO: 687257 - DNA, 25 bp, Mus musculus
gcggagtacggctgcctcaaggcca

SEQ ID NO: 687258 - DNA, 25 bp, Mus musculus
gcggagtccttcaggctgtgccccg

SEQ ID NO: 687259 - DNA, 25 bp, Mus musculus
gcggagtccttctggctgtgccccg

SEQ ID NO: 687260 - DNA, 25 bp, Mus musculus
gcggagtcgcagatgttctagaact

SEQ ID NO: 687261 - DNA, 25 bp, Mus musculus
gcggagtcgcagttgttctagaact

SEQ ID NO: 687262 - DNA, 25 bp, Mus musculus
gcggagtcggatcctcagtatcttc

SEQ ID NO: 687263 - DNA, 25 bp, Mus musculus
gcggagtcggatgctcagtatcttc

SEQ ID NO: 687264 - DNA, 25 bp, Mus musculus
gcggagtcgtcaccggccactcagt

SEQ ID NO: 687265 - DNA, 25 bp, Mus musculus
gcggagtcgtcagcggccactcagt

SEQ ID NO: 687266 - DNA, 25 bp, Mus musculus
gcggagtggagcacccagccagacc

SEQ ID NO: 687267 - DNA, 25 bp, Mus musculus
gcggagtggagctcccagccagacc

SEQ ID NO: 687268 - DNA, 25 bp, Mus musculus
gcggagttagacctcgccgtagccc

SEQ ID NO: 687269 - DNA, 25 bp, Mus musculus
gcggagttagacgtcgccgtagccc

SEQ ID NO: 687270 - DNA, 25 bp, Mus musculus
gcggagttcagcaggccttcgcgtc

SEQ ID NO: 687271 - DNA, 25 bp, Mus musculus
gcggagttcagctggccttcgcgtc

SEQ ID NO: 687272 - DNA, 25 bp, Mus musculus
gcggagttccacaccttcttcaatg

SEQ ID NO: 687273 - DNA, 25 bp, Mus musculus
gcggagttccactccttcttcaatg

SEQ ID NO: 687274 - DNA, 25 bp, Mus musculus
gcggataaagatccccaggacagta

SEQ ID NO: 687275 - DNA, 25 bp, Mus musculus
gcggataaagatgcccaggacagta

SEQ ID NO: 687276 - DNA, 25 bp, Mus musculus
gcggatacagcgacgcctagaggat

SEQ ID NO: 687277 - DNA, 25 bp, Mus musculus
gcggatacagcgtcgcctagaggat

SEQ ID NO: 687278 - DNA, 25 bp, Mus musculus
gcggatacgaatcgacagcattgga

SEQ ID NO: 687279 - DNA, 25 bp, Mus musculus
gcggatacgaatggacagcattgga

SEQ ID NO: 687280 - DNA, 25 bp, Mus musculus
gcggatacttggaccagcgagtgcc

SEQ ID NO: 687281 - DNA, 25 bp, Mus musculus
gcggatacttggtccagcgagtgcc

SEQ ID NO: 687282 - DNA, 25 bp, Mus musculus
gcggatatagacagcacttccctgc

SEQ ID NO: 687283 - DNA, 25 bp, Mus musculus
gcggatatagactgcacttccctgc

SEQ ID NO: 687284 - DNA, 25 bp, Mus musculus
gcggatccctgccttttgatggaca

SEQ ID NO: 687285 - DNA, 25 bp, Mus musculus
gcggatccctgcgttttgatggaca

SEQ ID NO: 687286 - DNA, 25 bp, Mus musculus
gcggatcctccccagtgagaagtcc

SEQ ID NO: 687287 - DNA, 25 bp, Mus musculus
gcggatcctcccgagtgagaagtcc

SEQ ID NO: 687288 - DNA, 25 bp, Mus musculus
gcggatctcgacaccaagccggttt

SEQ ID NO: 687289 - DNA, 25 bp, Mus musculus
gcggatctcgactccaagccggttt

SEQ ID NO: 687290 - DNA, 25 bp, Mus musculus
gcggatctctatatggcgacggctc

SEQ ID NO: 687291 - DNA, 25 bp, Mus musculus
gcggatctctatttggcgacggctc

SEQ ID NO: 687292 - DNA, 25 bp, Mus musculus
gcggatctctgtcaatagcctggtc

SEQ ID NO: 687293 - DNA, 25 bp, Mus musculus
gcggatctctgtgaatagcctggtc

SEQ ID NO: 687294 - DNA, 25 bp, Mus musculus
gcggattctactcgagcgccgtgac

SEQ ID NO: 687295 - DNA, 25 bp, Mus musculus
gcggattctactggagcgccgtgac

SEQ ID NO: 687296 - DNA, 25 bp, Mus musculus
gcggattctgagcacaataaactta

SEQ ID NO: 687297 - DNA, 25 bp, Mus musculus
gcggattctgaggacaataaactta

SEQ ID NO: 687298 - DNA, 25 bp, Mus musculus
gcggcaaattgacagcaattttgct

SEQ ID NO: 687299 - DNA, 25 bp, Mus musculus
gcggcaaattgagagcaattttgct

SEQ ID NO: 687300 - DNA, 25 bp, Mus musculus
gcggcaacttttctctaaccctgaa

SEQ ID NO: 687301 - DNA, 25 bp, Mus musculus
gcggcaacttttgtctaaccctgaa

SEQ ID NO: 687302 - DNA, 25 bp, Mus musculus
gcggcacaaaatcagcgtgagaagc

SEQ ID NO: 687303 - DNA, 25 bp, Mus musculus
gcggcacaaaatgagcgtgagaagc

SEQ ID NO: 687304 - DNA, 25 bp, Mus musculus
gcggcacaaagacacccgggtgctc

SEQ ID NO: 687305 - DNA, 25 bp, Mus musculus
gcggcacaaagagacccgggtgctc

SEQ ID NO: 687306 - DNA, 25 bp, Mus musculus
gcggcacaatggctctgctgagctt

SEQ ID NO: 687307 - DNA, 25 bp, Mus musculus
gcggcacaatgggtctgctgagctt

SEQ ID NO: 687308 - DNA, 25 bp, Mus musculus
gcggcaccttgcaatttcttctcag

SEQ ID NO: 687309 - DNA, 25 bp, Mus musculus
gcggcaccttgctatttcttctcag

SEQ ID NO: 687310 - DNA, 25 bp, Mus musculus
gcggcacgtcctaagggatttttcg

SEQ ID NO: 687311 - DNA, 25 bp, Mus musculus
gcggcacgtccttagggatttttcg

SEQ ID NO: 687312 - DNA, 25 bp, Mus musculus
gcggcactctggacaagcgcttgag

SEQ ID NO: 687313 - DNA, 25 bp, Mus musculus
gcggcactctggtcaagcgcttgag

SEQ ID NO: 687314 - DNA, 25 bp, Mus musculus
gcggcacttctgacatcaaagaggt

SEQ ID NO: 687315 - DNA, 25 bp, Mus musculus
gcggcacttctgtcatcaaagaggt

SEQ ID NO: 687316 - DNA, 25 bp, Mus musculus
gcggcagatctacgatcccaagtat

SEQ ID NO: 687317 - DNA, 25 bp, Mus musculus
gcggcagatctaggatcccaagtat

SEQ ID NO: 687318 - DNA, 25 bp, Mus musculus
gcggcagcatgaacatgtgatccac

SEQ ID NO: 687319 - DNA, 25 bp, Mus musculus
gcggcagcatgatcatgtgatccac

SEQ ID NO: 687320 - DNA, 25 bp, Mus musculus
gcggcagcgtcgcaagcaatcttct

SEQ ID NO: 687321 - DNA, 25 bp, Mus musculus
gcggcagcgtcggaagcaatcttct

SEQ ID NO: 687322 - DNA, 25 bp, Mus musculus
gcggcaggaaccagcaattactggg

SEQ ID NO: 687323 - DNA, 25 bp, Mus musculus
gcggcaggaacctgcaattactggg

SEQ ID NO: 687324 - DNA, 25 bp, Mus musculus
gcggcaggatggagctgaactctct

SEQ ID NO: 687325 - DNA, 25 bp, Mus musculus
gcggcaggatggtgctgaactctct

SEQ ID NO: 687326 - DNA, 25 bp, Mus musculus
gcggcagtccttatgatccagtcac

SEQ ID NO: 687327 - DNA, 25 bp, Mus musculus
gcggcagtccttttgatccagtcac

SEQ ID NO: 687328 - DNA, 25 bp, Mus musculus
gcggcatccatcactgccacaatgg

SEQ ID NO: 687329 - DNA, 25 bp, Mus musculus
gcggcatccatctctgccacaatgg

SEQ ID NO: 687330 - DNA, 25 bp, Mus musculus
gcggcatcccctcgaagtgcggtat

SEQ ID NO: 687331 - DNA, 25 bp, Mus musculus
gcggcatcccctggaagtgcggtat

SEQ ID NO: 687332 - DNA, 25 bp, Mus musculus
gcggcatcgatgatcatctcactga

SEQ ID NO: 687333 - DNA, 25 bp, Mus musculus
gcggcatcgatgttcatctcactga

SEQ ID NO: 687334 - DNA, 25 bp, Mus musculus
gcggcatctactcagactacttcag

SEQ ID NO: 687335 - DNA, 25 bp, Mus musculus
gcggcatctactgagactacttcag

SEQ ID NO: 687336 - DNA, 25 bp, Mus musculus
gcggcatctgcaatccgtggaccat

SEQ ID NO: 687337 - DNA, 25 bp, Mus musculus
gcggcatctgcattccgtggaccat

SEQ ID NO: 687338 - DNA, 25 bp, Mus musculus
gcggcatgcccaaacggattgaaaa

SEQ ID NO: 687339 - DNA, 25 bp, Mus musculus
gcggcatgcccatacggattgaaaa

SEQ ID NO: 687340 - DNA, 25 bp, Mus musculus
gcggcatggcaaatgcaaacatgaa

SEQ ID NO: 687341 - DNA, 25 bp, Mus musculus
gcggcatggcaattgcaaacatgaa

SEQ ID NO: 687342 - DNA, 25 bp, Mus musculus
gcggcatgtgaccatcactggctca

SEQ ID NO: 687343 - DNA, 25 bp, Mus musculus
gcggcatgtgacgatcactggctca

SEQ ID NO: 687344 - DNA, 25 bp, Mus musculus
gcggccaacgagaggaacgtgtcca

SEQ ID NO: 687345 - DNA, 25 bp, Mus musculus
gcggccaacgagtggaacgtgtcca

SEQ ID NO: 687346 - DNA, 25 bp, Mus musculus
gcggccaccgtaacagacgtgaaat

SEQ ID NO: 687347 - DNA, 25 bp, Mus musculus
gcggccaccgtatcagacgtgaaat

SEQ ID NO: 687348 - DNA, 25 bp, Mus musculus
gcggccactgtcctacaagacgttc

SEQ ID NO: 687349 - DNA, 25 bp, Mus musculus
gcggccactgtcgtacaagacgttc

SEQ ID NO: 687350 - DNA, 25 bp, Mus musculus
gcggccagaagaagtcagggacctt

SEQ ID NO: 687351 - DNA, 25 bp, Mus musculus
gcggccagaagatgtcagggacctt

SEQ ID NO: 687352 - DNA, 25 bp, Mus musculus
gcggccaggagtatgctgtcaagat

SEQ ID NO: 687353 - DNA, 25 bp, Mus musculus
gcggccaggagtttgctgtcaagat

SEQ ID NO: 687354 - DNA, 25 bp, Mus musculus
gcggccaggcaaaatgaagcccaaa

SEQ ID NO: 687355 - DNA, 25 bp, Mus musculus
gcggccaggcaatatgaagcccaaa

SEQ ID NO: 687356 - DNA, 25 bp, Mus musculus
gcggccatcatcaccctgggactgt

SEQ ID NO: 687357 - DNA, 25 bp, Mus musculus
gcggccatcatctccctgggactgt

SEQ ID NO: 687358 - DNA, 25 bp, Mus musculus
gcggccatggtgatccgagctcaca

SEQ ID NO: 687359 - DNA, 25 bp, Mus musculus
gcggccatggtgttccgagctcaca

SEQ ID NO: 687360 - DNA, 25 bp, Mus musculus
gcggcccaagagatcccatgtaaag

SEQ ID NO: 687361 - DNA, 25 bp, Mus musculus
gcggcccaagagttcccatgtaaag

SEQ ID NO: 687362 - DNA, 25 bp, Mus musculus
gcggcccacgccattgtctctgtga

SEQ ID NO: 687363 - DNA, 25 bp, Mus musculus
gcggcccacgcctttgtctctgtga

SEQ ID NO: 687364 - DNA, 25 bp, Mus musculus
gcggcccaggatcagttctaccgca

SEQ ID NO: 687365 - DNA, 25 bp, Mus musculus
gcggcccaggatgagttctaccgca

SEQ ID NO: 687366 - DNA, 25 bp, Mus musculus
gcggcccatagtcccttgcgatggc

SEQ ID NO: 687367 - DNA, 25 bp, Mus musculus
gcggcccatagtgccttgcgatggc

SEQ ID NO: 687368 - DNA, 25 bp, Mus musculus
gcggcccctctccacagtctgaggg

SEQ ID NO: 687369 - DNA, 25 bp, Mus musculus
gcggcccctctcgacagtctgaggg

SEQ ID NO: 687370 - DNA, 25 bp, Mus musculus
gcggcccgggacaatccgcagcaat

SEQ ID NO: 687371 - DNA, 25 bp, Mus musculus
gcggcccgggactatccgcagcaat

SEQ ID NO: 687372 - DNA, 25 bp, Mus musculus
gcggcccgtgcccaaatgtttcggt

SEQ ID NO: 687373 - DNA, 25 bp, Mus musculus
gcggcccgtgccgaaatgtttcggt

SEQ ID NO: 687374 - DNA, 25 bp, Mus musculus
gcggccctcttgaccacgatgtgta

SEQ ID NO: 687375 - DNA, 25 bp, Mus musculus
gcggccctcttgtccacgatgtgta

SEQ ID NO: 687376 - DNA, 25 bp, Mus musculus
gcggccgagccaaggcgcttcacgt

SEQ ID NO: 687377 - DNA, 25 bp, Mus musculus
gcggccgagccatggcgcttcacgt

SEQ ID NO: 687378 - DNA, 25 bp, Mus musculus
gcggccgcttcccacttagtttctt

SEQ ID NO: 687379 - DNA, 25 bp, Mus musculus
gcggccgcttccgacttagtttctt

SEQ ID NO: 687380 - DNA, 25 bp, Mus musculus
gcggccggaaatacatgtacccgaa

SEQ ID NO: 687381 - DNA, 25 bp, Mus musculus
gcggccggaaattcatgtacccgaa

SEQ ID NO: 687382 - DNA, 25 bp, Mus musculus
gcggccggttttacatcactggatt

SEQ ID NO: 687383 - DNA, 25 bp, Mus musculus
gcggccggtttttcatcactggatt

SEQ ID NO: 687384 - DNA, 25 bp, Mus musculus
gcggccgtatttcatttagacttgg

SEQ ID NO: 687385 - DNA, 25 bp, Mus musculus
gcggccgtatttgatttagacttgg

SEQ ID NO: 687386 - DNA, 25 bp, Mus musculus
gcggccgtccgacccaaaaacatga

SEQ ID NO: 687387 - DNA, 25 bp, Mus musculus
gcggccgtccgagccaaaaacatga

SEQ ID NO: 687388 - DNA, 25 bp, Mus musculus
gcggccgtgcgcaggcacttgtacc

SEQ ID NO: 687389 - DNA, 25 bp, Mus musculus
gcggccgtgcgctggcacttgtacc

SEQ ID NO: 687390 - DNA, 25 bp, Mus musculus
gcggccgtggtgaagcaccgcttcc

SEQ ID NO: 687391 - DNA, 25 bp, Mus musculus
gcggccgtggtgtagcaccgcttcc

SEQ ID NO: 687392 - DNA, 25 bp, Mus musculus
gcggccgtgtgcctgattacctagt

SEQ ID NO: 687393 - DNA, 25 bp, Mus musculus
gcggccgtgtgcgtgattacctagt

SEQ ID NO: 687394 - DNA, 25 bp, Mus musculus
gcggcctcactaacgctgggatcct

SEQ ID NO: 687395 - DNA, 25 bp, Mus musculus
gcggcctcactatcgctgggatcct

SEQ ID NO: 687396 - DNA, 25 bp, Mus musculus
gcggcctggattatcttcatgcaaa

SEQ ID NO: 687397 - DNA, 25 bp, Mus musculus
gcggcctggattttcttcatgcaaa

SEQ ID NO: 687398 - DNA, 25 bp, Mus musculus
gcggccttgggaagggctttgtgcc

SEQ ID NO: 687399 - DNA, 25 bp, Mus musculus
gcggccttgggatgggctttgtgcc

SEQ ID NO: 687400 - DNA, 25 bp, Mus musculus
gcggcgatgcagatgacaagaagaa

SEQ ID NO: 687401 - DNA, 25 bp, Mus musculus
gcggcgatgcagttgacaagaagaa

SEQ ID NO: 687402 - DNA, 25 bp, Mus musculus
gcggcgcagatcctcctgacctttg

SEQ ID NO: 687403 - DNA, 25 bp, Mus musculus
gcggcgcagatcgtcctgacctttg

SEQ ID NO: 687404 - DNA, 25 bp, Mus musculus
gcggcgcccatgcagctgttctgct

SEQ ID NO: 687405 - DNA, 25 bp, Mus musculus
gcggcgcccatggagctgttctgct

SEQ ID NO: 687406 - DNA, 25 bp, Mus musculus
gcggcgcgaactcttcctccgggaa

SEQ ID NO: 687407 - DNA, 25 bp, Mus musculus
gcggcgcgaactgttcctccgggaa

SEQ ID NO: 687408 - DNA, 25 bp, Mus musculus
gcggcgcggtcgattttatacattc

SEQ ID NO: 687409 - DNA, 25 bp, Mus musculus
gcggcgcggtcgtttttatacattc

SEQ ID NO: 687410 - DNA, 25 bp, Mus musculus
gcggcgctctcgcagaaggttttca

SEQ ID NO: 687411 - DNA, 25 bp, Mus musculus
gcggcgctctcggagaaggttttca

SEQ ID NO: 687412 - DNA, 25 bp, Mus musculus
gcggcggatgtaacctgtgcagctc

SEQ ID NO: 687413 - DNA, 25 bp, Mus musculus
gcggcggatgtatcctgtgcagctc

SEQ ID NO: 687414 - DNA, 25 bp, Mus musculus
gcggcggcatttagcaggcagcatt

SEQ ID NO: 687415 - DNA, 25 bp, Mus musculus
gcggcggcattttgcaggcagcatt

SEQ ID NO: 687416 - DNA, 25 bp, Mus musculus
gcggcggcctccaggcatggactac

SEQ ID NO: 687417 - DNA, 25 bp, Mus musculus
gcggcggcctcctggcatggactac

SEQ ID NO: 687418 - DNA, 25 bp, Mus musculus
gcggcggcgcttcgctgtatatatc

SEQ ID NO: 687419 - DNA, 25 bp, Mus musculus
gcggcggcgcttggctgtatatatc

SEQ ID NO: 687420 - DNA, 25 bp, Mus musculus
gcggcgtccttgcagggccggatcc

SEQ ID NO: 687421 - DNA, 25 bp, Mus musculus
gcggcgtccttggagggccggatcc

SEQ ID NO: 687422 - DNA, 25 bp, Mus musculus
gcggcgtctgaacaaacggaagacc

SEQ ID NO: 687423 - DNA, 25 bp, Mus musculus
gcggcgtctgaagaaacggaagacc

SEQ ID NO: 687424 - DNA, 25 bp, Mus musculus
gcggcgtctgagctctacatagaga

SEQ ID NO: 687425 - DNA, 25 bp, Mus musculus
gcggcgtctgaggtctacatagaga

SEQ ID NO: 687426 - DNA, 25 bp, Mus musculus
gcggcgtgtctacgatgccttaaat

SEQ ID NO: 687427 - DNA, 25 bp, Mus musculus
gcggcgtgtctaggatgccttaaat

SEQ ID NO: 687428 - DNA, 25 bp, Mus musculus
gcggcgttgggaagacatctctact

SEQ ID NO: 687429 - DNA, 25 bp, Mus musculus
gcggcgttgggatgacatctctact

SEQ ID NO: 687430 - DNA, 25 bp, Mus musculus
gcggctaaagagacacaccaccgtg

SEQ ID NO: 687431 - DNA, 25 bp, Mus musculus
gcggctaaagagtcacaccaccgtg

SEQ ID NO: 687432 - DNA, 25 bp, Mus musculus
gcggctaccatcagcaggtctaact

SEQ ID NO: 687433 - DNA, 25 bp, Mus musculus
gcggctaccatctgcaggtctaact

SEQ ID NO: 687434 - DNA, 25 bp, Mus musculus
gcggctagtcataccacaatgtaga

SEQ ID NO: 687435 - DNA, 25 bp, Mus musculus
gcggctagtcattccacaatgtaga

SEQ ID NO: 687436 - DNA, 25 bp, Mus musculus
gcggctagttagatggtagtcctac

SEQ ID NO: 687437 - DNA, 25 bp, Mus musculus
gcggctagttagttggtagtcctac

SEQ ID NO: 687438 - DNA, 25 bp, Mus musculus
gcggctatgggacccttccagtcac

SEQ ID NO: 687439 - DNA, 25 bp, Mus musculus
gcggctatgggagccttccagtcac

SEQ ID NO: 687440 - DNA, 25 bp, Mus musculus
gcggctcatctacagtggcaagcaa

SEQ ID NO: 687441 - DNA, 25 bp, Mus musculus
gcggctcatctagagtggcaagcaa

SEQ ID NO: 687442 - DNA, 25 bp, Mus musculus
gcggctccagtgatcatgaggcgaa

SEQ ID NO: 687443 - DNA, 25 bp, Mus musculus
gcggctccagtgttcatgaggcgaa

SEQ ID NO: 687444 - DNA, 25 bp, Mus musculus
gcggctccggaaaaggacagagttt

SEQ ID NO: 687445 - DNA, 25 bp, Mus musculus
gcggctccggaataggacagagttt

SEQ ID NO: 687446 - DNA, 25 bp, Mus musculus
gcggctctgaacacaccattgatgg

SEQ ID NO: 687447 - DNA, 25 bp, Mus musculus
gcggctctgaactcaccattgatgg

SEQ ID NO: 687448 - DNA, 25 bp, Mus musculus
gcggctgaaccaagcggactagctg

SEQ ID NO: 687449 - DNA, 25 bp, Mus musculus
gcggctgaaccatgcggactagctg

SEQ ID NO: 687450 - DNA, 25 bp, Mus musculus
gcggctgaccacagccaggagccaa

SEQ ID NO: 687451 - DNA, 25 bp, Mus musculus
gcggctgaccactgccaggagccaa

SEQ ID NO: 687452 - DNA, 25 bp, Mus musculus
gcggctgacgcaactccggagagct

SEQ ID NO: 687453 - DNA, 25 bp, Mus musculus
gcggctgacgcatctccggagagct

SEQ ID NO: 687454 - DNA, 25 bp, Mus musculus
gcggctgatcaaaaagctgtctatg

SEQ ID NO: 687455 - DNA, 25 bp, Mus musculus
gcggctgatcaataagctgtctatg

SEQ ID NO: 687456 - DNA, 25 bp, Mus musculus
gcggctgccagcagatctgcgtcaa

SEQ ID NO: 687457 - DNA, 25 bp, Mus musculus
gcggctgccagctgatctgcgtcaa

SEQ ID NO: 687458 - DNA, 25 bp, Mus musculus
gcggctgcgaccagggtcacaccga

SEQ ID NO: 687459 - DNA, 25 bp, Mus musculus
gcggctgcgacctgggtcacaccga

SEQ ID NO: 687460 - DNA, 25 bp, Mus musculus
gcggctgcgcaacaagtccaacgag

SEQ ID NO: 687461 - DNA, 25 bp, Mus musculus
gcggctgcgcaagaagtccaacgag

SEQ ID NO: 687462 - DNA, 25 bp, Mus musculus
gcggctgctctaagaggaagccaag

SEQ ID NO: 687463 - DNA, 25 bp, Mus musculus
gcggctgctctatgaggaagccaag

SEQ ID NO: 687464 - DNA, 25 bp, Mus musculus
gcggctggaacgacccgccacaatt

SEQ ID NO: 687465 - DNA, 25 bp, Mus musculus
gcggctggaacgtcccgccacaatt

SEQ ID NO: 687466 - DNA, 25 bp, Mus musculus
gcggctggaggtctctgctccaact

SEQ ID NO: 687467 - DNA, 25 bp, Mus musculus
gcggctggaggtgtctgctccaact

SEQ ID NO: 687468 - DNA, 25 bp, Mus musculus
gcggctggcgctatctgcgtatcgt

SEQ ID NO: 687469 - DNA, 25 bp, Mus musculus
gcggctggcgctttctgcgtatcgt

SEQ ID NO: 687470 - DNA, 25 bp, Mus musculus
gcggctggcttcagtcctcaacaca

SEQ ID NO: 687471 - DNA, 25 bp, Mus musculus
gcggctggcttctgtcctcaacaca

SEQ ID NO: 687472 - DNA, 25 bp, Mus musculus
gcggctgggcaactacgtcatcaat

SEQ ID NO: 687473 - DNA, 25 bp, Mus musculus
gcggctgggcaagtacgtcatcaat

SEQ ID NO: 687474 - DNA, 25 bp, Mus musculus
gcggctggtccgacttacctagaaa

SEQ ID NO: 687475 - DNA, 25 bp, Mus musculus
gcggctggtccgtcttacctagaaa

SEQ ID NO: 687476 - DNA, 25 bp, Mus musculus
gcggctggtcgccagtgctgagcag

SEQ ID NO: 687477 - DNA, 25 bp, Mus musculus
gcggctggtcgcgagtgctgagcag

SEQ ID NO: 687478 - DNA, 25 bp, Mus musculus
gcggcttaacacacaaatcactcaa

SEQ ID NO: 687479 - DNA, 25 bp, Mus musculus
gcggcttaacactcaaatcactcaa

SEQ ID NO: 687480 - DNA, 25 bp, Mus musculus
gcggcttcatagcagacacgtcaga

SEQ ID NO: 687481 - DNA, 25 bp, Mus musculus
gcggcttcataggagacacgtcaga

SEQ ID NO: 687482 - DNA, 25 bp, Mus musculus
gcggcttcgcggcttgtccaacgtc

SEQ ID NO: 687483 - DNA, 25 bp, Mus musculus
gcggcttcgcgggttgtccaacgtc

SEQ ID NO: 687484 - DNA, 25 bp, Mus musculus
gcggcttgtactctgccagcctggc

SEQ ID NO: 687485 - DNA, 25 bp, Mus musculus
gcggcttgtactgtgccagcctggc

SEQ ID NO: 687486 - DNA, 25 bp, Mus musculus
gcggctttctgtagactatggcaaa

SEQ ID NO: 687487 - DNA, 25 bp, Mus musculus
gcggctttctgttgactatggcaaa

SEQ ID NO: 687488 - DNA, 25 bp, Mus musculus
gcggctttgtggcacagacctctaa

SEQ ID NO: 687489 - DNA, 25 bp, Mus musculus
gcggctttgtgggacagacctctaa

SEQ ID NO: 687490 - DNA, 25 bp, Mus musculus
gcggcttttttcacagtgacaacca

SEQ ID NO: 687491 - DNA, 25 bp, Mus musculus
gcggcttttttctcagtgacaacca

SEQ ID NO: 687492 - DNA, 25 bp, Mus musculus
gcgggaaagtgtaccagcgcctgat

SEQ ID NO: 687493 - DNA, 25 bp, Mus musculus
gcgggaaagtgttccagcgcctgat

SEQ ID NO: 687494 - DNA, 25 bp, Mus musculus
gcgggaacatggctctaaaacggat

SEQ ID NO: 687495 - DNA, 25 bp, Mus musculus
gcgggaacatgggtctaaaacggat

SEQ ID NO: 687496 - DNA, 25 bp, Mus musculus
gcgggaacccaaaaggagataaact

SEQ ID NO: 687497 - DNA, 25 bp, Mus musculus
gcgggaacccaataggagataaact

SEQ ID NO: 687498 - DNA, 25 bp, Mus musculus
gcgggaacccggatcccaggttcag

SEQ ID NO: 687499 - DNA, 25 bp, Mus musculus
gcgggaacccggttcccaggttcag

SEQ ID NO: 687500 - DNA, 25 bp, Mus musculus
gcgggaacggagcatgtcggagacg

SEQ ID NO: 687501 - DNA, 25 bp, Mus musculus
gcgggaacggaggatgtcggagacg

SEQ ID NO: 687502 - DNA, 25 bp, Mus musculus
gcgggaactccacagcatgcctgtt

SEQ ID NO: 687503 - DNA, 25 bp, Mus musculus
gcgggaactccagagcatgcctgtt

SEQ ID NO: 687504 - DNA, 25 bp, Mus musculus
gcgggaacttctctgcaaaacatgt

SEQ ID NO: 687505 - DNA, 25 bp, Mus musculus
gcgggaacttctgtgcaaaacatgt

SEQ ID NO: 687506 - DNA, 25 bp, Mus musculus
gcgggaagacccaagacaagtgtgt

SEQ ID NO: 687507 - DNA, 25 bp, Mus musculus
gcgggaagaccctagacaagtgtgt

SEQ ID NO: 687508 - DNA, 25 bp, Mus musculus
gcgggaagtacacaatccctttcta

SEQ ID NO: 687509 - DNA, 25 bp, Mus musculus
gcgggaagtacacatttgcagccca

SEQ ID NO: 687510 - DNA, 25 bp, Mus musculus
gcgggaagtacagaatccctttcta

SEQ ID NO: 687511 - DNA, 25 bp, Mus musculus
gcgggaagtacagatttgcagccca

SEQ ID NO: 687512 - DNA, 25 bp, Mus musculus
gcgggaatcatgataagcagcttca

SEQ ID NO: 687513 - DNA, 25 bp, Mus musculus
gcgggaatcatgttaagcagcttca

SEQ ID NO: 687514 - DNA, 25 bp, Mus musculus
gcgggaattctgcatctcggcaaca

SEQ ID NO: 687515 - DNA, 25 bp, Mus musculus
gcgggaattctggatctcggcaaca

SEQ ID NO: 687516 - DNA, 25 bp, Mus musculus
gcgggacagcgtctaccacatcgag

SEQ ID NO: 687517 - DNA, 25 bp, Mus musculus
gcgggacagcgtgtaccacatcgag

SEQ ID NO: 687518 - DNA, 25 bp, Mus musculus
gcgggacctgccctcacttttgatg

SEQ ID NO: 687519 - DNA, 25 bp, Mus musculus
gcgggacctgccgtcacttttgatg

SEQ ID NO: 687520 - DNA, 25 bp, Mus musculus
gcgggacgcagaaaaccgctgcccg

SEQ ID NO: 687521 - DNA, 25 bp, Mus musculus
gcgggacgcagataaccgctgcccg

SEQ ID NO: 687522 - DNA, 25 bp, Mus musculus
gcgggacgttggcttgaattcccca

SEQ ID NO: 687523 - DNA, 25 bp, Mus musculus
gcgggacgttgggttgaattcccca

SEQ ID NO: 687524 - DNA, 25 bp, Mus musculus
gcgggacttaaaccgcgtagccaga

SEQ ID NO: 687525 - DNA, 25 bp, Mus musculus
gcgggacttaaagcgcgtagccaga

SEQ ID NO: 687526 - DNA, 25 bp, Mus musculus
gcgggacttcgacgcgacacttcta

SEQ ID NO: 687527 - DNA, 25 bp, Mus musculus
gcgggacttcgaggcgacacttcta

SEQ ID NO: 687528 - DNA, 25 bp, Mus musculus
gcgggagagcgcactgtcacttgcc

SEQ ID NO: 687529 - DNA, 25 bp, Mus musculus
gcgggagagcgctctgtcacttgcc

SEQ ID NO: 687530 - DNA, 25 bp, Mus musculus
gcgggagccactagtctctgggtac

SEQ ID NO: 687531 - DNA, 25 bp, Mus musculus
gcgggagccacttgtctctgggtac

SEQ ID NO: 687532 - DNA, 25 bp, Mus musculus
gcgggagcctaacaaaaagagttgt

SEQ ID NO: 687533 - DNA, 25 bp, Mus musculus
gcgggagcctaagaaaaagagttgt

SEQ ID NO: 687534 - DNA, 25 bp, Mus musculus
gcgggaggcatgatgtcttctaccc

SEQ ID NO: 687535 - DNA, 25 bp, Mus musculus
gcgggaggcatgttgtcttctaccc

SEQ ID NO: 687536 - DNA, 25 bp, Mus musculus
gcgggagtcagaaccacgaccagtt

SEQ ID NO: 687537 - DNA, 25 bp, Mus musculus
gcgggagtcagatccacgaccagtt

SEQ ID NO: 687538 - DNA, 25 bp, Mus musculus
gcgggagttagacccgagcggactt

SEQ ID NO: 687539 - DNA, 25 bp, Mus musculus
gcgggagttagagccgagcggactt

SEQ ID NO: 687540 - DNA, 25 bp, Mus musculus
gcgggatgccttacagcaaatcaaa

SEQ ID NO: 687541 - DNA, 25 bp, Mus musculus
gcgggatgcctttcagcaaatcaaa

SEQ ID NO: 687542 - DNA, 25 bp, Mus musculus
gcgggcaaaagccactgccacttca

SEQ ID NO: 687543 - DNA, 25 bp, Mus musculus
gcgggcaaaagcgactgccacttca

SEQ ID NO: 687544 - DNA, 25 bp, Mus musculus
gcgggcaattgacctctggtaccat

SEQ ID NO: 687545 - DNA, 25 bp, Mus musculus
gcgggcaattgagctctggtaccat

SEQ ID NO: 687546 - DNA, 25 bp, Mus musculus
gcgggcaccgtaagcaccggtctct

SEQ ID NO: 687547 - DNA, 25 bp, Mus musculus
gcgggcaccgtatgcaccggtctct

SEQ ID NO: 687548 - DNA, 25 bp, Mus musculus
gcgggcacctcaatttccagattga

SEQ ID NO: 687549 - DNA, 25 bp, Mus musculus
gcgggcacctcattttccagattga

SEQ ID NO: 687550 - DNA, 25 bp, Mus musculus
gcgggcacgtcgatgcgcgtcctca

SEQ ID NO: 687551 - DNA, 25 bp, Mus musculus
gcgggcacgtcgttgcgcgtcctca

SEQ ID NO: 687552 - DNA, 25 bp, Mus musculus
gcgggcacgttccttatcgtattcc

SEQ ID NO: 687553 - DNA, 25 bp, Mus musculus
gcgggcacgttcgttatcgtattcc

SEQ ID NO: 687554 - DNA, 25 bp, Mus musculus
gcgggcactgccactgcctacttgt

SEQ ID NO: 687555 - DNA, 25 bp, Mus musculus
gcgggcactgcctctgcctacttgt

SEQ ID NO: 687556 - DNA, 25 bp, Mus musculus
gcgggcagagaaagcatctttgcaa

SEQ ID NO: 687557 - DNA, 25 bp, Mus musculus
gcgggcagagaatgcatctttgcaa

SEQ ID NO: 687558 - DNA, 25 bp, Mus musculus
gcgggcagtgccctaagctgttcaa

SEQ ID NO: 687559 - DNA, 25 bp, Mus musculus
gcgggcagtgccgtaagctgttcaa

SEQ ID NO: 687560 - DNA, 25 bp, Mus musculus
gcgggccaccgcaaagttatctaaa

SEQ ID NO: 687561 - DNA, 25 bp, Mus musculus
gcgggccaccgctaagttatctaaa

SEQ ID NO: 687562 - DNA, 25 bp, Mus musculus
gcgggccagcgtccccttacaagtg

SEQ ID NO: 687563 - DNA, 25 bp, Mus musculus
gcgggccagcgtgcccttacaagtg

SEQ ID NO: 687564 - DNA, 25 bp, Mus musculus
gcgggccatctcatcaacaactatt

SEQ ID NO: 687565 - DNA, 25 bp, Mus musculus
gcgggccatctcttcaacaactatt

SEQ ID NO: 687566 - DNA, 25 bp, Mus musculus
gcgggcccagttagaaacacttcag

SEQ ID NO: 687567 - DNA, 25 bp, Mus musculus
gcgggcccagtttgaaacacttcag

SEQ ID NO: 687568 - DNA, 25 bp, Mus musculus
gcgggcccattgctaccacatgtga

SEQ ID NO: 687569 - DNA, 25 bp, Mus musculus
gcgggcccattggtaccacatgtga

SEQ ID NO: 687570 - DNA, 25 bp, Mus musculus
gcgggcccgtgcagattctcatctt

SEQ ID NO: 687571 - DNA, 25 bp, Mus musculus
gcgggcccgtgctgattctcatctt

SEQ ID NO: 687572 - DNA, 25 bp, Mus musculus
gcgggccttcgcaggttactgctca

SEQ ID NO: 687573 - DNA, 25 bp, Mus musculus
gcgggccttcgctggttactgctca

SEQ ID NO: 687574 - DNA, 25 bp, Mus musculus
gcgggcgagttcaaatacaagcaaa

SEQ ID NO: 687575 - DNA, 25 bp, Mus musculus
gcgggcgagttctaatacaagcaaa

SEQ ID NO: 687576 - DNA, 25 bp, Mus musculus
gcgggctcaagtcgcatttgaatgt

SEQ ID NO: 687577 - DNA, 25 bp, Mus musculus
gcgggctcaagtggcatttgaatgt

SEQ ID NO: 687578 - DNA, 25 bp, Mus musculus
gcgggctcacctcgcaacacagatg

SEQ ID NO: 687579 - DNA, 25 bp, Mus musculus
gcgggctcacctggcaacacagatg

SEQ ID NO: 687580 - DNA, 25 bp, Mus musculus
gcgggctcatttctgcagggattct

SEQ ID NO: 687581 - DNA, 25 bp, Mus musculus
gcgggctcatttgtgcagggattct

SEQ ID NO: 687582 - DNA, 25 bp, Mus musculus
gcgggctctcgcatggcccagagca

SEQ ID NO: 687583 - DNA, 25 bp, Mus musculus
gcgggctctcgcttggcccagagca

SEQ ID NO: 687584 - DNA, 25 bp, Mus musculus
gcgggctggtggaactcgtcctctc

SEQ ID NO: 687585 - DNA, 25 bp, Mus musculus
gcgggctggtggtactcgtcctctc

SEQ ID NO: 687586 - DNA, 25 bp, Mus musculus
gcgggcttctggaggcctctcagcc

SEQ ID NO: 687587 - DNA, 25 bp, Mus musculus
gcgggcttctggtggcctctcagcc

SEQ ID NO: 687588 - DNA, 25 bp, Mus musculus
gcgggcttgttcaccaacgatgagg

SEQ ID NO: 687589 - DNA, 25 bp, Mus musculus
gcgggcttgttctccaacgatgagg

SEQ ID NO: 687590 - DNA, 25 bp, Mus musculus
gcgggctttggcaatgacatgaaca

SEQ ID NO: 687591 - DNA, 25 bp, Mus musculus
gcgggctttggctatgacatgaaca

SEQ ID NO: 687592 - DNA, 25 bp, Mus musculus
gcgggtaattctatcgggatatcct

SEQ ID NO: 687593 - DNA, 25 bp, Mus musculus
gcgggtaattctttcgggatatcct

SEQ ID NO: 687594 - DNA, 25 bp, Mus musculus
gcgggtactatcagcctgagtgtat

SEQ ID NO: 687595 - DNA, 25 bp, Mus musculus
gcgggtactatctgcctgagtgtat

SEQ ID NO: 687596 - DNA, 25 bp, Mus musculus
gcgggtagcaatcctgctatcctat

SEQ ID NO: 687597 - DNA, 25 bp, Mus musculus
gcgggtagcaatgctgctatcctat

SEQ ID NO: 687598 - DNA, 25 bp, Mus musculus
gcgggtcaatgcacatgtacgccaa

SEQ ID NO: 687599 - DNA, 25 bp, Mus musculus
gcgggtcaatgctcatgtacgccaa

SEQ ID NO: 687600 - DNA, 25 bp, Mus musculus
gcgggtcatttgagcactgttcagt

SEQ ID NO: 687601 - DNA, 25 bp, Mus musculus
gcgggtcatttgtgcactgttcagt

SEQ ID NO: 687602 - DNA, 25 bp, Mus musculus
gcgggtctccttccagctcttcgaa

SEQ ID NO: 687603 - DNA, 25 bp, Mus musculus
gcgggtctccttgcagctcttcgaa

SEQ ID NO: 687604 - DNA, 25 bp, Mus musculus
gcgggtgaccagagaaatgctagtt

SEQ ID NO: 687605 - DNA, 25 bp, Mus musculus
gcgggtgaccagtgaaatgctagtt

SEQ ID NO: 687606 - DNA, 25 bp, Mus musculus
gcgggtgacgtaagtttcagctact

SEQ ID NO: 687607 - DNA, 25 bp, Mus musculus
gcgggtgacgtatgtttcagctact

SEQ ID NO: 687608 - DNA, 25 bp, Mus musculus
gcgggtgccttgctttcatactgga

SEQ ID NO: 687609 - DNA, 25 bp, Mus musculus
gcgggtgccttggtttcatactgga

SEQ ID NO: 687610 - DNA, 25 bp, Mus musculus
gcgggtgtttgccaatgctccagac

SEQ ID NO: 687611 - DNA, 25 bp, Mus musculus
gcgggtgtttgcgaatgctccagac

SEQ ID NO: 687612 - DNA, 25 bp, Mus musculus
gcgggttactacatctgcacctcca

SEQ ID NO: 687613 - DNA, 25 bp, Mus musculus
gcgggttactacttctgcacctcca

SEQ ID NO: 687614 - DNA, 25 bp, Mus musculus
gcgggttctcataactggtgccact

SEQ ID NO: 687615 - DNA, 25 bp, Mus musculus
gcgggttctcattactggtgccact

SEQ ID NO: 687616 - DNA, 25 bp, Mus musculus
gcgggttctctaactcgtccaagga

SEQ ID NO: 687617 - DNA, 25 bp, Mus musculus
gcgggttctctatctcgtccaagga

SEQ ID NO: 687618 - DNA, 25 bp, Mus musculus
gcggtaactccaccaatgccactag

SEQ ID NO: 687619 - DNA, 25 bp, Mus musculus
gcggtaactccagcaatgccactag

SEQ ID NO: 687620 - DNA, 25 bp, Mus musculus
gcggtaatgaggacttatggacact

SEQ ID NO: 687621 - DNA, 25 bp, Mus musculus
gcggtaatgaggtcttatggacact

SEQ ID NO: 687622 - DNA, 25 bp, Mus musculus
gcggtacaactcatttgccctggca

SEQ ID NO: 687623 - DNA, 25 bp, Mus musculus
gcggtacaactcttttgccctggca

SEQ ID NO: 687624 - DNA, 25 bp, Mus musculus
gcggtaccagcacataaagagttca

SEQ ID NO: 687625 - DNA, 25 bp, Mus musculus
gcggtaccagcagataaagagttca

SEQ ID NO: 687626 - DNA, 25 bp, Mus musculus
gcggtacccaggcatcttcaacagt

SEQ ID NO: 687627 - DNA, 25 bp, Mus musculus
gcggtacccagggatcttcaacagt

SEQ ID NO: 687628 - DNA, 25 bp, Mus musculus
gcggtacgaactcctgctcaaggaa

SEQ ID NO: 687629 - DNA, 25 bp, Mus musculus
gcggtacgaactgctgctcaaggaa

SEQ ID NO: 687630 - DNA, 25 bp, Mus musculus
gcggtactacagatggaacccagga

SEQ ID NO: 687631 - DNA, 25 bp, Mus musculus
gcggtactacagttggaacccagga

SEQ ID NO: 687632 - DNA, 25 bp, Mus musculus
gcggtactgtcactgcaatactggg

SEQ ID NO: 687633 - DNA, 25 bp, Mus musculus
gcggtactgtcagtgcaatactggg

SEQ ID NO: 687634 - DNA, 25 bp, Mus musculus
gcggtactgtgacagaagccatcag

SEQ ID NO: 687635 - DNA, 25 bp, Mus musculus
gcggtactgtgagagaagccatcag

SEQ ID NO: 687636 - DNA, 25 bp, Mus musculus
gcggtagccggaccggcagactgca

SEQ ID NO: 687637 - DNA, 25 bp, Mus musculus
gcggtagccggagcggcagactgca

SEQ ID NO: 687638 - DNA, 25 bp, Mus musculus
gcggtataggcaatattggtcagac

SEQ ID NO: 687639 - DNA, 25 bp, Mus musculus
gcggtataggcattattggtcagac

SEQ ID NO: 687640 - DNA, 25 bp, Mus musculus
gcggtatattgtccccatgattacg

SEQ ID NO: 687641 - DNA, 25 bp, Mus musculus
gcggtatattgtgcccatgattacg

SEQ ID NO: 687642 - DNA, 25 bp, Mus musculus
gcggtatctgccaggactatgacag

SEQ ID NO: 687643 - DNA, 25 bp, Mus musculus
gcggtatctgcctggactatgacag

SEQ ID NO: 687644 - DNA, 25 bp, Mus musculus
gcggtatgctcgcttgttgatatag

SEQ ID NO: 687645 - DNA, 25 bp, Mus musculus
gcggtatgctcggttgttgatatag

SEQ ID NO: 687646 - DNA, 25 bp, Mus musculus
gcggtattaccaccaacaccactaa

SEQ ID NO: 687647 - DNA, 25 bp, Mus musculus
gcggtattaccagcaacaccactaa

SEQ ID NO: 687648 - DNA, 25 bp, Mus musculus
gcggtatttccacaccgtcgtatcc

SEQ ID NO: 687649 - DNA, 25 bp, Mus musculus
gcggtatttccagaccgtcgtatcc

SEQ ID NO: 687650 - DNA, 25 bp, Mus musculus
gcggtcaccccaacgctgggaaggt

SEQ ID NO: 687651 - DNA, 25 bp, Mus musculus
gcggtcaccccatcgctgggaaggt

SEQ ID NO: 687652 - DNA, 25 bp, Mus musculus
gcggtcacgagcagccaagtttgaa

SEQ ID NO: 687653 - DNA, 25 bp, Mus musculus
gcggtcacgagctgccaagtttgaa

SEQ ID NO: 687654 - DNA, 25 bp, Mus musculus
gcggtcaggatgctaatccaatcct

SEQ ID NO: 687655 - DNA, 25 bp, Mus musculus
gcggtcaggatggtaatccaatcct

SEQ ID NO: 687656 - DNA, 25 bp, Mus musculus
gcggtcatctttccggatactctca

SEQ ID NO: 687657 - DNA, 25 bp, Mus musculus
gcggtcatctttgcggatactctca

SEQ ID NO: 687658 - DNA, 25 bp, Mus musculus
gcggtcccgacgctgtcattattgg

SEQ ID NO: 687659 - DNA, 25 bp, Mus musculus
gcggtcccgacggtgtcattattgg

SEQ ID NO: 687660 - DNA, 25 bp, Mus musculus
gcggtcctccccatagagttgagca

SEQ ID NO: 687661 - DNA, 25 bp, Mus musculus
gcggtcctccccttagagttgagca

SEQ ID NO: 687662 - DNA, 25 bp, Mus musculus
gcggtcgctggaagtgctcactgca

SEQ ID NO: 687663 - DNA, 25 bp, Mus musculus
gcggtcgctggatgtgctcactgca

SEQ ID NO: 687664 - DNA, 25 bp, Mus musculus
gcggtcgggtgtattctgcgctcac

SEQ ID NO: 687665 - DNA, 25 bp, Mus musculus
gcggtcgggtgttttctgcgctcac

SEQ ID NO: 687666 - DNA, 25 bp, Mus musculus
gcggtctccatgattgccttcaagc

SEQ ID NO: 687667 - DNA, 25 bp, Mus musculus
gcggtctccatgtttgccttcaagc

SEQ ID NO: 687668 - DNA, 25 bp, Mus musculus
gcggtctcttgcagccctggatgcg

SEQ ID NO: 687669 - DNA, 25 bp, Mus musculus
gcggtctcttgctgccctggatgcg

SEQ ID NO: 687670 - DNA, 25 bp, Mus musculus
gcggtctgatctccgggcctctctt

SEQ ID NO: 687671 - DNA, 25 bp, Mus musculus
gcggtctgatctgcgggcctctctt

SEQ ID NO: 687672 - DNA, 25 bp, Mus musculus
gcggtcttcgccacgacctagtcga

SEQ ID NO: 687673 - DNA, 25 bp, Mus musculus
gcggtcttcgcctcgacctagtcga

SEQ ID NO: 687674 - DNA, 25 bp, Mus musculus
gcggtgaaagaacccactaggccga

SEQ ID NO: 687675 - DNA, 25 bp, Mus musculus
gcggtgaaagaagccactaggccga

SEQ ID NO: 687676 - DNA, 25 bp, Mus musculus
gcggtgaccatcaatttcctttaaa

SEQ ID NO: 687677 - DNA, 25 bp, Mus musculus
gcggtgaccatctatttcctttaaa

SEQ ID NO: 687678 - DNA, 25 bp, Mus musculus
gcggtgacctgcctgctgctgtctc

SEQ ID NO: 687679 - DNA, 25 bp, Mus musculus
gcggtgacctgcgtgctgctgtctc

SEQ ID NO: 687680 - DNA, 25 bp, Mus musculus
gcggtgagaggcatttactgctccc

SEQ ID NO: 687681 - DNA, 25 bp, Mus musculus
gcggtgagaggcttttactgctccc

SEQ ID NO: 687682 - DNA, 25 bp, Mus musculus
gcggtgagtcaacgactaagttcca

SEQ ID NO: 687683 - DNA, 25 bp, Mus musculus
gcggtgagtcaaggactaagttcca

SEQ ID NO: 687684 - DNA, 25 bp, Mus musculus
gcggtgagttaccattgggccctat

SEQ ID NO: 687685 - DNA, 25 bp, Mus musculus
gcggtgagttacgattgggccctat

SEQ ID NO: 687686 - DNA, 25 bp, Mus musculus
gcggtgataactaatatgacggtat

SEQ ID NO: 687687 - DNA, 25 bp, Mus musculus
gcggtgataacttatatgacggtat

SEQ ID NO: 687688 - DNA, 25 bp, Mus musculus
gcggtgatggcgcacaacgccttca

SEQ ID NO: 687689 - DNA, 25 bp, Mus musculus
gcggtgatggcggacaacgccttca

SEQ ID NO: 687690 - DNA, 25 bp, Mus musculus
gcggtgcaagcaatatgcggatttt

SEQ ID NO: 687691 - DNA, 25 bp, Mus musculus
gcggtgcaagcattatgcggatttt

SEQ ID NO: 687692 - DNA, 25 bp, Mus musculus
gcggtgcacagtcctcttctgaccg

SEQ ID NO: 687693 - DNA, 25 bp, Mus musculus
gcggtgcacagtgctcttctgaccg

SEQ ID NO: 687694 - DNA, 25 bp, Mus musculus
gcggtgcagacaaagagcggcatct

SEQ ID NO: 687695 - DNA, 25 bp, Mus musculus
gcggtgcagacatagagcggcatct

SEQ ID NO: 687696 - DNA, 25 bp, Mus musculus
gcggtgctacctatttatagggtgc

SEQ ID NO: 687697 - DNA, 25 bp, Mus musculus
gcggtgctacctttttatagggtgc

SEQ ID NO: 687698 - DNA, 25 bp, Mus musculus
gcggtgctcttaccagacatccttc

SEQ ID NO: 687699 - DNA, 25 bp, Mus musculus
gcggtgctcttagcagacatccttc

SEQ ID NO: 687700 - DNA, 25 bp, Mus musculus
gcggtgctgagtatcatcctgtcca

SEQ ID NO: 687701 - DNA, 25 bp, Mus musculus
gcggtgctgagtttcatcctgtcca

SEQ ID NO: 687702 - DNA, 25 bp, Mus musculus
gcggtgctgtctcatgctatgtctc

SEQ ID NO: 687703 - DNA, 25 bp, Mus musculus
gcggtgctgtctgatgctatgtctc

SEQ ID NO: 687704 - DNA, 25 bp, Mus musculus
gcggtgctgttcatcacgggaatta

SEQ ID NO: 687705 - DNA, 25 bp, Mus musculus
gcggtgctgttcttcacgggaatta

SEQ ID NO: 687706 - DNA, 25 bp, Mus musculus
gcggtggacagcagaatagccaagc

SEQ ID NO: 687707 - DNA, 25 bp, Mus musculus
gcggtggacagctgaatagccaagc

SEQ ID NO: 687708 - DNA, 25 bp, Mus musculus
gcggtggagcagaccccgcgcaaac

SEQ ID NO: 687709 - DNA, 25 bp, Mus musculus
gcggtggagcagtccccgcgcaaac

SEQ ID NO: 687710 - DNA, 25 bp, Mus musculus
gcggtggccgtgagtcctgcaacct

SEQ ID NO: 687711 - DNA, 25 bp, Mus musculus
gcggtggccgtgtgtcctgcaacct

SEQ ID NO: 687712 - DNA, 25 bp, Mus musculus
gcggtggcgaagcagtgggcacaaa

SEQ ID NO: 687713 - DNA, 25 bp, Mus musculus
gcggtggcgaaggagtgggcacaaa

SEQ ID NO: 687714 - DNA, 25 bp, Mus musculus
gcggtgggaggcatcttttcacaaa

SEQ ID NO: 687715 - DNA, 25 bp, Mus musculus
gcggtgggaggcttcttttcacaaa

SEQ ID NO: 687716 - DNA, 25 bp, Mus musculus
gcggtggtcataccaagatcagaga

SEQ ID NO: 687717 - DNA, 25 bp, Mus musculus
gcggtggtcatagcaagatcagaga

SEQ ID NO: 687718 - DNA, 25 bp, Mus musculus
gcggtggtgagaagttcactcacct

SEQ ID NO: 687719 - DNA, 25 bp, Mus musculus
gcggtggtgagatgttcactcacct

SEQ ID NO: 687720 - DNA, 25 bp, Mus musculus
gcggtgtcacgactgaaaagttttt

SEQ ID NO: 687721 - DNA, 25 bp, Mus musculus
gcggtgtcacgagtgaaaagttttt

SEQ ID NO: 687722 - DNA, 25 bp, Mus musculus
gcggtgtcctggactactaaagtca

SEQ ID NO: 687723 - DNA, 25 bp, Mus musculus
gcggtgtcctggtctactaaagtca

SEQ ID NO: 687724 - DNA, 25 bp, Mus musculus
gcggtgtcggacaaccttctacaca

SEQ ID NO: 687725 - DNA, 25 bp, Mus musculus
gcggtgtcggactaccttctacaca

SEQ ID NO: 687726 - DNA, 25 bp, Mus musculus
gcggtgtctgcccttcaaacacaag

SEQ ID NO: 687727 - DNA, 25 bp, Mus musculus
gcggtgtctgccgttcaaacacaag

SEQ ID NO: 687728 - DNA, 25 bp, Mus musculus
gcggtgtgaactctctgtccttcca

SEQ ID NO: 687729 - DNA, 25 bp, Mus musculus
gcggtgtgaactgtctgtccttcca

SEQ ID NO: 687730 - DNA, 25 bp, Mus musculus
gcggtgttgatcagaggaagatttt

SEQ ID NO: 687731 - DNA, 25 bp, Mus musculus
gcggtgttgatctgaggaagatttt

SEQ ID NO: 687732 - DNA, 25 bp, Mus musculus
gcggttaaaagccaatctgtcagat

SEQ ID NO: 687733 - DNA, 25 bp, Mus musculus
gcggttaaaagcgaatctgtcagat

SEQ ID NO: 687734 - DNA, 25 bp, Mus musculus
gcggttacagggatagcagtgtctt

SEQ ID NO: 687735 - DNA, 25 bp, Mus musculus
gcggttacagggttagcagtgtctt

SEQ ID NO: 687736 - DNA, 25 bp, Mus musculus
gcggttacgtgtctgagcaccttca

SEQ ID NO: 687737 - DNA, 25 bp, Mus musculus
gcggttacgtgtgtgagcaccttca

SEQ ID NO: 687738 - DNA, 25 bp, Mus musculus
gcggttactaaaagtggcagtgtga

SEQ ID NO: 687739 - DNA, 25 bp, Mus musculus
gcggttactaaatgtggcagtgtga

SEQ ID NO: 687740 - DNA, 25 bp, Mus musculus
gcggttcaaggtcctcgaacttcga

SEQ ID NO: 687741 - DNA, 25 bp, Mus musculus
gcggttcaaggtgctcgaacttcga

SEQ ID NO: 687742 - DNA, 25 bp, Mus musculus
gcggttcaggcaaccaaatcggtca

SEQ ID NO: 687743 - DNA, 25 bp, Mus musculus
gcggttcaggcatccaaatcggtca

SEQ ID NO: 687744 - DNA, 25 bp, Mus musculus
gcggttcccagcatttggcttcgga

SEQ ID NO: 687745 - DNA, 25 bp, Mus musculus
gcggttcccagcttttggcttcgga

SEQ ID NO: 687746 - DNA, 25 bp, Mus musculus
gcggttccgctgactgggaagctct

SEQ ID NO: 687747 - DNA, 25 bp, Mus musculus
gcggttccgctgtctgggaagctct

SEQ ID NO: 687748 - DNA, 25 bp, Mus musculus
gcggttccggaacctcctacattta

SEQ ID NO: 687749 - DNA, 25 bp, Mus musculus
gcggttccggaagctcctacattta

SEQ ID NO: 687750 - DNA, 25 bp, Mus musculus
gcggttcgtccaatcctaggtcatt

SEQ ID NO: 687751 - DNA, 25 bp, Mus musculus
gcggttcgtccattcctaggtcatt

SEQ ID NO: 687752 - DNA, 25 bp, Mus musculus
gcggttctaaggaaaggccgtgcaa

SEQ ID NO: 687753 - DNA, 25 bp, Mus musculus
gcggttctaaggtaaggccgtgcaa

SEQ ID NO: 687754 - DNA, 25 bp, Mus musculus
gcggttctcaggaggctacccggcc

SEQ ID NO: 687755 - DNA, 25 bp, Mus musculus
gcggttctcaggtggctacccggcc

SEQ ID NO: 687756 - DNA, 25 bp, Mus musculus
gcggttgagaagaaaagtcttggcc

SEQ ID NO: 687757 - DNA, 25 bp, Mus musculus
gcggttgagaagtaaagtcttggcc

SEQ ID NO: 687758 - DNA, 25 bp, Mus musculus
gcggttgccaatacctatgcctgca

SEQ ID NO: 687759 - DNA, 25 bp, Mus musculus
gcggttgccaattcctatgcctgca

SEQ ID NO: 687760 - DNA, 25 bp, Mus musculus
gcggttgggagaataccaccacctt

SEQ ID NO: 687761 - DNA, 25 bp, Mus musculus
gcggttgggagattaccaccacctt

SEQ ID NO: 687762 - DNA, 25 bp, Mus musculus
gcggttgggccacctcaggctttct

SEQ ID NO: 687763 - DNA, 25 bp, Mus musculus
gcggttgggccagctcaggctttct

SEQ ID NO: 687764 - DNA, 25 bp, Mus musculus
gcggttttggatattagagagttca

SEQ ID NO: 687765 - DNA, 25 bp, Mus musculus
gcggttttggattttagagagttca

SEQ ID NO: 687766 - DNA, 25 bp, Mus musculus
gcgtaaaccagcaagaagagatgct

SEQ ID NO: 687767 - DNA, 25 bp, Mus musculus
gcgtaaaccagctagaagagatgct

SEQ ID NO: 687768 - DNA, 25 bp, Mus musculus
gcgtaaagcctacgcgcgaggctca

SEQ ID NO: 687769 - DNA, 25 bp, Mus musculus
gcgtaaagcctaggcgcgaggctca

SEQ ID NO: 687770 - DNA, 25 bp, Mus musculus
gcgtaacctaacatgggaagagagc

SEQ ID NO: 687771 - DNA, 25 bp, Mus musculus
gcgtaacctaacttgggaagagagc

SEQ ID NO: 687772 - DNA, 25 bp, Mus musculus
gcgtaatcaacacctggtccagact

SEQ ID NO: 687773 - DNA, 25 bp, Mus musculus
gcgtaatcaacagctggtccagact

SEQ ID NO: 687774 - DNA, 25 bp, Mus musculus
gcgtaatctgaaactaaaactccac

SEQ ID NO: 687775 - DNA, 25 bp, Mus musculus
gcgtaatctgaatctaaaactccac

SEQ ID NO: 687776 - DNA, 25 bp, Mus musculus
gcgtacagactgactcctaaactga

SEQ ID NO: 687777 - DNA, 25 bp, Mus musculus
gcgtacagactgtctcctaaactga

SEQ ID NO: 687778 - DNA, 25 bp, Mus musculus
gcgtacagcatccatggcccaaata

SEQ ID NO: 687779 - DNA, 25 bp, Mus musculus
gcgtacagcatcgatggcccaaata

SEQ ID NO: 687780 - DNA, 25 bp, Mus musculus
gcgtaccctgtacctagatcgtgag

SEQ ID NO: 687781 - DNA, 25 bp, Mus musculus
gcgtaccctgtagctagatcgtgag

SEQ ID NO: 687782 - DNA, 25 bp, Mus musculus
gcgtaccttgcaccacgtgctcagg

SEQ ID NO: 687783 - DNA, 25 bp, Mus musculus
gcgtaccttgcagcacgtgctcagg

SEQ ID NO: 687784 - DNA, 25 bp, Mus musculus
gcgtacgtggaacggctgcgtcttt

SEQ ID NO: 687785 - DNA, 25 bp, Mus musculus
gcgtacgtggaagggctgcgtcttt

SEQ ID NO: 687786 - DNA, 25 bp, Mus musculus
gcgtagacgtggcatttgagaatcc

SEQ ID NO: 687787 - DNA, 25 bp, Mus musculus
gcgtagacgtgggatttgagaatcc

SEQ ID NO: 687788 - DNA, 25 bp, Mus musculus
gcgtagactcaaaaacaaccgggag

SEQ ID NO: 687789 - DNA, 25 bp, Mus musculus
gcgtagactcaataacaaccgggag

SEQ ID NO: 687790 - DNA, 25 bp, Mus musculus
gcgtagagcaccatacgtttttcag

SEQ ID NO: 687791 - DNA, 25 bp, Mus musculus
gcgtagagcaccttacgtttttcag

SEQ ID NO: 687792 - DNA, 25 bp, Mus musculus
gcgtaggtgacaagatctcacagca

SEQ ID NO: 687793 - DNA, 25 bp, Mus musculus
gcgtaggtgacatgatctcacagca

SEQ ID NO: 687794 - DNA, 25 bp, Mus musculus
gcgtagtcaccgagaaatccccgac

SEQ ID NO: 687795 - DNA, 25 bp, Mus musculus
gcgtagtcaccgtgaaatccccgac

SEQ ID NO: 687796 - DNA, 25 bp, Mus musculus
gcgtagtggcacacctctcacatgg

SEQ ID NO: 687797 - DNA, 25 bp, Mus musculus
gcgtagtggcactcctctcacatgg

SEQ ID NO: 687798 - DNA, 25 bp, Mus musculus
gcgtagtttgcacccgggacaccgt

SEQ ID NO: 687799 - DNA, 25 bp, Mus musculus
gcgtagtttgcagccgggacaccgt

SEQ ID NO: 687800 - DNA, 25 bp, Mus musculus
gcgtataccacacaacactggctag

SEQ ID NO: 687801 - DNA, 25 bp, Mus musculus
gcgtataccacagaacactggctag

SEQ ID NO: 687802 - DNA, 25 bp, Mus musculus
gcgtatcagtgaacacaaacacaca

SEQ ID NO: 687803 - DNA, 25 bp, Mus musculus
gcgtatcagtgatcacaaacacaca

SEQ ID NO: 687804 - DNA, 25 bp, Mus musculus
gcgtatctttctcactctcactgaa

SEQ ID NO: 687805 - DNA, 25 bp, Mus musculus
gcgtatctttctgactctcactgaa

SEQ ID NO: 687806 - DNA, 25 bp, Mus musculus
gcgtatgaagttcctgccttacttg

SEQ ID NO: 687807 - DNA, 25 bp, Mus musculus
gcgtatgaagttgctgccttacttg

SEQ ID NO: 687808 - DNA, 25 bp, Mus musculus
gcgtatgagtgacttccggtatttc

SEQ ID NO: 687809 - DNA, 25 bp, Mus musculus
gcgtatgagtgagttccggtatttc

SEQ ID NO: 687810 - DNA, 25 bp, Mus musculus
gcgtatgtcggaatacatcaccaca

SEQ ID NO: 687811 - DNA, 25 bp, Mus musculus
gcgtatgtcggattacatcaccaca

SEQ ID NO: 687812 - DNA, 25 bp, Mus musculus
gcgtattggtgcagtctttcggata

SEQ ID NO: 687813 - DNA, 25 bp, Mus musculus
gcgtattggtgctgtctttcggata

SEQ ID NO: 687814 - DNA, 25 bp, Mus musculus
gcgtattgtgcaatctctggattat

SEQ ID NO: 687815 - DNA, 25 bp, Mus musculus
gcgtattgtgcattctctggattat

SEQ ID NO: 687816 - DNA, 25 bp, Mus musculus
gcgtcaactgcgacgtgctcagtgt

SEQ ID NO: 687817 - DNA, 25 bp, Mus musculus
gcgtcaactgcgtcgtgctcagtgt

SEQ ID NO: 687818 - DNA, 25 bp, Mus musculus
gcgtcaagtcgccactaagaaacct

SEQ ID NO: 687819 - DNA, 25 bp, Mus musculus
gcgtcaagtcgcgactaagaaacct

SEQ ID NO: 687820 - DNA, 25 bp, Mus musculus
gcgtcaagtgccagccttcacgggt

SEQ ID NO: 687821 - DNA, 25 bp, Mus musculus
gcgtcaagtgcctgccttcacgggt

SEQ ID NO: 687822 - DNA, 25 bp, Mus musculus
gcgtcaatgccaagggcagctatga

SEQ ID NO: 687823 - DNA, 25 bp, Mus musculus
gcgtcaatgccatgggcagctatga

SEQ ID NO: 687824 - DNA, 25 bp, Mus musculus
gcgtcaattatgatagccctgttcg

SEQ ID NO: 687825 - DNA, 25 bp, Mus musculus
gcgtcaattatgttagccctgttcg

SEQ ID NO: 687826 - DNA, 25 bp, Mus musculus
gcgtcacaatcacaagcctatctta

SEQ ID NO: 687827 - DNA, 25 bp, Mus musculus
gcgtcacaatcagaagcctatctta

SEQ ID NO: 687828 - DNA, 25 bp, Mus musculus
gcgtcacaatttaatctcagctcac

SEQ ID NO: 687829 - DNA, 25 bp, Mus musculus
gcgtcacaattttatctcagctcac

SEQ ID NO: 687830 - DNA, 25 bp, Mus musculus
gcgtcacatggccttaactgttaga

SEQ ID NO: 687831 - DNA, 25 bp, Mus musculus
gcgtcacatggcgttaactgttaga

SEQ ID NO: 687832 - DNA, 25 bp, Mus musculus
gcgtcacccagtatcttttgtagcc

SEQ ID NO: 687833 - DNA, 25 bp, Mus musculus
gcgtcacccagtttcttttgtagcc

SEQ ID NO: 687834 - DNA, 25 bp, Mus musculus
gcgtcaccctgcacgatgcttctga

SEQ ID NO: 687835 - DNA, 25 bp, Mus musculus
gcgtcaccctgctcgatgcttctga

SEQ ID NO: 687836 - DNA, 25 bp, Mus musculus
gcgtcacggccaacctggtgctgtt

SEQ ID NO: 687837 - DNA, 25 bp, Mus musculus
gcgtcacggccatcctggtgctgtt

SEQ ID NO: 687838 - DNA, 25 bp, Mus musculus
gcgtcactagaaccgtactgcaaac

SEQ ID NO: 687839 - DNA, 25 bp, Mus musculus
gcgtcactagaagcgtactgcaaac

SEQ ID NO: 687840 - DNA, 25 bp, Mus musculus
gcgtcactttaaccgtcctgcttat

SEQ ID NO: 687841 - DNA, 25 bp, Mus musculus
gcgtcactttaagcgtcctgcttat

SEQ ID NO: 687842 - DNA, 25 bp, Mus musculus
gcgtcagacttaacaggaagcttca

SEQ ID NO: 687843 - DNA, 25 bp, Mus musculus
gcgtcagacttatcaggaagcttca

SEQ ID NO: 687844 - DNA, 25 bp, Mus musculus
gcgtcagaggatcgcggtggcagga

SEQ ID NO: 687845 - DNA, 25 bp, Mus musculus
gcgtcagaggatggcggtggcagga

SEQ ID NO: 687846 - DNA, 25 bp, Mus musculus
gcgtcagaggccctggttcgccaaa

SEQ ID NO: 687847 - DNA, 25 bp, Mus musculus
gcgtcagaggccgtggttcgccaaa

SEQ ID NO: 687848 - DNA, 25 bp, Mus musculus
gcgtcagcgcagacgccgtgtctgt

SEQ ID NO: 687849 - DNA, 25 bp, Mus musculus
gcgtcagcgcagtcgccgtgtctgt

SEQ ID NO: 687850 - DNA, 25 bp, Mus musculus
gcgtcagcttcaccttttttggcac

SEQ ID NO: 687851 - DNA, 25 bp, Mus musculus
gcgtcagcttcagcttttttggcac

SEQ ID NO: 687852 - DNA, 25 bp, Mus musculus
gcgtcagtcaagaccaacatccggg

SEQ ID NO: 687853 - DNA, 25 bp, Mus musculus
gcgtcagtcaagtccaacatccggg

SEQ ID NO: 687854 - DNA, 25 bp, Mus musculus
gcgtcagtgacactgtcccaccaag

SEQ ID NO: 687855 - DNA, 25 bp, Mus musculus
gcgtcagtgacagtgtcccaccaag

SEQ ID NO: 687856 - DNA, 25 bp, Mus musculus
gcgtcagtttctaagcggcctggat

SEQ ID NO: 687857 - DNA, 25 bp, Mus musculus
gcgtcagtttcttagcggcctggat

SEQ ID NO: 687858 - DNA, 25 bp, Mus musculus
gcgtcatccaggattttcaagcttc

SEQ ID NO: 687859 - DNA, 25 bp, Mus musculus
gcgtcatccaggtttttcaagcttc

SEQ ID NO: 687860 - DNA, 25 bp, Mus musculus
gcgtcatcctctacatcctgcttag

SEQ ID NO: 687861 - DNA, 25 bp, Mus musculus
gcgtcatcctcttcatcctgcttag

SEQ ID NO: 687862 - DNA, 25 bp, Mus musculus
gcgtcatgacccacacaagctggtg

SEQ ID NO: 687863 - DNA, 25 bp, Mus musculus
gcgtcatgaccctcacaagctggtg

SEQ ID NO: 687864 - DNA, 25 bp, Mus musculus
gcgtcatgacctcgcgcagggaaaa

SEQ ID NO: 687865 - DNA, 25 bp, Mus musculus
gcgtcatgacctggcgcagggaaaa

SEQ ID NO: 687866 - DNA, 25 bp, Mus musculus
gcgtcattgctcagcgacatttcag

SEQ ID NO: 687867 - DNA, 25 bp, Mus musculus
gcgtcattgctctgcgacatttcag

SEQ ID NO: 687868 - DNA, 25 bp, Mus musculus
gcgtccaacacgatgaccctgaatg

SEQ ID NO: 687869 - DNA, 25 bp, Mus musculus
gcgtccaacacgttgaccctgaatg

SEQ ID NO: 687870 - DNA, 25 bp, Mus musculus
gcgtccaccaggctttgaccgtgtt

SEQ ID NO: 687871 - DNA, 25 bp, Mus musculus
gcgtccaccagggtttgaccgtgtt

SEQ ID NO: 687872 - DNA, 25 bp, Mus musculus
gcgtccaccagtatcaacgctatgg

SEQ ID NO: 687873 - DNA, 25 bp, Mus musculus
gcgtccaccagtttcaacgctatgg

SEQ ID NO: 687874 - DNA, 25 bp, Mus musculus
gcgtccacgaagagccaggacttca

SEQ ID NO: 687875 - DNA, 25 bp, Mus musculus
gcgtccacgaagtgccaggacttca

SEQ ID NO: 687876 - DNA, 25 bp, Mus musculus
gcgtccactttcagcctgttgctcg

SEQ ID NO: 687877 - DNA, 25 bp, Mus musculus
gcgtccactttctgcctgttgctcg

SEQ ID NO: 687878 - DNA, 25 bp, Mus musculus
gcgtccagacgacgcggtacaagtt

SEQ ID NO: 687879 - DNA, 25 bp, Mus musculus
gcgtccagacgaggcggtacaagtt

SEQ ID NO: 687880 - DNA, 25 bp, Mus musculus
gcgtccagagatcaccatcgtggca

SEQ ID NO: 687881 - DNA, 25 bp, Mus musculus
gcgtccagagatgaccatcgtggca

SEQ ID NO: 687882 - DNA, 25 bp, Mus musculus
gcgtccagcagcaccatgcaggtga

SEQ ID NO: 687883 - DNA, 25 bp, Mus musculus
gcgtccagcagctccatgcaggtga

SEQ ID NO: 687884 - DNA, 25 bp, Mus musculus
gcgtcccaattgactatgagaagta

SEQ ID NO: 687885 - DNA, 25 bp, Mus musculus
gcgtcccaattgtctatgagaagta

SEQ ID NO: 687886 - DNA, 25 bp, Mus musculus
gcgtcccagcagcagcggcttcaag

SEQ ID NO: 687887 - DNA, 25 bp, Mus musculus
gcgtcccagcaggagcggcttcaag

SEQ ID NO: 687888 - DNA, 25 bp, Mus musculus
gcgtcccagtcactgaccgttgtag

SEQ ID NO: 687889 - DNA, 25 bp, Mus musculus
gcgtcccagtcagtgaccgttgtag

SEQ ID NO: 687890 - DNA, 25 bp, Mus musculus
gcgtccccagacatttgatttgcac

SEQ ID NO: 687891 - DNA, 25 bp, Mus musculus
gcgtccccagacttttgatttgcac

SEQ ID NO: 687892 - DNA, 25 bp, Mus musculus
gcgtccccgtgacctcagaggctga

SEQ ID NO: 687893 - DNA, 25 bp, Mus musculus
gcgtccccgtgagctcagaggctga

SEQ ID NO: 687894 - DNA, 25 bp, Mus musculus
gcgtcccggtccaccggcatggttg

SEQ ID NO: 687895 - DNA, 25 bp, Mus musculus
gcgtcccggtcctccggcatggttg

SEQ ID NO: 687896 - DNA, 25 bp, Mus musculus
gcgtcccttcctcttcggacttggg

SEQ ID NO: 687897 - DNA, 25 bp, Mus musculus
gcgtcccttcctgttcggacttggg

SEQ ID NO: 687898 - DNA, 25 bp, Mus musculus
gcgtcccttggaagcttctgtttaa

SEQ ID NO: 687899 - DNA, 25 bp, Mus musculus
gcgtcccttggatgcttctgtttaa

SEQ ID NO: 687900 - DNA, 25 bp, Mus musculus
gcgtccgagaggcaacaaagtttgc

SEQ ID NO: 687901 - DNA, 25 bp, Mus musculus
gcgtccgagagggaacaaagtttgc

SEQ ID NO: 687902 - DNA, 25 bp, Mus musculus
gcgtccgagcaacgccgaaaggtcc

SEQ ID NO: 687903 - DNA, 25 bp, Mus musculus
gcgtccgagcaaggccgaaaggtcc

SEQ ID NO: 687904 - DNA, 25 bp, Mus musculus
gcgtccgagtacatggagaagccga

SEQ ID NO: 687905 - DNA, 25 bp, Mus musculus
gcgtccgagtacttggagaagccga

SEQ ID NO: 687906 - DNA, 25 bp, Mus musculus
gcgtccgtgcggacgcggtccctat

SEQ ID NO: 687907 - DNA, 25 bp, Mus musculus
gcgtccgtgcggtcgcggtccctat

SEQ ID NO: 687908 - DNA, 25 bp, Mus musculus
gcgtccgtgttgatgcgctacccac

SEQ ID NO: 687909 - DNA, 25 bp, Mus musculus
gcgtccgtgttgttgcgctacccac

SEQ ID NO: 687910 - DNA, 25 bp, Mus musculus
gcgtcctacatcagctaatggccta

SEQ ID NO: 687911 - DNA, 25 bp, Mus musculus
gcgtcctacatctgctaatggccta

SEQ ID NO: 687912 - DNA, 25 bp, Mus musculus
gcgtcctcgctcaacctgcaggtgg

SEQ ID NO: 687913 - DNA, 25 bp, Mus musculus
gcgtcctcgctctacctgcaggtgg

SEQ ID NO: 687914 - DNA, 25 bp, Mus musculus
gcgtcctctccaagcctaagtggga

SEQ ID NO: 687915 - DNA, 25 bp, Mus musculus
gcgtcctctccatgcctaagtggga

SEQ ID NO: 687916 - DNA, 25 bp, Mus musculus
gcgtcctgctgcaaggctgtaagga

SEQ ID NO: 687917 - DNA, 25 bp, Mus musculus
gcgtcctgctgctaggctgtaagga

SEQ ID NO: 687918 - DNA, 25 bp, Mus musculus
gcgtcctgcttaagcatctagctcc

SEQ ID NO: 687919 - DNA, 25 bp, Mus musculus
gcgtcctgcttatgcatctagctcc

SEQ ID NO: 687920 - DNA, 25 bp, Mus musculus
gcgtcctggtaccaactccacaggt

SEQ ID NO: 687921 - DNA, 25 bp, Mus musculus
gcgtcctggtacgaactccacaggt

SEQ ID NO: 687922 - DNA, 25 bp, Mus musculus
gcgtcctgtcagctatattcggaaa

SEQ ID NO: 687923 - DNA, 25 bp, Mus musculus
gcgtcctgtcaggtatattcggaaa

SEQ ID NO: 687924 - DNA, 25 bp, Mus musculus
gcgtccttagtgagcagttcgtcct

SEQ ID NO: 687925 - DNA, 25 bp, Mus musculus
gcgtccttagtgtgcagttcgtcct

SEQ ID NO: 687926 - DNA, 25 bp, Mus musculus
gcgtcctttctgaccattgattcca

SEQ ID NO: 687927 - DNA, 25 bp, Mus musculus
gcgtcctttctgtccattgattcca

SEQ ID NO: 687928 - DNA, 25 bp, Mus musculus
gcgtcgaacgacagaagccgcggcc

SEQ ID NO: 687929 - DNA, 25 bp, Mus musculus
gcgtcgaacgactgaagccgcggcc

SEQ ID NO: 687930 - DNA, 25 bp, Mus musculus
gcgtcgacctctatgtcctggagaa

SEQ ID NO: 687931 - DNA, 25 bp, Mus musculus
gcgtcgacctctttgtcctggagaa

SEQ ID NO: 687932 - DNA, 25 bp, Mus musculus
gcgtcgatcagcaaggtgaacgtaa

SEQ ID NO: 687933 - DNA, 25 bp, Mus musculus
gcgtcgatcagctaggtgaacgtaa

SEQ ID NO: 687934 - DNA, 25 bp, Mus musculus
gcgtcgcagacaaggagcaaggcta

SEQ ID NO: 687935 - DNA, 25 bp, Mus musculus
gcgtcgcagacatggagcaaggcta

SEQ ID NO: 687936 - DNA, 25 bp, Mus musculus
gcgtcgccatcaacgatcagtggat

SEQ ID NO: 687937 - DNA, 25 bp, Mus musculus
gcgtcgccatcatcgatcagtggat

SEQ ID NO: 687938 - DNA, 25 bp, Mus musculus
gcgtcgcctgggagcagcgcagtgt

SEQ ID NO: 687939 - DNA, 25 bp, Mus musculus
gcgtcgcctgggtgcagcgcagtgt

SEQ ID NO: 687940 - DNA, 25 bp, Mus musculus
gcgtcgcgggccataaccgacaagg

SEQ ID NO: 687941 - DNA, 25 bp, Mus musculus
gcgtcgcgggccttaaccgacaagg

SEQ ID NO: 687942 - DNA, 25 bp, Mus musculus
gcgtcgctctagctgtcgcctcgtt

SEQ ID NO: 687943 - DNA, 25 bp, Mus musculus
gcgtcgctctaggtgtcgcctcgtt

SEQ ID NO: 687944 - DNA, 25 bp, Mus musculus
gcgtcgcttggcaccaggcacggac

SEQ ID NO: 687945 - DNA, 25 bp, Mus musculus
gcgtcgcttggctccaggcacggac

SEQ ID NO: 687946 - DNA, 25 bp, Mus musculus
gcgtcggatgcgagaatctgtttcc

SEQ ID NO: 687947 - DNA, 25 bp, Mus musculus
gcgtcggatgcgtgaatctgtttcc

SEQ ID NO: 687948 - DNA, 25 bp, Mus musculus
gcgtcggcgaccaggtgtcgccact

SEQ ID NO: 687949 - DNA, 25 bp, Mus musculus
gcgtcggcgacctggtgtcgccact

SEQ ID NO: 687950 - DNA, 25 bp, Mus musculus
gcgtcgggatgtccaggaaattttt

SEQ ID NO: 687951 - DNA, 25 bp, Mus musculus
gcgtcgggatgtgcaggaaattttt

SEQ ID NO: 687952 - DNA, 25 bp, Mus musculus
gcgtcgggccaaacaagtgcaaatg

SEQ ID NO: 687953 - DNA, 25 bp, Mus musculus
gcgtcgggccaatcaagtgcaaatg

SEQ ID NO: 687954 - DNA, 25 bp, Mus musculus
gcgtcgtcatgtcgcccagagtgct

SEQ ID NO: 687955 - DNA, 25 bp, Mus musculus
gcgtcgtcatgtggcccagagtgct

SEQ ID NO: 687956 - DNA, 25 bp, Mus musculus
gcgtcgtctccgagcgtctttccgt

SEQ ID NO: 687957 - DNA, 25 bp, Mus musculus
gcgtcgtctccgtgcgtctttccgt

SEQ ID NO: 687958 - DNA, 25 bp, Mus musculus
gcgtctaatgagcaggacagtgaca

SEQ ID NO: 687959 - DNA, 25 bp, Mus musculus
gcgtctaatgaggaggacagtgaca

SEQ ID NO: 687960 - DNA, 25 bp, Mus musculus
gcgtctcatcatctctgaccgggct

SEQ ID NO: 687961 - DNA, 25 bp, Mus musculus
gcgtctcatcatgtctgaccgggct

SEQ ID NO: 687962 - DNA, 25 bp, Mus musculus
gcgtctcatggtcgaaaaagtcact

SEQ ID NO: 687963 - DNA, 25 bp, Mus musculus
gcgtctcatggtggaaaaagtcact

SEQ ID NO: 687964 - DNA, 25 bp, Mus musculus
gcgtctcgccttatgcctgccagag

SEQ ID NO: 687965 - DNA, 25 bp, Mus musculus
gcgtctcgccttttgcctgccagag

SEQ ID NO: 687966 - DNA, 25 bp, Mus musculus
gcgtctcggtcaatccagatgattc

SEQ ID NO: 687967 - DNA, 25 bp, Mus musculus
gcgtctcggtcattccagatgattc

SEQ ID NO: 687968 - DNA, 25 bp, Mus musculus
gcgtctctacctcctcatcatgagt

SEQ ID NO: 687969 - DNA, 25 bp, Mus musculus
gcgtctctacctgctcatcatgagt

SEQ ID NO: 687970 - DNA, 25 bp, Mus musculus
gcgtctctgaaaccggcagagccgc

SEQ ID NO: 687971 - DNA, 25 bp, Mus musculus
gcgtctctgaaagcggcagagccgc

SEQ ID NO: 687972 - DNA, 25 bp, Mus musculus
gcgtctcttttcaccaggaggaaaa

SEQ ID NO: 687973 - DNA, 25 bp, Mus musculus
gcgtctcttttctccaggaggaaaa

SEQ ID NO: 687974 - DNA, 25 bp, Mus musculus
gcgtctgcgccgactctgtagccgt

SEQ ID NO: 687975 - DNA, 25 bp, Mus musculus
gcgtctgcgccgtctctgtagccgt

SEQ ID NO: 687976 - DNA, 25 bp, Mus musculus
gcgtctggagtcatcccgcagattt

SEQ ID NO: 687977 - DNA, 25 bp, Mus musculus
gcgtctggagtcttcccgcagattt

SEQ ID NO: 687978 - DNA, 25 bp, Mus musculus
gcgtctggttcaacaaggtgcggaa

SEQ ID NO: 687979 - DNA, 25 bp, Mus musculus
gcgtctggttcatcaaggtgcggaa

SEQ ID NO: 687980 - DNA, 25 bp, Mus musculus
gcgtctggttttcaccctggagttc

SEQ ID NO: 687981 - DNA, 25 bp, Mus musculus
gcgtctggttttgaccctggagttc

SEQ ID NO: 687982 - DNA, 25 bp, Mus musculus
gcgtctgtgccccagactgttccaa

SEQ ID NO: 687983 - DNA, 25 bp, Mus musculus
gcgtctgtgcccgagactgttccaa

SEQ ID NO: 687984 - DNA, 25 bp, Mus musculus
gcgtctgtgctcacgcatctcctga

SEQ ID NO: 687985 - DNA, 25 bp, Mus musculus
gcgtctgtgctctcgcatctcctga

SEQ ID NO: 687986 - DNA, 25 bp, Mus musculus
gcgtcttacgttccaaagatatgct

SEQ ID NO: 687987 - DNA, 25 bp, Mus musculus
gcgtcttacgttgcaaagatatgct

SEQ ID NO: 687988 - DNA, 25 bp, Mus musculus
gcgtcttcaagcattccaaggttac

SEQ ID NO: 687989 - DNA, 25 bp, Mus musculus
gcgtcttcaagctttccaaggttac

SEQ ID NO: 687990 - DNA, 25 bp, Mus musculus
gcgtcttccctgactaaagagctct

SEQ ID NO: 687991 - DNA, 25 bp, Mus musculus
gcgtcttccctgtctaaagagctct

SEQ ID NO: 687992 - DNA, 25 bp, Mus musculus
gcgtcttcctgcacatgatcaccgg

SEQ ID NO: 687993 - DNA, 25 bp, Mus musculus
gcgtcttcctgctcatgatcaccgg

SEQ ID NO: 687994 - DNA, 25 bp, Mus musculus
gcgtctttgcttatgtgatcatggc

SEQ ID NO: 687995 - DNA, 25 bp, Mus musculus
gcgtctttgcttttgtgatcatggc

SEQ ID NO: 687996 - DNA, 25 bp, Mus musculus
gcgtctttttcaaggagcttatgca

SEQ ID NO: 687997 - DNA, 25 bp, Mus musculus
gcgtctttttcatggagcttatgca

SEQ ID NO: 687998 - DNA, 25 bp, Mus musculus
gcgtgaaaaagacgccaaagatctg

SEQ ID NO: 687999 - DNA, 25 bp, Mus musculus
gcgtgaaaaagaggccaaagatctg

SEQ ID NO: 688000 - DNA, 25 bp, Mus musculus
gcgtgaacagtcagaggacaccgcg

SEQ ID NO: 688001 - DNA, 25 bp, Mus musculus
gcgtgaacagtctgaggacaccgcg

SEQ ID NO: 688002 - DNA, 25 bp, Mus musculus
gcgtgaaccgctccattctgtgtgg

SEQ ID NO: 688003 - DNA, 25 bp, Mus musculus
gcgtgaaccgctgcattctgtgtgg

SEQ ID NO: 688004 - DNA, 25 bp, Mus musculus
gcgtgaatggctataactgcaccac

SEQ ID NO: 688005 - DNA, 25 bp, Mus musculus
gcgtgaatggctttaactgcaccac

SEQ ID NO: 688006 - DNA, 25 bp, Mus musculus
gcgtgaccaagtacaagctccaagg

SEQ ID NO: 688007 - DNA, 25 bp, Mus musculus
gcgtgaccaagttcaagctccaagg

SEQ ID NO: 688008 - DNA, 25 bp, Mus musculus
gcgtgactaccccttgcctgatgtg

SEQ ID NO: 688009 - DNA, 25 bp, Mus musculus
gcgtgactacccgttgcctgatgtg

SEQ ID NO: 688010 - DNA, 25 bp, Mus musculus
gcgtgactctctccgtcagacagaa

SEQ ID NO: 688011 - DNA, 25 bp, Mus musculus
gcgtgactctctgcgtcagacagaa

SEQ ID NO: 688012 - DNA, 25 bp, Mus musculus
gcgtgagagggtcctgctaacccat

SEQ ID NO: 688013 - DNA, 25 bp, Mus musculus
gcgtgagagggtgctgctaacccat

SEQ ID NO: 688014 - DNA, 25 bp, Mus musculus
gcgtgagccctcagtcctggactgt

SEQ ID NO: 688015 - DNA, 25 bp, Mus musculus
gcgtgagccctctgtcctggactgt

SEQ ID NO: 688016 - DNA, 25 bp, Mus musculus
gcgtgataaagcatcatatgtcaga

SEQ ID NO: 688017 - DNA, 25 bp, Mus musculus
gcgtgataaagcttcatatgtcaga

SEQ ID NO: 688018 - DNA, 25 bp, Mus musculus
gcgtgatcatcgagctcttcctcgg

SEQ ID NO: 688019 - DNA, 25 bp, Mus musculus
gcgtgatcatcgtgctcttcctcgg

SEQ ID NO: 688020 - DNA, 25 bp, Mus musculus
gcgtgatcctcccagacattgcaag

SEQ ID NO: 688021 - DNA, 25 bp, Mus musculus
gcgtgatcctccgagacattgcaag

SEQ ID NO: 688022 - DNA, 25 bp, Mus musculus
gcgtgatggaagaattgaaaaaaca

SEQ ID NO: 688023 - DNA, 25 bp, Mus musculus
gcgtgatggaagtattgaaaaaaca

SEQ ID NO: 688024 - DNA, 25 bp, Mus musculus
gcgtgcaaccttaggaaataactca

SEQ ID NO: 688025 - DNA, 25 bp, Mus musculus
gcgtgcaacctttggaaataactca

SEQ ID NO: 688026 - DNA, 25 bp, Mus musculus
gcgtgcaaggctctgaccgaccacg

SEQ ID NO: 688027 - DNA, 25 bp, Mus musculus
gcgtgcaaggctgtgaccgaccacg

SEQ ID NO: 688028 - DNA, 25 bp, Mus musculus
gcgtgcacctcaagaggctgtggaa

SEQ ID NO: 688029 - DNA, 25 bp, Mus musculus
gcgtgcacctcatgaggctgtggaa

SEQ ID NO: 688030 - DNA, 25 bp, Mus musculus
gcgtgcatcagactcttcaagccag

SEQ ID NO: 688031 - DNA, 25 bp, Mus musculus
gcgtgcatcagagtcttcaagccag

SEQ ID NO: 688032 - DNA, 25 bp, Mus musculus
gcgtgccaagctcagagcctggaat

SEQ ID NO: 688033 - DNA, 25 bp, Mus musculus
gcgtgccaagctgagagcctggaat

SEQ ID NO: 688034 - DNA, 25 bp, Mus musculus
gcgtgccacaccaatcgaggtgctg

SEQ ID NO: 688035 - DNA, 25 bp, Mus musculus
gcgtgccacacctatcgaggtgctg

SEQ ID NO: 688036 - DNA, 25 bp, Mus musculus
gcgtgccacagcagctgagcgccag

SEQ ID NO: 688037 - DNA, 25 bp, Mus musculus
gcgtgccacagctgctgagcgccag

SEQ ID NO: 688038 - DNA, 25 bp, Mus musculus
gcgtgccagccaacatgagagcaat

SEQ ID NO: 688039 - DNA, 25 bp, Mus musculus
gcgtgccagccatcatgagagcaat

SEQ ID NO: 688040 - DNA, 25 bp, Mus musculus
gcgtgccattgaaggtctggccaca

SEQ ID NO: 688041 - DNA, 25 bp, Mus musculus
gcgtgccattgatggtctggccaca

SEQ ID NO: 688042 - DNA, 25 bp, Mus musculus
gcgtgcccgggcagtttgctctcgt

SEQ ID NO: 688043 - DNA, 25 bp, Mus musculus
gcgtgcccgggctgtttgctctcgt

SEQ ID NO: 688044 - DNA, 25 bp, Mus musculus
gcgtgccggcgtcactcgaagacac

SEQ ID NO: 688045 - DNA, 25 bp, Mus musculus
gcgtgccggcgtgactcgaagacac

SEQ ID NO: 688046 - DNA, 25 bp, Mus musculus
gcgtgccgtagacaacgagctgcta

SEQ ID NO: 688047 - DNA, 25 bp, Mus musculus
gcgtgccgtagagaacgagctgcta

SEQ ID NO: 688048 - DNA, 25 bp, Mus musculus
gcgtgcctgatacctacttttcatt

SEQ ID NO: 688049 - DNA, 25 bp, Mus musculus
gcgtgcctgatagctacttttcatt

SEQ ID NO: 688050 - DNA, 25 bp, Mus musculus
gcgtgcggccagaactggagatcta

SEQ ID NO: 688051 - DNA, 25 bp, Mus musculus
gcgtgcggccagtactggagatcta

SEQ ID NO: 688052 - DNA, 25 bp, Mus musculus
gcgtgcggcctacagtttccaatcg

SEQ ID NO: 688053 - DNA, 25 bp, Mus musculus
gcgtgcggcctagagtttccaatcg

SEQ ID NO: 688054 - DNA, 25 bp, Mus musculus
gcgtgcggccttagctaacttcgat

SEQ ID NO: 688055 - DNA, 25 bp, Mus musculus
gcgtgcggcctttgctaacttcgat

SEQ ID NO: 688056 - DNA, 25 bp, Mus musculus
gcgtgctccagacgattttgtctga

SEQ ID NO: 688057 - DNA, 25 bp, Mus musculus
gcgtgctccagaggattttgtctga

SEQ ID NO: 688058 - DNA, 25 bp, Mus musculus
gcgtgctccagcagggactctctgt

SEQ ID NO: 688059 - DNA, 25 bp, Mus musculus
gcgtgctccagctgggactctctgt

SEQ ID NO: 688060 - DNA, 25 bp, Mus musculus
gcgtgctcggctatgcgcgcgctca

SEQ ID NO: 688061 - DNA, 25 bp, Mus musculus
gcgtgctcggctttgcgcgcgctca

SEQ ID NO: 688062 - DNA, 25 bp, Mus musculus
gcgtgcttctgtccttctcccagga

SEQ ID NO: 688063 - DNA, 25 bp, Mus musculus
gcgtgcttctgtgcttctcccagga

SEQ ID NO: 688064 - DNA, 25 bp, Mus musculus
gcgtgctttccgagccggcttcttc

SEQ ID NO: 688065 - DNA, 25 bp, Mus musculus
gcgtgctttccgtgccggcttcttc

SEQ ID NO: 688066 - DNA, 25 bp, Mus musculus
gcgtgcttttctatacatatcatga

SEQ ID NO: 688067 - DNA, 25 bp, Mus musculus
gcgtgcttttctttacatatcatga

SEQ ID NO: 688068 - DNA, 25 bp, Mus musculus
gcgtggaacaagctctgctggaacc

SEQ ID NO: 688069 - DNA, 25 bp, Mus musculus
gcgtggaacaaggtctgctggaacc

SEQ ID NO: 688070 - DNA, 25 bp, Mus musculus
gcgtggacgccaccgacaagatgct

SEQ ID NO: 688071 - DNA, 25 bp, Mus musculus
gcgtggacgccagcgacaagatgct

SEQ ID NO: 688072 - DNA, 25 bp, Mus musculus
gcgtggacgtggagcccaccttctg

SEQ ID NO: 688073 - DNA, 25 bp, Mus musculus
gcgtggacgtggtgcccaccttctg

SEQ ID NO: 688074 - DNA, 25 bp, Mus musculus
gcgtggactcgcagggcatgctact

SEQ ID NO: 688075 - DNA, 25 bp, Mus musculus
gcgtggactcgctgggcatgctact

SEQ ID NO: 688076 - DNA, 25 bp, Mus musculus
gcgtggagaactacgcgctgctcaa

SEQ ID NO: 688077 - DNA, 25 bp, Mus musculus
gcgtggagaacttcgcgctgctcaa

SEQ ID NO: 688078 - DNA, 25 bp, Mus musculus
gcgtggagcgttactgattcacaca

SEQ ID NO: 688079 - DNA, 25 bp, Mus musculus
gcgtggagcgtttctgattcacaca

SEQ ID NO: 688080 - DNA, 25 bp, Mus musculus
gcgtggaggacacctccgcagcgcg

SEQ ID NO: 688081 - DNA, 25 bp, Mus musculus
gcgtggaggacagctccgcagcgcg

SEQ ID NO: 688082 - DNA, 25 bp, Mus musculus
gcgtggatgacaacgaggagaccat

SEQ ID NO: 688083 - DNA, 25 bp, Mus musculus
gcgtggatgacatcgaggagaccat

SEQ ID NO: 688084 - DNA, 25 bp, Mus musculus
gcgtggcaaaggatgaccatgtcca

SEQ ID NO: 688085 - DNA, 25 bp, Mus musculus
gcgtggcaaaggttgaccatgtcca

SEQ ID NO: 688086 - DNA, 25 bp, Mus musculus
gcgtggcagttaccgaatcagcctg

SEQ ID NO: 688087 - DNA, 25 bp, Mus musculus
gcgtggcagttagcgaatcagcctg

SEQ ID NO: 688088 - DNA, 25 bp, Mus musculus
gcgtggccggtgaagcagtatttat

SEQ ID NO: 688089 - DNA, 25 bp, Mus musculus
gcgtggccggtgtagcagtatttat

SEQ ID NO: 688090 - DNA, 25 bp, Mus musculus
gcgtggcctccaaagattctgctga

SEQ ID NO: 688091 - DNA, 25 bp, Mus musculus
gcgtggcctccatagattctgctga

SEQ ID NO: 688092 - DNA, 25 bp, Mus musculus
gcgtggcgcggaaacaaactttgcc

SEQ ID NO: 688093 - DNA, 25 bp, Mus musculus
gcgtggcgcggatacaaactttgcc

SEQ ID NO: 688094 - DNA, 25 bp, Mus musculus
gcgtggcgtgtgacattcctgaaca

SEQ ID NO: 688095 - DNA, 25 bp, Mus musculus
gcgtggcgtgtgtcattcctgaaca

SEQ ID NO: 688096 - DNA, 25 bp, Mus musculus
gcgtggctcctcactgaagctgctc

SEQ ID NO: 688097 - DNA, 25 bp, Mus musculus
gcgtggctcctctctgaagctgctc

SEQ ID NO: 688098 - DNA, 25 bp, Mus musculus
gcgtggcttctcaggccccacagag

SEQ ID NO: 688099 - DNA, 25 bp, Mus musculus
gcgtggcttctctggccccacagag

SEQ ID NO: 688100 - DNA, 25 bp, Mus musculus
gcgtggctttctctacgtttgtagc

SEQ ID NO: 688101 - DNA, 25 bp, Mus musculus
gcgtggctttctgtacgtttgtagc

SEQ ID NO: 688102 - DNA, 25 bp, Mus musculus
gcgtgggcaaccattacagctggca

SEQ ID NO: 688103 - DNA, 25 bp, Mus musculus
gcgtgggcaacctttacagctggca

SEQ ID NO: 688104 - DNA, 25 bp, Mus musculus
gcgtgggcctttacaccaacctcgt

SEQ ID NO: 688105 - DNA, 25 bp, Mus musculus
gcgtgggccttttcaccaacctcgt

SEQ ID NO: 688106 - DNA, 25 bp, Mus musculus
gcgtggtcatagacagaatcagcca

SEQ ID NO: 688107 - DNA, 25 bp, Mus musculus
gcgtggtcatagtcagaatcagcca

SEQ ID NO: 688108 - DNA, 25 bp, Mus musculus
gcgtggtggatccagctcaggctgg

SEQ ID NO: 688109 - DNA, 25 bp, Mus musculus
gcgtggtggatcgagctcaggctgg

SEQ ID NO: 688110 - DNA, 25 bp, Mus musculus
gcgtggtgtttcctagatctgccct

SEQ ID NO: 688111 - DNA, 25 bp, Mus musculus
gcgtggtgtttcgtagatctgccct

SEQ ID NO: 688112 - DNA, 25 bp, Mus musculus
gcgtgtactacaccctcaacgtgct

SEQ ID NO: 688113 - DNA, 25 bp, Mus musculus
gcgtgtactacagcctcaacgtgct

SEQ ID NO: 688114 - DNA, 25 bp, Mus musculus
gcgtgtagtcggatcagccgccgcc

SEQ ID NO: 688115 - DNA, 25 bp, Mus musculus
gcgtgtagtcggttcagccgccgcc

SEQ ID NO: 688116 - DNA, 25 bp, Mus musculus
gcgtgtagtgtcatagtgtcgtcca

SEQ ID NO: 688117 - DNA, 25 bp, Mus musculus
gcgtgtagtgtcttagtgtcgtcca

SEQ ID NO: 688118 - DNA, 25 bp, Mus musculus
gcgtgtatcggcaccgccatggctc

SEQ ID NO: 688119 - DNA, 25 bp, Mus musculus
gcgtgtatcggctccgccatggctc

SEQ ID NO: 688120 - DNA, 25 bp, Mus musculus
gcgtgtattgccagctcaagccaca

SEQ ID NO: 688121 - DNA, 25 bp, Mus musculus
gcgtgtattgcctgctcaagccaca

SEQ ID NO: 688122 - DNA, 25 bp, Mus musculus
gcgtgtcaatggcagctgcgccttc

SEQ ID NO: 688123 - DNA, 25 bp, Mus musculus
gcgtgtcaatgggagctgcgccttc

SEQ ID NO: 688124 - DNA, 25 bp, Mus musculus
gcgtgtcacaagatacccgctgatc

SEQ ID NO: 688125 - DNA, 25 bp, Mus musculus
gcgtgtcacaagttacccgctgatc

SEQ ID NO: 688126 - DNA, 25 bp, Mus musculus
gcgtgtcatcaacgaagagtataaa

SEQ ID NO: 688127 - DNA, 25 bp, Mus musculus
gcgtgtcatcaaggaagagtataaa

SEQ ID NO: 688128 - DNA, 25 bp, Mus musculus
gcgtgtccaggcacaaagaaacaaa

SEQ ID NO: 688129 - DNA, 25 bp, Mus musculus
gcgtgtccaggctcaaagaaacaaa

SEQ ID NO: 688130 - DNA, 25 bp, Mus musculus
gcgtgtccgcgcaggcccagcgtta

SEQ ID NO: 688131 - DNA, 25 bp, Mus musculus
gcgtgtccgcgctggcccagcgtta

SEQ ID NO: 688132 - DNA, 25 bp, Mus musculus
gcgtgtcctcgtcggtacgtccacg

SEQ ID NO: 688133 - DNA, 25 bp, Mus musculus
gcgtgtcctcgtgggtacgtccacg

SEQ ID NO: 688134 - DNA, 25 bp, Mus musculus
gcgtgtcctgccagcacatgcctgt

SEQ ID NO: 688135 - DNA, 25 bp, Mus musculus
gcgtgtcctgcctgcacatgcctgt

SEQ ID NO: 688136 - DNA, 25 bp, Mus musculus
gcgtgtcgcccgacctcgagtggca

SEQ ID NO: 688137 - DNA, 25 bp, Mus musculus
gcgtgtcgcccgtcctcgagtggca

SEQ ID NO: 688138 - DNA, 25 bp, Mus musculus
gcgtgtcgcggtcgctctggagccg

SEQ ID NO: 688139 - DNA, 25 bp, Mus musculus
gcgtgtcgcggtggctctggagccg

SEQ ID NO: 688140 - DNA, 25 bp, Mus musculus
gcgtgtcgggtgaccgacttttctt

SEQ ID NO: 688141 - DNA, 25 bp, Mus musculus
gcgtgtcgggtgtccgacttttctt

SEQ ID NO: 688142 - DNA, 25 bp, Mus musculus
gcgtgtgacaggcttttggctcacc

SEQ ID NO: 688143 - DNA, 25 bp, Mus musculus
gcgtgtgacagggttttggctcacc

SEQ ID NO: 688144 - DNA, 25 bp, Mus musculus
gcgtgtgagtaactgaataaaatac

SEQ ID NO: 688145 - DNA, 25 bp, Mus musculus
gcgtgtgagtaagtgaataaaatac

SEQ ID NO: 688146 - DNA, 25 bp, Mus musculus
gcgtgtgatggcattagttctgctg

SEQ ID NO: 688147 - DNA, 25 bp, Mus musculus
gcgtgtgatggctttagttctgctg

SEQ ID NO: 688148 - DNA, 25 bp, Mus musculus
gcgtgtgcacacaaagacagcctgt

SEQ ID NO: 688149 - DNA, 25 bp, Mus musculus
gcgtgtgcacactaagacagcctgt

SEQ ID NO: 688150 - DNA, 25 bp, Mus musculus
gcgtgtgccgatccgactctttctc

SEQ ID NO: 688151 - DNA, 25 bp, Mus musculus
gcgtgtgccgatgcgactctttctc

SEQ ID NO: 688152 - DNA, 25 bp, Mus musculus
gcgtgttatccacgcaatgggctcg

SEQ ID NO: 688153 - DNA, 25 bp, Mus musculus
gcgtgttatccaggcaatgggctcg

SEQ ID NO: 688154 - DNA, 25 bp, Mus musculus
gcgtgttccggaacctatccctcga

SEQ ID NO: 688155 - DNA, 25 bp, Mus musculus
gcgtgttccggatcctatccctcga

SEQ ID NO: 688156 - DNA, 25 bp, Mus musculus
gcgtgttgagccctcctctcggaaa

SEQ ID NO: 688157 - DNA, 25 bp, Mus musculus
gcgtgttgagccgtcctctcggaaa

SEQ ID NO: 688158 - DNA, 25 bp, Mus musculus
gcgtgttttgaaacaagcccagtga

SEQ ID NO: 688159 - DNA, 25 bp, Mus musculus
gcgtgttttgaatcaagcccagtga

SEQ ID NO: 688160 - DNA, 25 bp, Mus musculus
gcgttacagcagattgcggattaca

SEQ ID NO: 688161 - DNA, 25 bp, Mus musculus
gcgttacagcagtttgcggattaca

SEQ ID NO: 688162 - DNA, 25 bp, Mus musculus
gcgttacatgggactcccaattcca

SEQ ID NO: 688163 - DNA, 25 bp, Mus musculus
gcgttacatgggtctcccaattcca

SEQ ID NO: 688164 - DNA, 25 bp, Mus musculus
gcgttaccaggtctgggttctacct

SEQ ID NO: 688165 - DNA, 25 bp, Mus musculus
gcgttaccaggtgtgggttctacct

SEQ ID NO: 688166 - DNA, 25 bp, Mus musculus
gcgttagaatacatgcaggctttgg

SEQ ID NO: 688167 - DNA, 25 bp, Mus musculus
gcgttagaatacttgcaggctttgg

SEQ ID NO: 688168 - DNA, 25 bp, Mus musculus
gcgttatgcaaaccctacacgttag

SEQ ID NO: 688169 - DNA, 25 bp, Mus musculus
gcgttatgcaaagcctacacgttag

SEQ ID NO: 688170 - DNA, 25 bp, Mus musculus
gcgttatgctctctaacacagagct

SEQ ID NO: 688171 - DNA, 25 bp, Mus musculus
gcgttatgctctgtaacacagagct

SEQ ID NO: 688172 - DNA, 25 bp, Mus musculus
gcgttcagggagatgcccatttcga

SEQ ID NO: 688173 - DNA, 25 bp, Mus musculus
gcgttcagggagttgcccatttcga

SEQ ID NO: 688174 - DNA, 25 bp, Mus musculus
gcgttcatcatcagaaagttcaaag

SEQ ID NO: 688175 - DNA, 25 bp, Mus musculus
gcgttcatcatctgaaagttcaaag

SEQ ID NO: 688176 - DNA, 25 bp, Mus musculus
gcgttcatcggacccttggagacta

SEQ ID NO: 688177 - DNA, 25 bp, Mus musculus
gcgttcatcggagccttggagacta

SEQ ID NO: 688178 - DNA, 25 bp, Mus musculus
gcgttcatgtccctctggtccttga

SEQ ID NO: 688179 - DNA, 25 bp, Mus musculus
gcgttcatgtccgtctggtccttga

SEQ ID NO: 688180 - DNA, 25 bp, Mus musculus
gcgttcattcagatccccaggtggg

SEQ ID NO: 688181 - DNA, 25 bp, Mus musculus
gcgttcattcagttccccaggtggg

SEQ ID NO: 688182 - DNA, 25 bp, Mus musculus
gcgttcccaactccgtgtgcgtcaa

SEQ ID NO: 688183 - DNA, 25 bp, Mus musculus
gcgttcccaactgcgtgtgcgtcaa

SEQ ID NO: 688184 - DNA, 25 bp, Mus musculus
gcgttccgcagcacacctgatttga

SEQ ID NO: 688185 - DNA, 25 bp, Mus musculus
gcgttccgcagctcacctgatttga

SEQ ID NO: 688186 - DNA, 25 bp, Mus musculus
gcgttcctaaccatcgtctgtatgg

SEQ ID NO: 688187 - DNA, 25 bp, Mus musculus
gcgttcctaaccttcgtctgtatgg

SEQ ID NO: 688188 - DNA, 25 bp, Mus musculus
gcgttcgacaaacttgagacaatgt

SEQ ID NO: 688189 - DNA, 25 bp, Mus musculus
gcgttcgacaaagttgagacaatgt

SEQ ID NO: 688190 - DNA, 25 bp, Mus musculus
gcgttcgtcgcgctctcacgatggc

SEQ ID NO: 688191 - DNA, 25 bp, Mus musculus
gcgttcgtcgcggtctcacgatggc

SEQ ID NO: 688192 - DNA, 25 bp, Mus musculus
gcgttcgtgccgacggccgtttcca

SEQ ID NO: 688193 - DNA, 25 bp, Mus musculus
gcgttcgtgccgtcggccgtttcca

SEQ ID NO: 688194 - DNA, 25 bp, Mus musculus
gcgttctagtgcacgccctggctat

SEQ ID NO: 688195 - DNA, 25 bp, Mus musculus
gcgttctagtgctcgccctggctat

SEQ ID NO: 688196 - DNA, 25 bp, Mus musculus
gcgttctatgttccggacctcggag

SEQ ID NO: 688197 - DNA, 25 bp, Mus musculus
gcgttctatgttgcggacctcggag

SEQ ID NO: 688198 - DNA, 25 bp, Mus musculus
gcgttctcagtcatcccaggccaag

SEQ ID NO: 688199 - DNA, 25 bp, Mus musculus
gcgttctcagtcttcccaggccaag

SEQ ID NO: 688200 - DNA, 25 bp, Mus musculus
gcgttctcggccaaggccttggctt

SEQ ID NO: 688201 - DNA, 25 bp, Mus musculus
gcgttctcggcctaggccttggctt

SEQ ID NO: 688202 - DNA, 25 bp, Mus musculus
gcgttctcgtgtcaaaaccactggt

SEQ ID NO: 688203 - DNA, 25 bp, Mus musculus
gcgttctcgtgtgaaaaccactggt

SEQ ID NO: 688204 - DNA, 25 bp, Mus musculus
gcgttcttccatatgtgtactctgc

SEQ ID NO: 688205 - DNA, 25 bp, Mus musculus
gcgttcttccatttgtgtactctgc

SEQ ID NO: 688206 - DNA, 25 bp, Mus musculus
gcgttgactggaagaacaaggtgat

SEQ ID NO: 688207 - DNA, 25 bp, Mus musculus
gcgttgactggatgaacaaggtgat

SEQ ID NO: 688208 - DNA, 25 bp, Mus musculus
gcgttgcagaaaacaagatttccct

SEQ ID NO: 688209 - DNA, 25 bp, Mus musculus
gcgttgcagaaatcaagatttccct

SEQ ID NO: 688210 - DNA, 25 bp, Mus musculus
gcgttgccagctagcccctaagcaa

SEQ ID NO: 688211 - DNA, 25 bp, Mus musculus
gcgttgccagcttgcccctaagcaa

SEQ ID NO: 688212 - DNA, 25 bp, Mus musculus
gcgttgccataccatcgagatggca

SEQ ID NO: 688213 - DNA, 25 bp, Mus musculus
gcgttgccatacgatcgagatggca

SEQ ID NO: 688214 - DNA, 25 bp, Mus musculus
gcgttgccgctgagcatcagcccat

SEQ ID NO: 688215 - DNA, 25 bp, Mus musculus
gcgttgccgctgtgcatcagcccat

SEQ ID NO: 688216 - DNA, 25 bp, Mus musculus
gcgttgcctgcacctgtggtgaccc

SEQ ID NO: 688217 - DNA, 25 bp, Mus musculus
gcgttgcctgcagctgtggtgaccc

SEQ ID NO: 688218 - DNA, 25 bp, Mus musculus
gcgttgggaagacatctctactggt

SEQ ID NO: 688219 - DNA, 25 bp, Mus musculus
gcgttgggaagacctcagcacatca

SEQ ID NO: 688220 - DNA, 25 bp, Mus musculus
gcgttgggaagagatctctactggt

SEQ ID NO: 688221 - DNA, 25 bp, Mus musculus
gcgttgggaagagctcagcacatca

SEQ ID NO: 688222 - DNA, 25 bp, Mus musculus
gcgttgggaagtcgcaggatcgata

SEQ ID NO: 688223 - DNA, 25 bp, Mus musculus
gcgttgggaagtggcaggatcgata

SEQ ID NO: 688224 - DNA, 25 bp, Mus musculus
gcgttgggcgctatcatcctgatcg

SEQ ID NO: 688225 - DNA, 25 bp, Mus musculus
gcgttgggcgctttcatcctgatcg

SEQ ID NO: 688226 - DNA, 25 bp, Mus musculus
gcgttgtccttgcagtgagacctaa

SEQ ID NO: 688227 - DNA, 25 bp, Mus musculus
gcgttgtccttggagtgagacctaa

SEQ ID NO: 688228 - DNA, 25 bp, Mus musculus
gcgttgtgcaacaatacctggatgt

SEQ ID NO: 688229 - DNA, 25 bp, Mus musculus
gcgttgtgcaactatacctggatgt

SEQ ID NO: 688230 - DNA, 25 bp, Mus musculus
gcgttgtgcggaatcaaagcgcaat

SEQ ID NO: 688231 - DNA, 25 bp, Mus musculus
gcgttgtgcggattcaaagcgcaat

SEQ ID NO: 688232 - DNA, 25 bp, Mus musculus
gcgtttaatggcagctgtccagact

SEQ ID NO: 688233 - DNA, 25 bp, Mus musculus
gcgtttaatggctgctgtccagact

SEQ ID NO: 688234 - DNA, 25 bp, Mus musculus
gcgtttaccagaactttgcggacga

SEQ ID NO: 688235 - DNA, 25 bp, Mus musculus
gcgtttaccagatctttgcggacga

SEQ ID NO: 688236 - DNA, 25 bp, Mus musculus
gcgtttactcgcaggctctcctgaa

SEQ ID NO: 688237 - DNA, 25 bp, Mus musculus
gcgtttactcgctggctctcctgaa

SEQ ID NO: 688238 - DNA, 25 bp, Mus musculus
gcgtttaggctaacaggtggcacca

SEQ ID NO: 688239 - DNA, 25 bp, Mus musculus
gcgtttaggctatcaggtggcacca

SEQ ID NO: 688240 - DNA, 25 bp, Mus musculus
gcgtttcaggatccagtctgtcccc

SEQ ID NO: 688241 - DNA, 25 bp, Mus musculus
gcgtttcaggatgcagtctgtcccc

SEQ ID NO: 688242 - DNA, 25 bp, Mus musculus
gcgtttcgatgtcaaggattgctcc

SEQ ID NO: 688243 - DNA, 25 bp, Mus musculus
gcgtttcgatgtgaaggattgctcc

SEQ ID NO: 688244 - DNA, 25 bp, Mus musculus
gcgtttctcactcatgacgctgcgg

SEQ ID NO: 688245 - DNA, 25 bp, Mus musculus
gcgtttctcactgatgacgctgcgg

SEQ ID NO: 688246 - DNA, 25 bp, Mus musculus
gcgtttctttccagtgcgaggccgg

SEQ ID NO: 688247 - DNA, 25 bp, Mus musculus
gcgtttctttcctgtgcgaggccgg

SEQ ID NO: 688248 - DNA, 25 bp, Mus musculus
gcgtttgcaagacgtggtaccgcct

SEQ ID NO: 688249 - DNA, 25 bp, Mus musculus
gcgtttgcaagaggtggtaccgcct

SEQ ID NO: 688250 - DNA, 25 bp, Mus musculus
gcgtttgcaccgcacaaaccaggaa

SEQ ID NO: 688251 - DNA, 25 bp, Mus musculus
gcgtttgcaccggacaaaccaggaa

SEQ ID NO: 688252 - DNA, 25 bp, Mus musculus
gcgtttgcccggctgaaccccatga

SEQ ID NO: 688253 - DNA, 25 bp, Mus musculus
gcgtttgcccgggtgaaccccatga

SEQ ID NO: 688254 - DNA, 25 bp, Mus musculus
gcgtttgctggaaactgctggcatc

SEQ ID NO: 688255 - DNA, 25 bp, Mus musculus
gcgtttgctggatactgctggcatc

SEQ ID NO: 688256 - DNA, 25 bp, Mus musculus
gcgtttgggacacagttcacggacc

SEQ ID NO: 688257 - DNA, 25 bp, Mus musculus
gcgtttgggacagagttcacggacc

SEQ ID NO: 688258 - DNA, 25 bp, Mus musculus
gcgtttggtgctccggtaaccacca

SEQ ID NO: 688259 - DNA, 25 bp, Mus musculus
gcgtttggtgctgcggtaaccacca

SEQ ID NO: 688260 - DNA, 25 bp, Mus musculus
gcgtttgtgagaacctgcggaagct

SEQ ID NO: 688261 - DNA, 25 bp, Mus musculus
gcgtttgtgagatcctgcggaagct

SEQ ID NO: 688262 - DNA, 25 bp, Mus musculus
gcgtttgtgttcatcttatcaggga

SEQ ID NO: 688263 - DNA, 25 bp, Mus musculus
gcgtttgtgttcttcttatcaggga

SEQ ID NO: 688264 - DNA, 25 bp, Mus musculus
gcgttttccgaaagggcgatagcgc

SEQ ID NO: 688265 - DNA, 25 bp, Mus musculus
gcgttttccgaatgggcgatagcgc

SEQ ID NO: 688266 - DNA, 25 bp, Mus musculus
gcgttttcgtgactggctttgtgaa

SEQ ID NO: 688267 - DNA, 25 bp, Mus musculus
gcgttttcgtgagtggctttgtgaa

SEQ ID NO: 688268 - DNA, 25 bp, Mus musculus
gcgttttttctaacagcggctggtg

SEQ ID NO: 688269 - DNA, 25 bp, Mus musculus
gcgttttttctatcagcggctggtg

SEQ ID NO: 688270 - DNA, 25 bp, Mus musculus
gctaaaaacctcaacagccgcttgt

SEQ ID NO: 688271 - DNA, 25 bp, Mus musculus
gctaaaaacctctacagccgcttgt

SEQ ID NO: 688272 - DNA, 25 bp, Mus musculus
gctaaaaagtccctggatatctcgg

SEQ ID NO: 688273 - DNA, 25 bp, Mus musculus
gctaaaaagtccgtggatatctcgg

SEQ ID NO: 688274 - DNA, 25 bp, Mus musculus
gctaaaaatgatcttgctgttgtgg

SEQ ID NO: 688275 - DNA, 25 bp, Mus musculus
gctaaaaatgatgttgctgttgtgg

SEQ ID NO: 688276 - DNA, 25 bp, Mus musculus
gctaaaaatggcacttcagtcgcaa

SEQ ID NO: 688277 - DNA, 25 bp, Mus musculus
gctaaaaatggcagcagaggagtga

SEQ ID NO: 688278 - DNA, 25 bp, Mus musculus
gctaaaaatggctcttcagtcgcaa

SEQ ID NO: 688279 - DNA, 25 bp, Mus musculus
gctaaaaatggctgcagaggagtga

SEQ ID NO: 688280 - DNA, 25 bp, Mus musculus
gctaaaacatggacttggcaacagg

SEQ ID NO: 688281 - DNA, 25 bp, Mus musculus
gctaaaacatggtcttggcaacagg

SEQ ID NO: 688282 - DNA, 25 bp, Mus musculus
gctaaaaccaagcaaaatcgccagt

SEQ ID NO: 688283 - DNA, 25 bp, Mus musculus
gctaaaaccaaggaaaatcgccagt

SEQ ID NO: 688284 - DNA, 25 bp, Mus musculus
gctaaaaccagaatacactgcccct

SEQ ID NO: 688285 - DNA, 25 bp, Mus musculus
gctaaaaccagattacactgcccct

SEQ ID NO: 688286 - DNA, 25 bp, Mus musculus
gctaaaaccgacactgaagaaaaag

SEQ ID NO: 688287 - DNA, 25 bp, Mus musculus
gctaaaaccgactctgaagaaaaag

SEQ ID NO: 688288 - DNA, 25 bp, Mus musculus
gctaaaactccccaactgcgtggct

SEQ ID NO: 688289 - DNA, 25 bp, Mus musculus
gctaaaactcccgaactgcgtggct

SEQ ID NO: 688290 - DNA, 25 bp, Mus musculus
gctaaaagaacaacttgaacaagtc

SEQ ID NO: 688291 - DNA, 25 bp, Mus musculus
gctaaaagaacatcttgaacaagtc

SEQ ID NO: 688292 - DNA, 25 bp, Mus musculus
gctaaaaggagaacttgaaagctca

SEQ ID NO: 688293 - DNA, 25 bp, Mus musculus
gctaaaaggagatcttgaaagctca

SEQ ID NO: 688294 - DNA, 25 bp, Mus musculus
gctaaaatcatcattgtgccgccaa

SEQ ID NO: 688295 - DNA, 25 bp, Mus musculus
gctaaaatcatctttgtgccgccaa

SEQ ID NO: 688296 - DNA, 25 bp, Mus musculus
gctaaaattaagaggagcgggcctg

SEQ ID NO: 688297 - DNA, 25 bp, Mus musculus
gctaaaattaagtggagcgggcctg

SEQ ID NO: 688298 - DNA, 25 bp, Mus musculus
gctaaaattgagcatagagacaaaa

SEQ ID NO: 688299 - DNA, 25 bp, Mus musculus
gctaaaattgaggatagagacaaaa

SEQ ID NO: 688300 - DNA, 25 bp, Mus musculus
gctaaaattgctagcttggccggga

SEQ ID NO: 688301 - DNA, 25 bp, Mus musculus
gctaaaattgcttgcttggccggga

SEQ ID NO: 688302 - DNA, 25 bp, Mus musculus
gctaaacaactgagtgggccactat

SEQ ID NO: 688303 - DNA, 25 bp, Mus musculus
gctaaacaactgtgtgggccactat

SEQ ID NO: 688304 - DNA, 25 bp, Mus musculus
gctaaacagaacaggttgttctccc

SEQ ID NO: 688305 - DNA, 25 bp, Mus musculus
gctaaacagaactggttgttctccc

SEQ ID NO: 688306 - DNA, 25 bp, Mus musculus
gctaaacaggacaatcggtccagga

SEQ ID NO: 688307 - DNA, 25 bp, Mus musculus
gctaaacaggactatcggtccagga

SEQ ID NO: 688308 - DNA, 25 bp, Mus musculus
gctaaaccggctcacaacagacttt

SEQ ID NO: 688309 - DNA, 25 bp, Mus musculus
gctaaaccggctgacaacagacttt

SEQ ID NO: 688310 - DNA, 25 bp, Mus musculus
gctaaacctctacctaatcatggag

SEQ ID NO: 688311 - DNA, 25 bp, Mus musculus
gctaaacctctagctaatcatggag

SEQ ID NO: 688312 - DNA, 25 bp, Mus musculus
gctaaacgtgccagagctgagcctc

SEQ ID NO: 688313 - DNA, 25 bp, Mus musculus
gctaaacgtgcctgagctgagcctc

SEQ ID NO: 688314 - DNA, 25 bp, Mus musculus
gctaaactcctgcagcagaagctga

SEQ ID NO: 688315 - DNA, 25 bp, Mus musculus
gctaaactcctggagcagaagctga

SEQ ID NO: 688316 - DNA, 25 bp, Mus musculus
gctaaactgataacactggcaagtc

SEQ ID NO: 688317 - DNA, 25 bp, Mus musculus
gctaaactgatatcactggcaagtc

SEQ ID NO: 688318 - DNA, 25 bp, Mus musculus
gctaaagaagcacgagctacagcca

SEQ ID NO: 688319 - DNA, 25 bp, Mus musculus
gctaaagaagcaggagctacagcca

SEQ ID NO: 688320 - DNA, 25 bp, Mus musculus
gctaaagaaggtccctttatcgtga

SEQ ID NO: 688321 - DNA, 25 bp, Mus musculus
gctaaagaaggtgcctttatcgtga

SEQ ID NO: 688322 - DNA, 25 bp, Mus musculus
gctaaagaatgactgctttccagaa

SEQ ID NO: 688323 - DNA, 25 bp, Mus musculus
gctaaagaatgagtgctttccagaa

SEQ ID NO: 688324 - DNA, 25 bp, Mus musculus
gctaaagacagccatccaggcagcc

SEQ ID NO: 688325 - DNA, 25 bp, Mus musculus
gctaaagacagcgatccaggcagcc

SEQ ID NO: 688326 - DNA, 25 bp, Mus musculus
gctaaagaccaaccacattggccac

SEQ ID NO: 688327 - DNA, 25 bp, Mus musculus
gctaaagaccaagcacattggccac

SEQ ID NO: 688328 - DNA, 25 bp, Mus musculus
gctaaagagtttatggaccgccatg

SEQ ID NO: 688329 - DNA, 25 bp, Mus musculus
gctaaagagtttttggaccgccatg

SEQ ID NO: 688330 - DNA, 25 bp, Mus musculus
gctaaagatgctagggaagttgcac

SEQ ID NO: 688331 - DNA, 25 bp, Mus musculus
gctaaagatgcttgggaagttgcac

SEQ ID NO: 688332 - DNA, 25 bp, Mus musculus
gctaaagcagatcgagcacactctg

SEQ ID NO: 688333 - DNA, 25 bp, Mus musculus
gctaaagcagatggagcacactctg

SEQ ID NO: 688334 - DNA, 25 bp, Mus musculus
gctaaagccttaagtggaacctctc

SEQ ID NO: 688335 - DNA, 25 bp, Mus musculus
gctaaagccttatgtggaacctctc

SEQ ID NO: 688336 - DNA, 25 bp, Mus musculus
gctaaagctgcaattgtctgttatg

SEQ ID NO: 688337 - DNA, 25 bp, Mus musculus
gctaaagctgcatttgtctgttatg

SEQ ID NO: 688338 - DNA, 25 bp, Mus musculus
gctaaaggagagatctcgaaaggca

SEQ ID NO: 688339 - DNA, 25 bp, Mus musculus
gctaaaggagagttctcgaaaggca

SEQ ID NO: 688340 - DNA, 25 bp, Mus musculus
gctaaagggccgaaacagcttctac

SEQ ID NO: 688341 - DNA, 25 bp, Mus musculus
gctaaagggccgtaacagcttctac

SEQ ID NO: 688342 - DNA, 25 bp, Mus musculus
gctaaaggtattcgcaagagacagt

SEQ ID NO: 688343 - DNA, 25 bp, Mus musculus
gctaaaggtattggcaagagacagt

SEQ ID NO: 688344 - DNA, 25 bp, Mus musculus
gctaaagtaaaacggatgtggcaag

SEQ ID NO: 688345 - DNA, 25 bp, Mus musculus
gctaaagtaaaagggatgtggcaag

SEQ ID NO: 688346 - DNA, 25 bp, Mus musculus
gctaaagtccaaattctaatcaggg

SEQ ID NO: 688347 - DNA, 25 bp, Mus musculus
gctaaagtccaatttctaatcaggg

SEQ ID NO: 688348 - DNA, 25 bp, Mus musculus
gctaaagtgcaacggtccccaagga

SEQ ID NO: 688349 - DNA, 25 bp, Mus musculus
gctaaagtgcaagggtccccaagga

SEQ ID NO: 688350 - DNA, 25 bp, Mus musculus
gctaaagtgctgattgcaaatcctc

SEQ ID NO: 688351 - DNA, 25 bp, Mus musculus
gctaaagtgctgtttgcaaatcctc

SEQ ID NO: 688352 - DNA, 25 bp, Mus musculus
gctaaagtggctctcctgggagctt

SEQ ID NO: 688353 - DNA, 25 bp, Mus musculus
gctaaagtggctgtcctgggagctt

SEQ ID NO: 688354 - DNA, 25 bp, Mus musculus
gctaaatctcatcctgatcgccatc

SEQ ID NO: 688355 - DNA, 25 bp, Mus musculus
gctaaatctcatgctgatcgccatc

SEQ ID NO: 688356 - DNA, 25 bp, Mus musculus
gctaaatgagctcagtgccatctcg

SEQ ID NO: 688357 - DNA, 25 bp, Mus musculus
gctaaatgagctgagtgccatctcg

SEQ ID NO: 688358 - DNA, 25 bp, Mus musculus
gctaaatggattacgatgtcagact

SEQ ID NO: 688359 - DNA, 25 bp, Mus musculus
gctaaatggatttcgatgtcagact

SEQ ID NO: 688360 - DNA, 25 bp, Mus musculus
gctaaatgtttcaaggatgcagtac

SEQ ID NO: 688361 - DNA, 25 bp, Mus musculus
gctaaatgtttctaggatgcagtac

SEQ ID NO: 688362 - DNA, 25 bp, Mus musculus
gctaaattgagccagcaggtcagga

SEQ ID NO: 688363 - DNA, 25 bp, Mus musculus
gctaaattgagcgagcaggtcagga

SEQ ID NO: 688364 - DNA, 25 bp, Mus musculus
gctaacaaatgcacttgtggaaaga

SEQ ID NO: 688365 - DNA, 25 bp, Mus musculus
gctaacaaatgctcttgtggaaaga

SEQ ID NO: 688366 - DNA, 25 bp, Mus musculus
gctaacaagcctattccagtgagac

SEQ ID NO: 688367 - DNA, 25 bp, Mus musculus
gctaacaagccttttccagtgagac

SEQ ID NO: 688368 - DNA, 25 bp, Mus musculus
gctaacacctgccacgcctggaggt

SEQ ID NO: 688369 - DNA, 25 bp, Mus musculus
gctaacacctgcgacgcctggaggt

SEQ ID NO: 688370 - DNA, 25 bp, Mus musculus
gctaacactgtgagcagttcatctg

SEQ ID NO: 688371 - DNA, 25 bp, Mus musculus
gctaacactgtgtgcagttcatctg

SEQ ID NO: 688372 - DNA, 25 bp, Mus musculus
gctaacagaacgcaacacaaacctg

SEQ ID NO: 688373 - DNA, 25 bp, Mus musculus
gctaacagaacggaacacaaacctg

SEQ ID NO: 688374 - DNA, 25 bp, Mus musculus
gctaacagtggcatgcacatcatca

SEQ ID NO: 688375 - DNA, 25 bp, Mus musculus
gctaacagtggcttgcacatcatca

SEQ ID NO: 688376 - DNA, 25 bp, Mus musculus
gctaacatctcaagcagtttgtaca

SEQ ID NO: 688377 - DNA, 25 bp, Mus musculus
gctaacatctcatgcagtttgtaca

SEQ ID NO: 688378 - DNA, 25 bp, Mus musculus
gctaacatgcttacgctactggagg

SEQ ID NO: 688379 - DNA, 25 bp, Mus musculus
gctaacatgctttcgctactggagg

SEQ ID NO: 688380 - DNA, 25 bp, Mus musculus
gctaaccacctgcaagaattgaata

SEQ ID NO: 688381 - DNA, 25 bp, Mus musculus
gctaaccacctggaagaattgaata

SEQ ID NO: 688382 - DNA, 25 bp, Mus musculus
gctaaccatggcctctggagatgac

SEQ ID NO: 688383 - DNA, 25 bp, Mus musculus
gctaaccatggcgtctggagatgac

SEQ ID NO: 688384 - DNA, 25 bp, Mus musculus
gctaacccacgaatatctgaacctg

SEQ ID NO: 688385 - DNA, 25 bp, Mus musculus
gctaacccacgattatctgaacctg

SEQ ID NO: 688386 - DNA, 25 bp, Mus musculus
gctaacccagtacaggtgcaaagtt

SEQ ID NO: 688387 - DNA, 25 bp, Mus musculus
gctaacccagtagaggtgcaaagtt

SEQ ID NO: 688388 - DNA, 25 bp, Mus musculus
gctaaccctttcaaggagcgaatct

SEQ ID NO: 688389 - DNA, 25 bp, Mus musculus
gctaaccctttctaggagcgaatct

SEQ ID NO: 688390 - DNA, 25 bp, Mus musculus
gctaaccggcttcggagagacgaaa

SEQ ID NO: 688391 - DNA, 25 bp, Mus musculus
gctaaccggcttgggagagacgaaa

SEQ ID NO: 688392 - DNA, 25 bp, Mus musculus
gctaacctgcgcaaccgttgcaatg

SEQ ID NO: 688393 - DNA, 25 bp, Mus musculus
gctaacctgcgctaccgttgcaatg

SEQ ID NO: 688394 - DNA, 25 bp, Mus musculus
gctaacgacggactgccttacgagt

SEQ ID NO: 688395 - DNA, 25 bp, Mus musculus
gctaacgacggagtgccttacgagt

SEQ ID NO: 688396 - DNA, 25 bp, Mus musculus
gctaacggcattattccctctttct

SEQ ID NO: 688397 - DNA, 25 bp, Mus musculus
gctaacggcatttttccctctttct

SEQ ID NO: 688398 - DNA, 25 bp, Mus musculus
gctaacgtcctgagccaggagagta

SEQ ID NO: 688399 - DNA, 25 bp, Mus musculus
gctaacgtcctgtgccaggagagta

SEQ ID NO: 688400 - DNA, 25 bp, Mus musculus
gctaactacaagaagcaaactagat

SEQ ID NO: 688401 - DNA, 25 bp, Mus musculus
gctaactacaagtagcaaactagat

SEQ ID NO: 688402 - DNA, 25 bp, Mus musculus
gctaactacgtcaatgggaatatgg

SEQ ID NO: 688403 - DNA, 25 bp, Mus musculus
gctaactacgtctatgggaatatgg

SEQ ID NO: 688404 - DNA, 25 bp, Mus musculus
gctaactagagtccagggagaagaa

SEQ ID NO: 688405 - DNA, 25 bp, Mus musculus
gctaactagagtgcagggagaagaa

SEQ ID NO: 688406 - DNA, 25 bp, Mus musculus
gctaactccaagacagctgatgggt

SEQ ID NO: 688407 - DNA, 25 bp, Mus musculus
gctaactccaagtcagctgatgggt

SEQ ID NO: 688408 - DNA, 25 bp, Mus musculus
gctaactgaatacatggagcacacg

SEQ ID NO: 688409 - DNA, 25 bp, Mus musculus
gctaactgaatagatggagcacacg

SEQ ID NO: 688410 - DNA, 25 bp, Mus musculus
gctaactgcataattcaggagaaag

SEQ ID NO: 688411 - DNA, 25 bp, Mus musculus
gctaactgcatatttcaggagaaag

SEQ ID NO: 688412 - DNA, 25 bp, Mus musculus
gctaactgccctacggtgtctccaa

SEQ ID NO: 688413 - DNA, 25 bp, Mus musculus
gctaactgcccttcggtgtctccaa

SEQ ID NO: 688414 - DNA, 25 bp, Mus musculus
gctaagaacggtaagaatgccaaga

SEQ ID NO: 688415 - DNA, 25 bp, Mus musculus
gctaagaacggttagaatgccaaga

SEQ ID NO: 688416 - DNA, 25 bp, Mus musculus
gctaagaatagccagcccaaccgat

SEQ ID NO: 688417 - DNA, 25 bp, Mus musculus
gctaagaatagcgagcccaaccgat

SEQ ID NO: 688418 - DNA, 25 bp, Mus musculus
gctaagaatgccagcgaccacctat

SEQ ID NO: 688419 - DNA, 25 bp, Mus musculus
gctaagaatgcctgcgaccacctat

SEQ ID NO: 688420 - DNA, 25 bp, Mus musculus
gctaagaattgacgttcctgggaac

SEQ ID NO: 688421 - DNA, 25 bp, Mus musculus
gctaagaattgaggttcctgggaac

SEQ ID NO: 688422 - DNA, 25 bp, Mus musculus
gctaagacatggacctcgggaagcg

SEQ ID NO: 688423 - DNA, 25 bp, Mus musculus
gctaagacatggtcctcgggaagcg

SEQ ID NO: 688424 - DNA, 25 bp, Mus musculus
gctaagaccacaaatactgacaatg

SEQ ID NO: 688425 - DNA, 25 bp, Mus musculus
gctaagaccacatatactgacaatg

SEQ ID NO: 688426 - DNA, 25 bp, Mus musculus
gctaagagcactccaactgctgaag

SEQ ID NO: 688427 - DNA, 25 bp, Mus musculus
gctaagagcactgcaactgctgaag

SEQ ID NO: 688428 - DNA, 25 bp, Mus musculus
gctaagataattcccatagtgaacg

SEQ ID NO: 688429 - DNA, 25 bp, Mus musculus
gctaagataattgccatagtgaacg

SEQ ID NO: 688430 - DNA, 25 bp, Mus musculus
gctaagattgccagatttaacctcc

SEQ ID NO: 688431 - DNA, 25 bp, Mus musculus
gctaagattgcctgatttaacctcc

SEQ ID NO: 688432 - DNA, 25 bp, Mus musculus
gctaagcaaagtcggcagctcagta

SEQ ID NO: 688433 - DNA, 25 bp, Mus musculus
gctaagcaaagtgggcagctcagta

SEQ ID NO: 688434 - DNA, 25 bp, Mus musculus
gctaagcacggcagggacatcaaca

SEQ ID NO: 688435 - DNA, 25 bp, Mus musculus
gctaagcacggctgggacatcaaca

SEQ ID NO: 688436 - DNA, 25 bp, Mus musculus
gctaagccagaaccagagcgatctg

SEQ ID NO: 688437 - DNA, 25 bp, Mus musculus
gctaagccagaagcagagcgatctg

SEQ ID NO: 688438 - DNA, 25 bp, Mus musculus
gctaagccgcgtcttgatccatctc

SEQ ID NO: 688439 - DNA, 25 bp, Mus musculus
gctaagccgcgtgttgatccatctc

SEQ ID NO: 688440 - DNA, 25 bp, Mus musculus
gctaagccggtcagctttaccttcc

SEQ ID NO: 688441 - DNA, 25 bp, Mus musculus
gctaagccggtctgctttaccttcc

SEQ ID NO: 688442 - DNA, 25 bp, Mus musculus
gctaagcgagcgaaaaatttggcct

SEQ ID NO: 688443 - DNA, 25 bp, Mus musculus
gctaagcgagcgtaaaatttggcct

SEQ ID NO: 688444 - DNA, 25 bp, Mus musculus
gctaagctaagcctgttatccctcc

SEQ ID NO: 688445 - DNA, 25 bp, Mus musculus
gctaagctaagcgtgttatccctcc

SEQ ID NO: 688446 - DNA, 25 bp, Mus musculus
gctaagctggcccaggactttctgg

SEQ ID NO: 688447 - DNA, 25 bp, Mus musculus
gctaagctggccgaggactttctgg

SEQ ID NO: 688448 - DNA, 25 bp, Mus musculus
gctaaggaaaccattcccctccagg

SEQ ID NO: 688449 - DNA, 25 bp, Mus musculus
gctaaggaaacctttcccctccagg

SEQ ID NO: 688450 - DNA, 25 bp, Mus musculus
gctaaggagctgctcgaccttctct

SEQ ID NO: 688451 - DNA, 25 bp, Mus musculus
gctaaggagctggtcgaccttctct

SEQ ID NO: 688452 - DNA, 25 bp, Mus musculus
gctaaggatgccagctacccgtgct

SEQ ID NO: 688453 - DNA, 25 bp, Mus musculus
gctaaggatgcctgctacccgtgct

SEQ ID NO: 688454 - DNA, 25 bp, Mus musculus
gctaaggatggacattttgccctgg

SEQ ID NO: 688455 - DNA, 25 bp, Mus musculus
gctaaggatggagattttgccctgg

SEQ ID NO: 688456 - DNA, 25 bp, Mus musculus
gctaaggatgtcactcttctgagca

SEQ ID NO: 688457 - DNA, 25 bp, Mus musculus
gctaaggatgtctctcttctgagca

SEQ ID NO: 688458 - DNA, 25 bp, Mus musculus
gctaaggccagactaccagcttcac

SEQ ID NO: 688459 - DNA, 25 bp, Mus musculus
gctaaggccagacttctttgactct

SEQ ID NO: 688460 - DNA, 25 bp, Mus musculus
gctaaggccagagtaccagcttcac

SEQ ID NO: 688461 - DNA, 25 bp, Mus musculus
gctaaggccagagttctttgactct

SEQ ID NO: 688462 - DNA, 25 bp, Mus musculus
gctaaggccttgctagaaaacggtg

SEQ ID NO: 688463 - DNA, 25 bp, Mus musculus
gctaaggccttggtagaaaacggtg

SEQ ID NO: 688464 - DNA, 25 bp, Mus musculus
gctaagggactaactgctgcctgga

SEQ ID NO: 688465 - DNA, 25 bp, Mus musculus
gctaagggactatctgctgcctgga

SEQ ID NO: 688466 - DNA, 25 bp, Mus musculus
gctaaggtgaatcgcaccacggtgt

SEQ ID NO: 688467 - DNA, 25 bp, Mus musculus
gctaaggtgaatggcaccacggtgt

SEQ ID NO: 688468 - DNA, 25 bp, Mus musculus
gctaaggttcacaagccctgctttt

SEQ ID NO: 688469 - DNA, 25 bp, Mus musculus
gctaaggttcactagccctgctttt

SEQ ID NO: 688470 - DNA, 25 bp, Mus musculus
gctaagtaaaagcactgacggataa

SEQ ID NO: 688471 - DNA, 25 bp, Mus musculus
gctaagtaaaaggactgacggataa

SEQ ID NO: 688472 - DNA, 25 bp, Mus musculus
gctaagtagcgtccaggagtccgat

SEQ ID NO: 688473 - DNA, 25 bp, Mus musculus
gctaagtagcgtgcaggagtccgat

SEQ ID NO: 688474 - DNA, 25 bp, Mus musculus
gctaagtatggcctaagattctggg

SEQ ID NO: 688475 - DNA, 25 bp, Mus musculus
gctaagtatggcgtaagattctggg

SEQ ID NO: 688476 - DNA, 25 bp, Mus musculus
gctaagtctgatcaaatgtgctgcc

SEQ ID NO: 688477 - DNA, 25 bp, Mus musculus
gctaagtctgatgaaatgtgctgcc

SEQ ID NO: 688478 - DNA, 25 bp, Mus musculus
gctaagtcttaactctctttcctag

SEQ ID NO: 688479 - DNA, 25 bp, Mus musculus
gctaagtcttaagtctctttcctag

SEQ ID NO: 688480 - DNA, 25 bp, Mus musculus
gctaagtcttcaatacagaagggta

SEQ ID NO: 688481 - DNA, 25 bp, Mus musculus
gctaagtcttcattacagaagggta

SEQ ID NO: 688482 - DNA, 25 bp, Mus musculus
gctaagtggcacaaggagcctggcc

SEQ ID NO: 688483 - DNA, 25 bp, Mus musculus
gctaagtggcactaggagcctggcc

SEQ ID NO: 688484 - DNA, 25 bp, Mus musculus
gctaagtgggaacgtgtcagaacaa

SEQ ID NO: 688485 - DNA, 25 bp, Mus musculus
gctaagtgggaaggtgtcagaacaa

SEQ ID NO: 688486 - DNA, 25 bp, Mus musculus
gctaagtgtggcaggcctctttccc

SEQ ID NO: 688487 - DNA, 25 bp, Mus musculus
gctaagtgtggctggcctctttccc

SEQ ID NO: 688488 - DNA, 25 bp, Mus musculus
gctaagttcagaagattctgcagca

SEQ ID NO: 688489 - DNA, 25 bp, Mus musculus
gctaagttcagatgattctgcagca

SEQ ID NO: 688490 - DNA, 25 bp, Mus musculus
gctaagttccggcatgtggcacatg

SEQ ID NO: 688491 - DNA, 25 bp, Mus musculus
gctaagttccgggatgtggcacatg

SEQ ID NO: 688492 - DNA, 25 bp, Mus musculus
gctaagttgacaaggatccgctcag

SEQ ID NO: 688493 - DNA, 25 bp, Mus musculus
gctaagttgacatggatccgctcag

SEQ ID NO: 688494 - DNA, 25 bp, Mus musculus
gctaataaagttccggcgcgtgcac

SEQ ID NO: 688495 - DNA, 25 bp, Mus musculus
gctaataaagttgcggcgcgtgcac

SEQ ID NO: 688496 - DNA, 25 bp, Mus musculus
gctaataagaagagaagtcggatcc

SEQ ID NO: 688497 - DNA, 25 bp, Mus musculus
gctaataagaagtgaagtcggatcc

SEQ ID NO: 688498 - DNA, 25 bp, Mus musculus
gctaataagactcaaggccgcatca

SEQ ID NO: 688499 - DNA, 25 bp, Mus musculus
gctaataagactgaaggccgcatca

SEQ ID NO: 688500 - DNA, 25 bp, Mus musculus
gctaatacagagattcactgacagg

SEQ ID NO: 688501 - DNA, 25 bp, Mus musculus
gctaatacagagtttcactgacagg

SEQ ID NO: 688502 - DNA, 25 bp, Mus musculus
gctaatacatgcagcttcagagagg

SEQ ID NO: 688503 - DNA, 25 bp, Mus musculus
gctaatacatgctgcttcagagagg

SEQ ID NO: 688504 - DNA, 25 bp, Mus musculus
gctaatactctgctgtgcgggtcat

SEQ ID NO: 688505 - DNA, 25 bp, Mus musculus
gctaatactctggtgtgcgggtcat

SEQ ID NO: 688506 - DNA, 25 bp, Mus musculus
gctaatagagttaggaagccttacg

SEQ ID NO: 688507 - DNA, 25 bp, Mus musculus
gctaatagagtttggaagccttacg

SEQ ID NO: 688508 - DNA, 25 bp, Mus musculus
gctaatataacacgctttgagtttg

SEQ ID NO: 688509 - DNA, 25 bp, Mus musculus
gctaatataacaggctttgagtttg

SEQ ID NO: 688510 - DNA, 25 bp, Mus musculus
gctaatatggtactagatgctgtgc

SEQ ID NO: 688511 - DNA, 25 bp, Mus musculus
gctaatatggtagtagatgctgtgc

SEQ ID NO: 688512 - DNA, 25 bp, Mus musculus
gctaatcaaatacatatggccttgg

SEQ ID NO: 688513 - DNA, 25 bp, Mus musculus
gctaatcaaatagatatggccttgg

SEQ ID NO: 688514 - DNA, 25 bp, Mus musculus
gctaatcaagagagaaaaacctgaa

SEQ ID NO: 688515 - DNA, 25 bp, Mus musculus
gctaatcaagagtgaaaaacctgaa

SEQ ID NO: 688516 - DNA, 25 bp, Mus musculus
gctaatcattgaaggacagcagcta

SEQ ID NO: 688517 - DNA, 25 bp, Mus musculus
gctaatcattgatggacagcagcta

SEQ ID NO: 688518 - DNA, 25 bp, Mus musculus
gctaatccacacctatgtccagaag

SEQ ID NO: 688519 - DNA, 25 bp, Mus musculus
gctaatccacacgtatgtccagaag

SEQ ID NO: 688520 - DNA, 25 bp, Mus musculus
gctaatcctgggagccattggcaaa

SEQ ID NO: 688521 - DNA, 25 bp, Mus musculus
gctaatcctgggtgccattggcaaa

SEQ ID NO: 688522 - DNA, 25 bp, Mus musculus
gctaatcggaagacacaagaacatc

SEQ ID NO: 688523 - DNA, 25 bp, Mus musculus
gctaatcggaagtcacaagaacatc

SEQ ID NO: 688524 - DNA, 25 bp, Mus musculus
gctaatctccttcagggtgtaatga

SEQ ID NO: 688525 - DNA, 25 bp, Mus musculus
gctaatctccttgagggtgtaatga

SEQ ID NO: 688526 - DNA, 25 bp, Mus musculus
gctaatgaagagactgaatggctcc

SEQ ID NO: 688527 - DNA, 25 bp, Mus musculus
gctaatgaagagtctgaatggctcc

SEQ ID NO: 688528 - DNA, 25 bp, Mus musculus
gctaatggaataattggctgttgct

SEQ ID NO: 688529 - DNA, 25 bp, Mus musculus
gctaatggaatatttggctgttgct

SEQ ID NO: 688530 - DNA, 25 bp, Mus musculus
gctaatggcaaaatcctctacagtg

SEQ ID NO: 688531 - DNA, 25 bp, Mus musculus
gctaatggcaaattcctctacagtg

SEQ ID NO: 688532 - DNA, 25 bp, Mus musculus
gctaatgggatgagcctccagccgc

SEQ ID NO: 688533 - DNA, 25 bp, Mus musculus
gctaatgggatgtgcctccagccgc

SEQ ID NO: 688534 - DNA, 25 bp, Mus musculus
gctaattacttccattcagaggacg

SEQ ID NO: 688535 - DNA, 25 bp, Mus musculus
gctaattacttcgattcagaggacg

SEQ ID NO: 688536 - DNA, 25 bp, Mus musculus
gctaattatcttatgggttcgacac

SEQ ID NO: 688537 - DNA, 25 bp, Mus musculus
gctaattatcttttgggttcgacac

SEQ ID NO: 688538 - DNA, 25 bp, Mus musculus
gctaattattatcacccctttcccg

SEQ ID NO: 688539 - DNA, 25 bp, Mus musculus
gctaattattatgacccctttcccg

SEQ ID NO: 688540 - DNA, 25 bp, Mus musculus
gctaattgcacacgactgcgggccg

SEQ ID NO: 688541 - DNA, 25 bp, Mus musculus
gctaattgcacaggactgcgggccg

SEQ ID NO: 688542 - DNA, 25 bp, Mus musculus
gctaattggactataacaccattga

SEQ ID NO: 688543 - DNA, 25 bp, Mus musculus
gctaattggactttaacaccattga

SEQ ID NO: 688544 - DNA, 25 bp, Mus musculus
gctaattgtaagatgtgggcctctg

SEQ ID NO: 688545 - DNA, 25 bp, Mus musculus
gctaattgtaagttgtgggcctctg

SEQ ID NO: 688546 - DNA, 25 bp, Mus musculus
gctaatttaaacaaaagggcctctg

SEQ ID NO: 688547 - DNA, 25 bp, Mus musculus
gctaatttaaactaaagggcctctg

SEQ ID NO: 688548 - DNA, 25 bp, Mus musculus
gctaatttcagaattgctgtggctt

SEQ ID NO: 688549 - DNA, 25 bp, Mus musculus
gctaatttcagatttgctgtggctt

SEQ ID NO: 688550 - DNA, 25 bp, Mus musculus
gctacaaacagaccagatacactgg

SEQ ID NO: 688551 - DNA, 25 bp, Mus musculus
gctacaaacagagcagatacactgg

SEQ ID NO: 688552 - DNA, 25 bp, Mus musculus
gctacaaaccagacagtataatggg

SEQ ID NO: 688553 - DNA, 25 bp, Mus musculus
gctacaaaccagtcagtataatggg

SEQ ID NO: 688554 - DNA, 25 bp, Mus musculus
gctacaaactccatggagggcttgc

SEQ ID NO: 688555 - DNA, 25 bp, Mus musculus
gctacaaactccttggagggcttgc

SEQ ID NO: 688556 - DNA, 25 bp, Mus musculus
gctacaaactctcctactcagcaga

SEQ ID NO: 688557 - DNA, 25 bp, Mus musculus
gctacaaactctgctactcagcaga

SEQ ID NO: 688558 - DNA, 25 bp, Mus musculus
gctacaaactgcacagcactgaagg

SEQ ID NO: 688559 - DNA, 25 bp, Mus musculus
gctacaaactgctcagcactgaagg

SEQ ID NO: 688560 - DNA, 25 bp, Mus musculus
gctacaaagcttaggctgaggttga

SEQ ID NO: 688561 - DNA, 25 bp, Mus musculus
gctacaaagctttggctgaggttga

SEQ ID NO: 688562 - DNA, 25 bp, Mus musculus
gctacaaatactccccatgcttaca

SEQ ID NO: 688563 - DNA, 25 bp, Mus musculus
gctacaaatactgcccatgcttaca

SEQ ID NO: 688564 - DNA, 25 bp, Mus musculus
gctacaaatgcacgcgtaagtcttc

SEQ ID NO: 688565 - DNA, 25 bp, Mus musculus
gctacaaatgcaggcgtaagtcttc

SEQ ID NO: 688566 - DNA, 25 bp, Mus musculus
gctacaaatggaaagtcagaggcca

SEQ ID NO: 688567 - DNA, 25 bp, Mus musculus
gctacaaatggatagtcagaggcca

SEQ ID NO: 688568 - DNA, 25 bp, Mus musculus
gctacaacaaagagctctccatggt

SEQ ID NO: 688569 - DNA, 25 bp, Mus musculus
gctacaacaaagtgctctccatggt

SEQ ID NO: 688570 - DNA, 25 bp, Mus musculus
gctacaacacacaactatgaccgag

SEQ ID NO: 688571 - DNA, 25 bp, Mus musculus
gctacaacacactactatgaccgag

SEQ ID NO: 688572 - DNA, 25 bp, Mus musculus
gctacaacataaactatacacccag

SEQ ID NO: 688573 - DNA, 25 bp, Mus musculus
gctacaacataatctatacacccag

SEQ ID NO: 688574 - DNA, 25 bp, Mus musculus
gctacaacgcttctctgacagactc

SEQ ID NO: 688575 - DNA, 25 bp, Mus musculus
gctacaacgcttgtctgacagactc

SEQ ID NO: 688576 - DNA, 25 bp, Mus musculus
gctacaactaaaccagaagaccgaa

SEQ ID NO: 688577 - DNA, 25 bp, Mus musculus
gctacaactaaagcagaagaccgaa

SEQ ID NO: 688578 - DNA, 25 bp, Mus musculus
gctacaacttgtatccagcccagta

SEQ ID NO: 688579 - DNA, 25 bp, Mus musculus
gctacaacttgtttccagcccagta

SEQ ID NO: 688580 - DNA, 25 bp, Mus musculus
gctacaagaattccttggagacggt

SEQ ID NO: 688581 - DNA, 25 bp, Mus musculus
gctacaagaattgcttggagacggt

SEQ ID NO: 688582 - DNA, 25 bp, Mus musculus
gctacaagagcgatgtacaagccaa

SEQ ID NO: 688583 - DNA, 25 bp, Mus musculus
gctacaagagcgttgtacaagccaa

SEQ ID NO: 688584 - DNA, 25 bp, Mus musculus
gctacaagaggacatggcgctgatt

SEQ ID NO: 688585 - DNA, 25 bp, Mus musculus
gctacaagaggagatggcgctgatt

SEQ ID NO: 688586 - DNA, 25 bp, Mus musculus
gctacaagaggcacaacagcaccca

SEQ ID NO: 688587 - DNA, 25 bp, Mus musculus
gctacaagaggctcaacagcaccca

SEQ ID NO: 688588 - DNA, 25 bp, Mus musculus
gctacaagatctcttcctgtggaca

SEQ ID NO: 688589 - DNA, 25 bp, Mus musculus
gctacaagatctgttcctgtggaca

SEQ ID NO: 688590 - DNA, 25 bp, Mus musculus
gctacaaggaccaatcgcaattctg

SEQ ID NO: 688591 - DNA, 25 bp, Mus musculus
gctacaaggacctatcgcaattctg

SEQ ID NO: 688592 - DNA, 25 bp, Mus musculus
gctacaaggcaacggcatgggatat

SEQ ID NO: 688593 - DNA, 25 bp, Mus musculus
gctacaaggcaagggcatgggatat

SEQ ID NO: 688594 - DNA, 25 bp, Mus musculus
gctacaaggcgcacacctgtgagcc

SEQ ID NO: 688595 - DNA, 25 bp, Mus musculus
gctacaaggcgctcacctgtgagcc

SEQ ID NO: 688596 - DNA, 25 bp, Mus musculus
gctacaagggccatcaggccctgca

SEQ ID NO: 688597 - DNA, 25 bp, Mus musculus
gctacaagggccttcaggccctgca

SEQ ID NO: 688598 - DNA, 25 bp, Mus musculus
gctacaagtgatcgtcaatgacctc

SEQ ID NO: 688599 - DNA, 25 bp, Mus musculus
gctacaagtgatggtcaatgacctc

SEQ ID NO: 688600 - DNA, 25 bp, Mus musculus
gctacaatagagagatggagagcag

SEQ ID NO: 688601 - DNA, 25 bp, Mus musculus
gctacaatagagtgatggagagcag

SEQ ID NO: 688602 - DNA, 25 bp, Mus musculus
gctacaatgcatattatgcacaggc

SEQ ID NO: 688603 - DNA, 25 bp, Mus musculus
gctacaatgcattttatgcacaggc

SEQ ID NO: 688604 - DNA, 25 bp, Mus musculus
gctacaatgtgtccatctttgccta

SEQ ID NO: 688605 - DNA, 25 bp, Mus musculus
gctacaatgtgtgcatctttgccta

SEQ ID NO: 688606 - DNA, 25 bp, Mus musculus
gctacacacgaacctgtcttataaa

SEQ ID NO: 688607 - DNA, 25 bp, Mus musculus
gctacacacgaagctgtcttataaa

SEQ ID NO: 688608 - DNA, 25 bp, Mus musculus
gctacacacttgatgactgaaggaa

SEQ ID NO: 688609 - DNA, 25 bp, Mus musculus
gctacacacttgttgactgaaggaa

SEQ ID NO: 688610 - DNA, 25 bp, Mus musculus
gctacacagaagcatgctatctcct

SEQ ID NO: 688611 - DNA, 25 bp, Mus musculus
gctacacagaaggatgctatctcct

SEQ ID NO: 688612 - DNA, 25 bp, Mus musculus
gctacacagaccacgtgggcttcag

SEQ ID NO: 688613 - DNA, 25 bp, Mus musculus
gctacacagacctcgtgggcttcag

SEQ ID NO: 688614 - DNA, 25 bp, Mus musculus
gctacacatccgaagcaacaagcag

SEQ ID NO: 688615 - DNA, 25 bp, Mus musculus
gctacacatccgtagcaacaagcag

SEQ ID NO: 688616 - DNA, 25 bp, Mus musculus
gctacacatgacatccagtccaaag

SEQ ID NO: 688617 - DNA, 25 bp, Mus musculus
gctacacatgacttccagtccaaag

SEQ ID NO: 688618 - DNA, 25 bp, Mus musculus
gctacaccactgcatggaaaccagg

SEQ ID NO: 688619 - DNA, 25 bp, Mus musculus
gctacaccactggatggaaaccagg

SEQ ID NO: 688620 - DNA, 25 bp, Mus musculus
gctacaccatatctgcttaataaat

SEQ ID NO: 688621 - DNA, 25 bp, Mus musculus
gctacaccatatgtgcttaataaat

SEQ ID NO: 688622 - DNA, 25 bp, Mus musculus
gctacacccggtccagctttttggg

SEQ ID NO: 688623 - DNA, 25 bp, Mus musculus
gctacacccggtgcagctttttggg

SEQ ID NO: 688624 - DNA, 25 bp, Mus musculus
gctacaccgactacgattaaagtta

SEQ ID NO: 688625 - DNA, 25 bp, Mus musculus
gctacaccgacttcgattaaagtta

SEQ ID NO: 688626 - DNA, 25 bp, Mus musculus
gctacaccgggaatggaaccacgtg

SEQ ID NO: 688627 - DNA, 25 bp, Mus musculus
gctacaccgggattggaaccacgtg

SEQ ID NO: 688628 - DNA, 25 bp, Mus musculus
gctacaccgtagaaaatgcaaagga

SEQ ID NO: 688629 - DNA, 25 bp, Mus musculus
gctacaccgtagtaaatgcaaagga

SEQ ID NO: 688630 - DNA, 25 bp, Mus musculus
gctacacctggtcccgagagtctgg

SEQ ID NO: 688631 - DNA, 25 bp, Mus musculus
gctacacctggtgccgagagtctgg

SEQ ID NO: 688632 - DNA, 25 bp, Mus musculus
gctacacgatatcgtcacagcggag

SEQ ID NO: 688633 - DNA, 25 bp, Mus musculus
gctacacgatatggtcacagcggag

SEQ ID NO: 688634 - DNA, 25 bp, Mus musculus
gctacacggaggaagaagccaaggc

SEQ ID NO: 688635 - DNA, 25 bp, Mus musculus
gctacacggaggtagaagccaaggc

SEQ ID NO: 688636 - DNA, 25 bp, Mus musculus
gctacacggtgacacaaacacaaga

SEQ ID NO: 688637 - DNA, 25 bp, Mus musculus
gctacacggtgagacaaacacaaga

SEQ ID NO: 688638 - DNA, 25 bp, Mus musculus
gctacactgtaacctctgtggagca

SEQ ID NO: 688639 - DNA, 25 bp, Mus musculus
gctacactgtaagctctgtggagca

SEQ ID NO: 688640 - DNA, 25 bp, Mus musculus
gctacactgtcccaaatgttgcccg

SEQ ID NO: 688641 - DNA, 25 bp, Mus musculus
gctacactgtccgaaatgttgcccg

SEQ ID NO: 688642 - DNA, 25 bp, Mus musculus
gctacactgtctctgcagcttcagt

SEQ ID NO: 688643 - DNA, 25 bp, Mus musculus
gctacactgtctgtgcagcttcagt

SEQ ID NO: 688644 - DNA, 25 bp, Mus musculus
gctacagaaaagagcaggagcgcct

SEQ ID NO: 688645 - DNA, 25 bp, Mus musculus
gctacagaaaagtgcaggagcgcct

SEQ ID NO: 688646 - DNA, 25 bp, Mus musculus
gctacagaacgactggctgcccttt

SEQ ID NO: 688647 - DNA, 25 bp, Mus musculus
gctacagaacgagtggctgcccttt

SEQ ID NO: 688648 - DNA, 25 bp, Mus musculus
gctacagaagacaaaggcaaacaac

SEQ ID NO: 688649 - DNA, 25 bp, Mus musculus
gctacagaagactaaggcaaacaac

SEQ ID NO: 688650 - DNA, 25 bp, Mus musculus
gctacagaatatcaccgcgggcgac

SEQ ID NO: 688651 - DNA, 25 bp, Mus musculus
gctacagaatatgaccgcgggcgac

SEQ ID NO: 688652 - DNA, 25 bp, Mus musculus
gctacagactatagaagactggaat

SEQ ID NO: 688653 - DNA, 25 bp, Mus musculus
gctacagactattgaagactggaat

SEQ ID NO: 688654 - DNA, 25 bp, Mus musculus
gctacagagatgagtctgatttaaa

SEQ ID NO: 688655 - DNA, 25 bp, Mus musculus
gctacagagatgtgtctgatttaaa

SEQ ID NO: 688656 - DNA, 25 bp, Mus musculus
gctacagagcaacatgacactggtg

SEQ ID NO: 688657 - DNA, 25 bp, Mus musculus
gctacagagcaagatgacactggtg

SEQ ID NO: 688658 - DNA, 25 bp, Mus musculus
gctacagaggatcgaattcatgtgc

SEQ ID NO: 688659 - DNA, 25 bp, Mus musculus
gctacagaggatggaattcatgtgc

SEQ ID NO: 688660 - DNA, 25 bp, Mus musculus
gctacagcaacacctgagccacttt

SEQ ID NO: 688661 - DNA, 25 bp, Mus musculus
gctacagcaacagctgagccacttt

SEQ ID NO: 688662 - DNA, 25 bp, Mus musculus
gctacagcaatgcaccgggcagcag

SEQ ID NO: 688663 - DNA, 25 bp, Mus musculus
gctacagcaatggaccgggcagcag

SEQ ID NO: 688664 - DNA, 25 bp, Mus musculus
gctacagccaggcacggcttacaaa

SEQ ID NO: 688665 - DNA, 25 bp, Mus musculus
gctacagccagggacggcttacaaa

SEQ ID NO: 688666 - DNA, 25 bp, Mus musculus
gctacagccatgatgattaaagcgg

SEQ ID NO: 688667 - DNA, 25 bp, Mus musculus
gctacagccatgttgattaaagcgg

SEQ ID NO: 688668 - DNA, 25 bp, Mus musculus
gctacagccgctatggacacagaga

SEQ ID NO: 688669 - DNA, 25 bp, Mus musculus
gctacagccgctttggacacagaga

SEQ ID NO: 688670 - DNA, 25 bp, Mus musculus
gctacagccgtgacatgggtgcatg

SEQ ID NO: 688671 - DNA, 25 bp, Mus musculus
gctacagccgtgtcatgggtgcatg

SEQ ID NO: 688672 - DNA, 25 bp, Mus musculus
gctacagcgatgatgaaagctcagt

SEQ ID NO: 688673 - DNA, 25 bp, Mus musculus
gctacagcgatgttgaaagctcagt

SEQ ID NO: 688674 - DNA, 25 bp, Mus musculus
gctacagcgctgctgtcacactctt

SEQ ID NO: 688675 - DNA, 25 bp, Mus musculus
gctacagcgctggtgtcacactctt

SEQ ID NO: 688676 - DNA, 25 bp, Mus musculus
gctacagcgtatccggcatgaattc

SEQ ID NO: 688677 - DNA, 25 bp, Mus musculus
gctacagcgtatccgtgccaaggga

SEQ ID NO: 688678 - DNA, 25 bp, Mus musculus
gctacagcgtatgcggcatgaattc

SEQ ID NO: 688679 - DNA, 25 bp, Mus musculus
gctacagcgtatgcgtgccaaggga

SEQ ID NO: 688680 - DNA, 25 bp, Mus musculus
gctacagctatcacctggatgtgct

SEQ ID NO: 688681 - DNA, 25 bp, Mus musculus
gctacagctatctcctggatgtgct

SEQ ID NO: 688682 - DNA, 25 bp, Mus musculus
gctacagctcctacaggacagactc

SEQ ID NO: 688683 - DNA, 25 bp, Mus musculus
gctacagctccttcaggacagactc

SEQ ID NO: 688684 - DNA, 25 bp, Mus musculus
gctacagctggcactggccctatca

SEQ ID NO: 688685 - DNA, 25 bp, Mus musculus
gctacagctggctctggccctatca

SEQ ID NO: 688686 - DNA, 25 bp, Mus musculus
gctacaggaattcaaagagaagggc

SEQ ID NO: 688687 - DNA, 25 bp, Mus musculus
gctacaggaattgaaagagaagggc

SEQ ID NO: 688688 - DNA, 25 bp, Mus musculus
gctacaggcactattccttattcag

SEQ ID NO: 688689 - DNA, 25 bp, Mus musculus
gctacaggcactctgtctgctctgc

SEQ ID NO: 688690 - DNA, 25 bp, Mus musculus
gctacaggcactgtgtctgctctgc

SEQ ID NO: 688691 - DNA, 25 bp, Mus musculus
gctacaggcacttttccttattcag

SEQ ID NO: 688692 - DNA, 25 bp, Mus musculus
gctacaggccctaccgagggcgtgc

SEQ ID NO: 688693 - DNA, 25 bp, Mus musculus
gctacaggcccttccgagggcgtgc

SEQ ID NO: 688694 - DNA, 25 bp, Mus musculus
gctacaggtcaaccgcctccaggag

SEQ ID NO: 688695 - DNA, 25 bp, Mus musculus
gctacaggtcaagcgcctccaggag

SEQ ID NO: 688696 - DNA, 25 bp, Mus musculus
gctacagtgacgacatacctgaaac

SEQ ID NO: 688697 - DNA, 25 bp, Mus musculus
gctacagtgacgtcatacctgaaac

SEQ ID NO: 688698 - DNA, 25 bp, Mus musculus
gctacagtgagtagtatacgttttc

SEQ ID NO: 688699 - DNA, 25 bp, Mus musculus
gctacagtgagttgtatacgttttc

SEQ ID NO: 688700 - DNA, 25 bp, Mus musculus
gctacagtgccccttttaaaaatgg

SEQ ID NO: 688701 - DNA, 25 bp, Mus musculus
gctacagtgcccgttttaaaaatgg

SEQ ID NO: 688702 - DNA, 25 bp, Mus musculus
gctacagtggagagtatgtacggcc

SEQ ID NO: 688703 - DNA, 25 bp, Mus musculus
gctacagtggagtgtatgtacggcc

SEQ ID NO: 688704 - DNA, 25 bp, Mus musculus
gctacagtgtacagtgataagctct

SEQ ID NO: 688705 - DNA, 25 bp, Mus musculus
gctacagtgtactgtgataagctct

SEQ ID NO: 688706 - DNA, 25 bp, Mus musculus
gctacagtttctctagatccttgaa

SEQ ID NO: 688707 - DNA, 25 bp, Mus musculus
gctacagtttctgtagatccttgaa

SEQ ID NO: 688708 - DNA, 25 bp, Mus musculus
gctacatagtcaccacgaagactgg

SEQ ID NO: 688709 - DNA, 25 bp, Mus musculus
gctacatagtcagcacgaagactgg

SEQ ID NO: 688710 - DNA, 25 bp, Mus musculus
gctacatcacagactgcgtggatag

SEQ ID NO: 688711 - DNA, 25 bp, Mus musculus
gctacatcacagtctgcgtggatag

SEQ ID NO: 688712 - DNA, 25 bp, Mus musculus
gctacatccattacgggcagactgt

SEQ ID NO: 688713 - DNA, 25 bp, Mus musculus
gctacatccatttcgggcagactgt

SEQ ID NO: 688714 - DNA, 25 bp, Mus musculus
gctacatcctggaggtctatggtgt

SEQ ID NO: 688715 - DNA, 25 bp, Mus musculus
gctacatcctggtggtctatggtgt

SEQ ID NO: 688716 - DNA, 25 bp, Mus musculus
gctacatcgcgccatgcagaattct

SEQ ID NO: 688717 - DNA, 25 bp, Mus musculus
gctacatcgcgcgatgcagaattct

SEQ ID NO: 688718 - DNA, 25 bp, Mus musculus
gctacatctactatggcgaggtcaa

SEQ ID NO: 688719 - DNA, 25 bp, Mus musculus
gctacatctactttggcgaggtcaa

SEQ ID NO: 688720 - DNA, 25 bp, Mus musculus
gctacatctgcccagtgaatgtgta

SEQ ID NO: 688721 - DNA, 25 bp, Mus musculus
gctacatctgccgagtgaatgtgta

SEQ ID NO: 688722 - DNA, 25 bp, Mus musculus
gctacatgccgtcgtagtccatgga

SEQ ID NO: 688723 - DNA, 25 bp, Mus musculus
gctacatgccgtggtagtccatgga

SEQ ID NO: 688724 - DNA, 25 bp, Mus musculus
gctacatgccttaccaagctcgtgt

SEQ ID NO: 688725 - DNA, 25 bp, Mus musculus
gctacatgcctttccaagctcgtgt

SEQ ID NO: 688726 - DNA, 25 bp, Mus musculus
gctacatgctcgagatgcgcaatat

SEQ ID NO: 688727 - DNA, 25 bp, Mus musculus
gctacatgctcgtgatgcgcaatat

SEQ ID NO: 688728 - DNA, 25 bp, Mus musculus
gctacatgctgcagtggcagcgagg

SEQ ID NO: 688729 - DNA, 25 bp, Mus musculus
gctacatgctgctgtggcagcgagg

SEQ ID NO: 688730 - DNA, 25 bp, Mus musculus
gctacatgctgtaaagaaagatcag

SEQ ID NO: 688731 - DNA, 25 bp, Mus musculus
gctacatgctgttaagaaagatcag

SEQ ID NO: 688732 - DNA, 25 bp, Mus musculus
gctacatggccccttatgataacta

SEQ ID NO: 688733 - DNA, 25 bp, Mus musculus
gctacatggcccgttatgataacta

SEQ ID NO: 688734 - DNA, 25 bp, Mus musculus
gctacatgtattaccgtgaccgcag

SEQ ID NO: 688735 - DNA, 25 bp, Mus musculus
gctacatgtatttccgtgaccgcag

SEQ ID NO: 688736 - DNA, 25 bp, Mus musculus
gctacatgtctcacttccaggtcaa

SEQ ID NO: 688737 - DNA, 25 bp, Mus musculus
gctacatgtctctcttccaggtcaa

SEQ ID NO: 688738 - DNA, 25 bp, Mus musculus
gctacatgttcgacaatctggcctg

SEQ ID NO: 688739 - DNA, 25 bp, Mus musculus
gctacatgttcgtcaatctggcctg

SEQ ID NO: 688740 - DNA, 25 bp, Mus musculus
gctacattaaacctgaagatctatc

SEQ ID NO: 688741 - DNA, 25 bp, Mus musculus
gctacattaaacgtgaagatctatc

SEQ ID NO: 688742 - DNA, 25 bp, Mus musculus
gctaccaaaaagaggtcctttctgg

SEQ ID NO: 688743 - DNA, 25 bp, Mus musculus
gctaccaaaaagtggtcctttctgg

SEQ ID NO: 688744 - DNA, 25 bp, Mus musculus
gctaccaaatagctgtgaacctaac

SEQ ID NO: 688745 - DNA, 25 bp, Mus musculus
gctaccaaataggtgtgaacctaac

SEQ ID NO: 688746 - DNA, 25 bp, Mus musculus
gctaccacagctacaggagacacag

SEQ ID NO: 688747 - DNA, 25 bp, Mus musculus
gctaccacagcttcaggagacacag

SEQ ID NO: 688748 - DNA, 25 bp, Mus musculus
gctaccacgtaccagtggtggttgt

SEQ ID NO: 688749 - DNA, 25 bp, Mus musculus
gctaccacgtacgagtggtggttgt

SEQ ID NO: 688750 - DNA, 25 bp, Mus musculus
gctaccactctgaaccaggcacatg

SEQ ID NO: 688751 - DNA, 25 bp, Mus musculus
gctaccactctgtaccaggcacatg

SEQ ID NO: 688752 - DNA, 25 bp, Mus musculus
gctaccactgcacccgtctatgaag

SEQ ID NO: 688753 - DNA, 25 bp, Mus musculus
gctaccactgcagccgtctatgaag

SEQ ID NO: 688754 - DNA, 25 bp, Mus musculus
gctaccagcctcatgaccctgataa

SEQ ID NO: 688755 - DNA, 25 bp, Mus musculus
gctaccagcctcttgaccctgataa

SEQ ID NO: 688756 - DNA, 25 bp, Mus musculus
gctaccagtagtccagtttcaaagg

SEQ ID NO: 688757 - DNA, 25 bp, Mus musculus
gctaccagtagtgcagtttcaaagg

SEQ ID NO: 688758 - DNA, 25 bp, Mus musculus
gctaccagtcgcagggctactgagc

SEQ ID NO: 688759 - DNA, 25 bp, Mus musculus
gctaccagtcgctgggctactgagc

SEQ ID NO: 688760 - DNA, 25 bp, Mus musculus
gctaccatacctatgtctgtggatg

SEQ ID NO: 688761 - DNA, 25 bp, Mus musculus
gctaccatacctttgtctgtggatg

SEQ ID NO: 688762 - DNA, 25 bp, Mus musculus
gctaccatctatcatgtcctatcaa

SEQ ID NO: 688763 - DNA, 25 bp, Mus musculus
gctaccatctatgatgtcctatcaa

SEQ ID NO: 688764 - DNA, 25 bp, Mus musculus
gctaccatgggtctaactgctccga

SEQ ID NO: 688765 - DNA, 25 bp, Mus musculus
gctaccatgggtgtaactgctccga

SEQ ID NO: 688766 - DNA, 25 bp, Mus musculus
gctacccaccatactgctccgagac

SEQ ID NO: 688767 - DNA, 25 bp, Mus musculus
gctacccaccattctgctccgagac

SEQ ID NO: 688768 - DNA, 25 bp, Mus musculus
gctacccagcagcagacgtgtttca

SEQ ID NO: 688769 - DNA, 25 bp, Mus musculus
gctacccagcaggagacgtgtttca

SEQ ID NO: 688770 - DNA, 25 bp, Mus musculus
gctacccaggagcaagtggaactct

SEQ ID NO: 688771 - DNA, 25 bp, Mus musculus
gctacccaggaggaagtggaactct

SEQ ID NO: 688772 - DNA, 25 bp, Mus musculus
gctacccaggcaaactaagtcccat

SEQ ID NO: 688773 - DNA, 25 bp, Mus musculus
gctacccaggcatactaagtcccat

SEQ ID NO: 688774 - DNA, 25 bp, Mus musculus
gctacccatatacagccccgtggag

SEQ ID NO: 688775 - DNA, 25 bp, Mus musculus
gctacccatatagagccccgtggag

SEQ ID NO: 688776 - DNA, 25 bp, Mus musculus
gctacccatggtctcatcgtggcct

SEQ ID NO: 688777 - DNA, 25 bp, Mus musculus
gctacccatggtgtcatcgtggcct

SEQ ID NO: 688778 - DNA, 25 bp, Mus musculus
gctaccccattgcaagtggccatca

SEQ ID NO: 688779 - DNA, 25 bp, Mus musculus
gctaccccattggaagtggccatca

SEQ ID NO: 688780 - DNA, 25 bp, Mus musculus
gctacccgacaacaagcacaaactg

SEQ ID NO: 688781 - DNA, 25 bp, Mus musculus
gctacccgacaagaagcacaaactg

SEQ ID NO: 688782 - DNA, 25 bp, Mus musculus
gctacccgtgaaaggcagtaactgt

SEQ ID NO: 688783 - DNA, 25 bp, Mus musculus
gctacccgtgaatggcagtaactgt

SEQ ID NO: 688784 - DNA, 25 bp, Mus musculus
gctaccctagtgcaggacaaaacca

SEQ ID NO: 688785 - DNA, 25 bp, Mus musculus
gctaccctagtggaggacaaaacca

SEQ ID NO: 688786 - DNA, 25 bp, Mus musculus
gctacccttgccactgagagaaatg

SEQ ID NO: 688787 - DNA, 25 bp, Mus musculus
gctacccttgcctctgagagaaatg

SEQ ID NO: 688788 - DNA, 25 bp, Mus musculus
gctaccgaaattcaattggctaaac

SEQ ID NO: 688789 - DNA, 25 bp, Mus musculus
gctaccgaaattgaattggctaaac

SEQ ID NO: 688790 - DNA, 25 bp, Mus musculus
gctaccgcctccacgtgggtgcagg

SEQ ID NO: 688791 - DNA, 25 bp, Mus musculus
gctaccgcctcctcgtgggtgcagg

SEQ ID NO: 688792 - DNA, 25 bp, Mus musculus
gctaccggagttcgtgagctcagtc

SEQ ID NO: 688793 - DNA, 25 bp, Mus musculus
gctaccggagttggtgagctcagtc

SEQ ID NO: 688794 - DNA, 25 bp, Mus musculus
gctacctcagagcatcggactccaa

SEQ ID NO: 688795 - DNA, 25 bp, Mus musculus
gctacctcagaggatcggactccaa

SEQ ID NO: 688796 - DNA, 25 bp, Mus musculus
gctacctcgattccgggcagaagaa

SEQ ID NO: 688797 - DNA, 25 bp, Mus musculus
gctacctcgattgcgggcagaagaa

SEQ ID NO: 688798 - DNA, 25 bp, Mus musculus
gctacctcgtggacttcggagtaaa

SEQ ID NO: 688799 - DNA, 25 bp, Mus musculus
gctacctcgtggtcttcggagtaaa

SEQ ID NO: 688800 - DNA, 25 bp, Mus musculus
gctacctctgcacatgactccaagg

SEQ ID NO: 688801 - DNA, 25 bp, Mus musculus
gctacctctgcagatgactccaagg

SEQ ID NO: 688802 - DNA, 25 bp, Mus musculus
gctacctgaagcaccgagagtacaa

SEQ ID NO: 688803 - DNA, 25 bp, Mus musculus
gctacctgaagctccgagagtacaa

SEQ ID NO: 688804 - DNA, 25 bp, Mus musculus
gctacctgaataagcttccggtgaa

SEQ ID NO: 688805 - DNA, 25 bp, Mus musculus
gctacctgaatatgcttccggtgaa

SEQ ID NO: 688806 - DNA, 25 bp, Mus musculus
gctacctgagtgagacacacttcca

SEQ ID NO: 688807 - DNA, 25 bp, Mus musculus
gctacctgagtgtgacacacttcca

SEQ ID NO: 688808 - DNA, 25 bp, Mus musculus
gctacctgcagactcaagttcttga

SEQ ID NO: 688809 - DNA, 25 bp, Mus musculus
gctacctgcagagtcaagttcttga

SEQ ID NO: 688810 - DNA, 25 bp, Mus musculus
gctacctgcccacctttcttgtgga

SEQ ID NO: 688811 - DNA, 25 bp, Mus musculus
gctacctgcccagctttcttgtgga

SEQ ID NO: 688812 - DNA, 25 bp, Mus musculus
gctacctggagcatcaactccgcag

SEQ ID NO: 688813 - DNA, 25 bp, Mus musculus
gctacctggagcttcaactccgcag

SEQ ID NO: 688814 - DNA, 25 bp, Mus musculus
gctacctgtgcacctgcaggcctgg

SEQ ID NO: 688815 - DNA, 25 bp, Mus musculus
gctacctgtgcagctgcaggcctgg

SEQ ID NO: 688816 - DNA, 25 bp, Mus musculus
gctaccttcatgaaaagaggtggca

SEQ ID NO: 688817 - DNA, 25 bp, Mus musculus
gctaccttcatgtaaagaggtggca

SEQ ID NO: 688818 - DNA, 25 bp, Mus musculus
gctaccttgactaggagaagtggga

SEQ ID NO: 688819 - DNA, 25 bp, Mus musculus
gctaccttgacttggagaagtggga

SEQ ID NO: 688820 - DNA, 25 bp, Mus musculus
gctacctttttaaagggtgcggagg

SEQ ID NO: 688821 - DNA, 25 bp, Mus musculus
gctacctttttatagggtgcggagg

SEQ ID NO: 688822 - DNA, 25 bp, Mus musculus
gctacgaactatacaagacgcaatg

SEQ ID NO: 688823 - DNA, 25 bp, Mus musculus
gctacgaactattcaagacgcaatg

SEQ ID NO: 688824 - DNA, 25 bp, Mus musculus
gctacgacctccagaacaagttcta

SEQ ID NO: 688825 - DNA, 25 bp, Mus musculus
gctacgacctcctgaacaagttcta

SEQ ID NO: 688826 - DNA, 25 bp, Mus musculus
gctacgacgtggagacagagacctg

SEQ ID NO: 688827 - DNA, 25 bp, Mus musculus
gctacgacgtggtgacagagacctg

SEQ ID NO: 688828 - DNA, 25 bp, Mus musculus
gctacgagaactatggttatggcta

SEQ ID NO: 688829 - DNA, 25 bp, Mus musculus
gctacgagaactttggttatggcta

SEQ ID NO: 688830 - DNA, 25 bp, Mus musculus
gctacgagttggctttgattctgaa

SEQ ID NO: 688831 - DNA, 25 bp, Mus musculus
gctacgagttgggtttgattctgaa

SEQ ID NO: 688832 - DNA, 25 bp, Mus musculus
gctacgatgacgagcgagggcttca

SEQ ID NO: 688833 - DNA, 25 bp, Mus musculus
gctacgatgacgtgcgagggcttca

SEQ ID NO: 688834 - DNA, 25 bp, Mus musculus
gctacgatgggcaggaccagttgaa

SEQ ID NO: 688835 - DNA, 25 bp, Mus musculus
gctacgatgggctggaccagttgaa

SEQ ID NO: 688836 - DNA, 25 bp, Mus musculus
gctacgatgtcaccattcctgtttt

SEQ ID NO: 688837 - DNA, 25 bp, Mus musculus
gctacgatgtcagcattcctgtttt

SEQ ID NO: 688838 - DNA, 25 bp, Mus musculus
gctacgcaagctagggatccggccg

SEQ ID NO: 688839 - DNA, 25 bp, Mus musculus
gctacgcaagcttgggatccggccg

SEQ ID NO: 688840 - DNA, 25 bp, Mus musculus
gctacgccactcaagaagccattgt

SEQ ID NO: 688841 - DNA, 25 bp, Mus musculus
gctacgccactctagaagccattgt

SEQ ID NO: 688842 - DNA, 25 bp, Mus musculus
gctacgccagcaactcatgcgtgag

SEQ ID NO: 688843 - DNA, 25 bp, Mus musculus
gctacgccagcatctcatgcgtgag

SEQ ID NO: 688844 - DNA, 25 bp, Mus musculus
gctacgccagtacgcagagaagaag

SEQ ID NO: 688845 - DNA, 25 bp, Mus musculus
gctacgccagtaggcagagaagaag

SEQ ID NO: 688846 - DNA, 25 bp, Mus musculus
gctacgccatcaaggcagatggtgt

SEQ ID NO: 688847 - DNA, 25 bp, Mus musculus
gctacgccatcatggcagatggtgt

SEQ ID NO: 688848 - DNA, 25 bp, Mus musculus
gctacgcccgggatgacacccatta

SEQ ID NO: 688849 - DNA, 25 bp, Mus musculus
gctacgcccgggttgacacccatta

SEQ ID NO: 688850 - DNA, 25 bp, Mus musculus
gctacgccctgcagcgtgtggaaca

SEQ ID NO: 688851 - DNA, 25 bp, Mus musculus
gctacgccctgctgcgtgtggaaca

SEQ ID NO: 688852 - DNA, 25 bp, Mus musculus
gctacgcctctaatgcagtgtctga

SEQ ID NO: 688853 - DNA, 25 bp, Mus musculus
gctacgcctctattgcagtgtctga

SEQ ID NO: 688854 - DNA, 25 bp, Mus musculus
gctacggaacacaccttagataatg

SEQ ID NO: 688855 - DNA, 25 bp, Mus musculus
gctacggaacactccttagataatg

SEQ ID NO: 688856 - DNA, 25 bp, Mus musculus
gctacggaaccactagtgtgcagaa

SEQ ID NO: 688857 - DNA, 25 bp, Mus musculus
gctacggaaccagtagtgtgcagaa

SEQ ID NO: 688858 - DNA, 25 bp, Mus musculus
gctacggacagaccgagtgcactgc

SEQ ID NO: 688859 - DNA, 25 bp, Mus musculus
gctacggacagagcgagtgcactgc

SEQ ID NO: 688860 - DNA, 25 bp, Mus musculus
gctacggctagaagcccgacttcct

SEQ ID NO: 688861 - DNA, 25 bp, Mus musculus
gctacggctagatgcccgacttcct

SEQ ID NO: 688862 - DNA, 25 bp, Mus musculus
gctacgggaagaacctggaggtgga

SEQ ID NO: 688863 - DNA, 25 bp, Mus musculus
gctacgggaagatcctggaggtgga

SEQ ID NO: 688864 - DNA, 25 bp, Mus musculus
gctacgggcgcacatgtacgagaca

SEQ ID NO: 688865 - DNA, 25 bp, Mus musculus
gctacgggcgcagatgtacgagaca

SEQ ID NO: 688866 - DNA, 25 bp, Mus musculus
gctacgggttctacaggcgtaacct

SEQ ID NO: 688867 - DNA, 25 bp, Mus musculus
gctacgggttcttcaggcgtaacct

SEQ ID NO: 688868 - DNA, 25 bp, Mus musculus
gctacgtcacagatccttccttcaa

SEQ ID NO: 688869 - DNA, 25 bp, Mus musculus
gctacgtcacagttccttccttcaa

SEQ ID NO: 688870 - DNA, 25 bp, Mus musculus
gctacgtccagcctgttggtcccgt

SEQ ID NO: 688871 - DNA, 25 bp, Mus musculus
gctacgtccagcgtgttggtcccgt

SEQ ID NO: 688872 - DNA, 25 bp, Mus musculus
gctacgtccctgaaatcatagagtt

SEQ ID NO: 688873 - DNA, 25 bp, Mus musculus
gctacgtccctgtaatcatagagtt

SEQ ID NO: 688874 - DNA, 25 bp, Mus musculus
gctacgtcctgtaggatgataaccg

SEQ ID NO: 688875 - DNA, 25 bp, Mus musculus
gctacgtcctgttggatgataaccg

SEQ ID NO: 688876 - DNA, 25 bp, Mus musculus
gctacgtgcagaaggacctcaagaa

SEQ ID NO: 688877 - DNA, 25 bp, Mus musculus
gctacgtgcagatggacctcaagaa

SEQ ID NO: 688878 - DNA, 25 bp, Mus musculus
gctacgtgcccacagctgggaagct

SEQ ID NO: 688879 - DNA, 25 bp, Mus musculus
gctacgtgcccagagctgggaagct

SEQ ID NO: 688880 - DNA, 25 bp, Mus musculus
gctacgtgcccgaaattgctgctct

SEQ ID NO: 688881 - DNA, 25 bp, Mus musculus
gctacgtgcccgtaattgctgctct

SEQ ID NO: 688882 - DNA, 25 bp, Mus musculus
gctacgttctatacacagctttgag

SEQ ID NO: 688883 - DNA, 25 bp, Mus musculus
gctacgttctattcacagctttgag

SEQ ID NO: 688884 - DNA, 25 bp, Mus musculus
gctacgttggctcgtaacttccgga

SEQ ID NO: 688885 - DNA, 25 bp, Mus musculus
gctacgttggctggtaacttccgga

SEQ ID NO: 688886 - DNA, 25 bp, Mus musculus
gctacgtttcccaggcagatgtgga

SEQ ID NO: 688887 - DNA, 25 bp, Mus musculus
gctacgtttccctggcagatgtgga

SEQ ID NO: 688888 - DNA, 25 bp, Mus musculus
gctactaaagcacgtgctgcgtcta

SEQ ID NO: 688889 - DNA, 25 bp, Mus musculus
gctactaaagcaggtgctgcgtcta

SEQ ID NO: 688890 - DNA, 25 bp, Mus musculus
gctactaacaacatctggtatccag

SEQ ID NO: 688891 - DNA, 25 bp, Mus musculus
gctactaacaacttctggtatccag

SEQ ID NO: 688892 - DNA, 25 bp, Mus musculus
gctactaagttcaagtgccatgatg

SEQ ID NO: 688893 - DNA, 25 bp, Mus musculus
gctactaagttctagtgccatgatg

SEQ ID NO: 688894 - DNA, 25 bp, Mus musculus
gctactacacggagcaagactccag

SEQ ID NO: 688895 - DNA, 25 bp, Mus musculus
gctactacacggtgcaagactccag

SEQ ID NO: 688896 - DNA, 25 bp, Mus musculus
gctactaccgcgaccacaacgtgga

SEQ ID NO: 688897 - DNA, 25 bp, Mus musculus
gctactaccgcgtccacaacgtgga

SEQ ID NO: 688898 - DNA, 25 bp, Mus musculus
gctactagtcagagcttcgcaagat

SEQ ID NO: 688899 - DNA, 25 bp, Mus musculus
gctactagtcagtgcttcgcaagat

SEQ ID NO: 688900 - DNA, 25 bp, Mus musculus
gctactatatgcctttcttctacac

SEQ ID NO: 688901 - DNA, 25 bp, Mus musculus
gctactatatgcgtttcttctacac

SEQ ID NO: 688902 - DNA, 25 bp, Mus musculus
gctactatcgcaatggctccgcaga

SEQ ID NO: 688903 - DNA, 25 bp, Mus musculus
gctactatcgcattggctccgcaga

SEQ ID NO: 688904 - DNA, 25 bp, Mus musculus
gctactatgagcaggcgcaggacta

SEQ ID NO: 688905 - DNA, 25 bp, Mus musculus
gctactatgagctggcgcaggacta

SEQ ID NO: 688906 - DNA, 25 bp, Mus musculus
gctactatggagcaaactgggccag

SEQ ID NO: 688907 - DNA, 25 bp, Mus musculus
gctactatggaggaaactgggccag

SEQ ID NO: 688908 - DNA, 25 bp, Mus musculus
gctactcaaaaacagattgagaaac

SEQ ID NO: 688909 - DNA, 25 bp, Mus musculus
gctactcaaaaagagattgagaaac

SEQ ID NO: 688910 - DNA, 25 bp, Mus musculus
gctactcaatgaactgaagcgccgt

SEQ ID NO: 688911 - DNA, 25 bp, Mus musculus
gctactcaatgatctgaagcgccgt

SEQ ID NO: 688912 - DNA, 25 bp, Mus musculus
gctactcagcatcctctggatggac

SEQ ID NO: 688913 - DNA, 25 bp, Mus musculus
gctactcagcatgctctggatggac

SEQ ID NO: 688914 - DNA, 25 bp, Mus musculus
gctactcagccgagcgaatggcccg

SEQ ID NO: 688915 - DNA, 25 bp, Mus musculus
gctactcagccgtgcgaatggcccg

SEQ ID NO: 688916 - DNA, 25 bp, Mus musculus
gctactcagcttctacgagcagcag

SEQ ID NO: 688917 - DNA, 25 bp, Mus musculus
gctactcagcttgtacgagcagcag

SEQ ID NO: 688918 - DNA, 25 bp, Mus musculus
gctactcagggccaacaggacaatt

SEQ ID NO: 688919 - DNA, 25 bp, Mus musculus
gctactcagggcgaacaggacaatt

SEQ ID NO: 688920 - DNA, 25 bp, Mus musculus
gctactcagttgcagctggacattt

SEQ ID NO: 688921 - DNA, 25 bp, Mus musculus
gctactcagttggagctggacattt

SEQ ID NO: 688922 - DNA, 25 bp, Mus musculus
gctactccgccgattacagctcttg

SEQ ID NO: 688923 - DNA, 25 bp, Mus musculus
gctactccgccgtttacagctcttg

SEQ ID NO: 688924 - DNA, 25 bp, Mus musculus
gctactccgggaagttcaactggcc

SEQ ID NO: 688925 - DNA, 25 bp, Mus musculus
gctactccgggatgttcaactggcc

SEQ ID NO: 688926 - DNA, 25 bp, Mus musculus
gctactctaggaacctcacgtggaa

SEQ ID NO: 688927 - DNA, 25 bp, Mus musculus
gctactctaggatcctcacgtggaa

SEQ ID NO: 688928 - DNA, 25 bp, Mus musculus
gctactctctatagctgccgaagga

SEQ ID NO: 688929 - DNA, 25 bp, Mus musculus
gctactctctattgctgccgaagga

SEQ ID NO: 688930 - DNA, 25 bp, Mus musculus
gctactctggataaagaatcgctag

SEQ ID NO: 688931 - DNA, 25 bp, Mus musculus
gctactctggattaagaatcgctag

SEQ ID NO: 688932 - DNA, 25 bp, Mus musculus
gctactctggcacgactcaagatac

SEQ ID NO: 688933 - DNA, 25 bp, Mus musculus
gctactctggcaggactcaagatac

SEQ ID NO: 688934 - DNA, 25 bp, Mus musculus
gctactctttcccagtgtaatgaca

SEQ ID NO: 688935 - DNA, 25 bp, Mus musculus
gctactctttccgagtgtaatgaca

SEQ ID NO: 688936 - DNA, 25 bp, Mus musculus
gctactgaaggtagcgggcagccct

SEQ ID NO: 688937 - DNA, 25 bp, Mus musculus
gctactgaaggttgcgggcagccct

SEQ ID NO: 688938 - DNA, 25 bp, Mus musculus
gctactgactccaacgttaatgttg

SEQ ID NO: 688939 - DNA, 25 bp, Mus musculus
gctactgactcctacgttaatgttg

SEQ ID NO: 688940 - DNA, 25 bp, Mus musculus
gctactgagggcacgactggctcag

SEQ ID NO: 688941 - DNA, 25 bp, Mus musculus
gctactgagggctcgactggctcag

SEQ ID NO: 688942 - DNA, 25 bp, Mus musculus
gctactgatgacctcatgctcctgg

SEQ ID NO: 688943 - DNA, 25 bp, Mus musculus
gctactgatgacgtcatgctcctgg

SEQ ID NO: 688944 - DNA, 25 bp, Mus musculus
gctactgcatggactgtgtactcga

SEQ ID NO: 688945 - DNA, 25 bp, Mus musculus
gctactgcatggtctgtgtactcga

SEQ ID NO: 688946 - DNA, 25 bp, Mus musculus
gctactgctaccattgctgggtgcc

SEQ ID NO: 688947 - DNA, 25 bp, Mus musculus
gctactgctacctttgctgggtgcc

SEQ ID NO: 688948 - DNA, 25 bp, Mus musculus
gctactgctcagatagcaccctttg

SEQ ID NO: 688949 - DNA, 25 bp, Mus musculus
gctactgctcagttagcaccctttg

SEQ ID NO: 688950 - DNA, 25 bp, Mus musculus
gctactggcatgatccgtacatcga

SEQ ID NO: 688951 - DNA, 25 bp, Mus musculus
gctactggcatgttccgtacatcga

SEQ ID NO: 688952 - DNA, 25 bp, Mus musculus
gctactggctctagattgagggttc

SEQ ID NO: 688953 - DNA, 25 bp, Mus musculus
gctactggctcttgattgagggttc

SEQ ID NO: 688954 - DNA, 25 bp, Mus musculus
gctactggctgtccttgaaattcga

SEQ ID NO: 688955 - DNA, 25 bp, Mus musculus
gctactggctgtgcttgaaattcga

SEQ ID NO: 688956 - DNA, 25 bp, Mus musculus
gctactgggttgctgtccgatatga

SEQ ID NO: 688957 - DNA, 25 bp, Mus musculus
gctactgggttggtgtccgatatga

SEQ ID NO: 688958 - DNA, 25 bp, Mus musculus
gctactggtggaacggagacaagta

SEQ ID NO: 688959 - DNA, 25 bp, Mus musculus
gctactggtggatcggagacaagta

SEQ ID NO: 688960 - DNA, 25 bp, Mus musculus
gctactgtctccaacaatgtgccgg

SEQ ID NO: 688961 - DNA, 25 bp, Mus musculus
gctactgtctccatctgtaagaagt

SEQ ID NO: 688962 - DNA, 25 bp, Mus musculus
gctactgtctcctacaatgtgccgg

SEQ ID NO: 688963 - DNA, 25 bp, Mus musculus
gctactgtctccttctgtaagaagt

SEQ ID NO: 688964 - DNA, 25 bp, Mus musculus
gctactgtgggcaggtgattcatca

SEQ ID NO: 688965 - DNA, 25 bp, Mus musculus
gctactgtgggctggtgattcatca

SEQ ID NO: 688966 - DNA, 25 bp, Mus musculus
gctacttaagtgcaaaatcatggag

SEQ ID NO: 688967 - DNA, 25 bp, Mus musculus
gctacttaagtggaaaatcatggag

SEQ ID NO: 688968 - DNA, 25 bp, Mus musculus
gctacttcaattcaccttatgggta

SEQ ID NO: 688969 - DNA, 25 bp, Mus musculus
gctacttcaattcggacgcttgcca

SEQ ID NO: 688970 - DNA, 25 bp, Mus musculus
gctacttcaattgaccttatgggta

SEQ ID NO: 688971 - DNA, 25 bp, Mus musculus
gctacttcaattgggacgcttgcca

SEQ ID NO: 688972 - DNA, 25 bp, Mus musculus
gctacttccccaagggcacgtggta

SEQ ID NO: 688973 - DNA, 25 bp, Mus musculus
gctacttccccatgggcacgtggta

SEQ ID NO: 688974 - DNA, 25 bp, Mus musculus
gctacttccgaacagtgtacggttg

SEQ ID NO: 688975 - DNA, 25 bp, Mus musculus
gctacttccgaaccatttttgaggg

SEQ ID NO: 688976 - DNA, 25 bp, Mus musculus
gctacttccgaagagtgtacggttg

SEQ ID NO: 688977 - DNA, 25 bp, Mus musculus
gctacttccgaagcatttttgaggg

SEQ ID NO: 688978 - DNA, 25 bp, Mus musculus
gctacttccgagactactttcccat

SEQ ID NO: 688979 - DNA, 25 bp, Mus musculus
gctacttccgagtctactttcccat

SEQ ID NO: 688980 - DNA, 25 bp, Mus musculus
gctacttcctccacaagaacgatgg

SEQ ID NO: 688981 - DNA, 25 bp, Mus musculus
gctacttcctcctcaagaacgatgg

SEQ ID NO: 688982 - DNA, 25 bp, Mus musculus
gctacttcctcgaccgggatttgtt

SEQ ID NO: 688983 - DNA, 25 bp, Mus musculus
gctacttcctcgtccgggatttgtt

SEQ ID NO: 688984 - DNA, 25 bp, Mus musculus
gctacttgaaagacccagcaagaac

SEQ ID NO: 688985 - DNA, 25 bp, Mus musculus
gctacttgaaagtcccagcaagaac

SEQ ID NO: 688986 - DNA, 25 bp, Mus musculus
gctacttgaaggatgggaactgcac

SEQ ID NO: 688987 - DNA, 25 bp, Mus musculus
gctacttgaaggttgggaactgcac

SEQ ID NO: 688988 - DNA, 25 bp, Mus musculus
gctacttggttgaccgctaagccga

SEQ ID NO: 688989 - DNA, 25 bp, Mus musculus
gctacttggttgtccgctaagccga

SEQ ID NO: 688990 - DNA, 25 bp, Mus musculus
gctacttgtcctcctgccgattctt

SEQ ID NO: 688991 - DNA, 25 bp, Mus musculus
gctacttgtcctgctgccgattctt

SEQ ID NO: 688992 - DNA, 25 bp, Mus musculus
gctacttgtgagctgactgtggtaa

SEQ ID NO: 688993 - DNA, 25 bp, Mus musculus
gctacttgtgaggtgactgtggtaa

SEQ ID NO: 688994 - DNA, 25 bp, Mus musculus
gctacttgtgtgaatgtggctggcc

SEQ ID NO: 688995 - DNA, 25 bp, Mus musculus
gctacttgtgtgtatgtggctggcc

SEQ ID NO: 688996 - DNA, 25 bp, Mus musculus
gctactttaagaagtcttcagccca

SEQ ID NO: 688997 - DNA, 25 bp, Mus musculus
gctactttaagatgtcttcagccca

SEQ ID NO: 688998 - DNA, 25 bp, Mus musculus
gctactttccctcttagtgtacaaa

SEQ ID NO: 688999 - DNA, 25 bp, Mus musculus
gctactttccctgttagtgtacaaa

SEQ ID NO: 689000 - DNA, 25 bp, Mus musculus
gctactttgtgaacaggatccagga

SEQ ID NO: 689001 - DNA, 25 bp, Mus musculus
gctactttgtgatcaggatccagga

SEQ ID NO: 689002 - DNA, 25 bp, Mus musculus
gctactttttgtacggtccttcgag

SEQ ID NO: 689003 - DNA, 25 bp, Mus musculus
gctactttttgttcggtccttcgag

SEQ ID NO: 689004 - DNA, 25 bp, Mus musculus
gctagaaaagacatactccgccaag

SEQ ID NO: 689005 - DNA, 25 bp, Mus musculus
gctagaaaagacttactccgccaag

SEQ ID NO: 689006 - DNA, 25 bp, Mus musculus
gctagaaccaaacgccagaaaaaag

SEQ ID NO: 689007 - DNA, 25 bp, Mus musculus
gctagaaccaaaggccagaaaaaag

SEQ ID NO: 689008 - DNA, 25 bp, Mus musculus
gctagaaccagccaaaaccagctat

SEQ ID NO: 689009 - DNA, 25 bp, Mus musculus
gctagaaccagcgaaaaccagctat

SEQ ID NO: 689010 - DNA, 25 bp, Mus musculus
gctagaacctgtcgcttactttcca

SEQ ID NO: 689011 - DNA, 25 bp, Mus musculus
gctagaacctgtggcttactttcca

SEQ ID NO: 689012 - DNA, 25 bp, Mus musculus
gctagaacgatcagacacctcccat

SEQ ID NO: 689013 - DNA, 25 bp, Mus musculus
gctagaacgatctgacacctcccat

SEQ ID NO: 689014 - DNA, 25 bp, Mus musculus
gctagaactgtaatccctgccaata

SEQ ID NO: 689015 - DNA, 25 bp, Mus musculus
gctagaactgtattccctgccaata

SEQ ID NO: 689016 - DNA, 25 bp, Mus musculus
gctagaagaataaaggcagacatgt

SEQ ID NO: 689017 - DNA, 25 bp, Mus musculus
gctagaagaatataggcagacatgt

SEQ ID NO: 689018 - DNA, 25 bp, Mus musculus
gctagaagaccaagaaaggatttca

SEQ ID NO: 689019 - DNA, 25 bp, Mus musculus
gctagaagaccatgaaaggatttca

SEQ ID NO: 689020 - DNA, 25 bp, Mus musculus
gctagaagcgatcaaagctcgagtc

SEQ ID NO: 689021 - DNA, 25 bp, Mus musculus
gctagaagcgatgaaagctcgagtc

SEQ ID NO: 689022 - DNA, 25 bp, Mus musculus
gctagaagctttagccaagcataat

SEQ ID NO: 689023 - DNA, 25 bp, Mus musculus
gctagaagcttttgccaagcataat

SEQ ID NO: 689024 - DNA, 25 bp, Mus musculus
gctagaagtgctagctcgtccgcag

SEQ ID NO: 689025 - DNA, 25 bp, Mus musculus
gctagaagtgcttgctcgtccgcag

SEQ ID NO: 689026 - DNA, 25 bp, Mus musculus
gctagaagttttatgcatttcagag

SEQ ID NO: 689027 - DNA, 25 bp, Mus musculus
gctagaagttttttgcatttcagag

SEQ ID NO: 689028 - DNA, 25 bp, Mus musculus
gctagacaaggaccacactacagcg

SEQ ID NO: 689029 - DNA, 25 bp, Mus musculus
gctagacaaggagcacactacagcg

SEQ ID NO: 689030 - DNA, 25 bp, Mus musculus
gctagacagtttaaatcagaaggag

SEQ ID NO: 689031 - DNA, 25 bp, Mus musculus
gctagacagttttaatcagaaggag

SEQ ID NO: 689032 - DNA, 25 bp, Mus musculus
gctagacctggtcaccaataaacag

SEQ ID NO: 689033 - DNA, 25 bp, Mus musculus
gctagacctggtgaccaataaacag

SEQ ID NO: 689034 - DNA, 25 bp, Mus musculus
gctagacgcttactctaccacgtga

SEQ ID NO: 689035 - DNA, 25 bp, Mus musculus
gctagacgcttagtctaccacgtga

SEQ ID NO: 689036 - DNA, 25 bp, Mus musculus
gctagactacgacaaactgggcaag

SEQ ID NO: 689037 - DNA, 25 bp, Mus musculus
gctagactacgagaaactgggcaag

SEQ ID NO: 689038 - DNA, 25 bp, Mus musculus
gctagactcaatcaagcaggaggac

SEQ ID NO: 689039 - DNA, 25 bp, Mus musculus
gctagactcaatgaagcaggaggac

SEQ ID NO: 689040 - DNA, 25 bp, Mus musculus
gctagactcagtcgccttcatggaa

SEQ ID NO: 689041 - DNA, 25 bp, Mus musculus
gctagactcagtggccttcatggaa

SEQ ID NO: 689042 - DNA, 25 bp, Mus musculus
gctagactgaacaacagagatcccc

SEQ ID NO: 689043 - DNA, 25 bp, Mus musculus
gctagactgaactacagagatcccc

SEQ ID NO: 689044 - DNA, 25 bp, Mus musculus
gctagactgccccattttgagagca

SEQ ID NO: 689045 - DNA, 25 bp, Mus musculus
gctagactgcccgattttgagagca

SEQ ID NO: 689046 - DNA, 25 bp, Mus musculus
gctagactttctctccagctatgag

SEQ ID NO: 689047 - DNA, 25 bp, Mus musculus
gctagactttctgtccagctatgag

SEQ ID NO: 689048 - DNA, 25 bp, Mus musculus
gctagagaagtacaagccttacgag

SEQ ID NO: 689049 - DNA, 25 bp, Mus musculus
gctagagaagtagaagccttacgag

SEQ ID NO: 689050 - DNA, 25 bp, Mus musculus
gctagagaatctactggaagagacc

SEQ ID NO: 689051 - DNA, 25 bp, Mus musculus
gctagagaatcttctggaagagacc

SEQ ID NO: 689052 - DNA, 25 bp, Mus musculus
gctagagaccatcgaccagctacat

SEQ ID NO: 689053 - DNA, 25 bp, Mus musculus
gctagagaccatggaccagctacat

SEQ ID NO: 689054 - DNA, 25 bp, Mus musculus
gctagagattccagtggaagagcac

SEQ ID NO: 689055 - DNA, 25 bp, Mus musculus
gctagagattcctgtggaagagcac

SEQ ID NO: 689056 - DNA, 25 bp, Mus musculus
gctagagcaaaaaatggaacaggca

SEQ ID NO: 689057 - DNA, 25 bp, Mus musculus
gctagagcaaaatatggaacaggca

SEQ ID NO: 689058 - DNA, 25 bp, Mus musculus
gctagagcacaacgagattgacggc

SEQ ID NO: 689059 - DNA, 25 bp, Mus musculus
gctagagcacaaggagattgacggc

SEQ ID NO: 689060 - DNA, 25 bp, Mus musculus
gctagagcacttacctaaaatgcaa

SEQ ID NO: 689061 - DNA, 25 bp, Mus musculus
gctagagcactttcctaaaatgcaa

SEQ ID NO: 689062 - DNA, 25 bp, Mus musculus
gctagagcttacagatacgtgggcc

SEQ ID NO: 689063 - DNA, 25 bp, Mus musculus
gctagagcttactgatacgtgggcc

SEQ ID NO: 689064 - DNA, 25 bp, Mus musculus
gctagagggctacactgcccacttc

SEQ ID NO: 689065 - DNA, 25 bp, Mus musculus
gctagagggctagactgcccacttc

SEQ ID NO: 689066 - DNA, 25 bp, Mus musculus
gctagagtgtctaataagatgtcaa

SEQ ID NO: 689067 - DNA, 25 bp, Mus musculus
gctagagtgtcttataagatgtcaa

SEQ ID NO: 689068 - DNA, 25 bp, Mus musculus
gctagagttcttcactctggataca

SEQ ID NO: 689069 - DNA, 25 bp, Mus musculus
gctagagttcttgactctggataca

SEQ ID NO: 689070 - DNA, 25 bp, Mus musculus
gctagatatcggagaggcttcattc

SEQ ID NO: 689071 - DNA, 25 bp, Mus musculus
gctagatatcggtgaggcttcattc

SEQ ID NO: 689072 - DNA, 25 bp, Mus musculus
gctagatcaggtacatgcactgatt

SEQ ID NO: 689073 - DNA, 25 bp, Mus musculus
gctagatcaggttcatgcactgatt

SEQ ID NO: 689074 - DNA, 25 bp, Mus musculus
gctagatgcctgatggaacctgaaa

SEQ ID NO: 689075 - DNA, 25 bp, Mus musculus
gctagatgcctgcagccagagttac

SEQ ID NO: 689076 - DNA, 25 bp, Mus musculus
gctagatgcctggagccagagttac

SEQ ID NO: 689077 - DNA, 25 bp, Mus musculus
gctagatgcctgttggaacctgaaa

SEQ ID NO: 689078 - DNA, 25 bp, Mus musculus
gctagatgttctcgtcaataatgcc

SEQ ID NO: 689079 - DNA, 25 bp, Mus musculus
gctagatgttctggtcaataatgcc

SEQ ID NO: 689080 - DNA, 25 bp, Mus musculus
gctagattgacactgagcctgtccg

SEQ ID NO: 689081 - DNA, 25 bp, Mus musculus
gctagattgacagtgagcctgtccg

SEQ ID NO: 689082 - DNA, 25 bp, Mus musculus
gctagcaaagtcacgtggtaacctt

SEQ ID NO: 689083 - DNA, 25 bp, Mus musculus
gctagcaaagtctcgtggtaacctt

SEQ ID NO: 689084 - DNA, 25 bp, Mus musculus
gctagcaatgctatcggcagacaca

SEQ ID NO: 689085 - DNA, 25 bp, Mus musculus
gctagcaatgctttcggcagacaca

SEQ ID NO: 689086 - DNA, 25 bp, Mus musculus
gctagcaccagaaaacaagaattgt

SEQ ID NO: 689087 - DNA, 25 bp, Mus musculus
gctagcaccagataacaagaattgt

SEQ ID NO: 689088 - DNA, 25 bp, Mus musculus
gctagcagacataggcagcatgttg

SEQ ID NO: 689089 - DNA, 25 bp, Mus musculus
gctagcagacattggcagcatgttg

SEQ ID NO: 689090 - DNA, 25 bp, Mus musculus
gctagcaggctgaggcatgaacaag

SEQ ID NO: 689091 - DNA, 25 bp, Mus musculus
gctagcaggctgtggcatgaacaag

SEQ ID NO: 689092 - DNA, 25 bp, Mus musculus
gctagcatcatgcaggaacttcatg

SEQ ID NO: 689093 - DNA, 25 bp, Mus musculus
gctagcatcatggaggaacttcatg

SEQ ID NO: 689094 - DNA, 25 bp, Mus musculus
gctagccactctcttgggtgactac

SEQ ID NO: 689095 - DNA, 25 bp, Mus musculus
gctagccactctgttgggtgactac

SEQ ID NO: 689096 - DNA, 25 bp, Mus musculus
gctagccactgcctgggtcaacctg

SEQ ID NO: 689097 - DNA, 25 bp, Mus musculus
gctagccactgcgtgggtcaacctg

SEQ ID NO: 689098 - DNA, 25 bp, Mus musculus
gctagccagggacagctgtgtaata

SEQ ID NO: 689099 - DNA, 25 bp, Mus musculus
gctagccagggagagctgtgtaata

SEQ ID NO: 689100 - DNA, 25 bp, Mus musculus
gctagccccgcaaagcacagaggag

SEQ ID NO: 689101 - DNA, 25 bp, Mus musculus
gctagccccgcatagcacagaggag

SEQ ID NO: 689102 - DNA, 25 bp, Mus musculus
gctagcccggaacaccagtgtcaat

SEQ ID NO: 689103 - DNA, 25 bp, Mus musculus
gctagcccggaagaccagtgtcaat

SEQ ID NO: 689104 - DNA, 25 bp, Mus musculus
gctagccgattccttggagccgtca

SEQ ID NO: 689105 - DNA, 25 bp, Mus musculus
gctagccgattcgttggagccgtca

SEQ ID NO: 689106 - DNA, 25 bp, Mus musculus
gctagcctcgggatctgcgcagttt

SEQ ID NO: 689107 - DNA, 25 bp, Mus musculus
gctagcctcgggttctgcgcagttt

SEQ ID NO: 689108 - DNA, 25 bp, Mus musculus
gctagcctgataaccactgctcttc

SEQ ID NO: 689109 - DNA, 25 bp, Mus musculus
gctagcctgatatccactgctcttc

SEQ ID NO: 689110 - DNA, 25 bp, Mus musculus
gctagccttcttcctcatggcagca

SEQ ID NO: 689111 - DNA, 25 bp, Mus musculus
gctagccttcttgctcatggcagca

SEQ ID NO: 689112 - DNA, 25 bp, Mus musculus
gctagcgggcctctgccctaacagg

SEQ ID NO: 689113 - DNA, 25 bp, Mus musculus
gctagcgggcctgtgccctaacagg

SEQ ID NO: 689114 - DNA, 25 bp, Mus musculus
gctagcggtgccagctgtgattagc

SEQ ID NO: 689115 - DNA, 25 bp, Mus musculus
gctagcggtgcctgctgtgattagc

SEQ ID NO: 689116 - DNA, 25 bp, Mus musculus
gctagcgtaagtagtcgctttgaag

SEQ ID NO: 689117 - DNA, 25 bp, Mus musculus
gctagcgtaagttgtcgctttgaag

SEQ ID NO: 689118 - DNA, 25 bp, Mus musculus
gctagctactgacctgattgacatg

SEQ ID NO: 689119 - DNA, 25 bp, Mus musculus
gctagctactgagctgattgacatg

SEQ ID NO: 689120 - DNA, 25 bp, Mus musculus
gctagctactttcggacaatttgtg

SEQ ID NO: 689121 - DNA, 25 bp, Mus musculus
gctagctactttgggacaatttgtg

SEQ ID NO: 689122 - DNA, 25 bp, Mus musculus
gctagctcacacacggacttcctaa

SEQ ID NO: 689123 - DNA, 25 bp, Mus musculus
gctagctcacactcggacttcctaa

SEQ ID NO: 689124 - DNA, 25 bp, Mus musculus
gctagctcccgaagggaggacctgt

SEQ ID NO: 689125 - DNA, 25 bp, Mus musculus
gctagctcccgatgggaggacctgt

SEQ ID NO: 689126 - DNA, 25 bp, Mus musculus
gctagctgagatcctgcctcctgtt

SEQ ID NO: 689127 - DNA, 25 bp, Mus musculus
gctagctgagatgctgcctcctgtt

SEQ ID NO: 689128 - DNA, 25 bp, Mus musculus
gctagctgagctacaagagttgggc

SEQ ID NO: 689129 - DNA, 25 bp, Mus musculus
gctagctgagcttcaagagttgggc

SEQ ID NO: 689130 - DNA, 25 bp, Mus musculus
gctagctgccaacaaggttatttcc

SEQ ID NO: 689131 - DNA, 25 bp, Mus musculus
gctagctgccaagaaggttatttcc

SEQ ID NO: 689132 - DNA, 25 bp, Mus musculus
gctagctgccacctcagaagccggg

SEQ ID NO: 689133 - DNA, 25 bp, Mus musculus
gctagctgccacgtcagaagccggg

SEQ ID NO: 689134 - DNA, 25 bp, Mus musculus
gctagctggcagagagtcagtgctc

SEQ ID NO: 689135 - DNA, 25 bp, Mus musculus
gctagctggcagtgagtcagtgctc

SEQ ID NO: 689136 - DNA, 25 bp, Mus musculus
gctagctgggcaagggcagtcctta

SEQ ID NO: 689137 - DNA, 25 bp, Mus musculus
gctagctgggcatgggcagtcctta

SEQ ID NO: 689138 - DNA, 25 bp, Mus musculus
gctagctgggtacctgctttgtcag

SEQ ID NO: 689139 - DNA, 25 bp, Mus musculus
gctagctgggtagctgctttgtcag

SEQ ID NO: 689140 - DNA, 25 bp, Mus musculus
gctagctgtcttccgagctcgggaa

SEQ ID NO: 689141 - DNA, 25 bp, Mus musculus
gctagctgtcttgcgagctcgggaa

SEQ ID NO: 689142 - DNA, 25 bp, Mus musculus
gctagcttaattagagccatcagag

SEQ ID NO: 689143 - DNA, 25 bp, Mus musculus
gctagcttaatttgagccatcagag

SEQ ID NO: 689144 - DNA, 25 bp, Mus musculus
gctagcttgtgactcttcggtccga

SEQ ID NO: 689145 - DNA, 25 bp, Mus musculus
gctagcttgtgagtcttcggtccga

SEQ ID NO: 689146 - DNA, 25 bp, Mus musculus
gctagctttttacagggaacagctt

SEQ ID NO: 689147 - DNA, 25 bp, Mus musculus
gctagctttttagagggaacagctt

SEQ ID NO: 689148 - DNA, 25 bp, Mus musculus
gctaggaatccaatctatgcgtgcc

SEQ ID NO: 689149 - DNA, 25 bp, Mus musculus
gctaggaatccattctatgcgtgcc

SEQ ID NO: 689150 - DNA, 25 bp, Mus musculus
gctaggagatatagatgctgtctct

SEQ ID NO: 689151 - DNA, 25 bp, Mus musculus
gctaggagatattgatgctgtctct

SEQ ID NO: 689152 - DNA, 25 bp, Mus musculus
gctaggagatgcagggagcccttac

SEQ ID NO: 689153 - DNA, 25 bp, Mus musculus
gctaggagatgctgggagcccttac

SEQ ID NO: 689154 - DNA, 25 bp, Mus musculus
gctaggatctttctgagtcagaaca

SEQ ID NO: 689155 - DNA, 25 bp, Mus musculus
gctaggatctttgtgagtcagaaca

SEQ ID NO: 689156 - DNA, 25 bp, Mus musculus
gctaggcaagccagaggattgtgct

SEQ ID NO: 689157 - DNA, 25 bp, Mus musculus
gctaggcaagcctgaggattgtgct

SEQ ID NO: 689158 - DNA, 25 bp, Mus musculus
gctaggcacctacatgggccacact

SEQ ID NO: 689159 - DNA, 25 bp, Mus musculus
gctaggcacctagatgggccacact

SEQ ID NO: 689160 - DNA, 25 bp, Mus musculus
gctaggcagccacctcacgtagctg

SEQ ID NO: 689161 - DNA, 25 bp, Mus musculus
gctaggcagccagctcacgtagctg

SEQ ID NO: 689162 - DNA, 25 bp, Mus musculus
gctaggcagctcctttccggagatc

SEQ ID NO: 689163 - DNA, 25 bp, Mus musculus
gctaggcagctcgtttccggagatc

SEQ ID NO: 689164 - DNA, 25 bp, Mus musculus
gctaggccagtcaagctgggatgat

SEQ ID NO: 689165 - DNA, 25 bp, Mus musculus
gctaggccagtctagctgggatgat

SEQ ID NO: 689166 - DNA, 25 bp, Mus musculus
gctaggccggcgacatggagcccct

SEQ ID NO: 689167 - DNA, 25 bp, Mus musculus
gctaggccggcgtcatggagcccct

SEQ ID NO: 689168 - DNA, 25 bp, Mus musculus
gctaggcctctgagccaaaattgag

SEQ ID NO: 689169 - DNA, 25 bp, Mus musculus
gctaggcctctgtgccaaaattgag

SEQ ID NO: 689170 - DNA, 25 bp, Mus musculus
gctaggcctgccagaatccctggaa

SEQ ID NO: 689171 - DNA, 25 bp, Mus musculus
gctaggcctgcctgaatccctggaa

SEQ ID NO: 689172 - DNA, 25 bp, Mus musculus
gctaggctagcgaagcccgagcgca

SEQ ID NO: 689173 - DNA, 25 bp, Mus musculus
gctaggctagcgtagcccgagcgca

SEQ ID NO: 689174 - DNA, 25 bp, Mus musculus
gctagggcctcacactacacagggt

SEQ ID NO: 689175 - DNA, 25 bp, Mus musculus
gctagggcctcagactacacagggt

SEQ ID NO: 689176 - DNA, 25 bp, Mus musculus
gctagggctctcaagccatggccac

SEQ ID NO: 689177 - DNA, 25 bp, Mus musculus
gctagggctctctagccatggccac

SEQ ID NO: 689178 - DNA, 25 bp, Mus musculus
gctaggtggagactgtctcctcaaa

SEQ ID NO: 689179 - DNA, 25 bp, Mus musculus
gctaggtggagagtgtctcctcaaa

SEQ ID NO: 689180 - DNA, 25 bp, Mus musculus
gctaggtgtactcgcgggcgtctga

SEQ ID NO: 689181 - DNA, 25 bp, Mus musculus
gctaggtgtactggcgggcgtctga

SEQ ID NO: 689182 - DNA, 25 bp, Mus musculus
gctaggttctccattctggtccttt

SEQ ID NO: 689183 - DNA, 25 bp, Mus musculus
gctaggttctcctttctggtccttt

SEQ ID NO: 689184 - DNA, 25 bp, Mus musculus
gctagtaatagaagcatccaaaagg

SEQ ID NO: 689185 - DNA, 25 bp, Mus musculus
gctagtaatagatgcatccaaaagg

SEQ ID NO: 689186 - DNA, 25 bp, Mus musculus
gctagtcaaacacaaaattcatcca

SEQ ID NO: 689187 - DNA, 25 bp, Mus musculus
gctagtcaaacagaaaattcatcca

SEQ ID NO: 689188 - DNA, 25 bp, Mus musculus
gctagtcacctcagctggtcggaga

SEQ ID NO: 689189 - DNA, 25 bp, Mus musculus
gctagtcacctctgctggtcggaga

SEQ ID NO: 689190 - DNA, 25 bp, Mus musculus
gctagtcctggaagccttactgcct

SEQ ID NO: 689191 - DNA, 25 bp, Mus musculus
gctagtcctggatgccttactgcct

SEQ ID NO: 689192 - DNA, 25 bp, Mus musculus
gctagtgactggaggcataagctct

SEQ ID NO: 689193 - DNA, 25 bp, Mus musculus
gctagtgactggtggcataagctct

SEQ ID NO: 689194 - DNA, 25 bp, Mus musculus
gctagtgagccccaataattaggct

SEQ ID NO: 689195 - DNA, 25 bp, Mus musculus
gctagtgagcccgaataattaggct

SEQ ID NO: 689196 - DNA, 25 bp, Mus musculus
gctagtgaggtaccccagatgccag

SEQ ID NO: 689197 - DNA, 25 bp, Mus musculus
gctagtgaggtagcccagatgccag

SEQ ID NO: 689198 - DNA, 25 bp, Mus musculus
gctagtgattcaagttcatccacag

SEQ ID NO: 689199 - DNA, 25 bp, Mus musculus
gctagtgattcatgttcatccacag

SEQ ID NO: 689200 - DNA, 25 bp, Mus musculus
gctagtgattggaggaaaccccgtg

SEQ ID NO: 689201 - DNA, 25 bp, Mus musculus
gctagtgattggtggaaaccccgtg

SEQ ID NO: 689202 - DNA, 25 bp, Mus musculus
gctagtggaagaaatcaagtacatc

SEQ ID NO: 689203 - DNA, 25 bp, Mus musculus
gctagtggaagatatcaagtacatc

SEQ ID NO: 689204 - DNA, 25 bp, Mus musculus
gctagtggagaactcagaggcctcc

SEQ ID NO: 689205 - DNA, 25 bp, Mus musculus
gctagtggagaagtcagaggcctcc

SEQ ID NO: 689206 - DNA, 25 bp, Mus musculus
gctagtgggtgtccatttagcaccc

SEQ ID NO: 689207 - DNA, 25 bp, Mus musculus
gctagtgggtgtgcatttagcaccc

SEQ ID NO: 689208 - DNA, 25 bp, Mus musculus
gctagttcgcttaccggcttgagaa

SEQ ID NO: 689209 - DNA, 25 bp, Mus musculus
gctagttcgctttccggcttgagaa

SEQ ID NO: 689210 - DNA, 25 bp, Mus musculus
gctagttgacgactaccagatggac

SEQ ID NO: 689211 - DNA, 25 bp, Mus musculus
gctagttgacgagtaccagatggac

SEQ ID NO: 689212 - DNA, 25 bp, Mus musculus
gctagttgcctcctttaaagtttga

SEQ ID NO: 689213 - DNA, 25 bp, Mus musculus
gctagttgcctcgtttaaagtttga

SEQ ID NO: 689214 - DNA, 25 bp, Mus musculus
gctagttgggcaactggaaagccac

SEQ ID NO: 689215 - DNA, 25 bp, Mus musculus
gctagttgggcatctggaaagccac

SEQ ID NO: 689216 - DNA, 25 bp, Mus musculus
gctagtttaaaaacttaggctggta

SEQ ID NO: 689217 - DNA, 25 bp, Mus musculus
gctagtttaaaatcttaggctggta

SEQ ID NO: 689218 - DNA, 25 bp, Mus musculus
gctagtttctgcagtgagccgtgaa

SEQ ID NO: 689219 - DNA, 25 bp, Mus musculus
gctagtttctgctgtgagccgtgaa

SEQ ID NO: 689220 - DNA, 25 bp, Mus musculus
gctagtttgatacctgagaccggga

SEQ ID NO: 689221 - DNA, 25 bp, Mus musculus
gctagtttgatagctgagaccggga

SEQ ID NO: 689222 - DNA, 25 bp, Mus musculus
gctagttttaatctccatgggatgg

SEQ ID NO: 689223 - DNA, 25 bp, Mus musculus
gctagttttaatgtccatgggatgg

SEQ ID NO: 689224 - DNA, 25 bp, Mus musculus
gctagttttgatccaagttcacaca

SEQ ID NO: 689225 - DNA, 25 bp, Mus musculus
gctagttttgatgcaagttcacaca

SEQ ID NO: 689226 - DNA, 25 bp, Mus musculus
gctataacctgtcacaaccggacgg

SEQ ID NO: 689227 - DNA, 25 bp, Mus musculus
gctataacctgtgacaaccggacgg

SEQ ID NO: 689228 - DNA, 25 bp, Mus musculus
gctataactgagaatattcctccca

SEQ ID NO: 689229 - DNA, 25 bp, Mus musculus
gctataactgagtatattcctccca

SEQ ID NO: 689230 - DNA, 25 bp, Mus musculus
gctataagagagctagacaatcttc

SEQ ID NO: 689231 - DNA, 25 bp, Mus musculus
gctataagagaggtagacaatcttc

SEQ ID NO: 689232 - DNA, 25 bp, Mus musculus
gctataagcccgatgagcagccttc

SEQ ID NO: 689233 - DNA, 25 bp, Mus musculus
gctataagcccgttgagcagccttc

SEQ ID NO: 689234 - DNA, 25 bp, Mus musculus
gctataagtgtgacaacgggttttc

SEQ ID NO: 689235 - DNA, 25 bp, Mus musculus
gctataagtgtgtcaacgggttttc

SEQ ID NO: 689236 - DNA, 25 bp, Mus musculus
gctataatacctatgcgtccgcgat

SEQ ID NO: 689237 - DNA, 25 bp, Mus musculus
gctataatacctttgcgtccgcgat

SEQ ID NO: 689238 - DNA, 25 bp, Mus musculus
gctataatcatcatggcctggtaga

SEQ ID NO: 689239 - DNA, 25 bp, Mus musculus
gctataatcatcttggcctggtaga

SEQ ID NO: 689240 - DNA, 25 bp, Mus musculus
gctataattatcacatacctgctga

SEQ ID NO: 689241 - DNA, 25 bp, Mus musculus
gctataattatctcatacctgctga

SEQ ID NO: 689242 - DNA, 25 bp, Mus musculus
gctatacaagacatcgctgccttca

SEQ ID NO: 689243 - DNA, 25 bp, Mus musculus
gctatacaagacttcgctgccttca

SEQ ID NO: 689244 - DNA, 25 bp, Mus musculus
gctatacatttgctgaaatgccttg

SEQ ID NO: 689245 - DNA, 25 bp, Mus musculus
gctatacatttggtgaaatgccttg

SEQ ID NO: 689246 - DNA, 25 bp, Mus musculus
gctataccactccagtctgtgccat

SEQ ID NO: 689247 - DNA, 25 bp, Mus musculus
gctataccactcgagtctgtgccat

SEQ ID NO: 689248 - DNA, 25 bp, Mus musculus
gctataccatgtcccgcagccttga

SEQ ID NO: 689249 - DNA, 25 bp, Mus musculus
gctataccatgtgccgcagccttga

SEQ ID NO: 689250 - DNA, 25 bp, Mus musculus
gctatacccgccatgagcctgtggg

SEQ ID NO: 689251 - DNA, 25 bp, Mus musculus
gctatacccgccttgagcctgtggg

SEQ ID NO: 689252 - DNA, 25 bp, Mus musculus
gctataccttggacccggatatcct

SEQ ID NO: 689253 - DNA, 25 bp, Mus musculus
gctataccttggtcccggatatcct

SEQ ID NO: 689254 - DNA, 25 bp, Mus musculus
gctatacgtccaagattgcaggaaa

SEQ ID NO: 689255 - DNA, 25 bp, Mus musculus
gctatacgtccatgattgcaggaaa

SEQ ID NO: 689256 - DNA, 25 bp, Mus musculus
gctatactcctgatctggtttgcgg

SEQ ID NO: 689257 - DNA, 25 bp, Mus musculus
gctatactcctgttctggtttgcgg

SEQ ID NO: 689258 - DNA, 25 bp, Mus musculus
gctatactttgcaccctagaccaca

SEQ ID NO: 689259 - DNA, 25 bp, Mus musculus
gctatactttgctccctagaccaca

SEQ ID NO: 689260 - DNA, 25 bp, Mus musculus
gctatagaatgcaaggagctctgga

SEQ ID NO: 689261 - DNA, 25 bp, Mus musculus
gctatagaatgctaggagctctgga

SEQ ID NO: 689262 - DNA, 25 bp, Mus musculus
gctatagactataccgctggcaggg

SEQ ID NO: 689263 - DNA, 25 bp, Mus musculus
gctatagactattccgctggcaggg

SEQ ID NO: 689264 - DNA, 25 bp, Mus musculus
gctatagcacttacgatgaccggca

SEQ ID NO: 689265 - DNA, 25 bp, Mus musculus
gctatagcactttcgatgaccggca

SEQ ID NO: 689266 - DNA, 25 bp, Mus musculus
gctatagctactactaatgcagtga

SEQ ID NO: 689267 - DNA, 25 bp, Mus musculus
gctatagctacttctaatgcagtga

SEQ ID NO: 689268 - DNA, 25 bp, Mus musculus
gctataggacagacgacaaaactca

SEQ ID NO: 689269 - DNA, 25 bp, Mus musculus
gctataggacagtcgacaaaactca

SEQ ID NO: 689270 - DNA, 25 bp, Mus musculus
gctatagtgccaaatttgcctcctg

SEQ ID NO: 689271 - DNA, 25 bp, Mus musculus
gctatagtgccatatttgcctcctg

SEQ ID NO: 689272 - DNA, 25 bp, Mus musculus
gctatatggagcagacgacaagttc

SEQ ID NO: 689273 - DNA, 25 bp, Mus musculus
gctatatggagctgacgacaagttc

SEQ ID NO: 689274 - DNA, 25 bp, Mus musculus
gctatattagcgctgccgagctgcg

SEQ ID NO: 689275 - DNA, 25 bp, Mus musculus
gctatattagcggtgccgagctgcg

SEQ ID NO: 689276 - DNA, 25 bp, Mus musculus
gctatattcacaagtcttccaggca

SEQ ID NO: 689277 - DNA, 25 bp, Mus musculus
gctatattcacatgtcttccaggca

SEQ ID NO: 689278 - DNA, 25 bp, Mus musculus
gctatcaactttcacccagaaaatc

SEQ ID NO: 689279 - DNA, 25 bp, Mus musculus
gctatcaactttgacccagaaaatc

SEQ ID NO: 689280 - DNA, 25 bp, Mus musculus
gctatcaagaaccactcaagggctg

SEQ ID NO: 689281 - DNA, 25 bp, Mus musculus
gctatcaagaacgactcaagggctg

SEQ ID NO: 689282 - DNA, 25 bp, Mus musculus
gctatcaccacactattgtctctgg

SEQ ID NO: 689283 - DNA, 25 bp, Mus musculus
gctatcaccacagtattgtctctgg

SEQ ID NO: 689284 - DNA, 25 bp, Mus musculus
gctatcactcacaccttctgtggca

SEQ ID NO: 689285 - DNA, 25 bp, Mus musculus
gctatcactcactccttctgtggca

SEQ ID NO: 689286 - DNA, 25 bp, Mus musculus
gctatcagaagtcccgtggatattc

SEQ ID NO: 689287 - DNA, 25 bp, Mus musculus
gctatcagaagtgccgtggatattc

SEQ ID NO: 689288 - DNA, 25 bp, Mus musculus
gctatcagacagcaggcctgccagt

SEQ ID NO: 689289 - DNA, 25 bp, Mus musculus
gctatcagacaggaggcctgccagt

SEQ ID NO: 689290 - DNA, 25 bp, Mus musculus
gctatcagatgccaggaggctccct

SEQ ID NO: 689291 - DNA, 25 bp, Mus musculus
gctatcagatgcgaggaggctccct

SEQ ID NO: 689292 - DNA, 25 bp, Mus musculus
gctatcaggtgaattcagggcccca

SEQ ID NO: 689293 - DNA, 25 bp, Mus musculus
gctatcaggtgatttcagggcccca

SEQ ID NO: 689294 - DNA, 25 bp, Mus musculus
gctatcatcttgatactgctcaaaa

SEQ ID NO: 689295 - DNA, 25 bp, Mus musculus
gctatcatcttgttactgctcaaaa

SEQ ID NO: 689296 - DNA, 25 bp, Mus musculus
gctatcattaccagcgttcaactgt

SEQ ID NO: 689297 - DNA, 25 bp, Mus musculus
gctatcattacctgcgttcaactgt

SEQ ID NO: 689298 - DNA, 25 bp, Mus musculus
gctatcattagcaaggccaggtggc

SEQ ID NO: 689299 - DNA, 25 bp, Mus musculus
gctatcattagctaggccaggtggc

SEQ ID NO: 689300 - DNA, 25 bp, Mus musculus
gctatccacaggaacctttcacaac

SEQ ID NO: 689301 - DNA, 25 bp, Mus musculus
gctatccacaggtacctttcacaac

SEQ ID NO: 689302 - DNA, 25 bp, Mus musculus
gctatccatcgtcgaatgccccagg

SEQ ID NO: 689303 - DNA, 25 bp, Mus musculus
gctatccatcgtggaatgccccagg

SEQ ID NO: 689304 - DNA, 25 bp, Mus musculus
gctatcccctttcaggtggcccaga

SEQ ID NO: 689305 - DNA, 25 bp, Mus musculus
gctatcccctttgaggtggcccaga

SEQ ID NO: 689306 - DNA, 25 bp, Mus musculus
gctatcctcgttcgcgcaggcctaa

SEQ ID NO: 689307 - DNA, 25 bp, Mus musculus
gctatcctcgttggcgcaggcctaa

SEQ ID NO: 689308 - DNA, 25 bp, Mus musculus
gctatcctggaccacttgttgaaac

SEQ ID NO: 689309 - DNA, 25 bp, Mus musculus
gctatcctggacgacttgttgaaac

SEQ ID NO: 689310 - DNA, 25 bp, Mus musculus
gctatcctggctaccggctcaaggc

SEQ ID NO: 689311 - DNA, 25 bp, Mus musculus
gctatcctggctcagccttagagct

SEQ ID NO: 689312 - DNA, 25 bp, Mus musculus
gctatcctggctgagccttagagct

SEQ ID NO: 689313 - DNA, 25 bp, Mus musculus
gctatcctggcttccggctcaaggc

SEQ ID NO: 689314 - DNA, 25 bp, Mus musculus
gctatcgcatctcctattctacacg

SEQ ID NO: 689315 - DNA, 25 bp, Mus musculus
gctatcgcatctgctattctacacg

SEQ ID NO: 689316 - DNA, 25 bp, Mus musculus
gctatcgccacaaacggatatgtca

SEQ ID NO: 689317 - DNA, 25 bp, Mus musculus
gctatcgccacatacggatatgtca

SEQ ID NO: 689318 - DNA, 25 bp, Mus musculus
gctatcgccagcatccagtcagctg

SEQ ID NO: 689319 - DNA, 25 bp, Mus musculus
gctatcgccagcttccagtcagctg

SEQ ID NO: 689320 - DNA, 25 bp, Mus musculus
gctatcgcctgtctgatccttctgt

SEQ ID NO: 689321 - DNA, 25 bp, Mus musculus
gctatcgcctgtgtgatccttctgt

SEQ ID NO: 689322 - DNA, 25 bp, Mus musculus
gctatcgggtggcttacaagacagt

SEQ ID NO: 689323 - DNA, 25 bp, Mus musculus
gctatcgggtgggttacaagacagt

SEQ ID NO: 689324 - DNA, 25 bp, Mus musculus
gctatcggttgacaaatgctggcta

SEQ ID NO: 689325 - DNA, 25 bp, Mus musculus
gctatcggttgagaaatgctggcta

SEQ ID NO: 689326 - DNA, 25 bp, Mus musculus
gctatctacaatcaacccggctggg

SEQ ID NO: 689327 - DNA, 25 bp, Mus musculus
gctatctacaatgaacccggctggg

SEQ ID NO: 689328 - DNA, 25 bp, Mus musculus
gctatctactttcgctatgggatcc

SEQ ID NO: 689329 - DNA, 25 bp, Mus musculus
gctatctactttggctatgggatcc

SEQ ID NO: 689330 - DNA, 25 bp, Mus musculus
gctatctatgacctgaccctgaact

SEQ ID NO: 689331 - DNA, 25 bp, Mus musculus
gctatctatgacgtgaccctgaact

SEQ ID NO: 689332 - DNA, 25 bp, Mus musculus
gctatctccgagctgccctgattgg

SEQ ID NO: 689333 - DNA, 25 bp, Mus musculus
gctatctccgaggtgccctgattgg

SEQ ID NO: 689334 - DNA, 25 bp, Mus musculus
gctatctcttgtaggcggtgataac

SEQ ID NO: 689335 - DNA, 25 bp, Mus musculus
gctatctcttgttggcggtgataac

SEQ ID NO: 689336 - DNA, 25 bp, Mus musculus
gctatctgaagaagcagcagcctga

SEQ ID NO: 689337 - DNA, 25 bp, Mus musculus
gctatctgaagatgcagcagcctga

SEQ ID NO: 689338 - DNA, 25 bp, Mus musculus
gctatctgacacctggaagggctca

SEQ ID NO: 689339 - DNA, 25 bp, Mus musculus
gctatctgacacgtggaagggctca

SEQ ID NO: 689340 - DNA, 25 bp, Mus musculus
gctatctgccttccctgtatctgga

SEQ ID NO: 689341 - DNA, 25 bp, Mus musculus
gctatctgccttgcctgtatctgga

SEQ ID NO: 689342 - DNA, 25 bp, Mus musculus
gctatctggaaaatggcttcagcca

SEQ ID NO: 689343 - DNA, 25 bp, Mus musculus
gctatctggaaattggcttcagcca

SEQ ID NO: 689344 - DNA, 25 bp, Mus musculus
gctatctggaagctctcaaggagga

SEQ ID NO: 689345 - DNA, 25 bp, Mus musculus
gctatctggaaggtctcaaggagga

SEQ ID NO: 689346 - DNA, 25 bp, Mus musculus
gctatctggaggctgcatcaagatt

SEQ ID NO: 689347 - DNA, 25 bp, Mus musculus
gctatctggagggtgcatcaagatt

SEQ ID NO: 689348 - DNA, 25 bp, Mus musculus
gctatctggttcactacacgtacga

SEQ ID NO: 689349 - DNA, 25 bp, Mus musculus
gctatctggttctctacacgtacga

SEQ ID NO: 689350 - DNA, 25 bp, Mus musculus
gctatcttcaggagctctctgacag

SEQ ID NO: 689351 - DNA, 25 bp, Mus musculus
gctatcttcaggtgctctctgacag

SEQ ID NO: 689352 - DNA, 25 bp, Mus musculus
gctatcttcctgagatcgacaatca

SEQ ID NO: 689353 - DNA, 25 bp, Mus musculus
gctatcttcctgtgatcgacaatca

SEQ ID NO: 689354 - DNA, 25 bp, Mus musculus
gctatcttgatcaacgtagccttct

SEQ ID NO: 689355 - DNA, 25 bp, Mus musculus
gctatcttgatctacgtagccttct

SEQ ID NO: 689356 - DNA, 25 bp, Mus musculus
gctatcttgctcaacctggcacaca

SEQ ID NO: 689357 - DNA, 25 bp, Mus musculus
gctatcttgctctacctggcacaca

SEQ ID NO: 689358 - DNA, 25 bp, Mus musculus
gctatgaactctataaaatcaagga

SEQ ID NO: 689359 - DNA, 25 bp, Mus musculus
gctatgaactctttaaaatcaagga

SEQ ID NO: 689360 - DNA, 25 bp, Mus musculus
gctatgaagccaccgcagagacggc

SEQ ID NO: 689361 - DNA, 25 bp, Mus musculus
gctatgaagccagcgcagagacggc

SEQ ID NO: 689362 - DNA, 25 bp, Mus musculus
gctatgacagaaaacaagcttgtgg

SEQ ID NO: 689363 - DNA, 25 bp, Mus musculus
gctatgacagaatacaagcttgtgg

SEQ ID NO: 689364 - DNA, 25 bp, Mus musculus
gctatgacagctataacaacggagg

SEQ ID NO: 689365 - DNA, 25 bp, Mus musculus
gctatgacagctttaacaacggagg

SEQ ID NO: 689366 - DNA, 25 bp, Mus musculus
gctatgacccggacagtgatacctg

SEQ ID NO: 689367 - DNA, 25 bp, Mus musculus
gctatgacccggtcagtgatacctg

SEQ ID NO: 689368 - DNA, 25 bp, Mus musculus
gctatgaccttactgtatccttcag

SEQ ID NO: 689369 - DNA, 25 bp, Mus musculus
gctatgaccttagtgtatccttcag

SEQ ID NO: 689370 - DNA, 25 bp, Mus musculus
gctatgacgccgagcagcactgccg

SEQ ID NO: 689371 - DNA, 25 bp, Mus musculus
gctatgacgccgtgcagcactgccg

SEQ ID NO: 689372 - DNA, 25 bp, Mus musculus
gctatgactacgacgccccactgag

SEQ ID NO: 689373 - DNA, 25 bp, Mus musculus
gctatgactacgtcgccccactgag

SEQ ID NO: 689374 - DNA, 25 bp, Mus musculus
gctatgactcccagccctagcccat

SEQ ID NO: 689375 - DNA, 25 bp, Mus musculus
gctatgactccctgccctagcccat

SEQ ID NO: 689376 - DNA, 25 bp, Mus musculus
gctatgactcttcgcttcgacacac

SEQ ID NO: 689377 - DNA, 25 bp, Mus musculus
gctatgactcttggcttcgacacac

SEQ ID NO: 689378 - DNA, 25 bp, Mus musculus
gctatgagatcccatggaaggtcat

SEQ ID NO: 689379 - DNA, 25 bp, Mus musculus
gctatgagatccgatggaaggtcat

SEQ ID NO: 689380 - DNA, 25 bp, Mus musculus
gctatgaggaaaacagccgggaaga

SEQ ID NO: 689381 - DNA, 25 bp, Mus musculus
gctatgaggaaatcagccgggaaga

SEQ ID NO: 689382 - DNA, 25 bp, Mus musculus
gctatgaggcttaactgctgtcata

SEQ ID NO: 689383 - DNA, 25 bp, Mus musculus
gctatgaggctttactgctgtcata

SEQ ID NO: 689384 - DNA, 25 bp, Mus musculus
gctatgaggtgtcctgataaactga

SEQ ID NO: 689385 - DNA, 25 bp, Mus musculus
gctatgaggtgtgctgataaactga

SEQ ID NO: 689386 - DNA, 25 bp, Mus musculus
gctatgatgagtatggtttccgtgt

SEQ ID NO: 689387 - DNA, 25 bp, Mus musculus
gctatgatgagtttggtttccgtgt

SEQ ID NO: 689388 - DNA, 25 bp, Mus musculus
gctatgatgtggataaacgatggat

SEQ ID NO: 689389 - DNA, 25 bp, Mus musculus
gctatgatgtggttaaacgatggat

SEQ ID NO: 689390 - DNA, 25 bp, Mus musculus
gctatgatttttcttaactggaagg

SEQ ID NO: 689391 - DNA, 25 bp, Mus musculus
gctatgatttttgttaactggaagg

SEQ ID NO: 689392 - DNA, 25 bp, Mus musculus
gctatgcaagtgctcagcgctgaat

SEQ ID NO: 689393 - DNA, 25 bp, Mus musculus
gctatgcaagtggtcagcgctgaat

SEQ ID NO: 689394 - DNA, 25 bp, Mus musculus
gctatgcacctaattgatgttgcca

SEQ ID NO: 689395 - DNA, 25 bp, Mus musculus
gctatgcacctatttgatgttgcca

SEQ ID NO: 689396 - DNA, 25 bp, Mus musculus
gctatgcactacacgggtgctgggc

SEQ ID NO: 689397 - DNA, 25 bp, Mus musculus
gctatgcactactcgggtgctgggc

SEQ ID NO: 689398 - DNA, 25 bp, Mus musculus
gctatgcagaccagtacagcttgca

SEQ ID NO: 689399 - DNA, 25 bp, Mus musculus
gctatgcagacctgtacagcttgca

SEQ ID NO: 689400 - DNA, 25 bp, Mus musculus
gctatgccaacaccagacgcaggaa

SEQ ID NO: 689401 - DNA, 25 bp, Mus musculus
gctatgccaacagcagacgcaggaa

SEQ ID NO: 689402 - DNA, 25 bp, Mus musculus
gctatgccaagaagtgtcaggtgga

SEQ ID NO: 689403 - DNA, 25 bp, Mus musculus
gctatgccaagatgtgtcaggtgga

SEQ ID NO: 689404 - DNA, 25 bp, Mus musculus
gctatgccctgcaatgccgcttcag

SEQ ID NO: 689405 - DNA, 25 bp, Mus musculus
gctatgccctgctatgccgcttcag

SEQ ID NO: 689406 - DNA, 25 bp, Mus musculus
gctatgcctgaaacatactccttca

SEQ ID NO: 689407 - DNA, 25 bp, Mus musculus
gctatgcctgaatcatactccttca

SEQ ID NO: 689408 - DNA, 25 bp, Mus musculus
gctatgcctgtaacaagagcatcac

SEQ ID NO: 689409 - DNA, 25 bp, Mus musculus
gctatgcctgtatcaagagcatcac

SEQ ID NO: 689410 - DNA, 25 bp, Mus musculus
gctatgccttcactagctgctcaat

SEQ ID NO: 689411 - DNA, 25 bp, Mus musculus
gctatgccttcagtagctgctcaat

SEQ ID NO: 689412 - DNA, 25 bp, Mus musculus
gctatgcctttgcaattctatctga

SEQ ID NO: 689413 - DNA, 25 bp, Mus musculus
gctatgcctttggaattctatctga

SEQ ID NO: 689414 - DNA, 25 bp, Mus musculus
gctatgctagaaatacactccttca

SEQ ID NO: 689415 - DNA, 25 bp, Mus musculus
gctatgctagaattacactccttca

SEQ ID NO: 689416 - DNA, 25 bp, Mus musculus
gctatgctgatgagagacttggacc

SEQ ID NO: 689417 - DNA, 25 bp, Mus musculus
gctatgctgatgtgagacttggacc

SEQ ID NO: 689418 - DNA, 25 bp, Mus musculus
gctatgctgccgagaacaacagggt

SEQ ID NO: 689419 - DNA, 25 bp, Mus musculus
gctatgctgccgtgaacaacagggt

SEQ ID NO: 689420 - DNA, 25 bp, Mus musculus
gctatgctggaaatgctagaataca

SEQ ID NO: 689421 - DNA, 25 bp, Mus musculus
gctatgctggaattgctagaataca

SEQ ID NO: 689422 - DNA, 25 bp, Mus musculus
gctatgctggccaacaatgtcttgg

SEQ ID NO: 689423 - DNA, 25 bp, Mus musculus
gctatgctggcctacaatgtcttgg

SEQ ID NO: 689424 - DNA, 25 bp, Mus musculus
gctatgcttgaccacaggacaacat

SEQ ID NO: 689425 - DNA, 25 bp, Mus musculus
gctatgcttgacgacaggacaacat

SEQ ID NO: 689426 - DNA, 25 bp, Mus musculus
gctatgcttgttcaaggatctcagt

SEQ ID NO: 689427 - DNA, 25 bp, Mus musculus
gctatgcttgttgaaggatctcagt

SEQ ID NO: 689428 - DNA, 25 bp, Mus musculus
gctatgcttttccacccctttacag

SEQ ID NO: 689429 - DNA, 25 bp, Mus musculus
gctatgcttttcgacccctttacag

SEQ ID NO: 689430 - DNA, 25 bp, Mus musculus
gctatggaagttcggaccttttccg

SEQ ID NO: 689431 - DNA, 25 bp, Mus musculus
gctatggaagttgggaccttttccg

SEQ ID NO: 689432 - DNA, 25 bp, Mus musculus
gctatggactgcacagcccgtgttc

SEQ ID NO: 689433 - DNA, 25 bp, Mus musculus
gctatggactgctcagcccgtgttc

SEQ ID NO: 689434 - DNA, 25 bp, Mus musculus
gctatggagcagagcatgtgcccct

SEQ ID NO: 689435 - DNA, 25 bp, Mus musculus
gctatggagcagtgcatgtgcccct

SEQ ID NO: 689436 - DNA, 25 bp, Mus musculus
gctatggagcatattgtgaagaagg

SEQ ID NO: 689437 - DNA, 25 bp, Mus musculus
gctatggagcattttgtgaagaagg

SEQ ID NO: 689438 - DNA, 25 bp, Mus musculus
gctatggatttgaacactttgaaac

SEQ ID NO: 689439 - DNA, 25 bp, Mus musculus
gctatggatttgtacactttgaaac

SEQ ID NO: 689440 - DNA, 25 bp, Mus musculus
gctatggcaagcaaagcagtgacga

SEQ ID NO: 689441 - DNA, 25 bp, Mus musculus
gctatggcaagctaagcagtgacga

SEQ ID NO: 689442 - DNA, 25 bp, Mus musculus
gctatggcaatgagttcagcctaca

SEQ ID NO: 689443 - DNA, 25 bp, Mus musculus
gctatggcaatgtgttcagcctaca

SEQ ID NO: 689444 - DNA, 25 bp, Mus musculus
gctatggcattcagccccaaagatc

SEQ ID NO: 689445 - DNA, 25 bp, Mus musculus
gctatggcattctgccccaaagatc

SEQ ID NO: 689446 - DNA, 25 bp, Mus musculus
gctatggccaccaactagggcggcc

SEQ ID NO: 689447 - DNA, 25 bp, Mus musculus
gctatggccacctactagggcggcc

SEQ ID NO: 689448 - DNA, 25 bp, Mus musculus
gctatggccaggataacaccaccaa

SEQ ID NO: 689449 - DNA, 25 bp, Mus musculus
gctatggccaggttaacaccaccaa

SEQ ID NO: 689450 - DNA, 25 bp, Mus musculus
gctatggccagtccaccggagagtt

SEQ ID NO: 689451 - DNA, 25 bp, Mus musculus
gctatggccagtgcaccggagagtt

SEQ ID NO: 689452 - DNA, 25 bp, Mus musculus
gctatggcccatcctttttcctgtg

SEQ ID NO: 689453 - DNA, 25 bp, Mus musculus
gctatggcccatgctttttcctgtg

SEQ ID NO: 689454 - DNA, 25 bp, Mus musculus
gctatggcgacacgtcgacctgacg

SEQ ID NO: 689455 - DNA, 25 bp, Mus musculus
gctatggcgacaggtcgacctgacg

SEQ ID NO: 689456 - DNA, 25 bp, Mus musculus
gctatggcggctatgattatactgg

SEQ ID NO: 689457 - DNA, 25 bp, Mus musculus
gctatggcggctttgattatactgg

SEQ ID NO: 689458 - DNA, 25 bp, Mus musculus
gctatggcgtttctaactgaagaca

SEQ ID NO: 689459 - DNA, 25 bp, Mus musculus
gctatggcgtttgtaactgaagaca

SEQ ID NO: 689460 - DNA, 25 bp, Mus musculus
gctatggctctcagcagatctgaaa

SEQ ID NO: 689461 - DNA, 25 bp, Mus musculus
gctatggctctctgcagatctgaaa

SEQ ID NO: 689462 - DNA, 25 bp, Mus musculus
gctatggctggcacccggccactgt

SEQ ID NO: 689463 - DNA, 25 bp, Mus musculus
gctatggctggctcccggccactgt

SEQ ID NO: 689464 - DNA, 25 bp, Mus musculus
gctatgggaactactgactggagag

SEQ ID NO: 689465 - DNA, 25 bp, Mus musculus
gctatgggaacttctgactggagag

SEQ ID NO: 689466 - DNA, 25 bp, Mus musculus
gctatgggaatgatgacagaatact

SEQ ID NO: 689467 - DNA, 25 bp, Mus musculus
gctatgggaatgttgacagaatact

SEQ ID NO: 689468 - DNA, 25 bp, Mus musculus
gctatgggcgcacgtatggccccaa

SEQ ID NO: 689469 - DNA, 25 bp, Mus musculus
gctatgggcgcaggtatggccccaa

SEQ ID NO: 689470 - DNA, 25 bp, Mus musculus
gctatggtgtgcagtatgattattt

SEQ ID NO: 689471 - DNA, 25 bp, Mus musculus
gctatggtgtgctgtatgattattt

SEQ ID NO: 689472 - DNA, 25 bp, Mus musculus
gctatggttaccaagccctggtgca

SEQ ID NO: 689473 - DNA, 25 bp, Mus musculus
gctatggttacctagccctggtgca

SEQ ID NO: 689474 - DNA, 25 bp, Mus musculus
gctatgtatacccaattaataaagt

SEQ ID NO: 689475 - DNA, 25 bp, Mus musculus
gctatgtataccgaattaataaagt

SEQ ID NO: 689476 - DNA, 25 bp, Mus musculus
gctatgtatgtaagccaaggagacc

SEQ ID NO: 689477 - DNA, 25 bp, Mus musculus
gctatgtatgtatgccaaggagacc

SEQ ID NO: 689478 - DNA, 25 bp, Mus musculus
gctatgtcatggaaagaattgtgct

SEQ ID NO: 689479 - DNA, 25 bp, Mus musculus
gctatgtcatggtaagaattgtgct

SEQ ID NO: 689480 - DNA, 25 bp, Mus musculus
gctatgtccggaagggaatcccgct

SEQ ID NO: 689481 - DNA, 25 bp, Mus musculus
gctatgtccggatgggaatcccgct

SEQ ID NO: 689482 - DNA, 25 bp, Mus musculus
gctatgtctcttccgggtgctccca

SEQ ID NO: 689483 - DNA, 25 bp, Mus musculus
gctatgtctcttgcgggtgctccca

SEQ ID NO: 689484 - DNA, 25 bp, Mus musculus
gctatgtctttcagatggaaatgat

SEQ ID NO: 689485 - DNA, 25 bp, Mus musculus
gctatgtctttctgatggaaatgat

SEQ ID NO: 689486 - DNA, 25 bp, Mus musculus
gctatgtgagctagaccctgcttgt

SEQ ID NO: 689487 - DNA, 25 bp, Mus musculus
gctatgtgagcttgaccctgcttgt

SEQ ID NO: 689488 - DNA, 25 bp, Mus musculus
gctatgtgagttccacaaaaccatc

SEQ ID NO: 689489 - DNA, 25 bp, Mus musculus
gctatgtgagttgcacaaaaccatc

SEQ ID NO: 689490 - DNA, 25 bp, Mus musculus
gctatgtgatccaagctagctttga

SEQ ID NO: 689491 - DNA, 25 bp, Mus musculus
gctatgtgatcctagctagctttga

SEQ ID NO: 689492 - DNA, 25 bp, Mus musculus
gctatgtgatcgctggctattacca

SEQ ID NO: 689493 - DNA, 25 bp, Mus musculus
gctatgtgatcggtggctattacca

SEQ ID NO: 689494 - DNA, 25 bp, Mus musculus
gctatgtggacgacatgcaggtcct

SEQ ID NO: 689495 - DNA, 25 bp, Mus musculus
gctatgtggacgtcatgcaggtcct

SEQ ID NO: 689496 - DNA, 25 bp, Mus musculus
gctatgtggcttagagcacagatca

SEQ ID NO: 689497 - DNA, 25 bp, Mus musculus
gctatgtggctttgagcacagatca

SEQ ID NO: 689498 - DNA, 25 bp, Mus musculus
gctatgttaatccttctggaggagc

SEQ ID NO: 689499 - DNA, 25 bp, Mus musculus
gctatgttaatcgttctggaggagc

SEQ ID NO: 689500 - DNA, 25 bp, Mus musculus
gctatgttttcgagctgctgcgggt

SEQ ID NO: 689501 - DNA, 25 bp, Mus musculus
gctatgttttcgtgctgctgcgggt

SEQ ID NO: 689502 - DNA, 25 bp, Mus musculus
gctattaaagctccggtcagtctag

SEQ ID NO: 689503 - DNA, 25 bp, Mus musculus
gctattaaagctgcggtcagtctag

SEQ ID NO: 689504 - DNA, 25 bp, Mus musculus
gctattaaatccctgtcgagaatat

SEQ ID NO: 689505 - DNA, 25 bp, Mus musculus
gctattaaatccgtgtcgagaatat

SEQ ID NO: 689506 - DNA, 25 bp, Mus musculus
gctattaacattccaaaactggacc

SEQ ID NO: 689507 - DNA, 25 bp, Mus musculus
gctattaacattgcaaaactggacc

SEQ ID NO: 689508 - DNA, 25 bp, Mus musculus
gctattaatcagaagctgggtgaca

SEQ ID NO: 689509 - DNA, 25 bp, Mus musculus
gctattaatcagtagctgggtgaca

SEQ ID NO: 689510 - DNA, 25 bp, Mus musculus
gctattaccgttcctgctgaaacag

SEQ ID NO: 689511 - DNA, 25 bp, Mus musculus
gctattaccgttgctgctgaaacag

SEQ ID NO: 689512 - DNA, 25 bp, Mus musculus
gctattacggctacggccccggcta

SEQ ID NO: 689513 - DNA, 25 bp, Mus musculus
gctattacggcttcggccccggcta

SEQ ID NO: 689514 - DNA, 25 bp, Mus musculus
gctattagacctccttggcaaagaa

SEQ ID NO: 689515 - DNA, 25 bp, Mus musculus
gctattagacctgcttggcaaagaa

SEQ ID NO: 689516 - DNA, 25 bp, Mus musculus
gctattagagacaaccacattggga

SEQ ID NO: 689517 - DNA, 25 bp, Mus musculus
gctattagagactaccacattggga

SEQ ID NO: 689518 - DNA, 25 bp, Mus musculus
gctattagagatcatgcataaattg

SEQ ID NO: 689519 - DNA, 25 bp, Mus musculus
gctattagagatgatgcataaattg

SEQ ID NO: 689520 - DNA, 25 bp, Mus musculus
gctattatgagaatggatcttcagt

SEQ ID NO: 689521 - DNA, 25 bp, Mus musculus
gctattatgagattggatcttcagt

SEQ ID NO: 689522 - DNA, 25 bp, Mus musculus
gctattcaccgcctctacgaggagt

SEQ ID NO: 689523 - DNA, 25 bp, Mus musculus
gctattcaccgcgtctacgaggagt

SEQ ID NO: 689524 - DNA, 25 bp, Mus musculus
gctattcagtgcaagctctatcaat

SEQ ID NO: 689525 - DNA, 25 bp, Mus musculus
gctattcagtgctagctctatcaat

SEQ ID NO: 689526 - DNA, 25 bp, Mus musculus
gctattcataaacagactggccaga

SEQ ID NO: 689527 - DNA, 25 bp, Mus musculus
gctattcataaagagactggccaga

SEQ ID NO: 689528 - DNA, 25 bp, Mus musculus
gctattcccggaaatgcaagcacag

SEQ ID NO: 689529 - DNA, 25 bp, Mus musculus
gctattcccggatatgcaagcacag

SEQ ID NO: 689530 - DNA, 25 bp, Mus musculus
gctattcctagaactggtcatgaca

SEQ ID NO: 689531 - DNA, 25 bp, Mus musculus
gctattcctagatctggtcatgaca

SEQ ID NO: 689532 - DNA, 25 bp, Mus musculus
gctattcctgtgaagatgatctgcc

SEQ ID NO: 689533 - DNA, 25 bp, Mus musculus
gctattcctgtgtagatgatctgcc

SEQ ID NO: 689534 - DNA, 25 bp, Mus musculus
gctattctagacacagttgagttga

SEQ ID NO: 689535 - DNA, 25 bp, Mus musculus
gctattctagactcagttgagttga

SEQ ID NO: 689536 - DNA, 25 bp, Mus musculus
gctattctattgaaactgccagtga

SEQ ID NO: 689537 - DNA, 25 bp, Mus musculus
gctattctattgtaactgccagtga

SEQ ID NO: 689538 - DNA, 25 bp, Mus musculus
gctattgaaaaaatgaatgggatgc

SEQ ID NO: 689539 - DNA, 25 bp, Mus musculus
gctattgaaaaattgaatgggatgc

SEQ ID NO: 689540 - DNA, 25 bp, Mus musculus
gctattgaaagcaagtgcccggagg

SEQ ID NO: 689541 - DNA, 25 bp, Mus musculus
gctattgaaagctagtgcccggagg

SEQ ID NO: 689542 - DNA, 25 bp, Mus musculus
gctattgacccaaacagctgttgga

SEQ ID NO: 689543 - DNA, 25 bp, Mus musculus
gctattgacccatacagctgttgga

SEQ ID NO: 689544 - DNA, 25 bp, Mus musculus
gctattgagaagctaacccacgatt

SEQ ID NO: 689545 - DNA, 25 bp, Mus musculus
gctattgagaaggtaacccacgatt

SEQ ID NO: 689546 - DNA, 25 bp, Mus musculus
gctattgagttgcaggacctacttc

SEQ ID NO: 689547 - DNA, 25 bp, Mus musculus
gctattgagttggaggacctacttc

SEQ ID NO: 689548 - DNA, 25 bp, Mus musculus
gctattgctatgcactctgactgca

SEQ ID NO: 689549 - DNA, 25 bp, Mus musculus
gctattgctatggactctgactgca

SEQ ID NO: 689550 - DNA, 25 bp, Mus musculus
gctattggatcgatgctgggtgtca

SEQ ID NO: 689551 - DNA, 25 bp, Mus musculus
gctattggatcgttgctgggtgtca

SEQ ID NO: 689552 - DNA, 25 bp, Mus musculus
gctattggcattcgcttggcatcta

SEQ ID NO: 689553 - DNA, 25 bp, Mus musculus
gctattggcattggcttggcatcta

SEQ ID NO: 689554 - DNA, 25 bp, Mus musculus
gctattggctataactgactgttaa

SEQ ID NO: 689555 - DNA, 25 bp, Mus musculus
gctattggctattactgactgttaa

SEQ ID NO: 689556 - DNA, 25 bp, Mus musculus
gctattgtgctcaggatctctcctg

SEQ ID NO: 689557 - DNA, 25 bp, Mus musculus
gctattgtgctctggatctctcctg

SEQ ID NO: 689558 - DNA, 25 bp, Mus musculus
gctattgtggacacagggacatctc

SEQ ID NO: 689559 - DNA, 25 bp, Mus musculus
gctattgtggactcagggacatctc

SEQ ID NO: 689560 - DNA, 25 bp, Mus musculus
gctattgtgggacttatggccaatg

SEQ ID NO: 689561 - DNA, 25 bp, Mus musculus
gctattgtgggagttatggccaatg

SEQ ID NO: 689562 - DNA, 25 bp, Mus musculus
gctattgttccacttactaagatgg

SEQ ID NO: 689563 - DNA, 25 bp, Mus musculus
gctattgttccagttactaagatgg

SEQ ID NO: 689564 - DNA, 25 bp, Mus musculus
gctatttactatccatcccagcact

SEQ ID NO: 689565 - DNA, 25 bp, Mus musculus
gctatttactatgcatcccagcact

SEQ ID NO: 689566 - DNA, 25 bp, Mus musculus
gctatttccagtccaccagcatttg

SEQ ID NO: 689567 - DNA, 25 bp, Mus musculus
gctatttccagtgcaccagcatttg

SEQ ID NO: 689568 - DNA, 25 bp, Mus musculus
gctatttcgccacgactagatatca

SEQ ID NO: 689569 - DNA, 25 bp, Mus musculus
gctatttcgccaggactagatatca

SEQ ID NO: 689570 - DNA, 25 bp, Mus musculus
gctatttctactatgggatcctgca

SEQ ID NO: 689571 - DNA, 25 bp, Mus musculus
gctatttctactttgggatcctgca

SEQ ID NO: 689572 - DNA, 25 bp, Mus musculus
gctatttgctgtagagttatcccaa

SEQ ID NO: 689573 - DNA, 25 bp, Mus musculus
gctatttgctgttgagttatcccaa

SEQ ID NO: 689574 - DNA, 25 bp, Mus musculus
gctattttaactaaggagcagaaca

SEQ ID NO: 689575 - DNA, 25 bp, Mus musculus
gctattttaacttaggagcagaaca

SEQ ID NO: 689576 - DNA, 25 bp, Mus musculus
gctattttacatcgattctacccag

SEQ ID NO: 689577 - DNA, 25 bp, Mus musculus
gctattttacatggattctacccag

SEQ ID NO: 689578 - DNA, 25 bp, Mus musculus
gctattttccatacccgaattacag

SEQ ID NO: 689579 - DNA, 25 bp, Mus musculus
gctattttccattcccgaattacag

SEQ ID NO: 689580 - DNA, 25 bp, Mus musculus
gctattttcgtccagtctcccaact

SEQ ID NO: 689581 - DNA, 25 bp, Mus musculus
gctattttcgtcgagtctcccaact

SEQ ID NO: 689582 - DNA, 25 bp, Mus musculus
gctattttctcaaagtcacagctag

SEQ ID NO: 689583 - DNA, 25 bp, Mus musculus
gctattttctcatagtcacagctag

SEQ ID NO: 689584 - DNA, 25 bp, Mus musculus
gctattttgtgcctgcagttccgca

SEQ ID NO: 689585 - DNA, 25 bp, Mus musculus
gctattttgtgcgtgcagttccgca

SEQ ID NO: 689586 - DNA, 25 bp, Mus musculus
gctcaaaagaggcttcgcccctcaa

SEQ ID NO: 689587 - DNA, 25 bp, Mus musculus
gctcaaaagagggttcgcccctcaa

SEQ ID NO: 689588 - DNA, 25 bp, Mus musculus
gctcaaactaccatccatatggttc

SEQ ID NO: 689589 - DNA, 25 bp, Mus musculus
gctcaaactaccttccatatggttc

SEQ ID NO: 689590 - DNA, 25 bp, Mus musculus
gctcaaactcacattcgagcagtct

SEQ ID NO: 689591 - DNA, 25 bp, Mus musculus
gctcaaactcactttcgagcagtct

SEQ ID NO: 689592 - DNA, 25 bp, Mus musculus
gctcaaactctcaaaggtcggacaa

SEQ ID NO: 689593 - DNA, 25 bp, Mus musculus
gctcaaactctctaaggtcggacaa

SEQ ID NO: 689594 - DNA, 25 bp, Mus musculus
gctcaaactgctaattctgccaatc

SEQ ID NO: 689595 - DNA, 25 bp, Mus musculus
gctcaaactgcttattctgccaatc

SEQ ID NO: 689596 - DNA, 25 bp, Mus musculus
gctcaaacttatccttctgttggag

SEQ ID NO: 689597 - DNA, 25 bp, Mus musculus
gctcaaacttatgcttctgttggag

SEQ ID NO: 689598 - DNA, 25 bp, Mus musculus
gctcaaacttcgactgccaccagag

SEQ ID NO: 689599 - DNA, 25 bp, Mus musculus
gctcaaacttcgtctgccaccagag

SEQ ID NO: 689600 - DNA, 25 bp, Mus musculus
gctcaaagataaaaaatgtcggtgg

SEQ ID NO: 689601 - DNA, 25 bp, Mus musculus
gctcaaagataataaatgtcggtgg

SEQ ID NO: 689602 - DNA, 25 bp, Mus musculus
gctcaaatgctaaagacgtggtcag

SEQ ID NO: 689603 - DNA, 25 bp, Mus musculus
gctcaaatgctatagacgtggtcag

SEQ ID NO: 689604 - DNA, 25 bp, Mus musculus
gctcaacaccaaagtagccaagaat

SEQ ID NO: 689605 - DNA, 25 bp, Mus musculus
gctcaacaccaatgtagccaagaat

SEQ ID NO: 689606 - DNA, 25 bp, Mus musculus
gctcaacagcggcaaggtgatgtac

SEQ ID NO: 689607 - DNA, 25 bp, Mus musculus
gctcaacagcgggaaggtgatgtac

SEQ ID NO: 689608 - DNA, 25 bp, Mus musculus
gctcaacatgaaattcaaggctgaa

SEQ ID NO: 689609 - DNA, 25 bp, Mus musculus
gctcaacatgaacaacgagaaatga

SEQ ID NO: 689610 - DNA, 25 bp, Mus musculus
gctcaacatgaagaacgagaaatga

SEQ ID NO: 689611 - DNA, 25 bp, Mus musculus
gctcaacatgaatttcaaggctgaa

SEQ ID NO: 689612 - DNA, 25 bp, Mus musculus
gctcaacatgttccagaccctcaag

SEQ ID NO: 689613 - DNA, 25 bp, Mus musculus
gctcaacatgttgcagaccctcaag

SEQ ID NO: 689614 - DNA, 25 bp, Mus musculus
gctcaacgaaatagtgggcaatgaa

SEQ ID NO: 689615 - DNA, 25 bp, Mus musculus
gctcaacgaaattgtgggcaatgaa

SEQ ID NO: 689616 - DNA, 25 bp, Mus musculus
gctcaacgcacaccgtgtcggatac

SEQ ID NO: 689617 - DNA, 25 bp, Mus musculus
gctcaacgcacagcgtgtcggatac

SEQ ID NO: 689618 - DNA, 25 bp, Mus musculus
gctcaacgccttcgccgagatgctg

SEQ ID NO: 689619 - DNA, 25 bp, Mus musculus
gctcaacgccttggccgagatgctg

SEQ ID NO: 689620 - DNA, 25 bp, Mus musculus
gctcaacgcttgcaaatttggcttg

SEQ ID NO: 689621 - DNA, 25 bp, Mus musculus
gctcaacgcttggaaatttggcttg

SEQ ID NO: 689622 - DNA, 25 bp, Mus musculus
gctcaacggaaacaggattccctac

SEQ ID NO: 689623 - DNA, 25 bp, Mus musculus
gctcaacggaaagaggattccctac

SEQ ID NO: 689624 - DNA, 25 bp, Mus musculus
gctcaacggcgtagttctcaacaag

SEQ ID NO: 689625 - DNA, 25 bp, Mus musculus
gctcaacggcgttgttctcaacaag

SEQ ID NO: 689626 - DNA, 25 bp, Mus musculus
gctcaactccaacgacgtctttctg

SEQ ID NO: 689627 - DNA, 25 bp, Mus musculus
gctcaactccaaggacgtctttctg

SEQ ID NO: 689628 - DNA, 25 bp, Mus musculus
gctcaactccacaaatggagagctg

SEQ ID NO: 689629 - DNA, 25 bp, Mus musculus
gctcaactccactaatggagagctg

SEQ ID NO: 689630 - DNA, 25 bp, Mus musculus
gctcaactgaataaagccttgtggg

SEQ ID NO: 689631 - DNA, 25 bp, Mus musculus
gctcaactgaattaagccttgtggg

SEQ ID NO: 689632 - DNA, 25 bp, Mus musculus
gctcaactgcctaatgtacaaaatg

SEQ ID NO: 689633 - DNA, 25 bp, Mus musculus
gctcaactgccttatgtacaaaatg

SEQ ID NO: 689634 - DNA, 25 bp, Mus musculus
gctcaactgttgacaggagatggaa

SEQ ID NO: 689635 - DNA, 25 bp, Mus musculus
gctcaactgttgtcaggagatggaa

SEQ ID NO: 689636 - DNA, 25 bp, Mus musculus
gctcaacttcgacgagatcgacgag

SEQ ID NO: 689637 - DNA, 25 bp, Mus musculus
gctcaacttcgaggagatcgacgag

SEQ ID NO: 689638 - DNA, 25 bp, Mus musculus
gctcaagaacttagccatgattggg

SEQ ID NO: 689639 - DNA, 25 bp, Mus musculus
gctcaagaactttgccatgattggg

SEQ ID NO: 689640 - DNA, 25 bp, Mus musculus
gctcaagatcaacgtcgcctcgaca

SEQ ID NO: 689641 - DNA, 25 bp, Mus musculus
gctcaagatcaaggtcgcctcgaca

SEQ ID NO: 689642 - DNA, 25 bp, Mus musculus
gctcaagatctcaagccacctgaag

SEQ ID NO: 689643 - DNA, 25 bp, Mus musculus
gctcaagatctctagccacctgaag

SEQ ID NO: 689644 - DNA, 25 bp, Mus musculus
gctcaagatgagagtgggcctgcca

SEQ ID NO: 689645 - DNA, 25 bp, Mus musculus
gctcaagatgagtgtgggcctgcca

SEQ ID NO: 689646 - DNA, 25 bp, Mus musculus
gctcaagatgtccacggaagagatt

SEQ ID NO: 689647 - DNA, 25 bp, Mus musculus
gctcaagatgtcgacggaagagatt

SEQ ID NO: 689648 - DNA, 25 bp, Mus musculus
gctcaagcaagacgtcgcaaataca

SEQ ID NO: 689649 - DNA, 25 bp, Mus musculus
gctcaagcaagaggtcgcaaataca

SEQ ID NO: 689650 - DNA, 25 bp, Mus musculus
gctcaagccacacagtatgccttcg

SEQ ID NO: 689651 - DNA, 25 bp, Mus musculus
gctcaagccacagagtatgccttcg

SEQ ID NO: 689652 - DNA, 25 bp, Mus musculus
gctcaagcgcatcggcatggcatgt

SEQ ID NO: 689653 - DNA, 25 bp, Mus musculus
gctcaagcgcatgggcatggcatgt

SEQ ID NO: 689654 - DNA, 25 bp, Mus musculus
gctcaagcggctcgatctgcgcgat

SEQ ID NO: 689655 - DNA, 25 bp, Mus musculus
gctcaagcggctggatctgcgcgat

SEQ ID NO: 689656 - DNA, 25 bp, Mus musculus
gctcaaggaaacaggaactctggaa

SEQ ID NO: 689657 - DNA, 25 bp, Mus musculus
gctcaaggaaactggaactctggaa

SEQ ID NO: 689658 - DNA, 25 bp, Mus musculus
gctcaaggagaaactgaaggacacc

SEQ ID NO: 689659 - DNA, 25 bp, Mus musculus
gctcaaggagaatctgaaggacacc

SEQ ID NO: 689660 - DNA, 25 bp, Mus musculus
gctcaaggccttctcactgaagttt

SEQ ID NO: 689661 - DNA, 25 bp, Mus musculus
gctcaaggccttgtcactgaagttt

SEQ ID NO: 689662 - DNA, 25 bp, Mus musculus
gctcaaggctttcggccacttctct

SEQ ID NO: 689663 - DNA, 25 bp, Mus musculus
gctcaaggctttgggccacttctct

SEQ ID NO: 689664 - DNA, 25 bp, Mus musculus
gctcaagggcatagtgaccaggtta

SEQ ID NO: 689665 - DNA, 25 bp, Mus musculus
gctcaagggcattgtgaccaggtta

SEQ ID NO: 689666 - DNA, 25 bp, Mus musculus
gctcaaggtcaactcagcattcctg

SEQ ID NO: 689667 - DNA, 25 bp, Mus musculus
gctcaaggtcaagtcagcattcctg

SEQ ID NO: 689668 - DNA, 25 bp, Mus musculus
gctcaagtaacacttttaacccagt

SEQ ID NO: 689669 - DNA, 25 bp, Mus musculus
gctcaagtaacagttttaacccagt

SEQ ID NO: 689670 - DNA, 25 bp, Mus musculus
gctcaagtacacctgtctgaagagg

SEQ ID NO: 689671 - DNA, 25 bp, Mus musculus
gctcaagtacacgtgtctgaagagg

SEQ ID NO: 689672 - DNA, 25 bp, Mus musculus
gctcaagtcaatacacagcaagatg

SEQ ID NO: 689673 - DNA, 25 bp, Mus musculus
gctcaagtcaattcacagcaagatg

SEQ ID NO: 689674 - DNA, 25 bp, Mus musculus
gctcaagtcattctcctggtcattc

SEQ ID NO: 689675 - DNA, 25 bp, Mus musculus
gctcaagtcattgtcctggtcattc

SEQ ID NO: 689676 - DNA, 25 bp, Mus musculus
gctcaagtgggacccgttccccttg

SEQ ID NO: 689677 - DNA, 25 bp, Mus musculus
gctcaagtgggagccgttccccttg

SEQ ID NO: 689678 - DNA, 25 bp, Mus musculus
gctcaagttagcagtggcctgggat

SEQ ID NO: 689679 - DNA, 25 bp, Mus musculus
gctcaagttagctgtggcctgggat

SEQ ID NO: 689680 - DNA, 25 bp, Mus musculus
gctcaagttcaacgcgtgtctggta

SEQ ID NO: 689681 - DNA, 25 bp, Mus musculus
gctcaagttcaaggcgtgtctggta

SEQ ID NO: 689682 - DNA, 25 bp, Mus musculus
gctcaagtttgaaatgggccacgtg

SEQ ID NO: 689683 - DNA, 25 bp, Mus musculus
gctcaagtttgatatgggccacgtg

SEQ ID NO: 689684 - DNA, 25 bp, Mus musculus
gctcaatgctataagagactaccac

SEQ ID NO: 689685 - DNA, 25 bp, Mus musculus
gctcaatgctattagagactaccac

SEQ ID NO: 689686 - DNA, 25 bp, Mus musculus
gctcaatggtttagaccctcagaaa

SEQ ID NO: 689687 - DNA, 25 bp, Mus musculus
gctcaatggttttgaccctcagaaa

SEQ ID NO: 689688 - DNA, 25 bp, Mus musculus
gctcaatgtctcaggccatgtcaag

SEQ ID NO: 689689 - DNA, 25 bp, Mus musculus
gctcaatgtctctggccatgtcaag

SEQ ID NO: 689690 - DNA, 25 bp, Mus musculus
gctcaatgtgtacaggagaaatggc

SEQ ID NO: 689691 - DNA, 25 bp, Mus musculus
gctcaatgtgtagaggagaaatggc

SEQ ID NO: 689692 - DNA, 25 bp, Mus musculus
gctcaatgtgtcaactgcaaaagtt

SEQ ID NO: 689693 - DNA, 25 bp, Mus musculus
gctcaatgtgtctactgcaaaagtt

SEQ ID NO: 689694 - DNA, 25 bp, Mus musculus
gctcaattaagaaacatcagggaga

SEQ ID NO: 689695 - DNA, 25 bp, Mus musculus
gctcaattaagatacatcagggaga

SEQ ID NO: 689696 - DNA, 25 bp, Mus musculus
gctcaattacctccgcatctcagag

SEQ ID NO: 689697 - DNA, 25 bp, Mus musculus
gctcaattacctgcgcatctcagag

SEQ ID NO: 689698 - DNA, 25 bp, Mus musculus
gctcaattgtgtcgttggatctcag

SEQ ID NO: 689699 - DNA, 25 bp, Mus musculus
gctcaattgtgtggttggatctcag

SEQ ID NO: 689700 - DNA, 25 bp, Mus musculus
gctcacaaacatcagaacatttgct

SEQ ID NO: 689701 - DNA, 25 bp, Mus musculus
gctcacaaacatgagaacatttgct

SEQ ID NO: 689702 - DNA, 25 bp, Mus musculus
gctcacaacagtcgcgaagactcag

SEQ ID NO: 689703 - DNA, 25 bp, Mus musculus
gctcacaacagtggcgaagactcag

SEQ ID NO: 689704 - DNA, 25 bp, Mus musculus
gctcacaactgcagaagatggacca

SEQ ID NO: 689705 - DNA, 25 bp, Mus musculus
gctcacaactgctgaagatggacca

SEQ ID NO: 689706 - DNA, 25 bp, Mus musculus
gctcacagaagccatgtataccaac

SEQ ID NO: 689707 - DNA, 25 bp, Mus musculus
gctcacagaagcgatgtataccaac

SEQ ID NO: 689708 - DNA, 25 bp, Mus musculus
gctcacagagatcggctttcctgag

SEQ ID NO: 689709 - DNA, 25 bp, Mus musculus
gctcacagagatgggctttcctgag

SEQ ID NO: 689710 - DNA, 25 bp, Mus musculus
gctcacagatgcactgacccagaga

SEQ ID NO: 689711 - DNA, 25 bp, Mus musculus
gctcacagatgctctgacccagaga

SEQ ID NO: 689712 - DNA, 25 bp, Mus musculus
gctcacagcccaactctaatgtcag

SEQ ID NO: 689713 - DNA, 25 bp, Mus musculus
gctcacagcccatctctaatgtcag

SEQ ID NO: 689714 - DNA, 25 bp, Mus musculus
gctcacaggagtatctggttcccaa

SEQ ID NO: 689715 - DNA, 25 bp, Mus musculus
gctcacaggagtttctggttcccaa

SEQ ID NO: 689716 - DNA, 25 bp, Mus musculus
gctcacagtactccagggctaccat

SEQ ID NO: 689717 - DNA, 25 bp, Mus musculus
gctcacagtactgcagggctaccat

SEQ ID NO: 689718 - DNA, 25 bp, Mus musculus
gctcacatcagtcctttaaatgctg

SEQ ID NO: 689719 - DNA, 25 bp, Mus musculus
gctcacatcagtgctttaaatgctg

SEQ ID NO: 689720 - DNA, 25 bp, Mus musculus
gctcacatcgtgctggaggccacct

SEQ ID NO: 689721 - DNA, 25 bp, Mus musculus
gctcacatcgtggtggaggccacct

SEQ ID NO: 689722 - DNA, 25 bp, Mus musculus
gctcaccaagaacatctggttgctt

SEQ ID NO: 689723 - DNA, 25 bp, Mus musculus
gctcaccaagaagatctggttgctt

SEQ ID NO: 689724 - DNA, 25 bp, Mus musculus
gctcaccaagatctgtaccattcga

SEQ ID NO: 689725 - DNA, 25 bp, Mus musculus
gctcaccaagatgtgtaccattcga

SEQ ID NO: 689726 - DNA, 25 bp, Mus musculus
gctcaccactgaatgacttccagct

SEQ ID NO: 689727 - DNA, 25 bp, Mus musculus
gctcaccactgattgacttccagct

SEQ ID NO: 689728 - DNA, 25 bp, Mus musculus
gctcaccagaatctatccaggcctg

SEQ ID NO: 689729 - DNA, 25 bp, Mus musculus
gctcaccagaatgtatccaggcctg

SEQ ID NO: 689730 - DNA, 25 bp, Mus musculus
gctcaccagttcagtgatgcatctc

SEQ ID NO: 689731 - DNA, 25 bp, Mus musculus
gctcaccagttctgtgatgcatctc

SEQ ID NO: 689732 - DNA, 25 bp, Mus musculus
gctcaccatcatccactttatcaat

SEQ ID NO: 689733 - DNA, 25 bp, Mus musculus
gctcaccatcatgcactttatcaat

SEQ ID NO: 689734 - DNA, 25 bp, Mus musculus
gctcaccatgttagatgcggtgctc

SEQ ID NO: 689735 - DNA, 25 bp, Mus musculus
gctcaccatgtttgatgcggtgctc

SEQ ID NO: 689736 - DNA, 25 bp, Mus musculus
gctcaccattggctagctcatgcag

SEQ ID NO: 689737 - DNA, 25 bp, Mus musculus
gctcaccattgggtagctcatgcag

SEQ ID NO: 689738 - DNA, 25 bp, Mus musculus
gctcacccaacaaagaaatttactg

SEQ ID NO: 689739 - DNA, 25 bp, Mus musculus
gctcacccaacatagaaatttactg

SEQ ID NO: 689740 - DNA, 25 bp, Mus musculus
gctcacccatttcgcaggaggtgga

SEQ ID NO: 689741 - DNA, 25 bp, Mus musculus
gctcacccatttggcaggaggtgga

SEQ ID NO: 689742 - DNA, 25 bp, Mus musculus
gctcaccccgttatcgggatgggag

SEQ ID NO: 689743 - DNA, 25 bp, Mus musculus
gctcaccccgttttcgggatgggag

SEQ ID NO: 689744 - DNA, 25 bp, Mus musculus
gctcacccttgcatgtggaggattg

SEQ ID NO: 689745 - DNA, 25 bp, Mus musculus
gctcacccttgcttgtggaggattg

SEQ ID NO: 689746 - DNA, 25 bp, Mus musculus
gctcaccgacaaccagcgactttga

SEQ ID NO: 689747 - DNA, 25 bp, Mus musculus
gctcaccgacaagcagcgactttga

SEQ ID NO: 689748 - DNA, 25 bp, Mus musculus
gctcaccgagtcagggcagccgtgc

SEQ ID NO: 689749 - DNA, 25 bp, Mus musculus
gctcaccgagtctgggcagccgtgc

SEQ ID NO: 689750 - DNA, 25 bp, Mus musculus
gctcaccggttcaggcttccgcgtg

SEQ ID NO: 689751 - DNA, 25 bp, Mus musculus
gctcaccggttctggcttccgcgtg

SEQ ID NO: 689752 - DNA, 25 bp, Mus musculus
gctcaccgtctccaagaagatactc

SEQ ID NO: 689753 - DNA, 25 bp, Mus musculus
gctcaccgtctcgaagaagatactc

SEQ ID NO: 689754 - DNA, 25 bp, Mus musculus
gctcacctgtgaccaggcccgagat

SEQ ID NO: 689755 - DNA, 25 bp, Mus musculus
gctcacctgtgagcaggcccgagat

SEQ ID NO: 689756 - DNA, 25 bp, Mus musculus
gctcacctgtggcacctgggctact

SEQ ID NO: 689757 - DNA, 25 bp, Mus musculus
gctcacctgtgggacctgggctact

SEQ ID NO: 689758 - DNA, 25 bp, Mus musculus
gctcacgcaccgagctgtgcgggac

SEQ ID NO: 689759 - DNA, 25 bp, Mus musculus
gctcacgcaccgtgctgtgcgggac

SEQ ID NO: 689760 - DNA, 25 bp, Mus musculus
gctcacggaccgagccagagattga

SEQ ID NO: 689761 - DNA, 25 bp, Mus musculus
gctcacggaccgtgccagagattga

SEQ ID NO: 689762 - DNA, 25 bp, Mus musculus
gctcacggagaaagacacgcaggaa

SEQ ID NO: 689763 - DNA, 25 bp, Mus musculus
gctcacggagaatgacacgcaggaa

SEQ ID NO: 689764 - DNA, 25 bp, Mus musculus
gctcacgggtacagtcacgtgaccc

SEQ ID NO: 689765 - DNA, 25 bp, Mus musculus
gctcacgggtactgtcacgtgaccc

SEQ ID NO: 689766 - DNA, 25 bp, Mus musculus
gctcacggtctgagccattcgcagg

SEQ ID NO: 689767 - DNA, 25 bp, Mus musculus
gctcacggtctgtgccattcgcagg

SEQ ID NO: 689768 - DNA, 25 bp, Mus musculus
gctcacggtgaacgatgatgtagac

SEQ ID NO: 689769 - DNA, 25 bp, Mus musculus
gctcacggtgaaggatgatgtagac

SEQ ID NO: 689770 - DNA, 25 bp, Mus musculus
gctcacgtacttcgatgtttctaaa

SEQ ID NO: 689771 - DNA, 25 bp, Mus musculus
gctcacgtacttggatgtttctaaa

SEQ ID NO: 689772 - DNA, 25 bp, Mus musculus
gctcacgttcctctgcagctgcgag

SEQ ID NO: 689773 - DNA, 25 bp, Mus musculus
gctcacgttcctgtgcagctgcgag

SEQ ID NO: 689774 - DNA, 25 bp, Mus musculus
gctcacgttctgcttactggcactg

SEQ ID NO: 689775 - DNA, 25 bp, Mus musculus
gctcacgttctggttactggcactg

SEQ ID NO: 689776 - DNA, 25 bp, Mus musculus
gctcactacattcctggcactatgg

SEQ ID NO: 689777 - DNA, 25 bp, Mus musculus
gctcactacattgctggcactatgg

SEQ ID NO: 689778 - DNA, 25 bp, Mus musculus
gctcactattcactttttccagaag

SEQ ID NO: 689779 - DNA, 25 bp, Mus musculus
gctcactattcagtttttccagaag

SEQ ID NO: 689780 - DNA, 25 bp, Mus musculus
gctcactcgctcaagggaaccggca

SEQ ID NO: 689781 - DNA, 25 bp, Mus musculus
gctcactcgctctagggaaccggca

SEQ ID NO: 689782 - DNA, 25 bp, Mus musculus
gctcactcggatccagggtcccagg

SEQ ID NO: 689783 - DNA, 25 bp, Mus musculus
gctcactcggatgcagggtcccagg

SEQ ID NO: 689784 - DNA, 25 bp, Mus musculus
gctcactctttgacgtcccctggat

SEQ ID NO: 689785 - DNA, 25 bp, Mus musculus
gctcactctttgtcgtcccctggat

SEQ ID NO: 689786 - DNA, 25 bp, Mus musculus
gctcactgccatcgacactacaaag

SEQ ID NO: 689787 - DNA, 25 bp, Mus musculus
gctcactgccatggacactacaaag

SEQ ID NO: 689788 - DNA, 25 bp, Mus musculus
gctcactggctgaccaacggaaagg

SEQ ID NO: 689789 - DNA, 25 bp, Mus musculus
gctcactggctgtccaacggaaagg

SEQ ID NO: 689790 - DNA, 25 bp, Mus musculus
gctcactggtgtacctagtctccaa

SEQ ID NO: 689791 - DNA, 25 bp, Mus musculus
gctcactggtgttcctagtctccaa

SEQ ID NO: 689792 - DNA, 25 bp, Mus musculus
gctcactgtgtgcttaataaatgga

SEQ ID NO: 689793 - DNA, 25 bp, Mus musculus
gctcactgtgtggttaataaatgga

SEQ ID NO: 689794 - DNA, 25 bp, Mus musculus
gctcacttggttcttatggccatgg

SEQ ID NO: 689795 - DNA, 25 bp, Mus musculus
gctcacttggttgttatggccatgg

SEQ ID NO: 689796 - DNA, 25 bp, Mus musculus
gctcagaaaagactcgaccctagga

SEQ ID NO: 689797 - DNA, 25 bp, Mus musculus
gctcagaaaagagtcgaccctagga

SEQ ID NO: 689798 - DNA, 25 bp, Mus musculus
gctcagaaagaaaaccattttgcca

SEQ ID NO: 689799 - DNA, 25 bp, Mus musculus
gctcagaaagaataccattttgcca

SEQ ID NO: 689800 - DNA, 25 bp, Mus musculus
gctcagaaaggcacgcgccttgcct

SEQ ID NO: 689801 - DNA, 25 bp, Mus musculus
gctcagaaaggctcgcgccttgcct

SEQ ID NO: 689802 - DNA, 25 bp, Mus musculus
gctcagaaatacatctcagaaagta

SEQ ID NO: 689803 - DNA, 25 bp, Mus musculus
gctcagaaatacttctcagaaagta

SEQ ID NO: 689804 - DNA, 25 bp, Mus musculus
gctcagaaccaaatgacagaggcac

SEQ ID NO: 689805 - DNA, 25 bp, Mus musculus
gctcagaaccaattgacagaggcac

SEQ ID NO: 689806 - DNA, 25 bp, Mus musculus
gctcagaatcaaaggccaagaattt

SEQ ID NO: 689807 - DNA, 25 bp, Mus musculus
gctcagaatcaaccatgaacttcca

SEQ ID NO: 689808 - DNA, 25 bp, Mus musculus
gctcagaatcaagcatgaacttcca

SEQ ID NO: 689809 - DNA, 25 bp, Mus musculus
gctcagaatcaatggccaagaattt

SEQ ID NO: 689810 - DNA, 25 bp, Mus musculus
gctcagaatgagagccttctcccca

SEQ ID NO: 689811 - DNA, 25 bp, Mus musculus
gctcagaatgagtgccttctcccca

SEQ ID NO: 689812 - DNA, 25 bp, Mus musculus
gctcagacatcactatcggttgtga

SEQ ID NO: 689813 - DNA, 25 bp, Mus musculus
gctcagacatcagtatcggttgtga

SEQ ID NO: 689814 - DNA, 25 bp, Mus musculus
gctcagaccagaccgtgaccacgtt

SEQ ID NO: 689815 - DNA, 25 bp, Mus musculus
gctcagaccagagcgtgaccacgtt

SEQ ID NO: 689816 - DNA, 25 bp, Mus musculus
gctcagaccccaatacctgtgcatt

SEQ ID NO: 689817 - DNA, 25 bp, Mus musculus
gctcagaccccattacctgtgcatt

SEQ ID NO: 689818 - DNA, 25 bp, Mus musculus
gctcagactcccagcgcctgggaga

SEQ ID NO: 689819 - DNA, 25 bp, Mus musculus
gctcagactccctgcgcctgggaga

SEQ ID NO: 689820 - DNA, 25 bp, Mus musculus
gctcagacttctccattgagcacag

SEQ ID NO: 689821 - DNA, 25 bp, Mus musculus
gctcagacttctgcattgagcacag

SEQ ID NO: 689822 - DNA, 25 bp, Mus musculus
gctcagagaaataatgaggacgttt

SEQ ID NO: 689823 - DNA, 25 bp, Mus musculus
gctcagagaaattatgaggacgttt

SEQ ID NO: 689824 - DNA, 25 bp, Mus musculus
gctcagaggactacgtggacattgt

SEQ ID NO: 689825 - DNA, 25 bp, Mus musculus
gctcagaggacttcgtggacattgt

SEQ ID NO: 689826 - DNA, 25 bp, Mus musculus
gctcagaggccaagcctgcgagcct

SEQ ID NO: 689827 - DNA, 25 bp, Mus musculus
gctcagaggccatgcctgcgagcct

SEQ ID NO: 689828 - DNA, 25 bp, Mus musculus
gctcagataagcactcaggaaggga

SEQ ID NO: 689829 - DNA, 25 bp, Mus musculus
gctcagataagctctcaggaaggga

SEQ ID NO: 689830 - DNA, 25 bp, Mus musculus
gctcagattcatacaaggtcggtga

SEQ ID NO: 689831 - DNA, 25 bp, Mus musculus
gctcagattcattcaaggtcggtga

SEQ ID NO: 689832 - DNA, 25 bp, Mus musculus
gctcagattggactctgtttccatc

SEQ ID NO: 689833 - DNA, 25 bp, Mus musculus
gctcagattggagtctgtttccatc

SEQ ID NO: 689834 - DNA, 25 bp, Mus musculus
gctcagcaaacaaatgcccctggaa

SEQ ID NO: 689835 - DNA, 25 bp, Mus musculus
gctcagcaaacatatgcccctggaa

SEQ ID NO: 689836 - DNA, 25 bp, Mus musculus
gctcagcaaagaaggctttagcaag

SEQ ID NO: 689837 - DNA, 25 bp, Mus musculus
gctcagcaaagatggctttagcaag

SEQ ID NO: 689838 - DNA, 25 bp, Mus musculus
gctcagcagaagaaaaagcccggat

SEQ ID NO: 689839 - DNA, 25 bp, Mus musculus
gctcagcagaagtaaaagcccggat

SEQ ID NO: 689840 - DNA, 25 bp, Mus musculus
gctcagcagagtccggagctgcaac

SEQ ID NO: 689841 - DNA, 25 bp, Mus musculus
gctcagcagagtcgaaccagcagac

SEQ ID NO: 689842 - DNA, 25 bp, Mus musculus
gctcagcagagtgcggagctgcaac

SEQ ID NO: 689843 - DNA, 25 bp, Mus musculus
gctcagcagagtggaaccagcagac

SEQ ID NO: 689844 - DNA, 25 bp, Mus musculus
gctcagcagggaactacaggagaaa

SEQ ID NO: 689845 - DNA, 25 bp, Mus musculus
gctcagcagggatctacaggagaaa

SEQ ID NO: 689846 - DNA, 25 bp, Mus musculus
gctcagcaggggagttggtctctta

SEQ ID NO: 689847 - DNA, 25 bp, Mus musculus
gctcagcaggggtgttggtctctta

SEQ ID NO: 689848 - DNA, 25 bp, Mus musculus
gctcagccattacaacctgactggg

SEQ ID NO: 689849 - DNA, 25 bp, Mus musculus
gctcagccattagaacctgactggg

SEQ ID NO: 689850 - DNA, 25 bp, Mus musculus
gctcagccccggaggcctggaaagc

SEQ ID NO: 689851 - DNA, 25 bp, Mus musculus
gctcagccccggtggcctggaaagc

SEQ ID NO: 689852 - DNA, 25 bp, Mus musculus
gctcagcccgacatgttgatctcgc

SEQ ID NO: 689853 - DNA, 25 bp, Mus musculus
gctcagcccgacttgttgatctcgc

SEQ ID NO: 689854 - DNA, 25 bp, Mus musculus
gctcagccgaagctttgcatttcca

SEQ ID NO: 689855 - DNA, 25 bp, Mus musculus
gctcagccgaaggtttgcatttcca

SEQ ID NO: 689856 - DNA, 25 bp, Mus musculus
gctcagccgctgaagaaccaagaac

SEQ ID NO: 689857 - DNA, 25 bp, Mus musculus
gctcagccgctgtagaaccaagaac

SEQ ID NO: 689858 - DNA, 25 bp, Mus musculus
gctcagccggccatttcagaatcag

SEQ ID NO: 689859 - DNA, 25 bp, Mus musculus
gctcagccggccttttcagaatcag

SEQ ID NO: 689860 - DNA, 25 bp, Mus musculus
gctcagccggtgctatgatataata

SEQ ID NO: 689861 - DNA, 25 bp, Mus musculus
gctcagccggtggtatgatataata

SEQ ID NO: 689862 - DNA, 25 bp, Mus musculus
gctcagcctctgctccaaaaataaa

SEQ ID NO: 689863 - DNA, 25 bp, Mus musculus
gctcagcctctggtccaaaaataaa

SEQ ID NO: 689864 - DNA, 25 bp, Mus musculus
gctcagcctttgactcgggccgctg

SEQ ID NO: 689865 - DNA, 25 bp, Mus musculus
gctcagcctttgtctcgggccgctg

SEQ ID NO: 689866 - DNA, 25 bp, Mus musculus
gctcagcgatctctgatccagacct

SEQ ID NO: 689867 - DNA, 25 bp, Mus musculus
gctcagcgatctgtgatccagacct

SEQ ID NO: 689868 - DNA, 25 bp, Mus musculus
gctcagcgttctcaattgcggcctc

SEQ ID NO: 689869 - DNA, 25 bp, Mus musculus
gctcagcgttctgaattgcggcctc

SEQ ID NO: 689870 - DNA, 25 bp, Mus musculus
gctcagcgtttccaatatcatccag

SEQ ID NO: 689871 - DNA, 25 bp, Mus musculus
gctcagcgtttcgaatatcatccag

SEQ ID NO: 689872 - DNA, 25 bp, Mus musculus
gctcagctatgtaaatcatgctgaa

SEQ ID NO: 689873 - DNA, 25 bp, Mus musculus
gctcagctatgttaatcatgctgaa

SEQ ID NO: 689874 - DNA, 25 bp, Mus musculus
gctcagctcattatcctttgcagag

SEQ ID NO: 689875 - DNA, 25 bp, Mus musculus
gctcagctcattttcctttgcagag

SEQ ID NO: 689876 - DNA, 25 bp, Mus musculus
gctcagctccggagatgtgggaaca

SEQ ID NO: 689877 - DNA, 25 bp, Mus musculus
gctcagctccggtgatgtgggaaca

SEQ ID NO: 689878 - DNA, 25 bp, Mus musculus
gctcagctcgcactcatgcagggag

SEQ ID NO: 689879 - DNA, 25 bp, Mus musculus
gctcagctcgcagtcatgcagggag

SEQ ID NO: 689880 - DNA, 25 bp, Mus musculus
gctcagctggaacttgaaagatgat

SEQ ID NO: 689881 - DNA, 25 bp, Mus musculus
gctcagctggaagttgaaagatgat

SEQ ID NO: 689882 - DNA, 25 bp, Mus musculus
gctcagctgtccacaggctctggaa

SEQ ID NO: 689883 - DNA, 25 bp, Mus musculus
gctcagctgtcctcaggctctggaa

SEQ ID NO: 689884 - DNA, 25 bp, Mus musculus
gctcagctttctacacccatagtgt

SEQ ID NO: 689885 - DNA, 25 bp, Mus musculus
gctcagctttcttcacccatagtgt

SEQ ID NO: 689886 - DNA, 25 bp, Mus musculus
gctcagctttgtacattcgaattgg

SEQ ID NO: 689887 - DNA, 25 bp, Mus musculus
gctcagctttgttcattcgaattgg

SEQ ID NO: 689888 - DNA, 25 bp, Mus musculus
gctcaggaagccactctgggtacct

SEQ ID NO: 689889 - DNA, 25 bp, Mus musculus
gctcaggaagcctctctgggtacct

SEQ ID NO: 689890 - DNA, 25 bp, Mus musculus
gctcaggagcaactgctgaatgcaa

SEQ ID NO: 689891 - DNA, 25 bp, Mus musculus
gctcaggagcaagtgctgaatgcaa

SEQ ID NO: 689892 - DNA, 25 bp, Mus musculus
gctcaggagcgtctggccacagctc

SEQ ID NO: 689893 - DNA, 25 bp, Mus musculus
gctcaggagcgtgtggccacagctc

SEQ ID NO: 689894 - DNA, 25 bp, Mus musculus
gctcaggagctcaaggaatagtgtg

SEQ ID NO: 689895 - DNA, 25 bp, Mus musculus
gctcaggagctctaggaatagtgtg

SEQ ID NO: 689896 - DNA, 25 bp, Mus musculus
gctcaggagctgatctccagtggga

SEQ ID NO: 689897 - DNA, 25 bp, Mus musculus
gctcaggagctgttctccagtggga

SEQ ID NO: 689898 - DNA, 25 bp, Mus musculus
gctcaggagggtcatgccagcatcc

SEQ ID NO: 689899 - DNA, 25 bp, Mus musculus
gctcaggagggtgatgccagcatcc

SEQ ID NO: 689900 - DNA, 25 bp, Mus musculus
gctcaggatttgcaaagcaagcctc

SEQ ID NO: 689901 - DNA, 25 bp, Mus musculus
gctcaggatttggaaagcaagcctc

SEQ ID NO: 689902 - DNA, 25 bp, Mus musculus
gctcaggcagccagactgtggttgt

SEQ ID NO: 689903 - DNA, 25 bp, Mus musculus
gctcaggcagcctgactgtggttgt

SEQ ID NO: 689904 - DNA, 25 bp, Mus musculus
gctcaggccaagattgacagctgcc

SEQ ID NO: 689905 - DNA, 25 bp, Mus musculus
gctcaggccaagtttgacagctgcc

SEQ ID NO: 689906 - DNA, 25 bp, Mus musculus
gctcaggccacaacaagtgccggct

SEQ ID NO: 689907 - DNA, 25 bp, Mus musculus
gctcaggccacatcaagtgccggct

SEQ ID NO: 689908 - DNA, 25 bp, Mus musculus
gctcaggccctacagctgtctaaga

SEQ ID NO: 689909 - DNA, 25 bp, Mus musculus
gctcaggccctagagctgtctaaga

SEQ ID NO: 689910 - DNA, 25 bp, Mus musculus
gctcagggaataactgcagctcagt

SEQ ID NO: 689911 - DNA, 25 bp, Mus musculus
gctcagggaatatctgcagctcagt

SEQ ID NO: 689912 - DNA, 25 bp, Mus musculus
gctcagggaatgacgcaacccatgc

SEQ ID NO: 689913 - DNA, 25 bp, Mus musculus
gctcagggaatgtcgcaacccatgc

SEQ ID NO: 689914 - DNA, 25 bp, Mus musculus
gctcagggaggccaagatcactgaa

SEQ ID NO: 689915 - DNA, 25 bp, Mus musculus
gctcagggaggcgaagatcactgaa

SEQ ID NO: 689916 - DNA, 25 bp, Mus musculus
gctcagggccacctcaactgtgaaa

SEQ ID NO: 689917 - DNA, 25 bp, Mus musculus
gctcagggccacgtcaactgtgaaa

SEQ ID NO: 689918 - DNA, 25 bp, Mus musculus
gctcagggctacagaacatacttgg

SEQ ID NO: 689919 - DNA, 25 bp, Mus musculus
gctcagggctactgaacatacttgg

SEQ ID NO: 689920 - DNA, 25 bp, Mus musculus
gctcagggcttactgctcaccggaa

SEQ ID NO: 689921 - DNA, 25 bp, Mus musculus
gctcagggcttagtgctcaccggaa

SEQ ID NO: 689922 - DNA, 25 bp, Mus musculus
gctcaggtccagctctgcccgagga

SEQ ID NO: 689923 - DNA, 25 bp, Mus musculus
gctcaggtccaggtctgcccgagga

SEQ ID NO: 689924 - DNA, 25 bp, Mus musculus
gctcaggtcctactggcattgggaa

SEQ ID NO: 689925 - DNA, 25 bp, Mus musculus
gctcaggtcctagtggcattgggaa

SEQ ID NO: 689926 - DNA, 25 bp, Mus musculus
gctcaggttacaagcttctgtgaag

SEQ ID NO: 689927 - DNA, 25 bp, Mus musculus
gctcaggttacatgcttctgtgaag

SEQ ID NO: 689928 - DNA, 25 bp, Mus musculus
gctcaggtttaaccatggaagaaat

SEQ ID NO: 689929 - DNA, 25 bp, Mus musculus
gctcaggtttaagcatggaagaaat

SEQ ID NO: 689930 - DNA, 25 bp, Mus musculus
gctcagtcagcgctagattctacgt

SEQ ID NO: 689931 - DNA, 25 bp, Mus musculus
gctcagtcagcggtagattctacgt

SEQ ID NO: 689932 - DNA, 25 bp, Mus musculus
gctcagtcagtcaaccatggattcg

SEQ ID NO: 689933 - DNA, 25 bp, Mus musculus
gctcagtcagtctaccatggattcg

SEQ ID NO: 689934 - DNA, 25 bp, Mus musculus
gctcagtccaagatcggctctcgga

SEQ ID NO: 689935 - DNA, 25 bp, Mus musculus
gctcagtccaagttcggctctcgga

SEQ ID NO: 689936 - DNA, 25 bp, Mus musculus
gctcagtcgattaggaaggtccaga

SEQ ID NO: 689937 - DNA, 25 bp, Mus musculus
gctcagtcgatttggaaggtccaga

SEQ ID NO: 689938 - DNA, 25 bp, Mus musculus
gctcagtctggaaggaaacaccatg

SEQ ID NO: 689939 - DNA, 25 bp, Mus musculus
gctcagtctggatggaaacaccatg

SEQ ID NO: 689940 - DNA, 25 bp, Mus musculus
gctcagtctttactcaacaagctga

SEQ ID NO: 689941 - DNA, 25 bp, Mus musculus
gctcagtctttagtcaacaagctga

SEQ ID NO: 689942 - DNA, 25 bp, Mus musculus
gctcagtgcacccatgcactgctga

SEQ ID NO: 689943 - DNA, 25 bp, Mus musculus
gctcagtgcaccgatgcactgctga

SEQ ID NO: 689944 - DNA, 25 bp, Mus musculus
gctcagtgcccgcaccttaatcgaa

SEQ ID NO: 689945 - DNA, 25 bp, Mus musculus
gctcagtgcccggaccttaatcgaa

SEQ ID NO: 689946 - DNA, 25 bp, Mus musculus
gctcagtgcttaagatttgatgttt

SEQ ID NO: 689947 - DNA, 25 bp, Mus musculus
gctcagtgcttatgatttgatgttt

SEQ ID NO: 689948 - DNA, 25 bp, Mus musculus
gctcagtggaagagtaaagcctgct

SEQ ID NO: 689949 - DNA, 25 bp, Mus musculus
gctcagtggaagtgtaaagcctgct

SEQ ID NO: 689950 - DNA, 25 bp, Mus musculus
gctcagtggtgtctaatttcttaaa

SEQ ID NO: 689951 - DNA, 25 bp, Mus musculus
gctcagtggtgtgtaatttcttaaa

SEQ ID NO: 689952 - DNA, 25 bp, Mus musculus
gctcagtggttcaccaactacctga

SEQ ID NO: 689953 - DNA, 25 bp, Mus musculus
gctcagtggttctccaactacctga

SEQ ID NO: 689954 - DNA, 25 bp, Mus musculus
gctcagtgtggcagcgtcctctagg

SEQ ID NO: 689955 - DNA, 25 bp, Mus musculus
gctcagtgtggctgcgtcctctagg

SEQ ID NO: 689956 - DNA, 25 bp, Mus musculus
gctcagttctgacaccagggatgga

SEQ ID NO: 689957 - DNA, 25 bp, Mus musculus
gctcagttctgagaccagggatgga

SEQ ID NO: 689958 - DNA, 25 bp, Mus musculus
gctcagttctttatactctttgaaa

SEQ ID NO: 689959 - DNA, 25 bp, Mus musculus
gctcagttctttttactctttgaaa

SEQ ID NO: 689960 - DNA, 25 bp, Mus musculus
gctcagtttcaactggatgaagaaa

SEQ ID NO: 689961 - DNA, 25 bp, Mus musculus
gctcagtttcaagtggatgaagaaa

SEQ ID NO: 689962 - DNA, 25 bp, Mus musculus
gctcagtttcccacacctttcggtg

SEQ ID NO: 689963 - DNA, 25 bp, Mus musculus
gctcagtttcccactcagcatttga

SEQ ID NO: 689964 - DNA, 25 bp, Mus musculus
gctcagtttccctcacctttcggtg

SEQ ID NO: 689965 - DNA, 25 bp, Mus musculus
gctcagtttccctctcagcatttga

SEQ ID NO: 689966 - DNA, 25 bp, Mus musculus
gctcagtttcgaagactcaactttg

SEQ ID NO: 689967 - DNA, 25 bp, Mus musculus
gctcagtttcgatgactcaactttg

SEQ ID NO: 689968 - DNA, 25 bp, Mus musculus
gctcagttttgtcgcgccttctgaa

SEQ ID NO: 689969 - DNA, 25 bp, Mus musculus
gctcagttttgtggcgccttctgaa

SEQ ID NO: 689970 - DNA, 25 bp, Mus musculus
gctcatacagagcttgcttctcttt

SEQ ID NO: 689971 - DNA, 25 bp, Mus musculus
gctcatacagaggttgcttctcttt

SEQ ID NO: 689972 - DNA, 25 bp, Mus musculus
gctcatacatttaggaaacacagtc

SEQ ID NO: 689973 - DNA, 25 bp, Mus musculus
gctcatacattttggaaacacagtc

SEQ ID NO: 689974 - DNA, 25 bp, Mus musculus
gctcatactaacaggtgtaaaagag

SEQ ID NO: 689975 - DNA, 25 bp, Mus musculus
gctcatactaactggtgtaaaagag

SEQ ID NO: 689976 - DNA, 25 bp, Mus musculus
gctcatagaccaccttgagtgcaag

SEQ ID NO: 689977 - DNA, 25 bp, Mus musculus
gctcatagaccagcttgagtgcaag

SEQ ID NO: 689978 - DNA, 25 bp, Mus musculus
gctcatagcccaaaacagttccttg

SEQ ID NO: 689979 - DNA, 25 bp, Mus musculus
gctcatagcccataacagttccttg

SEQ ID NO: 689980 - DNA, 25 bp, Mus musculus
gctcataggagacagctgcccggca

SEQ ID NO: 689981 - DNA, 25 bp, Mus musculus
gctcataggagagagctgcccggca

SEQ ID NO: 689982 - DNA, 25 bp, Mus musculus
gctcatatcttaagataaagctgcg

SEQ ID NO: 689983 - DNA, 25 bp, Mus musculus
gctcatatcttatgataaagctgcg

SEQ ID NO: 689984 - DNA, 25 bp, Mus musculus
gctcatattggtcaatccctttggg

SEQ ID NO: 689985 - DNA, 25 bp, Mus musculus
gctcatattggtgaatccctttggg

SEQ ID NO: 689986 - DNA, 25 bp, Mus musculus
gctcatcaaagcaccatcaaggtac

SEQ ID NO: 689987 - DNA, 25 bp, Mus musculus
gctcatcaaagctccatcaaggtac

SEQ ID NO: 689988 - DNA, 25 bp, Mus musculus
gctcatcaaaggaggagagcaccct

SEQ ID NO: 689989 - DNA, 25 bp, Mus musculus
gctcatcaaaggtggagagcaccct

SEQ ID NO: 689990 - DNA, 25 bp, Mus musculus
gctcatcactctacccaatggcgtc

SEQ ID NO: 689991 - DNA, 25 bp, Mus musculus
gctcatcactcttcccaatggcgtc

SEQ ID NO: 689992 - DNA, 25 bp, Mus musculus
gctcatcactgtagtcctggctaca

SEQ ID NO: 689993 - DNA, 25 bp, Mus musculus
gctcatcactgttgtcctggctaca

SEQ ID NO: 689994 - DNA, 25 bp, Mus musculus
gctcatcagaagatattaactggaa

SEQ ID NO: 689995 - DNA, 25 bp, Mus musculus
gctcatcagaagttattaactggaa

SEQ ID NO: 689996 - DNA, 25 bp, Mus musculus
gctcatcatcttagcctggctcaca

SEQ ID NO: 689997 - DNA, 25 bp, Mus musculus
gctcatcatctttgcctggctcaca

SEQ ID NO: 689998 - DNA, 25 bp, Mus musculus
gctcatcattaacaaactacggtat

SEQ ID NO: 689999 - DNA, 25 bp, Mus musculus
gctcatcattaagaaactacggtat

SEQ ID NO: 690000 - DNA, 25 bp, Mus musculus
gctcatcattgtcgtcctgggactg

SEQ ID NO: 690001 - DNA, 25 bp, Mus musculus
gctcatcattgtggtcctgggactg

SEQ ID NO: 690002 - DNA, 25 bp, Mus musculus
gctcatccaatgattatacctcaca

SEQ ID NO: 690003 - DNA, 25 bp, Mus musculus
gctcatccaatgtttatacctcaca

SEQ ID NO: 690004 - DNA, 25 bp, Mus musculus
gctcatccaggtagggaagtggaat

SEQ ID NO: 690005 - DNA, 25 bp, Mus musculus
gctcatccaggttgggaagtggaat

SEQ ID NO: 690006 - DNA, 25 bp, Mus musculus
gctcatcccgcaaagaagagttcag

SEQ ID NO: 690007 - DNA, 25 bp, Mus musculus
gctcatcccgcatagaagagttcag

SEQ ID NO: 690008 - DNA, 25 bp, Mus musculus
gctcatccggaacccagatgcctat

SEQ ID NO: 690009 - DNA, 25 bp, Mus musculus
gctcatccggaagccagatgcctat

SEQ ID NO: 690010 - DNA, 25 bp, Mus musculus
gctcatccgggcagcactgcgtgag

SEQ ID NO: 690011 - DNA, 25 bp, Mus musculus
gctcatccgggctgcactgcgtgag

SEQ ID NO: 690012 - DNA, 25 bp, Mus musculus
gctcatcctgcccaagcctgagaag

SEQ ID NO: 690013 - DNA, 25 bp, Mus musculus
gctcatcctgccgaagcctgagaag

SEQ ID NO: 690014 - DNA, 25 bp, Mus musculus
gctcatcgacatcccatgtgcagag

SEQ ID NO: 690015 - DNA, 25 bp, Mus musculus
gctcatcgacatgccatgtgcagag

SEQ ID NO: 690016 - DNA, 25 bp, Mus musculus
gctcatcgacttatacaagaaggaa

SEQ ID NO: 690017 - DNA, 25 bp, Mus musculus
gctcatcgacttttacaagaaggaa

SEQ ID NO: 690018 - DNA, 25 bp, Mus musculus
gctcatcgcccgaaaactgtactgt

SEQ ID NO: 690019 - DNA, 25 bp, Mus musculus
gctcatcgcccgtaaactgtactgt

SEQ ID NO: 690020 - DNA, 25 bp, Mus musculus
gctcatctaacacgaagcttgctga

SEQ ID NO: 690021 - DNA, 25 bp, Mus musculus
gctcatctaacaggaagcttgctga

SEQ ID NO: 690022 - DNA, 25 bp, Mus musculus
gctcatctagggaggcagcggctac

SEQ ID NO: 690023 - DNA, 25 bp, Mus musculus
gctcatctagggtggcagcggctac

SEQ ID NO: 690024 - DNA, 25 bp, Mus musculus
gctcatctatgccaggctgagcgga

SEQ ID NO: 690025 - DNA, 25 bp, Mus musculus
gctcatctatgcgaggctgagcgga

SEQ ID NO: 690026 - DNA, 25 bp, Mus musculus
gctcatctcagaacaggtcagccat

SEQ ID NO: 690027 - DNA, 25 bp, Mus musculus
gctcatctcagatcaggtcagccat

SEQ ID NO: 690028 - DNA, 25 bp, Mus musculus
gctcatctcgatatgactgcaactc

SEQ ID NO: 690029 - DNA, 25 bp, Mus musculus
gctcatctcgatttgactgcaactc

SEQ ID NO: 690030 - DNA, 25 bp, Mus musculus
gctcatctctgtctgttactttgag

SEQ ID NO: 690031 - DNA, 25 bp, Mus musculus
gctcatctctgtgtgttactttgag

SEQ ID NO: 690032 - DNA, 25 bp, Mus musculus
gctcatctgcgacggcaagctggtc

SEQ ID NO: 690033 - DNA, 25 bp, Mus musculus
gctcatctgcgagggcaagctggtc

SEQ ID NO: 690034 - DNA, 25 bp, Mus musculus
gctcatctgcgcacctgagttgtga

SEQ ID NO: 690035 - DNA, 25 bp, Mus musculus
gctcatctgcgctcctgagttgtga

SEQ ID NO: 690036 - DNA, 25 bp, Mus musculus
gctcatctgctgaacgatgctctca

SEQ ID NO: 690037 - DNA, 25 bp, Mus musculus
gctcatctgctgtacgatgctctca

SEQ ID NO: 690038 - DNA, 25 bp, Mus musculus
gctcatctggacacagacatacgaa

SEQ ID NO: 690039 - DNA, 25 bp, Mus musculus
gctcatctggactcagacatacgaa

SEQ ID NO: 690040 - DNA, 25 bp, Mus musculus
gctcatctgtcaccttggccataag

SEQ ID NO: 690041 - DNA, 25 bp, Mus musculus
gctcatctgtcagcttggccataag

SEQ ID NO: 690042 - DNA, 25 bp, Mus musculus
gctcatctgtgccagcaagttgaca

SEQ ID NO: 690043 - DNA, 25 bp, Mus musculus
gctcatctgtgcgagcaagttgaca

SEQ ID NO: 690044 - DNA, 25 bp, Mus musculus
gctcatcttcagagagtgccagccc

SEQ ID NO: 690045 - DNA, 25 bp, Mus musculus
gctcatcttcagtgagtgccagccc

SEQ ID NO: 690046 - DNA, 25 bp, Mus musculus
gctcatgaaacaaaccagactgttt

SEQ ID NO: 690047 - DNA, 25 bp, Mus musculus
gctcatgaaacataccagactgttt

SEQ ID NO: 690048 - DNA, 25 bp, Mus musculus
gctcatgaaagtcatcttcttaagg

SEQ ID NO: 690049 - DNA, 25 bp, Mus musculus
gctcatgaaagtgatcttcttaagg

SEQ ID NO: 690050 - DNA, 25 bp, Mus musculus
gctcatgaaggaaggcaagtggatc

SEQ ID NO: 690051 - DNA, 25 bp, Mus musculus
gctcatgaaggatggcaagtggatc

SEQ ID NO: 690052 - DNA, 25 bp, Mus musculus
gctcatgacaagatacacttaacag

SEQ ID NO: 690053 - DNA, 25 bp, Mus musculus
gctcatgacaagttacacttaacag

SEQ ID NO: 690054 - DNA, 25 bp, Mus musculus
gctcatgacagacatgctgaactgg

SEQ ID NO: 690055 - DNA, 25 bp, Mus musculus
gctcatgacagagatgctgaactgg

SEQ ID NO: 690056 - DNA, 25 bp, Mus musculus
gctcatgacagtcgccgagctactc

SEQ ID NO: 690057 - DNA, 25 bp, Mus musculus
gctcatgacagtggccgagctactc

SEQ ID NO: 690058 - DNA, 25 bp, Mus musculus
gctcatgacctgcagctactgagaa

SEQ ID NO: 690059 - DNA, 25 bp, Mus musculus
gctcatgacctggagctactgagaa

SEQ ID NO: 690060 - DNA, 25 bp, Mus musculus
gctcatgagagaaaagggcatttac

SEQ ID NO: 690061 - DNA, 25 bp, Mus musculus
gctcatgagagataagggcatttac

SEQ ID NO: 690062 - DNA, 25 bp, Mus musculus
gctcatgagtggaaccagagaagag

SEQ ID NO: 690063 - DNA, 25 bp, Mus musculus
gctcatgagtggtaccagagaagag

SEQ ID NO: 690064 - DNA, 25 bp, Mus musculus
gctcatgatggccttctacacggga

SEQ ID NO: 690065 - DNA, 25 bp, Mus musculus
gctcatgatggcgttctacacggga

SEQ ID NO: 690066 - DNA, 25 bp, Mus musculus
gctcatgcaactcaaggctgaagtt

SEQ ID NO: 690067 - DNA, 25 bp, Mus musculus
gctcatgcaactgaaggctgaagtt

SEQ ID NO: 690068 - DNA, 25 bp, Mus musculus
gctcatgcagaacatgctgtccgcc

SEQ ID NO: 690069 - DNA, 25 bp, Mus musculus
gctcatgcagaagatgctgtccgcc

SEQ ID NO: 690070 - DNA, 25 bp, Mus musculus
gctcatgcctcgatatggtctcgaa

SEQ ID NO: 690071 - DNA, 25 bp, Mus musculus
gctcatgcctcgttatggtctcgaa

SEQ ID NO: 690072 - DNA, 25 bp, Mus musculus
gctcatgcgccaatactgcctgtgc

SEQ ID NO: 690073 - DNA, 25 bp, Mus musculus
gctcatgcgccattactgcctgtgc

SEQ ID NO: 690074 - DNA, 25 bp, Mus musculus
gctcatgctctgagctttcgttggg

SEQ ID NO: 690075 - DNA, 25 bp, Mus musculus
gctcatgctctgtgctttcgttggg

SEQ ID NO: 690076 - DNA, 25 bp, Mus musculus
gctcatgctgatcggccttttgaag

SEQ ID NO: 690077 - DNA, 25 bp, Mus musculus
gctcatgctgatgggccttttgaag

SEQ ID NO: 690078 - DNA, 25 bp, Mus musculus
gctcatgctttgctgtgggcatcaa

SEQ ID NO: 690079 - DNA, 25 bp, Mus musculus
gctcatgctttggtgtgggcatcaa

SEQ ID NO: 690080 - DNA, 25 bp, Mus musculus
gctcatggcatcctccaaagtcctg

SEQ ID NO: 690081 - DNA, 25 bp, Mus musculus
gctcatggcatcgtccaaagtcctg

SEQ ID NO: 690082 - DNA, 25 bp, Mus musculus
gctcatggcctgatggtgctgcctg

SEQ ID NO: 690083 - DNA, 25 bp, Mus musculus
gctcatggcctgttggtgctgcctg

SEQ ID NO: 690084 - DNA, 25 bp, Mus musculus
gctcatgggcagaccttctgggtac

SEQ ID NO: 690085 - DNA, 25 bp, Mus musculus
gctcatgggcagtccttctgggtac

SEQ ID NO: 690086 - DNA, 25 bp, Mus musculus
gctcatggtgaacccgggattgccc

SEQ ID NO: 690087 - DNA, 25 bp, Mus musculus
gctcatggtgaagccgggattgccc

SEQ ID NO: 690088 - DNA, 25 bp, Mus musculus
gctcatggtggtattgtgccagcac

SEQ ID NO: 690089 - DNA, 25 bp, Mus musculus
gctcatggtggttttgtgccagcac

SEQ ID NO: 690090 - DNA, 25 bp, Mus musculus
gctcatgtacagacaggaatggttc

SEQ ID NO: 690091 - DNA, 25 bp, Mus musculus
gctcatgtacagtcaggaatggttc

SEQ ID NO: 690092 - DNA, 25 bp, Mus musculus
gctcatgtatgacatcgccaaccag

SEQ ID NO: 690093 - DNA, 25 bp, Mus musculus
gctcatgtatgagatcgccaaccag

SEQ ID NO: 690094 - DNA, 25 bp, Mus musculus
gctcatgtctggctattaacagaaa

SEQ ID NO: 690095 - DNA, 25 bp, Mus musculus
gctcatgtctgggtattaacagaaa

SEQ ID NO: 690096 - DNA, 25 bp, Mus musculus
gctcatgtggaaagcacgtgcgtgc

SEQ ID NO: 690097 - DNA, 25 bp, Mus musculus
gctcatgtggaatgcacgtgcgtgc

SEQ ID NO: 690098 - DNA, 25 bp, Mus musculus
gctcatgttgttaataaatagccca

SEQ ID NO: 690099 - DNA, 25 bp, Mus musculus
gctcatgttgtttataaatagccca

SEQ ID NO: 690100 - DNA, 25 bp, Mus musculus
gctcatgtttgaaccagtccctgtc

SEQ ID NO: 690101 - DNA, 25 bp, Mus musculus
gctcatgtttgatccagtccctgtc

SEQ ID NO: 690102 - DNA, 25 bp, Mus musculus
gctcattaacatagacccgtgtgct

SEQ ID NO: 690103 - DNA, 25 bp, Mus musculus
gctcattaacattgacccgtgtgct

SEQ ID NO: 690104 - DNA, 25 bp, Mus musculus
gctcattcctggcagcaaccagtga

SEQ ID NO: 690105 - DNA, 25 bp, Mus musculus
gctcattcctgggagcaaccagtga

SEQ ID NO: 690106 - DNA, 25 bp, Mus musculus
gctcattccttccagacctggtgga

SEQ ID NO: 690107 - DNA, 25 bp, Mus musculus
gctcattccttcgagacctggtgga

SEQ ID NO: 690108 - DNA, 25 bp, Mus musculus
gctcattcgctcactgacagagctg

SEQ ID NO: 690109 - DNA, 25 bp, Mus musculus
gctcattcgctctctgacagagctg

SEQ ID NO: 690110 - DNA, 25 bp, Mus musculus
gctcattgatatattctatccggga

SEQ ID NO: 690111 - DNA, 25 bp, Mus musculus
gctcattgatattttctatccggga

SEQ ID NO: 690112 - DNA, 25 bp, Mus musculus
gctcattgatgacgtgtgcaccatg

SEQ ID NO: 690113 - DNA, 25 bp, Mus musculus
gctcattgatgaggtgtgcaccatg

SEQ ID NO: 690114 - DNA, 25 bp, Mus musculus
gctcattgcccaccagaaaggacag

SEQ ID NO: 690115 - DNA, 25 bp, Mus musculus
gctcattgcccagcagaaaggacag

SEQ ID NO: 690116 - DNA, 25 bp, Mus musculus
gctcattgccggctgcatctacaag

SEQ ID NO: 690117 - DNA, 25 bp, Mus musculus
gctcattgccgggtgcatctacaag

SEQ ID NO: 690118 - DNA, 25 bp, Mus musculus
gctcattggcatcgacccggtagct

SEQ ID NO: 690119 - DNA, 25 bp, Mus musculus
gctcattggcatggacccggtagct

SEQ ID NO: 690120 - DNA, 25 bp, Mus musculus
gctcattgggaaatcttcatttgaa

SEQ ID NO: 690121 - DNA, 25 bp, Mus musculus
gctcattgggaacgtcttacaggca

SEQ ID NO: 690122 - DNA, 25 bp, Mus musculus
gctcattgggaaggtcttacaggca

SEQ ID NO: 690123 - DNA, 25 bp, Mus musculus
gctcattgggaattcttcatttgaa

SEQ ID NO: 690124 - DNA, 25 bp, Mus musculus
gctcattggtcgcaggaagctcacc

SEQ ID NO: 690125 - DNA, 25 bp, Mus musculus
gctcattggtcggaggaagctcacc

SEQ ID NO: 690126 - DNA, 25 bp, Mus musculus
gctcattgtcctctccccagagaga

SEQ ID NO: 690127 - DNA, 25 bp, Mus musculus
gctcattgtcctgtccccagagaga

SEQ ID NO: 690128 - DNA, 25 bp, Mus musculus
gctcattgtgagcattaccagtctg

SEQ ID NO: 690129 - DNA, 25 bp, Mus musculus
gctcattgtgaggattaccagtctg

SEQ ID NO: 690130 - DNA, 25 bp, Mus musculus
gctcatttcattccttggacaggcc

SEQ ID NO: 690131 - DNA, 25 bp, Mus musculus
gctcatttcattgcttggacaggcc

SEQ ID NO: 690132 - DNA, 25 bp, Mus musculus
gctcatttgtgcagggattctctgt

SEQ ID NO: 690133 - DNA, 25 bp, Mus musculus
gctcatttgtgctgggattctctgt

SEQ ID NO: 690134 - DNA, 25 bp, Mus musculus
gctcattttaagactcgttggaacc

SEQ ID NO: 690135 - DNA, 25 bp, Mus musculus
gctcattttaagagagtgggatgga

SEQ ID NO: 690136 - DNA, 25 bp, Mus musculus
gctcattttaagtctcgttggaacc

SEQ ID NO: 690137 - DNA, 25 bp, Mus musculus
gctcattttaagtgagtgggatgga

SEQ ID NO: 690138 - DNA, 25 bp, Mus musculus
gctcatttttcactgggaacaaaag

SEQ ID NO: 690139 - DNA, 25 bp, Mus musculus
gctcatttttcagtgggaacaaaag

SEQ ID NO: 690140 - DNA, 25 bp, Mus musculus
gctccaaacctgaagaagttgtcct

SEQ ID NO: 690141 - DNA, 25 bp, Mus musculus
gctccaaacctgtagaagttgtcct

SEQ ID NO: 690142 - DNA, 25 bp, Mus musculus
gctccaaagtgaaagacgtggctgg

SEQ ID NO: 690143 - DNA, 25 bp, Mus musculus
gctccaaagtgatagacgtggctgg

SEQ ID NO: 690144 - DNA, 25 bp, Mus musculus
gctccaacagaacgaacttagcagt

SEQ ID NO: 690145 - DNA, 25 bp, Mus musculus
gctccaacagaaggaacttagcagt

SEQ ID NO: 690146 - DNA, 25 bp, Mus musculus
gctccaacagtacctggcagatctg

SEQ ID NO: 690147 - DNA, 25 bp, Mus musculus
gctccaacagtagctggcagatctg

SEQ ID NO: 690148 - DNA, 25 bp, Mus musculus
gctccaacctcgaagtaggaatgaa

SEQ ID NO: 690149 - DNA, 25 bp, Mus musculus
gctccaacctcgtagtaggaatgaa

SEQ ID NO: 690150 - DNA, 25 bp, Mus musculus
gctccaacgtaactgcaatttaatg

SEQ ID NO: 690151 - DNA, 25 bp, Mus musculus
gctccaacgtaagtgcaatttaatg

SEQ ID NO: 690152 - DNA, 25 bp, Mus musculus
gctccaactgccaattatgatcaga

SEQ ID NO: 690153 - DNA, 25 bp, Mus musculus
gctccaactgcctattatgatcaga

SEQ ID NO: 690154 - DNA, 25 bp, Mus musculus
gctccaacttccaaggttttatctg

SEQ ID NO: 690155 - DNA, 25 bp, Mus musculus
gctccaacttcctaggttttatctg

SEQ ID NO: 690156 - DNA, 25 bp, Mus musculus
gctccaaggtctcagcaaactcagc

SEQ ID NO: 690157 - DNA, 25 bp, Mus musculus
gctccaaggtctgagcaaactcagc

SEQ ID NO: 690158 - DNA, 25 bp, Mus musculus
gctccaaggtggacgcgctcaggcc

SEQ ID NO: 690159 - DNA, 25 bp, Mus musculus
gctccaaggtggtcgcgctcaggcc

SEQ ID NO: 690160 - DNA, 25 bp, Mus musculus
gctccaagtactattatgaccaatg

SEQ ID NO: 690161 - DNA, 25 bp, Mus musculus
gctccaagtacttttatgaccaatg

SEQ ID NO: 690162 - DNA, 25 bp, Mus musculus
gctccaagtgaccaaagcagtggta

SEQ ID NO: 690163 - DNA, 25 bp, Mus musculus
gctccaagtgacgaaagcagtggta

SEQ ID NO: 690164 - DNA, 25 bp, Mus musculus
gctccaatagccagggacaactttc

SEQ ID NO: 690165 - DNA, 25 bp, Mus musculus
gctccaatagcctgggacaactttc

SEQ ID NO: 690166 - DNA, 25 bp, Mus musculus
gctccaatattgaggaagccaaatg

SEQ ID NO: 690167 - DNA, 25 bp, Mus musculus
gctccaatattgtggaagccaaatg

SEQ ID NO: 690168 - DNA, 25 bp, Mus musculus
gctccaatgattaccaagtagctat

SEQ ID NO: 690169 - DNA, 25 bp, Mus musculus
gctccaatgatttccaagtagctat

SEQ ID NO: 690170 - DNA, 25 bp, Mus musculus
gctccaatgcagaagtgctggctct

SEQ ID NO: 690171 - DNA, 25 bp, Mus musculus
gctccaatgcagtagtgctggctct

SEQ ID NO: 690172 - DNA, 25 bp, Mus musculus
gctccacaaatacgagttgtcaatg

SEQ ID NO: 690173 - DNA, 25 bp, Mus musculus
gctccacaaataggagttgtcaatg

SEQ ID NO: 690174 - DNA, 25 bp, Mus musculus
gctccacaagctcttggtctggaga

SEQ ID NO: 690175 - DNA, 25 bp, Mus musculus
gctccacaagctgttggtctggaga

SEQ ID NO: 690176 - DNA, 25 bp, Mus musculus
gctccacaagggacacggtgacatg

SEQ ID NO: 690177 - DNA, 25 bp, Mus musculus
gctccacaagggtcacggtgacatg

SEQ ID NO: 690178 - DNA, 25 bp, Mus musculus
gctccacagagtattgcggcggtta

SEQ ID NO: 690179 - DNA, 25 bp, Mus musculus
gctccacagagttttgcggcggtta

SEQ ID NO: 690180 - DNA, 25 bp, Mus musculus
gctccacaggaaccggatccattca

SEQ ID NO: 690181 - DNA, 25 bp, Mus musculus
gctccacaggaagcggatccattca

SEQ ID NO: 690182 - DNA, 25 bp, Mus musculus
gctccaccaacaaaacacagtgtaa

SEQ ID NO: 690183 - DNA, 25 bp, Mus musculus
gctccaccaacataacacagtgtaa

SEQ ID NO: 690184 - DNA, 25 bp, Mus musculus
gctccaccaaggacctaatcgagac

SEQ ID NO: 690185 - DNA, 25 bp, Mus musculus
gctccaccaaggtcctaatcgagac

SEQ ID NO: 690186 - DNA, 25 bp, Mus musculus
gctccaccaggaactttggctttga

SEQ ID NO: 690187 - DNA, 25 bp, Mus musculus
gctccaccaggatctttggctttga

SEQ ID NO: 690188 - DNA, 25 bp, Mus musculus
gctccaccatgtactcgcgggcgag

SEQ ID NO: 690189 - DNA, 25 bp, Mus musculus
gctccaccatgttctcgcgggcgag

SEQ ID NO: 690190 - DNA, 25 bp, Mus musculus
gctccacccagaaggtgacactatt

SEQ ID NO: 690191 - DNA, 25 bp, Mus musculus
gctccacccagatggtgacactatt

SEQ ID NO: 690192 - DNA, 25 bp, Mus musculus
gctccaccccagacaactgttgtga

SEQ ID NO: 690193 - DNA, 25 bp, Mus musculus
gctccaccccagtcaactgttgtga

SEQ ID NO: 690194 - DNA, 25 bp, Mus musculus
gctccacctgtgagaagtatctatg

SEQ ID NO: 690195 - DNA, 25 bp, Mus musculus
gctccacctgtgtgaagtatctatg

SEQ ID NO: 690196 - DNA, 25 bp, Mus musculus
gctccacgaagacactcaacattaa

SEQ ID NO: 690197 - DNA, 25 bp, Mus musculus
gctccacgaagagactcaacattaa

SEQ ID NO: 690198 - DNA, 25 bp, Mus musculus
gctccacgtcaaatacctgtatggg

SEQ ID NO: 690199 - DNA, 25 bp, Mus musculus
gctccacgtcaattacctgtatggg

SEQ ID NO: 690200 - DNA, 25 bp, Mus musculus
gctccactggctccggattttatgg

SEQ ID NO: 690201 - DNA, 25 bp, Mus musculus
gctccactggctgcggattttatgg

SEQ ID NO: 690202 - DNA, 25 bp, Mus musculus
gctccactgtatagctggcgcacag

SEQ ID NO: 690203 - DNA, 25 bp, Mus musculus
gctccactgtattgctggcgcacag

SEQ ID NO: 690204 - DNA, 25 bp, Mus musculus
gctccactgtgaatagccattcgaa

SEQ ID NO: 690205 - DNA, 25 bp, Mus musculus
gctccactgtgaatctgttcccctt

SEQ ID NO: 690206 - DNA, 25 bp, Mus musculus
gctccactgtgattagccattcgaa

SEQ ID NO: 690207 - DNA, 25 bp, Mus musculus
gctccactgtgattctgttcccctt

SEQ ID NO: 690208 - DNA, 25 bp, Mus musculus
gctccactgtggaagctcctaagat

SEQ ID NO: 690209 - DNA, 25 bp, Mus musculus
gctccactgtggtagctcctaagat

SEQ ID NO: 690210 - DNA, 25 bp, Mus musculus
gctccacttaccagtgggataccat

SEQ ID NO: 690211 - DNA, 25 bp, Mus musculus
gctccacttacctgtgggataccat

SEQ ID NO: 690212 - DNA, 25 bp, Mus musculus
gctccacttccaattggcttcggtg

SEQ ID NO: 690213 - DNA, 25 bp, Mus musculus
gctccacttccatttggcttcggtg

SEQ ID NO: 690214 - DNA, 25 bp, Mus musculus
gctccactttggcttcagagacgaa

SEQ ID NO: 690215 - DNA, 25 bp, Mus musculus
gctccactttgggttcagagacgaa

SEQ ID NO: 690216 - DNA, 25 bp, Mus musculus
gctccagaagtacatggtgtggtca

SEQ ID NO: 690217 - DNA, 25 bp, Mus musculus
gctccagaagtagatggtgtggtca

SEQ ID NO: 690218 - DNA, 25 bp, Mus musculus
gctccagacaaacatgctattcttc

SEQ ID NO: 690219 - DNA, 25 bp, Mus musculus
gctccagacaaagatgctattcttc

SEQ ID NO: 690220 - DNA, 25 bp, Mus musculus
gctccagacgatcgttgaacatcac

SEQ ID NO: 690221 - DNA, 25 bp, Mus musculus
gctccagacgatggttgaacatcac

SEQ ID NO: 690222 - DNA, 25 bp, Mus musculus
gctccagactacacaaaaatccaaa

SEQ ID NO: 690223 - DNA, 25 bp, Mus musculus
gctccagactactcaaaaatccaaa

SEQ ID NO: 690224 - DNA, 25 bp, Mus musculus
gctccagacttaccgctaccatgga

SEQ ID NO: 690225 - DNA, 25 bp, Mus musculus
gctccagacttagcgctaccatgga

SEQ ID NO: 690226 - DNA, 25 bp, Mus musculus
gctccagacttgcaaaagaggaaac

SEQ ID NO: 690227 - DNA, 25 bp, Mus musculus
gctccagacttggaaaagaggaaac

SEQ ID NO: 690228 - DNA, 25 bp, Mus musculus
gctccagaggcaatgttcgaccgcg

SEQ ID NO: 690229 - DNA, 25 bp, Mus musculus
gctccagaggcattgttcgaccgcg

SEQ ID NO: 690230 - DNA, 25 bp, Mus musculus
gctccagaggccatctttcttctgt

SEQ ID NO: 690231 - DNA, 25 bp, Mus musculus
gctccagaggccttctttcttctgt

SEQ ID NO: 690232 - DNA, 25 bp, Mus musculus
gctccagaggtgatcatgcagacgg

SEQ ID NO: 690233 - DNA, 25 bp, Mus musculus
gctccagaggtgttcatgcagacgg

SEQ ID NO: 690234 - DNA, 25 bp, Mus musculus
gctccagatgccagaatgtgtggta

SEQ ID NO: 690235 - DNA, 25 bp, Mus musculus
gctccagatgcctgaatgtgtggta

SEQ ID NO: 690236 - DNA, 25 bp, Mus musculus
gctccagattggaacaaagattttg

SEQ ID NO: 690237 - DNA, 25 bp, Mus musculus
gctccagattggtacaaagattttg

SEQ ID NO: 690238 - DNA, 25 bp, Mus musculus
gctccagcaagtcgcattgcagcaa

SEQ ID NO: 690239 - DNA, 25 bp, Mus musculus
gctccagcaagtggcattgcagcaa

SEQ ID NO: 690240 - DNA, 25 bp, Mus musculus
gctccagcataccatcttattttgg

SEQ ID NO: 690241 - DNA, 25 bp, Mus musculus
gctccagcatacgatcttattttgg

SEQ ID NO: 690242 - DNA, 25 bp, Mus musculus
gctccagcatggctgtgtgctctac

SEQ ID NO: 690243 - DNA, 25 bp, Mus musculus
gctccagcatgggtgtgtgctctac

SEQ ID NO: 690244 - DNA, 25 bp, Mus musculus
gctccagccaggcaaaacaactgct

SEQ ID NO: 690245 - DNA, 25 bp, Mus musculus
gctccagccagggaaaacaactgct

SEQ ID NO: 690246 - DNA, 25 bp, Mus musculus
gctccaggcagtcctaatcatcagg

SEQ ID NO: 690247 - DNA, 25 bp, Mus musculus
gctccaggcagtgctaatcatcagg

SEQ ID NO: 690248 - DNA, 25 bp, Mus musculus
gctccaggccgccatagacagcaat

SEQ ID NO: 690249 - DNA, 25 bp, Mus musculus
gctccaggccgcgatagacagcaat

SEQ ID NO: 690250 - DNA, 25 bp, Mus musculus
gctccagggaggagttctactgcct

SEQ ID NO: 690251 - DNA, 25 bp, Mus musculus
gctccagggaggtgttctactgcct

SEQ ID NO: 690252 - DNA, 25 bp, Mus musculus
gctccaggtaccacctactcggata

SEQ ID NO: 690253 - DNA, 25 bp, Mus musculus
gctccaggtacctcctactcggata

SEQ ID NO: 690254 - DNA, 25 bp, Mus musculus
gctccaggtgaacacgagccaagcc

SEQ ID NO: 690255 - DNA, 25 bp, Mus musculus
gctccaggtgaagacgagccaagcc

SEQ ID NO: 690256 - DNA, 25 bp, Mus musculus
gctccagtacgaataatggctccaa

SEQ ID NO: 690257 - DNA, 25 bp, Mus musculus
gctccagtacgattaatggctccaa

SEQ ID NO: 690258 - DNA, 25 bp, Mus musculus
gctccagtcagcacgagggtacttg

SEQ ID NO: 690259 - DNA, 25 bp, Mus musculus
gctccagtcagctcgagggtacttg

SEQ ID NO: 690260 - DNA, 25 bp, Mus musculus
gctccagtccggcttgttgctccag

SEQ ID NO: 690261 - DNA, 25 bp, Mus musculus
gctccagtccgggttgttgctccag

SEQ ID NO: 690262 - DNA, 25 bp, Mus musculus
gctccagtgatcatgaggcgaacct

SEQ ID NO: 690263 - DNA, 25 bp, Mus musculus
gctccagtgatcttgaggcgaacct

SEQ ID NO: 690264 - DNA, 25 bp, Mus musculus
gctccagtgtacactcagcctgtgt

SEQ ID NO: 690265 - DNA, 25 bp, Mus musculus
gctccagtgtactctcagcctgtgt

SEQ ID NO: 690266 - DNA, 25 bp, Mus musculus
gctccagttggtcttatgccccagg

SEQ ID NO: 690267 - DNA, 25 bp, Mus musculus
gctccagttggtgttatgccccagg

SEQ ID NO: 690268 - DNA, 25 bp, Mus musculus
gctccatagaaaagtgaccatcaaa

SEQ ID NO: 690269 - DNA, 25 bp, Mus musculus
gctccatagaaatgtgaccatcaaa

SEQ ID NO: 690270 - DNA, 25 bp, Mus musculus
gctccatagccaacaaaaaacggtc

SEQ ID NO: 690271 - DNA, 25 bp, Mus musculus
gctccatagccatcaaaaaacggtc

SEQ ID NO: 690272 - DNA, 25 bp, Mus musculus
gctccatatacaacctaaagacccg

SEQ ID NO: 690273 - DNA, 25 bp, Mus musculus
gctccatatacatcctaaagacccg

SEQ ID NO: 690274 - DNA, 25 bp, Mus musculus
gctccatataggactgaggacatcc

SEQ ID NO: 690275 - DNA, 25 bp, Mus musculus
gctccatataggtctgaggacatcc

SEQ ID NO: 690276 - DNA, 25 bp, Mus musculus
gctccatcaaggaacaatcttcgac

SEQ ID NO: 690277 - DNA, 25 bp, Mus musculus
gctccatcaaggtacaatcttcgac

SEQ ID NO: 690278 - DNA, 25 bp, Mus musculus
gctccatcagccagggtgtgctgga

SEQ ID NO: 690279 - DNA, 25 bp, Mus musculus
gctccatcagcctgggtgtgctgga

SEQ ID NO: 690280 - DNA, 25 bp, Mus musculus
gctccatcctgccatttgctactgt

SEQ ID NO: 690281 - DNA, 25 bp, Mus musculus
gctccatcctgcgatttgctactgt

SEQ ID NO: 690282 - DNA, 25 bp, Mus musculus
gctccatcgccaacctggagcagga

SEQ ID NO: 690283 - DNA, 25 bp, Mus musculus
gctccatcgccatcctggagcagga

SEQ ID NO: 690284 - DNA, 25 bp, Mus musculus
gctccatcgctgagcatgcagcact

SEQ ID NO: 690285 - DNA, 25 bp, Mus musculus
gctccatcgctgtgcatgcagcact

SEQ ID NO: 690286 - DNA, 25 bp, Mus musculus
gctccatctcttagggcggacagcc

SEQ ID NO: 690287 - DNA, 25 bp, Mus musculus
gctccatctctttgggcggacagcc

SEQ ID NO: 690288 - DNA, 25 bp, Mus musculus
gctccatgaagacgaagtgctccca

SEQ ID NO: 690289 - DNA, 25 bp, Mus musculus
gctccatgaagaggaagtgctccca

SEQ ID NO: 690290 - DNA, 25 bp, Mus musculus
gctccatgataaagcctgcagtttc

SEQ ID NO: 690291 - DNA, 25 bp, Mus musculus
gctccatgataatgcctgcagtttc

SEQ ID NO: 690292 - DNA, 25 bp, Mus musculus
gctccatgccaacaagggaaggcat

SEQ ID NO: 690293 - DNA, 25 bp, Mus musculus
gctccatgccaagaagggaaggcat

SEQ ID NO: 690294 - DNA, 25 bp, Mus musculus
gctccatggctgatgtggacactgg

SEQ ID NO: 690295 - DNA, 25 bp, Mus musculus
gctccatggctgttgtggacactgg

SEQ ID NO: 690296 - DNA, 25 bp, Mus musculus
gctccatgtcgcacatccgtttgtt

SEQ ID NO: 690297 - DNA, 25 bp, Mus musculus
gctccatgtcgctcatccgtttgtt

SEQ ID NO: 690298 - DNA, 25 bp, Mus musculus
gctccatgttttccccgggccagga

SEQ ID NO: 690299 - DNA, 25 bp, Mus musculus
gctccatgttttgcccgggccagga

SEQ ID NO: 690300 - DNA, 25 bp, Mus musculus
gctccattcgcaacctgtttggcag

SEQ ID NO: 690301 - DNA, 25 bp, Mus musculus
gctccattcgcatcctgtttggcag

SEQ ID NO: 690302 - DNA, 25 bp, Mus musculus
gctccattgaacactgtagagcaga

SEQ ID NO: 690303 - DNA, 25 bp, Mus musculus
gctccattgaactctgtagagcaga

SEQ ID NO: 690304 - DNA, 25 bp, Mus musculus
gctccattgatgaattttgccgaaa

SEQ ID NO: 690305 - DNA, 25 bp, Mus musculus
gctccattgatgtattttgccgaaa

SEQ ID NO: 690306 - DNA, 25 bp, Mus musculus
gctccattgcataatgaggaaatca

SEQ ID NO: 690307 - DNA, 25 bp, Mus musculus
gctccattgcattatgaggaaatca

SEQ ID NO: 690308 - DNA, 25 bp, Mus musculus
gctccatttggtcgcttcaaaatgt

SEQ ID NO: 690309 - DNA, 25 bp, Mus musculus
gctccatttggtggcttcaaaatgt

SEQ ID NO: 690310 - DNA, 25 bp, Mus musculus
gctcccaagaccatctggatccaga

SEQ ID NO: 690311 - DNA, 25 bp, Mus musculus
gctcccaagaccttctggatccaga

SEQ ID NO: 690312 - DNA, 25 bp, Mus musculus
gctcccacagagaagctaaacgtgc

SEQ ID NO: 690313 - DNA, 25 bp, Mus musculus
gctcccacagagagacagggctgga

SEQ ID NO: 690314 - DNA, 25 bp, Mus musculus
gctcccacagagtagctaaacgtgc

SEQ ID NO: 690315 - DNA, 25 bp, Mus musculus
gctcccacagagtgacagggctgga

SEQ ID NO: 690316 - DNA, 25 bp, Mus musculus
gctcccacgggccaagtgaatacca

SEQ ID NO: 690317 - DNA, 25 bp, Mus musculus
gctcccacgggcgaagtgaatacca

SEQ ID NO: 690318 - DNA, 25 bp, Mus musculus
gctcccagaactcaaaggcacttaa

SEQ ID NO: 690319 - DNA, 25 bp, Mus musculus
gctcccagaactgaaaggcacttaa

SEQ ID NO: 690320 - DNA, 25 bp, Mus musculus
gctcccagaagcaaaggacattgag

SEQ ID NO: 690321 - DNA, 25 bp, Mus musculus
gctcccagaagctaaggacattgag

SEQ ID NO: 690322 - DNA, 25 bp, Mus musculus
gctcccagcattaatgaacatgaag

SEQ ID NO: 690323 - DNA, 25 bp, Mus musculus
gctcccagcatttatgaacatgaag

SEQ ID NO: 690324 - DNA, 25 bp, Mus musculus
gctcccaggaagattttaaagacct

SEQ ID NO: 690325 - DNA, 25 bp, Mus musculus
gctcccaggaagtttttaaagacct

SEQ ID NO: 690326 - DNA, 25 bp, Mus musculus
gctcccagttccattgttgacaatc

SEQ ID NO: 690327 - DNA, 25 bp, Mus musculus
gctcccagttcctttgttgacaatc

SEQ ID NO: 690328 - DNA, 25 bp, Mus musculus
gctcccagttttagccccagtgtct

SEQ ID NO: 690329 - DNA, 25 bp, Mus musculus
gctcccagtttttgccccagtgtct

SEQ ID NO: 690330 - DNA, 25 bp, Mus musculus
gctcccatgattctgaatggagtgt

SEQ ID NO: 690331 - DNA, 25 bp, Mus musculus
gctcccatgattgtgaatggagtgt

SEQ ID NO: 690332 - DNA, 25 bp, Mus musculus
gctccccaagatagcctcggtaact

SEQ ID NO: 690333 - DNA, 25 bp, Mus musculus
gctccccaagattgcctcggtaact

SEQ ID NO: 690334 - DNA, 25 bp, Mus musculus
gctccccacaagagctgcacatggg

SEQ ID NO: 690335 - DNA, 25 bp, Mus musculus
gctccccacaagtgctgcacatggg

SEQ ID NO: 690336 - DNA, 25 bp, Mus musculus
gctccccagcgtacaatttattagg

SEQ ID NO: 690337 - DNA, 25 bp, Mus musculus
gctccccagcgttcaatttattagg

SEQ ID NO: 690338 - DNA, 25 bp, Mus musculus
gctccccatggcagcgggtgctgtt

SEQ ID NO: 690339 - DNA, 25 bp, Mus musculus
gctccccatggctgcgggtgctgtt

SEQ ID NO: 690340 - DNA, 25 bp, Mus musculus
gctcccctcagccttgtgcagaggg

SEQ ID NO: 690341 - DNA, 25 bp, Mus musculus
gctcccctcagcgttgtgcagaggg

SEQ ID NO: 690342 - DNA, 25 bp, Mus musculus
gctcccctggaccagattccagtgg

SEQ ID NO: 690343 - DNA, 25 bp, Mus musculus
gctcccctggacgagattccagtgg

SEQ ID NO: 690344 - DNA, 25 bp, Mus musculus
gctcccgagaggcattcaaagggca

SEQ ID NO: 690345 - DNA, 25 bp, Mus musculus
gctcccgagagggattcaaagggca

SEQ ID NO: 690346 - DNA, 25 bp, Mus musculus
gctcccgatctccattctacagtgg

SEQ ID NO: 690347 - DNA, 25 bp, Mus musculus
gctcccgatctcgattctacagtgg

SEQ ID NO: 690348 - DNA, 25 bp, Mus musculus
gctcccgatggccagattatggtgc

SEQ ID NO: 690349 - DNA, 25 bp, Mus musculus
gctcccgatggcgagattatggtgc

SEQ ID NO: 690350 - DNA, 25 bp, Mus musculus
gctcccgattacaaacaaaatttgg

SEQ ID NO: 690351 - DNA, 25 bp, Mus musculus
gctcccgattactaacaaaatttgg

SEQ ID NO: 690352 - DNA, 25 bp, Mus musculus
gctcccgcatggctgctcatctagt

SEQ ID NO: 690353 - DNA, 25 bp, Mus musculus
gctcccgcatgggtgctcatctagt

SEQ ID NO: 690354 - DNA, 25 bp, Mus musculus
gctcccgctgtgaagctgaccacaa

SEQ ID NO: 690355 - DNA, 25 bp, Mus musculus
gctcccgctgtgtagctgaccacaa

SEQ ID NO: 690356 - DNA, 25 bp, Mus musculus
gctcccggacctctgcgtgttaaag

SEQ ID NO: 690357 - DNA, 25 bp, Mus musculus
gctcccggacctgtgcgtgttaaag

SEQ ID NO: 690358 - DNA, 25 bp, Mus musculus
gctcccggcgctatgttgcagatcg

SEQ ID NO: 690359 - DNA, 25 bp, Mus musculus
gctcccggcgctttgttgcagatcg

SEQ ID NO: 690360 - DNA, 25 bp, Mus musculus
gctcccgggatcagcataaacagtg

SEQ ID NO: 690361 - DNA, 25 bp, Mus musculus
gctcccgggatctgcataaacagtg

SEQ ID NO: 690362 - DNA, 25 bp, Mus musculus
gctcccgggcccagataaagggcca

SEQ ID NO: 690363 - DNA, 25 bp, Mus musculus
gctcccgggccctgataaagggcca

SEQ ID NO: 690364 - DNA, 25 bp, Mus musculus
gctcccgtcattattccgagtctcg

SEQ ID NO: 690365 - DNA, 25 bp, Mus musculus
gctcccgtcatttttccgagtctcg

SEQ ID NO: 690366 - DNA, 25 bp, Mus musculus
gctcccgttcagctgaccgctataa

SEQ ID NO: 690367 - DNA, 25 bp, Mus musculus
gctcccgttcaggtgaccgctataa

SEQ ID NO: 690368 - DNA, 25 bp, Mus musculus
gctccctaagctccaagttggtttc

SEQ ID NO: 690369 - DNA, 25 bp, Mus musculus
gctccctaagctgcaagttggtttc

SEQ ID NO: 690370 - DNA, 25 bp, Mus musculus
gctccctatgataggcggcgagccc

SEQ ID NO: 690371 - DNA, 25 bp, Mus musculus
gctccctatgattggcggcgagccc

SEQ ID NO: 690372 - DNA, 25 bp, Mus musculus
gctccctatggaaaagccagctgcc

SEQ ID NO: 690373 - DNA, 25 bp, Mus musculus
gctccctatggataagccagctgcc

SEQ ID NO: 690374 - DNA, 25 bp, Mus musculus
gctccctcaactatggattatatgg

SEQ ID NO: 690375 - DNA, 25 bp, Mus musculus
gctccctcaactttggattatatgg

SEQ ID NO: 690376 - DNA, 25 bp, Mus musculus
gctccctcactgatgtggccgtgga

SEQ ID NO: 690377 - DNA, 25 bp, Mus musculus
gctccctcactgttgtggccgtgga

SEQ ID NO: 690378 - DNA, 25 bp, Mus musculus
gctccctcaggtcgtgatctttgtg

SEQ ID NO: 690379 - DNA, 25 bp, Mus musculus
gctccctcaggtggtgatctttgtg

SEQ ID NO: 690380 - DNA, 25 bp, Mus musculus
gctccctcgttacggaaggcccaga

SEQ ID NO: 690381 - DNA, 25 bp, Mus musculus
gctccctcgttagggaaggcccaga

SEQ ID NO: 690382 - DNA, 25 bp, Mus musculus
gctccctgatcccagcagcaaatga

SEQ ID NO: 690383 - DNA, 25 bp, Mus musculus
gctccctgatccgagcagcaaatga

SEQ ID NO: 690384 - DNA, 25 bp, Mus musculus
gctccctggtggatctctgcacttg

SEQ ID NO: 690385 - DNA, 25 bp, Mus musculus
gctccctggtggttctctgcacttg

SEQ ID NO: 690386 - DNA, 25 bp, Mus musculus
gctccctggtgtcgctctccatgta

SEQ ID NO: 690387 - DNA, 25 bp, Mus musculus
gctccctggtgtggctctccatgta

SEQ ID NO: 690388 - DNA, 25 bp, Mus musculus
gctccctggttcaaagggccgcagc

SEQ ID NO: 690389 - DNA, 25 bp, Mus musculus
gctccctggttctaagggccgcagc

SEQ ID NO: 690390 - DNA, 25 bp, Mus musculus
gctcccttatgtccatcttcacatg

SEQ ID NO: 690391 - DNA, 25 bp, Mus musculus
gctcccttatgtgcatcttcacatg

SEQ ID NO: 690392 - DNA, 25 bp, Mus musculus
gctcccttgggaaacaaagaaccag

SEQ ID NO: 690393 - DNA, 25 bp, Mus musculus
gctcccttgggatacaaagaaccag

SEQ ID NO: 690394 - DNA, 25 bp, Mus musculus
gctcccttggtaaagacctgccagg

SEQ ID NO: 690395 - DNA, 25 bp, Mus musculus
gctcccttggtatagacctgccagg

SEQ ID NO: 690396 - DNA, 25 bp, Mus musculus
gctccctttttcctgttcacctgtg

SEQ ID NO: 690397 - DNA, 25 bp, Mus musculus
gctccctttttcgtgttcacctgtg

SEQ ID NO: 690398 - DNA, 25 bp, Mus musculus
gctccgaaaaacagtggaggacctt

SEQ ID NO: 690399 - DNA, 25 bp, Mus musculus
gctccgaaaaactgtggaggacctt

SEQ ID NO: 690400 - DNA, 25 bp, Mus musculus
gctccgactgtgagcagaagtgtag

SEQ ID NO: 690401 - DNA, 25 bp, Mus musculus
gctccgactgtgtgcagaagtgtag

SEQ ID NO: 690402 - DNA, 25 bp, Mus musculus
gctccgagaccccacaagagacata

SEQ ID NO: 690403 - DNA, 25 bp, Mus musculus
gctccgagacccgacaagagacata

SEQ ID NO: 690404 - DNA, 25 bp, Mus musculus
gctccgagagtacaacaaagccgtg

SEQ ID NO: 690405 - DNA, 25 bp, Mus musculus
gctccgagagtagaacaaagccgtg

SEQ ID NO: 690406 - DNA, 25 bp, Mus musculus
gctccgagccagccaagaagaaatg

SEQ ID NO: 690407 - DNA, 25 bp, Mus musculus
gctccgagccaggcaagaagaaatg

SEQ ID NO: 690408 - DNA, 25 bp, Mus musculus
gctccgaggcagacaggccgctcag

SEQ ID NO: 690409 - DNA, 25 bp, Mus musculus
gctccgaggcagtcaggccgctcag

SEQ ID NO: 690410 - DNA, 25 bp, Mus musculus
gctccgaggcatccagcaagcagag

SEQ ID NO: 690411 - DNA, 25 bp, Mus musculus
gctccgaggcatgcagcaagcagag

SEQ ID NO: 690412 - DNA, 25 bp, Mus musculus
gctccgagtaggagggttgtatttt

SEQ ID NO: 690413 - DNA, 25 bp, Mus musculus
gctccgagtaggtgggttgtatttt

SEQ ID NO: 690414 - DNA, 25 bp, Mus musculus
gctccgagtctgcttcgtgtctcct

SEQ ID NO: 690415 - DNA, 25 bp, Mus musculus
gctccgagtctggttcgtgtctcct

SEQ ID NO: 690416 - DNA, 25 bp, Mus musculus
gctccgataggacgtgtgctcttca

SEQ ID NO: 690417 - DNA, 25 bp, Mus musculus
gctccgataggaggtgtgctcttca

SEQ ID NO: 690418 - DNA, 25 bp, Mus musculus
gctccgcctgagaaagcctgcttga

SEQ ID NO: 690419 - DNA, 25 bp, Mus musculus
gctccgcctgagtaagcctgcttga

SEQ ID NO: 690420 - DNA, 25 bp, Mus musculus
gctccgcctggtcaaatggtaggct

SEQ ID NO: 690421 - DNA, 25 bp, Mus musculus
gctccgcctggtgaaatggtaggct

SEQ ID NO: 690422 - DNA, 25 bp, Mus musculus
gctccgcggactactacaacaagaa

SEQ ID NO: 690423 - DNA, 25 bp, Mus musculus
gctccgcggacttctacaacaagaa

SEQ ID NO: 690424 - DNA, 25 bp, Mus musculus
gctccgcgtacaacaaagtgactct

SEQ ID NO: 690425 - DNA, 25 bp, Mus musculus
gctccgcgtacatcaaagtgactct

SEQ ID NO: 690426 - DNA, 25 bp, Mus musculus
gctccgctcgtgagtgttcactccg

SEQ ID NO: 690427 - DNA, 25 bp, Mus musculus
gctccgctcgtgtgtgttcactccg

SEQ ID NO: 690428 - DNA, 25 bp, Mus musculus
gctccggaacgaagtggccatttta

SEQ ID NO: 690429 - DNA, 25 bp, Mus musculus
gctccggaacgatgtggccatttta

SEQ ID NO: 690430 - DNA, 25 bp, Mus musculus
gctccggacacccagcatggatgtt

SEQ ID NO: 690431 - DNA, 25 bp, Mus musculus
gctccggacaccgagcatggatgtt

SEQ ID NO: 690432 - DNA, 25 bp, Mus musculus
gctccggaccagcatgaaatcgatt

SEQ ID NO: 690433 - DNA, 25 bp, Mus musculus
gctccggaccaggatgaaatcgatt

SEQ ID NO: 690434 - DNA, 25 bp, Mus musculus
gctccggattatcgctcgggtgtcc

SEQ ID NO: 690435 - DNA, 25 bp, Mus musculus
gctccggattatggctcgggtgtcc

SEQ ID NO: 690436 - DNA, 25 bp, Mus musculus
gctccggcaaacaagaacagaatct

SEQ ID NO: 690437 - DNA, 25 bp, Mus musculus
gctccggcaaactagaacagaatct

SEQ ID NO: 690438 - DNA, 25 bp, Mus musculus
gctccggctcagctctgtcctggag

SEQ ID NO: 690439 - DNA, 25 bp, Mus musculus
gctccggctcaggtctgtcctggag

SEQ ID NO: 690440 - DNA, 25 bp, Mus musculus
gctccggctgctctggaatttacag

SEQ ID NO: 690441 - DNA, 25 bp, Mus musculus
gctccggctgctgtggaatttacag

SEQ ID NO: 690442 - DNA, 25 bp, Mus musculus
gctccggcttcccagattttctact

SEQ ID NO: 690443 - DNA, 25 bp, Mus musculus
gctccggcttccgagattttctact

SEQ ID NO: 690444 - DNA, 25 bp, Mus musculus
gctccgggaacaaattgacaaccta

SEQ ID NO: 690445 - DNA, 25 bp, Mus musculus
gctccgggaacatattgacaaccta

SEQ ID NO: 690446 - DNA, 25 bp, Mus musculus
gctccgggaccgcttgcttcctgtt

SEQ ID NO: 690447 - DNA, 25 bp, Mus musculus
gctccgggaccggttgcttcctgtt

SEQ ID NO: 690448 - DNA, 25 bp, Mus musculus
gctccgggacgcaagtgctacttcg

SEQ ID NO: 690449 - DNA, 25 bp, Mus musculus
gctccgggacgctagtgctacttcg

SEQ ID NO: 690450 - DNA, 25 bp, Mus musculus
gctccgggcagacaacaagtcagct

SEQ ID NO: 690451 - DNA, 25 bp, Mus musculus
gctccgggcagagaacaagtcagct

SEQ ID NO: 690452 - DNA, 25 bp, Mus musculus
gctccgggcgccacaaggagacttg

SEQ ID NO: 690453 - DNA, 25 bp, Mus musculus
gctccgggcgcctcaaggagacttg

SEQ ID NO: 690454 - DNA, 25 bp, Mus musculus
gctccgtagtgcacacgtcgcacag

SEQ ID NO: 690455 - DNA, 25 bp, Mus musculus
gctccgtagtgctcacgtcgcacag

SEQ ID NO: 690456 - DNA, 25 bp, Mus musculus
gctccgtatgccaggagaccttccg

SEQ ID NO: 690457 - DNA, 25 bp, Mus musculus
gctccgtatgcctggagaccttccg

SEQ ID NO: 690458 - DNA, 25 bp, Mus musculus
gctccgtctgggaggccatggcctt

SEQ ID NO: 690459 - DNA, 25 bp, Mus musculus
gctccgtctgggtggccatggcctt

SEQ ID NO: 690460 - DNA, 25 bp, Mus musculus
gctccgtgacggagtccatccaggc

SEQ ID NO: 690461 - DNA, 25 bp, Mus musculus
gctccgtgacggtgtccatccaggc

SEQ ID NO: 690462 - DNA, 25 bp, Mus musculus
gctccgtgcccgaggtcagcaagca

SEQ ID NO: 690463 - DNA, 25 bp, Mus musculus
gctccgtgcccgtggtcagcaagca

SEQ ID NO: 690464 - DNA, 25 bp, Mus musculus
gctccgtgctcaccaagtgggacct

SEQ ID NO: 690465 - DNA, 25 bp, Mus musculus
gctccgtgctcagcaagtgggacct

SEQ ID NO: 690466 - DNA, 25 bp, Mus musculus
gctccgtgcttcagggtgcttccaa

SEQ ID NO: 690467 - DNA, 25 bp, Mus musculus
gctccgtgcttctgggtgcttccaa

SEQ ID NO: 690468 - DNA, 25 bp, Mus musculus
gctccgtggaccctgtttccatgaa

SEQ ID NO: 690469 - DNA, 25 bp, Mus musculus
gctccgtggaccgtgtttccatgaa

SEQ ID NO: 690470 - DNA, 25 bp, Mus musculus
gctccgtggcttcctgctgcagaac

SEQ ID NO: 690471 - DNA, 25 bp, Mus musculus
gctccgtggcttgctgctgcagaac

SEQ ID NO: 690472 - DNA, 25 bp, Mus musculus
gctccgtggtggaactcatctccca

SEQ ID NO: 690473 - DNA, 25 bp, Mus musculus
gctccgtggtggtactcatctccca

SEQ ID NO: 690474 - DNA, 25 bp, Mus musculus
gctccgtgtactacgtggctctggt

SEQ ID NO: 690475 - DNA, 25 bp, Mus musculus
gctccgtgtactcaggccctttgca

SEQ ID NO: 690476 - DNA, 25 bp, Mus musculus
gctccgtgtactgaggccctttgca

SEQ ID NO: 690477 - DNA, 25 bp, Mus musculus
gctccgtgtacttcgtggctctggt

SEQ ID NO: 690478 - DNA, 25 bp, Mus musculus
gctccgtgtgaacaacaaacatgtg

SEQ ID NO: 690479 - DNA, 25 bp, Mus musculus
gctccgtgtgaagaacaaacatgtg

SEQ ID NO: 690480 - DNA, 25 bp, Mus musculus
gctccgtttatgaaacacccattaa

SEQ ID NO: 690481 - DNA, 25 bp, Mus musculus
gctccgtttatgtaacacccattaa

SEQ ID NO: 690482 - DNA, 25 bp, Mus musculus
gctcctaaagcaaatgccaccattg

SEQ ID NO: 690483 - DNA, 25 bp, Mus musculus
gctcctaaagcatatgccaccattg

SEQ ID NO: 690484 - DNA, 25 bp, Mus musculus
gctcctaagagccaccgtattgtca

SEQ ID NO: 690485 - DNA, 25 bp, Mus musculus
gctcctaagagcgaccgtattgtca

SEQ ID NO: 690486 - DNA, 25 bp, Mus musculus
gctcctacacgaacagactgtcatt

SEQ ID NO: 690487 - DNA, 25 bp, Mus musculus
gctcctacacgatcagactgtcatt

SEQ ID NO: 690488 - DNA, 25 bp, Mus musculus
gctcctacagcaatgagccgcagtt

SEQ ID NO: 690489 - DNA, 25 bp, Mus musculus
gctcctacagcattgagccgcagtt

SEQ ID NO: 690490 - DNA, 25 bp, Mus musculus
gctcctacatgtcggcttgcccagg

SEQ ID NO: 690491 - DNA, 25 bp, Mus musculus
gctcctacatgtgggcttgcccagg

SEQ ID NO: 690492 - DNA, 25 bp, Mus musculus
gctcctacgctgatgtgggaccacc

SEQ ID NO: 690493 - DNA, 25 bp, Mus musculus
gctcctacgctgttgtgggaccacc

SEQ ID NO: 690494 - DNA, 25 bp, Mus musculus
gctcctagaggacgcagtaagcatg

SEQ ID NO: 690495 - DNA, 25 bp, Mus musculus
gctcctagaggaggcagtaagcatg

SEQ ID NO: 690496 - DNA, 25 bp, Mus musculus
gctcctagcgctaatgtttgagtat

SEQ ID NO: 690497 - DNA, 25 bp, Mus musculus
gctcctagcgcttatgtttgagtat

SEQ ID NO: 690498 - DNA, 25 bp, Mus musculus
gctcctaggcgaaagtgggcaagtc

SEQ ID NO: 690499 - DNA, 25 bp, Mus musculus
gctcctaggcgatagtgggcaagtc

SEQ ID NO: 690500 - DNA, 25 bp, Mus musculus
gctcctagggtgcacagctggacat

SEQ ID NO: 690501 - DNA, 25 bp, Mus musculus
gctcctagggtggacagctggacat

SEQ ID NO: 690502 - DNA, 25 bp, Mus musculus
gctcctagtggacggctctaccatc

SEQ ID NO: 690503 - DNA, 25 bp, Mus musculus
gctcctagtggagggctctaccatc

SEQ ID NO: 690504 - DNA, 25 bp, Mus musculus
gctcctatgtacaaccgaggatctg

SEQ ID NO: 690505 - DNA, 25 bp, Mus musculus
gctcctatgtactaccgaggatctg

SEQ ID NO: 690506 - DNA, 25 bp, Mus musculus
gctcctattgtgctagtgatcgcca

SEQ ID NO: 690507 - DNA, 25 bp, Mus musculus
gctcctattgtggtagtgatcgcca

SEQ ID NO: 690508 - DNA, 25 bp, Mus musculus
gctcctcaaagactcactcaacgag

SEQ ID NO: 690509 - DNA, 25 bp, Mus musculus
gctcctcaaagagtcactcaacgag

SEQ ID NO: 690510 - DNA, 25 bp, Mus musculus
gctcctccagggactgacccgtata

SEQ ID NO: 690511 - DNA, 25 bp, Mus musculus
gctcctccagggtctgacccgtata

SEQ ID NO: 690512 - DNA, 25 bp, Mus musculus
gctcctccatgaagccgggctttgt

SEQ ID NO: 690513 - DNA, 25 bp, Mus musculus
gctcctccatgatgccgggctttgt

SEQ ID NO: 690514 - DNA, 25 bp, Mus musculus
gctcctcccagcaggtcagagacat

SEQ ID NO: 690515 - DNA, 25 bp, Mus musculus
gctcctcccagctggtcagagacat

SEQ ID NO: 690516 - DNA, 25 bp, Mus musculus
gctcctccgggacagaatagtctta

SEQ ID NO: 690517 - DNA, 25 bp, Mus musculus
gctcctccgggagagaatagtctta

SEQ ID NO: 690518 - DNA, 25 bp, Mus musculus
gctcctcgggaaacgggcccgctgt

SEQ ID NO: 690519 - DNA, 25 bp, Mus musculus
gctcctcgggaatcgggcccgctgt

SEQ ID NO: 690520 - DNA, 25 bp, Mus musculus
gctcctcggtgacagatccgacgac

SEQ ID NO: 690521 - DNA, 25 bp, Mus musculus
gctcctcggtgagagatccgacgac

SEQ ID NO: 690522 - DNA, 25 bp, Mus musculus
gctcctctatgtcaccaaggtgaca

SEQ ID NO: 690523 - DNA, 25 bp, Mus musculus
gctcctctatgtgaccaaggtgaca

SEQ ID NO: 690524 - DNA, 25 bp, Mus musculus
gctcctctcgccaaggttattcatg

SEQ ID NO: 690525 - DNA, 25 bp, Mus musculus
gctcctctcgcctaggttattcatg

SEQ ID NO: 690526 - DNA, 25 bp, Mus musculus
gctcctctgatactgactgtggcaa

SEQ ID NO: 690527 - DNA, 25 bp, Mus musculus
gctcctctgatagtgactgtggcaa

SEQ ID NO: 690528 - DNA, 25 bp, Mus musculus
gctcctctgccaaatccagcgtggg

SEQ ID NO: 690529 - DNA, 25 bp, Mus musculus
gctcctctgccatatccagcgtggg

SEQ ID NO: 690530 - DNA, 25 bp, Mus musculus
gctcctcttacacctgtaatgaagg

SEQ ID NO: 690531 - DNA, 25 bp, Mus musculus
gctcctcttacagctgtaatgaagg

SEQ ID NO: 690532 - DNA, 25 bp, Mus musculus
gctcctgaagccctttttgatagag

SEQ ID NO: 690533 - DNA, 25 bp, Mus musculus
gctcctgaagccgtttttgatagag

SEQ ID NO: 690534 - DNA, 25 bp, Mus musculus
gctcctgaaggaagacctcgtgctg

SEQ ID NO: 690535 - DNA, 25 bp, Mus musculus
gctcctgaaggatgacctcgtgctg

SEQ ID NO: 690536 - DNA, 25 bp, Mus musculus
gctcctgaagttcgtgaaccggagt

SEQ ID NO: 690537 - DNA, 25 bp, Mus musculus
gctcctgaagttggtgaaccggagt

SEQ ID NO: 690538 - DNA, 25 bp, Mus musculus
gctcctgagcatacctgggtacctt

SEQ ID NO: 690539 - DNA, 25 bp, Mus musculus
gctcctgagcatagtctgtcagctg

SEQ ID NO: 690540 - DNA, 25 bp, Mus musculus
gctcctgagcattcctgggtacctt

SEQ ID NO: 690541 - DNA, 25 bp, Mus musculus
gctcctgagcattgtctgtcagctg

SEQ ID NO: 690542 - DNA, 25 bp, Mus musculus
gctcctgaggagcatcgtcaggtct

SEQ ID NO: 690543 - DNA, 25 bp, Mus musculus
gctcctgaggaggatcgtcaggtct

SEQ ID NO: 690544 - DNA, 25 bp, Mus musculus
gctcctgataggaacctttgtggca

SEQ ID NO: 690545 - DNA, 25 bp, Mus musculus
gctcctgataggtacctttgtggca

SEQ ID NO: 690546 - DNA, 25 bp, Mus musculus
gctcctgatgatagccattgagtac

SEQ ID NO: 690547 - DNA, 25 bp, Mus musculus
gctcctgatgattgccattgagtac

SEQ ID NO: 690548 - DNA, 25 bp, Mus musculus
gctcctgcaactctgtggacagcct

SEQ ID NO: 690549 - DNA, 25 bp, Mus musculus
gctcctgcaactgtgtggacagcct

SEQ ID NO: 690550 - DNA, 25 bp, Mus musculus
gctcctgcacacctgggttctctgg

SEQ ID NO: 690551 - DNA, 25 bp, Mus musculus
gctcctgcacacgtgggttctctgg

SEQ ID NO: 690552 - DNA, 25 bp, Mus musculus
gctcctgcccttcgtctggtcggaa

SEQ ID NO: 690553 - DNA, 25 bp, Mus musculus
gctcctgcccttggtctggtcggaa

SEQ ID NO: 690554 - DNA, 25 bp, Mus musculus
gctcctgccgatcgcctgaggcgaa

SEQ ID NO: 690555 - DNA, 25 bp, Mus musculus
gctcctgccgatggcctgaggcgaa

SEQ ID NO: 690556 - DNA, 25 bp, Mus musculus
gctcctgcctgtctttgtatggaac

SEQ ID NO: 690557 - DNA, 25 bp, Mus musculus
gctcctgcctgtgtttgtatggaac

SEQ ID NO: 690558 - DNA, 25 bp, Mus musculus
gctcctgcgcctctgcaggacagtg

SEQ ID NO: 690559 - DNA, 25 bp, Mus musculus
gctcctgcgcctgtgcaggacagtg

SEQ ID NO: 690560 - DNA, 25 bp, Mus musculus
gctcctgcgtcaagatatagtagca

SEQ ID NO: 690561 - DNA, 25 bp, Mus musculus
gctcctgcgtcatgatatagtagca

SEQ ID NO: 690562 - DNA, 25 bp, Mus musculus
gctcctgctttcaatggctttaaaa

SEQ ID NO: 690563 - DNA, 25 bp, Mus musculus
gctcctgctttctatggctttaaaa

SEQ ID NO: 690564 - DNA, 25 bp, Mus musculus
gctcctggaaagatcttgctacctc

SEQ ID NO: 690565 - DNA, 25 bp, Mus musculus
gctcctggaaagttcttgctacctc

SEQ ID NO: 690566 - DNA, 25 bp, Mus musculus
gctcctggagagagagtcgaagaaa

SEQ ID NO: 690567 - DNA, 25 bp, Mus musculus
gctcctggagagtgagtcgaagaaa

SEQ ID NO: 690568 - DNA, 25 bp, Mus musculus
gctcctggaggaattgccacaccgc

SEQ ID NO: 690569 - DNA, 25 bp, Mus musculus
gctcctggaggatttgccacaccgc

SEQ ID NO: 690570 - DNA, 25 bp, Mus musculus
gctcctggcaccaacttcagtggtg

SEQ ID NO: 690571 - DNA, 25 bp, Mus musculus
gctcctggcacctacttcagtggtg

SEQ ID NO: 690572 - DNA, 25 bp, Mus musculus
gctcctggccaacaagaagcagcac

SEQ ID NO: 690573 - DNA, 25 bp, Mus musculus
gctcctggccaagaagaagcagcac

SEQ ID NO: 690574 - DNA, 25 bp, Mus musculus
gctcctggcgccactgatgtaacca

SEQ ID NO: 690575 - DNA, 25 bp, Mus musculus
gctcctggcgcccttgactacaagt

SEQ ID NO: 690576 - DNA, 25 bp, Mus musculus
gctcctggcgccgttgactacaagt

SEQ ID NO: 690577 - DNA, 25 bp, Mus musculus
gctcctggcgcctctgatgtaacca

SEQ ID NO: 690578 - DNA, 25 bp, Mus musculus
gctcctggctaacaatccacctgag

SEQ ID NO: 690579 - DNA, 25 bp, Mus musculus
gctcctggctaacccgggtatactg

SEQ ID NO: 690580 - DNA, 25 bp, Mus musculus
gctcctggctaagaatccacctgag

SEQ ID NO: 690581 - DNA, 25 bp, Mus musculus
gctcctggctaagccgggtatactg

SEQ ID NO: 690582 - DNA, 25 bp, Mus musculus
gctcctgggaccaggccggttacct

SEQ ID NO: 690583 - DNA, 25 bp, Mus musculus
gctcctgggacctggccggttacct

SEQ ID NO: 690584 - DNA, 25 bp, Mus musculus
gctcctgggagtaacagcctactat

SEQ ID NO: 690585 - DNA, 25 bp, Mus musculus
gctcctgggagtcacgctcttgaag

SEQ ID NO: 690586 - DNA, 25 bp, Mus musculus
gctcctgggagtgacgctcttgaag

SEQ ID NO: 690587 - DNA, 25 bp, Mus musculus
gctcctgggagttacagcctactat

SEQ ID NO: 690588 - DNA, 25 bp, Mus musculus
gctcctgggctcctatgccgttcag

SEQ ID NO: 690589 - DNA, 25 bp, Mus musculus
gctcctgggctcgtatgccgttcag

SEQ ID NO: 690590 - DNA, 25 bp, Mus musculus
gctcctgggtacaaggtagaagaaa

SEQ ID NO: 690591 - DNA, 25 bp, Mus musculus
gctcctgggtactaggtagaagaaa

SEQ ID NO: 690592 - DNA, 25 bp, Mus musculus
gctcctggtagtatcagtttggatt

SEQ ID NO: 690593 - DNA, 25 bp, Mus musculus
gctcctggtagtttcagtttggatt

SEQ ID NO: 690594 - DNA, 25 bp, Mus musculus
gctcctggtgcaccgcagagatggc

SEQ ID NO: 690595 - DNA, 25 bp, Mus musculus
gctcctggtgcagcgcagagatggc

SEQ ID NO: 690596 - DNA, 25 bp, Mus musculus
gctcctggttaactgtttgatcacc

SEQ ID NO: 690597 - DNA, 25 bp, Mus musculus
gctcctggttaagtgtttgatcacc

SEQ ID NO: 690598 - DNA, 25 bp, Mus musculus
gctcctgtaggacccggcggcgaga

SEQ ID NO: 690599 - DNA, 25 bp, Mus musculus
gctcctgtaggacctgcgatcccag

SEQ ID NO: 690600 - DNA, 25 bp, Mus musculus
gctcctgtaggagccggcggcgaga

SEQ ID NO: 690601 - DNA, 25 bp, Mus musculus
gctcctgtaggagctgcgatcccag

SEQ ID NO: 690602 - DNA, 25 bp, Mus musculus
gctcctgtccacaggaatcatctgc

SEQ ID NO: 690603 - DNA, 25 bp, Mus musculus
gctcctgtccactggaatcatctgc

SEQ ID NO: 690604 - DNA, 25 bp, Mus musculus
gctcctgtctttcagcagaagtcag

SEQ ID NO: 690605 - DNA, 25 bp, Mus musculus
gctcctgtctttgagcagaagtcag

SEQ ID NO: 690606 - DNA, 25 bp, Mus musculus
gctcctgtggcccacacacatgagg

SEQ ID NO: 690607 - DNA, 25 bp, Mus musculus
gctcctgtggccgacacacatgagg

SEQ ID NO: 690608 - DNA, 25 bp, Mus musculus
gctcctgtgtccaaggtcaggtgcc

SEQ ID NO: 690609 - DNA, 25 bp, Mus musculus
gctcctgtgtcctaggtcaggtgcc

SEQ ID NO: 690610 - DNA, 25 bp, Mus musculus
gctcctgtttttcggatacaacatc

SEQ ID NO: 690611 - DNA, 25 bp, Mus musculus
gctcctgtttttgggatacaacatc

SEQ ID NO: 690612 - DNA, 25 bp, Mus musculus
gctccttaaaatcggcagtgctatt

SEQ ID NO: 690613 - DNA, 25 bp, Mus musculus
gctccttaaaatgggcagtgctatt

SEQ ID NO: 690614 - DNA, 25 bp, Mus musculus
gctccttaaggaaaacgaacatttc

SEQ ID NO: 690615 - DNA, 25 bp, Mus musculus
gctccttaaggataacgaacatttc

SEQ ID NO: 690616 - DNA, 25 bp, Mus musculus
gctccttagaaacccagatcgacaa

SEQ ID NO: 690617 - DNA, 25 bp, Mus musculus
gctccttagaaagccagatcgacaa

SEQ ID NO: 690618 - DNA, 25 bp, Mus musculus
gctccttaggctaatttccagctgt

SEQ ID NO: 690619 - DNA, 25 bp, Mus musculus
gctccttaggcttatttccagctgt

SEQ ID NO: 690620 - DNA, 25 bp, Mus musculus
gctccttagggcagccgctcgcgag

SEQ ID NO: 690621 - DNA, 25 bp, Mus musculus
gctccttagggctgccgctcgcgag

SEQ ID NO: 690622 - DNA, 25 bp, Mus musculus
gctccttattcacgcagcttgcaag

SEQ ID NO: 690623 - DNA, 25 bp, Mus musculus
gctccttattcaggcagcttgcaag

SEQ ID NO: 690624 - DNA, 25 bp, Mus musculus
gctccttcaaacaaagaggcttttg

SEQ ID NO: 690625 - DNA, 25 bp, Mus musculus
gctccttcaaactaagaggcttttg

SEQ ID NO: 690626 - DNA, 25 bp, Mus musculus
gctccttcagcgagcagaagcaaga

SEQ ID NO: 690627 - DNA, 25 bp, Mus musculus
gctccttcagcgtgcagaagcaaga

SEQ ID NO: 690628 - DNA, 25 bp, Mus musculus
gctccttccgggagccatatgagaa

SEQ ID NO: 690629 - DNA, 25 bp, Mus musculus
gctccttccgggtgccatatgagaa

SEQ ID NO: 690630 - DNA, 25 bp, Mus musculus
gctccttctcctccaaggactgtga

SEQ ID NO: 690631 - DNA, 25 bp, Mus musculus
gctccttctcctgcaaggactgtga

SEQ ID NO: 690632 - DNA, 25 bp, Mus musculus
gctccttgatctcccgtctgtttta

SEQ ID NO: 690633 - DNA, 25 bp, Mus musculus
gctccttgatctgccgtctgtttta

SEQ ID NO: 690634 - DNA, 25 bp, Mus musculus
gctccttgatttcaaaggtgaggat

SEQ ID NO: 690635 - DNA, 25 bp, Mus musculus
gctccttgatttgaaaggtgaggat

SEQ ID NO: 690636 - DNA, 25 bp, Mus musculus
gctccttgcagaaccgttgtcttgt

SEQ ID NO: 690637 - DNA, 25 bp, Mus musculus
gctccttgcagatccgttgtcttgt

SEQ ID NO: 690638 - DNA, 25 bp, Mus musculus
gctccttgctatattcctggctgca

SEQ ID NO: 690639 - DNA, 25 bp, Mus musculus
gctccttgctattttcctggctgca

SEQ ID NO: 690640 - DNA, 25 bp, Mus musculus
gctccttggagtctgccacgacaga

SEQ ID NO: 690641 - DNA, 25 bp, Mus musculus
gctccttggagtgtgccacgacaga

SEQ ID NO: 690642 - DNA, 25 bp, Mus musculus
gctccttgggatcagaaagataatg

SEQ ID NO: 690643 - DNA, 25 bp, Mus musculus
gctccttgggatgagaaagataatg

SEQ ID NO: 690644 - DNA, 25 bp, Mus musculus
gctccttgggctacgcgtacgtgaa

SEQ ID NO: 690645 - DNA, 25 bp, Mus musculus
gctccttgggcttcgcgtacgtgaa

SEQ ID NO: 690646 - DNA, 25 bp, Mus musculus
gctccttggtacctgtggttacgca

SEQ ID NO: 690647 - DNA, 25 bp, Mus musculus
gctccttggtacgtgtggttacgca

SEQ ID NO: 690648 - DNA, 25 bp, Mus musculus
gctccttgtgcacctatttgaccag

SEQ ID NO: 690649 - DNA, 25 bp, Mus musculus
gctccttgtgcagctatttgaccag

SEQ ID NO: 690650 - DNA, 25 bp, Mus musculus
gctccttgtgttagcaaacaaacag

SEQ ID NO: 690651 - DNA, 25 bp, Mus musculus
gctccttgtgtttgcaaacaaacag

SEQ ID NO: 690652 - DNA, 25 bp, Mus musculus
gctcctttaaatactcgataacttg

SEQ ID NO: 690653 - DNA, 25 bp, Mus musculus
gctcctttaaattctcgataacttg

SEQ ID NO: 690654 - DNA, 25 bp, Mus musculus
gctcctttcaagaacctaagtcctg

SEQ ID NO: 690655 - DNA, 25 bp, Mus musculus
gctcctttcaagtacctaagtcctg

SEQ ID NO: 690656 - DNA, 25 bp, Mus musculus
gctcctttcggtcctgagcaccgag

SEQ ID NO: 690657 - DNA, 25 bp, Mus musculus
gctcctttcggtgctgagcaccgag

SEQ ID NO: 690658 - DNA, 25 bp, Mus musculus
gctcctttctcaccaccggttggtt

SEQ ID NO: 690659 - DNA, 25 bp, Mus musculus
gctcctttctcagcaccggttggtt

SEQ ID NO: 690660 - DNA, 25 bp, Mus musculus
gctccttttgtgcttacctctgaca

SEQ ID NO: 690661 - DNA, 25 bp, Mus musculus
gctccttttgtggttacctctgaca

SEQ ID NO: 690662 - DNA, 25 bp, Mus musculus
gctcgaaaaatcctgcgggagctga

SEQ ID NO: 690663 - DNA, 25 bp, Mus musculus
gctcgaaaaatcgtgcgggagctga

SEQ ID NO: 690664 - DNA, 25 bp, Mus musculus
gctcgaaaacgaagtccagaaaccg

SEQ ID NO: 690665 - DNA, 25 bp, Mus musculus
gctcgaaaacgatgtccagaaaccg

SEQ ID NO: 690666 - DNA, 25 bp, Mus musculus
gctcgaaagcgaccagttcgtctcg

SEQ ID NO: 690667 - DNA, 25 bp, Mus musculus
gctcgaaagcgagcagttcgtctcg

SEQ ID NO: 690668 - DNA, 25 bp, Mus musculus
gctcgaaagctacctgaacctggcg

SEQ ID NO: 690669 - DNA, 25 bp, Mus musculus
gctcgaaagctagctgaacctggcg

SEQ ID NO: 690670 - DNA, 25 bp, Mus musculus
gctcgaaatgacatccagaggaatt

SEQ ID NO: 690671 - DNA, 25 bp, Mus musculus
gctcgaaatgacttccagaggaatt

SEQ ID NO: 690672 - DNA, 25 bp, Mus musculus
gctcgaaatggacacgtgctactaa

SEQ ID NO: 690673 - DNA, 25 bp, Mus musculus
gctcgaaatggagacgtgctactaa

SEQ ID NO: 690674 - DNA, 25 bp, Mus musculus
gctcgaactcccaaaaatcttacag

SEQ ID NO: 690675 - DNA, 25 bp, Mus musculus
gctcgaactccctaaaatcttacag

SEQ ID NO: 690676 - DNA, 25 bp, Mus musculus
gctcgaagaactcgcaaagcaggcc

SEQ ID NO: 690677 - DNA, 25 bp, Mus musculus
gctcgaagaactggcaaagcaggcc

SEQ ID NO: 690678 - DNA, 25 bp, Mus musculus
gctcgacacacactgatctgcaggc

SEQ ID NO: 690679 - DNA, 25 bp, Mus musculus
gctcgacacacagtgatctgcaggc

SEQ ID NO: 690680 - DNA, 25 bp, Mus musculus
gctcgacagaacacggttgctttgc

SEQ ID NO: 690681 - DNA, 25 bp, Mus musculus
gctcgacagaactcggttgctttgc

SEQ ID NO: 690682 - DNA, 25 bp, Mus musculus
gctcgaccagaaatggctttattta

SEQ ID NO: 690683 - DNA, 25 bp, Mus musculus
gctcgaccagaattggctttattta

SEQ ID NO: 690684 - DNA, 25 bp, Mus musculus
gctcgaccagatagcgccgctatgt

SEQ ID NO: 690685 - DNA, 25 bp, Mus musculus
gctcgaccagattgcgccgctatgt

SEQ ID NO: 690686 - DNA, 25 bp, Mus musculus
gctcgactcagacgtggataaagat

SEQ ID NO: 690687 - DNA, 25 bp, Mus musculus
gctcgactcagaggtggataaagat

SEQ ID NO: 690688 - DNA, 25 bp, Mus musculus
gctcgacttcaaataccgggcactg

SEQ ID NO: 690689 - DNA, 25 bp, Mus musculus
gctcgacttcaattaccgggcactg

SEQ ID NO: 690690 - DNA, 25 bp, Mus musculus
gctcgacttcggatggtagacattg

SEQ ID NO: 690691 - DNA, 25 bp, Mus musculus
gctcgacttcggttggtagacattg

SEQ ID NO: 690692 - DNA, 25 bp, Mus musculus
gctcgagacaaacgcttccaacagt

SEQ ID NO: 690693 - DNA, 25 bp, Mus musculus
gctcgagacaaaggcttccaacagt

SEQ ID NO: 690694 - DNA, 25 bp, Mus musculus
gctcgagacatcatgagggactcaa

SEQ ID NO: 690695 - DNA, 25 bp, Mus musculus
gctcgagacatcttgagggactcaa

SEQ ID NO: 690696 - DNA, 25 bp, Mus musculus
gctcgagaggttcaccctacatata

SEQ ID NO: 690697 - DNA, 25 bp, Mus musculus
gctcgagaggttgaccctacatata

SEQ ID NO: 690698 - DNA, 25 bp, Mus musculus
gctcgagatgtgcacaacctggact

SEQ ID NO: 690699 - DNA, 25 bp, Mus musculus
gctcgagatgtggacaacctggact

SEQ ID NO: 690700 - DNA, 25 bp, Mus musculus
gctcgagctttgcttcagcccagcg

SEQ ID NO: 690701 - DNA, 25 bp, Mus musculus
gctcgagctttggttcagcccagcg

SEQ ID NO: 690702 - DNA, 25 bp, Mus musculus
gctcgaggaacaacctgaagctgtg

SEQ ID NO: 690703 - DNA, 25 bp, Mus musculus
gctcgaggaacatcctgaagctgtg

SEQ ID NO: 690704 - DNA, 25 bp, Mus musculus
gctcgaggactgctgcttgaaaatg

SEQ ID NO: 690705 - DNA, 25 bp, Mus musculus
gctcgaggactggtgcttgaaaatg

SEQ ID NO: 690706 - DNA, 25 bp, Mus musculus
gctcgaggcacccttggaagagtcc

SEQ ID NO: 690707 - DNA, 25 bp, Mus musculus
gctcgaggcaccgttggaagagtcc

SEQ ID NO: 690708 - DNA, 25 bp, Mus musculus
gctcgaggctctaatagctgaggag

SEQ ID NO: 690709 - DNA, 25 bp, Mus musculus
gctcgaggctcttatagctgaggag

SEQ ID NO: 690710 - DNA, 25 bp, Mus musculus
gctcgagttccaagccccaaagttg

SEQ ID NO: 690711 - DNA, 25 bp, Mus musculus
gctcgagttccatgccccaaagttg

SEQ ID NO: 690712 - DNA, 25 bp, Mus musculus
gctcgatatggtcaccttgcacagg

SEQ ID NO: 690713 - DNA, 25 bp, Mus musculus
gctcgatatggtgaccttgcacagg

SEQ ID NO: 690714 - DNA, 25 bp, Mus musculus
gctcgatgagtcactctggcagtcc

SEQ ID NO: 690715 - DNA, 25 bp, Mus musculus
gctcgatgagtctctctggcagtcc

SEQ ID NO: 690716 - DNA, 25 bp, Mus musculus
gctcgatttgcacaagaccattttg

SEQ ID NO: 690717 - DNA, 25 bp, Mus musculus
gctcgatttgcagaagaccattttg

SEQ ID NO: 690718 - DNA, 25 bp, Mus musculus
gctcgcaaggctcttgtggtcttcg

SEQ ID NO: 690719 - DNA, 25 bp, Mus musculus
gctcgcaaggctgttgtggtcttcg

SEQ ID NO: 690720 - DNA, 25 bp, Mus musculus
gctcgcaccaaccaggcctatgcag

SEQ ID NO: 690721 - DNA, 25 bp, Mus musculus
gctcgcaccaacgaggcctatgcag

SEQ ID NO: 690722 - DNA, 25 bp, Mus musculus
gctcgcactgcaccgacgttaatga

SEQ ID NO: 690723 - DNA, 25 bp, Mus musculus
gctcgcactgcagcgacgttaatga

SEQ ID NO: 690724 - DNA, 25 bp, Mus musculus
gctcgcagggagcataccagtgaat

SEQ ID NO: 690725 - DNA, 25 bp, Mus musculus
gctcgcagggaggataccagtgaat

SEQ ID NO: 690726 - DNA, 25 bp, Mus musculus
gctcgcagttccaggttttggttgc

SEQ ID NO: 690727 - DNA, 25 bp, Mus musculus
gctcgcagttcctggttttggttgc

SEQ ID NO: 690728 - DNA, 25 bp, Mus musculus
gctcgcattgggaaagcagaacttc

SEQ ID NO: 690729 - DNA, 25 bp, Mus musculus
gctcgcattgggtaagcagaacttc

SEQ ID NO: 690730 - DNA, 25 bp, Mus musculus
gctcgccaaggaccagataccctag

SEQ ID NO: 690731 - DNA, 25 bp, Mus musculus
gctcgccaaggagcagataccctag

SEQ ID NO: 690732 - DNA, 25 bp, Mus musculus
gctcgccatcgtcgcctttgtctgg

SEQ ID NO: 690733 - DNA, 25 bp, Mus musculus
gctcgccatcgtggcctttgtctgg

SEQ ID NO: 690734 - DNA, 25 bp, Mus musculus
gctcgccatgcccagatcattgctg

SEQ ID NO: 690735 - DNA, 25 bp, Mus musculus
gctcgccatgccgagatcattgctg

SEQ ID NO: 690736 - DNA, 25 bp, Mus musculus
gctcgccatggcatacagcctgtca

SEQ ID NO: 690737 - DNA, 25 bp, Mus musculus
gctcgccatggcttacagcctgtca

SEQ ID NO: 690738 - DNA, 25 bp, Mus musculus
gctcgcccaactacatcaaccagtt

SEQ ID NO: 690739 - DNA, 25 bp, Mus musculus
gctcgcccaacttcatcaaccagtt

SEQ ID NO: 690740 - DNA, 25 bp, Mus musculus
gctcgccctggccaataaggcagag

SEQ ID NO: 690741 - DNA, 25 bp, Mus musculus
gctcgccctggcgaataaggcagag

SEQ ID NO: 690742 - DNA, 25 bp, Mus musculus
gctcgcctagatcacaagtttgatc

SEQ ID NO: 690743 - DNA, 25 bp, Mus musculus
gctcgcctagatgacaagtttgatc

SEQ ID NO: 690744 - DNA, 25 bp, Mus musculus
gctcgcctagccctttgatctcaga

SEQ ID NO: 690745 - DNA, 25 bp, Mus musculus
gctcgcctagccgtttgatctcaga

SEQ ID NO: 690746 - DNA, 25 bp, Mus musculus
gctcgcctccaacgtgtgctagaca

SEQ ID NO: 690747 - DNA, 25 bp, Mus musculus
gctcgcctccaaggtgtgctagaca

SEQ ID NO: 690748 - DNA, 25 bp, Mus musculus
gctcgcctgcttctagtgggcactg

SEQ ID NO: 690749 - DNA, 25 bp, Mus musculus
gctcgcctgcttgtagtgggcactg

SEQ ID NO: 690750 - DNA, 25 bp, Mus musculus
gctcgcctggacatcaaggtctcag

SEQ ID NO: 690751 - DNA, 25 bp, Mus musculus
gctcgcctggacttcaaggtctcag

SEQ ID NO: 690752 - DNA, 25 bp, Mus musculus
gctcgcctgtgcaataacatgcaga

SEQ ID NO: 690753 - DNA, 25 bp, Mus musculus
gctcgcctgtgctataacatgcaga

SEQ ID NO: 690754 - DNA, 25 bp, Mus musculus
gctcgcgcactcagcgggttgtgct

SEQ ID NO: 690755 - DNA, 25 bp, Mus musculus
gctcgcgcactctgcgggttgtgct

SEQ ID NO: 690756 - DNA, 25 bp, Mus musculus
gctcgcgcggccactgagctcagtg

SEQ ID NO: 690757 - DNA, 25 bp, Mus musculus
gctcgcgcggcctctgagctcagtg

SEQ ID NO: 690758 - DNA, 25 bp, Mus musculus
gctcgcggcttcaagtcaggtggtt

SEQ ID NO: 690759 - DNA, 25 bp, Mus musculus
gctcgcggcttctagtcaggtggtt

SEQ ID NO: 690760 - DNA, 25 bp, Mus musculus
gctcgctagtggactccaacatgct

SEQ ID NO: 690761 - DNA, 25 bp, Mus musculus
gctcgctagtggtctccaacatgct

SEQ ID NO: 690762 - DNA, 25 bp, Mus musculus
gctcgctctggaagcggctgactaa

SEQ ID NO: 690763 - DNA, 25 bp, Mus musculus
gctcgctctggatgcggctgactaa

SEQ ID NO: 690764 - DNA, 25 bp, Mus musculus
gctcgctgcacccaatatcttatca

SEQ ID NO: 690765 - DNA, 25 bp, Mus musculus
gctcgctgcaccgaatatcttatca

SEQ ID NO: 690766 - DNA, 25 bp, Mus musculus
gctcgctgccggactggagcactcg

SEQ ID NO: 690767 - DNA, 25 bp, Mus musculus
gctcgctgccggtctggagcactcg

SEQ ID NO: 690768 - DNA, 25 bp, Mus musculus
gctcgctgctgcctgatagaaacgc

SEQ ID NO: 690769 - DNA, 25 bp, Mus musculus
gctcgctgctgcgtgatagaaacgc

SEQ ID NO: 690770 - DNA, 25 bp, Mus musculus
gctcgctgctgtctagatgttacca

SEQ ID NO: 690771 - DNA, 25 bp, Mus musculus
gctcgctgctgtgtagatgttacca

SEQ ID NO: 690772 - DNA, 25 bp, Mus musculus
gctcgctgggaaatacacgcataca

SEQ ID NO: 690773 - DNA, 25 bp, Mus musculus
gctcgctgggaattacacgcataca

SEQ ID NO: 690774 - DNA, 25 bp, Mus musculus
gctcgcttctgtatatatgcaggca

SEQ ID NO: 690775 - DNA, 25 bp, Mus musculus
gctcgcttctgtttatatgcaggca

SEQ ID NO: 690776 - DNA, 25 bp, Mus musculus
gctcgctttggacaccgaataactg

SEQ ID NO: 690777 - DNA, 25 bp, Mus musculus
gctcgctttggagaccgaataactg

SEQ ID NO: 690778 - DNA, 25 bp, Mus musculus
gctcgcttttctcaaggcttacggg

SEQ ID NO: 690779 - DNA, 25 bp, Mus musculus
gctcgcttttctgaaggcttacggg

SEQ ID NO: 690780 - DNA, 25 bp, Mus musculus
gctcggaacctgatggactctcaca

SEQ ID NO: 690781 - DNA, 25 bp, Mus musculus
gctcggaacctgttggactctcaca

SEQ ID NO: 690782 - DNA, 25 bp, Mus musculus
gctcggaacgggcaatatgtcacca

SEQ ID NO: 690783 - DNA, 25 bp, Mus musculus
gctcggaacggggaatatgtcacca

SEQ ID NO: 690784 - DNA, 25 bp, Mus musculus
gctcggaagctgaccagtgcaatgt

SEQ ID NO: 690785 - DNA, 25 bp, Mus musculus
gctcggaagctgtccagtgcaatgt

SEQ ID NO: 690786 - DNA, 25 bp, Mus musculus
gctcggaaggccagcaatgatgcca

SEQ ID NO: 690787 - DNA, 25 bp, Mus musculus
gctcggaaggcctgcaatgatgcca

SEQ ID NO: 690788 - DNA, 25 bp, Mus musculus
gctcggacgctgcattaacacctgt

SEQ ID NO: 690789 - DNA, 25 bp, Mus musculus
gctcggacgctggattaacacctgt

SEQ ID NO: 690790 - DNA, 25 bp, Mus musculus
gctcggagaccacccgcctagtgag

SEQ ID NO: 690791 - DNA, 25 bp, Mus musculus
gctcggagaccagccgcctagtgag

SEQ ID NO: 690792 - DNA, 25 bp, Mus musculus
gctcggagccaaaaggagcctatcc

SEQ ID NO: 690793 - DNA, 25 bp, Mus musculus
gctcggagccaactgattgatgaat

SEQ ID NO: 690794 - DNA, 25 bp, Mus musculus
gctcggagccaagtgattgatgaat

SEQ ID NO: 690795 - DNA, 25 bp, Mus musculus
gctcggagccaataggagcctatcc

SEQ ID NO: 690796 - DNA, 25 bp, Mus musculus
gctcggagctttccccgggacttcg

SEQ ID NO: 690797 - DNA, 25 bp, Mus musculus
gctcggagctttgcccgggacttcg

SEQ ID NO: 690798 - DNA, 25 bp, Mus musculus
gctcggagtcctctctggcataata

SEQ ID NO: 690799 - DNA, 25 bp, Mus musculus
gctcggagtcctgtctggcataata

SEQ ID NO: 690800 - DNA, 25 bp, Mus musculus
gctcggatccagcagaagagagagg

SEQ ID NO: 690801 - DNA, 25 bp, Mus musculus
gctcggatccaggagaagagagagg

SEQ ID NO: 690802 - DNA, 25 bp, Mus musculus
gctcggatgtcactttactctcaaa

SEQ ID NO: 690803 - DNA, 25 bp, Mus musculus
gctcggatgtcagtttactctcaaa

SEQ ID NO: 690804 - DNA, 25 bp, Mus musculus
gctcggccgtgcatggcatcttcaa

SEQ ID NO: 690805 - DNA, 25 bp, Mus musculus
gctcggccgtgcttggcatcttcaa

SEQ ID NO: 690806 - DNA, 25 bp, Mus musculus
gctcggcctgcacatatggcagctg

SEQ ID NO: 690807 - DNA, 25 bp, Mus musculus
gctcggcctgcagatatggcagctg

SEQ ID NO: 690808 - DNA, 25 bp, Mus musculus
gctcggcctgtacacagagaatgag

SEQ ID NO: 690809 - DNA, 25 bp, Mus musculus
gctcggcctgtagacagagaatgag

SEQ ID NO: 690810 - DNA, 25 bp, Mus musculus
gctcggcgctatcgccttaaggata

SEQ ID NO: 690811 - DNA, 25 bp, Mus musculus
gctcggcgctatggccttaaggata

SEQ ID NO: 690812 - DNA, 25 bp, Mus musculus
gctcggcgtcctcggaaggtcacct

SEQ ID NO: 690813 - DNA, 25 bp, Mus musculus
gctcggcgtcctgggaaggtcacct

SEQ ID NO: 690814 - DNA, 25 bp, Mus musculus
gctcggctacaaaagaggtcggctg

SEQ ID NO: 690815 - DNA, 25 bp, Mus musculus
gctcggctacaatagaggtcggctg

SEQ ID NO: 690816 - DNA, 25 bp, Mus musculus
gctcggctattaccctttcagaaag

SEQ ID NO: 690817 - DNA, 25 bp, Mus musculus
gctcggctattagcctttcagaaag

SEQ ID NO: 690818 - DNA, 25 bp, Mus musculus
gctcggctctccacgtggactgcgt

SEQ ID NO: 690819 - DNA, 25 bp, Mus musculus
gctcggctctcctcgtggactgcgt

SEQ ID NO: 690820 - DNA, 25 bp, Mus musculus
gctcggctgagaacgctaaagatga

SEQ ID NO: 690821 - DNA, 25 bp, Mus musculus
gctcggctgagatcgctaaagatga

SEQ ID NO: 690822 - DNA, 25 bp, Mus musculus
gctcgggaccgaactggctaggcca

SEQ ID NO: 690823 - DNA, 25 bp, Mus musculus
gctcgggaccgatctggctaggcca

SEQ ID NO: 690824 - DNA, 25 bp, Mus musculus
gctcgggagatcacggacgctcagt

SEQ ID NO: 690825 - DNA, 25 bp, Mus musculus
gctcgggagatctcggacgctcagt

SEQ ID NO: 690826 - DNA, 25 bp, Mus musculus
gctcgggagtccagcgttaccaggt

SEQ ID NO: 690827 - DNA, 25 bp, Mus musculus
gctcgggagtcctgcgttaccaggt

SEQ ID NO: 690828 - DNA, 25 bp, Mus musculus
gctcgggagtgcctaacccttctct

SEQ ID NO: 690829 - DNA, 25 bp, Mus musculus
gctcgggagtgcgtaacccttctct

SEQ ID NO: 690830 - DNA, 25 bp, Mus musculus
gctcgggatgctaaaattgagcata

SEQ ID NO: 690831 - DNA, 25 bp, Mus musculus
gctcgggatgcttaaattgagcata

SEQ ID NO: 690832 - DNA, 25 bp, Mus musculus
gctcgggcagccagaccgaacaagc

SEQ ID NO: 690833 - DNA, 25 bp, Mus musculus
gctcgggcagcctgaccgaacaagc

SEQ ID NO: 690834 - DNA, 25 bp, Mus musculus
gctcgggccaagatccgtgtcacct

SEQ ID NO: 690835 - DNA, 25 bp, Mus musculus
gctcgggccaagttccgtgtcacct

SEQ ID NO: 690836 - DNA, 25 bp, Mus musculus
gctcgggtacagacgggctcccaga

SEQ ID NO: 690837 - DNA, 25 bp, Mus musculus
gctcgggtacagtcgggctcccaga

SEQ ID NO: 690838 - DNA, 25 bp, Mus musculus
gctcgggtgtccctcagtcaggaac

SEQ ID NO: 690839 - DNA, 25 bp, Mus musculus
gctcgggtgtccgtcagtcaggaac

SEQ ID NO: 690840 - DNA, 25 bp, Mus musculus
gctcgggtgttcactgcggccatga

SEQ ID NO: 690841 - DNA, 25 bp, Mus musculus
gctcgggtgttctctgcggccatga

SEQ ID NO: 690842 - DNA, 25 bp, Mus musculus
gctcggtaatggacctcatgcccca

SEQ ID NO: 690843 - DNA, 25 bp, Mus musculus
gctcggtaatggtcctcatgcccca

SEQ ID NO: 690844 - DNA, 25 bp, Mus musculus
gctcggtaccctagtgacttggagg

SEQ ID NO: 690845 - DNA, 25 bp, Mus musculus
gctcggtacccttgtgacttggagg

SEQ ID NO: 690846 - DNA, 25 bp, Mus musculus
gctcggtgttccagcccaggagcct

SEQ ID NO: 690847 - DNA, 25 bp, Mus musculus
gctcggtgttcctgcccaggagcct

SEQ ID NO: 690848 - DNA, 25 bp, Mus musculus
gctcggttcctcacgctctgcggag

SEQ ID NO: 690849 - DNA, 25 bp, Mus musculus
gctcggttcctctcgctctgcggag

SEQ ID NO: 690850 - DNA, 25 bp, Mus musculus
gctcggttcgaaaacaaaccaggag

SEQ ID NO: 690851 - DNA, 25 bp, Mus musculus
gctcggttcgaatacaaaccaggag

SEQ ID NO: 690852 - DNA, 25 bp, Mus musculus
gctcggttgttgattcctccaaaag

SEQ ID NO: 690853 - DNA, 25 bp, Mus musculus
gctcggttgttgtttcctccaaaag

SEQ ID NO: 690854 - DNA, 25 bp, Mus musculus
gctcgtaaagcgagtgccgatgcga

SEQ ID NO: 690855 - DNA, 25 bp, Mus musculus
gctcgtaaagcgtgtgccgatgcga

SEQ ID NO: 690856 - DNA, 25 bp, Mus musculus
gctcgtaacctgcatggacatataa

SEQ ID NO: 690857 - DNA, 25 bp, Mus musculus
gctcgtaacctggatggacatataa

SEQ ID NO: 690858 - DNA, 25 bp, Mus musculus
gctcgtaccactccgagtgtgatcg

SEQ ID NO: 690859 - DNA, 25 bp, Mus musculus
gctcgtaccactgcgagtgtgatcg

SEQ ID NO: 690860 - DNA, 25 bp, Mus musculus
gctcgtactggaacttcagaaatat

SEQ ID NO: 690861 - DNA, 25 bp, Mus musculus
gctcgtactggatcttcagaaatat

SEQ ID NO: 690862 - DNA, 25 bp, Mus musculus
gctcgtagcggccaacgtacggata

SEQ ID NO: 690863 - DNA, 25 bp, Mus musculus
gctcgtagcggcgaacgtacggata

SEQ ID NO: 690864 - DNA, 25 bp, Mus musculus
gctcgtatcaccctctggaaccggg

SEQ ID NO: 690865 - DNA, 25 bp, Mus musculus
gctcgtatcaccgtctggaaccggg

SEQ ID NO: 690866 - DNA, 25 bp, Mus musculus
gctcgtccagagaaatttgatgaga

SEQ ID NO: 690867 - DNA, 25 bp, Mus musculus
gctcgtccagagtaatttgatgaga

SEQ ID NO: 690868 - DNA, 25 bp, Mus musculus
gctcgtccccaaagcgcttaataga

SEQ ID NO: 690869 - DNA, 25 bp, Mus musculus
gctcgtccccaatgcgcttaataga

SEQ ID NO: 690870 - DNA, 25 bp, Mus musculus
gctcgtccctcaactgcatgagaga

SEQ ID NO: 690871 - DNA, 25 bp, Mus musculus
gctcgtccctcatctgcatgagaga

SEQ ID NO: 690872 - DNA, 25 bp, Mus musculus
gctcgtcccttgctcagcatgaaaa

SEQ ID NO: 690873 - DNA, 25 bp, Mus musculus
gctcgtcccttggtcagcatgaaaa

SEQ ID NO: 690874 - DNA, 25 bp, Mus musculus
gctcgtctacctagcggagagttca

SEQ ID NO: 690875 - DNA, 25 bp, Mus musculus
gctcgtctaccttgcggagagttca

SEQ ID NO: 690876 - DNA, 25 bp, Mus musculus
gctcgtctcatacccgagttcttct

SEQ ID NO: 690877 - DNA, 25 bp, Mus musculus
gctcgtctcatagccgagttcttct

SEQ ID NO: 690878 - DNA, 25 bp, Mus musculus
gctcgtctttgacattggctctttc

SEQ ID NO: 690879 - DNA, 25 bp, Mus musculus
gctcgtctttgagattggctctttc

SEQ ID NO: 690880 - DNA, 25 bp, Mus musculus
gctcgtggaaccagccgagcgtccg

SEQ ID NO: 690881 - DNA, 25 bp, Mus musculus
gctcgtggaacctgccgagcgtccg

SEQ ID NO: 690882 - DNA, 25 bp, Mus musculus
gctcgtgtcctgagaagcccgcggc

SEQ ID NO: 690883 - DNA, 25 bp, Mus musculus
gctcgtgtcctgtgaagcccgcggc

SEQ ID NO: 690884 - DNA, 25 bp, Mus musculus
gctcgtgtctcgcaaaaacctgctc

SEQ ID NO: 690885 - DNA, 25 bp, Mus musculus
gctcgtgtctcggaaaaacctgctc

SEQ ID NO: 690886 - DNA, 25 bp, Mus musculus
gctcgtgtgcagacctgtgtcaatc

SEQ ID NO: 690887 - DNA, 25 bp, Mus musculus
gctcgtgtgcagtcctgtgtcaatc

SEQ ID NO: 690888 - DNA, 25 bp, Mus musculus
gctcgtgttcctcagccttgcaagg

SEQ ID NO: 690889 - DNA, 25 bp, Mus musculus
gctcgtgttcctgagccttgcaagg

SEQ ID NO: 690890 - DNA, 25 bp, Mus musculus
gctcgttctgatatgggagaagagc

SEQ ID NO: 690891 - DNA, 25 bp, Mus musculus
gctcgttctgatttgggagaagagc

SEQ ID NO: 690892 - DNA, 25 bp, Mus musculus
gctcgttgcagtagccgctgcggcc

SEQ ID NO: 690893 - DNA, 25 bp, Mus musculus
gctcgttgcagttgccgctgcggcc

SEQ ID NO: 690894 - DNA, 25 bp, Mus musculus
gctcgttgggccagctaaacaaggg

SEQ ID NO: 690895 - DNA, 25 bp, Mus musculus
gctcgttgggcctgctaaacaaggg

SEQ ID NO: 690896 - DNA, 25 bp, Mus musculus
gctcgttgtactcctgggactctgc

SEQ ID NO: 690897 - DNA, 25 bp, Mus musculus
gctcgttgtactgctgggactctgc

SEQ ID NO: 690898 - DNA, 25 bp, Mus musculus
gctcgttgttgaaggtggacgtcca

SEQ ID NO: 690899 - DNA, 25 bp, Mus musculus
gctcgttgttgatggtggacgtcca

SEQ ID NO: 690900 - DNA, 25 bp, Mus musculus
gctcgtttgagaatgcaggaagatc

SEQ ID NO: 690901 - DNA, 25 bp, Mus musculus
gctcgtttgagattgcaggaagatc

SEQ ID NO: 690902 - DNA, 25 bp, Mus musculus
gctcgtttgattagagaaatgttta

SEQ ID NO: 690903 - DNA, 25 bp, Mus musculus
gctcgtttgatttgagaaatgttta

SEQ ID NO: 690904 - DNA, 25 bp, Mus musculus
gctctaaagcaaacacttcaacctg

SEQ ID NO: 690905 - DNA, 25 bp, Mus musculus
gctctaaagcaatcacttcaacctg

SEQ ID NO: 690906 - DNA, 25 bp, Mus musculus
gctctaaagcagatcgggccatcct

SEQ ID NO: 690907 - DNA, 25 bp, Mus musculus
gctctaaagcagttcgggccatcct

SEQ ID NO: 690908 - DNA, 25 bp, Mus musculus
gctctaaagcatcaagtctttctca

SEQ ID NO: 690909 - DNA, 25 bp, Mus musculus
gctctaaagcatgaagtctttctca

SEQ ID NO: 690910 - DNA, 25 bp, Mus musculus
gctctaaaggtgatccggctgcagg

SEQ ID NO: 690911 - DNA, 25 bp, Mus musculus
gctctaaaggtgttccggctgcagg

SEQ ID NO: 690912 - DNA, 25 bp, Mus musculus
gctctaacctatccttgtgaaaatg

SEQ ID NO: 690913 - DNA, 25 bp, Mus musculus
gctctaacctatgcttgtgaaaatg

SEQ ID NO: 690914 - DNA, 25 bp, Mus musculus
gctctaactcagacacagcagagat

SEQ ID NO: 690915 - DNA, 25 bp, Mus musculus
gctctaactcagtcacagcagagat

SEQ ID NO: 690916 - DNA, 25 bp, Mus musculus
gctctaaggtggcagttataaagga

SEQ ID NO: 690917 - DNA, 25 bp, Mus musculus
gctctaaggtgggagttataaagga

SEQ ID NO: 690918 - DNA, 25 bp, Mus musculus
gctctacaagaaagctcgggagcgg

SEQ ID NO: 690919 - DNA, 25 bp, Mus musculus
gctctacaagaatgctcgggagcgg

SEQ ID NO: 690920 - DNA, 25 bp, Mus musculus
gctctacaagctcatcattagccag

SEQ ID NO: 690921 - DNA, 25 bp, Mus musculus
gctctacaagctgatcattagccag

SEQ ID NO: 690922 - DNA, 25 bp, Mus musculus
gctctacagaaaccaagcccgtaaa

SEQ ID NO: 690923 - DNA, 25 bp, Mus musculus
gctctacagaaagcaagcccgtaaa

SEQ ID NO: 690924 - DNA, 25 bp, Mus musculus
gctctacaggtcagtcagatttgca

SEQ ID NO: 690925 - DNA, 25 bp, Mus musculus
gctctacaggtctgtcagatttgca

SEQ ID NO: 690926 - DNA, 25 bp, Mus musculus
gctctacatagacacggagaaaaag

SEQ ID NO: 690927 - DNA, 25 bp, Mus musculus
gctctacatagagacggagaaaaag

SEQ ID NO: 690928 - DNA, 25 bp, Mus musculus
gctctaccaaggaagtggccactta

SEQ ID NO: 690929 - DNA, 25 bp, Mus musculus
gctctaccaaggtagtggccactta

SEQ ID NO: 690930 - DNA, 25 bp, Mus musculus
gctctaccggaacagcttagctcat

SEQ ID NO: 690931 - DNA, 25 bp, Mus musculus
gctctaccggaagagcttagctcat

SEQ ID NO: 690932 - DNA, 25 bp, Mus musculus
gctctacctcggcatctttgtggcc

SEQ ID NO: 690933 - DNA, 25 bp, Mus musculus
gctctacctcgggatctttgtggcc

SEQ ID NO: 690934 - DNA, 25 bp, Mus musculus
gctctacctggcacacaagtataag

SEQ ID NO: 690935 - DNA, 25 bp, Mus musculus
gctctacctggctcacaagtataag

SEQ ID NO: 690936 - DNA, 25 bp, Mus musculus
gctctacgaaaacaaaatcttcgag

SEQ ID NO: 690937 - DNA, 25 bp, Mus musculus
gctctacgaaaagaaaatcttcgag

SEQ ID NO: 690938 - DNA, 25 bp, Mus musculus
gctctacgaatcactctgctccgtg

SEQ ID NO: 690939 - DNA, 25 bp, Mus musculus
gctctacgaatctctctgctccgtg

SEQ ID NO: 690940 - DNA, 25 bp, Mus musculus
gctctacgctgtccgtgggaaccac

SEQ ID NO: 690941 - DNA, 25 bp, Mus musculus
gctctacgctgtgcgtgggaaccac

SEQ ID NO: 690942 - DNA, 25 bp, Mus musculus
gctctacggtatctggcagcagcca

SEQ ID NO: 690943 - DNA, 25 bp, Mus musculus
gctctacggtatgtggcagcagcca

SEQ ID NO: 690944 - DNA, 25 bp, Mus musculus
gctctacggtggatagcgtgttccg

SEQ ID NO: 690945 - DNA, 25 bp, Mus musculus
gctctacggtggttagcgtgttccg

SEQ ID NO: 690946 - DNA, 25 bp, Mus musculus
gctctacgtggccaacttgatcaag

SEQ ID NO: 690947 - DNA, 25 bp, Mus musculus
gctctacgtggcgaacttgatcaag

SEQ ID NO: 690948 - DNA, 25 bp, Mus musculus
gctctactcagacgagggcaaagga

SEQ ID NO: 690949 - DNA, 25 bp, Mus musculus
gctctactcagaggagggcaaagga

SEQ ID NO: 690950 - DNA, 25 bp, Mus musculus
gctctactccttaggacttgttcaa

SEQ ID NO: 690951 - DNA, 25 bp, Mus musculus
gctctactcctttggacttgttcaa

SEQ ID NO: 690952 - DNA, 25 bp, Mus musculus
gctctagagagaacgcacatgaagg

SEQ ID NO: 690953 - DNA, 25 bp, Mus musculus
gctctagagagaagtgaaattacct

SEQ ID NO: 690954 - DNA, 25 bp, Mus musculus
gctctagagagatcgcacatgaagg

SEQ ID NO: 690955 - DNA, 25 bp, Mus musculus
gctctagagagatgtgaaattacct

SEQ ID NO: 690956 - DNA, 25 bp, Mus musculus
gctctagcacccagaaccaggattt

SEQ ID NO: 690957 - DNA, 25 bp, Mus musculus
gctctagcaccctgaaccaggattt

SEQ ID NO: 690958 - DNA, 25 bp, Mus musculus
gctctagcagaactacttggattag

SEQ ID NO: 690959 - DNA, 25 bp, Mus musculus
gctctagcagaagtacttggattag

SEQ ID NO: 690960 - DNA, 25 bp, Mus musculus
gctctagccaggatccaccagagaa

SEQ ID NO: 690961 - DNA, 25 bp, Mus musculus
gctctagccaggttccaccagagaa

SEQ ID NO: 690962 - DNA, 25 bp, Mus musculus
gctctagctggaaggacaaaacctg

SEQ ID NO: 690963 - DNA, 25 bp, Mus musculus
gctctagctggatggacaaaacctg

SEQ ID NO: 690964 - DNA, 25 bp, Mus musculus
gctctaggctgtaaagcaggcctga

SEQ ID NO: 690965 - DNA, 25 bp, Mus musculus
gctctaggctgttaagcaggcctga

SEQ ID NO: 690966 - DNA, 25 bp, Mus musculus
gctctagggataagttagccacagt

SEQ ID NO: 690967 - DNA, 25 bp, Mus musculus
gctctagggatatgttagccacagt

SEQ ID NO: 690968 - DNA, 25 bp, Mus musculus
gctctaggtgaactcatccctggtg

SEQ ID NO: 690969 - DNA, 25 bp, Mus musculus
gctctaggtgaagtcatccctggtg

SEQ ID NO: 690970 - DNA, 25 bp, Mus musculus
gctctaggttagaagtacccgttat

SEQ ID NO: 690971 - DNA, 25 bp, Mus musculus
gctctaggttagtagtacccgttat

SEQ ID NO: 690972 - DNA, 25 bp, Mus musculus
gctctagtaaatacttccttcccag

SEQ ID NO: 690973 - DNA, 25 bp, Mus musculus
gctctagtaaattcttccttcccag

SEQ ID NO: 690974 - DNA, 25 bp, Mus musculus
gctctataaggacctgtatgctcga

SEQ ID NO: 690975 - DNA, 25 bp, Mus musculus
gctctataaggagctgtatgctcga

SEQ ID NO: 690976 - DNA, 25 bp, Mus musculus
gctctataggacagccaatgaagcc

SEQ ID NO: 690977 - DNA, 25 bp, Mus musculus
gctctataggactgccaatgaagcc

SEQ ID NO: 690978 - DNA, 25 bp, Mus musculus
gctctatccggtattttgagatcac

SEQ ID NO: 690979 - DNA, 25 bp, Mus musculus
gctctatccggttttttgagatcac

SEQ ID NO: 690980 - DNA, 25 bp, Mus musculus
gctctatgacatcgaaagcggcacc

SEQ ID NO: 690981 - DNA, 25 bp, Mus musculus
gctctatgacatggaaagcggcacc

SEQ ID NO: 690982 - DNA, 25 bp, Mus musculus
gctctatggatgaattgaatcatga

SEQ ID NO: 690983 - DNA, 25 bp, Mus musculus
gctctatggatgtattgaatcatga

SEQ ID NO: 690984 - DNA, 25 bp, Mus musculus
gctctatggttcatttcaatcccag

SEQ ID NO: 690985 - DNA, 25 bp, Mus musculus
gctctatggttcttttcaatcccag

SEQ ID NO: 690986 - DNA, 25 bp, Mus musculus
gctctatgtggaatttgtctgaagg

SEQ ID NO: 690987 - DNA, 25 bp, Mus musculus
gctctatgtggattttgtctgaagg

SEQ ID NO: 690988 - DNA, 25 bp, Mus musculus
gctctattccataaaacctgccatt

SEQ ID NO: 690989 - DNA, 25 bp, Mus musculus
gctctattccattaaacctgccatt

SEQ ID NO: 690990 - DNA, 25 bp, Mus musculus
gctctcaaccttaccatcatgtttg

SEQ ID NO: 690991 - DNA, 25 bp, Mus musculus
gctctcaacctttccatcatgtttg

SEQ ID NO: 690992 - DNA, 25 bp, Mus musculus
gctctcaactacaacatcgtgtccg

SEQ ID NO: 690993 - DNA, 25 bp, Mus musculus
gctctcaactactacatcgtgtccg

SEQ ID NO: 690994 - DNA, 25 bp, Mus musculus
gctctcaatggtactaatgttgcta

SEQ ID NO: 690995 - DNA, 25 bp, Mus musculus
gctctcaatggttctaatgttgcta

SEQ ID NO: 690996 - DNA, 25 bp, Mus musculus
gctctcaccacacagcagaaactgg

SEQ ID NO: 690997 - DNA, 25 bp, Mus musculus
gctctcaccacagagcagaaactgg

SEQ ID NO: 690998 - DNA, 25 bp, Mus musculus
gctctcaccatgatgctcagttcct

SEQ ID NO: 690999 - DNA, 25 bp, Mus musculus
gctctcaccatgttgctcagttcct

SEQ ID NO: 691000 - DNA, 25 bp, Mus musculus
gctctcaccctaaggctggccatgg

SEQ ID NO: 691001 - DNA, 25 bp, Mus musculus
gctctcaccctatggctggccatgg

SEQ ID NO: 691002 - DNA, 25 bp, Mus musculus
gctctcacggaaccaataaagctct

SEQ ID NO: 691003 - DNA, 25 bp, Mus musculus
gctctcacggaagcaataaagctct

SEQ ID NO: 691004 - DNA, 25 bp, Mus musculus
gctctcagaaggctaagcgggccca

SEQ ID NO: 691005 - DNA, 25 bp, Mus musculus
gctctcagaagggtaagcgggccca

SEQ ID NO: 691006 - DNA, 25 bp, Mus musculus
gctctcagactgatacagttttcag

SEQ ID NO: 691007 - DNA, 25 bp, Mus musculus
gctctcagactgttacagttttcag

SEQ ID NO: 691008 - DNA, 25 bp, Mus musculus
gctctcagatgaatggcttggactg

SEQ ID NO: 691009 - DNA, 25 bp, Mus musculus
gctctcagatgattggcttggactg

SEQ ID NO: 691010 - DNA, 25 bp, Mus musculus
gctctcagcaccatgtagacaaagc

SEQ ID NO: 691011 - DNA, 25 bp, Mus musculus
gctctcagcaccttgtagacaaagc

SEQ ID NO: 691012 - DNA, 25 bp, Mus musculus
gctctcagctcacgtaagaaggctc

SEQ ID NO: 691013 - DNA, 25 bp, Mus musculus
gctctcagctcaggtaagaaggctc

SEQ ID NO: 691014 - DNA, 25 bp, Mus musculus
gctctcaggcgcctctgaggagctc

SEQ ID NO: 691015 - DNA, 25 bp, Mus musculus
gctctcaggcgcgtctgaggagctc

SEQ ID NO: 691016 - DNA, 25 bp, Mus musculus
gctctcagtggaattggctcatcag

SEQ ID NO: 691017 - DNA, 25 bp, Mus musculus
gctctcagtggatttggctcatcag

SEQ ID NO: 691018 - DNA, 25 bp, Mus musculus
gctctccaaagtaggaacgtgggac

SEQ ID NO: 691019 - DNA, 25 bp, Mus musculus
gctctccaaagttggaacgtgggac

SEQ ID NO: 691020 - DNA, 25 bp, Mus musculus
gctctccagctgacccaggtttctt

SEQ ID NO: 691021 - DNA, 25 bp, Mus musculus
gctctccagctgtcccaggtttctt

SEQ ID NO: 691022 - DNA, 25 bp, Mus musculus
gctctccaggctctgctgattggct

SEQ ID NO: 691023 - DNA, 25 bp, Mus musculus
gctctccaggctgtgctgattggct

SEQ ID NO: 691024 - DNA, 25 bp, Mus musculus
gctctccatggacaggtatggcaaa

SEQ ID NO: 691025 - DNA, 25 bp, Mus musculus
gctctccatggagaggtatggcaaa

SEQ ID NO: 691026 - DNA, 25 bp, Mus musculus
gctctccctgttcaggcagaatgct

SEQ ID NO: 691027 - DNA, 25 bp, Mus musculus
gctctccctgttgaggcagaatgct

SEQ ID NO: 691028 - DNA, 25 bp, Mus musculus
gctctccgatctcatcagacagtag

SEQ ID NO: 691029 - DNA, 25 bp, Mus musculus
gctctccgatctgatcagacagtag

SEQ ID NO: 691030 - DNA, 25 bp, Mus musculus
gctctccgccggatatattgttgaa

SEQ ID NO: 691031 - DNA, 25 bp, Mus musculus
gctctccgccggttatattgttgaa

SEQ ID NO: 691032 - DNA, 25 bp, Mus musculus
gctctccggtcaaggatactgcttt

SEQ ID NO: 691033 - DNA, 25 bp, Mus musculus
gctctccggtcatggatactgcttt

SEQ ID NO: 691034 - DNA, 25 bp, Mus musculus
gctctcctgcttacaacctcaaata

SEQ ID NO: 691035 - DNA, 25 bp, Mus musculus
gctctcctgctttcaacctcaaata

SEQ ID NO: 691036 - DNA, 25 bp, Mus musculus
gctctccttcgacccggaagactgg

SEQ ID NO: 691037 - DNA, 25 bp, Mus musculus
gctctccttcgagccggaagactgg

SEQ ID NO: 691038 - DNA, 25 bp, Mus musculus
gctctccttgttatggctcagcctg

SEQ ID NO: 691039 - DNA, 25 bp, Mus musculus
gctctccttgttttggctcagcctg

SEQ ID NO: 691040 - DNA, 25 bp, Mus musculus
gctctcgaaacaccagcccgagttg

SEQ ID NO: 691041 - DNA, 25 bp, Mus musculus
gctctcgaaacagcagcccgagttg

SEQ ID NO: 691042 - DNA, 25 bp, Mus musculus
gctctcgaacagagtggcctgatga

SEQ ID NO: 691043 - DNA, 25 bp, Mus musculus
gctctcgaacagtgtggcctgatga

SEQ ID NO: 691044 - DNA, 25 bp, Mus musculus
gctctcgaaccaaggtgcacctgca

SEQ ID NO: 691045 - DNA, 25 bp, Mus musculus
gctctcgaaccatggtgcacctgca

SEQ ID NO: 691046 - DNA, 25 bp, Mus musculus
gctctcgaagagcatgcgttagact

SEQ ID NO: 691047 - DNA, 25 bp, Mus musculus
gctctcgaagaggatgcgttagact

SEQ ID NO: 691048 - DNA, 25 bp, Mus musculus
gctctcgatcaacaactattatcca

SEQ ID NO: 691049 - DNA, 25 bp, Mus musculus
gctctcgatcaagaactattatcca

SEQ ID NO: 691050 - DNA, 25 bp, Mus musculus
gctctcgcgagcattgtctggaaga

SEQ ID NO: 691051 - DNA, 25 bp, Mus musculus
gctctcgcgagctttgtctggaaga

SEQ ID NO: 691052 - DNA, 25 bp, Mus musculus
gctctcggacacatatacctgcttc

SEQ ID NO: 691053 - DNA, 25 bp, Mus musculus
gctctcggacacttatacctgcttc

SEQ ID NO: 691054 - DNA, 25 bp, Mus musculus
gctctcggccgacgtcaagaaccgg

SEQ ID NO: 691055 - DNA, 25 bp, Mus musculus
gctctcggccgaggtcaagaaccgg

SEQ ID NO: 691056 - DNA, 25 bp, Mus musculus
gctctcggccggcacagcaagtcgt

SEQ ID NO: 691057 - DNA, 25 bp, Mus musculus
gctctcggccgggacagcaagtcgt

SEQ ID NO: 691058 - DNA, 25 bp, Mus musculus
gctctcgggacaatagcctgcttct

SEQ ID NO: 691059 - DNA, 25 bp, Mus musculus
gctctcgggacattagcctgcttct

SEQ ID NO: 691060 - DNA, 25 bp, Mus musculus
gctctcgggagaaagatgtgaagct

SEQ ID NO: 691061 - DNA, 25 bp, Mus musculus
gctctcgggagatagatgtgaagct

SEQ ID NO: 691062 - DNA, 25 bp, Mus musculus
gctctcgggatcagccttcacttgt

SEQ ID NO: 691063 - DNA, 25 bp, Mus musculus
gctctcgggatctgccttcacttgt

SEQ ID NO: 691064 - DNA, 25 bp, Mus musculus
gctctcgtaagtcagtccctcgcgg

SEQ ID NO: 691065 - DNA, 25 bp, Mus musculus
gctctcgtaagtgagtccctcgcgg

SEQ ID NO: 691066 - DNA, 25 bp, Mus musculus
gctctcgtgggcacactcgctctag

SEQ ID NO: 691067 - DNA, 25 bp, Mus musculus
gctctcgtgggctcactcgctctag

SEQ ID NO: 691068 - DNA, 25 bp, Mus musculus
gctctctaatctagttcagtttaca

SEQ ID NO: 691069 - DNA, 25 bp, Mus musculus
gctctctaatcttgttcagtttaca

SEQ ID NO: 691070 - DNA, 25 bp, Mus musculus
gctctctaatgcctcagtggtcaat

SEQ ID NO: 691071 - DNA, 25 bp, Mus musculus
gctctctaatgcgtcagtggtcaat

SEQ ID NO: 691072 - DNA, 25 bp, Mus musculus
gctctctaccatagggaagatagcc

SEQ ID NO: 691073 - DNA, 25 bp, Mus musculus
gctctctaccattgggaagatagcc

SEQ ID NO: 691074 - DNA, 25 bp, Mus musculus
gctctctacgaaccgctgaaagaga

SEQ ID NO: 691075 - DNA, 25 bp, Mus musculus
gctctctacgaagcgctgaaagaga

SEQ ID NO: 691076 - DNA, 25 bp, Mus musculus
gctctctagcaacgctgtgtacttc

SEQ ID NO: 691077 - DNA, 25 bp, Mus musculus
gctctctagcaaggctgtgtacttc

SEQ ID NO: 691078 - DNA, 25 bp, Mus musculus
gctctctagtgtcccgggaagccag

SEQ ID NO: 691079 - DNA, 25 bp, Mus musculus
gctctctagtgtgccgggaagccag

SEQ ID NO: 691080 - DNA, 25 bp, Mus musculus
gctctctcctccaggctggagcgga

SEQ ID NO: 691081 - DNA, 25 bp, Mus musculus
gctctctcctcctggctggagcgga

SEQ ID NO: 691082 - DNA, 25 bp, Mus musculus
gctctctcgaagcagatctgcgcag

SEQ ID NO: 691083 - DNA, 25 bp, Mus musculus
gctctctcgaaggagatctgcgcag

SEQ ID NO: 691084 - DNA, 25 bp, Mus musculus
gctctctctgcaaacgaaaatgtgg

SEQ ID NO: 691085 - DNA, 25 bp, Mus musculus
gctctctctgcatacgaaaatgtgg

SEQ ID NO: 691086 - DNA, 25 bp, Mus musculus
gctctctgaactccgagggctgtcc

SEQ ID NO: 691087 - DNA, 25 bp, Mus musculus
gctctctgaactgcgagggctgtcc

SEQ ID NO: 691088 - DNA, 25 bp, Mus musculus
gctctctgaagtactttggaccatg

SEQ ID NO: 691089 - DNA, 25 bp, Mus musculus
gctctctgaagttctttggaccatg

SEQ ID NO: 691090 - DNA, 25 bp, Mus musculus
gctctctgatcgagatttaaagaaa

SEQ ID NO: 691091 - DNA, 25 bp, Mus musculus
gctctctgatcgtgatttaaagaaa

SEQ ID NO: 691092 - DNA, 25 bp, Mus musculus
gctctctgcagaactgaaattcagg

SEQ ID NO: 691093 - DNA, 25 bp, Mus musculus
gctctctgcagatctgaaattcagg

SEQ ID NO: 691094 - DNA, 25 bp, Mus musculus
gctctctggtcaacagccgagtgga

SEQ ID NO: 691095 - DNA, 25 bp, Mus musculus
gctctctggtcatcagccgagtgga

SEQ ID NO: 691096 - DNA, 25 bp, Mus musculus
gctctctgtgacatcccactgtcct

SEQ ID NO: 691097 - DNA, 25 bp, Mus musculus
gctctctgtgacttcccactgtcct

SEQ ID NO: 691098 - DNA, 25 bp, Mus musculus
gctctctgtgtgcatacggagttat

SEQ ID NO: 691099 - DNA, 25 bp, Mus musculus
gctctctgtgtggatacggagttat

SEQ ID NO: 691100 - DNA, 25 bp, Mus musculus
gctctcttacagagctttactatta

SEQ ID NO: 691101 - DNA, 25 bp, Mus musculus
gctctcttacagtgctttactatta

SEQ ID NO: 691102 - DNA, 25 bp, Mus musculus
gctctcttgatcactagtgtttgga

SEQ ID NO: 691103 - DNA, 25 bp, Mus musculus
gctctcttgatctctagtgtttgga

SEQ ID NO: 691104 - DNA, 25 bp, Mus musculus
gctctctttctcctccagtgaagta

SEQ ID NO: 691105 - DNA, 25 bp, Mus musculus
gctctctttctcgtccagtgaagta

SEQ ID NO: 691106 - DNA, 25 bp, Mus musculus
gctctctttggaaacgcaagcgaca

SEQ ID NO: 691107 - DNA, 25 bp, Mus musculus
gctctctttggatacgcaagcgaca

SEQ ID NO: 691108 - DNA, 25 bp, Mus musculus
gctctctttgtgctgccgtgtactg

SEQ ID NO: 691109 - DNA, 25 bp, Mus musculus
gctctctttgtggtgccgtgtactg

SEQ ID NO: 691110 - DNA, 25 bp, Mus musculus
gctctgaaaaatctccggcccttgt

SEQ ID NO: 691111 - DNA, 25 bp, Mus musculus
gctctgaaaaatgtccggcccttgt

SEQ ID NO: 691112 - DNA, 25 bp, Mus musculus
gctctgaacaaaaattggcggtata

SEQ ID NO: 691113 - DNA, 25 bp, Mus musculus
gctctgaacaaatattggcggtata

SEQ ID NO: 691114 - DNA, 25 bp, Mus musculus
gctctgaacaagagcccagattttg

SEQ ID NO: 691115 - DNA, 25 bp, Mus musculus
gctctgaacaagtgcccagattttg

SEQ ID NO: 691116 - DNA, 25 bp, Mus musculus
gctctgaaccagactttttacataa

SEQ ID NO: 691117 - DNA, 25 bp, Mus musculus
gctctgaaccagtctttttacataa

SEQ ID NO: 691118 - DNA, 25 bp, Mus musculus
gctctgaactacaccttctaccaag

SEQ ID NO: 691119 - DNA, 25 bp, Mus musculus
gctctgaactactccttctaccaag

SEQ ID NO: 691120 - DNA, 25 bp, Mus musculus
gctctgaactccatcatctctggaa

SEQ ID NO: 691121 - DNA, 25 bp, Mus musculus
gctctgaactccttcatctctggaa

SEQ ID NO: 691122 - DNA, 25 bp, Mus musculus
gctctgaacttgattgggaagaagt

SEQ ID NO: 691123 - DNA, 25 bp, Mus musculus
gctctgaacttgtttgggaagaagt

SEQ ID NO: 691124 - DNA, 25 bp, Mus musculus
gctctgaagaagatctacagggccc

SEQ ID NO: 691125 - DNA, 25 bp, Mus musculus
gctctgaagaagttctacagggccc

SEQ ID NO: 691126 - DNA, 25 bp, Mus musculus
gctctgaatatgagacgatgctgac

SEQ ID NO: 691127 - DNA, 25 bp, Mus musculus
gctctgaatatgtgacgatgctgac

SEQ ID NO: 691128 - DNA, 25 bp, Mus musculus
gctctgacagccactttaataaacc

SEQ ID NO: 691129 - DNA, 25 bp, Mus musculus
gctctgacagcctctttaataaacc

SEQ ID NO: 691130 - DNA, 25 bp, Mus musculus
gctctgacccataccacagtggcta

SEQ ID NO: 691131 - DNA, 25 bp, Mus musculus
gctctgacccattccacagtggcta

SEQ ID NO: 691132 - DNA, 25 bp, Mus musculus
gctctgacctagcttcttggctggg

SEQ ID NO: 691133 - DNA, 25 bp, Mus musculus
gctctgacctaggttcttggctggg

SEQ ID NO: 691134 - DNA, 25 bp, Mus musculus
gctctgacgctacggcttgggacta

SEQ ID NO: 691135 - DNA, 25 bp, Mus musculus
gctctgacgctagggcttgggacta

SEQ ID NO: 691136 - DNA, 25 bp, Mus musculus
gctctgacggtcatgagtacatcta

SEQ ID NO: 691137 - DNA, 25 bp, Mus musculus
gctctgacggtcttgagtacatcta

SEQ ID NO: 691138 - DNA, 25 bp, Mus musculus
gctctgactaccctgcggagctgaa

SEQ ID NO: 691139 - DNA, 25 bp, Mus musculus
gctctgactaccgtgcggagctgaa

SEQ ID NO: 691140 - DNA, 25 bp, Mus musculus
gctctgactcttctggaataccctg

SEQ ID NO: 691141 - DNA, 25 bp, Mus musculus
gctctgactcttgtggaataccctg

SEQ ID NO: 691142 - DNA, 25 bp, Mus musculus
gctctgactgctaggtgtactggcg

SEQ ID NO: 691143 - DNA, 25 bp, Mus musculus
gctctgactgcttggtgtactggcg

SEQ ID NO: 691144 - DNA, 25 bp, Mus musculus
gctctgacttggacgggcatcctgt

SEQ ID NO: 691145 - DNA, 25 bp, Mus musculus
gctctgacttggctgagtcactaag

SEQ ID NO: 691146 - DNA, 25 bp, Mus musculus
gctctgacttgggtgagtcactaag

SEQ ID NO: 691147 - DNA, 25 bp, Mus musculus
gctctgacttggtcgggcatcctgt

SEQ ID NO: 691148 - DNA, 25 bp, Mus musculus
gctctgacttgtacaaaagatctag

SEQ ID NO: 691149 - DNA, 25 bp, Mus musculus
gctctgacttgttcaaaagatctag

SEQ ID NO: 691150 - DNA, 25 bp, Mus musculus
gctctgagaccgaggtacctgggaa

SEQ ID NO: 691151 - DNA, 25 bp, Mus musculus
gctctgagaccgtggtacctgggaa

SEQ ID NO: 691152 - DNA, 25 bp, Mus musculus
gctctgagagtgaagcttgggtcta

SEQ ID NO: 691153 - DNA, 25 bp, Mus musculus
gctctgagagtgtagcttgggtcta

SEQ ID NO: 691154 - DNA, 25 bp, Mus musculus
gctctgagcattagataatcctacg

SEQ ID NO: 691155 - DNA, 25 bp, Mus musculus
gctctgagcatttgataatcctacg

SEQ ID NO: 691156 - DNA, 25 bp, Mus musculus
gctctgagccgcagcctcttggttg

SEQ ID NO: 691157 - DNA, 25 bp, Mus musculus
gctctgagccgctgcctcttggttg

SEQ ID NO: 691158 - DNA, 25 bp, Mus musculus
gctctgagcgccctgcgtgaagaac

SEQ ID NO: 691159 - DNA, 25 bp, Mus musculus
gctctgagcgccgtgcgtgaagaac

SEQ ID NO: 691160 - DNA, 25 bp, Mus musculus
gctctgagctcaagaaagaacctgt

SEQ ID NO: 691161 - DNA, 25 bp, Mus musculus
gctctgagctcatgaaagaacctgt

SEQ ID NO: 691162 - DNA, 25 bp, Mus musculus
gctctgaggactctgacgatgaacc

SEQ ID NO: 691163 - DNA, 25 bp, Mus musculus
gctctgaggactgtgacgatgaacc

SEQ ID NO: 691164 - DNA, 25 bp, Mus musculus
gctctgaggtacctgaactttttca

SEQ ID NO: 691165 - DNA, 25 bp, Mus musculus
gctctgaggtacgtgaactttttca

SEQ ID NO: 691166 - DNA, 25 bp, Mus musculus
gctctgaggtcaacgcaccccaaaa

SEQ ID NO: 691167 - DNA, 25 bp, Mus musculus
gctctgaggtcatcgcaccccaaaa

SEQ ID NO: 691168 - DNA, 25 bp, Mus musculus
gctctgagttctaggttgcaggacg

SEQ ID NO: 691169 - DNA, 25 bp, Mus musculus
gctctgagttcttggttgcaggacg

SEQ ID NO: 691170 - DNA, 25 bp, Mus musculus
gctctgatagagctccctggccact

SEQ ID NO: 691171 - DNA, 25 bp, Mus musculus
gctctgatagaggtccctggccact

SEQ ID NO: 691172 - DNA, 25 bp, Mus musculus
gctctgatcaatcctgatgagctgc

SEQ ID NO: 691173 - DNA, 25 bp, Mus musculus
gctctgatcaatgctgatgagctgc

SEQ ID NO: 691174 - DNA, 25 bp, Mus musculus
gctctgatcgccatggctgtggttg

SEQ ID NO: 691175 - DNA, 25 bp, Mus musculus
gctctgatcgccttggctgtggttg

SEQ ID NO: 691176 - DNA, 25 bp, Mus musculus
gctctgatgcaaccaaagaaccttt

SEQ ID NO: 691177 - DNA, 25 bp, Mus musculus
gctctgatgcaagcaaagaaccttt

SEQ ID NO: 691178 - DNA, 25 bp, Mus musculus
gctctgatgcctactttgatgccct

SEQ ID NO: 691179 - DNA, 25 bp, Mus musculus
gctctgatgccttctttgatgccct

SEQ ID NO: 691180 - DNA, 25 bp, Mus musculus
gctctgatgctacagggacagcgat

SEQ ID NO: 691181 - DNA, 25 bp, Mus musculus
gctctgatgctagagggacagcgat

SEQ ID NO: 691182 - DNA, 25 bp, Mus musculus
gctctgatgtatcatgcagtgcacg

SEQ ID NO: 691183 - DNA, 25 bp, Mus musculus
gctctgatgtatgatgcagtgcacg

SEQ ID NO: 691184 - DNA, 25 bp, Mus musculus
gctctgatgtgcattcgagaagcct

SEQ ID NO: 691185 - DNA, 25 bp, Mus musculus
gctctgatgtgctttcgagaagcct

SEQ ID NO: 691186 - DNA, 25 bp, Mus musculus
gctctgcacagaacagggtattcag

SEQ ID NO: 691187 - DNA, 25 bp, Mus musculus
gctctgcacagacaggtagacggca

SEQ ID NO: 691188 - DNA, 25 bp, Mus musculus
gctctgcacagagaggtagacggca

SEQ ID NO: 691189 - DNA, 25 bp, Mus musculus
gctctgcacagatcagggtattcag

SEQ ID NO: 691190 - DNA, 25 bp, Mus musculus
gctctgcaccggcacatcatgatgg

SEQ ID NO: 691191 - DNA, 25 bp, Mus musculus
gctctgcaccgggacatcatgatgg

SEQ ID NO: 691192 - DNA, 25 bp, Mus musculus
gctctgcaccttcagcagtgtcctg

SEQ ID NO: 691193 - DNA, 25 bp, Mus musculus
gctctgcaccttgagcagtgtcctg

SEQ ID NO: 691194 - DNA, 25 bp, Mus musculus
gctctgcactggagtgcctactaca

SEQ ID NO: 691195 - DNA, 25 bp, Mus musculus
gctctgcactggtgtgcctactaca

SEQ ID NO: 691196 - DNA, 25 bp, Mus musculus
gctctgcaggttatcttcgtgtgtc

SEQ ID NO: 691197 - DNA, 25 bp, Mus musculus
gctctgcaggttttcttcgtgtgtc

SEQ ID NO: 691198 - DNA, 25 bp, Mus musculus
gctctgcagttgaggtcgtgttaaa

SEQ ID NO: 691199 - DNA, 25 bp, Mus musculus
gctctgcagttgtggtcgtgttaaa

SEQ ID NO: 691200 - DNA, 25 bp, Mus musculus
gctctgcatgagatcaaacctgtcg

SEQ ID NO: 691201 - DNA, 25 bp, Mus musculus
gctctgcatgagttcaaacctgtcg

SEQ ID NO: 691202 - DNA, 25 bp, Mus musculus
gctctgcccaacactgtgaactcca

SEQ ID NO: 691203 - DNA, 25 bp, Mus musculus
gctctgcccaactctgtgaactcca

SEQ ID NO: 691204 - DNA, 25 bp, Mus musculus
gctctgcccatgatgcttgctgaac

SEQ ID NO: 691205 - DNA, 25 bp, Mus musculus
gctctgcccatgatgggcaaatggg

SEQ ID NO: 691206 - DNA, 25 bp, Mus musculus
gctctgcccatgttgcttgctgaac

SEQ ID NO: 691207 - DNA, 25 bp, Mus musculus
gctctgcccatgttgggcaaatggg

SEQ ID NO: 691208 - DNA, 25 bp, Mus musculus
gctctgccgcacacatgcctggaaa

SEQ ID NO: 691209 - DNA, 25 bp, Mus musculus
gctctgccgcactcatgcctggaaa

SEQ ID NO: 691210 - DNA, 25 bp, Mus musculus
gctctgccgggcaggaagagtctct

SEQ ID NO: 691211 - DNA, 25 bp, Mus musculus
gctctgccgggctggaagagtctct

SEQ ID NO: 691212 - DNA, 25 bp, Mus musculus
gctctgccgggtagaaccctaccaa

SEQ ID NO: 691213 - DNA, 25 bp, Mus musculus
gctctgccgggttgaaccctaccaa

SEQ ID NO: 691214 - DNA, 25 bp, Mus musculus
gctctgcctagaacccgagagaagt

SEQ ID NO: 691215 - DNA, 25 bp, Mus musculus
gctctgcctagatcccgagagaagt

SEQ ID NO: 691216 - DNA, 25 bp, Mus musculus
gctctgcctcatcgatttaggacta

SEQ ID NO: 691217 - DNA, 25 bp, Mus musculus
gctctgcctcatggatttaggacta

SEQ ID NO: 691218 - DNA, 25 bp, Mus musculus
gctctgcctgaacgtaccgaggaca

SEQ ID NO: 691219 - DNA, 25 bp, Mus musculus
gctctgcctgaaggtaccgaggaca

SEQ ID NO: 691220 - DNA, 25 bp, Mus musculus
gctctgcgaggcatcagaggactcg

SEQ ID NO: 691221 - DNA, 25 bp, Mus musculus
gctctgcgaggcttcagaggactcg

SEQ ID NO: 691222 - DNA, 25 bp, Mus musculus
gctctgcggagacagcagcttctgc

SEQ ID NO: 691223 - DNA, 25 bp, Mus musculus
gctctgcggagagagcagcttctgc

SEQ ID NO: 691224 - DNA, 25 bp, Mus musculus
gctctgcggataaagagagacttgc

SEQ ID NO: 691225 - DNA, 25 bp, Mus musculus
gctctgcggatatagagagacttgc

SEQ ID NO: 691226 - DNA, 25 bp, Mus musculus
gctctgcgtaaactggatgacacca

SEQ ID NO: 691227 - DNA, 25 bp, Mus musculus
gctctgcgtaaagtggatgacacca

SEQ ID NO: 691228 - DNA, 25 bp, Mus musculus
gctctgcgtaagaacaagactctac

SEQ ID NO: 691229 - DNA, 25 bp, Mus musculus
gctctgcgtaagtacaagactctac

SEQ ID NO: 691230 - DNA, 25 bp, Mus musculus
gctctgctccacaagcgttttctgc

SEQ ID NO: 691231 - DNA, 25 bp, Mus musculus
gctctgctccactagcgttttctgc

SEQ ID NO: 691232 - DNA, 25 bp, Mus musculus
gctctgctctgcctcatggatttag

SEQ ID NO: 691233 - DNA, 25 bp, Mus musculus
gctctgctctgcgtcatggatttag

SEQ ID NO: 691234 - DNA, 25 bp, Mus musculus
gctctgctgctgaagtgtgggtaaa

SEQ ID NO: 691235 - DNA, 25 bp, Mus musculus
gctctgctgctgtagtgtgggtaaa

SEQ ID NO: 691236 - DNA, 25 bp, Mus musculus
gctctgctgggtctaggtcttgtca

SEQ ID NO: 691237 - DNA, 25 bp, Mus musculus
gctctgctgggtgtaggtcttgtca

SEQ ID NO: 691238 - DNA, 25 bp, Mus musculus
gctctgcttatgaacgtgtgcctgt

SEQ ID NO: 691239 - DNA, 25 bp, Mus musculus
gctctgcttatgtacgtgtgcctgt

SEQ ID NO: 691240 - DNA, 25 bp, Mus musculus
gctctgcttgctcaaactggaagtt

SEQ ID NO: 691241 - DNA, 25 bp, Mus musculus
gctctgcttgctgaaactggaagtt

SEQ ID NO: 691242 - DNA, 25 bp, Mus musculus
gctctgcttgggaatggctttacca

SEQ ID NO: 691243 - DNA, 25 bp, Mus musculus
gctctgcttgggtatggctttacca

SEQ ID NO: 691244 - DNA, 25 bp, Mus musculus
gctctggaaaggacttccccactag

SEQ ID NO: 691245 - DNA, 25 bp, Mus musculus
gctctggaaaggtcttccccactag

SEQ ID NO: 691246 - DNA, 25 bp, Mus musculus
gctctggaacggcaagtctttgact

SEQ ID NO: 691247 - DNA, 25 bp, Mus musculus
gctctggaacgggaagtctttgact

SEQ ID NO: 691248 - DNA, 25 bp, Mus musculus
gctctggaagaaagacggtatccag

SEQ ID NO: 691249 - DNA, 25 bp, Mus musculus
gctctggaagaatgacggtatccag

SEQ ID NO: 691250 - DNA, 25 bp, Mus musculus
gctctggaagttagtaaacaccaac

SEQ ID NO: 691251 - DNA, 25 bp, Mus musculus
gctctggaagtttgtaaacaccaac

SEQ ID NO: 691252 - DNA, 25 bp, Mus musculus
gctctggaatcaaaactgcactgtc

SEQ ID NO: 691253 - DNA, 25 bp, Mus musculus
gctctggaatcataactgcactgtc

SEQ ID NO: 691254 - DNA, 25 bp, Mus musculus
gctctggacctgagatagctctttg

SEQ ID NO: 691255 - DNA, 25 bp, Mus musculus
gctctggacctgtgatagctctttg

SEQ ID NO: 691256 - DNA, 25 bp, Mus musculus
gctctggagcagatcgtgaacagtg

SEQ ID NO: 691257 - DNA, 25 bp, Mus musculus
gctctggagcagttcgtgaacagtg

SEQ ID NO: 691258 - DNA, 25 bp, Mus musculus
gctctggagggcatgttccgcaagc

SEQ ID NO: 691259 - DNA, 25 bp, Mus musculus
gctctggagggcttgttccgcaagc

SEQ ID NO: 691260 - DNA, 25 bp, Mus musculus
gctctggccatgcttagtctggaaa

SEQ ID NO: 691261 - DNA, 25 bp, Mus musculus
gctctggccatggttagtctggaaa

SEQ ID NO: 691262 - DNA, 25 bp, Mus musculus
gctctggctactatctcagtcgttg

SEQ ID NO: 691263 - DNA, 25 bp, Mus musculus
gctctggctactttctcagtcgttg

SEQ ID NO: 691264 - DNA, 25 bp, Mus musculus
gctctggctgccagcaagatcataa

SEQ ID NO: 691265 - DNA, 25 bp, Mus musculus
gctctggctgcctgcaagatcataa

SEQ ID NO: 691266 - DNA, 25 bp, Mus musculus
gctctgggagacagtagcccccaga

SEQ ID NO: 691267 - DNA, 25 bp, Mus musculus
gctctgggagactgtagcccccaga

SEQ ID NO: 691268 - DNA, 25 bp, Mus musculus
gctctgggcacaagaagtggatcat

SEQ ID NO: 691269 - DNA, 25 bp, Mus musculus
gctctgggcacatgaagtggatcat

SEQ ID NO: 691270 - DNA, 25 bp, Mus musculus
gctctgggcgggaagactgcctacc

SEQ ID NO: 691271 - DNA, 25 bp, Mus musculus
gctctgggcgggtagactgcctacc

SEQ ID NO: 691272 - DNA, 25 bp, Mus musculus
gctctggggataccagaactggtca

SEQ ID NO: 691273 - DNA, 25 bp, Mus musculus
gctctggggatagcagaactggtca

SEQ ID NO: 691274 - DNA, 25 bp, Mus musculus
gctctgggtttactcctcagcacca

SEQ ID NO: 691275 - DNA, 25 bp, Mus musculus
gctctgggtttagtcctcagcacca

SEQ ID NO: 691276 - DNA, 25 bp, Mus musculus
gctctggtacaaccaggagtacgca

SEQ ID NO: 691277 - DNA, 25 bp, Mus musculus
gctctggtacaagcaggagtacgca

SEQ ID NO: 691278 - DNA, 25 bp, Mus musculus
gctctgtacaagcaacaatggctct

SEQ ID NO: 691279 - DNA, 25 bp, Mus musculus
gctctgtacaaggaacaatggctct

SEQ ID NO: 691280 - DNA, 25 bp, Mus musculus
gctctgtacccaactgggcctgagt

SEQ ID NO: 691281 - DNA, 25 bp, Mus musculus
gctctgtacccatctgggcctgagt

SEQ ID NO: 691282 - DNA, 25 bp, Mus musculus
gctctgtatcttctatatttgccgt

SEQ ID NO: 691283 - DNA, 25 bp, Mus musculus
gctctgtatcttgtatatttgccgt

SEQ ID NO: 691284 - DNA, 25 bp, Mus musculus
gctctgtatgttcccaccaaatgtt

SEQ ID NO: 691285 - DNA, 25 bp, Mus musculus
gctctgtatgttgccaccaaatgtt

SEQ ID NO: 691286 - DNA, 25 bp, Mus musculus
gctctgtcagccagtctgggcacct

SEQ ID NO: 691287 - DNA, 25 bp, Mus musculus
gctctgtcagcctgtctgggcacct

SEQ ID NO: 691288 - DNA, 25 bp, Mus musculus
gctctgtcaggcaggaatgactgcc

SEQ ID NO: 691289 - DNA, 25 bp, Mus musculus
gctctgtcaggctggaatgactgcc

SEQ ID NO: 691290 - DNA, 25 bp, Mus musculus
gctctgtccacaccaagtggtcttg

SEQ ID NO: 691291 - DNA, 25 bp, Mus musculus
gctctgtccacagcaagtggtcttg

SEQ ID NO: 691292 - DNA, 25 bp, Mus musculus
gctctgtcctgactggaatctgctg

SEQ ID NO: 691293 - DNA, 25 bp, Mus musculus
gctctgtcctgagtggaatctgctg

SEQ ID NO: 691294 - DNA, 25 bp, Mus musculus
gctctgtctactccatatcctcaga

SEQ ID NO: 691295 - DNA, 25 bp, Mus musculus
gctctgtctactgcatatcctcaga

SEQ ID NO: 691296 - DNA, 25 bp, Mus musculus
gctctgtctgtacaactcggaagaa

SEQ ID NO: 691297 - DNA, 25 bp, Mus musculus
gctctgtctgtagaactcggaagaa

SEQ ID NO: 691298 - DNA, 25 bp, Mus musculus
gctctgtcttaaatgtggccatcag

SEQ ID NO: 691299 - DNA, 25 bp, Mus musculus
gctctgtcttaattgtggccatcag

SEQ ID NO: 691300 - DNA, 25 bp, Mus musculus
gctctgtgagttagccttcaacatg

SEQ ID NO: 691301 - DNA, 25 bp, Mus musculus
gctctgtgagtttgccttcaacatg

SEQ ID NO: 691302 - DNA, 25 bp, Mus musculus
gctctgtgcaagcacaacatcttca

SEQ ID NO: 691303 - DNA, 25 bp, Mus musculus
gctctgtgcaaggacaacatcttca

SEQ ID NO: 691304 - DNA, 25 bp, Mus musculus
gctctgtgcagcagcattggtctgg

SEQ ID NO: 691305 - DNA, 25 bp, Mus musculus
gctctgtgcagctgcattggtctgg

SEQ ID NO: 691306 - DNA, 25 bp, Mus musculus
gctctgtgcagtcgctcgatagcag

SEQ ID NO: 691307 - DNA, 25 bp, Mus musculus
gctctgtgcagtggctcgatagcag

SEQ ID NO: 691308 - DNA, 25 bp, Mus musculus
gctctgtgcattcgtctttgggatc

SEQ ID NO: 691309 - DNA, 25 bp, Mus musculus
gctctgtgcattggtctttgggatc

SEQ ID NO: 691310 - DNA, 25 bp, Mus musculus
gctctgtgcgagagccctactgtgt

SEQ ID NO: 691311 - DNA, 25 bp, Mus musculus
gctctgtgcgagtgccctactgtgt

SEQ ID NO: 691312 - DNA, 25 bp, Mus musculus
gctctgtgctataggaattgctccc

SEQ ID NO: 691313 - DNA, 25 bp, Mus musculus
gctctgtgctattggaattgctccc

SEQ ID NO: 691314 - DNA, 25 bp, Mus musculus
gctctgtgctgcaacttgggcggca

SEQ ID NO: 691315 - DNA, 25 bp, Mus musculus
gctctgtgctgctacttgggcggca

SEQ ID NO: 691316 - DNA, 25 bp, Mus musculus
gctctgtgcttcagggcagcaccgt

SEQ ID NO: 691317 - DNA, 25 bp, Mus musculus
gctctgtgcttctgggcagcaccgt

SEQ ID NO: 691318 - DNA, 25 bp, Mus musculus
gctctgtgggttatgaggatgaaca

SEQ ID NO: 691319 - DNA, 25 bp, Mus musculus
gctctgtgggttttgaggatgaaca

SEQ ID NO: 691320 - DNA, 25 bp, Mus musculus
gctctgtgtcagagaatgctcatgt

SEQ ID NO: 691321 - DNA, 25 bp, Mus musculus
gctctgtgtcagtgaatgctcatgt

SEQ ID NO: 691322 - DNA, 25 bp, Mus musculus
gctctgtgtgcaagaagatggtgca

SEQ ID NO: 691323 - DNA, 25 bp, Mus musculus
gctctgtgtgcatgaagatggtgca

SEQ ID NO: 691324 - DNA, 25 bp, Mus musculus
gctctgtgtgctcatcccgaagtga

SEQ ID NO: 691325 - DNA, 25 bp, Mus musculus
gctctgtgtgctgatcccgaagtga

SEQ ID NO: 691326 - DNA, 25 bp, Mus musculus
gctctgtgttacatgagggcctgca

SEQ ID NO: 691327 - DNA, 25 bp, Mus musculus
gctctgtgttacttgagggcctgca

SEQ ID NO: 691328 - DNA, 25 bp, Mus musculus
gctctgttagaccaagaagggaacc

SEQ ID NO: 691329 - DNA, 25 bp, Mus musculus
gctctgttagacgaagaagggaacc

SEQ ID NO: 691330 - DNA, 25 bp, Mus musculus
gctctgttctctacactgccgtgca

SEQ ID NO: 691331 - DNA, 25 bp, Mus musculus
gctctgttctcttcactgccgtgca

SEQ ID NO: 691332 - DNA, 25 bp, Mus musculus
gctctgttgtcaacagcccacctga

SEQ ID NO: 691333 - DNA, 25 bp, Mus musculus
gctctgttgtcaagaaggtgaaaat

SEQ ID NO: 691334 - DNA, 25 bp, Mus musculus
gctctgttgtcatcagcccacctga

SEQ ID NO: 691335 - DNA, 25 bp, Mus musculus
gctctgttgtcatgaaggtgaaaat

SEQ ID NO: 691336 - DNA, 25 bp, Mus musculus
gctctgtttcttcacctgtcgcctg

SEQ ID NO: 691337 - DNA, 25 bp, Mus musculus
gctctgtttcttgacctgtcgcctg

SEQ ID NO: 691338 - DNA, 25 bp, Mus musculus
gctcttacaggaacactccagagcc

SEQ ID NO: 691339 - DNA, 25 bp, Mus musculus
gctcttacaggatcactccagagcc

SEQ ID NO: 691340 - DNA, 25 bp, Mus musculus
gctcttacatatcaagcttgaggat

SEQ ID NO: 691341 - DNA, 25 bp, Mus musculus
gctcttacatatgaagcttgaggat

SEQ ID NO: 691342 - DNA, 25 bp, Mus musculus
gctcttagattcctatcactaccaa

SEQ ID NO: 691343 - DNA, 25 bp, Mus musculus
gctcttagattcgtatcactaccaa

SEQ ID NO: 691344 - DNA, 25 bp, Mus musculus
gctcttagctggagccaagataatt

SEQ ID NO: 691345 - DNA, 25 bp, Mus musculus
gctcttagctggtgccaagataatt

SEQ ID NO: 691346 - DNA, 25 bp, Mus musculus
gctcttaggatcaggaaggtcactg

SEQ ID NO: 691347 - DNA, 25 bp, Mus musculus
gctcttaggatctggaaggtcactg

SEQ ID NO: 691348 - DNA, 25 bp, Mus musculus
gctcttagggaacaatattgtagaa

SEQ ID NO: 691349 - DNA, 25 bp, Mus musculus
gctcttagggaagaatattgtagaa

SEQ ID NO: 691350 - DNA, 25 bp, Mus musculus
gctcttaggtggagaatcgggcacc

SEQ ID NO: 691351 - DNA, 25 bp, Mus musculus
gctcttaggtggtgaatcgggcacc

SEQ ID NO: 691352 - DNA, 25 bp, Mus musculus
gctcttagtggaagcaggtgtctgc

SEQ ID NO: 691353 - DNA, 25 bp, Mus musculus
gctcttagtggatgcaggtgtctgc

SEQ ID NO: 691354 - DNA, 25 bp, Mus musculus
gctcttatagagctaatggtctgta

SEQ ID NO: 691355 - DNA, 25 bp, Mus musculus
gctcttatagaggtaatggtctgta

SEQ ID NO: 691356 - DNA, 25 bp, Mus musculus
gctcttcaagaaaacaataattaag

SEQ ID NO: 691357 - DNA, 25 bp, Mus musculus
gctcttcaagaatacaataattaag

SEQ ID NO: 691358 - DNA, 25 bp, Mus musculus
gctcttcaagcaagcagccctagtc

SEQ ID NO: 691359 - DNA, 25 bp, Mus musculus
gctcttcaagcatgcagccctagtc

SEQ ID NO: 691360 - DNA, 25 bp, Mus musculus
gctcttcaaggtcgttggccaggaa

SEQ ID NO: 691361 - DNA, 25 bp, Mus musculus
gctcttcaaggtggttggccaggaa

SEQ ID NO: 691362 - DNA, 25 bp, Mus musculus
gctcttcacacaacttgagcgagaa

SEQ ID NO: 691363 - DNA, 25 bp, Mus musculus
gctcttcacacatcttgagcgagaa

SEQ ID NO: 691364 - DNA, 25 bp, Mus musculus
gctcttcacagcagcattcgttctg

SEQ ID NO: 691365 - DNA, 25 bp, Mus musculus
gctcttcacagctgcattcgttctg

SEQ ID NO: 691366 - DNA, 25 bp, Mus musculus
gctcttcacatgctggacattaagg

SEQ ID NO: 691367 - DNA, 25 bp, Mus musculus
gctcttcacatggtggacattaagg

SEQ ID NO: 691368 - DNA, 25 bp, Mus musculus
gctcttcagcctcaaattgagcaat

SEQ ID NO: 691369 - DNA, 25 bp, Mus musculus
gctcttcagcctgaaattgagcaat

SEQ ID NO: 691370 - DNA, 25 bp, Mus musculus
gctcttcagcgactcggaggccagc

SEQ ID NO: 691371 - DNA, 25 bp, Mus musculus
gctcttcagcgagtcggaggccagc

SEQ ID NO: 691372 - DNA, 25 bp, Mus musculus
gctcttcagggtccagcaactcagg

SEQ ID NO: 691373 - DNA, 25 bp, Mus musculus
gctcttcagggtgcagcaactcagg

SEQ ID NO: 691374 - DNA, 25 bp, Mus musculus
gctcttcatcaacgatgtcattggg

SEQ ID NO: 691375 - DNA, 25 bp, Mus musculus
gctcttcatcaaggatgtcattggg

SEQ ID NO: 691376 - DNA, 25 bp, Mus musculus
gctcttcatgctatccaaggtcatt

SEQ ID NO: 691377 - DNA, 25 bp, Mus musculus
gctcttcatgctttccaaggtcatt

SEQ ID NO: 691378 - DNA, 25 bp, Mus musculus
gctcttcattatcctaacaagtaca

SEQ ID NO: 691379 - DNA, 25 bp, Mus musculus
gctcttcattatgctaacaagtaca

SEQ ID NO: 691380 - DNA, 25 bp, Mus musculus
gctcttcattgaatctcgggccaag

SEQ ID NO: 691381 - DNA, 25 bp, Mus musculus
gctcttcattgattctcgggccaag

SEQ ID NO: 691382 - DNA, 25 bp, Mus musculus
gctcttccaggaccatggcttcttc

SEQ ID NO: 691383 - DNA, 25 bp, Mus musculus
gctcttccaggagcatggcttcttc

SEQ ID NO: 691384 - DNA, 25 bp, Mus musculus
gctcttcccgagctcatgatggtat

SEQ ID NO: 691385 - DNA, 25 bp, Mus musculus
gctcttcccgaggtcatgatggtat

SEQ ID NO: 691386 - DNA, 25 bp, Mus musculus
gctcttcctagcagtttgttctgtg

SEQ ID NO: 691387 - DNA, 25 bp, Mus musculus
gctcttcctagctgtttgttctgtg

SEQ ID NO: 691388 - DNA, 25 bp, Mus musculus
gctcttcctcagaaggtcttctgta

SEQ ID NO: 691389 - DNA, 25 bp, Mus musculus
gctcttcctcagtaggtcttctgta

SEQ ID NO: 691390 - DNA, 25 bp, Mus musculus
gctcttcgcaaaaccgtgatgcccg

SEQ ID NO: 691391 - DNA, 25 bp, Mus musculus
gctcttcgcaaatccgtgatgcccg

SEQ ID NO: 691392 - DNA, 25 bp, Mus musculus
gctcttcggcaccattcaataccgg

SEQ ID NO: 691393 - DNA, 25 bp, Mus musculus
gctcttcggcacgattcaataccgg

SEQ ID NO: 691394 - DNA, 25 bp, Mus musculus
gctcttctacaacctcaactgataa

SEQ ID NO: 691395 - DNA, 25 bp, Mus musculus
gctcttctacaagctcaactgataa

SEQ ID NO: 691396 - DNA, 25 bp, Mus musculus
gctcttctaccgcaagctgacggga

SEQ ID NO: 691397 - DNA, 25 bp, Mus musculus
gctcttctaccggaagctgacggga

SEQ ID NO: 691398 - DNA, 25 bp, Mus musculus
gctcttctacggaatgagttctgaa

SEQ ID NO: 691399 - DNA, 25 bp, Mus musculus
gctcttctacggtatgagttctgaa

SEQ ID NO: 691400 - DNA, 25 bp, Mus musculus
gctcttctggacaagtacaacgctg

SEQ ID NO: 691401 - DNA, 25 bp, Mus musculus
gctcttctggactagtacaacgctg

SEQ ID NO: 691402 - DNA, 25 bp, Mus musculus
gctcttctgtctctctacccattta

SEQ ID NO: 691403 - DNA, 25 bp, Mus musculus
gctcttctgtctgtctacccattta

SEQ ID NO: 691404 - DNA, 25 bp, Mus musculus
gctcttctgtggatctcaagtcaga

SEQ ID NO: 691405 - DNA, 25 bp, Mus musculus
gctcttctgtggttctcaagtcaga

SEQ ID NO: 691406 - DNA, 25 bp, Mus musculus
gctcttcttagtcccctagattaaa

SEQ ID NO: 691407 - DNA, 25 bp, Mus musculus
gctcttcttagtgccctagattaaa

SEQ ID NO: 691408 - DNA, 25 bp, Mus musculus
gctcttcttgttcgttgacttcctg

SEQ ID NO: 691409 - DNA, 25 bp, Mus musculus
gctcttcttgttggttgacttcctg

SEQ ID NO: 691410 - DNA, 25 bp, Mus musculus
gctcttctttatcccacaagtattc

SEQ ID NO: 691411 - DNA, 25 bp, Mus musculus
gctcttctttatgccacaagtattc

SEQ ID NO: 691412 - DNA, 25 bp, Mus musculus
gctcttctttgcctacagtgacaag

SEQ ID NO: 691413 - DNA, 25 bp, Mus musculus
gctcttctttgcgtacagtgacaag

SEQ ID NO: 691414 - DNA, 25 bp, Mus musculus
gctcttcttttacatgttccggaag

SEQ ID NO: 691415 - DNA, 25 bp, Mus musculus
gctcttcttttagatgttccggaag

SEQ ID NO: 691416 - DNA, 25 bp, Mus musculus
gctcttgaactacctctgagcatca

SEQ ID NO: 691417 - DNA, 25 bp, Mus musculus
gctcttgaactagctctgagcatca

SEQ ID NO: 691418 - DNA, 25 bp, Mus musculus
gctcttgagcccaggaacatgcatg

SEQ ID NO: 691419 - DNA, 25 bp, Mus musculus
gctcttgagccctggaacatgcatg

SEQ ID NO: 691420 - DNA, 25 bp, Mus musculus
gctcttgcacgacttggccaacctg

SEQ ID NO: 691421 - DNA, 25 bp, Mus musculus
gctcttgcacgagttggccaacctg

SEQ ID NO: 691422 - DNA, 25 bp, Mus musculus
gctcttgcagcccaaaacattgtgg

SEQ ID NO: 691423 - DNA, 25 bp, Mus musculus
gctcttgcagccgaaaacattgtgg

SEQ ID NO: 691424 - DNA, 25 bp, Mus musculus
gctcttgcctgtcaacaatggttaa

SEQ ID NO: 691425 - DNA, 25 bp, Mus musculus
gctcttgcctgtgaacaatggttaa

SEQ ID NO: 691426 - DNA, 25 bp, Mus musculus
gctcttgctggtctctggctcgctc

SEQ ID NO: 691427 - DNA, 25 bp, Mus musculus
gctcttgctggtgtctggctcgctc

SEQ ID NO: 691428 - DNA, 25 bp, Mus musculus
gctcttggagatatcagggaaactg

SEQ ID NO: 691429 - DNA, 25 bp, Mus musculus
gctcttggagatttcagggaaactg

SEQ ID NO: 691430 - DNA, 25 bp, Mus musculus
gctcttggagccacttcccggagcg

SEQ ID NO: 691431 - DNA, 25 bp, Mus musculus
gctcttggagcctcttcccggagcg

SEQ ID NO: 691432 - DNA, 25 bp, Mus musculus
gctcttggccaacctgagtgtacag

SEQ ID NO: 691433 - DNA, 25 bp, Mus musculus
gctcttggccaagctgagtgtacag

SEQ ID NO: 691434 - DNA, 25 bp, Mus musculus
gctcttggctaacgcactctcggaa

SEQ ID NO: 691435 - DNA, 25 bp, Mus musculus
gctcttggctaaggcactctcggaa

SEQ ID NO: 691436 - DNA, 25 bp, Mus musculus
gctcttggctcaaggagctgaccct

SEQ ID NO: 691437 - DNA, 25 bp, Mus musculus
gctcttggctcatggagctgaccct

SEQ ID NO: 691438 - DNA, 25 bp, Mus musculus
gctcttggctccaggatttgtgcag

SEQ ID NO: 691439 - DNA, 25 bp, Mus musculus
gctcttggctcctggatttgtgcag

SEQ ID NO: 691440 - DNA, 25 bp, Mus musculus
gctcttggctgacgccttgaaccaa

SEQ ID NO: 691441 - DNA, 25 bp, Mus musculus
gctcttggctgaggccttgaaccaa

SEQ ID NO: 691442 - DNA, 25 bp, Mus musculus
gctcttgggaacaacacgtgggcca

SEQ ID NO: 691443 - DNA, 25 bp, Mus musculus
gctcttgggaactacacgtgggcca

SEQ ID NO: 691444 - DNA, 25 bp, Mus musculus
gctcttggtcatctgaacagcacaa

SEQ ID NO: 691445 - DNA, 25 bp, Mus musculus
gctcttggtcatgtgaacagcacaa

SEQ ID NO: 691446 - DNA, 25 bp, Mus musculus
gctcttggtgtactactacgacgat

SEQ ID NO: 691447 - DNA, 25 bp, Mus musculus
gctcttggtgtagtactacgacgat

SEQ ID NO: 691448 - DNA, 25 bp, Mus musculus
gctcttggttttcgtcacagaagtg

SEQ ID NO: 691449 - DNA, 25 bp, Mus musculus
gctcttggttttggtcacagaagtg

SEQ ID NO: 691450 - DNA, 25 bp, Mus musculus
gctcttgtcctgcagacaatctggg

SEQ ID NO: 691451 - DNA, 25 bp, Mus musculus
gctcttgtcctggagacaatctggg

SEQ ID NO: 691452 - DNA, 25 bp, Mus musculus
gctcttgtctctctcggtgactgtc

SEQ ID NO: 691453 - DNA, 25 bp, Mus musculus
gctcttgtctctgtcggtgactgtc

SEQ ID NO: 691454 - DNA, 25 bp, Mus musculus
gctcttgtgcaaaattgatagctaa

SEQ ID NO: 691455 - DNA, 25 bp, Mus musculus
gctcttgtgcaatattgatagctaa

SEQ ID NO: 691456 - DNA, 25 bp, Mus musculus
gctcttgtgcagcaggaagaagaaa

SEQ ID NO: 691457 - DNA, 25 bp, Mus musculus
gctcttgtgcaggaggaagaagaaa

SEQ ID NO: 691458 - DNA, 25 bp, Mus musculus
gctcttgttggaaggatactacctg

SEQ ID NO: 691459 - DNA, 25 bp, Mus musculus
gctcttgttggatggatactacctg

SEQ ID NO: 691460 - DNA, 25 bp, Mus musculus
gctctttacctacaactgctgcttc

SEQ ID NO: 691461 - DNA, 25 bp, Mus musculus
gctctttacctagaactgctgcttc

SEQ ID NO: 691462 - DNA, 25 bp, Mus musculus
gctctttagccacattggaccttgt

SEQ ID NO: 691463 - DNA, 25 bp, Mus musculus
gctctttagccagattggaccttgt

SEQ ID NO: 691464 - DNA, 25 bp, Mus musculus
gctctttatagacattctgaacagg

SEQ ID NO: 691465 - DNA, 25 bp, Mus musculus
gctctttatagagattctgaacagg

SEQ ID NO: 691466 - DNA, 25 bp, Mus musculus
gctctttatgcccacgttagtggaa

SEQ ID NO: 691467 - DNA, 25 bp, Mus musculus
gctctttatgccgacgttagtggaa

SEQ ID NO: 691468 - DNA, 25 bp, Mus musculus
gctctttcctcaccgcagaagaggg

SEQ ID NO: 691469 - DNA, 25 bp, Mus musculus
gctctttcctcagcgcagaagaggg

SEQ ID NO: 691470 - DNA, 25 bp, Mus musculus
gctctttcttgtcgatatatcacac

SEQ ID NO: 691471 - DNA, 25 bp, Mus musculus
gctctttcttgtggatatatcacac

SEQ ID NO: 691472 - DNA, 25 bp, Mus musculus
gctctttgaggacttccgggactct

SEQ ID NO: 691473 - DNA, 25 bp, Mus musculus
gctctttgaggagttccgggactct

SEQ ID NO: 691474 - DNA, 25 bp, Mus musculus
gctctttgcactaggtgccctctgg

SEQ ID NO: 691475 - DNA, 25 bp, Mus musculus
gctctttgcacttggtgccctctgg

SEQ ID NO: 691476 - DNA, 25 bp, Mus musculus
gctctttgccaacgcggatggcctc

SEQ ID NO: 691477 - DNA, 25 bp, Mus musculus
gctctttgccaaggcggatggcctc

SEQ ID NO: 691478 - DNA, 25 bp, Mus musculus
gctctttgccataggttcccagcta

SEQ ID NO: 691479 - DNA, 25 bp, Mus musculus
gctctttgccattggttcccagcta

SEQ ID NO: 691480 - DNA, 25 bp, Mus musculus
gctctttgccgtcgtgaagacgatg

SEQ ID NO: 691481 - DNA, 25 bp, Mus musculus
gctctttgccgtggtgaagacgatg

SEQ ID NO: 691482 - DNA, 25 bp, Mus musculus
gctctttggcagactactatatccg

SEQ ID NO: 691483 - DNA, 25 bp, Mus musculus
gctctttggcagtctactatatccg

SEQ ID NO: 691484 - DNA, 25 bp, Mus musculus
gctctttggcctaaaaatgacttaa

SEQ ID NO: 691485 - DNA, 25 bp, Mus musculus
gctctttggccttaaaatgacttaa

SEQ ID NO: 691486 - DNA, 25 bp, Mus musculus
gctctttgtcgaagctagaggaccg

SEQ ID NO: 691487 - DNA, 25 bp, Mus musculus
gctctttgtcgatgctagaggaccg

SEQ ID NO: 691488 - DNA, 25 bp, Mus musculus
gctctttgtttaccgtcagaccaga

SEQ ID NO: 691489 - DNA, 25 bp, Mus musculus
gctctttgtttagcgtcagaccaga

SEQ ID NO: 691490 - DNA, 25 bp, Mus musculus
gctcttttaaaaccacagccaagaa

SEQ ID NO: 691491 - DNA, 25 bp, Mus musculus
gctcttttaaaagcacagccaagaa

SEQ ID NO: 691492 - DNA, 25 bp, Mus musculus
gctcttttaaccatgcatcctgctt

SEQ ID NO: 691493 - DNA, 25 bp, Mus musculus
gctcttttaaccttgcatcctgctt

SEQ ID NO: 691494 - DNA, 25 bp, Mus musculus
gctcttttagagatccctgcagcta

SEQ ID NO: 691495 - DNA, 25 bp, Mus musculus
gctcttttagagttccctgcagcta

SEQ ID NO: 691496 - DNA, 25 bp, Mus musculus
gctcttttcagtagcattagcagaa

SEQ ID NO: 691497 - DNA, 25 bp, Mus musculus
gctcttttcagttgcattagcagaa

SEQ ID NO: 691498 - DNA, 25 bp, Mus musculus
gctcttttctaccaggaagaaatac

SEQ ID NO: 691499 - DNA, 25 bp, Mus musculus
gctcttttctacgaggaagaaatac

SEQ ID NO: 691500 - DNA, 25 bp, Mus musculus
gctcttttgccacgtcagaggcaga

SEQ ID NO: 691501 - DNA, 25 bp, Mus musculus
gctcttttgccaggtcagaggcaga

SEQ ID NO: 691502 - DNA, 25 bp, Mus musculus
gctcttttggaacagcagaacacca

SEQ ID NO: 691503 - DNA, 25 bp, Mus musculus
gctcttttggaagagcagaacacca

SEQ ID NO: 691504 - DNA, 25 bp, Mus musculus
gctctttttgccagccttccctgga

SEQ ID NO: 691505 - DNA, 25 bp, Mus musculus
gctctttttgcctgccttccctgga

SEQ ID NO: 691506 - DNA, 25 bp, Mus musculus
gctgaaaaaacaccatcgctaacta

SEQ ID NO: 691507 - DNA, 25 bp, Mus musculus
gctgaaaaaacagcatcgctaacta

SEQ ID NO: 691508 - DNA, 25 bp, Mus musculus
gctgaaaaactcagacgcaatataa

SEQ ID NO: 691509 - DNA, 25 bp, Mus musculus
gctgaaaaactctgacgcaatataa

SEQ ID NO: 691510 - DNA, 25 bp, Mus musculus
gctgaaaagaaacctgaatgtgggc

SEQ ID NO: 691511 - DNA, 25 bp, Mus musculus
gctgaaaagaaagctgaatgtgggc

SEQ ID NO: 691512 - DNA, 25 bp, Mus musculus
gctgaaaagcaactatgaggacctc

SEQ ID NO: 691513 - DNA, 25 bp, Mus musculus
gctgaaaagcaagtatgaggacctc

SEQ ID NO: 691514 - DNA, 25 bp, Mus musculus
gctgaaacaccgcaagctccgggaa

SEQ ID NO: 691515 - DNA, 25 bp, Mus musculus
gctgaaacaccggaagctccgggaa

SEQ ID NO: 691516 - DNA, 25 bp, Mus musculus
gctgaaacaggacgactggaccttt

SEQ ID NO: 691517 - DNA, 25 bp, Mus musculus
gctgaaacaggaggactggaccttt

SEQ ID NO: 691518 - DNA, 25 bp, Mus musculus
gctgaaacatccaaagtgctccgtg

SEQ ID NO: 691519 - DNA, 25 bp, Mus musculus
gctgaaacatcctaagtgctccgtg

SEQ ID NO: 691520 - DNA, 25 bp, Mus musculus
gctgaaaccgaacagggaacagtgc

SEQ ID NO: 691521 - DNA, 25 bp, Mus musculus
gctgaaaccgaagagggaacagtgc

SEQ ID NO: 691522 - DNA, 25 bp, Mus musculus
gctgaaaccttacgagactactggg

SEQ ID NO: 691523 - DNA, 25 bp, Mus musculus
gctgaaaccttaggagactactggg

SEQ ID NO: 691524 - DNA, 25 bp, Mus musculus
gctgaaactgagcagcactttgaga

SEQ ID NO: 691525 - DNA, 25 bp, Mus musculus
gctgaaactgaggagcactttgaga

SEQ ID NO: 691526 - DNA, 25 bp, Mus musculus
gctgaaagagaacgctgcagagtac

SEQ ID NO: 691527 - DNA, 25 bp, Mus musculus
gctgaaagagaaggctgcagagtac

SEQ ID NO: 691528 - DNA, 25 bp, Mus musculus
gctgaaagatttcgaggtatctgca

SEQ ID NO: 691529 - DNA, 25 bp, Mus musculus
gctgaaagatttggaggtatctgca

SEQ ID NO: 691530 - DNA, 25 bp, Mus musculus
gctgaaagcagaaacaactggttct

SEQ ID NO: 691531 - DNA, 25 bp, Mus musculus
gctgaaagcagatacaactggttct

SEQ ID NO: 691532 - DNA, 25 bp, Mus musculus
gctgaaaggatgctcatgtttgatc

SEQ ID NO: 691533 - DNA, 25 bp, Mus musculus
gctgaaaggatggtcatgtttgatc

SEQ ID NO: 691534 - DNA, 25 bp, Mus musculus
gctgaaagggctcgacacttacttc

SEQ ID NO: 691535 - DNA, 25 bp, Mus musculus
gctgaaagggctggacacttacttc

SEQ ID NO: 691536 - DNA, 25 bp, Mus musculus
gctgaaagtggacccgctcagcgca

SEQ ID NO: 691537 - DNA, 25 bp, Mus musculus
gctgaaagtggagccgctcagcgca

SEQ ID NO: 691538 - DNA, 25 bp, Mus musculus
gctgaaagttctacttctaatagac

SEQ ID NO: 691539 - DNA, 25 bp, Mus musculus
gctgaaagttcttcttctaatagac

SEQ ID NO: 691540 - DNA, 25 bp, Mus musculus
gctgaaatatctcgaacaattcctc

SEQ ID NO: 691541 - DNA, 25 bp, Mus musculus
gctgaaatatctggaacaattcctc

SEQ ID NO: 691542 - DNA, 25 bp, Mus musculus
gctgaaatcagactccacacagtgg

SEQ ID NO: 691543 - DNA, 25 bp, Mus musculus
gctgaaatcagagtccacacagtgg

SEQ ID NO: 691544 - DNA, 25 bp, Mus musculus
gctgaaatcatcatccttgtggtga

SEQ ID NO: 691545 - DNA, 25 bp, Mus musculus
gctgaaatcatcttccttgtggtga

SEQ ID NO: 691546 - DNA, 25 bp, Mus musculus
gctgaaatcgaaaacccgctggagg

SEQ ID NO: 691547 - DNA, 25 bp, Mus musculus
gctgaaatcgaacaaacctatgcaa

SEQ ID NO: 691548 - DNA, 25 bp, Mus musculus
gctgaaatcgaagaaacctatgcaa

SEQ ID NO: 691549 - DNA, 25 bp, Mus musculus
gctgaaatcgaatacccgctggagg

SEQ ID NO: 691550 - DNA, 25 bp, Mus musculus
gctgaaatgcctaggtatcaaagaa

SEQ ID NO: 691551 - DNA, 25 bp, Mus musculus
gctgaaatgccttggtatcaaagaa

SEQ ID NO: 691552 - DNA, 25 bp, Mus musculus
gctgaaattcatactgcaaaaacag

SEQ ID NO: 691553 - DNA, 25 bp, Mus musculus
gctgaaattcattctgcaaaaacag

SEQ ID NO: 691554 - DNA, 25 bp, Mus musculus
gctgaaattgtcaggagctcctccg

SEQ ID NO: 691555 - DNA, 25 bp, Mus musculus
gctgaaattgtctggagctcctccg

SEQ ID NO: 691556 - DNA, 25 bp, Mus musculus
gctgaaatttctcgctaaaggagag

SEQ ID NO: 691557 - DNA, 25 bp, Mus musculus
gctgaaatttctggctaaaggagag

SEQ ID NO: 691558 - DNA, 25 bp, Mus musculus
gctgaaatttgcagaatgcttagaa

SEQ ID NO: 691559 - DNA, 25 bp, Mus musculus
gctgaaatttgctgaatgcttagaa

SEQ ID NO: 691560 - DNA, 25 bp, Mus musculus
gctgaacaaggaatgctgcccgcct

SEQ ID NO: 691561 - DNA, 25 bp, Mus musculus
gctgaacaaggattgctgcccgcct

SEQ ID NO: 691562 - DNA, 25 bp, Mus musculus
gctgaacacttgaaggtggtaggca

SEQ ID NO: 691563 - DNA, 25 bp, Mus musculus
gctgaacacttgtaggtggtaggca

SEQ ID NO: 691564 - DNA, 25 bp, Mus musculus
gctgaacagaagagaagggatgcta

SEQ ID NO: 691565 - DNA, 25 bp, Mus musculus
gctgaacagaagtgaagggatgcta

SEQ ID NO: 691566 - DNA, 25 bp, Mus musculus
gctgaacagcaaccctggagagaag

SEQ ID NO: 691567 - DNA, 25 bp, Mus musculus
gctgaacagcaagcctggagagaag

SEQ ID NO: 691568 - DNA, 25 bp, Mus musculus
gctgaacagtgaattgcaacagcaa

SEQ ID NO: 691569 - DNA, 25 bp, Mus musculus
gctgaacagtgatttgcaacagcaa

SEQ ID NO: 691570 - DNA, 25 bp, Mus musculus
gctgaaccagcactttcaagaacca

SEQ ID NO: 691571 - DNA, 25 bp, Mus musculus
gctgaaccagcagtttcaagaacca

SEQ ID NO: 691572 - DNA, 25 bp, Mus musculus
gctgaaccagccacgtggaagacga

SEQ ID NO: 691573 - DNA, 25 bp, Mus musculus
gctgaaccagcctcgtggaagacga

SEQ ID NO: 691574 - DNA, 25 bp, Mus musculus
gctgaacccagccttcaatgagaca

SEQ ID NO: 691575 - DNA, 25 bp, Mus musculus
gctgaacccagcgttcaatgagaca

SEQ ID NO: 691576 - DNA, 25 bp, Mus musculus
gctgaaccctaaagatgctacttca

SEQ ID NO: 691577 - DNA, 25 bp, Mus musculus
gctgaaccctaatgatgctacttca

SEQ ID NO: 691578 - DNA, 25 bp, Mus musculus
gctgaaccctatagaagacagacct

SEQ ID NO: 691579 - DNA, 25 bp, Mus musculus
gctgaaccctattgaagacagacct

SEQ ID NO: 691580 - DNA, 25 bp, Mus musculus
gctgaaccgcaccttggctgtacct

SEQ ID NO: 691581 - DNA, 25 bp, Mus musculus
gctgaaccgcacgttggctgtacct

SEQ ID NO: 691582 - DNA, 25 bp, Mus musculus
gctgaacctcatctgacagtgggct

SEQ ID NO: 691583 - DNA, 25 bp, Mus musculus
gctgaacctcatgtgacagtgggct

SEQ ID NO: 691584 - DNA, 25 bp, Mus musculus
gctgaacctgttagcctatggtaca

SEQ ID NO: 691585 - DNA, 25 bp, Mus musculus
gctgaacctgtttgcctatggtaca

SEQ ID NO: 691586 - DNA, 25 bp, Mus musculus
gctgaacgagctagaaccggagaag

SEQ ID NO: 691587 - DNA, 25 bp, Mus musculus
gctgaacgagcttgaaccggagaag

SEQ ID NO: 691588 - DNA, 25 bp, Mus musculus
gctgaacggattcgaggccatgtcc

SEQ ID NO: 691589 - DNA, 25 bp, Mus musculus
gctgaacggattggaggccatgtcc

SEQ ID NO: 691590 - DNA, 25 bp, Mus musculus
gctgaacgggtcaagaagtggattc

SEQ ID NO: 691591 - DNA, 25 bp, Mus musculus
gctgaacgggtctagaagtggattc

SEQ ID NO: 691592 - DNA, 25 bp, Mus musculus
gctgaacgttgaccattatagagca

SEQ ID NO: 691593 - DNA, 25 bp, Mus musculus
gctgaacgttgagcattatagagca

SEQ ID NO: 691594 - DNA, 25 bp, Mus musculus
gctgaactaaacaccaccatgaaga

SEQ ID NO: 691595 - DNA, 25 bp, Mus musculus
gctgaactaaactccaccatgaaga

SEQ ID NO: 691596 - DNA, 25 bp, Mus musculus
gctgaactaccacgtgtctgagatc

SEQ ID NO: 691597 - DNA, 25 bp, Mus musculus
gctgaactaccaggtgtctgagatc

SEQ ID NO: 691598 - DNA, 25 bp, Mus musculus
gctgaactacttaaaccaacccaat

SEQ ID NO: 691599 - DNA, 25 bp, Mus musculus
gctgaactactttaaccaacccaat

SEQ ID NO: 691600 - DNA, 25 bp, Mus musculus
gctgaactcaatcagacctgggagg

SEQ ID NO: 691601 - DNA, 25 bp, Mus musculus
gctgaactcaatgagacctgggagg

SEQ ID NO: 691602 - DNA, 25 bp, Mus musculus
gctgaactcacgcatgtgacctttg

SEQ ID NO: 691603 - DNA, 25 bp, Mus musculus
gctgaactcacggatgtgacctttg

SEQ ID NO: 691604 - DNA, 25 bp, Mus musculus
gctgaactcagtaaccacacacggc

SEQ ID NO: 691605 - DNA, 25 bp, Mus musculus
gctgaactcagttaccacacacggc

SEQ ID NO: 691606 - DNA, 25 bp, Mus musculus
gctgaactccgtctccttaccgtgg

SEQ ID NO: 691607 - DNA, 25 bp, Mus musculus
gctgaactccgtgtccttaccgtgg

SEQ ID NO: 691608 - DNA, 25 bp, Mus musculus
gctgaactgctacaccagtgttggg

SEQ ID NO: 691609 - DNA, 25 bp, Mus musculus
gctgaactgctagaccagtgttggg

SEQ ID NO: 691610 - DNA, 25 bp, Mus musculus
gctgaactgggtcactatgatgccg

SEQ ID NO: 691611 - DNA, 25 bp, Mus musculus
gctgaactgggtgactatgatgccg

SEQ ID NO: 691612 - DNA, 25 bp, Mus musculus
gctgaacttgatacattaagtgaag

SEQ ID NO: 691613 - DNA, 25 bp, Mus musculus
gctgaacttgattcattaagtgaag

SEQ ID NO: 691614 - DNA, 25 bp, Mus musculus
gctgaactttgtaagcaagagggaa

SEQ ID NO: 691615 - DNA, 25 bp, Mus musculus
gctgaactttgttagcaagagggaa

SEQ ID NO: 691616 - DNA, 25 bp, Mus musculus
gctgaagaaaaaacagagcaatggt

SEQ ID NO: 691617 - DNA, 25 bp, Mus musculus
gctgaagaaaaatcagagcaatggt

SEQ ID NO: 691618 - DNA, 25 bp, Mus musculus
gctgaagaaacgaatgcagggcccc

SEQ ID NO: 691619 - DNA, 25 bp, Mus musculus
gctgaagaaacgtatgcagggcccc

SEQ ID NO: 691620 - DNA, 25 bp, Mus musculus
gctgaagaacatctcgcagcgcatc

SEQ ID NO: 691621 - DNA, 25 bp, Mus musculus
gctgaagaacatgtcgcagcgcatc

SEQ ID NO: 691622 - DNA, 25 bp, Mus musculus
gctgaagaaggcaacctatgacaag

SEQ ID NO: 691623 - DNA, 25 bp, Mus musculus
gctgaagaaggctacctatgacaag

SEQ ID NO: 691624 - DNA, 25 bp, Mus musculus
gctgaagaagtgacaccaatgtgtt

SEQ ID NO: 691625 - DNA, 25 bp, Mus musculus
gctgaagaagtgtcaccaatgtgtt

SEQ ID NO: 691626 - DNA, 25 bp, Mus musculus
gctgaagacaataaacctgcagagc

SEQ ID NO: 691627 - DNA, 25 bp, Mus musculus
gctgaagacaattaacctgcagagc

SEQ ID NO: 691628 - DNA, 25 bp, Mus musculus
gctgaagaccatccttgccaaaacg

SEQ ID NO: 691629 - DNA, 25 bp, Mus musculus
gctgaagaccatgcttgccaaaacg

SEQ ID NO: 691630 - DNA, 25 bp, Mus musculus
gctgaagacgctcttgaagactgaa

SEQ ID NO: 691631 - DNA, 25 bp, Mus musculus
gctgaagacgctgttgaagactgaa

SEQ ID NO: 691632 - DNA, 25 bp, Mus musculus
gctgaagactaacaccctaagggaa

SEQ ID NO: 691633 - DNA, 25 bp, Mus musculus
gctgaagactaagaccctaagggaa

SEQ ID NO: 691634 - DNA, 25 bp, Mus musculus
gctgaagactgcatggattggctcc

SEQ ID NO: 691635 - DNA, 25 bp, Mus musculus
gctgaagactgcttggattggctcc

SEQ ID NO: 691636 - DNA, 25 bp, Mus musculus
gctgaagacttacagattctgccta

SEQ ID NO: 691637 - DNA, 25 bp, Mus musculus
gctgaagacttagagattctgccta

SEQ ID NO: 691638 - DNA, 25 bp, Mus musculus
gctgaagactttaaagaagataccc

SEQ ID NO: 691639 - DNA, 25 bp, Mus musculus
gctgaagacttttaagaagataccc

SEQ ID NO: 691640 - DNA, 25 bp, Mus musculus
gctgaagagcccataaccaggaaag

SEQ ID NO: 691641 - DNA, 25 bp, Mus musculus
gctgaagagcccttaaccaggaaag

SEQ ID NO: 691642 - DNA, 25 bp, Mus musculus
gctgaagaggaacatggtttcctgt

SEQ ID NO: 691643 - DNA, 25 bp, Mus musculus
gctgaagaggaagatggtttcctgt

SEQ ID NO: 691644 - DNA, 25 bp, Mus musculus
gctgaagagttccatccctacatcc

SEQ ID NO: 691645 - DNA, 25 bp, Mus musculus
gctgaagagttcgatccctacatcc

SEQ ID NO: 691646 - DNA, 25 bp, Mus musculus
gctgaagatccgaagagtactgcac

SEQ ID NO: 691647 - DNA, 25 bp, Mus musculus
gctgaagatccgtagagtactgcac

SEQ ID NO: 691648 - DNA, 25 bp, Mus musculus
gctgaagatgacctgttgagccagt

SEQ ID NO: 691649 - DNA, 25 bp, Mus musculus
gctgaagatgacgtgttgagccagt

SEQ ID NO: 691650 - DNA, 25 bp, Mus musculus
gctgaagatgctcaccggaagtatg

SEQ ID NO: 691651 - DNA, 25 bp, Mus musculus
gctgaagatgctgaccggaagtatg

SEQ ID NO: 691652 - DNA, 25 bp, Mus musculus
gctgaagcacatcaaacacgaaaat

SEQ ID NO: 691653 - DNA, 25 bp, Mus musculus
gctgaagcacatgaaacacgaaaat

SEQ ID NO: 691654 - DNA, 25 bp, Mus musculus
gctgaagcaccactgtatgtgcgga

SEQ ID NO: 691655 - DNA, 25 bp, Mus musculus
gctgaagcaccagtgtatgtgcgga

SEQ ID NO: 691656 - DNA, 25 bp, Mus musculus
gctgaagcagccacaagactatttc

SEQ ID NO: 691657 - DNA, 25 bp, Mus musculus
gctgaagcagcctcaagactatttc

SEQ ID NO: 691658 - DNA, 25 bp, Mus musculus
gctgaagcaggacctacgccatctg

SEQ ID NO: 691659 - DNA, 25 bp, Mus musculus
gctgaagcaggagctacgccatctg

SEQ ID NO: 691660 - DNA, 25 bp, Mus musculus
gctgaagcagtaagattgttgtaag

SEQ ID NO: 691661 - DNA, 25 bp, Mus musculus
gctgaagcagtatgattgttgtaag

SEQ ID NO: 691662 - DNA, 25 bp, Mus musculus
gctgaagcagttcgatgcctaccct

SEQ ID NO: 691663 - DNA, 25 bp, Mus musculus
gctgaagcagttggatgcctaccct

SEQ ID NO: 691664 - DNA, 25 bp, Mus musculus
gctgaagcatcacaagcgctgtaag

SEQ ID NO: 691665 - DNA, 25 bp, Mus musculus
gctgaagcatcagaagcgctgtaag

SEQ ID NO: 691666 - DNA, 25 bp, Mus musculus
gctgaagccaggaaccagagttgct

SEQ ID NO: 691667 - DNA, 25 bp, Mus musculus
gctgaagccaggtaccagagttgct

SEQ ID NO: 691668 - DNA, 25 bp, Mus musculus
gctgaagctgacctagcttctctga

SEQ ID NO: 691669 - DNA, 25 bp, Mus musculus
gctgaagctgacgtagcttctctga

SEQ ID NO: 691670 - DNA, 25 bp, Mus musculus
gctgaagcttcgcatgcagaaggct

SEQ ID NO: 691671 - DNA, 25 bp, Mus musculus
gctgaagcttcggatgcagaaggct

SEQ ID NO: 691672 - DNA, 25 bp, Mus musculus
gctgaaggacgccagcgacaatgca

SEQ ID NO: 691673 - DNA, 25 bp, Mus musculus
gctgaaggacgcgagcgacaatgca

SEQ ID NO: 691674 - DNA, 25 bp, Mus musculus
gctgaaggagatcccgtacactaaa

SEQ ID NO: 691675 - DNA, 25 bp, Mus musculus
gctgaaggagatgccgtacactaaa

SEQ ID NO: 691676 - DNA, 25 bp, Mus musculus
gctgaaggagcacggcccagaaaac

SEQ ID NO: 691677 - DNA, 25 bp, Mus musculus
gctgaaggagcagggcccagaaaac

SEQ ID NO: 691678 - DNA, 25 bp, Mus musculus
gctgaaggaggtcgtaaaagacacc

SEQ ID NO: 691679 - DNA, 25 bp, Mus musculus
gctgaaggaggtggtaaaagacacc

SEQ ID NO: 691680 - DNA, 25 bp, Mus musculus
gctgaaggatacagggctgacttca

SEQ ID NO: 691681 - DNA, 25 bp, Mus musculus
gctgaaggatactgggctgacttca

SEQ ID NO: 691682 - DNA, 25 bp, Mus musculus
gctgaaggcaatacagaaagccaaa

SEQ ID NO: 691683 - DNA, 25 bp, Mus musculus
gctgaaggcaattcagaaagccaaa

SEQ ID NO: 691684 - DNA, 25 bp, Mus musculus
gctgaaggcattccaggtagcccat

SEQ ID NO: 691685 - DNA, 25 bp, Mus musculus
gctgaaggcattgcaggtagcccat

SEQ ID NO: 691686 - DNA, 25 bp, Mus musculus
gctgaaggctctcgcagcagatgac

SEQ ID NO: 691687 - DNA, 25 bp, Mus musculus
gctgaaggctctggcagcagatgac

SEQ ID NO: 691688 - DNA, 25 bp, Mus musculus
gctgaaggctgtcgaacacatcaac

SEQ ID NO: 691689 - DNA, 25 bp, Mus musculus
gctgaaggctgtggaacacatcaac

SEQ ID NO: 691690 - DNA, 25 bp, Mus musculus
gctgaaggtcatatccaagtccatg

SEQ ID NO: 691691 - DNA, 25 bp, Mus musculus
gctgaaggtcatttccaagtccatg

SEQ ID NO: 691692 - DNA, 25 bp, Mus musculus
gctgaaggtcgccagtgccctgtca

SEQ ID NO: 691693 - DNA, 25 bp, Mus musculus
gctgaaggtcgcgagtgccctgtca

SEQ ID NO: 691694 - DNA, 25 bp, Mus musculus
gctgaagtacagagcaaccggggct

SEQ ID NO: 691695 - DNA, 25 bp, Mus musculus
gctgaagtacagtgcaaccggggct

SEQ ID NO: 691696 - DNA, 25 bp, Mus musculus
gctgaagtcctgagtggaattggcc

SEQ ID NO: 691697 - DNA, 25 bp, Mus musculus
gctgaagtcctgtgtggaattggcc

SEQ ID NO: 691698 - DNA, 25 bp, Mus musculus
gctgaagtcgttcctcctgggctgt

SEQ ID NO: 691699 - DNA, 25 bp, Mus musculus
gctgaagtcgttgctcctgggctgt

SEQ ID NO: 691700 - DNA, 25 bp, Mus musculus
gctgaagtgagtccaggatgctctt

SEQ ID NO: 691701 - DNA, 25 bp, Mus musculus
gctgaagtgagtgcaggatgctctt

SEQ ID NO: 691702 - DNA, 25 bp, Mus musculus
gctgaagtggaaagaacaagtgaaa

SEQ ID NO: 691703 - DNA, 25 bp, Mus musculus
gctgaagtggaatgaacaagtgaaa

SEQ ID NO: 691704 - DNA, 25 bp, Mus musculus
gctgaagtggtaatagggaacatca

SEQ ID NO: 691705 - DNA, 25 bp, Mus musculus
gctgaagtggtattagggaacatca

SEQ ID NO: 691706 - DNA, 25 bp, Mus musculus
gctgaagtggtcagtccaaatccca

SEQ ID NO: 691707 - DNA, 25 bp, Mus musculus
gctgaagtggtctgtccaaatccca

SEQ ID NO: 691708 - DNA, 25 bp, Mus musculus
gctgaataaggacaccttagggttc

SEQ ID NO: 691709 - DNA, 25 bp, Mus musculus
gctgaataaggagaccttagggttc

SEQ ID NO: 691710 - DNA, 25 bp, Mus musculus
gctgaatagaagaggtgaacactgg

SEQ ID NO: 691711 - DNA, 25 bp, Mus musculus
gctgaatagaagtggtgaacactgg

SEQ ID NO: 691712 - DNA, 25 bp, Mus musculus
gctgaatagctgctgcctgcggcct

SEQ ID NO: 691713 - DNA, 25 bp, Mus musculus
gctgaatagctggtgcctgcggcct

SEQ ID NO: 691714 - DNA, 25 bp, Mus musculus
gctgaatatactatcattaaccctg

SEQ ID NO: 691715 - DNA, 25 bp, Mus musculus
gctgaatatactttcattaaccctg

SEQ ID NO: 691716 - DNA, 25 bp, Mus musculus
gctgaatatcttcctgcagagagag

SEQ ID NO: 691717 - DNA, 25 bp, Mus musculus
gctgaatatcttgctgcagagagag

SEQ ID NO: 691718 - DNA, 25 bp, Mus musculus
gctgaatatgacactccaaagaggg

SEQ ID NO: 691719 - DNA, 25 bp, Mus musculus
gctgaatatgactctccaaagaggg

SEQ ID NO: 691720 - DNA, 25 bp, Mus musculus
gctgaatcagtaccttgcaaatgtg

SEQ ID NO: 691721 - DNA, 25 bp, Mus musculus
gctgaatcagtagcttgcaaatgtg

SEQ ID NO: 691722 - DNA, 25 bp, Mus musculus
gctgaatcgcacctaggtggtacct

SEQ ID NO: 691723 - DNA, 25 bp, Mus musculus
gctgaatcgcacgtaggtggtacct

SEQ ID NO: 691724 - DNA, 25 bp, Mus musculus
gctgaatgaaatccgtaggctggaa

SEQ ID NO: 691725 - DNA, 25 bp, Mus musculus
gctgaatgaaatgcgtaggctggaa

SEQ ID NO: 691726 - DNA, 25 bp, Mus musculus
gctgaatgaagtagggccagacgct

SEQ ID NO: 691727 - DNA, 25 bp, Mus musculus
gctgaatgaagttgggccagacgct

SEQ ID NO: 691728 - DNA, 25 bp, Mus musculus
gctgaatgacaccaaaagccctcct

SEQ ID NO: 691729 - DNA, 25 bp, Mus musculus
gctgaatgacacgaaaagccctcct

SEQ ID NO: 691730 - DNA, 25 bp, Mus musculus
gctgaatgactccaaagagtaccca

SEQ ID NO: 691731 - DNA, 25 bp, Mus musculus
gctgaatgactcgaaagagtaccca

SEQ ID NO: 691732 - DNA, 25 bp, Mus musculus
gctgaatgcaagcagagccaggaaa

SEQ ID NO: 691733 - DNA, 25 bp, Mus musculus
gctgaatgcaaggagagccaggaaa

SEQ ID NO: 691734 - DNA, 25 bp, Mus musculus
gctgaatgcagcctttgccctggcg

SEQ ID NO: 691735 - DNA, 25 bp, Mus musculus
gctgaatgcagcgtttgccctggcg

SEQ ID NO: 691736 - DNA, 25 bp, Mus musculus
gctgaatgcagtccgcaggcaagct

SEQ ID NO: 691737 - DNA, 25 bp, Mus musculus
gctgaatgcagtgcgcaggcaagct

SEQ ID NO: 691738 - DNA, 25 bp, Mus musculus
gctgaatgccatcccaatgctacta

SEQ ID NO: 691739 - DNA, 25 bp, Mus musculus
gctgaatgccatgccaatgctacta

SEQ ID NO: 691740 - DNA, 25 bp, Mus musculus
gctgaatgccttccgtaggaagcat

SEQ ID NO: 691741 - DNA, 25 bp, Mus musculus
gctgaatgccttgcgtaggaagcat

SEQ ID NO: 691742 - DNA, 25 bp, Mus musculus
gctgaatgggatatgcgcccaggtt

SEQ ID NO: 691743 - DNA, 25 bp, Mus musculus
gctgaatgggatttgcgcccaggtt

SEQ ID NO: 691744 - DNA, 25 bp, Mus musculus
gctgaatgtgacagaagccctgagt

SEQ ID NO: 691745 - DNA, 25 bp, Mus musculus
gctgaatgtgactgaagccctgagt

SEQ ID NO: 691746 - DNA, 25 bp, Mus musculus
gctgaattacttcaggactgccaaa

SEQ ID NO: 691747 - DNA, 25 bp, Mus musculus
gctgaattacttgaggactgccaaa

SEQ ID NO: 691748 - DNA, 25 bp, Mus musculus
gctgaattcattcatagccttagtg

SEQ ID NO: 691749 - DNA, 25 bp, Mus musculus
gctgaattcattgatagccttagtg

SEQ ID NO: 691750 - DNA, 25 bp, Mus musculus
gctgaattctggagactacaagacc

SEQ ID NO: 691751 - DNA, 25 bp, Mus musculus
gctgaattctggtgactacaagacc

SEQ ID NO: 691752 - DNA, 25 bp, Mus musculus
gctgaattgactaatttggatccac

SEQ ID NO: 691753 - DNA, 25 bp, Mus musculus
gctgaattgacttatttggatccac

SEQ ID NO: 691754 - DNA, 25 bp, Mus musculus
gctgaattgcatcatcagcagatgg

SEQ ID NO: 691755 - DNA, 25 bp, Mus musculus
gctgaattgcatgatcagcagatgg

SEQ ID NO: 691756 - DNA, 25 bp, Mus musculus
gctgaatttcgtaatgacagaatat

SEQ ID NO: 691757 - DNA, 25 bp, Mus musculus
gctgaatttcgttatgacagaatat

SEQ ID NO: 691758 - DNA, 25 bp, Mus musculus
gctgaatttttcaagcagtgaactc

SEQ ID NO: 691759 - DNA, 25 bp, Mus musculus
gctgaatttttctagcagtgaactc

SEQ ID NO: 691760 - DNA, 25 bp, Mus musculus
gctgacaacacacacgttacccttg

SEQ ID NO: 691761 - DNA, 25 bp, Mus musculus
gctgacaacacagacgttacccttg

SEQ ID NO: 691762 - DNA, 25 bp, Mus musculus
gctgacaacagcatgcaaagaatcc

SEQ ID NO: 691763 - DNA, 25 bp, Mus musculus
gctgacaacagcttgcaaagaatcc

SEQ ID NO: 691764 - DNA, 25 bp, Mus musculus
gctgacaagactctgcaaaataaat

SEQ ID NO: 691765 - DNA, 25 bp, Mus musculus
gctgacaagactgtgcaaaataaat

SEQ ID NO: 691766 - DNA, 25 bp, Mus musculus
gctgacaaggaacgaatggacagaa

SEQ ID NO: 691767 - DNA, 25 bp, Mus musculus
gctgacaaggaaggaatggacagaa

SEQ ID NO: 691768 - DNA, 25 bp, Mus musculus
gctgacaaggctcccggtggagcgg

SEQ ID NO: 691769 - DNA, 25 bp, Mus musculus
gctgacaaggctgccggtggagcgg

SEQ ID NO: 691770 - DNA, 25 bp, Mus musculus
gctgacaagtaaccacggacaggcc

SEQ ID NO: 691771 - DNA, 25 bp, Mus musculus
gctgacaagtaagcacggacaggcc

SEQ ID NO: 691772 - DNA, 25 bp, Mus musculus
gctgacaatctcaaaaaacgcggag

SEQ ID NO: 691773 - DNA, 25 bp, Mus musculus
gctgacaatctctaaaaacgcggag

SEQ ID NO: 691774 - DNA, 25 bp, Mus musculus
gctgacacactaagtcgcacgtccg

SEQ ID NO: 691775 - DNA, 25 bp, Mus musculus
gctgacacactatgtcgcacgtccg

SEQ ID NO: 691776 - DNA, 25 bp, Mus musculus
gctgacacagagcacagtttctcta

SEQ ID NO: 691777 - DNA, 25 bp, Mus musculus
gctgacacagaggacagtttctcta

SEQ ID NO: 691778 - DNA, 25 bp, Mus musculus
gctgacacagttcgtgaccctcggg

SEQ ID NO: 691779 - DNA, 25 bp, Mus musculus
gctgacacagttggtgaccctcggg

SEQ ID NO: 691780 - DNA, 25 bp, Mus musculus
gctgacacattgcagatactggccc

SEQ ID NO: 691781 - DNA, 25 bp, Mus musculus
gctgacacattggagatactggccc

SEQ ID NO: 691782 - DNA, 25 bp, Mus musculus
gctgacacctggcaaaaaatgctac

SEQ ID NO: 691783 - DNA, 25 bp, Mus musculus
gctgacacctgggaaaaaatgctac

SEQ ID NO: 691784 - DNA, 25 bp, Mus musculus
gctgacactgaccaatgtcactggg

SEQ ID NO: 691785 - DNA, 25 bp, Mus musculus
gctgacactgacgaatgtcactggg

SEQ ID NO: 691786 - DNA, 25 bp, Mus musculus
gctgacactggaagccccactggat

SEQ ID NO: 691787 - DNA, 25 bp, Mus musculus
gctgacactggatgccccactggat

SEQ ID NO: 691788 - DNA, 25 bp, Mus musculus
gctgacactggcaaatgggaaccaa

SEQ ID NO: 691789 - DNA, 25 bp, Mus musculus
gctgacactggctaatgggaaccaa

SEQ ID NO: 691790 - DNA, 25 bp, Mus musculus
gctgacacttggaaagcctcttgga

SEQ ID NO: 691791 - DNA, 25 bp, Mus musculus
gctgacacttggtaagcctcttgga

SEQ ID NO: 691792 - DNA, 25 bp, Mus musculus
gctgacagaaggctatccgcctaca

SEQ ID NO: 691793 - DNA, 25 bp, Mus musculus
gctgacagaagggtatccgcctaca

SEQ ID NO: 691794 - DNA, 25 bp, Mus musculus
gctgacagaagtcacaatgtagacc

SEQ ID NO: 691795 - DNA, 25 bp, Mus musculus
gctgacagaagtgacaatgtagacc

SEQ ID NO: 691796 - DNA, 25 bp, Mus musculus
gctgacagacaaccatgcacctgag

SEQ ID NO: 691797 - DNA, 25 bp, Mus musculus
gctgacagacaagcatgcacctgag

SEQ ID NO: 691798 - DNA, 25 bp, Mus musculus
gctgacagagagactatcaacctga

SEQ ID NO: 691799 - DNA, 25 bp, Mus musculus
gctgacagagagtctatcaacctga

SEQ ID NO: 691800 - DNA, 25 bp, Mus musculus
gctgacagaggtcttcacccagagg

SEQ ID NO: 691801 - DNA, 25 bp, Mus musculus
gctgacagaggtgttcacccagagg

SEQ ID NO: 691802 - DNA, 25 bp, Mus musculus
gctgacagcaatctggtgttggaca

SEQ ID NO: 691803 - DNA, 25 bp, Mus musculus
gctgacagcaatgtggtgttggaca

SEQ ID NO: 691804 - DNA, 25 bp, Mus musculus
gctgacagccgcagaacgtattcac

SEQ ID NO: 691805 - DNA, 25 bp, Mus musculus
gctgacagccgctgaacgtattcac

SEQ ID NO: 691806 - DNA, 25 bp, Mus musculus
gctgacagtggaagaacatgtttgg

SEQ ID NO: 691807 - DNA, 25 bp, Mus musculus
gctgacagtggatgaacatgtttgg

SEQ ID NO: 691808 - DNA, 25 bp, Mus musculus
gctgacagttacagaaagaaggtgg

SEQ ID NO: 691809 - DNA, 25 bp, Mus musculus
gctgacagttactgaaagaaggtgg

SEQ ID NO: 691810 - DNA, 25 bp, Mus musculus
gctgacatctatccaatgggcttag

SEQ ID NO: 691811 - DNA, 25 bp, Mus musculus
gctgacatctatgcaatgggcttag

SEQ ID NO: 691812 - DNA, 25 bp, Mus musculus
gctgacatctgtccgaaactctgcc

SEQ ID NO: 691813 - DNA, 25 bp, Mus musculus
gctgacatctgtgcgaaactctgcc

SEQ ID NO: 691814 - DNA, 25 bp, Mus musculus
gctgacatgatcaaactcagaactc

SEQ ID NO: 691815 - DNA, 25 bp, Mus musculus
gctgacatgatctaactcagaactc

SEQ ID NO: 691816 - DNA, 25 bp, Mus musculus
gctgacatgattccttgcatcctgc

SEQ ID NO: 691817 - DNA, 25 bp, Mus musculus
gctgacatgattgcttgcatcctgc

SEQ ID NO: 691818 - DNA, 25 bp, Mus musculus
gctgacatggagctgacagtcctaa

SEQ ID NO: 691819 - DNA, 25 bp, Mus musculus
gctgacatggaggtgacagtcctaa

SEQ ID NO: 691820 - DNA, 25 bp, Mus musculus
gctgacatggcccagttcttgacct

SEQ ID NO: 691821 - DNA, 25 bp, Mus musculus
gctgacatggccgagttcttgacct

SEQ ID NO: 691822 - DNA, 25 bp, Mus musculus
gctgacatgggacacttaaagtatt

SEQ ID NO: 691823 - DNA, 25 bp, Mus musculus
gctgacatgggagacttaaagtatt

SEQ ID NO: 691824 - DNA, 25 bp, Mus musculus
gctgacattaagcaccagccagaaa

SEQ ID NO: 691825 - DNA, 25 bp, Mus musculus
gctgacattaaggaccagccagaaa

SEQ ID NO: 691826 - DNA, 25 bp, Mus musculus
gctgacattcctatgatgttaaaat

SEQ ID NO: 691827 - DNA, 25 bp, Mus musculus
gctgacattcctttgatgttaaaat

SEQ ID NO: 691828 - DNA, 25 bp, Mus musculus
gctgacattctgcttatcgctgcct

SEQ ID NO: 691829 - DNA, 25 bp, Mus musculus
gctgacattctggttatcgctgcct

SEQ ID NO: 691830 - DNA, 25 bp, Mus musculus
gctgacattgctcatcaattgctca

SEQ ID NO: 691831 - DNA, 25 bp, Mus musculus
gctgacattgctgatcaattgctca

SEQ ID NO: 691832 - DNA, 25 bp, Mus musculus
gctgaccaattcatttgaccttgaa

SEQ ID NO: 691833 - DNA, 25 bp, Mus musculus
gctgaccaattcttttgaccttgaa

SEQ ID NO: 691834 - DNA, 25 bp, Mus musculus
gctgaccacagtcgctatgccggag

SEQ ID NO: 691835 - DNA, 25 bp, Mus musculus
gctgaccacagtggctatgccggag

SEQ ID NO: 691836 - DNA, 25 bp, Mus musculus
gctgaccactcacaagcaagcggca

SEQ ID NO: 691837 - DNA, 25 bp, Mus musculus
gctgaccactcagaagcaagcggca

SEQ ID NO: 691838 - DNA, 25 bp, Mus musculus
gctgaccagggacgcaactccaaat

SEQ ID NO: 691839 - DNA, 25 bp, Mus musculus
gctgaccagggaggcaactccaaat

SEQ ID NO: 691840 - DNA, 25 bp, Mus musculus
gctgaccagttcctgcagctgtcca

SEQ ID NO: 691841 - DNA, 25 bp, Mus musculus
gctgaccagttcgtgcagctgtcca

SEQ ID NO: 691842 - DNA, 25 bp, Mus musculus
gctgaccagtttcccaatgagtggg

SEQ ID NO: 691843 - DNA, 25 bp, Mus musculus
gctgaccagtttgccaatgagtggg

SEQ ID NO: 691844 - DNA, 25 bp, Mus musculus
gctgaccatcttagctgcaaagcca

SEQ ID NO: 691845 - DNA, 25 bp, Mus musculus
gctgaccatctttgctgcaaagcca

SEQ ID NO: 691846 - DNA, 25 bp, Mus musculus
gctgacccaagaagtggagtttgtg

SEQ ID NO: 691847 - DNA, 25 bp, Mus musculus
gctgacccaagatgtggagtttgtg

SEQ ID NO: 691848 - DNA, 25 bp, Mus musculus
gctgaccccactcgagcctttggga

SEQ ID NO: 691849 - DNA, 25 bp, Mus musculus
gctgaccccactggagcctttggga

SEQ ID NO: 691850 - DNA, 25 bp, Mus musculus
gctgaccccagtactcggaacttgg

SEQ ID NO: 691851 - DNA, 25 bp, Mus musculus
gctgaccccagttctcggaacttgg

SEQ ID NO: 691852 - DNA, 25 bp, Mus musculus
gctgacccccaacgtaagggcctgt

SEQ ID NO: 691853 - DNA, 25 bp, Mus musculus
gctgacccccaaggtaagggcctgt

SEQ ID NO: 691854 - DNA, 25 bp, Mus musculus
gctgacccgcagcacagctgtcttt

SEQ ID NO: 691855 - DNA, 25 bp, Mus musculus
gctgacccgcaggacagctgtcttt

SEQ ID NO: 691856 - DNA, 25 bp, Mus musculus
gctgacccggatctgtgatgacctc

SEQ ID NO: 691857 - DNA, 25 bp, Mus musculus
gctgacccggatgtgtgatgacctc

SEQ ID NO: 691858 - DNA, 25 bp, Mus musculus
gctgaccctcacagtccatttagga

SEQ ID NO: 691859 - DNA, 25 bp, Mus musculus
gctgaccctcactgtccatttagga

SEQ ID NO: 691860 - DNA, 25 bp, Mus musculus
gctgaccctcgccaggagtttgaca

SEQ ID NO: 691861 - DNA, 25 bp, Mus musculus
gctgaccctcgcgaggagtttgaca

SEQ ID NO: 691862 - DNA, 25 bp, Mus musculus
gctgaccctgtgctgaggcgcccaa

SEQ ID NO: 691863 - DNA, 25 bp, Mus musculus
gctgaccctgtggtgaggcgcccaa

SEQ ID NO: 691864 - DNA, 25 bp, Mus musculus
gctgaccgacgaccacgttcagttt

SEQ ID NO: 691865 - DNA, 25 bp, Mus musculus
gctgaccgacgagcacgttcagttt

SEQ ID NO: 691866 - DNA, 25 bp, Mus musculus
gctgaccgagaaagctgaggtgaaa

SEQ ID NO: 691867 - DNA, 25 bp, Mus musculus
gctgaccgagaatgctgaggtgaaa

SEQ ID NO: 691868 - DNA, 25 bp, Mus musculus
gctgaccgatgcagagttcccacac

SEQ ID NO: 691869 - DNA, 25 bp, Mus musculus
gctgaccgatgctgagttcccacac

SEQ ID NO: 691870 - DNA, 25 bp, Mus musculus
gctgaccgccttccagctgctgttt

SEQ ID NO: 691871 - DNA, 25 bp, Mus musculus
gctgaccgccttgcagctgctgttt

SEQ ID NO: 691872 - DNA, 25 bp, Mus musculus
gctgacctcatcataaagcagaagc

SEQ ID NO: 691873 - DNA, 25 bp, Mus musculus
gctgacctcatcttaaagcagaagc

SEQ ID NO: 691874 - DNA, 25 bp, Mus musculus
gctgacctgctgcattacattaaag

SEQ ID NO: 691875 - DNA, 25 bp, Mus musculus
gctgacctgctggattacattaaag

SEQ ID NO: 691876 - DNA, 25 bp, Mus musculus
gctgacctggccaggtgattcctga

SEQ ID NO: 691877 - DNA, 25 bp, Mus musculus
gctgacctggcctggtgattcctga

SEQ ID NO: 691878 - DNA, 25 bp, Mus musculus
gctgacctggtcatctggaacccca

SEQ ID NO: 691879 - DNA, 25 bp, Mus musculus
gctgacctggtcttctggaacccca

SEQ ID NO: 691880 - DNA, 25 bp, Mus musculus
gctgacctggttctggttccacaaa

SEQ ID NO: 691881 - DNA, 25 bp, Mus musculus
gctgacctggttgtggttccacaaa

SEQ ID NO: 691882 - DNA, 25 bp, Mus musculus
gctgaccttctcagcccgcaagatg

SEQ ID NO: 691883 - DNA, 25 bp, Mus musculus
gctgaccttctctgcccgcaagatg

SEQ ID NO: 691884 - DNA, 25 bp, Mus musculus
gctgaccttgtgctgggactctgca

SEQ ID NO: 691885 - DNA, 25 bp, Mus musculus
gctgaccttgtggtgggactctgca

SEQ ID NO: 691886 - DNA, 25 bp, Mus musculus
gctgacgagtttctccaggagacat

SEQ ID NO: 691887 - DNA, 25 bp, Mus musculus
gctgacgagtttgtccaggagacat

SEQ ID NO: 691888 - DNA, 25 bp, Mus musculus
gctgacgatgatcatatctacaatg

SEQ ID NO: 691889 - DNA, 25 bp, Mus musculus
gctgacgatgatgatatctacaatg

SEQ ID NO: 691890 - DNA, 25 bp, Mus musculus
gctgacgcatgcatgcgcacacaac

SEQ ID NO: 691891 - DNA, 25 bp, Mus musculus
gctgacgcatgcttgcgcacacaac

SEQ ID NO: 691892 - DNA, 25 bp, Mus musculus
gctgacgccatcacctacatagtga

SEQ ID NO: 691893 - DNA, 25 bp, Mus musculus
gctgacgccatctcctacatagtga

SEQ ID NO: 691894 - DNA, 25 bp, Mus musculus
gctgacgcctcgcaaaaagagaccg

SEQ ID NO: 691895 - DNA, 25 bp, Mus musculus
gctgacgcctcggaaaaagagaccg

SEQ ID NO: 691896 - DNA, 25 bp, Mus musculus
gctgacggagaacggcaagcatggc

SEQ ID NO: 691897 - DNA, 25 bp, Mus musculus
gctgacggagaagggcaagcatggc

SEQ ID NO: 691898 - DNA, 25 bp, Mus musculus
gctgacgggtgacgacgtgttagtc

SEQ ID NO: 691899 - DNA, 25 bp, Mus musculus
gctgacgggtgaggacgtgttagtc

SEQ ID NO: 691900 - DNA, 25 bp, Mus musculus
gctgacggtcaacgagttgaattct

SEQ ID NO: 691901 - DNA, 25 bp, Mus musculus
gctgacggtcaaggagttgaattct

SEQ ID NO: 691902 - DNA, 25 bp, Mus musculus
gctgacgtcaccaaacttcatcctg

SEQ ID NO: 691903 - DNA, 25 bp, Mus musculus
gctgacgtcacctaacttcatcctg

SEQ ID NO: 691904 - DNA, 25 bp, Mus musculus
gctgacgtcaggagccaaaatggcg

SEQ ID NO: 691905 - DNA, 25 bp, Mus musculus
gctgacgtcaggtgccaaaatggcg

SEQ ID NO: 691906 - DNA, 25 bp, Mus musculus
gctgacgtcatcctcttacgagaac

SEQ ID NO: 691907 - DNA, 25 bp, Mus musculus
gctgacgtcatcgtcttacgagaac

SEQ ID NO: 691908 - DNA, 25 bp, Mus musculus
gctgacgtgctacttaagtgtatca

SEQ ID NO: 691909 - DNA, 25 bp, Mus musculus
gctgacgtgctagttaagtgtatca

SEQ ID NO: 691910 - DNA, 25 bp, Mus musculus
gctgacgtggttatcaagttccctg

SEQ ID NO: 691911 - DNA, 25 bp, Mus musculus
gctgacgtggttttcaagttccctg

SEQ ID NO: 691912 - DNA, 25 bp, Mus musculus
gctgacgtgtcccagtatcatgtca

SEQ ID NO: 691913 - DNA, 25 bp, Mus musculus
gctgacgtgtccgagtatcatgtca

SEQ ID NO: 691914 - DNA, 25 bp, Mus musculus
gctgacgtgtttcaggaatttgtca

SEQ ID NO: 691915 - DNA, 25 bp, Mus musculus
gctgacgtgtttgaggaatttgtca

SEQ ID NO: 691916 - DNA, 25 bp, Mus musculus
gctgactaacatcatgatctactgg

SEQ ID NO: 691917 - DNA, 25 bp, Mus musculus
gctgactaacatgatgatctactgg

SEQ ID NO: 691918 - DNA, 25 bp, Mus musculus
gctgactacattcctgctttcctgc

SEQ ID NO: 691919 - DNA, 25 bp, Mus musculus
gctgactacattgctgctttcctgc

SEQ ID NO: 691920 - DNA, 25 bp, Mus musculus
gctgactagtaccatcatgtgtgat

SEQ ID NO: 691921 - DNA, 25 bp, Mus musculus
gctgactagtacgatcatgtgtgat

SEQ ID NO: 691922 - DNA, 25 bp, Mus musculus
gctgactatcttacagggcaaagag

SEQ ID NO: 691923 - DNA, 25 bp, Mus musculus
gctgactatctttcagggcaaagag

SEQ ID NO: 691924 - DNA, 25 bp, Mus musculus
gctgactcactccttcaacacagaa

SEQ ID NO: 691925 - DNA, 25 bp, Mus musculus
gctgactcactcgttcaacacagaa

SEQ ID NO: 691926 - DNA, 25 bp, Mus musculus
gctgactcaggtaacgaccaagacg

SEQ ID NO: 691927 - DNA, 25 bp, Mus musculus
gctgactcaggttacgaccaagacg

SEQ ID NO: 691928 - DNA, 25 bp, Mus musculus
gctgactcataccaaaaactggaaa

SEQ ID NO: 691929 - DNA, 25 bp, Mus musculus
gctgactcatacgaaaaactggaaa

SEQ ID NO: 691930 - DNA, 25 bp, Mus musculus
gctgactccctacggcaatggcatc

SEQ ID NO: 691931 - DNA, 25 bp, Mus musculus
gctgactccctagggcaatggcatc

SEQ ID NO: 691932 - DNA, 25 bp, Mus musculus
gctgactcgacaactgacactgacg

SEQ ID NO: 691933 - DNA, 25 bp, Mus musculus
gctgactcgacatctgacactgacg

SEQ ID NO: 691934 - DNA, 25 bp, Mus musculus
gctgactctacgcagaactggccaa

SEQ ID NO: 691935 - DNA, 25 bp, Mus musculus
gctgactctacggagaactggccaa

SEQ ID NO: 691936 - DNA, 25 bp, Mus musculus
gctgactctgagatccctgtttgtc

SEQ ID NO: 691937 - DNA, 25 bp, Mus musculus
gctgactctgagttccctgtttgtc

SEQ ID NO: 691938 - DNA, 25 bp, Mus musculus
gctgactgaaagacaggatgcagac

SEQ ID NO: 691939 - DNA, 25 bp, Mus musculus
gctgactgaaagtcaggatgcagac

SEQ ID NO: 691940 - DNA, 25 bp, Mus musculus
gctgactgaagacccgattgcctcg

SEQ ID NO: 691941 - DNA, 25 bp, Mus musculus
gctgactgaagagccgattgcctcg

SEQ ID NO: 691942 - DNA, 25 bp, Mus musculus
gctgactgaattccctctgcgcatg

SEQ ID NO: 691943 - DNA, 25 bp, Mus musculus
gctgactgaattgcctctgcgcatg

SEQ ID NO: 691944 - DNA, 25 bp, Mus musculus
gctgactgacctctctagtcttctg

SEQ ID NO: 691945 - DNA, 25 bp, Mus musculus
gctgactgacctgtctagtcttctg

SEQ ID NO: 691946 - DNA, 25 bp, Mus musculus
gctgactgcagacgtataagaggat

SEQ ID NO: 691947 - DNA, 25 bp, Mus musculus
gctgactgcagaggtataagaggat

SEQ ID NO: 691948 - DNA, 25 bp, Mus musculus
gctgactgccagaggtagctaccct

SEQ ID NO: 691949 - DNA, 25 bp, Mus musculus
gctgactgccagtggtagctaccct

SEQ ID NO: 691950 - DNA, 25 bp, Mus musculus
gctgactgccggcagaatgtgatca

SEQ ID NO: 691951 - DNA, 25 bp, Mus musculus
gctgactgccgggagaatgtgatca

SEQ ID NO: 691952 - DNA, 25 bp, Mus musculus
gctgacttacagctcattgactttg

SEQ ID NO: 691953 - DNA, 25 bp, Mus musculus
gctgacttacaggtcattgactttg

SEQ ID NO: 691954 - DNA, 25 bp, Mus musculus
gctgacttcaatcccgttgagtata

SEQ ID NO: 691955 - DNA, 25 bp, Mus musculus
gctgacttcaatgccgttgagtata

SEQ ID NO: 691956 - DNA, 25 bp, Mus musculus
gctgacttccgccactggagccgtg

SEQ ID NO: 691957 - DNA, 25 bp, Mus musculus
gctgacttccgcgactggagccgtg

SEQ ID NO: 691958 - DNA, 25 bp, Mus musculus
gctgacttctagagtctgtgaagcc

SEQ ID NO: 691959 - DNA, 25 bp, Mus musculus
gctgacttctagtgtctgtgaagcc

SEQ ID NO: 691960 - DNA, 25 bp, Mus musculus
gctgacttctctagcatgctctctg

SEQ ID NO: 691961 - DNA, 25 bp, Mus musculus
gctgacttctcttgcatgctctctg

SEQ ID NO: 691962 - DNA, 25 bp, Mus musculus
gctgacttgatgaatattctctatg

SEQ ID NO: 691963 - DNA, 25 bp, Mus musculus
gctgacttgatgtatattctctatg

SEQ ID NO: 691964 - DNA, 25 bp, Mus musculus
gctgacttgtgcagtacaataggag

SEQ ID NO: 691965 - DNA, 25 bp, Mus musculus
gctgacttgtgctgtacaataggag

SEQ ID NO: 691966 - DNA, 25 bp, Mus musculus
gctgactttgcgaaggaaacccgga

SEQ ID NO: 691967 - DNA, 25 bp, Mus musculus
gctgactttgcgtaggaaacccgga

SEQ ID NO: 691968 - DNA, 25 bp, Mus musculus
gctgactttgtacgctataagctga

SEQ ID NO: 691969 - DNA, 25 bp, Mus musculus
gctgactttgtaggctataagctga

SEQ ID NO: 691970 - DNA, 25 bp, Mus musculus
gctgagaaactaacaggcccaatgg

SEQ ID NO: 691971 - DNA, 25 bp, Mus musculus
gctgagaaactatcaggcccaatgg

SEQ ID NO: 691972 - DNA, 25 bp, Mus musculus
gctgagaaagctactgacccctcaa

SEQ ID NO: 691973 - DNA, 25 bp, Mus musculus
gctgagaaagcttctgacccctcaa

SEQ ID NO: 691974 - DNA, 25 bp, Mus musculus
gctgagaacatcaataagtgggcct

SEQ ID NO: 691975 - DNA, 25 bp, Mus musculus
gctgagaacatctataagtgggcct

SEQ ID NO: 691976 - DNA, 25 bp, Mus musculus
gctgagaaccacatttccttgagag

SEQ ID NO: 691977 - DNA, 25 bp, Mus musculus
gctgagaaccacttttccttgagag

SEQ ID NO: 691978 - DNA, 25 bp, Mus musculus
gctgagaagagtatagagccttttc

SEQ ID NO: 691979 - DNA, 25 bp, Mus musculus
gctgagaagagtttagagccttttc

SEQ ID NO: 691980 - DNA, 25 bp, Mus musculus
gctgagaagattcgcaaaattggag

SEQ ID NO: 691981 - DNA, 25 bp, Mus musculus
gctgagaagattggcaaaattggag

SEQ ID NO: 691982 - DNA, 25 bp, Mus musculus
gctgagaagcagattgaggactcct

SEQ ID NO: 691983 - DNA, 25 bp, Mus musculus
gctgagaagcagtttgaggactcct

SEQ ID NO: 691984 - DNA, 25 bp, Mus musculus
gctgagaaggagagcgcttctgttc

SEQ ID NO: 691985 - DNA, 25 bp, Mus musculus
gctgagaaggagtgcgcttctgttc

SEQ ID NO: 691986 - DNA, 25 bp, Mus musculus
gctgagaaggatccccgcactgtga

SEQ ID NO: 691987 - DNA, 25 bp, Mus musculus
gctgagaaggatgcccgcactgtga

SEQ ID NO: 691988 - DNA, 25 bp, Mus musculus
gctgagaagggtagagatgctttcc

SEQ ID NO: 691989 - DNA, 25 bp, Mus musculus
gctgagaagggttgagatgctttcc

SEQ ID NO: 691990 - DNA, 25 bp, Mus musculus
gctgagaaggtaccaaacttgctgc

SEQ ID NO: 691991 - DNA, 25 bp, Mus musculus
gctgagaaggtagcaaacttgctgc

SEQ ID NO: 691992 - DNA, 25 bp, Mus musculus
gctgagacaaacacaacccctgatg

SEQ ID NO: 691993 - DNA, 25 bp, Mus musculus
gctgagacaaactcaacccctgatg

SEQ ID NO: 691994 - DNA, 25 bp, Mus musculus
gctgagacacatattcaactcctgt

SEQ ID NO: 691995 - DNA, 25 bp, Mus musculus
gctgagacacatccaccgctctggg

SEQ ID NO: 691996 - DNA, 25 bp, Mus musculus
gctgagacacatgcaccgctctggg

SEQ ID NO: 691997 - DNA, 25 bp, Mus musculus
gctgagacacattttcaactcctgt

SEQ ID NO: 691998 - DNA, 25 bp, Mus musculus
gctgagacaccaagaggtggttaaa

SEQ ID NO: 691999 - DNA, 25 bp, Mus musculus
gctgagacaccatgaggtggttaaa

SEQ ID NO: 692000 - DNA, 25 bp, Mus musculus
gctgagacacgaaggaatctggctt

SEQ ID NO: 692001 - DNA, 25 bp, Mus musculus
gctgagacacgatggaatctggctt

SEQ ID NO: 692002 - DNA, 25 bp, Mus musculus
gctgagacagagatgagcctcctgt

SEQ ID NO: 692003 - DNA, 25 bp, Mus musculus
gctgagacagagttgagcctcctgt

SEQ ID NO: 692004 - DNA, 25 bp, Mus musculus
gctgagacagttcattcccaagtct

SEQ ID NO: 692005 - DNA, 25 bp, Mus musculus
gctgagacagttgattcccaagtct

SEQ ID NO: 692006 - DNA, 25 bp, Mus musculus
gctgagaccagaagccataaggcaa

SEQ ID NO: 692007 - DNA, 25 bp, Mus musculus
gctgagaccagatgccataaggcaa

SEQ ID NO: 692008 - DNA, 25 bp, Mus musculus
gctgagacccggacaagcgctggac

SEQ ID NO: 692009 - DNA, 25 bp, Mus musculus
gctgagacccggtcaagcgctggac

SEQ ID NO: 692010 - DNA, 25 bp, Mus musculus
gctgagacgtaaccgacttccgctt

SEQ ID NO: 692011 - DNA, 25 bp, Mus musculus
gctgagacgtaagcgacttccgctt

SEQ ID NO: 692012 - DNA, 25 bp, Mus musculus
gctgagagacttcctggtcaagtac

SEQ ID NO: 692013 - DNA, 25 bp, Mus musculus
gctgagagacttgctggtcaagtac

SEQ ID NO: 692014 - DNA, 25 bp, Mus musculus
gctgagagccatcgactgtcaccct

SEQ ID NO: 692015 - DNA, 25 bp, Mus musculus
gctgagagccatggactgtcaccct

SEQ ID NO: 692016 - DNA, 25 bp, Mus musculus
gctgagagccccaaggtttgaccct

SEQ ID NO: 692017 - DNA, 25 bp, Mus musculus
gctgagagcccctaggtttgaccct

SEQ ID NO: 692018 - DNA, 25 bp, Mus musculus
gctgagaggaagaatacccaggagc

SEQ ID NO: 692019 - DNA, 25 bp, Mus musculus
gctgagaggaagtatacccaggagc

SEQ ID NO: 692020 - DNA, 25 bp, Mus musculus
gctgagaggatcctgcagaccttat

SEQ ID NO: 692021 - DNA, 25 bp, Mus musculus
gctgagaggatcgtgcagaccttat

SEQ ID NO: 692022 - DNA, 25 bp, Mus musculus
gctgagaggccgcaagatcagccct

SEQ ID NO: 692023 - DNA, 25 bp, Mus musculus
gctgagaggccggaagatcagccct

SEQ ID NO: 692024 - DNA, 25 bp, Mus musculus
gctgagaggctacagtgataaagaa

SEQ ID NO: 692025 - DNA, 25 bp, Mus musculus
gctgagaggctagagtgataaagaa

SEQ ID NO: 692026 - DNA, 25 bp, Mus musculus
gctgagagggccaagtttctctctc

SEQ ID NO: 692027 - DNA, 25 bp, Mus musculus
gctgagagggcctagtttctctctc

SEQ ID NO: 692028 - DNA, 25 bp, Mus musculus
gctgagagtccgcaagaagatgtct

SEQ ID NO: 692029 - DNA, 25 bp, Mus musculus
gctgagagtccggaagaagatgtct

SEQ ID NO: 692030 - DNA, 25 bp, Mus musculus
gctgagatacagctcttgagagaca

SEQ ID NO: 692031 - DNA, 25 bp, Mus musculus
gctgagatacaggtcttgagagaca

SEQ ID NO: 692032 - DNA, 25 bp, Mus musculus
gctgagatatccagctgatccttat

SEQ ID NO: 692033 - DNA, 25 bp, Mus musculus
gctgagatatcctgctgatccttat

SEQ ID NO: 692034 - DNA, 25 bp, Mus musculus
gctgagatcatcagcggactgcagt

SEQ ID NO: 692035 - DNA, 25 bp, Mus musculus
gctgagatcatctgcggactgcagt

SEQ ID NO: 692036 - DNA, 25 bp, Mus musculus
gctgagatctatcgcgtcacccaca

SEQ ID NO: 692037 - DNA, 25 bp, Mus musculus
gctgagatctatggcgtcacccaca

SEQ ID NO: 692038 - DNA, 25 bp, Mus musculus
gctgagatgaaaattactggtcacc

SEQ ID NO: 692039 - DNA, 25 bp, Mus musculus
gctgagatgaaatttactggtcacc

SEQ ID NO: 692040 - DNA, 25 bp, Mus musculus
gctgagatggcaatgtgcagcccat

SEQ ID NO: 692041 - DNA, 25 bp, Mus musculus
gctgagatggcacgatccagcctag

SEQ ID NO: 692042 - DNA, 25 bp, Mus musculus
gctgagatggcaggatccagcctag

SEQ ID NO: 692043 - DNA, 25 bp, Mus musculus
gctgagatggcattgtgcagcccat

SEQ ID NO: 692044 - DNA, 25 bp, Mus musculus
gctgagattggtaataaagactttg

SEQ ID NO: 692045 - DNA, 25 bp, Mus musculus
gctgagattggttataaagactttg

SEQ ID NO: 692046 - DNA, 25 bp, Mus musculus
gctgagatttcaacccacttgtggg

SEQ ID NO: 692047 - DNA, 25 bp, Mus musculus
gctgagatttcatcccacttgtggg

SEQ ID NO: 692048 - DNA, 25 bp, Mus musculus
gctgagatttgtcccagaattatgg

SEQ ID NO: 692049 - DNA, 25 bp, Mus musculus
gctgagatttgtgccagaattatgg

SEQ ID NO: 692050 - DNA, 25 bp, Mus musculus
gctgagcaaattctgatagattcaa

SEQ ID NO: 692051 - DNA, 25 bp, Mus musculus
gctgagcaaattgtgatagattcaa

SEQ ID NO: 692052 - DNA, 25 bp, Mus musculus
gctgagcaagacaaacctctacatc

SEQ ID NO: 692053 - DNA, 25 bp, Mus musculus
gctgagcaagactaacctctacatc

SEQ ID NO: 692054 - DNA, 25 bp, Mus musculus
gctgagcaagcaaaagtacttcctg

SEQ ID NO: 692055 - DNA, 25 bp, Mus musculus
gctgagcaagcataagtacttcctg

SEQ ID NO: 692056 - DNA, 25 bp, Mus musculus
gctgagcaaggaatactgggactgt

SEQ ID NO: 692057 - DNA, 25 bp, Mus musculus
gctgagcaaggattactgggactgt

SEQ ID NO: 692058 - DNA, 25 bp, Mus musculus
gctgagcaatgtccacttcactgga

SEQ ID NO: 692059 - DNA, 25 bp, Mus musculus
gctgagcaatgtgcacttcactgga

SEQ ID NO: 692060 - DNA, 25 bp, Mus musculus
gctgagcacctcatggaccgaggag

SEQ ID NO: 692061 - DNA, 25 bp, Mus musculus
gctgagcacctcttggaccgaggag

SEQ ID NO: 692062 - DNA, 25 bp, Mus musculus
gctgagcacgttcacagctccagag

SEQ ID NO: 692063 - DNA, 25 bp, Mus musculus
gctgagcacgttgacagctccagag

SEQ ID NO: 692064 - DNA, 25 bp, Mus musculus
gctgagcagcacaagattgtgatgg

SEQ ID NO: 692065 - DNA, 25 bp, Mus musculus
gctgagcagcactagattgtgatgg

SEQ ID NO: 692066 - DNA, 25 bp, Mus musculus
gctgagcagctcacgggatcagcct

SEQ ID NO: 692067 - DNA, 25 bp, Mus musculus
gctgagcagctctcgggatcagcct

SEQ ID NO: 692068 - DNA, 25 bp, Mus musculus
gctgagcagctgctcctcgaggcca

SEQ ID NO: 692069 - DNA, 25 bp, Mus musculus
gctgagcagctggtcctcgaggcca

SEQ ID NO: 692070 - DNA, 25 bp, Mus musculus
gctgagcaggaacttcgtgcagtat

SEQ ID NO: 692071 - DNA, 25 bp, Mus musculus
gctgagcaggaagttcgtgcagtat

SEQ ID NO: 692072 - DNA, 25 bp, Mus musculus
gctgagcagtggcaaacattacctc

SEQ ID NO: 692073 - DNA, 25 bp, Mus musculus
gctgagcagtgggaaacattacctc

SEQ ID NO: 692074 - DNA, 25 bp, Mus musculus
gctgagcccagtccaggcattggtt

SEQ ID NO: 692075 - DNA, 25 bp, Mus musculus
gctgagcccagtgcaggcattggtt

SEQ ID NO: 692076 - DNA, 25 bp, Mus musculus
gctgagccctctctaggtattcttt

SEQ ID NO: 692077 - DNA, 25 bp, Mus musculus
gctgagccctctgtaggtattcttt

SEQ ID NO: 692078 - DNA, 25 bp, Mus musculus
gctgagccgcatagagaagcaactc

SEQ ID NO: 692079 - DNA, 25 bp, Mus musculus
gctgagccgcattgagaagcaactc

SEQ ID NO: 692080 - DNA, 25 bp, Mus musculus
gctgagccgcctagcttcctacagt

SEQ ID NO: 692081 - DNA, 25 bp, Mus musculus
gctgagccgccttgcttcctacagt

SEQ ID NO: 692082 - DNA, 25 bp, Mus musculus
gctgagccgtcgagagcagcaacct

SEQ ID NO: 692083 - DNA, 25 bp, Mus musculus
gctgagccgtcgtgagcagcaacct

SEQ ID NO: 692084 - DNA, 25 bp, Mus musculus
gctgagcctctgatcttatctgtgg

SEQ ID NO: 692085 - DNA, 25 bp, Mus musculus
gctgagcctctgttcttatctgtgg

SEQ ID NO: 692086 - DNA, 25 bp, Mus musculus
gctgagcgacaaatagtatttaatg

SEQ ID NO: 692087 - DNA, 25 bp, Mus musculus
gctgagcgacaattagtatttaatg

SEQ ID NO: 692088 - DNA, 25 bp, Mus musculus
gctgagcgacttcgaatccctgagg

SEQ ID NO: 692089 - DNA, 25 bp, Mus musculus
gctgagcgacttggaatccctgagg

SEQ ID NO: 692090 - DNA, 25 bp, Mus musculus
gctgagcgagtgcacagcaccacct

SEQ ID NO: 692091 - DNA, 25 bp, Mus musculus
gctgagcgagtggacagcaccacct

SEQ ID NO: 692092 - DNA, 25 bp, Mus musculus
gctgagcgcggaacgtgcccgtaac

SEQ ID NO: 692093 - DNA, 25 bp, Mus musculus
gctgagcgcggatcgtgcccgtaac

SEQ ID NO: 692094 - DNA, 25 bp, Mus musculus
gctgagcgcttcatccggaagcttt

SEQ ID NO: 692095 - DNA, 25 bp, Mus musculus
gctgagcgcttcttccggaagcttt

SEQ ID NO: 692096 - DNA, 25 bp, Mus musculus
gctgagcggcaacacaacaaggaga

SEQ ID NO: 692097 - DNA, 25 bp, Mus musculus
gctgagcggcaagacaacaaggaga

SEQ ID NO: 692098 - DNA, 25 bp, Mus musculus
gctgagcggcctcaacaccatcaag

SEQ ID NO: 692099 - DNA, 25 bp, Mus musculus
gctgagcggcctgaacaccatcaag

SEQ ID NO: 692100 - DNA, 25 bp, Mus musculus
gctgagcgtctcagtgaatcacacc

SEQ ID NO: 692101 - DNA, 25 bp, Mus musculus
gctgagcgtctctgtgaatcacacc

SEQ ID NO: 692102 - DNA, 25 bp, Mus musculus
gctgagctaccgaagggcttctctc

SEQ ID NO: 692103 - DNA, 25 bp, Mus musculus
gctgagctaccgtagggcttctctc

SEQ ID NO: 692104 - DNA, 25 bp, Mus musculus
gctgagctagagagaacaaaatggc

SEQ ID NO: 692105 - DNA, 25 bp, Mus musculus
gctgagctagagtgaacaaaatggc

SEQ ID NO: 692106 - DNA, 25 bp, Mus musculus
gctgagctagctactgacctgattg

SEQ ID NO: 692107 - DNA, 25 bp, Mus musculus
gctgagctagcttctgacctgattg

SEQ ID NO: 692108 - DNA, 25 bp, Mus musculus
gctgagctccctaagctgcaagttg

SEQ ID NO: 692109 - DNA, 25 bp, Mus musculus
gctgagctcccttagctgcaagttg

SEQ ID NO: 692110 - DNA, 25 bp, Mus musculus
gctgagctctcgaagcagaatggct

SEQ ID NO: 692111 - DNA, 25 bp, Mus musculus
gctgagctctcgtagcagaatggct

SEQ ID NO: 692112 - DNA, 25 bp, Mus musculus
gctgagctgagtcattcgggcacct

SEQ ID NO: 692113 - DNA, 25 bp, Mus musculus
gctgagctgagtgattcgggcacct

SEQ ID NO: 692114 - DNA, 25 bp, Mus musculus
gctgagctgatgagcggcctcattg

SEQ ID NO: 692115 - DNA, 25 bp, Mus musculus
gctgagctgatgtgcggcctcattg

SEQ ID NO: 692116 - DNA, 25 bp, Mus musculus
gctgagctgcagagatgacgctaca

SEQ ID NO: 692117 - DNA, 25 bp, Mus musculus
gctgagctgcagatacaaaacatcg

SEQ ID NO: 692118 - DNA, 25 bp, Mus musculus
gctgagctgcagtgatgacgctaca

SEQ ID NO: 692119 - DNA, 25 bp, Mus musculus
gctgagctgcagttacaaaacatcg

SEQ ID NO: 692120 - DNA, 25 bp, Mus musculus
gctgagctgtccaactacagcagct

SEQ ID NO: 692121 - DNA, 25 bp, Mus musculus
gctgagctgtcctactacagcagct

SEQ ID NO: 692122 - DNA, 25 bp, Mus musculus
gctgagctgtgaaaatcgcaaggtc

SEQ ID NO: 692123 - DNA, 25 bp, Mus musculus
gctgagctgtgataatcgcaaggtc

SEQ ID NO: 692124 - DNA, 25 bp, Mus musculus
gctgagctgttgaccggaagaacgt

SEQ ID NO: 692125 - DNA, 25 bp, Mus musculus
gctgagctgttgtccggaagaacgt

SEQ ID NO: 692126 - DNA, 25 bp, Mus musculus
gctgagcttagtcctcctctcggaa

SEQ ID NO: 692127 - DNA, 25 bp, Mus musculus
gctgagcttagtgctcctctcggaa

SEQ ID NO: 692128 - DNA, 25 bp, Mus musculus
gctgagcttatgaacgaggtcaccc

SEQ ID NO: 692129 - DNA, 25 bp, Mus musculus
gctgagcttatgtacgaggtcaccc

SEQ ID NO: 692130 - DNA, 25 bp, Mus musculus
gctgagcttgagaagaccttgagta

SEQ ID NO: 692131 - DNA, 25 bp, Mus musculus
gctgagcttgagtagaccttgagta

SEQ ID NO: 692132 - DNA, 25 bp, Mus musculus
gctgaggaaaagacactaccggaaa

SEQ ID NO: 692133 - DNA, 25 bp, Mus musculus
gctgaggaaaagtcactaccggaaa

SEQ ID NO: 692134 - DNA, 25 bp, Mus musculus
gctgaggaaagaccccgtccaccga

SEQ ID NO: 692135 - DNA, 25 bp, Mus musculus
gctgaggaaagagcccgtccaccga

SEQ ID NO: 692136 - DNA, 25 bp, Mus musculus
gctgaggaacaacactgctttgcag

SEQ ID NO: 692137 - DNA, 25 bp, Mus musculus
gctgaggaacaagactgctttgcag

SEQ ID NO: 692138 - DNA, 25 bp, Mus musculus
gctgaggaacttcatccaaactgaa

SEQ ID NO: 692139 - DNA, 25 bp, Mus musculus
gctgaggaacttgatccaaactgaa

SEQ ID NO: 692140 - DNA, 25 bp, Mus musculus
gctgaggaagagcaatgcccttgtc

SEQ ID NO: 692141 - DNA, 25 bp, Mus musculus
gctgaggaagaggaatgcccttgtc

SEQ ID NO: 692142 - DNA, 25 bp, Mus musculus
gctgaggaagccaagcctgcagctc

SEQ ID NO: 692143 - DNA, 25 bp, Mus musculus
gctgaggaagcctagcctgcagctc

SEQ ID NO: 692144 - DNA, 25 bp, Mus musculus
gctgaggaagctagggctttcaacc

SEQ ID NO: 692145 - DNA, 25 bp, Mus musculus
gctgaggaagcttgggctttcaacc

SEQ ID NO: 692146 - DNA, 25 bp, Mus musculus
gctgaggaatacatcgagtatctca

SEQ ID NO: 692147 - DNA, 25 bp, Mus musculus
gctgaggaatacttcgagtatctca

SEQ ID NO: 692148 - DNA, 25 bp, Mus musculus
gctgaggaatcgacagcccgtgcgc

SEQ ID NO: 692149 - DNA, 25 bp, Mus musculus
gctgaggaatcgtcagcccgtgcgc

SEQ ID NO: 692150 - DNA, 25 bp, Mus musculus
gctgaggacaaaccagcctgaccgt

SEQ ID NO: 692151 - DNA, 25 bp, Mus musculus
gctgaggacaaagcagcctgaccgt

SEQ ID NO: 692152 - DNA, 25 bp, Mus musculus
gctgaggacccaaccgtcagtggtt

SEQ ID NO: 692153 - DNA, 25 bp, Mus musculus
gctgaggacccatccgtcagtggtt

SEQ ID NO: 692154 - DNA, 25 bp, Mus musculus
gctgaggaccccaggtgaccaggtc

SEQ ID NO: 692155 - DNA, 25 bp, Mus musculus
gctgaggacccctggtgaccaggtc

SEQ ID NO: 692156 - DNA, 25 bp, Mus musculus
gctgaggacttaactggcacagaga

SEQ ID NO: 692157 - DNA, 25 bp, Mus musculus
gctgaggacttatctggcacagaga

SEQ ID NO: 692158 - DNA, 25 bp, Mus musculus
gctgaggagacccaaaactctttgc

SEQ ID NO: 692159 - DNA, 25 bp, Mus musculus
gctgaggagaccgaaaactctttgc

SEQ ID NO: 692160 - DNA, 25 bp, Mus musculus
gctgaggatgccatggagacaagtc

SEQ ID NO: 692161 - DNA, 25 bp, Mus musculus
gctgaggatgccttggagacaagtc

SEQ ID NO: 692162 - DNA, 25 bp, Mus musculus
gctgaggatgcgatctatggaagaa

SEQ ID NO: 692163 - DNA, 25 bp, Mus musculus
gctgaggatgcgttctatggaagaa

SEQ ID NO: 692164 - DNA, 25 bp, Mus musculus
gctgaggcaagaacctgcagctgca

SEQ ID NO: 692165 - DNA, 25 bp, Mus musculus
gctgaggcaagatcctgcagctgca

SEQ ID NO: 692166 - DNA, 25 bp, Mus musculus
gctgaggcacatcctccagtgggaa

SEQ ID NO: 692167 - DNA, 25 bp, Mus musculus
gctgaggcacatgctccagtgggaa

SEQ ID NO: 692168 - DNA, 25 bp, Mus musculus
gctgaggccattatcagggcaacat

SEQ ID NO: 692169 - DNA, 25 bp, Mus musculus
gctgaggccattttcagggcaacat

SEQ ID NO: 692170 - DNA, 25 bp, Mus musculus
gctgaggccctcagtaagatgaaac

SEQ ID NO: 692171 - DNA, 25 bp, Mus musculus
gctgaggccctctgtaagatgaaac

SEQ ID NO: 692172 - DNA, 25 bp, Mus musculus
gctgaggccgggatttgctcccgac

SEQ ID NO: 692173 - DNA, 25 bp, Mus musculus
gctgaggccgggttttgctcccgac

SEQ ID NO: 692174 - DNA, 25 bp, Mus musculus
gctgaggccttccagatagtgctgt

SEQ ID NO: 692175 - DNA, 25 bp, Mus musculus
gctgaggccttcgagatagtgctgt

SEQ ID NO: 692176 - DNA, 25 bp, Mus musculus
gctgaggcctttcctataggtgccc

SEQ ID NO: 692177 - DNA, 25 bp, Mus musculus
gctgaggcctttgctataggtgccc

SEQ ID NO: 692178 - DNA, 25 bp, Mus musculus
gctgaggcggatctgctacctcacc

SEQ ID NO: 692179 - DNA, 25 bp, Mus musculus
gctgaggcggatgtgctacctcacc

SEQ ID NO: 692180 - DNA, 25 bp, Mus musculus
gctgaggctaataacctggcagcag

SEQ ID NO: 692181 - DNA, 25 bp, Mus musculus
gctgaggctaattacctggcagcag

SEQ ID NO: 692182 - DNA, 25 bp, Mus musculus
gctgaggctctactttgatgatgcg

SEQ ID NO: 692183 - DNA, 25 bp, Mus musculus
gctgaggctctagtttgatgatgcg

SEQ ID NO: 692184 - DNA, 25 bp, Mus musculus
gctgaggctttgatgttgctgccca

SEQ ID NO: 692185 - DNA, 25 bp, Mus musculus
gctgaggctttgttgttgctgccca

SEQ ID NO: 692186 - DNA, 25 bp, Mus musculus
gctgagggctgacggaaggcaaagg

SEQ ID NO: 692187 - DNA, 25 bp, Mus musculus
gctgagggctgagggaaggcaaagg

SEQ ID NO: 692188 - DNA, 25 bp, Mus musculus
gctgagggttggaagcaatcacacc

SEQ ID NO: 692189 - DNA, 25 bp, Mus musculus
gctgagggttggtagcaatcacacc

SEQ ID NO: 692190 - DNA, 25 bp, Mus musculus
gctgagggttttcaatcccgacctt

SEQ ID NO: 692191 - DNA, 25 bp, Mus musculus
gctgagggttttgaatcccgacctt

SEQ ID NO: 692192 - DNA, 25 bp, Mus musculus
gctgaggtaaggcaaaaccagcggg

SEQ ID NO: 692193 - DNA, 25 bp, Mus musculus
gctgaggtaagggaaaaccagcggg

SEQ ID NO: 692194 - DNA, 25 bp, Mus musculus
gctgaggtacagaggcgactgtcac

SEQ ID NO: 692195 - DNA, 25 bp, Mus musculus
gctgaggtacagtggcgactgtcac

SEQ ID NO: 692196 - DNA, 25 bp, Mus musculus
gctgaggtcaacagcctctcattca

SEQ ID NO: 692197 - DNA, 25 bp, Mus musculus
gctgaggtcaactgcctctcattca

SEQ ID NO: 692198 - DNA, 25 bp, Mus musculus
gctgaggtcgaacagatgtgcaata

SEQ ID NO: 692199 - DNA, 25 bp, Mus musculus
gctgaggtcgaagagatgtgcaata

SEQ ID NO: 692200 - DNA, 25 bp, Mus musculus
gctgaggtctaccaccacctcaagg

SEQ ID NO: 692201 - DNA, 25 bp, Mus musculus
gctgaggtctacgaccacctcaagg

SEQ ID NO: 692202 - DNA, 25 bp, Mus musculus
gctgaggtgagtcgtggtggccgca

SEQ ID NO: 692203 - DNA, 25 bp, Mus musculus
gctgaggtgagtggtggtggccgca

SEQ ID NO: 692204 - DNA, 25 bp, Mus musculus
gctgaggtgcaaatcgtgcgcgacc

SEQ ID NO: 692205 - DNA, 25 bp, Mus musculus
gctgaggtgcaattcgtgcgcgacc

SEQ ID NO: 692206 - DNA, 25 bp, Mus musculus
gctgaggtgctgctcaacatcatag

SEQ ID NO: 692207 - DNA, 25 bp, Mus musculus
gctgaggtgctggtcaacatcatag

SEQ ID NO: 692208 - DNA, 25 bp, Mus musculus
gctgagtaagacaaagcacgtcccc

SEQ ID NO: 692209 - DNA, 25 bp, Mus musculus
gctgagtaagactaagcacgtcccc

SEQ ID NO: 692210 - DNA, 25 bp, Mus musculus
gctgagtacaacctgcgctcacgca

SEQ ID NO: 692211 - DNA, 25 bp, Mus musculus
gctgagtacaacgtgcgctcacgca

SEQ ID NO: 692212 - DNA, 25 bp, Mus musculus
gctgagtaccgtcaaaccatctcca

SEQ ID NO: 692213 - DNA, 25 bp, Mus musculus
gctgagtaccgtgaaaccatctcca

SEQ ID NO: 692214 - DNA, 25 bp, Mus musculus
gctgagtacctacacctggcgctgt

SEQ ID NO: 692215 - DNA, 25 bp, Mus musculus
gctgagtacctagacctggcgctgt

SEQ ID NO: 692216 - DNA, 25 bp, Mus musculus
gctgagtactggcaaaagcgccctc

SEQ ID NO: 692217 - DNA, 25 bp, Mus musculus
gctgagtactgggaaaagcgccctc

SEQ ID NO: 692218 - DNA, 25 bp, Mus musculus
gctgagtagtctccatgggcagctc

SEQ ID NO: 692219 - DNA, 25 bp, Mus musculus
gctgagtagtctgcatgggcagctc

SEQ ID NO: 692220 - DNA, 25 bp, Mus musculus
gctgagtccaaaagcaggaatggcc

SEQ ID NO: 692221 - DNA, 25 bp, Mus musculus
gctgagtccaaatgcaggaatggcc

SEQ ID NO: 692222 - DNA, 25 bp, Mus musculus
gctgagtctacaacttcgcctgaga

SEQ ID NO: 692223 - DNA, 25 bp, Mus musculus
gctgagtctacatcttcgcctgaga

SEQ ID NO: 692224 - DNA, 25 bp, Mus musculus
gctgagtctgacatcgtgtgcaaaa

SEQ ID NO: 692225 - DNA, 25 bp, Mus musculus
gctgagtctgacttcgtgtgcaaaa

SEQ ID NO: 692226 - DNA, 25 bp, Mus musculus
gctgagtgacttcttgctctggcag

SEQ ID NO: 692227 - DNA, 25 bp, Mus musculus
gctgagtgacttgttgctctggcag

SEQ ID NO: 692228 - DNA, 25 bp, Mus musculus
gctgagtgagagacaccctgccaat

SEQ ID NO: 692229 - DNA, 25 bp, Mus musculus
gctgagtgagagtcaccctgccaat

SEQ ID NO: 692230 - DNA, 25 bp, Mus musculus
gctgagtgaggaccttctgatgaca

SEQ ID NO: 692231 - DNA, 25 bp, Mus musculus
gctgagtgaggagcttctgatgaca

SEQ ID NO: 692232 - DNA, 25 bp, Mus musculus
gctgagtgctgacctcctgcatctt

SEQ ID NO: 692233 - DNA, 25 bp, Mus musculus
gctgagtgctgagctcctgcatctt

SEQ ID NO: 692234 - DNA, 25 bp, Mus musculus
gctgagtggataaacagcacgggat

SEQ ID NO: 692235 - DNA, 25 bp, Mus musculus
gctgagtggatatacagcacgggat

SEQ ID NO: 692236 - DNA, 25 bp, Mus musculus
gctgagtgtcatctgaatcccatca

SEQ ID NO: 692237 - DNA, 25 bp, Mus musculus
gctgagtgtcatgtgaatcccatca

SEQ ID NO: 692238 - DNA, 25 bp, Mus musculus
gctgagtgtgccagtcaactctggt

SEQ ID NO: 692239 - DNA, 25 bp, Mus musculus
gctgagtgtgcctgtcaactctggt

SEQ ID NO: 692240 - DNA, 25 bp, Mus musculus
gctgagttctgtagccctgctgtgg

SEQ ID NO: 692241 - DNA, 25 bp, Mus musculus
gctgagttctgttgccctgctgtgg

SEQ ID NO: 692242 - DNA, 25 bp, Mus musculus
gctgagttgaacaggagcctttgta

SEQ ID NO: 692243 - DNA, 25 bp, Mus musculus
gctgagttgaactggagcctttgta

SEQ ID NO: 692244 - DNA, 25 bp, Mus musculus
gctgagttggacaccctgaatgaag

SEQ ID NO: 692245 - DNA, 25 bp, Mus musculus
gctgagttggactccctgaatgaag

SEQ ID NO: 692246 - DNA, 25 bp, Mus musculus
gctgagttggccactctctgcaggt

SEQ ID NO: 692247 - DNA, 25 bp, Mus musculus
gctgagttggcctctctctgcaggt

SEQ ID NO: 692248 - DNA, 25 bp, Mus musculus
gctgagttgtctcaaatccttagtg

SEQ ID NO: 692249 - DNA, 25 bp, Mus musculus
gctgagttgtctgaaatccttagtg

SEQ ID NO: 692250 - DNA, 25 bp, Mus musculus
gctgagtttggtaagagaatccatt

SEQ ID NO: 692251 - DNA, 25 bp, Mus musculus
gctgagtttggttagagaatccatt

SEQ ID NO: 692252 - DNA, 25 bp, Mus musculus
gctgataaaccgaatagagcgagcc

SEQ ID NO: 692253 - DNA, 25 bp, Mus musculus
gctgataaaccgtatagagcgagcc

SEQ ID NO: 692254 - DNA, 25 bp, Mus musculus
gctgataacgacaactgtatgtgca

SEQ ID NO: 692255 - DNA, 25 bp, Mus musculus
gctgataacgactactgtatgtgca

SEQ ID NO: 692256 - DNA, 25 bp, Mus musculus
gctgataagaaaagcctctgaagaa

SEQ ID NO: 692257 - DNA, 25 bp, Mus musculus
gctgataagaaatgcctctgaagaa

SEQ ID NO: 692258 - DNA, 25 bp, Mus musculus
gctgataagtctcttcttcaccgtg

SEQ ID NO: 692259 - DNA, 25 bp, Mus musculus
gctgataagtctgttcttcaccgtg

SEQ ID NO: 692260 - DNA, 25 bp, Mus musculus
gctgataatcggcacactggtagtt

SEQ ID NO: 692261 - DNA, 25 bp, Mus musculus
gctgataatcgggacactggtagtt

SEQ ID NO: 692262 - DNA, 25 bp, Mus musculus
gctgatacgaaacgaggagccaaga

SEQ ID NO: 692263 - DNA, 25 bp, Mus musculus
gctgatacgaaaggaggagccaaga

SEQ ID NO: 692264 - DNA, 25 bp, Mus musculus
gctgatactgacattttgaacatgc

SEQ ID NO: 692265 - DNA, 25 bp, Mus musculus
gctgatactgactttttgaacatgc

SEQ ID NO: 692266 - DNA, 25 bp, Mus musculus
gctgatagacttcgaagattcggca

SEQ ID NO: 692267 - DNA, 25 bp, Mus musculus
gctgatagacttggaagattcggca

SEQ ID NO: 692268 - DNA, 25 bp, Mus musculus
gctgatagagatcgcgttgctgtct

SEQ ID NO: 692269 - DNA, 25 bp, Mus musculus
gctgatagagatggcgttgctgtct

SEQ ID NO: 692270 - DNA, 25 bp, Mus musculus
gctgatagctacctcagtgacccca

SEQ ID NO: 692271 - DNA, 25 bp, Mus musculus
gctgatagctacgtcagtgacccca

SEQ ID NO: 692272 - DNA, 25 bp, Mus musculus
gctgatagggacatgttctgtgctg

SEQ ID NO: 692273 - DNA, 25 bp, Mus musculus
gctgatagggacttgttctgtgctg

SEQ ID NO: 692274 - DNA, 25 bp, Mus musculus
gctgatagtaataccttggagatca

SEQ ID NO: 692275 - DNA, 25 bp, Mus musculus
gctgatagtaattccttggagatca

SEQ ID NO: 692276 - DNA, 25 bp, Mus musculus
gctgatattgatccttctgagcacc

SEQ ID NO: 692277 - DNA, 25 bp, Mus musculus
gctgatattgatgcttctgagcacc

SEQ ID NO: 692278 - DNA, 25 bp, Mus musculus
gctgatattgccctggttgaactcc

SEQ ID NO: 692279 - DNA, 25 bp, Mus musculus
gctgatattgccgtggttgaactcc

SEQ ID NO: 692280 - DNA, 25 bp, Mus musculus
gctgatcaacacagtttagatttct

SEQ ID NO: 692281 - DNA, 25 bp, Mus musculus
gctgatcaacactgtttagatttct

SEQ ID NO: 692282 - DNA, 25 bp, Mus musculus
gctgatcaagaactgtctcctgaca

SEQ ID NO: 692283 - DNA, 25 bp, Mus musculus
gctgatcaagaagtgtctcctgaca

SEQ ID NO: 692284 - DNA, 25 bp, Mus musculus
gctgatcacttcatgggctccctgg

SEQ ID NO: 692285 - DNA, 25 bp, Mus musculus
gctgatcacttcttgggctccctgg

SEQ ID NO: 692286 - DNA, 25 bp, Mus musculus
gctgatcagaatagggtgaccactc

SEQ ID NO: 692287 - DNA, 25 bp, Mus musculus
gctgatcagaattgggtgaccactc

SEQ ID NO: 692288 - DNA, 25 bp, Mus musculus
gctgatcagagcagccatccgccga

SEQ ID NO: 692289 - DNA, 25 bp, Mus musculus
gctgatcagagctgccatccgccga

SEQ ID NO: 692290 - DNA, 25 bp, Mus musculus
gctgatcagattaaggtcctgatga

SEQ ID NO: 692291 - DNA, 25 bp, Mus musculus
gctgatcagattctgagcaaactcg

SEQ ID NO: 692292 - DNA, 25 bp, Mus musculus
gctgatcagattgtgagcaaactcg

SEQ ID NO: 692293 - DNA, 25 bp, Mus musculus
gctgatcagatttaggtcctgatga

SEQ ID NO: 692294 - DNA, 25 bp, Mus musculus
gctgatcagcgccacccctagaatt

SEQ ID NO: 692295 - DNA, 25 bp, Mus musculus
gctgatcagcgcgacccctagaatt

SEQ ID NO: 692296 - DNA, 25 bp, Mus musculus
gctgatcatggacggcctctcggcc

SEQ ID NO: 692297 - DNA, 25 bp, Mus musculus
gctgatcatggagggcctctcggcc

SEQ ID NO: 692298 - DNA, 25 bp, Mus musculus
gctgatcattggcaatagcagcgtg

SEQ ID NO: 692299 - DNA, 25 bp, Mus musculus
gctgatcattgggaatagcagcgtg

SEQ ID NO: 692300 - DNA, 25 bp, Mus musculus
gctgatccatgacccgtctgcagct

SEQ ID NO: 692301 - DNA, 25 bp, Mus musculus
gctgatccatgagccgtctgcagct

SEQ ID NO: 692302 - DNA, 25 bp, Mus musculus
gctgatccgtgacgacatccaaggg

SEQ ID NO: 692303 - DNA, 25 bp, Mus musculus
gctgatccgtgaggacatccaaggg

SEQ ID NO: 692304 - DNA, 25 bp, Mus musculus
gctgatcgagcgcatccttctgctg

SEQ ID NO: 692305 - DNA, 25 bp, Mus musculus
gctgatcgagcggatccttctgctg

SEQ ID NO: 692306 - DNA, 25 bp, Mus musculus
gctgatcgcgtacggcaatggcttt

SEQ ID NO: 692307 - DNA, 25 bp, Mus musculus
gctgatcgcgtagggcaatggcttt

SEQ ID NO: 692308 - DNA, 25 bp, Mus musculus
gctgatcgttacctttcaggcccag

SEQ ID NO: 692309 - DNA, 25 bp, Mus musculus
gctgatcgttacgtttcaggcccag

SEQ ID NO: 692310 - DNA, 25 bp, Mus musculus
gctgatctaaccaacagcagtgccc

SEQ ID NO: 692311 - DNA, 25 bp, Mus musculus
gctgatctaacctacagcagtgccc

SEQ ID NO: 692312 - DNA, 25 bp, Mus musculus
gctgatctcccaccagaaggtcttc

SEQ ID NO: 692313 - DNA, 25 bp, Mus musculus
gctgatctcccagcagaaggtcttc

SEQ ID NO: 692314 - DNA, 25 bp, Mus musculus
gctgatctgaacagcatgaaagatc

SEQ ID NO: 692315 - DNA, 25 bp, Mus musculus
gctgatctgaactgcatgaaagatc

SEQ ID NO: 692316 - DNA, 25 bp, Mus musculus
gctgatctgtagatccaacttgaaa

SEQ ID NO: 692317 - DNA, 25 bp, Mus musculus
gctgatctgtagttccaacttgaaa

SEQ ID NO: 692318 - DNA, 25 bp, Mus musculus
gctgatgaaccaatgacaacatttg

SEQ ID NO: 692319 - DNA, 25 bp, Mus musculus
gctgatgaaccattgacaacatttg

SEQ ID NO: 692320 - DNA, 25 bp, Mus musculus
gctgatgaagcccataatatagtca

SEQ ID NO: 692321 - DNA, 25 bp, Mus musculus
gctgatgaagccgataatatagtca

SEQ ID NO: 692322 - DNA, 25 bp, Mus musculus
gctgatgaaggacagacggtcttct

SEQ ID NO: 692323 - DNA, 25 bp, Mus musculus
gctgatgaaggagagacggtcttct

SEQ ID NO: 692324 - DNA, 25 bp, Mus musculus
gctgatgacaccaatcccagatggg

SEQ ID NO: 692325 - DNA, 25 bp, Mus musculus
gctgatgacacctatcccagatggg

SEQ ID NO: 692326 - DNA, 25 bp, Mus musculus
gctgatgacctaagttggtgctgtt

SEQ ID NO: 692327 - DNA, 25 bp, Mus musculus
gctgatgacctatgttggtgctgtt

SEQ ID NO: 692328 - DNA, 25 bp, Mus musculus
gctgatgagaaaccccgggagtcca

SEQ ID NO: 692329 - DNA, 25 bp, Mus musculus
gctgatgagaaagcccgggagtcca

SEQ ID NO: 692330 - DNA, 25 bp, Mus musculus
gctgatgatcaccagggctttgtgc

SEQ ID NO: 692331 - DNA, 25 bp, Mus musculus
gctgatgatcacgagggctttgtgc

SEQ ID NO: 692332 - DNA, 25 bp, Mus musculus
gctgatgccagtctatccagttaac

SEQ ID NO: 692333 - DNA, 25 bp, Mus musculus
gctgatgccagtgtatccagttaac

SEQ ID NO: 692334 - DNA, 25 bp, Mus musculus
gctgatgcccgcactatctacgttg

SEQ ID NO: 692335 - DNA, 25 bp, Mus musculus
gctgatgcccgctctatctacgttg

SEQ ID NO: 692336 - DNA, 25 bp, Mus musculus
gctgatgccctacactggtacagtt

SEQ ID NO: 692337 - DNA, 25 bp, Mus musculus
gctgatgccctagactggtacagtt

SEQ ID NO: 692338 - DNA, 25 bp, Mus musculus
gctgatgccttcaacaaagccaaga

SEQ ID NO: 692339 - DNA, 25 bp, Mus musculus
gctgatgccttctacaaagccaaga

SEQ ID NO: 692340 - DNA, 25 bp, Mus musculus
gctgatgcggatctcatcaatgcag

SEQ ID NO: 692341 - DNA, 25 bp, Mus musculus
gctgatgcggatgtcatcaatgcag

SEQ ID NO: 692342 - DNA, 25 bp, Mus musculus
gctgatgctattccttgttttcggg

SEQ ID NO: 692343 - DNA, 25 bp, Mus musculus
gctgatgctattgcttgttttcggg

SEQ ID NO: 692344 - DNA, 25 bp, Mus musculus
gctgatgctcttctccacgatctgg

SEQ ID NO: 692345 - DNA, 25 bp, Mus musculus
gctgatgctcttgtccacgatctgg

SEQ ID NO: 692346 - DNA, 25 bp, Mus musculus
gctgatgctgggatcctgcattacc

SEQ ID NO: 692347 - DNA, 25 bp, Mus musculus
gctgatgctgggttcctgcattacc

SEQ ID NO: 692348 - DNA, 25 bp, Mus musculus
gctgatgctggtcctagtgtctgct

SEQ ID NO: 692349 - DNA, 25 bp, Mus musculus
gctgatgctggtgctagtgtctgct

SEQ ID NO: 692350 - DNA, 25 bp, Mus musculus
gctgatggacaaccagaccttctgc

SEQ ID NO: 692351 - DNA, 25 bp, Mus musculus
gctgatggacaagcagaccttctgc

SEQ ID NO: 692352 - DNA, 25 bp, Mus musculus
gctgatggaccacccggagctcttc

SEQ ID NO: 692353 - DNA, 25 bp, Mus musculus
gctgatggaccagccggagctcttc

SEQ ID NO: 692354 - DNA, 25 bp, Mus musculus
gctgatggacgcaatgaggtgcttt

SEQ ID NO: 692355 - DNA, 25 bp, Mus musculus
gctgatggacgctatgaggtgcttt

SEQ ID NO: 692356 - DNA, 25 bp, Mus musculus
gctgatggaggcagaacaccagcag

SEQ ID NO: 692357 - DNA, 25 bp, Mus musculus
gctgatggaggcagcgccgcatcca

SEQ ID NO: 692358 - DNA, 25 bp, Mus musculus
gctgatggaggctgaacaccagcag

SEQ ID NO: 692359 - DNA, 25 bp, Mus musculus
gctgatggaggctgcgccgcatcca

SEQ ID NO: 692360 - DNA, 25 bp, Mus musculus
gctgatggattcaggacgagctcca

SEQ ID NO: 692361 - DNA, 25 bp, Mus musculus
gctgatggattctggacgagctcca

SEQ ID NO: 692362 - DNA, 25 bp, Mus musculus
gctgatggcaaacctgacggcccta

SEQ ID NO: 692363 - DNA, 25 bp, Mus musculus
gctgatggcaaagctgacggcccta

SEQ ID NO: 692364 - DNA, 25 bp, Mus musculus
gctgatgggcctagctcgtctcata

SEQ ID NO: 692365 - DNA, 25 bp, Mus musculus
gctgatgggccttgctcgtctcata

SEQ ID NO: 692366 - DNA, 25 bp, Mus musculus
gctgatgtaaaaatggacaagaaga

SEQ ID NO: 692367 - DNA, 25 bp, Mus musculus
gctgatgtaaaattggacaagaaga

SEQ ID NO: 692368 - DNA, 25 bp, Mus musculus
gctgatgtaacacctaagaacattc

SEQ ID NO: 692369 - DNA, 25 bp, Mus musculus
gctgatgtaacagctaagaacattc

SEQ ID NO: 692370 - DNA, 25 bp, Mus musculus
gctgatgtacggcttatgttctcca

SEQ ID NO: 692371 - DNA, 25 bp, Mus musculus
gctgatgtacgggttatgttctcca

SEQ ID NO: 692372 - DNA, 25 bp, Mus musculus
gctgatgtaggaacactgcagagac

SEQ ID NO: 692373 - DNA, 25 bp, Mus musculus
gctgatgtaggatcactgcagagac

SEQ ID NO: 692374 - DNA, 25 bp, Mus musculus
gctgatgtcaccaaggaggctgaga

SEQ ID NO: 692375 - DNA, 25 bp, Mus musculus
gctgatgtcacctaggaggctgaga

SEQ ID NO: 692376 - DNA, 25 bp, Mus musculus
gctgatgtcatcaacctccatcgaa

SEQ ID NO: 692377 - DNA, 25 bp, Mus musculus
gctgatgtcatctacctccatcgaa

SEQ ID NO: 692378 - DNA, 25 bp, Mus musculus
gctgatgtcctgaggcagattaaca

SEQ ID NO: 692379 - DNA, 25 bp, Mus musculus
gctgatgtcctgtggcagattaaca

SEQ ID NO: 692380 - DNA, 25 bp, Mus musculus
gctgatgtgcctctcattgagagcg

SEQ ID NO: 692381 - DNA, 25 bp, Mus musculus
gctgatgtgcctgtcattgagagcg

SEQ ID NO: 692382 - DNA, 25 bp, Mus musculus
gctgatgtgctcactacaccccagg

SEQ ID NO: 692383 - DNA, 25 bp, Mus musculus
gctgatgtgctctctacaccccagg

SEQ ID NO: 692384 - DNA, 25 bp, Mus musculus
gctgatgttcctcgaaaccagtgca

SEQ ID NO: 692385 - DNA, 25 bp, Mus musculus
gctgatgttcctggaaaccagtgca

SEQ ID NO: 692386 - DNA, 25 bp, Mus musculus
gctgatgttgggagaccctggtaca

SEQ ID NO: 692387 - DNA, 25 bp, Mus musculus
gctgatgttgggtgaccctggtaca

SEQ ID NO: 692388 - DNA, 25 bp, Mus musculus
gctgattatcaaagctcaacttggg

SEQ ID NO: 692389 - DNA, 25 bp, Mus musculus
gctgattatcaacgagacggcaaca

SEQ ID NO: 692390 - DNA, 25 bp, Mus musculus
gctgattatcaaggagacggcaaca

SEQ ID NO: 692391 - DNA, 25 bp, Mus musculus
gctgattatcaatgctcaacttggg

SEQ ID NO: 692392 - DNA, 25 bp, Mus musculus
gctgattcgtcgagtgaggccgtca

SEQ ID NO: 692393 - DNA, 25 bp, Mus musculus
gctgattcgtcgtgtgaggccgtca

SEQ ID NO: 692394 - DNA, 25 bp, Mus musculus
gctgattctgaacaaccacattatg

SEQ ID NO: 692395 - DNA, 25 bp, Mus musculus
gctgattctgaagaaccacattatg

SEQ ID NO: 692396 - DNA, 25 bp, Mus musculus
gctgattctgatccggaaaaagaac

SEQ ID NO: 692397 - DNA, 25 bp, Mus musculus
gctgattctgatgcggaaaaagaac

SEQ ID NO: 692398 - DNA, 25 bp, Mus musculus
gctgattgattcagtatgcgcctct

SEQ ID NO: 692399 - DNA, 25 bp, Mus musculus
gctgattgattctgtatgcgcctct

SEQ ID NO: 692400 - DNA, 25 bp, Mus musculus
gctgattgatttatgccataaaaga

SEQ ID NO: 692401 - DNA, 25 bp, Mus musculus
gctgattgatttttgccataaaaga

SEQ ID NO: 692402 - DNA, 25 bp, Mus musculus
gctgattggcgtccgatccaccatg

SEQ ID NO: 692403 - DNA, 25 bp, Mus musculus
gctgattggcgtgcgatccaccatg

SEQ ID NO: 692404 - DNA, 25 bp, Mus musculus
gctgattggctaatcattcctgaag

SEQ ID NO: 692405 - DNA, 25 bp, Mus musculus
gctgattggctattcattcctgaag

SEQ ID NO: 692406 - DNA, 25 bp, Mus musculus
gctgatttcgggaccagtgagcgcc

SEQ ID NO: 692407 - DNA, 25 bp, Mus musculus
gctgatttcgggtccagtgagcgcc

SEQ ID NO: 692408 - DNA, 25 bp, Mus musculus
gctgcaaaattgatgaaagacgcca

SEQ ID NO: 692409 - DNA, 25 bp, Mus musculus
gctgcaaaattgttgaaagacgcca

SEQ ID NO: 692410 - DNA, 25 bp, Mus musculus
gctgcaaacccaactttggcttttg

SEQ ID NO: 692411 - DNA, 25 bp, Mus musculus
gctgcaaacccatctttggcttttg

SEQ ID NO: 692412 - DNA, 25 bp, Mus musculus
gctgcaaactagagcctgaaagcag

SEQ ID NO: 692413 - DNA, 25 bp, Mus musculus
gctgcaaactagtgcctgaaagcag

SEQ ID NO: 692414 - DNA, 25 bp, Mus musculus
gctgcaaagattcccgaggaatcca

SEQ ID NO: 692415 - DNA, 25 bp, Mus musculus
gctgcaaagattgccgaggaatcca

SEQ ID NO: 692416 - DNA, 25 bp, Mus musculus
gctgcaaaggcaacggcaacaaatt

SEQ ID NO: 692417 - DNA, 25 bp, Mus musculus
gctgcaaaggcatcggcaacaaatt

SEQ ID NO: 692418 - DNA, 25 bp, Mus musculus
gctgcaaaggctaggccgacttctg

SEQ ID NO: 692419 - DNA, 25 bp, Mus musculus
gctgcaaaggcttggccgacttctg

SEQ ID NO: 692420 - DNA, 25 bp, Mus musculus
gctgcaacatgactatggccacctt

SEQ ID NO: 692421 - DNA, 25 bp, Mus musculus
gctgcaacatgagtatggccacctt

SEQ ID NO: 692422 - DNA, 25 bp, Mus musculus
gctgcaactctacagggagcacctg

SEQ ID NO: 692423 - DNA, 25 bp, Mus musculus
gctgcaactctagagggagcacctg

SEQ ID NO: 692424 - DNA, 25 bp, Mus musculus
gctgcaactggacgagacctgtgct

SEQ ID NO: 692425 - DNA, 25 bp, Mus musculus
gctgcaactggaggagacctgtgct

SEQ ID NO: 692426 - DNA, 25 bp, Mus musculus
gctgcaacttggagtgccagtgaat

SEQ ID NO: 692427 - DNA, 25 bp, Mus musculus
gctgcaacttggtgtgccagtgaat

SEQ ID NO: 692428 - DNA, 25 bp, Mus musculus
gctgcaagcacaatccttaccggga

SEQ ID NO: 692429 - DNA, 25 bp, Mus musculus
gctgcaagcacattccttaccggga

SEQ ID NO: 692430 - DNA, 25 bp, Mus musculus
gctgcaagcagtagagagcccgttg

SEQ ID NO: 692431 - DNA, 25 bp, Mus musculus
gctgcaagcagttgagagcccgttg

SEQ ID NO: 692432 - DNA, 25 bp, Mus musculus
gctgcaaggctgaggttcatgacag

SEQ ID NO: 692433 - DNA, 25 bp, Mus musculus
gctgcaaggctgtggttcatgacag

SEQ ID NO: 692434 - DNA, 25 bp, Mus musculus
gctgcaaggtatcggcaagagaaaa

SEQ ID NO: 692435 - DNA, 25 bp, Mus musculus
gctgcaaggtatgggcaagagaaaa

SEQ ID NO: 692436 - DNA, 25 bp, Mus musculus
gctgcaagtcagatcatcacagtga

SEQ ID NO: 692437 - DNA, 25 bp, Mus musculus
gctgcaagtcagttcatcacagtga

SEQ ID NO: 692438 - DNA, 25 bp, Mus musculus
gctgcaagtcccaggcaagcttcaa

SEQ ID NO: 692439 - DNA, 25 bp, Mus musculus
gctgcaagtccctggcaagcttcaa

SEQ ID NO: 692440 - DNA, 25 bp, Mus musculus
gctgcaatattgatccctgggttga

SEQ ID NO: 692441 - DNA, 25 bp, Mus musculus
gctgcaatattgttccctgggttga

SEQ ID NO: 692442 - DNA, 25 bp, Mus musculus
gctgcaatgaatcgacatgttcccg

SEQ ID NO: 692443 - DNA, 25 bp, Mus musculus
gctgcaatgaatggacatgttcccg

SEQ ID NO: 692444 - DNA, 25 bp, Mus musculus
gctgcaatgagcaaaatgacttgtt

SEQ ID NO: 692445 - DNA, 25 bp, Mus musculus
gctgcaatgagctaaatgacttgtt

SEQ ID NO: 692446 - DNA, 25 bp, Mus musculus
gctgcaatgcacctaagggctggta

SEQ ID NO: 692447 - DNA, 25 bp, Mus musculus
gctgcaatgcacgtaagggctggta

SEQ ID NO: 692448 - DNA, 25 bp, Mus musculus
gctgcaatggcaatggatttccttg

SEQ ID NO: 692449 - DNA, 25 bp, Mus musculus
gctgcaatggcattggatttccttg

SEQ ID NO: 692450 - DNA, 25 bp, Mus musculus
gctgcacaaaccaagagcaaactca

SEQ ID NO: 692451 - DNA, 25 bp, Mus musculus
gctgcacaaacctagagcaaactca

SEQ ID NO: 692452 - DNA, 25 bp, Mus musculus
gctgcacaaaggaattcctcacacc

SEQ ID NO: 692453 - DNA, 25 bp, Mus musculus
gctgcacaaaggtattcctcacacc

SEQ ID NO: 692454 - DNA, 25 bp, Mus musculus
gctgcacaaccaccttttacctaat

SEQ ID NO: 692455 - DNA, 25 bp, Mus musculus
gctgcacaaccagcttttacctaat

SEQ ID NO: 692456 - DNA, 25 bp, Mus musculus
gctgcacaacttacctcctgaccag

SEQ ID NO: 692457 - DNA, 25 bp, Mus musculus
gctgcacaactttcctcctgaccag

SEQ ID NO: 692458 - DNA, 25 bp, Mus musculus
gctgcacaagcaaaagcgttggtac

SEQ ID NO: 692459 - DNA, 25 bp, Mus musculus
gctgcacaagcataagcgttggtac

SEQ ID NO: 692460 - DNA, 25 bp, Mus musculus
gctgcacaattcagttggtcctggg

SEQ ID NO: 692461 - DNA, 25 bp, Mus musculus
gctgcacaattctgttggtcctggg

SEQ ID NO: 692462 - DNA, 25 bp, Mus musculus
gctgcacacactaggagatctcctc

SEQ ID NO: 692463 - DNA, 25 bp, Mus musculus
gctgcacacacttggagatctcctc

SEQ ID NO: 692464 - DNA, 25 bp, Mus musculus
gctgcacacggtacttatcatattg

SEQ ID NO: 692465 - DNA, 25 bp, Mus musculus
gctgcacacggttcttatcatattg

SEQ ID NO: 692466 - DNA, 25 bp, Mus musculus
gctgcacagatcctgcagagcgacc

SEQ ID NO: 692467 - DNA, 25 bp, Mus musculus
gctgcacagatcgtgcagagcgacc

SEQ ID NO: 692468 - DNA, 25 bp, Mus musculus
gctgcacagcaaaaggcatccctgt

SEQ ID NO: 692469 - DNA, 25 bp, Mus musculus
gctgcacagcaataggcatccctgt

SEQ ID NO: 692470 - DNA, 25 bp, Mus musculus
gctgcacaggagctgaaagctgatt

SEQ ID NO: 692471 - DNA, 25 bp, Mus musculus
gctgcacaggaggtgaaagctgatt

SEQ ID NO: 692472 - DNA, 25 bp, Mus musculus
gctgcacaggctcccttccagaagg

SEQ ID NO: 692473 - DNA, 25 bp, Mus musculus
gctgcacaggctgccttccagaagg

SEQ ID NO: 692474 - DNA, 25 bp, Mus musculus
gctgcacaggtactattgtgtaagc

SEQ ID NO: 692475 - DNA, 25 bp, Mus musculus
gctgcacaggtagtattgtgtaagc

SEQ ID NO: 692476 - DNA, 25 bp, Mus musculus
gctgcacatgagaaaagtacagaat

SEQ ID NO: 692477 - DNA, 25 bp, Mus musculus
gctgcacatgagtaaagtacagaat

SEQ ID NO: 692478 - DNA, 25 bp, Mus musculus
gctgcaccaaatccatcaaatacct

SEQ ID NO: 692479 - DNA, 25 bp, Mus musculus
gctgcaccaaatgcatcaaatacct

SEQ ID NO: 692480 - DNA, 25 bp, Mus musculus
gctgcaccaacgacaccatttgctt

SEQ ID NO: 692481 - DNA, 25 bp, Mus musculus
gctgcaccaacgtcaccatttgctt

SEQ ID NO: 692482 - DNA, 25 bp, Mus musculus
gctgcacccaaaccaagtgcaaagt

SEQ ID NO: 692483 - DNA, 25 bp, Mus musculus
gctgcacccaaagcaagtgcaaagt

SEQ ID NO: 692484 - DNA, 25 bp, Mus musculus
gctgcacccaccctcgtgtgtggga

SEQ ID NO: 692485 - DNA, 25 bp, Mus musculus
gctgcacccaccgtcgtgtgtggga

SEQ ID NO: 692486 - DNA, 25 bp, Mus musculus
gctgcacccgggacattgtgctacc

SEQ ID NO: 692487 - DNA, 25 bp, Mus musculus
gctgcacccgggtcattgtgctacc

SEQ ID NO: 692488 - DNA, 25 bp, Mus musculus
gctgcaccgatgacgtgtttgcctg

SEQ ID NO: 692489 - DNA, 25 bp, Mus musculus
gctgcaccgatgtcgtgtttgcctg

SEQ ID NO: 692490 - DNA, 25 bp, Mus musculus
gctgcaccgccaaatagaggaaggt

SEQ ID NO: 692491 - DNA, 25 bp, Mus musculus
gctgcaccgccatatagaggaaggt

SEQ ID NO: 692492 - DNA, 25 bp, Mus musculus
gctgcaccggagactgatggctctg

SEQ ID NO: 692493 - DNA, 25 bp, Mus musculus
gctgcaccggagtctgatggctctg

SEQ ID NO: 692494 - DNA, 25 bp, Mus musculus
gctgcacctagacctgaagccagcg

SEQ ID NO: 692495 - DNA, 25 bp, Mus musculus
gctgcacctagagctgaagccagcg

SEQ ID NO: 692496 - DNA, 25 bp, Mus musculus
gctgcacctggactaccgcttttac

SEQ ID NO: 692497 - DNA, 25 bp, Mus musculus
gctgcacctggagtaccgcttttac

SEQ ID NO: 692498 - DNA, 25 bp, Mus musculus
gctgcacgctcacccaaatcctggg

SEQ ID NO: 692499 - DNA, 25 bp, Mus musculus
gctgcacgctcagccaaatcctggg

SEQ ID NO: 692500 - DNA, 25 bp, Mus musculus
gctgcacgctggacgccttctgctg

SEQ ID NO: 692501 - DNA, 25 bp, Mus musculus
gctgcacgctggtcgccttctgctg

SEQ ID NO: 692502 - DNA, 25 bp, Mus musculus
gctgcacggacacacatggagagca

SEQ ID NO: 692503 - DNA, 25 bp, Mus musculus
gctgcacggacagacatggagagca

SEQ ID NO: 692504 - DNA, 25 bp, Mus musculus
gctgcacggcaactgctgtcagatg

SEQ ID NO: 692505 - DNA, 25 bp, Mus musculus
gctgcacggcaagtgctgtcagatg

SEQ ID NO: 692506 - DNA, 25 bp, Mus musculus
gctgcacgtgggaatttggagccat

SEQ ID NO: 692507 - DNA, 25 bp, Mus musculus
gctgcacgtgggtatttggagccat

SEQ ID NO: 692508 - DNA, 25 bp, Mus musculus
gctgcactgagcagtctcggaaccc

SEQ ID NO: 692509 - DNA, 25 bp, Mus musculus
gctgcactgagctgtctcggaaccc

SEQ ID NO: 692510 - DNA, 25 bp, Mus musculus
gctgcactgccgaactatgtggcct

SEQ ID NO: 692511 - DNA, 25 bp, Mus musculus
gctgcactgccgtactatgtggcct

SEQ ID NO: 692512 - DNA, 25 bp, Mus musculus
gctgcactgcgtcagctccgacaaa

SEQ ID NO: 692513 - DNA, 25 bp, Mus musculus
gctgcactgcgtgagctccgacaaa

SEQ ID NO: 692514 - DNA, 25 bp, Mus musculus
gctgcactggctccacgacgggatc

SEQ ID NO: 692515 - DNA, 25 bp, Mus musculus
gctgcactggctgcacgacgggatc

SEQ ID NO: 692516 - DNA, 25 bp, Mus musculus
gctgcactgggcatgctagtccact

SEQ ID NO: 692517 - DNA, 25 bp, Mus musculus
gctgcactgggcttgctagtccact

SEQ ID NO: 692518 - DNA, 25 bp, Mus musculus
gctgcactggtgcaacgcctcttta

SEQ ID NO: 692519 - DNA, 25 bp, Mus musculus
gctgcactggtggaacgcctcttta

SEQ ID NO: 692520 - DNA, 25 bp, Mus musculus
gctgcagaaatgcacttggaagatg

SEQ ID NO: 692521 - DNA, 25 bp, Mus musculus
gctgcagaaatggacttggaagatg

SEQ ID NO: 692522 - DNA, 25 bp, Mus musculus
gctgcagaacagcagacaacagttg

SEQ ID NO: 692523 - DNA, 25 bp, Mus musculus
gctgcagaacaggagacaacagttg

SEQ ID NO: 692524 - DNA, 25 bp, Mus musculus
gctgcagaagaaatccattttaaag

SEQ ID NO: 692525 - DNA, 25 bp, Mus musculus
gctgcagaagaattccattttaaag

SEQ ID NO: 692526 - DNA, 25 bp, Mus musculus
gctgcagaagacatagcatctaggg

SEQ ID NO: 692527 - DNA, 25 bp, Mus musculus
gctgcagaagacttagcatctaggg

SEQ ID NO: 692528 - DNA, 25 bp, Mus musculus
gctgcagaaggaacatgaagccttc

SEQ ID NO: 692529 - DNA, 25 bp, Mus musculus
gctgcagaaggatcatgaagccttc

SEQ ID NO: 692530 - DNA, 25 bp, Mus musculus
gctgcagaagtgagcccagaagacc

SEQ ID NO: 692531 - DNA, 25 bp, Mus musculus
gctgcagaagtgtgcccagaagacc

SEQ ID NO: 692532 - DNA, 25 bp, Mus musculus
gctgcagacagcaaggcggttttat

SEQ ID NO: 692533 - DNA, 25 bp, Mus musculus
gctgcagacagctaggcggttttat

SEQ ID NO: 692534 - DNA, 25 bp, Mus musculus
gctgcagacatcagcttcaccaagg

SEQ ID NO: 692535 - DNA, 25 bp, Mus musculus
gctgcagacatcattaaacactaca

SEQ ID NO: 692536 - DNA, 25 bp, Mus musculus
gctgcagacatctgcttcaccaagg

SEQ ID NO: 692537 - DNA, 25 bp, Mus musculus
gctgcagacatctttaaacactaca

SEQ ID NO: 692538 - DNA, 25 bp, Mus musculus
gctgcagaccaacggctttagctcc

SEQ ID NO: 692539 - DNA, 25 bp, Mus musculus
gctgcagaccaagggctttagctcc

SEQ ID NO: 692540 - DNA, 25 bp, Mus musculus
gctgcagaccatctatgaaatggag

SEQ ID NO: 692541 - DNA, 25 bp, Mus musculus
gctgcagaccatgtatgaaatggag

SEQ ID NO: 692542 - DNA, 25 bp, Mus musculus
gctgcagactctagctgcacttagt

SEQ ID NO: 692543 - DNA, 25 bp, Mus musculus
gctgcagactcttgctgcacttagt

SEQ ID NO: 692544 - DNA, 25 bp, Mus musculus
gctgcagagaccagccattcaccat

SEQ ID NO: 692545 - DNA, 25 bp, Mus musculus
gctgcagagacctgccattcaccat

SEQ ID NO: 692546 - DNA, 25 bp, Mus musculus
gctgcagaggaaactagatcatgag

SEQ ID NO: 692547 - DNA, 25 bp, Mus musculus
gctgcagaggaacatgcccggaacc

SEQ ID NO: 692548 - DNA, 25 bp, Mus musculus
gctgcagaggaagatgcccggaacc

SEQ ID NO: 692549 - DNA, 25 bp, Mus musculus
gctgcagaggaatctagatcatgag

SEQ ID NO: 692550 - DNA, 25 bp, Mus musculus
gctgcagatcataacagagaaaagt

SEQ ID NO: 692551 - DNA, 25 bp, Mus musculus
gctgcagatcattacagagaaaagt

SEQ ID NO: 692552 - DNA, 25 bp, Mus musculus
gctgcagatggcaattactgcgggt

SEQ ID NO: 692553 - DNA, 25 bp, Mus musculus
gctgcagatggctattactgcgggt

SEQ ID NO: 692554 - DNA, 25 bp, Mus musculus
gctgcagattctcgccagattctct

SEQ ID NO: 692555 - DNA, 25 bp, Mus musculus
gctgcagattctggccagattctct

SEQ ID NO: 692556 - DNA, 25 bp, Mus musculus
gctgcagcaagacaaaccatttaaa

SEQ ID NO: 692557 - DNA, 25 bp, Mus musculus
gctgcagcaagagaaaccatttaaa

SEQ ID NO: 692558 - DNA, 25 bp, Mus musculus
gctgcagcagctcattaaagatctc

SEQ ID NO: 692559 - DNA, 25 bp, Mus musculus
gctgcagcagctgattaaagatctc

SEQ ID NO: 692560 - DNA, 25 bp, Mus musculus
gctgcagcagggcttttaactcttc

SEQ ID NO: 692561 - DNA, 25 bp, Mus musculus
gctgcagcaggggttttaactcttc

SEQ ID NO: 692562 - DNA, 25 bp, Mus musculus
gctgcagcattacctcacatttctg

SEQ ID NO: 692563 - DNA, 25 bp, Mus musculus
gctgcagcattagctcacatttctg

SEQ ID NO: 692564 - DNA, 25 bp, Mus musculus
gctgcagccaagactgtgagtgaag

SEQ ID NO: 692565 - DNA, 25 bp, Mus musculus
gctgcagccaagtctgtgagtgaag

SEQ ID NO: 692566 - DNA, 25 bp, Mus musculus
gctgcagcccacctcgtggcgttag

SEQ ID NO: 692567 - DNA, 25 bp, Mus musculus
gctgcagcccacgtcgtggcgttag

SEQ ID NO: 692568 - DNA, 25 bp, Mus musculus
gctgcagccggcaggcatttatctc

SEQ ID NO: 692569 - DNA, 25 bp, Mus musculus
gctgcagccggctggcatttatctc

SEQ ID NO: 692570 - DNA, 25 bp, Mus musculus
gctgcagccgtactagtttacgata

SEQ ID NO: 692571 - DNA, 25 bp, Mus musculus
gctgcagccgtagtagtttacgata

SEQ ID NO: 692572 - DNA, 25 bp, Mus musculus
gctgcagccgtcacagattggcttt

SEQ ID NO: 692573 - DNA, 25 bp, Mus musculus
gctgcagccgtcatcgtctatgaca

SEQ ID NO: 692574 - DNA, 25 bp, Mus musculus
gctgcagccgtctcagattggcttt

SEQ ID NO: 692575 - DNA, 25 bp, Mus musculus
gctgcagccgtcttcgtctatgaca

SEQ ID NO: 692576 - DNA, 25 bp, Mus musculus
gctgcagccgtgcagaacaaccaga

SEQ ID NO: 692577 - DNA, 25 bp, Mus musculus
gctgcagccgtggagaacaaccaga

SEQ ID NO: 692578 - DNA, 25 bp, Mus musculus
gctgcagcgagacgcacagacactg

SEQ ID NO: 692579 - DNA, 25 bp, Mus musculus
gctgcagcgagacgctgaagaatct

SEQ ID NO: 692580 - DNA, 25 bp, Mus musculus
gctgcagcgagaggcacagacactg

SEQ ID NO: 692581 - DNA, 25 bp, Mus musculus
gctgcagcgagaggctgaagaatct

SEQ ID NO: 692582 - DNA, 25 bp, Mus musculus
gctgcagcgatacctgcccggttgt

SEQ ID NO: 692583 - DNA, 25 bp, Mus musculus
gctgcagcgatagctgcccggttgt

SEQ ID NO: 692584 - DNA, 25 bp, Mus musculus
gctgcagcgcgacttcaacaagctg

SEQ ID NO: 692585 - DNA, 25 bp, Mus musculus
gctgcagcgcgagttcaacaagctg

SEQ ID NO: 692586 - DNA, 25 bp, Mus musculus
gctgcagctaacagccttgggaaga

SEQ ID NO: 692587 - DNA, 25 bp, Mus musculus
gctgcagctaactgccttgggaaga

SEQ ID NO: 692588 - DNA, 25 bp, Mus musculus
gctgcagctacccttactgaagtgg

SEQ ID NO: 692589 - DNA, 25 bp, Mus musculus
gctgcagctaccgttactgaagtgg

SEQ ID NO: 692590 - DNA, 25 bp, Mus musculus
gctgcagctcccagaatcaaaaaat

SEQ ID NO: 692591 - DNA, 25 bp, Mus musculus
gctgcagctccctgaatcaaaaaat

SEQ ID NO: 692592 - DNA, 25 bp, Mus musculus
gctgcagctcgcacgatgggctgct

SEQ ID NO: 692593 - DNA, 25 bp, Mus musculus
gctgcagctcgctcgatgggctgct

SEQ ID NO: 692594 - DNA, 25 bp, Mus musculus
gctgcagctcttcggacctacgtgg

SEQ ID NO: 692595 - DNA, 25 bp, Mus musculus
gctgcagctcttgggacctacgtgg

SEQ ID NO: 692596 - DNA, 25 bp, Mus musculus
gctgcagctgcacaacttcaacacg

SEQ ID NO: 692597 - DNA, 25 bp, Mus musculus
gctgcagctgcagaacttcaacacg

SEQ ID NO: 692598 - DNA, 25 bp, Mus musculus
gctgcagctgccagatacaaagatt

SEQ ID NO: 692599 - DNA, 25 bp, Mus musculus
gctgcagctgcctgatacaaagatt

SEQ ID NO: 692600 - DNA, 25 bp, Mus musculus
gctgcagcttcgctcccaagacttg

SEQ ID NO: 692601 - DNA, 25 bp, Mus musculus
gctgcagcttcggtcccaagacttg

SEQ ID NO: 692602 - DNA, 25 bp, Mus musculus
gctgcaggaagtacaacgtcaagca

SEQ ID NO: 692603 - DNA, 25 bp, Mus musculus
gctgcaggaagtctagtgcattctg

SEQ ID NO: 692604 - DNA, 25 bp, Mus musculus
gctgcaggaagtgtagtgcattctg

SEQ ID NO: 692605 - DNA, 25 bp, Mus musculus
gctgcaggaagttcaacgtcaagca

SEQ ID NO: 692606 - DNA, 25 bp, Mus musculus
gctgcaggagatagatcgctacgcc

SEQ ID NO: 692607 - DNA, 25 bp, Mus musculus
gctgcaggagatagatgttttcaac

SEQ ID NO: 692608 - DNA, 25 bp, Mus musculus
gctgcaggagattgatcgctacgcc

SEQ ID NO: 692609 - DNA, 25 bp, Mus musculus
gctgcaggagattgatgttttcaac

SEQ ID NO: 692610 - DNA, 25 bp, Mus musculus
gctgcaggagcacgtagatcattgt

SEQ ID NO: 692611 - DNA, 25 bp, Mus musculus
gctgcaggagcaggtagatcattgt

SEQ ID NO: 692612 - DNA, 25 bp, Mus musculus
gctgcaggatgtccagatgccttca

SEQ ID NO: 692613 - DNA, 25 bp, Mus musculus
gctgcaggatgtgcagatgccttca

SEQ ID NO: 692614 - DNA, 25 bp, Mus musculus
gctgcaggcattagagaatattgaa

SEQ ID NO: 692615 - DNA, 25 bp, Mus musculus
gctgcaggcatttgagaatattgaa

SEQ ID NO: 692616 - DNA, 25 bp, Mus musculus
gctgcaggccctacagtagtgccca

SEQ ID NO: 692617 - DNA, 25 bp, Mus musculus
gctgcaggcccttcagtagtgccca

SEQ ID NO: 692618 - DNA, 25 bp, Mus musculus
gctgcagggattacctcgacctccg

SEQ ID NO: 692619 - DNA, 25 bp, Mus musculus
gctgcagggatttcctcgacctccg

SEQ ID NO: 692620 - DNA, 25 bp, Mus musculus
gctgcaggtccccaaaacaatagta

SEQ ID NO: 692621 - DNA, 25 bp, Mus musculus
gctgcaggtcccgaaaacaatagta

SEQ ID NO: 692622 - DNA, 25 bp, Mus musculus
gctgcagtaaacacactccggtctt

SEQ ID NO: 692623 - DNA, 25 bp, Mus musculus
gctgcagtaaactcactccggtctt

SEQ ID NO: 692624 - DNA, 25 bp, Mus musculus
gctgcagtaatgacaatgtgactgt

SEQ ID NO: 692625 - DNA, 25 bp, Mus musculus
gctgcagtaatgtcaatgtgactgt

SEQ ID NO: 692626 - DNA, 25 bp, Mus musculus
gctgcagtagttcagtatagtgacc

SEQ ID NO: 692627 - DNA, 25 bp, Mus musculus
gctgcagtagttgagtatagtgacc

SEQ ID NO: 692628 - DNA, 25 bp, Mus musculus
gctgcagtatacaagatctccagtt

SEQ ID NO: 692629 - DNA, 25 bp, Mus musculus
gctgcagtatactagatctccagtt

SEQ ID NO: 692630 - DNA, 25 bp, Mus musculus
gctgcagtcactctactaagagtgg

SEQ ID NO: 692631 - DNA, 25 bp, Mus musculus
gctgcagtcactgtactaagagtgg

SEQ ID NO: 692632 - DNA, 25 bp, Mus musculus
gctgcagtcatcatgagaataagag

SEQ ID NO: 692633 - DNA, 25 bp, Mus musculus
gctgcagtcatcttgagaataagag

SEQ ID NO: 692634 - DNA, 25 bp, Mus musculus
gctgcagtcgcacatctcagacaca

SEQ ID NO: 692635 - DNA, 25 bp, Mus musculus
gctgcagtcgcagatctcagacaca

SEQ ID NO: 692636 - DNA, 25 bp, Mus musculus
gctgcagtcggaccgggttctctat

SEQ ID NO: 692637 - DNA, 25 bp, Mus musculus
gctgcagtcggagcgggttctctat

SEQ ID NO: 692638 - DNA, 25 bp, Mus musculus
gctgcagtgacaagtccagcatgaa

SEQ ID NO: 692639 - DNA, 25 bp, Mus musculus
gctgcagtgacatgtccagcatgaa

SEQ ID NO: 692640 - DNA, 25 bp, Mus musculus
gctgcagtgcctcccacggaacaag

SEQ ID NO: 692641 - DNA, 25 bp, Mus musculus
gctgcagtgcctgccacggaacaag

SEQ ID NO: 692642 - DNA, 25 bp, Mus musculus
gctgcagtggtcctctccctacaga

SEQ ID NO: 692643 - DNA, 25 bp, Mus musculus
gctgcagtggtcgtctccctacaga

SEQ ID NO: 692644 - DNA, 25 bp, Mus musculus
gctgcagtgtaaattataccactga

SEQ ID NO: 692645 - DNA, 25 bp, Mus musculus
gctgcagtgtaatttataccactga

SEQ ID NO: 692646 - DNA, 25 bp, Mus musculus
gctgcagtgtctatgtggcaagagt

SEQ ID NO: 692647 - DNA, 25 bp, Mus musculus
gctgcagtgtctttgtggcaagagt

SEQ ID NO: 692648 - DNA, 25 bp, Mus musculus
gctgcagttctaccggtcgctctac

SEQ ID NO: 692649 - DNA, 25 bp, Mus musculus
gctgcagttctagcggtcgctctac

SEQ ID NO: 692650 - DNA, 25 bp, Mus musculus
gctgcagttgacagtcaggtgaccc

SEQ ID NO: 692651 - DNA, 25 bp, Mus musculus
gctgcagttgactgtcaggtgaccc

SEQ ID NO: 692652 - DNA, 25 bp, Mus musculus
gctgcataacggactggacttctct

SEQ ID NO: 692653 - DNA, 25 bp, Mus musculus
gctgcataacggtctggacttctct

SEQ ID NO: 692654 - DNA, 25 bp, Mus musculus
gctgcataactcatacacagatgtg

SEQ ID NO: 692655 - DNA, 25 bp, Mus musculus
gctgcataactcttacacagatgtg

SEQ ID NO: 692656 - DNA, 25 bp, Mus musculus
gctgcataatcactatgtgttggca

SEQ ID NO: 692657 - DNA, 25 bp, Mus musculus
gctgcataatcagtatgtgttggca

SEQ ID NO: 692658 - DNA, 25 bp, Mus musculus
gctgcatagagaacagtaccctctg

SEQ ID NO: 692659 - DNA, 25 bp, Mus musculus
gctgcatagagatcagtaccctctg

SEQ ID NO: 692660 - DNA, 25 bp, Mus musculus
gctgcatatgggatcctagagaaga

SEQ ID NO: 692661 - DNA, 25 bp, Mus musculus
gctgcatatgggttcctagagaaga

SEQ ID NO: 692662 - DNA, 25 bp, Mus musculus
gctgcatcaagtcacaatatcatgg

SEQ ID NO: 692663 - DNA, 25 bp, Mus musculus
gctgcatcaagtgacaatatcatgg

SEQ ID NO: 692664 - DNA, 25 bp, Mus musculus
gctgcatcaggaacttttgtcccga

SEQ ID NO: 692665 - DNA, 25 bp, Mus musculus
gctgcatcaggatcttttgtcccga

SEQ ID NO: 692666 - DNA, 25 bp, Mus musculus
gctgcatcatcacctctaaatttgg

SEQ ID NO: 692667 - DNA, 25 bp, Mus musculus
gctgcatcatcagctctaaatttgg

SEQ ID NO: 692668 - DNA, 25 bp, Mus musculus
gctgcatcatctatgagtactacgt

SEQ ID NO: 692669 - DNA, 25 bp, Mus musculus
gctgcatcatctttgagtactacgt

SEQ ID NO: 692670 - DNA, 25 bp, Mus musculus
gctgcatccaatcttcgggccgaaa

SEQ ID NO: 692671 - DNA, 25 bp, Mus musculus
gctgcatccaatgttcgggccgaaa

SEQ ID NO: 692672 - DNA, 25 bp, Mus musculus
gctgcatcccaacgacaaagtcatg

SEQ ID NO: 692673 - DNA, 25 bp, Mus musculus
gctgcatcccaaggacaaagtcatg

SEQ ID NO: 692674 - DNA, 25 bp, Mus musculus
gctgcatccgctccaatgccgagaa

SEQ ID NO: 692675 - DNA, 25 bp, Mus musculus
gctgcatccgctgcaatgccgagaa

SEQ ID NO: 692676 - DNA, 25 bp, Mus musculus
gctgcatcctggactgccagcctgg

SEQ ID NO: 692677 - DNA, 25 bp, Mus musculus
gctgcatcctggtctgccagcctgg

SEQ ID NO: 692678 - DNA, 25 bp, Mus musculus
gctgcatcgtcaacaactccaatgg

SEQ ID NO: 692679 - DNA, 25 bp, Mus musculus
gctgcatcgtcatcaactccaatgg

SEQ ID NO: 692680 - DNA, 25 bp, Mus musculus
gctgcatctcgaaggactatccaga

SEQ ID NO: 692681 - DNA, 25 bp, Mus musculus
gctgcatctcgatggactatccaga

SEQ ID NO: 692682 - DNA, 25 bp, Mus musculus
gctgcatgagcgaagttcctgagat

SEQ ID NO: 692683 - DNA, 25 bp, Mus musculus
gctgcatgagcgtagttcctgagat

SEQ ID NO: 692684 - DNA, 25 bp, Mus musculus
gctgcatgagtccttgtttggatct

SEQ ID NO: 692685 - DNA, 25 bp, Mus musculus
gctgcatgagtcgttgtttggatct

SEQ ID NO: 692686 - DNA, 25 bp, Mus musculus
gctgcatgccctatgcacgtgcgca

SEQ ID NO: 692687 - DNA, 25 bp, Mus musculus
gctgcatgccctttgcacgtgcgca

SEQ ID NO: 692688 - DNA, 25 bp, Mus musculus
gctgcatggaatcagcctccactca

SEQ ID NO: 692689 - DNA, 25 bp, Mus musculus
gctgcatggaatgagcctccactca

SEQ ID NO: 692690 - DNA, 25 bp, Mus musculus
gctgcatggcatcgtctggtacttc

SEQ ID NO: 692691 - DNA, 25 bp, Mus musculus
gctgcatggcatggtctggtacttc

SEQ ID NO: 692692 - DNA, 25 bp, Mus musculus
gctgcatggcccagcgatctggaca

SEQ ID NO: 692693 - DNA, 25 bp, Mus musculus
gctgcatggccctgcgatctggaca

SEQ ID NO: 692694 - DNA, 25 bp, Mus musculus
gctgcatgtcttctgaatagcaata

SEQ ID NO: 692695 - DNA, 25 bp, Mus musculus
gctgcatgtcttgtgaatagcaata

SEQ ID NO: 692696 - DNA, 25 bp, Mus musculus
gctgcattacggctcccacagtgag

SEQ ID NO: 692697 - DNA, 25 bp, Mus musculus
gctgcattacgggtcccacagtgag

SEQ ID NO: 692698 - DNA, 25 bp, Mus musculus
gctgcattagctcctatgaatggga

SEQ ID NO: 692699 - DNA, 25 bp, Mus musculus
gctgcattagctgctatgaatggga

SEQ ID NO: 692700 - DNA, 25 bp, Mus musculus
gctgcattttttctcacctatgaat

SEQ ID NO: 692701 - DNA, 25 bp, Mus musculus
gctgcattttttgtcacctatgaat

SEQ ID NO: 692702 - DNA, 25 bp, Mus musculus
gctgccaaacggagacccaaggaag

SEQ ID NO: 692703 - DNA, 25 bp, Mus musculus
gctgccaaacggtgacccaaggaag

SEQ ID NO: 692704 - DNA, 25 bp, Mus musculus
gctgccaacactaccagagggatcc

SEQ ID NO: 692705 - DNA, 25 bp, Mus musculus
gctgccaacacttccagagggatcc

SEQ ID NO: 692706 - DNA, 25 bp, Mus musculus
gctgccaacatacatgaagtgcaga

SEQ ID NO: 692707 - DNA, 25 bp, Mus musculus
gctgccaacatagatgaagtgcaga

SEQ ID NO: 692708 - DNA, 25 bp, Mus musculus
gctgccaactttcagaacttatctg

SEQ ID NO: 692709 - DNA, 25 bp, Mus musculus
gctgccaactttgagaacttatctg

SEQ ID NO: 692710 - DNA, 25 bp, Mus musculus
gctgccaaggagacaggtagtatcc

SEQ ID NO: 692711 - DNA, 25 bp, Mus musculus
gctgccaaggagtcaggtagtatcc

SEQ ID NO: 692712 - DNA, 25 bp, Mus musculus
gctgccaagtggaattcactgcctt

SEQ ID NO: 692713 - DNA, 25 bp, Mus musculus
gctgccaagtggtattcactgcctt

SEQ ID NO: 692714 - DNA, 25 bp, Mus musculus
gctgccaatagtcaccagtaaggtc

SEQ ID NO: 692715 - DNA, 25 bp, Mus musculus
gctgccaatagtgaccagtaaggtc

SEQ ID NO: 692716 - DNA, 25 bp, Mus musculus
gctgccacagcaccatctacaggga

SEQ ID NO: 692717 - DNA, 25 bp, Mus musculus
gctgccacagcagcatctacaggga

SEQ ID NO: 692718 - DNA, 25 bp, Mus musculus
gctgccacaggtctacttaatgcta

SEQ ID NO: 692719 - DNA, 25 bp, Mus musculus
gctgccacaggtgtacttaatgcta

SEQ ID NO: 692720 - DNA, 25 bp, Mus musculus
gctgccaccctcatggtctacgtag

SEQ ID NO: 692721 - DNA, 25 bp, Mus musculus
gctgccaccctcttggtctacgtag

SEQ ID NO: 692722 - DNA, 25 bp, Mus musculus
gctgccacctctcagtcaggcaggg

SEQ ID NO: 692723 - DNA, 25 bp, Mus musculus
gctgccacctctgagtcaggcaggg

SEQ ID NO: 692724 - DNA, 25 bp, Mus musculus
gctgccacgggaccagcttgttctg

SEQ ID NO: 692725 - DNA, 25 bp, Mus musculus
gctgccacgggagcagcttgttctg

SEQ ID NO: 692726 - DNA, 25 bp, Mus musculus
gctgccactatgcagtgataccaaa

SEQ ID NO: 692727 - DNA, 25 bp, Mus musculus
gctgccactatggagtgataccaaa

SEQ ID NO: 692728 - DNA, 25 bp, Mus musculus
gctgccactgataccaatggagatg

SEQ ID NO: 692729 - DNA, 25 bp, Mus musculus
gctgccactgattccaatggagatg

SEQ ID NO: 692730 - DNA, 25 bp, Mus musculus
gctgccactgccaccggcggaggaa

SEQ ID NO: 692731 - DNA, 25 bp, Mus musculus
gctgccactgcctccggcggaggaa

SEQ ID NO: 692732 - DNA, 25 bp, Mus musculus
gctgccactgttcgccaggttacgt

SEQ ID NO: 692733 - DNA, 25 bp, Mus musculus
gctgccactgttggccaggttacgt

SEQ ID NO: 692734 - DNA, 25 bp, Mus musculus
gctgccacttttcctagagagcaag

SEQ ID NO: 692735 - DNA, 25 bp, Mus musculus
gctgccacttttgctagagagcaag

SEQ ID NO: 692736 - DNA, 25 bp, Mus musculus
gctgccagaagaacccgactggagg

SEQ ID NO: 692737 - DNA, 25 bp, Mus musculus
gctgccagaagatcccgactggagg

SEQ ID NO: 692738 - DNA, 25 bp, Mus musculus
gctgccagaattccagcttaaccct

SEQ ID NO: 692739 - DNA, 25 bp, Mus musculus
gctgccagaattgcagcttaaccct

SEQ ID NO: 692740 - DNA, 25 bp, Mus musculus
gctgccagatacaaagattggtagc

SEQ ID NO: 692741 - DNA, 25 bp, Mus musculus
gctgccagatactaagattggtagc

SEQ ID NO: 692742 - DNA, 25 bp, Mus musculus
gctgccagcaatctaagggccccag

SEQ ID NO: 692743 - DNA, 25 bp, Mus musculus
gctgccagcaatgtaagggccccag

SEQ ID NO: 692744 - DNA, 25 bp, Mus musculus
gctgccagccttaggtttataggaa

SEQ ID NO: 692745 - DNA, 25 bp, Mus musculus
gctgccagcctttggtttataggaa

SEQ ID NO: 692746 - DNA, 25 bp, Mus musculus
gctgccagctccctgtgatgcaaga

SEQ ID NO: 692747 - DNA, 25 bp, Mus musculus
gctgccagctccgtgtgatgcaaga

SEQ ID NO: 692748 - DNA, 25 bp, Mus musculus
gctgccagtttgaagtcaagccgat

SEQ ID NO: 692749 - DNA, 25 bp, Mus musculus
gctgccagtttgagggttggaacat

SEQ ID NO: 692750 - DNA, 25 bp, Mus musculus
gctgccagtttgtagtcaagccgat

SEQ ID NO: 692751 - DNA, 25 bp, Mus musculus
gctgccagtttgtgggttggaacat

SEQ ID NO: 692752 - DNA, 25 bp, Mus musculus
gctgccatcatcaatctgctcagat

SEQ ID NO: 692753 - DNA, 25 bp, Mus musculus
gctgccatcatctatctgctcagat

SEQ ID NO: 692754 - DNA, 25 bp, Mus musculus
gctgccatcatgcttcgaccattga

SEQ ID NO: 692755 - DNA, 25 bp, Mus musculus
gctgccatcatggttcgaccattga

SEQ ID NO: 692756 - DNA, 25 bp, Mus musculus
gctgccatccacaagaaatgcattg

SEQ ID NO: 692757 - DNA, 25 bp, Mus musculus
gctgccatccactagaaatgcattg

SEQ ID NO: 692758 - DNA, 25 bp, Mus musculus
gctgccatcggcaacagtacctgtg

SEQ ID NO: 692759 - DNA, 25 bp, Mus musculus
gctgccatcggctacagtacctgtg

SEQ ID NO: 692760 - DNA, 25 bp, Mus musculus
gctgccatcgtgaaagagaagggaa

SEQ ID NO: 692761 - DNA, 25 bp, Mus musculus
gctgccatcgtgtaagagaagggaa

SEQ ID NO: 692762 - DNA, 25 bp, Mus musculus
gctgccatctccactggatcctgtg

SEQ ID NO: 692763 - DNA, 25 bp, Mus musculus
gctgccatctcctctggatcctgtg

SEQ ID NO: 692764 - DNA, 25 bp, Mus musculus
gctgccatgaatcggcggaagataa

SEQ ID NO: 692765 - DNA, 25 bp, Mus musculus
gctgccatgaatgggcggaagataa

SEQ ID NO: 692766 - DNA, 25 bp, Mus musculus
gctgccatgatgatgcctcctcagc

SEQ ID NO: 692767 - DNA, 25 bp, Mus musculus
gctgccatgatgttgcctcctcagc

SEQ ID NO: 692768 - DNA, 25 bp, Mus musculus
gctgccatgcggaacaccaaacggg

SEQ ID NO: 692769 - DNA, 25 bp, Mus musculus
gctgccatgcggtacaccaaacggg

SEQ ID NO: 692770 - DNA, 25 bp, Mus musculus
gctgccatggaaattgctgcctttg

SEQ ID NO: 692771 - DNA, 25 bp, Mus musculus
gctgccatggaatttgctgcctttg

SEQ ID NO: 692772 - DNA, 25 bp, Mus musculus
gctgccattctcatcctactccacc

SEQ ID NO: 692773 - DNA, 25 bp, Mus musculus
gctgccattctcttcctactccacc

SEQ ID NO: 692774 - DNA, 25 bp, Mus musculus
gctgccatttgcctactgagaggtg

SEQ ID NO: 692775 - DNA, 25 bp, Mus musculus
gctgccatttgcgtactgagaggtg

SEQ ID NO: 692776 - DNA, 25 bp, Mus musculus
gctgcccaaaaactgggaaatggcc

SEQ ID NO: 692777 - DNA, 25 bp, Mus musculus
gctgcccaaaaagtgggaaatggcc

SEQ ID NO: 692778 - DNA, 25 bp, Mus musculus
gctgcccaaactaactccatggtga

SEQ ID NO: 692779 - DNA, 25 bp, Mus musculus
gctgcccaaacttactccatggtga

SEQ ID NO: 692780 - DNA, 25 bp, Mus musculus
gctgcccaacttcagcgagtgctgg

SEQ ID NO: 692781 - DNA, 25 bp, Mus musculus
gctgcccaacttgagcgagtgctgg

SEQ ID NO: 692782 - DNA, 25 bp, Mus musculus
gctgcccaagcgcacagtaaagctg

SEQ ID NO: 692783 - DNA, 25 bp, Mus musculus
gctgcccaagcggacagtaaagctg

SEQ ID NO: 692784 - DNA, 25 bp, Mus musculus
gctgcccaagctccacattgtcaag

SEQ ID NO: 692785 - DNA, 25 bp, Mus musculus
gctgcccaagctgcacattgtcaag

SEQ ID NO: 692786 - DNA, 25 bp, Mus musculus
gctgcccagagtatggggctagaaa

SEQ ID NO: 692787 - DNA, 25 bp, Mus musculus
gctgcccagagtttggggctagaaa

SEQ ID NO: 692788 - DNA, 25 bp, Mus musculus
gctgcccagctgcattcgtcgacaa

SEQ ID NO: 692789 - DNA, 25 bp, Mus musculus
gctgcccagctggattcgtcgacaa

SEQ ID NO: 692790 - DNA, 25 bp, Mus musculus
gctgcccagcttcgatgctgagcct

SEQ ID NO: 692791 - DNA, 25 bp, Mus musculus
gctgcccagcttggatgctgagcct

SEQ ID NO: 692792 - DNA, 25 bp, Mus musculus
gctgcccaggatagcattgttctct

SEQ ID NO: 692793 - DNA, 25 bp, Mus musculus
gctgcccaggatcgacaacatcaaa

SEQ ID NO: 692794 - DNA, 25 bp, Mus musculus
gctgcccaggatggacaacatcaaa

SEQ ID NO: 692795 - DNA, 25 bp, Mus musculus
gctgcccaggattgcattgttctct

SEQ ID NO: 692796 - DNA, 25 bp, Mus musculus
gctgcccaggcacacatcggttctg

SEQ ID NO: 692797 - DNA, 25 bp, Mus musculus
gctgcccaggcagacatcggttctg

SEQ ID NO: 692798 - DNA, 25 bp, Mus musculus
gctgcccagtgaaaataagatctat

SEQ ID NO: 692799 - DNA, 25 bp, Mus musculus
gctgcccagtgataataagatctat

SEQ ID NO: 692800 - DNA, 25 bp, Mus musculus
gctgcccatgaacgaccagttctac

SEQ ID NO: 692801 - DNA, 25 bp, Mus musculus
gctgcccatgaaggaccagttctac

SEQ ID NO: 692802 - DNA, 25 bp, Mus musculus
gctgcccatgagatggagtccctcg

SEQ ID NO: 692803 - DNA, 25 bp, Mus musculus
gctgcccatgagttggagtccctcg

SEQ ID NO: 692804 - DNA, 25 bp, Mus musculus
gctgcccatgctccggtatgtgcag

SEQ ID NO: 692805 - DNA, 25 bp, Mus musculus
gctgcccatgctgcggtatgtgcag

SEQ ID NO: 692806 - DNA, 25 bp, Mus musculus
gctgcccattctatcttatcatcaa

SEQ ID NO: 692807 - DNA, 25 bp, Mus musculus
gctgcccattctttcttatcatcaa

SEQ ID NO: 692808 - DNA, 25 bp, Mus musculus
gctgccccagaacctttgctgaact

SEQ ID NO: 692809 - DNA, 25 bp, Mus musculus
gctgccccagaagctttgctgaact

SEQ ID NO: 692810 - DNA, 25 bp, Mus musculus
gctgccccgagtcggtgtgtgacca

SEQ ID NO: 692811 - DNA, 25 bp, Mus musculus
gctgccccgagtgggtgtgtgacca

SEQ ID NO: 692812 - DNA, 25 bp, Mus musculus
gctgcccctcgaagtggtccacgag

SEQ ID NO: 692813 - DNA, 25 bp, Mus musculus
gctgcccctcgatgtggtccacgag

SEQ ID NO: 692814 - DNA, 25 bp, Mus musculus
gctgcccgacaaaaagaagaagttt

SEQ ID NO: 692815 - DNA, 25 bp, Mus musculus
gctgcccgacaataagaagaagttt

SEQ ID NO: 692816 - DNA, 25 bp, Mus musculus
gctgcccgagaactggagactctgt

SEQ ID NO: 692817 - DNA, 25 bp, Mus musculus
gctgcccgagaagtggagactctgt

SEQ ID NO: 692818 - DNA, 25 bp, Mus musculus
gctgcccgccggaaagaggcttctc

SEQ ID NO: 692819 - DNA, 25 bp, Mus musculus
gctgcccgccggtaagaggcttctc

SEQ ID NO: 692820 - DNA, 25 bp, Mus musculus
gctgcccgcttgcattgcaagatca

SEQ ID NO: 692821 - DNA, 25 bp, Mus musculus
gctgcccgcttggattgcaagatca

SEQ ID NO: 692822 - DNA, 25 bp, Mus musculus
gctgcccggttgcattcacgctgca

SEQ ID NO: 692823 - DNA, 25 bp, Mus musculus
gctgcccggttggattcacgctgca

SEQ ID NO: 692824 - DNA, 25 bp, Mus musculus
gctgcccgtggaaggattttacaca

SEQ ID NO: 692825 - DNA, 25 bp, Mus musculus
gctgcccgtggatggattttacaca

SEQ ID NO: 692826 - DNA, 25 bp, Mus musculus
gctgccctacgtaactctcaagaag

SEQ ID NO: 692827 - DNA, 25 bp, Mus musculus
gctgccctacgttactctcaagaag

SEQ ID NO: 692828 - DNA, 25 bp, Mus musculus
gctgccctcagtcaagagctggatg

SEQ ID NO: 692829 - DNA, 25 bp, Mus musculus
gctgccctcagtgaagagctggatg

SEQ ID NO: 692830 - DNA, 25 bp, Mus musculus
gctgccctcgtgagcggtgttgtct

SEQ ID NO: 692831 - DNA, 25 bp, Mus musculus
gctgccctcgtgtgcggtgttgtct

SEQ ID NO: 692832 - DNA, 25 bp, Mus musculus
gctgccctctggcaagattgtggct

SEQ ID NO: 692833 - DNA, 25 bp, Mus musculus
gctgccctctgggaagattgtggct

SEQ ID NO: 692834 - DNA, 25 bp, Mus musculus
gctgccctgagacagctgcggtcac

SEQ ID NO: 692835 - DNA, 25 bp, Mus musculus
gctgccctgagagagctgcggtcac

SEQ ID NO: 692836 - DNA, 25 bp, Mus musculus
gctgccctgaggacttccggatctt

SEQ ID NO: 692837 - DNA, 25 bp, Mus musculus
gctgccctgaggtcttccggatctt

SEQ ID NO: 692838 - DNA, 25 bp, Mus musculus
gctgccctgctaaaacatggacttg

SEQ ID NO: 692839 - DNA, 25 bp, Mus musculus
gctgccctgctataacatggacttg

SEQ ID NO: 692840 - DNA, 25 bp, Mus musculus
gctgccctggagcacatgtccgctg

SEQ ID NO: 692841 - DNA, 25 bp, Mus musculus
gctgccctggaggacatgtccgctg

SEQ ID NO: 692842 - DNA, 25 bp, Mus musculus
gctgccctggataatgaatagaaat

SEQ ID NO: 692843 - DNA, 25 bp, Mus musculus
gctgccctggattatgaatagaaat

SEQ ID NO: 692844 - DNA, 25 bp, Mus musculus
gctgccctggccatgtacatggtca

SEQ ID NO: 692845 - DNA, 25 bp, Mus musculus
gctgccctggccttgtacatggtca

SEQ ID NO: 692846 - DNA, 25 bp, Mus musculus
gctgccctggctacacatttgttga

SEQ ID NO: 692847 - DNA, 25 bp, Mus musculus
gctgccctggcttcacatttgttga

SEQ ID NO: 692848 - DNA, 25 bp, Mus musculus
gctgccctggttagcctggtacaca

SEQ ID NO: 692849 - DNA, 25 bp, Mus musculus
gctgccctggtttgcctggtacaca

SEQ ID NO: 692850 - DNA, 25 bp, Mus musculus
gctgcccttcagatacactcctggt

SEQ ID NO: 692851 - DNA, 25 bp, Mus musculus
gctgcccttcagttacactcctggt

SEQ ID NO: 692852 - DNA, 25 bp, Mus musculus
gctgcccttcggcaggaattcctag

SEQ ID NO: 692853 - DNA, 25 bp, Mus musculus
gctgcccttcgggaggaattcctag

SEQ ID NO: 692854 - DNA, 25 bp, Mus musculus
gctgcccttgtgatgatttttatgg

SEQ ID NO: 692855 - DNA, 25 bp, Mus musculus
gctgcccttgtgttgatttttatgg

SEQ ID NO: 692856 - DNA, 25 bp, Mus musculus
gctgccgaaggtcaggtcctgcaca

SEQ ID NO: 692857 - DNA, 25 bp, Mus musculus
gctgccgaaggtgaggtcctgcaca

SEQ ID NO: 692858 - DNA, 25 bp, Mus musculus
gctgccgagatcatggctgtcctgt

SEQ ID NO: 692859 - DNA, 25 bp, Mus musculus
gctgccgagatcttggctgtcctgt

SEQ ID NO: 692860 - DNA, 25 bp, Mus musculus
gctgccgagctgagggctcctgacc

SEQ ID NO: 692861 - DNA, 25 bp, Mus musculus
gctgccgagctgtgggctcctgacc

SEQ ID NO: 692862 - DNA, 25 bp, Mus musculus
gctgccgaggaaatttcaggaagag

SEQ ID NO: 692863 - DNA, 25 bp, Mus musculus
gctgccgaggaattttcaggaagag

SEQ ID NO: 692864 - DNA, 25 bp, Mus musculus
gctgccgattctaagatgatggaca

SEQ ID NO: 692865 - DNA, 25 bp, Mus musculus
gctgccgattcttagatgatggaca

SEQ ID NO: 692866 - DNA, 25 bp, Mus musculus
gctgccgccgtactttccacttgta

SEQ ID NO: 692867 - DNA, 25 bp, Mus musculus
gctgccgccgtagtttccacttgta

SEQ ID NO: 692868 - DNA, 25 bp, Mus musculus
gctgccgctgctcgtgaatttgatc

SEQ ID NO: 692869 - DNA, 25 bp, Mus musculus
gctgccgctgctggtgaatttgatc

SEQ ID NO: 692870 - DNA, 25 bp, Mus musculus
gctgccgctgtcatctctgatgcca

SEQ ID NO: 692871 - DNA, 25 bp, Mus musculus
gctgccgctgtcttctctgatgcca

SEQ ID NO: 692872 - DNA, 25 bp, Mus musculus
gctgccggaagaaccctgtcctggt

SEQ ID NO: 692873 - DNA, 25 bp, Mus musculus
gctgccggaagatccctgtcctggt

SEQ ID NO: 692874 - DNA, 25 bp, Mus musculus
gctgccggaagcatcactgcaatgg

SEQ ID NO: 692875 - DNA, 25 bp, Mus musculus
gctgccggaagcttcactgcaatgg

SEQ ID NO: 692876 - DNA, 25 bp, Mus musculus
gctgccggctctcgccatagtaaaa

SEQ ID NO: 692877 - DNA, 25 bp, Mus musculus
gctgccggctctggccatagtaaaa

SEQ ID NO: 692878 - DNA, 25 bp, Mus musculus
gctgccgggtggaccttcctgtgtt

SEQ ID NO: 692879 - DNA, 25 bp, Mus musculus
gctgccgggtggtccttcctgtgtt

SEQ ID NO: 692880 - DNA, 25 bp, Mus musculus
gctgccgtacgtagcttgtccggtt

SEQ ID NO: 692881 - DNA, 25 bp, Mus musculus
gctgccgtacgttgcttgtccggtt

SEQ ID NO: 692882 - DNA, 25 bp, Mus musculus
gctgccgtagtcacccaggcctggg

SEQ ID NO: 692883 - DNA, 25 bp, Mus musculus
gctgccgtagtctcccaggcctggg

SEQ ID NO: 692884 - DNA, 25 bp, Mus musculus
gctgccgtcctgagaccttgctcgg

SEQ ID NO: 692885 - DNA, 25 bp, Mus musculus
gctgccgtcctgtgaccttgctcgg

SEQ ID NO: 692886 - DNA, 25 bp, Mus musculus
gctgccgtggccatgttcttcctca

SEQ ID NO: 692887 - DNA, 25 bp, Mus musculus
gctgccgtggccttgttcttcctca

SEQ ID NO: 692888 - DNA, 25 bp, Mus musculus
gctgccgtgtacagttagcaatgta

SEQ ID NO: 692889 - DNA, 25 bp, Mus musculus
gctgccgtgtactgttagcaatgta

SEQ ID NO: 692890 - DNA, 25 bp, Mus musculus
gctgcctaaaccacgtaatgaaata

SEQ ID NO: 692891 - DNA, 25 bp, Mus musculus
gctgcctaaacctcgtaatgaaata

SEQ ID NO: 692892 - DNA, 25 bp, Mus musculus
gctgcctaagccagctttgagatca

SEQ ID NO: 692893 - DNA, 25 bp, Mus musculus
gctgcctaagcctgctttgagatca

SEQ ID NO: 692894 - DNA, 25 bp, Mus musculus
gctgcctacatccaaacacagtttg

SEQ ID NO: 692895 - DNA, 25 bp, Mus musculus
gctgcctacatcgaaacacagtttg

SEQ ID NO: 692896 - DNA, 25 bp, Mus musculus
gctgcctacattaacattctccttg

SEQ ID NO: 692897 - DNA, 25 bp, Mus musculus
gctgcctacatttacattctccttg

SEQ ID NO: 692898 - DNA, 25 bp, Mus musculus
gctgcctcagcacagacactggcga

SEQ ID NO: 692899 - DNA, 25 bp, Mus musculus
gctgcctcagcagagacactggcga

SEQ ID NO: 692900 - DNA, 25 bp, Mus musculus
gctgcctcagcgctgaccatcaatt

SEQ ID NO: 692901 - DNA, 25 bp, Mus musculus
gctgcctcagcggtgaccatcaatt

SEQ ID NO: 692902 - DNA, 25 bp, Mus musculus
gctgcctcccagaaacattcctatg

SEQ ID NO: 692903 - DNA, 25 bp, Mus musculus
gctgcctcccagtaacattcctatg

SEQ ID NO: 692904 - DNA, 25 bp, Mus musculus
gctgcctccttcacaagctctaaga

SEQ ID NO: 692905 - DNA, 25 bp, Mus musculus
gctgcctccttcagcagcggaagat

SEQ ID NO: 692906 - DNA, 25 bp, Mus musculus
gctgcctccttctcaagctctaaga

SEQ ID NO: 692907 - DNA, 25 bp, Mus musculus
gctgcctccttctgcagcggaagat

SEQ ID NO: 692908 - DNA, 25 bp, Mus musculus
gctgcctcgattatccacgcaaggg

SEQ ID NO: 692909 - DNA, 25 bp, Mus musculus
gctgcctcgattttccacgcaaggg

SEQ ID NO: 692910 - DNA, 25 bp, Mus musculus
gctgcctcgctccagacggcaggat

SEQ ID NO: 692911 - DNA, 25 bp, Mus musculus
gctgcctcgctcgagacggcaggat

SEQ ID NO: 692912 - DNA, 25 bp, Mus musculus
gctgcctctcttatttgtttctgga

SEQ ID NO: 692913 - DNA, 25 bp, Mus musculus
gctgcctctcttttttgtttctgga

SEQ ID NO: 692914 - DNA, 25 bp, Mus musculus
gctgcctctggccatgagataattg

SEQ ID NO: 692915 - DNA, 25 bp, Mus musculus
gctgcctctggcgatgagataattg

SEQ ID NO: 692916 - DNA, 25 bp, Mus musculus
gctgcctgatagaagacccggccgc

SEQ ID NO: 692917 - DNA, 25 bp, Mus musculus
gctgcctgatagtagacccggccgc

SEQ ID NO: 692918 - DNA, 25 bp, Mus musculus
gctgcctgcaagatcataaaggaaa

SEQ ID NO: 692919 - DNA, 25 bp, Mus musculus
gctgcctgcaagttcataaaggaaa

SEQ ID NO: 692920 - DNA, 25 bp, Mus musculus
gctgcctgcagtcgaccacagtcat

SEQ ID NO: 692921 - DNA, 25 bp, Mus musculus
gctgcctgcagtggaccacagtcat

SEQ ID NO: 692922 - DNA, 25 bp, Mus musculus
gctgcctgcgctaattaacatcaaa

SEQ ID NO: 692923 - DNA, 25 bp, Mus musculus
gctgcctgcgcttattaacatcaaa

SEQ ID NO: 692924 - DNA, 25 bp, Mus musculus
gctgcctggctcaatgcctgagaaa

SEQ ID NO: 692925 - DNA, 25 bp, Mus musculus
gctgcctggctctatgcctgagaaa

SEQ ID NO: 692926 - DNA, 25 bp, Mus musculus
gctgcctgggatctgattttcaata

SEQ ID NO: 692927 - DNA, 25 bp, Mus musculus
gctgcctgggatgtgattttcaata

SEQ ID NO: 692928 - DNA, 25 bp, Mus musculus
gctgcctggtgactcctgttctgaa

SEQ ID NO: 692929 - DNA, 25 bp, Mus musculus
gctgcctggtgagtcctgttctgaa

SEQ ID NO: 692930 - DNA, 25 bp, Mus musculus
gctgcctgtaacatggcgcgcttgg

SEQ ID NO: 692931 - DNA, 25 bp, Mus musculus
gctgcctgtaacttggcgcgcttgg

SEQ ID NO: 692932 - DNA, 25 bp, Mus musculus
gctgcctgtagaagcagacatttta

SEQ ID NO: 692933 - DNA, 25 bp, Mus musculus
gctgcctgtagatgcagacatttta

SEQ ID NO: 692934 - DNA, 25 bp, Mus musculus
gctgcctgtcttaacctgcatcatg

SEQ ID NO: 692935 - DNA, 25 bp, Mus musculus
gctgcctgtctttacctgcatcatg

SEQ ID NO: 692936 - DNA, 25 bp, Mus musculus
gctgcctgtgcactgccgctgatga

SEQ ID NO: 692937 - DNA, 25 bp, Mus musculus
gctgcctgtgcagtgccgctgatga

SEQ ID NO: 692938 - DNA, 25 bp, Mus musculus
gctgcctgtgggatcgccgccactg

SEQ ID NO: 692939 - DNA, 25 bp, Mus musculus
gctgcctgtgggttcgccgccactg

SEQ ID NO: 692940 - DNA, 25 bp, Mus musculus
gctgcctgttgtcatgcctcctaag

SEQ ID NO: 692941 - DNA, 25 bp, Mus musculus
gctgcctgttgtgatgcctcctaag

SEQ ID NO: 692942 - DNA, 25 bp, Mus musculus
gctgcctgtttacagagttcttggg

SEQ ID NO: 692943 - DNA, 25 bp, Mus musculus
gctgcctgtttagagagttcttggg

SEQ ID NO: 692944 - DNA, 25 bp, Mus musculus
gctgccttagaaagatagtgtgctc

SEQ ID NO: 692945 - DNA, 25 bp, Mus musculus
gctgccttagaatgatagtgtgctc

SEQ ID NO: 692946 - DNA, 25 bp, Mus musculus
gctgccttaggacttatgcagatgg

SEQ ID NO: 692947 - DNA, 25 bp, Mus musculus
gctgccttaggagttatgcagatgg

SEQ ID NO: 692948 - DNA, 25 bp, Mus musculus
gctgccttcaccagagaactgagcc

SEQ ID NO: 692949 - DNA, 25 bp, Mus musculus
gctgccttcacctgagaactgagcc

SEQ ID NO: 692950 - DNA, 25 bp, Mus musculus
gctgccttcactctcattggactgc

SEQ ID NO: 692951 - DNA, 25 bp, Mus musculus
gctgccttcactgtcattggactgc

SEQ ID NO: 692952 - DNA, 25 bp, Mus musculus
gctgccttctctctgaacgcggctt

SEQ ID NO: 692953 - DNA, 25 bp, Mus musculus
gctgccttctctgtgaacgcggctt

SEQ ID NO: 692954 - DNA, 25 bp, Mus musculus
gctgccttgatcacctactttggct

SEQ ID NO: 692955 - DNA, 25 bp, Mus musculus
gctgccttgatctcctactttggct

SEQ ID NO: 692956 - DNA, 25 bp, Mus musculus
gctgccttgggaagttgacggacct

SEQ ID NO: 692957 - DNA, 25 bp, Mus musculus
gctgccttgggatgttgacggacct

SEQ ID NO: 692958 - DNA, 25 bp, Mus musculus
gctgcgaactgtctagcctgctcca

SEQ ID NO: 692959 - DNA, 25 bp, Mus musculus
gctgcgaactgtgtagcctgctcca

SEQ ID NO: 692960 - DNA, 25 bp, Mus musculus
gctgcgaatgtgctcattacccggg

SEQ ID NO: 692961 - DNA, 25 bp, Mus musculus
gctgcgaatgtggtcattacccggg

SEQ ID NO: 692962 - DNA, 25 bp, Mus musculus
gctgcgacagataggtatgggtttc

SEQ ID NO: 692963 - DNA, 25 bp, Mus musculus
gctgcgacagattggtatgggtttc

SEQ ID NO: 692964 - DNA, 25 bp, Mus musculus
gctgcgacaggtcagctacattcgc

SEQ ID NO: 692965 - DNA, 25 bp, Mus musculus
gctgcgacaggtgagctacattcgc

SEQ ID NO: 692966 - DNA, 25 bp, Mus musculus
gctgcgaccgcacctgtaaggacac

SEQ ID NO: 692967 - DNA, 25 bp, Mus musculus
gctgcgaccgcagctgtaaggacac

SEQ ID NO: 692968 - DNA, 25 bp, Mus musculus
gctgcgacctctctacatggacgta

SEQ ID NO: 692969 - DNA, 25 bp, Mus musculus
gctgcgacctctgtacatggacgta

SEQ ID NO: 692970 - DNA, 25 bp, Mus musculus
gctgcgagctgaacaaagagagcga

SEQ ID NO: 692971 - DNA, 25 bp, Mus musculus
gctgcgagctgatcaaagagagcga

SEQ ID NO: 692972 - DNA, 25 bp, Mus musculus
gctgcgaggctacagaaaccactgc

SEQ ID NO: 692973 - DNA, 25 bp, Mus musculus
gctgcgaggctagagaaaccactgc

SEQ ID NO: 692974 - DNA, 25 bp, Mus musculus
gctgcgagtgtcacccgccctggga

SEQ ID NO: 692975 - DNA, 25 bp, Mus musculus
gctgcgagtgtctcccgccctggga

SEQ ID NO: 692976 - DNA, 25 bp, Mus musculus
gctgcgatactaatatgagaaaggc

SEQ ID NO: 692977 - DNA, 25 bp, Mus musculus
gctgcgatactattatgagaaaggc

SEQ ID NO: 692978 - DNA, 25 bp, Mus musculus
gctgcgatgcctctataacccaggg

SEQ ID NO: 692979 - DNA, 25 bp, Mus musculus
gctgcgatgcctgtataacccaggg

SEQ ID NO: 692980 - DNA, 25 bp, Mus musculus
gctgcgatgggaaccagtacccgga

SEQ ID NO: 692981 - DNA, 25 bp, Mus musculus
gctgcgatgggatccagtacccgga

SEQ ID NO: 692982 - DNA, 25 bp, Mus musculus
gctgcgcaaggacaagggattatct

SEQ ID NO: 692983 - DNA, 25 bp, Mus musculus
gctgcgcaaggagaagggattatct

SEQ ID NO: 692984 - DNA, 25 bp, Mus musculus
gctgcgcagactctatgaaacctgg

SEQ ID NO: 692985 - DNA, 25 bp, Mus musculus
gctgcgcagactgtatgaaacctgg

SEQ ID NO: 692986 - DNA, 25 bp, Mus musculus
gctgcgcagagcatctgcatatgaa

SEQ ID NO: 692987 - DNA, 25 bp, Mus musculus
gctgcgcagagcttctgcatatgaa

SEQ ID NO: 692988 - DNA, 25 bp, Mus musculus
gctgcgcagagtacaccacgctgct

SEQ ID NO: 692989 - DNA, 25 bp, Mus musculus
gctgcgcagagttcaccacgctgct

SEQ ID NO: 692990 - DNA, 25 bp, Mus musculus
gctgcgcagtttccccgaagtaagt

SEQ ID NO: 692991 - DNA, 25 bp, Mus musculus
gctgcgcagtttgcccgaagtaagt

SEQ ID NO: 692992 - DNA, 25 bp, Mus musculus
gctgcgcatgtacaagaccattaca

SEQ ID NO: 692993 - DNA, 25 bp, Mus musculus
gctgcgcatgtagaagaccattaca

SEQ ID NO: 692994 - DNA, 25 bp, Mus musculus
gctgcgccgggcagctgaggaggct

SEQ ID NO: 692995 - DNA, 25 bp, Mus musculus
gctgcgccgggctgctgaggaggct

SEQ ID NO: 692996 - DNA, 25 bp, Mus musculus
gctgcgccgtcaagaaacagtttgc

SEQ ID NO: 692997 - DNA, 25 bp, Mus musculus
gctgcgccgtcatgaaacagtttgc

SEQ ID NO: 692998 - DNA, 25 bp, Mus musculus
gctgcgcctacgataccctcagaaa

SEQ ID NO: 692999 - DNA, 25 bp, Mus musculus
gctgcgcctacgttaccctcagaaa

SEQ ID NO: 693000 - DNA, 25 bp, Mus musculus
gctgcgcctgccatgtttacagagg

SEQ ID NO: 693001 - DNA, 25 bp, Mus musculus
gctgcgcctgccttgtttacagagg

SEQ ID NO: 693002 - DNA, 25 bp, Mus musculus
gctgcgcgcggtactactgtttctg

SEQ ID NO: 693003 - DNA, 25 bp, Mus musculus
gctgcgcgcggttctactgtttctg

SEQ ID NO: 693004 - DNA, 25 bp, Mus musculus
gctgcgctcagaacaagtgtaactt

SEQ ID NO: 693005 - DNA, 25 bp, Mus musculus
gctgcgctcagatcaagtgtaactt

SEQ ID NO: 693006 - DNA, 25 bp, Mus musculus
gctgcgctcgctaagcttcttctgg

SEQ ID NO: 693007 - DNA, 25 bp, Mus musculus
gctgcgctcgcttagcttcttctgg

SEQ ID NO: 693008 - DNA, 25 bp, Mus musculus
gctgcgctctctctttgaaagcaga

SEQ ID NO: 693009 - DNA, 25 bp, Mus musculus
gctgcgctctctgtttgaaagcaga

SEQ ID NO: 693010 - DNA, 25 bp, Mus musculus
gctgcgctctgccaggtatgtgact

SEQ ID NO: 693011 - DNA, 25 bp, Mus musculus
gctgcgctctgcgaggtatgtgact

SEQ ID NO: 693012 - DNA, 25 bp, Mus musculus
gctgcggaaccgatttgcggccctg

SEQ ID NO: 693013 - DNA, 25 bp, Mus musculus
gctgcggaaccgttttgcggccctg

SEQ ID NO: 693014 - DNA, 25 bp, Mus musculus
gctgcggaagaaaactgcctggcca

SEQ ID NO: 693015 - DNA, 25 bp, Mus musculus
gctgcggaagaatactgcctggcca

SEQ ID NO: 693016 - DNA, 25 bp, Mus musculus
gctgcggaaggacatttacagctcg

SEQ ID NO: 693017 - DNA, 25 bp, Mus musculus
gctgcggaaggagatttacagctcg

SEQ ID NO: 693018 - DNA, 25 bp, Mus musculus
gctgcggagctcaagtcgaaaagtt

SEQ ID NO: 693019 - DNA, 25 bp, Mus musculus
gctgcggagctctagtcgaaaagtt

SEQ ID NO: 693020 - DNA, 25 bp, Mus musculus
gctgcggagggaatgccaatcgttt

SEQ ID NO: 693021 - DNA, 25 bp, Mus musculus
gctgcggagggattgccaatcgttt

SEQ ID NO: 693022 - DNA, 25 bp, Mus musculus
gctgcggatacacctggttcccagc

SEQ ID NO: 693023 - DNA, 25 bp, Mus musculus
gctgcggatacagctggttcccagc

SEQ ID NO: 693024 - DNA, 25 bp, Mus musculus
gctgcggattttatggaaaccctcg

SEQ ID NO: 693025 - DNA, 25 bp, Mus musculus
gctgcggattttttggaaaccctcg

SEQ ID NO: 693026 - DNA, 25 bp, Mus musculus
gctgcggcagttcacaactcacagt

SEQ ID NO: 693027 - DNA, 25 bp, Mus musculus
gctgcggcagttgacaactcacagt

SEQ ID NO: 693028 - DNA, 25 bp, Mus musculus
gctgcggcgcctcagaaagatgaac

SEQ ID NO: 693029 - DNA, 25 bp, Mus musculus
gctgcggcgcctgagaaagatgaac

SEQ ID NO: 693030 - DNA, 25 bp, Mus musculus
gctgcggctgatccatgagccgtct

SEQ ID NO: 693031 - DNA, 25 bp, Mus musculus
gctgcggctgatgcatgagccgtct

SEQ ID NO: 693032 - DNA, 25 bp, Mus musculus
gctgcgggccttaagggcacgcatc

SEQ ID NO: 693033 - DNA, 25 bp, Mus musculus
gctgcgggcctttagggcacgcatc

SEQ ID NO: 693034 - DNA, 25 bp, Mus musculus
gctgcgggcgtcattcctgcttctg

SEQ ID NO: 693035 - DNA, 25 bp, Mus musculus
gctgcgggcgtctttcctgcttctg

SEQ ID NO: 693036 - DNA, 25 bp, Mus musculus
gctgcgggctcaccatgaggaccag

SEQ ID NO: 693037 - DNA, 25 bp, Mus musculus
gctgcgggctcagcatgaggaccag

SEQ ID NO: 693038 - DNA, 25 bp, Mus musculus
gctgcggtactgagacagaagccat

SEQ ID NO: 693039 - DNA, 25 bp, Mus musculus
gctgcggtactgtgacagaagccat

SEQ ID NO: 693040 - DNA, 25 bp, Mus musculus
gctgcggtagcaacggtactgcctg

SEQ ID NO: 693041 - DNA, 25 bp, Mus musculus
gctgcggtagcatcggtactgcctg

SEQ ID NO: 693042 - DNA, 25 bp, Mus musculus
gctgcggtccatcttcacgcgagct

SEQ ID NO: 693043 - DNA, 25 bp, Mus musculus
gctgcggtccatgttcacgcgagct

SEQ ID NO: 693044 - DNA, 25 bp, Mus musculus
gctgcggtgctgatcatcacgggaa

SEQ ID NO: 693045 - DNA, 25 bp, Mus musculus
gctgcggtgctgttcatcacgggaa

SEQ ID NO: 693046 - DNA, 25 bp, Mus musculus
gctgcggttactacctgaccctggt

SEQ ID NO: 693047 - DNA, 25 bp, Mus musculus
gctgcggttacttcctgaccctggt

SEQ ID NO: 693048 - DNA, 25 bp, Mus musculus
gctgcggttcgtccattcctaggtc

SEQ ID NO: 693049 - DNA, 25 bp, Mus musculus
gctgcggttcgtgcattcctaggtc

SEQ ID NO: 693050 - DNA, 25 bp, Mus musculus
gctgcgtcatcgacatctgcatgaa

SEQ ID NO: 693051 - DNA, 25 bp, Mus musculus
gctgcgtcatcgtcatctgcatgaa

SEQ ID NO: 693052 - DNA, 25 bp, Mus musculus
gctgcgtccaagagcattgtcaaca

SEQ ID NO: 693053 - DNA, 25 bp, Mus musculus
gctgcgtccaagtgcattgtcaaca

SEQ ID NO: 693054 - DNA, 25 bp, Mus musculus
gctgcgtctgaaatctaccgcaacg

SEQ ID NO: 693055 - DNA, 25 bp, Mus musculus
gctgcgtctgaattctaccgcaacg

SEQ ID NO: 693056 - DNA, 25 bp, Mus musculus
gctgcgtctgacaggacatttttac

SEQ ID NO: 693057 - DNA, 25 bp, Mus musculus
gctgcgtctgactggacatttttac

SEQ ID NO: 693058 - DNA, 25 bp, Mus musculus
gctgcgtgacatatgctccaagtac

SEQ ID NO: 693059 - DNA, 25 bp, Mus musculus
gctgcgtgacatttgctccaagtac

SEQ ID NO: 693060 - DNA, 25 bp, Mus musculus
gctgcgtggccaccaattcagcccg

SEQ ID NO: 693061 - DNA, 25 bp, Mus musculus
gctgcgtggccagcaattcagcccg

SEQ ID NO: 693062 - DNA, 25 bp, Mus musculus
gctgcgtggctcctctctgaagctg

SEQ ID NO: 693063 - DNA, 25 bp, Mus musculus
gctgcgtggctcgtctctgaagctg

SEQ ID NO: 693064 - DNA, 25 bp, Mus musculus
gctgcgtgtatcactggtggcaaca

SEQ ID NO: 693065 - DNA, 25 bp, Mus musculus
gctgcgtgtatctctggtggcaaca

SEQ ID NO: 693066 - DNA, 25 bp, Mus musculus
gctgcgtgtcttcacctgcacctga

SEQ ID NO: 693067 - DNA, 25 bp, Mus musculus
gctgcgtgtcttgacctgcacctga

SEQ ID NO: 693068 - DNA, 25 bp, Mus musculus
gctgcgttgcaaacgggatgtgttt

SEQ ID NO: 693069 - DNA, 25 bp, Mus musculus
gctgcgttgcaatcgggatgtgttt

SEQ ID NO: 693070 - DNA, 25 bp, Mus musculus
gctgctaaacctaacccagttatat

SEQ ID NO: 693071 - DNA, 25 bp, Mus musculus
gctgctaaaccttacccagttatat

SEQ ID NO: 693072 - DNA, 25 bp, Mus musculus
gctgctaacaatcgagctttacccc

SEQ ID NO: 693073 - DNA, 25 bp, Mus musculus
gctgctaacaatggagctttacccc

SEQ ID NO: 693074 - DNA, 25 bp, Mus musculus
gctgctaacagcacctttggcgtag

SEQ ID NO: 693075 - DNA, 25 bp, Mus musculus
gctgctaacagctcctttggcgtag

SEQ ID NO: 693076 - DNA, 25 bp, Mus musculus
gctgctaagaacatccgcgtctggt

SEQ ID NO: 693077 - DNA, 25 bp, Mus musculus
gctgctaagaacttccgcgtctggt

SEQ ID NO: 693078 - DNA, 25 bp, Mus musculus
gctgctaagactcttgaggaagatg

SEQ ID NO: 693079 - DNA, 25 bp, Mus musculus
gctgctaagactgttgaggaagatg

SEQ ID NO: 693080 - DNA, 25 bp, Mus musculus
gctgctaaggatctctctcttctga

SEQ ID NO: 693081 - DNA, 25 bp, Mus musculus
gctgctaaggatgtctctcttctga

SEQ ID NO: 693082 - DNA, 25 bp, Mus musculus
gctgctaataaacgccacggcaggt

SEQ ID NO: 693083 - DNA, 25 bp, Mus musculus
gctgctaataaaggccacggcaggt

SEQ ID NO: 693084 - DNA, 25 bp, Mus musculus
gctgctaatgaacttaaatggacaa

SEQ ID NO: 693085 - DNA, 25 bp, Mus musculus
gctgctaatgaagttaaatggacaa

SEQ ID NO: 693086 - DNA, 25 bp, Mus musculus
gctgctaatggaaacccagggtgcc

SEQ ID NO: 693087 - DNA, 25 bp, Mus musculus
gctgctaatggatacccagggtgcc

SEQ ID NO: 693088 - DNA, 25 bp, Mus musculus
gctgctacaataaggctcatttttc

SEQ ID NO: 693089 - DNA, 25 bp, Mus musculus
gctgctacaatatggctcatttttc

SEQ ID NO: 693090 - DNA, 25 bp, Mus musculus
gctgctacaattacttgaacaagga

SEQ ID NO: 693091 - DNA, 25 bp, Mus musculus
gctgctacaatttcttgaacaagga

SEQ ID NO: 693092 - DNA, 25 bp, Mus musculus
gctgctacagctcagttccggagag

SEQ ID NO: 693093 - DNA, 25 bp, Mus musculus
gctgctacagctgagttccggagag

SEQ ID NO: 693094 - DNA, 25 bp, Mus musculus
gctgctacagtaagtgtacaacctg

SEQ ID NO: 693095 - DNA, 25 bp, Mus musculus
gctgctacagtatgtgtacaacctg

SEQ ID NO: 693096 - DNA, 25 bp, Mus musculus
gctgctacagtgacgtcatacctga

SEQ ID NO: 693097 - DNA, 25 bp, Mus musculus
gctgctacagtgtcgtcatacctga

SEQ ID NO: 693098 - DNA, 25 bp, Mus musculus
gctgctacagttagagaacaatgca

SEQ ID NO: 693099 - DNA, 25 bp, Mus musculus
gctgctacagtttgagaacaatgca

SEQ ID NO: 693100 - DNA, 25 bp, Mus musculus
gctgctacctagaggagacactcca

SEQ ID NO: 693101 - DNA, 25 bp, Mus musculus
gctgctacctagtggagacactcca

SEQ ID NO: 693102 - DNA, 25 bp, Mus musculus
gctgctactcatatgcctctatggg

SEQ ID NO: 693103 - DNA, 25 bp, Mus musculus
gctgctactcatttgcctctatggg

SEQ ID NO: 693104 - DNA, 25 bp, Mus musculus
gctgctactgggattcttgctggtg

SEQ ID NO: 693105 - DNA, 25 bp, Mus musculus
gctgctactgggtttcttgctggtg

SEQ ID NO: 693106 - DNA, 25 bp, Mus musculus
gctgctactggtcccgaacaactca

SEQ ID NO: 693107 - DNA, 25 bp, Mus musculus
gctgctactggtgccgaacaactca

SEQ ID NO: 693108 - DNA, 25 bp, Mus musculus
gctgctagagatcctaaatgactcc

SEQ ID NO: 693109 - DNA, 25 bp, Mus musculus
gctgctagagatgctaaatgactcc

SEQ ID NO: 693110 - DNA, 25 bp, Mus musculus
gctgctagaggccacgcctgacacg

SEQ ID NO: 693111 - DNA, 25 bp, Mus musculus
gctgctagaggcgacgcctgacacg

SEQ ID NO: 693112 - DNA, 25 bp, Mus musculus
gctgctagtctacaaggagcagact

SEQ ID NO: 693113 - DNA, 25 bp, Mus musculus
gctgctagtctagaaggagcagact

SEQ ID NO: 693114 - DNA, 25 bp, Mus musculus
gctgctagttgtcgcgctctccatc

SEQ ID NO: 693115 - DNA, 25 bp, Mus musculus
gctgctagttgtggcgctctccatc

SEQ ID NO: 693116 - DNA, 25 bp, Mus musculus
gctgctatgaatcggagaaaaattt

SEQ ID NO: 693117 - DNA, 25 bp, Mus musculus
gctgctatgaatgggagaaaaattt

SEQ ID NO: 693118 - DNA, 25 bp, Mus musculus
gctgctatgagacagctatgacaag

SEQ ID NO: 693119 - DNA, 25 bp, Mus musculus
gctgctatgagagagctatgacaag

SEQ ID NO: 693120 - DNA, 25 bp, Mus musculus
gctgctatgtgtctgcttaaaacag

SEQ ID NO: 693121 - DNA, 25 bp, Mus musculus
gctgctatgtgtgtgcttaaaacag

SEQ ID NO: 693122 - DNA, 25 bp, Mus musculus
gctgctattgcaaatggcctggata

SEQ ID NO: 693123 - DNA, 25 bp, Mus musculus
gctgctattgcatatggcctggata

SEQ ID NO: 693124 - DNA, 25 bp, Mus musculus
gctgctcaataaatggtcactcaat

SEQ ID NO: 693125 - DNA, 25 bp, Mus musculus
gctgctcaataattggtcactcaat

SEQ ID NO: 693126 - DNA, 25 bp, Mus musculus
gctgctcaatgcagaacatggaaac

SEQ ID NO: 693127 - DNA, 25 bp, Mus musculus
gctgctcaatgctgaacatggaaac

SEQ ID NO: 693128 - DNA, 25 bp, Mus musculus
gctgctcaatggagaccctaaggag

SEQ ID NO: 693129 - DNA, 25 bp, Mus musculus
gctgctcaatggtgaccctaaggag

SEQ ID NO: 693130 - DNA, 25 bp, Mus musculus
gctgctcacagaaggttttagactg

SEQ ID NO: 693131 - DNA, 25 bp, Mus musculus
gctgctcacagatggttttagactg

SEQ ID NO: 693132 - DNA, 25 bp, Mus musculus
gctgctcaccgtagagagacttaca

SEQ ID NO: 693133 - DNA, 25 bp, Mus musculus
gctgctcaccgttgagagacttaca

SEQ ID NO: 693134 - DNA, 25 bp, Mus musculus
gctgctcactggcagacttccaaat

SEQ ID NO: 693135 - DNA, 25 bp, Mus musculus
gctgctcactgggagacttccaaat

SEQ ID NO: 693136 - DNA, 25 bp, Mus musculus
gctgctcagagaagttgatcatcca

SEQ ID NO: 693137 - DNA, 25 bp, Mus musculus
gctgctcagagatgttgatcatcca

SEQ ID NO: 693138 - DNA, 25 bp, Mus musculus
gctgctcagctccatgatctgagga

SEQ ID NO: 693139 - DNA, 25 bp, Mus musculus
gctgctcagctcgatgatctgagga

SEQ ID NO: 693140 - DNA, 25 bp, Mus musculus
gctgctcagtgtctcatttgtctca

SEQ ID NO: 693141 - DNA, 25 bp, Mus musculus
gctgctcagtgtgtcatttgtctca

SEQ ID NO: 693142 - DNA, 25 bp, Mus musculus
gctgctcatcatagtatgtcacaag

SEQ ID NO: 693143 - DNA, 25 bp, Mus musculus
gctgctcatcattgtatgtcacaag

SEQ ID NO: 693144 - DNA, 25 bp, Mus musculus
gctgctcatcccaatgtacttccag

SEQ ID NO: 693145 - DNA, 25 bp, Mus musculus
gctgctcatccctatgtacttccag

SEQ ID NO: 693146 - DNA, 25 bp, Mus musculus
gctgctcatctgctgaacgatgctc

SEQ ID NO: 693147 - DNA, 25 bp, Mus musculus
gctgctcatctggtgaacgatgctc

SEQ ID NO: 693148 - DNA, 25 bp, Mus musculus
gctgctcatcttctttgacttggct

SEQ ID NO: 693149 - DNA, 25 bp, Mus musculus
gctgctcatcttgtttgacttggct

SEQ ID NO: 693150 - DNA, 25 bp, Mus musculus
gctgctcatgaaagtgatcttctta

SEQ ID NO: 693151 - DNA, 25 bp, Mus musculus
gctgctcatgaatgtgatcttctta

SEQ ID NO: 693152 - DNA, 25 bp, Mus musculus
gctgctcatgacctggagctactga

SEQ ID NO: 693153 - DNA, 25 bp, Mus musculus
gctgctcatgacgtggagctactga

SEQ ID NO: 693154 - DNA, 25 bp, Mus musculus
gctgctcatgatcaacgacaacctc

SEQ ID NO: 693155 - DNA, 25 bp, Mus musculus
gctgctcatgatgaacgacaacctc

SEQ ID NO: 693156 - DNA, 25 bp, Mus musculus
gctgctccaactctaacgtgcacgg

SEQ ID NO: 693157 - DNA, 25 bp, Mus musculus
gctgctccaactgtaacgtgcacgg

SEQ ID NO: 693158 - DNA, 25 bp, Mus musculus
gctgctccaagacatccaggtcatg

SEQ ID NO: 693159 - DNA, 25 bp, Mus musculus
gctgctccaagagatccaggtcatg

SEQ ID NO: 693160 - DNA, 25 bp, Mus musculus
gctgctccagatcccagaatgtgtg

SEQ ID NO: 693161 - DNA, 25 bp, Mus musculus
gctgctccagatgccagaatgtgtg

SEQ ID NO: 693162 - DNA, 25 bp, Mus musculus
gctgctcccaataatgtctctatga

SEQ ID NO: 693163 - DNA, 25 bp, Mus musculus
gctgctcccaattatgtctctatga

SEQ ID NO: 693164 - DNA, 25 bp, Mus musculus
gctgctcccggtaggccctgacgga

SEQ ID NO: 693165 - DNA, 25 bp, Mus musculus
gctgctcccggttggccctgacgga

SEQ ID NO: 693166 - DNA, 25 bp, Mus musculus
gctgctccggatccatccgacgggt

SEQ ID NO: 693167 - DNA, 25 bp, Mus musculus
gctgctccggatgcatccgacgggt

SEQ ID NO: 693168 - DNA, 25 bp, Mus musculus
gctgctcctagccactttgtgctga

SEQ ID NO: 693169 - DNA, 25 bp, Mus musculus
gctgctcctagcgactttgtgctga

SEQ ID NO: 693170 - DNA, 25 bp, Mus musculus
gctgctcctcatagtacttctagtg

SEQ ID NO: 693171 - DNA, 25 bp, Mus musculus
gctgctcctcattgtacttctagtg

SEQ ID NO: 693172 - DNA, 25 bp, Mus musculus
gctgctcctttcaggagtctttggg

SEQ ID NO: 693173 - DNA, 25 bp, Mus musculus
gctgctcctttctggagtctttggg

SEQ ID NO: 693174 - DNA, 25 bp, Mus musculus
gctgctcgaggaaggagtgtcaccc

SEQ ID NO: 693175 - DNA, 25 bp, Mus musculus
gctgctcgaggatggagtgtcaccc

SEQ ID NO: 693176 - DNA, 25 bp, Mus musculus
gctgctcgcctgctgtgcagacgct

SEQ ID NO: 693177 - DNA, 25 bp, Mus musculus
gctgctcgcctggtgtgcagacgct

SEQ ID NO: 693178 - DNA, 25 bp, Mus musculus
gctgctcgtcctactgaagctggat

SEQ ID NO: 693179 - DNA, 25 bp, Mus musculus
gctgctcgtccttctgaagctggat

SEQ ID NO: 693180 - DNA, 25 bp, Mus musculus
gctgctcgtggcatggacattcctg

SEQ ID NO: 693181 - DNA, 25 bp, Mus musculus
gctgctcgtggcttggacattcctg

SEQ ID NO: 693182 - DNA, 25 bp, Mus musculus
gctgctctccgcaggcaaaaacggg

SEQ ID NO: 693183 - DNA, 25 bp, Mus musculus
gctgctctccgctggcaaaaacggg

SEQ ID NO: 693184 - DNA, 25 bp, Mus musculus
gctgctctctgtctcaagccatgtg

SEQ ID NO: 693185 - DNA, 25 bp, Mus musculus
gctgctctctgtgtcaagccatgtg

SEQ ID NO: 693186 - DNA, 25 bp, Mus musculus
gctgctctgcttctttgatgagaag

SEQ ID NO: 693187 - DNA, 25 bp, Mus musculus
gctgctctgcttgtttgatgagaag

SEQ ID NO: 693188 - DNA, 25 bp, Mus musculus
gctgctctgtagatctgaaggactg

SEQ ID NO: 693189 - DNA, 25 bp, Mus musculus
gctgctctgtagttctgaaggactg

SEQ ID NO: 693190 - DNA, 25 bp, Mus musculus
gctgctcttaaacgtacaggcctgg

SEQ ID NO: 693191 - DNA, 25 bp, Mus musculus
gctgctcttaaaggtacaggcctgg

SEQ ID NO: 693192 - DNA, 25 bp, Mus musculus
gctgctcttaggcaccggcctcttg

SEQ ID NO: 693193 - DNA, 25 bp, Mus musculus
gctgctcttagggaccggcctcttg

SEQ ID NO: 693194 - DNA, 25 bp, Mus musculus
gctgctcttcacactgccagggact

SEQ ID NO: 693195 - DNA, 25 bp, Mus musculus
gctgctcttcacagggcgtacgtgg

SEQ ID NO: 693196 - DNA, 25 bp, Mus musculus
gctgctcttcactctgccagggact

SEQ ID NO: 693197 - DNA, 25 bp, Mus musculus
gctgctcttcactgggcgtacgtgg

SEQ ID NO: 693198 - DNA, 25 bp, Mus musculus
gctgctcttggcagaatcccgctca

SEQ ID NO: 693199 - DNA, 25 bp, Mus musculus
gctgctcttggctgaatcccgctca

SEQ ID NO: 693200 - DNA, 25 bp, Mus musculus
gctgctctttgaatacctgaggtta

SEQ ID NO: 693201 - DNA, 25 bp, Mus musculus
gctgctctttgattacctgaggtta

SEQ ID NO: 693202 - DNA, 25 bp, Mus musculus
gctgctgaaaatcgcgtggcaaaac

SEQ ID NO: 693203 - DNA, 25 bp, Mus musculus
gctgctgaaaatggcgtggcaaaac

SEQ ID NO: 693204 - DNA, 25 bp, Mus musculus
gctgctgaaactaccgttttcaaga

SEQ ID NO: 693205 - DNA, 25 bp, Mus musculus
gctgctgaaacttccgttttcaaga

SEQ ID NO: 693206 - DNA, 25 bp, Mus musculus
gctgctgaaatacccaacgagactg

SEQ ID NO: 693207 - DNA, 25 bp, Mus musculus
gctgctgaaatagccaacgagactg

SEQ ID NO: 693208 - DNA, 25 bp, Mus musculus
gctgctgaaccgaatgtcgtccgaa

SEQ ID NO: 693209 - DNA, 25 bp, Mus musculus
gctgctgaaccgtatgtcgtccgaa

SEQ ID NO: 693210 - DNA, 25 bp, Mus musculus
gctgctgaacgcaggttccgcggta

SEQ ID NO: 693211 - DNA, 25 bp, Mus musculus
gctgctgaacgctggttccgcggta

SEQ ID NO: 693212 - DNA, 25 bp, Mus musculus
gctgctgaactcagctgctgcttcc

SEQ ID NO: 693213 - DNA, 25 bp, Mus musculus
gctgctgaactctgctgctgcttcc

SEQ ID NO: 693214 - DNA, 25 bp, Mus musculus
gctgctgaagttcgctccaccttag

SEQ ID NO: 693215 - DNA, 25 bp, Mus musculus
gctgctgaagttggctccaccttag

SEQ ID NO: 693216 - DNA, 25 bp, Mus musculus
gctgctgaataaagagggatcgctg

SEQ ID NO: 693217 - DNA, 25 bp, Mus musculus
gctgctgaataatgagggatcgctg

SEQ ID NO: 693218 - DNA, 25 bp, Mus musculus
gctgctgaatcacaggccgatgact

SEQ ID NO: 693219 - DNA, 25 bp, Mus musculus
gctgctgaatcagaggccgatgact

SEQ ID NO: 693220 - DNA, 25 bp, Mus musculus
gctgctgaatgaaatccgtaggctg

SEQ ID NO: 693221 - DNA, 25 bp, Mus musculus
gctgctgaatgacaccaaaagccct

SEQ ID NO: 693222 - DNA, 25 bp, Mus musculus
gctgctgaatgagaccaaaagccct

SEQ ID NO: 693223 - DNA, 25 bp, Mus musculus
gctgctgaatgatatccgtaggctg

SEQ ID NO: 693224 - DNA, 25 bp, Mus musculus
gctgctgaattacgccaggtagaca

SEQ ID NO: 693225 - DNA, 25 bp, Mus musculus
gctgctgaattaggccaggtagaca

SEQ ID NO: 693226 - DNA, 25 bp, Mus musculus
gctgctgacatcctgttcttactcg

SEQ ID NO: 693227 - DNA, 25 bp, Mus musculus
gctgctgacatcgtgttcttactcg

SEQ ID NO: 693228 - DNA, 25 bp, Mus musculus
gctgctgaccatcttagctgcaaag

SEQ ID NO: 693229 - DNA, 25 bp, Mus musculus
gctgctgaccatgttagctgcaaag

SEQ ID NO: 693230 - DNA, 25 bp, Mus musculus
gctgctgaccctactcgtgaggctt

SEQ ID NO: 693231 - DNA, 25 bp, Mus musculus
gctgctgacccttctcgtgaggctt

SEQ ID NO: 693232 - DNA, 25 bp, Mus musculus
gctgctgaccgactcatcaatcaga

SEQ ID NO: 693233 - DNA, 25 bp, Mus musculus
gctgctgaccgagtcatcaatcaga

SEQ ID NO: 693234 - DNA, 25 bp, Mus musculus
gctgctgacttcattcgagctggaa

SEQ ID NO: 693235 - DNA, 25 bp, Mus musculus
gctgctgacttctttcgagctggaa

SEQ ID NO: 693236 - DNA, 25 bp, Mus musculus
gctgctgactttccacaggctgcca

SEQ ID NO: 693237 - DNA, 25 bp, Mus musculus
gctgctgactttgcacaggctgcca

SEQ ID NO: 693238 - DNA, 25 bp, Mus musculus
gctgctgagcaacctccactgtgat

SEQ ID NO: 693239 - DNA, 25 bp, Mus musculus
gctgctgagcaagctccactgtgat

SEQ ID NO: 693240 - DNA, 25 bp, Mus musculus
gctgctgagcctctgcactaagagg

SEQ ID NO: 693241 - DNA, 25 bp, Mus musculus
gctgctgagcctgtgcactaagagg

SEQ ID NO: 693242 - DNA, 25 bp, Mus musculus
gctgctgagcgaagagagcgaagag

SEQ ID NO: 693243 - DNA, 25 bp, Mus musculus
gctgctgagcgaatggaaaaactcc

SEQ ID NO: 693244 - DNA, 25 bp, Mus musculus
gctgctgagcgatgagagcgaagag

SEQ ID NO: 693245 - DNA, 25 bp, Mus musculus
gctgctgagcgattggaaaaactcc

SEQ ID NO: 693246 - DNA, 25 bp, Mus musculus
gctgctgagcggcacgcagataacc

SEQ ID NO: 693247 - DNA, 25 bp, Mus musculus
gctgctgagcgggacgcagataacc

SEQ ID NO: 693248 - DNA, 25 bp, Mus musculus
gctgctgagctcctgtgcaaggaat

SEQ ID NO: 693249 - DNA, 25 bp, Mus musculus
gctgctgagctcgtgtgcaaggaat

SEQ ID NO: 693250 - DNA, 25 bp, Mus musculus
gctgctgaggtcagggttccccagt

SEQ ID NO: 693251 - DNA, 25 bp, Mus musculus
gctgctgaggtctgggttccccagt

SEQ ID NO: 693252 - DNA, 25 bp, Mus musculus
gctgctgagttaatgggccccttgg

SEQ ID NO: 693253 - DNA, 25 bp, Mus musculus
gctgctgagttattgggccccttgg

SEQ ID NO: 693254 - DNA, 25 bp, Mus musculus
gctgctgatctgctgagcgagaact

SEQ ID NO: 693255 - DNA, 25 bp, Mus musculus
gctgctgatctggtgagcgagaact

SEQ ID NO: 693256 - DNA, 25 bp, Mus musculus
gctgctgatgcccaagccatagctg

SEQ ID NO: 693257 - DNA, 25 bp, Mus musculus
gctgctgatgccgaagccatagctg

SEQ ID NO: 693258 - DNA, 25 bp, Mus musculus
gctgctgatgctcttaccgtggaaa

SEQ ID NO: 693259 - DNA, 25 bp, Mus musculus
gctgctgatgctgttaccgtggaaa

SEQ ID NO: 693260 - DNA, 25 bp, Mus musculus
gctgctgatgtacgaacactgcaga

SEQ ID NO: 693261 - DNA, 25 bp, Mus musculus
gctgctgatgtaggaacactgcaga

SEQ ID NO: 693262 - DNA, 25 bp, Mus musculus
gctgctgcaaggaaatctaaaggag

SEQ ID NO: 693263 - DNA, 25 bp, Mus musculus
gctgctgcaaggtaatctaaaggag

SEQ ID NO: 693264 - DNA, 25 bp, Mus musculus
gctgctgcactgcaaggctacagaa

SEQ ID NO: 693265 - DNA, 25 bp, Mus musculus
gctgctgcactggaaggctacagaa

SEQ ID NO: 693266 - DNA, 25 bp, Mus musculus
gctgctgcagctaaaaatgattggc

SEQ ID NO: 693267 - DNA, 25 bp, Mus musculus
gctgctgcagcttaaaatgattggc

SEQ ID NO: 693268 - DNA, 25 bp, Mus musculus
gctgctgcagttactagatgagacc

SEQ ID NO: 693269 - DNA, 25 bp, Mus musculus
gctgctgcagtttctagatgagacc

SEQ ID NO: 693270 - DNA, 25 bp, Mus musculus
gctgctgcatggaggttcatcgctg

SEQ ID NO: 693271 - DNA, 25 bp, Mus musculus
gctgctgcatggtggttcatcgctg

SEQ ID NO: 693272 - DNA, 25 bp, Mus musculus
gctgctgccacacgtctcactgttg

SEQ ID NO: 693273 - DNA, 25 bp, Mus musculus
gctgctgccacaggtctcactgttg

SEQ ID NO: 693274 - DNA, 25 bp, Mus musculus
gctgctgccatcattactgtgcaac

SEQ ID NO: 693275 - DNA, 25 bp, Mus musculus
gctgctgccatctttactgtgcaac

SEQ ID NO: 693276 - DNA, 25 bp, Mus musculus
gctgctgccgccatatgtcatttta

SEQ ID NO: 693277 - DNA, 25 bp, Mus musculus
gctgctgccgccttatgtcatttta

SEQ ID NO: 693278 - DNA, 25 bp, Mus musculus
gctgctgccgggaggtccttcctgt

SEQ ID NO: 693279 - DNA, 25 bp, Mus musculus
gctgctgccgggtggtccttcctgt

SEQ ID NO: 693280 - DNA, 25 bp, Mus musculus
gctgctgcgctgcacgcaggcaaca

SEQ ID NO: 693281 - DNA, 25 bp, Mus musculus
gctgctgcgctggacgcaggcaaca

SEQ ID NO: 693282 - DNA, 25 bp, Mus musculus
gctgctgctacaatggctgtgccta

SEQ ID NO: 693283 - DNA, 25 bp, Mus musculus
gctgctgctacattggctgtgccta

SEQ ID NO: 693284 - DNA, 25 bp, Mus musculus
gctgctgctcagactttaaatgtac

SEQ ID NO: 693285 - DNA, 25 bp, Mus musculus
gctgctgctcagtctttaaatgtac

SEQ ID NO: 693286 - DNA, 25 bp, Mus musculus
gctgctgctcatagctcgagccaga

SEQ ID NO: 693287 - DNA, 25 bp, Mus musculus
gctgctgctcattgctcgagccaga

SEQ ID NO: 693288 - DNA, 25 bp, Mus musculus
gctgctgctcggagaggactcccga

SEQ ID NO: 693289 - DNA, 25 bp, Mus musculus
gctgctgctcggtgaggactcccga

SEQ ID NO: 693290 - DNA, 25 bp, Mus musculus
gctgctgctgaacggctttggcaaa

SEQ ID NO: 693291 - DNA, 25 bp, Mus musculus
gctgctgctgaagggctttggcaaa

SEQ ID NO: 693292 - DNA, 25 bp, Mus musculus
gctgctgcttgtcgtccccggagtc

SEQ ID NO: 693293 - DNA, 25 bp, Mus musculus
gctgctgcttgtggtccccggagtc

SEQ ID NO: 693294 - DNA, 25 bp, Mus musculus
gctgctggaagaagggaaaacaaaa

SEQ ID NO: 693295 - DNA, 25 bp, Mus musculus
gctgctggaagatgggaaaacaaaa

SEQ ID NO: 693296 - DNA, 25 bp, Mus musculus
gctgctggacaaccgattgaattac

SEQ ID NO: 693297 - DNA, 25 bp, Mus musculus
gctgctggacaagcgattgaattac

SEQ ID NO: 693298 - DNA, 25 bp, Mus musculus
gctgctggaccaacagctagaacca

SEQ ID NO: 693299 - DNA, 25 bp, Mus musculus
gctgctggaccatcagctagaacca

SEQ ID NO: 693300 - DNA, 25 bp, Mus musculus
gctgctggacctagcccagaaacac

SEQ ID NO: 693301 - DNA, 25 bp, Mus musculus
gctgctggaccttgcccagaaacac

SEQ ID NO: 693302 - DNA, 25 bp, Mus musculus
gctgctggagaaagtaacagtgcag

SEQ ID NO: 693303 - DNA, 25 bp, Mus musculus
gctgctggagaatgtaacagtgcag

SEQ ID NO: 693304 - DNA, 25 bp, Mus musculus
gctgctggagcaaatgaagaactct

SEQ ID NO: 693305 - DNA, 25 bp, Mus musculus
gctgctggagcatatgaagaactct

SEQ ID NO: 693306 - DNA, 25 bp, Mus musculus
gctgctggaggtaccgctgtctctg

SEQ ID NO: 693307 - DNA, 25 bp, Mus musculus
gctgctggaggttccgctgtctctg

SEQ ID NO: 693308 - DNA, 25 bp, Mus musculus
gctgctggataccacaggagagacc

SEQ ID NO: 693309 - DNA, 25 bp, Mus musculus
gctgctggatacgacaggagagacc

SEQ ID NO: 693310 - DNA, 25 bp, Mus musculus
gctgctggatatccaagcatctcag

SEQ ID NO: 693311 - DNA, 25 bp, Mus musculus
gctgctggatatgcaagcatctcag

SEQ ID NO: 693312 - DNA, 25 bp, Mus musculus
gctgctggatcgagtctttaccaca

SEQ ID NO: 693313 - DNA, 25 bp, Mus musculus
gctgctggatcgtgtctttaccaca

SEQ ID NO: 693314 - DNA, 25 bp, Mus musculus
gctgctggcacaagtctatctcctt

SEQ ID NO: 693315 - DNA, 25 bp, Mus musculus
gctgctggcacatgtctatctcctt

SEQ ID NO: 693316 - DNA, 25 bp, Mus musculus
gctgctggcaccagtgttcgacttc

SEQ ID NO: 693317 - DNA, 25 bp, Mus musculus
gctgctggcacctgtgttcgacttc

SEQ ID NO: 693318 - DNA, 25 bp, Mus musculus
gctgctggcatgatgtatctcgaga

SEQ ID NO: 693319 - DNA, 25 bp, Mus musculus
gctgctggcatgttgtatctcgaga

SEQ ID NO: 693320 - DNA, 25 bp, Mus musculus
gctgctggctaaatgcacaggactg

SEQ ID NO: 693321 - DNA, 25 bp, Mus musculus
gctgctggctaattgcacaggactg

SEQ ID NO: 693322 - DNA, 25 bp, Mus musculus
gctgctggctacacttctctccagg

SEQ ID NO: 693323 - DNA, 25 bp, Mus musculus
gctgctggctaccactctgaaccag

SEQ ID NO: 693324 - DNA, 25 bp, Mus musculus
gctgctggctacgactctgaaccag

SEQ ID NO: 693325 - DNA, 25 bp, Mus musculus
gctgctggctactcttctctccagg

SEQ ID NO: 693326 - DNA, 25 bp, Mus musculus
gctgctgggccgcactacgctcaga

SEQ ID NO: 693327 - DNA, 25 bp, Mus musculus
gctgctgggccggactacgctcaga

SEQ ID NO: 693328 - DNA, 25 bp, Mus musculus
gctgctgggcctacaaatcatatgg

SEQ ID NO: 693329 - DNA, 25 bp, Mus musculus
gctgctgggccttcaaatcatatgg

SEQ ID NO: 693330 - DNA, 25 bp, Mus musculus
gctgctgggctcagtacagggctac

SEQ ID NO: 693331 - DNA, 25 bp, Mus musculus
gctgctgggctctgtacagggctac

SEQ ID NO: 693332 - DNA, 25 bp, Mus musculus
gctgctgggctgctatgccgccaat

SEQ ID NO: 693333 - DNA, 25 bp, Mus musculus
gctgctgggctggtatgccgccaat

SEQ ID NO: 693334 - DNA, 25 bp, Mus musculus
gctgctgggtcaactgagccattat

SEQ ID NO: 693335 - DNA, 25 bp, Mus musculus
gctgctgggtcatctgagccattat

SEQ ID NO: 693336 - DNA, 25 bp, Mus musculus
gctgctgggtttctgtagtgaaata

SEQ ID NO: 693337 - DNA, 25 bp, Mus musculus
gctgctgggtttgtgtagtgaaata

SEQ ID NO: 693338 - DNA, 25 bp, Mus musculus
gctgctggtaacaggacagatgccc

SEQ ID NO: 693339 - DNA, 25 bp, Mus musculus
gctgctggtaactggacagatgccc

SEQ ID NO: 693340 - DNA, 25 bp, Mus musculus
gctgctggtagaccagtacttccct

SEQ ID NO: 693341 - DNA, 25 bp, Mus musculus
gctgctggtagagcagtacttccct

SEQ ID NO: 693342 - DNA, 25 bp, Mus musculus
gctgctggtcggacgtttcccttga

SEQ ID NO: 693343 - DNA, 25 bp, Mus musculus
gctgctggtcggtcgtttcccttga

SEQ ID NO: 693344 - DNA, 25 bp, Mus musculus
gctgctggtggcatcgatgaatatt

SEQ ID NO: 693345 - DNA, 25 bp, Mus musculus
gctgctggtggcttcgatgaatatt

SEQ ID NO: 693346 - DNA, 25 bp, Mus musculus
gctgctggttgtcatccttgtcaaa

SEQ ID NO: 693347 - DNA, 25 bp, Mus musculus
gctgctggttgtgatccttgtcaaa

SEQ ID NO: 693348 - DNA, 25 bp, Mus musculus
gctgctgtagatagacggccccgcg

SEQ ID NO: 693349 - DNA, 25 bp, Mus musculus
gctgctgtagattgacggccccgcg

SEQ ID NO: 693350 - DNA, 25 bp, Mus musculus
gctgctgtatgaacctgagaaagat

SEQ ID NO: 693351 - DNA, 25 bp, Mus musculus
gctgctgtatgatcctgagaaagat

SEQ ID NO: 693352 - DNA, 25 bp, Mus musculus
gctgctgtcggccaccaacatgctg

SEQ ID NO: 693353 - DNA, 25 bp, Mus musculus
gctgctgtcggcgaccaacatgctg

SEQ ID NO: 693354 - DNA, 25 bp, Mus musculus
gctgctgtgaacaacgcccgagccg

SEQ ID NO: 693355 - DNA, 25 bp, Mus musculus
gctgctgtgaacaggctattggctt

SEQ ID NO: 693356 - DNA, 25 bp, Mus musculus
gctgctgtgaactacgcccgagccg

SEQ ID NO: 693357 - DNA, 25 bp, Mus musculus
gctgctgtgaactggctattggctt

SEQ ID NO: 693358 - DNA, 25 bp, Mus musculus
gctgctgtgactaatctctctctta

SEQ ID NO: 693359 - DNA, 25 bp, Mus musculus
gctgctgtgactctgttattatgat

SEQ ID NO: 693360 - DNA, 25 bp, Mus musculus
gctgctgtgactgtgttattatgat

SEQ ID NO: 693361 - DNA, 25 bp, Mus musculus
gctgctgtgacttatctctctctta

SEQ ID NO: 693362 - DNA, 25 bp, Mus musculus
gctgctgtgagccagtctctcaccg

SEQ ID NO: 693363 - DNA, 25 bp, Mus musculus
gctgctgtgagcgagtctctcaccg

SEQ ID NO: 693364 - DNA, 25 bp, Mus musculus
gctgctgtgcaacgaccctaagaag

SEQ ID NO: 693365 - DNA, 25 bp, Mus musculus
gctgctgtgcaaggaccctaagaag

SEQ ID NO: 693366 - DNA, 25 bp, Mus musculus
gctgctgtgcatcctgaccttcctg

SEQ ID NO: 693367 - DNA, 25 bp, Mus musculus
gctgctgtgcatgctgaccttcctg

SEQ ID NO: 693368 - DNA, 25 bp, Mus musculus
gctgctgtggaaacatcttttccta

SEQ ID NO: 693369 - DNA, 25 bp, Mus musculus
gctgctgtggaatcatcttttccta

SEQ ID NO: 693370 - DNA, 25 bp, Mus musculus
gctgctgtgtctacccactcaggac

SEQ ID NO: 693371 - DNA, 25 bp, Mus musculus
gctgctgtgtcttcccactcaggac

SEQ ID NO: 693372 - DNA, 25 bp, Mus musculus
gctgctgttgctcttctacctgatt

SEQ ID NO: 693373 - DNA, 25 bp, Mus musculus
gctgctgttgctgttctacctgatt

SEQ ID NO: 693374 - DNA, 25 bp, Mus musculus
gctgctgttggaacaccagtgtctc

SEQ ID NO: 693375 - DNA, 25 bp, Mus musculus
gctgctgttggacagacacaacttc

SEQ ID NO: 693376 - DNA, 25 bp, Mus musculus
gctgctgttggagagacacaacttc

SEQ ID NO: 693377 - DNA, 25 bp, Mus musculus
gctgctgttggatcaccagtgtctc

SEQ ID NO: 693378 - DNA, 25 bp, Mus musculus
gctgctgttgtcagctgacctggtc

SEQ ID NO: 693379 - DNA, 25 bp, Mus musculus
gctgctgttgtctgctgacctggtc

SEQ ID NO: 693380 - DNA, 25 bp, Mus musculus
gctgctgttgtgctcctgaagaacg

SEQ ID NO: 693381 - DNA, 25 bp, Mus musculus
gctgctgttgtggtcctgaagaacg

SEQ ID NO: 693382 - DNA, 25 bp, Mus musculus
gctgcttactatcaccaaactggtg

SEQ ID NO: 693383 - DNA, 25 bp, Mus musculus
gctgcttactatgaccaaactggtg

SEQ ID NO: 693384 - DNA, 25 bp, Mus musculus
gctgcttaggtaacgctctagccca

SEQ ID NO: 693385 - DNA, 25 bp, Mus musculus
gctgcttaggtatcgctctagccca

SEQ ID NO: 693386 - DNA, 25 bp, Mus musculus
gctgcttatgatccctgtgccaccg

SEQ ID NO: 693387 - DNA, 25 bp, Mus musculus
gctgcttatgatgcctgtgccaccg

SEQ ID NO: 693388 - DNA, 25 bp, Mus musculus
gctgcttattgcagtgtcagtgaat

SEQ ID NO: 693389 - DNA, 25 bp, Mus musculus
gctgcttattgctgtgtcagtgaat

SEQ ID NO: 693390 - DNA, 25 bp, Mus musculus
gctgcttcaagacgtgagaattcct

SEQ ID NO: 693391 - DNA, 25 bp, Mus musculus
gctgcttcaagaggtgagaattcct

SEQ ID NO: 693392 - DNA, 25 bp, Mus musculus
gctgcttcaagcaatcgtagatcag

SEQ ID NO: 693393 - DNA, 25 bp, Mus musculus
gctgcttcaagctatcgtagatcag

SEQ ID NO: 693394 - DNA, 25 bp, Mus musculus
gctgcttcactaagaggaggaagag

SEQ ID NO: 693395 - DNA, 25 bp, Mus musculus
gctgcttcactatgaggaggaagag

SEQ ID NO: 693396 - DNA, 25 bp, Mus musculus
gctgcttcactcaggcttagacctt

SEQ ID NO: 693397 - DNA, 25 bp, Mus musculus
gctgcttcactctggcttagacctt

SEQ ID NO: 693398 - DNA, 25 bp, Mus musculus
gctgcttcagagatcaccgtgctgg

SEQ ID NO: 693399 - DNA, 25 bp, Mus musculus
gctgcttcagagctctgctctgact

SEQ ID NO: 693400 - DNA, 25 bp, Mus musculus
gctgcttcagaggtctgctctgact

SEQ ID NO: 693401 - DNA, 25 bp, Mus musculus
gctgcttcagagttcaccgtgctgg

SEQ ID NO: 693402 - DNA, 25 bp, Mus musculus
gctgcttcaggaatcaacgcaactg

SEQ ID NO: 693403 - DNA, 25 bp, Mus musculus
gctgcttcaggattcaacgcaactg

SEQ ID NO: 693404 - DNA, 25 bp, Mus musculus
gctgcttccaggacacattgcccaa

SEQ ID NO: 693405 - DNA, 25 bp, Mus musculus
gctgcttccaggtcacattgcccaa

SEQ ID NO: 693406 - DNA, 25 bp, Mus musculus
gctgcttccatgagccgcggtgcct

SEQ ID NO: 693407 - DNA, 25 bp, Mus musculus
gctgcttccatgtgccgcggtgcct

SEQ ID NO: 693408 - DNA, 25 bp, Mus musculus
gctgcttcccctcatgagcagaagg

SEQ ID NO: 693409 - DNA, 25 bp, Mus musculus
gctgcttcccctgatgagcagaagg

SEQ ID NO: 693410 - DNA, 25 bp, Mus musculus
gctgcttcccttacgccagagacga

SEQ ID NO: 693411 - DNA, 25 bp, Mus musculus
gctgcttccctttcgccagagacga

SEQ ID NO: 693412 - DNA, 25 bp, Mus musculus
gctgcttcctcaatccaaatacaaa

SEQ ID NO: 693413 - DNA, 25 bp, Mus musculus
gctgcttcctcattccaaatacaaa

SEQ ID NO: 693414 - DNA, 25 bp, Mus musculus
gctgcttcctgtcccactactgtag

SEQ ID NO: 693415 - DNA, 25 bp, Mus musculus
gctgcttcctgtgccactactgtag

SEQ ID NO: 693416 - DNA, 25 bp, Mus musculus
gctgcttcgagaacagtgggctgga

SEQ ID NO: 693417 - DNA, 25 bp, Mus musculus
gctgcttcgagatcagtgggctgga

SEQ ID NO: 693418 - DNA, 25 bp, Mus musculus
gctgcttcgctacctactggatggg

SEQ ID NO: 693419 - DNA, 25 bp, Mus musculus
gctgcttcgctagctactggatggg

SEQ ID NO: 693420 - DNA, 25 bp, Mus musculus
gctgcttctccgagtccatgctagc

SEQ ID NO: 693421 - DNA, 25 bp, Mus musculus
gctgcttctccgtgtccatgctagc

SEQ ID NO: 693422 - DNA, 25 bp, Mus musculus
gctgcttctggtacagtgttcaagg

SEQ ID NO: 693423 - DNA, 25 bp, Mus musculus
gctgcttctggttcagtgttcaagg

SEQ ID NO: 693424 - DNA, 25 bp, Mus musculus
gctgcttgactgaggagttgacgtc

SEQ ID NO: 693425 - DNA, 25 bp, Mus musculus
gctgcttgactgtggagttgacgtc

SEQ ID NO: 693426 - DNA, 25 bp, Mus musculus
gctgcttgccagcattcttaaactc

SEQ ID NO: 693427 - DNA, 25 bp, Mus musculus
gctgcttgccaggattcttaaactc

SEQ ID NO: 693428 - DNA, 25 bp, Mus musculus
gctgcttgcctcagatccagctcta

SEQ ID NO: 693429 - DNA, 25 bp, Mus musculus
gctgcttgcctctgatccagctcta

SEQ ID NO: 693430 - DNA, 25 bp, Mus musculus
gctgcttggaagacacaactggacg

SEQ ID NO: 693431 - DNA, 25 bp, Mus musculus
gctgcttggaagtcacaactggacg

SEQ ID NO: 693432 - DNA, 25 bp, Mus musculus
gctgcttggcccctgatccttactg

SEQ ID NO: 693433 - DNA, 25 bp, Mus musculus
gctgcttggcccgtgatccttactg

SEQ ID NO: 693434 - DNA, 25 bp, Mus musculus
gctgcttgggaaaagtctgcaagtt

SEQ ID NO: 693435 - DNA, 25 bp, Mus musculus
gctgcttgggaatagtctgcaagtt

SEQ ID NO: 693436 - DNA, 25 bp, Mus musculus
gctgcttgtggaagcgccatgacaa

SEQ ID NO: 693437 - DNA, 25 bp, Mus musculus
gctgcttgtggatgcgccatgacaa

SEQ ID NO: 693438 - DNA, 25 bp, Mus musculus
gctgctttacagatgatggctcatg

SEQ ID NO: 693439 - DNA, 25 bp, Mus musculus
gctgctttacagttgatggctcatg

SEQ ID NO: 693440 - DNA, 25 bp, Mus musculus
gctgctttcaggctcccgagagaag

SEQ ID NO: 693441 - DNA, 25 bp, Mus musculus
gctgctttcagggtcccgagagaag

SEQ ID NO: 693442 - DNA, 25 bp, Mus musculus
gctgctttcagtagattgtgtaaaa

SEQ ID NO: 693443 - DNA, 25 bp, Mus musculus
gctgctttcagttgattgtgtaaaa

SEQ ID NO: 693444 - DNA, 25 bp, Mus musculus
gctgctttccggaacatcaagacca

SEQ ID NO: 693445 - DNA, 25 bp, Mus musculus
gctgctttccggcagacgttttccg

SEQ ID NO: 693446 - DNA, 25 bp, Mus musculus
gctgctttccgggagacgttttccg

SEQ ID NO: 693447 - DNA, 25 bp, Mus musculus
gctgctttccggtacatcaagacca

SEQ ID NO: 693448 - DNA, 25 bp, Mus musculus
gctgctttccttatgtggcttgaga

SEQ ID NO: 693449 - DNA, 25 bp, Mus musculus
gctgctttccttttgtggcttgaga

SEQ ID NO: 693450 - DNA, 25 bp, Mus musculus
gctgctttctggcttatttacagac

SEQ ID NO: 693451 - DNA, 25 bp, Mus musculus
gctgctttctgggttatttacagac

SEQ ID NO: 693452 - DNA, 25 bp, Mus musculus
gctgctttgccgcacttcggaggac

SEQ ID NO: 693453 - DNA, 25 bp, Mus musculus
gctgctttgccggacttcggaggac

SEQ ID NO: 693454 - DNA, 25 bp, Mus musculus
gctgctttgggacacctcatcagta

SEQ ID NO: 693455 - DNA, 25 bp, Mus musculus
gctgctttgggagacctcatcagta

SEQ ID NO: 693456 - DNA, 25 bp, Mus musculus
gctgctttggtgatgtacatcgagg

SEQ ID NO: 693457 - DNA, 25 bp, Mus musculus
gctgctttggtgttgtacatcgagg

SEQ ID NO: 693458 - DNA, 25 bp, Mus musculus
gctgctttgtacacacccattttaa

SEQ ID NO: 693459 - DNA, 25 bp, Mus musculus
gctgctttgtactcacccattttaa

SEQ ID NO: 693460 - DNA, 25 bp, Mus musculus
gctgctttgtctcgcaatctgtcgg

SEQ ID NO: 693461 - DNA, 25 bp, Mus musculus
gctgctttgtctggcaatctgtcgg

SEQ ID NO: 693462 - DNA, 25 bp, Mus musculus
gctgcttttcagacaattctaacag

SEQ ID NO: 693463 - DNA, 25 bp, Mus musculus
gctgcttttcagtcaattctaacag

SEQ ID NO: 693464 - DNA, 25 bp, Mus musculus
gctgcttttggaaggagttaggtaa

SEQ ID NO: 693465 - DNA, 25 bp, Mus musculus
gctgcttttggatggagttaggtaa

SEQ ID NO: 693466 - DNA, 25 bp, Mus musculus
gctgctttttcaccaaggtaccata

SEQ ID NO: 693467 - DNA, 25 bp, Mus musculus
gctgctttttcagcaaggtaccata

SEQ ID NO: 693468 - DNA, 25 bp, Mus musculus
gctggaaaacgaacttgacctgaaa

SEQ ID NO: 693469 - DNA, 25 bp, Mus musculus
gctggaaaacgatcttgacctgaaa

SEQ ID NO: 693470 - DNA, 25 bp, Mus musculus
gctggaaacagacaccttcaaactg

SEQ ID NO: 693471 - DNA, 25 bp, Mus musculus
gctggaaacagagaccttcaaactg

SEQ ID NO: 693472 - DNA, 25 bp, Mus musculus
gctggaaacctgatcctggatcccc

SEQ ID NO: 693473 - DNA, 25 bp, Mus musculus
gctggaaacctgttcctggatcccc

SEQ ID NO: 693474 - DNA, 25 bp, Mus musculus
gctggaaagaacacctggtttagag

SEQ ID NO: 693475 - DNA, 25 bp, Mus musculus
gctggaaagaactcctggtttagag

SEQ ID NO: 693476 - DNA, 25 bp, Mus musculus
gctggaaagattacactgcatacag

SEQ ID NO: 693477 - DNA, 25 bp, Mus musculus
gctggaaagatttcactgcatacag

SEQ ID NO: 693478 - DNA, 25 bp, Mus musculus
gctggaaaggtcctctcggagacta

SEQ ID NO: 693479 - DNA, 25 bp, Mus musculus
gctggaaaggtcgtctcggagacta

SEQ ID NO: 693480 - DNA, 25 bp, Mus musculus
gctggaaatatgctggttaagaaaa

SEQ ID NO: 693481 - DNA, 25 bp, Mus musculus
gctggaaatatggtggttaagaaaa

SEQ ID NO: 693482 - DNA, 25 bp, Mus musculus
gctggaaatcttccccgtcgggcag

SEQ ID NO: 693483 - DNA, 25 bp, Mus musculus
gctggaaatcttgcccgtcgggcag

SEQ ID NO: 693484 - DNA, 25 bp, Mus musculus
gctggaaatgggagatgattacatt

SEQ ID NO: 693485 - DNA, 25 bp, Mus musculus
gctggaaatgggtgatgattacatt

SEQ ID NO: 693486 - DNA, 25 bp, Mus musculus
gctggaacacagctgaccattagtt

SEQ ID NO: 693487 - DNA, 25 bp, Mus musculus
gctggaacacaggtgaccattagtt

SEQ ID NO: 693488 - DNA, 25 bp, Mus musculus
gctggaacaccacgttgaaatgctg

SEQ ID NO: 693489 - DNA, 25 bp, Mus musculus
gctggaacaccaggttgaaatgctg

SEQ ID NO: 693490 - DNA, 25 bp, Mus musculus
gctggaacactactgaccacgatga

SEQ ID NO: 693491 - DNA, 25 bp, Mus musculus
gctggaacactagtgaccacgatga

SEQ ID NO: 693492 - DNA, 25 bp, Mus musculus
gctggaacaggcaatccctgtgcgg

SEQ ID NO: 693493 - DNA, 25 bp, Mus musculus
gctggaacaggctatccctgtgcgg

SEQ ID NO: 693494 - DNA, 25 bp, Mus musculus
gctggaacagtaccaccaggcgatt

SEQ ID NO: 693495 - DNA, 25 bp, Mus musculus
gctggaacagtagcaccaggcgatt

SEQ ID NO: 693496 - DNA, 25 bp, Mus musculus
gctggaaccacacgttggcatggct

SEQ ID NO: 693497 - DNA, 25 bp, Mus musculus
gctggaaccacaggttggcatggct

SEQ ID NO: 693498 - DNA, 25 bp, Mus musculus
gctggaaccaggatgcagggccact

SEQ ID NO: 693499 - DNA, 25 bp, Mus musculus
gctggaaccaggttgcagggccact

SEQ ID NO: 693500 - DNA, 25 bp, Mus musculus
gctggaacctcaaggccctcaggac

SEQ ID NO: 693501 - DNA, 25 bp, Mus musculus
gctggaacctcatggccctcaggac

SEQ ID NO: 693502 - DNA, 25 bp, Mus musculus
gctggaacgagcagctgatcgcctc

SEQ ID NO: 693503 - DNA, 25 bp, Mus musculus
gctggaacgagctgctgatcgcctc

SEQ ID NO: 693504 - DNA, 25 bp, Mus musculus
gctggaacgcttctatgaccctgaa

SEQ ID NO: 693505 - DNA, 25 bp, Mus musculus
gctggaacgcttgtatgaccctgaa

SEQ ID NO: 693506 - DNA, 25 bp, Mus musculus
gctggaagaaagatccgtaatccaa

SEQ ID NO: 693507 - DNA, 25 bp, Mus musculus
gctggaagaaagttccgtaatccaa

SEQ ID NO: 693508 - DNA, 25 bp, Mus musculus
gctggaagaaggcaaaacaaaatgc

SEQ ID NO: 693509 - DNA, 25 bp, Mus musculus
gctggaagaagggaaaacaaaatgc

SEQ ID NO: 693510 - DNA, 25 bp, Mus musculus
gctggaagccaccattgctgtgctc

SEQ ID NO: 693511 - DNA, 25 bp, Mus musculus
gctggaagccacgattgctgtgctc

SEQ ID NO: 693512 - DNA, 25 bp, Mus musculus
gctggaagcccaatttcatggctgt

SEQ ID NO: 693513 - DNA, 25 bp, Mus musculus
gctggaagcccattttcatggctgt

SEQ ID NO: 693514 - DNA, 25 bp, Mus musculus
gctggaagctgtctacgaacgactc

SEQ ID NO: 693515 - DNA, 25 bp, Mus musculus
gctggaagctgtgtacgaacgactc

SEQ ID NO: 693516 - DNA, 25 bp, Mus musculus
gctggaaggagtcacaaagcagaaa

SEQ ID NO: 693517 - DNA, 25 bp, Mus musculus
gctggaaggagtgacaaagcagaaa

SEQ ID NO: 693518 - DNA, 25 bp, Mus musculus
gctggaaggtttccagacctcagat

SEQ ID NO: 693519 - DNA, 25 bp, Mus musculus
gctggaaggtttgcagacctcagat

SEQ ID NO: 693520 - DNA, 25 bp, Mus musculus
gctggaagtacgacttagatctatc

SEQ ID NO: 693521 - DNA, 25 bp, Mus musculus
gctggaagtacgtcttagatctatc

SEQ ID NO: 693522 - DNA, 25 bp, Mus musculus
gctggaagtcttcctgacgccatgt

SEQ ID NO: 693523 - DNA, 25 bp, Mus musculus
gctggaagtcttgctgacgccatgt

SEQ ID NO: 693524 - DNA, 25 bp, Mus musculus
gctggaatatctagtttttacacac

SEQ ID NO: 693525 - DNA, 25 bp, Mus musculus
gctggaatatcttgtttttacacac

SEQ ID NO: 693526 - DNA, 25 bp, Mus musculus
gctggaatatgactccgtgctgtgt

SEQ ID NO: 693527 - DNA, 25 bp, Mus musculus
gctggaatatgagtccgtgctgtgt

SEQ ID NO: 693528 - DNA, 25 bp, Mus musculus
gctggaatcggtctaaggttctttg

SEQ ID NO: 693529 - DNA, 25 bp, Mus musculus
gctggaatcggtgtaaggttctttg

SEQ ID NO: 693530 - DNA, 25 bp, Mus musculus
gctggaatgacactcacttatgacc

SEQ ID NO: 693531 - DNA, 25 bp, Mus musculus
gctggaatgacagtcacttatgacc

SEQ ID NO: 693532 - DNA, 25 bp, Mus musculus
gctggaatgccaatcactctcactg

SEQ ID NO: 693533 - DNA, 25 bp, Mus musculus
gctggaatgccattcactctcactg

SEQ ID NO: 693534 - DNA, 25 bp, Mus musculus
gctggaatggcaaaggcaaaagcag

SEQ ID NO: 693535 - DNA, 25 bp, Mus musculus
gctggaatggcataggcaaaagcag

SEQ ID NO: 693536 - DNA, 25 bp, Mus musculus
gctggaatgttccttgtcattgaac

SEQ ID NO: 693537 - DNA, 25 bp, Mus musculus
gctggaatgttcgttgtcattgaac

SEQ ID NO: 693538 - DNA, 25 bp, Mus musculus
gctggaattctcctttgaggactgg

SEQ ID NO: 693539 - DNA, 25 bp, Mus musculus
gctggaattctcgtttgaggactgg

SEQ ID NO: 693540 - DNA, 25 bp, Mus musculus
gctggaattctgcacctgctttcaa

SEQ ID NO: 693541 - DNA, 25 bp, Mus musculus
gctggaattctggacctgctttcaa

SEQ ID NO: 693542 - DNA, 25 bp, Mus musculus
gctggaattcttcctcacatcaatt

SEQ ID NO: 693543 - DNA, 25 bp, Mus musculus
gctggaattcttgctcacatcaatt

SEQ ID NO: 693544 - DNA, 25 bp, Mus musculus
gctggacaaacgcattggccctgat

SEQ ID NO: 693545 - DNA, 25 bp, Mus musculus
gctggacaaacggattggccctgat

SEQ ID NO: 693546 - DNA, 25 bp, Mus musculus
gctggacaaatcatgagaataaaat

SEQ ID NO: 693547 - DNA, 25 bp, Mus musculus
gctggacaaatcttgagaataaaat

SEQ ID NO: 693548 - DNA, 25 bp, Mus musculus
gctggacaacttatccaaacctgtg

SEQ ID NO: 693549 - DNA, 25 bp, Mus musculus
gctggacaacttttccaaacctgtg

SEQ ID NO: 693550 - DNA, 25 bp, Mus musculus
gctggacaagctcaagaaaaccaat

SEQ ID NO: 693551 - DNA, 25 bp, Mus musculus
gctggacaagctgaagaaaaccaat

SEQ ID NO: 693552 - DNA, 25 bp, Mus musculus
gctggacaaggcactaggacctaga

SEQ ID NO: 693553 - DNA, 25 bp, Mus musculus
gctggacaaggctctaggacctaga

SEQ ID NO: 693554 - DNA, 25 bp, Mus musculus
gctggacaagtaatcggaagcttta

SEQ ID NO: 693555 - DNA, 25 bp, Mus musculus
gctggacaagtattcggaagcttta

SEQ ID NO: 693556 - DNA, 25 bp, Mus musculus
gctggacaatcactatcacctggga

SEQ ID NO: 693557 - DNA, 25 bp, Mus musculus
gctggacaatcagtatcacctggga

SEQ ID NO: 693558 - DNA, 25 bp, Mus musculus
gctggacacagcagagaaatccgag

SEQ ID NO: 693559 - DNA, 25 bp, Mus musculus
gctggacacagctgagaaatccgag

SEQ ID NO: 693560 - DNA, 25 bp, Mus musculus
gctggacacagtagtccctttggag

SEQ ID NO: 693561 - DNA, 25 bp, Mus musculus
gctggacacagttgtccctttggag

SEQ ID NO: 693562 - DNA, 25 bp, Mus musculus
gctggacaccccactcgaaaggctt

SEQ ID NO: 693563 - DNA, 25 bp, Mus musculus
gctggacacccctctcgaaaggctt

SEQ ID NO: 693564 - DNA, 25 bp, Mus musculus
gctggacacctactccaatgctgta

SEQ ID NO: 693565 - DNA, 25 bp, Mus musculus
gctggacacctagtccaatgctgta

SEQ ID NO: 693566 - DNA, 25 bp, Mus musculus
gctggacacgacaaccgagtcagct

SEQ ID NO: 693567 - DNA, 25 bp, Mus musculus
gctggacacgactaccgagtcagct

SEQ ID NO: 693568 - DNA, 25 bp, Mus musculus
gctggacactggcattggacttcaa

SEQ ID NO: 693569 - DNA, 25 bp, Mus musculus
gctggacactgggattggacttcaa

SEQ ID NO: 693570 - DNA, 25 bp, Mus musculus
gctggacactgtcgacaactatgca

SEQ ID NO: 693571 - DNA, 25 bp, Mus musculus
gctggacactgtggacaactatgca

SEQ ID NO: 693572 - DNA, 25 bp, Mus musculus
gctggacagaggatctctacctgga

SEQ ID NO: 693573 - DNA, 25 bp, Mus musculus
gctggacagaggttctctacctgga

SEQ ID NO: 693574 - DNA, 25 bp, Mus musculus
gctggacagattcgccaatcagatt

SEQ ID NO: 693575 - DNA, 25 bp, Mus musculus
gctggacagattggccaatcagatt

SEQ ID NO: 693576 - DNA, 25 bp, Mus musculus
gctggacatcaacactcggctggaa

SEQ ID NO: 693577 - DNA, 25 bp, Mus musculus
gctggacatcaagactcggctggaa

SEQ ID NO: 693578 - DNA, 25 bp, Mus musculus
gctggacattaacgagcacaatgga

SEQ ID NO: 693579 - DNA, 25 bp, Mus musculus
gctggacattaaggagcacaatgga

SEQ ID NO: 693580 - DNA, 25 bp, Mus musculus
gctggacattgtccaccaggtcgcc

SEQ ID NO: 693581 - DNA, 25 bp, Mus musculus
gctggacattgtgcaccaggtcgcc

SEQ ID NO: 693582 - DNA, 25 bp, Mus musculus
gctggacatttcagagccatataaa

SEQ ID NO: 693583 - DNA, 25 bp, Mus musculus
gctggacatttctgagccatataaa

SEQ ID NO: 693584 - DNA, 25 bp, Mus musculus
gctggaccaaccaataggaaactgc

SEQ ID NO: 693585 - DNA, 25 bp, Mus musculus
gctggaccaacctataggaaactgc

SEQ ID NO: 693586 - DNA, 25 bp, Mus musculus
gctggaccaagcaggaaacatccgg

SEQ ID NO: 693587 - DNA, 25 bp, Mus musculus
gctggaccaagctggaaacatccgg

SEQ ID NO: 693588 - DNA, 25 bp, Mus musculus
gctggaccactgcttaaactgaaaa

SEQ ID NO: 693589 - DNA, 25 bp, Mus musculus
gctggaccactggttaaactgaaaa

SEQ ID NO: 693590 - DNA, 25 bp, Mus musculus
gctggaccaggtactacaaaaggca

SEQ ID NO: 693591 - DNA, 25 bp, Mus musculus
gctggaccaggttctacaaaaggca

SEQ ID NO: 693592 - DNA, 25 bp, Mus musculus
gctggaccgttgcttcatctctcta

SEQ ID NO: 693593 - DNA, 25 bp, Mus musculus
gctggaccgttggttcatctctcta

SEQ ID NO: 693594 - DNA, 25 bp, Mus musculus
gctggacctcccaattggcctagga

SEQ ID NO: 693595 - DNA, 25 bp, Mus musculus
gctggacctccctattggcctagga

SEQ ID NO: 693596 - DNA, 25 bp, Mus musculus
gctggacctcttaccggcaggttct

SEQ ID NO: 693597 - DNA, 25 bp, Mus musculus
gctggacctctttccggcaggttct

SEQ ID NO: 693598 - DNA, 25 bp, Mus musculus
gctggacctgaaccgctctcaggga

SEQ ID NO: 693599 - DNA, 25 bp, Mus musculus
gctggacctgaagcgctctcaggga

SEQ ID NO: 693600 - DNA, 25 bp, Mus musculus
gctggacctgctatgagaccttggg

SEQ ID NO: 693601 - DNA, 25 bp, Mus musculus
gctggacctgctttgagaccttggg

SEQ ID NO: 693602 - DNA, 25 bp, Mus musculus
gctggaccttggcatggtcatcatc

SEQ ID NO: 693603 - DNA, 25 bp, Mus musculus
gctggaccttgggatggtcatcatc

SEQ ID NO: 693604 - DNA, 25 bp, Mus musculus
gctggacctttaatgggcactgtgg

SEQ ID NO: 693605 - DNA, 25 bp, Mus musculus
gctggacctttattgggcactgtgg

SEQ ID NO: 693606 - DNA, 25 bp, Mus musculus
gctggacgaaacaggtcacctgcag

SEQ ID NO: 693607 - DNA, 25 bp, Mus musculus
gctggacgaaactggtcacctgcag

SEQ ID NO: 693608 - DNA, 25 bp, Mus musculus
gctggacgacggacactccatctgt

SEQ ID NO: 693609 - DNA, 25 bp, Mus musculus
gctggacgacggtcactccatctgt

SEQ ID NO: 693610 - DNA, 25 bp, Mus musculus
gctggacgagttcatatgtgattac

SEQ ID NO: 693611 - DNA, 25 bp, Mus musculus
gctggacgagttgatatgtgattac

SEQ ID NO: 693612 - DNA, 25 bp, Mus musculus
gctggacggacgcctagctagttca

SEQ ID NO: 693613 - DNA, 25 bp, Mus musculus
gctggacggacggctagctagttca

SEQ ID NO: 693614 - DNA, 25 bp, Mus musculus
gctggacggagacgtgtacccacct

SEQ ID NO: 693615 - DNA, 25 bp, Mus musculus
gctggacggagaggtgtacccacct

SEQ ID NO: 693616 - DNA, 25 bp, Mus musculus
gctggacggcgaagaagtcatcata

SEQ ID NO: 693617 - DNA, 25 bp, Mus musculus
gctggacggcgatgaagtcatcata

SEQ ID NO: 693618 - DNA, 25 bp, Mus musculus
gctggacggcttacagcccaacact

SEQ ID NO: 693619 - DNA, 25 bp, Mus musculus
gctggacggctttcagcccaacact

SEQ ID NO: 693620 - DNA, 25 bp, Mus musculus
gctggactacaaagcagggctgctc

SEQ ID NO: 693621 - DNA, 25 bp, Mus musculus
gctggactacaatgcagggctgctc

SEQ ID NO: 693622 - DNA, 25 bp, Mus musculus
gctggactacctcttccaccgtgag

SEQ ID NO: 693623 - DNA, 25 bp, Mus musculus
gctggactacctgttccaccgtgag

SEQ ID NO: 693624 - DNA, 25 bp, Mus musculus
gctggactacggcatctatatcatc

SEQ ID NO: 693625 - DNA, 25 bp, Mus musculus
gctggactacgggatctatatcatc

SEQ ID NO: 693626 - DNA, 25 bp, Mus musculus
gctggactagctagctttcctgaca

SEQ ID NO: 693627 - DNA, 25 bp, Mus musculus
gctggactagcttgctttcctgaca

SEQ ID NO: 693628 - DNA, 25 bp, Mus musculus
gctggactcgaactccctgaggctc

SEQ ID NO: 693629 - DNA, 25 bp, Mus musculus
gctggactcgaagtccctgaggctc

SEQ ID NO: 693630 - DNA, 25 bp, Mus musculus
gctggactctgaaagctcttctggg

SEQ ID NO: 693631 - DNA, 25 bp, Mus musculus
gctggactctgatagctcttctggg

SEQ ID NO: 693632 - DNA, 25 bp, Mus musculus
gctggactgcctcttgagaagcgaa

SEQ ID NO: 693633 - DNA, 25 bp, Mus musculus
gctggactgcctgttgagaagcgaa

SEQ ID NO: 693634 - DNA, 25 bp, Mus musculus
gctggactggcgacaactgcgacgt

SEQ ID NO: 693635 - DNA, 25 bp, Mus musculus
gctggactggcgtcaactgcgacgt

SEQ ID NO: 693636 - DNA, 25 bp, Mus musculus
gctggactgttgaaccatggctgcg

SEQ ID NO: 693637 - DNA, 25 bp, Mus musculus
gctggactgttgtaccatggctgcg

SEQ ID NO: 693638 - DNA, 25 bp, Mus musculus
gctggactttagcaagcagggcttt

SEQ ID NO: 693639 - DNA, 25 bp, Mus musculus
gctggactttaggaagcagggcttt

SEQ ID NO: 693640 - DNA, 25 bp, Mus musculus
gctggactttctattggacaggaca

SEQ ID NO: 693641 - DNA, 25 bp, Mus musculus
gctggactttcttttggacaggaca

SEQ ID NO: 693642 - DNA, 25 bp, Mus musculus
gctggacttttcacctacatgacct

SEQ ID NO: 693643 - DNA, 25 bp, Mus musculus
gctggacttttctcctacatgacct

SEQ ID NO: 693644 - DNA, 25 bp, Mus musculus
gctggagaacgacatctatcagatc

SEQ ID NO: 693645 - DNA, 25 bp, Mus musculus
gctggagaacgagatctatcagatc

SEQ ID NO: 693646 - DNA, 25 bp, Mus musculus
gctggagaacgtcttacttgactca

SEQ ID NO: 693647 - DNA, 25 bp, Mus musculus
gctggagaacgtgttacttgactca

SEQ ID NO: 693648 - DNA, 25 bp, Mus musculus
gctggagaactaagaacaaccggtg

SEQ ID NO: 693649 - DNA, 25 bp, Mus musculus
gctggagaactatgaacaaccggtg

SEQ ID NO: 693650 - DNA, 25 bp, Mus musculus
gctggagaagatcccatctatccct

SEQ ID NO: 693651 - DNA, 25 bp, Mus musculus
gctggagaagatgccatctatccct

SEQ ID NO: 693652 - DNA, 25 bp, Mus musculus
gctggagaagtaccccgtcatctaa

SEQ ID NO: 693653 - DNA, 25 bp, Mus musculus
gctggagaagtagcccgtcatctaa

SEQ ID NO: 693654 - DNA, 25 bp, Mus musculus
gctggagaatcacgaaaaagcacca

SEQ ID NO: 693655 - DNA, 25 bp, Mus musculus
gctggagaatcaggaaaaagcacca

SEQ ID NO: 693656 - DNA, 25 bp, Mus musculus
gctggagacaatatcctctgctttg

SEQ ID NO: 693657 - DNA, 25 bp, Mus musculus
gctggagacaatttcctctgctttg

SEQ ID NO: 693658 - DNA, 25 bp, Mus musculus
gctggagacaccatcaatgcctctg

SEQ ID NO: 693659 - DNA, 25 bp, Mus musculus
gctggagacaccttcaatgcctctg

SEQ ID NO: 693660 - DNA, 25 bp, Mus musculus
gctggagacccaaagaaaatacagt

SEQ ID NO: 693661 - DNA, 25 bp, Mus musculus
gctggagacccatagaaaatacagt

SEQ ID NO: 693662 - DNA, 25 bp, Mus musculus
gctggagagactccatgtaagctcg

SEQ ID NO: 693663 - DNA, 25 bp, Mus musculus
gctggagagactgcatgtaagctcg

SEQ ID NO: 693664 - DNA, 25 bp, Mus musculus
gctggagagcgaacacattgtcttt

SEQ ID NO: 693665 - DNA, 25 bp, Mus musculus
gctggagagcgatcacattgtcttt

SEQ ID NO: 693666 - DNA, 25 bp, Mus musculus
gctggagatcatatcacattggagt

SEQ ID NO: 693667 - DNA, 25 bp, Mus musculus
gctggagatcatttcacattggagt

SEQ ID NO: 693668 - DNA, 25 bp, Mus musculus
gctggagatcgcacaccgtgggaat

SEQ ID NO: 693669 - DNA, 25 bp, Mus musculus
gctggagatcgctcaccgtgggaat

SEQ ID NO: 693670 - DNA, 25 bp, Mus musculus
gctggagatgaccatcctctttatc

SEQ ID NO: 693671 - DNA, 25 bp, Mus musculus
gctggagatgacgatcctctttatc

SEQ ID NO: 693672 - DNA, 25 bp, Mus musculus
gctggagatggaaccaagaagatca

SEQ ID NO: 693673 - DNA, 25 bp, Mus musculus
gctggagatggatccaagaagatca

SEQ ID NO: 693674 - DNA, 25 bp, Mus musculus
gctggagatggcaactgtcaggcat

SEQ ID NO: 693675 - DNA, 25 bp, Mus musculus
gctggagatggctactgtcaggcat

SEQ ID NO: 693676 - DNA, 25 bp, Mus musculus
gctggagattttcgttcgcgaccca

SEQ ID NO: 693677 - DNA, 25 bp, Mus musculus
gctggagattttggttcgcgaccca

SEQ ID NO: 693678 - DNA, 25 bp, Mus musculus
gctggagcaaaaagtacaggaaaat

SEQ ID NO: 693679 - DNA, 25 bp, Mus musculus
gctggagcaaaatgtacaggaaaat

SEQ ID NO: 693680 - DNA, 25 bp, Mus musculus
gctggagcaaggcatcactggtcct

SEQ ID NO: 693681 - DNA, 25 bp, Mus musculus
gctggagcaagggatcactggtcct

SEQ ID NO: 693682 - DNA, 25 bp, Mus musculus
gctggagcagcaaatattacaagat

SEQ ID NO: 693683 - DNA, 25 bp, Mus musculus
gctggagcagcatatattacaagat

SEQ ID NO: 693684 - DNA, 25 bp, Mus musculus
gctggagcatgccaaccggcacctg

SEQ ID NO: 693685 - DNA, 25 bp, Mus musculus
gctggagcatgcgaaccggcacctg

SEQ ID NO: 693686 - DNA, 25 bp, Mus musculus
gctggagccaacatgaggcgttaca

SEQ ID NO: 693687 - DNA, 25 bp, Mus musculus
gctggagccaacttgaggcgttaca

SEQ ID NO: 693688 - DNA, 25 bp, Mus musculus
gctggagccaagcattctgtagcca

SEQ ID NO: 693689 - DNA, 25 bp, Mus musculus
gctggagccaaggattctgtagcca

SEQ ID NO: 693690 - DNA, 25 bp, Mus musculus
gctggagccattatggcacgcatcg

SEQ ID NO: 693691 - DNA, 25 bp, Mus musculus
gctggagccattttggcacgcatcg

SEQ ID NO: 693692 - DNA, 25 bp, Mus musculus
gctggagccccaccgaagtagcagc

SEQ ID NO: 693693 - DNA, 25 bp, Mus musculus
gctggagccccagcgaagtagcagc

SEQ ID NO: 693694 - DNA, 25 bp, Mus musculus
gctggagccctccactcttgtaaat

SEQ ID NO: 693695 - DNA, 25 bp, Mus musculus
gctggagccctcgactcttgtaaat

SEQ ID NO: 693696 - DNA, 25 bp, Mus musculus
gctggagccgtgattggagctgtcc

SEQ ID NO: 693697 - DNA, 25 bp, Mus musculus
gctggagccgtgtttggagctgtcc

SEQ ID NO: 693698 - DNA, 25 bp, Mus musculus
gctggagcctcgaatgatcgtgcgt

SEQ ID NO: 693699 - DNA, 25 bp, Mus musculus
gctggagcctcgtatgatcgtgcgt

SEQ ID NO: 693700 - DNA, 25 bp, Mus musculus
gctggagcctggaccttgagtctga

SEQ ID NO: 693701 - DNA, 25 bp, Mus musculus
gctggagcctggtccttgagtctga

SEQ ID NO: 693702 - DNA, 25 bp, Mus musculus
gctggagcgcccaggacgctatcta

SEQ ID NO: 693703 - DNA, 25 bp, Mus musculus
gctggagcgccctggacgctatcta

SEQ ID NO: 693704 - DNA, 25 bp, Mus musculus
gctggagcgctcattcaggcaaaaa

SEQ ID NO: 693705 - DNA, 25 bp, Mus musculus
gctggagcgctctttcaggcaaaaa

SEQ ID NO: 693706 - DNA, 25 bp, Mus musculus
gctggagctacaccaactggagata

SEQ ID NO: 693707 - DNA, 25 bp, Mus musculus
gctggagctacagcaactggagata

SEQ ID NO: 693708 - DNA, 25 bp, Mus musculus
gctggagctactaccgagcctcctg

SEQ ID NO: 693709 - DNA, 25 bp, Mus musculus
gctggagctacttccgagcctcctg

SEQ ID NO: 693710 - DNA, 25 bp, Mus musculus
gctggagctcaaccgcacgctggac

SEQ ID NO: 693711 - DNA, 25 bp, Mus musculus
gctggagctcaagcgcacgctggac

SEQ ID NO: 693712 - DNA, 25 bp, Mus musculus
gctggagctcagaaataagtgcaca

SEQ ID NO: 693713 - DNA, 25 bp, Mus musculus
gctggagctcagtaataagtgcaca

SEQ ID NO: 693714 - DNA, 25 bp, Mus musculus
gctggagctcctcggtctcacaggc

SEQ ID NO: 693715 - DNA, 25 bp, Mus musculus
gctggagctcctgggtctcacaggc

SEQ ID NO: 693716 - DNA, 25 bp, Mus musculus
gctggagctctgataaggcacacaa

SEQ ID NO: 693717 - DNA, 25 bp, Mus musculus
gctggagctctgttaaggcacacaa

SEQ ID NO: 693718 - DNA, 25 bp, Mus musculus
gctggagctgcacctcttgggacct

SEQ ID NO: 693719 - DNA, 25 bp, Mus musculus
gctggagctgcagctcttgggacct

SEQ ID NO: 693720 - DNA, 25 bp, Mus musculus
gctggagctgctcgatttaacgtgc

SEQ ID NO: 693721 - DNA, 25 bp, Mus musculus
gctggagctgctggatttaacgtgc

SEQ ID NO: 693722 - DNA, 25 bp, Mus musculus
gctggagctggtacggaccttctct

SEQ ID NO: 693723 - DNA, 25 bp, Mus musculus
gctggagctggttcggaccttctct

SEQ ID NO: 693724 - DNA, 25 bp, Mus musculus
gctggaggacttcatcaacaacatc

SEQ ID NO: 693725 - DNA, 25 bp, Mus musculus
gctggaggacttgatcaacaacatc

SEQ ID NO: 693726 - DNA, 25 bp, Mus musculus
gctggaggataacaagaaatgtctg

SEQ ID NO: 693727 - DNA, 25 bp, Mus musculus
gctggaggataagaagaaatgtctg

SEQ ID NO: 693728 - DNA, 25 bp, Mus musculus
gctggaggatttcattgcacagccg

SEQ ID NO: 693729 - DNA, 25 bp, Mus musculus
gctggaggatttgattgcacagccg

SEQ ID NO: 693730 - DNA, 25 bp, Mus musculus
gctggaggcaagcatataaattcac

SEQ ID NO: 693731 - DNA, 25 bp, Mus musculus
gctggaggcaaggatataaattcac

SEQ ID NO: 693732 - DNA, 25 bp, Mus musculus
gctggaggccctacacagtgaacat

SEQ ID NO: 693733 - DNA, 25 bp, Mus musculus
gctggaggccctagtcagggacaaa

SEQ ID NO: 693734 - DNA, 25 bp, Mus musculus
gctggaggcccttcacagtgaacat

SEQ ID NO: 693735 - DNA, 25 bp, Mus musculus
gctggaggcccttgtcagggacaaa

SEQ ID NO: 693736 - DNA, 25 bp, Mus musculus
gctggaggtctcagctccaactctt

SEQ ID NO: 693737 - DNA, 25 bp, Mus musculus
gctggaggtctctgctccaactctt

SEQ ID NO: 693738 - DNA, 25 bp, Mus musculus
gctggaggtgccatgtcttccaagt

SEQ ID NO: 693739 - DNA, 25 bp, Mus musculus
gctggaggtgccttgtcttccaagt

SEQ ID NO: 693740 - DNA, 25 bp, Mus musculus
gctggaggttctctgctccagcctg

SEQ ID NO: 693741 - DNA, 25 bp, Mus musculus
gctggaggttctgtgctccagcctg

SEQ ID NO: 693742 - DNA, 25 bp, Mus musculus
gctggagtaagcctgcctgcaccag

SEQ ID NO: 693743 - DNA, 25 bp, Mus musculus
gctggagtaagcgtgcctgcaccag

SEQ ID NO: 693744 - DNA, 25 bp, Mus musculus
gctggagtcaaacgaaagctaggca

SEQ ID NO: 693745 - DNA, 25 bp, Mus musculus
gctggagtcaaaggaaagctaggca

SEQ ID NO: 693746 - DNA, 25 bp, Mus musculus
gctggagttggaagcagtcacactg

SEQ ID NO: 693747 - DNA, 25 bp, Mus musculus
gctggagttggatgcagtcacactg

SEQ ID NO: 693748 - DNA, 25 bp, Mus musculus
gctggagttgggaagtgctcctctc

SEQ ID NO: 693749 - DNA, 25 bp, Mus musculus
gctggagttgggtagtgctcctctc

SEQ ID NO: 693750 - DNA, 25 bp, Mus musculus
gctggagttggtactattgtccatg

SEQ ID NO: 693751 - DNA, 25 bp, Mus musculus
gctggagttggttctattgtccatg

SEQ ID NO: 693752 - DNA, 25 bp, Mus musculus
gctggagttgttccccatcctcctg

SEQ ID NO: 693753 - DNA, 25 bp, Mus musculus
gctggagttgttgcccatcctcctg

SEQ ID NO: 693754 - DNA, 25 bp, Mus musculus
gctggagtttctcttggccgtttac

SEQ ID NO: 693755 - DNA, 25 bp, Mus musculus
gctggagtttctgttggccgtttac

SEQ ID NO: 693756 - DNA, 25 bp, Mus musculus
gctggagtttgcaagtgatggaatc

SEQ ID NO: 693757 - DNA, 25 bp, Mus musculus
gctggagtttgctagtgatggaatc

SEQ ID NO: 693758 - DNA, 25 bp, Mus musculus
gctggataaccccactcatatgaat

SEQ ID NO: 693759 - DNA, 25 bp, Mus musculus
gctggataacccgactcatatgaat

SEQ ID NO: 693760 - DNA, 25 bp, Mus musculus
gctggataacgacatggaccttcga

SEQ ID NO: 693761 - DNA, 25 bp, Mus musculus
gctggataacgagatggaccttcga

SEQ ID NO: 693762 - DNA, 25 bp, Mus musculus
gctggataaggacaaacccaaccgt

SEQ ID NO: 693763 - DNA, 25 bp, Mus musculus
gctggataaggagaaacccaaccgt

SEQ ID NO: 693764 - DNA, 25 bp, Mus musculus
gctggataccacaggagagacctct

SEQ ID NO: 693765 - DNA, 25 bp, Mus musculus
gctggataccactggagagacctct

SEQ ID NO: 693766 - DNA, 25 bp, Mus musculus
gctggataccctcgccggaaacagt

SEQ ID NO: 693767 - DNA, 25 bp, Mus musculus
gctggataccctggccggaaacagt

SEQ ID NO: 693768 - DNA, 25 bp, Mus musculus
gctggatactataagtccctcctgg

SEQ ID NO: 693769 - DNA, 25 bp, Mus musculus
gctggatactattagtccctcctgg

SEQ ID NO: 693770 - DNA, 25 bp, Mus musculus
gctggatatccgagtgggcaaaatc

SEQ ID NO: 693771 - DNA, 25 bp, Mus musculus
gctggatatccgtgtgggcaaaatc

SEQ ID NO: 693772 - DNA, 25 bp, Mus musculus
gctggatatgccaaatgttagagag

SEQ ID NO: 693773 - DNA, 25 bp, Mus musculus
gctggatatgcctaatgttagagag

SEQ ID NO: 693774 - DNA, 25 bp, Mus musculus
gctggatcaggcaagctccagcaca

SEQ ID NO: 693775 - DNA, 25 bp, Mus musculus
gctggatcaggctagctccagcaca

SEQ ID NO: 693776 - DNA, 25 bp, Mus musculus
gctggatcccgcaaaaacccttgca

SEQ ID NO: 693777 - DNA, 25 bp, Mus musculus
gctggatcccgctaaaacccttgca

SEQ ID NO: 693778 - DNA, 25 bp, Mus musculus
gctggatccggaagcagaaccaaga

SEQ ID NO: 693779 - DNA, 25 bp, Mus musculus
gctggatccggatgcagaaccaaga

SEQ ID NO: 693780 - DNA, 25 bp, Mus musculus
gctggatctcatcacctgggaactg

SEQ ID NO: 693781 - DNA, 25 bp, Mus musculus
gctggatctcatgacctgggaactg

SEQ ID NO: 693782 - DNA, 25 bp, Mus musculus
gctggatgaggaagacttgtgctat

SEQ ID NO: 693783 - DNA, 25 bp, Mus musculus
gctggatgaggatgacttgtgctat

SEQ ID NO: 693784 - DNA, 25 bp, Mus musculus
gctggatgatcaccactggcattct

SEQ ID NO: 693785 - DNA, 25 bp, Mus musculus
gctggatgatcagcactggcattct

SEQ ID NO: 693786 - DNA, 25 bp, Mus musculus
gctggatgatgaataccttgaaaat

SEQ ID NO: 693787 - DNA, 25 bp, Mus musculus
gctggatgatgattaccttgaaaat

SEQ ID NO: 693788 - DNA, 25 bp, Mus musculus
gctggatgatttcaagaatgtaatg

SEQ ID NO: 693789 - DNA, 25 bp, Mus musculus
gctggatgatttgaagaatgtaatg

SEQ ID NO: 693790 - DNA, 25 bp, Mus musculus
gctggatgcggaacagcgggtgaca

SEQ ID NO: 693791 - DNA, 25 bp, Mus musculus
gctggatgcggatcagcgggtgaca

SEQ ID NO: 693792 - DNA, 25 bp, Mus musculus
gctggatgctgtagagaaccagctc

SEQ ID NO: 693793 - DNA, 25 bp, Mus musculus
gctggatgctgttgagaaccagctc

SEQ ID NO: 693794 - DNA, 25 bp, Mus musculus
gctggatggattctcccactccgga

SEQ ID NO: 693795 - DNA, 25 bp, Mus musculus
gctggatggattgtcccactccgga

SEQ ID NO: 693796 - DNA, 25 bp, Mus musculus
gctggatggcacagaaactagtggc

SEQ ID NO: 693797 - DNA, 25 bp, Mus musculus
gctggatggcactgaaactagtggc

SEQ ID NO: 693798 - DNA, 25 bp, Mus musculus
gctggatgggaaacccggagcccct

SEQ ID NO: 693799 - DNA, 25 bp, Mus musculus
gctggatgggaatcccggagcccct

SEQ ID NO: 693800 - DNA, 25 bp, Mus musculus
gctggatggtttccagccaggcact

SEQ ID NO: 693801 - DNA, 25 bp, Mus musculus
gctggatggtttgcagccaggcact

SEQ ID NO: 693802 - DNA, 25 bp, Mus musculus
gctggatgtaccagccacctcatga

SEQ ID NO: 693803 - DNA, 25 bp, Mus musculus
gctggatgtacctgccacctcatga

SEQ ID NO: 693804 - DNA, 25 bp, Mus musculus
gctggatgtcacagaagacttctct

SEQ ID NO: 693805 - DNA, 25 bp, Mus musculus
gctggatgtcactgaagacttctct

SEQ ID NO: 693806 - DNA, 25 bp, Mus musculus
gctggatgtgctcactgcatggctc

SEQ ID NO: 693807 - DNA, 25 bp, Mus musculus
gctggatgtgctgactgcatggctc

SEQ ID NO: 693808 - DNA, 25 bp, Mus musculus
gctggattacataaaagcactgaat

SEQ ID NO: 693809 - DNA, 25 bp, Mus musculus
gctggattacattaaagcactgaat

SEQ ID NO: 693810 - DNA, 25 bp, Mus musculus
gctggattatctcgttgtggacaca

SEQ ID NO: 693811 - DNA, 25 bp, Mus musculus
gctggattatctggttgtggacaca

SEQ ID NO: 693812 - DNA, 25 bp, Mus musculus
gctggattctcaaagaccgatgtgg

SEQ ID NO: 693813 - DNA, 25 bp, Mus musculus
gctggattctcatagaccgatgtgg

SEQ ID NO: 693814 - DNA, 25 bp, Mus musculus
gctggattctgcagcacaaatcttc

SEQ ID NO: 693815 - DNA, 25 bp, Mus musculus
gctggattctgctgcacaaatcttc

SEQ ID NO: 693816 - DNA, 25 bp, Mus musculus
gctggattgatcaccacagattgga

SEQ ID NO: 693817 - DNA, 25 bp, Mus musculus
gctggattgatctccacagattgga

SEQ ID NO: 693818 - DNA, 25 bp, Mus musculus
gctggattggcccatgaatcacatc

SEQ ID NO: 693819 - DNA, 25 bp, Mus musculus
gctggattggccgatgaatcacatc

SEQ ID NO: 693820 - DNA, 25 bp, Mus musculus
gctggattggctaatttcagggcaa

SEQ ID NO: 693821 - DNA, 25 bp, Mus musculus
gctggattggcttatttcagggcaa

SEQ ID NO: 693822 - DNA, 25 bp, Mus musculus
gctggattgtcgcttcctttccaag

SEQ ID NO: 693823 - DNA, 25 bp, Mus musculus
gctggattgtcggttcctttccaag

SEQ ID NO: 693824 - DNA, 25 bp, Mus musculus
gctggatttaacctgctgcggctga

SEQ ID NO: 693825 - DNA, 25 bp, Mus musculus
gctggatttaacgtgctgcggctga

SEQ ID NO: 693826 - DNA, 25 bp, Mus musculus
gctggatttagccaagatcattttt

SEQ ID NO: 693827 - DNA, 25 bp, Mus musculus
gctggatttagcgaagatcattttt

SEQ ID NO: 693828 - DNA, 25 bp, Mus musculus
gctggatttcaacttgtttctcccc

SEQ ID NO: 693829 - DNA, 25 bp, Mus musculus
gctggatttcaagttgtttctcccc

SEQ ID NO: 693830 - DNA, 25 bp, Mus musculus
gctggatttgagagcaggccctgat

SEQ ID NO: 693831 - DNA, 25 bp, Mus musculus
gctggatttgagtgcaggccctgat

SEQ ID NO: 693832 - DNA, 25 bp, Mus musculus
gctggatttgggaagtaatgaattc

SEQ ID NO: 693833 - DNA, 25 bp, Mus musculus
gctggatttgggtagtaatgaattc

SEQ ID NO: 693834 - DNA, 25 bp, Mus musculus
gctggcaaaaccctggaagcagaaa

SEQ ID NO: 693835 - DNA, 25 bp, Mus musculus
gctggcaaaaccgtggaagcagaaa

SEQ ID NO: 693836 - DNA, 25 bp, Mus musculus
gctggcaaacggactgttgcttccc

SEQ ID NO: 693837 - DNA, 25 bp, Mus musculus
gctggcaaacggtctgttgcttccc

SEQ ID NO: 693838 - DNA, 25 bp, Mus musculus
gctggcaaatcgctgggacccacct

SEQ ID NO: 693839 - DNA, 25 bp, Mus musculus
gctggcaaatcggtgggacccacct

SEQ ID NO: 693840 - DNA, 25 bp, Mus musculus
gctggcaaccgaatgctggcccagc

SEQ ID NO: 693841 - DNA, 25 bp, Mus musculus
gctggcaaccgattgctggcccagc

SEQ ID NO: 693842 - DNA, 25 bp, Mus musculus
gctggcaagtttaaggatgatcccg

SEQ ID NO: 693843 - DNA, 25 bp, Mus musculus
gctggcaagttttaggatgatcccg

SEQ ID NO: 693844 - DNA, 25 bp, Mus musculus
gctggcaatcacattcttagttgct

SEQ ID NO: 693845 - DNA, 25 bp, Mus musculus
gctggcaatcactttcttagttgct

SEQ ID NO: 693846 - DNA, 25 bp, Mus musculus
gctggcacactaccgcatcagcatg

SEQ ID NO: 693847 - DNA, 25 bp, Mus musculus
gctggcacactagcgcatcagcatg

SEQ ID NO: 693848 - DNA, 25 bp, Mus musculus
gctggcacagaactcgtgaaggcca

SEQ ID NO: 693849 - DNA, 25 bp, Mus musculus
gctggcacagaagtcgtgaaggcca

SEQ ID NO: 693850 - DNA, 25 bp, Mus musculus
gctggcacagcgcaagctgcacttc

SEQ ID NO: 693851 - DNA, 25 bp, Mus musculus
gctggcacagcggaagctgcacttc

SEQ ID NO: 693852 - DNA, 25 bp, Mus musculus
gctggcaccaacagcagaacgagaa

SEQ ID NO: 693853 - DNA, 25 bp, Mus musculus
gctggcaccaactgcagaacgagaa

SEQ ID NO: 693854 - DNA, 25 bp, Mus musculus
gctggcaccatgaagatctggactt

SEQ ID NO: 693855 - DNA, 25 bp, Mus musculus
gctggcaccatgtagatctggactt

SEQ ID NO: 693856 - DNA, 25 bp, Mus musculus
gctggcacgcatccacagagtgttt

SEQ ID NO: 693857 - DNA, 25 bp, Mus musculus
gctggcacgcatgcacagagtgttt

SEQ ID NO: 693858 - DNA, 25 bp, Mus musculus
gctggcacggagcaaacaatcctgt

SEQ ID NO: 693859 - DNA, 25 bp, Mus musculus
gctggcacggaggaaacaatcctgt

SEQ ID NO: 693860 - DNA, 25 bp, Mus musculus
gctggcacggcgaagaaattacatg

SEQ ID NO: 693861 - DNA, 25 bp, Mus musculus
gctggcacggcgtagaaattacatg

SEQ ID NO: 693862 - DNA, 25 bp, Mus musculus
gctggcactattaggcagcatttct

SEQ ID NO: 693863 - DNA, 25 bp, Mus musculus
gctggcactatttggcagcatttct

SEQ ID NO: 693864 - DNA, 25 bp, Mus musculus
gctggcactggccaagttttccgag

SEQ ID NO: 693865 - DNA, 25 bp, Mus musculus
gctggcactggcgaagttttccgag

SEQ ID NO: 693866 - DNA, 25 bp, Mus musculus
gctggcagagctcaacaccttctac

SEQ ID NO: 693867 - DNA, 25 bp, Mus musculus
gctggcagagctgaacaccttctac

SEQ ID NO: 693868 - DNA, 25 bp, Mus musculus
gctggcagccccagcgctttgatgg

SEQ ID NO: 693869 - DNA, 25 bp, Mus musculus
gctggcagcccctgcgctttgatgg

SEQ ID NO: 693870 - DNA, 25 bp, Mus musculus
gctggcagcctgaattcctcgcctg

SEQ ID NO: 693871 - DNA, 25 bp, Mus musculus
gctggcagcctgtattcctcgcctg

SEQ ID NO: 693872 - DNA, 25 bp, Mus musculus
gctggcagcgagatcaagaacatct

SEQ ID NO: 693873 - DNA, 25 bp, Mus musculus
gctggcagcgagttcaagaacatct

SEQ ID NO: 693874 - DNA, 25 bp, Mus musculus
gctggcagctgcacggacagacatg

SEQ ID NO: 693875 - DNA, 25 bp, Mus musculus
gctggcagctgctcggacagacatg

SEQ ID NO: 693876 - DNA, 25 bp, Mus musculus
gctggcagctggcatctacctaact

SEQ ID NO: 693877 - DNA, 25 bp, Mus musculus
gctggcagctgggatctacctaact

SEQ ID NO: 693878 - DNA, 25 bp, Mus musculus
gctggcagctgtcattgctggtcca

SEQ ID NO: 693879 - DNA, 25 bp, Mus musculus
gctggcagctgtgattgctggtcca

SEQ ID NO: 693880 - DNA, 25 bp, Mus musculus
gctggcaggagacgccaccactctt

SEQ ID NO: 693881 - DNA, 25 bp, Mus musculus
gctggcaggagaggccaccactctt

SEQ ID NO: 693882 - DNA, 25 bp, Mus musculus
gctggcaggtacagcgccttgaaaa

SEQ ID NO: 693883 - DNA, 25 bp, Mus musculus
gctggcaggtactgcgccttgaaaa

SEQ ID NO: 693884 - DNA, 25 bp, Mus musculus
gctggcagtcgcaatgagactgaga

SEQ ID NO: 693885 - DNA, 25 bp, Mus musculus
gctggcagtcgctatgagactgaga

SEQ ID NO: 693886 - DNA, 25 bp, Mus musculus
gctggcagtgcaccgcgaccacgaa

SEQ ID NO: 693887 - DNA, 25 bp, Mus musculus
gctggcagtgcagcgcgaccacgaa

SEQ ID NO: 693888 - DNA, 25 bp, Mus musculus
gctggcagtggcaatgacagccgta

SEQ ID NO: 693889 - DNA, 25 bp, Mus musculus
gctggcagtggctatgacagccgta

SEQ ID NO: 693890 - DNA, 25 bp, Mus musculus
gctggcatacgccttcaatcctagc

SEQ ID NO: 693891 - DNA, 25 bp, Mus musculus
gctggcatacgcgttcaatcctagc

SEQ ID NO: 693892 - DNA, 25 bp, Mus musculus
gctggcatggctcctttatgggaaa

SEQ ID NO: 693893 - DNA, 25 bp, Mus musculus
gctggcatggctgctttatgggaaa

SEQ ID NO: 693894 - DNA, 25 bp, Mus musculus
gctggcatttcaagccactgcagaa

SEQ ID NO: 693895 - DNA, 25 bp, Mus musculus
gctggcatttcatgccactgcagaa

SEQ ID NO: 693896 - DNA, 25 bp, Mus musculus
gctggccaacacctacaagatcgta

SEQ ID NO: 693897 - DNA, 25 bp, Mus musculus
gctggccaacacgtacaagatcgta

SEQ ID NO: 693898 - DNA, 25 bp, Mus musculus
gctggccacaatatggagtaggagc

SEQ ID NO: 693899 - DNA, 25 bp, Mus musculus
gctggccacaatttggagtaggagc

SEQ ID NO: 693900 - DNA, 25 bp, Mus musculus
gctggccacctccaaaaaattccat

SEQ ID NO: 693901 - DNA, 25 bp, Mus musculus
gctggccacctcgaaaaaattccat

SEQ ID NO: 693902 - DNA, 25 bp, Mus musculus
gctggccactctctctgttgctgct

SEQ ID NO: 693903 - DNA, 25 bp, Mus musculus
gctggccactctgtctgttgctgct

SEQ ID NO: 693904 - DNA, 25 bp, Mus musculus
gctggccagcaactggatcctccag

SEQ ID NO: 693905 - DNA, 25 bp, Mus musculus
gctggccagcaagtggatcctccag

SEQ ID NO: 693906 - DNA, 25 bp, Mus musculus
gctggccagctaacttcacacgggt

SEQ ID NO: 693907 - DNA, 25 bp, Mus musculus
gctggccagctatcttcacacgggt

SEQ ID NO: 693908 - DNA, 25 bp, Mus musculus
gctggccaggacagttgttccctgg

SEQ ID NO: 693909 - DNA, 25 bp, Mus musculus
gctggccaggactgttgttccctgg

SEQ ID NO: 693910 - DNA, 25 bp, Mus musculus
gctggccaggttacctgcagaaggc

SEQ ID NO: 693911 - DNA, 25 bp, Mus musculus
gctggccaggtttcctgcagaaggc

SEQ ID NO: 693912 - DNA, 25 bp, Mus musculus
gctggccagtgcattctcatcgaga

SEQ ID NO: 693913 - DNA, 25 bp, Mus musculus
gctggccagtgctttctcatcgaga

SEQ ID NO: 693914 - DNA, 25 bp, Mus musculus
gctggccataaccatgcagaggatg

SEQ ID NO: 693915 - DNA, 25 bp, Mus musculus
gctggccataacgatgcagaggatg

SEQ ID NO: 693916 - DNA, 25 bp, Mus musculus
gctggccatggacaggaagtcctca

SEQ ID NO: 693917 - DNA, 25 bp, Mus musculus
gctggccatggagaggaagtcctca

SEQ ID NO: 693918 - DNA, 25 bp, Mus musculus
gctggccatgtaatgcaacgggaac

SEQ ID NO: 693919 - DNA, 25 bp, Mus musculus
gctggccatgtattgcaacgggaac

SEQ ID NO: 693920 - DNA, 25 bp, Mus musculus
gctggcccaccgcaaggctatgaag

SEQ ID NO: 693921 - DNA, 25 bp, Mus musculus
gctggcccaccggaaggctatgaag

SEQ ID NO: 693922 - DNA, 25 bp, Mus musculus
gctggcccagtacatattcaccttg

SEQ ID NO: 693923 - DNA, 25 bp, Mus musculus
gctggcccagtacccaaacatatcg

SEQ ID NO: 693924 - DNA, 25 bp, Mus musculus
gctggcccagtagatattcaccttg

SEQ ID NO: 693925 - DNA, 25 bp, Mus musculus
gctggcccagtagccaaacatatcg

SEQ ID NO: 693926 - DNA, 25 bp, Mus musculus
gctggcccatgaaggacacaactgc

SEQ ID NO: 693927 - DNA, 25 bp, Mus musculus
gctggcccatgatggacacaactgc

SEQ ID NO: 693928 - DNA, 25 bp, Mus musculus
gctggccccgttactgaaaatgtac

SEQ ID NO: 693929 - DNA, 25 bp, Mus musculus
gctggccccgtttctgaaaatgtac

SEQ ID NO: 693930 - DNA, 25 bp, Mus musculus
gctggcccctgacctgtttggagaa

SEQ ID NO: 693931 - DNA, 25 bp, Mus musculus
gctggcccctgagctgtttggagaa

SEQ ID NO: 693932 - DNA, 25 bp, Mus musculus
gctggcccgcgaacgcttcaaggtg

SEQ ID NO: 693933 - DNA, 25 bp, Mus musculus
gctggcccgcgatcgcttcaaggtg

SEQ ID NO: 693934 - DNA, 25 bp, Mus musculus
gctggccgaccaagaggagtgtctc

SEQ ID NO: 693935 - DNA, 25 bp, Mus musculus
gctggccgaccatgaggagtgtctc

SEQ ID NO: 693936 - DNA, 25 bp, Mus musculus
gctggccgccagctacatagacttc

SEQ ID NO: 693937 - DNA, 25 bp, Mus musculus
gctggccgccaggtacatagacttc

SEQ ID NO: 693938 - DNA, 25 bp, Mus musculus
gctggccgccatcaaggttatggac

SEQ ID NO: 693939 - DNA, 25 bp, Mus musculus
gctggccgccatgaaggttatggac

SEQ ID NO: 693940 - DNA, 25 bp, Mus musculus
gctggccggccacgtgtttgtgacg

SEQ ID NO: 693941 - DNA, 25 bp, Mus musculus
gctggccggccaggtgtttgtgacg

SEQ ID NO: 693942 - DNA, 25 bp, Mus musculus
gctggcctactgacaaaatattcca

SEQ ID NO: 693943 - DNA, 25 bp, Mus musculus
gctggcctactgtcaaaatattcca

SEQ ID NO: 693944 - DNA, 25 bp, Mus musculus
gctggcctatctacaacagctacat

SEQ ID NO: 693945 - DNA, 25 bp, Mus musculus
gctggcctatcttcaacagctacat

SEQ ID NO: 693946 - DNA, 25 bp, Mus musculus
gctggcctcatacctaagcaaacct

SEQ ID NO: 693947 - DNA, 25 bp, Mus musculus
gctggcctcatagctaagcaaacct

SEQ ID NO: 693948 - DNA, 25 bp, Mus musculus
gctggcctgagaagaaactcaaagt

SEQ ID NO: 693949 - DNA, 25 bp, Mus musculus
gctggcctgagatgaaactcaaagt

SEQ ID NO: 693950 - DNA, 25 bp, Mus musculus
gctggcctggtcattggcagactcc

SEQ ID NO: 693951 - DNA, 25 bp, Mus musculus
gctggcctggtctttggcagactcc

SEQ ID NO: 693952 - DNA, 25 bp, Mus musculus
gctggccttaggatgtggttgtcaa

SEQ ID NO: 693953 - DNA, 25 bp, Mus musculus
gctggccttaggttgtggttgtcaa

SEQ ID NO: 693954 - DNA, 25 bp, Mus musculus
gctggccttgagagcctggttctcc

SEQ ID NO: 693955 - DNA, 25 bp, Mus musculus
gctggccttgagtgcctggttctcc

SEQ ID NO: 693956 - DNA, 25 bp, Mus musculus
gctggccttggcactgatcttcaaa

SEQ ID NO: 693957 - DNA, 25 bp, Mus musculus
gctggccttggctctgatcttcaaa

SEQ ID NO: 693958 - DNA, 25 bp, Mus musculus
gctggccttgtcatcgagtacgcat

SEQ ID NO: 693959 - DNA, 25 bp, Mus musculus
gctggccttgtcttcgagtacgcat

SEQ ID NO: 693960 - DNA, 25 bp, Mus musculus
gctggccttgtgctaaagctgctaa

SEQ ID NO: 693961 - DNA, 25 bp, Mus musculus
gctggccttgtggtaaagctgctaa

SEQ ID NO: 693962 - DNA, 25 bp, Mus musculus
gctggcgaaagacgtctacgcgtca

SEQ ID NO: 693963 - DNA, 25 bp, Mus musculus
gctggcgaaagaggtctacgcgtca

SEQ ID NO: 693964 - DNA, 25 bp, Mus musculus
gctggcgaaggactcgttaccgtca

SEQ ID NO: 693965 - DNA, 25 bp, Mus musculus
gctggcgaaggagtcgttaccgtca

SEQ ID NO: 693966 - DNA, 25 bp, Mus musculus
gctggcgactagcagcctgtgaccc

SEQ ID NO: 693967 - DNA, 25 bp, Mus musculus
gctggcgactaggagcctgtgaccc

SEQ ID NO: 693968 - DNA, 25 bp, Mus musculus
gctggcgacttcaccaaccacaatg

SEQ ID NO: 693969 - DNA, 25 bp, Mus musculus
gctggcgacttctccaaccacaatg

SEQ ID NO: 693970 - DNA, 25 bp, Mus musculus
gctggcgcattgcatttgctgaaag

SEQ ID NO: 693971 - DNA, 25 bp, Mus musculus
gctggcgcattggatttgctgaaag

SEQ ID NO: 693972 - DNA, 25 bp, Mus musculus
gctggcgctgtcaaagaagctggtt

SEQ ID NO: 693973 - DNA, 25 bp, Mus musculus
gctggcgctgtctaagaagctggtt

SEQ ID NO: 693974 - DNA, 25 bp, Mus musculus
gctggcggagaaaaaggccacagat

SEQ ID NO: 693975 - DNA, 25 bp, Mus musculus
gctggcggagaataaggccacagat

SEQ ID NO: 693976 - DNA, 25 bp, Mus musculus
gctggcgggcaccttcgttatcgta

SEQ ID NO: 693977 - DNA, 25 bp, Mus musculus
gctggcgggcacgttcgttatcgta

SEQ ID NO: 693978 - DNA, 25 bp, Mus musculus
gctggcgtggctcttttcatgtata

SEQ ID NO: 693979 - DNA, 25 bp, Mus musculus
gctggcgtggctgttttcatgtata

SEQ ID NO: 693980 - DNA, 25 bp, Mus musculus
gctggctaaagtacggatgatgaaa

SEQ ID NO: 693981 - DNA, 25 bp, Mus musculus
gctggctaaagttcggatgatgaaa

SEQ ID NO: 693982 - DNA, 25 bp, Mus musculus
gctggctaccttagagcctgaacag

SEQ ID NO: 693983 - DNA, 25 bp, Mus musculus
gctggctacctttgagcctgaacag

SEQ ID NO: 693984 - DNA, 25 bp, Mus musculus
gctggctacgatctgccgaccatca

SEQ ID NO: 693985 - DNA, 25 bp, Mus musculus
gctggctacgatgtgccgaccatca

SEQ ID NO: 693986 - DNA, 25 bp, Mus musculus
gctggctacggacttggctttgatc

SEQ ID NO: 693987 - DNA, 25 bp, Mus musculus
gctggctacggagttggctttgatc

SEQ ID NO: 693988 - DNA, 25 bp, Mus musculus
gctggctagcctatggagatgcgca

SEQ ID NO: 693989 - DNA, 25 bp, Mus musculus
gctggctagcctttggagatgcgca

SEQ ID NO: 693990 - DNA, 25 bp, Mus musculus
gctggctatgataacctagctctga

SEQ ID NO: 693991 - DNA, 25 bp, Mus musculus
gctggctatgattacctagctctga

SEQ ID NO: 693992 - DNA, 25 bp, Mus musculus
gctggctatgttccaagtgctgacc

SEQ ID NO: 693993 - DNA, 25 bp, Mus musculus
gctggctatgttgcaagtgctgacc

SEQ ID NO: 693994 - DNA, 25 bp, Mus musculus
gctggctcacaactattttgagctc

SEQ ID NO: 693995 - DNA, 25 bp, Mus musculus
gctggctcacaagtattttgagctc

SEQ ID NO: 693996 - DNA, 25 bp, Mus musculus
gctggctcagaccaaagagtagtta

SEQ ID NO: 693997 - DNA, 25 bp, Mus musculus
gctggctcagacgaaagagtagtta

SEQ ID NO: 693998 - DNA, 25 bp, Mus musculus
gctggctcagcaagcccgataagca

SEQ ID NO: 693999 - DNA, 25 bp, Mus musculus
gctggctcagcatgcccgataagca

SEQ ID NO: 694000 - DNA, 25 bp, Mus musculus
gctggctcagctaagcaaagtgggc

SEQ ID NO: 694001 - DNA, 25 bp, Mus musculus
gctggctcagcttagcaaagtgggc

SEQ ID NO: 694002 - DNA, 25 bp, Mus musculus
gctggctcaggaactctgccaaagc

SEQ ID NO: 694003 - DNA, 25 bp, Mus musculus
gctggctcaggatctctgccaaagc

SEQ ID NO: 694004 - DNA, 25 bp, Mus musculus
gctggctccatgctctcagaacaaa

SEQ ID NO: 694005 - DNA, 25 bp, Mus musculus
gctggctccatggtctcagaacaaa

SEQ ID NO: 694006 - DNA, 25 bp, Mus musculus
gctggctcgaagacagatccacagc

SEQ ID NO: 694007 - DNA, 25 bp, Mus musculus
gctggctcgaagtcagatccacagc

SEQ ID NO: 694008 - DNA, 25 bp, Mus musculus
gctggctcggtgcactgatgacttc

SEQ ID NO: 694009 - DNA, 25 bp, Mus musculus
gctggctcggtggactgatgacttc

SEQ ID NO: 694010 - DNA, 25 bp, Mus musculus
gctggctctcctcaacaacgtcagt

SEQ ID NO: 694011 - DNA, 25 bp, Mus musculus
gctggctctcctgaacaacgtcagt

SEQ ID NO: 694012 - DNA, 25 bp, Mus musculus
gctggctctctaatgcctcagtggt

SEQ ID NO: 694013 - DNA, 25 bp, Mus musculus
gctggctctctattgcctcagtggt

SEQ ID NO: 694014 - DNA, 25 bp, Mus musculus
gctggctctggcagaacggattcga

SEQ ID NO: 694015 - DNA, 25 bp, Mus musculus
gctggctctggctgaacggattcga

SEQ ID NO: 694016 - DNA, 25 bp, Mus musculus
gctggctcttcgcaaaaccgtgatg

SEQ ID NO: 694017 - DNA, 25 bp, Mus musculus
gctggctcttcggaaaaccgtgatg

SEQ ID NO: 694018 - DNA, 25 bp, Mus musculus
gctggctgacccaggtggtgaccca

SEQ ID NO: 694019 - DNA, 25 bp, Mus musculus
gctggctgaccctggtggtgaccca

SEQ ID NO: 694020 - DNA, 25 bp, Mus musculus
gctggctgaggacttaactggcaca

SEQ ID NO: 694021 - DNA, 25 bp, Mus musculus
gctggctgaggagttaactggcaca

SEQ ID NO: 694022 - DNA, 25 bp, Mus musculus
gctggctgccctcgcagatttggaa

SEQ ID NO: 694023 - DNA, 25 bp, Mus musculus
gctggctgccctggcagatttggaa

SEQ ID NO: 694024 - DNA, 25 bp, Mus musculus
gctggctgccgtcatctgcagtgct

SEQ ID NO: 694025 - DNA, 25 bp, Mus musculus
gctggctgccgtgatctgcagtgct

SEQ ID NO: 694026 - DNA, 25 bp, Mus musculus
gctggctgcctgagtaaggaccaaa

SEQ ID NO: 694027 - DNA, 25 bp, Mus musculus
gctggctgcctgtgtaaggaccaaa

SEQ ID NO: 694028 - DNA, 25 bp, Mus musculus
gctggctgggtaagaatgcagaatc

SEQ ID NO: 694029 - DNA, 25 bp, Mus musculus
gctggctgggtatgaatgcagaatc

SEQ ID NO: 694030 - DNA, 25 bp, Mus musculus
gctggctgtaagaccaccacgtctg

SEQ ID NO: 694031 - DNA, 25 bp, Mus musculus
gctggctgtaagtccaccacgtctg

SEQ ID NO: 694032 - DNA, 25 bp, Mus musculus
gctggctgtccccatgttcaggaag

SEQ ID NO: 694033 - DNA, 25 bp, Mus musculus
gctggctgtcccgatgttcaggaag

SEQ ID NO: 694034 - DNA, 25 bp, Mus musculus
gctggctgtcttatgccttttgctg

SEQ ID NO: 694035 - DNA, 25 bp, Mus musculus
gctggctgtcttttgccttttgctg

SEQ ID NO: 694036 - DNA, 25 bp, Mus musculus
gctggctgtgatcggctcccttact

SEQ ID NO: 694037 - DNA, 25 bp, Mus musculus
gctggctgtgatgggctcccttact

SEQ ID NO: 694038 - DNA, 25 bp, Mus musculus
gctggctgtggacactaagaatttc

SEQ ID NO: 694039 - DNA, 25 bp, Mus musculus
gctggctgtggagactaagaatttc

SEQ ID NO: 694040 - DNA, 25 bp, Mus musculus
gctggctgttgtaactggacctcca

SEQ ID NO: 694041 - DNA, 25 bp, Mus musculus
gctggctgttgttactggacctcca

SEQ ID NO: 694042 - DNA, 25 bp, Mus musculus
gctggcttaattctcctacttttgg

SEQ ID NO: 694043 - DNA, 25 bp, Mus musculus
gctggcttaattgtcctacttttgg

SEQ ID NO: 694044 - DNA, 25 bp, Mus musculus
gctggcttcagcagtacagccacga

SEQ ID NO: 694045 - DNA, 25 bp, Mus musculus
gctggcttcagctgtacagccacga

SEQ ID NO: 694046 - DNA, 25 bp, Mus musculus
gctggcttccacatcgggcttcgtt

SEQ ID NO: 694047 - DNA, 25 bp, Mus musculus
gctggcttccacttcgggcttcgtt

SEQ ID NO: 694048 - DNA, 25 bp, Mus musculus
gctggcttcctaaatccgtcctgag

SEQ ID NO: 694049 - DNA, 25 bp, Mus musculus
gctggcttcctatatccgtcctgag

SEQ ID NO: 694050 - DNA, 25 bp, Mus musculus
gctggcttcggcatgctaacctgcc

SEQ ID NO: 694051 - DNA, 25 bp, Mus musculus
gctggcttcggcttgctaacctgcc

SEQ ID NO: 694052 - DNA, 25 bp, Mus musculus
gctggcttgactccctcagtgatac

SEQ ID NO: 694053 - DNA, 25 bp, Mus musculus
gctggcttgactgcctcagtgatac

SEQ ID NO: 694054 - DNA, 25 bp, Mus musculus
gctggcttgctaatggccttctact

SEQ ID NO: 694055 - DNA, 25 bp, Mus musculus
gctggcttgctattggccttctact

SEQ ID NO: 694056 - DNA, 25 bp, Mus musculus
gctggcttgtgactgtcctctcaga

SEQ ID NO: 694057 - DNA, 25 bp, Mus musculus
gctggcttgtgagtgtcctctcaga

SEQ ID NO: 694058 - DNA, 25 bp, Mus musculus
gctggctttaatcgccttcggcagg

SEQ ID NO: 694059 - DNA, 25 bp, Mus musculus
gctggctttaatggccttcggcagg

SEQ ID NO: 694060 - DNA, 25 bp, Mus musculus
gctggctttctgctcatctagggtg

SEQ ID NO: 694061 - DNA, 25 bp, Mus musculus
gctggctttctggtcatctagggtg

SEQ ID NO: 694062 - DNA, 25 bp, Mus musculus
gctggcttttagcaattcctgtccc

SEQ ID NO: 694063 - DNA, 25 bp, Mus musculus
gctggcttttaggaattcctgtccc

SEQ ID NO: 694064 - DNA, 25 bp, Mus musculus
gctggcttttcacatcagcaaggaa

SEQ ID NO: 694065 - DNA, 25 bp, Mus musculus
gctggcttttcagatcagcaaggaa

SEQ ID NO: 694066 - DNA, 25 bp, Mus musculus
gctgggaaaccgaatcgacgacgtc

SEQ ID NO: 694067 - DNA, 25 bp, Mus musculus
gctgggaaaccgtatcgacgacgtc

SEQ ID NO: 694068 - DNA, 25 bp, Mus musculus
gctgggaaactcctgacacaagtcg

SEQ ID NO: 694069 - DNA, 25 bp, Mus musculus
gctgggaaactcgtgacacaagtcg

SEQ ID NO: 694070 - DNA, 25 bp, Mus musculus
gctgggaacgatactgaaagaacgg

SEQ ID NO: 694071 - DNA, 25 bp, Mus musculus
gctgggaacgattctgaaagaacgg

SEQ ID NO: 694072 - DNA, 25 bp, Mus musculus
gctgggaactggagacaaaatggac

SEQ ID NO: 694073 - DNA, 25 bp, Mus musculus
gctgggaactggtgacaaaatggac

SEQ ID NO: 694074 - DNA, 25 bp, Mus musculus
gctgggaagctcaccgtctgtatcc

SEQ ID NO: 694075 - DNA, 25 bp, Mus musculus
gctgggaagctctccgtctgtatcc

SEQ ID NO: 694076 - DNA, 25 bp, Mus musculus
gctgggaaggagcttacaacttgca

SEQ ID NO: 694077 - DNA, 25 bp, Mus musculus
gctgggaaggaggttacaacttgca

SEQ ID NO: 694078 - DNA, 25 bp, Mus musculus
gctgggaagggactacacaaactct

SEQ ID NO: 694079 - DNA, 25 bp, Mus musculus
gctgggaagggagtacacaaactct

SEQ ID NO: 694080 - DNA, 25 bp, Mus musculus
gctgggaagtgcataggagtctacc

SEQ ID NO: 694081 - DNA, 25 bp, Mus musculus
gctgggaagtgcttaggagtctacc

SEQ ID NO: 694082 - DNA, 25 bp, Mus musculus
gctgggaatcaacaacgagactgag

SEQ ID NO: 694083 - DNA, 25 bp, Mus musculus
gctgggaatcaagaacgagactgag

SEQ ID NO: 694084 - DNA, 25 bp, Mus musculus
gctgggaattctcatcgcctccctg

SEQ ID NO: 694085 - DNA, 25 bp, Mus musculus
gctgggaattctgatcgcctccctg

SEQ ID NO: 694086 - DNA, 25 bp, Mus musculus
gctgggacagctataaccgaggcga

SEQ ID NO: 694087 - DNA, 25 bp, Mus musculus
gctgggacagctttaaccgaggcga

SEQ ID NO: 694088 - DNA, 25 bp, Mus musculus
gctgggacatcaatggcaagaacct

SEQ ID NO: 694089 - DNA, 25 bp, Mus musculus
gctgggacatcattggcaagaacct

SEQ ID NO: 694090 - DNA, 25 bp, Mus musculus
gctgggaccaaaatcaggttcctgt

SEQ ID NO: 694091 - DNA, 25 bp, Mus musculus
gctgggaccaaattcaggttcctgt

SEQ ID NO: 694092 - DNA, 25 bp, Mus musculus
gctgggaccccaccttatttatttt

SEQ ID NO: 694093 - DNA, 25 bp, Mus musculus
gctgggaccccagcttatttatttt

SEQ ID NO: 694094 - DNA, 25 bp, Mus musculus
gctgggacctgacctctgggcacaa

SEQ ID NO: 694095 - DNA, 25 bp, Mus musculus
gctgggacctgagctctgggcacaa

SEQ ID NO: 694096 - DNA, 25 bp, Mus musculus
gctgggacgggaaattctgcgaaat

SEQ ID NO: 694097 - DNA, 25 bp, Mus musculus
gctgggacgggatattctgcgaaat

SEQ ID NO: 694098 - DNA, 25 bp, Mus musculus
gctgggacgtataatgatggatcac

SEQ ID NO: 694099 - DNA, 25 bp, Mus musculus
gctgggacgtattatgatggatcac

SEQ ID NO: 694100 - DNA, 25 bp, Mus musculus
gctgggactaacacaagaccaaggg

SEQ ID NO: 694101 - DNA, 25 bp, Mus musculus
gctgggactaactcaagaccaaggg

SEQ ID NO: 694102 - DNA, 25 bp, Mus musculus
gctgggactcctctctttagaccaa

SEQ ID NO: 694103 - DNA, 25 bp, Mus musculus
gctgggactcctgtctttagaccaa

SEQ ID NO: 694104 - DNA, 25 bp, Mus musculus
gctgggactgatagatttttcggaa

SEQ ID NO: 694105 - DNA, 25 bp, Mus musculus
gctgggactgattgatttttcggaa

SEQ ID NO: 694106 - DNA, 25 bp, Mus musculus
gctgggacttcgaagaacgaacgtt

SEQ ID NO: 694107 - DNA, 25 bp, Mus musculus
gctgggacttcgacaagaacatatc

SEQ ID NO: 694108 - DNA, 25 bp, Mus musculus
gctgggacttcgtagaacgaacgtt

SEQ ID NO: 694109 - DNA, 25 bp, Mus musculus
gctgggacttcgtcaagaacatatc

SEQ ID NO: 694110 - DNA, 25 bp, Mus musculus
gctgggacttgcctgtagactacac

SEQ ID NO: 694111 - DNA, 25 bp, Mus musculus
gctgggacttgcgtgtagactacac

SEQ ID NO: 694112 - DNA, 25 bp, Mus musculus
gctgggagaaaaaagaggaccctca

SEQ ID NO: 694113 - DNA, 25 bp, Mus musculus
gctgggagaaaatagaggaccctca

SEQ ID NO: 694114 - DNA, 25 bp, Mus musculus
gctgggagacctccttcagagcttt

SEQ ID NO: 694115 - DNA, 25 bp, Mus musculus
gctgggagacctgcttcagagcttt

SEQ ID NO: 694116 - DNA, 25 bp, Mus musculus
gctgggagagaaagtcaacatggtc

SEQ ID NO: 694117 - DNA, 25 bp, Mus musculus
gctgggagagaatgtcaacatggtc

SEQ ID NO: 694118 - DNA, 25 bp, Mus musculus
gctgggagatgcaactgccattgtg

SEQ ID NO: 694119 - DNA, 25 bp, Mus musculus
gctgggagatgctactgccattgtg

SEQ ID NO: 694120 - DNA, 25 bp, Mus musculus
gctgggagccaaagttgaaatacaa

SEQ ID NO: 694121 - DNA, 25 bp, Mus musculus
gctgggagccaatgttgaaatacaa

SEQ ID NO: 694122 - DNA, 25 bp, Mus musculus
gctgggagcctgactggccttaata

SEQ ID NO: 694123 - DNA, 25 bp, Mus musculus
gctgggagcctgtctggccttaata

SEQ ID NO: 694124 - DNA, 25 bp, Mus musculus
gctgggagctacacagccactgcca

SEQ ID NO: 694125 - DNA, 25 bp, Mus musculus
gctgggagctactcagccactgcca

SEQ ID NO: 694126 - DNA, 25 bp, Mus musculus
gctgggagctatctgtgccatcatc

SEQ ID NO: 694127 - DNA, 25 bp, Mus musculus
gctgggagctatgtgtgccatcatc

SEQ ID NO: 694128 - DNA, 25 bp, Mus musculus
gctgggagtcctactccaatgtgag

SEQ ID NO: 694129 - DNA, 25 bp, Mus musculus
gctgggagtccttctccaatgtgag

SEQ ID NO: 694130 - DNA, 25 bp, Mus musculus
gctgggatatcgaaccagaaaacaa

SEQ ID NO: 694131 - DNA, 25 bp, Mus musculus
gctgggatatcgtaccagaaaacaa

SEQ ID NO: 694132 - DNA, 25 bp, Mus musculus
gctgggatcccacgaacacatattg

SEQ ID NO: 694133 - DNA, 25 bp, Mus musculus
gctgggatcccaggaacacatattg

SEQ ID NO: 694134 - DNA, 25 bp, Mus musculus
gctgggatctacctaacttggaggc

SEQ ID NO: 694135 - DNA, 25 bp, Mus musculus
gctgggatctacgtaacttggaggc

SEQ ID NO: 694136 - DNA, 25 bp, Mus musculus
gctgggatgaaaatgtctactacac

SEQ ID NO: 694137 - DNA, 25 bp, Mus musculus
gctgggatgaaattgtctactacac

SEQ ID NO: 694138 - DNA, 25 bp, Mus musculus
gctgggatgacacccagaaatacct

SEQ ID NO: 694139 - DNA, 25 bp, Mus musculus
gctgggatgacagccagaaatacct

SEQ ID NO: 694140 - DNA, 25 bp, Mus musculus
gctgggatggataccaccttctgga

SEQ ID NO: 694141 - DNA, 25 bp, Mus musculus
gctgggatggattccaccttctgga

SEQ ID NO: 694142 - DNA, 25 bp, Mus musculus
gctgggattcatccacagagatatc

SEQ ID NO: 694143 - DNA, 25 bp, Mus musculus
gctgggattcatgcacagagatatc

SEQ ID NO: 694144 - DNA, 25 bp, Mus musculus
gctgggattggcatgcctcctcggg

SEQ ID NO: 694145 - DNA, 25 bp, Mus musculus
gctgggattggcttgcctcctcggg

SEQ ID NO: 694146 - DNA, 25 bp, Mus musculus
gctgggattggtacttgaggcttct

SEQ ID NO: 694147 - DNA, 25 bp, Mus musculus
gctgggattggttcttgaggcttct

SEQ ID NO: 694148 - DNA, 25 bp, Mus musculus
gctgggcaagaacactacgatcgcc

SEQ ID NO: 694149 - DNA, 25 bp, Mus musculus
gctgggcaagaagactacgatcgcc

SEQ ID NO: 694150 - DNA, 25 bp, Mus musculus
gctgggcaatggcacaacgaatcat

SEQ ID NO: 694151 - DNA, 25 bp, Mus musculus
gctgggcaatgggacaacgaatcat

SEQ ID NO: 694152 - DNA, 25 bp, Mus musculus
gctgggcaattaaaggaccctggta

SEQ ID NO: 694153 - DNA, 25 bp, Mus musculus
gctgggcaattataggaccctggta

SEQ ID NO: 694154 - DNA, 25 bp, Mus musculus
gctgggcaccgaaaaggcggctcca

SEQ ID NO: 694155 - DNA, 25 bp, Mus musculus
gctgggcaccgataaggcggctcca

SEQ ID NO: 694156 - DNA, 25 bp, Mus musculus
gctgggcacgagaagtcaacctcaa

SEQ ID NO: 694157 - DNA, 25 bp, Mus musculus
gctgggcacgagtagtcaacctcaa

SEQ ID NO: 694158 - DNA, 25 bp, Mus musculus
gctgggcactgaacatgaaggaact

SEQ ID NO: 694159 - DNA, 25 bp, Mus musculus
gctgggcactgatcatgaaggaact

SEQ ID NO: 694160 - DNA, 25 bp, Mus musculus
gctgggcatgcgctacgcgttcatc

SEQ ID NO: 694161 - DNA, 25 bp, Mus musculus
gctgggcatgcggtacgcgttcatc

SEQ ID NO: 694162 - DNA, 25 bp, Mus musculus
gctgggcatgttaacacacaaggag

SEQ ID NO: 694163 - DNA, 25 bp, Mus musculus
gctgggcatgtttacacacaaggag

SEQ ID NO: 694164 - DNA, 25 bp, Mus musculus
gctgggcattccactggatgggcct

SEQ ID NO: 694165 - DNA, 25 bp, Mus musculus
gctgggcattcctctggatgggcct

SEQ ID NO: 694166 - DNA, 25 bp, Mus musculus
gctgggccaagtacttcctgctgaa

SEQ ID NO: 694167 - DNA, 25 bp, Mus musculus
gctgggccaagttcttcctgctgaa

SEQ ID NO: 694168 - DNA, 25 bp, Mus musculus
gctgggccaggtattctgggctttt

SEQ ID NO: 694169 - DNA, 25 bp, Mus musculus
gctgggccaggttttctgggctttt

SEQ ID NO: 694170 - DNA, 25 bp, Mus musculus
gctgggccatgaaggccttgttgat

SEQ ID NO: 694171 - DNA, 25 bp, Mus musculus
gctgggccatgatggccttgttgat

SEQ ID NO: 694172 - DNA, 25 bp, Mus musculus
gctgggccgctcagaaggtaccaga

SEQ ID NO: 694173 - DNA, 25 bp, Mus musculus
gctgggccgctctgaaggtaccaga

SEQ ID NO: 694174 - DNA, 25 bp, Mus musculus
gctgggccgtccactttggctgttt

SEQ ID NO: 694175 - DNA, 25 bp, Mus musculus
gctgggccgtcctctttggctgttt

SEQ ID NO: 694176 - DNA, 25 bp, Mus musculus
gctgggcctgacaccgatgttctca

SEQ ID NO: 694177 - DNA, 25 bp, Mus musculus
gctgggcctgactccgatgttctca

SEQ ID NO: 694178 - DNA, 25 bp, Mus musculus
gctgggccttcacgcagtgctatgt

SEQ ID NO: 694179 - DNA, 25 bp, Mus musculus
gctgggccttcaggcagtgctatgt

SEQ ID NO: 694180 - DNA, 25 bp, Mus musculus
gctgggcgaattccagaattcttcc

SEQ ID NO: 694181 - DNA, 25 bp, Mus musculus
gctgggcgaattgcagaattcttcc

SEQ ID NO: 694182 - DNA, 25 bp, Mus musculus
gctgggcgagatcttgcttatgctt

SEQ ID NO: 694183 - DNA, 25 bp, Mus musculus
gctgggcgagatgttgcttatgctt

SEQ ID NO: 694184 - DNA, 25 bp, Mus musculus
gctgggcgcagcacagtgacaccta

SEQ ID NO: 694185 - DNA, 25 bp, Mus musculus
gctgggcgcagctcagtgacaccta

SEQ ID NO: 694186 - DNA, 25 bp, Mus musculus
gctgggcgcctacgtgcttgtctac

SEQ ID NO: 694187 - DNA, 25 bp, Mus musculus
gctgggcgcctaggtgcttgtctac

SEQ ID NO: 694188 - DNA, 25 bp, Mus musculus
gctgggcggtttagttttcgccttg

SEQ ID NO: 694189 - DNA, 25 bp, Mus musculus
gctgggcggttttgttttcgccttg

SEQ ID NO: 694190 - DNA, 25 bp, Mus musculus
gctgggctacatctatttccgtgac

SEQ ID NO: 694191 - DNA, 25 bp, Mus musculus
gctgggctacatgtatttccgtgac

SEQ ID NO: 694192 - DNA, 25 bp, Mus musculus
gctgggctacgtcactctcctagaa

SEQ ID NO: 694193 - DNA, 25 bp, Mus musculus
gctgggctacgtgactctcctagaa

SEQ ID NO: 694194 - DNA, 25 bp, Mus musculus
gctgggctcctgaaggacctgcgat

SEQ ID NO: 694195 - DNA, 25 bp, Mus musculus
gctgggctcctgtaggacctgcgat

SEQ ID NO: 694196 - DNA, 25 bp, Mus musculus
gctgggctctgcaccactgttgtaa

SEQ ID NO: 694197 - DNA, 25 bp, Mus musculus
gctgggctctgctccactgttgtaa

SEQ ID NO: 694198 - DNA, 25 bp, Mus musculus
gctgggctcttgacatcctttggag

SEQ ID NO: 694199 - DNA, 25 bp, Mus musculus
gctgggctcttgtcatcctttggag

SEQ ID NO: 694200 - DNA, 25 bp, Mus musculus
gctgggctgacaagtaccatgggaa

SEQ ID NO: 694201 - DNA, 25 bp, Mus musculus
gctgggctgacatgtaccatgggaa

SEQ ID NO: 694202 - DNA, 25 bp, Mus musculus
gctgggctgatgagtctgacgcact

SEQ ID NO: 694203 - DNA, 25 bp, Mus musculus
gctgggctgatgtgtctgacgcact

SEQ ID NO: 694204 - DNA, 25 bp, Mus musculus
gctgggcttccacaagttctacatt

SEQ ID NO: 694205 - DNA, 25 bp, Mus musculus
gctgggcttccagaagttctacatt

SEQ ID NO: 694206 - DNA, 25 bp, Mus musculus
gctgggcttctgaaaatagggcttc

SEQ ID NO: 694207 - DNA, 25 bp, Mus musculus
gctgggcttctgtaaatagggcttc

SEQ ID NO: 694208 - DNA, 25 bp, Mus musculus
gctgggtaacagaatcacttgacac

SEQ ID NO: 694209 - DNA, 25 bp, Mus musculus
gctgggtaacagtatcacttgacac

SEQ ID NO: 694210 - DNA, 25 bp, Mus musculus
gctgggtacaccatcacccaaatcg

SEQ ID NO: 694211 - DNA, 25 bp, Mus musculus
gctgggtacaccttcacccaaatcg

SEQ ID NO: 694212 - DNA, 25 bp, Mus musculus
gctgggtacatgatgacttgaatca

SEQ ID NO: 694213 - DNA, 25 bp, Mus musculus
gctgggtacatgttgacttgaatca

SEQ ID NO: 694214 - DNA, 25 bp, Mus musculus
gctgggtactaccatgccaatgcgg

SEQ ID NO: 694215 - DNA, 25 bp, Mus musculus
gctgggtactacgatgccaatgcgg

SEQ ID NO: 694216 - DNA, 25 bp, Mus musculus
gctgggtactttagccacaccagga

SEQ ID NO: 694217 - DNA, 25 bp, Mus musculus
gctgggtacttttgccacaccagga

SEQ ID NO: 694218 - DNA, 25 bp, Mus musculus
gctgggtagcccagtaataaagaca

SEQ ID NO: 694219 - DNA, 25 bp, Mus musculus
gctgggtagccctgtaataaagaca

SEQ ID NO: 694220 - DNA, 25 bp, Mus musculus
gctgggtatgaaagcagaatcccac

SEQ ID NO: 694221 - DNA, 25 bp, Mus musculus
gctgggtatgaatgcagaatcccac

SEQ ID NO: 694222 - DNA, 25 bp, Mus musculus
gctgggtcaaacagatctggagatc

SEQ ID NO: 694223 - DNA, 25 bp, Mus musculus
gctgggtcaaactgatctggagatc

SEQ ID NO: 694224 - DNA, 25 bp, Mus musculus
gctgggtccagaacaagtgtgagct

SEQ ID NO: 694225 - DNA, 25 bp, Mus musculus
gctgggtccagatcaagtgtgagct

SEQ ID NO: 694226 - DNA, 25 bp, Mus musculus
gctgggtccatcacagaccttgtga

SEQ ID NO: 694227 - DNA, 25 bp, Mus musculus
gctgggtccatctcagaccttgtga

SEQ ID NO: 694228 - DNA, 25 bp, Mus musculus
gctgggtcccacatcaaaagatctg

SEQ ID NO: 694229 - DNA, 25 bp, Mus musculus
gctgggtcccacttcaaaagatctg

SEQ ID NO: 694230 - DNA, 25 bp, Mus musculus
gctgggtccccgaaatgtactgctg

SEQ ID NO: 694231 - DNA, 25 bp, Mus musculus
gctgggtccccgtaatgtactgctg

SEQ ID NO: 694232 - DNA, 25 bp, Mus musculus
gctgggtcccgactgagccatacat

SEQ ID NO: 694233 - DNA, 25 bp, Mus musculus
gctgggtcccgagtgagccatacat

SEQ ID NO: 694234 - DNA, 25 bp, Mus musculus
gctgggtcgtagactgtgcgtcctt

SEQ ID NO: 694235 - DNA, 25 bp, Mus musculus
gctgggtcgtagtctgtgcgtcctt

SEQ ID NO: 694236 - DNA, 25 bp, Mus musculus
gctgggtctcctcatggtgattctg

SEQ ID NO: 694237 - DNA, 25 bp, Mus musculus
gctgggtctcctgatggtgattctg

SEQ ID NO: 694238 - DNA, 25 bp, Mus musculus
gctgggtctttacgtttctattcat

SEQ ID NO: 694239 - DNA, 25 bp, Mus musculus
gctgggtctttaggtttctattcat

SEQ ID NO: 694240 - DNA, 25 bp, Mus musculus
gctgggtgagtaccccgtctctgtc

SEQ ID NO: 694241 - DNA, 25 bp, Mus musculus
gctgggtgagtagcccgtctctgtc

SEQ ID NO: 694242 - DNA, 25 bp, Mus musculus
gctgggtgcaacatccattttaggt

SEQ ID NO: 694243 - DNA, 25 bp, Mus musculus
gctgggtgcaacttccattttaggt

SEQ ID NO: 694244 - DNA, 25 bp, Mus musculus
gctgggtgcaccaaccccattagtg

SEQ ID NO: 694245 - DNA, 25 bp, Mus musculus
gctgggtgcacctaccccattagtg

SEQ ID NO: 694246 - DNA, 25 bp, Mus musculus
gctgggtgccccatgtcatggacga

SEQ ID NO: 694247 - DNA, 25 bp, Mus musculus
gctgggtgccccttgtcatggacga

SEQ ID NO: 694248 - DNA, 25 bp, Mus musculus
gctgggtgcctgcagaatatcctcg

SEQ ID NO: 694249 - DNA, 25 bp, Mus musculus
gctgggtgcctggagaatatcctcg

SEQ ID NO: 694250 - DNA, 25 bp, Mus musculus
gctgggtgccttatcatcatgacca

SEQ ID NO: 694251 - DNA, 25 bp, Mus musculus
gctgggtgccttttcatcatgacca

SEQ ID NO: 694252 - DNA, 25 bp, Mus musculus
gctgggtgggtgaactacacattcc

SEQ ID NO: 694253 - DNA, 25 bp, Mus musculus
gctgggtgggtgtactacacattcc

SEQ ID NO: 694254 - DNA, 25 bp, Mus musculus
gctgggttactcagatgggtctgat

SEQ ID NO: 694255 - DNA, 25 bp, Mus musculus
gctgggttactctgatgggtctgat

SEQ ID NO: 694256 - DNA, 25 bp, Mus musculus
gctgggttcgacagtcaacacgtaa

SEQ ID NO: 694257 - DNA, 25 bp, Mus musculus
gctgggttcgactgtcaacacgtaa

SEQ ID NO: 694258 - DNA, 25 bp, Mus musculus
gctgggttgcttatcgcccaaatca

SEQ ID NO: 694259 - DNA, 25 bp, Mus musculus
gctgggttgcttttcgcccaaatca

SEQ ID NO: 694260 - DNA, 25 bp, Mus musculus
gctggtaaacctacgggctatgcag

SEQ ID NO: 694261 - DNA, 25 bp, Mus musculus
gctggtaaaccttcgggctatgcag

SEQ ID NO: 694262 - DNA, 25 bp, Mus musculus
gctggtaactggacagatgcccaca

SEQ ID NO: 694263 - DNA, 25 bp, Mus musculus
gctggtaactggtcagatgcccaca

SEQ ID NO: 694264 - DNA, 25 bp, Mus musculus
gctggtacaaggacctccaccgtta

SEQ ID NO: 694265 - DNA, 25 bp, Mus musculus
gctggtacaaggtcctccaccgtta

SEQ ID NO: 694266 - DNA, 25 bp, Mus musculus
gctggtacagaaagccaaactggct

SEQ ID NO: 694267 - DNA, 25 bp, Mus musculus
gctggtacagaatgccaaactggct

SEQ ID NO: 694268 - DNA, 25 bp, Mus musculus
gctggtacatccacgatttcctcaa

SEQ ID NO: 694269 - DNA, 25 bp, Mus musculus
gctggtacatcctcgatttcctcaa

SEQ ID NO: 694270 - DNA, 25 bp, Mus musculus
gctggtaccctacgcaggcagcaga

SEQ ID NO: 694271 - DNA, 25 bp, Mus musculus
gctggtaccctaggcaggcagcaga

SEQ ID NO: 694272 - DNA, 25 bp, Mus musculus
gctggtactcctcctctggaaggct

SEQ ID NO: 694273 - DNA, 25 bp, Mus musculus
gctggtactcctgctctggaaggct

SEQ ID NO: 694274 - DNA, 25 bp, Mus musculus
gctggtacttagaacttggaccaat

SEQ ID NO: 694275 - DNA, 25 bp, Mus musculus
gctggtacttagtacttggaccaat

SEQ ID NO: 694276 - DNA, 25 bp, Mus musculus
gctggtagagaaagtcaaccggctg

SEQ ID NO: 694277 - DNA, 25 bp, Mus musculus
gctggtagagaatgtcaaccggctg

SEQ ID NO: 694278 - DNA, 25 bp, Mus musculus
gctggtagagtcagacatcaacggc

SEQ ID NO: 694279 - DNA, 25 bp, Mus musculus
gctggtagagtctgacatcaacggc

SEQ ID NO: 694280 - DNA, 25 bp, Mus musculus
gctggtagatcaaatcgaagctctg

SEQ ID NO: 694281 - DNA, 25 bp, Mus musculus
gctggtagatcatatcgaagctctg

SEQ ID NO: 694282 - DNA, 25 bp, Mus musculus
gctggtagctgcaccattgtttgag

SEQ ID NO: 694283 - DNA, 25 bp, Mus musculus
gctggtagctgctccattgtttgag

SEQ ID NO: 694284 - DNA, 25 bp, Mus musculus
gctggtaggaaccacttgcatcagt

SEQ ID NO: 694285 - DNA, 25 bp, Mus musculus
gctggtaggaacgacttgcatcagt

SEQ ID NO: 694286 - DNA, 25 bp, Mus musculus
gctggtaggccacaggtacaacgaa

SEQ ID NO: 694287 - DNA, 25 bp, Mus musculus
gctggtaggccagaggtacaacgaa

SEQ ID NO: 694288 - DNA, 25 bp, Mus musculus
gctggtagtcgaacctgagactgat

SEQ ID NO: 694289 - DNA, 25 bp, Mus musculus
gctggtagtcgatcctgagactgat

SEQ ID NO: 694290 - DNA, 25 bp, Mus musculus
gctggtatcactccatatttgcctg

SEQ ID NO: 694291 - DNA, 25 bp, Mus musculus
gctggtatcactgcatatttgcctg

SEQ ID NO: 694292 - DNA, 25 bp, Mus musculus
gctggtatcagtccacatattacgg

SEQ ID NO: 694293 - DNA, 25 bp, Mus musculus
gctggtatcagtgcacatattacgg

SEQ ID NO: 694294 - DNA, 25 bp, Mus musculus
gctggtatgagtacaagagttgcat

SEQ ID NO: 694295 - DNA, 25 bp, Mus musculus
gctggtatgagttcaagagttgcat

SEQ ID NO: 694296 - DNA, 25 bp, Mus musculus
gctggtatggcaccagcgccattta

SEQ ID NO: 694297 - DNA, 25 bp, Mus musculus
gctggtatggcagcagcgccattta

SEQ ID NO: 694298 - DNA, 25 bp, Mus musculus
gctggtattcctagtcactgccgcc

SEQ ID NO: 694299 - DNA, 25 bp, Mus musculus
gctggtattccttgtcactgccgcc

SEQ ID NO: 694300 - DNA, 25 bp, Mus musculus
gctggtatttagagcgcagcgcctg

SEQ ID NO: 694301 - DNA, 25 bp, Mus musculus
gctggtatttagtgcgcagcgcctg

SEQ ID NO: 694302 - DNA, 25 bp, Mus musculus
gctggtcaaattccatattcactgt

SEQ ID NO: 694303 - DNA, 25 bp, Mus musculus
gctggtcaaattgcatattcactgt

SEQ ID NO: 694304 - DNA, 25 bp, Mus musculus
gctggtcaagtgagaagccttcccc

SEQ ID NO: 694305 - DNA, 25 bp, Mus musculus
gctggtcaagtgtgaagccttcccc

SEQ ID NO: 694306 - DNA, 25 bp, Mus musculus
gctggtcacagccatgcgatgtatg

SEQ ID NO: 694307 - DNA, 25 bp, Mus musculus
gctggtcacagcgatgcgatgtatg

SEQ ID NO: 694308 - DNA, 25 bp, Mus musculus
gctggtcaccaaagcctgcctcata

SEQ ID NO: 694309 - DNA, 25 bp, Mus musculus
gctggtcaccaatgcctgcctcata

SEQ ID NO: 694310 - DNA, 25 bp, Mus musculus
gctggtcagagaagccgcctcccgg

SEQ ID NO: 694311 - DNA, 25 bp, Mus musculus
gctggtcagagatgccgcctcccgg

SEQ ID NO: 694312 - DNA, 25 bp, Mus musculus
gctggtcaggatccaggttcccgtc

SEQ ID NO: 694313 - DNA, 25 bp, Mus musculus
gctggtcaggatgcaggttcccgtc

SEQ ID NO: 694314 - DNA, 25 bp, Mus musculus
gctggtcagtaactctgcagacagg

SEQ ID NO: 694315 - DNA, 25 bp, Mus musculus
gctggtcagtaagtctgcagacagg

SEQ ID NO: 694316 - DNA, 25 bp, Mus musculus
gctggtcatcatcgagagcgacctg

SEQ ID NO: 694317 - DNA, 25 bp, Mus musculus
gctggtcatcatggagagcgacctg

SEQ ID NO: 694318 - DNA, 25 bp, Mus musculus
gctggtccagtcagcttcgtctgca

SEQ ID NO: 694319 - DNA, 25 bp, Mus musculus
gctggtccagtctgcttcgtctgca

SEQ ID NO: 694320 - DNA, 25 bp, Mus musculus
gctggtcccttaagagccaccacag

SEQ ID NO: 694321 - DNA, 25 bp, Mus musculus
gctggtcccttatgagccaccacag

SEQ ID NO: 694322 - DNA, 25 bp, Mus musculus
gctggtccttcacgtatgcttggat

SEQ ID NO: 694323 - DNA, 25 bp, Mus musculus
gctggtccttcaggtatgcttggat

SEQ ID NO: 694324 - DNA, 25 bp, Mus musculus
gctggtcgacaaactgccagaggaa

SEQ ID NO: 694325 - DNA, 25 bp, Mus musculus
gctggtcgacaatctgccagaggaa

SEQ ID NO: 694326 - DNA, 25 bp, Mus musculus
gctggtcggcgactctgctcagcct

SEQ ID NO: 694327 - DNA, 25 bp, Mus musculus
gctggtcggcgagtctgctcagcct

SEQ ID NO: 694328 - DNA, 25 bp, Mus musculus
gctggtctacttagcagaatacttt

SEQ ID NO: 694329 - DNA, 25 bp, Mus musculus
gctggtctacttcccgtacgactac

SEQ ID NO: 694330 - DNA, 25 bp, Mus musculus
gctggtctacttgccgtacgactac

SEQ ID NO: 694331 - DNA, 25 bp, Mus musculus
gctggtctactttgcagaatacttt

SEQ ID NO: 694332 - DNA, 25 bp, Mus musculus
gctggtctagcccacctctgtgaat

SEQ ID NO: 694333 - DNA, 25 bp, Mus musculus
gctggtctagccgacctctgtgaat

SEQ ID NO: 694334 - DNA, 25 bp, Mus musculus
gctggtctatttcgagatggatcct

SEQ ID NO: 694335 - DNA, 25 bp, Mus musculus
gctggtctatttggagatggatcct

SEQ ID NO: 694336 - DNA, 25 bp, Mus musculus
gctggtctcaatagtttgcggttaa

SEQ ID NO: 694337 - DNA, 25 bp, Mus musculus
gctggtctcaattgtttgcggttaa

SEQ ID NO: 694338 - DNA, 25 bp, Mus musculus
gctggtctgcccagaatggctctta

SEQ ID NO: 694339 - DNA, 25 bp, Mus musculus
gctggtctgccctgaatggctctta

SEQ ID NO: 694340 - DNA, 25 bp, Mus musculus
gctggtctgcgaaggcgactgcctc

SEQ ID NO: 694341 - DNA, 25 bp, Mus musculus
gctggtctgcgatggcgactgcctc

SEQ ID NO: 694342 - DNA, 25 bp, Mus musculus
gctggtcttcgaactgcagctgtgg

SEQ ID NO: 694343 - DNA, 25 bp, Mus musculus
gctggtcttcgatctgcagctgtgg

SEQ ID NO: 694344 - DNA, 25 bp, Mus musculus
gctggtcttggcaacaggattatcc

SEQ ID NO: 694345 - DNA, 25 bp, Mus musculus
gctggtcttggctacaggattatcc

SEQ ID NO: 694346 - DNA, 25 bp, Mus musculus
gctggtctttgcatctagtaataaa

SEQ ID NO: 694347 - DNA, 25 bp, Mus musculus
gctggtctttgcttctagtaataaa

SEQ ID NO: 694348 - DNA, 25 bp, Mus musculus
gctggtgaaacacaccatcgcgcac

SEQ ID NO: 694349 - DNA, 25 bp, Mus musculus
gctggtgaaacagaccatcgcgcac

SEQ ID NO: 694350 - DNA, 25 bp, Mus musculus
gctggtgaagatagctgattttgga

SEQ ID NO: 694351 - DNA, 25 bp, Mus musculus
gctggtgaagattgctgattttgga

SEQ ID NO: 694352 - DNA, 25 bp, Mus musculus
gctggtgaaggcagtctccggcccc

SEQ ID NO: 694353 - DNA, 25 bp, Mus musculus
gctggtgaaggctgtctccggcccc

SEQ ID NO: 694354 - DNA, 25 bp, Mus musculus
gctggtgacaggacgcacatggaaa

SEQ ID NO: 694355 - DNA, 25 bp, Mus musculus
gctggtgacaggtcgcacatggaaa

SEQ ID NO: 694356 - DNA, 25 bp, Mus musculus
gctggtgacatgcaactcaagccct

SEQ ID NO: 694357 - DNA, 25 bp, Mus musculus
gctggtgacatggaactcaagccct

SEQ ID NO: 694358 - DNA, 25 bp, Mus musculus
gctggtgacttaagatcaggagatg

SEQ ID NO: 694359 - DNA, 25 bp, Mus musculus
gctggtgacttatgatcaggagatg

SEQ ID NO: 694360 - DNA, 25 bp, Mus musculus
gctggtgagcacctgccagactgcc

SEQ ID NO: 694361 - DNA, 25 bp, Mus musculus
gctggtgagcacgtgccagactgcc

SEQ ID NO: 694362 - DNA, 25 bp, Mus musculus
gctggtgagtttcacccaatgatcc

SEQ ID NO: 694363 - DNA, 25 bp, Mus musculus
gctggtgagtttgacccaatgatcc

SEQ ID NO: 694364 - DNA, 25 bp, Mus musculus
gctggtgattcaacactccctagga

SEQ ID NO: 694365 - DNA, 25 bp, Mus musculus
gctggtgattcatcactccctagga

SEQ ID NO: 694366 - DNA, 25 bp, Mus musculus
gctggtgattctatactgcaaccta

SEQ ID NO: 694367 - DNA, 25 bp, Mus musculus
gctggtgattctttactgcaaccta

SEQ ID NO: 694368 - DNA, 25 bp, Mus musculus
gctggtgcaaagaaaggacaataga

SEQ ID NO: 694369 - DNA, 25 bp, Mus musculus
gctggtgcaaagtaaggacaataga

SEQ ID NO: 694370 - DNA, 25 bp, Mus musculus
gctggtgcagcccaaaccacgatgg

SEQ ID NO: 694371 - DNA, 25 bp, Mus musculus
gctggtgcagccgaaaccacgatgg

SEQ ID NO: 694372 - DNA, 25 bp, Mus musculus
gctggtgcatgtcgtctgtcagtcc

SEQ ID NO: 694373 - DNA, 25 bp, Mus musculus
gctggtgcatgtggtctgtcagtcc

SEQ ID NO: 694374 - DNA, 25 bp, Mus musculus
gctggtgcccgaaacgtatccgaat

SEQ ID NO: 694375 - DNA, 25 bp, Mus musculus
gctggtgcccgatacgtatccgaat

SEQ ID NO: 694376 - DNA, 25 bp, Mus musculus
gctggtgcgcagctacaagaaactc

SEQ ID NO: 694377 - DNA, 25 bp, Mus musculus
gctggtgcgcaggtacaagaaactc

SEQ ID NO: 694378 - DNA, 25 bp, Mus musculus
gctggtgctgccattctcaggagca

SEQ ID NO: 694379 - DNA, 25 bp, Mus musculus
gctggtgctgcctttctcaggagca

SEQ ID NO: 694380 - DNA, 25 bp, Mus musculus
gctggtgctggaacccccaacactg

SEQ ID NO: 694381 - DNA, 25 bp, Mus musculus
gctggtgctggatcccccaacactg

SEQ ID NO: 694382 - DNA, 25 bp, Mus musculus
gctggtggaagacattgccaagcaa

SEQ ID NO: 694383 - DNA, 25 bp, Mus musculus
gctggtggaagagattgccaagcaa

SEQ ID NO: 694384 - DNA, 25 bp, Mus musculus
gctggtggaaggacttgtgctcatt

SEQ ID NO: 694385 - DNA, 25 bp, Mus musculus
gctggtggaaggtcttgtgctcatt

SEQ ID NO: 694386 - DNA, 25 bp, Mus musculus
gctggtggagatagtcgccaagtac

SEQ ID NO: 694387 - DNA, 25 bp, Mus musculus
gctggtggagattgtcgccaagtac

SEQ ID NO: 694388 - DNA, 25 bp, Mus musculus
gctggtggagtcagacctcaatggc

SEQ ID NO: 694389 - DNA, 25 bp, Mus musculus
gctggtggagtctgacctcaatggc

SEQ ID NO: 694390 - DNA, 25 bp, Mus musculus
gctggtggatgaactggacagcctc

SEQ ID NO: 694391 - DNA, 25 bp, Mus musculus
gctggtggatgatctggacagcctc

SEQ ID NO: 694392 - DNA, 25 bp, Mus musculus
gctggtggcccaagcttatactcgt

SEQ ID NO: 694393 - DNA, 25 bp, Mus musculus
gctggtggcccatgcttatactcgt

SEQ ID NO: 694394 - DNA, 25 bp, Mus musculus
gctggtggccgtattattcttattc

SEQ ID NO: 694395 - DNA, 25 bp, Mus musculus
gctggtggccgttttattcttattc

SEQ ID NO: 694396 - DNA, 25 bp, Mus musculus
gctggtggcggcatttctacctgga

SEQ ID NO: 694397 - DNA, 25 bp, Mus musculus
gctggtggcggcttttctacctgga

SEQ ID NO: 694398 - DNA, 25 bp, Mus musculus
gctggtggctctacgcagaattcaa

SEQ ID NO: 694399 - DNA, 25 bp, Mus musculus
gctggtggctcttcgcagaattcaa

SEQ ID NO: 694400 - DNA, 25 bp, Mus musculus
gctggtggcttacttcaacatcgag

SEQ ID NO: 694401 - DNA, 25 bp, Mus musculus
gctggtggcttagttcaacatcgag

SEQ ID NO: 694402 - DNA, 25 bp, Mus musculus
gctggtgggctcaaaggctctgtca

SEQ ID NO: 694403 - DNA, 25 bp, Mus musculus
gctggtgggctctaaggctctgtca

SEQ ID NO: 694404 - DNA, 25 bp, Mus musculus
gctggtggtactcacagactgatcc

SEQ ID NO: 694405 - DNA, 25 bp, Mus musculus
gctggtggtactcgtcctctcccgt

SEQ ID NO: 694406 - DNA, 25 bp, Mus musculus
gctggtggtactgacagactgatcc

SEQ ID NO: 694407 - DNA, 25 bp, Mus musculus
gctggtggtactggtcctctcccgt

SEQ ID NO: 694408 - DNA, 25 bp, Mus musculus
gctggtggtctgcaataatcagaat

SEQ ID NO: 694409 - DNA, 25 bp, Mus musculus
gctggtggtctggaataatcagaat

SEQ ID NO: 694410 - DNA, 25 bp, Mus musculus
gctggtggtgtcaatcgttattggt

SEQ ID NO: 694411 - DNA, 25 bp, Mus musculus
gctggtggtgtctatcgttattggt

SEQ ID NO: 694412 - DNA, 25 bp, Mus musculus
gctggtggttggagaccaagcacct

SEQ ID NO: 694413 - DNA, 25 bp, Mus musculus
gctggtggttggtgaccaagcacct

SEQ ID NO: 694414 - DNA, 25 bp, Mus musculus
gctggtgtaactctgcatgaggcct

SEQ ID NO: 694415 - DNA, 25 bp, Mus musculus
gctggtgtaactgtgcatgaggcct

SEQ ID NO: 694416 - DNA, 25 bp, Mus musculus
gctggtgtaccgagtcttcagaaga

SEQ ID NO: 694417 - DNA, 25 bp, Mus musculus
gctggtgtaccgtgtcttcagaaga

SEQ ID NO: 694418 - DNA, 25 bp, Mus musculus
gctggtgtcactccaaaagaaactc

SEQ ID NO: 694419 - DNA, 25 bp, Mus musculus
gctggtgtcactgcaaaagaaactc

SEQ ID NO: 694420 - DNA, 25 bp, Mus musculus
gctggtgtgctcatagttgcctaca

SEQ ID NO: 694421 - DNA, 25 bp, Mus musculus
gctggtgtgctcttagttgcctaca

SEQ ID NO: 694422 - DNA, 25 bp, Mus musculus
gctggtgtggtcaatacggtcttca

SEQ ID NO: 694423 - DNA, 25 bp, Mus musculus
gctggtgtggtctatacggtcttca

SEQ ID NO: 694424 - DNA, 25 bp, Mus musculus
gctggtgtttccacggacgcccaag

SEQ ID NO: 694425 - DNA, 25 bp, Mus musculus
gctggtgtttcctcggacgcccaag

SEQ ID NO: 694426 - DNA, 25 bp, Mus musculus
gctggtgtttgcattacagatgggc

SEQ ID NO: 694427 - DNA, 25 bp, Mus musculus
gctggtgtttgctttacagatgggc

SEQ ID NO: 694428 - DNA, 25 bp, Mus musculus
gctggttaccttcctgcttgtcact

SEQ ID NO: 694429 - DNA, 25 bp, Mus musculus
gctggttaccttgctgcttgtcact

SEQ ID NO: 694430 - DNA, 25 bp, Mus musculus
gctggttactagattgactacttat

SEQ ID NO: 694431 - DNA, 25 bp, Mus musculus
gctggttactagtttgactacttat

SEQ ID NO: 694432 - DNA, 25 bp, Mus musculus
gctggttagctcaactccccatgag

SEQ ID NO: 694433 - DNA, 25 bp, Mus musculus
gctggttagctctactccccatgag

SEQ ID NO: 694434 - DNA, 25 bp, Mus musculus
gctggttcatctccctgtttgtgga

SEQ ID NO: 694435 - DNA, 25 bp, Mus musculus
gctggttcatctgcctgtttgtgga

SEQ ID NO: 694436 - DNA, 25 bp, Mus musculus
gctggttccgttccctctttgtcca

SEQ ID NO: 694437 - DNA, 25 bp, Mus musculus
gctggttccgttgcctctttgtcca

SEQ ID NO: 694438 - DNA, 25 bp, Mus musculus
gctggttcgatgaccataagaacag

SEQ ID NO: 694439 - DNA, 25 bp, Mus musculus
gctggttcgatgtccataagaacag

SEQ ID NO: 694440 - DNA, 25 bp, Mus musculus
gctggttcgctaccgtggccctgaa

SEQ ID NO: 694441 - DNA, 25 bp, Mus musculus
gctggttcgctagcgtggccctgaa

SEQ ID NO: 694442 - DNA, 25 bp, Mus musculus
gctggttcggaccttctcttccatg

SEQ ID NO: 694443 - DNA, 25 bp, Mus musculus
gctggttcggacgttctcttccatg

SEQ ID NO: 694444 - DNA, 25 bp, Mus musculus
gctggttctggcaacctgactctga

SEQ ID NO: 694445 - DNA, 25 bp, Mus musculus
gctggttctggctacctgactctga

SEQ ID NO: 694446 - DNA, 25 bp, Mus musculus
gctggttctgtccttggtcctacaa

SEQ ID NO: 694447 - DNA, 25 bp, Mus musculus
gctggttctgtcgttggtcctacaa

SEQ ID NO: 694448 - DNA, 25 bp, Mus musculus
gctggttggaagcttgtccaatgcc

SEQ ID NO: 694449 - DNA, 25 bp, Mus musculus
gctggttggaaggttgtccaatgcc

SEQ ID NO: 694450 - DNA, 25 bp, Mus musculus
gctggttgtatacattgcgatccac

SEQ ID NO: 694451 - DNA, 25 bp, Mus musculus
gctggttgtatagattgcgatccac

SEQ ID NO: 694452 - DNA, 25 bp, Mus musculus
gctggtttacaacagaacatctcgg

SEQ ID NO: 694453 - DNA, 25 bp, Mus musculus
gctggtttacaagagaacatctcgg

SEQ ID NO: 694454 - DNA, 25 bp, Mus musculus
gctggtttcagacgtacaggctcag

SEQ ID NO: 694455 - DNA, 25 bp, Mus musculus
gctggtttcagaggtacaggctcag

SEQ ID NO: 694456 - DNA, 25 bp, Mus musculus
gctggtttcgaacacatgtggtgta

SEQ ID NO: 694457 - DNA, 25 bp, Mus musculus
gctggtttcgaagacatgtggtgta

SEQ ID NO: 694458 - DNA, 25 bp, Mus musculus
gctggtttctacagagagccacctt

SEQ ID NO: 694459 - DNA, 25 bp, Mus musculus
gctggtttctactgagagccacctt

SEQ ID NO: 694460 - DNA, 25 bp, Mus musculus
gctggtttgagcaggtgcgtctcca

SEQ ID NO: 694461 - DNA, 25 bp, Mus musculus
gctggtttgagctggtgcgtctcca

SEQ ID NO: 694462 - DNA, 25 bp, Mus musculus
gctggtttgtccatcgccagtcgaa

SEQ ID NO: 694463 - DNA, 25 bp, Mus musculus
gctggtttgtccttcgccagtcgaa

SEQ ID NO: 694464 - DNA, 25 bp, Mus musculus
gctggttttaacctgcgcaaagtta

SEQ ID NO: 694465 - DNA, 25 bp, Mus musculus
gctggttttaacgtgcgcaaagtta

SEQ ID NO: 694466 - DNA, 25 bp, Mus musculus
gctggttttcctcgtcgccctgggt

SEQ ID NO: 694467 - DNA, 25 bp, Mus musculus
gctggttttcctggtcgccctgggt

SEQ ID NO: 694468 - DNA, 25 bp, Mus musculus
gctgtaaaacataccaaaatcaagg

SEQ ID NO: 694469 - DNA, 25 bp, Mus musculus
gctgtaaaacattccaaaatcaagg

SEQ ID NO: 694470 - DNA, 25 bp, Mus musculus
gctgtaaacctcctaccgtatgtgg

SEQ ID NO: 694471 - DNA, 25 bp, Mus musculus
gctgtaaacctcgtaccgtatgtgg

SEQ ID NO: 694472 - DNA, 25 bp, Mus musculus
gctgtaaacctgatattccctccca

SEQ ID NO: 694473 - DNA, 25 bp, Mus musculus
gctgtaaacctgttattccctccca

SEQ ID NO: 694474 - DNA, 25 bp, Mus musculus
gctgtaaagctcagtaaagatattc

SEQ ID NO: 694475 - DNA, 25 bp, Mus musculus
gctgtaaagctctgtaaagatattc

SEQ ID NO: 694476 - DNA, 25 bp, Mus musculus
gctgtaacacaaccagtggtagtga

SEQ ID NO: 694477 - DNA, 25 bp, Mus musculus
gctgtaacacaagcagtggtagtga

SEQ ID NO: 694478 - DNA, 25 bp, Mus musculus
gctgtaacagttctgaagatgtgcg

SEQ ID NO: 694479 - DNA, 25 bp, Mus musculus
gctgtaacagttgtgaagatgtgcg

SEQ ID NO: 694480 - DNA, 25 bp, Mus musculus
gctgtaaccatgatgccgctgccca

SEQ ID NO: 694481 - DNA, 25 bp, Mus musculus
gctgtaaccatgttgccgctgccca

SEQ ID NO: 694482 - DNA, 25 bp, Mus musculus
gctgtaacccagaaccacctcttgt

SEQ ID NO: 694483 - DNA, 25 bp, Mus musculus
gctgtaacccagtaccacctcttgt

SEQ ID NO: 694484 - DNA, 25 bp, Mus musculus
gctgtaagaccaccacgtctgccgt

SEQ ID NO: 694485 - DNA, 25 bp, Mus musculus
gctgtaagaccagcacgtctgccgt

SEQ ID NO: 694486 - DNA, 25 bp, Mus musculus
gctgtaagcccgcagacggaagtct

SEQ ID NO: 694487 - DNA, 25 bp, Mus musculus
gctgtaagcccggagacggaagtct

SEQ ID NO: 694488 - DNA, 25 bp, Mus musculus
gctgtaaggatcacgtgggctacat

SEQ ID NO: 694489 - DNA, 25 bp, Mus musculus
gctgtaaggatctcgtgggctacat

SEQ ID NO: 694490 - DNA, 25 bp, Mus musculus
gctgtaaggcctacactacgaggga

SEQ ID NO: 694491 - DNA, 25 bp, Mus musculus
gctgtaaggccttcactacgaggga

SEQ ID NO: 694492 - DNA, 25 bp, Mus musculus
gctgtaaggttcatgtggagctacc

SEQ ID NO: 694493 - DNA, 25 bp, Mus musculus
gctgtaaggttcttgtggagctacc

SEQ ID NO: 694494 - DNA, 25 bp, Mus musculus
gctgtaatctagagaaactgtagcc

SEQ ID NO: 694495 - DNA, 25 bp, Mus musculus
gctgtaatctagtgaaactgtagcc

SEQ ID NO: 694496 - DNA, 25 bp, Mus musculus
gctgtacaaccaagggccagaatac

SEQ ID NO: 694497 - DNA, 25 bp, Mus musculus
gctgtacaaccatgggccagaatac

SEQ ID NO: 694498 - DNA, 25 bp, Mus musculus
gctgtacaagatcacactaccggac

SEQ ID NO: 694499 - DNA, 25 bp, Mus musculus
gctgtacaagatgacactaccggac

SEQ ID NO: 694500 - DNA, 25 bp, Mus musculus
gctgtacacacacgtggagggcttc

SEQ ID NO: 694501 - DNA, 25 bp, Mus musculus
gctgtacacacaggtggagggcttc

SEQ ID NO: 694502 - DNA, 25 bp, Mus musculus
gctgtacagaaacactctgaaagaa

SEQ ID NO: 694503 - DNA, 25 bp, Mus musculus
gctgtacagaaagactctgaaagaa

SEQ ID NO: 694504 - DNA, 25 bp, Mus musculus
gctgtacagccacaagcaacatggg

SEQ ID NO: 694505 - DNA, 25 bp, Mus musculus
gctgtacagccagaagcaacatggg

SEQ ID NO: 694506 - DNA, 25 bp, Mus musculus
gctgtacagctcactaattaataca

SEQ ID NO: 694507 - DNA, 25 bp, Mus musculus
gctgtacagctctctaattaataca

SEQ ID NO: 694508 - DNA, 25 bp, Mus musculus
gctgtacatgctagtgagtggtcct

SEQ ID NO: 694509 - DNA, 25 bp, Mus musculus
gctgtacatgcttgtgagtggtcct

SEQ ID NO: 694510 - DNA, 25 bp, Mus musculus
gctgtacatgtacatcacatcaagg

SEQ ID NO: 694511 - DNA, 25 bp, Mus musculus
gctgtacatgtagatcacatcaagg

SEQ ID NO: 694512 - DNA, 25 bp, Mus musculus
gctgtaccagatcctgtgtggcatc

SEQ ID NO: 694513 - DNA, 25 bp, Mus musculus
gctgtaccagatgctgtgtggcatc

SEQ ID NO: 694514 - DNA, 25 bp, Mus musculus
gctgtaccagcgcaaagagcctgtt

SEQ ID NO: 694515 - DNA, 25 bp, Mus musculus
gctgtaccagcggaaagagcctgtt

SEQ ID NO: 694516 - DNA, 25 bp, Mus musculus
gctgtaccagctctcactgcagcga

SEQ ID NO: 694517 - DNA, 25 bp, Mus musculus
gctgtaccagctgtcactgcagcga

SEQ ID NO: 694518 - DNA, 25 bp, Mus musculus
gctgtaccagtccaaccagacagag

SEQ ID NO: 694519 - DNA, 25 bp, Mus musculus
gctgtaccagtcgaaccagacagag

SEQ ID NO: 694520 - DNA, 25 bp, Mus musculus
gctgtaccgggtaagctgcttgcca

SEQ ID NO: 694521 - DNA, 25 bp, Mus musculus
gctgtaccgggttagctgcttgcca

SEQ ID NO: 694522 - DNA, 25 bp, Mus musculus
gctgtacctaccagaagtcttctat

SEQ ID NO: 694523 - DNA, 25 bp, Mus musculus
gctgtacctacctgaagtcttctat

SEQ ID NO: 694524 - DNA, 25 bp, Mus musculus
gctgtacgagaaaaagaagattgcc

SEQ ID NO: 694525 - DNA, 25 bp, Mus musculus
gctgtacgagaataagaagattgcc

SEQ ID NO: 694526 - DNA, 25 bp, Mus musculus
gctgtacgagctactttgggattca

SEQ ID NO: 694527 - DNA, 25 bp, Mus musculus
gctgtacgagcttctttgggattca

SEQ ID NO: 694528 - DNA, 25 bp, Mus musculus
gctgtacgaggtccgttcgccaccg

SEQ ID NO: 694529 - DNA, 25 bp, Mus musculus
gctgtacgaggtgcgttcgccaccg

SEQ ID NO: 694530 - DNA, 25 bp, Mus musculus
gctgtacgatcgcagtctggagtca

SEQ ID NO: 694531 - DNA, 25 bp, Mus musculus
gctgtacgatcggagtctggagtca

SEQ ID NO: 694532 - DNA, 25 bp, Mus musculus
gctgtacggcaaacgcggtaaatac

SEQ ID NO: 694533 - DNA, 25 bp, Mus musculus
gctgtacggcaatcgcggtaaatac

SEQ ID NO: 694534 - DNA, 25 bp, Mus musculus
gctgtacggtgacatcgatgcttta

SEQ ID NO: 694535 - DNA, 25 bp, Mus musculus
gctgtacggtgagatcgatgcttta

SEQ ID NO: 694536 - DNA, 25 bp, Mus musculus
gctgtactacgaccagccatcaggg

SEQ ID NO: 694537 - DNA, 25 bp, Mus musculus
gctgtactacgagcagccatcaggg

SEQ ID NO: 694538 - DNA, 25 bp, Mus musculus
gctgtactcgcacgacaagcatgag

SEQ ID NO: 694539 - DNA, 25 bp, Mus musculus
gctgtactcgcaggacaagcatgag

SEQ ID NO: 694540 - DNA, 25 bp, Mus musculus
gctgtactctacagcttcctgaatg

SEQ ID NO: 694541 - DNA, 25 bp, Mus musculus
gctgtactctactgcttcctgaatg

SEQ ID NO: 694542 - DNA, 25 bp, Mus musculus
gctgtactgccacattgcgaagaca

SEQ ID NO: 694543 - DNA, 25 bp, Mus musculus
gctgtactgccagattgcgaagaca

SEQ ID NO: 694544 - DNA, 25 bp, Mus musculus
gctgtactgcccaagctgcacctgg

SEQ ID NO: 694545 - DNA, 25 bp, Mus musculus
gctgtactgccctagctgcacctgg

SEQ ID NO: 694546 - DNA, 25 bp, Mus musculus
gctgtactggaaccctacgagagca

SEQ ID NO: 694547 - DNA, 25 bp, Mus musculus
gctgtactggaagcctacgagagca

SEQ ID NO: 694548 - DNA, 25 bp, Mus musculus
gctgtactggccagaagagcagctt

SEQ ID NO: 694549 - DNA, 25 bp, Mus musculus
gctgtactggcctgaagagcagctt

SEQ ID NO: 694550 - DNA, 25 bp, Mus musculus
gctgtactgggcatcgacaacgtgt

SEQ ID NO: 694551 - DNA, 25 bp, Mus musculus
gctgtactgggcttcgacaacgtgt

SEQ ID NO: 694552 - DNA, 25 bp, Mus musculus
gctgtactggtcatgcaggatccta

SEQ ID NO: 694553 - DNA, 25 bp, Mus musculus
gctgtactggtcttgcaggatccta

SEQ ID NO: 694554 - DNA, 25 bp, Mus musculus
gctgtacttcaacatcagccttcga

SEQ ID NO: 694555 - DNA, 25 bp, Mus musculus
gctgtacttcaagatcagccttcga

SEQ ID NO: 694556 - DNA, 25 bp, Mus musculus
gctgtacttgctctgacacattgag

SEQ ID NO: 694557 - DNA, 25 bp, Mus musculus
gctgtacttgctgtgacacattgag

SEQ ID NO: 694558 - DNA, 25 bp, Mus musculus
gctgtacttgggaaccatcaaaaag

SEQ ID NO: 694559 - DNA, 25 bp, Mus musculus
gctgtacttgggtaccatcaaaaag

SEQ ID NO: 694560 - DNA, 25 bp, Mus musculus
gctgtagaacaaacactctgtgcct

SEQ ID NO: 694561 - DNA, 25 bp, Mus musculus
gctgtagaacaatcactctgtgcct

SEQ ID NO: 694562 - DNA, 25 bp, Mus musculus
gctgtagaagttaagagaccccggg

SEQ ID NO: 694563 - DNA, 25 bp, Mus musculus
gctgtagaagtttagagaccccggg

SEQ ID NO: 694564 - DNA, 25 bp, Mus musculus
gctgtagacaccaggacacagctgc

SEQ ID NO: 694565 - DNA, 25 bp, Mus musculus
gctgtagacacctggacacagctgc

SEQ ID NO: 694566 - DNA, 25 bp, Mus musculus
gctgtagacctcatccgtaatgcgg

SEQ ID NO: 694567 - DNA, 25 bp, Mus musculus
gctgtagacctcttccgtaatgcgg

SEQ ID NO: 694568 - DNA, 25 bp, Mus musculus
gctgtagagcggcagacacccgatc

SEQ ID NO: 694569 - DNA, 25 bp, Mus musculus
gctgtagagcgggagacacccgatc

SEQ ID NO: 694570 - DNA, 25 bp, Mus musculus
gctgtagatctcaccgatccaacag

SEQ ID NO: 694571 - DNA, 25 bp, Mus musculus
gctgtagatctctccgatccaacag

SEQ ID NO: 694572 - DNA, 25 bp, Mus musculus
gctgtagattgacggccccgcgcta

SEQ ID NO: 694573 - DNA, 25 bp, Mus musculus
gctgtagattgagggccccgcgcta

SEQ ID NO: 694574 - DNA, 25 bp, Mus musculus
gctgtagccacaagggatcaggctc

SEQ ID NO: 694575 - DNA, 25 bp, Mus musculus
gctgtagccacatgggatcaggctc

SEQ ID NO: 694576 - DNA, 25 bp, Mus musculus
gctgtagcctgtcaacagttcctgg

SEQ ID NO: 694577 - DNA, 25 bp, Mus musculus
gctgtagcctgtgaacagttcctgg

SEQ ID NO: 694578 - DNA, 25 bp, Mus musculus
gctgtaggagccatgcttttcatca

SEQ ID NO: 694579 - DNA, 25 bp, Mus musculus
gctgtaggagccttgcttttcatca

SEQ ID NO: 694580 - DNA, 25 bp, Mus musculus
gctgtaggcgatcgcatagttcttt

SEQ ID NO: 694581 - DNA, 25 bp, Mus musculus
gctgtaggcgatggcatagttcttt

SEQ ID NO: 694582 - DNA, 25 bp, Mus musculus
gctgtagggacgaaatcccgtgtga

SEQ ID NO: 694583 - DNA, 25 bp, Mus musculus
gctgtagggacgtaatcccgtgtga

SEQ ID NO: 694584 - DNA, 25 bp, Mus musculus
gctgtagggctgaagcttcagctgt

SEQ ID NO: 694585 - DNA, 25 bp, Mus musculus
gctgtagggctgtagcttcagctgt

SEQ ID NO: 694586 - DNA, 25 bp, Mus musculus
gctgtagtcaatccattttattcct

SEQ ID NO: 694587 - DNA, 25 bp, Mus musculus
gctgtagtcaatgcattttattcct

SEQ ID NO: 694588 - DNA, 25 bp, Mus musculus
gctgtagtccaacaagctgcccaaa

SEQ ID NO: 694589 - DNA, 25 bp, Mus musculus
gctgtagtccaagaagctgcccaaa

SEQ ID NO: 694590 - DNA, 25 bp, Mus musculus
gctgtatactggcatcgtgatctac

SEQ ID NO: 694591 - DNA, 25 bp, Mus musculus
gctgtatactgggatcgtgatctac

SEQ ID NO: 694592 - DNA, 25 bp, Mus musculus
gctgtatatagcacgtgtatgctgg

SEQ ID NO: 694593 - DNA, 25 bp, Mus musculus
gctgtatatagctcgtgtatgctgg

SEQ ID NO: 694594 - DNA, 25 bp, Mus musculus
gctgtatatcgactccccagctggg

SEQ ID NO: 694595 - DNA, 25 bp, Mus musculus
gctgtatatcgagtccccagctggg

SEQ ID NO: 694596 - DNA, 25 bp, Mus musculus
gctgtatcaaccactccttcgcgta

SEQ ID NO: 694597 - DNA, 25 bp, Mus musculus
gctgtatcaacctctccttcgcgta

SEQ ID NO: 694598 - DNA, 25 bp, Mus musculus
gctgtatcagcaacgccctcaaggc

SEQ ID NO: 694599 - DNA, 25 bp, Mus musculus
gctgtatcagcatcgccctcaaggc

SEQ ID NO: 694600 - DNA, 25 bp, Mus musculus
gctgtatccctcaggacacgtacct

SEQ ID NO: 694601 - DNA, 25 bp, Mus musculus
gctgtatccctctggacacgtacct

SEQ ID NO: 694602 - DNA, 25 bp, Mus musculus
gctgtatcctatctaaataaccttc

SEQ ID NO: 694603 - DNA, 25 bp, Mus musculus
gctgtatcctatgtaaataaccttc

SEQ ID NO: 694604 - DNA, 25 bp, Mus musculus
gctgtatcgctaccctagtggagga

SEQ ID NO: 694605 - DNA, 25 bp, Mus musculus
gctgtatcgctagcctagtggagga

SEQ ID NO: 694606 - DNA, 25 bp, Mus musculus
gctgtatgcactcactgccctggct

SEQ ID NO: 694607 - DNA, 25 bp, Mus musculus
gctgtatgcactgactgccctggct

SEQ ID NO: 694608 - DNA, 25 bp, Mus musculus
gctgtatgcatgctaaaagagggca

SEQ ID NO: 694609 - DNA, 25 bp, Mus musculus
gctgtatgcatggtaaaagagggca

SEQ ID NO: 694610 - DNA, 25 bp, Mus musculus
gctgtatgcccaaggtcttggcgat

SEQ ID NO: 694611 - DNA, 25 bp, Mus musculus
gctgtatgcccatggtcttggcgat

SEQ ID NO: 694612 - DNA, 25 bp, Mus musculus
gctgtatgcgccagggcaactatca

SEQ ID NO: 694613 - DNA, 25 bp, Mus musculus
gctgtatgcgcctgggcaactatca

SEQ ID NO: 694614 - DNA, 25 bp, Mus musculus
gctgtatgctatccctcccaacgat

SEQ ID NO: 694615 - DNA, 25 bp, Mus musculus
gctgtatgctatgcctcccaacgat

SEQ ID NO: 694616 - DNA, 25 bp, Mus musculus
gctgtatggaaaacctaagataaag

SEQ ID NO: 694617 - DNA, 25 bp, Mus musculus
gctgtatggaaatcctaagataaag

SEQ ID NO: 694618 - DNA, 25 bp, Mus musculus
gctgtatggaccacgtggtgccaat

SEQ ID NO: 694619 - DNA, 25 bp, Mus musculus
gctgtatggacctcgtggtgccaat

SEQ ID NO: 694620 - DNA, 25 bp, Mus musculus
gctgtatggagtctcgatgctctgt

SEQ ID NO: 694621 - DNA, 25 bp, Mus musculus
gctgtatggagtgtcgatgctctgt

SEQ ID NO: 694622 - DNA, 25 bp, Mus musculus
gctgtatgtatacggtacgtgagaa

SEQ ID NO: 694623 - DNA, 25 bp, Mus musculus
gctgtatgtatagggtacgtgagaa

SEQ ID NO: 694624 - DNA, 25 bp, Mus musculus
gctgtattcattcccaaagacggca

SEQ ID NO: 694625 - DNA, 25 bp, Mus musculus
gctgtattcattgccaaagacggca

SEQ ID NO: 694626 - DNA, 25 bp, Mus musculus
gctgtattcttgctgaagcgaagcc

SEQ ID NO: 694627 - DNA, 25 bp, Mus musculus
gctgtattcttggtgaagcgaagcc

SEQ ID NO: 694628 - DNA, 25 bp, Mus musculus
gctgtatttctaagagcgcagccgg

SEQ ID NO: 694629 - DNA, 25 bp, Mus musculus
gctgtatttctatgagcgcagccgg

SEQ ID NO: 694630 - DNA, 25 bp, Mus musculus
gctgtatttcttccttccctggtga

SEQ ID NO: 694631 - DNA, 25 bp, Mus musculus
gctgtatttcttgcttccctggtga

SEQ ID NO: 694632 - DNA, 25 bp, Mus musculus
gctgtcaaaatacaacactttgcca

SEQ ID NO: 694633 - DNA, 25 bp, Mus musculus
gctgtcaaaatagaacactttgcca

SEQ ID NO: 694634 - DNA, 25 bp, Mus musculus
gctgtcaaagacctcgtgtgctcca

SEQ ID NO: 694635 - DNA, 25 bp, Mus musculus
gctgtcaaagacgtcgtgtgctcca

SEQ ID NO: 694636 - DNA, 25 bp, Mus musculus
gctgtcaacaagcagcagatattct

SEQ ID NO: 694637 - DNA, 25 bp, Mus musculus
gctgtcaacaaggagcagatattct

SEQ ID NO: 694638 - DNA, 25 bp, Mus musculus
gctgtcaacacaccaggaggctgag

SEQ ID NO: 694639 - DNA, 25 bp, Mus musculus
gctgtcaacacagcaggaggctgag

SEQ ID NO: 694640 - DNA, 25 bp, Mus musculus
gctgtcaaccctatctttggaaatc

SEQ ID NO: 694641 - DNA, 25 bp, Mus musculus
gctgtcaaccctttctttggaaatc

SEQ ID NO: 694642 - DNA, 25 bp, Mus musculus
gctgtcaaccgtatttcctttggct

SEQ ID NO: 694643 - DNA, 25 bp, Mus musculus
gctgtcaaccgtttttcctttggct

SEQ ID NO: 694644 - DNA, 25 bp, Mus musculus
gctgtcaacctcaaagtgctcaact

SEQ ID NO: 694645 - DNA, 25 bp, Mus musculus
gctgtcaacctctaagtgctcaact

SEQ ID NO: 694646 - DNA, 25 bp, Mus musculus
gctgtcaagaacaaggtaccacccc

SEQ ID NO: 694647 - DNA, 25 bp, Mus musculus
gctgtcaagaactaggtaccacccc

SEQ ID NO: 694648 - DNA, 25 bp, Mus musculus
gctgtcaagcctacaacttgataag

SEQ ID NO: 694649 - DNA, 25 bp, Mus musculus
gctgtcaagccttcaacttgataag

SEQ ID NO: 694650 - DNA, 25 bp, Mus musculus
gctgtcaaggaacccaatgcctatg

SEQ ID NO: 694651 - DNA, 25 bp, Mus musculus
gctgtcaaggaagccaatgcctatg

SEQ ID NO: 694652 - DNA, 25 bp, Mus musculus
gctgtcaagggcagagtcctcccgt

SEQ ID NO: 694653 - DNA, 25 bp, Mus musculus
gctgtcaagggctgagtcctcccgt

SEQ ID NO: 694654 - DNA, 25 bp, Mus musculus
gctgtcacacacctgggcatggatg

SEQ ID NO: 694655 - DNA, 25 bp, Mus musculus
gctgtcacacacgtgggcatggatg

SEQ ID NO: 694656 - DNA, 25 bp, Mus musculus
gctgtcacagaaagttcatgccctg

SEQ ID NO: 694657 - DNA, 25 bp, Mus musculus
gctgtcacagaatgttcatgccctg

SEQ ID NO: 694658 - DNA, 25 bp, Mus musculus
gctgtcacagttcgactctgggatc

SEQ ID NO: 694659 - DNA, 25 bp, Mus musculus
gctgtcacagttggactctgggatc

SEQ ID NO: 694660 - DNA, 25 bp, Mus musculus
gctgtcaccaccatcgacaatattg

SEQ ID NO: 694661 - DNA, 25 bp, Mus musculus
gctgtcaccaccttcgacaatattg

SEQ ID NO: 694662 - DNA, 25 bp, Mus musculus
gctgtcaccgacattatcatcaagg

SEQ ID NO: 694663 - DNA, 25 bp, Mus musculus
gctgtcaccgactttatcatcaagg

SEQ ID NO: 694664 - DNA, 25 bp, Mus musculus
gctgtcaccgagatgaatggacgca

SEQ ID NO: 694665 - DNA, 25 bp, Mus musculus
gctgtcaccgagttgaatggacgca

SEQ ID NO: 694666 - DNA, 25 bp, Mus musculus
gctgtcaccgtaatctgccttggat

SEQ ID NO: 694667 - DNA, 25 bp, Mus musculus
gctgtcaccgtattctgccttggat

SEQ ID NO: 694668 - DNA, 25 bp, Mus musculus
gctgtcacggctaatagtagaagag

SEQ ID NO: 694669 - DNA, 25 bp, Mus musculus
gctgtcacggctccatattgaagca

SEQ ID NO: 694670 - DNA, 25 bp, Mus musculus
gctgtcacggctgcatattgaagca

SEQ ID NO: 694671 - DNA, 25 bp, Mus musculus
gctgtcacggcttatagtagaagag

SEQ ID NO: 694672 - DNA, 25 bp, Mus musculus
gctgtcactcaacggaagacgctgg

SEQ ID NO: 694673 - DNA, 25 bp, Mus musculus
gctgtcactcaagggaagacgctgg

SEQ ID NO: 694674 - DNA, 25 bp, Mus musculus
gctgtcactcggagaccaaatcctg

SEQ ID NO: 694675 - DNA, 25 bp, Mus musculus
gctgtcactcggtgaccaaatcctg

SEQ ID NO: 694676 - DNA, 25 bp, Mus musculus
gctgtcactggtatcagtctctcag

SEQ ID NO: 694677 - DNA, 25 bp, Mus musculus
gctgtcactggtttcagtctctcag

SEQ ID NO: 694678 - DNA, 25 bp, Mus musculus
gctgtcagccataggactccctgtg

SEQ ID NO: 694679 - DNA, 25 bp, Mus musculus
gctgtcagccattggactccctgtg

SEQ ID NO: 694680 - DNA, 25 bp, Mus musculus
gctgtcagctcgattgcggcagcac

SEQ ID NO: 694681 - DNA, 25 bp, Mus musculus
gctgtcagctcgtttgcggcagcac

SEQ ID NO: 694682 - DNA, 25 bp, Mus musculus
gctgtcaggaggatgaagtagcaca

SEQ ID NO: 694683 - DNA, 25 bp, Mus musculus
gctgtcaggaggttgaagtagcaca

SEQ ID NO: 694684 - DNA, 25 bp, Mus musculus
gctgtcaggagtatgccgtggactt

SEQ ID NO: 694685 - DNA, 25 bp, Mus musculus
gctgtcaggagtttgccgtggactt

SEQ ID NO: 694686 - DNA, 25 bp, Mus musculus
gctgtcagggttacctatctgctaa

SEQ ID NO: 694687 - DNA, 25 bp, Mus musculus
gctgtcagggtttcctatctgctaa

SEQ ID NO: 694688 - DNA, 25 bp, Mus musculus
gctgtcaggttgaagctccgtcaga

SEQ ID NO: 694689 - DNA, 25 bp, Mus musculus
gctgtcaggttgtagctccgtcaga

SEQ ID NO: 694690 - DNA, 25 bp, Mus musculus
gctgtcagtcacagaggtggcaaca

SEQ ID NO: 694691 - DNA, 25 bp, Mus musculus
gctgtcagtcactgaggtggcaaca

SEQ ID NO: 694692 - DNA, 25 bp, Mus musculus
gctgtcagtcatcgcgctgtcctcg

SEQ ID NO: 694693 - DNA, 25 bp, Mus musculus
gctgtcagtcatggcgctgtcctcg

SEQ ID NO: 694694 - DNA, 25 bp, Mus musculus
gctgtcatagcaactcctctcggag

SEQ ID NO: 694695 - DNA, 25 bp, Mus musculus
gctgtcatagcatctcctctcggag

SEQ ID NO: 694696 - DNA, 25 bp, Mus musculus
gctgtcatcccgagaagcgaatgcg

SEQ ID NO: 694697 - DNA, 25 bp, Mus musculus
gctgtcatcccgtgaagcgaatgcg

SEQ ID NO: 694698 - DNA, 25 bp, Mus musculus
gctgtcatgattatgcggaaaccca

SEQ ID NO: 694699 - DNA, 25 bp, Mus musculus
gctgtcatgattttgcggaaaccca

SEQ ID NO: 694700 - DNA, 25 bp, Mus musculus
gctgtcatggcccagttggatccat

SEQ ID NO: 694701 - DNA, 25 bp, Mus musculus
gctgtcatggccgagttggatccat

SEQ ID NO: 694702 - DNA, 25 bp, Mus musculus
gctgtcattaccattggccaacaag

SEQ ID NO: 694703 - DNA, 25 bp, Mus musculus
gctgtcattacctttggccaacaag

SEQ ID NO: 694704 - DNA, 25 bp, Mus musculus
gctgtcattaggcagagacggcaca

SEQ ID NO: 694705 - DNA, 25 bp, Mus musculus
gctgtcattagggagagacggcaca

SEQ ID NO: 694706 - DNA, 25 bp, Mus musculus
gctgtccaaaaacattacccggtgt

SEQ ID NO: 694707 - DNA, 25 bp, Mus musculus
gctgtccaaaaagattacccggtgt

SEQ ID NO: 694708 - DNA, 25 bp, Mus musculus
gctgtccaacagattccccagatga

SEQ ID NO: 694709 - DNA, 25 bp, Mus musculus
gctgtccaacagtttccccagatga

SEQ ID NO: 694710 - DNA, 25 bp, Mus musculus
gctgtccacaccaggcattatcgtg

SEQ ID NO: 694711 - DNA, 25 bp, Mus musculus
gctgtccacacctggcattatcgtg

SEQ ID NO: 694712 - DNA, 25 bp, Mus musculus
gctgtccagcagaacctagaagaga

SEQ ID NO: 694713 - DNA, 25 bp, Mus musculus
gctgtccagcagtacctagaagaga

SEQ ID NO: 694714 - DNA, 25 bp, Mus musculus
gctgtccaggagaaaccagttgctt

SEQ ID NO: 694715 - DNA, 25 bp, Mus musculus
gctgtccaggagtaaccagttgctt

SEQ ID NO: 694716 - DNA, 25 bp, Mus musculus
gctgtccagtttaagatcccaggag

SEQ ID NO: 694717 - DNA, 25 bp, Mus musculus
gctgtccagttttagatcccaggag

SEQ ID NO: 694718 - DNA, 25 bp, Mus musculus
gctgtccatctacgtgggctgtgat

SEQ ID NO: 694719 - DNA, 25 bp, Mus musculus
gctgtccatctaggtgggctgtgat

SEQ ID NO: 694720 - DNA, 25 bp, Mus musculus
gctgtcccacagcacatagaagagg

SEQ ID NO: 694721 - DNA, 25 bp, Mus musculus
gctgtcccacaggacatagaagagg

SEQ ID NO: 694722 - DNA, 25 bp, Mus musculus
gctgtcccaggtccagtgcctgatc

SEQ ID NO: 694723 - DNA, 25 bp, Mus musculus
gctgtcccaggtgcagtgcctgatc

SEQ ID NO: 694724 - DNA, 25 bp, Mus musculus
gctgtccccagaccgagacgaagac

SEQ ID NO: 694725 - DNA, 25 bp, Mus musculus
gctgtccccagagcgagacgaagac

SEQ ID NO: 694726 - DNA, 25 bp, Mus musculus
gctgtccccggacacttattgcaga

SEQ ID NO: 694727 - DNA, 25 bp, Mus musculus
gctgtccccggagacttattgcaga

SEQ ID NO: 694728 - DNA, 25 bp, Mus musculus
gctgtccgacctcaccgtgggcaaa

SEQ ID NO: 694729 - DNA, 25 bp, Mus musculus
gctgtccgacctgaccgtgggcaaa

SEQ ID NO: 694730 - DNA, 25 bp, Mus musculus
gctgtccggaatactctggttttct

SEQ ID NO: 694731 - DNA, 25 bp, Mus musculus
gctgtccggaattctctggttttct

SEQ ID NO: 694732 - DNA, 25 bp, Mus musculus
gctgtccggcaaataccccaaggtc

SEQ ID NO: 694733 - DNA, 25 bp, Mus musculus
gctgtccggcaattaccccaaggtc

SEQ ID NO: 694734 - DNA, 25 bp, Mus musculus
gctgtccgggcgctgcttaacccaa

SEQ ID NO: 694735 - DNA, 25 bp, Mus musculus
gctgtccgggcggtgcttaacccaa

SEQ ID NO: 694736 - DNA, 25 bp, Mus musculus
gctgtccgtataacttcaactaaga

SEQ ID NO: 694737 - DNA, 25 bp, Mus musculus
gctgtccgtatatcttcaactaaga

SEQ ID NO: 694738 - DNA, 25 bp, Mus musculus
gctgtccgtcatcttccgattccga

SEQ ID NO: 694739 - DNA, 25 bp, Mus musculus
gctgtccgtcatgttccgattccga

SEQ ID NO: 694740 - DNA, 25 bp, Mus musculus
gctgtccgtgcacagctgaagcaca

SEQ ID NO: 694741 - DNA, 25 bp, Mus musculus
gctgtccgtgcagagctgaagcaca

SEQ ID NO: 694742 - DNA, 25 bp, Mus musculus
gctgtccgttccaccattcatctgt

SEQ ID NO: 694743 - DNA, 25 bp, Mus musculus
gctgtccgttcctccattcatctgt

SEQ ID NO: 694744 - DNA, 25 bp, Mus musculus
gctgtcctaaggaatgcggtcgccc

SEQ ID NO: 694745 - DNA, 25 bp, Mus musculus
gctgtcctaaggtatgcggtcgccc

SEQ ID NO: 694746 - DNA, 25 bp, Mus musculus
gctgtcctactacagcagctgctgg

SEQ ID NO: 694747 - DNA, 25 bp, Mus musculus
gctgtcctactagagcagctgctgg

SEQ ID NO: 694748 - DNA, 25 bp, Mus musculus
gctgtcctcactagacaccctagaa

SEQ ID NO: 694749 - DNA, 25 bp, Mus musculus
gctgtcctcacttgacaccctagaa

SEQ ID NO: 694750 - DNA, 25 bp, Mus musculus
gctgtcctgcacatgccaggtgctt

SEQ ID NO: 694751 - DNA, 25 bp, Mus musculus
gctgtcctgcacttgccaggtgctt

SEQ ID NO: 694752 - DNA, 25 bp, Mus musculus
gctgtcctggccctcttcatcatca

SEQ ID NO: 694753 - DNA, 25 bp, Mus musculus
gctgtcctggccgtcttcatcatca

SEQ ID NO: 694754 - DNA, 25 bp, Mus musculus
gctgtcgacatgaagaaggtttccg

SEQ ID NO: 694755 - DNA, 25 bp, Mus musculus
gctgtcgacatgtagaaggtttccg

SEQ ID NO: 694756 - DNA, 25 bp, Mus musculus
gctgtcgacgcaccgaggagacata

SEQ ID NO: 694757 - DNA, 25 bp, Mus musculus
gctgtcgacgcagcgaggagacata

SEQ ID NO: 694758 - DNA, 25 bp, Mus musculus
gctgtcgagcttcggctcaagcttg

SEQ ID NO: 694759 - DNA, 25 bp, Mus musculus
gctgtcgagcttgggctcaagcttg

SEQ ID NO: 694760 - DNA, 25 bp, Mus musculus
gctgtcgcagccattgttattatcc

SEQ ID NO: 694761 - DNA, 25 bp, Mus musculus
gctgtcgcagcctttgttattatcc

SEQ ID NO: 694762 - DNA, 25 bp, Mus musculus
gctgtcgccgctcgttgcagtagcc

SEQ ID NO: 694763 - DNA, 25 bp, Mus musculus
gctgtcgccgctggttgcagtagcc

SEQ ID NO: 694764 - DNA, 25 bp, Mus musculus
gctgtcgcgcacagacttgactgac

SEQ ID NO: 694765 - DNA, 25 bp, Mus musculus
gctgtcgcgcactgacttgactgac

SEQ ID NO: 694766 - DNA, 25 bp, Mus musculus
gctgtcggccagattatgacatttg

SEQ ID NO: 694767 - DNA, 25 bp, Mus musculus
gctgtcggccagtttatgacatttg

SEQ ID NO: 694768 - DNA, 25 bp, Mus musculus
gctgtcggcttgcatccaaagaccc

SEQ ID NO: 694769 - DNA, 25 bp, Mus musculus
gctgtcggcttggatccaaagaccc

SEQ ID NO: 694770 - DNA, 25 bp, Mus musculus
gctgtcgtactcaaacttgctcctt

SEQ ID NO: 694771 - DNA, 25 bp, Mus musculus
gctgtcgtactctaacttgctcctt

SEQ ID NO: 694772 - DNA, 25 bp, Mus musculus
gctgtctaacccctccgaaacagaa

SEQ ID NO: 694773 - DNA, 25 bp, Mus musculus
gctgtctaacccgtccgaaacagaa

SEQ ID NO: 694774 - DNA, 25 bp, Mus musculus
gctgtctacactcacatcatccagg

SEQ ID NO: 694775 - DNA, 25 bp, Mus musculus
gctgtctacactgacatcatccagg

SEQ ID NO: 694776 - DNA, 25 bp, Mus musculus
gctgtctacatcagggaaagcctcc

SEQ ID NO: 694777 - DNA, 25 bp, Mus musculus
gctgtctacatctgggaaagcctcc

SEQ ID NO: 694778 - DNA, 25 bp, Mus musculus
gctgtctaccagctgacgcgcatgt

SEQ ID NO: 694779 - DNA, 25 bp, Mus musculus
gctgtctaccaggtgacgcgcatgt

SEQ ID NO: 694780 - DNA, 25 bp, Mus musculus
gctgtctacgagcacctgcgaagga

SEQ ID NO: 694781 - DNA, 25 bp, Mus musculus
gctgtctacgaggacctgcgaagga

SEQ ID NO: 694782 - DNA, 25 bp, Mus musculus
gctgtctagaggcatcagacagacc

SEQ ID NO: 694783 - DNA, 25 bp, Mus musculus
gctgtctagagggatcagacagacc

SEQ ID NO: 694784 - DNA, 25 bp, Mus musculus
gctgtctagttaagggatacttggc

SEQ ID NO: 694785 - DNA, 25 bp, Mus musculus
gctgtctagttatgggatacttggc

SEQ ID NO: 694786 - DNA, 25 bp, Mus musculus
gctgtctattacagggtgtgtcccc

SEQ ID NO: 694787 - DNA, 25 bp, Mus musculus
gctgtctattactgggtgtgtcccc

SEQ ID NO: 694788 - DNA, 25 bp, Mus musculus
gctgtctcatgcaatgtctcttctc

SEQ ID NO: 694789 - DNA, 25 bp, Mus musculus
gctgtctcatgctatgtctcttctc

SEQ ID NO: 694790 - DNA, 25 bp, Mus musculus
gctgtctccaagatgttaaataagt

SEQ ID NO: 694791 - DNA, 25 bp, Mus musculus
gctgtctccaagttgttaaataagt

SEQ ID NO: 694792 - DNA, 25 bp, Mus musculus
gctgtctccggcagcttgaagctgt

SEQ ID NO: 694793 - DNA, 25 bp, Mus musculus
gctgtctccggctgcttgaagctgt

SEQ ID NO: 694794 - DNA, 25 bp, Mus musculus
gctgtctctacccatgaaggctcga

SEQ ID NO: 694795 - DNA, 25 bp, Mus musculus
gctgtctctaccgatgaaggctcga

SEQ ID NO: 694796 - DNA, 25 bp, Mus musculus
gctgtctctgacagtgttcagcatt

SEQ ID NO: 694797 - DNA, 25 bp, Mus musculus
gctgtctctgactgtgttcagcatt

SEQ ID NO: 694798 - DNA, 25 bp, Mus musculus
gctgtctctgtaagggaaccctcgt

SEQ ID NO: 694799 - DNA, 25 bp, Mus musculus
gctgtctctgtatgggaaccctcgt

SEQ ID NO: 694800 - DNA, 25 bp, Mus musculus
gctgtctcttatcacgctgcactgg

SEQ ID NO: 694801 - DNA, 25 bp, Mus musculus
gctgtctcttatgacgctgcactgg

SEQ ID NO: 694802 - DNA, 25 bp, Mus musculus
gctgtctgcctgctgttgctccaca

SEQ ID NO: 694803 - DNA, 25 bp, Mus musculus
gctgtctgcctggtgttgctccaca

SEQ ID NO: 694804 - DNA, 25 bp, Mus musculus
gctgtctgctgaccatagccacgga

SEQ ID NO: 694805 - DNA, 25 bp, Mus musculus
gctgtctgctgagcatagccacgga

SEQ ID NO: 694806 - DNA, 25 bp, Mus musculus
gctgtctgctttatccccaagggtg

SEQ ID NO: 694807 - DNA, 25 bp, Mus musculus
gctgtctgctttttccccaagggtg

SEQ ID NO: 694808 - DNA, 25 bp, Mus musculus
gctgtctggagaacagatgttgact

SEQ ID NO: 694809 - DNA, 25 bp, Mus musculus
gctgtctggagatcagatgttgact

SEQ ID NO: 694810 - DNA, 25 bp, Mus musculus
gctgtctggcctatcttgctgctca

SEQ ID NO: 694811 - DNA, 25 bp, Mus musculus
gctgtctggcctttcttgctgctca

SEQ ID NO: 694812 - DNA, 25 bp, Mus musculus
gctgtctggtggaggaaacccctag

SEQ ID NO: 694813 - DNA, 25 bp, Mus musculus
gctgtctggtggtggaaacccctag

SEQ ID NO: 694814 - DNA, 25 bp, Mus musculus
gctgtctgtcacctggacgctcctg

SEQ ID NO: 694815 - DNA, 25 bp, Mus musculus
gctgtctgtcacgtggacgctcctg

SEQ ID NO: 694816 - DNA, 25 bp, Mus musculus
gctgtctgtcctaccgggaaaaagg

SEQ ID NO: 694817 - DNA, 25 bp, Mus musculus
gctgtctgtccttccgggaaaaagg

SEQ ID NO: 694818 - DNA, 25 bp, Mus musculus
gctgtctgtctgaggcagcacgaca

SEQ ID NO: 694819 - DNA, 25 bp, Mus musculus
gctgtctgtctgtggcagcacgaca

SEQ ID NO: 694820 - DNA, 25 bp, Mus musculus
gctgtctgtgtgagactggcttcca

SEQ ID NO: 694821 - DNA, 25 bp, Mus musculus
gctgtctgtgtgtgactggcttcca

SEQ ID NO: 694822 - DNA, 25 bp, Mus musculus
gctgtcttccgcctggaccaagtta

SEQ ID NO: 694823 - DNA, 25 bp, Mus musculus
gctgtcttccgcgtggaccaagtta

SEQ ID NO: 694824 - DNA, 25 bp, Mus musculus
gctgtcttccgtccaggctttcggc

SEQ ID NO: 694825 - DNA, 25 bp, Mus musculus
gctgtcttccgtgcaggctttcggc

SEQ ID NO: 694826 - DNA, 25 bp, Mus musculus
gctgtcttctcaaacaagggcgact

SEQ ID NO: 694827 - DNA, 25 bp, Mus musculus
gctgtcttctcatacaagggcgact

SEQ ID NO: 694828 - DNA, 25 bp, Mus musculus
gctgtcttctccatctcagccggac

SEQ ID NO: 694829 - DNA, 25 bp, Mus musculus
gctgtcttctccttctcagccggac

SEQ ID NO: 694830 - DNA, 25 bp, Mus musculus
gctgtcttctcgactgtgttctact

SEQ ID NO: 694831 - DNA, 25 bp, Mus musculus
gctgtcttctcgtctgtgttctact

SEQ ID NO: 694832 - DNA, 25 bp, Mus musculus
gctgtcttggtacaacaaacccgct

SEQ ID NO: 694833 - DNA, 25 bp, Mus musculus
gctgtcttggtagaacaaacccgct

SEQ ID NO: 694834 - DNA, 25 bp, Mus musculus
gctgtctttccaagcactccatcaa

SEQ ID NO: 694835 - DNA, 25 bp, Mus musculus
gctgtctttccatgcactccatcaa

SEQ ID NO: 694836 - DNA, 25 bp, Mus musculus
gctgtctttcggatactgctgacta

SEQ ID NO: 694837 - DNA, 25 bp, Mus musculus
gctgtctttcggttactgctgacta

SEQ ID NO: 694838 - DNA, 25 bp, Mus musculus
gctgtctttgtactgccattgtttt

SEQ ID NO: 694839 - DNA, 25 bp, Mus musculus
gctgtctttgtagtgccattgtttt

SEQ ID NO: 694840 - DNA, 25 bp, Mus musculus
gctgtgaaacagaaaccacacacct

SEQ ID NO: 694841 - DNA, 25 bp, Mus musculus
gctgtgaaacagtaaccacacacct

SEQ ID NO: 694842 - DNA, 25 bp, Mus musculus
gctgtgaaacgtacaagttctgtga

SEQ ID NO: 694843 - DNA, 25 bp, Mus musculus
gctgtgaaacgttcaagttctgtga

SEQ ID NO: 694844 - DNA, 25 bp, Mus musculus
gctgtgaaagatctatgttgccaaa

SEQ ID NO: 694845 - DNA, 25 bp, Mus musculus
gctgtgaaagatgtatgttgccaaa

SEQ ID NO: 694846 - DNA, 25 bp, Mus musculus
gctgtgaaaggccttgtcaccaagg

SEQ ID NO: 694847 - DNA, 25 bp, Mus musculus
gctgtgaaaggcgttgtcaccaagg

SEQ ID NO: 694848 - DNA, 25 bp, Mus musculus
gctgtgaaatttcaaccgtaccacg

SEQ ID NO: 694849 - DNA, 25 bp, Mus musculus
gctgtgaaatttgaaccgtaccacg

SEQ ID NO: 694850 - DNA, 25 bp, Mus musculus
gctgtgaacaagacagaccaataaa

SEQ ID NO: 694851 - DNA, 25 bp, Mus musculus
gctgtgaacaagtcagaccaataaa

SEQ ID NO: 694852 - DNA, 25 bp, Mus musculus
gctgtgaagaagcttcgagatctca

SEQ ID NO: 694853 - DNA, 25 bp, Mus musculus
gctgtgaagaaggttcgagatctca

SEQ ID NO: 694854 - DNA, 25 bp, Mus musculus
gctgtgaagataattactggtcccc

SEQ ID NO: 694855 - DNA, 25 bp, Mus musculus
gctgtgaagatatttactggtcccc

SEQ ID NO: 694856 - DNA, 25 bp, Mus musculus
gctgtgaagatcatcgacaagaccc

SEQ ID NO: 694857 - DNA, 25 bp, Mus musculus
gctgtgaagatcttcgacaagaccc

SEQ ID NO: 694858 - DNA, 25 bp, Mus musculus
gctgtgaaggtgaagagcccctcat

SEQ ID NO: 694859 - DNA, 25 bp, Mus musculus
gctgtgaaggtgtagagcccctcat

SEQ ID NO: 694860 - DNA, 25 bp, Mus musculus
gctgtgaaggttcagtcattccaga

SEQ ID NO: 694861 - DNA, 25 bp, Mus musculus
gctgtgaaggttgagtcattccaga

SEQ ID NO: 694862 - DNA, 25 bp, Mus musculus
gctgtgaatccaactgtaaagttct

SEQ ID NO: 694863 - DNA, 25 bp, Mus musculus
gctgtgaatccatctgtaaagttct

SEQ ID NO: 694864 - DNA, 25 bp, Mus musculus
gctgtgaattccatgttttcactgg

SEQ ID NO: 694865 - DNA, 25 bp, Mus musculus
gctgtgaattccttgttttcactgg

SEQ ID NO: 694866 - DNA, 25 bp, Mus musculus
gctgtgacaagaacattattaatct

SEQ ID NO: 694867 - DNA, 25 bp, Mus musculus
gctgtgacaagatcattattaatct

SEQ ID NO: 694868 - DNA, 25 bp, Mus musculus
gctgtgacaattaaggtaagaacta

SEQ ID NO: 694869 - DNA, 25 bp, Mus musculus
gctgtgacaatttaggtaagaacta

SEQ ID NO: 694870 - DNA, 25 bp, Mus musculus
gctgtgacagccatactgctgcctt

SEQ ID NO: 694871 - DNA, 25 bp, Mus musculus
gctgtgacagccttactgctgcctt

SEQ ID NO: 694872 - DNA, 25 bp, Mus musculus
gctgtgacatccacaggccgctcaa

SEQ ID NO: 694873 - DNA, 25 bp, Mus musculus
gctgtgacatcctcaggccgctcaa

SEQ ID NO: 694874 - DNA, 25 bp, Mus musculus
gctgtgacccgtatgggcatatatg

SEQ ID NO: 694875 - DNA, 25 bp, Mus musculus
gctgtgacccgtttgggcatatatg

SEQ ID NO: 694876 - DNA, 25 bp, Mus musculus
gctgtgaccgacactggcaagatgc

SEQ ID NO: 694877 - DNA, 25 bp, Mus musculus
gctgtgaccgactctggcaagatgc

SEQ ID NO: 694878 - DNA, 25 bp, Mus musculus
gctgtgacgtataaccgcgatgggt

SEQ ID NO: 694879 - DNA, 25 bp, Mus musculus
gctgtgacgtattaccgcgatgggt

SEQ ID NO: 694880 - DNA, 25 bp, Mus musculus
gctgtgactctgctccgcgacaatg

SEQ ID NO: 694881 - DNA, 25 bp, Mus musculus
gctgtgactctggtccgcgacaatg

SEQ ID NO: 694882 - DNA, 25 bp, Mus musculus
gctgtgactgcaagaaggatttctg

SEQ ID NO: 694883 - DNA, 25 bp, Mus musculus
gctgtgactgcatgaaggatttctg

SEQ ID NO: 694884 - DNA, 25 bp, Mus musculus
gctgtgaggaaacaaaagttgcttg

SEQ ID NO: 694885 - DNA, 25 bp, Mus musculus
gctgtgaggaaagaaaagttgcttg

SEQ ID NO: 694886 - DNA, 25 bp, Mus musculus
gctgtgaggagaacattcaagacag

SEQ ID NO: 694887 - DNA, 25 bp, Mus musculus
gctgtgaggagatcattcaagacag

SEQ ID NO: 694888 - DNA, 25 bp, Mus musculus
gctgtgaggctcatgttgtgaagaa

SEQ ID NO: 694889 - DNA, 25 bp, Mus musculus
gctgtgaggctcttgttgtgaagaa

SEQ ID NO: 694890 - DNA, 25 bp, Mus musculus
gctgtgagtaccacatggagctgat

SEQ ID NO: 694891 - DNA, 25 bp, Mus musculus
gctgtgagtacctcatggagctgat

SEQ ID NO: 694892 - DNA, 25 bp, Mus musculus
gctgtgagtccacgaagcggatccc

SEQ ID NO: 694893 - DNA, 25 bp, Mus musculus
gctgtgagtccaggaagcggatccc

SEQ ID NO: 694894 - DNA, 25 bp, Mus musculus
gctgtgagtgagatcgacgccctct

SEQ ID NO: 694895 - DNA, 25 bp, Mus musculus
gctgtgagtgagttcgacgccctct

SEQ ID NO: 694896 - DNA, 25 bp, Mus musculus
gctgtgagtgctatggctaaatttg

SEQ ID NO: 694897 - DNA, 25 bp, Mus musculus
gctgtgagtgctttggctaaatttg

SEQ ID NO: 694898 - DNA, 25 bp, Mus musculus
gctgtgatactcagccgcctgcgca

SEQ ID NO: 694899 - DNA, 25 bp, Mus musculus
gctgtgatactctgccgcctgcgca

SEQ ID NO: 694900 - DNA, 25 bp, Mus musculus
gctgtgatagaccaagggctgacta

SEQ ID NO: 694901 - DNA, 25 bp, Mus musculus
gctgtgatagacgaagggctgacta

SEQ ID NO: 694902 - DNA, 25 bp, Mus musculus
gctgtgatagtgagtaccttggtgc

SEQ ID NO: 694903 - DNA, 25 bp, Mus musculus
gctgtgatagtgtgtaccttggtgc

SEQ ID NO: 694904 - DNA, 25 bp, Mus musculus
gctgtgatcgataaggctgcttcaa

SEQ ID NO: 694905 - DNA, 25 bp, Mus musculus
gctgtgatcgattaggctgcttcaa

SEQ ID NO: 694906 - DNA, 25 bp, Mus musculus
gctgtgatctatagtttgaaacaac

SEQ ID NO: 694907 - DNA, 25 bp, Mus musculus
gctgtgatctattgtttgaaacaac

SEQ ID NO: 694908 - DNA, 25 bp, Mus musculus
gctgtgatctttcctcggcagcact

SEQ ID NO: 694909 - DNA, 25 bp, Mus musculus
gctgtgatctttgctcggcagcact

SEQ ID NO: 694910 - DNA, 25 bp, Mus musculus
gctgtgatgaggctttgacaatcca

SEQ ID NO: 694911 - DNA, 25 bp, Mus musculus
gctgtgatgagggtttgacaatcca

SEQ ID NO: 694912 - DNA, 25 bp, Mus musculus
gctgtgatgatgattgtaggcttcc

SEQ ID NO: 694913 - DNA, 25 bp, Mus musculus
gctgtgatgatgtttgtaggcttcc

SEQ ID NO: 694914 - DNA, 25 bp, Mus musculus
gctgtgatgggcacccttactcact

SEQ ID NO: 694915 - DNA, 25 bp, Mus musculus
gctgtgatgggctcccttactcact

SEQ ID NO: 694916 - DNA, 25 bp, Mus musculus
gctgtgatgtcacacctgaacacag

SEQ ID NO: 694917 - DNA, 25 bp, Mus musculus
gctgtgatgtcagacctgaacacag

SEQ ID NO: 694918 - DNA, 25 bp, Mus musculus
gctgtgcaaacactagaccccttca

SEQ ID NO: 694919 - DNA, 25 bp, Mus musculus
gctgtgcaaacagtagaccccttca

SEQ ID NO: 694920 - DNA, 25 bp, Mus musculus
gctgtgcacacaattaagaaaacta

SEQ ID NO: 694921 - DNA, 25 bp, Mus musculus
gctgtgcacacatttaagaaaacta

SEQ ID NO: 694922 - DNA, 25 bp, Mus musculus
gctgtgcactggctctcgggacaat

SEQ ID NO: 694923 - DNA, 25 bp, Mus musculus
gctgtgcactgggtctcgggacaat

SEQ ID NO: 694924 - DNA, 25 bp, Mus musculus
gctgtgcagcggagcagaaagctgc

SEQ ID NO: 694925 - DNA, 25 bp, Mus musculus
gctgtgcagcggtgcagaaagctgc

SEQ ID NO: 694926 - DNA, 25 bp, Mus musculus
gctgtgcatccaaagtaccaagaga

SEQ ID NO: 694927 - DNA, 25 bp, Mus musculus
gctgtgcatccatagtaccaagaga

SEQ ID NO: 694928 - DNA, 25 bp, Mus musculus
gctgtgcatgcaagatcatcccctt

SEQ ID NO: 694929 - DNA, 25 bp, Mus musculus
gctgtgcatgcatgatcatcccctt

SEQ ID NO: 694930 - DNA, 25 bp, Mus musculus
gctgtgccaaacctgtccaaaatct

SEQ ID NO: 694931 - DNA, 25 bp, Mus musculus
gctgtgccaaacgtgtccaaaatct

SEQ ID NO: 694932 - DNA, 25 bp, Mus musculus
gctgtgccacacctgaccggacagt

SEQ ID NO: 694933 - DNA, 25 bp, Mus musculus
gctgtgccacacgtgaccggacagt

SEQ ID NO: 694934 - DNA, 25 bp, Mus musculus
gctgtgccaggcagacttctagagt

SEQ ID NO: 694935 - DNA, 25 bp, Mus musculus
gctgtgccaggcattgcataaacca

SEQ ID NO: 694936 - DNA, 25 bp, Mus musculus
gctgtgccaggctgacttctagagt

SEQ ID NO: 694937 - DNA, 25 bp, Mus musculus
gctgtgccaggctttgcataaacca

SEQ ID NO: 694938 - DNA, 25 bp, Mus musculus
gctgtgcccactagtactgcagaaa

SEQ ID NO: 694939 - DNA, 25 bp, Mus musculus
gctgtgcccacttgtactgcagaaa

SEQ ID NO: 694940 - DNA, 25 bp, Mus musculus
gctgtgccccagaaggaatcccgtt

SEQ ID NO: 694941 - DNA, 25 bp, Mus musculus
gctgtgccccagtaggaatcccgtt

SEQ ID NO: 694942 - DNA, 25 bp, Mus musculus
gctgtgccgactacatggagcagtg

SEQ ID NO: 694943 - DNA, 25 bp, Mus musculus
gctgtgccgacttcatggagcagtg

SEQ ID NO: 694944 - DNA, 25 bp, Mus musculus
gctgtgcctcagacatcaaggctga

SEQ ID NO: 694945 - DNA, 25 bp, Mus musculus
gctgtgcctcagtcatcaaggctga

SEQ ID NO: 694946 - DNA, 25 bp, Mus musculus
gctgtgccttctaccagtgtttctg

SEQ ID NO: 694947 - DNA, 25 bp, Mus musculus
gctgtgccttcttccagtgtttctg

SEQ ID NO: 694948 - DNA, 25 bp, Mus musculus
gctgtgcgacgcaacatgaagaaca

SEQ ID NO: 694949 - DNA, 25 bp, Mus musculus
gctgtgcgacgctacatgaagaaca

SEQ ID NO: 694950 - DNA, 25 bp, Mus musculus
gctgtgcgaggacatcgtggtctac

SEQ ID NO: 694951 - DNA, 25 bp, Mus musculus
gctgtgcgaggagatcgtggtctac

SEQ ID NO: 694952 - DNA, 25 bp, Mus musculus
gctgtgctataaatctcgactcccc

SEQ ID NO: 694953 - DNA, 25 bp, Mus musculus
gctgtgctataattctcgactcccc

SEQ ID NO: 694954 - DNA, 25 bp, Mus musculus
gctgtgctcactccgcagtttgggt

SEQ ID NO: 694955 - DNA, 25 bp, Mus musculus
gctgtgctcactgcgcagtttgggt

SEQ ID NO: 694956 - DNA, 25 bp, Mus musculus
gctgtgctcatcctagcctatttta

SEQ ID NO: 694957 - DNA, 25 bp, Mus musculus
gctgtgctcatcgtagcctatttta

SEQ ID NO: 694958 - DNA, 25 bp, Mus musculus
gctgtgctcatgcagaataatgcag

SEQ ID NO: 694959 - DNA, 25 bp, Mus musculus
gctgtgctcatggagaataatgcag

SEQ ID NO: 694960 - DNA, 25 bp, Mus musculus
gctgtgctccttctgtttgcaaaca

SEQ ID NO: 694961 - DNA, 25 bp, Mus musculus
gctgtgctccttgtgtttgcaaaca

SEQ ID NO: 694962 - DNA, 25 bp, Mus musculus
gctgtgctctgaatgactctcctgt

SEQ ID NO: 694963 - DNA, 25 bp, Mus musculus
gctgtgctctgattgactctcctgt

SEQ ID NO: 694964 - DNA, 25 bp, Mus musculus
gctgtgctcttgacccgtagcctca

SEQ ID NO: 694965 - DNA, 25 bp, Mus musculus
gctgtgctcttgcagtatgtctcta

SEQ ID NO: 694966 - DNA, 25 bp, Mus musculus
gctgtgctcttggagtatgtctcta

SEQ ID NO: 694967 - DNA, 25 bp, Mus musculus
gctgtgctcttgtcccgtagcctca

SEQ ID NO: 694968 - DNA, 25 bp, Mus musculus
gctgtgctgaggctctactttgatg

SEQ ID NO: 694969 - DNA, 25 bp, Mus musculus
gctgtgctgagggtctactttgatg

SEQ ID NO: 694970 - DNA, 25 bp, Mus musculus
gctgtgctgcagaatcgttatgaga

SEQ ID NO: 694971 - DNA, 25 bp, Mus musculus
gctgtgctgcagtatcgttatgaga

SEQ ID NO: 694972 - DNA, 25 bp, Mus musculus
gctgtgctgcccattggagggacat

SEQ ID NO: 694973 - DNA, 25 bp, Mus musculus
gctgtgctgccctttggagggacat

SEQ ID NO: 694974 - DNA, 25 bp, Mus musculus
gctgtgctggtcacagccactctct

SEQ ID NO: 694975 - DNA, 25 bp, Mus musculus
gctgtgctggtctcagccactctct

SEQ ID NO: 694976 - DNA, 25 bp, Mus musculus
gctgtgctgtcactcttccagtcca

SEQ ID NO: 694977 - DNA, 25 bp, Mus musculus
gctgtgctgtcagtcttccagtcca

SEQ ID NO: 694978 - DNA, 25 bp, Mus musculus
gctgtgcttacccatgtctcctgtg

SEQ ID NO: 694979 - DNA, 25 bp, Mus musculus
gctgtgcttaccgatgtctcctgtg

SEQ ID NO: 694980 - DNA, 25 bp, Mus musculus
gctgtgcttctcactacgctacgtg

SEQ ID NO: 694981 - DNA, 25 bp, Mus musculus
gctgtgcttctctctacgctacgtg

SEQ ID NO: 694982 - DNA, 25 bp, Mus musculus
gctgtgcttgccagacctggctcca

SEQ ID NO: 694983 - DNA, 25 bp, Mus musculus
gctgtgcttgcctgacctggctcca

SEQ ID NO: 694984 - DNA, 25 bp, Mus musculus
gctgtggaaagccaataagtgaaga

SEQ ID NO: 694985 - DNA, 25 bp, Mus musculus
gctgtggaaagcgaataagtgaaga

SEQ ID NO: 694986 - DNA, 25 bp, Mus musculus
gctgtggaaagtatcctccgaggga

SEQ ID NO: 694987 - DNA, 25 bp, Mus musculus
gctgtggaaagtttcctccgaggga

SEQ ID NO: 694988 - DNA, 25 bp, Mus musculus
gctgtggaaataatgcatatctcac

SEQ ID NO: 694989 - DNA, 25 bp, Mus musculus
gctgtggaaatattgcatatctcac

SEQ ID NO: 694990 - DNA, 25 bp, Mus musculus
gctgtggaacacatacctctgcatc

SEQ ID NO: 694991 - DNA, 25 bp, Mus musculus
gctgtggaacacatcaacaagactc

SEQ ID NO: 694992 - DNA, 25 bp, Mus musculus
gctgtggaacacttacctctgcatc

SEQ ID NO: 694993 - DNA, 25 bp, Mus musculus
gctgtggaacacttcaacaagactc

SEQ ID NO: 694994 - DNA, 25 bp, Mus musculus
gctgtggaacgccaactttcggtat

SEQ ID NO: 694995 - DNA, 25 bp, Mus musculus
gctgtggaacgcgaactttcggtat

SEQ ID NO: 694996 - DNA, 25 bp, Mus musculus
gctgtggaattcacctggcaggaat

SEQ ID NO: 694997 - DNA, 25 bp, Mus musculus
gctgtggaattctcctggcaggaat

SEQ ID NO: 694998 - DNA, 25 bp, Mus musculus
gctgtggaatttacagcatagccca

SEQ ID NO: 694999 - DNA, 25 bp, Mus musculus
gctgtggaattttcagcatagccca

SEQ ID NO: 695000 - DNA, 25 bp, Mus musculus
gctgtggaccatacggagatctgcc

SEQ ID NO: 695001 - DNA, 25 bp, Mus musculus
gctgtggaccattcggagatctgcc

SEQ ID NO: 695002 - DNA, 25 bp, Mus musculus
gctgtggacgaacactgtagagact

SEQ ID NO: 695003 - DNA, 25 bp, Mus musculus
gctgtggacgaagactgtagagact

SEQ ID NO: 695004 - DNA, 25 bp, Mus musculus
gctgtggactggaatgcaatcagca

SEQ ID NO: 695005 - DNA, 25 bp, Mus musculus
gctgtggactggtatgcaatcagca

SEQ ID NO: 695006 - DNA, 25 bp, Mus musculus
gctgtggagagcacccccaggcagc

SEQ ID NO: 695007 - DNA, 25 bp, Mus musculus
gctgtggagagctcccccaggcagc

SEQ ID NO: 695008 - DNA, 25 bp, Mus musculus
gctgtggagccaaggatgatgccca

SEQ ID NO: 695009 - DNA, 25 bp, Mus musculus
gctgtggagccatggatgatgccca

SEQ ID NO: 695010 - DNA, 25 bp, Mus musculus
gctgtggaggaacttcagagcataa

SEQ ID NO: 695011 - DNA, 25 bp, Mus musculus
gctgtggaggaagttcagagcataa

SEQ ID NO: 695012 - DNA, 25 bp, Mus musculus
gctgtggataaacctaatggctact

SEQ ID NO: 695013 - DNA, 25 bp, Mus musculus
gctgtggataaagctaatggctact

SEQ ID NO: 695014 - DNA, 25 bp, Mus musculus
gctgtggatcccaaaggaagagctg

SEQ ID NO: 695015 - DNA, 25 bp, Mus musculus
gctgtggatccctaaggaagagctg

SEQ ID NO: 695016 - DNA, 25 bp, Mus musculus
gctgtggatcctcaagtcaacatga

SEQ ID NO: 695017 - DNA, 25 bp, Mus musculus
gctgtggatcctgaagtcaacatga

SEQ ID NO: 695018 - DNA, 25 bp, Mus musculus
gctgtggattatcatggagtacctg

SEQ ID NO: 695019 - DNA, 25 bp, Mus musculus
gctgtggattatgatggagtacctg

SEQ ID NO: 695020 - DNA, 25 bp, Mus musculus
gctgtggcaaatcaaactggagcct

SEQ ID NO: 695021 - DNA, 25 bp, Mus musculus
gctgtggcaaatgaaactggagcct

SEQ ID NO: 695022 - DNA, 25 bp, Mus musculus
gctgtggcacccagcagagccgtag

SEQ ID NO: 695023 - DNA, 25 bp, Mus musculus
gctgtggcaccctgcagagccgtag

SEQ ID NO: 695024 - DNA, 25 bp, Mus musculus
gctgtggcagagattctcaggagca

SEQ ID NO: 695025 - DNA, 25 bp, Mus musculus
gctgtggcagagtttctcaggagca

SEQ ID NO: 695026 - DNA, 25 bp, Mus musculus
gctgtggccattctccgaccctgtt

SEQ ID NO: 695027 - DNA, 25 bp, Mus musculus
gctgtggccattgtccgaccctgtt

SEQ ID NO: 695028 - DNA, 25 bp, Mus musculus
gctgtggccgcaacctgtgattaaa

SEQ ID NO: 695029 - DNA, 25 bp, Mus musculus
gctgtggccgcatcctgtgattaaa

SEQ ID NO: 695030 - DNA, 25 bp, Mus musculus
gctgtggctcacatccaagggcagt

SEQ ID NO: 695031 - DNA, 25 bp, Mus musculus
gctgtggctcacttccaagggcagt

SEQ ID NO: 695032 - DNA, 25 bp, Mus musculus
gctgtggctctgcatacctatgaga

SEQ ID NO: 695033 - DNA, 25 bp, Mus musculus
gctgtggctctggatacctatgaga

SEQ ID NO: 695034 - DNA, 25 bp, Mus musculus
gctgtggctgacaacgtcgtcctcg

SEQ ID NO: 695035 - DNA, 25 bp, Mus musculus
gctgtggctgacctctggaaaccct

SEQ ID NO: 695036 - DNA, 25 bp, Mus musculus
gctgtggctgacgtctggaaaccct

SEQ ID NO: 695037 - DNA, 25 bp, Mus musculus
gctgtggctgactacgtcgtcctcg

SEQ ID NO: 695038 - DNA, 25 bp, Mus musculus
gctgtggctgttcagataaatccac

SEQ ID NO: 695039 - DNA, 25 bp, Mus musculus
gctgtggctgttgagataaatccac

SEQ ID NO: 695040 - DNA, 25 bp, Mus musculus
gctgtggcttggctttgacctgaca

SEQ ID NO: 695041 - DNA, 25 bp, Mus musculus
gctgtggcttgggtttgacctgaca

SEQ ID NO: 695042 - DNA, 25 bp, Mus musculus
gctgtgggaaaaccttactggctaa

SEQ ID NO: 695043 - DNA, 25 bp, Mus musculus
gctgtgggaaaagcttactggctaa

SEQ ID NO: 695044 - DNA, 25 bp, Mus musculus
gctgtgggaaatcccgcagatatcc

SEQ ID NO: 695045 - DNA, 25 bp, Mus musculus
gctgtgggaaatgccgcagatatcc

SEQ ID NO: 695046 - DNA, 25 bp, Mus musculus
gctgtgggacttacgccatctttgc

SEQ ID NO: 695047 - DNA, 25 bp, Mus musculus
gctgtgggactttcgccatctttgc

SEQ ID NO: 695048 - DNA, 25 bp, Mus musculus
gctgtgggcaatcgacttgcctcct

SEQ ID NO: 695049 - DNA, 25 bp, Mus musculus
gctgtgggcaatggacttgcctcct

SEQ ID NO: 695050 - DNA, 25 bp, Mus musculus
gctgtgggcgccacaacaagccagg

SEQ ID NO: 695051 - DNA, 25 bp, Mus musculus
gctgtgggcgcctcaacaagccagg

SEQ ID NO: 695052 - DNA, 25 bp, Mus musculus
gctgtgggggtcattgtcaacttga

SEQ ID NO: 695053 - DNA, 25 bp, Mus musculus
gctgtgggggtctttgtcaacttga

SEQ ID NO: 695054 - DNA, 25 bp, Mus musculus
gctgtggtagagatccttcttcaga

SEQ ID NO: 695055 - DNA, 25 bp, Mus musculus
gctgtggtagagttccttcttcaga

SEQ ID NO: 695056 - DNA, 25 bp, Mus musculus
gctgtggtcacaactgcaaggaggc

SEQ ID NO: 695057 - DNA, 25 bp, Mus musculus
gctgtggtcacatctgcaaggaggc

SEQ ID NO: 695058 - DNA, 25 bp, Mus musculus
gctgtggtccggaacatcctgcgtc

SEQ ID NO: 695059 - DNA, 25 bp, Mus musculus
gctgtggtccggtacatcctgcgtc

SEQ ID NO: 695060 - DNA, 25 bp, Mus musculus
gctgtggtcctcatgctggccttcg

SEQ ID NO: 695061 - DNA, 25 bp, Mus musculus
gctgtggtcctcttgctggccttcg

SEQ ID NO: 695062 - DNA, 25 bp, Mus musculus
gctgtggtcctgctgatcctgctga

SEQ ID NO: 695063 - DNA, 25 bp, Mus musculus
gctgtggtcctggtgatcctgctga

SEQ ID NO: 695064 - DNA, 25 bp, Mus musculus
gctgtggtgaagattgaaaaagatg

SEQ ID NO: 695065 - DNA, 25 bp, Mus musculus
gctgtggtgaagtttgaaaaagatg

SEQ ID NO: 695066 - DNA, 25 bp, Mus musculus
gctgtggtgcgcatgggaatctaca

SEQ ID NO: 695067 - DNA, 25 bp, Mus musculus
gctgtggtgcgcttgggaatctaca

SEQ ID NO: 695068 - DNA, 25 bp, Mus musculus
gctgtggtgctccatggcacagaca

SEQ ID NO: 695069 - DNA, 25 bp, Mus musculus
gctgtggtgctcgatggcacagaca

SEQ ID NO: 695070 - DNA, 25 bp, Mus musculus
gctgtggtggatactgtcttggcta

SEQ ID NO: 695071 - DNA, 25 bp, Mus musculus
gctgtggtggattctgtcttggcta

SEQ ID NO: 695072 - DNA, 25 bp, Mus musculus
gctgtggtggccatactcatgcatt

SEQ ID NO: 695073 - DNA, 25 bp, Mus musculus
gctgtggtggccttactcatgcatt

SEQ ID NO: 695074 - DNA, 25 bp, Mus musculus
gctgtggtgtacatccgagatggct

SEQ ID NO: 695075 - DNA, 25 bp, Mus musculus
gctgtggtgtacttccgagatggct

SEQ ID NO: 695076 - DNA, 25 bp, Mus musculus
gctgtggttaccagcatgagacttc

SEQ ID NO: 695077 - DNA, 25 bp, Mus musculus
gctgtggttacctgcatgagacttc

SEQ ID NO: 695078 - DNA, 25 bp, Mus musculus
gctgtggttcaaacaagatgataaa

SEQ ID NO: 695079 - DNA, 25 bp, Mus musculus
gctgtggttcaatcaagatgataaa

SEQ ID NO: 695080 - DNA, 25 bp, Mus musculus
gctgtggttcatcccacagccaaag

SEQ ID NO: 695081 - DNA, 25 bp, Mus musculus
gctgtggttcatgccacagccaaag

SEQ ID NO: 695082 - DNA, 25 bp, Mus musculus
gctgtggttcgcctggagaccatct

SEQ ID NO: 695083 - DNA, 25 bp, Mus musculus
gctgtggttcgcgtggagaccatct

SEQ ID NO: 695084 - DNA, 25 bp, Mus musculus
gctgtggtttctagttctcatctcg

SEQ ID NO: 695085 - DNA, 25 bp, Mus musculus
gctgtggtttcttgttctcatctcg

SEQ ID NO: 695086 - DNA, 25 bp, Mus musculus
gctgtgtaatatacaggccccttta

SEQ ID NO: 695087 - DNA, 25 bp, Mus musculus
gctgtgtaatattcaggccccttta

SEQ ID NO: 695088 - DNA, 25 bp, Mus musculus
gctgtgtacagaccagtcaccattg

SEQ ID NO: 695089 - DNA, 25 bp, Mus musculus
gctgtgtacagagcagtcaccattg

SEQ ID NO: 695090 - DNA, 25 bp, Mus musculus
gctgtgtactctagtccgtttgatg

SEQ ID NO: 695091 - DNA, 25 bp, Mus musculus
gctgtgtactcttgtccgtttgatg

SEQ ID NO: 695092 - DNA, 25 bp, Mus musculus
gctgtgtagcctattaaccacctga

SEQ ID NO: 695093 - DNA, 25 bp, Mus musculus
gctgtgtagccttttaaccacctga

SEQ ID NO: 695094 - DNA, 25 bp, Mus musculus
gctgtgtaggagctccttgactttg

SEQ ID NO: 695095 - DNA, 25 bp, Mus musculus
gctgtgtaggaggtccttgactttg

SEQ ID NO: 695096 - DNA, 25 bp, Mus musculus
gctgtgtcacagcacaaacactagg

SEQ ID NO: 695097 - DNA, 25 bp, Mus musculus
gctgtgtcacaggacaaacactagg

SEQ ID NO: 695098 - DNA, 25 bp, Mus musculus
gctgtgtcacggacaggcacagctc

SEQ ID NO: 695099 - DNA, 25 bp, Mus musculus
gctgtgtcacggtcaggcacagctc

SEQ ID NO: 695100 - DNA, 25 bp, Mus musculus
gctgtgtcagaacaccatggctcca

SEQ ID NO: 695101 - DNA, 25 bp, Mus musculus
gctgtgtcagaagaccatggctcca

SEQ ID NO: 695102 - DNA, 25 bp, Mus musculus
gctgtgtcagttctatcaggagcac

SEQ ID NO: 695103 - DNA, 25 bp, Mus musculus
gctgtgtcagttgtatcaggagcac

SEQ ID NO: 695104 - DNA, 25 bp, Mus musculus
gctgtgtccatgagtgatatcaatc

SEQ ID NO: 695105 - DNA, 25 bp, Mus musculus
gctgtgtccatgtgtgatatcaatc

SEQ ID NO: 695106 - DNA, 25 bp, Mus musculus
gctgtgtcccggcatgagttcttat

SEQ ID NO: 695107 - DNA, 25 bp, Mus musculus
gctgtgtcccgggatgagttcttat

SEQ ID NO: 695108 - DNA, 25 bp, Mus musculus
gctgtgtcctgacagtaagtcggat

SEQ ID NO: 695109 - DNA, 25 bp, Mus musculus
gctgtgtcctgagagtaagtcggat

SEQ ID NO: 695110 - DNA, 25 bp, Mus musculus
gctgtgtctacaaaatggaagattt

SEQ ID NO: 695111 - DNA, 25 bp, Mus musculus
gctgtgtctacataatggaagattt

SEQ ID NO: 695112 - DNA, 25 bp, Mus musculus
gctgtgtctcgtctctggagtacga

SEQ ID NO: 695113 - DNA, 25 bp, Mus musculus
gctgtgtctcgtgtctggagtacga

SEQ ID NO: 695114 - DNA, 25 bp, Mus musculus
gctgtgtctgaacatctggatatag

SEQ ID NO: 695115 - DNA, 25 bp, Mus musculus
gctgtgtctgaagatctggatatag

SEQ ID NO: 695116 - DNA, 25 bp, Mus musculus
gctgtgtgacggagtggcttcctca

SEQ ID NO: 695117 - DNA, 25 bp, Mus musculus
gctgtgtgacggtgtggcttcctca

SEQ ID NO: 695118 - DNA, 25 bp, Mus musculus
gctgtgtgactgaccccgaggaact

SEQ ID NO: 695119 - DNA, 25 bp, Mus musculus
gctgtgtgactgtccccgaggaact

SEQ ID NO: 695120 - DNA, 25 bp, Mus musculus
gctgtgtgagttcaactgcaacatc

SEQ ID NO: 695121 - DNA, 25 bp, Mus musculus
gctgtgtgagttgaactgcaacatc

SEQ ID NO: 695122 - DNA, 25 bp, Mus musculus
gctgtgtgcaatctaaggataaaga

SEQ ID NO: 695123 - DNA, 25 bp, Mus musculus
gctgtgtgcaatgtaaggataaaga

SEQ ID NO: 695124 - DNA, 25 bp, Mus musculus
gctgtgtgcgcgcaggagcgagctg

SEQ ID NO: 695125 - DNA, 25 bp, Mus musculus
gctgtgtgcgcggaggagcgagctg

SEQ ID NO: 695126 - DNA, 25 bp, Mus musculus
gctgtgtgctgtccgctctacactg

SEQ ID NO: 695127 - DNA, 25 bp, Mus musculus
gctgtgtgctgtgcgctctacactg

SEQ ID NO: 695128 - DNA, 25 bp, Mus musculus
gctgtgtgctttatgccatgatgtt

SEQ ID NO: 695129 - DNA, 25 bp, Mus musculus
gctgtgtgctttttgccatgatgtt

SEQ ID NO: 695130 - DNA, 25 bp, Mus musculus
gctgtgtggatgacttcactgcaag

SEQ ID NO: 695131 - DNA, 25 bp, Mus musculus
gctgtgtggatgtcttcactgcaag

SEQ ID NO: 695132 - DNA, 25 bp, Mus musculus
gctgtgtggtataccagagaatctt

SEQ ID NO: 695133 - DNA, 25 bp, Mus musculus
gctgtgtggtattccagagaatctt

SEQ ID NO: 695134 - DNA, 25 bp, Mus musculus
gctgtgtgtctactgaaccccaaga

SEQ ID NO: 695135 - DNA, 25 bp, Mus musculus
gctgtgtgtctagtgaaccccaaga

SEQ ID NO: 695136 - DNA, 25 bp, Mus musculus
gctgtgtgtgtcaggtgagcctttc

SEQ ID NO: 695137 - DNA, 25 bp, Mus musculus
gctgtgtgtgtctggtgagcctttc

SEQ ID NO: 695138 - DNA, 25 bp, Mus musculus
gctgtgtgttagagtggtctacgaa

SEQ ID NO: 695139 - DNA, 25 bp, Mus musculus
gctgtgtgttagtgtggtctacgaa

SEQ ID NO: 695140 - DNA, 25 bp, Mus musculus
gctgtgttacaccaggactcataaa

SEQ ID NO: 695141 - DNA, 25 bp, Mus musculus
gctgtgttacacgaggactcataaa

SEQ ID NO: 695142 - DNA, 25 bp, Mus musculus
gctgtgttcacgctgcctcagtttc

SEQ ID NO: 695143 - DNA, 25 bp, Mus musculus
gctgtgttcacggtgcctcagtttc

SEQ ID NO: 695144 - DNA, 25 bp, Mus musculus
gctgtgttccatacagttcagaaca

SEQ ID NO: 695145 - DNA, 25 bp, Mus musculus
gctgtgttccattcagttcagaaca

SEQ ID NO: 695146 - DNA, 25 bp, Mus musculus
gctgtgttccgcagggctgtactac

SEQ ID NO: 695147 - DNA, 25 bp, Mus musculus
gctgtgttccgctgggctgtactac

SEQ ID NO: 695148 - DNA, 25 bp, Mus musculus
gctgtgttgactagaaccttgcccc

SEQ ID NO: 695149 - DNA, 25 bp, Mus musculus
gctgtgttgacttgaaccttgcccc

SEQ ID NO: 695150 - DNA, 25 bp, Mus musculus
gctgtgtttggtcgaatctattgtc

SEQ ID NO: 695151 - DNA, 25 bp, Mus musculus
gctgtgtttggtggaatctattgtc

SEQ ID NO: 695152 - DNA, 25 bp, Mus musculus
gctgtgttttcacaagtagcacgca

SEQ ID NO: 695153 - DNA, 25 bp, Mus musculus
gctgtgttttcagaagtagcacgca

SEQ ID NO: 695154 - DNA, 25 bp, Mus musculus
gctgtgttttctctgtcaagtactg

SEQ ID NO: 695155 - DNA, 25 bp, Mus musculus
gctgtgttttctgtgtcaagtactg

SEQ ID NO: 695156 - DNA, 25 bp, Mus musculus
gctgttaaagatcttcctaaggttc

SEQ ID NO: 695157 - DNA, 25 bp, Mus musculus
gctgttaaagatgttcctaaggttc

SEQ ID NO: 695158 - DNA, 25 bp, Mus musculus
gctgttaaaggcaaatacaagtttc

SEQ ID NO: 695159 - DNA, 25 bp, Mus musculus
gctgttaaaggctaatacaagtttc

SEQ ID NO: 695160 - DNA, 25 bp, Mus musculus
gctgttaaagtgacatctgacaaca

SEQ ID NO: 695161 - DNA, 25 bp, Mus musculus
gctgttaaagtgtcatctgacaaca

SEQ ID NO: 695162 - DNA, 25 bp, Mus musculus
gctgttaagcacatgagttagccat

SEQ ID NO: 695163 - DNA, 25 bp, Mus musculus
gctgttaagcacttgagttagccat

SEQ ID NO: 695164 - DNA, 25 bp, Mus musculus
gctgttaatacacgaaacagttgca

SEQ ID NO: 695165 - DNA, 25 bp, Mus musculus
gctgttaatacaggaaacagttgca

SEQ ID NO: 695166 - DNA, 25 bp, Mus musculus
gctgttacagttcccctttgtggcc

SEQ ID NO: 695167 - DNA, 25 bp, Mus musculus
gctgttacagttgccctttgtggcc

SEQ ID NO: 695168 - DNA, 25 bp, Mus musculus
gctgttactcttctgagcccctgag

SEQ ID NO: 695169 - DNA, 25 bp, Mus musculus
gctgttactcttgtgagcccctgag

SEQ ID NO: 695170 - DNA, 25 bp, Mus musculus
gctgttagaactctgccctgtgccc

SEQ ID NO: 695171 - DNA, 25 bp, Mus musculus
gctgttagaactgtgccctgtgccc

SEQ ID NO: 695172 - DNA, 25 bp, Mus musculus
gctgttagcactcaatcccgatgca

SEQ ID NO: 695173 - DNA, 25 bp, Mus musculus
gctgttagcactgaatcccgatgca

SEQ ID NO: 695174 - DNA, 25 bp, Mus musculus
gctgttatccgtcccatgcctgtct

SEQ ID NO: 695175 - DNA, 25 bp, Mus musculus
gctgttatccgtgccatgcctgtct

SEQ ID NO: 695176 - DNA, 25 bp, Mus musculus
gctgttatcgaacgcagtcggcaca

SEQ ID NO: 695177 - DNA, 25 bp, Mus musculus
gctgttatcgaaggcagtcggcaca

SEQ ID NO: 695178 - DNA, 25 bp, Mus musculus
gctgttatcttcacgaattttagca

SEQ ID NO: 695179 - DNA, 25 bp, Mus musculus
gctgttatcttctcgaattttagca

SEQ ID NO: 695180 - DNA, 25 bp, Mus musculus
gctgttatgatcaggtgaccagttt

SEQ ID NO: 695181 - DNA, 25 bp, Mus musculus
gctgttatgatctggtgaccagttt

SEQ ID NO: 695182 - DNA, 25 bp, Mus musculus
gctgttattgttacagctcagctgg

SEQ ID NO: 695183 - DNA, 25 bp, Mus musculus
gctgttattgtttcagctcagctgg

SEQ ID NO: 695184 - DNA, 25 bp, Mus musculus
gctgttcagcagacatgacccacaa

SEQ ID NO: 695185 - DNA, 25 bp, Mus musculus
gctgttcagcagtcatgacccacaa

SEQ ID NO: 695186 - DNA, 25 bp, Mus musculus
gctgttcatctacttcaggaaccag

SEQ ID NO: 695187 - DNA, 25 bp, Mus musculus
gctgttcatctagttcaggaaccag

SEQ ID NO: 695188 - DNA, 25 bp, Mus musculus
gctgttcatgagaggaacccatgct

SEQ ID NO: 695189 - DNA, 25 bp, Mus musculus
gctgttcatgagtggaacccatgct

SEQ ID NO: 695190 - DNA, 25 bp, Mus musculus
gctgttcattgaaggcctatacctc

SEQ ID NO: 695191 - DNA, 25 bp, Mus musculus
gctgttcattgatggcctatacctc

SEQ ID NO: 695192 - DNA, 25 bp, Mus musculus
gctgttccagcgagatcccagtgat

SEQ ID NO: 695193 - DNA, 25 bp, Mus musculus
gctgttccagcgcttcttttacact

SEQ ID NO: 695194 - DNA, 25 bp, Mus musculus
gctgttccagcggttcttttacact

SEQ ID NO: 695195 - DNA, 25 bp, Mus musculus
gctgttccagcgtgatcccagtgat

SEQ ID NO: 695196 - DNA, 25 bp, Mus musculus
gctgttccctcgctggcttcagtga

SEQ ID NO: 695197 - DNA, 25 bp, Mus musculus
gctgttccctcggtggcttcagtga

SEQ ID NO: 695198 - DNA, 25 bp, Mus musculus
gctgttccggccagtggccgcagat

SEQ ID NO: 695199 - DNA, 25 bp, Mus musculus
gctgttccggcctgtggccgcagat

SEQ ID NO: 695200 - DNA, 25 bp, Mus musculus
gctgttcctatcaagatgggagctc

SEQ ID NO: 695201 - DNA, 25 bp, Mus musculus
gctgttcctatctagatgggagctc

SEQ ID NO: 695202 - DNA, 25 bp, Mus musculus
gctgttcctcatctaaggccacgct

SEQ ID NO: 695203 - DNA, 25 bp, Mus musculus
gctgttcctcatgtaaggccacgct

SEQ ID NO: 695204 - DNA, 25 bp, Mus musculus
gctgttcctctgaacaatctacaag

SEQ ID NO: 695205 - DNA, 25 bp, Mus musculus
gctgttcctctgtacaatctacaag

SEQ ID NO: 695206 - DNA, 25 bp, Mus musculus
gctgttcctggtcagagtgcatctg

SEQ ID NO: 695207 - DNA, 25 bp, Mus musculus
gctgttcctggtgagagtgcatctg

SEQ ID NO: 695208 - DNA, 25 bp, Mus musculus
gctgttcgagaacgttctccagcca

SEQ ID NO: 695209 - DNA, 25 bp, Mus musculus
gctgttcgagaaggttctccagcca

SEQ ID NO: 695210 - DNA, 25 bp, Mus musculus
gctgttcggcatcaagtgtgcccag

SEQ ID NO: 695211 - DNA, 25 bp, Mus musculus
gctgttcggcatgaagtgtgcccag

SEQ ID NO: 695212 - DNA, 25 bp, Mus musculus
gctgttctaagtagtccactggcat

SEQ ID NO: 695213 - DNA, 25 bp, Mus musculus
gctgttctaagttgtccactggcat

SEQ ID NO: 695214 - DNA, 25 bp, Mus musculus
gctgttctacgcagcctactagcct

SEQ ID NO: 695215 - DNA, 25 bp, Mus musculus
gctgttctacgctgcctactagcct

SEQ ID NO: 695216 - DNA, 25 bp, Mus musculus
gctgttctcgctatctccccagtat

SEQ ID NO: 695217 - DNA, 25 bp, Mus musculus
gctgttctcgctttctccccagtat

SEQ ID NO: 695218 - DNA, 25 bp, Mus musculus
gctgttctgaatagcccagcctgta

SEQ ID NO: 695219 - DNA, 25 bp, Mus musculus
gctgttctgaattgcccagcctgta

SEQ ID NO: 695220 - DNA, 25 bp, Mus musculus
gctgttctggctcaggccatctatg

SEQ ID NO: 695221 - DNA, 25 bp, Mus musculus
gctgttctggctgaggccatctatg

SEQ ID NO: 695222 - DNA, 25 bp, Mus musculus
gctgttctgtggctcattggataat

SEQ ID NO: 695223 - DNA, 25 bp, Mus musculus
gctgttctgtgggtcattggataat

SEQ ID NO: 695224 - DNA, 25 bp, Mus musculus
gctgttctgttcagtggttcctcac

SEQ ID NO: 695225 - DNA, 25 bp, Mus musculus
gctgttctgttctgtggttcctcac

SEQ ID NO: 695226 - DNA, 25 bp, Mus musculus
gctgttcttcatcccgggcgtggtt

SEQ ID NO: 695227 - DNA, 25 bp, Mus musculus
gctgttcttcatgccgggcgtggtt

SEQ ID NO: 695228 - DNA, 25 bp, Mus musculus
gctgttcttcgactggctgggcctt

SEQ ID NO: 695229 - DNA, 25 bp, Mus musculus
gctgttcttcgagtggctgggcctt

SEQ ID NO: 695230 - DNA, 25 bp, Mus musculus
gctgttcttgtgacttctgcggcga

SEQ ID NO: 695231 - DNA, 25 bp, Mus musculus
gctgttcttgtgtcttctgcggcga

SEQ ID NO: 695232 - DNA, 25 bp, Mus musculus
gctgttgaacatcactactttacct

SEQ ID NO: 695233 - DNA, 25 bp, Mus musculus
gctgttgaacatgactactttacct

SEQ ID NO: 695234 - DNA, 25 bp, Mus musculus
gctgttgaagaaattccccttgtgt

SEQ ID NO: 695235 - DNA, 25 bp, Mus musculus
gctgttgaagaatttccccttgtgt

SEQ ID NO: 695236 - DNA, 25 bp, Mus musculus
gctgttgaccagctcctacctgtca

SEQ ID NO: 695237 - DNA, 25 bp, Mus musculus
gctgttgaccaggtcctacctgtca

SEQ ID NO: 695238 - DNA, 25 bp, Mus musculus
gctgttgaccggaagaacgttgttt

SEQ ID NO: 695239 - DNA, 25 bp, Mus musculus
gctgttgaccggtagaacgttgttt

SEQ ID NO: 695240 - DNA, 25 bp, Mus musculus
gctgttgacggtcactttgcattaa

SEQ ID NO: 695241 - DNA, 25 bp, Mus musculus
gctgttgacggtgactttgcattaa

SEQ ID NO: 695242 - DNA, 25 bp, Mus musculus
gctgttgacttgatcaaacaactat

SEQ ID NO: 695243 - DNA, 25 bp, Mus musculus
gctgttgacttgttcaaacaactat

SEQ ID NO: 695244 - DNA, 25 bp, Mus musculus
gctgttgagaacagtccaggcctct

SEQ ID NO: 695245 - DNA, 25 bp, Mus musculus
gctgttgagaactgtccaggcctct

SEQ ID NO: 695246 - DNA, 25 bp, Mus musculus
gctgttgagttaacccaacttaaag

SEQ ID NO: 695247 - DNA, 25 bp, Mus musculus
gctgttgagttatcccaacttaaag

SEQ ID NO: 695248 - DNA, 25 bp, Mus musculus
gctgttgccaatactgtaaggtaga

SEQ ID NO: 695249 - DNA, 25 bp, Mus musculus
gctgttgccaattctgtaaggtaga

SEQ ID NO: 695250 - DNA, 25 bp, Mus musculus
gctgttgccactcaagagcacagcc

SEQ ID NO: 695251 - DNA, 25 bp, Mus musculus
gctgttgccactgaagagcacagcc

SEQ ID NO: 695252 - DNA, 25 bp, Mus musculus
gctgttgcccagaagttcatgtgtt

SEQ ID NO: 695253 - DNA, 25 bp, Mus musculus
gctgttgcccagtagttcatgtgtt

SEQ ID NO: 695254 - DNA, 25 bp, Mus musculus
gctgttgcgggcataccaagcccga

SEQ ID NO: 695255 - DNA, 25 bp, Mus musculus
gctgttgcgggcttaccaagcccga

SEQ ID NO: 695256 - DNA, 25 bp, Mus musculus
gctgttgctcttctacctgattcgg

SEQ ID NO: 695257 - DNA, 25 bp, Mus musculus
gctgttgctcttgtacctgattcgg

SEQ ID NO: 695258 - DNA, 25 bp, Mus musculus
gctgttggaaacatgtgacttagaa

SEQ ID NO: 695259 - DNA, 25 bp, Mus musculus
gctgttggaaacttgtgacttagaa

SEQ ID NO: 695260 - DNA, 25 bp, Mus musculus
gctgttggaacacatctcttccctg

SEQ ID NO: 695261 - DNA, 25 bp, Mus musculus
gctgttggaacagatctcttccctg

SEQ ID NO: 695262 - DNA, 25 bp, Mus musculus
gctgttggaggtacctgcactggca

SEQ ID NO: 695263 - DNA, 25 bp, Mus musculus
gctgttggaggttcctgcactggca

SEQ ID NO: 695264 - DNA, 25 bp, Mus musculus
gctgttggcccgagactttgagaag

SEQ ID NO: 695265 - DNA, 25 bp, Mus musculus
gctgttggcccgtgactttgagaag

SEQ ID NO: 695266 - DNA, 25 bp, Mus musculus
gctgttggccgactcaccctggctt

SEQ ID NO: 695267 - DNA, 25 bp, Mus musculus
gctgttggccgagtcaccctggctt

SEQ ID NO: 695268 - DNA, 25 bp, Mus musculus
gctgttggcctcagcttctacttgg

SEQ ID NO: 695269 - DNA, 25 bp, Mus musculus
gctgttggcctctgcttctacttgg

SEQ ID NO: 695270 - DNA, 25 bp, Mus musculus
gctgttggccttaaagacctgggtt

SEQ ID NO: 695271 - DNA, 25 bp, Mus musculus
gctgttggcctttaagacctgggtt

SEQ ID NO: 695272 - DNA, 25 bp, Mus musculus
gctgttggcggcagcagaaccagat

SEQ ID NO: 695273 - DNA, 25 bp, Mus musculus
gctgttggcggctgcagaaccagat

SEQ ID NO: 695274 - DNA, 25 bp, Mus musculus
gctgttggctttaataaagggcctc

SEQ ID NO: 695275 - DNA, 25 bp, Mus musculus
gctgttggcttttataaagggcctc

SEQ ID NO: 695276 - DNA, 25 bp, Mus musculus
gctgttgggagcatgaagaccataa

SEQ ID NO: 695277 - DNA, 25 bp, Mus musculus
gctgttgggagcttgaagaccataa

SEQ ID NO: 695278 - DNA, 25 bp, Mus musculus
gctgttggtgtgcagcaactacacc

SEQ ID NO: 695279 - DNA, 25 bp, Mus musculus
gctgttggtgtggagcaactacacc

SEQ ID NO: 695280 - DNA, 25 bp, Mus musculus
gctgttgtagaccttcagaggtgat

SEQ ID NO: 695281 - DNA, 25 bp, Mus musculus
gctgttgtagacgttcagaggtgat

SEQ ID NO: 695282 - DNA, 25 bp, Mus musculus
gctgttgtagtcaccggtgcaggaa

SEQ ID NO: 695283 - DNA, 25 bp, Mus musculus
gctgttgtagtctccggtgcaggaa

SEQ ID NO: 695284 - DNA, 25 bp, Mus musculus
gctgttgtccgaaacactcagatca

SEQ ID NO: 695285 - DNA, 25 bp, Mus musculus
gctgttgtccgatacactcagatca

SEQ ID NO: 695286 - DNA, 25 bp, Mus musculus
gctgttgtctgcagacctggtcaga

SEQ ID NO: 695287 - DNA, 25 bp, Mus musculus
gctgttgtctgctgacctggtcaga

SEQ ID NO: 695288 - DNA, 25 bp, Mus musculus
gctgttgtgaagagctcgtacttct

SEQ ID NO: 695289 - DNA, 25 bp, Mus musculus
gctgttgtgaagtgctcgtacttct

SEQ ID NO: 695290 - DNA, 25 bp, Mus musculus
gctgttgtgtacactccagggcaag

SEQ ID NO: 695291 - DNA, 25 bp, Mus musculus
gctgttgtgtacctgagcctggaca

SEQ ID NO: 695292 - DNA, 25 bp, Mus musculus
gctgttgtgtacgtgagcctggaca

SEQ ID NO: 695293 - DNA, 25 bp, Mus musculus
gctgttgtgtactctccagggcaag

SEQ ID NO: 695294 - DNA, 25 bp, Mus musculus
gctgttgtgttgacgctgctcgcga

SEQ ID NO: 695295 - DNA, 25 bp, Mus musculus
gctgttgtgttgtcgctgctcgcga

SEQ ID NO: 695296 - DNA, 25 bp, Mus musculus
gctgttgttcttacagtctgaaagc

SEQ ID NO: 695297 - DNA, 25 bp, Mus musculus
gctgttgttctttcagtctgaaagc

SEQ ID NO: 695298 - DNA, 25 bp, Mus musculus
gctgttgttggacacacgttccccg

SEQ ID NO: 695299 - DNA, 25 bp, Mus musculus
gctgttgttggagacacgttccccg

SEQ ID NO: 695300 - DNA, 25 bp, Mus musculus
gctgtttaatcaagaggacccaagt

SEQ ID NO: 695301 - DNA, 25 bp, Mus musculus
gctgtttaatcatgaggacccaagt

SEQ ID NO: 695302 - DNA, 25 bp, Mus musculus
gctgtttacctaagacaatgctgcg

SEQ ID NO: 695303 - DNA, 25 bp, Mus musculus
gctgtttacctatgacaatgctgcg

SEQ ID NO: 695304 - DNA, 25 bp, Mus musculus
gctgtttattgacaagttggattca

SEQ ID NO: 695305 - DNA, 25 bp, Mus musculus
gctgtttattgagaagttggattca

SEQ ID NO: 695306 - DNA, 25 bp, Mus musculus
gctgtttcaggaaagtgagactcaa

SEQ ID NO: 695307 - DNA, 25 bp, Mus musculus
gctgtttcaggatagtgagactcaa

SEQ ID NO: 695308 - DNA, 25 bp, Mus musculus
gctgtttccgacactggcatcgttg

SEQ ID NO: 695309 - DNA, 25 bp, Mus musculus
gctgtttccgactctggcatcgttg

SEQ ID NO: 695310 - DNA, 25 bp, Mus musculus
gctgtttccgatcctggtcccgtcg

SEQ ID NO: 695311 - DNA, 25 bp, Mus musculus
gctgtttccgatgctggtcccgtcg

SEQ ID NO: 695312 - DNA, 25 bp, Mus musculus
gctgtttcgcatccaatagactagg

SEQ ID NO: 695313 - DNA, 25 bp, Mus musculus
gctgtttcgcatgcaatagactagg

SEQ ID NO: 695314 - DNA, 25 bp, Mus musculus
gctgtttgaaaacctggaacttgtg

SEQ ID NO: 695315 - DNA, 25 bp, Mus musculus
gctgtttgaaaagctggaacttgtg

SEQ ID NO: 695316 - DNA, 25 bp, Mus musculus
gctgtttgccacaccgatgcctata

SEQ ID NO: 695317 - DNA, 25 bp, Mus musculus
gctgtttgccactccgatgcctata

SEQ ID NO: 695318 - DNA, 25 bp, Mus musculus
gctgtttgctacagttgtccacccc

SEQ ID NO: 695319 - DNA, 25 bp, Mus musculus
gctgtttgctactgttgtccacccc

SEQ ID NO: 695320 - DNA, 25 bp, Mus musculus
gctgtttgctcccttttcatgacga

SEQ ID NO: 695321 - DNA, 25 bp, Mus musculus
gctgtttgctccgttttcatgacga

SEQ ID NO: 695322 - DNA, 25 bp, Mus musculus
gctgtttgctctatgcctgcttcat

SEQ ID NO: 695323 - DNA, 25 bp, Mus musculus
gctgtttgctctttgcctgcttcat

SEQ ID NO: 695324 - DNA, 25 bp, Mus musculus
gctgtttgcttcagggctaaagaga

SEQ ID NO: 695325 - DNA, 25 bp, Mus musculus
gctgtttgcttctgggctaaagaga

SEQ ID NO: 695326 - DNA, 25 bp, Mus musculus
gctgtttggagaacctagagcagat

SEQ ID NO: 695327 - DNA, 25 bp, Mus musculus
gctgtttggagatcctagagcagat

SEQ ID NO: 695328 - DNA, 25 bp, Mus musculus
gctgtttggccacaatgatgaattg

SEQ ID NO: 695329 - DNA, 25 bp, Mus musculus
gctgtttggccagaatgatgaattg

SEQ ID NO: 695330 - DNA, 25 bp, Mus musculus
gctgtttggtctcgacatcaaaggc

SEQ ID NO: 695331 - DNA, 25 bp, Mus musculus
gctgtttggtctggacatcaaaggc

SEQ ID NO: 695332 - DNA, 25 bp, Mus musculus
gctgtttgtgatctgctaattttca

SEQ ID NO: 695333 - DNA, 25 bp, Mus musculus
gctgtttgtgatgtgctaattttca

SEQ ID NO: 695334 - DNA, 25 bp, Mus musculus
gctgttttacatctatacttctggg

SEQ ID NO: 695335 - DNA, 25 bp, Mus musculus
gctgttttacatgtatacttctggg

SEQ ID NO: 695336 - DNA, 25 bp, Mus musculus
gctgtttttaagactctgaggatgg

SEQ ID NO: 695337 - DNA, 25 bp, Mus musculus
gctgtttttaagtctctgaggatgg

SEQ ID NO: 695338 - DNA, 25 bp, Mus musculus
gctgtttttcataatactttatacc

SEQ ID NO: 695339 - DNA, 25 bp, Mus musculus
gctgtttttcattatactttatacc

SEQ ID NO: 695340 - DNA, 25 bp, Mus musculus
gctgtttttggaccgctttagagga

SEQ ID NO: 695341 - DNA, 25 bp, Mus musculus
gctgtttttggagcgctttagagga

SEQ ID NO: 695342 - DNA, 25 bp, Mus musculus
gcttaaaaagcaccgaggttgccaa

SEQ ID NO: 695343 - DNA, 25 bp, Mus musculus
gcttaaaaagcagcgaggttgccaa

SEQ ID NO: 695344 - DNA, 25 bp, Mus musculus
gcttaaaacccaccaactgcaatgg

SEQ ID NO: 695345 - DNA, 25 bp, Mus musculus
gcttaaaacccagcaactgcaatgg

SEQ ID NO: 695346 - DNA, 25 bp, Mus musculus
gcttaaaagccgagtcctctgatgg

SEQ ID NO: 695347 - DNA, 25 bp, Mus musculus
gcttaaaagccgtgtcctctgatgg

SEQ ID NO: 695348 - DNA, 25 bp, Mus musculus
gcttaaaatttgaagggatcgtaga

SEQ ID NO: 695349 - DNA, 25 bp, Mus musculus
gcttaaaatttgtagggatcgtaga

SEQ ID NO: 695350 - DNA, 25 bp, Mus musculus
gcttaaagaaaaacccatggtcatg

SEQ ID NO: 695351 - DNA, 25 bp, Mus musculus
gcttaaagaaaatcccatggtcatg

SEQ ID NO: 695352 - DNA, 25 bp, Mus musculus
gcttaaccaataaccagtggcttgg

SEQ ID NO: 695353 - DNA, 25 bp, Mus musculus
gcttaaccaatatccagtggcttgg

SEQ ID NO: 695354 - DNA, 25 bp, Mus musculus
gcttaacccagtccgtgctgagtgt

SEQ ID NO: 695355 - DNA, 25 bp, Mus musculus
gcttaacccagtgcgtgctgagtgt

SEQ ID NO: 695356 - DNA, 25 bp, Mus musculus
gcttaaccccgacgcttcgcttgaa

SEQ ID NO: 695357 - DNA, 25 bp, Mus musculus
gcttaaccccgaggcttcgcttgaa

SEQ ID NO: 695358 - DNA, 25 bp, Mus musculus
gcttaacgatgtagataccttctga

SEQ ID NO: 695359 - DNA, 25 bp, Mus musculus
gcttaacgatgttgataccttctga

SEQ ID NO: 695360 - DNA, 25 bp, Mus musculus
gcttaagacagaagaacaagtcttt

SEQ ID NO: 695361 - DNA, 25 bp, Mus musculus
gcttaagacagatgaacaagtcttt

SEQ ID NO: 695362 - DNA, 25 bp, Mus musculus
gcttaagacctgaatcacacttgtg

SEQ ID NO: 695363 - DNA, 25 bp, Mus musculus
gcttaagacctgtatcacacttgtg

SEQ ID NO: 695364 - DNA, 25 bp, Mus musculus
gcttaagagcttcgacgatcactat

SEQ ID NO: 695365 - DNA, 25 bp, Mus musculus
gcttaagagcttggacgatcactat

SEQ ID NO: 695366 - DNA, 25 bp, Mus musculus
gcttaagccacaacctctgctcaga

SEQ ID NO: 695367 - DNA, 25 bp, Mus musculus
gcttaagccacatcctctgctcaga

SEQ ID NO: 695368 - DNA, 25 bp, Mus musculus
gcttaagcgacacgtctccagatga

SEQ ID NO: 695369 - DNA, 25 bp, Mus musculus
gcttaagcgacaggtctccagatga

SEQ ID NO: 695370 - DNA, 25 bp, Mus musculus
gcttaagctccacctgcagagcaac

SEQ ID NO: 695371 - DNA, 25 bp, Mus musculus
gcttaagctccagctgcagagcaac

SEQ ID NO: 695372 - DNA, 25 bp, Mus musculus
gcttaaggaactatccaggaagcca

SEQ ID NO: 695373 - DNA, 25 bp, Mus musculus
gcttaaggaactttccaggaagcca

SEQ ID NO: 695374 - DNA, 25 bp, Mus musculus
gcttaaggaagcacagttggcatcc

SEQ ID NO: 695375 - DNA, 25 bp, Mus musculus
gcttaaggaagctcagttggcatcc

SEQ ID NO: 695376 - DNA, 25 bp, Mus musculus
gcttaaggtcagctggcaggactca

SEQ ID NO: 695377 - DNA, 25 bp, Mus musculus
gcttaaggtcaggtggcaggactca

SEQ ID NO: 695378 - DNA, 25 bp, Mus musculus
gcttaagtagagctgaggccaggcg

SEQ ID NO: 695379 - DNA, 25 bp, Mus musculus
gcttaagtagaggtgaggccaggcg

SEQ ID NO: 695380 - DNA, 25 bp, Mus musculus
gcttaagtctaacgaagatggtccc

SEQ ID NO: 695381 - DNA, 25 bp, Mus musculus
gcttaagtctaaggaagatggtccc

SEQ ID NO: 695382 - DNA, 25 bp, Mus musculus
gcttaagtgggactcactccagtaa

SEQ ID NO: 695383 - DNA, 25 bp, Mus musculus
gcttaagtgggagtcactccagtaa

SEQ ID NO: 695384 - DNA, 25 bp, Mus musculus
gcttaagttcttaaagatggcggcg

SEQ ID NO: 695385 - DNA, 25 bp, Mus musculus
gcttaagttctttaagatggcggcg

SEQ ID NO: 695386 - DNA, 25 bp, Mus musculus
gcttaattgtccaacttttggatga

SEQ ID NO: 695387 - DNA, 25 bp, Mus musculus
gcttaattgtcctacttttggatga

SEQ ID NO: 695388 - DNA, 25 bp, Mus musculus
gcttacaaatctcagctcagctgtg

SEQ ID NO: 695389 - DNA, 25 bp, Mus musculus
gcttacaaatctgagctcagctgtg

SEQ ID NO: 695390 - DNA, 25 bp, Mus musculus
gcttacaaccgaaatttagtttgca

SEQ ID NO: 695391 - DNA, 25 bp, Mus musculus
gcttacaaccgatatttagtttgca

SEQ ID NO: 695392 - DNA, 25 bp, Mus musculus
gcttacaagacactgacagacatgg

SEQ ID NO: 695393 - DNA, 25 bp, Mus musculus
gcttacaagacagtgacagacatgg

SEQ ID NO: 695394 - DNA, 25 bp, Mus musculus
gcttacagagcacggcccctttctg

SEQ ID NO: 695395 - DNA, 25 bp, Mus musculus
gcttacagagcagggcccctttctg

SEQ ID NO: 695396 - DNA, 25 bp, Mus musculus
gcttacaggcgtattctaggaacct

SEQ ID NO: 695397 - DNA, 25 bp, Mus musculus
gcttacaggcgttttctaggaacct

SEQ ID NO: 695398 - DNA, 25 bp, Mus musculus
gcttacagtctccagtgcgcatcct

SEQ ID NO: 695399 - DNA, 25 bp, Mus musculus
gcttacagtctcgagtgcgcatcct

SEQ ID NO: 695400 - DNA, 25 bp, Mus musculus
gcttacatcaagcaaccagagcctg

SEQ ID NO: 695401 - DNA, 25 bp, Mus musculus
gcttacatcaaggaaccagagcctg

SEQ ID NO: 695402 - DNA, 25 bp, Mus musculus
gcttacattttcagtgaatgtcaca

SEQ ID NO: 695403 - DNA, 25 bp, Mus musculus
gcttacattttctgtgaatgtcaca

SEQ ID NO: 695404 - DNA, 25 bp, Mus musculus
gcttaccaacacagctggctgcctt

SEQ ID NO: 695405 - DNA, 25 bp, Mus musculus
gcttaccaacactgctggctgcctt

SEQ ID NO: 695406 - DNA, 25 bp, Mus musculus
gcttaccagataatgctactttatt

SEQ ID NO: 695407 - DNA, 25 bp, Mus musculus
gcttaccagatattgctactttatt

SEQ ID NO: 695408 - DNA, 25 bp, Mus musculus
gcttaccattgtctcgggctggtat

SEQ ID NO: 695409 - DNA, 25 bp, Mus musculus
gcttaccattgtgtcgggctggtat

SEQ ID NO: 695410 - DNA, 25 bp, Mus musculus
gcttaccatttcagcacaggagagt

SEQ ID NO: 695411 - DNA, 25 bp, Mus musculus
gcttaccatttctgcacaggagagt

SEQ ID NO: 695412 - DNA, 25 bp, Mus musculus
gcttaccgagacctggaacgagagc

SEQ ID NO: 695413 - DNA, 25 bp, Mus musculus
gcttaccgagacgtggaacgagagc

SEQ ID NO: 695414 - DNA, 25 bp, Mus musculus
gcttaccgggacatggcgttagaga

SEQ ID NO: 695415 - DNA, 25 bp, Mus musculus
gcttaccgggacttggcgttagaga

SEQ ID NO: 695416 - DNA, 25 bp, Mus musculus
gcttacctctagatacactacttgt

SEQ ID NO: 695417 - DNA, 25 bp, Mus musculus
gcttacctctagttacactacttgt

SEQ ID NO: 695418 - DNA, 25 bp, Mus musculus
gcttacctgcttcgctactagagaa

SEQ ID NO: 695419 - DNA, 25 bp, Mus musculus
gcttacctgcttggctactagagaa

SEQ ID NO: 695420 - DNA, 25 bp, Mus musculus
gcttacgactccacatgcacacatt

SEQ ID NO: 695421 - DNA, 25 bp, Mus musculus
gcttacgactcctcatgcacacatt

SEQ ID NO: 695422 - DNA, 25 bp, Mus musculus
gcttacgcgacacagcttgtttgga

SEQ ID NO: 695423 - DNA, 25 bp, Mus musculus
gcttacgcgacagagcttgtttgga

SEQ ID NO: 695424 - DNA, 25 bp, Mus musculus
gcttacggccgtcgcgttgtcaccg

SEQ ID NO: 695425 - DNA, 25 bp, Mus musculus
gcttacggccgtggcgttgtcaccg

SEQ ID NO: 695426 - DNA, 25 bp, Mus musculus
gcttacggcgtgctatccatgtgca

SEQ ID NO: 695427 - DNA, 25 bp, Mus musculus
gcttacggcgtggtatccatgtgca

SEQ ID NO: 695428 - DNA, 25 bp, Mus musculus
gcttacgtcttcatcggtgtgggcg

SEQ ID NO: 695429 - DNA, 25 bp, Mus musculus
gcttacgtcttcttcggtgtgggcg

SEQ ID NO: 695430 - DNA, 25 bp, Mus musculus
gcttacgtggctcaagtctggacca

SEQ ID NO: 695431 - DNA, 25 bp, Mus musculus
gcttacgtggctgaagtctggacca

SEQ ID NO: 695432 - DNA, 25 bp, Mus musculus
gcttacgttgcacttattcgtccaa

SEQ ID NO: 695433 - DNA, 25 bp, Mus musculus
gcttacgttgcagttattcgtccaa

SEQ ID NO: 695434 - DNA, 25 bp, Mus musculus
gcttactaattgcttatcagatgcc

SEQ ID NO: 695435 - DNA, 25 bp, Mus musculus
gcttactaattggttatcagatgcc

SEQ ID NO: 695436 - DNA, 25 bp, Mus musculus
gcttactacttcagctgaccttgag

SEQ ID NO: 695437 - DNA, 25 bp, Mus musculus
gcttactacttctgctgaccttgag

SEQ ID NO: 695438 - DNA, 25 bp, Mus musculus
gcttactctcagaaacttacctgga

SEQ ID NO: 695439 - DNA, 25 bp, Mus musculus
gcttactctcagtaacttacctgga

SEQ ID NO: 695440 - DNA, 25 bp, Mus musculus
gcttactctttgctggctgcctgtg

SEQ ID NO: 695441 - DNA, 25 bp, Mus musculus
gcttactctttggtggctgcctgtg

SEQ ID NO: 695442 - DNA, 25 bp, Mus musculus
gcttactgaacgagcttgaggtcct

SEQ ID NO: 695443 - DNA, 25 bp, Mus musculus
gcttactgaacgtgcttgaggtcct

SEQ ID NO: 695444 - DNA, 25 bp, Mus musculus
gcttactgagctcgctgatccatca

SEQ ID NO: 695445 - DNA, 25 bp, Mus musculus
gcttactgagctggctgatccatca

SEQ ID NO: 695446 - DNA, 25 bp, Mus musculus
gcttactgctcccacgacggtttgt

SEQ ID NO: 695447 - DNA, 25 bp, Mus musculus
gcttactgctccgacgacggtttgt

SEQ ID NO: 695448 - DNA, 25 bp, Mus musculus
gcttactgggagaagtcagcttgct

SEQ ID NO: 695449 - DNA, 25 bp, Mus musculus
gcttactgggagtagtcagcttgct

SEQ ID NO: 695450 - DNA, 25 bp, Mus musculus
gcttactgtgtcattgtggcatcac

SEQ ID NO: 695451 - DNA, 25 bp, Mus musculus
gcttactgtgtctttgtggcatcac

SEQ ID NO: 695452 - DNA, 25 bp, Mus musculus
gcttacttaccacgttgcctctgca

SEQ ID NO: 695453 - DNA, 25 bp, Mus musculus
gcttacttaccaggttgcctctgca

SEQ ID NO: 695454 - DNA, 25 bp, Mus musculus
gcttacttagacatcttggacactg

SEQ ID NO: 695455 - DNA, 25 bp, Mus musculus
gcttacttagacttcttggacactg

SEQ ID NO: 695456 - DNA, 25 bp, Mus musculus
gcttagaaaaccaagaattacagct

SEQ ID NO: 695457 - DNA, 25 bp, Mus musculus
gcttagaaaacctagaattacagct

SEQ ID NO: 695458 - DNA, 25 bp, Mus musculus
gcttagactccacccaacagtgagg

SEQ ID NO: 695459 - DNA, 25 bp, Mus musculus
gcttagactccagccaacagtgagg

SEQ ID NO: 695460 - DNA, 25 bp, Mus musculus
gcttagatcattccagcgtgccgga

SEQ ID NO: 695461 - DNA, 25 bp, Mus musculus
gcttagatcattgcagcgtgccgga

SEQ ID NO: 695462 - DNA, 25 bp, Mus musculus
gcttagatgcgccacggcttcggta

SEQ ID NO: 695463 - DNA, 25 bp, Mus musculus
gcttagatgcgcgacggcttcggta

SEQ ID NO: 695464 - DNA, 25 bp, Mus musculus
gcttagatttctacccttcctgtgg

SEQ ID NO: 695465 - DNA, 25 bp, Mus musculus
gcttagatttcttcccttcctgtgg

SEQ ID NO: 695466 - DNA, 25 bp, Mus musculus
gcttagccggcaactacagaagatg

SEQ ID NO: 695467 - DNA, 25 bp, Mus musculus
gcttagccggcatctacagaagatg

SEQ ID NO: 695468 - DNA, 25 bp, Mus musculus
gcttagcctgagctgcgtctctgca

SEQ ID NO: 695469 - DNA, 25 bp, Mus musculus
gcttagcctgaggtgcgtctctgca

SEQ ID NO: 695470 - DNA, 25 bp, Mus musculus
gcttagcgagcacggcaggttcctt

SEQ ID NO: 695471 - DNA, 25 bp, Mus musculus
gcttagcgagcagggcaggttcctt

SEQ ID NO: 695472 - DNA, 25 bp, Mus musculus
gcttagctccgaactagtgtagcag

SEQ ID NO: 695473 - DNA, 25 bp, Mus musculus
gcttagctccgatctagtgtagcag

SEQ ID NO: 695474 - DNA, 25 bp, Mus musculus
gcttagctcttcatagtcccctaga

SEQ ID NO: 695475 - DNA, 25 bp, Mus musculus
gcttagctcttcttagtcccctaga

SEQ ID NO: 695476 - DNA, 25 bp, Mus musculus
gcttagcttccgcagttccaggtga

SEQ ID NO: 695477 - DNA, 25 bp, Mus musculus
gcttagcttccggagttccaggtga

SEQ ID NO: 695478 - DNA, 25 bp, Mus musculus
gcttaggagtctaccagacagagtc

SEQ ID NO: 695479 - DNA, 25 bp, Mus musculus
gcttaggagtcttccagacagagtc

SEQ ID NO: 695480 - DNA, 25 bp, Mus musculus
gcttaggccttgaagcgattcagca

SEQ ID NO: 695481 - DNA, 25 bp, Mus musculus
gcttaggccttgtagcgattcagca

SEQ ID NO: 695482 - DNA, 25 bp, Mus musculus
gcttaggcttatccatgcaagtgtt

SEQ ID NO: 695483 - DNA, 25 bp, Mus musculus
gcttaggcttatgcatgcaagtgtt

SEQ ID NO: 695484 - DNA, 25 bp, Mus musculus
gcttagggcccacgagaatgagact

SEQ ID NO: 695485 - DNA, 25 bp, Mus musculus
gcttagggcccaggagaatgagact

SEQ ID NO: 695486 - DNA, 25 bp, Mus musculus
gcttaggtacatcagccgcgatgac

SEQ ID NO: 695487 - DNA, 25 bp, Mus musculus
gcttaggtacatgagccgcgatgac

SEQ ID NO: 695488 - DNA, 25 bp, Mus musculus
gcttaggtatttctacaccgctgtg

SEQ ID NO: 695489 - DNA, 25 bp, Mus musculus
gcttaggtatttgtacaccgctgtg

SEQ ID NO: 695490 - DNA, 25 bp, Mus musculus
gcttaggtggttcgctatccctgag

SEQ ID NO: 695491 - DNA, 25 bp, Mus musculus
gcttaggtggttggctatccctgag

SEQ ID NO: 695492 - DNA, 25 bp, Mus musculus
gcttagtaaattaccccttggctag

SEQ ID NO: 695493 - DNA, 25 bp, Mus musculus
gcttagtaaatttccccttggctag

SEQ ID NO: 695494 - DNA, 25 bp, Mus musculus
gcttagtaatgcagagcacaagagg

SEQ ID NO: 695495 - DNA, 25 bp, Mus musculus
gcttagtaatgctgagcacaagagg

SEQ ID NO: 695496 - DNA, 25 bp, Mus musculus
gcttagtagacacataacagacaag

SEQ ID NO: 695497 - DNA, 25 bp, Mus musculus
gcttagtagacagataacagacaag

SEQ ID NO: 695498 - DNA, 25 bp, Mus musculus
gcttagtatgccagacgatctcgta

SEQ ID NO: 695499 - DNA, 25 bp, Mus musculus
gcttagtatgcctgacgatctcgta

SEQ ID NO: 695500 - DNA, 25 bp, Mus musculus
gcttagtcctccactcggaaggaaa

SEQ ID NO: 695501 - DNA, 25 bp, Mus musculus
gcttagtcctcctctcggaaggaaa

SEQ ID NO: 695502 - DNA, 25 bp, Mus musculus
gcttagtctctgagtccccagggaa

SEQ ID NO: 695503 - DNA, 25 bp, Mus musculus
gcttagtctctgtgtccccagggaa

SEQ ID NO: 695504 - DNA, 25 bp, Mus musculus
gcttagtgacatacaatcagatgct

SEQ ID NO: 695505 - DNA, 25 bp, Mus musculus
gcttagtgacattcaatcagatgct

SEQ ID NO: 695506 - DNA, 25 bp, Mus musculus
gcttagtgctccatacagggttgca

SEQ ID NO: 695507 - DNA, 25 bp, Mus musculus
gcttagtgctccttacagggttgca

SEQ ID NO: 695508 - DNA, 25 bp, Mus musculus
gcttagtggctacccgcccttcgtg

SEQ ID NO: 695509 - DNA, 25 bp, Mus musculus
gcttagtggctagccgcccttcgtg

SEQ ID NO: 695510 - DNA, 25 bp, Mus musculus
gcttagtgggtactccccattctat

SEQ ID NO: 695511 - DNA, 25 bp, Mus musculus
gcttagtgggtagtccccattctat

SEQ ID NO: 695512 - DNA, 25 bp, Mus musculus
gcttagtgtacacgtaatttcttac

SEQ ID NO: 695513 - DNA, 25 bp, Mus musculus
gcttagtgtacaggtaatttcttac

SEQ ID NO: 695514 - DNA, 25 bp, Mus musculus
gcttagttttcacacagctgaggat

SEQ ID NO: 695515 - DNA, 25 bp, Mus musculus
gcttagttttcagacagctgaggat

SEQ ID NO: 695516 - DNA, 25 bp, Mus musculus
gcttataaaacccaggtgaggattg

SEQ ID NO: 695517 - DNA, 25 bp, Mus musculus
gcttataaaaccgaggtgaggattg

SEQ ID NO: 695518 - DNA, 25 bp, Mus musculus
gcttataactgtacacttcgcccag

SEQ ID NO: 695519 - DNA, 25 bp, Mus musculus
gcttataactgttcacttcgcccag

SEQ ID NO: 695520 - DNA, 25 bp, Mus musculus
gcttatacctccatcatcgcagatg

SEQ ID NO: 695521 - DNA, 25 bp, Mus musculus
gcttatacctccttcatcgcagatg

SEQ ID NO: 695522 - DNA, 25 bp, Mus musculus
gcttatactgaacaggacgtaagac

SEQ ID NO: 695523 - DNA, 25 bp, Mus musculus
gcttatactgaagaggacgtaagac

SEQ ID NO: 695524 - DNA, 25 bp, Mus musculus
gcttatatgatgacatctccactca

SEQ ID NO: 695525 - DNA, 25 bp, Mus musculus
gcttatatgatgtcatctccactca

SEQ ID NO: 695526 - DNA, 25 bp, Mus musculus
gcttatatgcctcggagaaccatca

SEQ ID NO: 695527 - DNA, 25 bp, Mus musculus
gcttatatgcctgggagaaccatca

SEQ ID NO: 695528 - DNA, 25 bp, Mus musculus
gcttatattatactgagggaaccac

SEQ ID NO: 695529 - DNA, 25 bp, Mus musculus
gcttatattatagtgagggaaccac

SEQ ID NO: 695530 - DNA, 25 bp, Mus musculus
gcttatcaaaacactgtgtcatgta

SEQ ID NO: 695531 - DNA, 25 bp, Mus musculus
gcttatcaaaactctgtgtcatgta

SEQ ID NO: 695532 - DNA, 25 bp, Mus musculus
gcttatcaaactcaagctacaagga

SEQ ID NO: 695533 - DNA, 25 bp, Mus musculus
gcttatcaaactgaagctacaagga

SEQ ID NO: 695534 - DNA, 25 bp, Mus musculus
gcttatcaaataaatgcattggcca

SEQ ID NO: 695535 - DNA, 25 bp, Mus musculus
gcttatcaaatatatgcattggcca

SEQ ID NO: 695536 - DNA, 25 bp, Mus musculus
gcttatcaacttctgccacatggct

SEQ ID NO: 695537 - DNA, 25 bp, Mus musculus
gcttatcaacttgtgccacatggct

SEQ ID NO: 695538 - DNA, 25 bp, Mus musculus
gcttatcaggcgaggacctggcacc

SEQ ID NO: 695539 - DNA, 25 bp, Mus musculus
gcttatcaggcgtggacctggcacc

SEQ ID NO: 695540 - DNA, 25 bp, Mus musculus
gcttatcaggttcgtcacaatctgt

SEQ ID NO: 695541 - DNA, 25 bp, Mus musculus
gcttatcaggttggtcacaatctgt

SEQ ID NO: 695542 - DNA, 25 bp, Mus musculus
gcttatccgctgcaggtgaccaaac

SEQ ID NO: 695543 - DNA, 25 bp, Mus musculus
gcttatccgctggaggtgaccaaac

SEQ ID NO: 695544 - DNA, 25 bp, Mus musculus
gcttatccggagacaaaccctggac

SEQ ID NO: 695545 - DNA, 25 bp, Mus musculus
gcttatccggagtcaaaccctggac

SEQ ID NO: 695546 - DNA, 25 bp, Mus musculus
gcttatcgtagtagtgatcaaagtt

SEQ ID NO: 695547 - DNA, 25 bp, Mus musculus
gcttatcgtagttgtgatcaaagtt

SEQ ID NO: 695548 - DNA, 25 bp, Mus musculus
gcttatctcattaacaggatgccaa

SEQ ID NO: 695549 - DNA, 25 bp, Mus musculus
gcttatctcatttacaggatgccaa

SEQ ID NO: 695550 - DNA, 25 bp, Mus musculus
gcttatcttcggaggaaccatggga

SEQ ID NO: 695551 - DNA, 25 bp, Mus musculus
gcttatcttcggtggaaccatggga

SEQ ID NO: 695552 - DNA, 25 bp, Mus musculus
gcttatgacaggagagcagccccaa

SEQ ID NO: 695553 - DNA, 25 bp, Mus musculus
gcttatgacaggtgagcagccccaa

SEQ ID NO: 695554 - DNA, 25 bp, Mus musculus
gcttatgatgataaggacaacacca

SEQ ID NO: 695555 - DNA, 25 bp, Mus musculus
gcttatgatgattaggacaacacca

SEQ ID NO: 695556 - DNA, 25 bp, Mus musculus
gcttatgcacagaacagccttagga

SEQ ID NO: 695557 - DNA, 25 bp, Mus musculus
gcttatgcacagtacagccttagga

SEQ ID NO: 695558 - DNA, 25 bp, Mus musculus
gcttatgcatgactttgggattggc

SEQ ID NO: 695559 - DNA, 25 bp, Mus musculus
gcttatgcatgagtttgggattggc

SEQ ID NO: 695560 - DNA, 25 bp, Mus musculus
gcttatgctggaccccgctttgtct

SEQ ID NO: 695561 - DNA, 25 bp, Mus musculus
gcttatgctggagcccgctttgtct

SEQ ID NO: 695562 - DNA, 25 bp, Mus musculus
gcttatgctggcctcgatgttccac

SEQ ID NO: 695563 - DNA, 25 bp, Mus musculus
gcttatgctggcgtcgatgttccac

SEQ ID NO: 695564 - DNA, 25 bp, Mus musculus
gcttatggacaaccgcatggtgctg

SEQ ID NO: 695565 - DNA, 25 bp, Mus musculus
gcttatggacaagcgcatggtgctg

SEQ ID NO: 695566 - DNA, 25 bp, Mus musculus
gcttatggagaaatcacgtggagca

SEQ ID NO: 695567 - DNA, 25 bp, Mus musculus
gcttatggagaattcacgtggagca

SEQ ID NO: 695568 - DNA, 25 bp, Mus musculus
gcttatggagttataacctatgggc

SEQ ID NO: 695569 - DNA, 25 bp, Mus musculus
gcttatggagttttaacctatgggc

SEQ ID NO: 695570 - DNA, 25 bp, Mus musculus
gcttatgggatacatgaaaggtgcc

SEQ ID NO: 695571 - DNA, 25 bp, Mus musculus
gcttatgggatagatgaaaggtgcc

SEQ ID NO: 695572 - DNA, 25 bp, Mus musculus
gcttatgggattcgacaagaccacc

SEQ ID NO: 695573 - DNA, 25 bp, Mus musculus
gcttatgggattggacaagaccacc

SEQ ID NO: 695574 - DNA, 25 bp, Mus musculus
gcttatgttgccacctctgattcca

SEQ ID NO: 695575 - DNA, 25 bp, Mus musculus
gcttatgttgcctcctctgattcca

SEQ ID NO: 695576 - DNA, 25 bp, Mus musculus
gcttattaccacctgctcgagcaag

SEQ ID NO: 695577 - DNA, 25 bp, Mus musculus
gcttattaccacgtgctcgagcaag

SEQ ID NO: 695578 - DNA, 25 bp, Mus musculus
gcttattactcaactgtggatcgag

SEQ ID NO: 695579 - DNA, 25 bp, Mus musculus
gcttattactcatctgtggatcgag

SEQ ID NO: 695580 - DNA, 25 bp, Mus musculus
gcttattcccagagctttgagtgat

SEQ ID NO: 695581 - DNA, 25 bp, Mus musculus
gcttattcccagtgctttgagtgat

SEQ ID NO: 695582 - DNA, 25 bp, Mus musculus
gcttattgaactctgtacggtttgg

SEQ ID NO: 695583 - DNA, 25 bp, Mus musculus
gcttattgaactgtgtacggtttgg

SEQ ID NO: 695584 - DNA, 25 bp, Mus musculus
gcttattgacatcactgtgcgccag

SEQ ID NO: 695585 - DNA, 25 bp, Mus musculus
gcttattgacatgactgtgcgccag

SEQ ID NO: 695586 - DNA, 25 bp, Mus musculus
gcttattgagttcgcctacacggcc

SEQ ID NO: 695587 - DNA, 25 bp, Mus musculus
gcttattgagttggcctacacggcc

SEQ ID NO: 695588 - DNA, 25 bp, Mus musculus
gcttattggctgacctgggagagca

SEQ ID NO: 695589 - DNA, 25 bp, Mus musculus
gcttattggctgtcctgggagagca

SEQ ID NO: 695590 - DNA, 25 bp, Mus musculus
gcttatttaacaaaagagagcatgg

SEQ ID NO: 695591 - DNA, 25 bp, Mus musculus
gcttatttaacataagagagcatgg

SEQ ID NO: 695592 - DNA, 25 bp, Mus musculus
gcttatttaatgcatcaggacccac

SEQ ID NO: 695593 - DNA, 25 bp, Mus musculus
gcttatttaatggatcaggacccac

SEQ ID NO: 695594 - DNA, 25 bp, Mus musculus
gcttatttcaccacaaaggccttgg

SEQ ID NO: 695595 - DNA, 25 bp, Mus musculus
gcttatttcacctcaaaggccttgg

SEQ ID NO: 695596 - DNA, 25 bp, Mus musculus
gcttcaaaaagtactgttggtgtta

SEQ ID NO: 695597 - DNA, 25 bp, Mus musculus
gcttcaaaaagttctgttggtgtta

SEQ ID NO: 695598 - DNA, 25 bp, Mus musculus
gcttcaaaatgtctgggaatggcag

SEQ ID NO: 695599 - DNA, 25 bp, Mus musculus
gcttcaaaatgtgtgggaatggcag

SEQ ID NO: 695600 - DNA, 25 bp, Mus musculus
gcttcaaacagtatctcaggaatcc

SEQ ID NO: 695601 - DNA, 25 bp, Mus musculus
gcttcaaacagtttctcaggaatcc

SEQ ID NO: 695602 - DNA, 25 bp, Mus musculus
gcttcaaatccgacgaagcagcaca

SEQ ID NO: 695603 - DNA, 25 bp, Mus musculus
gcttcaaatccgtcgaagcagcaca

SEQ ID NO: 695604 - DNA, 25 bp, Mus musculus
gcttcaacacacatcagggaaggcc

SEQ ID NO: 695605 - DNA, 25 bp, Mus musculus
gcttcaacacacttcagggaaggcc

SEQ ID NO: 695606 - DNA, 25 bp, Mus musculus
gcttcaacagcaacaccgttatgga

SEQ ID NO: 695607 - DNA, 25 bp, Mus musculus
gcttcaacagcatcaccgttatgga

SEQ ID NO: 695608 - DNA, 25 bp, Mus musculus
gcttcaacagctagagaagaatttg

SEQ ID NO: 695609 - DNA, 25 bp, Mus musculus
gcttcaacagcttgagaagaatttg

SEQ ID NO: 695610 - DNA, 25 bp, Mus musculus
gcttcaaccatgattttcacttgtg

SEQ ID NO: 695611 - DNA, 25 bp, Mus musculus
gcttcaaccatgtttttcacttgtg

SEQ ID NO: 695612 - DNA, 25 bp, Mus musculus
gcttcaacggctaggcaactgccct

SEQ ID NO: 695613 - DNA, 25 bp, Mus musculus
gcttcaacggcttggcaactgccct

SEQ ID NO: 695614 - DNA, 25 bp, Mus musculus
gcttcaacgggcacctgtgccagta

SEQ ID NO: 695615 - DNA, 25 bp, Mus musculus
gcttcaacgggcagatcggctggtt

SEQ ID NO: 695616 - DNA, 25 bp, Mus musculus
gcttcaacgggctcctgtgccagta

SEQ ID NO: 695617 - DNA, 25 bp, Mus musculus
gcttcaacgggctgatcggctggtt

SEQ ID NO: 695618 - DNA, 25 bp, Mus musculus
gcttcaactcatagggattacctca

SEQ ID NO: 695619 - DNA, 25 bp, Mus musculus
gcttcaactcattgggattacctca

SEQ ID NO: 695620 - DNA, 25 bp, Mus musculus
gcttcaacttaacctgtagccaagg

SEQ ID NO: 695621 - DNA, 25 bp, Mus musculus
gcttcaacttaagctgtagccaagg

SEQ ID NO: 695622 - DNA, 25 bp, Mus musculus
gcttcaacttggcttctcactcgcg

SEQ ID NO: 695623 - DNA, 25 bp, Mus musculus
gcttcaacttgggttctcactcgcg

SEQ ID NO: 695624 - DNA, 25 bp, Mus musculus
gcttcaagaagaactagaacaggag

SEQ ID NO: 695625 - DNA, 25 bp, Mus musculus
gcttcaagaagacggcggcctgcct

SEQ ID NO: 695626 - DNA, 25 bp, Mus musculus
gcttcaagaagagggcggcctgcct

SEQ ID NO: 695627 - DNA, 25 bp, Mus musculus
gcttcaagaagatctagaacaggag

SEQ ID NO: 695628 - DNA, 25 bp, Mus musculus
gcttcaagaaggacaccctacctgt

SEQ ID NO: 695629 - DNA, 25 bp, Mus musculus
gcttcaagaaggtcaccctacctgt

SEQ ID NO: 695630 - DNA, 25 bp, Mus musculus
gcttcaagcgttcagctcagttctt

SEQ ID NO: 695631 - DNA, 25 bp, Mus musculus
gcttcaagcgttgagctcagttctt

SEQ ID NO: 695632 - DNA, 25 bp, Mus musculus
gcttcaagctctcgtacacagtgga

SEQ ID NO: 695633 - DNA, 25 bp, Mus musculus
gcttcaagctctggtacacagtgga

SEQ ID NO: 695634 - DNA, 25 bp, Mus musculus
gcttcaaggtggactttgcgccagt

SEQ ID NO: 695635 - DNA, 25 bp, Mus musculus
gcttcaaggtggtctttgcgccagt

SEQ ID NO: 695636 - DNA, 25 bp, Mus musculus
gcttcaagtacacctgccagccatg

SEQ ID NO: 695637 - DNA, 25 bp, Mus musculus
gcttcaagtacagctgccagccatg

SEQ ID NO: 695638 - DNA, 25 bp, Mus musculus
gcttcaagtcaacttagtccgttcc

SEQ ID NO: 695639 - DNA, 25 bp, Mus musculus
gcttcaagtcaagttagtccgttcc

SEQ ID NO: 695640 - DNA, 25 bp, Mus musculus
gcttcaagtgaacatgagaaaacga

SEQ ID NO: 695641 - DNA, 25 bp, Mus musculus
gcttcaagtgaagatgagaaaacga

SEQ ID NO: 695642 - DNA, 25 bp, Mus musculus
gcttcaatctgtcaaaatcccagga

SEQ ID NO: 695643 - DNA, 25 bp, Mus musculus
gcttcaatctgtgaaaatcccagga

SEQ ID NO: 695644 - DNA, 25 bp, Mus musculus
gcttcaatgccacgtgaggaagcag

SEQ ID NO: 695645 - DNA, 25 bp, Mus musculus
gcttcaatgccaggtgaggaagcag

SEQ ID NO: 695646 - DNA, 25 bp, Mus musculus
gcttcaatgcttacccataaataag

SEQ ID NO: 695647 - DNA, 25 bp, Mus musculus
gcttcaatgctttcccataaataag

SEQ ID NO: 695648 - DNA, 25 bp, Mus musculus
gcttcaatttgaagagcaggtgaac

SEQ ID NO: 695649 - DNA, 25 bp, Mus musculus
gcttcaatttgatgagcaggtgaac

SEQ ID NO: 695650 - DNA, 25 bp, Mus musculus
gcttcacacgcgaccagagaaatgg

SEQ ID NO: 695651 - DNA, 25 bp, Mus musculus
gcttcacacgcgtccagagaaatgg

SEQ ID NO: 695652 - DNA, 25 bp, Mus musculus
gcttcacagttacaaagataataaa

SEQ ID NO: 695653 - DNA, 25 bp, Mus musculus
gcttcacagttagaaagataataaa

SEQ ID NO: 695654 - DNA, 25 bp, Mus musculus
gcttcacagttcaggaaaatagtcg

SEQ ID NO: 695655 - DNA, 25 bp, Mus musculus
gcttcacagttctggaaaatagtcg

SEQ ID NO: 695656 - DNA, 25 bp, Mus musculus
gcttcaccatgtacctgtgctccgg

SEQ ID NO: 695657 - DNA, 25 bp, Mus musculus
gcttcaccatgttcctgtgctccgg

SEQ ID NO: 695658 - DNA, 25 bp, Mus musculus
gcttcacccaggattccgacgaact

SEQ ID NO: 695659 - DNA, 25 bp, Mus musculus
gcttcacccaggtttccgacgaact

SEQ ID NO: 695660 - DNA, 25 bp, Mus musculus
gcttcacccgcaacatatggctcat

SEQ ID NO: 695661 - DNA, 25 bp, Mus musculus
gcttcacccgcatcatatggctcat

SEQ ID NO: 695662 - DNA, 25 bp, Mus musculus
gcttcaccgatacagacacattttg

SEQ ID NO: 695663 - DNA, 25 bp, Mus musculus
gcttcaccgatagagacacattttg

SEQ ID NO: 695664 - DNA, 25 bp, Mus musculus
gcttcaccggtgatcgatgccaaac

SEQ ID NO: 695665 - DNA, 25 bp, Mus musculus
gcttcaccggtgttcgatgccaaac

SEQ ID NO: 695666 - DNA, 25 bp, Mus musculus
gcttcacctactaagtgtccaataa

SEQ ID NO: 695667 - DNA, 25 bp, Mus musculus
gcttcacctacttagtgtccaataa

SEQ ID NO: 695668 - DNA, 25 bp, Mus musculus
gcttcacctctcactgggactcgag

SEQ ID NO: 695669 - DNA, 25 bp, Mus musculus
gcttcacctctctctgggactcgag

SEQ ID NO: 695670 - DNA, 25 bp, Mus musculus
gcttcaccttcgatgatgcccagca

SEQ ID NO: 695671 - DNA, 25 bp, Mus musculus
gcttcaccttcgttgatgcccagca

SEQ ID NO: 695672 - DNA, 25 bp, Mus musculus
gcttcaccttttatggcacctcctt

SEQ ID NO: 695673 - DNA, 25 bp, Mus musculus
gcttcaccttttttggcacctcctt

SEQ ID NO: 695674 - DNA, 25 bp, Mus musculus
gcttcacgccgtccatgtcgagcgg

SEQ ID NO: 695675 - DNA, 25 bp, Mus musculus
gcttcacgccgtgcatgtcgagcgg

SEQ ID NO: 695676 - DNA, 25 bp, Mus musculus
gcttcactccacacccttcttggag

SEQ ID NO: 695677 - DNA, 25 bp, Mus musculus
gcttcactccactcccttcttggag

SEQ ID NO: 695678 - DNA, 25 bp, Mus musculus
gcttcactgcaaagggccgcaacaa

SEQ ID NO: 695679 - DNA, 25 bp, Mus musculus
gcttcactgcaatgggccgcaacaa

SEQ ID NO: 695680 - DNA, 25 bp, Mus musculus
gcttcactgcataggctcttctgca

SEQ ID NO: 695681 - DNA, 25 bp, Mus musculus
gcttcactgcattggctcttctgca

SEQ ID NO: 695682 - DNA, 25 bp, Mus musculus
gcttcagaaagtatcaggtaaccag

SEQ ID NO: 695683 - DNA, 25 bp, Mus musculus
gcttcagaaagtttcaggtaaccag

SEQ ID NO: 695684 - DNA, 25 bp, Mus musculus
gcttcagaacgtcgtaccccagtta

SEQ ID NO: 695685 - DNA, 25 bp, Mus musculus
gcttcagaacgtggtaccccagtta

SEQ ID NO: 695686 - DNA, 25 bp, Mus musculus
gcttcagaagcaagcgccgcgtcca

SEQ ID NO: 695687 - DNA, 25 bp, Mus musculus
gcttcagaagcatgcgccgcgtcca

SEQ ID NO: 695688 - DNA, 25 bp, Mus musculus
gcttcagaagctagtaaagtgcaca

SEQ ID NO: 695689 - DNA, 25 bp, Mus musculus
gcttcagaagcttgtaaagtgcaca

SEQ ID NO: 695690 - DNA, 25 bp, Mus musculus
gcttcagaagttaaggtaagttggt

SEQ ID NO: 695691 - DNA, 25 bp, Mus musculus
gcttcagaagtttaggtaagttggt

SEQ ID NO: 695692 - DNA, 25 bp, Mus musculus
gcttcagaataacgatgtaattgcc

SEQ ID NO: 695693 - DNA, 25 bp, Mus musculus
gcttcagaataaggatgtaattgcc

SEQ ID NO: 695694 - DNA, 25 bp, Mus musculus
gcttcagacactctggtcacacagg

SEQ ID NO: 695695 - DNA, 25 bp, Mus musculus
gcttcagacactgtggtcacacagg

SEQ ID NO: 695696 - DNA, 25 bp, Mus musculus
gcttcagagatcaccgtgctggaga

SEQ ID NO: 695697 - DNA, 25 bp, Mus musculus
gcttcagagatctccgtgctggaga

SEQ ID NO: 695698 - DNA, 25 bp, Mus musculus
gcttcagaggcccaggcactcactg

SEQ ID NO: 695699 - DNA, 25 bp, Mus musculus
gcttcagaggccgaggcactcactg

SEQ ID NO: 695700 - DNA, 25 bp, Mus musculus
gcttcagaggttcatctacctgaca

SEQ ID NO: 695701 - DNA, 25 bp, Mus musculus
gcttcagaggttgatctacctgaca

SEQ ID NO: 695702 - DNA, 25 bp, Mus musculus
gcttcagatacgatgcactcaggca

SEQ ID NO: 695703 - DNA, 25 bp, Mus musculus
gcttcagatacgttgcactcaggca

SEQ ID NO: 695704 - DNA, 25 bp, Mus musculus
gcttcagatcggaggtgtatgtgca

SEQ ID NO: 695705 - DNA, 25 bp, Mus musculus
gcttcagatcggtggtgtatgtgca

SEQ ID NO: 695706 - DNA, 25 bp, Mus musculus
gcttcagatgcaattgctacattca

SEQ ID NO: 695707 - DNA, 25 bp, Mus musculus
gcttcagatgcatttgctacattca

SEQ ID NO: 695708 - DNA, 25 bp, Mus musculus
gcttcagcaaacacagatgatgatg

SEQ ID NO: 695709 - DNA, 25 bp, Mus musculus
gcttcagcaaactcagatgatgatg

SEQ ID NO: 695710 - DNA, 25 bp, Mus musculus
gcttcagcaagcaactgcaggttct

SEQ ID NO: 695711 - DNA, 25 bp, Mus musculus
gcttcagcaagctactgcaggttct

SEQ ID NO: 695712 - DNA, 25 bp, Mus musculus
gcttcagcaccccaggctttagttc

SEQ ID NO: 695713 - DNA, 25 bp, Mus musculus
gcttcagcacccgaggctttagttc

SEQ ID NO: 695714 - DNA, 25 bp, Mus musculus
gcttcagcagataatgcgtctgacg

SEQ ID NO: 695715 - DNA, 25 bp, Mus musculus
gcttcagcagattatgcgtctgacg

SEQ ID NO: 695716 - DNA, 25 bp, Mus musculus
gcttcagcatcgacaaccctggcta

SEQ ID NO: 695717 - DNA, 25 bp, Mus musculus
gcttcagcatcgtcaaccctggcta

SEQ ID NO: 695718 - DNA, 25 bp, Mus musculus
gcttcagccagtcgaactatgcagt

SEQ ID NO: 695719 - DNA, 25 bp, Mus musculus
gcttcagccagtggaactatgcagt

SEQ ID NO: 695720 - DNA, 25 bp, Mus musculus
gcttcagccatacgccgtggactta

SEQ ID NO: 695721 - DNA, 25 bp, Mus musculus
gcttcagccataggccgtggactta

SEQ ID NO: 695722 - DNA, 25 bp, Mus musculus
gcttcagcctggctggtaacatcgt

SEQ ID NO: 695723 - DNA, 25 bp, Mus musculus
gcttcagcctgggtggtaacatcgt

SEQ ID NO: 695724 - DNA, 25 bp, Mus musculus
gcttcagcgaccacgagctggtgca

SEQ ID NO: 695725 - DNA, 25 bp, Mus musculus
gcttcagcgacctcgagctggtgca

SEQ ID NO: 695726 - DNA, 25 bp, Mus musculus
gcttcagcgcaccagagcagcagcg

SEQ ID NO: 695727 - DNA, 25 bp, Mus musculus
gcttcagcgcacgagagcagcagcg

SEQ ID NO: 695728 - DNA, 25 bp, Mus musculus
gcttcagcgggaacatcgcttccta

SEQ ID NO: 695729 - DNA, 25 bp, Mus musculus
gcttcagcgggatcatcgcttccta

SEQ ID NO: 695730 - DNA, 25 bp, Mus musculus
gcttcagcgggcagcagtttcatcg

SEQ ID NO: 695731 - DNA, 25 bp, Mus musculus
gcttcagcgggctgcagtttcatcg

SEQ ID NO: 695732 - DNA, 25 bp, Mus musculus
gcttcagctccacaaggctaggctg

SEQ ID NO: 695733 - DNA, 25 bp, Mus musculus
gcttcagctccagaaggctaggctg

SEQ ID NO: 695734 - DNA, 25 bp, Mus musculus
gcttcagctgttaattgacaagttg

SEQ ID NO: 695735 - DNA, 25 bp, Mus musculus
gcttcagctgtttattgacaagttg

SEQ ID NO: 695736 - DNA, 25 bp, Mus musculus
gcttcagcttcgaaaagaaaagaaa

SEQ ID NO: 695737 - DNA, 25 bp, Mus musculus
gcttcagcttcgtaaagaaaagaaa

SEQ ID NO: 695738 - DNA, 25 bp, Mus musculus
gcttcaggaaaaacacgtatagagg

SEQ ID NO: 695739 - DNA, 25 bp, Mus musculus
gcttcaggaaaatcacgtatagagg

SEQ ID NO: 695740 - DNA, 25 bp, Mus musculus
gcttcaggaacgaaggtggcactgt

SEQ ID NO: 695741 - DNA, 25 bp, Mus musculus
gcttcaggaacgtaggtggcactgt

SEQ ID NO: 695742 - DNA, 25 bp, Mus musculus
gcttcaggaagactccggctgcact

SEQ ID NO: 695743 - DNA, 25 bp, Mus musculus
gcttcaggaagagtccggctgcact

SEQ ID NO: 695744 - DNA, 25 bp, Mus musculus
gcttcaggatccagacttaaggcag

SEQ ID NO: 695745 - DNA, 25 bp, Mus musculus
gcttcaggatcctgacttaaggcag

SEQ ID NO: 695746 - DNA, 25 bp, Mus musculus
gcttcaggccatactgaaagccacg

SEQ ID NO: 695747 - DNA, 25 bp, Mus musculus
gcttcaggccattctgaaagccacg

SEQ ID NO: 695748 - DNA, 25 bp, Mus musculus
gcttcaggcccgctacttcaattgg

SEQ ID NO: 695749 - DNA, 25 bp, Mus musculus
gcttcaggcccggtacttcaattgg

SEQ ID NO: 695750 - DNA, 25 bp, Mus musculus
gcttcaggcctaccaggaggactcg

SEQ ID NO: 695751 - DNA, 25 bp, Mus musculus
gcttcaggcctagcaggaggactcg

SEQ ID NO: 695752 - DNA, 25 bp, Mus musculus
gcttcaggcgccctgcgatcgactt

SEQ ID NO: 695753 - DNA, 25 bp, Mus musculus
gcttcaggcgccgtgcgatcgactt

SEQ ID NO: 695754 - DNA, 25 bp, Mus musculus
gcttcagggacaattaatcaggtca

SEQ ID NO: 695755 - DNA, 25 bp, Mus musculus
gcttcagggacatttaatcaggtca

SEQ ID NO: 695756 - DNA, 25 bp, Mus musculus
gcttcagggccaagggcggtatcca

SEQ ID NO: 695757 - DNA, 25 bp, Mus musculus
gcttcagggccatgggcggtatcca

SEQ ID NO: 695758 - DNA, 25 bp, Mus musculus
gcttcagtaagaagccccacgtgca

SEQ ID NO: 695759 - DNA, 25 bp, Mus musculus
gcttcagtaagatgccccacgtgca

SEQ ID NO: 695760 - DNA, 25 bp, Mus musculus
gcttcagtacttaggccctggttga

SEQ ID NO: 695761 - DNA, 25 bp, Mus musculus
gcttcagtactttggccctggttga

SEQ ID NO: 695762 - DNA, 25 bp, Mus musculus
gcttcagtcaccctgcacttggagg

SEQ ID NO: 695763 - DNA, 25 bp, Mus musculus
gcttcagtcaccgtgcacttggagg

SEQ ID NO: 695764 - DNA, 25 bp, Mus musculus
gcttcagtcatcatgggcctctctc

SEQ ID NO: 695765 - DNA, 25 bp, Mus musculus
gcttcagtcatcttgggcctctctc

SEQ ID NO: 695766 - DNA, 25 bp, Mus musculus
gcttcagtcctacggaagtatctct

SEQ ID NO: 695767 - DNA, 25 bp, Mus musculus
gcttcagtcctagggaagtatctct

SEQ ID NO: 695768 - DNA, 25 bp, Mus musculus
gcttcagtctaacgcggctgacgca

SEQ ID NO: 695769 - DNA, 25 bp, Mus musculus
gcttcagtctaaggcggctgacgca

SEQ ID NO: 695770 - DNA, 25 bp, Mus musculus
gcttcagtctcacgtcatgaacata

SEQ ID NO: 695771 - DNA, 25 bp, Mus musculus
gcttcagtctcaggtcatgaacata

SEQ ID NO: 695772 - DNA, 25 bp, Mus musculus
gcttcagtctgacctatcctcacaa

SEQ ID NO: 695773 - DNA, 25 bp, Mus musculus
gcttcagtctgagctatcctcacaa

SEQ ID NO: 695774 - DNA, 25 bp, Mus musculus
gcttcagtgactacgaggtgcggca

SEQ ID NO: 695775 - DNA, 25 bp, Mus musculus
gcttcagtgacttcgaggtgcggca

SEQ ID NO: 695776 - DNA, 25 bp, Mus musculus
gcttcagtgcttcctgagtacggga

SEQ ID NO: 695777 - DNA, 25 bp, Mus musculus
gcttcagtgcttgctgagtacggga

SEQ ID NO: 695778 - DNA, 25 bp, Mus musculus
gcttcagtggaccagtaagttctga

SEQ ID NO: 695779 - DNA, 25 bp, Mus musculus
gcttcagtggacgagtaagttctga

SEQ ID NO: 695780 - DNA, 25 bp, Mus musculus
gcttcagtggcaagaaccgcttcaa

SEQ ID NO: 695781 - DNA, 25 bp, Mus musculus
gcttcagtggcatgaaccgcttcaa

SEQ ID NO: 695782 - DNA, 25 bp, Mus musculus
gcttcagtgtggctgccaacgtccg

SEQ ID NO: 695783 - DNA, 25 bp, Mus musculus
gcttcagtgtgggtgccaacgtccg

SEQ ID NO: 695784 - DNA, 25 bp, Mus musculus
gcttcagttccgcaaatgtactgca

SEQ ID NO: 695785 - DNA, 25 bp, Mus musculus
gcttcagttccggaaatgtactgca

SEQ ID NO: 695786 - DNA, 25 bp, Mus musculus
gcttcagtttcaagctgtgcagagc

SEQ ID NO: 695787 - DNA, 25 bp, Mus musculus
gcttcagtttcatgctgtgcagagc

SEQ ID NO: 695788 - DNA, 25 bp, Mus musculus
gcttcataatgcatgattgattcca

SEQ ID NO: 695789 - DNA, 25 bp, Mus musculus
gcttcataatgcttgattgattcca

SEQ ID NO: 695790 - DNA, 25 bp, Mus musculus
gcttcatatgtcagaagagtagcag

SEQ ID NO: 695791 - DNA, 25 bp, Mus musculus
gcttcatatgtctgaagagtagcag

SEQ ID NO: 695792 - DNA, 25 bp, Mus musculus
gcttcatcaagaccccagagtatct

SEQ ID NO: 695793 - DNA, 25 bp, Mus musculus
gcttcatcaagagcccagagtatct

SEQ ID NO: 695794 - DNA, 25 bp, Mus musculus
gcttcatcctgcaggcgggctcgct

SEQ ID NO: 695795 - DNA, 25 bp, Mus musculus
gcttcatcctgctggcgggctcgct

SEQ ID NO: 695796 - DNA, 25 bp, Mus musculus
gcttcatctaggctgtttatctctg

SEQ ID NO: 695797 - DNA, 25 bp, Mus musculus
gcttcatctagggtgtttatctctg

SEQ ID NO: 695798 - DNA, 25 bp, Mus musculus
gcttcatctgccaggtcttggtcac

SEQ ID NO: 695799 - DNA, 25 bp, Mus musculus
gcttcatctgcctggtcttggtcac

SEQ ID NO: 695800 - DNA, 25 bp, Mus musculus
gcttcatgagcgcaagtgtgagccc

SEQ ID NO: 695801 - DNA, 25 bp, Mus musculus
gcttcatgagcggaagtgtgagccc

SEQ ID NO: 695802 - DNA, 25 bp, Mus musculus
gcttcatgatgacccgggcagaaga

SEQ ID NO: 695803 - DNA, 25 bp, Mus musculus
gcttcatgatgagccgggcagaaga

SEQ ID NO: 695804 - DNA, 25 bp, Mus musculus
gcttcatgatgcaccagatccggaa

SEQ ID NO: 695805 - DNA, 25 bp, Mus musculus
gcttcatgatgctccagatccggaa

SEQ ID NO: 695806 - DNA, 25 bp, Mus musculus
gcttcatgattccagagagtgaaac

SEQ ID NO: 695807 - DNA, 25 bp, Mus musculus
gcttcatgattcgagagagtgaaac

SEQ ID NO: 695808 - DNA, 25 bp, Mus musculus
gcttcatggaacaactccgcaccta

SEQ ID NO: 695809 - DNA, 25 bp, Mus musculus
gcttcatggaactactccgcaccta

SEQ ID NO: 695810 - DNA, 25 bp, Mus musculus
gcttcatggaatagccaatgaagac

SEQ ID NO: 695811 - DNA, 25 bp, Mus musculus
gcttcatggaattgccaatgaagac

SEQ ID NO: 695812 - DNA, 25 bp, Mus musculus
gcttcatggagaccgacatgtttgt

SEQ ID NO: 695813 - DNA, 25 bp, Mus musculus
gcttcatggagagcgacatgtttgt

SEQ ID NO: 695814 - DNA, 25 bp, Mus musculus
gcttcatggagccatcgagcgcgac

SEQ ID NO: 695815 - DNA, 25 bp, Mus musculus
gcttcatggagcgatcgagcgcgac

SEQ ID NO: 695816 - DNA, 25 bp, Mus musculus
gcttcattcatgactgagggttcac

SEQ ID NO: 695817 - DNA, 25 bp, Mus musculus
gcttcattcatgtctgagggttcac

SEQ ID NO: 695818 - DNA, 25 bp, Mus musculus
gcttcatttgcaaacagcaagtgtt

SEQ ID NO: 695819 - DNA, 25 bp, Mus musculus
gcttcatttgcatacagcaagtgtt

SEQ ID NO: 695820 - DNA, 25 bp, Mus musculus
gcttccaaaatacaagaggctccga

SEQ ID NO: 695821 - DNA, 25 bp, Mus musculus
gcttccaaaatagaagaggctccga

SEQ ID NO: 695822 - DNA, 25 bp, Mus musculus
gcttccaagagaaaggctcagctcc

SEQ ID NO: 695823 - DNA, 25 bp, Mus musculus
gcttccaagagataggctcagctcc

SEQ ID NO: 695824 - DNA, 25 bp, Mus musculus
gcttccaagctcagcaccaattctg

SEQ ID NO: 695825 - DNA, 25 bp, Mus musculus
gcttccaagctctgcaccaattctg

SEQ ID NO: 695826 - DNA, 25 bp, Mus musculus
gcttccaatagaacccaagttgaac

SEQ ID NO: 695827 - DNA, 25 bp, Mus musculus
gcttccaatagatcccaagttgaac

SEQ ID NO: 695828 - DNA, 25 bp, Mus musculus
gcttccaatcacacgaaaattttat

SEQ ID NO: 695829 - DNA, 25 bp, Mus musculus
gcttccaatcactcgaaaattttat

SEQ ID NO: 695830 - DNA, 25 bp, Mus musculus
gcttccaatgcacaacaacttatgg

SEQ ID NO: 695831 - DNA, 25 bp, Mus musculus
gcttccaatgcagaacaacttatgg

SEQ ID NO: 695832 - DNA, 25 bp, Mus musculus
gcttccactcgcacgggtgcgcggg

SEQ ID NO: 695833 - DNA, 25 bp, Mus musculus
gcttccactcgctcgggtgcgcggg

SEQ ID NO: 695834 - DNA, 25 bp, Mus musculus
gcttccacttctatgtccagggtag

SEQ ID NO: 695835 - DNA, 25 bp, Mus musculus
gcttccacttctttgtccagggtag

SEQ ID NO: 695836 - DNA, 25 bp, Mus musculus
gcttccagacggattgcctcgggtg

SEQ ID NO: 695837 - DNA, 25 bp, Mus musculus
gcttccagacggtttgcctcgggtg

SEQ ID NO: 695838 - DNA, 25 bp, Mus musculus
gcttccagagcgctgagcctgattg

SEQ ID NO: 695839 - DNA, 25 bp, Mus musculus
gcttccagagcggtgagcctgattg

SEQ ID NO: 695840 - DNA, 25 bp, Mus musculus
gcttccagagctcggccaacagcta

SEQ ID NO: 695841 - DNA, 25 bp, Mus musculus
gcttccagagctgggccaacagcta

SEQ ID NO: 695842 - DNA, 25 bp, Mus musculus
gcttccagatgcatactgagtggga

SEQ ID NO: 695843 - DNA, 25 bp, Mus musculus
gcttccagatgcttactgagtggga

SEQ ID NO: 695844 - DNA, 25 bp, Mus musculus
gcttccagccatacgagtcctacga

SEQ ID NO: 695845 - DNA, 25 bp, Mus musculus
gcttccagccattcgagtcctacga

SEQ ID NO: 695846 - DNA, 25 bp, Mus musculus
gcttccagctggacaatggcaccat

SEQ ID NO: 695847 - DNA, 25 bp, Mus musculus
gcttccagctggtcaatggcaccat

SEQ ID NO: 695848 - DNA, 25 bp, Mus musculus
gcttccaggagcagtggccttctcc

SEQ ID NO: 695849 - DNA, 25 bp, Mus musculus
gcttccaggagctgtggccttctcc

SEQ ID NO: 695850 - DNA, 25 bp, Mus musculus
gcttccaggaggcaaaggatgattc

SEQ ID NO: 695851 - DNA, 25 bp, Mus musculus
gcttccaggagggaaaggatgattc

SEQ ID NO: 695852 - DNA, 25 bp, Mus musculus
gcttccaggagtcataccagcttta

SEQ ID NO: 695853 - DNA, 25 bp, Mus musculus
gcttccaggagtgataccagcttta

SEQ ID NO: 695854 - DNA, 25 bp, Mus musculus
gcttccaggtgcaagtgctccgggt

SEQ ID NO: 695855 - DNA, 25 bp, Mus musculus
gcttccaggtgctagtgctccgggt

SEQ ID NO: 695856 - DNA, 25 bp, Mus musculus
gcttccagtacgcaaaccttacatg

SEQ ID NO: 695857 - DNA, 25 bp, Mus musculus
gcttccagtacggaaaccttacatg

SEQ ID NO: 695858 - DNA, 25 bp, Mus musculus
gcttccagtgatcttctacgggtca

SEQ ID NO: 695859 - DNA, 25 bp, Mus musculus
gcttccagtgatgttctacgggtca

SEQ ID NO: 695860 - DNA, 25 bp, Mus musculus
gcttccagtgctacggttatgaccc

SEQ ID NO: 695861 - DNA, 25 bp, Mus musculus
gcttccagtgcttcggttatgaccc

SEQ ID NO: 695862 - DNA, 25 bp, Mus musculus
gcttccagtggacgagaccttctcg

SEQ ID NO: 695863 - DNA, 25 bp, Mus musculus
gcttccagtggaggagaccttctcg

SEQ ID NO: 695864 - DNA, 25 bp, Mus musculus
gcttccataagacagcatctggcat

SEQ ID NO: 695865 - DNA, 25 bp, Mus musculus
gcttccataagagagcatctggcat

SEQ ID NO: 695866 - DNA, 25 bp, Mus musculus
gcttccatcactcacacatgtgagg

SEQ ID NO: 695867 - DNA, 25 bp, Mus musculus
gcttccatcactgacacatgtgagg

SEQ ID NO: 695868 - DNA, 25 bp, Mus musculus
gcttccatcttcaacacgctgtcag

SEQ ID NO: 695869 - DNA, 25 bp, Mus musculus
gcttccatcttctacacgctgtcag

SEQ ID NO: 695870 - DNA, 25 bp, Mus musculus
gcttccatgctcaggagttcatccc

SEQ ID NO: 695871 - DNA, 25 bp, Mus musculus
gcttccatgctctggagttcatccc

SEQ ID NO: 695872 - DNA, 25 bp, Mus musculus
gcttccatgtacaggtggccaacca

SEQ ID NO: 695873 - DNA, 25 bp, Mus musculus
gcttccatgtactggtggccaacca

SEQ ID NO: 695874 - DNA, 25 bp, Mus musculus
gcttcccaaatgagttctgtctgga

SEQ ID NO: 695875 - DNA, 25 bp, Mus musculus
gcttcccaaatgtgttctgtctgga

SEQ ID NO: 695876 - DNA, 25 bp, Mus musculus
gcttcccagaataacctcaggcagt

SEQ ID NO: 695877 - DNA, 25 bp, Mus musculus
gcttcccagaattacctcaggcagt

SEQ ID NO: 695878 - DNA, 25 bp, Mus musculus
gcttcccagagaagtatgctgacca

SEQ ID NO: 695879 - DNA, 25 bp, Mus musculus
gcttcccagagatgtatgctgacca

SEQ ID NO: 695880 - DNA, 25 bp, Mus musculus
gcttcccagaggcatcggtcacctt

SEQ ID NO: 695881 - DNA, 25 bp, Mus musculus
gcttcccagagggatcggtcacctt

SEQ ID NO: 695882 - DNA, 25 bp, Mus musculus
gcttcccatccgaacgtggactcag

SEQ ID NO: 695883 - DNA, 25 bp, Mus musculus
gcttcccatccgtacgtggactcag

SEQ ID NO: 695884 - DNA, 25 bp, Mus musculus
gcttcccatggaaacaaaaacaaat

SEQ ID NO: 695885 - DNA, 25 bp, Mus musculus
gcttcccatggatacaaaaacaaat

SEQ ID NO: 695886 - DNA, 25 bp, Mus musculus
gcttccccaggcaatgtcacaattc

SEQ ID NO: 695887 - DNA, 25 bp, Mus musculus
gcttccccaggctatgtcacaattc

SEQ ID NO: 695888 - DNA, 25 bp, Mus musculus
gcttccccgaatctttgaggctcag

SEQ ID NO: 695889 - DNA, 25 bp, Mus musculus
gcttccccgaatgtttgaggctcag

SEQ ID NO: 695890 - DNA, 25 bp, Mus musculus
gcttcccctgatcagcagaaggtat

SEQ ID NO: 695891 - DNA, 25 bp, Mus musculus
gcttcccctgatgagcagaaggtat

SEQ ID NO: 695892 - DNA, 25 bp, Mus musculus
gcttcccgctgcagggagaatctca

SEQ ID NO: 695893 - DNA, 25 bp, Mus musculus
gcttcccgctgctgggagaatctca

SEQ ID NO: 695894 - DNA, 25 bp, Mus musculus
gcttcccggcatattcctctttgga

SEQ ID NO: 695895 - DNA, 25 bp, Mus musculus
gcttcccggcattttcctctttgga

SEQ ID NO: 695896 - DNA, 25 bp, Mus musculus
gcttcccggtgcagtttacctatga

SEQ ID NO: 695897 - DNA, 25 bp, Mus musculus
gcttcccggtgctgtttacctatga

SEQ ID NO: 695898 - DNA, 25 bp, Mus musculus
gcttcccgtaatattgcaaatgatg

SEQ ID NO: 695899 - DNA, 25 bp, Mus musculus
gcttcccgtaattttgcaaatgatg

SEQ ID NO: 695900 - DNA, 25 bp, Mus musculus
gcttcccgtacacatacaagcagca

SEQ ID NO: 695901 - DNA, 25 bp, Mus musculus
gcttcccgtacagatacaagcagca

SEQ ID NO: 695902 - DNA, 25 bp, Mus musculus
gcttcccgtgttcatttcaattaaa

SEQ ID NO: 695903 - DNA, 25 bp, Mus musculus
gcttcccgtgttgatttcaattaaa

SEQ ID NO: 695904 - DNA, 25 bp, Mus musculus
gcttccctgcttctggaatgtgcag

SEQ ID NO: 695905 - DNA, 25 bp, Mus musculus
gcttccctgcttgtggaatgtgcag

SEQ ID NO: 695906 - DNA, 25 bp, Mus musculus
gcttccctggagaacgatatcaaac

SEQ ID NO: 695907 - DNA, 25 bp, Mus musculus
gcttccctggagtacgatatcaaac

SEQ ID NO: 695908 - DNA, 25 bp, Mus musculus
gcttccctgttcatgttctctagat

SEQ ID NO: 695909 - DNA, 25 bp, Mus musculus
gcttccctgttcttgttctctagat

SEQ ID NO: 695910 - DNA, 25 bp, Mus musculus
gcttcccttagcacgggccaagatc

SEQ ID NO: 695911 - DNA, 25 bp, Mus musculus
gcttcccttagctcgggccaagatc

SEQ ID NO: 695912 - DNA, 25 bp, Mus musculus
gcttccctttggaaaagagcagtga

SEQ ID NO: 695913 - DNA, 25 bp, Mus musculus
gcttccctttggtaaagagcagtga

SEQ ID NO: 695914 - DNA, 25 bp, Mus musculus
gcttccgaagtcatagtgccctgtt

SEQ ID NO: 695915 - DNA, 25 bp, Mus musculus
gcttccgaagtcttagtgccctgtt

SEQ ID NO: 695916 - DNA, 25 bp, Mus musculus
gcttccgagaagctgcctacacgaa

SEQ ID NO: 695917 - DNA, 25 bp, Mus musculus
gcttccgagaaggtgcctacacgaa

SEQ ID NO: 695918 - DNA, 25 bp, Mus musculus
gcttccgagcacaaggtatctccat

SEQ ID NO: 695919 - DNA, 25 bp, Mus musculus
gcttccgagcactaggtatctccat

SEQ ID NO: 695920 - DNA, 25 bp, Mus musculus
gcttccgaggctccttcgggaagcc

SEQ ID NO: 695921 - DNA, 25 bp, Mus musculus
gcttccgaggctgcttcgggaagcc

SEQ ID NO: 695922 - DNA, 25 bp, Mus musculus
gcttccgataatcagccaactgtaa

SEQ ID NO: 695923 - DNA, 25 bp, Mus musculus
gcttccgataatgagccaactgtaa

SEQ ID NO: 695924 - DNA, 25 bp, Mus musculus
gcttccgcagtgacactagcagact

SEQ ID NO: 695925 - DNA, 25 bp, Mus musculus
gcttccgcagtgagacccatgctta

SEQ ID NO: 695926 - DNA, 25 bp, Mus musculus
gcttccgcagtgtcactagcagact

SEQ ID NO: 695927 - DNA, 25 bp, Mus musculus
gcttccgcagtgtgacccatgctta

SEQ ID NO: 695928 - DNA, 25 bp, Mus musculus
gcttccgctaccatctgggtaatga

SEQ ID NO: 695929 - DNA, 25 bp, Mus musculus
gcttccgctaccttctgggtaatga

SEQ ID NO: 695930 - DNA, 25 bp, Mus musculus
gcttccggagtcaataccaggatcg

SEQ ID NO: 695931 - DNA, 25 bp, Mus musculus
gcttccggagtctataccaggatcg

SEQ ID NO: 695932 - DNA, 25 bp, Mus musculus
gcttccggtgaacaatgaatacccc

SEQ ID NO: 695933 - DNA, 25 bp, Mus musculus
gcttccggtgaagaatgaatacccc

SEQ ID NO: 695934 - DNA, 25 bp, Mus musculus
gcttccgtgagaagaccggagcgct

SEQ ID NO: 695935 - DNA, 25 bp, Mus musculus
gcttccgtgagatgaccggagcgct

SEQ ID NO: 695936 - DNA, 25 bp, Mus musculus
gcttccgtggctactacaagggcac

SEQ ID NO: 695937 - DNA, 25 bp, Mus musculus
gcttccgtggcttctacaagggcac

SEQ ID NO: 695938 - DNA, 25 bp, Mus musculus
gcttccgtgtacaagatttgcagag

SEQ ID NO: 695939 - DNA, 25 bp, Mus musculus
gcttccgtgtactagatttgcagag

SEQ ID NO: 695940 - DNA, 25 bp, Mus musculus
gcttccgttcggagtccagtccaca

SEQ ID NO: 695941 - DNA, 25 bp, Mus musculus
gcttccgttcggtgtccagtccaca

SEQ ID NO: 695942 - DNA, 25 bp, Mus musculus
gcttcctaaccactatggccaggag

SEQ ID NO: 695943 - DNA, 25 bp, Mus musculus
gcttcctaaccagtatggccaggag

SEQ ID NO: 695944 - DNA, 25 bp, Mus musculus
gcttcctacagcaatcctctgaact

SEQ ID NO: 695945 - DNA, 25 bp, Mus musculus
gcttcctacagctatcctctgaact

SEQ ID NO: 695946 - DNA, 25 bp, Mus musculus
gcttcctaccttagagagttgggtg

SEQ ID NO: 695947 - DNA, 25 bp, Mus musculus
gcttcctacctttgagagttgggtg

SEQ ID NO: 695948 - DNA, 25 bp, Mus musculus
gcttcctactgacgcctgggaaagg

SEQ ID NO: 695949 - DNA, 25 bp, Mus musculus
gcttcctactgaggcctgggaaagg

SEQ ID NO: 695950 - DNA, 25 bp, Mus musculus
gcttcctagaggagctgcgggcact

SEQ ID NO: 695951 - DNA, 25 bp, Mus musculus
gcttcctagaggtgctgcgggcact

SEQ ID NO: 695952 - DNA, 25 bp, Mus musculus
gcttcctagcaccttctcacagtat

SEQ ID NO: 695953 - DNA, 25 bp, Mus musculus
gcttcctagcacgttctcacagtat

SEQ ID NO: 695954 - DNA, 25 bp, Mus musculus
gcttcctatgaaagcatgtgtgctg

SEQ ID NO: 695955 - DNA, 25 bp, Mus musculus
gcttcctatgaatgcatgtgtgctg

SEQ ID NO: 695956 - DNA, 25 bp, Mus musculus
gcttcctatgcacccggggtggcca

SEQ ID NO: 695957 - DNA, 25 bp, Mus musculus
gcttcctatgcagccggggtggcca

SEQ ID NO: 695958 - DNA, 25 bp, Mus musculus
gcttcctcatcaaagtgctggtgca

SEQ ID NO: 695959 - DNA, 25 bp, Mus musculus
gcttcctcatcaaattgtgtgactg

SEQ ID NO: 695960 - DNA, 25 bp, Mus musculus
gcttcctcatcatagtgctggtgca

SEQ ID NO: 695961 - DNA, 25 bp, Mus musculus
gcttcctcatcatattgtgtgactg

SEQ ID NO: 695962 - DNA, 25 bp, Mus musculus
gcttcctccgtgaacccaagtgggt

SEQ ID NO: 695963 - DNA, 25 bp, Mus musculus
gcttcctccgtgtacccaagtgggt

SEQ ID NO: 695964 - DNA, 25 bp, Mus musculus
gcttcctcctgcaactgacggatct

SEQ ID NO: 695965 - DNA, 25 bp, Mus musculus
gcttcctcctgctactgacggatct

SEQ ID NO: 695966 - DNA, 25 bp, Mus musculus
gcttcctctaacagcagcgtttgag

SEQ ID NO: 695967 - DNA, 25 bp, Mus musculus
gcttcctctaactgcagcgtttgag

SEQ ID NO: 695968 - DNA, 25 bp, Mus musculus
gcttcctctgtcactttaatgcgag

SEQ ID NO: 695969 - DNA, 25 bp, Mus musculus
gcttcctctgtctctttaatgcgag

SEQ ID NO: 695970 - DNA, 25 bp, Mus musculus
gcttcctgaatgagaggcgggaaca

SEQ ID NO: 695971 - DNA, 25 bp, Mus musculus
gcttcctgaatgtgaggcgggaaca

SEQ ID NO: 695972 - DNA, 25 bp, Mus musculus
gcttcctgaattactatgatgcctg

SEQ ID NO: 695973 - DNA, 25 bp, Mus musculus
gcttcctgaatttctatgatgcctg

SEQ ID NO: 695974 - DNA, 25 bp, Mus musculus
gcttcctgatttcaatgcactagac

SEQ ID NO: 695975 - DNA, 25 bp, Mus musculus
gcttcctgatttgaatgcactagac

SEQ ID NO: 695976 - DNA, 25 bp, Mus musculus
gcttcctgcaagaaaaggcttgggg

SEQ ID NO: 695977 - DNA, 25 bp, Mus musculus
gcttcctgcaagtaaaggcttgggg

SEQ ID NO: 695978 - DNA, 25 bp, Mus musculus
gcttcctgcagcacataggggacaa

SEQ ID NO: 695979 - DNA, 25 bp, Mus musculus
gcttcctgcagctcataggggacaa

SEQ ID NO: 695980 - DNA, 25 bp, Mus musculus
gcttcctgcaggaagtgcagaaccc

SEQ ID NO: 695981 - DNA, 25 bp, Mus musculus
gcttcctgcaggtagtgcagaaccc

SEQ ID NO: 695982 - DNA, 25 bp, Mus musculus
gcttcctgcatgcaactggagctat

SEQ ID NO: 695983 - DNA, 25 bp, Mus musculus
gcttcctgcatggaactggagctat

SEQ ID NO: 695984 - DNA, 25 bp, Mus musculus
gcttcctgctccagttttccaacat

SEQ ID NO: 695985 - DNA, 25 bp, Mus musculus
gcttcctgctcctgttttccaacat

SEQ ID NO: 695986 - DNA, 25 bp, Mus musculus
gcttcctggatgaaagcacaggatt

SEQ ID NO: 695987 - DNA, 25 bp, Mus musculus
gcttcctggatgtaagcacaggatt

SEQ ID NO: 695988 - DNA, 25 bp, Mus musculus
gcttcctggctgcatactttccatc

SEQ ID NO: 695989 - DNA, 25 bp, Mus musculus
gcttcctggctggatactttccatc

SEQ ID NO: 695990 - DNA, 25 bp, Mus musculus
gcttcctgggaacccctgattgcca

SEQ ID NO: 695991 - DNA, 25 bp, Mus musculus
gcttcctgggaagccctgattgcca

SEQ ID NO: 695992 - DNA, 25 bp, Mus musculus
gcttcctgggctctatcggtgctgt

SEQ ID NO: 695993 - DNA, 25 bp, Mus musculus
gcttcctgggctgtatcggtgctgt

SEQ ID NO: 695994 - DNA, 25 bp, Mus musculus
gcttcctggttcaagactactttgt

SEQ ID NO: 695995 - DNA, 25 bp, Mus musculus
gcttcctggttctagactactttgt

SEQ ID NO: 695996 - DNA, 25 bp, Mus musculus
gcttcctgtccgctgagcgtcgaac

SEQ ID NO: 695997 - DNA, 25 bp, Mus musculus
gcttcctgtccggtgagcgtcgaac

SEQ ID NO: 695998 - DNA, 25 bp, Mus musculus
gcttcctgtggaacgtcttccagcg

SEQ ID NO: 695999 - DNA, 25 bp, Mus musculus
gcttcctgtggatcgtcttccagcg

SEQ ID NO: 696000 - DNA, 25 bp, Mus musculus
gcttccttgcagcaatggcagcagt

SEQ ID NO: 696001 - DNA, 25 bp, Mus musculus
gcttccttgcaggaatggcagcagt

SEQ ID NO: 696002 - DNA, 25 bp, Mus musculus
gcttccttgccaagaagatagcatc

SEQ ID NO: 696003 - DNA, 25 bp, Mus musculus
gcttccttgccatgaagatagcatc

SEQ ID NO: 696004 - DNA, 25 bp, Mus musculus
gcttccttgttacggaggtcacgga

SEQ ID NO: 696005 - DNA, 25 bp, Mus musculus
gcttccttgttagggaggtcacgga

SEQ ID NO: 696006 - DNA, 25 bp, Mus musculus
gcttcctttcctaggccttctctgg

SEQ ID NO: 696007 - DNA, 25 bp, Mus musculus
gcttcctttccttggccttctctgg

SEQ ID NO: 696008 - DNA, 25 bp, Mus musculus
gcttcctttggcagcagccagctag

SEQ ID NO: 696009 - DNA, 25 bp, Mus musculus
gcttcctttggctgcagccagctag

SEQ ID NO: 696010 - DNA, 25 bp, Mus musculus
gcttcgacttccactttggcttctg

SEQ ID NO: 696011 - DNA, 25 bp, Mus musculus
gcttcgacttcctctttggcttctg

SEQ ID NO: 696012 - DNA, 25 bp, Mus musculus
gcttcgagaagaatgaaatcttaca

SEQ ID NO: 696013 - DNA, 25 bp, Mus musculus
gcttcgagaagattgaaatcttaca

SEQ ID NO: 696014 - DNA, 25 bp, Mus musculus
gcttcgagacctcgttacccagcag

SEQ ID NO: 696015 - DNA, 25 bp, Mus musculus
gcttcgagacctggttacccagcag

SEQ ID NO: 696016 - DNA, 25 bp, Mus musculus
gcttcgagcacgaggaccgcttcca

SEQ ID NO: 696017 - DNA, 25 bp, Mus musculus
gcttcgagcacgtggaccgcttcca

SEQ ID NO: 696018 - DNA, 25 bp, Mus musculus
gcttcgaggcggatgacgacgcctt

SEQ ID NO: 696019 - DNA, 25 bp, Mus musculus
gcttcgaggcggttgacgacgcctt

SEQ ID NO: 696020 - DNA, 25 bp, Mus musculus
gcttcgagggacagtacaagaaaaa

SEQ ID NO: 696021 - DNA, 25 bp, Mus musculus
gcttcgagggactgtacaagaaaaa

SEQ ID NO: 696022 - DNA, 25 bp, Mus musculus
gcttcgagggctcaccctgcgtcaa

SEQ ID NO: 696023 - DNA, 25 bp, Mus musculus
gcttcgagggctgaccctgcgtcaa

SEQ ID NO: 696024 - DNA, 25 bp, Mus musculus
gcttcgaggttcacagaccccaggt

SEQ ID NO: 696025 - DNA, 25 bp, Mus musculus
gcttcgaggttctcagaccccaggt

SEQ ID NO: 696026 - DNA, 25 bp, Mus musculus
gcttcgagtaccatccacagctcaa

SEQ ID NO: 696027 - DNA, 25 bp, Mus musculus
gcttcgagtaccttccacagctcaa

SEQ ID NO: 696028 - DNA, 25 bp, Mus musculus
gcttcgagtactcgcagaaacctat

SEQ ID NO: 696029 - DNA, 25 bp, Mus musculus
gcttcgagtactggcagaaacctat

SEQ ID NO: 696030 - DNA, 25 bp, Mus musculus
gcttcgataaggacgagttcatgaa

SEQ ID NO: 696031 - DNA, 25 bp, Mus musculus
gcttcgataaggtcgagttcatgaa

SEQ ID NO: 696032 - DNA, 25 bp, Mus musculus
gcttcgattctgactgcagcgagga

SEQ ID NO: 696033 - DNA, 25 bp, Mus musculus
gcttcgattctgtctgcagcgagga

SEQ ID NO: 696034 - DNA, 25 bp, Mus musculus
gcttcgcaaagaagagcagagctcg

SEQ ID NO: 696035 - DNA, 25 bp, Mus musculus
gcttcgcaaagatgagcagagctcg

SEQ ID NO: 696036 - DNA, 25 bp, Mus musculus
gcttcgcaagaacaagaacctcctg

SEQ ID NO: 696037 - DNA, 25 bp, Mus musculus
gcttcgcaagaagaagaacctcctg

SEQ ID NO: 696038 - DNA, 25 bp, Mus musculus
gcttcgcacccgatccaggtggtac

SEQ ID NO: 696039 - DNA, 25 bp, Mus musculus
gcttcgcacccgttccaggtggtac

SEQ ID NO: 696040 - DNA, 25 bp, Mus musculus
gcttcgcagtgacatgtacattctc

SEQ ID NO: 696041 - DNA, 25 bp, Mus musculus
gcttcgcagtgagatgtacattctc

SEQ ID NO: 696042 - DNA, 25 bp, Mus musculus
gcttcgcatacgagtacacgctgga

SEQ ID NO: 696043 - DNA, 25 bp, Mus musculus
gcttcgcatacgtgtacacgctgga

SEQ ID NO: 696044 - DNA, 25 bp, Mus musculus
gcttcgccgccgctggatcagcatg

SEQ ID NO: 696045 - DNA, 25 bp, Mus musculus
gcttcgccgccggtggatcagcatg

SEQ ID NO: 696046 - DNA, 25 bp, Mus musculus
gcttcgccgggtcgtcagcagcttt

SEQ ID NO: 696047 - DNA, 25 bp, Mus musculus
gcttcgccgggtggtcagcagcttt

SEQ ID NO: 696048 - DNA, 25 bp, Mus musculus
gcttcgcggagcatgcacaaatcta

SEQ ID NO: 696049 - DNA, 25 bp, Mus musculus
gcttcgcggagcttgcacaaatcta

SEQ ID NO: 696050 - DNA, 25 bp, Mus musculus
gcttcgctacatcacagactgcgtg

SEQ ID NO: 696051 - DNA, 25 bp, Mus musculus
gcttcgctacatgacagactgcgtg

SEQ ID NO: 696052 - DNA, 25 bp, Mus musculus
gcttcgctgctcagagcgccagtgt

SEQ ID NO: 696053 - DNA, 25 bp, Mus musculus
gcttcgctgctctgagcgccagtgt

SEQ ID NO: 696054 - DNA, 25 bp, Mus musculus
gcttcgctttgcaccgtctagagga

SEQ ID NO: 696055 - DNA, 25 bp, Mus musculus
gcttcgctttgctccgtctagagga

SEQ ID NO: 696056 - DNA, 25 bp, Mus musculus
gcttcggaattcactgcggcccagc

SEQ ID NO: 696057 - DNA, 25 bp, Mus musculus
gcttcggaattctctgcggcccagc

SEQ ID NO: 696058 - DNA, 25 bp, Mus musculus
gcttcggagtcaagagggcctacta

SEQ ID NO: 696059 - DNA, 25 bp, Mus musculus
gcttcggagtcatgagggcctacta

SEQ ID NO: 696060 - DNA, 25 bp, Mus musculus
gcttcggagtccctgcgaatgcgaa

SEQ ID NO: 696061 - DNA, 25 bp, Mus musculus
gcttcggagtccgtgcgaatgcgaa

SEQ ID NO: 696062 - DNA, 25 bp, Mus musculus
gcttcggcagctcaagctggacaat

SEQ ID NO: 696063 - DNA, 25 bp, Mus musculus
gcttcggcagctgaagctggacaat

SEQ ID NO: 696064 - DNA, 25 bp, Mus musculus
gcttcggcatatccggctgtccaaa

SEQ ID NO: 696065 - DNA, 25 bp, Mus musculus
gcttcggcatatgcggctgtccaaa

SEQ ID NO: 696066 - DNA, 25 bp, Mus musculus
gcttcggcctgtagtagagaagccc

SEQ ID NO: 696067 - DNA, 25 bp, Mus musculus
gcttcggcctgttgtagagaagccc

SEQ ID NO: 696068 - DNA, 25 bp, Mus musculus
gcttcgggaagacttcaagatgcag

SEQ ID NO: 696069 - DNA, 25 bp, Mus musculus
gcttcgggaagagttcaagatgcag

SEQ ID NO: 696070 - DNA, 25 bp, Mus musculus
gcttcgggaatcctgagcctggccc

SEQ ID NO: 696071 - DNA, 25 bp, Mus musculus
gcttcgggaatcgtgagcctggccc

SEQ ID NO: 696072 - DNA, 25 bp, Mus musculus
gcttcgggacctccacatttcagaa

SEQ ID NO: 696073 - DNA, 25 bp, Mus musculus
gcttcgggacctgcacatttcagaa

SEQ ID NO: 696074 - DNA, 25 bp, Mus musculus
gcttcgggagatcgtgtcccagaca

SEQ ID NO: 696075 - DNA, 25 bp, Mus musculus
gcttcgggagatggtgtcccagaca

SEQ ID NO: 696076 - DNA, 25 bp, Mus musculus
gcttcgggcgtacgctgacagcaaa

SEQ ID NO: 696077 - DNA, 25 bp, Mus musculus
gcttcgggcgtaggctgacagcaaa

SEQ ID NO: 696078 - DNA, 25 bp, Mus musculus
gcttcgggtgttaccgcagccttgc

SEQ ID NO: 696079 - DNA, 25 bp, Mus musculus
gcttcgggtgtttccgcagccttgc

SEQ ID NO: 696080 - DNA, 25 bp, Mus musculus
gcttcggtcatcagcaacgacgatg

SEQ ID NO: 696081 - DNA, 25 bp, Mus musculus
gcttcggtcatctgcaacgacgatg

SEQ ID NO: 696082 - DNA, 25 bp, Mus musculus
gcttcggtcccaccatgtgcaggtg

SEQ ID NO: 696083 - DNA, 25 bp, Mus musculus
gcttcggtcccagcatgtgcaggtg

SEQ ID NO: 696084 - DNA, 25 bp, Mus musculus
gcttcggtttcgattcagtatttta

SEQ ID NO: 696085 - DNA, 25 bp, Mus musculus
gcttcggtttcgtttcagtatttta

SEQ ID NO: 696086 - DNA, 25 bp, Mus musculus
gcttcgtcaccacacaggtaaccat

SEQ ID NO: 696087 - DNA, 25 bp, Mus musculus
gcttcgtcaccagacaggtaaccat

SEQ ID NO: 696088 - DNA, 25 bp, Mus musculus
gcttcgtcctggctgtctttgccag

SEQ ID NO: 696089 - DNA, 25 bp, Mus musculus
gcttcgtcctgggtgtctttgccag

SEQ ID NO: 696090 - DNA, 25 bp, Mus musculus
gcttcgtcgacacagtacttctggt

SEQ ID NO: 696091 - DNA, 25 bp, Mus musculus
gcttcgtcgacagagtacttctggt

SEQ ID NO: 696092 - DNA, 25 bp, Mus musculus
gcttcgtggtcgctcttgagcaaca

SEQ ID NO: 696093 - DNA, 25 bp, Mus musculus
gcttcgtggtcggtcttgagcaaca

SEQ ID NO: 696094 - DNA, 25 bp, Mus musculus
gcttcgtgtccccagagttctgtcg

SEQ ID NO: 696095 - DNA, 25 bp, Mus musculus
gcttcgtgtcccgagagttctgtcg

SEQ ID NO: 696096 - DNA, 25 bp, Mus musculus
gcttcgtgtctgacaagagacccca

SEQ ID NO: 696097 - DNA, 25 bp, Mus musculus
gcttcgtgtctgtcaagagacccca

SEQ ID NO: 696098 - DNA, 25 bp, Mus musculus
gcttcgttatcactgcgaacgagca

SEQ ID NO: 696099 - DNA, 25 bp, Mus musculus
gcttcgttatcagtgcgaacgagca

SEQ ID NO: 696100 - DNA, 25 bp, Mus musculus
gcttctaaaacaatgccgtcaaatt

SEQ ID NO: 696101 - DNA, 25 bp, Mus musculus
gcttctaaaacattgccgtcaaatt

SEQ ID NO: 696102 - DNA, 25 bp, Mus musculus
gcttctaacagccagtggcagctgg

SEQ ID NO: 696103 - DNA, 25 bp, Mus musculus
gcttctaacagcgagtggcagctgg

SEQ ID NO: 696104 - DNA, 25 bp, Mus musculus
gcttctaatcctaatactcaggagg

SEQ ID NO: 696105 - DNA, 25 bp, Mus musculus
gcttctaatccttatactcaggagg

SEQ ID NO: 696106 - DNA, 25 bp, Mus musculus
gcttctacaaaaaaggtaaggtggc

SEQ ID NO: 696107 - DNA, 25 bp, Mus musculus
gcttctacaaaataggtaaggtggc

SEQ ID NO: 696108 - DNA, 25 bp, Mus musculus
gcttctacctggaattgaggtgctt

SEQ ID NO: 696109 - DNA, 25 bp, Mus musculus
gcttctacctggtattgaggtgctt

SEQ ID NO: 696110 - DNA, 25 bp, Mus musculus
gcttctacctgtcgtagactcacag

SEQ ID NO: 696111 - DNA, 25 bp, Mus musculus
gcttctacctgtggtagactcacag

SEQ ID NO: 696112 - DNA, 25 bp, Mus musculus
gcttctacgactccagcgctgtgga

SEQ ID NO: 696113 - DNA, 25 bp, Mus musculus
gcttctacgactgcagcgctgtgga

SEQ ID NO: 696114 - DNA, 25 bp, Mus musculus
gcttctacgttcagtccattgagac

SEQ ID NO: 696115 - DNA, 25 bp, Mus musculus
gcttctacgttctgtccattgagac

SEQ ID NO: 696116 - DNA, 25 bp, Mus musculus
gcttctactggaaaggaaccctctg

SEQ ID NO: 696117 - DNA, 25 bp, Mus musculus
gcttctactggataggaaccctctg

SEQ ID NO: 696118 - DNA, 25 bp, Mus musculus
gcttctactgggaggaccggctgct

SEQ ID NO: 696119 - DNA, 25 bp, Mus musculus
gcttctactgggtggaccggctgct

SEQ ID NO: 696120 - DNA, 25 bp, Mus musculus
gcttctagctttctacttgctccag

SEQ ID NO: 696121 - DNA, 25 bp, Mus musculus
gcttctagctttgtacttgctccag

SEQ ID NO: 696122 - DNA, 25 bp, Mus musculus
gcttctaggaaaaatgctagggccg

SEQ ID NO: 696123 - DNA, 25 bp, Mus musculus
gcttctaggaaatatgctagggccg

SEQ ID NO: 696124 - DNA, 25 bp, Mus musculus
gcttctaggaggacagcggacctct

SEQ ID NO: 696125 - DNA, 25 bp, Mus musculus
gcttctaggaggtcagcggacctct

SEQ ID NO: 696126 - DNA, 25 bp, Mus musculus
gcttctagttaccattcagaaaaca

SEQ ID NO: 696127 - DNA, 25 bp, Mus musculus
gcttctagttacgattcagaaaaca

SEQ ID NO: 696128 - DNA, 25 bp, Mus musculus
gcttctagttccagctcagattcca

SEQ ID NO: 696129 - DNA, 25 bp, Mus musculus
gcttctagttcctgctcagattcca

SEQ ID NO: 696130 - DNA, 25 bp, Mus musculus
gcttctataagaacatcagcgacaa

SEQ ID NO: 696131 - DNA, 25 bp, Mus musculus
gcttctataagatcatcagcgacaa

SEQ ID NO: 696132 - DNA, 25 bp, Mus musculus
gcttctatattaccatggaggagta

SEQ ID NO: 696133 - DNA, 25 bp, Mus musculus
gcttctatattagcatggaggagta

SEQ ID NO: 696134 - DNA, 25 bp, Mus musculus
gcttctatcactacacggagtctga

SEQ ID NO: 696135 - DNA, 25 bp, Mus musculus
gcttctatcacttcacggagtctga

SEQ ID NO: 696136 - DNA, 25 bp, Mus musculus
gcttctatctaaaacctggtcacag

SEQ ID NO: 696137 - DNA, 25 bp, Mus musculus
gcttctatctaatacctggtcacag

SEQ ID NO: 696138 - DNA, 25 bp, Mus musculus
gcttctatcttgaggcatgtgggcc

SEQ ID NO: 696139 - DNA, 25 bp, Mus musculus
gcttctatcttgtggcatgtgggcc

SEQ ID NO: 696140 - DNA, 25 bp, Mus musculus
gcttctatgcctaatacacaacctt

SEQ ID NO: 696141 - DNA, 25 bp, Mus musculus
gcttctatgccttatacacaacctt

SEQ ID NO: 696142 - DNA, 25 bp, Mus musculus
gcttctattgccaacattgttaaaa

SEQ ID NO: 696143 - DNA, 25 bp, Mus musculus
gcttctattgcctacattgttaaaa

SEQ ID NO: 696144 - DNA, 25 bp, Mus musculus
gcttctcaaaccagggctgcttcct

SEQ ID NO: 696145 - DNA, 25 bp, Mus musculus
gcttctcaaacctgggctgcttcct

SEQ ID NO: 696146 - DNA, 25 bp, Mus musculus
gcttctcaacttcgaggagtactac

SEQ ID NO: 696147 - DNA, 25 bp, Mus musculus
gcttctcaacttggaggagtactac

SEQ ID NO: 696148 - DNA, 25 bp, Mus musculus
gcttctcaccaaagccgagatgcag

SEQ ID NO: 696149 - DNA, 25 bp, Mus musculus
gcttctcaccaatgccgagatgcag

SEQ ID NO: 696150 - DNA, 25 bp, Mus musculus
gcttctcagacactcggctccatga

SEQ ID NO: 696151 - DNA, 25 bp, Mus musculus
gcttctcagacagtcggctccatga

SEQ ID NO: 696152 - DNA, 25 bp, Mus musculus
gcttctcagaggagttaactgtgga

SEQ ID NO: 696153 - DNA, 25 bp, Mus musculus
gcttctcagaggtgttaactgtgga

SEQ ID NO: 696154 - DNA, 25 bp, Mus musculus
gcttctcagtaaaacagcctctggg

SEQ ID NO: 696155 - DNA, 25 bp, Mus musculus
gcttctcagtaatacagcctctggg

SEQ ID NO: 696156 - DNA, 25 bp, Mus musculus
gcttctcatcatcgcggaccctaga

SEQ ID NO: 696157 - DNA, 25 bp, Mus musculus
gcttctcatcatggcggaccctaga

SEQ ID NO: 696158 - DNA, 25 bp, Mus musculus
gcttctcatcttcgagaggtttggg

SEQ ID NO: 696159 - DNA, 25 bp, Mus musculus
gcttctcatcttggagaggtttggg

SEQ ID NO: 696160 - DNA, 25 bp, Mus musculus
gcttctccagcaatgattacttcag

SEQ ID NO: 696161 - DNA, 25 bp, Mus musculus
gcttctccagcattgattacttcag

SEQ ID NO: 696162 - DNA, 25 bp, Mus musculus
gcttctccatttaagcccgttttgg

SEQ ID NO: 696163 - DNA, 25 bp, Mus musculus
gcttctccattttagcccgttttgg

SEQ ID NO: 696164 - DNA, 25 bp, Mus musculus
gcttctccctggacggggaagcctg

SEQ ID NO: 696165 - DNA, 25 bp, Mus musculus
gcttctccctggtcggggaagcctg

SEQ ID NO: 696166 - DNA, 25 bp, Mus musculus
gcttctcccttgagggcaacaaatg

SEQ ID NO: 696167 - DNA, 25 bp, Mus musculus
gcttctcccttgtgggcaacaaatg

SEQ ID NO: 696168 - DNA, 25 bp, Mus musculus
gcttctccgagacagccaagtgtca

SEQ ID NO: 696169 - DNA, 25 bp, Mus musculus
gcttctccgagagagccaagtgtca

SEQ ID NO: 696170 - DNA, 25 bp, Mus musculus
gcttctccgccgcacttaagtcggg

SEQ ID NO: 696171 - DNA, 25 bp, Mus musculus
gcttctccgccggacttaagtcggg

SEQ ID NO: 696172 - DNA, 25 bp, Mus musculus
gcttctccgtgtccatgctagcagg

SEQ ID NO: 696173 - DNA, 25 bp, Mus musculus
gcttctccgtgtgcatgctagcagg

SEQ ID NO: 696174 - DNA, 25 bp, Mus musculus
gcttctcctaccatgataaggcaga

SEQ ID NO: 696175 - DNA, 25 bp, Mus musculus
gcttctcctaccttgataaggcaga

SEQ ID NO: 696176 - DNA, 25 bp, Mus musculus
gcttctcctgacaatgaaaggatca

SEQ ID NO: 696177 - DNA, 25 bp, Mus musculus
gcttctcctgactatgaaaggatca

SEQ ID NO: 696178 - DNA, 25 bp, Mus musculus
gcttctcgcagcatgctcgcactag

SEQ ID NO: 696179 - DNA, 25 bp, Mus musculus
gcttctcgcagcttgctcgcactag

SEQ ID NO: 696180 - DNA, 25 bp, Mus musculus
gcttctcgcggcatgatctcattgg

SEQ ID NO: 696181 - DNA, 25 bp, Mus musculus
gcttctcgcggcctgccagggtata

SEQ ID NO: 696182 - DNA, 25 bp, Mus musculus
gcttctcgcggcgtgccagggtata

SEQ ID NO: 696183 - DNA, 25 bp, Mus musculus
gcttctcgcggcttgatctcattgg

SEQ ID NO: 696184 - DNA, 25 bp, Mus musculus
gcttctcggaaccatctgtggatca

SEQ ID NO: 696185 - DNA, 25 bp, Mus musculus
gcttctcggaacgatctgtggatca

SEQ ID NO: 696186 - DNA, 25 bp, Mus musculus
gcttctcgggaaaaggtgctctgca

SEQ ID NO: 696187 - DNA, 25 bp, Mus musculus
gcttctcgggaataggtgctctgca

SEQ ID NO: 696188 - DNA, 25 bp, Mus musculus
gcttctcgggcaagttctatcatac

SEQ ID NO: 696189 - DNA, 25 bp, Mus musculus
gcttctcgggcatgttctatcatac

SEQ ID NO: 696190 - DNA, 25 bp, Mus musculus
gcttctctagtacagagactcagcc

SEQ ID NO: 696191 - DNA, 25 bp, Mus musculus
gcttctctagtagagagactcagcc

SEQ ID NO: 696192 - DNA, 25 bp, Mus musculus
gcttctctcaggaaaatgaggctga

SEQ ID NO: 696193 - DNA, 25 bp, Mus musculus
gcttctctcaggtaaatgaggctga

SEQ ID NO: 696194 - DNA, 25 bp, Mus musculus
gcttctctcggacttttggtcatga

SEQ ID NO: 696195 - DNA, 25 bp, Mus musculus
gcttctctcggagttttggtcatga

SEQ ID NO: 696196 - DNA, 25 bp, Mus musculus
gcttctctgatgcttaccgctttgg

SEQ ID NO: 696197 - DNA, 25 bp, Mus musculus
gcttctctgatggttaccgctttgg

SEQ ID NO: 696198 - DNA, 25 bp, Mus musculus
gcttctctgcagaaagcctgttctg

SEQ ID NO: 696199 - DNA, 25 bp, Mus musculus
gcttctctgcagtaagcctgttctg

SEQ ID NO: 696200 - DNA, 25 bp, Mus musculus
gcttctctggagatttgagaacgaa

SEQ ID NO: 696201 - DNA, 25 bp, Mus musculus
gcttctctggagttttgagaacgaa

SEQ ID NO: 696202 - DNA, 25 bp, Mus musculus
gcttctctggctacacaacgtatgg

SEQ ID NO: 696203 - DNA, 25 bp, Mus musculus
gcttctctggcttcacaacgtatgg

SEQ ID NO: 696204 - DNA, 25 bp, Mus musculus
gcttctctgtgtctcggagatgtag

SEQ ID NO: 696205 - DNA, 25 bp, Mus musculus
gcttctctgtgtgtcggagatgtag

SEQ ID NO: 696206 - DNA, 25 bp, Mus musculus
gcttctcttccacttcagcgggtca

SEQ ID NO: 696207 - DNA, 25 bp, Mus musculus
gcttctcttccagttcagcgggtca

SEQ ID NO: 696208 - DNA, 25 bp, Mus musculus
gcttctcttgatcatgggctgtaac

SEQ ID NO: 696209 - DNA, 25 bp, Mus musculus
gcttctcttgatgatgggctgtaac

SEQ ID NO: 696210 - DNA, 25 bp, Mus musculus
gcttctcttgttaattcactttcca

SEQ ID NO: 696211 - DNA, 25 bp, Mus musculus
gcttctcttgtttattcactttcca

SEQ ID NO: 696212 - DNA, 25 bp, Mus musculus
gcttctgaatctatctggccaccaa

SEQ ID NO: 696213 - DNA, 25 bp, Mus musculus
gcttctgaatctttctggccaccaa

SEQ ID NO: 696214 - DNA, 25 bp, Mus musculus
gcttctgacccaagccctattattt

SEQ ID NO: 696215 - DNA, 25 bp, Mus musculus
gcttctgacccatgccctattattt

SEQ ID NO: 696216 - DNA, 25 bp, Mus musculus
gcttctgactctaactgtcctcaga

SEQ ID NO: 696217 - DNA, 25 bp, Mus musculus
gcttctgactcttactgtcctcaga

SEQ ID NO: 696218 - DNA, 25 bp, Mus musculus
gcttctgacttcatcgtccgccagg

SEQ ID NO: 696219 - DNA, 25 bp, Mus musculus
gcttctgacttcttcgtccgccagg

SEQ ID NO: 696220 - DNA, 25 bp, Mus musculus
gcttctgagaacattatctactctt

SEQ ID NO: 696221 - DNA, 25 bp, Mus musculus
gcttctgagaactttatctactctt

SEQ ID NO: 696222 - DNA, 25 bp, Mus musculus
gcttctgagatcctgtttggcctgg

SEQ ID NO: 696223 - DNA, 25 bp, Mus musculus
gcttctgagatcgtgtttggcctgg

SEQ ID NO: 696224 - DNA, 25 bp, Mus musculus
gcttctgagctcagacagagcctgg

SEQ ID NO: 696225 - DNA, 25 bp, Mus musculus
gcttctgagctctgacagagcctgg

SEQ ID NO: 696226 - DNA, 25 bp, Mus musculus
gcttctgatgacaatggccaggatt

SEQ ID NO: 696227 - DNA, 25 bp, Mus musculus
gcttctgatgacatagatgatttga

SEQ ID NO: 696228 - DNA, 25 bp, Mus musculus
gcttctgatgactatggccaggatt

SEQ ID NO: 696229 - DNA, 25 bp, Mus musculus
gcttctgatgacttagatgatttga

SEQ ID NO: 696230 - DNA, 25 bp, Mus musculus
gcttctgattggagatttctcaaag

SEQ ID NO: 696231 - DNA, 25 bp, Mus musculus
gcttctgattggtgatttctcaaag

SEQ ID NO: 696232 - DNA, 25 bp, Mus musculus
gcttctgcaaacataagtggctctg

SEQ ID NO: 696233 - DNA, 25 bp, Mus musculus
gcttctgcaaacttaagtggctctg

SEQ ID NO: 696234 - DNA, 25 bp, Mus musculus
gcttctgcagaacatgttttatcac

SEQ ID NO: 696235 - DNA, 25 bp, Mus musculus
gcttctgcagaagatgttttatcac

SEQ ID NO: 696236 - DNA, 25 bp, Mus musculus
gcttctgccaggacccagtcatttg

SEQ ID NO: 696237 - DNA, 25 bp, Mus musculus
gcttctgccaggtcccagtcatttg

SEQ ID NO: 696238 - DNA, 25 bp, Mus musculus
gcttctgcctaaagtggtgaacaca

SEQ ID NO: 696239 - DNA, 25 bp, Mus musculus
gcttctgcctaatgtggtgaacaca

SEQ ID NO: 696240 - DNA, 25 bp, Mus musculus
gcttctgcctataaaattctgggat

SEQ ID NO: 696241 - DNA, 25 bp, Mus musculus
gcttctgcctattaaattctgggat

SEQ ID NO: 696242 - DNA, 25 bp, Mus musculus
gcttctgcgacaatgcaccttcctg

SEQ ID NO: 696243 - DNA, 25 bp, Mus musculus
gcttctgcgacattgcaccttcctg

SEQ ID NO: 696244 - DNA, 25 bp, Mus musculus
gcttctgcgagtccagggagggcgc

SEQ ID NO: 696245 - DNA, 25 bp, Mus musculus
gcttctgcgagtgcagggagggcgc

SEQ ID NO: 696246 - DNA, 25 bp, Mus musculus
gcttctgctacgctgtcgacactgg

SEQ ID NO: 696247 - DNA, 25 bp, Mus musculus
gcttctgctacggtgtcgacactgg

SEQ ID NO: 696248 - DNA, 25 bp, Mus musculus
gcttctgctcgcacgcacgctgtta

SEQ ID NO: 696249 - DNA, 25 bp, Mus musculus
gcttctgctcgctcgcacgctgtta

SEQ ID NO: 696250 - DNA, 25 bp, Mus musculus
gcttctgctgatcattctgatccta

SEQ ID NO: 696251 - DNA, 25 bp, Mus musculus
gcttctgctgatgattctgatccta

SEQ ID NO: 696252 - DNA, 25 bp, Mus musculus
gcttctgctgttcccactcgaggtt

SEQ ID NO: 696253 - DNA, 25 bp, Mus musculus
gcttctgctgttgccactcgaggtt

SEQ ID NO: 696254 - DNA, 25 bp, Mus musculus
gcttctggacaaccttcggaagatg

SEQ ID NO: 696255 - DNA, 25 bp, Mus musculus
gcttctggacaagcttcggaagatg

SEQ ID NO: 696256 - DNA, 25 bp, Mus musculus
gcttctggacttcgcctcattgtaa

SEQ ID NO: 696257 - DNA, 25 bp, Mus musculus
gcttctggacttggcctcattgtaa

SEQ ID NO: 696258 - DNA, 25 bp, Mus musculus
gcttctggagaacccgctcttgttc

SEQ ID NO: 696259 - DNA, 25 bp, Mus musculus
gcttctggagaagccgctcttgttc

SEQ ID NO: 696260 - DNA, 25 bp, Mus musculus
gcttctggatttaggattcccaccc

SEQ ID NO: 696261 - DNA, 25 bp, Mus musculus
gcttctggattttggattcccaccc

SEQ ID NO: 696262 - DNA, 25 bp, Mus musculus
gcttctggcaaacgacattcgggac

SEQ ID NO: 696263 - DNA, 25 bp, Mus musculus
gcttctggcaaaggacattcgggac

SEQ ID NO: 696264 - DNA, 25 bp, Mus musculus
gcttctggcagtagcatgatcttgc

SEQ ID NO: 696265 - DNA, 25 bp, Mus musculus
gcttctggcagttgcatgatcttgc

SEQ ID NO: 696266 - DNA, 25 bp, Mus musculus
gcttctggcattctttaccctctga

SEQ ID NO: 696267 - DNA, 25 bp, Mus musculus
gcttctggcattgtttaccctctga

SEQ ID NO: 696268 - DNA, 25 bp, Mus musculus
gcttctggccatccatttgtttata

SEQ ID NO: 696269 - DNA, 25 bp, Mus musculus
gcttctggccatgcatttgtttata

SEQ ID NO: 696270 - DNA, 25 bp, Mus musculus
gcttctgggaacaagatggcatccg

SEQ ID NO: 696271 - DNA, 25 bp, Mus musculus
gcttctgggaactagatggcatccg

SEQ ID NO: 696272 - DNA, 25 bp, Mus musculus
gcttctgggagacacttatgaatta

SEQ ID NO: 696273 - DNA, 25 bp, Mus musculus
gcttctgggagagacttatgaatta

SEQ ID NO: 696274 - DNA, 25 bp, Mus musculus
gcttctgggccacaaaaaaggcaca

SEQ ID NO: 696275 - DNA, 25 bp, Mus musculus
gcttctgggccagaaaaaaggcaca

SEQ ID NO: 696276 - DNA, 25 bp, Mus musculus
gcttctgggtgcatccaatgcagaa

SEQ ID NO: 696277 - DNA, 25 bp, Mus musculus
gcttctgggtgcttccaatgcagaa

SEQ ID NO: 696278 - DNA, 25 bp, Mus musculus
gcttctgggttgctagactcatgtc

SEQ ID NO: 696279 - DNA, 25 bp, Mus musculus
gcttctgggttggtagactcatgtc

SEQ ID NO: 696280 - DNA, 25 bp, Mus musculus
gcttctggtgaaattgcattatgca

SEQ ID NO: 696281 - DNA, 25 bp, Mus musculus
gcttctggtgaatttgcattatgca

SEQ ID NO: 696282 - DNA, 25 bp, Mus musculus
gcttctgtaaatagggcttctcggg

SEQ ID NO: 696283 - DNA, 25 bp, Mus musculus
gcttctgtaaattgggcttctcggg

SEQ ID NO: 696284 - DNA, 25 bp, Mus musculus
gcttctgtaggacacacatacccag

SEQ ID NO: 696285 - DNA, 25 bp, Mus musculus
gcttctgtaggacccgaggaacact

SEQ ID NO: 696286 - DNA, 25 bp, Mus musculus
gcttctgtaggagacacatacccag

SEQ ID NO: 696287 - DNA, 25 bp, Mus musculus
gcttctgtaggagccgaggaacact

SEQ ID NO: 696288 - DNA, 25 bp, Mus musculus
gcttctgtccttagttctttctaga

SEQ ID NO: 696289 - DNA, 25 bp, Mus musculus
gcttctgtcctttgttctttctaga

SEQ ID NO: 696290 - DNA, 25 bp, Mus musculus
gcttctgtctggaactaactggcca

SEQ ID NO: 696291 - DNA, 25 bp, Mus musculus
gcttctgtctggtactaactggcca

SEQ ID NO: 696292 - DNA, 25 bp, Mus musculus
gcttctgtgctgagctataattctc

SEQ ID NO: 696293 - DNA, 25 bp, Mus musculus
gcttctgtgctgtgctataattctc

SEQ ID NO: 696294 - DNA, 25 bp, Mus musculus
gcttctgtggctctctcctattaga

SEQ ID NO: 696295 - DNA, 25 bp, Mus musculus
gcttctgtggctgtctcctattaga

SEQ ID NO: 696296 - DNA, 25 bp, Mus musculus
gcttctgtgtctagatgtcagctca

SEQ ID NO: 696297 - DNA, 25 bp, Mus musculus
gcttctgtgtcttgatgtcagctca

SEQ ID NO: 696298 - DNA, 25 bp, Mus musculus
gcttctgtgtgactgtcttagcaaa

SEQ ID NO: 696299 - DNA, 25 bp, Mus musculus
gcttctgtgtgagtgtcttagcaaa

SEQ ID NO: 696300 - DNA, 25 bp, Mus musculus
gcttctgttagacactaagccctgg

SEQ ID NO: 696301 - DNA, 25 bp, Mus musculus
gcttctgttagagactaagccctgg

SEQ ID NO: 696302 - DNA, 25 bp, Mus musculus
gcttctgttattatcaggagatgcc

SEQ ID NO: 696303 - DNA, 25 bp, Mus musculus
gcttctgttattttcaggagatgcc

SEQ ID NO: 696304 - DNA, 25 bp, Mus musculus
gcttctgtttcacagatgcccgtgt

SEQ ID NO: 696305 - DNA, 25 bp, Mus musculus
gcttctgtttcagagatgcccgtgt

SEQ ID NO: 696306 - DNA, 25 bp, Mus musculus
gcttctgtttcccaggtgggctttg

SEQ ID NO: 696307 - DNA, 25 bp, Mus musculus
gcttctgtttccgaggtgggctttg

SEQ ID NO: 696308 - DNA, 25 bp, Mus musculus
gcttcttaagctcgtcatggctggg

SEQ ID NO: 696309 - DNA, 25 bp, Mus musculus
gcttcttaagctggtcatggctggg

SEQ ID NO: 696310 - DNA, 25 bp, Mus musculus
gcttcttaaggacgcagcacgacac

SEQ ID NO: 696311 - DNA, 25 bp, Mus musculus
gcttcttaaggaggcagcacgacac

SEQ ID NO: 696312 - DNA, 25 bp, Mus musculus
gcttcttacccacaaaggaccacgt

SEQ ID NO: 696313 - DNA, 25 bp, Mus musculus
gcttcttacccagaaaggaccacgt

SEQ ID NO: 696314 - DNA, 25 bp, Mus musculus
gcttcttactctaagttgccctttg

SEQ ID NO: 696315 - DNA, 25 bp, Mus musculus
gcttcttactcttagttgccctttg

SEQ ID NO: 696316 - DNA, 25 bp, Mus musculus
gcttcttatttcaaccaccaggcta

SEQ ID NO: 696317 - DNA, 25 bp, Mus musculus
gcttcttatttctaccaccaggcta

SEQ ID NO: 696318 - DNA, 25 bp, Mus musculus
gcttcttcacatctcttggccgtga

SEQ ID NO: 696319 - DNA, 25 bp, Mus musculus
gcttcttcacatgtcttggccgtga

SEQ ID NO: 696320 - DNA, 25 bp, Mus musculus
gcttcttcactaactacgagagccg

SEQ ID NO: 696321 - DNA, 25 bp, Mus musculus
gcttcttcactactgtggcagcgac

SEQ ID NO: 696322 - DNA, 25 bp, Mus musculus
gcttcttcactagtgtggcagcgac

SEQ ID NO: 696323 - DNA, 25 bp, Mus musculus
gcttcttcactatctacgagagccg

SEQ ID NO: 696324 - DNA, 25 bp, Mus musculus
gcttcttcagagattgctacttctc

SEQ ID NO: 696325 - DNA, 25 bp, Mus musculus
gcttcttcagagtttgctacttctc

SEQ ID NO: 696326 - DNA, 25 bp, Mus musculus
gcttcttcagatcgcccttgggaaa

SEQ ID NO: 696327 - DNA, 25 bp, Mus musculus
gcttcttcagatcgcgcaagtctca

SEQ ID NO: 696328 - DNA, 25 bp, Mus musculus
gcttcttcagatggcccttgggaaa

SEQ ID NO: 696329 - DNA, 25 bp, Mus musculus
gcttcttcagatggcgcaagtctca

SEQ ID NO: 696330 - DNA, 25 bp, Mus musculus
gcttcttcagctcggagaccactgc

SEQ ID NO: 696331 - DNA, 25 bp, Mus musculus
gcttcttcagctgggagaccactgc

SEQ ID NO: 696332 - DNA, 25 bp, Mus musculus
gcttcttcccggatgaccctagctt

SEQ ID NO: 696333 - DNA, 25 bp, Mus musculus
gcttcttcccggttgaccctagctt

SEQ ID NO: 696334 - DNA, 25 bp, Mus musculus
gcttcttcctgactgatatgactga

SEQ ID NO: 696335 - DNA, 25 bp, Mus musculus
gcttcttcctgagtgatatgactga

SEQ ID NO: 696336 - DNA, 25 bp, Mus musculus
gcttcttccttaaccgcgcttcagg

SEQ ID NO: 696337 - DNA, 25 bp, Mus musculus
gcttcttccttatccgcgcttcagg

SEQ ID NO: 696338 - DNA, 25 bp, Mus musculus
gcttcttcggagactgcgtgactca

SEQ ID NO: 696339 - DNA, 25 bp, Mus musculus
gcttcttcggagtctgcgtgactca

SEQ ID NO: 696340 - DNA, 25 bp, Mus musculus
gcttcttgactcatacatagacggg

SEQ ID NO: 696341 - DNA, 25 bp, Mus musculus
gcttcttgactcttacatagacggg

SEQ ID NO: 696342 - DNA, 25 bp, Mus musculus
gcttcttgcatccaggtgggcgcaa

SEQ ID NO: 696343 - DNA, 25 bp, Mus musculus
gcttcttgcatcgaggtgggcgcaa

SEQ ID NO: 696344 - DNA, 25 bp, Mus musculus
gcttcttgcgcacggatcagctgga

SEQ ID NO: 696345 - DNA, 25 bp, Mus musculus
gcttcttgcgcagggatcagctgga

SEQ ID NO: 696346 - DNA, 25 bp, Mus musculus
gcttcttgtagcacggttgacatgg

SEQ ID NO: 696347 - DNA, 25 bp, Mus musculus
gcttcttgtagctcggttgacatgg

SEQ ID NO: 696348 - DNA, 25 bp, Mus musculus
gcttcttgtggccatttctggtacc

SEQ ID NO: 696349 - DNA, 25 bp, Mus musculus
gcttcttgtggcgatttctggtacc

SEQ ID NO: 696350 - DNA, 25 bp, Mus musculus
gcttctttaaatcagagaccaagga

SEQ ID NO: 696351 - DNA, 25 bp, Mus musculus
gcttctttaaatgagagaccaagga

SEQ ID NO: 696352 - DNA, 25 bp, Mus musculus
gcttctttacggctaagaccacctt

SEQ ID NO: 696353 - DNA, 25 bp, Mus musculus
gcttctttacgggtaagaccacctt

SEQ ID NO: 696354 - DNA, 25 bp, Mus musculus
gcttctttccctagactccgctgga

SEQ ID NO: 696355 - DNA, 25 bp, Mus musculus
gcttctttcccttgactccgctgga

SEQ ID NO: 696356 - DNA, 25 bp, Mus musculus
gcttctttgagtaccgagcgtacag

SEQ ID NO: 696357 - DNA, 25 bp, Mus musculus
gcttctttgagttccgagcgtacag

SEQ ID NO: 696358 - DNA, 25 bp, Mus musculus
gcttctttggaccagagttcccctc

SEQ ID NO: 696359 - DNA, 25 bp, Mus musculus
gcttctttggacgagagttcccctc

SEQ ID NO: 696360 - DNA, 25 bp, Mus musculus
gcttctttggctagcgaaccttcag

SEQ ID NO: 696361 - DNA, 25 bp, Mus musculus
gcttctttggcttgcgaaccttcag

SEQ ID NO: 696362 - DNA, 25 bp, Mus musculus
gcttgaaaaatgactcagcacaggg

SEQ ID NO: 696363 - DNA, 25 bp, Mus musculus
gcttgaaaaatgtctcagcacaggg

SEQ ID NO: 696364 - DNA, 25 bp, Mus musculus
gcttgaaacttcaagctagactgtc

SEQ ID NO: 696365 - DNA, 25 bp, Mus musculus
gcttgaaacttctagctagactgtc

SEQ ID NO: 696366 - DNA, 25 bp, Mus musculus
gcttgaaatgaacacctagatcaca

SEQ ID NO: 696367 - DNA, 25 bp, Mus musculus
gcttgaaatgaagacctagatcaca

SEQ ID NO: 696368 - DNA, 25 bp, Mus musculus
gcttgaacaaaaatatggagtctct

SEQ ID NO: 696369 - DNA, 25 bp, Mus musculus
gcttgaacaaaattatggagtctct

SEQ ID NO: 696370 - DNA, 25 bp, Mus musculus
gcttgaacagtaagctattaagaag

SEQ ID NO: 696371 - DNA, 25 bp, Mus musculus
gcttgaacagtatgctattaagaag

SEQ ID NO: 696372 - DNA, 25 bp, Mus musculus
gcttgaaccaaaaatggtgagtgcc

SEQ ID NO: 696373 - DNA, 25 bp, Mus musculus
gcttgaaccaaatatggtgagtgcc

SEQ ID NO: 696374 - DNA, 25 bp, Mus musculus
gcttgaaccaggaagcagcggagcc

SEQ ID NO: 696375 - DNA, 25 bp, Mus musculus
gcttgaaccaggtagcagcggagcc

SEQ ID NO: 696376 - DNA, 25 bp, Mus musculus
gcttgaactcatagaagagccctcc

SEQ ID NO: 696377 - DNA, 25 bp, Mus musculus
gcttgaactcattgaagagccctcc

SEQ ID NO: 696378 - DNA, 25 bp, Mus musculus
gcttgaagaaaactgtctcgttccc

SEQ ID NO: 696379 - DNA, 25 bp, Mus musculus
gcttgaagaaaagtgtctcgttccc

SEQ ID NO: 696380 - DNA, 25 bp, Mus musculus
gcttgaagacacatggcttccttac

SEQ ID NO: 696381 - DNA, 25 bp, Mus musculus
gcttgaagacacttggcttccttac

SEQ ID NO: 696382 - DNA, 25 bp, Mus musculus
gcttgaagagcacctggatcacctg

SEQ ID NO: 696383 - DNA, 25 bp, Mus musculus
gcttgaagagcagctggatcacctg

SEQ ID NO: 696384 - DNA, 25 bp, Mus musculus
gcttgaagatagaggccgccaatgt

SEQ ID NO: 696385 - DNA, 25 bp, Mus musculus
gcttgaagatagtggccgccaatgt

SEQ ID NO: 696386 - DNA, 25 bp, Mus musculus
gcttgaagattgaaggcacgcgtgt

SEQ ID NO: 696387 - DNA, 25 bp, Mus musculus
gcttgaagattgtaggcacgcgtgt

SEQ ID NO: 696388 - DNA, 25 bp, Mus musculus
gcttgaagctgaaggtgactgtcaa

SEQ ID NO: 696389 - DNA, 25 bp, Mus musculus
gcttgaagctgatggtgactgtcaa

SEQ ID NO: 696390 - DNA, 25 bp, Mus musculus
gcttgaaggaaaaacagcacagcct

SEQ ID NO: 696391 - DNA, 25 bp, Mus musculus
gcttgaaggaaatacagcacagcct

SEQ ID NO: 696392 - DNA, 25 bp, Mus musculus
gcttgaataaaaagtgctcaaacct

SEQ ID NO: 696393 - DNA, 25 bp, Mus musculus
gcttgaataaaatgtgctcaaacct

SEQ ID NO: 696394 - DNA, 25 bp, Mus musculus
gcttgaatcaacaagatttgtgact

SEQ ID NO: 696395 - DNA, 25 bp, Mus musculus
gcttgaatcaactagatttgtgact

SEQ ID NO: 696396 - DNA, 25 bp, Mus musculus
gcttgaatcgtacgaggaaaaaacg

SEQ ID NO: 696397 - DNA, 25 bp, Mus musculus
gcttgaatcgtaggaggaaaaaacg

SEQ ID NO: 696398 - DNA, 25 bp, Mus musculus
gcttgaatctagcagctttattgac

SEQ ID NO: 696399 - DNA, 25 bp, Mus musculus
gcttgaatctaggagctttattgac

SEQ ID NO: 696400 - DNA, 25 bp, Mus musculus
gcttgaatctgtatatattgatgaa

SEQ ID NO: 696401 - DNA, 25 bp, Mus musculus
gcttgaatctgtttatattgatgaa

SEQ ID NO: 696402 - DNA, 25 bp, Mus musculus
gcttgaatgaaaacctggcttcatc

SEQ ID NO: 696403 - DNA, 25 bp, Mus musculus
gcttgaatgaaatcctggcttcatc

SEQ ID NO: 696404 - DNA, 25 bp, Mus musculus
gcttgaatgtcacctgcagacagaa

SEQ ID NO: 696405 - DNA, 25 bp, Mus musculus
gcttgaatgtcagctgcagacagaa

SEQ ID NO: 696406 - DNA, 25 bp, Mus musculus
gcttgaattccccagccatggtcct

SEQ ID NO: 696407 - DNA, 25 bp, Mus musculus
gcttgaattcccgagccatggtcct

SEQ ID NO: 696408 - DNA, 25 bp, Mus musculus
gcttgaattggccatgctgagtttt

SEQ ID NO: 696409 - DNA, 25 bp, Mus musculus
gcttgaattggcgatgctgagtttt

SEQ ID NO: 696410 - DNA, 25 bp, Mus musculus
gcttgacaacgcacccctttatcag

SEQ ID NO: 696411 - DNA, 25 bp, Mus musculus
gcttgacaacgctcccctttatcag

SEQ ID NO: 696412 - DNA, 25 bp, Mus musculus
gcttgacaactgaacttggaataaa

SEQ ID NO: 696413 - DNA, 25 bp, Mus musculus
gcttgacaactgtacttggaataaa

SEQ ID NO: 696414 - DNA, 25 bp, Mus musculus
gcttgacaacttaatcccagggtgg

SEQ ID NO: 696415 - DNA, 25 bp, Mus musculus
gcttgacaactttatcccagggtgg

SEQ ID NO: 696416 - DNA, 25 bp, Mus musculus
gcttgacaagaacaaactacaggcg

SEQ ID NO: 696417 - DNA, 25 bp, Mus musculus
gcttgacaagaagaaactacaggcg

SEQ ID NO: 696418 - DNA, 25 bp, Mus musculus
gcttgacaccgaccagaagtgcctt

SEQ ID NO: 696419 - DNA, 25 bp, Mus musculus
gcttgacaccgagcagaagtgcctt

SEQ ID NO: 696420 - DNA, 25 bp, Mus musculus
gcttgacattctcaaagactggtgc

SEQ ID NO: 696421 - DNA, 25 bp, Mus musculus
gcttgacattctgaaagactggtgc

SEQ ID NO: 696422 - DNA, 25 bp, Mus musculus
gcttgaccagcaatggctctgatga

SEQ ID NO: 696423 - DNA, 25 bp, Mus musculus
gcttgaccagcattggctctgatga

SEQ ID NO: 696424 - DNA, 25 bp, Mus musculus
gcttgactgactcccaacttggaaa

SEQ ID NO: 696425 - DNA, 25 bp, Mus musculus
gcttgactgactgccaacttggaaa

SEQ ID NO: 696426 - DNA, 25 bp, Mus musculus
gcttgactgtcaacgctgacgtagg

SEQ ID NO: 696427 - DNA, 25 bp, Mus musculus
gcttgactgtcatcgctgacgtagg

SEQ ID NO: 696428 - DNA, 25 bp, Mus musculus
gcttgacttcagaagaacagtttgg

SEQ ID NO: 696429 - DNA, 25 bp, Mus musculus
gcttgacttcagtagaacagtttgg

SEQ ID NO: 696430 - DNA, 25 bp, Mus musculus
gcttgacttcggctccttgaggagt

SEQ ID NO: 696431 - DNA, 25 bp, Mus musculus
gcttgacttcgggtccttgaggagt

SEQ ID NO: 696432 - DNA, 25 bp, Mus musculus
gcttgagatctacctggcttcaccg

SEQ ID NO: 696433 - DNA, 25 bp, Mus musculus
gcttgagatctagctggcttcaccg

SEQ ID NO: 696434 - DNA, 25 bp, Mus musculus
gcttgagatgaaagacatccatggc

SEQ ID NO: 696435 - DNA, 25 bp, Mus musculus
gcttgagatgaatgacatccatggc

SEQ ID NO: 696436 - DNA, 25 bp, Mus musculus
gcttgagatgctcccagccaagtgg

SEQ ID NO: 696437 - DNA, 25 bp, Mus musculus
gcttgagatgctgccagccaagtgg

SEQ ID NO: 696438 - DNA, 25 bp, Mus musculus
gcttgagcatccagtacaatacctg

SEQ ID NO: 696439 - DNA, 25 bp, Mus musculus
gcttgagcatcctgtacaatacctg

SEQ ID NO: 696440 - DNA, 25 bp, Mus musculus
gcttgagcctaacaaacccatgtgt

SEQ ID NO: 696441 - DNA, 25 bp, Mus musculus
gcttgagcctaagaaacccatgtgt

SEQ ID NO: 696442 - DNA, 25 bp, Mus musculus
gcttgagcctctacaaggcttccaa

SEQ ID NO: 696443 - DNA, 25 bp, Mus musculus
gcttgagcctcttcaaggcttccaa

SEQ ID NO: 696444 - DNA, 25 bp, Mus musculus
gcttgagctggcctggactacatga

SEQ ID NO: 696445 - DNA, 25 bp, Mus musculus
gcttgagctggcgtggactacatga

SEQ ID NO: 696446 - DNA, 25 bp, Mus musculus
gcttgaggccggaggatgctggcat

SEQ ID NO: 696447 - DNA, 25 bp, Mus musculus
gcttgaggccggtggatgctggcat

SEQ ID NO: 696448 - DNA, 25 bp, Mus musculus
gcttgagtccttcgctgtccctgta

SEQ ID NO: 696449 - DNA, 25 bp, Mus musculus
gcttgagtccttggctgtccctgta

SEQ ID NO: 696450 - DNA, 25 bp, Mus musculus
gcttgagttactctgcaggttcatc

SEQ ID NO: 696451 - DNA, 25 bp, Mus musculus
gcttgagttactgtgcaggttcatc

SEQ ID NO: 696452 - DNA, 25 bp, Mus musculus
gcttgatactgtaaagagtccactc

SEQ ID NO: 696453 - DNA, 25 bp, Mus musculus
gcttgatactgttaagagtccactc

SEQ ID NO: 696454 - DNA, 25 bp, Mus musculus
gcttgataggaacttggcagcacaa

SEQ ID NO: 696455 - DNA, 25 bp, Mus musculus
gcttgataggaagttggcagcacaa

SEQ ID NO: 696456 - DNA, 25 bp, Mus musculus
gcttgatccaggaatttatctgagg

SEQ ID NO: 696457 - DNA, 25 bp, Mus musculus
gcttgatccaggtatttatctgagg

SEQ ID NO: 696458 - DNA, 25 bp, Mus musculus
gcttgatcggctctggattttccac

SEQ ID NO: 696459 - DNA, 25 bp, Mus musculus
gcttgatcggctgtggattttccac

SEQ ID NO: 696460 - DNA, 25 bp, Mus musculus
gcttgatcgtgtcatcgctttctgg

SEQ ID NO: 696461 - DNA, 25 bp, Mus musculus
gcttgatcgtgtgatcgctttctgg

SEQ ID NO: 696462 - DNA, 25 bp, Mus musculus
gcttgatcttcgaagtggacagcaa

SEQ ID NO: 696463 - DNA, 25 bp, Mus musculus
gcttgatcttcgtagtggacagcaa

SEQ ID NO: 696464 - DNA, 25 bp, Mus musculus
gcttgatgattccacccaagactga

SEQ ID NO: 696465 - DNA, 25 bp, Mus musculus
gcttgatgattcgacccaagactga

SEQ ID NO: 696466 - DNA, 25 bp, Mus musculus
gcttgatgcaggatcttttggaaca

SEQ ID NO: 696467 - DNA, 25 bp, Mus musculus
gcttgatgcaggttcttttggaaca

SEQ ID NO: 696468 - DNA, 25 bp, Mus musculus
gcttgatgccaacacacagaggaga

SEQ ID NO: 696469 - DNA, 25 bp, Mus musculus
gcttgatgccaagacacagaggaga

SEQ ID NO: 696470 - DNA, 25 bp, Mus musculus
gcttgatgctctagtaatggacaga

SEQ ID NO: 696471 - DNA, 25 bp, Mus musculus
gcttgatgctcttgtaatggacaga

SEQ ID NO: 696472 - DNA, 25 bp, Mus musculus
gcttgatgggctatttgccctcgtt

SEQ ID NO: 696473 - DNA, 25 bp, Mus musculus
gcttgatgggctttttgccctcgtt

SEQ ID NO: 696474 - DNA, 25 bp, Mus musculus
gcttgatgggtcaggccggtctcct

SEQ ID NO: 696475 - DNA, 25 bp, Mus musculus
gcttgatgggtctggccggtctcct

SEQ ID NO: 696476 - DNA, 25 bp, Mus musculus
gcttgatgtccacgttgtcagcgca

SEQ ID NO: 696477 - DNA, 25 bp, Mus musculus
gcttgatgtccaggttgtcagcgca

SEQ ID NO: 696478 - DNA, 25 bp, Mus musculus
gcttgattgcttcagcgtgccatcg

SEQ ID NO: 696479 - DNA, 25 bp, Mus musculus
gcttgattgcttgagcgtgccatcg

SEQ ID NO: 696480 - DNA, 25 bp, Mus musculus
gcttgattggcaacgctttaactta

SEQ ID NO: 696481 - DNA, 25 bp, Mus musculus
gcttgattggcatcgctttaactta

SEQ ID NO: 696482 - DNA, 25 bp, Mus musculus
gcttgattttggcttggctcgacaa

SEQ ID NO: 696483 - DNA, 25 bp, Mus musculus
gcttgattttgggttggctcgacaa

SEQ ID NO: 696484 - DNA, 25 bp, Mus musculus
gcttgcaaggccctcctggaaaagt

SEQ ID NO: 696485 - DNA, 25 bp, Mus musculus
gcttgcaaggccgtcctggaaaagt

SEQ ID NO: 696486 - DNA, 25 bp, Mus musculus
gcttgcaagtcaacatgaccatgag

SEQ ID NO: 696487 - DNA, 25 bp, Mus musculus
gcttgcaagtcatcatgaccatgag

SEQ ID NO: 696488 - DNA, 25 bp, Mus musculus
gcttgcacacagatgatgtatggca

SEQ ID NO: 696489 - DNA, 25 bp, Mus musculus
gcttgcacacagttgatgtatggca

SEQ ID NO: 696490 - DNA, 25 bp, Mus musculus
gcttgcacagcaaatgtggatttta

SEQ ID NO: 696491 - DNA, 25 bp, Mus musculus
gcttgcacagcatatgtggatttta

SEQ ID NO: 696492 - DNA, 25 bp, Mus musculus
gcttgcacattacagcgcacgtggt

SEQ ID NO: 696493 - DNA, 25 bp, Mus musculus
gcttgcacattagagcgcacgtggt

SEQ ID NO: 696494 - DNA, 25 bp, Mus musculus
gcttgcacctcaagctgctcagcgt

SEQ ID NO: 696495 - DNA, 25 bp, Mus musculus
gcttgcacctcatgctgctcagcgt

SEQ ID NO: 696496 - DNA, 25 bp, Mus musculus
gcttgcacctgcatgccgagttttg

SEQ ID NO: 696497 - DNA, 25 bp, Mus musculus
gcttgcacctgcttgccgagttttg

SEQ ID NO: 696498 - DNA, 25 bp, Mus musculus
gcttgcacgcttagtgtcgcgcgac

SEQ ID NO: 696499 - DNA, 25 bp, Mus musculus
gcttgcacgctttgtgtcgcgcgac

SEQ ID NO: 696500 - DNA, 25 bp, Mus musculus
gcttgcagatggctcaaggactctg

SEQ ID NO: 696501 - DNA, 25 bp, Mus musculus
gcttgcagatgggtcaaggactctg

SEQ ID NO: 696502 - DNA, 25 bp, Mus musculus
gcttgcagccttcggccaaaacgag

SEQ ID NO: 696503 - DNA, 25 bp, Mus musculus
gcttgcagccttgggccaaaacgag

SEQ ID NO: 696504 - DNA, 25 bp, Mus musculus
gcttgcagcgctactttgagacacg

SEQ ID NO: 696505 - DNA, 25 bp, Mus musculus
gcttgcagcgcttctttgagacacg

SEQ ID NO: 696506 - DNA, 25 bp, Mus musculus
gcttgcaggccaaatgcacagagct

SEQ ID NO: 696507 - DNA, 25 bp, Mus musculus
gcttgcaggccatatgcacagagct

SEQ ID NO: 696508 - DNA, 25 bp, Mus musculus
gcttgcagggacatcccaaccatgg

SEQ ID NO: 696509 - DNA, 25 bp, Mus musculus
gcttgcagggacttcccaaccatgg

SEQ ID NO: 696510 - DNA, 25 bp, Mus musculus
gcttgcaggtgcctgaatgccttag

SEQ ID NO: 696511 - DNA, 25 bp, Mus musculus
gcttgcaggtgcgtgaatgccttag

SEQ ID NO: 696512 - DNA, 25 bp, Mus musculus
gcttgcatacagcagcaaagtagac

SEQ ID NO: 696513 - DNA, 25 bp, Mus musculus
gcttgcatacaggagcaaagtagac

SEQ ID NO: 696514 - DNA, 25 bp, Mus musculus
gcttgcatatctagacaaagattct

SEQ ID NO: 696515 - DNA, 25 bp, Mus musculus
gcttgcatatcttgacaaagattct

SEQ ID NO: 696516 - DNA, 25 bp, Mus musculus
gcttgcatgtcactggtagagacct

SEQ ID NO: 696517 - DNA, 25 bp, Mus musculus
gcttgcatgtcagtggtagagacct

SEQ ID NO: 696518 - DNA, 25 bp, Mus musculus
gcttgccaacgtcagggctgtgcca

SEQ ID NO: 696519 - DNA, 25 bp, Mus musculus
gcttgccaacgtgagggctgtgcca

SEQ ID NO: 696520 - DNA, 25 bp, Mus musculus
gcttgccacactagccgatgaagtg

SEQ ID NO: 696521 - DNA, 25 bp, Mus musculus
gcttgccacacttgccgatgaagtg

SEQ ID NO: 696522 - DNA, 25 bp, Mus musculus
gcttgccagatgagaagggtcgact

SEQ ID NO: 696523 - DNA, 25 bp, Mus musculus
gcttgccagatgtgaagggtcgact

SEQ ID NO: 696524 - DNA, 25 bp, Mus musculus
gcttgccatctccaagcacactgaa

SEQ ID NO: 696525 - DNA, 25 bp, Mus musculus
gcttgccatctcgaagcacactgaa

SEQ ID NO: 696526 - DNA, 25 bp, Mus musculus
gcttgccattgacatgggactccga

SEQ ID NO: 696527 - DNA, 25 bp, Mus musculus
gcttgccattgagatgggactccga

SEQ ID NO: 696528 - DNA, 25 bp, Mus musculus
gcttgcccacacaggtctgacagga

SEQ ID NO: 696529 - DNA, 25 bp, Mus musculus
gcttgcccacactggtctgacagga

SEQ ID NO: 696530 - DNA, 25 bp, Mus musculus
gcttgccgagttatgctgaaggaac

SEQ ID NO: 696531 - DNA, 25 bp, Mus musculus
gcttgccgagttttgctgaaggaac

SEQ ID NO: 696532 - DNA, 25 bp, Mus musculus
gcttgccgctggaggtgccctccag

SEQ ID NO: 696533 - DNA, 25 bp, Mus musculus
gcttgccgctggtggtgccctccag

SEQ ID NO: 696534 - DNA, 25 bp, Mus musculus
gcttgcctcagaaccagctctatgg

SEQ ID NO: 696535 - DNA, 25 bp, Mus musculus
gcttgcctcagatccagctctatgg

SEQ ID NO: 696536 - DNA, 25 bp, Mus musculus
gcttgcgaaataaacacgaaatggt

SEQ ID NO: 696537 - DNA, 25 bp, Mus musculus
gcttgcgaaatatacacgaaatggt

SEQ ID NO: 696538 - DNA, 25 bp, Mus musculus
gcttgcgaagtgagtggctttaccc

SEQ ID NO: 696539 - DNA, 25 bp, Mus musculus
gcttgcgaagtgtgtggctttaccc

SEQ ID NO: 696540 - DNA, 25 bp, Mus musculus
gcttgcgactttctcctcttgctgg

SEQ ID NO: 696541 - DNA, 25 bp, Mus musculus
gcttgcgactttgtcctcttgctgg

SEQ ID NO: 696542 - DNA, 25 bp, Mus musculus
gcttgcgtagccagatgcccaacag

SEQ ID NO: 696543 - DNA, 25 bp, Mus musculus
gcttgcgtagcctgatgcccaacag

SEQ ID NO: 696544 - DNA, 25 bp, Mus musculus
gcttgctacttacatctagatccca

SEQ ID NO: 696545 - DNA, 25 bp, Mus musculus
gcttgctacttagatctagatccca

SEQ ID NO: 696546 - DNA, 25 bp, Mus musculus
gcttgctacttcacggtccctgagg

SEQ ID NO: 696547 - DNA, 25 bp, Mus musculus
gcttgctacttctcggtccctgagg

SEQ ID NO: 696548 - DNA, 25 bp, Mus musculus
gcttgctacttgactgagactcgga

SEQ ID NO: 696549 - DNA, 25 bp, Mus musculus
gcttgctacttgtctgagactcgga

SEQ ID NO: 696550 - DNA, 25 bp, Mus musculus
gcttgctagtgcagaaagatgtgaa

SEQ ID NO: 696551 - DNA, 25 bp, Mus musculus
gcttgctagtgctgaaagatgtgaa

SEQ ID NO: 696552 - DNA, 25 bp, Mus musculus
gcttgctatcttcgtggcttgaact

SEQ ID NO: 696553 - DNA, 25 bp, Mus musculus
gcttgctatcttggtggcttgaact

SEQ ID NO: 696554 - DNA, 25 bp, Mus musculus
gcttgctattagagagacaaacaga

SEQ ID NO: 696555 - DNA, 25 bp, Mus musculus
gcttgctattagtgagacaaacaga

SEQ ID NO: 696556 - DNA, 25 bp, Mus musculus
gcttgctcagagattcagttccatg

SEQ ID NO: 696557 - DNA, 25 bp, Mus musculus
gcttgctcagagtttcagttccatg

SEQ ID NO: 696558 - DNA, 25 bp, Mus musculus
gcttgctcatcaatctgggccgcta

SEQ ID NO: 696559 - DNA, 25 bp, Mus musculus
gcttgctcatcattctgggccgcta

SEQ ID NO: 696560 - DNA, 25 bp, Mus musculus
gcttgctccaccaaaaagagagggt

SEQ ID NO: 696561 - DNA, 25 bp, Mus musculus
gcttgctccacctaaaagagagggt

SEQ ID NO: 696562 - DNA, 25 bp, Mus musculus
gcttgctctcttatcccctcggaag

SEQ ID NO: 696563 - DNA, 25 bp, Mus musculus
gcttgctctcttttcccctcggaag

SEQ ID NO: 696564 - DNA, 25 bp, Mus musculus
gcttgctcttaaacaaaatacatta

SEQ ID NO: 696565 - DNA, 25 bp, Mus musculus
gcttgctcttaatcaaaatacatta

SEQ ID NO: 696566 - DNA, 25 bp, Mus musculus
gcttgctgaataacttgctgcagag

SEQ ID NO: 696567 - DNA, 25 bp, Mus musculus
gcttgctgaatatcttgctgcagag

SEQ ID NO: 696568 - DNA, 25 bp, Mus musculus
gcttgctgacatcattccttgcatc

SEQ ID NO: 696569 - DNA, 25 bp, Mus musculus
gcttgctgacatgattccttgcatc

SEQ ID NO: 696570 - DNA, 25 bp, Mus musculus
gcttgctgctccactgggcctagct

SEQ ID NO: 696571 - DNA, 25 bp, Mus musculus
gcttgctgctcctctgggcctagct

SEQ ID NO: 696572 - DNA, 25 bp, Mus musculus
gcttgctgggcgacaacacaaggaa

SEQ ID NO: 696573 - DNA, 25 bp, Mus musculus
gcttgctgggcgtcaacacaaggaa

SEQ ID NO: 696574 - DNA, 25 bp, Mus musculus
gcttgctgtcgaccccaagactgag

SEQ ID NO: 696575 - DNA, 25 bp, Mus musculus
gcttgctgtcgagcccaagactgag

SEQ ID NO: 696576 - DNA, 25 bp, Mus musculus
gcttgctgttcaaggaaacctccgc

SEQ ID NO: 696577 - DNA, 25 bp, Mus musculus
gcttgctgttcatggaaacctccgc

SEQ ID NO: 696578 - DNA, 25 bp, Mus musculus
gcttggaaaaatctgtctcctgagg

SEQ ID NO: 696579 - DNA, 25 bp, Mus musculus
gcttggaaaaatgtgtctcctgagg

SEQ ID NO: 696580 - DNA, 25 bp, Mus musculus
gcttggaaacaccacagaaagtgga

SEQ ID NO: 696581 - DNA, 25 bp, Mus musculus
gcttggaaacacgacagaaagtgga

SEQ ID NO: 696582 - DNA, 25 bp, Mus musculus
gcttggaacataacgacttgccctg

SEQ ID NO: 696583 - DNA, 25 bp, Mus musculus
gcttggaacatatcgacttgccctg

SEQ ID NO: 696584 - DNA, 25 bp, Mus musculus
gcttggaagaggatataagccacca

SEQ ID NO: 696585 - DNA, 25 bp, Mus musculus
gcttggaagaggttataagccacca

SEQ ID NO: 696586 - DNA, 25 bp, Mus musculus
gcttggaagctaatgttccagttac

SEQ ID NO: 696587 - DNA, 25 bp, Mus musculus
gcttggaagctattgttccagttac

SEQ ID NO: 696588 - DNA, 25 bp, Mus musculus
gcttggaagttgagaaccatgaagt

SEQ ID NO: 696589 - DNA, 25 bp, Mus musculus
gcttggaagttgtgaaccatgaagt

SEQ ID NO: 696590 - DNA, 25 bp, Mus musculus
gcttggactatacgacactgcagga

SEQ ID NO: 696591 - DNA, 25 bp, Mus musculus
gcttggactataggacactgcagga

SEQ ID NO: 696592 - DNA, 25 bp, Mus musculus
gcttggagactccggtcatggaaat

SEQ ID NO: 696593 - DNA, 25 bp, Mus musculus
gcttggagactcgggtcatggaaat

SEQ ID NO: 696594 - DNA, 25 bp, Mus musculus
gcttggagagagcagacgtcctctc

SEQ ID NO: 696595 - DNA, 25 bp, Mus musculus
gcttggagagaggagacgtcctctc

SEQ ID NO: 696596 - DNA, 25 bp, Mus musculus
gcttggagcaggacaagaagctcaa

SEQ ID NO: 696597 - DNA, 25 bp, Mus musculus
gcttggagcaggtcaagaagctcaa

SEQ ID NO: 696598 - DNA, 25 bp, Mus musculus
gcttggagccaccaagaggtccatg

SEQ ID NO: 696599 - DNA, 25 bp, Mus musculus
gcttggagccacgaagaggtccatg

SEQ ID NO: 696600 - DNA, 25 bp, Mus musculus
gcttggaggagaacctgtcagcctg

SEQ ID NO: 696601 - DNA, 25 bp, Mus musculus
gcttggaggagatcctgtcagcctg

SEQ ID NO: 696602 - DNA, 25 bp, Mus musculus
gcttggaggatgacatcgtggaccc

SEQ ID NO: 696603 - DNA, 25 bp, Mus musculus
gcttggaggatgtcatcgtggaccc

SEQ ID NO: 696604 - DNA, 25 bp, Mus musculus
gcttggaggcttatgtggctattgc

SEQ ID NO: 696605 - DNA, 25 bp, Mus musculus
gcttggaggcttttgtggctattgc

SEQ ID NO: 696606 - DNA, 25 bp, Mus musculus
gcttggagggataagacagctcgca

SEQ ID NO: 696607 - DNA, 25 bp, Mus musculus
gcttggagggattagacagctcgca

SEQ ID NO: 696608 - DNA, 25 bp, Mus musculus
gcttggagtctaagctgggcacagc

SEQ ID NO: 696609 - DNA, 25 bp, Mus musculus
gcttggagtctatgctgggcacagc

SEQ ID NO: 696610 - DNA, 25 bp, Mus musculus
gcttggagtgcccacaggcatgcaa

SEQ ID NO: 696611 - DNA, 25 bp, Mus musculus
gcttggagtgccgacaggcatgcaa

SEQ ID NO: 696612 - DNA, 25 bp, Mus musculus
gcttggatagcacactctggctgaa

SEQ ID NO: 696613 - DNA, 25 bp, Mus musculus
gcttggatagcagactctggctgaa

SEQ ID NO: 696614 - DNA, 25 bp, Mus musculus
gcttggatctagcacaagctggatc

SEQ ID NO: 696615 - DNA, 25 bp, Mus musculus
gcttggatctaggacaagctggatc

SEQ ID NO: 696616 - DNA, 25 bp, Mus musculus
gcttggatctcaccgtttctctgcg

SEQ ID NO: 696617 - DNA, 25 bp, Mus musculus
gcttggatctcagcgtttctctgcg

SEQ ID NO: 696618 - DNA, 25 bp, Mus musculus
gcttggatgagtctaactgcaggaa

SEQ ID NO: 696619 - DNA, 25 bp, Mus musculus
gcttggatgagtgtaactgcaggaa

SEQ ID NO: 696620 - DNA, 25 bp, Mus musculus
gcttggatgcagattcctctctcct

SEQ ID NO: 696621 - DNA, 25 bp, Mus musculus
gcttggatgcagtttcctctctcct

SEQ ID NO: 696622 - DNA, 25 bp, Mus musculus
gcttggatgccaaaggacccttttt

SEQ ID NO: 696623 - DNA, 25 bp, Mus musculus
gcttggatgccataggacccttttt

SEQ ID NO: 696624 - DNA, 25 bp, Mus musculus
gcttggatggttctactaatgcaca

SEQ ID NO: 696625 - DNA, 25 bp, Mus musculus
gcttggatggttgtactaatgcaca

SEQ ID NO: 696626 - DNA, 25 bp, Mus musculus
gcttggcaaattccccgcttggacc

SEQ ID NO: 696627 - DNA, 25 bp, Mus musculus
gcttggcaaattgcccgcttggacc

SEQ ID NO: 696628 - DNA, 25 bp, Mus musculus
gcttggcaagtccatactctgcttt

SEQ ID NO: 696629 - DNA, 25 bp, Mus musculus
gcttggcaagtcgatactctgcttt

SEQ ID NO: 696630 - DNA, 25 bp, Mus musculus
gcttggcaatggcaacattaagttg

SEQ ID NO: 696631 - DNA, 25 bp, Mus musculus
gcttggcaatgggaacattaagttg

SEQ ID NO: 696632 - DNA, 25 bp, Mus musculus
gcttggcaccctacactggctacta

SEQ ID NO: 696633 - DNA, 25 bp, Mus musculus
gcttggcacccttcactggctacta

SEQ ID NO: 696634 - DNA, 25 bp, Mus musculus
gcttggcagccgcaacccaggctgt

SEQ ID NO: 696635 - DNA, 25 bp, Mus musculus
gcttggcagccggaacccaggctgt

SEQ ID NO: 696636 - DNA, 25 bp, Mus musculus
gcttggcccgtgatccttactgcgc

SEQ ID NO: 696637 - DNA, 25 bp, Mus musculus
gcttggcccgtgttccttactgcgc

SEQ ID NO: 696638 - DNA, 25 bp, Mus musculus
gcttggccgggaatgtattcatatt

SEQ ID NO: 696639 - DNA, 25 bp, Mus musculus
gcttggccgggattgtattcatatt

SEQ ID NO: 696640 - DNA, 25 bp, Mus musculus
gcttggcctgaaactgaataagttc

SEQ ID NO: 696641 - DNA, 25 bp, Mus musculus
gcttggcctgaatctgaataagttc

SEQ ID NO: 696642 - DNA, 25 bp, Mus musculus
gcttggcctgcacaacctccatgat

SEQ ID NO: 696643 - DNA, 25 bp, Mus musculus
gcttggcctgcagaacctccatgat

SEQ ID NO: 696644 - DNA, 25 bp, Mus musculus
gcttggcgctgcatcgagaacagtg

SEQ ID NO: 696645 - DNA, 25 bp, Mus musculus
gcttggcgctgcttcgagaacagtg

SEQ ID NO: 696646 - DNA, 25 bp, Mus musculus
gcttggctcaccatgtttgatgcgg

SEQ ID NO: 696647 - DNA, 25 bp, Mus musculus
gcttggctcaccttgtttgatgcgg

SEQ ID NO: 696648 - DNA, 25 bp, Mus musculus
gcttggctccaaaacgaggttacca

SEQ ID NO: 696649 - DNA, 25 bp, Mus musculus
gcttggctccaatacgaggttacca

SEQ ID NO: 696650 - DNA, 25 bp, Mus musculus
gcttggctccctacagtttggctat

SEQ ID NO: 696651 - DNA, 25 bp, Mus musculus
gcttggctcccttcagtttggctat

SEQ ID NO: 696652 - DNA, 25 bp, Mus musculus
gcttggctgaaccatcacagatgtt

SEQ ID NO: 696653 - DNA, 25 bp, Mus musculus
gcttggctgaacgatcacagatgtt

SEQ ID NO: 696654 - DNA, 25 bp, Mus musculus
gcttgggaaaagactgcaagttgtc

SEQ ID NO: 696655 - DNA, 25 bp, Mus musculus
gcttgggaaaagtctgcaagttgtc

SEQ ID NO: 696656 - DNA, 25 bp, Mus musculus
gcttgggaagggagctaaatctttt

SEQ ID NO: 696657 - DNA, 25 bp, Mus musculus
gcttgggaagggtgctaaatctttt

SEQ ID NO: 696658 - DNA, 25 bp, Mus musculus
gcttgggaatgaagtcagctgctcc

SEQ ID NO: 696659 - DNA, 25 bp, Mus musculus
gcttgggaatgatgtcagctgctcc

SEQ ID NO: 696660 - DNA, 25 bp, Mus musculus
gcttgggaatggctttaccatcacc

SEQ ID NO: 696661 - DNA, 25 bp, Mus musculus
gcttgggaatgggtttaccatcacc

SEQ ID NO: 696662 - DNA, 25 bp, Mus musculus
gcttgggaatgtcactactgcagag

SEQ ID NO: 696663 - DNA, 25 bp, Mus musculus
gcttgggaatgtgactactgcagag

SEQ ID NO: 696664 - DNA, 25 bp, Mus musculus
gcttgggagtgcctcacagcaaacg

SEQ ID NO: 696665 - DNA, 25 bp, Mus musculus
gcttgggagtgcgtcacagcaaacg

SEQ ID NO: 696666 - DNA, 25 bp, Mus musculus
gcttgggcatgactagaactttaaa

SEQ ID NO: 696667 - DNA, 25 bp, Mus musculus
gcttgggcatgagtagaactttaaa

SEQ ID NO: 696668 - DNA, 25 bp, Mus musculus
gcttgggccttcacagacagcagaa

SEQ ID NO: 696669 - DNA, 25 bp, Mus musculus
gcttgggccttctcagacagcagaa

SEQ ID NO: 696670 - DNA, 25 bp, Mus musculus
gcttgggtaacaatgatgacatcag

SEQ ID NO: 696671 - DNA, 25 bp, Mus musculus
gcttgggtaacattgatgacatcag

SEQ ID NO: 696672 - DNA, 25 bp, Mus musculus
gcttgggtccaactattgttcagta

SEQ ID NO: 696673 - DNA, 25 bp, Mus musculus
gcttgggtccaagtattgttcagta

SEQ ID NO: 696674 - DNA, 25 bp, Mus musculus
gcttgggtggctctcccttgcctgt

SEQ ID NO: 696675 - DNA, 25 bp, Mus musculus
gcttgggtggctgtcccttgcctgt

SEQ ID NO: 696676 - DNA, 25 bp, Mus musculus
gcttggtaattgaatcgattagaat

SEQ ID NO: 696677 - DNA, 25 bp, Mus musculus
gcttggtaattgtatcgattagaat

SEQ ID NO: 696678 - DNA, 25 bp, Mus musculus
gcttggtactcaagataaggacgat

SEQ ID NO: 696679 - DNA, 25 bp, Mus musculus
gcttggtactcatgataaggacgat

SEQ ID NO: 696680 - DNA, 25 bp, Mus musculus
gcttggtagagaatcctgctgttac

SEQ ID NO: 696681 - DNA, 25 bp, Mus musculus
gcttggtagagattcctgctgttac

SEQ ID NO: 696682 - DNA, 25 bp, Mus musculus
gcttggtccatgactcctctaggtc

SEQ ID NO: 696683 - DNA, 25 bp, Mus musculus
gcttggtccatgtctcctctaggtc

SEQ ID NO: 696684 - DNA, 25 bp, Mus musculus
gcttggtctcttcggcaacacttgg

SEQ ID NO: 696685 - DNA, 25 bp, Mus musculus
gcttggtctcttgggcaacacttgg

SEQ ID NO: 696686 - DNA, 25 bp, Mus musculus
gcttggtgacaccagttgaccagag

SEQ ID NO: 696687 - DNA, 25 bp, Mus musculus
gcttggtgacacgagttgaccagag

SEQ ID NO: 696688 - DNA, 25 bp, Mus musculus
gcttggtgcacacctagcagacacc

SEQ ID NO: 696689 - DNA, 25 bp, Mus musculus
gcttggtgcacagctagcagacacc

SEQ ID NO: 696690 - DNA, 25 bp, Mus musculus
gcttggtgcaccaagtgctcctctg

SEQ ID NO: 696691 - DNA, 25 bp, Mus musculus
gcttggtgcacctagtgctcctctg

SEQ ID NO: 696692 - DNA, 25 bp, Mus musculus
gcttggtgccagagtccttgaggat

SEQ ID NO: 696693 - DNA, 25 bp, Mus musculus
gcttggtgccagtgtccttgaggat

SEQ ID NO: 696694 - DNA, 25 bp, Mus musculus
gcttggtgcctaaccctggccaaga

SEQ ID NO: 696695 - DNA, 25 bp, Mus musculus
gcttggtgcctatccctggccaaga

SEQ ID NO: 696696 - DNA, 25 bp, Mus musculus
gcttggtgctccatactctgtgtgg

SEQ ID NO: 696697 - DNA, 25 bp, Mus musculus
gcttggtgctccttactctgtgtgg

SEQ ID NO: 696698 - DNA, 25 bp, Mus musculus
gcttggtgcttcaaccggactgact

SEQ ID NO: 696699 - DNA, 25 bp, Mus musculus
gcttggtgcttctaccggactgact

SEQ ID NO: 696700 - DNA, 25 bp, Mus musculus
gcttggtggaggagactcgaatcca

SEQ ID NO: 696701 - DNA, 25 bp, Mus musculus
gcttggtggaggtgactcgaatcca

SEQ ID NO: 696702 - DNA, 25 bp, Mus musculus
gcttggtggcacagactccaagtac

SEQ ID NO: 696703 - DNA, 25 bp, Mus musculus
gcttggtggcactgactccaagtac

SEQ ID NO: 696704 - DNA, 25 bp, Mus musculus
gcttggtgtgagatctcttcgggta

SEQ ID NO: 696705 - DNA, 25 bp, Mus musculus
gcttggtgtgagttctcttcgggta

SEQ ID NO: 696706 - DNA, 25 bp, Mus musculus
gcttggtgtggacccctccctacag

SEQ ID NO: 696707 - DNA, 25 bp, Mus musculus
gcttggtgtggagccctccctacag

SEQ ID NO: 696708 - DNA, 25 bp, Mus musculus
gcttggtgttcacggtctcccctgc

SEQ ID NO: 696709 - DNA, 25 bp, Mus musculus
gcttggtgttcagggtctcccctgc

SEQ ID NO: 696710 - DNA, 25 bp, Mus musculus
gcttggttggttcctcagctgcctg

SEQ ID NO: 696711 - DNA, 25 bp, Mus musculus
gcttggttggttgctcagctgcctg

SEQ ID NO: 696712 - DNA, 25 bp, Mus musculus
gcttgtagagttagccaccatctgt

SEQ ID NO: 696713 - DNA, 25 bp, Mus musculus
gcttgtagagtttgccaccatctgt

SEQ ID NO: 696714 - DNA, 25 bp, Mus musculus
gcttgtagcgcccagcgcttgcgct

SEQ ID NO: 696715 - DNA, 25 bp, Mus musculus
gcttgtagcgccgagcgcttgcgct

SEQ ID NO: 696716 - DNA, 25 bp, Mus musculus
gcttgtagctccagaggttcggtcc

SEQ ID NO: 696717 - DNA, 25 bp, Mus musculus
gcttgtagctcctgaggttcggtcc

SEQ ID NO: 696718 - DNA, 25 bp, Mus musculus
gcttgtaggaaaagaggttgagtct

SEQ ID NO: 696719 - DNA, 25 bp, Mus musculus
gcttgtaggaaatgaggttgagtct

SEQ ID NO: 696720 - DNA, 25 bp, Mus musculus
gcttgtaggactaggccagcccgcc

SEQ ID NO: 696721 - DNA, 25 bp, Mus musculus
gcttgtaggacttggccagcccgcc

SEQ ID NO: 696722 - DNA, 25 bp, Mus musculus
gcttgtatacttagctccacctgtg

SEQ ID NO: 696723 - DNA, 25 bp, Mus musculus
gcttgtatactttgctccacctgtg

SEQ ID NO: 696724 - DNA, 25 bp, Mus musculus
gcttgtatcccaagggcttattact

SEQ ID NO: 696725 - DNA, 25 bp, Mus musculus
gcttgtatcccatgggcttattact

SEQ ID NO: 696726 - DNA, 25 bp, Mus musculus
gcttgtatctcgctacggtggcaga

SEQ ID NO: 696727 - DNA, 25 bp, Mus musculus
gcttgtatctcggtacggtggcaga

SEQ ID NO: 696728 - DNA, 25 bp, Mus musculus
gcttgtatgcctctacttctgaagg

SEQ ID NO: 696729 - DNA, 25 bp, Mus musculus
gcttgtatgcctgtacttctgaagg

SEQ ID NO: 696730 - DNA, 25 bp, Mus musculus
gcttgtatgtctccagttgttatgt

SEQ ID NO: 696731 - DNA, 25 bp, Mus musculus
gcttgtatgtctgcagttgttatgt

SEQ ID NO: 696732 - DNA, 25 bp, Mus musculus
gcttgtattctaagtggcccaggct

SEQ ID NO: 696733 - DNA, 25 bp, Mus musculus
gcttgtattctatgtggcccaggct

SEQ ID NO: 696734 - DNA, 25 bp, Mus musculus
gcttgtcaacttagatttcttggga

SEQ ID NO: 696735 - DNA, 25 bp, Mus musculus
gcttgtcaactttgatttcttggga

SEQ ID NO: 696736 - DNA, 25 bp, Mus musculus
gcttgtcaagaacaggtaagagact

SEQ ID NO: 696737 - DNA, 25 bp, Mus musculus
gcttgtcaagaagaggtaagagact

SEQ ID NO: 696738 - DNA, 25 bp, Mus musculus
gcttgtcacactagctgccagctac

SEQ ID NO: 696739 - DNA, 25 bp, Mus musculus
gcttgtcacacttgctgccagctac

SEQ ID NO: 696740 - DNA, 25 bp, Mus musculus
gcttgtcactaaagtgctgctcatg

SEQ ID NO: 696741 - DNA, 25 bp, Mus musculus
gcttgtcactaatgtgctgctcatg

SEQ ID NO: 696742 - DNA, 25 bp, Mus musculus
gcttgtcactcaacagaatggcctg

SEQ ID NO: 696743 - DNA, 25 bp, Mus musculus
gcttgtcactcatcagaatggcctg

SEQ ID NO: 696744 - DNA, 25 bp, Mus musculus
gcttgtcactgccttcatcctctgg

SEQ ID NO: 696745 - DNA, 25 bp, Mus musculus
gcttgtcactgcgttcatcctctgg

SEQ ID NO: 696746 - DNA, 25 bp, Mus musculus
gcttgtcagaagctattttaagtac

SEQ ID NO: 696747 - DNA, 25 bp, Mus musculus
gcttgtcagaaggtattttaagtac

SEQ ID NO: 696748 - DNA, 25 bp, Mus musculus
gcttgtcaggacagtaaagtcagag

SEQ ID NO: 696749 - DNA, 25 bp, Mus musculus
gcttgtcaggactgtaaagtcagag

SEQ ID NO: 696750 - DNA, 25 bp, Mus musculus
gcttgtccaactacaacagtcggca

SEQ ID NO: 696751 - DNA, 25 bp, Mus musculus
gcttgtccaacttcaacagtcggca

SEQ ID NO: 696752 - DNA, 25 bp, Mus musculus
gcttgtccacacaagtccgtcctgt

SEQ ID NO: 696753 - DNA, 25 bp, Mus musculus
gcttgtccacactagtccgtcctgt

SEQ ID NO: 696754 - DNA, 25 bp, Mus musculus
gcttgtccataactaaaaacataga

SEQ ID NO: 696755 - DNA, 25 bp, Mus musculus
gcttgtccataagtaaaaacataga

SEQ ID NO: 696756 - DNA, 25 bp, Mus musculus
gcttgtccatgccatcgtgcctgga

SEQ ID NO: 696757 - DNA, 25 bp, Mus musculus
gcttgtccatgcgatcgtgcctgga

SEQ ID NO: 696758 - DNA, 25 bp, Mus musculus
gcttgtcccctgacttttcctgtct

SEQ ID NO: 696759 - DNA, 25 bp, Mus musculus
gcttgtcccctgtcttttcctgtct

SEQ ID NO: 696760 - DNA, 25 bp, Mus musculus
gcttgtccgggcaaggagcttccgc

SEQ ID NO: 696761 - DNA, 25 bp, Mus musculus
gcttgtccgggctaggagcttccgc

SEQ ID NO: 696762 - DNA, 25 bp, Mus musculus
gcttgtcctggaaacaaagcagcag

SEQ ID NO: 696763 - DNA, 25 bp, Mus musculus
gcttgtcctggatacaaagcagcag

SEQ ID NO: 696764 - DNA, 25 bp, Mus musculus
gcttgtcctgggagcccctagtcgg

SEQ ID NO: 696765 - DNA, 25 bp, Mus musculus
gcttgtcctgggtgcccctagtcgg

SEQ ID NO: 696766 - DNA, 25 bp, Mus musculus
gcttgtcgagagaagagcatgttcc

SEQ ID NO: 696767 - DNA, 25 bp, Mus musculus
gcttgtcgagagtagagcatgttcc

SEQ ID NO: 696768 - DNA, 25 bp, Mus musculus
gcttgtcgccctctgagtggaacca

SEQ ID NO: 696769 - DNA, 25 bp, Mus musculus
gcttgtcgccctgtgagtggaacca

SEQ ID NO: 696770 - DNA, 25 bp, Mus musculus
gcttgtctaagactttaccattcga

SEQ ID NO: 696771 - DNA, 25 bp, Mus musculus
gcttgtctaagagtttaccattcga

SEQ ID NO: 696772 - DNA, 25 bp, Mus musculus
gcttgtctagcaccaacagtctcta

SEQ ID NO: 696773 - DNA, 25 bp, Mus musculus
gcttgtctagcagcaacagtctcta

SEQ ID NO: 696774 - DNA, 25 bp, Mus musculus
gcttgtcttcatactgcctcacaga

SEQ ID NO: 696775 - DNA, 25 bp, Mus musculus
gcttgtcttcattctgcctcacaga

SEQ ID NO: 696776 - DNA, 25 bp, Mus musculus
gcttgtcttcctattgatgatgtat

SEQ ID NO: 696777 - DNA, 25 bp, Mus musculus
gcttgtcttccttttgatgatgtat

SEQ ID NO: 696778 - DNA, 25 bp, Mus musculus
gcttgtcttttgcttgcaggaagca

SEQ ID NO: 696779 - DNA, 25 bp, Mus musculus
gcttgtcttttggttgcaggaagca

SEQ ID NO: 696780 - DNA, 25 bp, Mus musculus
gcttgtgaaaccatctgacctttca

SEQ ID NO: 696781 - DNA, 25 bp, Mus musculus
gcttgtgaaaccttctgacctttca

SEQ ID NO: 696782 - DNA, 25 bp, Mus musculus
gcttgtgacatgagccacggatcgt

SEQ ID NO: 696783 - DNA, 25 bp, Mus musculus
gcttgtgacatgcacgtggccgaca

SEQ ID NO: 696784 - DNA, 25 bp, Mus musculus
gcttgtgacatggacgtggccgaca

SEQ ID NO: 696785 - DNA, 25 bp, Mus musculus
gcttgtgacatgtgccacggatcgt

SEQ ID NO: 696786 - DNA, 25 bp, Mus musculus
gcttgtgaccatcttaacgattcta

SEQ ID NO: 696787 - DNA, 25 bp, Mus musculus
gcttgtgaccatgttaacgattcta

SEQ ID NO: 696788 - DNA, 25 bp, Mus musculus
gcttgtgattttaaaccttggcggc

SEQ ID NO: 696789 - DNA, 25 bp, Mus musculus
gcttgtgatttttaaccttggcggc

SEQ ID NO: 696790 - DNA, 25 bp, Mus musculus
gcttgtgcaaaaccaactgtggcgt

SEQ ID NO: 696791 - DNA, 25 bp, Mus musculus
gcttgtgcaaaagcaactgtggcgt

SEQ ID NO: 696792 - DNA, 25 bp, Mus musculus
gcttgtgcaaatatatactttgaag

SEQ ID NO: 696793 - DNA, 25 bp, Mus musculus
gcttgtgcaaatttatactttgaag

SEQ ID NO: 696794 - DNA, 25 bp, Mus musculus
gcttgtgccaggacattcccattaa

SEQ ID NO: 696795 - DNA, 25 bp, Mus musculus
gcttgtgccaggtcattcccattaa

SEQ ID NO: 696796 - DNA, 25 bp, Mus musculus
gcttgtgcgtccattctgtccattg

SEQ ID NO: 696797 - DNA, 25 bp, Mus musculus
gcttgtgcgtcctttctgtccattg

SEQ ID NO: 696798 - DNA, 25 bp, Mus musculus
gcttgtgctaaacaaaagtcttcca

SEQ ID NO: 696799 - DNA, 25 bp, Mus musculus
gcttgtgctaaagaaaagtcttcca

SEQ ID NO: 696800 - DNA, 25 bp, Mus musculus
gcttgtgctagacgaatctgctgcc

SEQ ID NO: 696801 - DNA, 25 bp, Mus musculus
gcttgtgctagaggaatctgctgcc

SEQ ID NO: 696802 - DNA, 25 bp, Mus musculus
gcttgtgctgaaatacaccaaaatg

SEQ ID NO: 696803 - DNA, 25 bp, Mus musculus
gcttgtgctgaattacaccaaaatg

SEQ ID NO: 696804 - DNA, 25 bp, Mus musculus
gcttgtgctggtatgtggctctatc

SEQ ID NO: 696805 - DNA, 25 bp, Mus musculus
gcttgtgctggtttgtggctctatc

SEQ ID NO: 696806 - DNA, 25 bp, Mus musculus
gcttgtgcttggaatgcaatttaag

SEQ ID NO: 696807 - DNA, 25 bp, Mus musculus
gcttgtgcttggtatgcaatttaag

SEQ ID NO: 696808 - DNA, 25 bp, Mus musculus
gcttgtggacccatctggactgtca

SEQ ID NO: 696809 - DNA, 25 bp, Mus musculus
gcttgtggacccttctggactgtca

SEQ ID NO: 696810 - DNA, 25 bp, Mus musculus
gcttgtggaggcacaatccagacca

SEQ ID NO: 696811 - DNA, 25 bp, Mus musculus
gcttgtggaggctcaatccagacca

SEQ ID NO: 696812 - DNA, 25 bp, Mus musculus
gcttgtggatgtagcctggcttcat

SEQ ID NO: 696813 - DNA, 25 bp, Mus musculus
gcttgtggatgttgcctggcttcat

SEQ ID NO: 696814 - DNA, 25 bp, Mus musculus
gcttgtggcaacacgggccgtgaat

SEQ ID NO: 696815 - DNA, 25 bp, Mus musculus
gcttgtggcaactcgggccgtgaat

SEQ ID NO: 696816 - DNA, 25 bp, Mus musculus
gcttgtgggcaaaaagagtgattta

SEQ ID NO: 696817 - DNA, 25 bp, Mus musculus
gcttgtgggcaataagagtgattta

SEQ ID NO: 696818 - DNA, 25 bp, Mus musculus
gcttgtgggctaaggaagagatcca

SEQ ID NO: 696819 - DNA, 25 bp, Mus musculus
gcttgtgggctatggaagagatcca

SEQ ID NO: 696820 - DNA, 25 bp, Mus musculus
gcttgtggtgacctcatctccggga

SEQ ID NO: 696821 - DNA, 25 bp, Mus musculus
gcttgtggtgacgtcatctccggga

SEQ ID NO: 696822 - DNA, 25 bp, Mus musculus
gcttgtgtacgcatgactgcatgga

SEQ ID NO: 696823 - DNA, 25 bp, Mus musculus
gcttgtgtacgcttgactgcatgga

SEQ ID NO: 696824 - DNA, 25 bp, Mus musculus
gcttgtgtcgtcaaaatgccagata

SEQ ID NO: 696825 - DNA, 25 bp, Mus musculus
gcttgtgtcgtctaaatgccagata

SEQ ID NO: 696826 - DNA, 25 bp, Mus musculus
gcttgtgtgggcagctatctggaaa

SEQ ID NO: 696827 - DNA, 25 bp, Mus musculus
gcttgtgtgggctgctatctggaaa

SEQ ID NO: 696828 - DNA, 25 bp, Mus musculus
gcttgtgttcacctggcttccaaaa

SEQ ID NO: 696829 - DNA, 25 bp, Mus musculus
gcttgtgttcacgtggcttccaaaa

SEQ ID NO: 696830 - DNA, 25 bp, Mus musculus
gcttgtgttgcgcaggctttatccc

SEQ ID NO: 696831 - DNA, 25 bp, Mus musculus
gcttgtgttgcggaggctttatccc

SEQ ID NO: 696832 - DNA, 25 bp, Mus musculus
gcttgttaaggccaaagaacagatt

SEQ ID NO: 696833 - DNA, 25 bp, Mus musculus
gcttgttaaggcgaaagaacagatt

SEQ ID NO: 696834 - DNA, 25 bp, Mus musculus
gcttgttacagaagaatgtcgaaga

SEQ ID NO: 696835 - DNA, 25 bp, Mus musculus
gcttgttacagatgaatgtcgaaga

SEQ ID NO: 696836 - DNA, 25 bp, Mus musculus
gcttgttacattcacattcctgcag

SEQ ID NO: 696837 - DNA, 25 bp, Mus musculus
gcttgttacattgacattcctgcag

SEQ ID NO: 696838 - DNA, 25 bp, Mus musculus
gcttgttaccggcaagcctgcctgg

SEQ ID NO: 696839 - DNA, 25 bp, Mus musculus
gcttgttaccgggaagcctgcctgg

SEQ ID NO: 696840 - DNA, 25 bp, Mus musculus
gcttgttagagtagggactgctgat

SEQ ID NO: 696841 - DNA, 25 bp, Mus musculus
gcttgttagagttgggactgctgat

SEQ ID NO: 696842 - DNA, 25 bp, Mus musculus
gcttgttcaaacatcgaagagtatt

SEQ ID NO: 696843 - DNA, 25 bp, Mus musculus
gcttgttcaaacttcgaagagtatt

SEQ ID NO: 696844 - DNA, 25 bp, Mus musculus
gcttgttcaaccatacaaccctgcg

SEQ ID NO: 696845 - DNA, 25 bp, Mus musculus
gcttgttcaaccttacaaccctgcg

SEQ ID NO: 696846 - DNA, 25 bp, Mus musculus
gcttgttcatcgagcatgagatctg

SEQ ID NO: 696847 - DNA, 25 bp, Mus musculus
gcttgttcatcgtgcatgagatctg

SEQ ID NO: 696848 - DNA, 25 bp, Mus musculus
gcttgttcattgaggccactgagcg

SEQ ID NO: 696849 - DNA, 25 bp, Mus musculus
gcttgttcattgtggccactgagcg

SEQ ID NO: 696850 - DNA, 25 bp, Mus musculus
gcttgttccccaacacaatgctctt

SEQ ID NO: 696851 - DNA, 25 bp, Mus musculus
gcttgttccccatcacaatgctctt

SEQ ID NO: 696852 - DNA, 25 bp, Mus musculus
gcttgttccgagcaagctagctgaa

SEQ ID NO: 696853 - DNA, 25 bp, Mus musculus
gcttgttccgaggaagctagctgaa

SEQ ID NO: 696854 - DNA, 25 bp, Mus musculus
gcttgttcctttaccacggtgtgga

SEQ ID NO: 696855 - DNA, 25 bp, Mus musculus
gcttgttccttttccacggtgtgga

SEQ ID NO: 696856 - DNA, 25 bp, Mus musculus
gcttgttgaaggatctcagtgacaa

SEQ ID NO: 696857 - DNA, 25 bp, Mus musculus
gcttgttgaaggttctcagtgacaa

SEQ ID NO: 696858 - DNA, 25 bp, Mus musculus
gcttgttggagacccgcttgcatgt

SEQ ID NO: 696859 - DNA, 25 bp, Mus musculus
gcttgttggagagccgcttgcatgt

SEQ ID NO: 696860 - DNA, 25 bp, Mus musculus
gcttgttggccaagaaggatcaggc

SEQ ID NO: 696861 - DNA, 25 bp, Mus musculus
gcttgttggccatgaaggatcaggc

SEQ ID NO: 696862 - DNA, 25 bp, Mus musculus
gcttgttggttcagtgtcgccgcgc

SEQ ID NO: 696863 - DNA, 25 bp, Mus musculus
gcttgttggttctgtgtcgccgcgc

SEQ ID NO: 696864 - DNA, 25 bp, Mus musculus
gcttgttgtccaacttctcacggag

SEQ ID NO: 696865 - DNA, 25 bp, Mus musculus
gcttgttgtccatcttctcacggag

SEQ ID NO: 696866 - DNA, 25 bp, Mus musculus
gcttgtttgatgagaagcgtcatga

SEQ ID NO: 696867 - DNA, 25 bp, Mus musculus
gcttgtttgatgtgaagcgtcatga

SEQ ID NO: 696868 - DNA, 25 bp, Mus musculus
gcttgtttgggacctccttggagca

SEQ ID NO: 696869 - DNA, 25 bp, Mus musculus
gcttgtttgggagctccttggagca

SEQ ID NO: 696870 - DNA, 25 bp, Mus musculus
gcttgtttgtacactcctccgaccg

SEQ ID NO: 696871 - DNA, 25 bp, Mus musculus
gcttgtttgtactctcctccgaccg

SEQ ID NO: 696872 - DNA, 25 bp, Mus musculus
gcttgttttcacaggtaatttgctg

SEQ ID NO: 696873 - DNA, 25 bp, Mus musculus
gcttgttttcactggtaatttgctg

SEQ ID NO: 696874 - DNA, 25 bp, Mus musculus
gcttgttttgctcagggtccgatgt

SEQ ID NO: 696875 - DNA, 25 bp, Mus musculus
gcttgttttgctgagggtccgatgt

SEQ ID NO: 696876 - DNA, 25 bp, Mus musculus
gctttaaaacttagggctgggcgag

SEQ ID NO: 696877 - DNA, 25 bp, Mus musculus
gctttaaaactttgggctgggcgag

SEQ ID NO: 696878 - DNA, 25 bp, Mus musculus
gctttaaaagatctgcgtctgacag

SEQ ID NO: 696879 - DNA, 25 bp, Mus musculus
gctttaaaagatgtgcgtctgacag

SEQ ID NO: 696880 - DNA, 25 bp, Mus musculus
gctttaaaagtaacaacgtggatgt

SEQ ID NO: 696881 - DNA, 25 bp, Mus musculus
gctttaaaagtaacaccattctcag

SEQ ID NO: 696882 - DNA, 25 bp, Mus musculus
gctttaaaagtatcaacgtggatgt

SEQ ID NO: 696883 - DNA, 25 bp, Mus musculus
gctttaaaagtatcaccattctcag

SEQ ID NO: 696884 - DNA, 25 bp, Mus musculus
gctttaaaatggcaactttgtccag

SEQ ID NO: 696885 - DNA, 25 bp, Mus musculus
gctttaaaatgggaactttgtccag

SEQ ID NO: 696886 - DNA, 25 bp, Mus musculus
gctttaaaccaacagcccttcggtg

SEQ ID NO: 696887 - DNA, 25 bp, Mus musculus
gctttaaaccaagagcccttcggtg

SEQ ID NO: 696888 - DNA, 25 bp, Mus musculus
gctttaaacttgaaagactttgcca

SEQ ID NO: 696889 - DNA, 25 bp, Mus musculus
gctttaaacttgtaagactttgcca

SEQ ID NO: 696890 - DNA, 25 bp, Mus musculus
gctttaaagatcctgtgtaccgggc

SEQ ID NO: 696891 - DNA, 25 bp, Mus musculus
gctttaaagatcgtgtgtaccgggc

SEQ ID NO: 696892 - DNA, 25 bp, Mus musculus
gctttaaatgctcacttcagtagca

SEQ ID NO: 696893 - DNA, 25 bp, Mus musculus
gctttaaatgctgacttcagtagca

SEQ ID NO: 696894 - DNA, 25 bp, Mus musculus
gctttaactactctatgcctttaga

SEQ ID NO: 696895 - DNA, 25 bp, Mus musculus
gctttaactactgtatgcctttaga

SEQ ID NO: 696896 - DNA, 25 bp, Mus musculus
gctttaactgtaagaagtgctccct

SEQ ID NO: 696897 - DNA, 25 bp, Mus musculus
gctttaactgtatgaagtgctccct

SEQ ID NO: 696898 - DNA, 25 bp, Mus musculus
gctttaaggaacagaatgctgaaga

SEQ ID NO: 696899 - DNA, 25 bp, Mus musculus
gctttaaggaactgaatgctgaaga

SEQ ID NO: 696900 - DNA, 25 bp, Mus musculus
gctttaatcaagatcaagaatgaag

SEQ ID NO: 696901 - DNA, 25 bp, Mus musculus
gctttaatcaagttcaagaatgaag

SEQ ID NO: 696902 - DNA, 25 bp, Mus musculus
gctttaatcatgagcaggtgtaggg

SEQ ID NO: 696903 - DNA, 25 bp, Mus musculus
gctttaatcatgtgcaggtgtaggg

SEQ ID NO: 696904 - DNA, 25 bp, Mus musculus
gctttaatcgccatcggcaggaaca

SEQ ID NO: 696905 - DNA, 25 bp, Mus musculus
gctttaatcgccttcggcaggaaca

SEQ ID NO: 696906 - DNA, 25 bp, Mus musculus
gctttaatggagcagacctgagaaa

SEQ ID NO: 696907 - DNA, 25 bp, Mus musculus
gctttaatggaggagacctgagaaa

SEQ ID NO: 696908 - DNA, 25 bp, Mus musculus
gctttaatgggacagagggcccaac

SEQ ID NO: 696909 - DNA, 25 bp, Mus musculus
gctttaatgggagagagggcccaac

SEQ ID NO: 696910 - DNA, 25 bp, Mus musculus
gctttaattggaagctcttctggca

SEQ ID NO: 696911 - DNA, 25 bp, Mus musculus
gctttaattggatgctcttctggca

SEQ ID NO: 696912 - DNA, 25 bp, Mus musculus
gctttacaaagcaacaacagttgac

SEQ ID NO: 696913 - DNA, 25 bp, Mus musculus
gctttacaaagctacaacagttgac

SEQ ID NO: 696914 - DNA, 25 bp, Mus musculus
gctttacaaccgaaccccagagcag

SEQ ID NO: 696915 - DNA, 25 bp, Mus musculus
gctttacaaccgtaccccagagcag

SEQ ID NO: 696916 - DNA, 25 bp, Mus musculus
gctttacatgaacgagatgagagcc

SEQ ID NO: 696917 - DNA, 25 bp, Mus musculus
gctttacatgaaggagatgagagcc

SEQ ID NO: 696918 - DNA, 25 bp, Mus musculus
gctttaccaatacaatagagtctgc

SEQ ID NO: 696919 - DNA, 25 bp, Mus musculus
gctttaccaatagaatagagtctgc

SEQ ID NO: 696920 - DNA, 25 bp, Mus musculus
gctttaccacggcagtccagtgcct

SEQ ID NO: 696921 - DNA, 25 bp, Mus musculus
gctttaccacgggagtccagtgcct

SEQ ID NO: 696922 - DNA, 25 bp, Mus musculus
gctttacccagacttctttgctccg

SEQ ID NO: 696923 - DNA, 25 bp, Mus musculus
gctttacccagagttctttgctccg

SEQ ID NO: 696924 - DNA, 25 bp, Mus musculus
gctttaccctttcttgcacggagac

SEQ ID NO: 696925 - DNA, 25 bp, Mus musculus
gctttaccctttgttgcacggagac

SEQ ID NO: 696926 - DNA, 25 bp, Mus musculus
gctttaccgtgtacagctctaaaag

SEQ ID NO: 696927 - DNA, 25 bp, Mus musculus
gctttaccgtgttcagctctaaaag

SEQ ID NO: 696928 - DNA, 25 bp, Mus musculus
gctttacctggtctctacattggcc

SEQ ID NO: 696929 - DNA, 25 bp, Mus musculus
gctttacctggtgtctacattggcc

SEQ ID NO: 696930 - DNA, 25 bp, Mus musculus
gctttaccttccatacagacgttgg

SEQ ID NO: 696931 - DNA, 25 bp, Mus musculus
gctttaccttccttacagacgttgg

SEQ ID NO: 696932 - DNA, 25 bp, Mus musculus
gctttacctttgactagatgccggg

SEQ ID NO: 696933 - DNA, 25 bp, Mus musculus
gctttacctttgtctagatgccggg

SEQ ID NO: 696934 - DNA, 25 bp, Mus musculus
gctttacgacagaagctctgccaga

SEQ ID NO: 696935 - DNA, 25 bp, Mus musculus
gctttacgacagtagctctgccaga

SEQ ID NO: 696936 - DNA, 25 bp, Mus musculus
gctttacgttaacagcgctcgggac

SEQ ID NO: 696937 - DNA, 25 bp, Mus musculus
gctttacgttaagagcgctcgggac

SEQ ID NO: 696938 - DNA, 25 bp, Mus musculus
gctttactaggtcaagtctctctta

SEQ ID NO: 696939 - DNA, 25 bp, Mus musculus
gctttactaggtgaagtctctctta

SEQ ID NO: 696940 - DNA, 25 bp, Mus musculus
gctttactggctcagtccccaacat

SEQ ID NO: 696941 - DNA, 25 bp, Mus musculus
gctttactggctgagtccccaacat

SEQ ID NO: 696942 - DNA, 25 bp, Mus musculus
gctttacttctaactgctgccatag

SEQ ID NO: 696943 - DNA, 25 bp, Mus musculus
gctttacttctatctgctgccatag

SEQ ID NO: 696944 - DNA, 25 bp, Mus musculus
gctttagaaactctgatatgtcctt

SEQ ID NO: 696945 - DNA, 25 bp, Mus musculus
gctttagaaactgtgatatgtcctt

SEQ ID NO: 696946 - DNA, 25 bp, Mus musculus
gctttagaagaactactttcatggc

SEQ ID NO: 696947 - DNA, 25 bp, Mus musculus
gctttagaagaagtactttcatggc

SEQ ID NO: 696948 - DNA, 25 bp, Mus musculus
gctttagaccaacagcaaagaattg

SEQ ID NO: 696949 - DNA, 25 bp, Mus musculus
gctttagaccaagagcaaagaattg

SEQ ID NO: 696950 - DNA, 25 bp, Mus musculus
gctttagagaagcttggtgctgtct

SEQ ID NO: 696951 - DNA, 25 bp, Mus musculus
gctttagagaaggttggtgctgtct

SEQ ID NO: 696952 - DNA, 25 bp, Mus musculus
gctttagagaccaatgaggaccccg

SEQ ID NO: 696953 - DNA, 25 bp, Mus musculus
gctttagagacctatgaggaccccg

SEQ ID NO: 696954 - DNA, 25 bp, Mus musculus
gctttagcgagaaatgcccctggaa

SEQ ID NO: 696955 - DNA, 25 bp, Mus musculus
gctttagcgagatatgcccctggaa

SEQ ID NO: 696956 - DNA, 25 bp, Mus musculus
gctttaggaaacatcatagaagaag

SEQ ID NO: 696957 - DNA, 25 bp, Mus musculus
gctttaggaaacttcatagaagaag

SEQ ID NO: 696958 - DNA, 25 bp, Mus musculus
gctttaggaccaatgagaactgcgc

SEQ ID NO: 696959 - DNA, 25 bp, Mus musculus
gctttaggaccattgagaactgcgc

SEQ ID NO: 696960 - DNA, 25 bp, Mus musculus
gctttaggaggacgtttgctgctgc

SEQ ID NO: 696961 - DNA, 25 bp, Mus musculus
gctttaggaggaggtttgctgctgc

SEQ ID NO: 696962 - DNA, 25 bp, Mus musculus
gctttagggaacattgccagtaaga

SEQ ID NO: 696963 - DNA, 25 bp, Mus musculus
gctttagggaactttgccagtaaga

SEQ ID NO: 696964 - DNA, 25 bp, Mus musculus
gctttagggttgatagggctacagc

SEQ ID NO: 696965 - DNA, 25 bp, Mus musculus
gctttagggttgttagggctacagc

SEQ ID NO: 696966 - DNA, 25 bp, Mus musculus
gctttaggtgacaggaaatttgccc

SEQ ID NO: 696967 - DNA, 25 bp, Mus musculus
gctttaggtgactggaaatttgccc

SEQ ID NO: 696968 - DNA, 25 bp, Mus musculus
gctttagtggccaaagtatcccaga

SEQ ID NO: 696969 - DNA, 25 bp, Mus musculus
gctttagtggcctaagtatcccaga

SEQ ID NO: 696970 - DNA, 25 bp, Mus musculus
gctttagttcctcctctgcagagga

SEQ ID NO: 696971 - DNA, 25 bp, Mus musculus
gctttagttcctgctctgcagagga

SEQ ID NO: 696972 - DNA, 25 bp, Mus musculus
gctttataacaaaatgacattggcc

SEQ ID NO: 696973 - DNA, 25 bp, Mus musculus
gctttataacaatatgacattggcc

SEQ ID NO: 696974 - DNA, 25 bp, Mus musculus
gctttatactgaagcctatgcagcg

SEQ ID NO: 696975 - DNA, 25 bp, Mus musculus
gctttatactgatgcctatgcagcg

SEQ ID NO: 696976 - DNA, 25 bp, Mus musculus
gctttatacttgagcttcaatcccc

SEQ ID NO: 696977 - DNA, 25 bp, Mus musculus
gctttatacttgtgcttcaatcccc

SEQ ID NO: 696978 - DNA, 25 bp, Mus musculus
gctttatagatacctggcccaccct

SEQ ID NO: 696979 - DNA, 25 bp, Mus musculus
gctttatagatagctggcccaccct

SEQ ID NO: 696980 - DNA, 25 bp, Mus musculus
gctttatcagacagactgaagtgag

SEQ ID NO: 696981 - DNA, 25 bp, Mus musculus
gctttatcagactgactgaagtgag

SEQ ID NO: 696982 - DNA, 25 bp, Mus musculus
gctttatcttcaagacagtcgtgta

SEQ ID NO: 696983 - DNA, 25 bp, Mus musculus
gctttatcttcatgacagtcgtgta

SEQ ID NO: 696984 - DNA, 25 bp, Mus musculus
gctttatgaaacacttacttactcg

SEQ ID NO: 696985 - DNA, 25 bp, Mus musculus
gctttatgaaactcttacttactcg

SEQ ID NO: 696986 - DNA, 25 bp, Mus musculus
gctttatgcgagaggcactgtcaga

SEQ ID NO: 696987 - DNA, 25 bp, Mus musculus
gctttatgcgagtggcactgtcaga

SEQ ID NO: 696988 - DNA, 25 bp, Mus musculus
gctttatggattacggaatttcgga

SEQ ID NO: 696989 - DNA, 25 bp, Mus musculus
gctttatggatttcggaatttcgga

SEQ ID NO: 696990 - DNA, 25 bp, Mus musculus
gctttatgggacctgcgtaatctga

SEQ ID NO: 696991 - DNA, 25 bp, Mus musculus
gctttatgggacgtgcgtaatctga

SEQ ID NO: 696992 - DNA, 25 bp, Mus musculus
gctttatgtatgatctctgcaaata

SEQ ID NO: 696993 - DNA, 25 bp, Mus musculus
gctttatgtatgttctctgcaaata

SEQ ID NO: 696994 - DNA, 25 bp, Mus musculus
gctttatgtgagaatgcgagatcca

SEQ ID NO: 696995 - DNA, 25 bp, Mus musculus
gctttatgtgagtatgcgagatcca

SEQ ID NO: 696996 - DNA, 25 bp, Mus musculus
gctttattacaacgtgggcaaaaag

SEQ ID NO: 696997 - DNA, 25 bp, Mus musculus
gctttattacaaggtgggcaaaaag

SEQ ID NO: 696998 - DNA, 25 bp, Mus musculus
gctttatttgggacggagagaagcc

SEQ ID NO: 696999 - DNA, 25 bp, Mus musculus
gctttatttgggtcggagagaagcc

SEQ ID NO: 697000 - DNA, 25 bp, Mus musculus
gctttcaaagtcagagaattttcta

SEQ ID NO: 697001 - DNA, 25 bp, Mus musculus
gctttcaaagtctgagaattttcta

SEQ ID NO: 697002 - DNA, 25 bp, Mus musculus
gctttcaaccgaatatatgtggcct

SEQ ID NO: 697003 - DNA, 25 bp, Mus musculus
gctttcaaccgattatatgtggcct

SEQ ID NO: 697004 - DNA, 25 bp, Mus musculus
gctttcaactttcacaaggagactg

SEQ ID NO: 697005 - DNA, 25 bp, Mus musculus
gctttcaactttgacaaggagactg

SEQ ID NO: 697006 - DNA, 25 bp, Mus musculus
gctttcaatctgaccacaggaccag

SEQ ID NO: 697007 - DNA, 25 bp, Mus musculus
gctttcaatctgtccacaggaccag

SEQ ID NO: 697008 - DNA, 25 bp, Mus musculus
gctttcacaatgcagtccagtacaa

SEQ ID NO: 697009 - DNA, 25 bp, Mus musculus
gctttcacaatggagtccagtacaa

SEQ ID NO: 697010 - DNA, 25 bp, Mus musculus
gctttcacgaggatggtcgctggat

SEQ ID NO: 697011 - DNA, 25 bp, Mus musculus
gctttcacgaggttggtcgctggat

SEQ ID NO: 697012 - DNA, 25 bp, Mus musculus
gctttcacgtttctcaagtttccaa

SEQ ID NO: 697013 - DNA, 25 bp, Mus musculus
gctttcacgtttgtcaagtttccaa

SEQ ID NO: 697014 - DNA, 25 bp, Mus musculus
gctttcactgaacaaattctcaagg

SEQ ID NO: 697015 - DNA, 25 bp, Mus musculus
gctttcactgaagaaattctcaagg

SEQ ID NO: 697016 - DNA, 25 bp, Mus musculus
gctttcactgacctatgagccactc

SEQ ID NO: 697017 - DNA, 25 bp, Mus musculus
gctttcactgacgtatgagccactc

SEQ ID NO: 697018 - DNA, 25 bp, Mus musculus
gctttcactgcaccaacactgggta

SEQ ID NO: 697019 - DNA, 25 bp, Mus musculus
gctttcactgcagcaacactgggta

SEQ ID NO: 697020 - DNA, 25 bp, Mus musculus
gctttcagcctgatggatatgagca

SEQ ID NO: 697021 - DNA, 25 bp, Mus musculus
gctttcagcctgttggatatgagca

SEQ ID NO: 697022 - DNA, 25 bp, Mus musculus
gctttcaggtttcgctggcgttccg

SEQ ID NO: 697023 - DNA, 25 bp, Mus musculus
gctttcaggtttggctggcgttccg

SEQ ID NO: 697024 - DNA, 25 bp, Mus musculus
gctttcagtcaccagctagagcgca

SEQ ID NO: 697025 - DNA, 25 bp, Mus musculus
gctttcagtcacgagctagagcgca

SEQ ID NO: 697026 - DNA, 25 bp, Mus musculus
gctttcagtgccagctggtgcgccc

SEQ ID NO: 697027 - DNA, 25 bp, Mus musculus
gctttcagtgcctgctggtgcgccc

SEQ ID NO: 697028 - DNA, 25 bp, Mus musculus
gctttcatcctacacgcaaatccag

SEQ ID NO: 697029 - DNA, 25 bp, Mus musculus
gctttcatcctagacgcaaatccag

SEQ ID NO: 697030 - DNA, 25 bp, Mus musculus
gctttcatctggagtctgtcatgat

SEQ ID NO: 697031 - DNA, 25 bp, Mus musculus
gctttcatctggtgtctgtcatgat

SEQ ID NO: 697032 - DNA, 25 bp, Mus musculus
gctttcattaagaagagccctccag

SEQ ID NO: 697033 - DNA, 25 bp, Mus musculus
gctttcattaagtagagccctccag

SEQ ID NO: 697034 - DNA, 25 bp, Mus musculus
gctttcattgaacaagaagccaatg

SEQ ID NO: 697035 - DNA, 25 bp, Mus musculus
gctttcattgaagaagaagccaatg

SEQ ID NO: 697036 - DNA, 25 bp, Mus musculus
gctttcatttatatcccacgagtta

SEQ ID NO: 697037 - DNA, 25 bp, Mus musculus
gctttcatttatttcccacgagtta

SEQ ID NO: 697038 - DNA, 25 bp, Mus musculus
gctttccaaagtagttgctgcctgt

SEQ ID NO: 697039 - DNA, 25 bp, Mus musculus
gctttccaaagttgttgctgcctgt

SEQ ID NO: 697040 - DNA, 25 bp, Mus musculus
gctttccacagcagaaggcaggaca

SEQ ID NO: 697041 - DNA, 25 bp, Mus musculus
gctttccacagctgaaggcaggaca

SEQ ID NO: 697042 - DNA, 25 bp, Mus musculus
gctttccagcagacgggcacagctg

SEQ ID NO: 697043 - DNA, 25 bp, Mus musculus
gctttccagcagtcgggcacagctg

SEQ ID NO: 697044 - DNA, 25 bp, Mus musculus
gctttccagggaaatggttggcctt

SEQ ID NO: 697045 - DNA, 25 bp, Mus musculus
gctttccagggatatggttggcctt

SEQ ID NO: 697046 - DNA, 25 bp, Mus musculus
gctttcccagaacctgcgtgttcag

SEQ ID NO: 697047 - DNA, 25 bp, Mus musculus
gctttcccagaagctgcgtgttcag

SEQ ID NO: 697048 - DNA, 25 bp, Mus musculus
gctttccccgtgacatgtagttgag

SEQ ID NO: 697049 - DNA, 25 bp, Mus musculus
gctttccccgtgtcatgtagttgag

SEQ ID NO: 697050 - DNA, 25 bp, Mus musculus
gctttcccgacgagaacttcacact

SEQ ID NO: 697051 - DNA, 25 bp, Mus musculus
gctttcccgacgtgaacttcacact

SEQ ID NO: 697052 - DNA, 25 bp, Mus musculus
gctttcccggccagccttctggaag

SEQ ID NO: 697053 - DNA, 25 bp, Mus musculus
gctttcccggcctgccttctggaag

SEQ ID NO: 697054 - DNA, 25 bp, Mus musculus
gctttcccgtccaggctaggttagg

SEQ ID NO: 697055 - DNA, 25 bp, Mus musculus
gctttcccgtcctggctaggttagg

SEQ ID NO: 697056 - DNA, 25 bp, Mus musculus
gctttcccgtttagaggctctgaag

SEQ ID NO: 697057 - DNA, 25 bp, Mus musculus
gctttcccgttttgaggctctgaag

SEQ ID NO: 697058 - DNA, 25 bp, Mus musculus
gctttccctagacatagcaaactta

SEQ ID NO: 697059 - DNA, 25 bp, Mus musculus
gctttccctagagatagcaaactta

SEQ ID NO: 697060 - DNA, 25 bp, Mus musculus
gctttccgacttcagttcagcacca

SEQ ID NO: 697061 - DNA, 25 bp, Mus musculus
gctttccgacttgagttcagcacca

SEQ ID NO: 697062 - DNA, 25 bp, Mus musculus
gctttccggaacatcaagaccatcg

SEQ ID NO: 697063 - DNA, 25 bp, Mus musculus
gctttccggaacttcaagaccatcg

SEQ ID NO: 697064 - DNA, 25 bp, Mus musculus
gctttccggctgattcgtcgagtga

SEQ ID NO: 697065 - DNA, 25 bp, Mus musculus
gctttccggctgtttcgtcgagtga

SEQ ID NO: 697066 - DNA, 25 bp, Mus musculus
gctttccgtgtgagtgaggtaccca

SEQ ID NO: 697067 - DNA, 25 bp, Mus musculus
gctttccgtgtgtgtgaggtaccca

SEQ ID NO: 697068 - DNA, 25 bp, Mus musculus
gctttcctacacagttattcattag

SEQ ID NO: 697069 - DNA, 25 bp, Mus musculus
gctttcctacactgttattcattag

SEQ ID NO: 697070 - DNA, 25 bp, Mus musculus
gctttcctcaaactcccagttaatg

SEQ ID NO: 697071 - DNA, 25 bp, Mus musculus
gctttcctcaaagtcccagttaatg

SEQ ID NO: 697072 - DNA, 25 bp, Mus musculus
gctttcctgacaactaagggactcc

SEQ ID NO: 697073 - DNA, 25 bp, Mus musculus
gctttcctgacatctaagggactcc

SEQ ID NO: 697074 - DNA, 25 bp, Mus musculus
gctttcctgcgacagtatggccaga

SEQ ID NO: 697075 - DNA, 25 bp, Mus musculus
gctttcctgcgagagtatggccaga

SEQ ID NO: 697076 - DNA, 25 bp, Mus musculus
gctttcctggctattgaacgctacg

SEQ ID NO: 697077 - DNA, 25 bp, Mus musculus
gctttcctggctcggttggtagacc

SEQ ID NO: 697078 - DNA, 25 bp, Mus musculus
gctttcctggctgggttggtagacc

SEQ ID NO: 697079 - DNA, 25 bp, Mus musculus
gctttcctggcttttgaacgctacg

SEQ ID NO: 697080 - DNA, 25 bp, Mus musculus
gctttcctggtcaaccatgacttca

SEQ ID NO: 697081 - DNA, 25 bp, Mus musculus
gctttcctggtctaccatgacttca

SEQ ID NO: 697082 - DNA, 25 bp, Mus musculus
gctttccttgaaatcttaccagcta

SEQ ID NO: 697083 - DNA, 25 bp, Mus musculus
gctttccttgaattcttaccagcta

SEQ ID NO: 697084 - DNA, 25 bp, Mus musculus
gctttccttgagagtcagccccgct

SEQ ID NO: 697085 - DNA, 25 bp, Mus musculus
gctttccttgagtgtcagccccgct

SEQ ID NO: 697086 - DNA, 25 bp, Mus musculus
gctttcctttacctctttgtctgct

SEQ ID NO: 697087 - DNA, 25 bp, Mus musculus
gctttcctttacgtctttgtctgct

SEQ ID NO: 697088 - DNA, 25 bp, Mus musculus
gctttcctttgacacagttttagag

SEQ ID NO: 697089 - DNA, 25 bp, Mus musculus
gctttcctttgagacagttttagag

SEQ ID NO: 697090 - DNA, 25 bp, Mus musculus
gctttccttttgaggcttgagagaa

SEQ ID NO: 697091 - DNA, 25 bp, Mus musculus
gctttccttttgtggcttgagagaa

SEQ ID NO: 697092 - DNA, 25 bp, Mus musculus
gctttcgatgaacccattgctgaac

SEQ ID NO: 697093 - DNA, 25 bp, Mus musculus
gctttcgatgaagccattgctgaac

SEQ ID NO: 697094 - DNA, 25 bp, Mus musculus
gctttcggaacacgatgactttgcc

SEQ ID NO: 697095 - DNA, 25 bp, Mus musculus
gctttcggaacaggatgactttgcc

SEQ ID NO: 697096 - DNA, 25 bp, Mus musculus
gctttcggcagcatcttgaacctgg

SEQ ID NO: 697097 - DNA, 25 bp, Mus musculus
gctttcggcagcttcttgaacctgg

SEQ ID NO: 697098 - DNA, 25 bp, Mus musculus
gctttcggctccatgcttttcgttg

SEQ ID NO: 697099 - DNA, 25 bp, Mus musculus
gctttcggctccttgcttttcgttg

SEQ ID NO: 697100 - DNA, 25 bp, Mus musculus
gctttcgggcctcggtgctagccca

SEQ ID NO: 697101 - DNA, 25 bp, Mus musculus
gctttcgggcctgggtgctagccca

SEQ ID NO: 697102 - DNA, 25 bp, Mus musculus
gctttcgtgcctagagcgtgtctgg

SEQ ID NO: 697103 - DNA, 25 bp, Mus musculus
gctttcgtgccttgagcgtgtctgg

SEQ ID NO: 697104 - DNA, 25 bp, Mus musculus
gctttctaaaatagagcgtgcaaac

SEQ ID NO: 697105 - DNA, 25 bp, Mus musculus
gctttctaaaattgagcgtgcaaac

SEQ ID NO: 697106 - DNA, 25 bp, Mus musculus
gctttctaaactagcaagtctgcag

SEQ ID NO: 697107 - DNA, 25 bp, Mus musculus
gctttctaaacttgcaagtctgcag

SEQ ID NO: 697108 - DNA, 25 bp, Mus musculus
gctttctaagacatggccgtgcgcg

SEQ ID NO: 697109 - DNA, 25 bp, Mus musculus
gctttctaagacttggccgtgcgcg

SEQ ID NO: 697110 - DNA, 25 bp, Mus musculus
gctttctaagcccaacggataggaa

SEQ ID NO: 697111 - DNA, 25 bp, Mus musculus
gctttctaagccgaacggataggaa

SEQ ID NO: 697112 - DNA, 25 bp, Mus musculus
gctttctacctcacagaaaggccaa

SEQ ID NO: 697113 - DNA, 25 bp, Mus musculus
gctttctacctctcagaaaggccaa

SEQ ID NO: 697114 - DNA, 25 bp, Mus musculus
gctttctagacaagaccttggatga

SEQ ID NO: 697115 - DNA, 25 bp, Mus musculus
gctttctagacatgaccttggatga

SEQ ID NO: 697116 - DNA, 25 bp, Mus musculus
gctttctattcgacttaggctccaa

SEQ ID NO: 697117 - DNA, 25 bp, Mus musculus
gctttctattcgtcttaggctccaa

SEQ ID NO: 697118 - DNA, 25 bp, Mus musculus
gctttctcacttctgcatgaaaaga

SEQ ID NO: 697119 - DNA, 25 bp, Mus musculus
gctttctcacttgtgcatgaaaaga

SEQ ID NO: 697120 - DNA, 25 bp, Mus musculus
gctttctccatgaaaggtaactgca

SEQ ID NO: 697121 - DNA, 25 bp, Mus musculus
gctttctccatgtaaggtaactgca

SEQ ID NO: 697122 - DNA, 25 bp, Mus musculus
gctttctcccggacacagtccttat

SEQ ID NO: 697123 - DNA, 25 bp, Mus musculus
gctttctcccggtcacagtccttat

SEQ ID NO: 697124 - DNA, 25 bp, Mus musculus
gctttctcctgtcataaactcatta

SEQ ID NO: 697125 - DNA, 25 bp, Mus musculus
gctttctcctgtgataaactcatta

SEQ ID NO: 697126 - DNA, 25 bp, Mus musculus
gctttctctccgagggaaccccagg

SEQ ID NO: 697127 - DNA, 25 bp, Mus musculus
gctttctctccgtgggaaccccagg

SEQ ID NO: 697128 - DNA, 25 bp, Mus musculus
gctttctgacaaagcagcatctctt

SEQ ID NO: 697129 - DNA, 25 bp, Mus musculus
gctttctgacaatgcagcatctctt

SEQ ID NO: 697130 - DNA, 25 bp, Mus musculus
gctttctgagaacctagcggtgtct

SEQ ID NO: 697131 - DNA, 25 bp, Mus musculus
gctttctgagaagctagcggtgtct

SEQ ID NO: 697132 - DNA, 25 bp, Mus musculus
gctttctgccaccacttgtgctgaa

SEQ ID NO: 697133 - DNA, 25 bp, Mus musculus
gctttctgccacgacttgtgctgaa

SEQ ID NO: 697134 - DNA, 25 bp, Mus musculus
gctttctgtgtcaagagcgtttcag

SEQ ID NO: 697135 - DNA, 25 bp, Mus musculus
gctttctgtgtctagagcgtttcag

SEQ ID NO: 697136 - DNA, 25 bp, Mus musculus
gctttctgttgactatggcaaaaag

SEQ ID NO: 697137 - DNA, 25 bp, Mus musculus
gctttctgttgagtatggcaaaaag

SEQ ID NO: 697138 - DNA, 25 bp, Mus musculus
gctttcttaagaaccatgtgggcca

SEQ ID NO: 697139 - DNA, 25 bp, Mus musculus
gctttcttaagatccatgtgggcca

SEQ ID NO: 697140 - DNA, 25 bp, Mus musculus
gctttcttatggatctgttggctaa

SEQ ID NO: 697141 - DNA, 25 bp, Mus musculus
gctttcttatggttctgttggctaa

SEQ ID NO: 697142 - DNA, 25 bp, Mus musculus
gctttcttcaaacgcaccacgtcgg

SEQ ID NO: 697143 - DNA, 25 bp, Mus musculus
gctttcttcaaaggcaccacgtcgg

SEQ ID NO: 697144 - DNA, 25 bp, Mus musculus
gctttcttcgccctcgctatcgggt

SEQ ID NO: 697145 - DNA, 25 bp, Mus musculus
gctttcttcgccgtcgctatcgggt

SEQ ID NO: 697146 - DNA, 25 bp, Mus musculus
gctttcttcgtacgccctgggaaca

SEQ ID NO: 697147 - DNA, 25 bp, Mus musculus
gctttcttcgtaggccctgggaaca

SEQ ID NO: 697148 - DNA, 25 bp, Mus musculus
gctttcttctgtactggctgctctg

SEQ ID NO: 697149 - DNA, 25 bp, Mus musculus
gctttcttctgttctggctgctctg

SEQ ID NO: 697150 - DNA, 25 bp, Mus musculus
gctttcttgggactagacgatgcca

SEQ ID NO: 697151 - DNA, 25 bp, Mus musculus
gctttcttgggagtagacgatgcca

SEQ ID NO: 697152 - DNA, 25 bp, Mus musculus
gctttctttcatcgccaagccctga

SEQ ID NO: 697153 - DNA, 25 bp, Mus musculus
gctttctttcatggccaagccctga

SEQ ID NO: 697154 - DNA, 25 bp, Mus musculus
gctttgaaattaaatgacctctggg

SEQ ID NO: 697155 - DNA, 25 bp, Mus musculus
gctttgaaattatatgacctctggg

SEQ ID NO: 697156 - DNA, 25 bp, Mus musculus
gctttgaacaagagagggaaataag

SEQ ID NO: 697157 - DNA, 25 bp, Mus musculus
gctttgaacaagtgagggaaataag

SEQ ID NO: 697158 - DNA, 25 bp, Mus musculus
gctttgaaccaccatctttgataac

SEQ ID NO: 697159 - DNA, 25 bp, Mus musculus
gctttgaaccacgatctttgataac

SEQ ID NO: 697160 - DNA, 25 bp, Mus musculus
gctttgaaccagaatggctgaccct

SEQ ID NO: 697161 - DNA, 25 bp, Mus musculus
gctttgaaccagtatggctgaccct

SEQ ID NO: 697162 - DNA, 25 bp, Mus musculus
gctttgaacttcaccgcgcacgtgg

SEQ ID NO: 697163 - DNA, 25 bp, Mus musculus
gctttgaacttctccgcgcacgtgg

SEQ ID NO: 697164 - DNA, 25 bp, Mus musculus
gctttgaagcctcgcaaaggccctg

SEQ ID NO: 697165 - DNA, 25 bp, Mus musculus
gctttgaagcctggcaaaggccctg

SEQ ID NO: 697166 - DNA, 25 bp, Mus musculus
gctttgaattcaagatttggctacc

SEQ ID NO: 697167 - DNA, 25 bp, Mus musculus
gctttgaattcatgatttggctacc

SEQ ID NO: 697168 - DNA, 25 bp, Mus musculus
gctttgacaaacaacagaaggctct

SEQ ID NO: 697169 - DNA, 25 bp, Mus musculus
gctttgacaaactacagaaggctct

SEQ ID NO: 697170 - DNA, 25 bp, Mus musculus
gctttgacacagaacaatggcatca

SEQ ID NO: 697171 - DNA, 25 bp, Mus musculus
gctttgacacagtacaatggcatca

SEQ ID NO: 697172 - DNA, 25 bp, Mus musculus
gctttgacccgcagggagactgacg

SEQ ID NO: 697173 - DNA, 25 bp, Mus musculus
gctttgacccgctgggagactgacg

SEQ ID NO: 697174 - DNA, 25 bp, Mus musculus
gctttgaccctcatgtttgggatat

SEQ ID NO: 697175 - DNA, 25 bp, Mus musculus
gctttgaccctcttgtttgggatat

SEQ ID NO: 697176 - DNA, 25 bp, Mus musculus
gctttgacctgaacagctaccggga

SEQ ID NO: 697177 - DNA, 25 bp, Mus musculus
gctttgacctgatcagctaccggga

SEQ ID NO: 697178 - DNA, 25 bp, Mus musculus
gctttgacgatgacgtattgcccac

SEQ ID NO: 697179 - DNA, 25 bp, Mus musculus
gctttgacgatgtcgtattgcccac

SEQ ID NO: 697180 - DNA, 25 bp, Mus musculus
gctttgacgcagctgctaagccaag

SEQ ID NO: 697181 - DNA, 25 bp, Mus musculus
gctttgacgcaggtgctaagccaag

SEQ ID NO: 697182 - DNA, 25 bp, Mus musculus
gctttgactcacacttcctgcttca

SEQ ID NO: 697183 - DNA, 25 bp, Mus musculus
gctttgactcactcttcctgcttca

SEQ ID NO: 697184 - DNA, 25 bp, Mus musculus
gctttgactgccaccactgcaatga

SEQ ID NO: 697185 - DNA, 25 bp, Mus musculus
gctttgactgcctccactgcaatga

SEQ ID NO: 697186 - DNA, 25 bp, Mus musculus
gctttgacttttacacattctctgg

SEQ ID NO: 697187 - DNA, 25 bp, Mus musculus
gctttgactttttcacattctctgg

SEQ ID NO: 697188 - DNA, 25 bp, Mus musculus
gctttgagcctccttccttcgtggg

SEQ ID NO: 697189 - DNA, 25 bp, Mus musculus
gctttgagcctcgttccttcgtggg

SEQ ID NO: 697190 - DNA, 25 bp, Mus musculus
gctttgagctacagagtgtactggg

SEQ ID NO: 697191 - DNA, 25 bp, Mus musculus
gctttgagctactgagtgtactggg

SEQ ID NO: 697192 - DNA, 25 bp, Mus musculus
gctttgagctgtatataattccatt

SEQ ID NO: 697193 - DNA, 25 bp, Mus musculus
gctttgagctgtttataattccatt

SEQ ID NO: 697194 - DNA, 25 bp, Mus musculus
gctttgaggatcaacgtcttagcca

SEQ ID NO: 697195 - DNA, 25 bp, Mus musculus
gctttgaggatctacgtcttagcca

SEQ ID NO: 697196 - DNA, 25 bp, Mus musculus
gctttgaggcagagacagctggacc

SEQ ID NO: 697197 - DNA, 25 bp, Mus musculus
gctttgaggcagtgacagctggacc

SEQ ID NO: 697198 - DNA, 25 bp, Mus musculus
gctttgagggctaccagctggatgc

SEQ ID NO: 697199 - DNA, 25 bp, Mus musculus
gctttgagggcttccagctggatgc

SEQ ID NO: 697200 - DNA, 25 bp, Mus musculus
gctttgagtacccttggttcaacaa

SEQ ID NO: 697201 - DNA, 25 bp, Mus musculus
gctttgagtaccgttggttcaacaa

SEQ ID NO: 697202 - DNA, 25 bp, Mus musculus
gctttgagtcgtccaccttctccgg

SEQ ID NO: 697203 - DNA, 25 bp, Mus musculus
gctttgagtcgtgcaccttctccgg

SEQ ID NO: 697204 - DNA, 25 bp, Mus musculus
gctttgatatgtcaacaaaggatca

SEQ ID NO: 697205 - DNA, 25 bp, Mus musculus
gctttgatatgtgaacaaaggatca

SEQ ID NO: 697206 - DNA, 25 bp, Mus musculus
gctttgatatttcaaggcgggccaa

SEQ ID NO: 697207 - DNA, 25 bp, Mus musculus
gctttgatatttgaaggcgggccaa

SEQ ID NO: 697208 - DNA, 25 bp, Mus musculus
gctttgatgaaacacgctatgagta

SEQ ID NO: 697209 - DNA, 25 bp, Mus musculus
gctttgatgaaagacgctatgagta

SEQ ID NO: 697210 - DNA, 25 bp, Mus musculus
gctttgatgccgacaacgtcaaggg

SEQ ID NO: 697211 - DNA, 25 bp, Mus musculus
gctttgatgccgtcaacgtcaaggg

SEQ ID NO: 697212 - DNA, 25 bp, Mus musculus
gctttgatgcgcactgccacagtgc

SEQ ID NO: 697213 - DNA, 25 bp, Mus musculus
gctttgatgcgctctgccacagtgc

SEQ ID NO: 697214 - DNA, 25 bp, Mus musculus
gctttgatgggcagtcaggacccaa

SEQ ID NO: 697215 - DNA, 25 bp, Mus musculus
gctttgatgggctgtcaggacccaa

SEQ ID NO: 697216 - DNA, 25 bp, Mus musculus
gctttgattaaacacatccgggaga

SEQ ID NO: 697217 - DNA, 25 bp, Mus musculus
gctttgattaaagacatccgggaga

SEQ ID NO: 697218 - DNA, 25 bp, Mus musculus
gctttgcaaagcaggtgccacagtt

SEQ ID NO: 697219 - DNA, 25 bp, Mus musculus
gctttgcaaagctggtgccacagtt

SEQ ID NO: 697220 - DNA, 25 bp, Mus musculus
gctttgcaaggaaggagattctata

SEQ ID NO: 697221 - DNA, 25 bp, Mus musculus
gctttgcaaggatggagattctata

SEQ ID NO: 697222 - DNA, 25 bp, Mus musculus
gctttgcaatggcaacctggtggat

SEQ ID NO: 697223 - DNA, 25 bp, Mus musculus
gctttgcaatgggaacctggtggat

SEQ ID NO: 697224 - DNA, 25 bp, Mus musculus
gctttgcacttactatcagagctgc

SEQ ID NO: 697225 - DNA, 25 bp, Mus musculus
gctttgcacttagtatcagagctgc

SEQ ID NO: 697226 - DNA, 25 bp, Mus musculus
gctttgcagagcaacctgggcctgt

SEQ ID NO: 697227 - DNA, 25 bp, Mus musculus
gctttgcagagctacctgggcctgt

SEQ ID NO: 697228 - DNA, 25 bp, Mus musculus
gctttgcagatcaccagggcaccag

SEQ ID NO: 697229 - DNA, 25 bp, Mus musculus
gctttgcagatctccagggcaccag

SEQ ID NO: 697230 - DNA, 25 bp, Mus musculus
gctttgcagctaatgccccttcaga

SEQ ID NO: 697231 - DNA, 25 bp, Mus musculus
gctttgcagctattgccccttcaga

SEQ ID NO: 697232 - DNA, 25 bp, Mus musculus
gctttgcagtctctctcccttcgaa

SEQ ID NO: 697233 - DNA, 25 bp, Mus musculus
gctttgcagtctgtctcccttcgaa

SEQ ID NO: 697234 - DNA, 25 bp, Mus musculus
gctttgcatacacatcacgtcatga

SEQ ID NO: 697235 - DNA, 25 bp, Mus musculus
gctttgcatacagatcacgtcatga

SEQ ID NO: 697236 - DNA, 25 bp, Mus musculus
gctttgccaatgagaacagcatcgg

SEQ ID NO: 697237 - DNA, 25 bp, Mus musculus
gctttgccaatgctgtcgtactcta

SEQ ID NO: 697238 - DNA, 25 bp, Mus musculus
gctttgccaatggtgtcgtactcta

SEQ ID NO: 697239 - DNA, 25 bp, Mus musculus
gctttgccaatgtgaacagcatcgg

SEQ ID NO: 697240 - DNA, 25 bp, Mus musculus
gctttgccacggacacattatgccc

SEQ ID NO: 697241 - DNA, 25 bp, Mus musculus
gctttgccacggtcacattatgccc

SEQ ID NO: 697242 - DNA, 25 bp, Mus musculus
gctttgccactcaagtgtactgcaa

SEQ ID NO: 697243 - DNA, 25 bp, Mus musculus
gctttgccactctagtgtactgcaa

SEQ ID NO: 697244 - DNA, 25 bp, Mus musculus
gctttgccatcacctaacaaatgca

SEQ ID NO: 697245 - DNA, 25 bp, Mus musculus
gctttgccatcagctaacaaatgca

SEQ ID NO: 697246 - DNA, 25 bp, Mus musculus
gctttgcccgccaaaaactctttcg

SEQ ID NO: 697247 - DNA, 25 bp, Mus musculus
gctttgcccgcctaaaactctttcg

SEQ ID NO: 697248 - DNA, 25 bp, Mus musculus
gctttgccctgtcattctgcatcct

SEQ ID NO: 697249 - DNA, 25 bp, Mus musculus
gctttgccctgtgattctgcatcct

SEQ ID NO: 697250 - DNA, 25 bp, Mus musculus
gctttgccgtatagtgatggagatt

SEQ ID NO: 697251 - DNA, 25 bp, Mus musculus
gctttgccgtattgtgatggagatt

SEQ ID NO: 697252 - DNA, 25 bp, Mus musculus
gctttgccgtgcacagactgggaga

SEQ ID NO: 697253 - DNA, 25 bp, Mus musculus
gctttgccgtgctcagactgggaga

SEQ ID NO: 697254 - DNA, 25 bp, Mus musculus
gctttgcctaaaaacatctcccagt

SEQ ID NO: 697255 - DNA, 25 bp, Mus musculus
gctttgcctaaatacatctcccagt

SEQ ID NO: 697256 - DNA, 25 bp, Mus musculus
gctttgcctggcaccgtttatgaaa

SEQ ID NO: 697257 - DNA, 25 bp, Mus musculus
gctttgcctggctccgtttatgaaa

SEQ ID NO: 697258 - DNA, 25 bp, Mus musculus
gctttgccttcacgactcgagctga

SEQ ID NO: 697259 - DNA, 25 bp, Mus musculus
gctttgccttcaggactcgagctga

SEQ ID NO: 697260 - DNA, 25 bp, Mus musculus
gctttgccttcgaggagtacgaggt

SEQ ID NO: 697261 - DNA, 25 bp, Mus musculus
gctttgccttcgtggagtacgaggt

SEQ ID NO: 697262 - DNA, 25 bp, Mus musculus
gctttgcggatgcaacccggtgacc

SEQ ID NO: 697263 - DNA, 25 bp, Mus musculus
gctttgcggatggaacccggtgacc

SEQ ID NO: 697264 - DNA, 25 bp, Mus musculus
gctttgcggctgacactcacagtca

SEQ ID NO: 697265 - DNA, 25 bp, Mus musculus
gctttgcggctgtcactcacagtca

SEQ ID NO: 697266 - DNA, 25 bp, Mus musculus
gctttgctcccgaacagaaggagat

SEQ ID NO: 697267 - DNA, 25 bp, Mus musculus
gctttgctcccgtacagaaggagat

SEQ ID NO: 697268 - DNA, 25 bp, Mus musculus
gctttgctccgtctagaggaaggac

SEQ ID NO: 697269 - DNA, 25 bp, Mus musculus
gctttgctccgtgtagaggaaggac

SEQ ID NO: 697270 - DNA, 25 bp, Mus musculus
gctttgctctatatagagcgggtgg

SEQ ID NO: 697271 - DNA, 25 bp, Mus musculus
gctttgctctatttagagcgggtgg

SEQ ID NO: 697272 - DNA, 25 bp, Mus musculus
gctttgctctgcagggaggacaccc

SEQ ID NO: 697273 - DNA, 25 bp, Mus musculus
gctttgctctgctgggaggacaccc

SEQ ID NO: 697274 - DNA, 25 bp, Mus musculus
gctttgctgaaaaccagaggctgtt

SEQ ID NO: 697275 - DNA, 25 bp, Mus musculus
gctttgctgaaatccagaggctgtt

SEQ ID NO: 697276 - DNA, 25 bp, Mus musculus
gctttgctgaacagctacaccagtg

SEQ ID NO: 697277 - DNA, 25 bp, Mus musculus
gctttgctgaactgctacaccagtg

SEQ ID NO: 697278 - DNA, 25 bp, Mus musculus
gctttgctgatactaattccttgga

SEQ ID NO: 697279 - DNA, 25 bp, Mus musculus
gctttgctgatagtaattccttgga

SEQ ID NO: 697280 - DNA, 25 bp, Mus musculus
gctttgctgatgaagaaagttacag

SEQ ID NO: 697281 - DNA, 25 bp, Mus musculus
gctttgctgatgtagaaagttacag

SEQ ID NO: 697282 - DNA, 25 bp, Mus musculus
gctttgctgcttccctttcgccaga

SEQ ID NO: 697283 - DNA, 25 bp, Mus musculus
gctttgctgcttgcctttcgccaga

SEQ ID NO: 697284 - DNA, 25 bp, Mus musculus
gctttgctggaaatgctgttggtgc

SEQ ID NO: 697285 - DNA, 25 bp, Mus musculus
gctttgctggaattgctgttggtgc

SEQ ID NO: 697286 - DNA, 25 bp, Mus musculus
gctttgctgtacacaaaggactgag

SEQ ID NO: 697287 - DNA, 25 bp, Mus musculus
gctttgctgtactcaaaggactgag

SEQ ID NO: 697288 - DNA, 25 bp, Mus musculus
gctttgcttatccaatgcctttttg

SEQ ID NO: 697289 - DNA, 25 bp, Mus musculus
gctttgcttatcgaatgcctttttg

SEQ ID NO: 697290 - DNA, 25 bp, Mus musculus
gctttgcttgtcaccatgtttctgt

SEQ ID NO: 697291 - DNA, 25 bp, Mus musculus
gctttgcttgtctccatgtttctgt

SEQ ID NO: 697292 - DNA, 25 bp, Mus musculus
gctttggacacgagggactcggatt

SEQ ID NO: 697293 - DNA, 25 bp, Mus musculus
gctttggacacgtgggactcggatt

SEQ ID NO: 697294 - DNA, 25 bp, Mus musculus
gctttggaccagacaacatgggcag

SEQ ID NO: 697295 - DNA, 25 bp, Mus musculus
gctttggaccagtcaacatgggcag

SEQ ID NO: 697296 - DNA, 25 bp, Mus musculus
gctttggacctgagtcagatgtgga

SEQ ID NO: 697297 - DNA, 25 bp, Mus musculus
gctttggacctgtgtcagatgtgga

SEQ ID NO: 697298 - DNA, 25 bp, Mus musculus
gctttggagacaacaaagtgtcaga

SEQ ID NO: 697299 - DNA, 25 bp, Mus musculus
gctttggagacatcaaagtgtcaga

SEQ ID NO: 697300 - DNA, 25 bp, Mus musculus
gctttggagactacccgacagtgcc

SEQ ID NO: 697301 - DNA, 25 bp, Mus musculus
gctttggagacttcccgacagtgcc

SEQ ID NO: 697302 - DNA, 25 bp, Mus musculus
gctttggagatgagccgaaatcgaa

SEQ ID NO: 697303 - DNA, 25 bp, Mus musculus
gctttggagatgtgccgaaatcgaa

SEQ ID NO: 697304 - DNA, 25 bp, Mus musculus
gctttggaggccaaaatctgtcatc

SEQ ID NO: 697305 - DNA, 25 bp, Mus musculus
gctttggaggccattgcactctggc

SEQ ID NO: 697306 - DNA, 25 bp, Mus musculus
gctttggaggcctaaatctgtcatc

SEQ ID NO: 697307 - DNA, 25 bp, Mus musculus
gctttggaggcctttgcactctggc

SEQ ID NO: 697308 - DNA, 25 bp, Mus musculus
gctttggaggctcaacacttttccc

SEQ ID NO: 697309 - DNA, 25 bp, Mus musculus
gctttggaggctctgttccctttct

SEQ ID NO: 697310 - DNA, 25 bp, Mus musculus
gctttggaggctgaacacttttccc

SEQ ID NO: 697311 - DNA, 25 bp, Mus musculus
gctttggaggctgtgttccctttct

SEQ ID NO: 697312 - DNA, 25 bp, Mus musculus
gctttggagggaacacagctgacga

SEQ ID NO: 697313 - DNA, 25 bp, Mus musculus
gctttggagggatcacagctgacga

SEQ ID NO: 697314 - DNA, 25 bp, Mus musculus
gctttggagtacagcttcaagtgaa

SEQ ID NO: 697315 - DNA, 25 bp, Mus musculus
gctttggagtactgcttcaagtgaa

SEQ ID NO: 697316 - DNA, 25 bp, Mus musculus
gctttggagtcacaggtcagactaa

SEQ ID NO: 697317 - DNA, 25 bp, Mus musculus
gctttggagtcagaggtcagactaa

SEQ ID NO: 697318 - DNA, 25 bp, Mus musculus
gctttggatatcattcagtgtcacc

SEQ ID NO: 697319 - DNA, 25 bp, Mus musculus
gctttggatatctttcagtgtcacc

SEQ ID NO: 697320 - DNA, 25 bp, Mus musculus
gctttggatatgaccacactaacca

SEQ ID NO: 697321 - DNA, 25 bp, Mus musculus
gctttggatatgtccacactaacca

SEQ ID NO: 697322 - DNA, 25 bp, Mus musculus
gctttggcaccaccgacattgatct

SEQ ID NO: 697323 - DNA, 25 bp, Mus musculus
gctttggcaccagcgacattgatct

SEQ ID NO: 697324 - DNA, 25 bp, Mus musculus
gctttggcatttctccgaagtagga

SEQ ID NO: 697325 - DNA, 25 bp, Mus musculus
gctttggcatttgtccgaagtagga

SEQ ID NO: 697326 - DNA, 25 bp, Mus musculus
gctttggccaataagatgggtctga

SEQ ID NO: 697327 - DNA, 25 bp, Mus musculus
gctttggccaattagatgggtctga

SEQ ID NO: 697328 - DNA, 25 bp, Mus musculus
gctttggccacgattttctccttcg

SEQ ID NO: 697329 - DNA, 25 bp, Mus musculus
gctttggccacgtttttctccttcg

SEQ ID NO: 697330 - DNA, 25 bp, Mus musculus
gctttggccgagaacgcaattcagg

SEQ ID NO: 697331 - DNA, 25 bp, Mus musculus
gctttggccgagtacgcaattcagg

SEQ ID NO: 697332 - DNA, 25 bp, Mus musculus
gctttggcgtgtaatgcttcagaca

SEQ ID NO: 697333 - DNA, 25 bp, Mus musculus
gctttggcgtgttatgcttcagaca

SEQ ID NO: 697334 - DNA, 25 bp, Mus musculus
gctttggctgacaccaatgttctat

SEQ ID NO: 697335 - DNA, 25 bp, Mus musculus
gctttggctgactccaatgttctat

SEQ ID NO: 697336 - DNA, 25 bp, Mus musculus
gctttggcttccaaacaaattctgg

SEQ ID NO: 697337 - DNA, 25 bp, Mus musculus
gctttggcttcctaacaaattctgg

SEQ ID NO: 697338 - DNA, 25 bp, Mus musculus
gctttggcttgtatctttttgaaac

SEQ ID NO: 697339 - DNA, 25 bp, Mus musculus
gctttggcttgtttctttttgaaac

SEQ ID NO: 697340 - DNA, 25 bp, Mus musculus
gctttgggaacaaccatagctgttg

SEQ ID NO: 697341 - DNA, 25 bp, Mus musculus
gctttgggaacatccatagctgttg

SEQ ID NO: 697342 - DNA, 25 bp, Mus musculus
gctttgggatgaccagctagcatct

SEQ ID NO: 697343 - DNA, 25 bp, Mus musculus
gctttgggatgagcagctagcatct

SEQ ID NO: 697344 - DNA, 25 bp, Mus musculus
gctttgggtacactagcacacacca

SEQ ID NO: 697345 - DNA, 25 bp, Mus musculus
gctttgggtacagtagcacacacca

SEQ ID NO: 697346 - DNA, 25 bp, Mus musculus
gctttgggtccacacactgtgcaga

SEQ ID NO: 697347 - DNA, 25 bp, Mus musculus
gctttgggtccagacactgtgcaga

SEQ ID NO: 697348 - DNA, 25 bp, Mus musculus
gctttggtgaaacgtccagaggctt

SEQ ID NO: 697349 - DNA, 25 bp, Mus musculus
gctttggtgaaaggtccagaggctt

SEQ ID NO: 697350 - DNA, 25 bp, Mus musculus
gctttggtgaagaaggaatctcgac

SEQ ID NO: 697351 - DNA, 25 bp, Mus musculus
gctttggtgaagtaggaatctcgac

SEQ ID NO: 697352 - DNA, 25 bp, Mus musculus
gctttggtgagccataagctgtacc

SEQ ID NO: 697353 - DNA, 25 bp, Mus musculus
gctttggtgagcgataagctgtacc

SEQ ID NO: 697354 - DNA, 25 bp, Mus musculus
gctttggtgggcaccgtattcgcct

SEQ ID NO: 697355 - DNA, 25 bp, Mus musculus
gctttggtgggctccgtattcgcct

SEQ ID NO: 697356 - DNA, 25 bp, Mus musculus
gctttggttctgaaacagggaaaat

SEQ ID NO: 697357 - DNA, 25 bp, Mus musculus
gctttggttctgtaacagggaaaat

SEQ ID NO: 697358 - DNA, 25 bp, Mus musculus
gctttggttgaacgaagaacttagc

SEQ ID NO: 697359 - DNA, 25 bp, Mus musculus
gctttggttgaaggaagaacttagc

SEQ ID NO: 697360 - DNA, 25 bp, Mus musculus
gctttggttttgcagcctcagtagc

SEQ ID NO: 697361 - DNA, 25 bp, Mus musculus
gctttggttttggagcctcagtagc

SEQ ID NO: 697362 - DNA, 25 bp, Mus musculus
gctttgtaaactagagaacactttt

SEQ ID NO: 697363 - DNA, 25 bp, Mus musculus
gctttgtaaacttgagaacactttt

SEQ ID NO: 697364 - DNA, 25 bp, Mus musculus
gctttgtaagccatctgtagagcaa

SEQ ID NO: 697365 - DNA, 25 bp, Mus musculus
gctttgtaagccttctgtagagcaa

SEQ ID NO: 697366 - DNA, 25 bp, Mus musculus
gctttgtacagcagtcccgtctcgt

SEQ ID NO: 697367 - DNA, 25 bp, Mus musculus
gctttgtacagctgtcccgtctcgt

SEQ ID NO: 697368 - DNA, 25 bp, Mus musculus
gctttgtagaagcaccactccgggc

SEQ ID NO: 697369 - DNA, 25 bp, Mus musculus
gctttgtagaaggaccactccgggc

SEQ ID NO: 697370 - DNA, 25 bp, Mus musculus
gctttgtagtacaggctagccccta

SEQ ID NO: 697371 - DNA, 25 bp, Mus musculus
gctttgtagtactggctagccccta

SEQ ID NO: 697372 - DNA, 25 bp, Mus musculus
gctttgtatttaattgcagcgaacc

SEQ ID NO: 697373 - DNA, 25 bp, Mus musculus
gctttgtatttatttgcagcgaacc

SEQ ID NO: 697374 - DNA, 25 bp, Mus musculus
gctttgtcacctcgaaaacagttga

SEQ ID NO: 697375 - DNA, 25 bp, Mus musculus
gctttgtcacctggaaaacagttga

SEQ ID NO: 697376 - DNA, 25 bp, Mus musculus
gctttgtccgggagaatgtctggac

SEQ ID NO: 697377 - DNA, 25 bp, Mus musculus
gctttgtccgggtgaatgtctggac

SEQ ID NO: 697378 - DNA, 25 bp, Mus musculus
gctttgtcgtgcagtggctcattta

SEQ ID NO: 697379 - DNA, 25 bp, Mus musculus
gctttgtcgtgctgtggctcattta

SEQ ID NO: 697380 - DNA, 25 bp, Mus musculus
gctttgtctacacgaagttcaagaa

SEQ ID NO: 697381 - DNA, 25 bp, Mus musculus
gctttgtctacaggaagttcaagaa

SEQ ID NO: 697382 - DNA, 25 bp, Mus musculus
gctttgtcttctcctggtttcccaa

SEQ ID NO: 697383 - DNA, 25 bp, Mus musculus
gctttgtcttctgctggtttcccaa

SEQ ID NO: 697384 - DNA, 25 bp, Mus musculus
gctttgtgagagcatcaggccctgt

SEQ ID NO: 697385 - DNA, 25 bp, Mus musculus
gctttgtgagaggatcaggccctgt

SEQ ID NO: 697386 - DNA, 25 bp, Mus musculus
gctttgtgagttagctaagtcattc

SEQ ID NO: 697387 - DNA, 25 bp, Mus musculus
gctttgtgagtttgctaagtcattc

SEQ ID NO: 697388 - DNA, 25 bp, Mus musculus
gctttgtgatccctaactccacaaa

SEQ ID NO: 697389 - DNA, 25 bp, Mus musculus
gctttgtgatccgtaactccacaaa

SEQ ID NO: 697390 - DNA, 25 bp, Mus musculus
gctttgtgccccaactcatgatcct

SEQ ID NO: 697391 - DNA, 25 bp, Mus musculus
gctttgtgcccctactcatgatcct

SEQ ID NO: 697392 - DNA, 25 bp, Mus musculus
gctttgtgctgcaacatgaacttca

SEQ ID NO: 697393 - DNA, 25 bp, Mus musculus
gctttgtgctgctacatgaacttca

SEQ ID NO: 697394 - DNA, 25 bp, Mus musculus
gctttgtggtgcaacaagacttggt

SEQ ID NO: 697395 - DNA, 25 bp, Mus musculus
gctttgtggtgcactcatcagctac

SEQ ID NO: 697396 - DNA, 25 bp, Mus musculus
gctttgtggtgctacaagacttggt

SEQ ID NO: 697397 - DNA, 25 bp, Mus musculus
gctttgtggtgctctcatcagctac

SEQ ID NO: 697398 - DNA, 25 bp, Mus musculus
gctttgtgtcaaagaggagctgcag

SEQ ID NO: 697399 - DNA, 25 bp, Mus musculus
gctttgtgtcaatgaggagctgcag

SEQ ID NO: 697400 - DNA, 25 bp, Mus musculus
gctttgtgtgcgactcagcctttga

SEQ ID NO: 697401 - DNA, 25 bp, Mus musculus
gctttgtgtgcgtctcagcctttga

SEQ ID NO: 697402 - DNA, 25 bp, Mus musculus
gctttgtgtgtgatggtactcgcct

SEQ ID NO: 697403 - DNA, 25 bp, Mus musculus
gctttgtgtgtgttggtactcgcct

SEQ ID NO: 697404 - DNA, 25 bp, Mus musculus
gctttgttcctgcacacttcattgg

SEQ ID NO: 697405 - DNA, 25 bp, Mus musculus
gctttgttcctggacacttcattgg

SEQ ID NO: 697406 - DNA, 25 bp, Mus musculus
gctttgttctggatgccttctctca

SEQ ID NO: 697407 - DNA, 25 bp, Mus musculus
gctttgttctggttgccttctctca

SEQ ID NO: 697408 - DNA, 25 bp, Mus musculus
gctttgttgaagaatgatgagacta

SEQ ID NO: 697409 - DNA, 25 bp, Mus musculus
gctttgttgaagtatgatgagacta

SEQ ID NO: 697410 - DNA, 25 bp, Mus musculus
gctttgttgagaagtatgagaattc

SEQ ID NO: 697411 - DNA, 25 bp, Mus musculus
gctttgttgagatgtatgagaattc

SEQ ID NO: 697412 - DNA, 25 bp, Mus musculus
gctttgttgtgcataggaaatgttg

SEQ ID NO: 697413 - DNA, 25 bp, Mus musculus
gctttgttgtgcttaggaaatgttg

SEQ ID NO: 697414 - DNA, 25 bp, Mus musculus
gctttgtttcctcagtccgatttgt

SEQ ID NO: 697415 - DNA, 25 bp, Mus musculus
gctttgtttcctgagtccgatttgt

SEQ ID NO: 697416 - DNA, 25 bp, Mus musculus
gcttttaactttcctacagctacct

SEQ ID NO: 697417 - DNA, 25 bp, Mus musculus
gcttttaactttgctacagctacct

SEQ ID NO: 697418 - DNA, 25 bp, Mus musculus
gcttttaatcaaatatggtgctgat

SEQ ID NO: 697419 - DNA, 25 bp, Mus musculus
gcttttaatcaattatggtgctgat

SEQ ID NO: 697420 - DNA, 25 bp, Mus musculus
gcttttaccaccatggtcactcatg

SEQ ID NO: 697421 - DNA, 25 bp, Mus musculus
gcttttaccaccttggtcactcatg

SEQ ID NO: 697422 - DNA, 25 bp, Mus musculus
gcttttaccaggctccatctcattt

SEQ ID NO: 697423 - DNA, 25 bp, Mus musculus
gcttttaccagggtccatctcattt

SEQ ID NO: 697424 - DNA, 25 bp, Mus musculus
gcttttactagacaactgcatgaga

SEQ ID NO: 697425 - DNA, 25 bp, Mus musculus
gcttttactagagaactgcatgaga

SEQ ID NO: 697426 - DNA, 25 bp, Mus musculus
gcttttagaagaccagagagtgcat

SEQ ID NO: 697427 - DNA, 25 bp, Mus musculus
gcttttagaagagcagagagtgcat

SEQ ID NO: 697428 - DNA, 25 bp, Mus musculus
gcttttagacatatccaaatggttg

SEQ ID NO: 697429 - DNA, 25 bp, Mus musculus
gcttttagacatttccaaatggttg

SEQ ID NO: 697430 - DNA, 25 bp, Mus musculus
gcttttagcaatacctgtccctcct

SEQ ID NO: 697431 - DNA, 25 bp, Mus musculus
gcttttagcaattcctgtccctcct

SEQ ID NO: 697432 - DNA, 25 bp, Mus musculus
gcttttagcctcagcactttggaga

SEQ ID NO: 697433 - DNA, 25 bp, Mus musculus
gcttttagcctctgcactttggaga

SEQ ID NO: 697434 - DNA, 25 bp, Mus musculus
gcttttaggacaacacttaactttg

SEQ ID NO: 697435 - DNA, 25 bp, Mus musculus
gcttttaggacatcacttaactttg

SEQ ID NO: 697436 - DNA, 25 bp, Mus musculus
gcttttaggcatacaagtacccttg

SEQ ID NO: 697437 - DNA, 25 bp, Mus musculus
gcttttaggcattcaagtacccttg

SEQ ID NO: 697438 - DNA, 25 bp, Mus musculus
gcttttatagaccagcccaaggaag

SEQ ID NO: 697439 - DNA, 25 bp, Mus musculus
gcttttatagacgagcccaaggaag

SEQ ID NO: 697440 - DNA, 25 bp, Mus musculus
gcttttatttgtcggctcgagagaa

SEQ ID NO: 697441 - DNA, 25 bp, Mus musculus
gcttttatttgtgggctcgagagaa

SEQ ID NO: 697442 - DNA, 25 bp, Mus musculus
gcttttcaactacaacaaagttctc

SEQ ID NO: 697443 - DNA, 25 bp, Mus musculus
gcttttcaactagaacaaagttctc

SEQ ID NO: 697444 - DNA, 25 bp, Mus musculus
gcttttcaagctcttgaaagagggc

SEQ ID NO: 697445 - DNA, 25 bp, Mus musculus
gcttttcaagctgttgaaagagggc

SEQ ID NO: 697446 - DNA, 25 bp, Mus musculus
gcttttcagaggattctcctacaca

SEQ ID NO: 697447 - DNA, 25 bp, Mus musculus
gcttttcagaggtttctcctacaca

SEQ ID NO: 697448 - DNA, 25 bp, Mus musculus
gcttttcatcataggcctgatcggc

SEQ ID NO: 697449 - DNA, 25 bp, Mus musculus
gcttttcatcattggcctgatcggc

SEQ ID NO: 697450 - DNA, 25 bp, Mus musculus
gcttttcatgcaacttctactagtg

SEQ ID NO: 697451 - DNA, 25 bp, Mus musculus
gcttttcatgcatcttctactagtg

SEQ ID NO: 697452 - DNA, 25 bp, Mus musculus
gcttttcatgccctattggttaacc

SEQ ID NO: 697453 - DNA, 25 bp, Mus musculus
gcttttcatgccgtattggttaacc

SEQ ID NO: 697454 - DNA, 25 bp, Mus musculus
gcttttcatggcactacttgtggct

SEQ ID NO: 697455 - DNA, 25 bp, Mus musculus
gcttttcatggctctacttgtggct

SEQ ID NO: 697456 - DNA, 25 bp, Mus musculus
gcttttcatttccactgcatctctc

SEQ ID NO: 697457 - DNA, 25 bp, Mus musculus
gcttttcatttcgactgcatctctc

SEQ ID NO: 697458 - DNA, 25 bp, Mus musculus
gcttttccaaaaaggaggcctcctc

SEQ ID NO: 697459 - DNA, 25 bp, Mus musculus
gcttttccaaaatggaggcctcctc

SEQ ID NO: 697460 - DNA, 25 bp, Mus musculus
gcttttccctttcgtcatgaccttg

SEQ ID NO: 697461 - DNA, 25 bp, Mus musculus
gcttttccctttggtcatgaccttg

SEQ ID NO: 697462 - DNA, 25 bp, Mus musculus
gcttttcgagctcaagcccagatct

SEQ ID NO: 697463 - DNA, 25 bp, Mus musculus
gcttttcgagctgaagcccagatct

SEQ ID NO: 697464 - DNA, 25 bp, Mus musculus
gcttttcgaggccaaggcggttatc

SEQ ID NO: 697465 - DNA, 25 bp, Mus musculus
gcttttcgaggcgaaggcggttatc

SEQ ID NO: 697466 - DNA, 25 bp, Mus musculus
gcttttcgatacaaagagaattccc

SEQ ID NO: 697467 - DNA, 25 bp, Mus musculus
gcttttcgatactaagagaattccc

SEQ ID NO: 697468 - DNA, 25 bp, Mus musculus
gcttttctacatcgagcttgccatt

SEQ ID NO: 697469 - DNA, 25 bp, Mus musculus
gcttttctacatggagcttgccatt

SEQ ID NO: 697470 - DNA, 25 bp, Mus musculus
gcttttctacctcgacttaccggca

SEQ ID NO: 697471 - DNA, 25 bp, Mus musculus
gcttttctacctggacttaccggca

SEQ ID NO: 697472 - DNA, 25 bp, Mus musculus
gcttttctcggtacagtctccgtga

SEQ ID NO: 697473 - DNA, 25 bp, Mus musculus
gcttttctcggttcagtctccgtga

SEQ ID NO: 697474 - DNA, 25 bp, Mus musculus
gcttttctgcataagcaccatggtg

SEQ ID NO: 697475 - DNA, 25 bp, Mus musculus
gcttttctgcattagcaccatggtg

SEQ ID NO: 697476 - DNA, 25 bp, Mus musculus
gcttttctgctccatcgggtttcca

SEQ ID NO: 697477 - DNA, 25 bp, Mus musculus
gcttttctgctcgatcgggtttcca

SEQ ID NO: 697478 - DNA, 25 bp, Mus musculus
gcttttctggaaccaagacctttag

SEQ ID NO: 697479 - DNA, 25 bp, Mus musculus
gcttttctggaagcaagacctttag

SEQ ID NO: 697480 - DNA, 25 bp, Mus musculus
gcttttctgtgtcgtcactggtaca

SEQ ID NO: 697481 - DNA, 25 bp, Mus musculus
gcttttctgtgtggtcactggtaca

SEQ ID NO: 697482 - DNA, 25 bp, Mus musculus
gcttttgaaaacaggagctcctacc

SEQ ID NO: 697483 - DNA, 25 bp, Mus musculus
gcttttgaaaactggagctcctacc

SEQ ID NO: 697484 - DNA, 25 bp, Mus musculus
gcttttgaagctccgtttccttgtg

SEQ ID NO: 697485 - DNA, 25 bp, Mus musculus
gcttttgaagctgcgtttccttgtg

SEQ ID NO: 697486 - DNA, 25 bp, Mus musculus
gcttttgacgtcagggctccacttt

SEQ ID NO: 697487 - DNA, 25 bp, Mus musculus
gcttttgacgtctgggctccacttt

SEQ ID NO: 697488 - DNA, 25 bp, Mus musculus
gcttttgagatgctgatgcgggccc

SEQ ID NO: 697489 - DNA, 25 bp, Mus musculus
gcttttgagatggtgatgcgggccc

SEQ ID NO: 697490 - DNA, 25 bp, Mus musculus
gcttttgagcacagcgtgcatcgct

SEQ ID NO: 697491 - DNA, 25 bp, Mus musculus
gcttttgagcactgcgtgcatcgct

SEQ ID NO: 697492 - DNA, 25 bp, Mus musculus
gcttttgaggttcacgcacctgttc

SEQ ID NO: 697493 - DNA, 25 bp, Mus musculus
gcttttgaggttgacgcacctgttc

SEQ ID NO: 697494 - DNA, 25 bp, Mus musculus
gcttttgattgcagggactgagtcc

SEQ ID NO: 697495 - DNA, 25 bp, Mus musculus
gcttttgattgctgggactgagtcc

SEQ ID NO: 697496 - DNA, 25 bp, Mus musculus
gcttttgccaagagtcagctatttg

SEQ ID NO: 697497 - DNA, 25 bp, Mus musculus
gcttttgccaagcataataagatga

SEQ ID NO: 697498 - DNA, 25 bp, Mus musculus
gcttttgccaaggataataagatga

SEQ ID NO: 697499 - DNA, 25 bp, Mus musculus
gcttttgccaagtgtcagctatttg

SEQ ID NO: 697500 - DNA, 25 bp, Mus musculus
gcttttgcccagcttgtgattttta

SEQ ID NO: 697501 - DNA, 25 bp, Mus musculus
gcttttgcccaggttgtgattttta

SEQ ID NO: 697502 - DNA, 25 bp, Mus musculus
gcttttgcccatattaccatggagg

SEQ ID NO: 697503 - DNA, 25 bp, Mus musculus
gcttttgcccattttaccatggagg

SEQ ID NO: 697504 - DNA, 25 bp, Mus musculus
gcttttgccgcacttgaattcatct

SEQ ID NO: 697505 - DNA, 25 bp, Mus musculus
gcttttgccgcagttgaattcatct

SEQ ID NO: 697506 - DNA, 25 bp, Mus musculus
gcttttgcctgtacactggcttcct

SEQ ID NO: 697507 - DNA, 25 bp, Mus musculus
gcttttgcctgttcactggcttcct

SEQ ID NO: 697508 - DNA, 25 bp, Mus musculus
gcttttgcgggtctgaaaacaggac

SEQ ID NO: 697509 - DNA, 25 bp, Mus musculus
gcttttgcgggtgtgaaaacaggac

SEQ ID NO: 697510 - DNA, 25 bp, Mus musculus
gcttttgctagaactgttgggctct

SEQ ID NO: 697511 - DNA, 25 bp, Mus musculus
gcttttgctagatctgttgggctct

SEQ ID NO: 697512 - DNA, 25 bp, Mus musculus
gcttttgctcatatcactggaggcg

SEQ ID NO: 697513 - DNA, 25 bp, Mus musculus
gcttttgctcatttcactggaggcg

SEQ ID NO: 697514 - DNA, 25 bp, Mus musculus
gcttttgctgggaagacggccaaca

SEQ ID NO: 697515 - DNA, 25 bp, Mus musculus
gcttttgctgggtagacggccaaca

SEQ ID NO: 697516 - DNA, 25 bp, Mus musculus
gcttttggaagtctaagttgtcctt

SEQ ID NO: 697517 - DNA, 25 bp, Mus musculus
gcttttggaagtgtaagttgtcctt

SEQ ID NO: 697518 - DNA, 25 bp, Mus musculus
gcttttggataaccctggtttgagg

SEQ ID NO: 697519 - DNA, 25 bp, Mus musculus
gcttttggataagcctggtttgagg

SEQ ID NO: 697520 - DNA, 25 bp, Mus musculus
gcttttggatacattgaggtcaccc

SEQ ID NO: 697521 - DNA, 25 bp, Mus musculus
gcttttggatactttgaggtcaccc

SEQ ID NO: 697522 - DNA, 25 bp, Mus musculus
gcttttggctcaccgagtagaaacg

SEQ ID NO: 697523 - DNA, 25 bp, Mus musculus
gcttttggctcagcgagtagaaacg

SEQ ID NO: 697524 - DNA, 25 bp, Mus musculus
gcttttggctgtccactggtacatt

SEQ ID NO: 697525 - DNA, 25 bp, Mus musculus
gcttttggctgtgcactggtacatt

SEQ ID NO: 697526 - DNA, 25 bp, Mus musculus
gcttttgggctacaatgtccatgtg

SEQ ID NO: 697527 - DNA, 25 bp, Mus musculus
gcttttgggctagaatgtccatgtg

SEQ ID NO: 697528 - DNA, 25 bp, Mus musculus
gcttttggttggaaatcactgcttg

SEQ ID NO: 697529 - DNA, 25 bp, Mus musculus
gcttttggttggtaatcactgcttg

SEQ ID NO: 697530 - DNA, 25 bp, Mus musculus
gcttttgtatctccgaagtgcttca

SEQ ID NO: 697531 - DNA, 25 bp, Mus musculus
gcttttgtatctgcgaagtgcttca

SEQ ID NO: 697532 - DNA, 25 bp, Mus musculus
gcttttgtcgaaactgaaggagaca

SEQ ID NO: 697533 - DNA, 25 bp, Mus musculus
gcttttgtcgaatctgaaggagaca

SEQ ID NO: 697534 - DNA, 25 bp, Mus musculus
gcttttgtctcacgccgagcacatg

SEQ ID NO: 697535 - DNA, 25 bp, Mus musculus
gcttttgtctcaggccgagcacatg

SEQ ID NO: 697536 - DNA, 25 bp, Mus musculus
gcttttgtgcgaccagatgtcagcc

SEQ ID NO: 697537 - DNA, 25 bp, Mus musculus
gcttttgtgcgagcagatgtcagcc

SEQ ID NO: 697538 - DNA, 25 bp, Mus musculus
gcttttgtggctacaggaaccaatc

SEQ ID NO: 697539 - DNA, 25 bp, Mus musculus
gcttttgtggcttcaggaaccaatc

SEQ ID NO: 697540 - DNA, 25 bp, Mus musculus
gcttttgtgtccatgtgaagcaccc

SEQ ID NO: 697541 - DNA, 25 bp, Mus musculus
gcttttgtgtccttgtgaagcaccc

SEQ ID NO: 697542 - DNA, 25 bp, Mus musculus
gcttttgttccacggaggcgccttg

SEQ ID NO: 697543 - DNA, 25 bp, Mus musculus
gcttttgttccagggaggcgccttg

SEQ ID NO: 697544 - DNA, 25 bp, Mus musculus
gcttttgttgaaaccccttagacca

SEQ ID NO: 697545 - DNA, 25 bp, Mus musculus
gcttttgttgaatccccttagacca

SEQ ID NO: 697546 - DNA, 25 bp, Mus musculus
gctttttaacagcacacgccttcct

SEQ ID NO: 697547 - DNA, 25 bp, Mus musculus
gctttttaacaggacacgccttcct

SEQ ID NO: 697548 - DNA, 25 bp, Mus musculus
gctttttaccctccaggactccagg

SEQ ID NO: 697549 - DNA, 25 bp, Mus musculus
gctttttaccctgcaggactccagg

SEQ ID NO: 697550 - DNA, 25 bp, Mus musculus
gctttttacttgcaacccacatgat

SEQ ID NO: 697551 - DNA, 25 bp, Mus musculus
gctttttacttggaacccacatgat

SEQ ID NO: 697552 - DNA, 25 bp, Mus musculus
gctttttagcacagacagccaagaa

SEQ ID NO: 697553 - DNA, 25 bp, Mus musculus
gctttttagcactgacagccaagaa

SEQ ID NO: 697554 - DNA, 25 bp, Mus musculus
gctttttatactcgttccatgacaa

SEQ ID NO: 697555 - DNA, 25 bp, Mus musculus
gctttttatactggttccatgacaa

SEQ ID NO: 697556 - DNA, 25 bp, Mus musculus
gctttttatataacacatgcaccat

SEQ ID NO: 697557 - DNA, 25 bp, Mus musculus
gctttttatatatcacatgcaccat

SEQ ID NO: 697558 - DNA, 25 bp, Mus musculus
gctttttatgtccaggagtcctgca

SEQ ID NO: 697559 - DNA, 25 bp, Mus musculus
gctttttatgtcgaggagtcctgca

SEQ ID NO: 697560 - DNA, 25 bp, Mus musculus
gctttttcctgtcgcctcccgtggg

SEQ ID NO: 697561 - DNA, 25 bp, Mus musculus
gctttttcctgtggcctcccgtggg

SEQ ID NO: 697562 - DNA, 25 bp, Mus musculus
gctttttctcgtatgcatgtctgca

SEQ ID NO: 697563 - DNA, 25 bp, Mus musculus
gctttttctcgtttgcatgtctgca

SEQ ID NO: 697564 - DNA, 25 bp, Mus musculus
gctttttgaccaagtaggttgctta

SEQ ID NO: 697565 - DNA, 25 bp, Mus musculus
gctttttgaccatgtaggttgctta

SEQ ID NO: 697566 - DNA, 25 bp, Mus musculus
gctttttgctcaatggcgtggctgc

SEQ ID NO: 697567 - DNA, 25 bp, Mus musculus
gctttttgctcattggcgtggctgc

SEQ ID NO: 697568 - DNA, 25 bp, Mus musculus
gctttttggcaccacaggaaactgt

SEQ ID NO: 697569 - DNA, 25 bp, Mus musculus
gctttttggcacgacaggaaactgt

SEQ ID NO: 697570 - DNA, 25 bp, Mus musculus
gctttttggtaccttccatgtggcc

SEQ ID NO: 697571 - DNA, 25 bp, Mus musculus
gctttttggtacgttccatgtggcc

SEQ ID NO: 697572 - DNA, 25 bp, Mus musculus
gctttttgtcatcggcttggcaaac

SEQ ID NO: 697573 - DNA, 25 bp, Mus musculus
gctttttgtcatgggcttggcaaac

SEQ ID NO: 697574 - DNA, 25 bp, Mus musculus
gcttttttaggaccaaaggacatat

SEQ ID NO: 697575 - DNA, 25 bp, Mus musculus
gcttttttaggagcaaaggacatat

SEQ ID NO: 697576 - DNA, 25 bp, Mus musculus
gcttttttctggaagacagctttac

SEQ ID NO: 697577 - DNA, 25 bp, Mus musculus
gcttttttctggtagacagctttac

SEQ ID NO: 697578 - DNA, 25 bp, Mus musculus
gcttttttgcgaactgcatcgagga

SEQ ID NO: 697579 - DNA, 25 bp, Mus musculus
gcttttttgcgatctgcatcgagga

SEQ ID NO: 697580 - DNA, 25 bp, Mus musculus
ggaaaaaacagaccgagacaagagc

SEQ ID NO: 697581 - DNA, 25 bp, Mus musculus
ggaaaaaacagagcgagacaagagc

SEQ ID NO: 697582 - DNA, 25 bp, Mus musculus
ggaaaaaagttcagtaggcttgact

SEQ ID NO: 697583 - DNA, 25 bp, Mus musculus
ggaaaaaagttctgtaggcttgact

SEQ ID NO: 697584 - DNA, 25 bp, Mus musculus
ggaaaaacagccaacgctaatgaca

SEQ ID NO: 697585 - DNA, 25 bp, Mus musculus
ggaaaaacagcctacgctaatgaca

SEQ ID NO: 697586 - DNA, 25 bp, Mus musculus
ggaaaaacgtgcagggccatatgca

SEQ ID NO: 697587 - DNA, 25 bp, Mus musculus
ggaaaaacgtgctgggccatatgca

SEQ ID NO: 697588 - DNA, 25 bp, Mus musculus
ggaaaaactcagacaaatacttcca

SEQ ID NO: 697589 - DNA, 25 bp, Mus musculus
ggaaaaactcagtcaaatacttcca

SEQ ID NO: 697590 - DNA, 25 bp, Mus musculus
ggaaaaactcatctgaagaaattct

SEQ ID NO: 697591 - DNA, 25 bp, Mus musculus
ggaaaaactcatgtgaagaaattct

SEQ ID NO: 697592 - DNA, 25 bp, Mus musculus
ggaaaaacttcactcgtagctcgga

SEQ ID NO: 697593 - DNA, 25 bp, Mus musculus
ggaaaaacttcagtcgtagctcgga

SEQ ID NO: 697594 - DNA, 25 bp, Mus musculus
ggaaaaagcctacagaggatccagc

SEQ ID NO: 697595 - DNA, 25 bp, Mus musculus
ggaaaaagcctagagaggatccagc

SEQ ID NO: 697596 - DNA, 25 bp, Mus musculus
ggaaaaatacttctgatggacttga

SEQ ID NO: 697597 - DNA, 25 bp, Mus musculus
ggaaaaatacttgtgatggacttga

SEQ ID NO: 697598 - DNA, 25 bp, Mus musculus
ggaaaaatgactcaaaaagctgcaa

SEQ ID NO: 697599 - DNA, 25 bp, Mus musculus
ggaaaaatgactgaaaaagctgcaa

SEQ ID NO: 697600 - DNA, 25 bp, Mus musculus
ggaaaaatgctacggccgagagcct

SEQ ID NO: 697601 - DNA, 25 bp, Mus musculus
ggaaaaatgctagggccgagagcct

SEQ ID NO: 697602 - DNA, 25 bp, Mus musculus
ggaaaaattacacctatcgacggag

SEQ ID NO: 697603 - DNA, 25 bp, Mus musculus
ggaaaaattacagctatcgacggag

SEQ ID NO: 697604 - DNA, 25 bp, Mus musculus
ggaaaacaaaaaacacgaaacaatg

SEQ ID NO: 697605 - DNA, 25 bp, Mus musculus
ggaaaacaaaaatcacgaaacaatg

SEQ ID NO: 697606 - DNA, 25 bp, Mus musculus
ggaaaacactcaacatctcaccgtc

SEQ ID NO: 697607 - DNA, 25 bp, Mus musculus
ggaaaacactcatcatctcaccgtc

SEQ ID NO: 697608 - DNA, 25 bp, Mus musculus
ggaaaacactctaggcacgagctgt

SEQ ID NO: 697609 - DNA, 25 bp, Mus musculus
ggaaaacactcttggcacgagctgt

SEQ ID NO: 697610 - DNA, 25 bp, Mus musculus
ggaaaacagatacgtgcatgacaaa

SEQ ID NO: 697611 - DNA, 25 bp, Mus musculus
ggaaaacagataggtgcatgacaaa

SEQ ID NO: 697612 - DNA, 25 bp, Mus musculus
ggaaaacagtgaagtcttttctggc

SEQ ID NO: 697613 - DNA, 25 bp, Mus musculus
ggaaaacagtgatgtcttttctggc

SEQ ID NO: 697614 - DNA, 25 bp, Mus musculus
ggaaaacatcccaacagtgggcttg

SEQ ID NO: 697615 - DNA, 25 bp, Mus musculus
ggaaaacatccctacagtgggcttg

SEQ ID NO: 697616 - DNA, 25 bp, Mus musculus
ggaaaacatgtgcatgccaaaggca

SEQ ID NO: 697617 - DNA, 25 bp, Mus musculus
ggaaaacatgtggatgccaaaggca

SEQ ID NO: 697618 - DNA, 25 bp, Mus musculus
ggaaaacattgaaacagtggtcaca

SEQ ID NO: 697619 - DNA, 25 bp, Mus musculus
ggaaaacattgatacagtggtcaca

SEQ ID NO: 697620 - DNA, 25 bp, Mus musculus
ggaaaaccaaaaccctgttggatgg

SEQ ID NO: 697621 - DNA, 25 bp, Mus musculus
ggaaaaccaaaagcctgttggatgg

SEQ ID NO: 697622 - DNA, 25 bp, Mus musculus
ggaaaaccagatcctcacccgagat

SEQ ID NO: 697623 - DNA, 25 bp, Mus musculus
ggaaaaccagatgctcacccgagat

SEQ ID NO: 697624 - DNA, 25 bp, Mus musculus
ggaaaaccctcaatccagtcttcaa

SEQ ID NO: 697625 - DNA, 25 bp, Mus musculus
ggaaaaccctcattccagtcttcaa

SEQ ID NO: 697626 - DNA, 25 bp, Mus musculus
ggaaaacctactatgctcacgatgc

SEQ ID NO: 697627 - DNA, 25 bp, Mus musculus
ggaaaacctactttgctcacgatgc

SEQ ID NO: 697628 - DNA, 25 bp, Mus musculus
ggaaaacctgtaagagactacctca

SEQ ID NO: 697629 - DNA, 25 bp, Mus musculus
ggaaaacctgtatgagactacctca

SEQ ID NO: 697630 - DNA, 25 bp, Mus musculus
ggaaaaccttccagctgtacaacca

SEQ ID NO: 697631 - DNA, 25 bp, Mus musculus
ggaaaaccttcctgctgtacaacca

SEQ ID NO: 697632 - DNA, 25 bp, Mus musculus
ggaaaacgaactcgctctctccaca

SEQ ID NO: 697633 - DNA, 25 bp, Mus musculus
ggaaaacgaactggctctctccaca

SEQ ID NO: 697634 - DNA, 25 bp, Mus musculus
ggaaaacgagccacttcaggaatct

SEQ ID NO: 697635 - DNA, 25 bp, Mus musculus
ggaaaacgagcctcttcaggaatct

SEQ ID NO: 697636 - DNA, 25 bp, Mus musculus
ggaaaacgcctcctagacctcttgg

SEQ ID NO: 697637 - DNA, 25 bp, Mus musculus
ggaaaacgcctcgtagacctcttgg

SEQ ID NO: 697638 - DNA, 25 bp, Mus musculus
ggaaaactaatgaagatggtggatc

SEQ ID NO: 697639 - DNA, 25 bp, Mus musculus
ggaaaactaatgtagatggtggatc

SEQ ID NO: 697640 - DNA, 25 bp, Mus musculus
ggaaaactacccagatgttatccga

SEQ ID NO: 697641 - DNA, 25 bp, Mus musculus
ggaaaactaccctgatgttatccga

SEQ ID NO: 697642 - DNA, 25 bp, Mus musculus
ggaaaactattcacaccacggaaga

SEQ ID NO: 697643 - DNA, 25 bp, Mus musculus
ggaaaactattctcaccacggaaga

SEQ ID NO: 697644 - DNA, 25 bp, Mus musculus
ggaaaactgctaagagttggaggcc

SEQ ID NO: 697645 - DNA, 25 bp, Mus musculus
ggaaaactgctatgagttggaggcc

SEQ ID NO: 697646 - DNA, 25 bp, Mus musculus
ggaaaagaacagagacacattcaga

SEQ ID NO: 697647 - DNA, 25 bp, Mus musculus
ggaaaagaacagtgacacattcaga

SEQ ID NO: 697648 - DNA, 25 bp, Mus musculus
ggaaaagaagagattacacagctga

SEQ ID NO: 697649 - DNA, 25 bp, Mus musculus
ggaaaagaagagtttacacagctga

SEQ ID NO: 697650 - DNA, 25 bp, Mus musculus
ggaaaagaaggtcccctggtacatg

SEQ ID NO: 697651 - DNA, 25 bp, Mus musculus
ggaaaagaaggtgccctggtacatg

SEQ ID NO: 697652 - DNA, 25 bp, Mus musculus
ggaaaagaatgtcgaccaggcctct

SEQ ID NO: 697653 - DNA, 25 bp, Mus musculus
ggaaaagaatgtggaccaggcctct

SEQ ID NO: 697654 - DNA, 25 bp, Mus musculus
ggaaaagacggaagccttgacttct

SEQ ID NO: 697655 - DNA, 25 bp, Mus musculus
ggaaaagacggatgccttgacttct

SEQ ID NO: 697656 - DNA, 25 bp, Mus musculus
ggaaaagactcgaccaagatctcgg

SEQ ID NO: 697657 - DNA, 25 bp, Mus musculus
ggaaaagactcgtccaagatctcgg

SEQ ID NO: 697658 - DNA, 25 bp, Mus musculus
ggaaaagacttcatagtcgtcctga

SEQ ID NO: 697659 - DNA, 25 bp, Mus musculus
ggaaaagacttcttagtcgtcctga

SEQ ID NO: 697660 - DNA, 25 bp, Mus musculus
ggaaaagagcttcctggttgccttg

SEQ ID NO: 697661 - DNA, 25 bp, Mus musculus
ggaaaagagcttgctggttgccttg

SEQ ID NO: 697662 - DNA, 25 bp, Mus musculus
ggaaaagagtggatgtatactggaa

SEQ ID NO: 697663 - DNA, 25 bp, Mus musculus
ggaaaagagtggttgtatactggaa

SEQ ID NO: 697664 - DNA, 25 bp, Mus musculus
ggaaaagatgctacatacctggtaa

SEQ ID NO: 697665 - DNA, 25 bp, Mus musculus
ggaaaagatgcttcatacctggtaa

SEQ ID NO: 697666 - DNA, 25 bp, Mus musculus
ggaaaagcacgcagacaaggaagac

SEQ ID NO: 697667 - DNA, 25 bp, Mus musculus
ggaaaagcacgctgacaaggaagac

SEQ ID NO: 697668 - DNA, 25 bp, Mus musculus
ggaaaagcacggagacatatttact

SEQ ID NO: 697669 - DNA, 25 bp, Mus musculus
ggaaaagcacggtgacatatttact

SEQ ID NO: 697670 - DNA, 25 bp, Mus musculus
ggaaaagcacgtcctcccaagatag

SEQ ID NO: 697671 - DNA, 25 bp, Mus musculus
ggaaaagcacgtgctcccaagatag

SEQ ID NO: 697672 - DNA, 25 bp, Mus musculus
ggaaaagcagagactgaggccacct

SEQ ID NO: 697673 - DNA, 25 bp, Mus musculus
ggaaaagcagagtctgaggccacct

SEQ ID NO: 697674 - DNA, 25 bp, Mus musculus
ggaaaagcaggtcaacgtggcctcc

SEQ ID NO: 697675 - DNA, 25 bp, Mus musculus
ggaaaagcaggtgaacgtggcctcc

SEQ ID NO: 697676 - DNA, 25 bp, Mus musculus
ggaaaagcccttacatgtccctggg

SEQ ID NO: 697677 - DNA, 25 bp, Mus musculus
ggaaaagccctttcatgtccctggg

SEQ ID NO: 697678 - DNA, 25 bp, Mus musculus
ggaaaagccgtcatcacagcgaact

SEQ ID NO: 697679 - DNA, 25 bp, Mus musculus
ggaaaagccgtcttcacagcgaact

SEQ ID NO: 697680 - DNA, 25 bp, Mus musculus
ggaaaagcctatcgaacagcaaaca

SEQ ID NO: 697681 - DNA, 25 bp, Mus musculus
ggaaaagcctatggaacagcaaaca

SEQ ID NO: 697682 - DNA, 25 bp, Mus musculus
ggaaaagcggacatatccagacagc

SEQ ID NO: 697683 - DNA, 25 bp, Mus musculus
ggaaaagcggacttatccagacagc

SEQ ID NO: 697684 - DNA, 25 bp, Mus musculus
ggaaaagctgacacatacgaaaaac

SEQ ID NO: 697685 - DNA, 25 bp, Mus musculus
ggaaaagctgactcatacgaaaaac

SEQ ID NO: 697686 - DNA, 25 bp, Mus musculus
ggaaaagcttttcgactgctgaagg

SEQ ID NO: 697687 - DNA, 25 bp, Mus musculus
ggaaaagcttttggactgctgaagg

SEQ ID NO: 697688 - DNA, 25 bp, Mus musculus
ggaaaaggacacattcgacaacagg

SEQ ID NO: 697689 - DNA, 25 bp, Mus musculus
ggaaaaggacactttcgacaacagg

SEQ ID NO: 697690 - DNA, 25 bp, Mus musculus
ggaaaaggcaatcacgacgtgctca

SEQ ID NO: 697691 - DNA, 25 bp, Mus musculus
ggaaaaggcaatgacgacgtgctca

SEQ ID NO: 697692 - DNA, 25 bp, Mus musculus
ggaaaaggcagtagcaaccaggtgt

SEQ ID NO: 697693 - DNA, 25 bp, Mus musculus
ggaaaaggcagttgcaaccaggtgt

SEQ ID NO: 697694 - DNA, 25 bp, Mus musculus
ggaaaaggccttacaccagtataca

SEQ ID NO: 697695 - DNA, 25 bp, Mus musculus
ggaaaaggcctttcaccagtataca

SEQ ID NO: 697696 - DNA, 25 bp, Mus musculus
ggaaaaggctctagggctgcagata

SEQ ID NO: 697697 - DNA, 25 bp, Mus musculus
ggaaaaggctcttgggctgcagata

SEQ ID NO: 697698 - DNA, 25 bp, Mus musculus
ggaaaagtactacgccacacagaaa

SEQ ID NO: 697699 - DNA, 25 bp, Mus musculus
ggaaaagtactaggccacacagaaa

SEQ ID NO: 697700 - DNA, 25 bp, Mus musculus
ggaaaagtcgcgctgagctactttg

SEQ ID NO: 697701 - DNA, 25 bp, Mus musculus
ggaaaagtcgcggtgagctactttg

SEQ ID NO: 697702 - DNA, 25 bp, Mus musculus
ggaaaagtctgtcttctgccgaatc

SEQ ID NO: 697703 - DNA, 25 bp, Mus musculus
ggaaaagtctgtgttctgccgaatc

SEQ ID NO: 697704 - DNA, 25 bp, Mus musculus
ggaaaagtggacagagtgaaccaat

SEQ ID NO: 697705 - DNA, 25 bp, Mus musculus
ggaaaagtggactgagtgaaccaat

SEQ ID NO: 697706 - DNA, 25 bp, Mus musculus
ggaaaagttctcacatgcccaccat

SEQ ID NO: 697707 - DNA, 25 bp, Mus musculus
ggaaaagttctcagcaccacaaatg

SEQ ID NO: 697708 - DNA, 25 bp, Mus musculus
ggaaaagttctctcatgcccaccat

SEQ ID NO: 697709 - DNA, 25 bp, Mus musculus
ggaaaagttctctgcaccacaaatg

SEQ ID NO: 697710 - DNA, 25 bp, Mus musculus
ggaaaagttcttcatccccaatgct

SEQ ID NO: 697711 - DNA, 25 bp, Mus musculus
ggaaaagttcttgatccccaatgct

SEQ ID NO: 697712 - DNA, 25 bp, Mus musculus
ggaaaagtttaacgaccactcaatg

SEQ ID NO: 697713 - DNA, 25 bp, Mus musculus
ggaaaagtttaaggaccactcaatg

SEQ ID NO: 697714 - DNA, 25 bp, Mus musculus
ggaaaataattacgaatggctgtgg

SEQ ID NO: 697715 - DNA, 25 bp, Mus musculus
ggaaaataattaggaatggctgtgg

SEQ ID NO: 697716 - DNA, 25 bp, Mus musculus
ggaaaatacagactccttgtaggca

SEQ ID NO: 697717 - DNA, 25 bp, Mus musculus
ggaaaatacagagtccttgtaggca

SEQ ID NO: 697718 - DNA, 25 bp, Mus musculus
ggaaaataccacagcatcaaagagg

SEQ ID NO: 697719 - DNA, 25 bp, Mus musculus
ggaaaataccactgcatcaaagagg

SEQ ID NO: 697720 - DNA, 25 bp, Mus musculus
ggaaaatagtcaaagatggagaaga

SEQ ID NO: 697721 - DNA, 25 bp, Mus musculus
ggaaaatagtcatagatggagaaga

SEQ ID NO: 697722 - DNA, 25 bp, Mus musculus
ggaaaatcaaccacccagctcatgc

SEQ ID NO: 697723 - DNA, 25 bp, Mus musculus
ggaaaatcaacctcccagctcatgc

SEQ ID NO: 697724 - DNA, 25 bp, Mus musculus
ggaaaatcacacaagcaagtattag

SEQ ID NO: 697725 - DNA, 25 bp, Mus musculus
ggaaaatcacactagcaagtattag

SEQ ID NO: 697726 - DNA, 25 bp, Mus musculus
ggaaaatcagatcaacagctttggc

SEQ ID NO: 697727 - DNA, 25 bp, Mus musculus
ggaaaatcagatgaacagctttggc

SEQ ID NO: 697728 - DNA, 25 bp, Mus musculus
ggaaaatcatccagcagacttggaa

SEQ ID NO: 697729 - DNA, 25 bp, Mus musculus
ggaaaatcatcctgcagacttggaa

SEQ ID NO: 697730 - DNA, 25 bp, Mus musculus
ggaaaatctactctgtggcttgtca

SEQ ID NO: 697731 - DNA, 25 bp, Mus musculus
ggaaaatctactgtgtggcttgtca

SEQ ID NO: 697732 - DNA, 25 bp, Mus musculus
ggaaaatctgaaaactttagacctt

SEQ ID NO: 697733 - DNA, 25 bp, Mus musculus
ggaaaatctgaatactttagacctt

SEQ ID NO: 697734 - DNA, 25 bp, Mus musculus
ggaaaatgacccagcctatgattgc

SEQ ID NO: 697735 - DNA, 25 bp, Mus musculus
ggaaaatgaccctgcctatgattgc

SEQ ID NO: 697736 - DNA, 25 bp, Mus musculus
ggaaaatgtctcagtacctggaaaa

SEQ ID NO: 697737 - DNA, 25 bp, Mus musculus
ggaaaatgtctctgtacctggaaaa

SEQ ID NO: 697738 - DNA, 25 bp, Mus musculus
ggaaaatgtgtcacaggcccctcac

SEQ ID NO: 697739 - DNA, 25 bp, Mus musculus
ggaaaatgtgtctcaggcccctcac

SEQ ID NO: 697740 - DNA, 25 bp, Mus musculus
ggaaaattctcaaaggctctgaaga

SEQ ID NO: 697741 - DNA, 25 bp, Mus musculus
ggaaaattctcataggctctgaaga

SEQ ID NO: 697742 - DNA, 25 bp, Mus musculus
ggaaaattctctatgcacctgacac

SEQ ID NO: 697743 - DNA, 25 bp, Mus musculus
ggaaaattctctttgcacctgacac

SEQ ID NO: 697744 - DNA, 25 bp, Mus musculus
ggaaacaacagaagtaccctcagta

SEQ ID NO: 697745 - DNA, 25 bp, Mus musculus
ggaaacaacagatgtaccctcagta

SEQ ID NO: 697746 - DNA, 25 bp, Mus musculus
ggaaacaagttgagtacattggtgc

SEQ ID NO: 697747 - DNA, 25 bp, Mus musculus
ggaaacaagttgtgtacattggtgc

SEQ ID NO: 697748 - DNA, 25 bp, Mus musculus
ggaaacaatgaacccttgactggct

SEQ ID NO: 697749 - DNA, 25 bp, Mus musculus
ggaaacaatgaagccttgactggct

SEQ ID NO: 697750 - DNA, 25 bp, Mus musculus
ggaaacacacacatggcgagaacat

SEQ ID NO: 697751 - DNA, 25 bp, Mus musculus
ggaaacacacacttggcgagaacat

SEQ ID NO: 697752 - DNA, 25 bp, Mus musculus
ggaaacaccgccctccatgttgctg

SEQ ID NO: 697753 - DNA, 25 bp, Mus musculus
ggaaacaccgccgtccatgttgctg

SEQ ID NO: 697754 - DNA, 25 bp, Mus musculus
ggaaacaccgttctcagcacttgga

SEQ ID NO: 697755 - DNA, 25 bp, Mus musculus
ggaaacaccgttgtcagcacttgga

SEQ ID NO: 697756 - DNA, 25 bp, Mus musculus
ggaaacacctcacagaagaacttat

SEQ ID NO: 697757 - DNA, 25 bp, Mus musculus
ggaaacacctcagagaagaacttat

SEQ ID NO: 697758 - DNA, 25 bp, Mus musculus
ggaaacagagtgaagaatctccagc

SEQ ID NO: 697759 - DNA, 25 bp, Mus musculus
ggaaacagagtgtagaatctccagc

SEQ ID NO: 697760 - DNA, 25 bp, Mus musculus
ggaaacagagttacttcgattaaag

SEQ ID NO: 697761 - DNA, 25 bp, Mus musculus
ggaaacagagtttcttcgattaaag

SEQ ID NO: 697762 - DNA, 25 bp, Mus musculus
ggaaacagccaaagaatgaccctag

SEQ ID NO: 697763 - DNA, 25 bp, Mus musculus
ggaaacagccaatgaatgaccctag

SEQ ID NO: 697764 - DNA, 25 bp, Mus musculus
ggaaacagccagaagagagtacaag

SEQ ID NO: 697765 - DNA, 25 bp, Mus musculus
ggaaacagccagtagagagtacaag

SEQ ID NO: 697766 - DNA, 25 bp, Mus musculus
ggaaacatcaggattcacccctttt

SEQ ID NO: 697767 - DNA, 25 bp, Mus musculus
ggaaacatcaggtttcacccctttt

SEQ ID NO: 697768 - DNA, 25 bp, Mus musculus
ggaaaccaaagccttctgaccaagc

SEQ ID NO: 697769 - DNA, 25 bp, Mus musculus
ggaaaccaaagcgttctgaccaagc

SEQ ID NO: 697770 - DNA, 25 bp, Mus musculus
ggaaaccaagagagttgaacaggaa

SEQ ID NO: 697771 - DNA, 25 bp, Mus musculus
ggaaaccaagagtgttgaacaggaa

SEQ ID NO: 697772 - DNA, 25 bp, Mus musculus
ggaaaccacatcactcggactctga

SEQ ID NO: 697773 - DNA, 25 bp, Mus musculus
ggaaaccacatctctcggactctga

SEQ ID NO: 697774 - DNA, 25 bp, Mus musculus
ggaaaccacgccacgacacaagcag

SEQ ID NO: 697775 - DNA, 25 bp, Mus musculus
ggaaaccacgcctcgacacaagcag

SEQ ID NO: 697776 - DNA, 25 bp, Mus musculus
ggaaaccacggaccttctgaagcag

SEQ ID NO: 697777 - DNA, 25 bp, Mus musculus
ggaaaccacggagcttctgaagcag

SEQ ID NO: 697778 - DNA, 25 bp, Mus musculus
ggaaaccactgccagacatcatgtg

SEQ ID NO: 697779 - DNA, 25 bp, Mus musculus
ggaaaccactgcgagacatcatgtg

SEQ ID NO: 697780 - DNA, 25 bp, Mus musculus
ggaaaccagtgacctcaaggaggct

SEQ ID NO: 697781 - DNA, 25 bp, Mus musculus
ggaaaccagtgagctcaaggaggct

SEQ ID NO: 697782 - DNA, 25 bp, Mus musculus
ggaaaccatattcgcgcacctgaaa

SEQ ID NO: 697783 - DNA, 25 bp, Mus musculus
ggaaaccatattggcgcacctgaaa

SEQ ID NO: 697784 - DNA, 25 bp, Mus musculus
ggaaacccaagccacattggaagta

SEQ ID NO: 697785 - DNA, 25 bp, Mus musculus
ggaaacccaagcgacattggaagta

SEQ ID NO: 697786 - DNA, 25 bp, Mus musculus
ggaaacccactacgctgccgaattg

SEQ ID NO: 697787 - DNA, 25 bp, Mus musculus
ggaaacccactaggctgccgaattg

SEQ ID NO: 697788 - DNA, 25 bp, Mus musculus
ggaaacccagacattcagctcactg

SEQ ID NO: 697789 - DNA, 25 bp, Mus musculus
ggaaacccagactttcagctcactg

SEQ ID NO: 697790 - DNA, 25 bp, Mus musculus
ggaaacccagccctcttctgatgct

SEQ ID NO: 697791 - DNA, 25 bp, Mus musculus
ggaaacccagccgtcttctgatgct

SEQ ID NO: 697792 - DNA, 25 bp, Mus musculus
ggaaacccagcgctctacacaagag

SEQ ID NO: 697793 - DNA, 25 bp, Mus musculus
ggaaacccagcggtctacacaagag

SEQ ID NO: 697794 - DNA, 25 bp, Mus musculus
ggaaacccagttagagctcagagtc

SEQ ID NO: 697795 - DNA, 25 bp, Mus musculus
ggaaacccagtttgagctcagagtc

SEQ ID NO: 697796 - DNA, 25 bp, Mus musculus
ggaaaccgcttgcaaaagcccttgg

SEQ ID NO: 697797 - DNA, 25 bp, Mus musculus
ggaaaccgcttggaaaagcccttgg

SEQ ID NO: 697798 - DNA, 25 bp, Mus musculus
ggaaaccggctcatcgtgggccgca

SEQ ID NO: 697799 - DNA, 25 bp, Mus musculus
ggaaaccggctcttcgtgggccgca

SEQ ID NO: 697800 - DNA, 25 bp, Mus musculus
ggaaacctattaccctctgcctcga

SEQ ID NO: 697801 - DNA, 25 bp, Mus musculus
ggaaacctattagcctctgcctcga

SEQ ID NO: 697802 - DNA, 25 bp, Mus musculus
ggaaacctccgccaagctgaactac

SEQ ID NO: 697803 - DNA, 25 bp, Mus musculus
ggaaacctccgcgaagctgaactac

SEQ ID NO: 697804 - DNA, 25 bp, Mus musculus
ggaaacctggatctgaatagtatga

SEQ ID NO: 697805 - DNA, 25 bp, Mus musculus
ggaaacctggatgtgaatagtatga

SEQ ID NO: 697806 - DNA, 25 bp, Mus musculus
ggaaacctgtatagcactggtcgtg

SEQ ID NO: 697807 - DNA, 25 bp, Mus musculus
ggaaacctgtattgcactggtcgtg

SEQ ID NO: 697808 - DNA, 25 bp, Mus musculus
ggaaaccttaatccaaacaagtctg

SEQ ID NO: 697809 - DNA, 25 bp, Mus musculus
ggaaaccttaatgcaaacaagtctg

SEQ ID NO: 697810 - DNA, 25 bp, Mus musculus
ggaaaccttgggagctacaccactt

SEQ ID NO: 697811 - DNA, 25 bp, Mus musculus
ggaaaccttgggtgctacaccactt

SEQ ID NO: 697812 - DNA, 25 bp, Mus musculus
ggaaacctttgaacagaacatagaa

SEQ ID NO: 697813 - DNA, 25 bp, Mus musculus
ggaaacctttgatcagaacatagaa

SEQ ID NO: 697814 - DNA, 25 bp, Mus musculus
ggaaacgaatgacgaaccacctcct

SEQ ID NO: 697815 - DNA, 25 bp, Mus musculus
ggaaacgaatgaggaaccacctcct

SEQ ID NO: 697816 - DNA, 25 bp, Mus musculus
ggaaacgagagacactccagactgt

SEQ ID NO: 697817 - DNA, 25 bp, Mus musculus
ggaaacgagagagactccagactgt

SEQ ID NO: 697818 - DNA, 25 bp, Mus musculus
ggaaacgagcagcagccagacgtca

SEQ ID NO: 697819 - DNA, 25 bp, Mus musculus
ggaaacgagcaggagccagacgtca

SEQ ID NO: 697820 - DNA, 25 bp, Mus musculus
ggaaacgagttgcagacaatgactt

SEQ ID NO: 697821 - DNA, 25 bp, Mus musculus
ggaaacgagttggagacaatgactt

SEQ ID NO: 697822 - DNA, 25 bp, Mus musculus
ggaaacgatggcactagtggtcccc

SEQ ID NO: 697823 - DNA, 25 bp, Mus musculus
ggaaacgatggctctagtggtcccc

SEQ ID NO: 697824 - DNA, 25 bp, Mus musculus
ggaaacgcaagcaggaggaacaaat

SEQ ID NO: 697825 - DNA, 25 bp, Mus musculus
ggaaacgcaagctggaggaacaaat

SEQ ID NO: 697826 - DNA, 25 bp, Mus musculus
ggaaacgccacaagctagtctgaaa

SEQ ID NO: 697827 - DNA, 25 bp, Mus musculus
ggaaacgccacatgctagtctgaaa

SEQ ID NO: 697828 - DNA, 25 bp, Mus musculus
ggaaacgccaggagcccctcatggt

SEQ ID NO: 697829 - DNA, 25 bp, Mus musculus
ggaaacgccaggtgcccctcatggt

SEQ ID NO: 697830 - DNA, 25 bp, Mus musculus
ggaaacggagctctgagacctgcca

SEQ ID NO: 697831 - DNA, 25 bp, Mus musculus
ggaaacggagctgtgagacctgcca

SEQ ID NO: 697832 - DNA, 25 bp, Mus musculus
ggaaactaaagacccgtcagtgcct

SEQ ID NO: 697833 - DNA, 25 bp, Mus musculus
ggaaactaaagagccgtcagtgcct

SEQ ID NO: 697834 - DNA, 25 bp, Mus musculus
ggaaactacacaccctacaagtaca

SEQ ID NO: 697835 - DNA, 25 bp, Mus musculus
ggaaactacacagcctacaagtaca

SEQ ID NO: 697836 - DNA, 25 bp, Mus musculus
ggaaactaggtccacggccgacagc

SEQ ID NO: 697837 - DNA, 25 bp, Mus musculus
ggaaactaggtcgacggccgacagc

SEQ ID NO: 697838 - DNA, 25 bp, Mus musculus
ggaaactattggatatcccagaggg

SEQ ID NO: 697839 - DNA, 25 bp, Mus musculus
ggaaactattggttatcccagaggg

SEQ ID NO: 697840 - DNA, 25 bp, Mus musculus
ggaaactcagacaccttgcgcatag

SEQ ID NO: 697841 - DNA, 25 bp, Mus musculus
ggaaactcagactccttgcgcatag

SEQ ID NO: 697842 - DNA, 25 bp, Mus musculus
ggaaactcagctctccaggcttctg

SEQ ID NO: 697843 - DNA, 25 bp, Mus musculus
ggaaactcagctgtccaggcttctg

SEQ ID NO: 697844 - DNA, 25 bp, Mus musculus
ggaaactcatccaagactctgcccg

SEQ ID NO: 697845 - DNA, 25 bp, Mus musculus
ggaaactcatcctagactctgcccg

SEQ ID NO: 697846 - DNA, 25 bp, Mus musculus
ggaaactcatggaatatcctccaga

SEQ ID NO: 697847 - DNA, 25 bp, Mus musculus
ggaaactcatggtatatcctccaga

SEQ ID NO: 697848 - DNA, 25 bp, Mus musculus
ggaaactcccaaactctgtcctctt

SEQ ID NO: 697849 - DNA, 25 bp, Mus musculus
ggaaactcccaatctctgtcctctt

SEQ ID NO: 697850 - DNA, 25 bp, Mus musculus
ggaaactcctctacgtcagtattag

SEQ ID NO: 697851 - DNA, 25 bp, Mus musculus
ggaaactcctcttcgtcagtattag

SEQ ID NO: 697852 - DNA, 25 bp, Mus musculus
ggaaactctcccagcgggcctgtgc

SEQ ID NO: 697853 - DNA, 25 bp, Mus musculus
ggaaactctccctgcgggcctgtgc

SEQ ID NO: 697854 - DNA, 25 bp, Mus musculus
ggaaactctcgaaggacattctggg

SEQ ID NO: 697855 - DNA, 25 bp, Mus musculus
ggaaactctcgatggacattctggg

SEQ ID NO: 697856 - DNA, 25 bp, Mus musculus
ggaaactctgaacccgaccagttgg

SEQ ID NO: 697857 - DNA, 25 bp, Mus musculus
ggaaactctgaagccgaccagttgg

SEQ ID NO: 697858 - DNA, 25 bp, Mus musculus
ggaaactctggcctaattcgaggaa

SEQ ID NO: 697859 - DNA, 25 bp, Mus musculus
ggaaactctggcgtaattcgaggaa

SEQ ID NO: 697860 - DNA, 25 bp, Mus musculus
ggaaactcttgcagcagatccgact

SEQ ID NO: 697861 - DNA, 25 bp, Mus musculus
ggaaactcttgctgcagatccgact

SEQ ID NO: 697862 - DNA, 25 bp, Mus musculus
ggaaactgaaggagatgtgacatct

SEQ ID NO: 697863 - DNA, 25 bp, Mus musculus
ggaaactgaaggtgatgtgacatct

SEQ ID NO: 697864 - DNA, 25 bp, Mus musculus
ggaaactgattgacatcatggcatc

SEQ ID NO: 697865 - DNA, 25 bp, Mus musculus
ggaaactgattgtcatcatggcatc

SEQ ID NO: 697866 - DNA, 25 bp, Mus musculus
ggaaactgccccatttcacagaggc

SEQ ID NO: 697867 - DNA, 25 bp, Mus musculus
ggaaactgccccttttcacagaggc

SEQ ID NO: 697868 - DNA, 25 bp, Mus musculus
ggaaactgctatctctggaacctga

SEQ ID NO: 697869 - DNA, 25 bp, Mus musculus
ggaaactgctatgtctggaacctga

SEQ ID NO: 697870 - DNA, 25 bp, Mus musculus
ggaaactggcaaaccctactaagtg

SEQ ID NO: 697871 - DNA, 25 bp, Mus musculus
ggaaactggcaatccctactaagtg

SEQ ID NO: 697872 - DNA, 25 bp, Mus musculus
ggaaactggcgtctgagtaactgaa

SEQ ID NO: 697873 - DNA, 25 bp, Mus musculus
ggaaactggcgtgtgagtaactgaa

SEQ ID NO: 697874 - DNA, 25 bp, Mus musculus
ggaaactgggctcacctggaccaac

SEQ ID NO: 697875 - DNA, 25 bp, Mus musculus
ggaaactgggctgacctggaccaac

SEQ ID NO: 697876 - DNA, 25 bp, Mus musculus
ggaaactgtccccttgagatcgtct

SEQ ID NO: 697877 - DNA, 25 bp, Mus musculus
ggaaactgtcccgttgagatcgtct

SEQ ID NO: 697878 - DNA, 25 bp, Mus musculus
ggaaacttagggaacaatagcacag

SEQ ID NO: 697879 - DNA, 25 bp, Mus musculus
ggaaacttagggtacaatagcacag

SEQ ID NO: 697880 - DNA, 25 bp, Mus musculus
ggaaacttcagtcatctgatctgag

SEQ ID NO: 697881 - DNA, 25 bp, Mus musculus
ggaaacttcagtgatctgatctgag

SEQ ID NO: 697882 - DNA, 25 bp, Mus musculus
ggaaacttccatcgtgaatacccag

SEQ ID NO: 697883 - DNA, 25 bp, Mus musculus
ggaaacttccatggtgaatacccag

SEQ ID NO: 697884 - DNA, 25 bp, Mus musculus
ggaaacttgaccatgtgctcggctg

SEQ ID NO: 697885 - DNA, 25 bp, Mus musculus
ggaaacttgaccttgtgctcggctg

SEQ ID NO: 697886 - DNA, 25 bp, Mus musculus
ggaaacttgctacaaatgatgtacc

SEQ ID NO: 697887 - DNA, 25 bp, Mus musculus
ggaaacttgctagaaatgatgtacc

SEQ ID NO: 697888 - DNA, 25 bp, Mus musculus
ggaaacttggacctattgccttggg

SEQ ID NO: 697889 - DNA, 25 bp, Mus musculus
ggaaacttggacgtattgccttggg

SEQ ID NO: 697890 - DNA, 25 bp, Mus musculus
ggaaagaaccacacacaatcccctg

SEQ ID NO: 697891 - DNA, 25 bp, Mus musculus
ggaaagaaccactcacaatcccctg

SEQ ID NO: 697892 - DNA, 25 bp, Mus musculus
ggaaagaacctaatacagagacggg

SEQ ID NO: 697893 - DNA, 25 bp, Mus musculus
ggaaagaacctattacagagacggg

SEQ ID NO: 697894 - DNA, 25 bp, Mus musculus
ggaaagaacttgaggaatatgtgga

SEQ ID NO: 697895 - DNA, 25 bp, Mus musculus
ggaaagaacttgtggaatatgtgga

SEQ ID NO: 697896 - DNA, 25 bp, Mus musculus
ggaaagaatctgactcacatcaaag

SEQ ID NO: 697897 - DNA, 25 bp, Mus musculus
ggaaagaatctgtctcacatcaaag

SEQ ID NO: 697898 - DNA, 25 bp, Mus musculus
ggaaagacatacatgaagctaaaca

SEQ ID NO: 697899 - DNA, 25 bp, Mus musculus
ggaaagacatacttgaagctaaaca

SEQ ID NO: 697900 - DNA, 25 bp, Mus musculus
ggaaagacgcagaattggcaaactc

SEQ ID NO: 697901 - DNA, 25 bp, Mus musculus
ggaaagacgcagtattggcaaactc

SEQ ID NO: 697902 - DNA, 25 bp, Mus musculus
ggaaagacttcactccctatgacta

SEQ ID NO: 697903 - DNA, 25 bp, Mus musculus
ggaaagacttcagtccctatgacta

SEQ ID NO: 697904 - DNA, 25 bp, Mus musculus
ggaaagagacaacgcgggcagatgg

SEQ ID NO: 697905 - DNA, 25 bp, Mus musculus
ggaaagagacaaggcgggcagatgg

SEQ ID NO: 697906 - DNA, 25 bp, Mus musculus
ggaaagagaccaacccaatgccact

SEQ ID NO: 697907 - DNA, 25 bp, Mus musculus
ggaaagagaccacattatgccccta

SEQ ID NO: 697908 - DNA, 25 bp, Mus musculus
ggaaagagaccagattatgccccta

SEQ ID NO: 697909 - DNA, 25 bp, Mus musculus
ggaaagagaccatcccaatgccact

SEQ ID NO: 697910 - DNA, 25 bp, Mus musculus
ggaaagagcctgatatcagctccgt

SEQ ID NO: 697911 - DNA, 25 bp, Mus musculus
ggaaagagcctgttatcagctccgt

SEQ ID NO: 697912 - DNA, 25 bp, Mus musculus
ggaaagagcgccaaacggaaaatgg

SEQ ID NO: 697913 - DNA, 25 bp, Mus musculus
ggaaagagcgcctaacggaaaatgg

SEQ ID NO: 697914 - DNA, 25 bp, Mus musculus
ggaaagaggattccctacttccctg

SEQ ID NO: 697915 - DNA, 25 bp, Mus musculus
ggaaagaggattgcctacttccctg

SEQ ID NO: 697916 - DNA, 25 bp, Mus musculus
ggaaagatacagcacaagccacagc

SEQ ID NO: 697917 - DNA, 25 bp, Mus musculus
ggaaagatacagcaccatcaccaca

SEQ ID NO: 697918 - DNA, 25 bp, Mus musculus
ggaaagatacaggacaagccacagc

SEQ ID NO: 697919 - DNA, 25 bp, Mus musculus
ggaaagatacaggaccatcaccaca

SEQ ID NO: 697920 - DNA, 25 bp, Mus musculus
ggaaagatcaacagaccaagtcatc

SEQ ID NO: 697921 - DNA, 25 bp, Mus musculus
ggaaagatcaactgaccaagtcatc

SEQ ID NO: 697922 - DNA, 25 bp, Mus musculus
ggaaagatctacaccttggttgtga

SEQ ID NO: 697923 - DNA, 25 bp, Mus musculus
ggaaagatctactccttggttgtga

SEQ ID NO: 697924 - DNA, 25 bp, Mus musculus
ggaaagatggcccacatgtacaccc

SEQ ID NO: 697925 - DNA, 25 bp, Mus musculus
ggaaagatggccgacatgtacaccc

SEQ ID NO: 697926 - DNA, 25 bp, Mus musculus
ggaaagatggcgaaccagagcctcc

SEQ ID NO: 697927 - DNA, 25 bp, Mus musculus
ggaaagatggcgtaccagagcctcc

SEQ ID NO: 697928 - DNA, 25 bp, Mus musculus
ggaaagatgggaagcttactgaagt

SEQ ID NO: 697929 - DNA, 25 bp, Mus musculus
ggaaagatgggatgcttactgaagt

SEQ ID NO: 697930 - DNA, 25 bp, Mus musculus
ggaaagatgtccacaccagcacgta

SEQ ID NO: 697931 - DNA, 25 bp, Mus musculus
ggaaagatgtcctcaccagcacgta

SEQ ID NO: 697932 - DNA, 25 bp, Mus musculus
ggaaagatttcactgcatacagatg

SEQ ID NO: 697933 - DNA, 25 bp, Mus musculus
ggaaagatttcagtgcatacagatg

SEQ ID NO: 697934 - DNA, 25 bp, Mus musculus
ggaaagcaacacatagacaacctct

SEQ ID NO: 697935 - DNA, 25 bp, Mus musculus
ggaaagcaacacttagacaacctct

SEQ ID NO: 697936 - DNA, 25 bp, Mus musculus
ggaaagcaccaacctgatcctcaag

SEQ ID NO: 697937 - DNA, 25 bp, Mus musculus
ggaaagcaccaagctgatcctcaag

SEQ ID NO: 697938 - DNA, 25 bp, Mus musculus
ggaaagcaccgtcgcctcctggtat

SEQ ID NO: 697939 - DNA, 25 bp, Mus musculus
ggaaagcaccgtggcctcctggtat

SEQ ID NO: 697940 - DNA, 25 bp, Mus musculus
ggaaagcactttcgcaccatcttga

SEQ ID NO: 697941 - DNA, 25 bp, Mus musculus
ggaaagcactttggcaccatcttga

SEQ ID NO: 697942 - DNA, 25 bp, Mus musculus
ggaaagcagacacgactcgtcagga

SEQ ID NO: 697943 - DNA, 25 bp, Mus musculus
ggaaagcagacaggactcgtcagga

SEQ ID NO: 697944 - DNA, 25 bp, Mus musculus
ggaaagcagatgatggacctaggac

SEQ ID NO: 697945 - DNA, 25 bp, Mus musculus
ggaaagcagatgttggacctaggac

SEQ ID NO: 697946 - DNA, 25 bp, Mus musculus
ggaaagcagcagatacaacggaagt

SEQ ID NO: 697947 - DNA, 25 bp, Mus musculus
ggaaagcagcagttacaacggaagt

SEQ ID NO: 697948 - DNA, 25 bp, Mus musculus
ggaaagcatttacaccgtggagcca

SEQ ID NO: 697949 - DNA, 25 bp, Mus musculus
ggaaagcatttagaccgtggagcca

SEQ ID NO: 697950 - DNA, 25 bp, Mus musculus
ggaaagccctcacggtcgtcgagca

SEQ ID NO: 697951 - DNA, 25 bp, Mus musculus
ggaaagccctcagggtcgtcgagca

SEQ ID NO: 697952 - DNA, 25 bp, Mus musculus
ggaaagccctttacagctccctgct

SEQ ID NO: 697953 - DNA, 25 bp, Mus musculus
ggaaagcccttttcagctccctgct

SEQ ID NO: 697954 - DNA, 25 bp, Mus musculus
ggaaagccgagtcccgctgtcagcc

SEQ ID NO: 697955 - DNA, 25 bp, Mus musculus
ggaaagccgagtgccgctgtcagcc

SEQ ID NO: 697956 - DNA, 25 bp, Mus musculus
ggaaagcctaccacagtgctcagga

SEQ ID NO: 697957 - DNA, 25 bp, Mus musculus
ggaaagcctacctcagtgctcagga

SEQ ID NO: 697958 - DNA, 25 bp, Mus musculus
ggaaagcctatcacatccagctacg

SEQ ID NO: 697959 - DNA, 25 bp, Mus musculus
ggaaagcctatcaccacggatgtca

SEQ ID NO: 697960 - DNA, 25 bp, Mus musculus
ggaaagcctatctcatccagctacg

SEQ ID NO: 697961 - DNA, 25 bp, Mus musculus
ggaaagcctatctccacggatgtca

SEQ ID NO: 697962 - DNA, 25 bp, Mus musculus
ggaaagcctctcaccatagaggaga

SEQ ID NO: 697963 - DNA, 25 bp, Mus musculus
ggaaagcctctctccatagaggaga

SEQ ID NO: 697964 - DNA, 25 bp, Mus musculus
ggaaagcctggtatcccgtgtgcca

SEQ ID NO: 697965 - DNA, 25 bp, Mus musculus
ggaaagcctggtttcccgtgtgcca

SEQ ID NO: 697966 - DNA, 25 bp, Mus musculus
ggaaagctaacaacccaattatgga

SEQ ID NO: 697967 - DNA, 25 bp, Mus musculus
ggaaagctaacatcccaattatgga

SEQ ID NO: 697968 - DNA, 25 bp, Mus musculus
ggaaagctaactacagaatgtactc

SEQ ID NO: 697969 - DNA, 25 bp, Mus musculus
ggaaagctaacttcagaatgtactc

SEQ ID NO: 697970 - DNA, 25 bp, Mus musculus
ggaaagctagctctacatatcctct

SEQ ID NO: 697971 - DNA, 25 bp, Mus musculus
ggaaagctagctgtacatatcctct

SEQ ID NO: 697972 - DNA, 25 bp, Mus musculus
ggaaagctcctgataaactgggtag

SEQ ID NO: 697973 - DNA, 25 bp, Mus musculus
ggaaagctcctgttaaactgggtag

SEQ ID NO: 697974 - DNA, 25 bp, Mus musculus
ggaaagctggtcagagaagccgcct

SEQ ID NO: 697975 - DNA, 25 bp, Mus musculus
ggaaagctggtctgagaagccgcct

SEQ ID NO: 697976 - DNA, 25 bp, Mus musculus
ggaaagcttcaaaattcactggact

SEQ ID NO: 697977 - DNA, 25 bp, Mus musculus
ggaaagcttcaatattcactggact

SEQ ID NO: 697978 - DNA, 25 bp, Mus musculus
ggaaagcttcgaattaagataggag

SEQ ID NO: 697979 - DNA, 25 bp, Mus musculus
ggaaagcttcgatttaagataggag

SEQ ID NO: 697980 - DNA, 25 bp, Mus musculus
ggaaagctttaccacaggcctacag

SEQ ID NO: 697981 - DNA, 25 bp, Mus musculus
ggaaagctttacgacaggcctacag

SEQ ID NO: 697982 - DNA, 25 bp, Mus musculus
ggaaaggacagacaactatcaacca

SEQ ID NO: 697983 - DNA, 25 bp, Mus musculus
ggaaaggacagagaactatcaacca

SEQ ID NO: 697984 - DNA, 25 bp, Mus musculus
ggaaaggcaatcatctcctgcagct

SEQ ID NO: 697985 - DNA, 25 bp, Mus musculus
ggaaaggcaatcttctcctgcagct

SEQ ID NO: 697986 - DNA, 25 bp, Mus musculus
ggaaaggcacaaacctgatatcttc

SEQ ID NO: 697987 - DNA, 25 bp, Mus musculus
ggaaaggcacaatcctgatatcttc

SEQ ID NO: 697988 - DNA, 25 bp, Mus musculus
ggaaaggcactgctgttcttgagca

SEQ ID NO: 697989 - DNA, 25 bp, Mus musculus
ggaaaggcactggtgttcttgagca

SEQ ID NO: 697990 - DNA, 25 bp, Mus musculus
ggaaaggcaggtacttccccacagg

SEQ ID NO: 697991 - DNA, 25 bp, Mus musculus
ggaaaggcaggttcttccccacagg

SEQ ID NO: 697992 - DNA, 25 bp, Mus musculus
ggaaaggccacaataccggagagca

SEQ ID NO: 697993 - DNA, 25 bp, Mus musculus
ggaaaggccacattaccggagagca

SEQ ID NO: 697994 - DNA, 25 bp, Mus musculus
ggaaaggccataatatttctgaagg

SEQ ID NO: 697995 - DNA, 25 bp, Mus musculus
ggaaaggccatattatttctgaagg

SEQ ID NO: 697996 - DNA, 25 bp, Mus musculus
ggaaaggccttcactaggcccctgg

SEQ ID NO: 697997 - DNA, 25 bp, Mus musculus
ggaaaggccttctctaggcccctgg

SEQ ID NO: 697998 - DNA, 25 bp, Mus musculus
ggaaaggctacactcaggacaacaa

SEQ ID NO: 697999 - DNA, 25 bp, Mus musculus
ggaaaggctacagtcaggacaacaa

SEQ ID NO: 698000 - DNA, 25 bp, Mus musculus
ggaaaggctgctccgtctccagtga

SEQ ID NO: 698001 - DNA, 25 bp, Mus musculus
ggaaaggctgctgcgtctccagtga

SEQ ID NO: 698002 - DNA, 25 bp, Mus musculus
ggaaagggactgacgagctctcctg

SEQ ID NO: 698003 - DNA, 25 bp, Mus musculus
ggaaagggactgtcgagctctcctg

SEQ ID NO: 698004 - DNA, 25 bp, Mus musculus
ggaaagggcaatctccaccacctct

SEQ ID NO: 698005 - DNA, 25 bp, Mus musculus
ggaaagggcaatgtccaccacctct

SEQ ID NO: 698006 - DNA, 25 bp, Mus musculus
ggaaagggctcaacgcctagcagag

SEQ ID NO: 698007 - DNA, 25 bp, Mus musculus
ggaaagggctcatcgcctagcagag

SEQ ID NO: 698008 - DNA, 25 bp, Mus musculus
ggaaagggctttaaatgatgttttg

SEQ ID NO: 698009 - DNA, 25 bp, Mus musculus
ggaaagggcttttaatgatgttttg

SEQ ID NO: 698010 - DNA, 25 bp, Mus musculus
ggaaagggtacacaggcgcggacct

SEQ ID NO: 698011 - DNA, 25 bp, Mus musculus
ggaaagggtacagaggcgcggacct

SEQ ID NO: 698012 - DNA, 25 bp, Mus musculus
ggaaaggtgcagagttacacgtgcc

SEQ ID NO: 698013 - DNA, 25 bp, Mus musculus
ggaaaggtgcagtgttacacgtgcc

SEQ ID NO: 698014 - DNA, 25 bp, Mus musculus
ggaaaggttgtaaccagcaaaggcc

SEQ ID NO: 698015 - DNA, 25 bp, Mus musculus
ggaaaggttgtatccagcaaaggcc

SEQ ID NO: 698016 - DNA, 25 bp, Mus musculus
ggaaagtaaaagcaacaattgagca

SEQ ID NO: 698017 - DNA, 25 bp, Mus musculus
ggaaagtaaaaggaacaattgagca

SEQ ID NO: 698018 - DNA, 25 bp, Mus musculus
ggaaagtactgaaggcgagcgcctt

SEQ ID NO: 698019 - DNA, 25 bp, Mus musculus
ggaaagtactgatggcgagcgcctt

SEQ ID NO: 698020 - DNA, 25 bp, Mus musculus
ggaaagtataccctctgatcagccg

SEQ ID NO: 698021 - DNA, 25 bp, Mus musculus
ggaaagtataccgtctgatcagccg

SEQ ID NO: 698022 - DNA, 25 bp, Mus musculus
ggaaagtatatgacacacgggatga

SEQ ID NO: 698023 - DNA, 25 bp, Mus musculus
ggaaagtatatgtcacacgggatga

SEQ ID NO: 698024 - DNA, 25 bp, Mus musculus
ggaaagtatgtccattctaagaaca

SEQ ID NO: 698025 - DNA, 25 bp, Mus musculus
ggaaagtatgtcgattctaagaaca

SEQ ID NO: 698026 - DNA, 25 bp, Mus musculus
ggaaagtcaggtccaattctagcag

SEQ ID NO: 698027 - DNA, 25 bp, Mus musculus
ggaaagtcaggtgcaattctagcag

SEQ ID NO: 698028 - DNA, 25 bp, Mus musculus
ggaaagtcagtcacaaggctcatca

SEQ ID NO: 698029 - DNA, 25 bp, Mus musculus
ggaaagtcagtctcaaggctcatca

SEQ ID NO: 698030 - DNA, 25 bp, Mus musculus
ggaaagtcataaaccaagtactagc

SEQ ID NO: 698031 - DNA, 25 bp, Mus musculus
ggaaagtcataatccaagtactagc

SEQ ID NO: 698032 - DNA, 25 bp, Mus musculus
ggaaagtccaaacgctatggttttg

SEQ ID NO: 698033 - DNA, 25 bp, Mus musculus
ggaaagtccaaaggctatggttttg

SEQ ID NO: 698034 - DNA, 25 bp, Mus musculus
ggaaagtcccctcaagtgcctgtaa

SEQ ID NO: 698035 - DNA, 25 bp, Mus musculus
ggaaagtcccctgaagtgcctgtaa

SEQ ID NO: 698036 - DNA, 25 bp, Mus musculus
ggaaagtcctgccttctccttaggt

SEQ ID NO: 698037 - DNA, 25 bp, Mus musculus
ggaaagtcctgcgttctccttaggt

SEQ ID NO: 698038 - DNA, 25 bp, Mus musculus
ggaaagtctactaggaagatggctt

SEQ ID NO: 698039 - DNA, 25 bp, Mus musculus
ggaaagtctacttggaagatggctt

SEQ ID NO: 698040 - DNA, 25 bp, Mus musculus
ggaaagtgacttcataccagggttt

SEQ ID NO: 698041 - DNA, 25 bp, Mus musculus
ggaaagtgacttgataccagggttt

SEQ ID NO: 698042 - DNA, 25 bp, Mus musculus
ggaaagtgatctccatccccaaaag

SEQ ID NO: 698043 - DNA, 25 bp, Mus musculus
ggaaagtgatctgcatccccaaaag

SEQ ID NO: 698044 - DNA, 25 bp, Mus musculus
ggaaagtgcgagattcatcctgaac

SEQ ID NO: 698045 - DNA, 25 bp, Mus musculus
ggaaagtgcgagtttcatcctgaac

SEQ ID NO: 698046 - DNA, 25 bp, Mus musculus
ggaaagttcaaacctcaactgggca

SEQ ID NO: 698047 - DNA, 25 bp, Mus musculus
ggaaagttcaaagctcaactgggca

SEQ ID NO: 698048 - DNA, 25 bp, Mus musculus
ggaaagttcctcaaccacaaatcca

SEQ ID NO: 698049 - DNA, 25 bp, Mus musculus
ggaaagttcctctaccacaaatcca

SEQ ID NO: 698050 - DNA, 25 bp, Mus musculus
ggaaagttctagcttcaggaatgca

SEQ ID NO: 698051 - DNA, 25 bp, Mus musculus
ggaaagttctaggttcaggaatgca

SEQ ID NO: 698052 - DNA, 25 bp, Mus musculus
ggaaagttcttcatactacagcatg

SEQ ID NO: 698053 - DNA, 25 bp, Mus musculus
ggaaagttcttcttactacagcatg

SEQ ID NO: 698054 - DNA, 25 bp, Mus musculus
ggaaagttgcctagtggcagctatg

SEQ ID NO: 698055 - DNA, 25 bp, Mus musculus
ggaaagttgccttgtggcagctatg

SEQ ID NO: 698056 - DNA, 25 bp, Mus musculus
ggaaagttttcaacacccgcaagtc

SEQ ID NO: 698057 - DNA, 25 bp, Mus musculus
ggaaagttttcatcacccgcaagtc

SEQ ID NO: 698058 - DNA, 25 bp, Mus musculus
ggaaataaacttcactcaagagctt

SEQ ID NO: 698059 - DNA, 25 bp, Mus musculus
ggaaataaacttgactcaagagctt

SEQ ID NO: 698060 - DNA, 25 bp, Mus musculus
ggaaataacaaccagccagtgtgca

SEQ ID NO: 698061 - DNA, 25 bp, Mus musculus
ggaaataacaacgagccagtgtgca

SEQ ID NO: 698062 - DNA, 25 bp, Mus musculus
ggaaataaccctacagtttctctga

SEQ ID NO: 698063 - DNA, 25 bp, Mus musculus
ggaaataacccttcagtttctctga

SEQ ID NO: 698064 - DNA, 25 bp, Mus musculus
ggaaataatgcacgcaatcctggtt

SEQ ID NO: 698065 - DNA, 25 bp, Mus musculus
ggaaataatgcaggcaatcctggtt

SEQ ID NO: 698066 - DNA, 25 bp, Mus musculus
ggaaataattgtagaccagaagcag

SEQ ID NO: 698067 - DNA, 25 bp, Mus musculus
ggaaataattgttgaccagaagcag

SEQ ID NO: 698068 - DNA, 25 bp, Mus musculus
ggaaatacaatccttctgaagaaga

SEQ ID NO: 698069 - DNA, 25 bp, Mus musculus
ggaaatacaatcgttctgaagaaga

SEQ ID NO: 698070 - DNA, 25 bp, Mus musculus
ggaaatacaccactttggctggcat

SEQ ID NO: 698071 - DNA, 25 bp, Mus musculus
ggaaatacaccagtttggctggcat

SEQ ID NO: 698072 - DNA, 25 bp, Mus musculus
ggaaatacagtgaacccttggagga

SEQ ID NO: 698073 - DNA, 25 bp, Mus musculus
ggaaatacagtgtacccttggagga

SEQ ID NO: 698074 - DNA, 25 bp, Mus musculus
ggaaatacatgtacccgaagaacag

SEQ ID NO: 698075 - DNA, 25 bp, Mus musculus
ggaaatacatgttcccgaagaacag

SEQ ID NO: 698076 - DNA, 25 bp, Mus musculus
ggaaatacgtgccttgcctgtgacg

SEQ ID NO: 698077 - DNA, 25 bp, Mus musculus
ggaaatacgtgcgttgcctgtgacg

SEQ ID NO: 698078 - DNA, 25 bp, Mus musculus
ggaaatacttatctgtctaaaggag

SEQ ID NO: 698079 - DNA, 25 bp, Mus musculus
ggaaatacttatgtgtctaaaggag

SEQ ID NO: 698080 - DNA, 25 bp, Mus musculus
ggaaatacttcgagctgtgcctggc

SEQ ID NO: 698081 - DNA, 25 bp, Mus musculus
ggaaatacttcgtgctgtgcctggc

SEQ ID NO: 698082 - DNA, 25 bp, Mus musculus
ggaaatagatgtcgaaggtcaactc

SEQ ID NO: 698083 - DNA, 25 bp, Mus musculus
ggaaatagatgtggaaggtcaactc

SEQ ID NO: 698084 - DNA, 25 bp, Mus musculus
ggaaatagccgcctggttctctttt

SEQ ID NO: 698085 - DNA, 25 bp, Mus musculus
ggaaatagccgcgtggttctctttt

SEQ ID NO: 698086 - DNA, 25 bp, Mus musculus
ggaaatataagaaaacgtcccagag

SEQ ID NO: 698087 - DNA, 25 bp, Mus musculus
ggaaatataagataacgtcccagag

SEQ ID NO: 698088 - DNA, 25 bp, Mus musculus
ggaaatatccttcagatcaatgtga

SEQ ID NO: 698089 - DNA, 25 bp, Mus musculus
ggaaatatccttgagatcaatgtga

SEQ ID NO: 698090 - DNA, 25 bp, Mus musculus
ggaaatatgctgaacagggttcact

SEQ ID NO: 698091 - DNA, 25 bp, Mus musculus
ggaaatatgctgtacagggttcact

SEQ ID NO: 698092 - DNA, 25 bp, Mus musculus
ggaaatcaacaacaacccaaaatat

SEQ ID NO: 698093 - DNA, 25 bp, Mus musculus
ggaaatcaacaagaacccaaaatat

SEQ ID NO: 698094 - DNA, 25 bp, Mus musculus
ggaaatcaacacaaaccaggaagct

SEQ ID NO: 698095 - DNA, 25 bp, Mus musculus
ggaaatcaacactaaccaggaagct

SEQ ID NO: 698096 - DNA, 25 bp, Mus musculus
ggaaatcaacccagtccccagatca

SEQ ID NO: 698097 - DNA, 25 bp, Mus musculus
ggaaatcaaccctgtccccagatca

SEQ ID NO: 698098 - DNA, 25 bp, Mus musculus
ggaaatcaaggcagacatcaagttc

SEQ ID NO: 698099 - DNA, 25 bp, Mus musculus
ggaaatcaaggctgacatcaagttc

SEQ ID NO: 698100 - DNA, 25 bp, Mus musculus
ggaaatcaccaaatatctcgcaact

SEQ ID NO: 698101 - DNA, 25 bp, Mus musculus
ggaaatcaccaattatctcgcaact

SEQ ID NO: 698102 - DNA, 25 bp, Mus musculus
ggaaatcaccctcatcacctgtgca

SEQ ID NO: 698103 - DNA, 25 bp, Mus musculus
ggaaatcaccctgatcacctgtgca

SEQ ID NO: 698104 - DNA, 25 bp, Mus musculus
ggaaatcaccgcatagtctctgaag

SEQ ID NO: 698105 - DNA, 25 bp, Mus musculus
ggaaatcaccgcttagtctctgaag

SEQ ID NO: 698106 - DNA, 25 bp, Mus musculus
ggaaatcagtccactttgtaatcaa

SEQ ID NO: 698107 - DNA, 25 bp, Mus musculus
ggaaatcagtcctctttgtaatcaa

SEQ ID NO: 698108 - DNA, 25 bp, Mus musculus
ggaaatcagttgagatcaccacagg

SEQ ID NO: 698109 - DNA, 25 bp, Mus musculus
ggaaatcagttgtgatcaccacagg

SEQ ID NO: 698110 - DNA, 25 bp, Mus musculus
ggaaatcagtttaacaaacttactg

SEQ ID NO: 698111 - DNA, 25 bp, Mus musculus
ggaaatcagttttacaaacttactg

SEQ ID NO: 698112 - DNA, 25 bp, Mus musculus
ggaaatcattcaacgacccagtatc

SEQ ID NO: 698113 - DNA, 25 bp, Mus musculus
ggaaatcattcatcgacccagtatc

SEQ ID NO: 698114 - DNA, 25 bp, Mus musculus
ggaaatccacagagagcactgttgt

SEQ ID NO: 698115 - DNA, 25 bp, Mus musculus
ggaaatccacagtgagcactgttgt

SEQ ID NO: 698116 - DNA, 25 bp, Mus musculus
ggaaatcccactcatgctttgtaag

SEQ ID NO: 698117 - DNA, 25 bp, Mus musculus
ggaaatcccactgatgctttgtaag

SEQ ID NO: 698118 - DNA, 25 bp, Mus musculus
ggaaatcccgatcctccaggaaaca

SEQ ID NO: 698119 - DNA, 25 bp, Mus musculus
ggaaatcccgatgctccaggaaaca

SEQ ID NO: 698120 - DNA, 25 bp, Mus musculus
ggaaatcctcaaccaacatcttcgg

SEQ ID NO: 698121 - DNA, 25 bp, Mus musculus
ggaaatcctcaagcaacatcttcgg

SEQ ID NO: 698122 - DNA, 25 bp, Mus musculus
ggaaatcctcagcttcaagaacaaa

SEQ ID NO: 698123 - DNA, 25 bp, Mus musculus
ggaaatcctcaggttcaagaacaaa

SEQ ID NO: 698124 - DNA, 25 bp, Mus musculus
ggaaatcctgccacggactcctctg

SEQ ID NO: 698125 - DNA, 25 bp, Mus musculus
ggaaatcctgcctcggactcctctg

SEQ ID NO: 698126 - DNA, 25 bp, Mus musculus
ggaaatcgacatagaatcccaatgc

SEQ ID NO: 698127 - DNA, 25 bp, Mus musculus
ggaaatcgacattgaatcccaatgc

SEQ ID NO: 698128 - DNA, 25 bp, Mus musculus
ggaaatctacgacaagcataaaagc

SEQ ID NO: 698129 - DNA, 25 bp, Mus musculus
ggaaatctacgagaagcataaaagc

SEQ ID NO: 698130 - DNA, 25 bp, Mus musculus
ggaaatctgattaatttggcagccg

SEQ ID NO: 698131 - DNA, 25 bp, Mus musculus
ggaaatctgatttatttggcagccg

SEQ ID NO: 698132 - DNA, 25 bp, Mus musculus
ggaaatcttagcagccatcgcggca

SEQ ID NO: 698133 - DNA, 25 bp, Mus musculus
ggaaatcttagctgccatcgcggca

SEQ ID NO: 698134 - DNA, 25 bp, Mus musculus
ggaaatgaaattcaaccaggaaata

SEQ ID NO: 698135 - DNA, 25 bp, Mus musculus
ggaaatgaaattgaaccaggaaata

SEQ ID NO: 698136 - DNA, 25 bp, Mus musculus
ggaaatgaacgccttcaagcagaga

SEQ ID NO: 698137 - DNA, 25 bp, Mus musculus
ggaaatgaacgcgttcaagcagaga

SEQ ID NO: 698138 - DNA, 25 bp, Mus musculus
ggaaatgacccaaactgttttgtgg

SEQ ID NO: 698139 - DNA, 25 bp, Mus musculus
ggaaatgacccacggatatggctcc

SEQ ID NO: 698140 - DNA, 25 bp, Mus musculus
ggaaatgacccagggatatggctcc

SEQ ID NO: 698141 - DNA, 25 bp, Mus musculus
ggaaatgacccatactgttttgtgg

SEQ ID NO: 698142 - DNA, 25 bp, Mus musculus
ggaaatgagctaatccaagttcaag

SEQ ID NO: 698143 - DNA, 25 bp, Mus musculus
ggaaatgagctattccaagttcaag

SEQ ID NO: 698144 - DNA, 25 bp, Mus musculus
ggaaatgattgtacgagcaagacag

SEQ ID NO: 698145 - DNA, 25 bp, Mus musculus
ggaaatgattgttcgagcaagacag

SEQ ID NO: 698146 - DNA, 25 bp, Mus musculus
ggaaatgcaccaatcagctgctccc

SEQ ID NO: 698147 - DNA, 25 bp, Mus musculus
ggaaatgcaccattcagctgctccc

SEQ ID NO: 698148 - DNA, 25 bp, Mus musculus
ggaaatgccagtcccgaacaggtct

SEQ ID NO: 698149 - DNA, 25 bp, Mus musculus
ggaaatgccagtgccgaacaggtct

SEQ ID NO: 698150 - DNA, 25 bp, Mus musculus
ggaaatgcgtttcgctctccagtca

SEQ ID NO: 698151 - DNA, 25 bp, Mus musculus
ggaaatgcgtttggctctccagtca

SEQ ID NO: 698152 - DNA, 25 bp, Mus musculus
ggaaatgctcataaaatcatggaga

SEQ ID NO: 698153 - DNA, 25 bp, Mus musculus
ggaaatgctcattaaatcatggaga

SEQ ID NO: 698154 - DNA, 25 bp, Mus musculus
ggaaatgctgaaagttcttcttcta

SEQ ID NO: 698155 - DNA, 25 bp, Mus musculus
ggaaatgctgaatgttcttcttcta

SEQ ID NO: 698156 - DNA, 25 bp, Mus musculus
ggaaatgcttctcgattctactaca

SEQ ID NO: 698157 - DNA, 25 bp, Mus musculus
ggaaatgcttctggattctactaca

SEQ ID NO: 698158 - DNA, 25 bp, Mus musculus
ggaaatggcaccaatggacaagtct

SEQ ID NO: 698159 - DNA, 25 bp, Mus musculus
ggaaatggcacctatggacaagtct

SEQ ID NO: 698160 - DNA, 25 bp, Mus musculus
ggaaatggcctacactgacacagga

SEQ ID NO: 698161 - DNA, 25 bp, Mus musculus
ggaaatggcctagactgacacagga

SEQ ID NO: 698162 - DNA, 25 bp, Mus musculus
ggaaatgggcaaaattcacagagca

SEQ ID NO: 698163 - DNA, 25 bp, Mus musculus
ggaaatgggcaatattcacagagca

SEQ ID NO: 698164 - DNA, 25 bp, Mus musculus
ggaaatggttttctccaggacaaga

SEQ ID NO: 698165 - DNA, 25 bp, Mus musculus
ggaaatggttttgtccaggacaaga

SEQ ID NO: 698166 - DNA, 25 bp, Mus musculus
ggaaatgtaggaaccagactggcgt

SEQ ID NO: 698167 - DNA, 25 bp, Mus musculus
ggaaatgtaggatccagactggcgt

SEQ ID NO: 698168 - DNA, 25 bp, Mus musculus
ggaaatgtcttcattcattcaccac

SEQ ID NO: 698169 - DNA, 25 bp, Mus musculus
ggaaatgtcttctttcattcaccac

SEQ ID NO: 698170 - DNA, 25 bp, Mus musculus
ggaaatgttgcccaggacatcttca

SEQ ID NO: 698171 - DNA, 25 bp, Mus musculus
ggaaatgttgccgaggacatcttca

SEQ ID NO: 698172 - DNA, 25 bp, Mus musculus
ggaaattaaagtacttcagtccaca

SEQ ID NO: 698173 - DNA, 25 bp, Mus musculus
ggaaattaaagttcttcagtccaca

SEQ ID NO: 698174 - DNA, 25 bp, Mus musculus
ggaaattacagtacctgctccaaca

SEQ ID NO: 698175 - DNA, 25 bp, Mus musculus
ggaaattacagttcctgctccaaca

SEQ ID NO: 698176 - DNA, 25 bp, Mus musculus
ggaaattaccttcatgatgctctta

SEQ ID NO: 698177 - DNA, 25 bp, Mus musculus
ggaaattaccttccatttttatctg

SEQ ID NO: 698178 - DNA, 25 bp, Mus musculus
ggaaattaccttgatgatgctctta

SEQ ID NO: 698179 - DNA, 25 bp, Mus musculus
ggaaattaccttgcatttttatctg

SEQ ID NO: 698180 - DNA, 25 bp, Mus musculus
ggaaattatcgcattatgaaactct

SEQ ID NO: 698181 - DNA, 25 bp, Mus musculus
ggaaattatcgctttatgaaactct

SEQ ID NO: 698182 - DNA, 25 bp, Mus musculus
ggaaattcaacgatcaagagttagc

SEQ ID NO: 698183 - DNA, 25 bp, Mus musculus
ggaaattcaacgttcaagagttagc

SEQ ID NO: 698184 - DNA, 25 bp, Mus musculus
ggaaattcacaacgatcaacccggc

SEQ ID NO: 698185 - DNA, 25 bp, Mus musculus
ggaaattcacaaggatcaacccggc

SEQ ID NO: 698186 - DNA, 25 bp, Mus musculus
ggaaattccaagaccagccttgctc

SEQ ID NO: 698187 - DNA, 25 bp, Mus musculus
ggaaattccaagtccagccttgctc

SEQ ID NO: 698188 - DNA, 25 bp, Mus musculus
ggaaattctttacagcaaatgctgg

SEQ ID NO: 698189 - DNA, 25 bp, Mus musculus
ggaaattctttagagcaaatgctgg

SEQ ID NO: 698190 - DNA, 25 bp, Mus musculus
ggaaattggcaccaagaaaaaggtg

SEQ ID NO: 698191 - DNA, 25 bp, Mus musculus
ggaaattggcacgaagaaaaaggtg

SEQ ID NO: 698192 - DNA, 25 bp, Mus musculus
ggaaattgttccagatcccaggaag

SEQ ID NO: 698193 - DNA, 25 bp, Mus musculus
ggaaattgttcctgatcccaggaag

SEQ ID NO: 698194 - DNA, 25 bp, Mus musculus
ggaacaaaaagacaccagtttgact

SEQ ID NO: 698195 - DNA, 25 bp, Mus musculus
ggaacaaaaagagaccagtttgact

SEQ ID NO: 698196 - DNA, 25 bp, Mus musculus
ggaacaaaatccatgacgagcacct

SEQ ID NO: 698197 - DNA, 25 bp, Mus musculus
ggaacaaaatccttgacgagcacct

SEQ ID NO: 698198 - DNA, 25 bp, Mus musculus
ggaacaaacaggaagccatgggcag

SEQ ID NO: 698199 - DNA, 25 bp, Mus musculus
ggaacaaacaggtagccatgggcag

SEQ ID NO: 698200 - DNA, 25 bp, Mus musculus
ggaacaaaccggatgctgggcttag

SEQ ID NO: 698201 - DNA, 25 bp, Mus musculus
ggaacaaaccggttgctgggcttag

SEQ ID NO: 698202 - DNA, 25 bp, Mus musculus
ggaacaaaccgtctgataaggccac

SEQ ID NO: 698203 - DNA, 25 bp, Mus musculus
ggaacaaaccgtgtgataaggccac

SEQ ID NO: 698204 - DNA, 25 bp, Mus musculus
ggaacaaactgcacttcattgagac

SEQ ID NO: 698205 - DNA, 25 bp, Mus musculus
ggaacaaactgctcttcattgagac

SEQ ID NO: 698206 - DNA, 25 bp, Mus musculus
ggaacaaagaagacctcccactagg

SEQ ID NO: 698207 - DNA, 25 bp, Mus musculus
ggaacaaagaagtcctcccactagg

SEQ ID NO: 698208 - DNA, 25 bp, Mus musculus
ggaacaaagtcaatcagtgcacagt

SEQ ID NO: 698209 - DNA, 25 bp, Mus musculus
ggaacaaagtcattcagtgcacagt

SEQ ID NO: 698210 - DNA, 25 bp, Mus musculus
ggaacaaagtttccctattgatgaa

SEQ ID NO: 698211 - DNA, 25 bp, Mus musculus
ggaacaaagtttgcctattgatgaa

SEQ ID NO: 698212 - DNA, 25 bp, Mus musculus
ggaacaaatgccagtactgccgttt

SEQ ID NO: 698213 - DNA, 25 bp, Mus musculus
ggaacaaatgcctgtactgccgttt

SEQ ID NO: 698214 - DNA, 25 bp, Mus musculus
ggaacaacactgctttgcagtctgt

SEQ ID NO: 698215 - DNA, 25 bp, Mus musculus
ggaacaacactggtttgcagtctgt

SEQ ID NO: 698216 - DNA, 25 bp, Mus musculus
ggaacaacaggcctcggccgagctt

SEQ ID NO: 698217 - DNA, 25 bp, Mus musculus
ggaacaacaggcgtcggccgagctt

SEQ ID NO: 698218 - DNA, 25 bp, Mus musculus
ggaacaaccatacctgttgggatgt

SEQ ID NO: 698219 - DNA, 25 bp, Mus musculus
ggaacaaccatagctgttgggatgt

SEQ ID NO: 698220 - DNA, 25 bp, Mus musculus
ggaacaacgaccagaccatctcact

SEQ ID NO: 698221 - DNA, 25 bp, Mus musculus
ggaacaacgacctgaccatctcact

SEQ ID NO: 698222 - DNA, 25 bp, Mus musculus
ggaacaacggcgctttgctgccctc

SEQ ID NO: 698223 - DNA, 25 bp, Mus musculus
ggaacaacggcggtttgctgccctc

SEQ ID NO: 698224 - DNA, 25 bp, Mus musculus
ggaacaagaacccatctctactggg

SEQ ID NO: 698225 - DNA, 25 bp, Mus musculus
ggaacaagaaccgatctctactggg

SEQ ID NO: 698226 - DNA, 25 bp, Mus musculus
ggaacaagagtgaggagaactgctc

SEQ ID NO: 698227 - DNA, 25 bp, Mus musculus
ggaacaagagtgtggagaactgctc

SEQ ID NO: 698228 - DNA, 25 bp, Mus musculus
ggaacaagatcaccatcctccttag

SEQ ID NO: 698229 - DNA, 25 bp, Mus musculus
ggaacaagatcagcatcctccttag

SEQ ID NO: 698230 - DNA, 25 bp, Mus musculus
ggaacaagatccaaccaacctgtac

SEQ ID NO: 698231 - DNA, 25 bp, Mus musculus
ggaacaagatcctaccaacctgtac

SEQ ID NO: 698232 - DNA, 25 bp, Mus musculus
ggaacaagcaaaatcaccccaactg

SEQ ID NO: 698233 - DNA, 25 bp, Mus musculus
ggaacaagcaaattcaccccaactg

SEQ ID NO: 698234 - DNA, 25 bp, Mus musculus
ggaacaagctgtccgatctagacca

SEQ ID NO: 698235 - DNA, 25 bp, Mus musculus
ggaacaagctgtgcgatctagacca

SEQ ID NO: 698236 - DNA, 25 bp, Mus musculus
ggaacaaggcaacctgccaagacac

SEQ ID NO: 698237 - DNA, 25 bp, Mus musculus
ggaacaaggcaagctgccaagacac

SEQ ID NO: 698238 - DNA, 25 bp, Mus musculus
ggaacaagtctgacctaaagcagct

SEQ ID NO: 698239 - DNA, 25 bp, Mus musculus
ggaacaagtctgtcctaaagcagct

SEQ ID NO: 698240 - DNA, 25 bp, Mus musculus
ggaacaagtgcgcagcaggataatc

SEQ ID NO: 698241 - DNA, 25 bp, Mus musculus
ggaacaagtgcggagcaggataatc

SEQ ID NO: 698242 - DNA, 25 bp, Mus musculus
ggaacaatcgctcttgagccaggca

SEQ ID NO: 698243 - DNA, 25 bp, Mus musculus
ggaacaatcgctgttgagccaggca

SEQ ID NO: 698244 - DNA, 25 bp, Mus musculus
ggaacaatgcccaggctctctaaat

SEQ ID NO: 698245 - DNA, 25 bp, Mus musculus
ggaacaatgccctggctctctaaat

SEQ ID NO: 698246 - DNA, 25 bp, Mus musculus
ggaacaatgttgcaagccgttgaaa

SEQ ID NO: 698247 - DNA, 25 bp, Mus musculus
ggaacaatgttggaagccgttgaaa

SEQ ID NO: 698248 - DNA, 25 bp, Mus musculus
ggaacaattcccaggtgagcctgac

SEQ ID NO: 698249 - DNA, 25 bp, Mus musculus
ggaacaattccctggtgagcctgac

SEQ ID NO: 698250 - DNA, 25 bp, Mus musculus
ggaacaattggaattcatgatggag

SEQ ID NO: 698251 - DNA, 25 bp, Mus musculus
ggaacaattggatttcatgatggag

SEQ ID NO: 698252 - DNA, 25 bp, Mus musculus
ggaacacaagtacctgtgaattcgt

SEQ ID NO: 698253 - DNA, 25 bp, Mus musculus
ggaacacaagtagctgtgaattcgt

SEQ ID NO: 698254 - DNA, 25 bp, Mus musculus
ggaacacagcccagcatgtggcggt

SEQ ID NO: 698255 - DNA, 25 bp, Mus musculus
ggaacacagccctgcatgtggcggt

SEQ ID NO: 698256 - DNA, 25 bp, Mus musculus
ggaacacagccgacacacttggtgt

SEQ ID NO: 698257 - DNA, 25 bp, Mus musculus
ggaacacagccgtcacacttggtgt

SEQ ID NO: 698258 - DNA, 25 bp, Mus musculus
ggaacacagggacctccagaagtac

SEQ ID NO: 698259 - DNA, 25 bp, Mus musculus
ggaacacagggagctccagaagtac

SEQ ID NO: 698260 - DNA, 25 bp, Mus musculus
ggaacacatcaacaagactctaggt

SEQ ID NO: 698261 - DNA, 25 bp, Mus musculus
ggaacacatcaagaagactctaggt

SEQ ID NO: 698262 - DNA, 25 bp, Mus musculus
ggaacaccagagaccgcaatcaata

SEQ ID NO: 698263 - DNA, 25 bp, Mus musculus
ggaacaccagagtccgcaatcaata

SEQ ID NO: 698264 - DNA, 25 bp, Mus musculus
ggaacaccaggtcaaaacttacatc

SEQ ID NO: 698265 - DNA, 25 bp, Mus musculus
ggaacaccaggtgaaaacttacatc

SEQ ID NO: 698266 - DNA, 25 bp, Mus musculus
ggaacaccatacaacatgtcacccg

SEQ ID NO: 698267 - DNA, 25 bp, Mus musculus
ggaacaccatactacatgtcacccg

SEQ ID NO: 698268 - DNA, 25 bp, Mus musculus
ggaacacccgtaagcagctcacgga

SEQ ID NO: 698269 - DNA, 25 bp, Mus musculus
ggaacacccgtatgcagctcacgga

SEQ ID NO: 698270 - DNA, 25 bp, Mus musculus
ggaacaccctatagttacggcccag

SEQ ID NO: 698271 - DNA, 25 bp, Mus musculus
ggaacaccctattgttacggcccag

SEQ ID NO: 698272 - DNA, 25 bp, Mus musculus
ggaacaccctgtatcacctttatag

SEQ ID NO: 698273 - DNA, 25 bp, Mus musculus
ggaacaccctgtttcacctttatag

SEQ ID NO: 698274 - DNA, 25 bp, Mus musculus
ggaacaccctttcctgagtggtctg

SEQ ID NO: 698275 - DNA, 25 bp, Mus musculus
ggaacaccctttgctgagtggtctg

SEQ ID NO: 698276 - DNA, 25 bp, Mus musculus
ggaacaccttgtcctgaattcatga

SEQ ID NO: 698277 - DNA, 25 bp, Mus musculus
ggaacaccttgtgctgaattcatga

SEQ ID NO: 698278 - DNA, 25 bp, Mus musculus
ggaacacggcccattttgtgggaag

SEQ ID NO: 698279 - DNA, 25 bp, Mus musculus
ggaacacggccctttttgtgggaag

SEQ ID NO: 698280 - DNA, 25 bp, Mus musculus
ggaacacggtatactcatcttctgg

SEQ ID NO: 698281 - DNA, 25 bp, Mus musculus
ggaacacggtattctcatcttctgg

SEQ ID NO: 698282 - DNA, 25 bp, Mus musculus
ggaacactctccagctttagactcg

SEQ ID NO: 698283 - DNA, 25 bp, Mus musculus
ggaacactctcctgctttagactcg

SEQ ID NO: 698284 - DNA, 25 bp, Mus musculus
ggaacacttcccaaagccatgctca

SEQ ID NO: 698285 - DNA, 25 bp, Mus musculus
ggaacacttccctaagccatgctca

SEQ ID NO: 698286 - DNA, 25 bp, Mus musculus
ggaacagatgaaatgatgagtctga

SEQ ID NO: 698287 - DNA, 25 bp, Mus musculus
ggaacagatgaattgatgagtctga

SEQ ID NO: 698288 - DNA, 25 bp, Mus musculus
ggaacagatggaagtgatacaccgc

SEQ ID NO: 698289 - DNA, 25 bp, Mus musculus
ggaacagatggatgtgatacaccgc

SEQ ID NO: 698290 - DNA, 25 bp, Mus musculus
ggaacagcaccactaaatcttaata

SEQ ID NO: 698291 - DNA, 25 bp, Mus musculus
ggaacagcaccagtaaatcttaata

SEQ ID NO: 698292 - DNA, 25 bp, Mus musculus
ggaacagcacttattgaacacttag

SEQ ID NO: 698293 - DNA, 25 bp, Mus musculus
ggaacagcactttttgaacacttag

SEQ ID NO: 698294 - DNA, 25 bp, Mus musculus
ggaacagcatgccaagtggtaccca

SEQ ID NO: 698295 - DNA, 25 bp, Mus musculus
ggaacagcatgcgaagtggtaccca

SEQ ID NO: 698296 - DNA, 25 bp, Mus musculus
ggaacagcattcacacagcatcacc

SEQ ID NO: 698297 - DNA, 25 bp, Mus musculus
ggaacagcattctcacagcatcacc

SEQ ID NO: 698298 - DNA, 25 bp, Mus musculus
ggaacagctacaagcgctcggcggc

SEQ ID NO: 698299 - DNA, 25 bp, Mus musculus
ggaacagctacatgcgctcggcggc

SEQ ID NO: 698300 - DNA, 25 bp, Mus musculus
ggaacagctctgagtgtgacgaaag

SEQ ID NO: 698301 - DNA, 25 bp, Mus musculus
ggaacagctctgtgtgtgacgaaag

SEQ ID NO: 698302 - DNA, 25 bp, Mus musculus
ggaacagcttgtagtgggcacttct

SEQ ID NO: 698303 - DNA, 25 bp, Mus musculus
ggaacagcttgttgtgggcacttct

SEQ ID NO: 698304 - DNA, 25 bp, Mus musculus
ggaacaggactcagctacccaatac

SEQ ID NO: 698305 - DNA, 25 bp, Mus musculus
ggaacaggactctgctacccaatac

SEQ ID NO: 698306 - DNA, 25 bp, Mus musculus
ggaacaggatatcatggcgtcctct

SEQ ID NO: 698307 - DNA, 25 bp, Mus musculus
ggaacaggatatgatggcgtcctct

SEQ ID NO: 698308 - DNA, 25 bp, Mus musculus
ggaacaggatgactttgccaatatc

SEQ ID NO: 698309 - DNA, 25 bp, Mus musculus
ggaacaggatgagtttgccaatatc

SEQ ID NO: 698310 - DNA, 25 bp, Mus musculus
ggaacaggatgcagatctaatcgtg

SEQ ID NO: 698311 - DNA, 25 bp, Mus musculus
ggaacaggatgctgatctaatcgtg

SEQ ID NO: 698312 - DNA, 25 bp, Mus musculus
ggaacaggccatcaagatggtagtc

SEQ ID NO: 698313 - DNA, 25 bp, Mus musculus
ggaacaggccatgaagatggtagtc

SEQ ID NO: 698314 - DNA, 25 bp, Mus musculus
ggaacaggcgctcagaccaggctac

SEQ ID NO: 698315 - DNA, 25 bp, Mus musculus
ggaacaggcgctgagaccaggctac

SEQ ID NO: 698316 - DNA, 25 bp, Mus musculus
ggaacagggtcaccatcatgggcat

SEQ ID NO: 698317 - DNA, 25 bp, Mus musculus
ggaacagggtcagcatcatgggcat

SEQ ID NO: 698318 - DNA, 25 bp, Mus musculus
ggaacaggtaagaagcctctccaca

SEQ ID NO: 698319 - DNA, 25 bp, Mus musculus
ggaacaggtaagtagcctctccaca

SEQ ID NO: 698320 - DNA, 25 bp, Mus musculus
ggaacaggtcccagagcaggtctct

SEQ ID NO: 698321 - DNA, 25 bp, Mus musculus
ggaacaggtccctgagcaggtctct

SEQ ID NO: 698322 - DNA, 25 bp, Mus musculus
ggaacaggtctcacactgcctgaga

SEQ ID NO: 698323 - DNA, 25 bp, Mus musculus
ggaacaggtctctcactgcctgaga

SEQ ID NO: 698324 - DNA, 25 bp, Mus musculus
ggaacagtataacaaggagctagaa

SEQ ID NO: 698325 - DNA, 25 bp, Mus musculus
ggaacagtataagaaggagctagaa

SEQ ID NO: 698326 - DNA, 25 bp, Mus musculus
ggaacagtccaaacgggaacctcat

SEQ ID NO: 698327 - DNA, 25 bp, Mus musculus
ggaacagtccaaattctatcttcaa

SEQ ID NO: 698328 - DNA, 25 bp, Mus musculus
ggaacagtccaatcgggaacctcat

SEQ ID NO: 698329 - DNA, 25 bp, Mus musculus
ggaacagtccaatttctatcttcaa

SEQ ID NO: 698330 - DNA, 25 bp, Mus musculus
ggaacagtccatcgccttctcaggc

SEQ ID NO: 698331 - DNA, 25 bp, Mus musculus
ggaacagtccatggccttctcaggc

SEQ ID NO: 698332 - DNA, 25 bp, Mus musculus
ggaacagtccctcaccttgggacct

SEQ ID NO: 698333 - DNA, 25 bp, Mus musculus
ggaacagtccctgaccttgggacct

SEQ ID NO: 698334 - DNA, 25 bp, Mus musculus
ggaacagtctataacacatttggtc

SEQ ID NO: 698335 - DNA, 25 bp, Mus musculus
ggaacagtctattacacatttggtc

SEQ ID NO: 698336 - DNA, 25 bp, Mus musculus
ggaacagtctggaaactctgttgtg

SEQ ID NO: 698337 - DNA, 25 bp, Mus musculus
ggaacagtctggtaactctgttgtg

SEQ ID NO: 698338 - DNA, 25 bp, Mus musculus
ggaacagtctgtcaccgaaagtggg

SEQ ID NO: 698339 - DNA, 25 bp, Mus musculus
ggaacagtctgtgaccgaaagtggg

SEQ ID NO: 698340 - DNA, 25 bp, Mus musculus
ggaacagtgaagaccatggtccggg

SEQ ID NO: 698341 - DNA, 25 bp, Mus musculus
ggaacagtgaagtccatggtccggg

SEQ ID NO: 698342 - DNA, 25 bp, Mus musculus
ggaacagtgaccacatatgggccca

SEQ ID NO: 698343 - DNA, 25 bp, Mus musculus
ggaacagtgacctcatatgggccca

SEQ ID NO: 698344 - DNA, 25 bp, Mus musculus
ggaacagtgcttctatcagatctac

SEQ ID NO: 698345 - DNA, 25 bp, Mus musculus
ggaacagtgcttgtatcagatctac

SEQ ID NO: 698346 - DNA, 25 bp, Mus musculus
ggaacatacaaaatccatgtggtaa

SEQ ID NO: 698347 - DNA, 25 bp, Mus musculus
ggaacatacaaattccatgtggtaa

SEQ ID NO: 698348 - DNA, 25 bp, Mus musculus
ggaacatactatcgcccaccaggtc

SEQ ID NO: 698349 - DNA, 25 bp, Mus musculus
ggaacatactatggcccaccaggtc

SEQ ID NO: 698350 - DNA, 25 bp, Mus musculus
ggaacatatactcctccgcccagat

SEQ ID NO: 698351 - DNA, 25 bp, Mus musculus
ggaacatatactgctccgcccagat

SEQ ID NO: 698352 - DNA, 25 bp, Mus musculus
ggaacatatttgaccagcgtgccgt

SEQ ID NO: 698353 - DNA, 25 bp, Mus musculus
ggaacatatttgtccagcgtgccgt

SEQ ID NO: 698354 - DNA, 25 bp, Mus musculus
ggaacatcattaagaagaagggatg

SEQ ID NO: 698355 - DNA, 25 bp, Mus musculus
ggaacatcattatgaagaagggatg

SEQ ID NO: 698356 - DNA, 25 bp, Mus musculus
ggaacatcctgtcactgaaatgatc

SEQ ID NO: 698357 - DNA, 25 bp, Mus musculus
ggaacatcctgtgactgaaatgatc

SEQ ID NO: 698358 - DNA, 25 bp, Mus musculus
ggaacatcctttactattgactgca

SEQ ID NO: 698359 - DNA, 25 bp, Mus musculus
ggaacatccttttctattgactgca

SEQ ID NO: 698360 - DNA, 25 bp, Mus musculus
ggaacatcgctcacgggacaagcag

SEQ ID NO: 698361 - DNA, 25 bp, Mus musculus
ggaacatcgctctcgggacaagcag

SEQ ID NO: 698362 - DNA, 25 bp, Mus musculus
ggaacatgaactccctagctccttg

SEQ ID NO: 698363 - DNA, 25 bp, Mus musculus
ggaacatgaactgcctagctccttg

SEQ ID NO: 698364 - DNA, 25 bp, Mus musculus
ggaacatgccccaggccgcatactg

SEQ ID NO: 698365 - DNA, 25 bp, Mus musculus
ggaacatgcccctggccgcatactg

SEQ ID NO: 698366 - DNA, 25 bp, Mus musculus
ggaacatgccttcaacattgcaaaa

SEQ ID NO: 698367 - DNA, 25 bp, Mus musculus
ggaacatgccttgaacattgcaaaa

SEQ ID NO: 698368 - DNA, 25 bp, Mus musculus
ggaacatggaagctactaacgccta

SEQ ID NO: 698369 - DNA, 25 bp, Mus musculus
ggaacatggaaggtactaacgccta

SEQ ID NO: 698370 - DNA, 25 bp, Mus musculus
ggaacatggccgctgcctgatagaa

SEQ ID NO: 698371 - DNA, 25 bp, Mus musculus
ggaacatggccggtgcctgatagaa

SEQ ID NO: 698372 - DNA, 25 bp, Mus musculus
ggaacatggtttcctgttacttatc

SEQ ID NO: 698373 - DNA, 25 bp, Mus musculus
ggaacatggtttgctgttacttatc

SEQ ID NO: 698374 - DNA, 25 bp, Mus musculus
ggaacattatgaaaacgccattgag

SEQ ID NO: 698375 - DNA, 25 bp, Mus musculus
ggaacattatgataacgccattgag

SEQ ID NO: 698376 - DNA, 25 bp, Mus musculus
ggaacattctacagcgcctgcaact

SEQ ID NO: 698377 - DNA, 25 bp, Mus musculus
ggaacattctactgcgcctgcaact

SEQ ID NO: 698378 - DNA, 25 bp, Mus musculus
ggaacattgctgcacttatccggca

SEQ ID NO: 698379 - DNA, 25 bp, Mus musculus
ggaacattgctggacttatccggca

SEQ ID NO: 698380 - DNA, 25 bp, Mus musculus
ggaacatttaatcaccagaacggta

SEQ ID NO: 698381 - DNA, 25 bp, Mus musculus
ggaacatttaatgaccagaacggta

SEQ ID NO: 698382 - DNA, 25 bp, Mus musculus
ggaacatttgctatctccgagggca

SEQ ID NO: 698383 - DNA, 25 bp, Mus musculus
ggaacatttgctttctccgagggca

SEQ ID NO: 698384 - DNA, 25 bp, Mus musculus
ggaaccaaacctcaggcctctgtgg

SEQ ID NO: 698385 - DNA, 25 bp, Mus musculus
ggaaccaaacctgaggcctctgtgg

SEQ ID NO: 698386 - DNA, 25 bp, Mus musculus
ggaaccaaccgcacatagaactgtt

SEQ ID NO: 698387 - DNA, 25 bp, Mus musculus
ggaaccaaccgctcatagaactgtt

SEQ ID NO: 698388 - DNA, 25 bp, Mus musculus
ggaaccaacttcatcactggcgagg

SEQ ID NO: 698389 - DNA, 25 bp, Mus musculus
ggaaccaacttcttcactggcgagg

SEQ ID NO: 698390 - DNA, 25 bp, Mus musculus
ggaaccacaaagaagtcacacatgg

SEQ ID NO: 698391 - DNA, 25 bp, Mus musculus
ggaaccacaaagtagtcacacatgg

SEQ ID NO: 698392 - DNA, 25 bp, Mus musculus
ggaaccacattcactagtatcagat

SEQ ID NO: 698393 - DNA, 25 bp, Mus musculus
ggaaccacattctctagtatcagat

SEQ ID NO: 698394 - DNA, 25 bp, Mus musculus
ggaaccaccaagatcattgcgcctt

SEQ ID NO: 698395 - DNA, 25 bp, Mus musculus
ggaaccaccaagttcattgcgcctt

SEQ ID NO: 698396 - DNA, 25 bp, Mus musculus
ggaaccaggaccactaccagtctct

SEQ ID NO: 698397 - DNA, 25 bp, Mus musculus
ggaaccaggacctctaccagtctct

SEQ ID NO: 698398 - DNA, 25 bp, Mus musculus
ggaaccaggagcaagaacgacagct

SEQ ID NO: 698399 - DNA, 25 bp, Mus musculus
ggaaccaggagctagaacgacagct

SEQ ID NO: 698400 - DNA, 25 bp, Mus musculus
ggaaccaggccaaggcagatgcctt

SEQ ID NO: 698401 - DNA, 25 bp, Mus musculus
ggaaccaggccatggcagatgcctt

SEQ ID NO: 698402 - DNA, 25 bp, Mus musculus
ggaaccagtctgagaggctacctct

SEQ ID NO: 698403 - DNA, 25 bp, Mus musculus
ggaaccagtctgtgaggctacctct

SEQ ID NO: 698404 - DNA, 25 bp, Mus musculus
ggaaccagtgaaccctgtcatgtca

SEQ ID NO: 698405 - DNA, 25 bp, Mus musculus
ggaaccagtgaagcctgtcatgtca

SEQ ID NO: 698406 - DNA, 25 bp, Mus musculus
ggaaccagtgtccttactgcaggct

SEQ ID NO: 698407 - DNA, 25 bp, Mus musculus
ggaaccagtgtcgttactgcaggct

SEQ ID NO: 698408 - DNA, 25 bp, Mus musculus
ggaaccagttgccacgggtcccgat

SEQ ID NO: 698409 - DNA, 25 bp, Mus musculus
ggaaccagttgcgacgggtcccgat

SEQ ID NO: 698410 - DNA, 25 bp, Mus musculus
ggaaccataatgataagcttatcaa

SEQ ID NO: 698411 - DNA, 25 bp, Mus musculus
ggaaccataatgttaagcttatcaa

SEQ ID NO: 698412 - DNA, 25 bp, Mus musculus
ggaaccatccgcagtccgcgggcga

SEQ ID NO: 698413 - DNA, 25 bp, Mus musculus
ggaaccatccgctgtccgcgggcga

SEQ ID NO: 698414 - DNA, 25 bp, Mus musculus
ggaaccatctgtcgatcagggcccc

SEQ ID NO: 698415 - DNA, 25 bp, Mus musculus
ggaaccatctgtggatcagggcccc

SEQ ID NO: 698416 - DNA, 25 bp, Mus musculus
ggaaccatgatcctgaccaatttga

SEQ ID NO: 698417 - DNA, 25 bp, Mus musculus
ggaaccatgatcgtgaccaatttga

SEQ ID NO: 698418 - DNA, 25 bp, Mus musculus
ggaaccatggaaaacatccctacag

SEQ ID NO: 698419 - DNA, 25 bp, Mus musculus
ggaaccatggaatacatccctacag

SEQ ID NO: 698420 - DNA, 25 bp, Mus musculus
ggaaccatgggaagcaatgctctga

SEQ ID NO: 698421 - DNA, 25 bp, Mus musculus
ggaaccatgggatgcaatgctctga

SEQ ID NO: 698422 - DNA, 25 bp, Mus musculus
ggaacccaaatactgctgtcttcct

SEQ ID NO: 698423 - DNA, 25 bp, Mus musculus
ggaacccaaatagtgctgtcttcct

SEQ ID NO: 698424 - DNA, 25 bp, Mus musculus
ggaacccacacaagaggaggacctc

SEQ ID NO: 698425 - DNA, 25 bp, Mus musculus
ggaacccacacatgaggaggacctc

SEQ ID NO: 698426 - DNA, 25 bp, Mus musculus
ggaacccagctgaggatcgcctgtg

SEQ ID NO: 698427 - DNA, 25 bp, Mus musculus
ggaacccagctgtggatcgcctgtg

SEQ ID NO: 698428 - DNA, 25 bp, Mus musculus
ggaacccagtaccaatctaagtgtg

SEQ ID NO: 698429 - DNA, 25 bp, Mus musculus
ggaacccagtacgaatctaagtgtg

SEQ ID NO: 698430 - DNA, 25 bp, Mus musculus
ggaacccagtatccaggacaaagat

SEQ ID NO: 698431 - DNA, 25 bp, Mus musculus
ggaacccagtatgcaggacaaagat

SEQ ID NO: 698432 - DNA, 25 bp, Mus musculus
ggaacccagtccctggggccactga

SEQ ID NO: 698433 - DNA, 25 bp, Mus musculus
ggaacccagtccgtggggccactga

SEQ ID NO: 698434 - DNA, 25 bp, Mus musculus
ggaaccccaactcccttcaaaagag

SEQ ID NO: 698435 - DNA, 25 bp, Mus musculus
ggaaccccaactgccttcaaaagag

SEQ ID NO: 698436 - DNA, 25 bp, Mus musculus
ggaaccccagacatggtgcaatgga

SEQ ID NO: 698437 - DNA, 25 bp, Mus musculus
ggaaccccagacttggtgcaatgga

SEQ ID NO: 698438 - DNA, 25 bp, Mus musculus
ggaaccccagtcagtaagagaacct

SEQ ID NO: 698439 - DNA, 25 bp, Mus musculus
ggaaccccagtctgtaagagaacct

SEQ ID NO: 698440 - DNA, 25 bp, Mus musculus
ggaacccgaacccatcgctggcgat

SEQ ID NO: 698441 - DNA, 25 bp, Mus musculus
ggaacccgaaccgatcgctggcgat

SEQ ID NO: 698442 - DNA, 25 bp, Mus musculus
ggaacccggaaaccctggcattcct

SEQ ID NO: 698443 - DNA, 25 bp, Mus musculus
ggaacccggaaagcctggcattcct

SEQ ID NO: 698444 - DNA, 25 bp, Mus musculus
ggaacccgtgcacctgctagagcat

SEQ ID NO: 698445 - DNA, 25 bp, Mus musculus
ggaacccgtgcagctgctagagcat

SEQ ID NO: 698446 - DNA, 25 bp, Mus musculus
ggaaccctatctatgctgaggcgga

SEQ ID NO: 698447 - DNA, 25 bp, Mus musculus
ggaaccctatctttgctgaggcgga

SEQ ID NO: 698448 - DNA, 25 bp, Mus musculus
ggaaccctcctgactatcgagggca

SEQ ID NO: 698449 - DNA, 25 bp, Mus musculus
ggaaccctcctgtctatcgagggca

SEQ ID NO: 698450 - DNA, 25 bp, Mus musculus
ggaaccctcggaatctggagctctt

SEQ ID NO: 698451 - DNA, 25 bp, Mus musculus
ggaaccctcggattctggagctctt

SEQ ID NO: 698452 - DNA, 25 bp, Mus musculus
ggaaccctgctcatggaggtgtcaa

SEQ ID NO: 698453 - DNA, 25 bp, Mus musculus
ggaaccctgctcttggaggtgtcaa

SEQ ID NO: 698454 - DNA, 25 bp, Mus musculus
ggaaccctggatctctccttgaaca

SEQ ID NO: 698455 - DNA, 25 bp, Mus musculus
ggaaccctggatgtctccttgaaca

SEQ ID NO: 698456 - DNA, 25 bp, Mus musculus
ggaaccctgtcgcaagcaaattgat

SEQ ID NO: 698457 - DNA, 25 bp, Mus musculus
ggaaccctgtcggaagcaaattgat

SEQ ID NO: 698458 - DNA, 25 bp, Mus musculus
ggaaccctgttaagacatctaccgg

SEQ ID NO: 698459 - DNA, 25 bp, Mus musculus
ggaaccctgttatgacatctaccgg

SEQ ID NO: 698460 - DNA, 25 bp, Mus musculus
ggaaccgaacaaaaccagagtaaat

SEQ ID NO: 698461 - DNA, 25 bp, Mus musculus
ggaaccgaacaataccagagtaaat

SEQ ID NO: 698462 - DNA, 25 bp, Mus musculus
ggaaccgaagggagcgcttctctcc

SEQ ID NO: 698463 - DNA, 25 bp, Mus musculus
ggaaccgaagggtgcgcttctctcc

SEQ ID NO: 698464 - DNA, 25 bp, Mus musculus
ggaaccgagcctactcacagtacga

SEQ ID NO: 698465 - DNA, 25 bp, Mus musculus
ggaaccgagccttctcacagtacga

SEQ ID NO: 698466 - DNA, 25 bp, Mus musculus
ggaaccgcccaacatggcatcagag

SEQ ID NO: 698467 - DNA, 25 bp, Mus musculus
ggaaccgcccaagatggcatcagag

SEQ ID NO: 698468 - DNA, 25 bp, Mus musculus
ggaaccggatgtattttgttgctcc

SEQ ID NO: 698469 - DNA, 25 bp, Mus musculus
ggaaccggatgttttttgttgctcc

SEQ ID NO: 698470 - DNA, 25 bp, Mus musculus
ggaaccgggccaaagaaaccatgta

SEQ ID NO: 698471 - DNA, 25 bp, Mus musculus
ggaaccgggccatagaaaccatgta

SEQ ID NO: 698472 - DNA, 25 bp, Mus musculus
ggaaccggttccatgctgcacatag

SEQ ID NO: 698473 - DNA, 25 bp, Mus musculus
ggaaccggttccttgctgcacatag

SEQ ID NO: 698474 - DNA, 25 bp, Mus musculus
ggaaccgtggctcctgagctaacct

SEQ ID NO: 698475 - DNA, 25 bp, Mus musculus
ggaaccgtggctgctgagctaacct

SEQ ID NO: 698476 - DNA, 25 bp, Mus musculus
ggaacctagctcagattcatacaag

SEQ ID NO: 698477 - DNA, 25 bp, Mus musculus
ggaacctagctctgattcatacaag

SEQ ID NO: 698478 - DNA, 25 bp, Mus musculus
ggaacctcccaactatggcatcgtc

SEQ ID NO: 698479 - DNA, 25 bp, Mus musculus
ggaacctcccaagtatggcatcgtc

SEQ ID NO: 698480 - DNA, 25 bp, Mus musculus
ggaacctctgtcaccaacaccattg

SEQ ID NO: 698481 - DNA, 25 bp, Mus musculus
ggaacctctgtctccaacaccattg

SEQ ID NO: 698482 - DNA, 25 bp, Mus musculus
ggaacctgcctcatcttggtggcgt

SEQ ID NO: 698483 - DNA, 25 bp, Mus musculus
ggaacctgcctcttcttggtggcgt

SEQ ID NO: 698484 - DNA, 25 bp, Mus musculus
ggaacctggtacacctggagctgtg

SEQ ID NO: 698485 - DNA, 25 bp, Mus musculus
ggaacctggtactcctggagctgtg

SEQ ID NO: 698486 - DNA, 25 bp, Mus musculus
ggaacctggtcaccctctaagctag

SEQ ID NO: 698487 - DNA, 25 bp, Mus musculus
ggaacctggtcagcctctaagctag

SEQ ID NO: 698488 - DNA, 25 bp, Mus musculus
ggaacctgtaccaccaggcctggag

SEQ ID NO: 698489 - DNA, 25 bp, Mus musculus
ggaacctgtacctccaggcctggag

SEQ ID NO: 698490 - DNA, 25 bp, Mus musculus
ggaacctgtgatcagcacaatgcct

SEQ ID NO: 698491 - DNA, 25 bp, Mus musculus
ggaacctgtgatgagcacaatgcct

SEQ ID NO: 698492 - DNA, 25 bp, Mus musculus
ggaacctgtgctcagatgacacccc

SEQ ID NO: 698493 - DNA, 25 bp, Mus musculus
ggaacctgtgctgagatgacacccc

SEQ ID NO: 698494 - DNA, 25 bp, Mus musculus
ggaaccttcattctgattgacatcc

SEQ ID NO: 698495 - DNA, 25 bp, Mus musculus
ggaaccttcattgtgattgacatcc

SEQ ID NO: 698496 - DNA, 25 bp, Mus musculus
ggaaccttcgccagagggctcgaag

SEQ ID NO: 698497 - DNA, 25 bp, Mus musculus
ggaaccttcgcctgagggctcgaag

SEQ ID NO: 698498 - DNA, 25 bp, Mus musculus
ggaaccttgaccatatttctgcaat

SEQ ID NO: 698499 - DNA, 25 bp, Mus musculus
ggaaccttgaccttatttctgcaat

SEQ ID NO: 698500 - DNA, 25 bp, Mus musculus
ggaaccttggatacccatgctggta

SEQ ID NO: 698501 - DNA, 25 bp, Mus musculus
ggaaccttggattcccatgctggta

SEQ ID NO: 698502 - DNA, 25 bp, Mus musculus
ggaacctttcacacttgaggcctac

SEQ ID NO: 698503 - DNA, 25 bp, Mus musculus
ggaacctttcactcttgaggcctac

SEQ ID NO: 698504 - DNA, 25 bp, Mus musculus
ggaacctttccaagtgctccctttg

SEQ ID NO: 698505 - DNA, 25 bp, Mus musculus
ggaacctttccatgtgctccctttg

SEQ ID NO: 698506 - DNA, 25 bp, Mus musculus
ggaacctttgatcgcaatgatctca

SEQ ID NO: 698507 - DNA, 25 bp, Mus musculus
ggaacctttgatggcaatgatctca

SEQ ID NO: 698508 - DNA, 25 bp, Mus musculus
ggaacctttgtccagctgccatcag

SEQ ID NO: 698509 - DNA, 25 bp, Mus musculus
ggaacctttgtcgagctgccatcag

SEQ ID NO: 698510 - DNA, 25 bp, Mus musculus
ggaacgaactaacaatggagtcata

SEQ ID NO: 698511 - DNA, 25 bp, Mus musculus
ggaacgaactaagaatggagtcata

SEQ ID NO: 698512 - DNA, 25 bp, Mus musculus
ggaacgacattgctgccactgtcca

SEQ ID NO: 698513 - DNA, 25 bp, Mus musculus
ggaacgacattggtgccactgtcca

SEQ ID NO: 698514 - DNA, 25 bp, Mus musculus
ggaacgacgaccagagccttggaat

SEQ ID NO: 698515 - DNA, 25 bp, Mus musculus
ggaacgacgacctgagccttggaat

SEQ ID NO: 698516 - DNA, 25 bp, Mus musculus
ggaacgacgggcagacagagctgca

SEQ ID NO: 698517 - DNA, 25 bp, Mus musculus
ggaacgacgggctgacagagctgca

SEQ ID NO: 698518 - DNA, 25 bp, Mus musculus
ggaacgagctgcagatcgcctcctt

SEQ ID NO: 698519 - DNA, 25 bp, Mus musculus
ggaacgagctgctgatcgcctcctt

SEQ ID NO: 698520 - DNA, 25 bp, Mus musculus
ggaacgaggtacatgactgactcaa

SEQ ID NO: 698521 - DNA, 25 bp, Mus musculus
ggaacgaggtacttgactgactcaa

SEQ ID NO: 698522 - DNA, 25 bp, Mus musculus
ggaacgatactgaaagaacgggctc

SEQ ID NO: 698523 - DNA, 25 bp, Mus musculus
ggaacgatactgtaagaacgggctc

SEQ ID NO: 698524 - DNA, 25 bp, Mus musculus
ggaacgatgagcctctgatgcgcat

SEQ ID NO: 698525 - DNA, 25 bp, Mus musculus
ggaacgatgagcgtctgatgcgcat

SEQ ID NO: 698526 - DNA, 25 bp, Mus musculus
ggaacgatggccacagagtctacag

SEQ ID NO: 698527 - DNA, 25 bp, Mus musculus
ggaacgatggcctcagagtctacag

SEQ ID NO: 698528 - DNA, 25 bp, Mus musculus
ggaacgatgtctagcagtatgagac

SEQ ID NO: 698529 - DNA, 25 bp, Mus musculus
ggaacgatgtcttgcagtatgagac

SEQ ID NO: 698530 - DNA, 25 bp, Mus musculus
ggaacgcaccacaattgctcagcaa

SEQ ID NO: 698531 - DNA, 25 bp, Mus musculus
ggaacgcaccactattgctcagcaa

SEQ ID NO: 698532 - DNA, 25 bp, Mus musculus
ggaacgcaccggcaagctcacctgt

SEQ ID NO: 698533 - DNA, 25 bp, Mus musculus
ggaacgcaccgggaagctcacctgt

SEQ ID NO: 698534 - DNA, 25 bp, Mus musculus
ggaacgcagctaaggtcactgagga

SEQ ID NO: 698535 - DNA, 25 bp, Mus musculus
ggaacgcagctatggtcactgagga

SEQ ID NO: 698536 - DNA, 25 bp, Mus musculus
ggaacgccagtactcgcttctctga

SEQ ID NO: 698537 - DNA, 25 bp, Mus musculus
ggaacgccagtagtcgcttctctga

SEQ ID NO: 698538 - DNA, 25 bp, Mus musculus
ggaacgcccaggaacctttggctct

SEQ ID NO: 698539 - DNA, 25 bp, Mus musculus
ggaacgcccaggtacctttggctct

SEQ ID NO: 698540 - DNA, 25 bp, Mus musculus
ggaacgccgcacagtggtagacagt

SEQ ID NO: 698541 - DNA, 25 bp, Mus musculus
ggaacgccgcactgtggtagacagt

SEQ ID NO: 698542 - DNA, 25 bp, Mus musculus
ggaacgccggagaacctggcccctg

SEQ ID NO: 698543 - DNA, 25 bp, Mus musculus
ggaacgccggagtacctggcccctg

SEQ ID NO: 698544 - DNA, 25 bp, Mus musculus
ggaacgcctggcagtcgctcgcgca

SEQ ID NO: 698545 - DNA, 25 bp, Mus musculus
ggaacgcctggctgtcgctcgcgca

SEQ ID NO: 698546 - DNA, 25 bp, Mus musculus
ggaacgccttggaccttttcagaca

SEQ ID NO: 698547 - DNA, 25 bp, Mus musculus
ggaacgccttggtccttttcagaca

SEQ ID NO: 698548 - DNA, 25 bp, Mus musculus
ggaacgcgcagcagaacgaggttct

SEQ ID NO: 698549 - DNA, 25 bp, Mus musculus
ggaacgcgcagctgaacgaggttct

SEQ ID NO: 698550 - DNA, 25 bp, Mus musculus
ggaacgcgctctaggcacctccaag

SEQ ID NO: 698551 - DNA, 25 bp, Mus musculus
ggaacgcgctcttggcacctccaag

SEQ ID NO: 698552 - DNA, 25 bp, Mus musculus
ggaacgctgcgcctctgggatctca

SEQ ID NO: 698553 - DNA, 25 bp, Mus musculus
ggaacgctgcgcgtctgggatctca

SEQ ID NO: 698554 - DNA, 25 bp, Mus musculus
ggaacggaaagcatcctgatggcct

SEQ ID NO: 698555 - DNA, 25 bp, Mus musculus
ggaacggaaagcttcctgatggcct

SEQ ID NO: 698556 - DNA, 25 bp, Mus musculus
ggaacggaatgacgccaagaatgct

SEQ ID NO: 698557 - DNA, 25 bp, Mus musculus
ggaacggaatgaggccaagaatgct

SEQ ID NO: 698558 - DNA, 25 bp, Mus musculus
ggaacggaatgtagaggatgactac

SEQ ID NO: 698559 - DNA, 25 bp, Mus musculus
ggaacggaatgttgaggatgactac

SEQ ID NO: 698560 - DNA, 25 bp, Mus musculus
ggaacggaccctcacttcacataca

SEQ ID NO: 698561 - DNA, 25 bp, Mus musculus
ggaacggaccctgacttcacataca

SEQ ID NO: 698562 - DNA, 25 bp, Mus musculus
ggaacggagcaacatgctgctgtcc

SEQ ID NO: 698563 - DNA, 25 bp, Mus musculus
ggaacggagcaagatgctgctgtcc

SEQ ID NO: 698564 - DNA, 25 bp, Mus musculus
ggaacggatcatcaagcgagccgcc

SEQ ID NO: 698565 - DNA, 25 bp, Mus musculus
ggaacggatcatgaagcgagccgcc

SEQ ID NO: 698566 - DNA, 25 bp, Mus musculus
ggaacggcaataacctcagaaatac

SEQ ID NO: 698567 - DNA, 25 bp, Mus musculus
ggaacggcaatatcctcagaaatac

SEQ ID NO: 698568 - DNA, 25 bp, Mus musculus
ggaacggcagacctagactcacttg

SEQ ID NO: 698569 - DNA, 25 bp, Mus musculus
ggaacggcagacgtagactcacttg

SEQ ID NO: 698570 - DNA, 25 bp, Mus musculus
ggaacggcagctcttgtgcatagca

SEQ ID NO: 698571 - DNA, 25 bp, Mus musculus
ggaacggcagctgttgtgcatagca

SEQ ID NO: 698572 - DNA, 25 bp, Mus musculus
ggaacggccacactctactacttag

SEQ ID NO: 698573 - DNA, 25 bp, Mus musculus
ggaacggccacagtctactacttag

SEQ ID NO: 698574 - DNA, 25 bp, Mus musculus
ggaacggctcggaatttgctccagc

SEQ ID NO: 698575 - DNA, 25 bp, Mus musculus
ggaacggctcggtatttgctccagc

SEQ ID NO: 698576 - DNA, 25 bp, Mus musculus
ggaacgggagcaccgccttctgctc

SEQ ID NO: 698577 - DNA, 25 bp, Mus musculus
ggaacgggagcagcgccttctgctc

SEQ ID NO: 698578 - DNA, 25 bp, Mus musculus
ggaacgggcatgattaaggaactct

SEQ ID NO: 698579 - DNA, 25 bp, Mus musculus
ggaacgggcatgtttaaggaactct

SEQ ID NO: 698580 - DNA, 25 bp, Mus musculus
ggaacggttctgagctaacatcata

SEQ ID NO: 698581 - DNA, 25 bp, Mus musculus
ggaacggttctgtgctaacatcata

SEQ ID NO: 698582 - DNA, 25 bp, Mus musculus
ggaacgtaaattcaccaaggagcag

SEQ ID NO: 698583 - DNA, 25 bp, Mus musculus
ggaacgtaaattgaccaaggagcag

SEQ ID NO: 698584 - DNA, 25 bp, Mus musculus
ggaacgtagaggattactgctctgc

SEQ ID NO: 698585 - DNA, 25 bp, Mus musculus
ggaacgtagaggtttactgctctgc

SEQ ID NO: 698586 - DNA, 25 bp, Mus musculus
ggaacgtcaactaggcagtttaact

SEQ ID NO: 698587 - DNA, 25 bp, Mus musculus
ggaacgtcaacttggcagtttaact

SEQ ID NO: 698588 - DNA, 25 bp, Mus musculus
ggaacgtcagagaattacagatcat

SEQ ID NO: 698589 - DNA, 25 bp, Mus musculus
ggaacgtcagagtattacagatcat

SEQ ID NO: 698590 - DNA, 25 bp, Mus musculus
ggaacgtccttaacgctcagtgtca

SEQ ID NO: 698591 - DNA, 25 bp, Mus musculus
ggaacgtccttatcgctcagtgtca

SEQ ID NO: 698592 - DNA, 25 bp, Mus musculus
ggaacgtcgtggaccatgactggct

SEQ ID NO: 698593 - DNA, 25 bp, Mus musculus
ggaacgtcgtggtccatgactggct

SEQ ID NO: 698594 - DNA, 25 bp, Mus musculus
ggaacgtctgcacattgatgagcag

SEQ ID NO: 698595 - DNA, 25 bp, Mus musculus
ggaacgtctgcagattgatgagcag

SEQ ID NO: 698596 - DNA, 25 bp, Mus musculus
ggaacgtgcacacggacttcatccc

SEQ ID NO: 698597 - DNA, 25 bp, Mus musculus
ggaacgtgcacagggacttcatccc

SEQ ID NO: 698598 - DNA, 25 bp, Mus musculus
ggaacgtgccacagaaactgtcgcc

SEQ ID NO: 698599 - DNA, 25 bp, Mus musculus
ggaacgtgccactgaaactgtcgcc

SEQ ID NO: 698600 - DNA, 25 bp, Mus musculus
ggaacgtgccttacatctcaaacat

SEQ ID NO: 698601 - DNA, 25 bp, Mus musculus
ggaacgtgcctttcatctcaaacat

SEQ ID NO: 698602 - DNA, 25 bp, Mus musculus
ggaacgtgctcactctcgctcaaaa

SEQ ID NO: 698603 - DNA, 25 bp, Mus musculus
ggaacgtgctcagtctcgctcaaaa

SEQ ID NO: 698604 - DNA, 25 bp, Mus musculus
ggaacgtttaacagggcaaagctgc

SEQ ID NO: 698605 - DNA, 25 bp, Mus musculus
ggaacgtttaactgggcaaagctgc

SEQ ID NO: 698606 - DNA, 25 bp, Mus musculus
ggaactaaggtcagatccctggaaa

SEQ ID NO: 698607 - DNA, 25 bp, Mus musculus
ggaactaaggtctgatccctggaaa

SEQ ID NO: 698608 - DNA, 25 bp, Mus musculus
ggaactaagtgaagcatctagttgt

SEQ ID NO: 698609 - DNA, 25 bp, Mus musculus
ggaactaagtgatgcatctagttgt

SEQ ID NO: 698610 - DNA, 25 bp, Mus musculus
ggaactacacctatgccagcactga

SEQ ID NO: 698611 - DNA, 25 bp, Mus musculus
ggaactacacctttgccagcactga

SEQ ID NO: 698612 - DNA, 25 bp, Mus musculus
ggaactacgcaaacgggtgcgccat

SEQ ID NO: 698613 - DNA, 25 bp, Mus musculus
ggaactacgcaatcgggtgcgccat

SEQ ID NO: 698614 - DNA, 25 bp, Mus musculus
ggaactagattcagttcgtgaaatc

SEQ ID NO: 698615 - DNA, 25 bp, Mus musculus
ggaactagattctgttcgtgaaatc

SEQ ID NO: 698616 - DNA, 25 bp, Mus musculus
ggaactagctgaagaacttctgagg

SEQ ID NO: 698617 - DNA, 25 bp, Mus musculus
ggaactagctgatgaacttctgagg

SEQ ID NO: 698618 - DNA, 25 bp, Mus musculus
ggaactataccaagaaaccctgagc

SEQ ID NO: 698619 - DNA, 25 bp, Mus musculus
ggaactataccatgaaaccctgagc

SEQ ID NO: 698620 - DNA, 25 bp, Mus musculus
ggaactatacctcgcccacaaggat

SEQ ID NO: 698621 - DNA, 25 bp, Mus musculus
ggaactatacctggcccacaaggat

SEQ ID NO: 698622 - DNA, 25 bp, Mus musculus
ggaactatgaggagaaactccggct

SEQ ID NO: 698623 - DNA, 25 bp, Mus musculus
ggaactatgaggtgaaactccggct

SEQ ID NO: 698624 - DNA, 25 bp, Mus musculus
ggaactatgatgcttttcgaggcca

SEQ ID NO: 698625 - DNA, 25 bp, Mus musculus
ggaactatgatggttttcgaggcca

SEQ ID NO: 698626 - DNA, 25 bp, Mus musculus
ggaactatggaacctacagaagcct

SEQ ID NO: 698627 - DNA, 25 bp, Mus musculus
ggaactatggaagctacagaagcct

SEQ ID NO: 698628 - DNA, 25 bp, Mus musculus
ggaactatgggacatcattcaggaa

SEQ ID NO: 698629 - DNA, 25 bp, Mus musculus
ggaactatgggagatcattcaggaa

SEQ ID NO: 698630 - DNA, 25 bp, Mus musculus
ggaactcaagccctttagtggagaa

SEQ ID NO: 698631 - DNA, 25 bp, Mus musculus
ggaactcaagccgtttagtggagaa

SEQ ID NO: 698632 - DNA, 25 bp, Mus musculus
ggaactcaccacctagcagcagtct

SEQ ID NO: 698633 - DNA, 25 bp, Mus musculus
ggaactcaccacgtagcagcagtct

SEQ ID NO: 698634 - DNA, 25 bp, Mus musculus
ggaactcaccagcttaatgcttaca

SEQ ID NO: 698635 - DNA, 25 bp, Mus musculus
ggaactcaccaggttaatgcttaca

SEQ ID NO: 698636 - DNA, 25 bp, Mus musculus
ggaactcacggcagaccaacagacc

SEQ ID NO: 698637 - DNA, 25 bp, Mus musculus
ggaactcacggctgaccaacagacc

SEQ ID NO: 698638 - DNA, 25 bp, Mus musculus
ggaactcactcgacagaagaagaca

SEQ ID NO: 698639 - DNA, 25 bp, Mus musculus
ggaactcactcgtcagaagaagaca

SEQ ID NO: 698640 - DNA, 25 bp, Mus musculus
ggaactcagcacatatttgaggatg

SEQ ID NO: 698641 - DNA, 25 bp, Mus musculus
ggaactcagcacttatttgaggatg

SEQ ID NO: 698642 - DNA, 25 bp, Mus musculus
ggaactcagtgtatcagatcgccat

SEQ ID NO: 698643 - DNA, 25 bp, Mus musculus
ggaactcagtgtttcagatcgccat

SEQ ID NO: 698644 - DNA, 25 bp, Mus musculus
ggaactcagtttactttcgacagct

SEQ ID NO: 698645 - DNA, 25 bp, Mus musculus
ggaactcagttttctttcgacagct

SEQ ID NO: 698646 - DNA, 25 bp, Mus musculus
ggaactcatagccttgctgctggag

SEQ ID NO: 698647 - DNA, 25 bp, Mus musculus
ggaactcatagcgttgctgctggag

SEQ ID NO: 698648 - DNA, 25 bp, Mus musculus
ggaactcattctatgtcatgacaaa

SEQ ID NO: 698649 - DNA, 25 bp, Mus musculus
ggaactcattctttgtcatgacaaa

SEQ ID NO: 698650 - DNA, 25 bp, Mus musculus
ggaactccaactcgactggcagaag

SEQ ID NO: 698651 - DNA, 25 bp, Mus musculus
ggaactccaactggactggcagaag

SEQ ID NO: 698652 - DNA, 25 bp, Mus musculus
ggaactccactcactgaggcactgt

SEQ ID NO: 698653 - DNA, 25 bp, Mus musculus
ggaactccactctctgaggcactgt

SEQ ID NO: 698654 - DNA, 25 bp, Mus musculus
ggaactccagaacggccatattgtg

SEQ ID NO: 698655 - DNA, 25 bp, Mus musculus
ggaactccagaagggccatattgtg

SEQ ID NO: 698656 - DNA, 25 bp, Mus musculus
ggaactccagagataaaagagaagg

SEQ ID NO: 698657 - DNA, 25 bp, Mus musculus
ggaactccagagttaaaagagaagg

SEQ ID NO: 698658 - DNA, 25 bp, Mus musculus
ggaactccccatcgacggtcagctt

SEQ ID NO: 698659 - DNA, 25 bp, Mus musculus
ggaactccccatggacggtcagctt

SEQ ID NO: 698660 - DNA, 25 bp, Mus musculus
ggaactccggtcactcattgcttac

SEQ ID NO: 698661 - DNA, 25 bp, Mus musculus
ggaactccggtctctcattgcttac

SEQ ID NO: 698662 - DNA, 25 bp, Mus musculus
ggaactccgtatcatcaaagaaaac

SEQ ID NO: 698663 - DNA, 25 bp, Mus musculus
ggaactccgtatgatcaaagaaaac

SEQ ID NO: 698664 - DNA, 25 bp, Mus musculus
ggaactcctcttcgatgtcttgtca

SEQ ID NO: 698665 - DNA, 25 bp, Mus musculus
ggaactcctcttggatgtcttgtca

SEQ ID NO: 698666 - DNA, 25 bp, Mus musculus
ggaactcctgaaacagaggaacaag

SEQ ID NO: 698667 - DNA, 25 bp, Mus musculus
ggaactcctgaatcagaggaacaag

SEQ ID NO: 698668 - DNA, 25 bp, Mus musculus
ggaactcgagtgagtttcagtgccc

SEQ ID NO: 698669 - DNA, 25 bp, Mus musculus
ggaactcgagtgtgtttcagtgccc

SEQ ID NO: 698670 - DNA, 25 bp, Mus musculus
ggaactcggcctagatttctgccgt

SEQ ID NO: 698671 - DNA, 25 bp, Mus musculus
ggaactcggccttgatttctgccgt

SEQ ID NO: 698672 - DNA, 25 bp, Mus musculus
ggaactctcaacattggtgggatca

SEQ ID NO: 698673 - DNA, 25 bp, Mus musculus
ggaactctcaactttggtgggatca

SEQ ID NO: 698674 - DNA, 25 bp, Mus musculus
ggaactctgggaatcatacttgaag

SEQ ID NO: 698675 - DNA, 25 bp, Mus musculus
ggaactctgggattcatacttgaag

SEQ ID NO: 698676 - DNA, 25 bp, Mus musculus
ggaactcttaaacaagttccagcag

SEQ ID NO: 698677 - DNA, 25 bp, Mus musculus
ggaactcttaaagaagttccagcag

SEQ ID NO: 698678 - DNA, 25 bp, Mus musculus
ggaactgaagatccattgaccagaa

SEQ ID NO: 698679 - DNA, 25 bp, Mus musculus
ggaactgaagatgcattgaccagaa

SEQ ID NO: 698680 - DNA, 25 bp, Mus musculus
ggaactgaagcgagtggcctcacag

SEQ ID NO: 698681 - DNA, 25 bp, Mus musculus
ggaactgaagcgtgtggcctcacag

SEQ ID NO: 698682 - DNA, 25 bp, Mus musculus
ggaactgacaccagagcaggcacct

SEQ ID NO: 698683 - DNA, 25 bp, Mus musculus
ggaactgacacctgagcaggcacct

SEQ ID NO: 698684 - DNA, 25 bp, Mus musculus
ggaactgacagtcgtacttggtcaa

SEQ ID NO: 698685 - DNA, 25 bp, Mus musculus
ggaactgacagtggtacttggtcaa

SEQ ID NO: 698686 - DNA, 25 bp, Mus musculus
ggaactgaggaacgaacattctgct

SEQ ID NO: 698687 - DNA, 25 bp, Mus musculus
ggaactgaggaaggaacattctgct

SEQ ID NO: 698688 - DNA, 25 bp, Mus musculus
ggaactgagttcatgctttacgacg

SEQ ID NO: 698689 - DNA, 25 bp, Mus musculus
ggaactgagttcttgctttacgacg

SEQ ID NO: 698690 - DNA, 25 bp, Mus musculus
ggaactgattgtatctaagtaactc

SEQ ID NO: 698691 - DNA, 25 bp, Mus musculus
ggaactgattgtttctaagtaactc

SEQ ID NO: 698692 - DNA, 25 bp, Mus musculus
ggaactgcaagactgtgcccttccc

SEQ ID NO: 698693 - DNA, 25 bp, Mus musculus
ggaactgcaagagtgtgcccttccc

SEQ ID NO: 698694 - DNA, 25 bp, Mus musculus
ggaactgcactaccacaccaattgt

SEQ ID NO: 698695 - DNA, 25 bp, Mus musculus
ggaactgcactagcacaccaattgt

SEQ ID NO: 698696 - DNA, 25 bp, Mus musculus
ggaactgcaggcactgtctccgagt

SEQ ID NO: 698697 - DNA, 25 bp, Mus musculus
ggaactgcaggctctgtctccgagt

SEQ ID NO: 698698 - DNA, 25 bp, Mus musculus
ggaactgccgcaatctctgaaagac

SEQ ID NO: 698699 - DNA, 25 bp, Mus musculus
ggaactgccgcattctctgaaagac

SEQ ID NO: 698700 - DNA, 25 bp, Mus musculus
ggaactgcgctcaagtccttgcttc

SEQ ID NO: 698701 - DNA, 25 bp, Mus musculus
ggaactgcgctctagtccttgcttc

SEQ ID NO: 698702 - DNA, 25 bp, Mus musculus
ggaactgctaatcaaccatgggaag

SEQ ID NO: 698703 - DNA, 25 bp, Mus musculus
ggaactgctaatgaaccatgggaag

SEQ ID NO: 698704 - DNA, 25 bp, Mus musculus
ggaactgctcttatctcgcttttct

SEQ ID NO: 698705 - DNA, 25 bp, Mus musculus
ggaactgctcttttctcgcttttct

SEQ ID NO: 698706 - DNA, 25 bp, Mus musculus
ggaactggaaatactgagctgccat

SEQ ID NO: 698707 - DNA, 25 bp, Mus musculus
ggaactggaaattctgagctgccat

SEQ ID NO: 698708 - DNA, 25 bp, Mus musculus
ggaactggagaaactgagcctctta

SEQ ID NO: 698709 - DNA, 25 bp, Mus musculus
ggaactggagaaattgcccatacac

SEQ ID NO: 698710 - DNA, 25 bp, Mus musculus
ggaactggagaatctgagcctctta

SEQ ID NO: 698711 - DNA, 25 bp, Mus musculus
ggaactggagaatttgcccatacac

SEQ ID NO: 698712 - DNA, 25 bp, Mus musculus
ggaactggagtaaatctactctcaa

SEQ ID NO: 698713 - DNA, 25 bp, Mus musculus
ggaactggagtatatctactctcaa

SEQ ID NO: 698714 - DNA, 25 bp, Mus musculus
ggaactggagttacttagcatggcc

SEQ ID NO: 698715 - DNA, 25 bp, Mus musculus
ggaactggagtttcttagcatggcc

SEQ ID NO: 698716 - DNA, 25 bp, Mus musculus
ggaactggcaagctcacgtgtgtca

SEQ ID NO: 698717 - DNA, 25 bp, Mus musculus
ggaactggcaaggtcacgtgtgtca

SEQ ID NO: 698718 - DNA, 25 bp, Mus musculus
ggaactggcatcaccacacgagtta

SEQ ID NO: 698719 - DNA, 25 bp, Mus musculus
ggaactggcatctccacacgagtta

SEQ ID NO: 698720 - DNA, 25 bp, Mus musculus
ggaactggcattccttaagcaggaa

SEQ ID NO: 698721 - DNA, 25 bp, Mus musculus
ggaactggcattgcttaagcaggaa

SEQ ID NO: 698722 - DNA, 25 bp, Mus musculus
ggaactggcggcagaagaacatcaa

SEQ ID NO: 698723 - DNA, 25 bp, Mus musculus
ggaactggcggctgaagaacatcaa

SEQ ID NO: 698724 - DNA, 25 bp, Mus musculus
ggaactggcttgatacctgaccacg

SEQ ID NO: 698725 - DNA, 25 bp, Mus musculus
ggaactggcttgttacctgaccacg

SEQ ID NO: 698726 - DNA, 25 bp, Mus musculus
ggaactgggagtatttatgtagcca

SEQ ID NO: 698727 - DNA, 25 bp, Mus musculus
ggaactgggagtttttatgtagcca

SEQ ID NO: 698728 - DNA, 25 bp, Mus musculus
ggaactggtggtccggctactggga

SEQ ID NO: 698729 - DNA, 25 bp, Mus musculus
ggaactggtggtgcggctactggga

SEQ ID NO: 698730 - DNA, 25 bp, Mus musculus
ggaactggtgtaagtcctccagaca

SEQ ID NO: 698731 - DNA, 25 bp, Mus musculus
ggaactggtgtatgtcctccagaca

SEQ ID NO: 698732 - DNA, 25 bp, Mus musculus
ggaactgtacaacctcatgcgcctg

SEQ ID NO: 698733 - DNA, 25 bp, Mus musculus
ggaactgtacaagctcatgcgcctg

SEQ ID NO: 698734 - DNA, 25 bp, Mus musculus
ggaactgtccaacaactaacctgcc

SEQ ID NO: 698735 - DNA, 25 bp, Mus musculus
ggaactgtccaagaactaacctgcc

SEQ ID NO: 698736 - DNA, 25 bp, Mus musculus
ggaactgtcctgatggtgacctcca

SEQ ID NO: 698737 - DNA, 25 bp, Mus musculus
ggaactgtcctgttggtgacctcca

SEQ ID NO: 698738 - DNA, 25 bp, Mus musculus
ggaactgtcttaaacacaggagact

SEQ ID NO: 698739 - DNA, 25 bp, Mus musculus
ggaactgtcttatacacaggagact

SEQ ID NO: 698740 - DNA, 25 bp, Mus musculus
ggaactgtgataagtcccttgtgaa

SEQ ID NO: 698741 - DNA, 25 bp, Mus musculus
ggaactgtgatatgtcccttgtgaa

SEQ ID NO: 698742 - DNA, 25 bp, Mus musculus
ggaactgtgcaaagctgctacttga

SEQ ID NO: 698743 - DNA, 25 bp, Mus musculus
ggaactgtgcaatgctgctacttga

SEQ ID NO: 698744 - DNA, 25 bp, Mus musculus
ggaactgtgcaccaaactttatagc

SEQ ID NO: 698745 - DNA, 25 bp, Mus musculus
ggaactgtgcacgaaactttatagc

SEQ ID NO: 698746 - DNA, 25 bp, Mus musculus
ggaactgttattacaccctcgaggg

SEQ ID NO: 698747 - DNA, 25 bp, Mus musculus
ggaactgttatttcaccctcgaggg

SEQ ID NO: 698748 - DNA, 25 bp, Mus musculus
ggaactgttcagagctcgccctatg

SEQ ID NO: 698749 - DNA, 25 bp, Mus musculus
ggaactgttcagtgctcgccctatg

SEQ ID NO: 698750 - DNA, 25 bp, Mus musculus
ggaactgttccacacagcatttccc

SEQ ID NO: 698751 - DNA, 25 bp, Mus musculus
ggaactgttccagacagcatttccc

SEQ ID NO: 698752 - DNA, 25 bp, Mus musculus
ggaactgttgcaacttagcattcaa

SEQ ID NO: 698753 - DNA, 25 bp, Mus musculus
ggaactgttgcatcttagcattcaa

SEQ ID NO: 698754 - DNA, 25 bp, Mus musculus
ggaactgttgggatagaatgtctag

SEQ ID NO: 698755 - DNA, 25 bp, Mus musculus
ggaactgttgggttagaatgtctag

SEQ ID NO: 698756 - DNA, 25 bp, Mus musculus
ggaacttaacagaaagctcagtagt

SEQ ID NO: 698757 - DNA, 25 bp, Mus musculus
ggaacttaacagtaagctcagtagt

SEQ ID NO: 698758 - DNA, 25 bp, Mus musculus
ggaacttagctgagcaatctgagaa

SEQ ID NO: 698759 - DNA, 25 bp, Mus musculus
ggaacttagctgtgcaatctgagaa

SEQ ID NO: 698760 - DNA, 25 bp, Mus musculus
ggaacttcacaaaaagctcagtatt

SEQ ID NO: 698761 - DNA, 25 bp, Mus musculus
ggaacttcacaataagctcagtatt

SEQ ID NO: 698762 - DNA, 25 bp, Mus musculus
ggaacttcaggaagctgccgatgaa

SEQ ID NO: 698763 - DNA, 25 bp, Mus musculus
ggaacttcaggatgctgccgatgaa

SEQ ID NO: 698764 - DNA, 25 bp, Mus musculus
ggaacttccccaacgatgtgacctt

SEQ ID NO: 698765 - DNA, 25 bp, Mus musculus
ggaacttccccatcgatgtgacctt

SEQ ID NO: 698766 - DNA, 25 bp, Mus musculus
ggaacttcccgcacctgatgcaagc

SEQ ID NO: 698767 - DNA, 25 bp, Mus musculus
ggaacttcccgctcctgatgcaagc

SEQ ID NO: 698768 - DNA, 25 bp, Mus musculus
ggaacttcgtgtcctacagacgctc

SEQ ID NO: 698769 - DNA, 25 bp, Mus musculus
ggaacttcgtgtgctacagacgctc

SEQ ID NO: 698770 - DNA, 25 bp, Mus musculus
ggaacttctgtgcaaaacatgttac

SEQ ID NO: 698771 - DNA, 25 bp, Mus musculus
ggaacttctgtggaaaacatgttac

SEQ ID NO: 698772 - DNA, 25 bp, Mus musculus
ggaacttcttttcggctcatgctca

SEQ ID NO: 698773 - DNA, 25 bp, Mus musculus
ggaacttcttttgggctcatgctca

SEQ ID NO: 698774 - DNA, 25 bp, Mus musculus
ggaacttgactactgaagcagcaga

SEQ ID NO: 698775 - DNA, 25 bp, Mus musculus
ggaacttgactagtgaagcagcaga

SEQ ID NO: 698776 - DNA, 25 bp, Mus musculus
ggaacttgatccagtctcggctgac

SEQ ID NO: 698777 - DNA, 25 bp, Mus musculus
ggaacttgatcctgtctcggctgac

SEQ ID NO: 698778 - DNA, 25 bp, Mus musculus
ggaacttgcacactgacatcatctg

SEQ ID NO: 698779 - DNA, 25 bp, Mus musculus
ggaacttgcacagtgacatcatctg

SEQ ID NO: 698780 - DNA, 25 bp, Mus musculus
ggaacttgccccacaagtgtttgga

SEQ ID NO: 698781 - DNA, 25 bp, Mus musculus
ggaacttgcccctcaagtgtttgga

SEQ ID NO: 698782 - DNA, 25 bp, Mus musculus
ggaacttgcgccactgggctccctg

SEQ ID NO: 698783 - DNA, 25 bp, Mus musculus
ggaacttgcgcctctgggctccctg

SEQ ID NO: 698784 - DNA, 25 bp, Mus musculus
ggaacttggaacactgggacaaata

SEQ ID NO: 698785 - DNA, 25 bp, Mus musculus
ggaacttggaactctgggacaaata

SEQ ID NO: 698786 - DNA, 25 bp, Mus musculus
ggaacttggcccagcctgacgacat

SEQ ID NO: 698787 - DNA, 25 bp, Mus musculus
ggaacttggccctgcctgacgacat

SEQ ID NO: 698788 - DNA, 25 bp, Mus musculus
ggaacttgtgttcctaatgggaaac

SEQ ID NO: 698789 - DNA, 25 bp, Mus musculus
ggaacttgtgttgctaatgggaaac

SEQ ID NO: 698790 - DNA, 25 bp, Mus musculus
ggaactttcagcaccggcgccaagt

SEQ ID NO: 698791 - DNA, 25 bp, Mus musculus
ggaactttcagctccggcgccaagt

SEQ ID NO: 698792 - DNA, 25 bp, Mus musculus
ggaactttccagaacgctcggtggg

SEQ ID NO: 698793 - DNA, 25 bp, Mus musculus
ggaactttccagtacgctcggtggg

SEQ ID NO: 698794 - DNA, 25 bp, Mus musculus
ggaactttgggcactggctcctgag

SEQ ID NO: 698795 - DNA, 25 bp, Mus musculus
ggaactttgggctctggctcctgag

SEQ ID NO: 698796 - DNA, 25 bp, Mus musculus
ggaactttgtcaaccatcgtttggg

SEQ ID NO: 698797 - DNA, 25 bp, Mus musculus
ggaactttgtcatccatcgtttggg

SEQ ID NO: 698798 - DNA, 25 bp, Mus musculus
ggaacttttgtaatggagcacagct

SEQ ID NO: 698799 - DNA, 25 bp, Mus musculus
ggaacttttgtattggagcacagct

SEQ ID NO: 698800 - DNA, 25 bp, Mus musculus
ggaagaaaaactactaatactatgt

SEQ ID NO: 698801 - DNA, 25 bp, Mus musculus
ggaagaaaaacttctaatactatgt

SEQ ID NO: 698802 - DNA, 25 bp, Mus musculus
ggaagaaaaatcagcccttggcact

SEQ ID NO: 698803 - DNA, 25 bp, Mus musculus
ggaagaaaaatctgcccttggcact

SEQ ID NO: 698804 - DNA, 25 bp, Mus musculus
ggaagaaacttaaatgagttggcct

SEQ ID NO: 698805 - DNA, 25 bp, Mus musculus
ggaagaaacttatatgagttggcct

SEQ ID NO: 698806 - DNA, 25 bp, Mus musculus
ggaagaaacttcacagcttgctgca

SEQ ID NO: 698807 - DNA, 25 bp, Mus musculus
ggaagaaacttctcagcttgctgca

SEQ ID NO: 698808 - DNA, 25 bp, Mus musculus
ggaagaaagaagagcctattttgac

SEQ ID NO: 698809 - DNA, 25 bp, Mus musculus
ggaagaaagaagtgcctattttgac

SEQ ID NO: 698810 - DNA, 25 bp, Mus musculus
ggaagaaagcaacccttgtcctccg

SEQ ID NO: 698811 - DNA, 25 bp, Mus musculus
ggaagaaagcaagccttgtcctccg

SEQ ID NO: 698812 - DNA, 25 bp, Mus musculus
ggaagaaaggaacacttgggcttct

SEQ ID NO: 698813 - DNA, 25 bp, Mus musculus
ggaagaaaggaagacttgggcttct

SEQ ID NO: 698814 - DNA, 25 bp, Mus musculus
ggaagaaaggcgaaaacgtattgca

SEQ ID NO: 698815 - DNA, 25 bp, Mus musculus
ggaagaaaggcgtaaacgtattgca

SEQ ID NO: 698816 - DNA, 25 bp, Mus musculus
ggaagaaagtctcgataggaatcaa

SEQ ID NO: 698817 - DNA, 25 bp, Mus musculus
ggaagaaagtctggataggaatcaa

SEQ ID NO: 698818 - DNA, 25 bp, Mus musculus
ggaagaaagtttcccacatataacc

SEQ ID NO: 698819 - DNA, 25 bp, Mus musculus
ggaagaaagtttgccacatataacc

SEQ ID NO: 698820 - DNA, 25 bp, Mus musculus
ggaagaaatacaccaagccctacga

SEQ ID NO: 698821 - DNA, 25 bp, Mus musculus
ggaagaaatacagcaagccctacga

SEQ ID NO: 698822 - DNA, 25 bp, Mus musculus
ggaagaaatcaaactggagataaat

SEQ ID NO: 698823 - DNA, 25 bp, Mus musculus
ggaagaaatcaatctggagataaat

SEQ ID NO: 698824 - DNA, 25 bp, Mus musculus
ggaagaacagagaaaacagcgggct

SEQ ID NO: 698825 - DNA, 25 bp, Mus musculus
ggaagaacagagtaaacagcgggct

SEQ ID NO: 698826 - DNA, 25 bp, Mus musculus
ggaagaaccacaagtactcctgcag

SEQ ID NO: 698827 - DNA, 25 bp, Mus musculus
ggaagaaccacatgtactcctgcag

SEQ ID NO: 698828 - DNA, 25 bp, Mus musculus
ggaagaaccactacactgtggccca

SEQ ID NO: 698829 - DNA, 25 bp, Mus musculus
ggaagaaccacttcactgtggccca

SEQ ID NO: 698830 - DNA, 25 bp, Mus musculus
ggaagaacccaacttccaagctcat

SEQ ID NO: 698831 - DNA, 25 bp, Mus musculus
ggaagaacccaagttccaagctcat

SEQ ID NO: 698832 - DNA, 25 bp, Mus musculus
ggaagaacctccacatgaagcacga

SEQ ID NO: 698833 - DNA, 25 bp, Mus musculus
ggaagaacctcctcatgaagcacga

SEQ ID NO: 698834 - DNA, 25 bp, Mus musculus
ggaagaacttccatcgcgtgggccg

SEQ ID NO: 698835 - DNA, 25 bp, Mus musculus
ggaagaacttccattcgaaatctga

SEQ ID NO: 698836 - DNA, 25 bp, Mus musculus
ggaagaacttccttcgcgtgggccg

SEQ ID NO: 698837 - DNA, 25 bp, Mus musculus
ggaagaacttcctttcgaaatctga

SEQ ID NO: 698838 - DNA, 25 bp, Mus musculus
ggaagaagaacccaaatcgcaaagt

SEQ ID NO: 698839 - DNA, 25 bp, Mus musculus
ggaagaagaaccgaaatcgcaaagt

SEQ ID NO: 698840 - DNA, 25 bp, Mus musculus
ggaagaagaactccctcaatgctgt

SEQ ID NO: 698841 - DNA, 25 bp, Mus musculus
ggaagaagaactgcctcaatgctgt

SEQ ID NO: 698842 - DNA, 25 bp, Mus musculus
ggaagaagacatccgtcctgaaatg

SEQ ID NO: 698843 - DNA, 25 bp, Mus musculus
ggaagaagacatgcgtcctgaaatg

SEQ ID NO: 698844 - DNA, 25 bp, Mus musculus
ggaagaagaccccactcttacagaa

SEQ ID NO: 698845 - DNA, 25 bp, Mus musculus
ggaagaagacccgactcttacagaa

SEQ ID NO: 698846 - DNA, 25 bp, Mus musculus
ggaagaagacttagcgactactacg

SEQ ID NO: 698847 - DNA, 25 bp, Mus musculus
ggaagaagactttgcgactactacg

SEQ ID NO: 698848 - DNA, 25 bp, Mus musculus
ggaagaagagcaagacctaccagag

SEQ ID NO: 698849 - DNA, 25 bp, Mus musculus
ggaagaagagcatgacctaccagag

SEQ ID NO: 698850 - DNA, 25 bp, Mus musculus
ggaagaagattgagccagaggccat

SEQ ID NO: 698851 - DNA, 25 bp, Mus musculus
ggaagaagattgtgccagaggccat

SEQ ID NO: 698852 - DNA, 25 bp, Mus musculus
ggaagaagcacgagggtccggagac

SEQ ID NO: 698853 - DNA, 25 bp, Mus musculus
ggaagaagcacgtgggtccggagac

SEQ ID NO: 698854 - DNA, 25 bp, Mus musculus
ggaagaagccaaaagttatgactct

SEQ ID NO: 698855 - DNA, 25 bp, Mus musculus
ggaagaagccaacgcgctggctgag

SEQ ID NO: 698856 - DNA, 25 bp, Mus musculus
ggaagaagccaaggcgctggctgag

SEQ ID NO: 698857 - DNA, 25 bp, Mus musculus
ggaagaagccaatagttatgactct

SEQ ID NO: 698858 - DNA, 25 bp, Mus musculus
ggaagaagctctcctggtctgtgac

SEQ ID NO: 698859 - DNA, 25 bp, Mus musculus
ggaagaagctctgctggtctgtgac

SEQ ID NO: 698860 - DNA, 25 bp, Mus musculus
ggaagaagtgtcactttgccagctt

SEQ ID NO: 698861 - DNA, 25 bp, Mus musculus
ggaagaagtgtctctttgccagctt

SEQ ID NO: 698862 - DNA, 25 bp, Mus musculus
ggaagaagttgaaaaccagaaagag

SEQ ID NO: 698863 - DNA, 25 bp, Mus musculus
ggaagaagttgataaccagaaagag

SEQ ID NO: 698864 - DNA, 25 bp, Mus musculus
ggaagaagtttcagtggcctgcaag

SEQ ID NO: 698865 - DNA, 25 bp, Mus musculus
ggaagaagtttctgtggcctgcaag

SEQ ID NO: 698866 - DNA, 25 bp, Mus musculus
ggaagaatacgacgcatggaaagtc

SEQ ID NO: 698867 - DNA, 25 bp, Mus musculus
ggaagaatacgaggcatggaaagtc

SEQ ID NO: 698868 - DNA, 25 bp, Mus musculus
ggaagaatatggagacacacacgtg

SEQ ID NO: 698869 - DNA, 25 bp, Mus musculus
ggaagaatatggtgacacacacgtg

SEQ ID NO: 698870 - DNA, 25 bp, Mus musculus
ggaagaatcaaaaactgacgtgata

SEQ ID NO: 698871 - DNA, 25 bp, Mus musculus
ggaagaatcaaatactgacgtgata

SEQ ID NO: 698872 - DNA, 25 bp, Mus musculus
ggaagaatggaactcagcgcccaag

SEQ ID NO: 698873 - DNA, 25 bp, Mus musculus
ggaagaatggaagtcagcgcccaag

SEQ ID NO: 698874 - DNA, 25 bp, Mus musculus
ggaagaatggagactgtcagtaccg

SEQ ID NO: 698875 - DNA, 25 bp, Mus musculus
ggaagaatggagtctgtcagtaccg

SEQ ID NO: 698876 - DNA, 25 bp, Mus musculus
ggaagaatgtgccaccagctgttct

SEQ ID NO: 698877 - DNA, 25 bp, Mus musculus
ggaagaatgtgcgaccagctgttct

SEQ ID NO: 698878 - DNA, 25 bp, Mus musculus
ggaagaatgtgtaaggaaactgacc

SEQ ID NO: 698879 - DNA, 25 bp, Mus musculus
ggaagaatgtgttaggaaactgacc

SEQ ID NO: 698880 - DNA, 25 bp, Mus musculus
ggaagacaacgtagctctctccctt

SEQ ID NO: 698881 - DNA, 25 bp, Mus musculus
ggaagacaacgttgctctctccctt

SEQ ID NO: 698882 - DNA, 25 bp, Mus musculus
ggaagacaagatattatacgtgtca

SEQ ID NO: 698883 - DNA, 25 bp, Mus musculus
ggaagacaagattttatacgtgtca

SEQ ID NO: 698884 - DNA, 25 bp, Mus musculus
ggaagacaccataccttatgcctta

SEQ ID NO: 698885 - DNA, 25 bp, Mus musculus
ggaagacaccattccttatgcctta

SEQ ID NO: 698886 - DNA, 25 bp, Mus musculus
ggaagacacgatagctcctcgagcc

SEQ ID NO: 698887 - DNA, 25 bp, Mus musculus
ggaagacacgattgctcctcgagcc

SEQ ID NO: 698888 - DNA, 25 bp, Mus musculus
ggaagacagcccaggaaatggtcca

SEQ ID NO: 698889 - DNA, 25 bp, Mus musculus
ggaagacagccctggaaatggtcca

SEQ ID NO: 698890 - DNA, 25 bp, Mus musculus
ggaagacaggccacatcattgctgt

SEQ ID NO: 698891 - DNA, 25 bp, Mus musculus
ggaagacaggcctcatcattgctgt

SEQ ID NO: 698892 - DNA, 25 bp, Mus musculus
ggaagacatcttcacatagggctct

SEQ ID NO: 698893 - DNA, 25 bp, Mus musculus
ggaagacatcttccacgagcacatg

SEQ ID NO: 698894 - DNA, 25 bp, Mus musculus
ggaagacatcttgacatagggctct

SEQ ID NO: 698895 - DNA, 25 bp, Mus musculus
ggaagacatcttgcacgagcacatg

SEQ ID NO: 698896 - DNA, 25 bp, Mus musculus
ggaagaccaactcccatgttacttg

SEQ ID NO: 698897 - DNA, 25 bp, Mus musculus
ggaagaccaactgccatgttacttg

SEQ ID NO: 698898 - DNA, 25 bp, Mus musculus
ggaagaccaggtaaagcccagggat

SEQ ID NO: 698899 - DNA, 25 bp, Mus musculus
ggaagaccaggttaagcccagggat

SEQ ID NO: 698900 - DNA, 25 bp, Mus musculus
ggaagaccccgtacacacatttagg

SEQ ID NO: 698901 - DNA, 25 bp, Mus musculus
ggaagaccccgttcacacatttagg

SEQ ID NO: 698902 - DNA, 25 bp, Mus musculus
ggaagaccctgacctcaaggtcgtc

SEQ ID NO: 698903 - DNA, 25 bp, Mus musculus
ggaagaccctgagctcaaggtcgtc

SEQ ID NO: 698904 - DNA, 25 bp, Mus musculus
ggaagaccgtacatccatgccttac

SEQ ID NO: 698905 - DNA, 25 bp, Mus musculus
ggaagaccgtacttccatgccttac

SEQ ID NO: 698906 - DNA, 25 bp, Mus musculus
ggaagacctcaaataccatgaccca

SEQ ID NO: 698907 - DNA, 25 bp, Mus musculus
ggaagacctcaattaccatgaccca

SEQ ID NO: 698908 - DNA, 25 bp, Mus musculus
ggaagacctcatcaagcccaggatg

SEQ ID NO: 698909 - DNA, 25 bp, Mus musculus
ggaagacctcatgaagcccaggatg

SEQ ID NO: 698910 - DNA, 25 bp, Mus musculus
ggaagacctcggacgtgttgaatgc

SEQ ID NO: 698911 - DNA, 25 bp, Mus musculus
ggaagacctcggtcgtgttgaatgc

SEQ ID NO: 698912 - DNA, 25 bp, Mus musculus
ggaagacggcgtccaaatgagaaca

SEQ ID NO: 698913 - DNA, 25 bp, Mus musculus
ggaagacggcgtgcaaatgagaaca

SEQ ID NO: 698914 - DNA, 25 bp, Mus musculus
ggaagacgggatcgttccctgcaaa

SEQ ID NO: 698915 - DNA, 25 bp, Mus musculus
ggaagacgggatggttccctgcaaa

SEQ ID NO: 698916 - DNA, 25 bp, Mus musculus
ggaagacgtcttactctatgtcagt

SEQ ID NO: 698917 - DNA, 25 bp, Mus musculus
ggaagacgtctttctctatgtcagt

SEQ ID NO: 698918 - DNA, 25 bp, Mus musculus
ggaagactcccacagtgccttgtct

SEQ ID NO: 698919 - DNA, 25 bp, Mus musculus
ggaagactcccagagtgccttgtct

SEQ ID NO: 698920 - DNA, 25 bp, Mus musculus
ggaagactccttatgacccaaggca

SEQ ID NO: 698921 - DNA, 25 bp, Mus musculus
ggaagactccttttgacccaaggca

SEQ ID NO: 698922 - DNA, 25 bp, Mus musculus
ggaagactgcccaggctgcaaagat

SEQ ID NO: 698923 - DNA, 25 bp, Mus musculus
ggaagactgccctggctgcaaagat

SEQ ID NO: 698924 - DNA, 25 bp, Mus musculus
ggaagactgctaagggaaaacttgc

SEQ ID NO: 698925 - DNA, 25 bp, Mus musculus
ggaagactgctatgggaaaacttgc

SEQ ID NO: 698926 - DNA, 25 bp, Mus musculus
ggaagactgggaagactccgtgaat

SEQ ID NO: 698927 - DNA, 25 bp, Mus musculus
ggaagactgggatgactccgtgaat

SEQ ID NO: 698928 - DNA, 25 bp, Mus musculus
ggaagacttattccagagaaacaga

SEQ ID NO: 698929 - DNA, 25 bp, Mus musculus
ggaagacttattgcagagaaacaga

SEQ ID NO: 698930 - DNA, 25 bp, Mus musculus
ggaagagaaacaaatatttgagaac

SEQ ID NO: 698931 - DNA, 25 bp, Mus musculus
ggaagagaaacatatatttgagaac

SEQ ID NO: 698932 - DNA, 25 bp, Mus musculus
ggaagagaagttcccttacatggta

SEQ ID NO: 698933 - DNA, 25 bp, Mus musculus
ggaagagaagttgccttacatggta

SEQ ID NO: 698934 - DNA, 25 bp, Mus musculus
ggaagagaccaaagtataataagct

SEQ ID NO: 698935 - DNA, 25 bp, Mus musculus
ggaagagaccaatgtataataagct

SEQ ID NO: 698936 - DNA, 25 bp, Mus musculus
ggaagagacctaaattgccaccatc

SEQ ID NO: 698937 - DNA, 25 bp, Mus musculus
ggaagagacctatattgccaccatc

SEQ ID NO: 698938 - DNA, 25 bp, Mus musculus
ggaagagacgagacctcacgtcctt

SEQ ID NO: 698939 - DNA, 25 bp, Mus musculus
ggaagagacgagtcctcacgtcctt

SEQ ID NO: 698940 - DNA, 25 bp, Mus musculus
ggaagagactcccttgttacctttg

SEQ ID NO: 698941 - DNA, 25 bp, Mus musculus
ggaagagactccgttgttacctttg

SEQ ID NO: 698942 - DNA, 25 bp, Mus musculus
ggaagagactctcgaaccgggcctc

SEQ ID NO: 698943 - DNA, 25 bp, Mus musculus
ggaagagactctggaaccgggcctc

SEQ ID NO: 698944 - DNA, 25 bp, Mus musculus
ggaagagagcacactctagtgactt

SEQ ID NO: 698945 - DNA, 25 bp, Mus musculus
ggaagagagcactctctagtgactt

SEQ ID NO: 698946 - DNA, 25 bp, Mus musculus
ggaagagagtttccgccactcaggc

SEQ ID NO: 698947 - DNA, 25 bp, Mus musculus
ggaagagagtttgcgccactcaggc

SEQ ID NO: 698948 - DNA, 25 bp, Mus musculus
ggaagagataccctagaaagaacag

SEQ ID NO: 698949 - DNA, 25 bp, Mus musculus
ggaagagataccgtagaaagaacag

SEQ ID NO: 698950 - DNA, 25 bp, Mus musculus
ggaagagatattattgcacagagaa

SEQ ID NO: 698951 - DNA, 25 bp, Mus musculus
ggaagagatatttttgcacagagaa

SEQ ID NO: 698952 - DNA, 25 bp, Mus musculus
ggaagagattgcagctcgcctccaa

SEQ ID NO: 698953 - DNA, 25 bp, Mus musculus
ggaagagattgctgctcgcctccaa

SEQ ID NO: 698954 - DNA, 25 bp, Mus musculus
ggaagagcagaacaaccatctagca

SEQ ID NO: 698955 - DNA, 25 bp, Mus musculus
ggaagagcagaagaaccatctagca

SEQ ID NO: 698956 - DNA, 25 bp, Mus musculus
ggaagagcatccattactttactta

SEQ ID NO: 698957 - DNA, 25 bp, Mus musculus
ggaagagcatcctttactttactta

SEQ ID NO: 698958 - DNA, 25 bp, Mus musculus
ggaagagcattccttttctgaaatc

SEQ ID NO: 698959 - DNA, 25 bp, Mus musculus
ggaagagcattcgttttctgaaatc

SEQ ID NO: 698960 - DNA, 25 bp, Mus musculus
ggaagagccccaaacggcaataaag

SEQ ID NO: 698961 - DNA, 25 bp, Mus musculus
ggaagagccccatacggcaataaag

SEQ ID NO: 698962 - DNA, 25 bp, Mus musculus
ggaagagccttcaagtaagtggaac

SEQ ID NO: 698963 - DNA, 25 bp, Mus musculus
ggaagagccttctagtaagtggaac

SEQ ID NO: 698964 - DNA, 25 bp, Mus musculus
ggaagagctctgaagttgccaaacc

SEQ ID NO: 698965 - DNA, 25 bp, Mus musculus
ggaagagctctgtagttgccaaacc

SEQ ID NO: 698966 - DNA, 25 bp, Mus musculus
ggaagagctgcgctccatgttcacg

SEQ ID NO: 698967 - DNA, 25 bp, Mus musculus
ggaagagctgcggtccatgttcacg

SEQ ID NO: 698968 - DNA, 25 bp, Mus musculus
ggaagagcttccatttcgccagcgc

SEQ ID NO: 698969 - DNA, 25 bp, Mus musculus
ggaagagcttccttttcgccagcgc

SEQ ID NO: 698970 - DNA, 25 bp, Mus musculus
ggaagaggactgatcctaagtctaa

SEQ ID NO: 698971 - DNA, 25 bp, Mus musculus
ggaagaggactgttcctaagtctaa

SEQ ID NO: 698972 - DNA, 25 bp, Mus musculus
ggaagaggagaaagtcattccgatg

SEQ ID NO: 698973 - DNA, 25 bp, Mus musculus
ggaagaggagaatgtcattccgatg

SEQ ID NO: 698974 - DNA, 25 bp, Mus musculus
ggaagaggataccacctgctataaa

SEQ ID NO: 698975 - DNA, 25 bp, Mus musculus
ggaagaggatacgacctgctataaa

SEQ ID NO: 698976 - DNA, 25 bp, Mus musculus
ggaagaggatggacaactgaagtca

SEQ ID NO: 698977 - DNA, 25 bp, Mus musculus
ggaagaggatggtcaactgaagtca

SEQ ID NO: 698978 - DNA, 25 bp, Mus musculus
ggaagaggcattagatgccctgaaa

SEQ ID NO: 698979 - DNA, 25 bp, Mus musculus
ggaagaggcatttgatgccctgaaa

SEQ ID NO: 698980 - DNA, 25 bp, Mus musculus
ggaagaggcctcagcagacatgcaa

SEQ ID NO: 698981 - DNA, 25 bp, Mus musculus
ggaagaggcctctgcagacatgcaa

SEQ ID NO: 698982 - DNA, 25 bp, Mus musculus
ggaagaggcgcacccttacgacttg

SEQ ID NO: 698983 - DNA, 25 bp, Mus musculus
ggaagaggcgcagccttacgacttg

SEQ ID NO: 698984 - DNA, 25 bp, Mus musculus
ggaagagggtcaatgtaattggcat

SEQ ID NO: 698985 - DNA, 25 bp, Mus musculus
ggaagagggtcattgtaattggcat

SEQ ID NO: 698986 - DNA, 25 bp, Mus musculus
ggaagaggtgtcaactctgaaattg

SEQ ID NO: 698987 - DNA, 25 bp, Mus musculus
ggaagaggtgtctactctgaaattg

SEQ ID NO: 698988 - DNA, 25 bp, Mus musculus
ggaagaggtttaatgatccagcaca

SEQ ID NO: 698989 - DNA, 25 bp, Mus musculus
ggaagaggtttattgatccagcaca

SEQ ID NO: 698990 - DNA, 25 bp, Mus musculus
ggaagagtattaacctttctctgag

SEQ ID NO: 698991 - DNA, 25 bp, Mus musculus
ggaagagtattatcctttctctgag

SEQ ID NO: 698992 - DNA, 25 bp, Mus musculus
ggaagagtcctcatcactcttggag

SEQ ID NO: 698993 - DNA, 25 bp, Mus musculus
ggaagagtcctcttcactcttggag

SEQ ID NO: 698994 - DNA, 25 bp, Mus musculus
ggaagagtggctcggaaagttccca

SEQ ID NO: 698995 - DNA, 25 bp, Mus musculus
ggaagagtggctgggaaagttccca

SEQ ID NO: 698996 - DNA, 25 bp, Mus musculus
ggaagagtgtcccagcagctatatc

SEQ ID NO: 698997 - DNA, 25 bp, Mus musculus
ggaagagtgtccgagcagctatatc

SEQ ID NO: 698998 - DNA, 25 bp, Mus musculus
ggaagagttacaacgcccagaacca

SEQ ID NO: 698999 - DNA, 25 bp, Mus musculus
ggaagagttacatcgcccagaacca

SEQ ID NO: 699000 - DNA, 25 bp, Mus musculus
ggaagagttgtgacccttgttgaag

SEQ ID NO: 699001 - DNA, 25 bp, Mus musculus
ggaagagttgtgtcccttgttgaag

SEQ ID NO: 699002 - DNA, 25 bp, Mus musculus
ggaagataacccactgcattggaca

SEQ ID NO: 699003 - DNA, 25 bp, Mus musculus
ggaagataaccctctgcattggaca

SEQ ID NO: 699004 - DNA, 25 bp, Mus musculus
ggaagataactacgaaagatgtagc

SEQ ID NO: 699005 - DNA, 25 bp, Mus musculus
ggaagataactaggaaagatgtagc

SEQ ID NO: 699006 - DNA, 25 bp, Mus musculus
ggaagataagacaagagcgcacccg

SEQ ID NO: 699007 - DNA, 25 bp, Mus musculus
ggaagataagactagagcgcacccg

SEQ ID NO: 699008 - DNA, 25 bp, Mus musculus
ggaagatacacactgccgtccagtc

SEQ ID NO: 699009 - DNA, 25 bp, Mus musculus
ggaagatacacagtgccgtccagtc

SEQ ID NO: 699010 - DNA, 25 bp, Mus musculus
ggaagatacaggactggtccagcaa

SEQ ID NO: 699011 - DNA, 25 bp, Mus musculus
ggaagatacaggtctggtccagcaa

SEQ ID NO: 699012 - DNA, 25 bp, Mus musculus
ggaagatagccgaagaccttatgaa

SEQ ID NO: 699013 - DNA, 25 bp, Mus musculus
ggaagatagccgtagaccttatgaa

SEQ ID NO: 699014 - DNA, 25 bp, Mus musculus
ggaagatatattacccaatcagcct

SEQ ID NO: 699015 - DNA, 25 bp, Mus musculus
ggaagatatatttcccaatcagcct

SEQ ID NO: 699016 - DNA, 25 bp, Mus musculus
ggaagatattgactggatagacaat

SEQ ID NO: 699017 - DNA, 25 bp, Mus musculus
ggaagatattgagtggatagacaat

SEQ ID NO: 699018 - DNA, 25 bp, Mus musculus
ggaagatcccgaagctcacagtgaa

SEQ ID NO: 699019 - DNA, 25 bp, Mus musculus
ggaagatcccgatgctcacagtgaa

SEQ ID NO: 699020 - DNA, 25 bp, Mus musculus
ggaagatcctaaatacaacgtgtgt

SEQ ID NO: 699021 - DNA, 25 bp, Mus musculus
ggaagatcctaattacaacgtgtgt

SEQ ID NO: 699022 - DNA, 25 bp, Mus musculus
ggaagatccttgaaggcagtgacga

SEQ ID NO: 699023 - DNA, 25 bp, Mus musculus
ggaagatccttgtaggcagtgacga

SEQ ID NO: 699024 - DNA, 25 bp, Mus musculus
ggaagatcggatccctgagctctgt

SEQ ID NO: 699025 - DNA, 25 bp, Mus musculus
ggaagatcggatgcctgagctctgt

SEQ ID NO: 699026 - DNA, 25 bp, Mus musculus
ggaagatcgtacaggctcaagagtg

SEQ ID NO: 699027 - DNA, 25 bp, Mus musculus
ggaagatcgtactggctcaagagtg

SEQ ID NO: 699028 - DNA, 25 bp, Mus musculus
ggaagatctaaaagcccaagttgaa

SEQ ID NO: 699029 - DNA, 25 bp, Mus musculus
ggaagatctaaatgcccaagttgaa

SEQ ID NO: 699030 - DNA, 25 bp, Mus musculus
ggaagatctcaccaacaatcctaca

SEQ ID NO: 699031 - DNA, 25 bp, Mus musculus
ggaagatctcacgaacaatcctaca

SEQ ID NO: 699032 - DNA, 25 bp, Mus musculus
ggaagatctgctcactaacatcatg

SEQ ID NO: 699033 - DNA, 25 bp, Mus musculus
ggaagatctgctgactaacatcatg

SEQ ID NO: 699034 - DNA, 25 bp, Mus musculus
ggaagatgagacaacaccagagatg

SEQ ID NO: 699035 - DNA, 25 bp, Mus musculus
ggaagatgagactacaccagagatg

SEQ ID NO: 699036 - DNA, 25 bp, Mus musculus
ggaagatgccatatattggacgtaa

SEQ ID NO: 699037 - DNA, 25 bp, Mus musculus
ggaagatgccatttattggacgtaa

SEQ ID NO: 699038 - DNA, 25 bp, Mus musculus
ggaagatgctgaacaagaagtgtct

SEQ ID NO: 699039 - DNA, 25 bp, Mus musculus
ggaagatgctgatcaagaagtgtct

SEQ ID NO: 699040 - DNA, 25 bp, Mus musculus
ggaagatggagaaccgtgactaccg

SEQ ID NO: 699041 - DNA, 25 bp, Mus musculus
ggaagatggagatccgtgactaccg

SEQ ID NO: 699042 - DNA, 25 bp, Mus musculus
ggaagatggagcacttcagccaacc

SEQ ID NO: 699043 - DNA, 25 bp, Mus musculus
ggaagatggagctcttcagccaacc

SEQ ID NO: 699044 - DNA, 25 bp, Mus musculus
ggaagatgggctatttcatgatcca

SEQ ID NO: 699045 - DNA, 25 bp, Mus musculus
ggaagatgggctttttcatgatcca

SEQ ID NO: 699046 - DNA, 25 bp, Mus musculus
ggaagatgtgtcagcacgcctctcg

SEQ ID NO: 699047 - DNA, 25 bp, Mus musculus
ggaagatgtgtctgcacgcctctcg

SEQ ID NO: 699048 - DNA, 25 bp, Mus musculus
ggaagattaccacggtcacaaccca

SEQ ID NO: 699049 - DNA, 25 bp, Mus musculus
ggaagattaccagggtcacaaccca

SEQ ID NO: 699050 - DNA, 25 bp, Mus musculus
ggaagattccaacagaaacaaatag

SEQ ID NO: 699051 - DNA, 25 bp, Mus musculus
ggaagattccaagagaaacaaatag

SEQ ID NO: 699052 - DNA, 25 bp, Mus musculus
ggaagattctaaccacgggtttcag

SEQ ID NO: 699053 - DNA, 25 bp, Mus musculus
ggaagattctaagcacgggtttcag

SEQ ID NO: 699054 - DNA, 25 bp, Mus musculus
ggaagattgcctacatcaaactgga

SEQ ID NO: 699055 - DNA, 25 bp, Mus musculus
ggaagattgccttcatcaaactgga

SEQ ID NO: 699056 - DNA, 25 bp, Mus musculus
ggaagattgcgtactgagggccacc

SEQ ID NO: 699057 - DNA, 25 bp, Mus musculus
ggaagattgcgttctgagggccacc

SEQ ID NO: 699058 - DNA, 25 bp, Mus musculus
ggaagatttaaacgaagccatgttt

SEQ ID NO: 699059 - DNA, 25 bp, Mus musculus
ggaagatttaaaggaagccatgttt

SEQ ID NO: 699060 - DNA, 25 bp, Mus musculus
ggaagatttacacccagatccagaa

SEQ ID NO: 699061 - DNA, 25 bp, Mus musculus
ggaagatttacagccagatccagaa

SEQ ID NO: 699062 - DNA, 25 bp, Mus musculus
ggaagatttgataatgcagatagga

SEQ ID NO: 699063 - DNA, 25 bp, Mus musculus
ggaagatttgattatgcagatagga

SEQ ID NO: 699064 - DNA, 25 bp, Mus musculus
ggaagattttatacaagttcccagg

SEQ ID NO: 699065 - DNA, 25 bp, Mus musculus
ggaagattttattcaagttcccagg

SEQ ID NO: 699066 - DNA, 25 bp, Mus musculus
ggaagattttcaaagccggcccact

SEQ ID NO: 699067 - DNA, 25 bp, Mus musculus
ggaagattttcatagccggcccact

SEQ ID NO: 699068 - DNA, 25 bp, Mus musculus
ggaagattttccacatcgacaccaa

SEQ ID NO: 699069 - DNA, 25 bp, Mus musculus
ggaagattttcctcatcgacaccaa

SEQ ID NO: 699070 - DNA, 25 bp, Mus musculus
ggaagcaaagatacaaacagatccc

SEQ ID NO: 699071 - DNA, 25 bp, Mus musculus
ggaagcaaagattcaaacagatccc

SEQ ID NO: 699072 - DNA, 25 bp, Mus musculus
ggaagcaaaggacagaacggccacc

SEQ ID NO: 699073 - DNA, 25 bp, Mus musculus
ggaagcaaaggagagaacggccacc

SEQ ID NO: 699074 - DNA, 25 bp, Mus musculus
ggaagcaagacaccgatgaaatgcc

SEQ ID NO: 699075 - DNA, 25 bp, Mus musculus
ggaagcaagacagcgatgaaatgcc

SEQ ID NO: 699076 - DNA, 25 bp, Mus musculus
ggaagcaagcacacctggaagggct

SEQ ID NO: 699077 - DNA, 25 bp, Mus musculus
ggaagcaagcactcctggaagggct

SEQ ID NO: 699078 - DNA, 25 bp, Mus musculus
ggaagcaatggacaacgaacagttt

SEQ ID NO: 699079 - DNA, 25 bp, Mus musculus
ggaagcaatggagaacgaacagttt

SEQ ID NO: 699080 - DNA, 25 bp, Mus musculus
ggaagcaatttaacaactcagtgag

SEQ ID NO: 699081 - DNA, 25 bp, Mus musculus
ggaagcaatttatcaactcagtgag

SEQ ID NO: 699082 - DNA, 25 bp, Mus musculus
ggaagcacaaatcccgtcgtcggaa

SEQ ID NO: 699083 - DNA, 25 bp, Mus musculus
ggaagcacaaatgccgtcgtcggaa

SEQ ID NO: 699084 - DNA, 25 bp, Mus musculus
ggaagcacaagaatatcatcaacct

SEQ ID NO: 699085 - DNA, 25 bp, Mus musculus
ggaagcacaagattatcatcaacct

SEQ ID NO: 699086 - DNA, 25 bp, Mus musculus
ggaagcacaggtcgaagagttttct

SEQ ID NO: 699087 - DNA, 25 bp, Mus musculus
ggaagcacaggtggaagagttttct

SEQ ID NO: 699088 - DNA, 25 bp, Mus musculus
ggaagcactgacaccctggaccaag

SEQ ID NO: 699089 - DNA, 25 bp, Mus musculus
ggaagcactgactccctggaccaag

SEQ ID NO: 699090 - DNA, 25 bp, Mus musculus
ggaagcactttcagagactgctggg

SEQ ID NO: 699091 - DNA, 25 bp, Mus musculus
ggaagcactttctgagactgctggg

SEQ ID NO: 699092 - DNA, 25 bp, Mus musculus
ggaagcagccacaccagcggtggca

SEQ ID NO: 699093 - DNA, 25 bp, Mus musculus
ggaagcagccactccagcggtggca

SEQ ID NO: 699094 - DNA, 25 bp, Mus musculus
ggaagcagctagctcagataaagga

SEQ ID NO: 699095 - DNA, 25 bp, Mus musculus
ggaagcagctaggtcagataaagga

SEQ ID NO: 699096 - DNA, 25 bp, Mus musculus
ggaagcaggctaagcagacctcgat

SEQ ID NO: 699097 - DNA, 25 bp, Mus musculus
ggaagcaggctatgcagacctcgat

SEQ ID NO: 699098 - DNA, 25 bp, Mus musculus
ggaagcaggtgccagatgcatacat

SEQ ID NO: 699099 - DNA, 25 bp, Mus musculus
ggaagcaggtgcgagatgcatacat

SEQ ID NO: 699100 - DNA, 25 bp, Mus musculus
ggaagcagtactcggagtacgaatt

SEQ ID NO: 699101 - DNA, 25 bp, Mus musculus
ggaagcagtactgggagtacgaatt

SEQ ID NO: 699102 - DNA, 25 bp, Mus musculus
ggaagcatacgtcttgctccctgca

SEQ ID NO: 699103 - DNA, 25 bp, Mus musculus
ggaagcatacgtgttgctccctgca

SEQ ID NO: 699104 - DNA, 25 bp, Mus musculus
ggaagcatgctccacatacatgttt

SEQ ID NO: 699105 - DNA, 25 bp, Mus musculus
ggaagcatgctcctcttacacgttt

SEQ ID NO: 699106 - DNA, 25 bp, Mus musculus
ggaagcatgctcgacatacatgttt

SEQ ID NO: 699107 - DNA, 25 bp, Mus musculus
ggaagcatgctcgtcttacacgttt

SEQ ID NO: 699108 - DNA, 25 bp, Mus musculus
ggaagccaaaccattcaaacccaga

SEQ ID NO: 699109 - DNA, 25 bp, Mus musculus
ggaagccaaacctttcaaacccaga

SEQ ID NO: 699110 - DNA, 25 bp, Mus musculus
ggaagccacgagatctttgaagcca

SEQ ID NO: 699111 - DNA, 25 bp, Mus musculus
ggaagccacgagttctttgaagcca

SEQ ID NO: 699112 - DNA, 25 bp, Mus musculus
ggaagccagtggcatgaaatccacc

SEQ ID NO: 699113 - DNA, 25 bp, Mus musculus
ggaagccagtgggatgaaatccacc

SEQ ID NO: 699114 - DNA, 25 bp, Mus musculus
ggaagccatgatctccgctgcaatg

SEQ ID NO: 699115 - DNA, 25 bp, Mus musculus
ggaagccatgatgtccgctgcaatg

SEQ ID NO: 699116 - DNA, 25 bp, Mus musculus
ggaagccatgcgatttgcccgacgt

SEQ ID NO: 699117 - DNA, 25 bp, Mus musculus
ggaagccatgcgttttgcccgacgt

SEQ ID NO: 699118 - DNA, 25 bp, Mus musculus
ggaagccattccagcagtttgcaag

SEQ ID NO: 699119 - DNA, 25 bp, Mus musculus
ggaagccattcctgcagtttgcaag

SEQ ID NO: 699120 - DNA, 25 bp, Mus musculus
ggaagcccaactatagcgagctgca

SEQ ID NO: 699121 - DNA, 25 bp, Mus musculus
ggaagcccaactttagcgagctgca

SEQ ID NO: 699122 - DNA, 25 bp, Mus musculus
ggaagcccacccaggtgatcctgag

SEQ ID NO: 699123 - DNA, 25 bp, Mus musculus
ggaagcccaccctggtgatcctgag

SEQ ID NO: 699124 - DNA, 25 bp, Mus musculus
ggaagcccacgaacaaggcatggac

SEQ ID NO: 699125 - DNA, 25 bp, Mus musculus
ggaagcccacgatcaaggcatggac

SEQ ID NO: 699126 - DNA, 25 bp, Mus musculus
ggaagcccagcacggagtcagggaa

SEQ ID NO: 699127 - DNA, 25 bp, Mus musculus
ggaagcccagcagggagtcagggaa

SEQ ID NO: 699128 - DNA, 25 bp, Mus musculus
ggaagcccatgacgaacagaatgtg

SEQ ID NO: 699129 - DNA, 25 bp, Mus musculus
ggaagcccatgaggaacagaatgtg

SEQ ID NO: 699130 - DNA, 25 bp, Mus musculus
ggaagcccgctccttgacaaccggg

SEQ ID NO: 699131 - DNA, 25 bp, Mus musculus
ggaagcccgctcgttgacaaccggg

SEQ ID NO: 699132 - DNA, 25 bp, Mus musculus
ggaagccctcatcacagtgaaaggg

SEQ ID NO: 699133 - DNA, 25 bp, Mus musculus
ggaagccctcatgacagtgaaaggg

SEQ ID NO: 699134 - DNA, 25 bp, Mus musculus
ggaagccgaaccacaccggaagatt

SEQ ID NO: 699135 - DNA, 25 bp, Mus musculus
ggaagccgaacctcaccggaagatt

SEQ ID NO: 699136 - DNA, 25 bp, Mus musculus
ggaagccgctttcccgacgagaact

SEQ ID NO: 699137 - DNA, 25 bp, Mus musculus
ggaagccgctttgccgacgagaact

SEQ ID NO: 699138 - DNA, 25 bp, Mus musculus
ggaagccggtctcaagccatttgaa

SEQ ID NO: 699139 - DNA, 25 bp, Mus musculus
ggaagccggtctgaagccatttgaa

SEQ ID NO: 699140 - DNA, 25 bp, Mus musculus
ggaagccgttctctgacatcatgga

SEQ ID NO: 699141 - DNA, 25 bp, Mus musculus
ggaagccgttctgtgacatcatgga

SEQ ID NO: 699142 - DNA, 25 bp, Mus musculus
ggaagccgtttcaaggaccagacag

SEQ ID NO: 699143 - DNA, 25 bp, Mus musculus
ggaagccgtttctaggaccagacag

SEQ ID NO: 699144 - DNA, 25 bp, Mus musculus
ggaagcctagcaagctcctacctgg

SEQ ID NO: 699145 - DNA, 25 bp, Mus musculus
ggaagcctagcatgctcctacctgg

SEQ ID NO: 699146 - DNA, 25 bp, Mus musculus
ggaagcctcaccattaatgccaacc

SEQ ID NO: 699147 - DNA, 25 bp, Mus musculus
ggaagcctcacctttaatgccaacc

SEQ ID NO: 699148 - DNA, 25 bp, Mus musculus
ggaagcctccggcaacgaatagaga

SEQ ID NO: 699149 - DNA, 25 bp, Mus musculus
ggaagcctccgggaacgaatagaga

SEQ ID NO: 699150 - DNA, 25 bp, Mus musculus
ggaagcctcctcagcgacaccgagt

SEQ ID NO: 699151 - DNA, 25 bp, Mus musculus
ggaagcctcctctgcgacaccgagt

SEQ ID NO: 699152 - DNA, 25 bp, Mus musculus
ggaagcctctctactacctggtcaa

SEQ ID NO: 699153 - DNA, 25 bp, Mus musculus
ggaagcctctcttctacctggtcaa

SEQ ID NO: 699154 - DNA, 25 bp, Mus musculus
ggaagccttaaacgcaggtttggat

SEQ ID NO: 699155 - DNA, 25 bp, Mus musculus
ggaagccttaaaggcaggtttggat

SEQ ID NO: 699156 - DNA, 25 bp, Mus musculus
ggaagccttagcagctccgctggat

SEQ ID NO: 699157 - DNA, 25 bp, Mus musculus
ggaagccttagctgctccgctggat

SEQ ID NO: 699158 - DNA, 25 bp, Mus musculus
ggaagcgacaggagctcagctgact

SEQ ID NO: 699159 - DNA, 25 bp, Mus musculus
ggaagcgacaggtgctcagctgact

SEQ ID NO: 699160 - DNA, 25 bp, Mus musculus
ggaagcgagtcactcagatcctgca

SEQ ID NO: 699161 - DNA, 25 bp, Mus musculus
ggaagcgagtcagtcagatcctgca

SEQ ID NO: 699162 - DNA, 25 bp, Mus musculus
ggaagcgccatgacaaccaatgtgt

SEQ ID NO: 699163 - DNA, 25 bp, Mus musculus
ggaagcgccatgtcaaccaatgtgt

SEQ ID NO: 699164 - DNA, 25 bp, Mus musculus
ggaagcgctcgcaccggtcatgttt

SEQ ID NO: 699165 - DNA, 25 bp, Mus musculus
ggaagcgctcgctccggtcatgttt

SEQ ID NO: 699166 - DNA, 25 bp, Mus musculus
ggaagcggaaaaccaaacaagcagt

SEQ ID NO: 699167 - DNA, 25 bp, Mus musculus
ggaagcggaaaagcaaacaagcagt

SEQ ID NO: 699168 - DNA, 25 bp, Mus musculus
ggaagcggacacctcagtgccgcca

SEQ ID NO: 699169 - DNA, 25 bp, Mus musculus
ggaagcggacacgtcagtgccgcca

SEQ ID NO: 699170 - DNA, 25 bp, Mus musculus
ggaagcggcatgaagagactcccca

SEQ ID NO: 699171 - DNA, 25 bp, Mus musculus
ggaagcggcatgtagagactcccca

SEQ ID NO: 699172 - DNA, 25 bp, Mus musculus
ggaagcggcccgagcccaaatgttt

SEQ ID NO: 699173 - DNA, 25 bp, Mus musculus
ggaagcggcccgtgcccaaatgttt

SEQ ID NO: 699174 - DNA, 25 bp, Mus musculus
ggaagcggccgcattcgacctccgt

SEQ ID NO: 699175 - DNA, 25 bp, Mus musculus
ggaagcggccgctttcgacctccgt

SEQ ID NO: 699176 - DNA, 25 bp, Mus musculus
ggaagctaaacacctcagctatctg

SEQ ID NO: 699177 - DNA, 25 bp, Mus musculus
ggaagctaaacagctcagctatctg

SEQ ID NO: 699178 - DNA, 25 bp, Mus musculus
ggaagctaatgtctgtctcaagaca

SEQ ID NO: 699179 - DNA, 25 bp, Mus musculus
ggaagctaatgtgtgtctcaagaca

SEQ ID NO: 699180 - DNA, 25 bp, Mus musculus
ggaagctagagaccacagtgaacct

SEQ ID NO: 699181 - DNA, 25 bp, Mus musculus
ggaagctagagagcacagtgaacct

SEQ ID NO: 699182 - DNA, 25 bp, Mus musculus
ggaagctagcctactgctgagggcc

SEQ ID NO: 699183 - DNA, 25 bp, Mus musculus
ggaagctagccttctgctgagggcc

SEQ ID NO: 699184 - DNA, 25 bp, Mus musculus
ggaagctagtctattgctttgccca

SEQ ID NO: 699185 - DNA, 25 bp, Mus musculus
ggaagctagtcttttgctttgccca

SEQ ID NO: 699186 - DNA, 25 bp, Mus musculus
ggaagctattcccaatatcactgag

SEQ ID NO: 699187 - DNA, 25 bp, Mus musculus
ggaagctattccgaatatcactgag

SEQ ID NO: 699188 - DNA, 25 bp, Mus musculus
ggaagctcaccgactgtatcctgga

SEQ ID NO: 699189 - DNA, 25 bp, Mus musculus
ggaagctcaccgtctgtatcctgga

SEQ ID NO: 699190 - DNA, 25 bp, Mus musculus
ggaagctcagtaaccgctgacggaa

SEQ ID NO: 699191 - DNA, 25 bp, Mus musculus
ggaagctcagtatccgctgacggaa

SEQ ID NO: 699192 - DNA, 25 bp, Mus musculus
ggaagctcattgaagcagaggacaa

SEQ ID NO: 699193 - DNA, 25 bp, Mus musculus
ggaagctcattgtagcagaggacaa

SEQ ID NO: 699194 - DNA, 25 bp, Mus musculus
ggaagctcctgtcaaggtgatccac

SEQ ID NO: 699195 - DNA, 25 bp, Mus musculus
ggaagctcctgtgaaggtgatccac

SEQ ID NO: 699196 - DNA, 25 bp, Mus musculus
ggaagctcctttatagcaatcaaaa

SEQ ID NO: 699197 - DNA, 25 bp, Mus musculus
ggaagctcctttttagcaatcaaaa

SEQ ID NO: 699198 - DNA, 25 bp, Mus musculus
ggaagctcgaccacagtacaactga

SEQ ID NO: 699199 - DNA, 25 bp, Mus musculus
ggaagctcgacctcagtacaactga

SEQ ID NO: 699200 - DNA, 25 bp, Mus musculus
ggaagctcgcacagtctcctcaggt

SEQ ID NO: 699201 - DNA, 25 bp, Mus musculus
ggaagctcgcactgtctcctcaggt

SEQ ID NO: 699202 - DNA, 25 bp, Mus musculus
ggaagctcgggaatatctcaacaag

SEQ ID NO: 699203 - DNA, 25 bp, Mus musculus
ggaagctcgggattatctcaacaag

SEQ ID NO: 699204 - DNA, 25 bp, Mus musculus
ggaagctcttctcgcatttccttca

SEQ ID NO: 699205 - DNA, 25 bp, Mus musculus
ggaagctcttctggcatttccttca

SEQ ID NO: 699206 - DNA, 25 bp, Mus musculus
ggaagctcttggcacgttttgtcat

SEQ ID NO: 699207 - DNA, 25 bp, Mus musculus
ggaagctcttgggacgttttgtcat

SEQ ID NO: 699208 - DNA, 25 bp, Mus musculus
ggaagctgaagcagttcgatgccta

SEQ ID NO: 699209 - DNA, 25 bp, Mus musculus
ggaagctgaagctgttcgatgccta

SEQ ID NO: 699210 - DNA, 25 bp, Mus musculus
ggaagctgcataactcttacacaga

SEQ ID NO: 699211 - DNA, 25 bp, Mus musculus
ggaagctgcatatctcttacacaga

SEQ ID NO: 699212 - DNA, 25 bp, Mus musculus
ggaagctgcccaaagtcaacgatca

SEQ ID NO: 699213 - DNA, 25 bp, Mus musculus
ggaagctgcccatagtcaacgatca

SEQ ID NO: 699214 - DNA, 25 bp, Mus musculus
ggaagctgcccgcagcgaaaacaag

SEQ ID NO: 699215 - DNA, 25 bp, Mus musculus
ggaagctgcccggagcgaaaacaag

SEQ ID NO: 699216 - DNA, 25 bp, Mus musculus
ggaagctgctcgagaaggacatgaa

SEQ ID NO: 699217 - DNA, 25 bp, Mus musculus
ggaagctgctcgtgaaggacatgaa

SEQ ID NO: 699218 - DNA, 25 bp, Mus musculus
ggaagctgcttcaagctgtggccca

SEQ ID NO: 699219 - DNA, 25 bp, Mus musculus
ggaagctgcttctagctgtggccca

SEQ ID NO: 699220 - DNA, 25 bp, Mus musculus
ggaagctggcgacagccttagctct

SEQ ID NO: 699221 - DNA, 25 bp, Mus musculus
ggaagctggcgagagccttagctct

SEQ ID NO: 699222 - DNA, 25 bp, Mus musculus
ggaagctgggtcaaaactgtgccat

SEQ ID NO: 699223 - DNA, 25 bp, Mus musculus
ggaagctgggtctaaactgtgccat

SEQ ID NO: 699224 - DNA, 25 bp, Mus musculus
ggaagctgtccaccaagaaagcctg

SEQ ID NO: 699225 - DNA, 25 bp, Mus musculus
ggaagctgtccactgcaatgtctgc

SEQ ID NO: 699226 - DNA, 25 bp, Mus musculus
ggaagctgtccagcaagaaagcctg

SEQ ID NO: 699227 - DNA, 25 bp, Mus musculus
ggaagctgtccagtgcaatgtctgc

SEQ ID NO: 699228 - DNA, 25 bp, Mus musculus
ggaagcttccagacatgccatcatg

SEQ ID NO: 699229 - DNA, 25 bp, Mus musculus
ggaagcttccagtcatgccatcatg

SEQ ID NO: 699230 - DNA, 25 bp, Mus musculus
ggaagctttcatccatccaatagga

SEQ ID NO: 699231 - DNA, 25 bp, Mus musculus
ggaagctttcatgcatccaatagga

SEQ ID NO: 699232 - DNA, 25 bp, Mus musculus
ggaaggaaaggtagcttattcccag

SEQ ID NO: 699233 - DNA, 25 bp, Mus musculus
ggaaggaaaggttgcttattcccag

SEQ ID NO: 699234 - DNA, 25 bp, Mus musculus
ggaaggaacttcaggccgaagccac

SEQ ID NO: 699235 - DNA, 25 bp, Mus musculus
ggaaggaacttctggccgaagccac

SEQ ID NO: 699236 - DNA, 25 bp, Mus musculus
ggaaggaagatcaggctgtttttat

SEQ ID NO: 699237 - DNA, 25 bp, Mus musculus
ggaaggaagatctggctgtttttat

SEQ ID NO: 699238 - DNA, 25 bp, Mus musculus
ggaaggaagccaagatactccagca

SEQ ID NO: 699239 - DNA, 25 bp, Mus musculus
ggaaggaagccatgatactccagca

SEQ ID NO: 699240 - DNA, 25 bp, Mus musculus
ggaaggaagcccagcataagcgaca

SEQ ID NO: 699241 - DNA, 25 bp, Mus musculus
ggaaggaagccctgcataagcgaca

SEQ ID NO: 699242 - DNA, 25 bp, Mus musculus
ggaaggaagccgctctgaagccatt

SEQ ID NO: 699243 - DNA, 25 bp, Mus musculus
ggaaggaagccggtctgaagccatt

SEQ ID NO: 699244 - DNA, 25 bp, Mus musculus
ggaaggaaggcaaccacgtcccttt

SEQ ID NO: 699245 - DNA, 25 bp, Mus musculus
ggaaggaaggcatccacgtcccttt

SEQ ID NO: 699246 - DNA, 25 bp, Mus musculus
ggaaggaagggtcttagccacacca

SEQ ID NO: 699247 - DNA, 25 bp, Mus musculus
ggaaggaagggtgttagccacacca

SEQ ID NO: 699248 - DNA, 25 bp, Mus musculus
ggaaggaatatgattttgctgactc

SEQ ID NO: 699249 - DNA, 25 bp, Mus musculus
ggaaggaatatgtttttgctgactc

SEQ ID NO: 699250 - DNA, 25 bp, Mus musculus
ggaaggacaactccaattctctaca

SEQ ID NO: 699251 - DNA, 25 bp, Mus musculus
ggaaggacaactgcaattctctaca

SEQ ID NO: 699252 - DNA, 25 bp, Mus musculus
ggaaggacaagcagactgcaggcct

SEQ ID NO: 699253 - DNA, 25 bp, Mus musculus
ggaaggacaagctgactgcaggcct

SEQ ID NO: 699254 - DNA, 25 bp, Mus musculus
ggaaggacagacaccactgatgctg

SEQ ID NO: 699255 - DNA, 25 bp, Mus musculus
ggaaggacagaccatcaaattgagt

SEQ ID NO: 699256 - DNA, 25 bp, Mus musculus
ggaaggacagacgatcaaattgagt

SEQ ID NO: 699257 - DNA, 25 bp, Mus musculus
ggaaggacagactccactgatgctg

SEQ ID NO: 699258 - DNA, 25 bp, Mus musculus
ggaaggacatttcattgccgagatg

SEQ ID NO: 699259 - DNA, 25 bp, Mus musculus
ggaaggacatttgattgccgagatg

SEQ ID NO: 699260 - DNA, 25 bp, Mus musculus
ggaaggaccattagcacaccatcat

SEQ ID NO: 699261 - DNA, 25 bp, Mus musculus
ggaaggaccatttgcacaccatcat

SEQ ID NO: 699262 - DNA, 25 bp, Mus musculus
ggaaggacgcagacgctgccctctg

SEQ ID NO: 699263 - DNA, 25 bp, Mus musculus
ggaaggacgcagtcgctgccctctg

SEQ ID NO: 699264 - DNA, 25 bp, Mus musculus
ggaaggacgtttcaagaagaagcag

SEQ ID NO: 699265 - DNA, 25 bp, Mus musculus
ggaaggacgtttgaagaagaagcag

SEQ ID NO: 699266 - DNA, 25 bp, Mus musculus
ggaaggagatgtctgctcaccagta

SEQ ID NO: 699267 - DNA, 25 bp, Mus musculus
ggaaggagatgtgtgctcaccagta

SEQ ID NO: 699268 - DNA, 25 bp, Mus musculus
ggaaggagattacagcttcagttac

SEQ ID NO: 699269 - DNA, 25 bp, Mus musculus
ggaaggagattagagcttcagttac

SEQ ID NO: 699270 - DNA, 25 bp, Mus musculus
ggaaggagattgagatagacatcga

SEQ ID NO: 699271 - DNA, 25 bp, Mus musculus
ggaaggagattgtgatagacatcga

SEQ ID NO: 699272 - DNA, 25 bp, Mus musculus
ggaaggagcaatactaccgctacta

SEQ ID NO: 699273 - DNA, 25 bp, Mus musculus
ggaaggagcaattctaccgctacta

SEQ ID NO: 699274 - DNA, 25 bp, Mus musculus
ggaaggagctcaagaagctgccctc

SEQ ID NO: 699275 - DNA, 25 bp, Mus musculus
ggaaggagctcatgaagctgccctc

SEQ ID NO: 699276 - DNA, 25 bp, Mus musculus
ggaaggaggatcacccatcaaatat

SEQ ID NO: 699277 - DNA, 25 bp, Mus musculus
ggaaggaggatctcccatcaaatat

SEQ ID NO: 699278 - DNA, 25 bp, Mus musculus
ggaaggaggcgacaacatcaagcca

SEQ ID NO: 699279 - DNA, 25 bp, Mus musculus
ggaaggaggcgagaacatcaagcca

SEQ ID NO: 699280 - DNA, 25 bp, Mus musculus
ggaaggagtcccctggcatctcccg

SEQ ID NO: 699281 - DNA, 25 bp, Mus musculus
ggaaggagtcccgtggcatctcccg

SEQ ID NO: 699282 - DNA, 25 bp, Mus musculus
ggaaggagtgtcaccctcccgtgca

SEQ ID NO: 699283 - DNA, 25 bp, Mus musculus
ggaaggagtgtctccctcccgtgca

SEQ ID NO: 699284 - DNA, 25 bp, Mus musculus
ggaaggcaatcccacttatggcctt

SEQ ID NO: 699285 - DNA, 25 bp, Mus musculus
ggaaggcaatccgacttatggcctt

SEQ ID NO: 699286 - DNA, 25 bp, Mus musculus
ggaaggcacttaagacacagctctg

SEQ ID NO: 699287 - DNA, 25 bp, Mus musculus
ggaaggcacttatgacacagctctg

SEQ ID NO: 699288 - DNA, 25 bp, Mus musculus
ggaaggcattacagggtacctacct

SEQ ID NO: 699289 - DNA, 25 bp, Mus musculus
ggaaggcattactgggtacctacct

SEQ ID NO: 699290 - DNA, 25 bp, Mus musculus
ggaaggccacttctcaatgaccgct

SEQ ID NO: 699291 - DNA, 25 bp, Mus musculus
ggaaggccacttgtcaatgaccgct

SEQ ID NO: 699292 - DNA, 25 bp, Mus musculus
ggaaggcccagtaggacaatctcaa

SEQ ID NO: 699293 - DNA, 25 bp, Mus musculus
ggaaggcccagttggacaatctcaa

SEQ ID NO: 699294 - DNA, 25 bp, Mus musculus
ggaaggcctcttctgcactggagac

SEQ ID NO: 699295 - DNA, 25 bp, Mus musculus
ggaaggcctcttgtgcactggagac

SEQ ID NO: 699296 - DNA, 25 bp, Mus musculus
ggaaggcctgcaatgatgccacgct

SEQ ID NO: 699297 - DNA, 25 bp, Mus musculus
ggaaggcctgcattgatgccacgct

SEQ ID NO: 699298 - DNA, 25 bp, Mus musculus
ggaaggccttacagggcaaaaactg

SEQ ID NO: 699299 - DNA, 25 bp, Mus musculus
ggaaggccttactgggcaaaaactg

SEQ ID NO: 699300 - DNA, 25 bp, Mus musculus
ggaaggcgactactcactgatcatg

SEQ ID NO: 699301 - DNA, 25 bp, Mus musculus
ggaaggcgactagtcactgatcatg

SEQ ID NO: 699302 - DNA, 25 bp, Mus musculus
ggaaggcgccgaacctcgacaagat

SEQ ID NO: 699303 - DNA, 25 bp, Mus musculus
ggaaggcgccgatcctcgacaagat

SEQ ID NO: 699304 - DNA, 25 bp, Mus musculus
ggaaggcgctctagactctgctgaa

SEQ ID NO: 699305 - DNA, 25 bp, Mus musculus
ggaaggcgctcttgactctgctgaa

SEQ ID NO: 699306 - DNA, 25 bp, Mus musculus
ggaaggcgtgacacccaagaagcag

SEQ ID NO: 699307 - DNA, 25 bp, Mus musculus
ggaaggcgtgactcccaagaagcag

SEQ ID NO: 699308 - DNA, 25 bp, Mus musculus
ggaaggctaaacactgagacacagc

SEQ ID NO: 699309 - DNA, 25 bp, Mus musculus
ggaaggctaaactctgagacacagc

SEQ ID NO: 699310 - DNA, 25 bp, Mus musculus
ggaaggctgcacaaaggaattcctc

SEQ ID NO: 699311 - DNA, 25 bp, Mus musculus
ggaaggctgcactaaggaattcctc

SEQ ID NO: 699312 - DNA, 25 bp, Mus musculus
ggaaggctgtaaagcagccatcaga

SEQ ID NO: 699313 - DNA, 25 bp, Mus musculus
ggaaggctgtaatgcagccatcaga

SEQ ID NO: 699314 - DNA, 25 bp, Mus musculus
ggaagggaacaaaggccatcgatgt

SEQ ID NO: 699315 - DNA, 25 bp, Mus musculus
ggaagggaacaatggccatcgatgt

SEQ ID NO: 699316 - DNA, 25 bp, Mus musculus
ggaagggacggcattattgacctga

SEQ ID NO: 699317 - DNA, 25 bp, Mus musculus
ggaagggacggctttattgacctga

SEQ ID NO: 699318 - DNA, 25 bp, Mus musculus
ggaagggagtggatcaagaccctaa

SEQ ID NO: 699319 - DNA, 25 bp, Mus musculus
ggaagggagtggttcaagaccctaa

SEQ ID NO: 699320 - DNA, 25 bp, Mus musculus
ggaagggcatcaactccggctctgt

SEQ ID NO: 699321 - DNA, 25 bp, Mus musculus
ggaagggcatcatctccggctctgt

SEQ ID NO: 699322 - DNA, 25 bp, Mus musculus
ggaagggtaacacatacccgccgca

SEQ ID NO: 699323 - DNA, 25 bp, Mus musculus
ggaagggtaacagatacccgccgca

SEQ ID NO: 699324 - DNA, 25 bp, Mus musculus
ggaagggtgcgtccactataaagtc

SEQ ID NO: 699325 - DNA, 25 bp, Mus musculus
ggaagggtgcgtgcactataaagtc

SEQ ID NO: 699326 - DNA, 25 bp, Mus musculus
ggaaggtaggcccatggacgccctg

SEQ ID NO: 699327 - DNA, 25 bp, Mus musculus
ggaaggtaggccgatggacgccctg

SEQ ID NO: 699328 - DNA, 25 bp, Mus musculus
ggaaggtatatgatcacctcaaata

SEQ ID NO: 699329 - DNA, 25 bp, Mus musculus
ggaaggtatatgttcacctcaaata

SEQ ID NO: 699330 - DNA, 25 bp, Mus musculus
ggaaggtatccaagtatctgcttac

SEQ ID NO: 699331 - DNA, 25 bp, Mus musculus
ggaaggtatccatgtatctgcttac

SEQ ID NO: 699332 - DNA, 25 bp, Mus musculus
ggaaggtcaactcaaaaggctcaag

SEQ ID NO: 699333 - DNA, 25 bp, Mus musculus
ggaaggtcaactgaaaaggctcaag

SEQ ID NO: 699334 - DNA, 25 bp, Mus musculus
ggaaggtcttacaggcagaattaca

SEQ ID NO: 699335 - DNA, 25 bp, Mus musculus
ggaaggtcttactggcagaattaca

SEQ ID NO: 699336 - DNA, 25 bp, Mus musculus
ggaaggtgactcagattctcatagc

SEQ ID NO: 699337 - DNA, 25 bp, Mus musculus
ggaaggtgactctgattctcatagc

SEQ ID NO: 699338 - DNA, 25 bp, Mus musculus
ggaaggtgatgtacgccttctgcag

SEQ ID NO: 699339 - DNA, 25 bp, Mus musculus
ggaaggtgatgttcgccttctgcag

SEQ ID NO: 699340 - DNA, 25 bp, Mus musculus
ggaaggtgattgctacagccatgat

SEQ ID NO: 699341 - DNA, 25 bp, Mus musculus
ggaaggtgattggtacagccatgat

SEQ ID NO: 699342 - DNA, 25 bp, Mus musculus
ggaaggtggtacaaacatttcaaga

SEQ ID NO: 699343 - DNA, 25 bp, Mus musculus
ggaaggtggtactaacatttcaaga

SEQ ID NO: 699344 - DNA, 25 bp, Mus musculus
ggaaggtgtaaacgccaccaccaag

SEQ ID NO: 699345 - DNA, 25 bp, Mus musculus
ggaaggtgtaaaggccaccaccaag

SEQ ID NO: 699346 - DNA, 25 bp, Mus musculus
ggaaggtgtcatacaagttaaaaca

SEQ ID NO: 699347 - DNA, 25 bp, Mus musculus
ggaaggtgtcattcaagttaaaaca

SEQ ID NO: 699348 - DNA, 25 bp, Mus musculus
ggaaggtgtctccatgcctgcctca

SEQ ID NO: 699349 - DNA, 25 bp, Mus musculus
ggaaggtgtctcgatgcctgcctca

SEQ ID NO: 699350 - DNA, 25 bp, Mus musculus
ggaaggttaccaaaagccagatcag

SEQ ID NO: 699351 - DNA, 25 bp, Mus musculus
ggaaggttaccataagccagatcag

SEQ ID NO: 699352 - DNA, 25 bp, Mus musculus
ggaaggttcacaatcaagtctgacg

SEQ ID NO: 699353 - DNA, 25 bp, Mus musculus
ggaaggttcacattcaagtctgacg

SEQ ID NO: 699354 - DNA, 25 bp, Mus musculus
ggaaggttctccctctctggacgca

SEQ ID NO: 699355 - DNA, 25 bp, Mus musculus
ggaaggttctccgtctctggacgca

SEQ ID NO: 699356 - DNA, 25 bp, Mus musculus
ggaagtaaacgcctcctaatttgag

SEQ ID NO: 699357 - DNA, 25 bp, Mus musculus
ggaagtaaacgcgtcctaatttgag

SEQ ID NO: 699358 - DNA, 25 bp, Mus musculus
ggaagtaactttccctttcctgcct

SEQ ID NO: 699359 - DNA, 25 bp, Mus musculus
ggaagtaactttgcctttcctgcct

SEQ ID NO: 699360 - DNA, 25 bp, Mus musculus
ggaagtacaacgacaagcacaagag

SEQ ID NO: 699361 - DNA, 25 bp, Mus musculus
ggaagtacaacgtcaagcacaagag

SEQ ID NO: 699362 - DNA, 25 bp, Mus musculus
ggaagtacaagacggatatggcttt

SEQ ID NO: 699363 - DNA, 25 bp, Mus musculus
ggaagtacaagagggatatggcttt

SEQ ID NO: 699364 - DNA, 25 bp, Mus musculus
ggaagtacacatatgcagcccacat

SEQ ID NO: 699365 - DNA, 25 bp, Mus musculus
ggaagtacacatttgcagcccacat

SEQ ID NO: 699366 - DNA, 25 bp, Mus musculus
ggaagtacactcacatagacaaaaa

SEQ ID NO: 699367 - DNA, 25 bp, Mus musculus
ggaagtacactctcatagacaaaaa

SEQ ID NO: 699368 - DNA, 25 bp, Mus musculus
ggaagtacagatcgctgcagcacct

SEQ ID NO: 699369 - DNA, 25 bp, Mus musculus
ggaagtacagatggctgcagcacct

SEQ ID NO: 699370 - DNA, 25 bp, Mus musculus
ggaagtacatgtcccggatcatagt

SEQ ID NO: 699371 - DNA, 25 bp, Mus musculus
ggaagtacatgtgccggatcatagt

SEQ ID NO: 699372 - DNA, 25 bp, Mus musculus
ggaagtaccttgagccctccgacct

SEQ ID NO: 699373 - DNA, 25 bp, Mus musculus
ggaagtaccttgtgccctccgacct

SEQ ID NO: 699374 - DNA, 25 bp, Mus musculus
ggaagtagcagaatgcctccctgac

SEQ ID NO: 699375 - DNA, 25 bp, Mus musculus
ggaagtagcagattgcctccctgac

SEQ ID NO: 699376 - DNA, 25 bp, Mus musculus
ggaagtagcccacagcctgacaata

SEQ ID NO: 699377 - DNA, 25 bp, Mus musculus
ggaagtagcccagagcctgacaata

SEQ ID NO: 699378 - DNA, 25 bp, Mus musculus
ggaagtagcttcactagcggcggca

SEQ ID NO: 699379 - DNA, 25 bp, Mus musculus
ggaagtagcttctctagcggcggca

SEQ ID NO: 699380 - DNA, 25 bp, Mus musculus
ggaagtaggcctacaacatggcggc

SEQ ID NO: 699381 - DNA, 25 bp, Mus musculus
ggaagtaggccttcaacatggcggc

SEQ ID NO: 699382 - DNA, 25 bp, Mus musculus
ggaagtatgacaccgggatcccacc

SEQ ID NO: 699383 - DNA, 25 bp, Mus musculus
ggaagtatgacagcgggatcccacc

SEQ ID NO: 699384 - DNA, 25 bp, Mus musculus
ggaagtatgagtctgaatggaccaa

SEQ ID NO: 699385 - DNA, 25 bp, Mus musculus
ggaagtatgagtgtgaatggaccaa

SEQ ID NO: 699386 - DNA, 25 bp, Mus musculus
ggaagtatgctacactacaaaggag

SEQ ID NO: 699387 - DNA, 25 bp, Mus musculus
ggaagtatgctagactacaaaggag

SEQ ID NO: 699388 - DNA, 25 bp, Mus musculus
ggaagtatgtacattgtgtgctaaa

SEQ ID NO: 699389 - DNA, 25 bp, Mus musculus
ggaagtatgtactttgtgtgctaaa

SEQ ID NO: 699390 - DNA, 25 bp, Mus musculus
ggaagtattttaccgacggccactg

SEQ ID NO: 699391 - DNA, 25 bp, Mus musculus
ggaagtattttagcgacggccactg

SEQ ID NO: 699392 - DNA, 25 bp, Mus musculus
ggaagtcactgcctagaacctgaga

SEQ ID NO: 699393 - DNA, 25 bp, Mus musculus
ggaagtcactgcgtagaacctgaga

SEQ ID NO: 699394 - DNA, 25 bp, Mus musculus
ggaagtcactggcatgagcagctcc

SEQ ID NO: 699395 - DNA, 25 bp, Mus musculus
ggaagtcactgggatgagcagctcc

SEQ ID NO: 699396 - DNA, 25 bp, Mus musculus
ggaagtcacttcaggagttagccag

SEQ ID NO: 699397 - DNA, 25 bp, Mus musculus
ggaagtcacttctggagttagccag

SEQ ID NO: 699398 - DNA, 25 bp, Mus musculus
ggaagtcagtatccatatttccatg

SEQ ID NO: 699399 - DNA, 25 bp, Mus musculus
ggaagtcagtatgcatatttccatg

SEQ ID NO: 699400 - DNA, 25 bp, Mus musculus
ggaagtcatcaacccattctgtgtc

SEQ ID NO: 699401 - DNA, 25 bp, Mus musculus
ggaagtcatcaagccattctgtgtc

SEQ ID NO: 699402 - DNA, 25 bp, Mus musculus
ggaagtcatcccatcccggctggat

SEQ ID NO: 699403 - DNA, 25 bp, Mus musculus
ggaagtcatcccttcccggctggat

SEQ ID NO: 699404 - DNA, 25 bp, Mus musculus
ggaagtcatggtaagcctgttttca

SEQ ID NO: 699405 - DNA, 25 bp, Mus musculus
ggaagtcatggttagcctgttttca

SEQ ID NO: 699406 - DNA, 25 bp, Mus musculus
ggaagtcctgccctaaatggtctgt

SEQ ID NO: 699407 - DNA, 25 bp, Mus musculus
ggaagtcctgccgtaaatggtctgt

SEQ ID NO: 699408 - DNA, 25 bp, Mus musculus
ggaagtcgctatccatcgtcatctg

SEQ ID NO: 699409 - DNA, 25 bp, Mus musculus
ggaagtcgctatgcatcgtcatctg

SEQ ID NO: 699410 - DNA, 25 bp, Mus musculus
ggaagtctatgcatgggcaccgaag

SEQ ID NO: 699411 - DNA, 25 bp, Mus musculus
ggaagtctatgcttgggcaccgaag

SEQ ID NO: 699412 - DNA, 25 bp, Mus musculus
ggaagtctcactcccagaagcaagc

SEQ ID NO: 699413 - DNA, 25 bp, Mus musculus
ggaagtctcactgccagaagcaagc

SEQ ID NO: 699414 - DNA, 25 bp, Mus musculus
ggaagtctcagaccacaactatgag

SEQ ID NO: 699415 - DNA, 25 bp, Mus musculus
ggaagtctcagagcacaactatgag

SEQ ID NO: 699416 - DNA, 25 bp, Mus musculus
ggaagtctctgcagcttggggccca

SEQ ID NO: 699417 - DNA, 25 bp, Mus musculus
ggaagtctctgctgcttggggccca

SEQ ID NO: 699418 - DNA, 25 bp, Mus musculus
ggaagtctctgtattcacatatcat

SEQ ID NO: 699419 - DNA, 25 bp, Mus musculus
ggaagtctctgttttcacatatcat

SEQ ID NO: 699420 - DNA, 25 bp, Mus musculus
ggaagtctggcaacaaaataatgag

SEQ ID NO: 699421 - DNA, 25 bp, Mus musculus
ggaagtctggcatcaaaataatgag

SEQ ID NO: 699422 - DNA, 25 bp, Mus musculus
ggaagtctggccctgatcctgagat

SEQ ID NO: 699423 - DNA, 25 bp, Mus musculus
ggaagtctggccgtgatcctgagat

SEQ ID NO: 699424 - DNA, 25 bp, Mus musculus
ggaagtctggtaacacttccctgct

SEQ ID NO: 699425 - DNA, 25 bp, Mus musculus
ggaagtctggtatcacttccctgct

SEQ ID NO: 699426 - DNA, 25 bp, Mus musculus
ggaagtcttcggagcctactctgca

SEQ ID NO: 699427 - DNA, 25 bp, Mus musculus
ggaagtcttcggtgcctactctgca

SEQ ID NO: 699428 - DNA, 25 bp, Mus musculus
ggaagtcttgctcacgccatgtccc

SEQ ID NO: 699429 - DNA, 25 bp, Mus musculus
ggaagtcttgctgacgccatgtccc

SEQ ID NO: 699430 - DNA, 25 bp, Mus musculus
ggaagtctttaaagccaagcaccgt

SEQ ID NO: 699431 - DNA, 25 bp, Mus musculus
ggaagtctttaatgccaagcaccgt

SEQ ID NO: 699432 - DNA, 25 bp, Mus musculus
ggaagtgaagatactcgtctttgat

SEQ ID NO: 699433 - DNA, 25 bp, Mus musculus
ggaagtgaagattctcgtctttgat

SEQ ID NO: 699434 - DNA, 25 bp, Mus musculus
ggaagtgaaggcagcttcccgcctc

SEQ ID NO: 699435 - DNA, 25 bp, Mus musculus
ggaagtgaaggctgcttcccgcctc

SEQ ID NO: 699436 - DNA, 25 bp, Mus musculus
ggaagtgaccacctttcgagaaaag

SEQ ID NO: 699437 - DNA, 25 bp, Mus musculus
ggaagtgaccacgtttcgagaaaag

SEQ ID NO: 699438 - DNA, 25 bp, Mus musculus
ggaagtgactaaacagtgcatggca

SEQ ID NO: 699439 - DNA, 25 bp, Mus musculus
ggaagtgactaatcagtgcatggca

SEQ ID NO: 699440 - DNA, 25 bp, Mus musculus
ggaagtgactttcacctcagaatag

SEQ ID NO: 699441 - DNA, 25 bp, Mus musculus
ggaagtgactttgacctcagaatag

SEQ ID NO: 699442 - DNA, 25 bp, Mus musculus
ggaagtgatgagctatggagaacgg

SEQ ID NO: 699443 - DNA, 25 bp, Mus musculus
ggaagtgatgaggtatggagaacgg

SEQ ID NO: 699444 - DNA, 25 bp, Mus musculus
ggaagtgattgaaggctaccagaag

SEQ ID NO: 699445 - DNA, 25 bp, Mus musculus
ggaagtgattgatggctaccagaag

SEQ ID NO: 699446 - DNA, 25 bp, Mus musculus
ggaagtggaaaacaaggcgatcatt

SEQ ID NO: 699447 - DNA, 25 bp, Mus musculus
ggaagtggaaaagaaggcgatcatt

SEQ ID NO: 699448 - DNA, 25 bp, Mus musculus
ggaagtggacaccacctaccaattc

SEQ ID NO: 699449 - DNA, 25 bp, Mus musculus
ggaagtggacacgacctaccaattc

SEQ ID NO: 699450 - DNA, 25 bp, Mus musculus
ggaagtggccaaaatgacctcagtg

SEQ ID NO: 699451 - DNA, 25 bp, Mus musculus
ggaagtggccaatatgacctcagtg

SEQ ID NO: 699452 - DNA, 25 bp, Mus musculus
ggaagtggccacctacaccttcatc

SEQ ID NO: 699453 - DNA, 25 bp, Mus musculus
ggaagtggccacgtacaccttcatc

SEQ ID NO: 699454 - DNA, 25 bp, Mus musculus
ggaagtggccatcaaacctcaatat

SEQ ID NO: 699455 - DNA, 25 bp, Mus musculus
ggaagtggccatgaaacctcaatat

SEQ ID NO: 699456 - DNA, 25 bp, Mus musculus
ggaagtgggaggacctgcctccgca

SEQ ID NO: 699457 - DNA, 25 bp, Mus musculus
ggaagtgggaggtcctgcctccgca

SEQ ID NO: 699458 - DNA, 25 bp, Mus musculus
ggaagtggtaagaacatttgcttag

SEQ ID NO: 699459 - DNA, 25 bp, Mus musculus
ggaagtggtaagtacatttgcttag

SEQ ID NO: 699460 - DNA, 25 bp, Mus musculus
ggaagtggtagactgcacaattaaa

SEQ ID NO: 699461 - DNA, 25 bp, Mus musculus
ggaagtggtagagtgcacaattaaa

SEQ ID NO: 699462 - DNA, 25 bp, Mus musculus
ggaagtgtcacaccctaacggcgtc

SEQ ID NO: 699463 - DNA, 25 bp, Mus musculus
ggaagtgtcacagcctaacggcgtc

SEQ ID NO: 699464 - DNA, 25 bp, Mus musculus
ggaagtgtctcgaattgtgggcaaa

SEQ ID NO: 699465 - DNA, 25 bp, Mus musculus
ggaagtgtctcgtattgtgggcaaa

SEQ ID NO: 699466 - DNA, 25 bp, Mus musculus
ggaagttatttcacctgcttacaag

SEQ ID NO: 699467 - DNA, 25 bp, Mus musculus
ggaagttatttctcctgcttacaag

SEQ ID NO: 699468 - DNA, 25 bp, Mus musculus
ggaagttcacacagagccgatgggt

SEQ ID NO: 699469 - DNA, 25 bp, Mus musculus
ggaagttcacactgagccgatgggt

SEQ ID NO: 699470 - DNA, 25 bp, Mus musculus
ggaagttcctatccgtgggtcttca

SEQ ID NO: 699471 - DNA, 25 bp, Mus musculus
ggaagttcctatgcgtgggtcttca

SEQ ID NO: 699472 - DNA, 25 bp, Mus musculus
ggaagttcgtggaaggcaatgctca

SEQ ID NO: 699473 - DNA, 25 bp, Mus musculus
ggaagttcgtggtaggcaatgctca

SEQ ID NO: 699474 - DNA, 25 bp, Mus musculus
ggaagttcgtttcaaaacaggcagt

SEQ ID NO: 699475 - DNA, 25 bp, Mus musculus
ggaagttcgtttcttgaatagcaca

SEQ ID NO: 699476 - DNA, 25 bp, Mus musculus
ggaagttcgtttgaaaacaggcagt

SEQ ID NO: 699477 - DNA, 25 bp, Mus musculus
ggaagttcgtttgttgaatagcaca

SEQ ID NO: 699478 - DNA, 25 bp, Mus musculus
ggaagttctttcaggcaccctagga

SEQ ID NO: 699479 - DNA, 25 bp, Mus musculus
ggaagttctttctggcaccctagga

SEQ ID NO: 699480 - DNA, 25 bp, Mus musculus
ggaagttgacacactggagaccact

SEQ ID NO: 699481 - DNA, 25 bp, Mus musculus
ggaagttgacactctggagaccact

SEQ ID NO: 699482 - DNA, 25 bp, Mus musculus
ggaagttgccacaatgaaggacttt

SEQ ID NO: 699483 - DNA, 25 bp, Mus musculus
ggaagttgccactatgaaggacttt

SEQ ID NO: 699484 - DNA, 25 bp, Mus musculus
ggaagttgcgatagcagaagctctt

SEQ ID NO: 699485 - DNA, 25 bp, Mus musculus
ggaagttgcgattgcagaagctctt

SEQ ID NO: 699486 - DNA, 25 bp, Mus musculus
ggaagttggaagatcagaatgagta

SEQ ID NO: 699487 - DNA, 25 bp, Mus musculus
ggaagttggaagttcagaatgagta

SEQ ID NO: 699488 - DNA, 25 bp, Mus musculus
ggaagtttaccactctatcggccac

SEQ ID NO: 699489 - DNA, 25 bp, Mus musculus
ggaagtttaccagtctatcggccac

SEQ ID NO: 699490 - DNA, 25 bp, Mus musculus
ggaagtttacccagaagccaatgca

SEQ ID NO: 699491 - DNA, 25 bp, Mus musculus
ggaagtttaccctgaagccaatgca

SEQ ID NO: 699492 - DNA, 25 bp, Mus musculus
ggaagtttatctccaaagactgtac

SEQ ID NO: 699493 - DNA, 25 bp, Mus musculus
ggaagtttatctgcaaagactgtac

SEQ ID NO: 699494 - DNA, 25 bp, Mus musculus
ggaagtttatgaagatgtcctcttc

SEQ ID NO: 699495 - DNA, 25 bp, Mus musculus
ggaagtttatgatgatgtcctcttc

SEQ ID NO: 699496 - DNA, 25 bp, Mus musculus
ggaagtttccataactacaactaga

SEQ ID NO: 699497 - DNA, 25 bp, Mus musculus
ggaagtttccattactacaactaga

SEQ ID NO: 699498 - DNA, 25 bp, Mus musculus
ggaagtttcccacctctggtcagtg

SEQ ID NO: 699499 - DNA, 25 bp, Mus musculus
ggaagtttcccagctctggtcagtg

SEQ ID NO: 699500 - DNA, 25 bp, Mus musculus
ggaagtttctctaccctccagagct

SEQ ID NO: 699501 - DNA, 25 bp, Mus musculus
ggaagtttctcttccctccagagct

SEQ ID NO: 699502 - DNA, 25 bp, Mus musculus
ggaagtttgataatcttgtctcaaa

SEQ ID NO: 699503 - DNA, 25 bp, Mus musculus
ggaagtttgatattcttgtctcaaa

SEQ ID NO: 699504 - DNA, 25 bp, Mus musculus
ggaagtttggatcagaaattagccc

SEQ ID NO: 699505 - DNA, 25 bp, Mus musculus
ggaagtttggatgagaaattagccc

SEQ ID NO: 699506 - DNA, 25 bp, Mus musculus
ggaagtttgtcaaccaccctgagag

SEQ ID NO: 699507 - DNA, 25 bp, Mus musculus
ggaagtttgtcatccaccctgagag

SEQ ID NO: 699508 - DNA, 25 bp, Mus musculus
ggaagttttagaagggtacttcagc

SEQ ID NO: 699509 - DNA, 25 bp, Mus musculus
ggaagttttagatgggtacttcagc

SEQ ID NO: 699510 - DNA, 25 bp, Mus musculus
ggaataaaatttacttgtcaccttg

SEQ ID NO: 699511 - DNA, 25 bp, Mus musculus
ggaataaaattttcttgtcaccttg

SEQ ID NO: 699512 - DNA, 25 bp, Mus musculus
ggaataaagtccacctccttctgag

SEQ ID NO: 699513 - DNA, 25 bp, Mus musculus
ggaataaagtcctcctccttctgag

SEQ ID NO: 699514 - DNA, 25 bp, Mus musculus
ggaataactcctaccagacaagaag

SEQ ID NO: 699515 - DNA, 25 bp, Mus musculus
ggaataactccttccagacaagaag

SEQ ID NO: 699516 - DNA, 25 bp, Mus musculus
ggaataatacccatatttctcgagt

SEQ ID NO: 699517 - DNA, 25 bp, Mus musculus
ggaataatacccttatttctcgagt

SEQ ID NO: 699518 - DNA, 25 bp, Mus musculus
ggaataatacctccaaaaggctgtt

SEQ ID NO: 699519 - DNA, 25 bp, Mus musculus
ggaataatacctgcaaaaggctgtt

SEQ ID NO: 699520 - DNA, 25 bp, Mus musculus
ggaataatctatagttaaatgcctc

SEQ ID NO: 699521 - DNA, 25 bp, Mus musculus
ggaataatctattgttaaatgcctc

SEQ ID NO: 699522 - DNA, 25 bp, Mus musculus
ggaataatgacaaaaagccctgata

SEQ ID NO: 699523 - DNA, 25 bp, Mus musculus
ggaataatgacataaagccctgata

SEQ ID NO: 699524 - DNA, 25 bp, Mus musculus
ggaataattaatcctgtgattgaac

SEQ ID NO: 699525 - DNA, 25 bp, Mus musculus
ggaataattaatgctgtgattgaac

SEQ ID NO: 699526 - DNA, 25 bp, Mus musculus
ggaatacacagaaacaggctatgaa

SEQ ID NO: 699527 - DNA, 25 bp, Mus musculus
ggaatacacagatacaggctatgaa

SEQ ID NO: 699528 - DNA, 25 bp, Mus musculus
ggaatacaggaaattctttagagca

SEQ ID NO: 699529 - DNA, 25 bp, Mus musculus
ggaatacaggaatttctttagagca

SEQ ID NO: 699530 - DNA, 25 bp, Mus musculus
ggaatacagtcccttgttcaacaga

SEQ ID NO: 699531 - DNA, 25 bp, Mus musculus
ggaatacagtccgttgttcaacaga

SEQ ID NO: 699532 - DNA, 25 bp, Mus musculus
ggaatacatccaacttgtagagcaa

SEQ ID NO: 699533 - DNA, 25 bp, Mus musculus
ggaatacatccatcttgtagagcaa

SEQ ID NO: 699534 - DNA, 25 bp, Mus musculus
ggaatacatggcaaagaagcccaag

SEQ ID NO: 699535 - DNA, 25 bp, Mus musculus
ggaatacatggctaagaagcccaag

SEQ ID NO: 699536 - DNA, 25 bp, Mus musculus
ggaatacattgaactgatggagaca

SEQ ID NO: 699537 - DNA, 25 bp, Mus musculus
ggaatacattgatctgatggagaca

SEQ ID NO: 699538 - DNA, 25 bp, Mus musculus
ggaataccatacagataccactgtg

SEQ ID NO: 699539 - DNA, 25 bp, Mus musculus
ggaataccatactgataccactgtg

SEQ ID NO: 699540 - DNA, 25 bp, Mus musculus
ggaatacccctaatgaagacgacag

SEQ ID NO: 699541 - DNA, 25 bp, Mus musculus
ggaatacccctattgaagacgacag

SEQ ID NO: 699542 - DNA, 25 bp, Mus musculus
ggaataccctgaaactcggaatcag

SEQ ID NO: 699543 - DNA, 25 bp, Mus musculus
ggaataccctgatactcggaatcag

SEQ ID NO: 699544 - DNA, 25 bp, Mus musculus
ggaatacctacccactgataaaact

SEQ ID NO: 699545 - DNA, 25 bp, Mus musculus
ggaatacctaccgactgataaaact

SEQ ID NO: 699546 - DNA, 25 bp, Mus musculus
ggaatacctccgagcccggaggcca

SEQ ID NO: 699547 - DNA, 25 bp, Mus musculus
ggaatacctccgtgcccggaggcca

SEQ ID NO: 699548 - DNA, 25 bp, Mus musculus
ggaatacgaggacttttcagcaaca

SEQ ID NO: 699549 - DNA, 25 bp, Mus musculus
ggaatacgaggagttttcagcaaca

SEQ ID NO: 699550 - DNA, 25 bp, Mus musculus
ggaatactaagaacccactcagggc

SEQ ID NO: 699551 - DNA, 25 bp, Mus musculus
ggaatactaagatcccactcagggc

SEQ ID NO: 699552 - DNA, 25 bp, Mus musculus
ggaatactaagcaccaccctgagga

SEQ ID NO: 699553 - DNA, 25 bp, Mus musculus
ggaatactaagctccaccctgagga

SEQ ID NO: 699554 - DNA, 25 bp, Mus musculus
ggaatactatgacgaagagagctgc

SEQ ID NO: 699555 - DNA, 25 bp, Mus musculus
ggaatactatgaggaagagagctgc

SEQ ID NO: 699556 - DNA, 25 bp, Mus musculus
ggaatactctggctgtctgcaagta

SEQ ID NO: 699557 - DNA, 25 bp, Mus musculus
ggaatactctgggtgtctgcaagta

SEQ ID NO: 699558 - DNA, 25 bp, Mus musculus
ggaatactgccaccatgagacggct

SEQ ID NO: 699559 - DNA, 25 bp, Mus musculus
ggaatactgccagcatgagacggct

SEQ ID NO: 699560 - DNA, 25 bp, Mus musculus
ggaatacttggccatctttaagaag

SEQ ID NO: 699561 - DNA, 25 bp, Mus musculus
ggaatacttggcgatctttaagaag

SEQ ID NO: 699562 - DNA, 25 bp, Mus musculus
ggaatagaacctcttttggaaagtg

SEQ ID NO: 699563 - DNA, 25 bp, Mus musculus
ggaatagaacctgttttggaaagtg

SEQ ID NO: 699564 - DNA, 25 bp, Mus musculus
ggaatagaatttccaaccctttgag

SEQ ID NO: 699565 - DNA, 25 bp, Mus musculus
ggaatagaatttgcaaccctttgag

SEQ ID NO: 699566 - DNA, 25 bp, Mus musculus
ggaatagattctcttctccgaaaaa

SEQ ID NO: 699567 - DNA, 25 bp, Mus musculus
ggaatagattctgttctccgaaaaa

SEQ ID NO: 699568 - DNA, 25 bp, Mus musculus
ggaatagatttaaaaatccaatcca

SEQ ID NO: 699569 - DNA, 25 bp, Mus musculus
ggaatagatttataaatccaatcca

SEQ ID NO: 699570 - DNA, 25 bp, Mus musculus
ggaatagccaccacttgaccagtca

SEQ ID NO: 699571 - DNA, 25 bp, Mus musculus
ggaatagccacctcttgaccagtca

SEQ ID NO: 699572 - DNA, 25 bp, Mus musculus
ggaatagccaggaagaacgagagca

SEQ ID NO: 699573 - DNA, 25 bp, Mus musculus
ggaatagccaggtagaacgagagca

SEQ ID NO: 699574 - DNA, 25 bp, Mus musculus
ggaatagcctgtccttatgccgtga

SEQ ID NO: 699575 - DNA, 25 bp, Mus musculus
ggaatagcctgtgcttatgccgtga

SEQ ID NO: 699576 - DNA, 25 bp, Mus musculus
ggaatagcttctccagcaatgatta

SEQ ID NO: 699577 - DNA, 25 bp, Mus musculus
ggaatagcttctgcagcaatgatta

SEQ ID NO: 699578 - DNA, 25 bp, Mus musculus
ggaatagctttgatccttagccacg

SEQ ID NO: 699579 - DNA, 25 bp, Mus musculus
ggaatagctttgttccttagccacg

SEQ ID NO: 699580 - DNA, 25 bp, Mus musculus
ggaatatatgtgagctcatgacaag

SEQ ID NO: 699581 - DNA, 25 bp, Mus musculus
ggaatatatgtgtgctcatgacaag

SEQ ID NO: 699582 - DNA, 25 bp, Mus musculus
ggaatatcattcctgctatagctac

SEQ ID NO: 699583 - DNA, 25 bp, Mus musculus
ggaatatcattcgtgctatagctac

SEQ ID NO: 699584 - DNA, 25 bp, Mus musculus
ggaatatcggaacaagacacacagg

SEQ ID NO: 699585 - DNA, 25 bp, Mus musculus
ggaatatcggaagaagacacacagg

SEQ ID NO: 699586 - DNA, 25 bp, Mus musculus
ggaatatctgatccaggagctccga

SEQ ID NO: 699587 - DNA, 25 bp, Mus musculus
ggaatatctgatgcaggagctccga

SEQ ID NO: 699588 - DNA, 25 bp, Mus musculus
ggaatatgaagaccatcccgatgag

SEQ ID NO: 699589 - DNA, 25 bp, Mus musculus
ggaatatgaagagcatcccgatgag

SEQ ID NO: 699590 - DNA, 25 bp, Mus musculus
ggaatatgagttcttccctgaagaa

SEQ ID NO: 699591 - DNA, 25 bp, Mus musculus
ggaatatgagttgttccctgaagaa

SEQ ID NO: 699592 - DNA, 25 bp, Mus musculus
ggaatatgctgacagttttggaaag

SEQ ID NO: 699593 - DNA, 25 bp, Mus musculus
ggaatatgctgagagttttggaaag

SEQ ID NO: 699594 - DNA, 25 bp, Mus musculus
ggaatatgtcacatgtcacacatgc

SEQ ID NO: 699595 - DNA, 25 bp, Mus musculus
ggaatatgtcacttgtcacacatgc

SEQ ID NO: 699596 - DNA, 25 bp, Mus musculus
ggaatatgtcgacttagagagagaa

SEQ ID NO: 699597 - DNA, 25 bp, Mus musculus
ggaatatgtcgagttagagagagaa

SEQ ID NO: 699598 - DNA, 25 bp, Mus musculus
ggaatattccagatatcgggcagcc

SEQ ID NO: 699599 - DNA, 25 bp, Mus musculus
ggaatattccagttatcgggcagcc

SEQ ID NO: 699600 - DNA, 25 bp, Mus musculus
ggaatattggatccgtcctgtcctg

SEQ ID NO: 699601 - DNA, 25 bp, Mus musculus
ggaatattggatgcgtcctgtcctg

SEQ ID NO: 699602 - DNA, 25 bp, Mus musculus
ggaatcaaagacaccatctggggca

SEQ ID NO: 699603 - DNA, 25 bp, Mus musculus
ggaatcaaagactccatctggggca

SEQ ID NO: 699604 - DNA, 25 bp, Mus musculus
ggaatcaacaggagtgctgacttcc

SEQ ID NO: 699605 - DNA, 25 bp, Mus musculus
ggaatcaacaggtgtgctgacttcc

SEQ ID NO: 699606 - DNA, 25 bp, Mus musculus
ggaatcaacgaacgagttcttcaca

SEQ ID NO: 699607 - DNA, 25 bp, Mus musculus
ggaatcaacgaaggagttcttcaca

SEQ ID NO: 699608 - DNA, 25 bp, Mus musculus
ggaatcaacggaaaaatgcgaagct

SEQ ID NO: 699609 - DNA, 25 bp, Mus musculus
ggaatcaacggataaatgcgaagct

SEQ ID NO: 699610 - DNA, 25 bp, Mus musculus
ggaatcacaaagctcaagccaaatg

SEQ ID NO: 699611 - DNA, 25 bp, Mus musculus
ggaatcacaaaggtcaagccaaatg

SEQ ID NO: 699612 - DNA, 25 bp, Mus musculus
ggaatcacagtcacactagaccaga

SEQ ID NO: 699613 - DNA, 25 bp, Mus musculus
ggaatcacagtctcactagaccaga

SEQ ID NO: 699614 - DNA, 25 bp, Mus musculus
ggaatcaccgctctccagttgctac

SEQ ID NO: 699615 - DNA, 25 bp, Mus musculus
ggaatcaccgctgtccagttgctac

SEQ ID NO: 699616 - DNA, 25 bp, Mus musculus
ggaatcacttctcggacaatgaggc

SEQ ID NO: 699617 - DNA, 25 bp, Mus musculus
ggaatcacttctgggacaatgaggc

SEQ ID NO: 699618 - DNA, 25 bp, Mus musculus
ggaatcactttaagagcgggcactg

SEQ ID NO: 699619 - DNA, 25 bp, Mus musculus
ggaatcactttatgagcgggcactg

SEQ ID NO: 699620 - DNA, 25 bp, Mus musculus
ggaatcagcggaagtagtggccttc

SEQ ID NO: 699621 - DNA, 25 bp, Mus musculus
ggaatcagcggatgtagtggccttc

SEQ ID NO: 699622 - DNA, 25 bp, Mus musculus
ggaatcagctttccccaaacagaca

SEQ ID NO: 699623 - DNA, 25 bp, Mus musculus
ggaatcagctttgcccaaacagaca

SEQ ID NO: 699624 - DNA, 25 bp, Mus musculus
ggaatcatagttcgcgtcttgttag

SEQ ID NO: 699625 - DNA, 25 bp, Mus musculus
ggaatcatagttggcgtcttgttag

SEQ ID NO: 699626 - DNA, 25 bp, Mus musculus
ggaatccaaaatcctacaaagaagt

SEQ ID NO: 699627 - DNA, 25 bp, Mus musculus
ggaatccaaaatgctacaaagaagt

SEQ ID NO: 699628 - DNA, 25 bp, Mus musculus
ggaatccaaatccaggatcgacgtg

SEQ ID NO: 699629 - DNA, 25 bp, Mus musculus
ggaatccaaatcgaggatcgacgtg

SEQ ID NO: 699630 - DNA, 25 bp, Mus musculus
ggaatccaactactccatccatctg

SEQ ID NO: 699631 - DNA, 25 bp, Mus musculus
ggaatccaactagtccatccatctg

SEQ ID NO: 699632 - DNA, 25 bp, Mus musculus
ggaatccaagaacccaccagctaaa

SEQ ID NO: 699633 - DNA, 25 bp, Mus musculus
ggaatccaagaagccaccagctaaa

SEQ ID NO: 699634 - DNA, 25 bp, Mus musculus
ggaatccacattctcgcctttgcag

SEQ ID NO: 699635 - DNA, 25 bp, Mus musculus
ggaatccacattgtcgcctttgcag

SEQ ID NO: 699636 - DNA, 25 bp, Mus musculus
ggaatccagcatcgcaggcacaagt

SEQ ID NO: 699637 - DNA, 25 bp, Mus musculus
ggaatccagcatggcaggcacaagt

SEQ ID NO: 699638 - DNA, 25 bp, Mus musculus
ggaatccagttcatcacgttagctg

SEQ ID NO: 699639 - DNA, 25 bp, Mus musculus
ggaatccagttcttcacgttagctg

SEQ ID NO: 699640 - DNA, 25 bp, Mus musculus
ggaatccatagcagaggaataggct

SEQ ID NO: 699641 - DNA, 25 bp, Mus musculus
ggaatccatagctgaggaataggct

SEQ ID NO: 699642 - DNA, 25 bp, Mus musculus
ggaatccattctatgcgtgcctggg

SEQ ID NO: 699643 - DNA, 25 bp, Mus musculus
ggaatccattctttgcgtgcctggg

SEQ ID NO: 699644 - DNA, 25 bp, Mus musculus
ggaatcccaaccactcttcgtaaca

SEQ ID NO: 699645 - DNA, 25 bp, Mus musculus
ggaatcccaacctctcttcgtaaca

SEQ ID NO: 699646 - DNA, 25 bp, Mus musculus
ggaatccctcggaacagcacagagg

SEQ ID NO: 699647 - DNA, 25 bp, Mus musculus
ggaatccctcggtacagcacagagg

SEQ ID NO: 699648 - DNA, 25 bp, Mus musculus
ggaatccctctacaccagtgccagg

SEQ ID NO: 699649 - DNA, 25 bp, Mus musculus
ggaatccctctagaccagtgccagg

SEQ ID NO: 699650 - DNA, 25 bp, Mus musculus
ggaatccgtggtctcccaggcatta

SEQ ID NO: 699651 - DNA, 25 bp, Mus musculus
ggaatccgtggtgtcccaggcatta

SEQ ID NO: 699652 - DNA, 25 bp, Mus musculus
ggaatcctacccacagcccgagatt

SEQ ID NO: 699653 - DNA, 25 bp, Mus musculus
ggaatcctaccctcagcccgagatt

SEQ ID NO: 699654 - DNA, 25 bp, Mus musculus
ggaatcctagatacatgaatcaact

SEQ ID NO: 699655 - DNA, 25 bp, Mus musculus
ggaatcctagattcatgaatcaact

SEQ ID NO: 699656 - DNA, 25 bp, Mus musculus
ggaatcctcattccaaaatcacaga

SEQ ID NO: 699657 - DNA, 25 bp, Mus musculus
ggaatcctcattgcaaaatcacaga

SEQ ID NO: 699658 - DNA, 25 bp, Mus musculus
ggaatcctgattctgtgggacccat

SEQ ID NO: 699659 - DNA, 25 bp, Mus musculus
ggaatcctgattgtgtgggacccat

SEQ ID NO: 699660 - DNA, 25 bp, Mus musculus
ggaatcctgggacctttcgtcttgc

SEQ ID NO: 699661 - DNA, 25 bp, Mus musculus
ggaatcctgggagctttcgtcttgc

SEQ ID NO: 699662 - DNA, 25 bp, Mus musculus
ggaatcctggttaacaccccgacag

SEQ ID NO: 699663 - DNA, 25 bp, Mus musculus
ggaatcctggtttacaccccgacag

SEQ ID NO: 699664 - DNA, 25 bp, Mus musculus
ggaatccttacaactatggctgctt

SEQ ID NO: 699665 - DNA, 25 bp, Mus musculus
ggaatccttacatctatggctgctt

SEQ ID NO: 699666 - DNA, 25 bp, Mus musculus
ggaatccttgatcgaaacctcatga

SEQ ID NO: 699667 - DNA, 25 bp, Mus musculus
ggaatccttgatggaaacctcatga

SEQ ID NO: 699668 - DNA, 25 bp, Mus musculus
ggaatcgcagccactgccggcttca

SEQ ID NO: 699669 - DNA, 25 bp, Mus musculus
ggaatcgcagcctctgccggcttca

SEQ ID NO: 699670 - DNA, 25 bp, Mus musculus
ggaatcgctagacttgcagtgcatg

SEQ ID NO: 699671 - DNA, 25 bp, Mus musculus
ggaatcgctagagttgcagtgcatg

SEQ ID NO: 699672 - DNA, 25 bp, Mus musculus
ggaatcgctcctacaactccgcggg

SEQ ID NO: 699673 - DNA, 25 bp, Mus musculus
ggaatcgctccttcaactccgcggg

SEQ ID NO: 699674 - DNA, 25 bp, Mus musculus
ggaatcggaccaacttactcctcca

SEQ ID NO: 699675 - DNA, 25 bp, Mus musculus
ggaatcggaccatcttactcctcca

SEQ ID NO: 699676 - DNA, 25 bp, Mus musculus
ggaatcggacctagctatgagaacc

SEQ ID NO: 699677 - DNA, 25 bp, Mus musculus
ggaatcggaccttgctatgagaacc

SEQ ID NO: 699678 - DNA, 25 bp, Mus musculus
ggaatcggccctcgatctctgctgt

SEQ ID NO: 699679 - DNA, 25 bp, Mus musculus
ggaatcggccctggatctctgctgt

SEQ ID NO: 699680 - DNA, 25 bp, Mus musculus
ggaatcgtggccacttagacctcaa

SEQ ID NO: 699681 - DNA, 25 bp, Mus musculus
ggaatcgtggcctcttagacctcaa

SEQ ID NO: 699682 - DNA, 25 bp, Mus musculus
ggaatcgtgggaactgcttactgtg

SEQ ID NO: 699683 - DNA, 25 bp, Mus musculus
ggaatcgtgggatctgcttactgtg

SEQ ID NO: 699684 - DNA, 25 bp, Mus musculus
ggaatctataccagctgcagcaaaa

SEQ ID NO: 699685 - DNA, 25 bp, Mus musculus
ggaatctatacctgctgcagcaaaa

SEQ ID NO: 699686 - DNA, 25 bp, Mus musculus
ggaatctatataaccggctcatcca

SEQ ID NO: 699687 - DNA, 25 bp, Mus musculus
ggaatctatatatccggctcatcca

SEQ ID NO: 699688 - DNA, 25 bp, Mus musculus
ggaatctcgcctagcagcctcctat

SEQ ID NO: 699689 - DNA, 25 bp, Mus musculus
ggaatctcgccttgcagcctcctat

SEQ ID NO: 699690 - DNA, 25 bp, Mus musculus
ggaatctctgctacatctaccacgt

SEQ ID NO: 699691 - DNA, 25 bp, Mus musculus
ggaatctctgcttcatctaccacgt

SEQ ID NO: 699692 - DNA, 25 bp, Mus musculus
ggaatctctgtcacccttctgggac

SEQ ID NO: 699693 - DNA, 25 bp, Mus musculus
ggaatctctgtctcccttctgggac

SEQ ID NO: 699694 - DNA, 25 bp, Mus musculus
ggaatctcttgcacatgtctggcta

SEQ ID NO: 699695 - DNA, 25 bp, Mus musculus
ggaatctcttgctcatgtctggcta

SEQ ID NO: 699696 - DNA, 25 bp, Mus musculus
ggaatctgaaatatgagagagaaac

SEQ ID NO: 699697 - DNA, 25 bp, Mus musculus
ggaatctgaaatttgagagagaaac

SEQ ID NO: 699698 - DNA, 25 bp, Mus musculus
ggaatctgatgccttttaccactag

SEQ ID NO: 699699 - DNA, 25 bp, Mus musculus
ggaatctgatgcgttttaccactag

SEQ ID NO: 699700 - DNA, 25 bp, Mus musculus
ggaatctgctatcaggcttaactgc

SEQ ID NO: 699701 - DNA, 25 bp, Mus musculus
ggaatctgctatgaggcttaactgc

SEQ ID NO: 699702 - DNA, 25 bp, Mus musculus
ggaatctggcacactgcctccaggg

SEQ ID NO: 699703 - DNA, 25 bp, Mus musculus
ggaatctggcactctgcctccaggg

SEQ ID NO: 699704 - DNA, 25 bp, Mus musculus
ggaatctggcagatctccgccgtag

SEQ ID NO: 699705 - DNA, 25 bp, Mus musculus
ggaatctggcagttctccgccgtag

SEQ ID NO: 699706 - DNA, 25 bp, Mus musculus
ggaatctggcttctcggtctatgta

SEQ ID NO: 699707 - DNA, 25 bp, Mus musculus
ggaatctggcttgtcggtctatgta

SEQ ID NO: 699708 - DNA, 25 bp, Mus musculus
ggaatctgggacagccttagggaca

SEQ ID NO: 699709 - DNA, 25 bp, Mus musculus
ggaatctgggactgccttagggaca

SEQ ID NO: 699710 - DNA, 25 bp, Mus musculus
ggaatctgtcgcacagatgaccata

SEQ ID NO: 699711 - DNA, 25 bp, Mus musculus
ggaatctgtcgctcagatgaccata

SEQ ID NO: 699712 - DNA, 25 bp, Mus musculus
ggaatctgttatccccgtcacctga

SEQ ID NO: 699713 - DNA, 25 bp, Mus musculus
ggaatctgttatgcccgtcacctga

SEQ ID NO: 699714 - DNA, 25 bp, Mus musculus
ggaatcttagccaacagaaacaccg

SEQ ID NO: 699715 - DNA, 25 bp, Mus musculus
ggaatcttagcctacagaaacaccg

SEQ ID NO: 699716 - DNA, 25 bp, Mus musculus
ggaatcttcggtctttgccaccatg

SEQ ID NO: 699717 - DNA, 25 bp, Mus musculus
ggaatcttcggtgtttgccaccatg

SEQ ID NO: 699718 - DNA, 25 bp, Mus musculus
ggaatcttgactacctcaagccttt

SEQ ID NO: 699719 - DNA, 25 bp, Mus musculus
ggaatcttgacttcctcaagccttt

SEQ ID NO: 699720 - DNA, 25 bp, Mus musculus
ggaatgaacagacgtccaattttaa

SEQ ID NO: 699721 - DNA, 25 bp, Mus musculus
ggaatgaacagaggtccaattttaa

SEQ ID NO: 699722 - DNA, 25 bp, Mus musculus
ggaatgaagctgaaacatacagtca

SEQ ID NO: 699723 - DNA, 25 bp, Mus musculus
ggaatgaagctgtaacatacagtca

SEQ ID NO: 699724 - DNA, 25 bp, Mus musculus
ggaatgaatccaccttcgtactaca

SEQ ID NO: 699725 - DNA, 25 bp, Mus musculus
ggaatgaatccagcttcgtactaca

SEQ ID NO: 699726 - DNA, 25 bp, Mus musculus
ggaatgaatgcacccgtgcgctctg

SEQ ID NO: 699727 - DNA, 25 bp, Mus musculus
ggaatgaatgcagccgtgcgctctg

SEQ ID NO: 699728 - DNA, 25 bp, Mus musculus
ggaatgaatttcatagctgggtatc

SEQ ID NO: 699729 - DNA, 25 bp, Mus musculus
ggaatgaatttcttagctgggtatc

SEQ ID NO: 699730 - DNA, 25 bp, Mus musculus
ggaatgacattccaaggaacctggc

SEQ ID NO: 699731 - DNA, 25 bp, Mus musculus
ggaatgacattcgaaggaacctggc

SEQ ID NO: 699732 - DNA, 25 bp, Mus musculus
ggaatgaccacacgatctgactctc

SEQ ID NO: 699733 - DNA, 25 bp, Mus musculus
ggaatgaccacaggatctgactctc

SEQ ID NO: 699734 - DNA, 25 bp, Mus musculus
ggaatgacctgactaacttcactag

SEQ ID NO: 699735 - DNA, 25 bp, Mus musculus
ggaatgacctgagtaacttcactag

SEQ ID NO: 699736 - DNA, 25 bp, Mus musculus
ggaatgacgcaacccatgccctcag

SEQ ID NO: 699737 - DNA, 25 bp, Mus musculus
ggaatgacgcaagccatgccctcag

SEQ ID NO: 699738 - DNA, 25 bp, Mus musculus
ggaatgagaaaacagttacccatgg

SEQ ID NO: 699739 - DNA, 25 bp, Mus musculus
ggaatgagaaaagagttacccatgg

SEQ ID NO: 699740 - DNA, 25 bp, Mus musculus
ggaatgagaaagagacgcagtctga

SEQ ID NO: 699741 - DNA, 25 bp, Mus musculus
ggaatgagaaagtgacgcagtctga

SEQ ID NO: 699742 - DNA, 25 bp, Mus musculus
ggaatgagccacagccccgagctgg

SEQ ID NO: 699743 - DNA, 25 bp, Mus musculus
ggaatgagccactgccccgagctgg

SEQ ID NO: 699744 - DNA, 25 bp, Mus musculus
ggaatgagcttacatgactgcctta

SEQ ID NO: 699745 - DNA, 25 bp, Mus musculus
ggaatgagcttagatgactgcctta

SEQ ID NO: 699746 - DNA, 25 bp, Mus musculus
ggaatgagtatcagtctagctctga

SEQ ID NO: 699747 - DNA, 25 bp, Mus musculus
ggaatgagtatctgtctagctctga

SEQ ID NO: 699748 - DNA, 25 bp, Mus musculus
ggaatgagtctccaggctaactgag

SEQ ID NO: 699749 - DNA, 25 bp, Mus musculus
ggaatgagtctcgaggctaactgag

SEQ ID NO: 699750 - DNA, 25 bp, Mus musculus
ggaatgagttctcaaatggccatga

SEQ ID NO: 699751 - DNA, 25 bp, Mus musculus
ggaatgagttctgaaatggccatga

SEQ ID NO: 699752 - DNA, 25 bp, Mus musculus
ggaatgatcgatatgaaggctactg

SEQ ID NO: 699753 - DNA, 25 bp, Mus musculus
ggaatgatcgatttgaaggctactg

SEQ ID NO: 699754 - DNA, 25 bp, Mus musculus
ggaatgatgaggctttactctgagt

SEQ ID NO: 699755 - DNA, 25 bp, Mus musculus
ggaatgatgagggtttactctgagt

SEQ ID NO: 699756 - DNA, 25 bp, Mus musculus
ggaatgcaactccacagctaacact

SEQ ID NO: 699757 - DNA, 25 bp, Mus musculus
ggaatgcaactcgacagctaacact

SEQ ID NO: 699758 - DNA, 25 bp, Mus musculus
ggaatgcaatttcggcgccagctcc

SEQ ID NO: 699759 - DNA, 25 bp, Mus musculus
ggaatgcaatttgggcgccagctcc

SEQ ID NO: 699760 - DNA, 25 bp, Mus musculus
ggaatgcagtccctgacatccaggg

SEQ ID NO: 699761 - DNA, 25 bp, Mus musculus
ggaatgcagtccgtgacatccaggg

SEQ ID NO: 699762 - DNA, 25 bp, Mus musculus
ggaatgcattctcctggtgactcag

SEQ ID NO: 699763 - DNA, 25 bp, Mus musculus
ggaatgcattctgctggtgactcag

SEQ ID NO: 699764 - DNA, 25 bp, Mus musculus
ggaatgccaagacagcccacaacaa

SEQ ID NO: 699765 - DNA, 25 bp, Mus musculus
ggaatgccaagagagcccacaacaa

SEQ ID NO: 699766 - DNA, 25 bp, Mus musculus
ggaatgccaagtacgccaacatgtg

SEQ ID NO: 699767 - DNA, 25 bp, Mus musculus
ggaatgccaagttcgccaacatgtg

SEQ ID NO: 699768 - DNA, 25 bp, Mus musculus
ggaatgccaatcactctcactgtgt

SEQ ID NO: 699769 - DNA, 25 bp, Mus musculus
ggaatgccaatctctctcactgtgt

SEQ ID NO: 699770 - DNA, 25 bp, Mus musculus
ggaatgccactgaatgcctagccaa

SEQ ID NO: 699771 - DNA, 25 bp, Mus musculus
ggaatgccactgtatgcctagccaa

SEQ ID NO: 699772 - DNA, 25 bp, Mus musculus
ggaatgccatccatacctggctcag

SEQ ID NO: 699773 - DNA, 25 bp, Mus musculus
ggaatgccatccttacctggctcag

SEQ ID NO: 699774 - DNA, 25 bp, Mus musculus
ggaatgcctctgaccagctttatac

SEQ ID NO: 699775 - DNA, 25 bp, Mus musculus
ggaatgcctctgtccagctttatac

SEQ ID NO: 699776 - DNA, 25 bp, Mus musculus
ggaatgcggcatacagaatcagtgg

SEQ ID NO: 699777 - DNA, 25 bp, Mus musculus
ggaatgcggcattcagaatcagtgg

SEQ ID NO: 699778 - DNA, 25 bp, Mus musculus
ggaatgcttcccaggtcacctacta

SEQ ID NO: 699779 - DNA, 25 bp, Mus musculus
ggaatgcttccctggtcacctacta

SEQ ID NO: 699780 - DNA, 25 bp, Mus musculus
ggaatgctttggagtctcatttgga

SEQ ID NO: 699781 - DNA, 25 bp, Mus musculus
ggaatgctttggtgtctcatttgga

SEQ ID NO: 699782 - DNA, 25 bp, Mus musculus
ggaatggaaatcagttgagatcacc

SEQ ID NO: 699783 - DNA, 25 bp, Mus musculus
ggaatggaaatctgttgagatcacc

SEQ ID NO: 699784 - DNA, 25 bp, Mus musculus
ggaatggagatccttcagaccatga

SEQ ID NO: 699785 - DNA, 25 bp, Mus musculus
ggaatggagatcgttcagaccatga

SEQ ID NO: 699786 - DNA, 25 bp, Mus musculus
ggaatggatcaacaccacactcctc

SEQ ID NO: 699787 - DNA, 25 bp, Mus musculus
ggaatggatcaagaccacactcctc

SEQ ID NO: 699788 - DNA, 25 bp, Mus musculus
ggaatggcacatattgaggcgatca

SEQ ID NO: 699789 - DNA, 25 bp, Mus musculus
ggaatggcacattttgaggcgatca

SEQ ID NO: 699790 - DNA, 25 bp, Mus musculus
ggaatggccctcagtacttctaaca

SEQ ID NO: 699791 - DNA, 25 bp, Mus musculus
ggaatggccctctgtacttctaaca

SEQ ID NO: 699792 - DNA, 25 bp, Mus musculus
ggaatggctataatagcgctgccga

SEQ ID NO: 699793 - DNA, 25 bp, Mus musculus
ggaatggctatattagcgctgccga

SEQ ID NO: 699794 - DNA, 25 bp, Mus musculus
ggaatgggaggcacctaggacccca

SEQ ID NO: 699795 - DNA, 25 bp, Mus musculus
ggaatgggaggctcctaggacccca

SEQ ID NO: 699796 - DNA, 25 bp, Mus musculus
ggaatggtactgacgggagtgccga

SEQ ID NO: 699797 - DNA, 25 bp, Mus musculus
ggaatggtactgtcgggagtgccga

SEQ ID NO: 699798 - DNA, 25 bp, Mus musculus
ggaatggtccctccaatgatgccgg

SEQ ID NO: 699799 - DNA, 25 bp, Mus musculus
ggaatggtccctgcaatgatgccgg

SEQ ID NO: 699800 - DNA, 25 bp, Mus musculus
ggaatggtggtcactaccgggctct

SEQ ID NO: 699801 - DNA, 25 bp, Mus musculus
ggaatggtggtctctaccgggctct

SEQ ID NO: 699802 - DNA, 25 bp, Mus musculus
ggaatggttatgaatttgaccgacc

SEQ ID NO: 699803 - DNA, 25 bp, Mus musculus
ggaatggttatgtatttgaccgacc

SEQ ID NO: 699804 - DNA, 25 bp, Mus musculus
ggaatggtttggctacctgaaccaa

SEQ ID NO: 699805 - DNA, 25 bp, Mus musculus
ggaatggtttgggtacctgaaccaa

SEQ ID NO: 699806 - DNA, 25 bp, Mus musculus
ggaatgtaactcaaagctggacccc

SEQ ID NO: 699807 - DNA, 25 bp, Mus musculus
ggaatgtaactctaagctggacccc

SEQ ID NO: 699808 - DNA, 25 bp, Mus musculus
ggaatgtcagcaatgaccccgatgt

SEQ ID NO: 699809 - DNA, 25 bp, Mus musculus
ggaatgtcagcattgaccccgatgt

SEQ ID NO: 699810 - DNA, 25 bp, Mus musculus
ggaatgtcatgacccactacctacc

SEQ ID NO: 699811 - DNA, 25 bp, Mus musculus
ggaatgtcatgagccactacctacc

SEQ ID NO: 699812 - DNA, 25 bp, Mus musculus
ggaatgtccttgaccctgcctgatc

SEQ ID NO: 699813 - DNA, 25 bp, Mus musculus
ggaatgtccttgtccctgcctgatc

SEQ ID NO: 699814 - DNA, 25 bp, Mus musculus
ggaatgtctccacccttagtatctt

SEQ ID NO: 699815 - DNA, 25 bp, Mus musculus
ggaatgtctccagccttagtatctt

SEQ ID NO: 699816 - DNA, 25 bp, Mus musculus
ggaatgtcttcaatatctgcttcta

SEQ ID NO: 699817 - DNA, 25 bp, Mus musculus
ggaatgtcttcattatctgcttcta

SEQ ID NO: 699818 - DNA, 25 bp, Mus musculus
ggaatgtgcaagatcttctagagta

SEQ ID NO: 699819 - DNA, 25 bp, Mus musculus
ggaatgtgcaagttcttctagagta

SEQ ID NO: 699820 - DNA, 25 bp, Mus musculus
ggaatgtgccagacacaaatcccta

SEQ ID NO: 699821 - DNA, 25 bp, Mus musculus
ggaatgtgccagtcacaaatcccta

SEQ ID NO: 699822 - DNA, 25 bp, Mus musculus
ggaatgtgcccgatgacgtactgca

SEQ ID NO: 699823 - DNA, 25 bp, Mus musculus
ggaatgtgcccgctcccagggcttt

SEQ ID NO: 699824 - DNA, 25 bp, Mus musculus
ggaatgtgcccggtcccagggcttt

SEQ ID NO: 699825 - DNA, 25 bp, Mus musculus
ggaatgtgcccgttgacgtactgca

SEQ ID NO: 699826 - DNA, 25 bp, Mus musculus
ggaatgtggagcctgctaaaagcac

SEQ ID NO: 699827 - DNA, 25 bp, Mus musculus
ggaatgtggagcgtgctaaaagcac

SEQ ID NO: 699828 - DNA, 25 bp, Mus musculus
ggaatgtgtgacatcgacatcagac

SEQ ID NO: 699829 - DNA, 25 bp, Mus musculus
ggaatgtgtgacttcgacatcagac

SEQ ID NO: 699830 - DNA, 25 bp, Mus musculus
ggaatgtgtggcacctgtgctgaac

SEQ ID NO: 699831 - DNA, 25 bp, Mus musculus
ggaatgtgtggctcctgtgctgaac

SEQ ID NO: 699832 - DNA, 25 bp, Mus musculus
ggaattaatgtgaggaaatgcagac

SEQ ID NO: 699833 - DNA, 25 bp, Mus musculus
ggaattaatgtgtggaaatgcagac

SEQ ID NO: 699834 - DNA, 25 bp, Mus musculus
ggaattacacaaagttgaaggctac

SEQ ID NO: 699835 - DNA, 25 bp, Mus musculus
ggaattacacaatgttgaaggctac

SEQ ID NO: 699836 - DNA, 25 bp, Mus musculus
ggaattacgatgctcccgaagccgt

SEQ ID NO: 699837 - DNA, 25 bp, Mus musculus
ggaattacgatggtcccgaagccgt

SEQ ID NO: 699838 - DNA, 25 bp, Mus musculus
ggaattactagacattcgattatga

SEQ ID NO: 699839 - DNA, 25 bp, Mus musculus
ggaattactagagattcgattatga

SEQ ID NO: 699840 - DNA, 25 bp, Mus musculus
ggaattagaacaattaggcgagttc

SEQ ID NO: 699841 - DNA, 25 bp, Mus musculus
ggaattagaacatttaggcgagttc

SEQ ID NO: 699842 - DNA, 25 bp, Mus musculus
ggaattagacttagaactgagcctc

SEQ ID NO: 699843 - DNA, 25 bp, Mus musculus
ggaattagactttgaactgagcctc

SEQ ID NO: 699844 - DNA, 25 bp, Mus musculus
ggaattagcacacgcaactctcatg

SEQ ID NO: 699845 - DNA, 25 bp, Mus musculus
ggaattagcacaggcaactctcatg

SEQ ID NO: 699846 - DNA, 25 bp, Mus musculus
ggaattagccttactggaggccacg

SEQ ID NO: 699847 - DNA, 25 bp, Mus musculus
ggaattagcctttctggaggccacg

SEQ ID NO: 699848 - DNA, 25 bp, Mus musculus
ggaattaggatgcatttgccttgtg

SEQ ID NO: 699849 - DNA, 25 bp, Mus musculus
ggaattaggatggatttgccttgtg

SEQ ID NO: 699850 - DNA, 25 bp, Mus musculus
ggaattatccgccacgaggcagctt

SEQ ID NO: 699851 - DNA, 25 bp, Mus musculus
ggaattatccgcgacgaggcagctt

SEQ ID NO: 699852 - DNA, 25 bp, Mus musculus
ggaattatgctccttctgggacgga

SEQ ID NO: 699853 - DNA, 25 bp, Mus musculus
ggaattatgctcgttctgggacgga

SEQ ID NO: 699854 - DNA, 25 bp, Mus musculus
ggaattcacctgagccttgagagag

SEQ ID NO: 699855 - DNA, 25 bp, Mus musculus
ggaattcacctgtgccttgagagag

SEQ ID NO: 699856 - DNA, 25 bp, Mus musculus
ggaattcagcctactctatgaccaa

SEQ ID NO: 699857 - DNA, 25 bp, Mus musculus
ggaattcagccttctctatgaccaa

SEQ ID NO: 699858 - DNA, 25 bp, Mus musculus
ggaattcagtgtatcctcatcgtgg

SEQ ID NO: 699859 - DNA, 25 bp, Mus musculus
ggaattcagtgtttcctcatcgtgg

SEQ ID NO: 699860 - DNA, 25 bp, Mus musculus
ggaattccagaaaggcaaggtagca

SEQ ID NO: 699861 - DNA, 25 bp, Mus musculus
ggaattccagaatggcaaggtagca

SEQ ID NO: 699862 - DNA, 25 bp, Mus musculus
ggaattccagctcagattaaacttt

SEQ ID NO: 699863 - DNA, 25 bp, Mus musculus
ggaattccagctgagattaaacttt

SEQ ID NO: 699864 - DNA, 25 bp, Mus musculus
ggaattccaggacaccatctcaggt

SEQ ID NO: 699865 - DNA, 25 bp, Mus musculus
ggaattccaggagaccatctcaggt

SEQ ID NO: 699866 - DNA, 25 bp, Mus musculus
ggaattcctagaccccagcaagagg

SEQ ID NO: 699867 - DNA, 25 bp, Mus musculus
ggaattcctagagcccagcaagagg

SEQ ID NO: 699868 - DNA, 25 bp, Mus musculus
ggaattcctagcaaggtccggagtt

SEQ ID NO: 699869 - DNA, 25 bp, Mus musculus
ggaattcctagctaggtccggagtt

SEQ ID NO: 699870 - DNA, 25 bp, Mus musculus
ggaattccttgcaactggagctcag

SEQ ID NO: 699871 - DNA, 25 bp, Mus musculus
ggaattccttgccttcagataacca

SEQ ID NO: 699872 - DNA, 25 bp, Mus musculus
ggaattccttgcgttcagataacca

SEQ ID NO: 699873 - DNA, 25 bp, Mus musculus
ggaattccttgctactggagctcag

SEQ ID NO: 699874 - DNA, 25 bp, Mus musculus
ggaattcggaacagctcgatgcgca

SEQ ID NO: 699875 - DNA, 25 bp, Mus musculus
ggaattcggaactgctcgatgcgca

SEQ ID NO: 699876 - DNA, 25 bp, Mus musculus
ggaattctaactaggcccacaagta

SEQ ID NO: 699877 - DNA, 25 bp, Mus musculus
ggaattctaacttggcccacaagta

SEQ ID NO: 699878 - DNA, 25 bp, Mus musculus
ggaattctaatcagagtgggcatct

SEQ ID NO: 699879 - DNA, 25 bp, Mus musculus
ggaattctaatctgagtgggcatct

SEQ ID NO: 699880 - DNA, 25 bp, Mus musculus
ggaattctatctcactcccagctct

SEQ ID NO: 699881 - DNA, 25 bp, Mus musculus
ggaattctatctgactcccagctct

SEQ ID NO: 699882 - DNA, 25 bp, Mus musculus
ggaattctctctcaagagctgcgtg

SEQ ID NO: 699883 - DNA, 25 bp, Mus musculus
ggaattctctctgaagagctgcgtg

SEQ ID NO: 699884 - DNA, 25 bp, Mus musculus
ggaattctctggactgaactgttta

SEQ ID NO: 699885 - DNA, 25 bp, Mus musculus
ggaattctctggatttcttcgcagg

SEQ ID NO: 699886 - DNA, 25 bp, Mus musculus
ggaattctctggtctgaactgttta

SEQ ID NO: 699887 - DNA, 25 bp, Mus musculus
ggaattctctggttttcttcgcagg

SEQ ID NO: 699888 - DNA, 25 bp, Mus musculus
ggaattctgaccagctctaccagga

SEQ ID NO: 699889 - DNA, 25 bp, Mus musculus
ggaattctgacctgctctaccagga

SEQ ID NO: 699890 - DNA, 25 bp, Mus musculus
ggaattctggcactagatgaacgaa

SEQ ID NO: 699891 - DNA, 25 bp, Mus musculus
ggaattctggcagtagatgaacgaa

SEQ ID NO: 699892 - DNA, 25 bp, Mus musculus
ggaattctgtctattgtcacagaga

SEQ ID NO: 699893 - DNA, 25 bp, Mus musculus
ggaattctgtcttttgtcacagaga

SEQ ID NO: 699894 - DNA, 25 bp, Mus musculus
ggaattgaatgtcgcctcagatttc

SEQ ID NO: 699895 - DNA, 25 bp, Mus musculus
ggaattgaatgtggcctcagatttc

SEQ ID NO: 699896 - DNA, 25 bp, Mus musculus
ggaattgatcacaaaccctgcagag

SEQ ID NO: 699897 - DNA, 25 bp, Mus musculus
ggaattgatcacaccttttcagtta

SEQ ID NO: 699898 - DNA, 25 bp, Mus musculus
ggaattgatcactaaccctgcagag

SEQ ID NO: 699899 - DNA, 25 bp, Mus musculus
ggaattgatcactccttttcagtta

SEQ ID NO: 699900 - DNA, 25 bp, Mus musculus
ggaattgcagatcttactgggattc

SEQ ID NO: 699901 - DNA, 25 bp, Mus musculus
ggaattgcagatgttactgggattc

SEQ ID NO: 699902 - DNA, 25 bp, Mus musculus
ggaattgccacaccgccagtgtacg

SEQ ID NO: 699903 - DNA, 25 bp, Mus musculus
ggaattgccacagcgccagtgtacg

SEQ ID NO: 699904 - DNA, 25 bp, Mus musculus
ggaattgccaccctcgatacagtac

SEQ ID NO: 699905 - DNA, 25 bp, Mus musculus
ggaattgccaccgtcgatacagtac

SEQ ID NO: 699906 - DNA, 25 bp, Mus musculus
ggaattgctaaacgaggcaaagcgt

SEQ ID NO: 699907 - DNA, 25 bp, Mus musculus
ggaattgctaaaggaggcaaagcgt

SEQ ID NO: 699908 - DNA, 25 bp, Mus musculus
ggaattgctttcatagcaaccgttg

SEQ ID NO: 699909 - DNA, 25 bp, Mus musculus
ggaattgctttcttagcaaccgttg

SEQ ID NO: 699910 - DNA, 25 bp, Mus musculus
ggaattggaaaaccatatgcagaag

SEQ ID NO: 699911 - DNA, 25 bp, Mus musculus
ggaattggaaaagcatatgcagaag

SEQ ID NO: 699912 - DNA, 25 bp, Mus musculus
ggaattggaccacggcatcgatccc

SEQ ID NO: 699913 - DNA, 25 bp, Mus musculus
ggaattggaccagggcatcgatccc

SEQ ID NO: 699914 - DNA, 25 bp, Mus musculus
ggaattggagcaaatcacatccgaa

SEQ ID NO: 699915 - DNA, 25 bp, Mus musculus
ggaattggagcatatcacatccgaa

SEQ ID NO: 699916 - DNA, 25 bp, Mus musculus
ggaattggagtcaggcgcagatcca

SEQ ID NO: 699917 - DNA, 25 bp, Mus musculus
ggaattggagtctggcgcagatcca

SEQ ID NO: 699918 - DNA, 25 bp, Mus musculus
ggaattggcatccttaagcaagcca

SEQ ID NO: 699919 - DNA, 25 bp, Mus musculus
ggaattggcatcgttaagcaagcca

SEQ ID NO: 699920 - DNA, 25 bp, Mus musculus
ggaattggctgcatattttgaccct

SEQ ID NO: 699921 - DNA, 25 bp, Mus musculus
ggaattggctgcttattttgaccct

SEQ ID NO: 699922 - DNA, 25 bp, Mus musculus
ggaattggttcaatttcctgttcag

SEQ ID NO: 699923 - DNA, 25 bp, Mus musculus
ggaattggttcattttcctgttcag

SEQ ID NO: 699924 - DNA, 25 bp, Mus musculus
ggaattgtcatgattgtctactaca

SEQ ID NO: 699925 - DNA, 25 bp, Mus musculus
ggaattgtcatgtttgtctactaca

SEQ ID NO: 699926 - DNA, 25 bp, Mus musculus
ggaattgtctggcacatttgctcat

SEQ ID NO: 699927 - DNA, 25 bp, Mus musculus
ggaattgtctgggacatttgctcat

SEQ ID NO: 699928 - DNA, 25 bp, Mus musculus
ggaattgtgacgatcctcatgaatg

SEQ ID NO: 699929 - DNA, 25 bp, Mus musculus
ggaattgtgacgttcctcatgaatg

SEQ ID NO: 699930 - DNA, 25 bp, Mus musculus
ggaattgtttccacattgaaatgag

SEQ ID NO: 699931 - DNA, 25 bp, Mus musculus
ggaattgtttcctcattgaaatgag

SEQ ID NO: 699932 - DNA, 25 bp, Mus musculus
ggaatttaaacacctagcaaccaag

SEQ ID NO: 699933 - DNA, 25 bp, Mus musculus
ggaatttaaacagctagcaaccaag

SEQ ID NO: 699934 - DNA, 25 bp, Mus musculus
ggaatttaaacccaccctcatccag

SEQ ID NO: 699935 - DNA, 25 bp, Mus musculus
ggaatttaaaccgaccctcatccag

SEQ ID NO: 699936 - DNA, 25 bp, Mus musculus
ggaatttacaagctggacaacctcg

SEQ ID NO: 699937 - DNA, 25 bp, Mus musculus
ggaatttacaaggtggacaacctcg

SEQ ID NO: 699938 - DNA, 25 bp, Mus musculus
ggaatttaccggctgagagatgccc

SEQ ID NO: 699939 - DNA, 25 bp, Mus musculus
ggaatttaccgggtgagagatgccc

SEQ ID NO: 699940 - DNA, 25 bp, Mus musculus
ggaatttcgtacctcacctgagagc

SEQ ID NO: 699941 - DNA, 25 bp, Mus musculus
ggaatttcgtacgtcacctgagagc

SEQ ID NO: 699942 - DNA, 25 bp, Mus musculus
ggaatttctgcgcacctatgctggg

SEQ ID NO: 699943 - DNA, 25 bp, Mus musculus
ggaatttctgcggacctatgctggg

SEQ ID NO: 699944 - DNA, 25 bp, Mus musculus
ggaatttgatgtccagccagcctat

SEQ ID NO: 699945 - DNA, 25 bp, Mus musculus
ggaatttgatgtgcagccagcctat

SEQ ID NO: 699946 - DNA, 25 bp, Mus musculus
ggaatttgccaccttgcaaggctca

SEQ ID NO: 699947 - DNA, 25 bp, Mus musculus
ggaatttgccacgttgcaaggctca

SEQ ID NO: 699948 - DNA, 25 bp, Mus musculus
ggaatttgctgccacctctgagtca

SEQ ID NO: 699949 - DNA, 25 bp, Mus musculus
ggaatttgctgcgacctctgagtca

SEQ ID NO: 699950 - DNA, 25 bp, Mus musculus
ggaatttggtcacttggacagcgaa

SEQ ID NO: 699951 - DNA, 25 bp, Mus musculus
ggaatttggtcagttggacagcgaa

SEQ ID NO: 699952 - DNA, 25 bp, Mus musculus
ggaatttgtgcacatgataaaacta

SEQ ID NO: 699953 - DNA, 25 bp, Mus musculus
ggaatttgtgcagatgataaaacta

SEQ ID NO: 699954 - DNA, 25 bp, Mus musculus
ggaattttaattaggacatgggact

SEQ ID NO: 699955 - DNA, 25 bp, Mus musculus
ggaattttaatttggacatgggact

SEQ ID NO: 699956 - DNA, 25 bp, Mus musculus
ggaattttccagcactactttggca

SEQ ID NO: 699957 - DNA, 25 bp, Mus musculus
ggaattttccaggactactttggca

SEQ ID NO: 699958 - DNA, 25 bp, Mus musculus
ggaattttgcggaggaattcacccg

SEQ ID NO: 699959 - DNA, 25 bp, Mus musculus
ggaattttgcggtggaattcacccg

SEQ ID NO: 699960 - DNA, 25 bp, Mus musculus
ggaatttttcccagcgtttcaagct

SEQ ID NO: 699961 - DNA, 25 bp, Mus musculus
ggaatttttccctgcgtttcaagct

SEQ ID NO: 699962 - DNA, 25 bp, Mus musculus
ggaattttttccagagctaaagtgt

SEQ ID NO: 699963 - DNA, 25 bp, Mus musculus
ggaattttttcctgagctaaagtgt

SEQ ID NO: 699964 - DNA, 25 bp, Mus musculus
ggacaaaacagaaacagccctgaac

SEQ ID NO: 699965 - DNA, 25 bp, Mus musculus
ggacaaaacagatacagccctgaac

SEQ ID NO: 699966 - DNA, 25 bp, Mus musculus
ggacaaacataacgagcccaaccct

SEQ ID NO: 699967 - DNA, 25 bp, Mus musculus
ggacaaacataaggagcccaaccct

SEQ ID NO: 699968 - DNA, 25 bp, Mus musculus
ggacaaacatgccacacttcagaaa

SEQ ID NO: 699969 - DNA, 25 bp, Mus musculus
ggacaaacatgcgacacttcagaaa

SEQ ID NO: 699970 - DNA, 25 bp, Mus musculus
ggacaaacctgacacctaccgctat

SEQ ID NO: 699971 - DNA, 25 bp, Mus musculus
ggacaaacctgagacctaccgctat

SEQ ID NO: 699972 - DNA, 25 bp, Mus musculus
ggacaaactcccaaggctggcacta

SEQ ID NO: 699973 - DNA, 25 bp, Mus musculus
ggacaaactccctaggctggcacta

SEQ ID NO: 699974 - DNA, 25 bp, Mus musculus
ggacaaagatgaccacatcaccatg

SEQ ID NO: 699975 - DNA, 25 bp, Mus musculus
ggacaaagatgagcacatcaccatg

SEQ ID NO: 699976 - DNA, 25 bp, Mus musculus
ggacaaagcaagagtcacaagtgcc

SEQ ID NO: 699977 - DNA, 25 bp, Mus musculus
ggacaaagcaagtgtcacaagtgcc

SEQ ID NO: 699978 - DNA, 25 bp, Mus musculus
ggacaaagctatctcttaaatcgct

SEQ ID NO: 699979 - DNA, 25 bp, Mus musculus
ggacaaagctatgtcttaaatcgct

SEQ ID NO: 699980 - DNA, 25 bp, Mus musculus
ggacaaaggccgcttcgaactctac

SEQ ID NO: 699981 - DNA, 25 bp, Mus musculus
ggacaaaggccggttcgaactctac

SEQ ID NO: 699982 - DNA, 25 bp, Mus musculus
ggacaaagggccctgacattagagt

SEQ ID NO: 699983 - DNA, 25 bp, Mus musculus
ggacaaagggccgtgacattagagt

SEQ ID NO: 699984 - DNA, 25 bp, Mus musculus
ggacaaatcattacaagttcgggag

SEQ ID NO: 699985 - DNA, 25 bp, Mus musculus
ggacaaatcatttcaagttcgggag

SEQ ID NO: 699986 - DNA, 25 bp, Mus musculus
ggacaaattattaccatcagagcaa

SEQ ID NO: 699987 - DNA, 25 bp, Mus musculus
ggacaaattatttccatcagagcaa

SEQ ID NO: 699988 - DNA, 25 bp, Mus musculus
ggacaaattcacacaatcacaagtt

SEQ ID NO: 699989 - DNA, 25 bp, Mus musculus
ggacaaattcactcaatcacaagtt

SEQ ID NO: 699990 - DNA, 25 bp, Mus musculus
ggacaacagccgaagtcccaatgca

SEQ ID NO: 699991 - DNA, 25 bp, Mus musculus
ggacaacagccgtagtcccaatgca

SEQ ID NO: 699992 - DNA, 25 bp, Mus musculus
ggacaacatcaaacagcaccaacca

SEQ ID NO: 699993 - DNA, 25 bp, Mus musculus
ggacaacatcaatcagcaccaacca

SEQ ID NO: 699994 - DNA, 25 bp, Mus musculus
ggacaacatccaattacacccagag

SEQ ID NO: 699995 - DNA, 25 bp, Mus musculus
ggacaacatccatttacacccagag

SEQ ID NO: 699996 - DNA, 25 bp, Mus musculus
ggacaacccatcaaccagtggctgc

SEQ ID NO: 699997 - DNA, 25 bp, Mus musculus
ggacaacccatctaccagtggctgc

SEQ ID NO: 699998 - DNA, 25 bp, Mus musculus
ggacaaccccacactgtatctagag

SEQ ID NO: 699999 - DNA, 25 bp, Mus musculus
ggacaaccccactctgtatctagag

SEQ ID NO: 700000 - DNA, 25 bp, Mus musculus
ggacaacccgttccacggcatcgtt

SEQ ID NO: 700001 - DNA, 25 bp, Mus musculus
ggacaacccgttgcacggcatcgtt

SEQ ID NO: 700002 - DNA, 25 bp, Mus musculus
ggacaacctcgtagccatttttgac

SEQ ID NO: 700003 - DNA, 25 bp, Mus musculus
ggacaacctcgttgccatttttgac

SEQ ID NO: 700004 - DNA, 25 bp, Mus musculus
ggacaaccttgacctgacagcctac

SEQ ID NO: 700005 - DNA, 25 bp, Mus musculus
ggacaaccttgagctgacagcctac

SEQ ID NO: 700006 - DNA, 25 bp, Mus musculus
ggacaacgtaagaacaagcctacca

SEQ ID NO: 700007 - DNA, 25 bp, Mus musculus
ggacaacgtaagtacaagcctacca

SEQ ID NO: 700008 - DNA, 25 bp, Mus musculus
ggacaactccacatcgttctggaga

SEQ ID NO: 700009 - DNA, 25 bp, Mus musculus
ggacaactccacttcgttctggaga

SEQ ID NO: 700010 - DNA, 25 bp, Mus musculus
ggacaactcgagatgagaaacggag

SEQ ID NO: 700011 - DNA, 25 bp, Mus musculus
ggacaactcgagttgagaaacggag

SEQ ID NO: 700012 - DNA, 25 bp, Mus musculus
ggacaactcgatatggctccattgc

SEQ ID NO: 700013 - DNA, 25 bp, Mus musculus
ggacaactcgatttggctccattgc

SEQ ID NO: 700014 - DNA, 25 bp, Mus musculus
ggacaactctaaacagacacagcat

SEQ ID NO: 700015 - DNA, 25 bp, Mus musculus
ggacaactctaatcagacacagcat

SEQ ID NO: 700016 - DNA, 25 bp, Mus musculus
ggacaactgagacccagatttcttt

SEQ ID NO: 700017 - DNA, 25 bp, Mus musculus
ggacaactgagagccagatttcttt

SEQ ID NO: 700018 - DNA, 25 bp, Mus musculus
ggacaactgccgcttggtgcctaac

SEQ ID NO: 700019 - DNA, 25 bp, Mus musculus
ggacaactgccggttggtgcctaac

SEQ ID NO: 700020 - DNA, 25 bp, Mus musculus
ggacaacttatccaaacctgtggct

SEQ ID NO: 700021 - DNA, 25 bp, Mus musculus
ggacaacttatcgaaacctgtggct

SEQ ID NO: 700022 - DNA, 25 bp, Mus musculus
ggacaagaagttcggctcctcctgg

SEQ ID NO: 700023 - DNA, 25 bp, Mus musculus
ggacaagaagttgggctcctcctgg

SEQ ID NO: 700024 - DNA, 25 bp, Mus musculus
ggacaagacagcattctctggccat

SEQ ID NO: 700025 - DNA, 25 bp, Mus musculus
ggacaagacagctttctctggccat

SEQ ID NO: 700026 - DNA, 25 bp, Mus musculus
ggacaagagggcaatgtaccctata

SEQ ID NO: 700027 - DNA, 25 bp, Mus musculus
ggacaagagggctatgtaccctata

SEQ ID NO: 700028 - DNA, 25 bp, Mus musculus
ggacaagagtttatctgcaagggcc

SEQ ID NO: 700029 - DNA, 25 bp, Mus musculus
ggacaagagtttttctgcaagggcc

SEQ ID NO: 700030 - DNA, 25 bp, Mus musculus
ggacaagcagacagcaggcctcaag

SEQ ID NO: 700031 - DNA, 25 bp, Mus musculus
ggacaagcagactgcaggcctcaag

SEQ ID NO: 700032 - DNA, 25 bp, Mus musculus
ggacaagctgccagaagtctgatcc

SEQ ID NO: 700033 - DNA, 25 bp, Mus musculus
ggacaagctgcctgaagtctgatcc

SEQ ID NO: 700034 - DNA, 25 bp, Mus musculus
ggacaagctgtaccccgagtccaag

SEQ ID NO: 700035 - DNA, 25 bp, Mus musculus
ggacaagctgtagcccgagtccaag

SEQ ID NO: 700036 - DNA, 25 bp, Mus musculus
ggacaaggaagaccaggagccaatc

SEQ ID NO: 700037 - DNA, 25 bp, Mus musculus
ggacaaggaagagcaggagccaatc

SEQ ID NO: 700038 - DNA, 25 bp, Mus musculus
ggacaaggaaggcaaacattcacct

SEQ ID NO: 700039 - DNA, 25 bp, Mus musculus
ggacaaggaagggaaacattcacct

SEQ ID NO: 700040 - DNA, 25 bp, Mus musculus
ggacaaggaatactacgagcccatg

SEQ ID NO: 700041 - DNA, 25 bp, Mus musculus
ggacaaggaatagtacgagcccatg

SEQ ID NO: 700042 - DNA, 25 bp, Mus musculus
ggacaaggacccctgctctgtgctc

SEQ ID NO: 700043 - DNA, 25 bp, Mus musculus
ggacaaggacccgtgctctgtgctc

SEQ ID NO: 700044 - DNA, 25 bp, Mus musculus
ggacaaggctccacaagaccctggg

SEQ ID NO: 700045 - DNA, 25 bp, Mus musculus
ggacaaggctcctcaagaccctggg

SEQ ID NO: 700046 - DNA, 25 bp, Mus musculus
ggacaagtacaacgctgagaagcct

SEQ ID NO: 700047 - DNA, 25 bp, Mus musculus
ggacaagtacaaggctgagaagcct

SEQ ID NO: 700048 - DNA, 25 bp, Mus musculus
ggacaagtccttcctccaacaagtg

SEQ ID NO: 700049 - DNA, 25 bp, Mus musculus
ggacaagtccttgctccaacaagtg

SEQ ID NO: 700050 - DNA, 25 bp, Mus musculus
ggacaagtgcctctcaccagagctg

SEQ ID NO: 700051 - DNA, 25 bp, Mus musculus
ggacaagtgcctgtcaccagagctg

SEQ ID NO: 700052 - DNA, 25 bp, Mus musculus
ggacaagtggcccagtatcacatca

SEQ ID NO: 700053 - DNA, 25 bp, Mus musculus
ggacaagtggccgagtatcacatca

SEQ ID NO: 700054 - DNA, 25 bp, Mus musculus
ggacaagttcaacccacaatggagg

SEQ ID NO: 700055 - DNA, 25 bp, Mus musculus
ggacaagttcaagccacaatggagg

SEQ ID NO: 700056 - DNA, 25 bp, Mus musculus
ggacaagttctacagccacaaaaaa

SEQ ID NO: 700057 - DNA, 25 bp, Mus musculus
ggacaagttctagagccacaaaaaa

SEQ ID NO: 700058 - DNA, 25 bp, Mus musculus
ggacaatagacaaccagctgttctt

SEQ ID NO: 700059 - DNA, 25 bp, Mus musculus
ggacaatagacatccagctgttctt

SEQ ID NO: 700060 - DNA, 25 bp, Mus musculus
ggacaatagatgatccctacgtcag

SEQ ID NO: 700061 - DNA, 25 bp, Mus musculus
ggacaatagatgttccctacgtcag

SEQ ID NO: 700062 - DNA, 25 bp, Mus musculus
ggacaatagccaccagtcttagcag

SEQ ID NO: 700063 - DNA, 25 bp, Mus musculus
ggacaatagccagcagtcttagcag

SEQ ID NO: 700064 - DNA, 25 bp, Mus musculus
ggacaatatccaactcactccagag

SEQ ID NO: 700065 - DNA, 25 bp, Mus musculus
ggacaatatccatctcactccagag

SEQ ID NO: 700066 - DNA, 25 bp, Mus musculus
ggacaatatgctattggcagaaggg

SEQ ID NO: 700067 - DNA, 25 bp, Mus musculus
ggacaatatgcttttggcagaaggg

SEQ ID NO: 700068 - DNA, 25 bp, Mus musculus
ggacaatgatacctgcggcgtctca

SEQ ID NO: 700069 - DNA, 25 bp, Mus musculus
ggacaatgatacgtgcggcgtctca

SEQ ID NO: 700070 - DNA, 25 bp, Mus musculus
ggacaatgatagagccagccagtat

SEQ ID NO: 700071 - DNA, 25 bp, Mus musculus
ggacaatgatagtgccagccagtat

SEQ ID NO: 700072 - DNA, 25 bp, Mus musculus
ggacaatgattgcttccgactggag

SEQ ID NO: 700073 - DNA, 25 bp, Mus musculus
ggacaatgattggttccgactggag

SEQ ID NO: 700074 - DNA, 25 bp, Mus musculus
ggacaatgcccacgtaatcctcgtg

SEQ ID NO: 700075 - DNA, 25 bp, Mus musculus
ggacaatgcccaggtaatcctcgtg

SEQ ID NO: 700076 - DNA, 25 bp, Mus musculus
ggacaatgtaagctaatagccacaa

SEQ ID NO: 700077 - DNA, 25 bp, Mus musculus
ggacaatgtaaggtaatagccacaa

SEQ ID NO: 700078 - DNA, 25 bp, Mus musculus
ggacaatgtaccatgaacaggctgc

SEQ ID NO: 700079 - DNA, 25 bp, Mus musculus
ggacaatgtaccttgaacaggctgc

SEQ ID NO: 700080 - DNA, 25 bp, Mus musculus
ggacaattcccgcaatgcccctttg

SEQ ID NO: 700081 - DNA, 25 bp, Mus musculus
ggacaattcccggaatgcccctttg

SEQ ID NO: 700082 - DNA, 25 bp, Mus musculus
ggacaattctatcacctcaaggagc

SEQ ID NO: 700083 - DNA, 25 bp, Mus musculus
ggacaattctatgacctcaaggagc

SEQ ID NO: 700084 - DNA, 25 bp, Mus musculus
ggacaattggctcctgcaaccgcat

SEQ ID NO: 700085 - DNA, 25 bp, Mus musculus
ggacaattggctgctgcaaccgcat

SEQ ID NO: 700086 - DNA, 25 bp, Mus musculus
ggacacaaggatcgccaccagaccg

SEQ ID NO: 700087 - DNA, 25 bp, Mus musculus
ggacacaaggatggccaccagaccg

SEQ ID NO: 700088 - DNA, 25 bp, Mus musculus
ggacacaatgatcggcaaagcagtg

SEQ ID NO: 700089 - DNA, 25 bp, Mus musculus
ggacacaatgatgggcaaagcagtg

SEQ ID NO: 700090 - DNA, 25 bp, Mus musculus
ggacacacaacgctgcaaaatgcaa

SEQ ID NO: 700091 - DNA, 25 bp, Mus musculus
ggacacacaacggtgcaaaatgcaa

SEQ ID NO: 700092 - DNA, 25 bp, Mus musculus
ggacacacacgtaggcacttcttgg

SEQ ID NO: 700093 - DNA, 25 bp, Mus musculus
ggacacacacgttggcacttcttgg

SEQ ID NO: 700094 - DNA, 25 bp, Mus musculus
ggacacacagacatggctgctcgcg

SEQ ID NO: 700095 - DNA, 25 bp, Mus musculus
ggacacacagacttggctgctcgcg

SEQ ID NO: 700096 - DNA, 25 bp, Mus musculus
ggacacacccgaccgcaaggaagtc

SEQ ID NO: 700097 - DNA, 25 bp, Mus musculus
ggacacacccgagcgcaaggaagtc

SEQ ID NO: 700098 - DNA, 25 bp, Mus musculus
ggacacacgtgacggaatggaatcc

SEQ ID NO: 700099 - DNA, 25 bp, Mus musculus
ggacacacgtgagggaatggaatcc

SEQ ID NO: 700100 - DNA, 25 bp, Mus musculus
ggacacagatgaacacttccctggg

SEQ ID NO: 700101 - DNA, 25 bp, Mus musculus
ggacacagatgatcacttccctggg

SEQ ID NO: 700102 - DNA, 25 bp, Mus musculus
ggacacagcatgagtgaccctggag

SEQ ID NO: 700103 - DNA, 25 bp, Mus musculus
ggacacagcatgtgtgaccctggag

SEQ ID NO: 700104 - DNA, 25 bp, Mus musculus
ggacacagggaaagttcccactggg

SEQ ID NO: 700105 - DNA, 25 bp, Mus musculus
ggacacagggaatgttcccactggg

SEQ ID NO: 700106 - DNA, 25 bp, Mus musculus
ggacacagggacatctcttctggtg

SEQ ID NO: 700107 - DNA, 25 bp, Mus musculus
ggacacagggacttctcttctggtg

SEQ ID NO: 700108 - DNA, 25 bp, Mus musculus
ggacacagtcttctaccgtttcctg

SEQ ID NO: 700109 - DNA, 25 bp, Mus musculus
ggacacagtcttgtaccgtttcctg

SEQ ID NO: 700110 - DNA, 25 bp, Mus musculus
ggacacagtgaacaagttacaagaa

SEQ ID NO: 700111 - DNA, 25 bp, Mus musculus
ggacacagtgaagaagttacaagaa

SEQ ID NO: 700112 - DNA, 25 bp, Mus musculus
ggacacagtttacaacagcctagct

SEQ ID NO: 700113 - DNA, 25 bp, Mus musculus
ggacacagtttagaacagcctagct

SEQ ID NO: 700114 - DNA, 25 bp, Mus musculus
ggacacatacccagcaattgcaagg

SEQ ID NO: 700115 - DNA, 25 bp, Mus musculus
ggacacataccctgcaattgcaagg

SEQ ID NO: 700116 - DNA, 25 bp, Mus musculus
ggacacatctcacacatcaacgctg

SEQ ID NO: 700117 - DNA, 25 bp, Mus musculus
ggacacatctcagacatcaacgctg

SEQ ID NO: 700118 - DNA, 25 bp, Mus musculus
ggacacatgaaacagatccaatcta

SEQ ID NO: 700119 - DNA, 25 bp, Mus musculus
ggacacatgaaagagatccaatcta

SEQ ID NO: 700120 - DNA, 25 bp, Mus musculus
ggacacattcttcggaattacaaga

SEQ ID NO: 700121 - DNA, 25 bp, Mus musculus
ggacacattcttgggaattacaaga

SEQ ID NO: 700122 - DNA, 25 bp, Mus musculus
ggacacattgagctcgaaaataaaa

SEQ ID NO: 700123 - DNA, 25 bp, Mus musculus
ggacacattgaggtcgaaaataaaa

SEQ ID NO: 700124 - DNA, 25 bp, Mus musculus
ggacacatttgacatcagaatggta

SEQ ID NO: 700125 - DNA, 25 bp, Mus musculus
ggacacatttgagatcagaatggta

SEQ ID NO: 700126 - DNA, 25 bp, Mus musculus
ggacaccaaacgatgaccaccttgc

SEQ ID NO: 700127 - DNA, 25 bp, Mus musculus
ggacaccaaacgttgaccaccttgc

SEQ ID NO: 700128 - DNA, 25 bp, Mus musculus
ggacaccaaagcatagaggtggaag

SEQ ID NO: 700129 - DNA, 25 bp, Mus musculus
ggacaccaaagcttagaggtggaag

SEQ ID NO: 700130 - DNA, 25 bp, Mus musculus
ggacaccaacaacatgattgaccgc

SEQ ID NO: 700131 - DNA, 25 bp, Mus musculus
ggacaccaacaagatgattgaccgc

SEQ ID NO: 700132 - DNA, 25 bp, Mus musculus
ggacaccaagatctggaagccgccc

SEQ ID NO: 700133 - DNA, 25 bp, Mus musculus
ggacaccaagatgtggaagccgccc

SEQ ID NO: 700134 - DNA, 25 bp, Mus musculus
ggacaccaagttcaacttagctact

SEQ ID NO: 700135 - DNA, 25 bp, Mus musculus
ggacaccaagttgaacttagctact

SEQ ID NO: 700136 - DNA, 25 bp, Mus musculus
ggacaccacaagaaagctcacagaa

SEQ ID NO: 700137 - DNA, 25 bp, Mus musculus
ggacaccacaagtaagctcacagaa

SEQ ID NO: 700138 - DNA, 25 bp, Mus musculus
ggacaccacctaccaattcataaat

SEQ ID NO: 700139 - DNA, 25 bp, Mus musculus
ggacaccacctagcaattcataaat

SEQ ID NO: 700140 - DNA, 25 bp, Mus musculus
ggacaccagagaagagtccccagag

SEQ ID NO: 700141 - DNA, 25 bp, Mus musculus
ggacaccagagatgagtccccagag

SEQ ID NO: 700142 - DNA, 25 bp, Mus musculus
ggacaccatcctcagcctcagaggg

SEQ ID NO: 700143 - DNA, 25 bp, Mus musculus
ggacaccatcctgagcctcagaggg

SEQ ID NO: 700144 - DNA, 25 bp, Mus musculus
ggacaccatgctcaggagtccacag

SEQ ID NO: 700145 - DNA, 25 bp, Mus musculus
ggacaccatgctgaggagtccacag

SEQ ID NO: 700146 - DNA, 25 bp, Mus musculus
ggacacccaaggatggcactgattg

SEQ ID NO: 700147 - DNA, 25 bp, Mus musculus
ggacacccaaggttggcactgattg

SEQ ID NO: 700148 - DNA, 25 bp, Mus musculus
ggacacccagaaaacctaccagtgg

SEQ ID NO: 700149 - DNA, 25 bp, Mus musculus
ggacacccagaaatttggcatcatg

SEQ ID NO: 700150 - DNA, 25 bp, Mus musculus
ggacacccagaatacctaccagtgg

SEQ ID NO: 700151 - DNA, 25 bp, Mus musculus
ggacacccagaattttggcatcatg

SEQ ID NO: 700152 - DNA, 25 bp, Mus musculus
ggacacccgaatcactgaggccatg

SEQ ID NO: 700153 - DNA, 25 bp, Mus musculus
ggacacccgaatgactgaggccatg

SEQ ID NO: 700154 - DNA, 25 bp, Mus musculus
ggacaccctctaagaggaaccacca

SEQ ID NO: 700155 - DNA, 25 bp, Mus musculus
ggacaccctctatgaggaaccacca

SEQ ID NO: 700156 - DNA, 25 bp, Mus musculus
ggacaccctgcacccaagttctttg

SEQ ID NO: 700157 - DNA, 25 bp, Mus musculus
ggacaccctgcagccaagttctttg

SEQ ID NO: 700158 - DNA, 25 bp, Mus musculus
ggacaccctgcgaaggaacgagagt

SEQ ID NO: 700159 - DNA, 25 bp, Mus musculus
ggacaccctgcgtaggaacgagagt

SEQ ID NO: 700160 - DNA, 25 bp, Mus musculus
ggacaccgggctagctcggtcgcct

SEQ ID NO: 700161 - DNA, 25 bp, Mus musculus
ggacaccgggcttgctcggtcgcct

SEQ ID NO: 700162 - DNA, 25 bp, Mus musculus
ggacaccgtcatctcacggatatgg

SEQ ID NO: 700163 - DNA, 25 bp, Mus musculus
ggacaccgtcatgtcacggatatgg

SEQ ID NO: 700164 - DNA, 25 bp, Mus musculus
ggacacctcctcctggacagtgacg

SEQ ID NO: 700165 - DNA, 25 bp, Mus musculus
ggacacctcctcgtggacagtgacg

SEQ ID NO: 700166 - DNA, 25 bp, Mus musculus
ggacacctctgaaaggaagattgaa

SEQ ID NO: 700167 - DNA, 25 bp, Mus musculus
ggacacctctgataggaagattgaa

SEQ ID NO: 700168 - DNA, 25 bp, Mus musculus
ggacaccttcatccagtttcctggg

SEQ ID NO: 700169 - DNA, 25 bp, Mus musculus
ggacaccttcatgcagtttcctggg

SEQ ID NO: 700170 - DNA, 25 bp, Mus musculus
ggacacgacattcgggttttctaga

SEQ ID NO: 700171 - DNA, 25 bp, Mus musculus
ggacacgacattggggttttctaga

SEQ ID NO: 700172 - DNA, 25 bp, Mus musculus
ggacacgatgccagccttcttcggg

SEQ ID NO: 700173 - DNA, 25 bp, Mus musculus
ggacacgatgcctgccttcttcggg

SEQ ID NO: 700174 - DNA, 25 bp, Mus musculus
ggacacgttgtcacatgcttggaga

SEQ ID NO: 700175 - DNA, 25 bp, Mus musculus
ggacacgttgtctcatgcttggaga

SEQ ID NO: 700176 - DNA, 25 bp, Mus musculus
ggacactatgaacaagtagagctga

SEQ ID NO: 700177 - DNA, 25 bp, Mus musculus
ggacactatgaagaagtagagctga

SEQ ID NO: 700178 - DNA, 25 bp, Mus musculus
ggacactatttgatccggcacaaag

SEQ ID NO: 700179 - DNA, 25 bp, Mus musculus
ggacactatttgttccggcacaaag

SEQ ID NO: 700180 - DNA, 25 bp, Mus musculus
ggacactccatcagttgggcctggc

SEQ ID NO: 700181 - DNA, 25 bp, Mus musculus
ggacactccatctgttgggcctggc

SEQ ID NO: 700182 - DNA, 25 bp, Mus musculus
ggacactcctacagcagctggacga

SEQ ID NO: 700183 - DNA, 25 bp, Mus musculus
ggacactcctactgcagctggacga

SEQ ID NO: 700184 - DNA, 25 bp, Mus musculus
ggacactcgaatacagatgggcatg

SEQ ID NO: 700185 - DNA, 25 bp, Mus musculus
ggacactcgaattcagatgggcatg

SEQ ID NO: 700186 - DNA, 25 bp, Mus musculus
ggacactctacgaatctcagccaga

SEQ ID NO: 700187 - DNA, 25 bp, Mus musculus
ggacactctacgtatctcagccaga

SEQ ID NO: 700188 - DNA, 25 bp, Mus musculus
ggacactctcaccactgtgttcttc

SEQ ID NO: 700189 - DNA, 25 bp, Mus musculus
ggacactctcacgactgtgttcttc

SEQ ID NO: 700190 - DNA, 25 bp, Mus musculus
ggacactgacgtcatcctcatgtgt

SEQ ID NO: 700191 - DNA, 25 bp, Mus musculus
ggacactgacgtcccagggtagttc

SEQ ID NO: 700192 - DNA, 25 bp, Mus musculus
ggacactgacgtgatcctcatgtgt

SEQ ID NO: 700193 - DNA, 25 bp, Mus musculus
ggacactgacgtgccagggtagttc

SEQ ID NO: 700194 - DNA, 25 bp, Mus musculus
ggacactgagcacaagacccaaact

SEQ ID NO: 700195 - DNA, 25 bp, Mus musculus
ggacactgagcagaagacccaaact

SEQ ID NO: 700196 - DNA, 25 bp, Mus musculus
ggacactgaggacacgttctctgag

SEQ ID NO: 700197 - DNA, 25 bp, Mus musculus
ggacactgaggagacgttctctgag

SEQ ID NO: 700198 - DNA, 25 bp, Mus musculus
ggacactgcactccgctactatgag

SEQ ID NO: 700199 - DNA, 25 bp, Mus musculus
ggacactgcactgcgctactatgag

SEQ ID NO: 700200 - DNA, 25 bp, Mus musculus
ggacactgcgtgctcaagctggtcc

SEQ ID NO: 700201 - DNA, 25 bp, Mus musculus
ggacactgcgtggtcaagctggtcc

SEQ ID NO: 700202 - DNA, 25 bp, Mus musculus
ggacactggatgcactggtccctga

SEQ ID NO: 700203 - DNA, 25 bp, Mus musculus
ggacactggatggactggtccctga

SEQ ID NO: 700204 - DNA, 25 bp, Mus musculus
ggacactggcttaacatcttaaaaa

SEQ ID NO: 700205 - DNA, 25 bp, Mus musculus
ggacactggctttacatcttaaaaa

SEQ ID NO: 700206 - DNA, 25 bp, Mus musculus
ggacactgtgcccttgcgctccaaa

SEQ ID NO: 700207 - DNA, 25 bp, Mus musculus
ggacactgtgccgttgcgctccaaa

SEQ ID NO: 700208 - DNA, 25 bp, Mus musculus
ggacactgtggcagatccagatgca

SEQ ID NO: 700209 - DNA, 25 bp, Mus musculus
ggacactgtggctgatccagatgca

SEQ ID NO: 700210 - DNA, 25 bp, Mus musculus
ggacactgtgggaccggtacctgct

SEQ ID NO: 700211 - DNA, 25 bp, Mus musculus
ggacactgtgggtccggtacctgct

SEQ ID NO: 700212 - DNA, 25 bp, Mus musculus
ggacacttgtgacaacaatcaggac

SEQ ID NO: 700213 - DNA, 25 bp, Mus musculus
ggacacttgtgagaacaatcaggac

SEQ ID NO: 700214 - DNA, 25 bp, Mus musculus
ggacactttcacatgttctgacaca

SEQ ID NO: 700215 - DNA, 25 bp, Mus musculus
ggacactttcacttgttctgacaca

SEQ ID NO: 700216 - DNA, 25 bp, Mus musculus
ggacacttttgtactgggacccaga

SEQ ID NO: 700217 - DNA, 25 bp, Mus musculus
ggacacttttgttctgggacccaga

SEQ ID NO: 700218 - DNA, 25 bp, Mus musculus
ggacagaaaacaacagctgccctgt

SEQ ID NO: 700219 - DNA, 25 bp, Mus musculus
ggacagaaaacatcagctgccctgt

SEQ ID NO: 700220 - DNA, 25 bp, Mus musculus
ggacagaaatctagggccccattag

SEQ ID NO: 700221 - DNA, 25 bp, Mus musculus
ggacagaaatcttgggccccattag

SEQ ID NO: 700222 - DNA, 25 bp, Mus musculus
ggacagaacaacaagaagcattgaa

SEQ ID NO: 700223 - DNA, 25 bp, Mus musculus
ggacagaacaactagaagcattgaa

SEQ ID NO: 700224 - DNA, 25 bp, Mus musculus
ggacagaacaggagctcctgcccag

SEQ ID NO: 700225 - DNA, 25 bp, Mus musculus
ggacagaacaggtgctcctgcccag

SEQ ID NO: 700226 - DNA, 25 bp, Mus musculus
ggacagaagcaaattctccctcaga

SEQ ID NO: 700227 - DNA, 25 bp, Mus musculus
ggacagaagcaatttctccctcaga

SEQ ID NO: 700228 - DNA, 25 bp, Mus musculus
ggacagaatctgattactaaagacg

SEQ ID NO: 700229 - DNA, 25 bp, Mus musculus
ggacagaatctgtttactaaagacg

SEQ ID NO: 700230 - DNA, 25 bp, Mus musculus
ggacagaattctcccaattgctgag

SEQ ID NO: 700231 - DNA, 25 bp, Mus musculus
ggacagaattctgccaattgctgag

SEQ ID NO: 700232 - DNA, 25 bp, Mus musculus
ggacagacacagcatcccatctttg

SEQ ID NO: 700233 - DNA, 25 bp, Mus musculus
ggacagacacaggatcccatctttg

SEQ ID NO: 700234 - DNA, 25 bp, Mus musculus
ggacagacatggcaaaactgctgtg

SEQ ID NO: 700235 - DNA, 25 bp, Mus musculus
ggacagacatgggaaaactgctgtg

SEQ ID NO: 700236 - DNA, 25 bp, Mus musculus
ggacagaccgagagcactgctggtt

SEQ ID NO: 700237 - DNA, 25 bp, Mus musculus
ggacagaccgagtgcactgctggtt

SEQ ID NO: 700238 - DNA, 25 bp, Mus musculus
ggacagaccgcacgctgcagagact

SEQ ID NO: 700239 - DNA, 25 bp, Mus musculus
ggacagaccgcaggctgcagagact

SEQ ID NO: 700240 - DNA, 25 bp, Mus musculus
ggacagagaaataatgcacatggct

SEQ ID NO: 700241 - DNA, 25 bp, Mus musculus
ggacagagaaattatgcacatggct

SEQ ID NO: 700242 - DNA, 25 bp, Mus musculus
ggacagagctgtaattgagcataat

SEQ ID NO: 700243 - DNA, 25 bp, Mus musculus
ggacagagctgttattgagcataat

SEQ ID NO: 700244 - DNA, 25 bp, Mus musculus
ggacagaggcccatgaagccaggcc

SEQ ID NO: 700245 - DNA, 25 bp, Mus musculus
ggacagaggcccttgaagccaggcc

SEQ ID NO: 700246 - DNA, 25 bp, Mus musculus
ggacagaggtccagacatactgtca

SEQ ID NO: 700247 - DNA, 25 bp, Mus musculus
ggacagaggtcctgacatactgtca

SEQ ID NO: 700248 - DNA, 25 bp, Mus musculus
ggacagagtcagaacaccaagagaa

SEQ ID NO: 700249 - DNA, 25 bp, Mus musculus
ggacagagtcagtacaccaagagaa

SEQ ID NO: 700250 - DNA, 25 bp, Mus musculus
ggacagagtccactcgaagattggc

SEQ ID NO: 700251 - DNA, 25 bp, Mus musculus
ggacagagtccagtcgaagattggc

SEQ ID NO: 700252 - DNA, 25 bp, Mus musculus
ggacagagttcacggaccattacat

SEQ ID NO: 700253 - DNA, 25 bp, Mus musculus
ggacagagttcagggaccattacat

SEQ ID NO: 700254 - DNA, 25 bp, Mus musculus
ggacagatcatcacccgacaacagc

SEQ ID NO: 700255 - DNA, 25 bp, Mus musculus
ggacagatcatctcccgacaacagc

SEQ ID NO: 700256 - DNA, 25 bp, Mus musculus
ggacagatgcgtctgtgaccccagt

SEQ ID NO: 700257 - DNA, 25 bp, Mus musculus
ggacagatgcgtgtgtgaccccagt

SEQ ID NO: 700258 - DNA, 25 bp, Mus musculus
ggacagattgtgatgccacgaggca

SEQ ID NO: 700259 - DNA, 25 bp, Mus musculus
ggacagattgtgttgccacgaggca

SEQ ID NO: 700260 - DNA, 25 bp, Mus musculus
ggacagcaaaggaaaagacaaggaa

SEQ ID NO: 700261 - DNA, 25 bp, Mus musculus
ggacagcaaaggtaaagacaaggaa

SEQ ID NO: 700262 - DNA, 25 bp, Mus musculus
ggacagcaaatcagcaaatcattaa

SEQ ID NO: 700263 - DNA, 25 bp, Mus musculus
ggacagcaaatctgcaaatcattaa

SEQ ID NO: 700264 - DNA, 25 bp, Mus musculus
ggacagcacaggaaaggccaagtgc

SEQ ID NO: 700265 - DNA, 25 bp, Mus musculus
ggacagcacaggtaaggccaagtgc

SEQ ID NO: 700266 - DNA, 25 bp, Mus musculus
ggacagcacgctatgaatgccacac

SEQ ID NO: 700267 - DNA, 25 bp, Mus musculus
ggacagcacgctttgaatgccacac

SEQ ID NO: 700268 - DNA, 25 bp, Mus musculus
ggacagcagagtctaacggagccat

SEQ ID NO: 700269 - DNA, 25 bp, Mus musculus
ggacagcagagtgtaacggagccat

SEQ ID NO: 700270 - DNA, 25 bp, Mus musculus
ggacagcagctaagaactacccctg

SEQ ID NO: 700271 - DNA, 25 bp, Mus musculus
ggacagcagctatgaactacccctg

SEQ ID NO: 700272 - DNA, 25 bp, Mus musculus
ggacagcaggtcaatcattttcaaa

SEQ ID NO: 700273 - DNA, 25 bp, Mus musculus
ggacagcaggtctatcattttcaaa

SEQ ID NO: 700274 - DNA, 25 bp, Mus musculus
ggacagcattggatcaaccatctct

SEQ ID NO: 700275 - DNA, 25 bp, Mus musculus
ggacagcattggttcaaccatctct

SEQ ID NO: 700276 - DNA, 25 bp, Mus musculus
ggacagcatttcacttcagaagcag

SEQ ID NO: 700277 - DNA, 25 bp, Mus musculus
ggacagcatttctcttcagaagcag

SEQ ID NO: 700278 - DNA, 25 bp, Mus musculus
ggacagcccacactgctgctgtatg

SEQ ID NO: 700279 - DNA, 25 bp, Mus musculus
ggacagcccacagtgctgctgtatg

SEQ ID NO: 700280 - DNA, 25 bp, Mus musculus
ggacagccccaccatgaagaagaaa

SEQ ID NO: 700281 - DNA, 25 bp, Mus musculus
ggacagccccacgatgaagaagaaa

SEQ ID NO: 700282 - DNA, 25 bp, Mus musculus
ggacagcctaaaaggacacccagtt

SEQ ID NO: 700283 - DNA, 25 bp, Mus musculus
ggacagcctaaatggacacccagtt

SEQ ID NO: 700284 - DNA, 25 bp, Mus musculus
ggacagcctctcacctattctgttt

SEQ ID NO: 700285 - DNA, 25 bp, Mus musculus
ggacagcctctctcctattctgttt

SEQ ID NO: 700286 - DNA, 25 bp, Mus musculus
ggacagccttcccattgtgtgcgca

SEQ ID NO: 700287 - DNA, 25 bp, Mus musculus
ggacagccttccgattgtgtgcgca

SEQ ID NO: 700288 - DNA, 25 bp, Mus musculus
ggacagcggatcactcctgccgcgt

SEQ ID NO: 700289 - DNA, 25 bp, Mus musculus
ggacagcggatctctcctgccgcgt

SEQ ID NO: 700290 - DNA, 25 bp, Mus musculus
ggacagctaccacgttcggtcccga

SEQ ID NO: 700291 - DNA, 25 bp, Mus musculus
ggacagctaccaggttcggtcccga

SEQ ID NO: 700292 - DNA, 25 bp, Mus musculus
ggacagctatcaatatgatgatggc

SEQ ID NO: 700293 - DNA, 25 bp, Mus musculus
ggacagctatcattatgatgatggc

SEQ ID NO: 700294 - DNA, 25 bp, Mus musculus
ggacagctgcccatggcgctgatga

SEQ ID NO: 700295 - DNA, 25 bp, Mus musculus
ggacagctgcccttggcgctgatga

SEQ ID NO: 700296 - DNA, 25 bp, Mus musculus
ggacagctgctgatttactctaata

SEQ ID NO: 700297 - DNA, 25 bp, Mus musculus
ggacagctgctgttttactctaata

SEQ ID NO: 700298 - DNA, 25 bp, Mus musculus
ggacagctgtgtcggctggctagaa

SEQ ID NO: 700299 - DNA, 25 bp, Mus musculus
ggacagctgtgtgggctggctagaa

SEQ ID NO: 700300 - DNA, 25 bp, Mus musculus
ggacaggactttcgcgctgcccgtc

SEQ ID NO: 700301 - DNA, 25 bp, Mus musculus
ggacaggactttggcgctgcccgtc

SEQ ID NO: 700302 - DNA, 25 bp, Mus musculus
ggacaggagcaaaccgagctttcat

SEQ ID NO: 700303 - DNA, 25 bp, Mus musculus
ggacaggagcaatccgagctttcat

SEQ ID NO: 700304 - DNA, 25 bp, Mus musculus
ggacaggattgaagcatattcctga

SEQ ID NO: 700305 - DNA, 25 bp, Mus musculus
ggacaggattgaccaacagagccat

SEQ ID NO: 700306 - DNA, 25 bp, Mus musculus
ggacaggattgagcaacagagccat

SEQ ID NO: 700307 - DNA, 25 bp, Mus musculus
ggacaggattgatgcatattcctga

SEQ ID NO: 700308 - DNA, 25 bp, Mus musculus
ggacaggcaaatcctcaaagatgtc

SEQ ID NO: 700309 - DNA, 25 bp, Mus musculus
ggacaggcaaatgctcaaagatgtc

SEQ ID NO: 700310 - DNA, 25 bp, Mus musculus
ggacaggcggtcaatgacctcataa

SEQ ID NO: 700311 - DNA, 25 bp, Mus musculus
ggacaggcggtctatgacctcataa

SEQ ID NO: 700312 - DNA, 25 bp, Mus musculus
ggacagggactgacctgtcaccact

SEQ ID NO: 700313 - DNA, 25 bp, Mus musculus
ggacagggactgtcctgtcaccact

SEQ ID NO: 700314 - DNA, 25 bp, Mus musculus
ggacagggccttctgaagcagccaa

SEQ ID NO: 700315 - DNA, 25 bp, Mus musculus
ggacagggccttgtgaagcagccaa

SEQ ID NO: 700316 - DNA, 25 bp, Mus musculus
ggacagggctttcggctccttgctt

SEQ ID NO: 700317 - DNA, 25 bp, Mus musculus
ggacagggctttgggctccttgctt

SEQ ID NO: 700318 - DNA, 25 bp, Mus musculus
ggacaggggaggctaccactcctca

SEQ ID NO: 700319 - DNA, 25 bp, Mus musculus
ggacaggggagggtaccactcctca

SEQ ID NO: 700320 - DNA, 25 bp, Mus musculus
ggacaggtacgacctcactgccttg

SEQ ID NO: 700321 - DNA, 25 bp, Mus musculus
ggacaggtacgagctcactgccttg

SEQ ID NO: 700322 - DNA, 25 bp, Mus musculus
ggacaggtccgaagtcagtgtccat

SEQ ID NO: 700323 - DNA, 25 bp, Mus musculus
ggacaggtccgatgtcagtgtccat

SEQ ID NO: 700324 - DNA, 25 bp, Mus musculus
ggacaggtggtcatttctgagacag

SEQ ID NO: 700325 - DNA, 25 bp, Mus musculus
ggacaggtggtcttttctgagacag

SEQ ID NO: 700326 - DNA, 25 bp, Mus musculus
ggacagtaaatccaagccttcctcc

SEQ ID NO: 700327 - DNA, 25 bp, Mus musculus
ggacagtaaatcgaagccttcctcc

SEQ ID NO: 700328 - DNA, 25 bp, Mus musculus
ggacagtacacaccaccagagtctg

SEQ ID NO: 700329 - DNA, 25 bp, Mus musculus
ggacagtacacagcaccagagtctg

SEQ ID NO: 700330 - DNA, 25 bp, Mus musculus
ggacagtatctactacctggaagag

SEQ ID NO: 700331 - DNA, 25 bp, Mus musculus
ggacagtatctagtacctggaagag

SEQ ID NO: 700332 - DNA, 25 bp, Mus musculus
ggacagtatggcctggcccagacac

SEQ ID NO: 700333 - DNA, 25 bp, Mus musculus
ggacagtatggcgtggcccagacac

SEQ ID NO: 700334 - DNA, 25 bp, Mus musculus
ggacagtccacacctttcccaagtg

SEQ ID NO: 700335 - DNA, 25 bp, Mus musculus
ggacagtccacagctttcccaagtg

SEQ ID NO: 700336 - DNA, 25 bp, Mus musculus
ggacagtcgtgcaggcccagtgcac

SEQ ID NO: 700337 - DNA, 25 bp, Mus musculus
ggacagtcgtgctggcccagtgcac

SEQ ID NO: 700338 - DNA, 25 bp, Mus musculus
ggacagtctgcacgatgagatcaac

SEQ ID NO: 700339 - DNA, 25 bp, Mus musculus
ggacagtctgcaggatgagatcaac

SEQ ID NO: 700340 - DNA, 25 bp, Mus musculus
ggacagtctggtcagccgagcacac

SEQ ID NO: 700341 - DNA, 25 bp, Mus musculus
ggacagtctggtgagccgagcacac

SEQ ID NO: 700342 - DNA, 25 bp, Mus musculus
ggacagtgcccacacccttggtggt

SEQ ID NO: 700343 - DNA, 25 bp, Mus musculus
ggacagtgcccagacccttggtggt

SEQ ID NO: 700344 - DNA, 25 bp, Mus musculus
ggacagtgccttatctaacctggag

SEQ ID NO: 700345 - DNA, 25 bp, Mus musculus
ggacagtgccttcaggttagtctct

SEQ ID NO: 700346 - DNA, 25 bp, Mus musculus
ggacagtgccttgaggttagtctct

SEQ ID NO: 700347 - DNA, 25 bp, Mus musculus
ggacagtgccttttctaacctggag

SEQ ID NO: 700348 - DNA, 25 bp, Mus musculus
ggacagtgctatcctagaatacctg

SEQ ID NO: 700349 - DNA, 25 bp, Mus musculus
ggacagtgctatgctagaatacctg

SEQ ID NO: 700350 - DNA, 25 bp, Mus musculus
ggacagtggacacaacccgtttcca

SEQ ID NO: 700351 - DNA, 25 bp, Mus musculus
ggacagtggacagaacccgtttcca

SEQ ID NO: 700352 - DNA, 25 bp, Mus musculus
ggacagtggagcaacccacaccact

SEQ ID NO: 700353 - DNA, 25 bp, Mus musculus
ggacagtggagctacccacaccact

SEQ ID NO: 700354 - DNA, 25 bp, Mus musculus
ggacagttccccaaaccagttcagc

SEQ ID NO: 700355 - DNA, 25 bp, Mus musculus
ggacagttcccctaaccagttcagc

SEQ ID NO: 700356 - DNA, 25 bp, Mus musculus
ggacagttctaccatccagatcaga

SEQ ID NO: 700357 - DNA, 25 bp, Mus musculus
ggacagttctacgatccagatcaga

SEQ ID NO: 700358 - DNA, 25 bp, Mus musculus
ggacagttctatcgccacacccata

SEQ ID NO: 700359 - DNA, 25 bp, Mus musculus
ggacagttctatggccacacccata

SEQ ID NO: 700360 - DNA, 25 bp, Mus musculus
ggacagttcttaaagggccagcccg

SEQ ID NO: 700361 - DNA, 25 bp, Mus musculus
ggacagttcttatagggccagcccg

SEQ ID NO: 700362 - DNA, 25 bp, Mus musculus
ggacagtttccaagaaatctgccta

SEQ ID NO: 700363 - DNA, 25 bp, Mus musculus
ggacagtttccatgaaatctgccta

SEQ ID NO: 700364 - DNA, 25 bp, Mus musculus
ggacagtttggtaccagtggaaatg

SEQ ID NO: 700365 - DNA, 25 bp, Mus musculus
ggacagtttggtcccagctcttcag

SEQ ID NO: 700366 - DNA, 25 bp, Mus musculus
ggacagtttggtgccagctcttcag

SEQ ID NO: 700367 - DNA, 25 bp, Mus musculus
ggacagtttggttccagtggaaatg

SEQ ID NO: 700368 - DNA, 25 bp, Mus musculus
ggacataaaccaatcctctgtcttg

SEQ ID NO: 700369 - DNA, 25 bp, Mus musculus
ggacataaaccattcctctgtcttg

SEQ ID NO: 700370 - DNA, 25 bp, Mus musculus
ggacataagccgctcagaatccctc

SEQ ID NO: 700371 - DNA, 25 bp, Mus musculus
ggacataagccggtcagaatccctc

SEQ ID NO: 700372 - DNA, 25 bp, Mus musculus
ggacataattctcgctcatcacttt

SEQ ID NO: 700373 - DNA, 25 bp, Mus musculus
ggacataattctggctcatcacttt

SEQ ID NO: 700374 - DNA, 25 bp, Mus musculus
ggacatacacctacatctccagata

SEQ ID NO: 700375 - DNA, 25 bp, Mus musculus
ggacatacaccttcatctccagata

SEQ ID NO: 700376 - DNA, 25 bp, Mus musculus
ggacataccagcctgaatttggaaa

SEQ ID NO: 700377 - DNA, 25 bp, Mus musculus
ggacataccagcgtgaatttggaaa

SEQ ID NO: 700378 - DNA, 25 bp, Mus musculus
ggacatagcagcagacagtcgggcc

SEQ ID NO: 700379 - DNA, 25 bp, Mus musculus
ggacatagcagctgacagtcgggcc

SEQ ID NO: 700380 - DNA, 25 bp, Mus musculus
ggacatagccaccactgaagctggg

SEQ ID NO: 700381 - DNA, 25 bp, Mus musculus
ggacatagccacgactgaagctggg

SEQ ID NO: 700382 - DNA, 25 bp, Mus musculus
ggacatagggaaaacctgtcacctt

SEQ ID NO: 700383 - DNA, 25 bp, Mus musculus
ggacatagggaatacctgtcacctt

SEQ ID NO: 700384 - DNA, 25 bp, Mus musculus
ggacatatcagactgatccaaagca

SEQ ID NO: 700385 - DNA, 25 bp, Mus musculus
ggacatatcagagtgatccaaagca

SEQ ID NO: 700386 - DNA, 25 bp, Mus musculus
ggacatatgccccagagtgatatag

SEQ ID NO: 700387 - DNA, 25 bp, Mus musculus
ggacatatgcccgagagtgatatag

SEQ ID NO: 700388 - DNA, 25 bp, Mus musculus
ggacatcaaagcagaggatgtggtt

SEQ ID NO: 700389 - DNA, 25 bp, Mus musculus
ggacatcaaagctgaggatgtggtt

SEQ ID NO: 700390 - DNA, 25 bp, Mus musculus
ggacatcaactaagatgagaccctc

SEQ ID NO: 700391 - DNA, 25 bp, Mus musculus
ggacatcaactatgatgagaccctc

SEQ ID NO: 700392 - DNA, 25 bp, Mus musculus
ggacatcaagacacggctggaacag

SEQ ID NO: 700393 - DNA, 25 bp, Mus musculus
ggacatcaagactcggctggaacag

SEQ ID NO: 700394 - DNA, 25 bp, Mus musculus
ggacatcacataacgactgccggag

SEQ ID NO: 700395 - DNA, 25 bp, Mus musculus
ggacatcacatatcgactgccggag

SEQ ID NO: 700396 - DNA, 25 bp, Mus musculus
ggacatcaccaccacggaagagaag

SEQ ID NO: 700397 - DNA, 25 bp, Mus musculus
ggacatcaccacgacggaagagaag

SEQ ID NO: 700398 - DNA, 25 bp, Mus musculus
ggacatcatcacagtggcagctggt

SEQ ID NO: 700399 - DNA, 25 bp, Mus musculus
ggacatcatcactgtggcagctggt

SEQ ID NO: 700400 - DNA, 25 bp, Mus musculus
ggacatcatcccatcaaatcttcta

SEQ ID NO: 700401 - DNA, 25 bp, Mus musculus
ggacatcatcccttcaaatcttcta

SEQ ID NO: 700402 - DNA, 25 bp, Mus musculus
ggacatccacatctgcggcctctgt

SEQ ID NO: 700403 - DNA, 25 bp, Mus musculus
ggacatccacatgtgcggcctctgt

SEQ ID NO: 700404 - DNA, 25 bp, Mus musculus
ggacatccactcactggtgaccgaa

SEQ ID NO: 700405 - DNA, 25 bp, Mus musculus
ggacatccactctctggtgaccgaa

SEQ ID NO: 700406 - DNA, 25 bp, Mus musculus
ggacatccacttcatccacgtgaaa

SEQ ID NO: 700407 - DNA, 25 bp, Mus musculus
ggacatccacttgatccacgtgaaa

SEQ ID NO: 700408 - DNA, 25 bp, Mus musculus
ggacatccgaatcgtgcctgaggac

SEQ ID NO: 700409 - DNA, 25 bp, Mus musculus
ggacatccgaatggtgcctgaggac

SEQ ID NO: 700410 - DNA, 25 bp, Mus musculus
ggacatccgccgaccggcctgtggt

SEQ ID NO: 700411 - DNA, 25 bp, Mus musculus
ggacatccgccgtccggcctgtggt

SEQ ID NO: 700412 - DNA, 25 bp, Mus musculus
ggacatcctccgaaccagagtcaaa

SEQ ID NO: 700413 - DNA, 25 bp, Mus musculus
ggacatcctccgtaccagagtcaaa

SEQ ID NO: 700414 - DNA, 25 bp, Mus musculus
ggacatcgagacaccaggattaaca

SEQ ID NO: 700415 - DNA, 25 bp, Mus musculus
ggacatcgagactccaggattaaca

SEQ ID NO: 700416 - DNA, 25 bp, Mus musculus
ggacatcgcagccaaagagaagctg

SEQ ID NO: 700417 - DNA, 25 bp, Mus musculus
ggacatcgcagcgaaagagaagctg

SEQ ID NO: 700418 - DNA, 25 bp, Mus musculus
ggacatcgcccacgacatggttctg

SEQ ID NO: 700419 - DNA, 25 bp, Mus musculus
ggacatcgcccaggacatggttctg

SEQ ID NO: 700420 - DNA, 25 bp, Mus musculus
ggacatcggactacttaccaagccg

SEQ ID NO: 700421 - DNA, 25 bp, Mus musculus
ggacatcggacttcttaccaagccg

SEQ ID NO: 700422 - DNA, 25 bp, Mus musculus
ggacatctacccatcgagccgggac

SEQ ID NO: 700423 - DNA, 25 bp, Mus musculus
ggacatctacccttcgagccgggac

SEQ ID NO: 700424 - DNA, 25 bp, Mus musculus
ggacatctcggtcaccttgtacagg

SEQ ID NO: 700425 - DNA, 25 bp, Mus musculus
ggacatctcggtgaccttgtacagg

SEQ ID NO: 700426 - DNA, 25 bp, Mus musculus
ggacatctgcggacctggcaccaag

SEQ ID NO: 700427 - DNA, 25 bp, Mus musculus
ggacatctgcggcttcataggagac

SEQ ID NO: 700428 - DNA, 25 bp, Mus musculus
ggacatctgcgggttcataggagac

SEQ ID NO: 700429 - DNA, 25 bp, Mus musculus
ggacatctgcggtcctggcaccaag

SEQ ID NO: 700430 - DNA, 25 bp, Mus musculus
ggacatctgcgtagtgtagccacac

SEQ ID NO: 700431 - DNA, 25 bp, Mus musculus
ggacatctgcgttgtgtagccacac

SEQ ID NO: 700432 - DNA, 25 bp, Mus musculus
ggacatctgctcagacacatccttc

SEQ ID NO: 700433 - DNA, 25 bp, Mus musculus
ggacatctgctctgacacatccttc

SEQ ID NO: 700434 - DNA, 25 bp, Mus musculus
ggacatcttagacacagcaggtcaa

SEQ ID NO: 700435 - DNA, 25 bp, Mus musculus
ggacatcttagagacagcaggtcaa

SEQ ID NO: 700436 - DNA, 25 bp, Mus musculus
ggacatcttcaaaagtaactagaga

SEQ ID NO: 700437 - DNA, 25 bp, Mus musculus
ggacatcttcaatagtaactagaga

SEQ ID NO: 700438 - DNA, 25 bp, Mus musculus
ggacatcttccacagcttcacctga

SEQ ID NO: 700439 - DNA, 25 bp, Mus musculus
ggacatcttccagagcttcacctga

SEQ ID NO: 700440 - DNA, 25 bp, Mus musculus
ggacatcttggcaccgagctcttca

SEQ ID NO: 700441 - DNA, 25 bp, Mus musculus
ggacatcttggctccgagctcttca

SEQ ID NO: 700442 - DNA, 25 bp, Mus musculus
ggacatgaaaccagagaacttgctc

SEQ ID NO: 700443 - DNA, 25 bp, Mus musculus
ggacatgaaacctgagaacttgctc

SEQ ID NO: 700444 - DNA, 25 bp, Mus musculus
ggacatgactggcacaccaggagct

SEQ ID NO: 700445 - DNA, 25 bp, Mus musculus
ggacatgactgggacaccaggagct

SEQ ID NO: 700446 - DNA, 25 bp, Mus musculus
ggacatgattaaagaggtggatgct

SEQ ID NO: 700447 - DNA, 25 bp, Mus musculus
ggacatgattaatgaggtggatgct

SEQ ID NO: 700448 - DNA, 25 bp, Mus musculus
ggacatgctttcctcgctgggcaga

SEQ ID NO: 700449 - DNA, 25 bp, Mus musculus
ggacatgctttcgtcgctgggcaga

SEQ ID NO: 700450 - DNA, 25 bp, Mus musculus
ggacatggagcgacacctgaagatc

SEQ ID NO: 700451 - DNA, 25 bp, Mus musculus
ggacatggagcgtcacctgaagatc

SEQ ID NO: 700452 - DNA, 25 bp, Mus musculus
ggacatggcattactgtacccagaa

SEQ ID NO: 700453 - DNA, 25 bp, Mus musculus
ggacatggcatttctgtacccagaa

SEQ ID NO: 700454 - DNA, 25 bp, Mus musculus
ggacatgggaggcacatctgatcca

SEQ ID NO: 700455 - DNA, 25 bp, Mus musculus
ggacatgggagggacatctgatcca

SEQ ID NO: 700456 - DNA, 25 bp, Mus musculus
ggacatggttttatgactttcgacc

SEQ ID NO: 700457 - DNA, 25 bp, Mus musculus
ggacatggttttttgactttcgacc

SEQ ID NO: 700458 - DNA, 25 bp, Mus musculus
ggacatgtatgcatgtgtagctacc

SEQ ID NO: 700459 - DNA, 25 bp, Mus musculus
ggacatgtatgcttgtgtagctacc

SEQ ID NO: 700460 - DNA, 25 bp, Mus musculus
ggacatgtccctcttccgtatcagg

SEQ ID NO: 700461 - DNA, 25 bp, Mus musculus
ggacatgtccctgttccgtatcagg

SEQ ID NO: 700462 - DNA, 25 bp, Mus musculus
ggacatgtctacatacaccctggag

SEQ ID NO: 700463 - DNA, 25 bp, Mus musculus
ggacatgtctacttacaccctggag

SEQ ID NO: 700464 - DNA, 25 bp, Mus musculus
ggacatgtgccactccttcacatct

SEQ ID NO: 700465 - DNA, 25 bp, Mus musculus
ggacatgtgccagtccttcacatct

SEQ ID NO: 700466 - DNA, 25 bp, Mus musculus
ggacatgtgtgacatctgcaggctt

SEQ ID NO: 700467 - DNA, 25 bp, Mus musculus
ggacatgtgtgagatctgcaggctt

SEQ ID NO: 700468 - DNA, 25 bp, Mus musculus
ggacatgtgtttcccagctaccagg

SEQ ID NO: 700469 - DNA, 25 bp, Mus musculus
ggacatgtgtttgccagctaccagg

SEQ ID NO: 700470 - DNA, 25 bp, Mus musculus
ggacattaagaaaacaatggaagaa

SEQ ID NO: 700471 - DNA, 25 bp, Mus musculus
ggacattaagaatacaatggaagaa

SEQ ID NO: 700472 - DNA, 25 bp, Mus musculus
ggacattaaggaccacaatggacag

SEQ ID NO: 700473 - DNA, 25 bp, Mus musculus
ggacattaaggagcacaatggacag

SEQ ID NO: 700474 - DNA, 25 bp, Mus musculus
ggacattagagaacacccagtgcag

SEQ ID NO: 700475 - DNA, 25 bp, Mus musculus
ggacattagagatcacccagtgcag

SEQ ID NO: 700476 - DNA, 25 bp, Mus musculus
ggacattataccagatagcaccact

SEQ ID NO: 700477 - DNA, 25 bp, Mus musculus
ggacattatacctgatagcaccact

SEQ ID NO: 700478 - DNA, 25 bp, Mus musculus
ggacattattttccagccaacctga

SEQ ID NO: 700479 - DNA, 25 bp, Mus musculus
ggacattattttgcagccaacctga

SEQ ID NO: 700480 - DNA, 25 bp, Mus musculus
ggacattcaaccatcaccacgctga

SEQ ID NO: 700481 - DNA, 25 bp, Mus musculus
ggacattcaaccttcaccacgctga

SEQ ID NO: 700482 - DNA, 25 bp, Mus musculus
ggacattcaactctgggattggagc

SEQ ID NO: 700483 - DNA, 25 bp, Mus musculus
ggacattcaactgtgggattggagc

SEQ ID NO: 700484 - DNA, 25 bp, Mus musculus
ggacattcctgtctgaaacatcagt

SEQ ID NO: 700485 - DNA, 25 bp, Mus musculus
ggacattcctgtgtgaaacatcagt

SEQ ID NO: 700486 - DNA, 25 bp, Mus musculus
ggacattcgctactctttcatacta

SEQ ID NO: 700487 - DNA, 25 bp, Mus musculus
ggacattcgctagtctttcatacta

SEQ ID NO: 700488 - DNA, 25 bp, Mus musculus
ggacattcgcttctacactgggcag

SEQ ID NO: 700489 - DNA, 25 bp, Mus musculus
ggacattcgcttgtacactgggcag

SEQ ID NO: 700490 - DNA, 25 bp, Mus musculus
ggacattctcccagttggtctgatg

SEQ ID NO: 700491 - DNA, 25 bp, Mus musculus
ggacattctccctgttggtctgatg

SEQ ID NO: 700492 - DNA, 25 bp, Mus musculus
ggacattgacacagcaactgcccag

SEQ ID NO: 700493 - DNA, 25 bp, Mus musculus
ggacattgacactgcaactgcccag

SEQ ID NO: 700494 - DNA, 25 bp, Mus musculus
ggacattgacctctcgtccctgcgg

SEQ ID NO: 700495 - DNA, 25 bp, Mus musculus
ggacattgacctgtcgtccctgcgg

SEQ ID NO: 700496 - DNA, 25 bp, Mus musculus
ggacattgagcactggctgtccaca

SEQ ID NO: 700497 - DNA, 25 bp, Mus musculus
ggacattgagcagtggctgtccaca

SEQ ID NO: 700498 - DNA, 25 bp, Mus musculus
ggacattgctgcctatatcaagaag

SEQ ID NO: 700499 - DNA, 25 bp, Mus musculus
ggacattgctgcgtatatcaagaag

SEQ ID NO: 700500 - DNA, 25 bp, Mus musculus
ggacattggacaaagcaagctagag

SEQ ID NO: 700501 - DNA, 25 bp, Mus musculus
ggacattggacatagcaagctagag

SEQ ID NO: 700502 - DNA, 25 bp, Mus musculus
ggacattgtgctacctgatggccgg

SEQ ID NO: 700503 - DNA, 25 bp, Mus musculus
ggacattgtgcttcctgatggccgg

SEQ ID NO: 700504 - DNA, 25 bp, Mus musculus
ggacatttcagtaccaggactctct

SEQ ID NO: 700505 - DNA, 25 bp, Mus musculus
ggacatttcagttccaggactctct

SEQ ID NO: 700506 - DNA, 25 bp, Mus musculus
ggacatttcccaaacctggcctgga

SEQ ID NO: 700507 - DNA, 25 bp, Mus musculus
ggacatttcccatacctggcctgga

SEQ ID NO: 700508 - DNA, 25 bp, Mus musculus
ggacatttgatgaatttcaggaact

SEQ ID NO: 700509 - DNA, 25 bp, Mus musculus
ggacatttgatgtatttcaggaact

SEQ ID NO: 700510 - DNA, 25 bp, Mus musculus
ggacattttcgaagtccacatacta

SEQ ID NO: 700511 - DNA, 25 bp, Mus musculus
ggacattttcgatgtccacatacta

SEQ ID NO: 700512 - DNA, 25 bp, Mus musculus
ggaccaaagtgcagcgatgcccatg

SEQ ID NO: 700513 - DNA, 25 bp, Mus musculus
ggaccaaagtgctgcgatgcccatg

SEQ ID NO: 700514 - DNA, 25 bp, Mus musculus
ggaccaaagttaactcttgagtgct

SEQ ID NO: 700515 - DNA, 25 bp, Mus musculus
ggaccaaagttatctcttgagtgct

SEQ ID NO: 700516 - DNA, 25 bp, Mus musculus
ggaccaaccaccacaagcaaagaag

SEQ ID NO: 700517 - DNA, 25 bp, Mus musculus
ggaccaaccacctcaagcaaagaag

SEQ ID NO: 700518 - DNA, 25 bp, Mus musculus
ggaccaacccgcctttcaacagctg

SEQ ID NO: 700519 - DNA, 25 bp, Mus musculus
ggaccaacccgcgtttcaacagctg

SEQ ID NO: 700520 - DNA, 25 bp, Mus musculus
ggaccaaccgctcggtcgaatccaa

SEQ ID NO: 700521 - DNA, 25 bp, Mus musculus
ggaccaaccgctgggtcgaatccaa

SEQ ID NO: 700522 - DNA, 25 bp, Mus musculus
ggaccaacttacacctccaaagctg

SEQ ID NO: 700523 - DNA, 25 bp, Mus musculus
ggaccaacttactcctccaaagctg

SEQ ID NO: 700524 - DNA, 25 bp, Mus musculus
ggaccaacttcaatcacctgcactg

SEQ ID NO: 700525 - DNA, 25 bp, Mus musculus
ggaccaacttcattcacctgcactg

SEQ ID NO: 700526 - DNA, 25 bp, Mus musculus
ggaccaagaggtacccaagccagaa

SEQ ID NO: 700527 - DNA, 25 bp, Mus musculus
ggaccaagaggttcccaagccagaa

SEQ ID NO: 700528 - DNA, 25 bp, Mus musculus
ggaccaagccgcagggcatgtgact

SEQ ID NO: 700529 - DNA, 25 bp, Mus musculus
ggaccaagccgctgggcatgtgact

SEQ ID NO: 700530 - DNA, 25 bp, Mus musculus
ggaccaagggctctctcatccggca

SEQ ID NO: 700531 - DNA, 25 bp, Mus musculus
ggaccaagggctgtctcatccggca

SEQ ID NO: 700532 - DNA, 25 bp, Mus musculus
ggaccaagggtcacagcttacaaga

SEQ ID NO: 700533 - DNA, 25 bp, Mus musculus
ggaccaagggtctcagcttacaaga

SEQ ID NO: 700534 - DNA, 25 bp, Mus musculus
ggaccaagtatcatcactgccccaa

SEQ ID NO: 700535 - DNA, 25 bp, Mus musculus
ggaccaagtatcttcactgccccaa

SEQ ID NO: 700536 - DNA, 25 bp, Mus musculus
ggaccaagtgatcctcaaagccatg

SEQ ID NO: 700537 - DNA, 25 bp, Mus musculus
ggaccaagtgatgctcaaagccatg

SEQ ID NO: 700538 - DNA, 25 bp, Mus musculus
ggaccaagtggcagctctgcattgg

SEQ ID NO: 700539 - DNA, 25 bp, Mus musculus
ggaccaagtggctgctctgcattgg

SEQ ID NO: 700540 - DNA, 25 bp, Mus musculus
ggaccaatgaaaccttagaacctcg

SEQ ID NO: 700541 - DNA, 25 bp, Mus musculus
ggaccaatgaaagcttagaacctcg

SEQ ID NO: 700542 - DNA, 25 bp, Mus musculus
ggaccaatgcgaatcccagaaagcc

SEQ ID NO: 700543 - DNA, 25 bp, Mus musculus
ggaccaatgcgattcccagaaagcc

SEQ ID NO: 700544 - DNA, 25 bp, Mus musculus
ggaccaattcttccaatagtgtctg

SEQ ID NO: 700545 - DNA, 25 bp, Mus musculus
ggaccaattcttgcaatagtgtctg

SEQ ID NO: 700546 - DNA, 25 bp, Mus musculus
ggaccacaaccgagcaaaatctcaa

SEQ ID NO: 700547 - DNA, 25 bp, Mus musculus
ggaccacaaccgtgcaaaatctcaa

SEQ ID NO: 700548 - DNA, 25 bp, Mus musculus
ggaccacaagcacagtgctgaaggt

SEQ ID NO: 700549 - DNA, 25 bp, Mus musculus
ggaccacaagcagagtgctgaaggt

SEQ ID NO: 700550 - DNA, 25 bp, Mus musculus
ggaccacaatggactctatgcagat

SEQ ID NO: 700551 - DNA, 25 bp, Mus musculus
ggaccacaatggtctctatgcagat

SEQ ID NO: 700552 - DNA, 25 bp, Mus musculus
ggaccacatcagaaaatattcagaa

SEQ ID NO: 700553 - DNA, 25 bp, Mus musculus
ggaccacatcagtaaatattcagaa

SEQ ID NO: 700554 - DNA, 25 bp, Mus musculus
ggaccacatccacagccgaattgta

SEQ ID NO: 700555 - DNA, 25 bp, Mus musculus
ggaccacatccagagccgaattgta

SEQ ID NO: 700556 - DNA, 25 bp, Mus musculus
ggaccacattcacaacctaaggctg

SEQ ID NO: 700557 - DNA, 25 bp, Mus musculus
ggaccacattcagaacctaaggctg

SEQ ID NO: 700558 - DNA, 25 bp, Mus musculus
ggaccaccgggcatcctaaggctgc

SEQ ID NO: 700559 - DNA, 25 bp, Mus musculus
ggaccaccgggcttcctaaggctgc

SEQ ID NO: 700560 - DNA, 25 bp, Mus musculus
ggaccacctcaaaccaagttgggtg

SEQ ID NO: 700561 - DNA, 25 bp, Mus musculus
ggaccacctcaatccaagttgggtg

SEQ ID NO: 700562 - DNA, 25 bp, Mus musculus
ggaccacgacctactcacctgtggg

SEQ ID NO: 700563 - DNA, 25 bp, Mus musculus
ggaccacgaccttctcacctgtggg

SEQ ID NO: 700564 - DNA, 25 bp, Mus musculus
ggaccacgctctcaacgatatgact

SEQ ID NO: 700565 - DNA, 25 bp, Mus musculus
ggaccacgctctgaacgatatgact

SEQ ID NO: 700566 - DNA, 25 bp, Mus musculus
ggaccacgggatccaagctttgtaa

SEQ ID NO: 700567 - DNA, 25 bp, Mus musculus
ggaccacgggatgcaagctttgtaa

SEQ ID NO: 700568 - DNA, 25 bp, Mus musculus
ggaccacgtggtcgcaaatcctcca

SEQ ID NO: 700569 - DNA, 25 bp, Mus musculus
ggaccacgtggtggcaaatcctcca

SEQ ID NO: 700570 - DNA, 25 bp, Mus musculus
ggaccacttagacactttgcaccta

SEQ ID NO: 700571 - DNA, 25 bp, Mus musculus
ggaccacttagagactttgcaccta

SEQ ID NO: 700572 - DNA, 25 bp, Mus musculus
ggaccagaagggactccaggcatac

SEQ ID NO: 700573 - DNA, 25 bp, Mus musculus
ggaccagaagggtctccaggcatac

SEQ ID NO: 700574 - DNA, 25 bp, Mus musculus
ggaccagactgcagggtgctgtttc

SEQ ID NO: 700575 - DNA, 25 bp, Mus musculus
ggaccagactgctgggtgctgtttc

SEQ ID NO: 700576 - DNA, 25 bp, Mus musculus
ggaccagatattccaggcgctcttc

SEQ ID NO: 700577 - DNA, 25 bp, Mus musculus
ggaccagatattgcaggcgctcttc

SEQ ID NO: 700578 - DNA, 25 bp, Mus musculus
ggaccagatcctcaataacctaagc

SEQ ID NO: 700579 - DNA, 25 bp, Mus musculus
ggaccagatcctgaataacctaagc

SEQ ID NO: 700580 - DNA, 25 bp, Mus musculus
ggaccagcacggcaagccatatttc

SEQ ID NO: 700581 - DNA, 25 bp, Mus musculus
ggaccagcacgggaagccatatttc

SEQ ID NO: 700582 - DNA, 25 bp, Mus musculus
ggaccagcagaaactaccctacggt

SEQ ID NO: 700583 - DNA, 25 bp, Mus musculus
ggaccagcagaatctaccctacggt

SEQ ID NO: 700584 - DNA, 25 bp, Mus musculus
ggaccagcagagcatcccctgcagt

SEQ ID NO: 700585 - DNA, 25 bp, Mus musculus
ggaccagcagaggatcccctgcagt

SEQ ID NO: 700586 - DNA, 25 bp, Mus musculus
ggaccagcatatcctgatcagcatt

SEQ ID NO: 700587 - DNA, 25 bp, Mus musculus
ggaccagcatatgctgatcagcatt

SEQ ID NO: 700588 - DNA, 25 bp, Mus musculus
ggaccagcatcaaaattactacagc

SEQ ID NO: 700589 - DNA, 25 bp, Mus musculus
ggaccagcatcataattactacagc

SEQ ID NO: 700590 - DNA, 25 bp, Mus musculus
ggaccagcgctgacctagcaagaga

SEQ ID NO: 700591 - DNA, 25 bp, Mus musculus
ggaccagcgctgtcctagcaagaga

SEQ ID NO: 700592 - DNA, 25 bp, Mus musculus
ggaccagcggctcgtgtcattgccc

SEQ ID NO: 700593 - DNA, 25 bp, Mus musculus
ggaccagcggctggtgtcattgccc

SEQ ID NO: 700594 - DNA, 25 bp, Mus musculus
ggaccagcgggaagagatcctgtta

SEQ ID NO: 700595 - DNA, 25 bp, Mus musculus
ggaccagcgggatgagatcctgtta

SEQ ID NO: 700596 - DNA, 25 bp, Mus musculus
ggaccagcttccaggagggcacgct

SEQ ID NO: 700597 - DNA, 25 bp, Mus musculus
ggaccagcttcctggagggcacgct

SEQ ID NO: 700598 - DNA, 25 bp, Mus musculus
ggaccaggaagaaccacatactgaa

SEQ ID NO: 700599 - DNA, 25 bp, Mus musculus
ggaccaggaagatccacatactgaa

SEQ ID NO: 700600 - DNA, 25 bp, Mus musculus
ggaccaggaataaggacccatgact

SEQ ID NO: 700601 - DNA, 25 bp, Mus musculus
ggaccaggaatatggacccatgact

SEQ ID NO: 700602 - DNA, 25 bp, Mus musculus
ggaccaggcagtcgctatcatgaga

SEQ ID NO: 700603 - DNA, 25 bp, Mus musculus
ggaccaggcagtggctatcatgaga

SEQ ID NO: 700604 - DNA, 25 bp, Mus musculus
ggaccaggcattcgtgccagtgaac

SEQ ID NO: 700605 - DNA, 25 bp, Mus musculus
ggaccaggcattggtgccagtgaac

SEQ ID NO: 700606 - DNA, 25 bp, Mus musculus
ggaccaggccccattttatcacttg

SEQ ID NO: 700607 - DNA, 25 bp, Mus musculus
ggaccaggcccctttttatcacttg

SEQ ID NO: 700608 - DNA, 25 bp, Mus musculus
ggaccagggactcccaggcctgcat

SEQ ID NO: 700609 - DNA, 25 bp, Mus musculus
ggaccagggactgccaggcctgcat

SEQ ID NO: 700610 - DNA, 25 bp, Mus musculus
ggaccagggcacctccatgtgtctg

SEQ ID NO: 700611 - DNA, 25 bp, Mus musculus
ggaccagggcacgtccatgtgtctg

SEQ ID NO: 700612 - DNA, 25 bp, Mus musculus
ggaccagggcatcgatcccaatagc

SEQ ID NO: 700613 - DNA, 25 bp, Mus musculus
ggaccagggcatggatcccaatagc

SEQ ID NO: 700614 - DNA, 25 bp, Mus musculus
ggaccaggtggtagagcgcctcctt

SEQ ID NO: 700615 - DNA, 25 bp, Mus musculus
ggaccaggtggttgagcgcctcctt

SEQ ID NO: 700616 - DNA, 25 bp, Mus musculus
ggaccagtatgaaaccaaagagtgg

SEQ ID NO: 700617 - DNA, 25 bp, Mus musculus
ggaccagtatgataccaaagagtgg

SEQ ID NO: 700618 - DNA, 25 bp, Mus musculus
ggaccagtctgaacagtgcctgaga

SEQ ID NO: 700619 - DNA, 25 bp, Mus musculus
ggaccagtctgatcagtgcctgaga

SEQ ID NO: 700620 - DNA, 25 bp, Mus musculus
ggaccagtgatgcaaatcctcaaat

SEQ ID NO: 700621 - DNA, 25 bp, Mus musculus
ggaccagtgatggaaatcctcaaat

SEQ ID NO: 700622 - DNA, 25 bp, Mus musculus
ggaccagtgccaaggacagtcccct

SEQ ID NO: 700623 - DNA, 25 bp, Mus musculus
ggaccagtgccatggacagtcccct

SEQ ID NO: 700624 - DNA, 25 bp, Mus musculus
ggaccagttccaagactgcttctcc

SEQ ID NO: 700625 - DNA, 25 bp, Mus musculus
ggaccagttccatgactgcttctcc

SEQ ID NO: 700626 - DNA, 25 bp, Mus musculus
ggaccagttgataacccacaccttg

SEQ ID NO: 700627 - DNA, 25 bp, Mus musculus
ggaccagttgattacccacaccttg

SEQ ID NO: 700628 - DNA, 25 bp, Mus musculus
ggaccatcaactcataaagaccctg

SEQ ID NO: 700629 - DNA, 25 bp, Mus musculus
ggaccatcaactgataaagaccctg

SEQ ID NO: 700630 - DNA, 25 bp, Mus musculus
ggaccatccccaagtttgtgccaga

SEQ ID NO: 700631 - DNA, 25 bp, Mus musculus
ggaccatccccatgtttgtgccaga

SEQ ID NO: 700632 - DNA, 25 bp, Mus musculus
ggaccatccgagacaagttcgcccg

SEQ ID NO: 700633 - DNA, 25 bp, Mus musculus
ggaccatccgagtcaagttcgcccg

SEQ ID NO: 700634 - DNA, 25 bp, Mus musculus
ggaccatcgagtcatcctgggagat

SEQ ID NO: 700635 - DNA, 25 bp, Mus musculus
ggaccatcgagtgatcctgggagat

SEQ ID NO: 700636 - DNA, 25 bp, Mus musculus
ggaccatcttatcccagtgaatctg

SEQ ID NO: 700637 - DNA, 25 bp, Mus musculus
ggaccatcttatgccagtgaatctg

SEQ ID NO: 700638 - DNA, 25 bp, Mus musculus
ggaccatgacacagaaggatgtgga

SEQ ID NO: 700639 - DNA, 25 bp, Mus musculus
ggaccatgacactgaaggatgtgga

SEQ ID NO: 700640 - DNA, 25 bp, Mus musculus
ggaccatgacctagctgaccatgaa

SEQ ID NO: 700641 - DNA, 25 bp, Mus musculus
ggaccatgaccttgctgaccatgaa

SEQ ID NO: 700642 - DNA, 25 bp, Mus musculus
ggaccatgagaacctgatgaatgtg

SEQ ID NO: 700643 - DNA, 25 bp, Mus musculus
ggaccatgagaagctgatgaatgtg

SEQ ID NO: 700644 - DNA, 25 bp, Mus musculus
ggaccatgctgcagcaactcacaca

SEQ ID NO: 700645 - DNA, 25 bp, Mus musculus
ggaccatgctgctgcaactcacaca

SEQ ID NO: 700646 - DNA, 25 bp, Mus musculus
ggaccatgggccagctttgctgctt

SEQ ID NO: 700647 - DNA, 25 bp, Mus musculus
ggaccatgggcctgctttgctgctt

SEQ ID NO: 700648 - DNA, 25 bp, Mus musculus
ggaccattacccaaaagctttgcag

SEQ ID NO: 700649 - DNA, 25 bp, Mus musculus
ggaccattaccctaaagctttgcag

SEQ ID NO: 700650 - DNA, 25 bp, Mus musculus
ggaccattacgaagctacagcaatg

SEQ ID NO: 700651 - DNA, 25 bp, Mus musculus
ggaccattacgatgctacagcaatg

SEQ ID NO: 700652 - DNA, 25 bp, Mus musculus
ggaccattcacccaagtgccaatcg

SEQ ID NO: 700653 - DNA, 25 bp, Mus musculus
ggaccattcaccgaagtgccaatcg

SEQ ID NO: 700654 - DNA, 25 bp, Mus musculus
ggaccattgcaaacagccagggact

SEQ ID NO: 700655 - DNA, 25 bp, Mus musculus
ggaccattgcaatcagccagggact

SEQ ID NO: 700656 - DNA, 25 bp, Mus musculus
ggaccattttaaccctgatggagca

SEQ ID NO: 700657 - DNA, 25 bp, Mus musculus
ggaccattttaagcctgatggagca

SEQ ID NO: 700658 - DNA, 25 bp, Mus musculus
ggacccaaacagcagacattcacct

SEQ ID NO: 700659 - DNA, 25 bp, Mus musculus
ggacccaaacaggagacattcacct

SEQ ID NO: 700660 - DNA, 25 bp, Mus musculus
ggacccaacagtactctgatcatca

SEQ ID NO: 700661 - DNA, 25 bp, Mus musculus
ggacccaacagttctctgatcatca

SEQ ID NO: 700662 - DNA, 25 bp, Mus musculus
ggacccaactatctgcagatacctg

SEQ ID NO: 700663 - DNA, 25 bp, Mus musculus
ggacccaactatgtgcagatacctg

SEQ ID NO: 700664 - DNA, 25 bp, Mus musculus
ggacccaaggtcagatattcagcac

SEQ ID NO: 700665 - DNA, 25 bp, Mus musculus
ggacccaaggtctgatattcagcac

SEQ ID NO: 700666 - DNA, 25 bp, Mus musculus
ggacccacactcacagacaagaagc

SEQ ID NO: 700667 - DNA, 25 bp, Mus musculus
ggacccacactctcagacaagaagc

SEQ ID NO: 700668 - DNA, 25 bp, Mus musculus
ggacccacacttaaagcgaacgaag

SEQ ID NO: 700669 - DNA, 25 bp, Mus musculus
ggacccacactttaagcgaacgaag

SEQ ID NO: 700670 - DNA, 25 bp, Mus musculus
ggacccacatcactgtagttgccca

SEQ ID NO: 700671 - DNA, 25 bp, Mus musculus
ggacccacatcagtgtagttgccca

SEQ ID NO: 700672 - DNA, 25 bp, Mus musculus
ggacccacccaaaggtgtctgggca

SEQ ID NO: 700673 - DNA, 25 bp, Mus musculus
ggacccacccaatggtgtctgggca

SEQ ID NO: 700674 - DNA, 25 bp, Mus musculus
ggacccacgggcatcctgggatcag

SEQ ID NO: 700675 - DNA, 25 bp, Mus musculus
ggacccacgggcttcctgggatcag

SEQ ID NO: 700676 - DNA, 25 bp, Mus musculus
ggacccacttgaccgccagtttgag

SEQ ID NO: 700677 - DNA, 25 bp, Mus musculus
ggacccacttgagcgccagtttgag

SEQ ID NO: 700678 - DNA, 25 bp, Mus musculus
ggacccagagatcgccaaaagcaag

SEQ ID NO: 700679 - DNA, 25 bp, Mus musculus
ggacccagagatggccaaaagcaag

SEQ ID NO: 700680 - DNA, 25 bp, Mus musculus
ggacccagattgacttgtggacgga

SEQ ID NO: 700681 - DNA, 25 bp, Mus musculus
ggacccagattgtcttgtggacgga

SEQ ID NO: 700682 - DNA, 25 bp, Mus musculus
ggacccagccaaagatacctttgac

SEQ ID NO: 700683 - DNA, 25 bp, Mus musculus
ggacccagccaatgatacctttgac

SEQ ID NO: 700684 - DNA, 25 bp, Mus musculus
ggacccagctctctaggaagcagga

SEQ ID NO: 700685 - DNA, 25 bp, Mus musculus
ggacccagctctgtaggaagcagga

SEQ ID NO: 700686 - DNA, 25 bp, Mus musculus
ggacccaggataagaaatgacaacg

SEQ ID NO: 700687 - DNA, 25 bp, Mus musculus
ggacccaggatatgaaatgacaacg

SEQ ID NO: 700688 - DNA, 25 bp, Mus musculus
ggacccaggcaaagtcagaagtctg

SEQ ID NO: 700689 - DNA, 25 bp, Mus musculus
ggacccaggcaatgtcagaagtctg

SEQ ID NO: 700690 - DNA, 25 bp, Mus musculus
ggacccagtcctatgactacagata

SEQ ID NO: 700691 - DNA, 25 bp, Mus musculus
ggacccagtcctttgactacagata

SEQ ID NO: 700692 - DNA, 25 bp, Mus musculus
ggacccagtggaagccaaaccattc

SEQ ID NO: 700693 - DNA, 25 bp, Mus musculus
ggacccagtggatgccaaaccattc

SEQ ID NO: 700694 - DNA, 25 bp, Mus musculus
ggacccatgatgacttgaagaaagc

SEQ ID NO: 700695 - DNA, 25 bp, Mus musculus
ggacccatgatgtcttgaagaaagc

SEQ ID NO: 700696 - DNA, 25 bp, Mus musculus
ggacccatgcacaatgtctagaaga

SEQ ID NO: 700697 - DNA, 25 bp, Mus musculus
ggacccatgcactatgtctagaaga

SEQ ID NO: 700698 - DNA, 25 bp, Mus musculus
ggacccatgtgccacctcctgtggt

SEQ ID NO: 700699 - DNA, 25 bp, Mus musculus
ggacccatgtgcgacctcctgtggt

SEQ ID NO: 700700 - DNA, 25 bp, Mus musculus
ggaccccaagatcgcagacctggta

SEQ ID NO: 700701 - DNA, 25 bp, Mus musculus
ggaccccaagatggcagacctggta

SEQ ID NO: 700702 - DNA, 25 bp, Mus musculus
ggaccccaatgcagggcgctttgtt

SEQ ID NO: 700703 - DNA, 25 bp, Mus musculus
ggaccccaatgctgggcgctttgtt

SEQ ID NO: 700704 - DNA, 25 bp, Mus musculus
ggaccccacaacaggcaagcacaag

SEQ ID NO: 700705 - DNA, 25 bp, Mus musculus
ggaccccacaactggcaagcacaag

SEQ ID NO: 700706 - DNA, 25 bp, Mus musculus
ggaccccacaggacttcacatactg

SEQ ID NO: 700707 - DNA, 25 bp, Mus musculus
ggaccccacaggtcttcacatactg

SEQ ID NO: 700708 - DNA, 25 bp, Mus musculus
ggaccccagagactaacaggtgtct

SEQ ID NO: 700709 - DNA, 25 bp, Mus musculus
ggaccccagagagtaacaggtgtct

SEQ ID NO: 700710 - DNA, 25 bp, Mus musculus
ggaccccagagcagtgtacagtaga

SEQ ID NO: 700711 - DNA, 25 bp, Mus musculus
ggaccccagagctgtgtacagtaga

SEQ ID NO: 700712 - DNA, 25 bp, Mus musculus
ggaccccagaggagaagcacttttg

SEQ ID NO: 700713 - DNA, 25 bp, Mus musculus
ggaccccagaggtgaagcacttttg

SEQ ID NO: 700714 - DNA, 25 bp, Mus musculus
ggaccccagcgtcggaagctgcttt

SEQ ID NO: 700715 - DNA, 25 bp, Mus musculus
ggaccccagcgtgggaagctgcttt

SEQ ID NO: 700716 - DNA, 25 bp, Mus musculus
ggaccccagtccatccaatctataa

SEQ ID NO: 700717 - DNA, 25 bp, Mus musculus
ggaccccagtccttccaatctataa

SEQ ID NO: 700718 - DNA, 25 bp, Mus musculus
ggaccccgtcgtaccctttgatgcg

SEQ ID NO: 700719 - DNA, 25 bp, Mus musculus
ggaccccgtcgttccctttgatgcg

SEQ ID NO: 700720 - DNA, 25 bp, Mus musculus
ggacccctcttaagtatgccgctag

SEQ ID NO: 700721 - DNA, 25 bp, Mus musculus
ggacccctcttatgtatgccgctag

SEQ ID NO: 700722 - DNA, 25 bp, Mus musculus
ggacccctggagagttctgcctgct

SEQ ID NO: 700723 - DNA, 25 bp, Mus musculus
ggacccctggagtgttctgcctgct

SEQ ID NO: 700724 - DNA, 25 bp, Mus musculus
ggacccctttctctaattgtctccg

SEQ ID NO: 700725 - DNA, 25 bp, Mus musculus
ggacccctttctgtaattgtctccg

SEQ ID NO: 700726 - DNA, 25 bp, Mus musculus
ggacccgacgtcagcatcctcttgc

SEQ ID NO: 700727 - DNA, 25 bp, Mus musculus
ggacccgacgtctgcatcctcttgc

SEQ ID NO: 700728 - DNA, 25 bp, Mus musculus
ggacccggaggcacatctatgacac

SEQ ID NO: 700729 - DNA, 25 bp, Mus musculus
ggacccggaggctcatctatgacac

SEQ ID NO: 700730 - DNA, 25 bp, Mus musculus
ggacccgttttaacttcatccttgt

SEQ ID NO: 700731 - DNA, 25 bp, Mus musculus
ggacccgttttatcttcatccttgt

SEQ ID NO: 700732 - DNA, 25 bp, Mus musculus
ggaccctaacaaccggagatccaga

SEQ ID NO: 700733 - DNA, 25 bp, Mus musculus
ggaccctaacaagcggagatccaga

SEQ ID NO: 700734 - DNA, 25 bp, Mus musculus
ggaccctaactcaatgtaccaggaa

SEQ ID NO: 700735 - DNA, 25 bp, Mus musculus
ggaccctaactctatgtaccaggaa

SEQ ID NO: 700736 - DNA, 25 bp, Mus musculus
ggaccctagcagatcacaaaacttt

SEQ ID NO: 700737 - DNA, 25 bp, Mus musculus
ggaccctagcagttcacaaaacttt

SEQ ID NO: 700738 - DNA, 25 bp, Mus musculus
ggaccctcctcgcaggacaatggag

SEQ ID NO: 700739 - DNA, 25 bp, Mus musculus
ggaccctcctcggaggacaatggag

SEQ ID NO: 700740 - DNA, 25 bp, Mus musculus
ggaccctcgggcagagacttgacac

SEQ ID NO: 700741 - DNA, 25 bp, Mus musculus
ggaccctcgggctgagacttgacac

SEQ ID NO: 700742 - DNA, 25 bp, Mus musculus
ggaccctcgggtattccagctgcaa

SEQ ID NO: 700743 - DNA, 25 bp, Mus musculus
ggaccctcgggttttccagctgcaa

SEQ ID NO: 700744 - DNA, 25 bp, Mus musculus
ggaccctctgataggcgggctcgcc

SEQ ID NO: 700745 - DNA, 25 bp, Mus musculus
ggaccctctgattggcgggctcgcc

SEQ ID NO: 700746 - DNA, 25 bp, Mus musculus
ggaccctggctgatacccagagaag

SEQ ID NO: 700747 - DNA, 25 bp, Mus musculus
ggaccctggctgttacccagagaag

SEQ ID NO: 700748 - DNA, 25 bp, Mus musculus
ggaccctgggaccacaacgcacttg

SEQ ID NO: 700749 - DNA, 25 bp, Mus musculus
ggaccctgggacgacaacgcacttg

SEQ ID NO: 700750 - DNA, 25 bp, Mus musculus
ggaccctgtaatatgcctaagcctg

SEQ ID NO: 700751 - DNA, 25 bp, Mus musculus
ggaccctgtaatttgcctaagcctg

SEQ ID NO: 700752 - DNA, 25 bp, Mus musculus
ggaccctgtccaatatgccaagcag

SEQ ID NO: 700753 - DNA, 25 bp, Mus musculus
ggaccctgtccattatgccaagcag

SEQ ID NO: 700754 - DNA, 25 bp, Mus musculus
ggacccttgacccagtgctccggtg

SEQ ID NO: 700755 - DNA, 25 bp, Mus musculus
ggacccttgaccgagtgctccggtg

SEQ ID NO: 700756 - DNA, 25 bp, Mus musculus
ggaccctttcaacatccatgactta

SEQ ID NO: 700757 - DNA, 25 bp, Mus musculus
ggaccctttcaagatccatgactta

SEQ ID NO: 700758 - DNA, 25 bp, Mus musculus
ggaccctttctaccacaggtgctga

SEQ ID NO: 700759 - DNA, 25 bp, Mus musculus
ggaccctttctagcacaggtgctga

SEQ ID NO: 700760 - DNA, 25 bp, Mus musculus
ggaccgaaagcgacgctgctccgct

SEQ ID NO: 700761 - DNA, 25 bp, Mus musculus
ggaccgaaagcgtcgctgctccgct

SEQ ID NO: 700762 - DNA, 25 bp, Mus musculus
ggaccgaattgcatcaacaacgaaa

SEQ ID NO: 700763 - DNA, 25 bp, Mus musculus
ggaccgaattgcttcaacaacgaaa

SEQ ID NO: 700764 - DNA, 25 bp, Mus musculus
ggaccgactcaacgtattcatgcag

SEQ ID NO: 700765 - DNA, 25 bp, Mus musculus
ggaccgactcaaggtattcatgcag

SEQ ID NO: 700766 - DNA, 25 bp, Mus musculus
ggaccgagaaaacgagattctcatg

SEQ ID NO: 700767 - DNA, 25 bp, Mus musculus
ggaccgagaaaaggagattctcatg

SEQ ID NO: 700768 - DNA, 25 bp, Mus musculus
ggaccgagaccactttgccaagctg

SEQ ID NO: 700769 - DNA, 25 bp, Mus musculus
ggaccgagaccagtttgccaagctg

SEQ ID NO: 700770 - DNA, 25 bp, Mus musculus
ggaccgagagatcatgcgtcatgac

SEQ ID NO: 700771 - DNA, 25 bp, Mus musculus
ggaccgagagatgatgcgtcatgac

SEQ ID NO: 700772 - DNA, 25 bp, Mus musculus
ggaccgagccccacgtgataggcat

SEQ ID NO: 700773 - DNA, 25 bp, Mus musculus
ggaccgagcccctcgtgataggcat

SEQ ID NO: 700774 - DNA, 25 bp, Mus musculus
ggaccgagccttcagcaacctagaa

SEQ ID NO: 700775 - DNA, 25 bp, Mus musculus
ggaccgagccttgagcaacctagaa

SEQ ID NO: 700776 - DNA, 25 bp, Mus musculus
ggaccgagctaccttctacctgaat

SEQ ID NO: 700777 - DNA, 25 bp, Mus musculus
ggaccgagctacgttctacctgaat

SEQ ID NO: 700778 - DNA, 25 bp, Mus musculus
ggaccgagctccatttgtgcttacc

SEQ ID NO: 700779 - DNA, 25 bp, Mus musculus
ggaccgagctccttttgtgcttacc

SEQ ID NO: 700780 - DNA, 25 bp, Mus musculus
ggaccgaggcagcagcagtcaccac

SEQ ID NO: 700781 - DNA, 25 bp, Mus musculus
ggaccgaggcaggagcagtcaccac

SEQ ID NO: 700782 - DNA, 25 bp, Mus musculus
ggaccgagtaaaccgaggcttccag

SEQ ID NO: 700783 - DNA, 25 bp, Mus musculus
ggaccgagtaaagcgaggcttccag

SEQ ID NO: 700784 - DNA, 25 bp, Mus musculus
ggaccgagtgacagagttcctccag

SEQ ID NO: 700785 - DNA, 25 bp, Mus musculus
ggaccgagtgactgagttcctccag

SEQ ID NO: 700786 - DNA, 25 bp, Mus musculus
ggaccgatcccaaggctcctatctg

SEQ ID NO: 700787 - DNA, 25 bp, Mus musculus
ggaccgatcccatggctcctatctg

SEQ ID NO: 700788 - DNA, 25 bp, Mus musculus
ggaccgatgctgaatgctgcccaac

SEQ ID NO: 700789 - DNA, 25 bp, Mus musculus
ggaccgatgctgtatgctgcccaac

SEQ ID NO: 700790 - DNA, 25 bp, Mus musculus
ggaccgcagtccctaattcctggca

SEQ ID NO: 700791 - DNA, 25 bp, Mus musculus
ggaccgcagtccgtaattcctggca

SEQ ID NO: 700792 - DNA, 25 bp, Mus musculus
ggaccgcctgagaatcaaccgcttt

SEQ ID NO: 700793 - DNA, 25 bp, Mus musculus
ggaccgcctgagtatcaaccgcttt

SEQ ID NO: 700794 - DNA, 25 bp, Mus musculus
ggaccgcgaatgacatagcctcaca

SEQ ID NO: 700795 - DNA, 25 bp, Mus musculus
ggaccgcgaatgtcatagcctcaca

SEQ ID NO: 700796 - DNA, 25 bp, Mus musculus
ggaccgcgcctgagccgcctgttgt

SEQ ID NO: 700797 - DNA, 25 bp, Mus musculus
ggaccgcgcctgtgccgcctgttgt

SEQ ID NO: 700798 - DNA, 25 bp, Mus musculus
ggaccgcggagcagttctagcccgc

SEQ ID NO: 700799 - DNA, 25 bp, Mus musculus
ggaccgcggagctgttctagcccgc

SEQ ID NO: 700800 - DNA, 25 bp, Mus musculus
ggaccgctacatcagccccatggag

SEQ ID NO: 700801 - DNA, 25 bp, Mus musculus
ggaccgctacatgagccccatggag

SEQ ID NO: 700802 - DNA, 25 bp, Mus musculus
ggaccgctggagctgccatgtcttc

SEQ ID NO: 700803 - DNA, 25 bp, Mus musculus
ggaccgctggaggtgccatgtcttc

SEQ ID NO: 700804 - DNA, 25 bp, Mus musculus
ggaccggactccaacaggcctgcaa

SEQ ID NO: 700805 - DNA, 25 bp, Mus musculus
ggaccggactcctacaggcctgcaa

SEQ ID NO: 700806 - DNA, 25 bp, Mus musculus
ggaccggagagtccgaaccagttat

SEQ ID NO: 700807 - DNA, 25 bp, Mus musculus
ggaccggagagtgcgaaccagttat

SEQ ID NO: 700808 - DNA, 25 bp, Mus musculus
ggaccggctacacagaacaactgca

SEQ ID NO: 700809 - DNA, 25 bp, Mus musculus
ggaccggctacagagaacaactgca

SEQ ID NO: 700810 - DNA, 25 bp, Mus musculus
ggaccggtgcctacaaccccatgtg

SEQ ID NO: 700811 - DNA, 25 bp, Mus musculus
ggaccggtgccttcaaccccatgtg

SEQ ID NO: 700812 - DNA, 25 bp, Mus musculus
ggaccggtttgcaagaggccagctc

SEQ ID NO: 700813 - DNA, 25 bp, Mus musculus
ggaccggtttgctagaggccagctc

SEQ ID NO: 700814 - DNA, 25 bp, Mus musculus
ggaccgtgaaggagaagagttcaaa

SEQ ID NO: 700815 - DNA, 25 bp, Mus musculus
ggaccgtgaaggtgaagagttcaaa

SEQ ID NO: 700816 - DNA, 25 bp, Mus musculus
ggaccgtgcggacttgctcgtccct

SEQ ID NO: 700817 - DNA, 25 bp, Mus musculus
ggaccgtgcggagttgctcgtccct

SEQ ID NO: 700818 - DNA, 25 bp, Mus musculus
ggaccgtgtcagacagctgcatgaa

SEQ ID NO: 700819 - DNA, 25 bp, Mus musculus
ggaccgtgtcagtcagctgcatgaa

SEQ ID NO: 700820 - DNA, 25 bp, Mus musculus
ggaccgtgtggaagtacttcgtgca

SEQ ID NO: 700821 - DNA, 25 bp, Mus musculus
ggaccgtgtggatgtacttcgtgca

SEQ ID NO: 700822 - DNA, 25 bp, Mus musculus
ggaccgtttctacctggtgtttgag

SEQ ID NO: 700823 - DNA, 25 bp, Mus musculus
ggaccgtttctagctggtgtttgag

SEQ ID NO: 700824 - DNA, 25 bp, Mus musculus
ggacctaaagaacgcctaccgcaag

SEQ ID NO: 700825 - DNA, 25 bp, Mus musculus
ggacctaaagaaggcctaccgcaag

SEQ ID NO: 700826 - DNA, 25 bp, Mus musculus
ggacctaactccaagagatcctgga

SEQ ID NO: 700827 - DNA, 25 bp, Mus musculus
ggacctaactcctagagatcctgga

SEQ ID NO: 700828 - DNA, 25 bp, Mus musculus
ggacctaagaggcaacgcatttaat

SEQ ID NO: 700829 - DNA, 25 bp, Mus musculus
ggacctaagagggaacgcatttaat

SEQ ID NO: 700830 - DNA, 25 bp, Mus musculus
ggacctaagattatcatgatcacta

SEQ ID NO: 700831 - DNA, 25 bp, Mus musculus
ggacctaagattttcatgatcacta

SEQ ID NO: 700832 - DNA, 25 bp, Mus musculus
ggacctacactaaggaatcctcatt

SEQ ID NO: 700833 - DNA, 25 bp, Mus musculus
ggacctacactatggaatcctcatt

SEQ ID NO: 700834 - DNA, 25 bp, Mus musculus
ggacctaccggccagagtatgcagt

SEQ ID NO: 700835 - DNA, 25 bp, Mus musculus
ggacctaccggcgagagtatgcagt

SEQ ID NO: 700836 - DNA, 25 bp, Mus musculus
ggacctacctctccaatgttaacaa

SEQ ID NO: 700837 - DNA, 25 bp, Mus musculus
ggacctacctctgcaatgttaacaa

SEQ ID NO: 700838 - DNA, 25 bp, Mus musculus
ggacctactgaaagccaatgtgaaa

SEQ ID NO: 700839 - DNA, 25 bp, Mus musculus
ggacctactgaatgccaatgtgaaa

SEQ ID NO: 700840 - DNA, 25 bp, Mus musculus
ggacctagctctcgtttgaacacac

SEQ ID NO: 700841 - DNA, 25 bp, Mus musculus
ggacctagctctggtttgaacacac

SEQ ID NO: 700842 - DNA, 25 bp, Mus musculus
ggacctaggactcctaatgttacag

SEQ ID NO: 700843 - DNA, 25 bp, Mus musculus
ggacctaggactgctaatgttacag

SEQ ID NO: 700844 - DNA, 25 bp, Mus musculus
ggacctatagtacatcgaggtgaag

SEQ ID NO: 700845 - DNA, 25 bp, Mus musculus
ggacctatagtagatcgaggtgaag

SEQ ID NO: 700846 - DNA, 25 bp, Mus musculus
ggacctatatcccagaagcagcggc

SEQ ID NO: 700847 - DNA, 25 bp, Mus musculus
ggacctatatccgagaagcagcggc

SEQ ID NO: 700848 - DNA, 25 bp, Mus musculus
ggacctatatgcctcaagtgctaga

SEQ ID NO: 700849 - DNA, 25 bp, Mus musculus
ggacctatatgcgtcaagtgctaga

SEQ ID NO: 700850 - DNA, 25 bp, Mus musculus
ggacctatatttagagcattgtagc

SEQ ID NO: 700851 - DNA, 25 bp, Mus musculus
ggacctatattttgagcattgtagc

SEQ ID NO: 700852 - DNA, 25 bp, Mus musculus
ggacctatcccacctgcaagtgaag

SEQ ID NO: 700853 - DNA, 25 bp, Mus musculus
ggacctatcccagctgcaagtgaag

SEQ ID NO: 700854 - DNA, 25 bp, Mus musculus
ggacctatgagaatgccaaggatca

SEQ ID NO: 700855 - DNA, 25 bp, Mus musculus
ggacctatgagattgccaaggatca

SEQ ID NO: 700856 - DNA, 25 bp, Mus musculus
ggacctatggtgatggatgctttaa

SEQ ID NO: 700857 - DNA, 25 bp, Mus musculus
ggacctatggtgttggatgctttaa

SEQ ID NO: 700858 - DNA, 25 bp, Mus musculus
ggacctcaaaatcagtgaagaaact

SEQ ID NO: 700859 - DNA, 25 bp, Mus musculus
ggacctcaaaatgagtgaagaaact

SEQ ID NO: 700860 - DNA, 25 bp, Mus musculus
ggacctcaaccgactgctgtacaag

SEQ ID NO: 700861 - DNA, 25 bp, Mus musculus
ggacctcaaccgtctgctgtacaag

SEQ ID NO: 700862 - DNA, 25 bp, Mus musculus
ggacctcaaggtccaagatgccaat

SEQ ID NO: 700863 - DNA, 25 bp, Mus musculus
ggacctcaaggtgcaagatgccaat

SEQ ID NO: 700864 - DNA, 25 bp, Mus musculus
ggacctcaagtccaagaatgtcttc

SEQ ID NO: 700865 - DNA, 25 bp, Mus musculus
ggacctcaagtcgaagaatgtcttc

SEQ ID NO: 700866 - DNA, 25 bp, Mus musculus
ggacctcacctgaaacggccacgtg

SEQ ID NO: 700867 - DNA, 25 bp, Mus musculus
ggacctcacctgtaacggccacgtg

SEQ ID NO: 700868 - DNA, 25 bp, Mus musculus
ggacctcagacacatgacatggaag

SEQ ID NO: 700869 - DNA, 25 bp, Mus musculus
ggacctcagacagatgacatggaag

SEQ ID NO: 700870 - DNA, 25 bp, Mus musculus
ggacctcaggagaaaaggtgttgct

SEQ ID NO: 700871 - DNA, 25 bp, Mus musculus
ggacctcaggagtaaaggtgttgct

SEQ ID NO: 700872 - DNA, 25 bp, Mus musculus
ggacctcagggcattccaggtgcag

SEQ ID NO: 700873 - DNA, 25 bp, Mus musculus
ggacctcagggctttccaggtgcag

SEQ ID NO: 700874 - DNA, 25 bp, Mus musculus
ggacctcaggtgcaccgcagccaaa

SEQ ID NO: 700875 - DNA, 25 bp, Mus musculus
ggacctcaggtggaccgcagccaaa

SEQ ID NO: 700876 - DNA, 25 bp, Mus musculus
ggacctcatgacatcctgcttagta

SEQ ID NO: 700877 - DNA, 25 bp, Mus musculus
ggacctcatgacttcctgcttagta

SEQ ID NO: 700878 - DNA, 25 bp, Mus musculus
ggacctcatggactcagggaacaag

SEQ ID NO: 700879 - DNA, 25 bp, Mus musculus
ggacctcatggagtcagggaacaag

SEQ ID NO: 700880 - DNA, 25 bp, Mus musculus
ggacctcatgtccattggcactctc

SEQ ID NO: 700881 - DNA, 25 bp, Mus musculus
ggacctcatgtcgattggcactctc

SEQ ID NO: 700882 - DNA, 25 bp, Mus musculus
ggacctcattcaaacctacagactg

SEQ ID NO: 700883 - DNA, 25 bp, Mus musculus
ggacctcattcatacctacagactg

SEQ ID NO: 700884 - DNA, 25 bp, Mus musculus
ggacctcccctgatgtggcacttct

SEQ ID NO: 700885 - DNA, 25 bp, Mus musculus
ggacctcccctgttgtggcacttct

SEQ ID NO: 700886 - DNA, 25 bp, Mus musculus
ggacctcctgctctgccacatgtgg

SEQ ID NO: 700887 - DNA, 25 bp, Mus musculus
ggacctcctgctgtgccacatgtgg

SEQ ID NO: 700888 - DNA, 25 bp, Mus musculus
ggacctcctggactcaagggtgcca

SEQ ID NO: 700889 - DNA, 25 bp, Mus musculus
ggacctcctggagtcaagggtgcca

SEQ ID NO: 700890 - DNA, 25 bp, Mus musculus
ggacctccttccagaaaacgaccat

SEQ ID NO: 700891 - DNA, 25 bp, Mus musculus
ggacctccttcctgaaaacgaccat

SEQ ID NO: 700892 - DNA, 25 bp, Mus musculus
ggacctcgaggaacctaaaagctca

SEQ ID NO: 700893 - DNA, 25 bp, Mus musculus
ggacctcgaggatcctaaaagctca

SEQ ID NO: 700894 - DNA, 25 bp, Mus musculus
ggacctcgcaagctgtgtgttaaag

SEQ ID NO: 700895 - DNA, 25 bp, Mus musculus
ggacctcgcaaggtgtgtgttaaag

SEQ ID NO: 700896 - DNA, 25 bp, Mus musculus
ggacctctcactagtcacggagatg

SEQ ID NO: 700897 - DNA, 25 bp, Mus musculus
ggacctctcacttgtcacggagatg

SEQ ID NO: 700898 - DNA, 25 bp, Mus musculus
ggacctctccctccaggaaaggtgg

SEQ ID NO: 700899 - DNA, 25 bp, Mus musculus
ggacctctccctgcaggaaaggtgg

SEQ ID NO: 700900 - DNA, 25 bp, Mus musculus
ggacctctcgaactgttggatacag

SEQ ID NO: 700901 - DNA, 25 bp, Mus musculus
ggacctctcgaagtgttggatacag

SEQ ID NO: 700902 - DNA, 25 bp, Mus musculus
ggacctctgtgcacacaaggctggg

SEQ ID NO: 700903 - DNA, 25 bp, Mus musculus
ggacctctgtgctcacaaggctggg

SEQ ID NO: 700904 - DNA, 25 bp, Mus musculus
ggacctctttttcggtggaacagag

SEQ ID NO: 700905 - DNA, 25 bp, Mus musculus
ggacctctttttgggtggaacagag

SEQ ID NO: 700906 - DNA, 25 bp, Mus musculus
ggacctgaattacctcatatatgtg

SEQ ID NO: 700907 - DNA, 25 bp, Mus musculus
ggacctgaattagctcatatatgtg

SEQ ID NO: 700908 - DNA, 25 bp, Mus musculus
ggacctgactcacgcatgaactcca

SEQ ID NO: 700909 - DNA, 25 bp, Mus musculus
ggacctgactcaggcatgaactcca

SEQ ID NO: 700910 - DNA, 25 bp, Mus musculus
ggacctgagactcatttcttgacta

SEQ ID NO: 700911 - DNA, 25 bp, Mus musculus
ggacctgagactgatttcttgacta

SEQ ID NO: 700912 - DNA, 25 bp, Mus musculus
ggacctgagttcacacccgggaagc

SEQ ID NO: 700913 - DNA, 25 bp, Mus musculus
ggacctgagttctcacccgggaagc

SEQ ID NO: 700914 - DNA, 25 bp, Mus musculus
ggacctgatgatcctccgatacgct

SEQ ID NO: 700915 - DNA, 25 bp, Mus musculus
ggacctgatgatgctccgatacgct

SEQ ID NO: 700916 - DNA, 25 bp, Mus musculus
ggacctgatggaacccctggctctg

SEQ ID NO: 700917 - DNA, 25 bp, Mus musculus
ggacctgatggatcccctggctctg

SEQ ID NO: 700918 - DNA, 25 bp, Mus musculus
ggacctgattctcaacctgggatct

SEQ ID NO: 700919 - DNA, 25 bp, Mus musculus
ggacctgattctgaacctgggatct

SEQ ID NO: 700920 - DNA, 25 bp, Mus musculus
ggacctgcagtcagagggctctgat

SEQ ID NO: 700921 - DNA, 25 bp, Mus musculus
ggacctgcagtctgagggctctgat

SEQ ID NO: 700922 - DNA, 25 bp, Mus musculus
ggacctgcatgacatcaaccgagag

SEQ ID NO: 700923 - DNA, 25 bp, Mus musculus
ggacctgcatgagatcaaccgagag

SEQ ID NO: 700924 - DNA, 25 bp, Mus musculus
ggacctgcatgtctacgagatcccc

SEQ ID NO: 700925 - DNA, 25 bp, Mus musculus
ggacctgcatgtgtacgagatcccc

SEQ ID NO: 700926 - DNA, 25 bp, Mus musculus
ggacctgccacaatcaggagtgtga

SEQ ID NO: 700927 - DNA, 25 bp, Mus musculus
ggacctgccacattcaggagtgtga

SEQ ID NO: 700928 - DNA, 25 bp, Mus musculus
ggacctgccccaagagcttctgctt

SEQ ID NO: 700929 - DNA, 25 bp, Mus musculus
ggacctgccccatgagcttctgctt

SEQ ID NO: 700930 - DNA, 25 bp, Mus musculus
ggacctgcctcacaaggccttcaga

SEQ ID NO: 700931 - DNA, 25 bp, Mus musculus
ggacctgcctcagaaggccttcaga

SEQ ID NO: 700932 - DNA, 25 bp, Mus musculus
ggacctgctcggaggaatggcgccg

SEQ ID NO: 700933 - DNA, 25 bp, Mus musculus
ggacctgctcggtggaatggcgccg

SEQ ID NO: 700934 - DNA, 25 bp, Mus musculus
ggacctgctgccatctctaaaaggg

SEQ ID NO: 700935 - DNA, 25 bp, Mus musculus
ggacctgctgccttctctaaaaggg

SEQ ID NO: 700936 - DNA, 25 bp, Mus musculus
ggacctggaagcaacttctggcaag

SEQ ID NO: 700937 - DNA, 25 bp, Mus musculus
ggacctggaagctacttctggcaag

SEQ ID NO: 700938 - DNA, 25 bp, Mus musculus
ggacctggactcacaccaatccttt

SEQ ID NO: 700939 - DNA, 25 bp, Mus musculus
ggacctggactctcaccaatccttt

SEQ ID NO: 700940 - DNA, 25 bp, Mus musculus
ggacctggatgcagatgagttagaa

SEQ ID NO: 700941 - DNA, 25 bp, Mus musculus
ggacctggatgctgatgagttagaa

SEQ ID NO: 700942 - DNA, 25 bp, Mus musculus
ggacctggatgtcccgtactttgcg

SEQ ID NO: 700943 - DNA, 25 bp, Mus musculus
ggacctggatgtgccgtactttgcg

SEQ ID NO: 700944 - DNA, 25 bp, Mus musculus
ggacctggcacccataaatgctttc

SEQ ID NO: 700945 - DNA, 25 bp, Mus musculus
ggacctggcaccgataaatgctttc

SEQ ID NO: 700946 - DNA, 25 bp, Mus musculus
ggacctggcctgaatgatcacaaca

SEQ ID NO: 700947 - DNA, 25 bp, Mus musculus
ggacctggcctgtatgatcacaaca

SEQ ID NO: 700948 - DNA, 25 bp, Mus musculus
ggacctggcggaaaccctgcagtga

SEQ ID NO: 700949 - DNA, 25 bp, Mus musculus
ggacctggcggataccctgcagtga

SEQ ID NO: 700950 - DNA, 25 bp, Mus musculus
ggacctggctccagagcggctccag

SEQ ID NO: 700951 - DNA, 25 bp, Mus musculus
ggacctggctcctgagcggctccag

SEQ ID NO: 700952 - DNA, 25 bp, Mus musculus
ggacctgggcaccatggacttagct

SEQ ID NO: 700953 - DNA, 25 bp, Mus musculus
ggacctgggcacgatggacttagct

SEQ ID NO: 700954 - DNA, 25 bp, Mus musculus
ggacctggtagaagttgtcctgtca

SEQ ID NO: 700955 - DNA, 25 bp, Mus musculus
ggacctggtagatgttgtcctgtca

SEQ ID NO: 700956 - DNA, 25 bp, Mus musculus
ggacctgtatccactccccatatgg

SEQ ID NO: 700957 - DNA, 25 bp, Mus musculus
ggacctgtatcctctccccatatgg

SEQ ID NO: 700958 - DNA, 25 bp, Mus musculus
ggacctgtattcacaccttctttga

SEQ ID NO: 700959 - DNA, 25 bp, Mus musculus
ggacctgtattcagagtgaacttca

SEQ ID NO: 700960 - DNA, 25 bp, Mus musculus
ggacctgtattctcaccttctttga

SEQ ID NO: 700961 - DNA, 25 bp, Mus musculus
ggacctgtattctgagtgaacttca

SEQ ID NO: 700962 - DNA, 25 bp, Mus musculus
ggacctgtgttacctaccttgggac

SEQ ID NO: 700963 - DNA, 25 bp, Mus musculus
ggacctgtgttagctaccttgggac

SEQ ID NO: 700964 - DNA, 25 bp, Mus musculus
ggacctgtgtttcgagaactgtcag

SEQ ID NO: 700965 - DNA, 25 bp, Mus musculus
ggacctgtgtttggagaactgtcag

SEQ ID NO: 700966 - DNA, 25 bp, Mus musculus
ggacctgttcaccaactacatttca

SEQ ID NO: 700967 - DNA, 25 bp, Mus musculus
ggacctgttcacgaactacatttca

SEQ ID NO: 700968 - DNA, 25 bp, Mus musculus
ggaccttaatagcatctgcctgcag

SEQ ID NO: 700969 - DNA, 25 bp, Mus musculus
ggaccttaataggatctgcctgcag

SEQ ID NO: 700970 - DNA, 25 bp, Mus musculus
ggaccttactttccatatttcagta

SEQ ID NO: 700971 - DNA, 25 bp, Mus musculus
ggaccttactttgcatatttcagta

SEQ ID NO: 700972 - DNA, 25 bp, Mus musculus
ggaccttatgtaatgatgattggaa

SEQ ID NO: 700973 - DNA, 25 bp, Mus musculus
ggaccttatgtattgatgattggaa

SEQ ID NO: 700974 - DNA, 25 bp, Mus musculus
ggaccttatgttctccctggaaccg

SEQ ID NO: 700975 - DNA, 25 bp, Mus musculus
ggaccttatgttgtccctggaaccg

SEQ ID NO: 700976 - DNA, 25 bp, Mus musculus
ggaccttccactagctcaatcagga

SEQ ID NO: 700977 - DNA, 25 bp, Mus musculus
ggaccttccacttgctcaatcagga

SEQ ID NO: 700978 - DNA, 25 bp, Mus musculus
ggaccttccatcacatcgcggagtc

SEQ ID NO: 700979 - DNA, 25 bp, Mus musculus
ggaccttccatctcatcgcggagtc

SEQ ID NO: 700980 - DNA, 25 bp, Mus musculus
ggaccttccattcccggagatcacg

SEQ ID NO: 700981 - DNA, 25 bp, Mus musculus
ggaccttccattgccggagatcacg

SEQ ID NO: 700982 - DNA, 25 bp, Mus musculus
ggaccttcctagaagaataccacac

SEQ ID NO: 700983 - DNA, 25 bp, Mus musculus
ggaccttcctagtagaataccacac

SEQ ID NO: 700984 - DNA, 25 bp, Mus musculus
ggaccttcctctagcaacagagaac

SEQ ID NO: 700985 - DNA, 25 bp, Mus musculus
ggaccttcctcttgcaacagagaac

SEQ ID NO: 700986 - DNA, 25 bp, Mus musculus
ggaccttcgtcaaggccatcggctt

SEQ ID NO: 700987 - DNA, 25 bp, Mus musculus
ggaccttcgtcatggccatcggctt

SEQ ID NO: 700988 - DNA, 25 bp, Mus musculus
ggaccttcgtgacaatttctgccgg

SEQ ID NO: 700989 - DNA, 25 bp, Mus musculus
ggaccttcgtgagaatttctgccgg

SEQ ID NO: 700990 - DNA, 25 bp, Mus musculus
ggaccttctacactgtccatccaag

SEQ ID NO: 700991 - DNA, 25 bp, Mus musculus
ggaccttctacagtgtccatccaag

SEQ ID NO: 700992 - DNA, 25 bp, Mus musculus
ggaccttctcctactgtggcacaat

SEQ ID NO: 700993 - DNA, 25 bp, Mus musculus
ggaccttctccttctgtggcacaat

SEQ ID NO: 700994 - DNA, 25 bp, Mus musculus
ggaccttctgtgcatcccttagatg

SEQ ID NO: 700995 - DNA, 25 bp, Mus musculus
ggaccttctgtggatcccttagatg

SEQ ID NO: 700996 - DNA, 25 bp, Mus musculus
ggaccttgaaaaccgacagaagaag

SEQ ID NO: 700997 - DNA, 25 bp, Mus musculus
ggaccttgaaaagcgacagaagaag

SEQ ID NO: 700998 - DNA, 25 bp, Mus musculus
ggaccttgaaatcgtgatcatctgg

SEQ ID NO: 700999 - DNA, 25 bp, Mus musculus
ggaccttgaaatggtgatcatctgg

SEQ ID NO: 701000 - DNA, 25 bp, Mus musculus
ggaccttgatggatctggacatgga

SEQ ID NO: 701001 - DNA, 25 bp, Mus musculus
ggaccttgatggttctggacatgga

SEQ ID NO: 701002 - DNA, 25 bp, Mus musculus
ggaccttgcgtcattgcttttgtga

SEQ ID NO: 701003 - DNA, 25 bp, Mus musculus
ggaccttgcgtctttgcttttgtga

SEQ ID NO: 701004 - DNA, 25 bp, Mus musculus
ggaccttggcccaggctatcagaga

SEQ ID NO: 701005 - DNA, 25 bp, Mus musculus
ggaccttggccctggctatcagaga

SEQ ID NO: 701006 - DNA, 25 bp, Mus musculus
ggaccttgggatcgtcatcatccag

SEQ ID NO: 701007 - DNA, 25 bp, Mus musculus
ggaccttgggatggtcatcatccag

SEQ ID NO: 701008 - DNA, 25 bp, Mus musculus
ggaccttggtggaccctgcagtcct

SEQ ID NO: 701009 - DNA, 25 bp, Mus musculus
ggaccttggtggtccctgcagtcct

SEQ ID NO: 701010 - DNA, 25 bp, Mus musculus
ggaccttgtggaagaccagaactca

SEQ ID NO: 701011 - DNA, 25 bp, Mus musculus
ggaccttgtggatgaccagaactca

SEQ ID NO: 701012 - DNA, 25 bp, Mus musculus
ggacctttcaagcacactgtgaccg

SEQ ID NO: 701013 - DNA, 25 bp, Mus musculus
ggacctttcaaggacactgtgaccg

SEQ ID NO: 701014 - DNA, 25 bp, Mus musculus
ggacctttctctacatgggccaggg

SEQ ID NO: 701015 - DNA, 25 bp, Mus musculus
ggacctttctcttcatgggccaggg

SEQ ID NO: 701016 - DNA, 25 bp, Mus musculus
ggacctttgcagaccttgcatacag

SEQ ID NO: 701017 - DNA, 25 bp, Mus musculus
ggacctttgcagtccttgcatacag

SEQ ID NO: 701018 - DNA, 25 bp, Mus musculus
ggaccttttcatagggtgagtactc

SEQ ID NO: 701019 - DNA, 25 bp, Mus musculus
ggaccttttcattgggtgagtactc

SEQ ID NO: 701020 - DNA, 25 bp, Mus musculus
ggaccttttcgacctgtgcgaccgc

SEQ ID NO: 701021 - DNA, 25 bp, Mus musculus
ggaccttttcgagctgtgcgaccgc

SEQ ID NO: 701022 - DNA, 25 bp, Mus musculus
ggacgaaagcatcactgtaatcact

SEQ ID NO: 701023 - DNA, 25 bp, Mus musculus
ggacgaaagcatgactgtaatcact

SEQ ID NO: 701024 - DNA, 25 bp, Mus musculus
ggacgaaagccaacaagccttctca

SEQ ID NO: 701025 - DNA, 25 bp, Mus musculus
ggacgaaagccatcaagccttctca

SEQ ID NO: 701026 - DNA, 25 bp, Mus musculus
ggacgaacaaataagccagccgctc

SEQ ID NO: 701027 - DNA, 25 bp, Mus musculus
ggacgaacaaattagccagccgctc

SEQ ID NO: 701028 - DNA, 25 bp, Mus musculus
ggacgaagactgaagagactaccca

SEQ ID NO: 701029 - DNA, 25 bp, Mus musculus
ggacgaagactgtagagactaccca

SEQ ID NO: 701030 - DNA, 25 bp, Mus musculus
ggacgaagcccaaaacagactgaga

SEQ ID NO: 701031 - DNA, 25 bp, Mus musculus
ggacgaagcccataacagactgaga

SEQ ID NO: 701032 - DNA, 25 bp, Mus musculus
ggacgaatctgacccagacgtagat

SEQ ID NO: 701033 - DNA, 25 bp, Mus musculus
ggacgaatctgagccagacgtagat

SEQ ID NO: 701034 - DNA, 25 bp, Mus musculus
ggacgaatgtctcagtgacccctgc

SEQ ID NO: 701035 - DNA, 25 bp, Mus musculus
ggacgaatgtctgagtgacccctgc

SEQ ID NO: 701036 - DNA, 25 bp, Mus musculus
ggacgaattccaacttgctttactc

SEQ ID NO: 701037 - DNA, 25 bp, Mus musculus
ggacgaattccatcttgctttactc

SEQ ID NO: 701038 - DNA, 25 bp, Mus musculus
ggacgacaataccttgctcaagaag

SEQ ID NO: 701039 - DNA, 25 bp, Mus musculus
ggacgacaatacgttgctcaagaag

SEQ ID NO: 701040 - DNA, 25 bp, Mus musculus
ggacgacaatcaatctttcaaaaag

SEQ ID NO: 701041 - DNA, 25 bp, Mus musculus
ggacgacaatcattctttcaaaaag

SEQ ID NO: 701042 - DNA, 25 bp, Mus musculus
ggacgacacagccaatggaccaaga

SEQ ID NO: 701043 - DNA, 25 bp, Mus musculus
ggacgacacagcgaatggaccaaga

SEQ ID NO: 701044 - DNA, 25 bp, Mus musculus
ggacgaccagccatccatctttgag

SEQ ID NO: 701045 - DNA, 25 bp, Mus musculus
ggacgaccagccttccatctttgag

SEQ ID NO: 701046 - DNA, 25 bp, Mus musculus
ggacgaccctgtcacctacaagggt

SEQ ID NO: 701047 - DNA, 25 bp, Mus musculus
ggacgaccctgtgacctacaagggt

SEQ ID NO: 701048 - DNA, 25 bp, Mus musculus
ggacgacctagaagctctcaaggca

SEQ ID NO: 701049 - DNA, 25 bp, Mus musculus
ggacgacctagatgctctcaaggca

SEQ ID NO: 701050 - DNA, 25 bp, Mus musculus
ggacgacctctaagtctccgacgca

SEQ ID NO: 701051 - DNA, 25 bp, Mus musculus
ggacgacctctatgtctccgacgca

SEQ ID NO: 701052 - DNA, 25 bp, Mus musculus
ggacgactctgtcacagaaggagta

SEQ ID NO: 701053 - DNA, 25 bp, Mus musculus
ggacgactctgtgacagaaggagta

SEQ ID NO: 701054 - DNA, 25 bp, Mus musculus
ggacgacttcttactcatgttagca

SEQ ID NO: 701055 - DNA, 25 bp, Mus musculus
ggacgacttctttctcatgttagca

SEQ ID NO: 701056 - DNA, 25 bp, Mus musculus
ggacgagagtatcggatgatctacc

SEQ ID NO: 701057 - DNA, 25 bp, Mus musculus
ggacgagagtatgggatgatctacc

SEQ ID NO: 701058 - DNA, 25 bp, Mus musculus
ggacgagatctgctgctggtctttc

SEQ ID NO: 701059 - DNA, 25 bp, Mus musculus
ggacgagatctggtgctggtctttc

SEQ ID NO: 701060 - DNA, 25 bp, Mus musculus
ggacgagtatgaacccactatagag

SEQ ID NO: 701061 - DNA, 25 bp, Mus musculus
ggacgagtatgatcccactatagag

SEQ ID NO: 701062 - DNA, 25 bp, Mus musculus
ggacgagtgctgctgtccagccaac

SEQ ID NO: 701063 - DNA, 25 bp, Mus musculus
ggacgagtgctggtgtccagccaac

SEQ ID NO: 701064 - DNA, 25 bp, Mus musculus
ggacgagttggactcatccttcgag

SEQ ID NO: 701065 - DNA, 25 bp, Mus musculus
ggacgagttggagtcatccttcgag

SEQ ID NO: 701066 - DNA, 25 bp, Mus musculus
ggacgagtttgcattccggtgtgtc

SEQ ID NO: 701067 - DNA, 25 bp, Mus musculus
ggacgagtttgctttccggtgtgtc

SEQ ID NO: 701068 - DNA, 25 bp, Mus musculus
ggacgatacggtcccactgacgtga

SEQ ID NO: 701069 - DNA, 25 bp, Mus musculus
ggacgatacggtgccactgacgtga

SEQ ID NO: 701070 - DNA, 25 bp, Mus musculus
ggacgatatcatcagattctaccag

SEQ ID NO: 701071 - DNA, 25 bp, Mus musculus
ggacgatatcatgagattctaccag

SEQ ID NO: 701072 - DNA, 25 bp, Mus musculus
ggacgatcagatatattacatcact

SEQ ID NO: 701073 - DNA, 25 bp, Mus musculus
ggacgatcagatttattacatcact

SEQ ID NO: 701074 - DNA, 25 bp, Mus musculus
ggacgatgatgactacgttgatgaa

SEQ ID NO: 701075 - DNA, 25 bp, Mus musculus
ggacgatgatgagtacgttgatgaa

SEQ ID NO: 701076 - DNA, 25 bp, Mus musculus
ggacgatggagaagactctgaaatg

SEQ ID NO: 701077 - DNA, 25 bp, Mus musculus
ggacgatggagatgactctgaaatg

SEQ ID NO: 701078 - DNA, 25 bp, Mus musculus
ggacgatgtcaaagtggccacacac

SEQ ID NO: 701079 - DNA, 25 bp, Mus musculus
ggacgatgtcaatgtggccacacac

SEQ ID NO: 701080 - DNA, 25 bp, Mus musculus
ggacgattggttaatgtcttcagtc

SEQ ID NO: 701081 - DNA, 25 bp, Mus musculus
ggacgattggtttatgtcttcagtc

SEQ ID NO: 701082 - DNA, 25 bp, Mus musculus
ggacgattgtgactgtcatcctgaa

SEQ ID NO: 701083 - DNA, 25 bp, Mus musculus
ggacgattgtgagtgtcatcctgaa

SEQ ID NO: 701084 - DNA, 25 bp, Mus musculus
ggacgcaaatctcacatcttggttt

SEQ ID NO: 701085 - DNA, 25 bp, Mus musculus
ggacgcaaatctgacatcttggttt

SEQ ID NO: 701086 - DNA, 25 bp, Mus musculus
ggacgcaagccccaaaagaccacat

SEQ ID NO: 701087 - DNA, 25 bp, Mus musculus
ggacgcaagcccgaaaagaccacat

SEQ ID NO: 701088 - DNA, 25 bp, Mus musculus
ggacgcaagggaagcaaactttact

SEQ ID NO: 701089 - DNA, 25 bp, Mus musculus
ggacgcaagggatgcaaactttact

SEQ ID NO: 701090 - DNA, 25 bp, Mus musculus
ggacgcaagtgcaacttcgcacccg

SEQ ID NO: 701091 - DNA, 25 bp, Mus musculus
ggacgcaagtgctacttcgcacccg

SEQ ID NO: 701092 - DNA, 25 bp, Mus musculus
ggacgcacctgaagggcccacagtg

SEQ ID NO: 701093 - DNA, 25 bp, Mus musculus
ggacgcacctgatgggcccacagtg

SEQ ID NO: 701094 - DNA, 25 bp, Mus musculus
ggacgcagagccagagcccgatcca

SEQ ID NO: 701095 - DNA, 25 bp, Mus musculus
ggacgcagagcctgagcccgatcca

SEQ ID NO: 701096 - DNA, 25 bp, Mus musculus
ggacgcagtcgcagccctctgatct

SEQ ID NO: 701097 - DNA, 25 bp, Mus musculus
ggacgcagtcgctgccctctgatct

SEQ ID NO: 701098 - DNA, 25 bp, Mus musculus
ggacgcatgaatcggtttattgacc

SEQ ID NO: 701099 - DNA, 25 bp, Mus musculus
ggacgcatgaatgggtttattgacc

SEQ ID NO: 701100 - DNA, 25 bp, Mus musculus
ggacgccactgccttgtccttgcag

SEQ ID NO: 701101 - DNA, 25 bp, Mus musculus
ggacgccactgcgttgtccttgcag

SEQ ID NO: 701102 - DNA, 25 bp, Mus musculus
ggacgccagcgacaagatgctgaaa

SEQ ID NO: 701103 - DNA, 25 bp, Mus musculus
ggacgccagcgagaagatgctgaaa

SEQ ID NO: 701104 - DNA, 25 bp, Mus musculus
ggacgccatccccagagggaccatg

SEQ ID NO: 701105 - DNA, 25 bp, Mus musculus
ggacgccatcccgagagggaccatg

SEQ ID NO: 701106 - DNA, 25 bp, Mus musculus
ggacgccatccgcaccagaaaaagc

SEQ ID NO: 701107 - DNA, 25 bp, Mus musculus
ggacgccatccggaccagaaaaagc

SEQ ID NO: 701108 - DNA, 25 bp, Mus musculus
ggacgccatctacacacctggtggg

SEQ ID NO: 701109 - DNA, 25 bp, Mus musculus
ggacgccatctagacacctggtggg

SEQ ID NO: 701110 - DNA, 25 bp, Mus musculus
ggacgccatgctaaaagccaaaatg

SEQ ID NO: 701111 - DNA, 25 bp, Mus musculus
ggacgccatgcttaaagccaaaatg

SEQ ID NO: 701112 - DNA, 25 bp, Mus musculus
ggacgccgacatcgtcagtcgctgc

SEQ ID NO: 701113 - DNA, 25 bp, Mus musculus
ggacgccgacatggtcagtcgctgc

SEQ ID NO: 701114 - DNA, 25 bp, Mus musculus
ggacgccgccgactccgtttgtctg

SEQ ID NO: 701115 - DNA, 25 bp, Mus musculus
ggacgccgccgagtccgtttgtctg

SEQ ID NO: 701116 - DNA, 25 bp, Mus musculus
ggacgccgccggcaagcactttgtt

SEQ ID NO: 701117 - DNA, 25 bp, Mus musculus
ggacgccgccgggaagcactttgtt

SEQ ID NO: 701118 - DNA, 25 bp, Mus musculus
ggacgccgcgatcagccgccatgaa

SEQ ID NO: 701119 - DNA, 25 bp, Mus musculus
ggacgccgcgatgagccgccatgaa

SEQ ID NO: 701120 - DNA, 25 bp, Mus musculus
ggacgccgtccccaagattgaatac

SEQ ID NO: 701121 - DNA, 25 bp, Mus musculus
ggacgccgtcccgaagattgaatac

SEQ ID NO: 701122 - DNA, 25 bp, Mus musculus
ggacgcctggctcgaatcctaggac

SEQ ID NO: 701123 - DNA, 25 bp, Mus musculus
ggacgcctggctggaatcctaggac

SEQ ID NO: 701124 - DNA, 25 bp, Mus musculus
ggacgccttcggaccgcggtgacct

SEQ ID NO: 701125 - DNA, 25 bp, Mus musculus
ggacgccttcggtccgcggtgacct

SEQ ID NO: 701126 - DNA, 25 bp, Mus musculus
ggacgcgaccatccccagggtgaaa

SEQ ID NO: 701127 - DNA, 25 bp, Mus musculus
ggacgcgaccatgcccagggtgaaa

SEQ ID NO: 701128 - DNA, 25 bp, Mus musculus
ggacgcgcgcgcatcccttattggg

SEQ ID NO: 701129 - DNA, 25 bp, Mus musculus
ggacgcgcgcgcttcccttattggg

SEQ ID NO: 701130 - DNA, 25 bp, Mus musculus
ggacgcgtacaccttacgctgctgt

SEQ ID NO: 701131 - DNA, 25 bp, Mus musculus
ggacgcgtacacgttacgctgctgt

SEQ ID NO: 701132 - DNA, 25 bp, Mus musculus
ggacgcgtcctcagacgccgcgagt

SEQ ID NO: 701133 - DNA, 25 bp, Mus musculus
ggacgcgtcctctgacgccgcgagt

SEQ ID NO: 701134 - DNA, 25 bp, Mus musculus
ggacgctatgtacccctggatgaga

SEQ ID NO: 701135 - DNA, 25 bp, Mus musculus
ggacgctatgtagccctggatgaga

SEQ ID NO: 701136 - DNA, 25 bp, Mus musculus
ggacgctcaagtacctgtggaccgt

SEQ ID NO: 701137 - DNA, 25 bp, Mus musculus
ggacgctcaagttcctgtggaccgt

SEQ ID NO: 701138 - DNA, 25 bp, Mus musculus
ggacgctttccgcagcagagcacag

SEQ ID NO: 701139 - DNA, 25 bp, Mus musculus
ggacgctttccggagcagagcacag

SEQ ID NO: 701140 - DNA, 25 bp, Mus musculus
ggacgctttctgctccttaaggccc

SEQ ID NO: 701141 - DNA, 25 bp, Mus musculus
ggacgctttctggtccttaaggccc

SEQ ID NO: 701142 - DNA, 25 bp, Mus musculus
ggacggaaaaatcgcgcctcccagt

SEQ ID NO: 701143 - DNA, 25 bp, Mus musculus
ggacggaaaaatggcgcctcccagt

SEQ ID NO: 701144 - DNA, 25 bp, Mus musculus
ggacggaagcctcctacttttggag

SEQ ID NO: 701145 - DNA, 25 bp, Mus musculus
ggacggaagcctgctacttttggag

SEQ ID NO: 701146 - DNA, 25 bp, Mus musculus
ggacggaattacactttctggcagt

SEQ ID NO: 701147 - DNA, 25 bp, Mus musculus
ggacggaattactctttctggcagt

SEQ ID NO: 701148 - DNA, 25 bp, Mus musculus
ggacggacagctcaaattaaaaagc

SEQ ID NO: 701149 - DNA, 25 bp, Mus musculus
ggacggacagctgaaattaaaaagc

SEQ ID NO: 701150 - DNA, 25 bp, Mus musculus
ggacggacccctacacagctggatt

SEQ ID NO: 701151 - DNA, 25 bp, Mus musculus
ggacggaccccttcacagctggatt

SEQ ID NO: 701152 - DNA, 25 bp, Mus musculus
ggacggacgccaatatcgcagctcc

SEQ ID NO: 701153 - DNA, 25 bp, Mus musculus
ggacggacgccattatcgcagctcc

SEQ ID NO: 701154 - DNA, 25 bp, Mus musculus
ggacggagagctccttacatcaggc

SEQ ID NO: 701155 - DNA, 25 bp, Mus musculus
ggacggagagctgcttacatcaggc

SEQ ID NO: 701156 - DNA, 25 bp, Mus musculus
ggacggagtgttagacatccactta

SEQ ID NO: 701157 - DNA, 25 bp, Mus musculus
ggacggagtgtttgacatccactta

SEQ ID NO: 701158 - DNA, 25 bp, Mus musculus
ggacggcatcccattgccttcatgc

SEQ ID NO: 701159 - DNA, 25 bp, Mus musculus
ggacggcatccctttgccttcatgc

SEQ ID NO: 701160 - DNA, 25 bp, Mus musculus
ggacggccacatcaagatcgctgac

SEQ ID NO: 701161 - DNA, 25 bp, Mus musculus
ggacggccacatgaagatcgctgac

SEQ ID NO: 701162 - DNA, 25 bp, Mus musculus
ggacggccaccaatgtatacatgaa

SEQ ID NO: 701163 - DNA, 25 bp, Mus musculus
ggacggccaccattgtatacatgaa

SEQ ID NO: 701164 - DNA, 25 bp, Mus musculus
ggacggcgagttaccagttggagac

SEQ ID NO: 701165 - DNA, 25 bp, Mus musculus
ggacggcgagtttccagttggagac

SEQ ID NO: 701166 - DNA, 25 bp, Mus musculus
ggacggcgtgaaaacctacaattgc

SEQ ID NO: 701167 - DNA, 25 bp, Mus musculus
ggacggcgtgaatacctacaattgc

SEQ ID NO: 701168 - DNA, 25 bp, Mus musculus
ggacggcttcagagtcatcctggac

SEQ ID NO: 701169 - DNA, 25 bp, Mus musculus
ggacggcttcagtgtcatcctggac

SEQ ID NO: 701170 - DNA, 25 bp, Mus musculus
ggacggctttatagacctgatggag

SEQ ID NO: 701171 - DNA, 25 bp, Mus musculus
ggacggctttattgacctgatggag

SEQ ID NO: 701172 - DNA, 25 bp, Mus musculus
ggacgggagttacattaggctacct

SEQ ID NO: 701173 - DNA, 25 bp, Mus musculus
ggacgggagttagattaggctacct

SEQ ID NO: 701174 - DNA, 25 bp, Mus musculus
ggacgggcaagtcaccttcctccat

SEQ ID NO: 701175 - DNA, 25 bp, Mus musculus
ggacgggcaagtgaccttcctccat

SEQ ID NO: 701176 - DNA, 25 bp, Mus musculus
ggacgggcttctaactccggcgttg

SEQ ID NO: 701177 - DNA, 25 bp, Mus musculus
ggacgggcttcttactccggcgttg

SEQ ID NO: 701178 - DNA, 25 bp, Mus musculus
ggacgggtaacaaaccaactgcagt

SEQ ID NO: 701179 - DNA, 25 bp, Mus musculus
ggacgggtaacataccaactgcagt

SEQ ID NO: 701180 - DNA, 25 bp, Mus musculus
ggacgggtaaccacagagctgtgaa

SEQ ID NO: 701181 - DNA, 25 bp, Mus musculus
ggacgggtaacctcagagctgtgaa

SEQ ID NO: 701182 - DNA, 25 bp, Mus musculus
ggacggtaacagagcccgtgtcgta

SEQ ID NO: 701183 - DNA, 25 bp, Mus musculus
ggacggtaacagtgcccgtgtcgta

SEQ ID NO: 701184 - DNA, 25 bp, Mus musculus
ggacggtcctccattctacacagta

SEQ ID NO: 701185 - DNA, 25 bp, Mus musculus
ggacggtcctcctttctacacagta

SEQ ID NO: 701186 - DNA, 25 bp, Mus musculus
ggacggtctggaagcctcctccagc

SEQ ID NO: 701187 - DNA, 25 bp, Mus musculus
ggacggtctggatgcctcctccagc

SEQ ID NO: 701188 - DNA, 25 bp, Mus musculus
ggacggtgtccgcagcctccttcag

SEQ ID NO: 701189 - DNA, 25 bp, Mus musculus
ggacggtgtccggagcctccttcag

SEQ ID NO: 701190 - DNA, 25 bp, Mus musculus
ggacgtagttctcacagcatgactg

SEQ ID NO: 701191 - DNA, 25 bp, Mus musculus
ggacgtagttctgacagcatgactg

SEQ ID NO: 701192 - DNA, 25 bp, Mus musculus
ggacgtcactcgaagggccgttgca

SEQ ID NO: 701193 - DNA, 25 bp, Mus musculus
ggacgtcactcgtagggccgttgca

SEQ ID NO: 701194 - DNA, 25 bp, Mus musculus
ggacgtcaggaacccagtcatttat

SEQ ID NO: 701195 - DNA, 25 bp, Mus musculus
ggacgtcaggaagccagtcatttat

SEQ ID NO: 701196 - DNA, 25 bp, Mus musculus
ggacgtcccccaatcacaagtacat

SEQ ID NO: 701197 - DNA, 25 bp, Mus musculus
ggacgtcccccattcacaagtacat

SEQ ID NO: 701198 - DNA, 25 bp, Mus musculus
ggacgtccttcgaaacaggaacatc

SEQ ID NO: 701199 - DNA, 25 bp, Mus musculus
ggacgtccttcgtaacaggaacatc

SEQ ID NO: 701200 - DNA, 25 bp, Mus musculus
ggacgtcggatgaagacctggacaa

SEQ ID NO: 701201 - DNA, 25 bp, Mus musculus
ggacgtcggatgtagacctggacaa

SEQ ID NO: 701202 - DNA, 25 bp, Mus musculus
ggacgtctaccaagcacattctgga

SEQ ID NO: 701203 - DNA, 25 bp, Mus musculus
ggacgtctaccatgcacattctgga

SEQ ID NO: 701204 - DNA, 25 bp, Mus musculus
ggacgtctgctcatcagggctgcag

SEQ ID NO: 701205 - DNA, 25 bp, Mus musculus
ggacgtctgctcttcagggctgcag

SEQ ID NO: 701206 - DNA, 25 bp, Mus musculus
ggacgtgaatatccggaacacatat

SEQ ID NO: 701207 - DNA, 25 bp, Mus musculus
ggacgtgaatatgcggaacacatat

SEQ ID NO: 701208 - DNA, 25 bp, Mus musculus
ggacgtgagcacagatgaattcgaa

SEQ ID NO: 701209 - DNA, 25 bp, Mus musculus
ggacgtgagcactgatgaattcgaa

SEQ ID NO: 701210 - DNA, 25 bp, Mus musculus
ggacgtgcgcatctctggtgttaca

SEQ ID NO: 701211 - DNA, 25 bp, Mus musculus
ggacgtgcgcatgtctggtgttaca

SEQ ID NO: 701212 - DNA, 25 bp, Mus musculus
ggacgtggagcacctgggagaacag

SEQ ID NO: 701213 - DNA, 25 bp, Mus musculus
ggacgtggagcagctgggagaacag

SEQ ID NO: 701214 - DNA, 25 bp, Mus musculus
ggacgtgggcagcaagaccacccta

SEQ ID NO: 701215 - DNA, 25 bp, Mus musculus
ggacgtgggcaggaagaccacccta

SEQ ID NO: 701216 - DNA, 25 bp, Mus musculus
ggacgtggtgcccaccttctgctgt

SEQ ID NO: 701217 - DNA, 25 bp, Mus musculus
ggacgtggtgccgaccttctgctgt

SEQ ID NO: 701218 - DNA, 25 bp, Mus musculus
ggacgtgttcacaatgccagaggat

SEQ ID NO: 701219 - DNA, 25 bp, Mus musculus
ggacgtgttcactatgccagaggat

SEQ ID NO: 701220 - DNA, 25 bp, Mus musculus
ggacgttcaaccctatgcatttacc

SEQ ID NO: 701221 - DNA, 25 bp, Mus musculus
ggacgttcaaccgtatgcatttacc

SEQ ID NO: 701222 - DNA, 25 bp, Mus musculus
ggacgttctcggctctgtgcattca

SEQ ID NO: 701223 - DNA, 25 bp, Mus musculus
ggacgttctcgggtctgtgcattca

SEQ ID NO: 701224 - DNA, 25 bp, Mus musculus
ggacgttctctgacaccacatcatc

SEQ ID NO: 701225 - DNA, 25 bp, Mus musculus
ggacgttctctgtcaccacatcatc

SEQ ID NO: 701226 - DNA, 25 bp, Mus musculus
ggacgttgacagagggtatttttag

SEQ ID NO: 701227 - DNA, 25 bp, Mus musculus
ggacgttgacagtgggtatttttag

SEQ ID NO: 701228 - DNA, 25 bp, Mus musculus
ggacgtttccccagtacatgtagga

SEQ ID NO: 701229 - DNA, 25 bp, Mus musculus
ggacgtttcccctgtacatgtagga

SEQ ID NO: 701230 - DNA, 25 bp, Mus musculus
ggacgtttctatcattccacccctg

SEQ ID NO: 701231 - DNA, 25 bp, Mus musculus
ggacgtttctatgattccacccctg

SEQ ID NO: 701232 - DNA, 25 bp, Mus musculus
ggacgttttacaaccaggtcatgac

SEQ ID NO: 701233 - DNA, 25 bp, Mus musculus
ggacgttttacatccaggtcatgac

SEQ ID NO: 701234 - DNA, 25 bp, Mus musculus
ggacgttttgccagtcgctgtagga

SEQ ID NO: 701235 - DNA, 25 bp, Mus musculus
ggacgttttgcctgtcgctgtagga

SEQ ID NO: 701236 - DNA, 25 bp, Mus musculus
ggactacaaccacggcctggtgctg

SEQ ID NO: 701237 - DNA, 25 bp, Mus musculus
ggactacaaccagggcctggtgctg

SEQ ID NO: 701238 - DNA, 25 bp, Mus musculus
ggactacagcgtatgggatcacatc

SEQ ID NO: 701239 - DNA, 25 bp, Mus musculus
ggactacagcgtttgggatcacatc

SEQ ID NO: 701240 - DNA, 25 bp, Mus musculus
ggactacatcagaaactgcaacatg

SEQ ID NO: 701241 - DNA, 25 bp, Mus musculus
ggactacatcagtaactgcaacatg

SEQ ID NO: 701242 - DNA, 25 bp, Mus musculus
ggactaccaagacttttgcacaaag

SEQ ID NO: 701243 - DNA, 25 bp, Mus musculus
ggactaccaagagttttgcacaaag

SEQ ID NO: 701244 - DNA, 25 bp, Mus musculus
ggactaccagcacctaatagaagac

SEQ ID NO: 701245 - DNA, 25 bp, Mus musculus
ggactaccagcagctaatagaagac

SEQ ID NO: 701246 - DNA, 25 bp, Mus musculus
ggactaccaggaccctgaagttcca

SEQ ID NO: 701247 - DNA, 25 bp, Mus musculus
ggactaccaggagcctgaagttcca

SEQ ID NO: 701248 - DNA, 25 bp, Mus musculus
ggactacccgtaacctactgacttt

SEQ ID NO: 701249 - DNA, 25 bp, Mus musculus
ggactacccgtatcctactgacttt

SEQ ID NO: 701250 - DNA, 25 bp, Mus musculus
ggactaccctctaataccagttggc

SEQ ID NO: 701251 - DNA, 25 bp, Mus musculus
ggactaccctcttataccagttggc

SEQ ID NO: 701252 - DNA, 25 bp, Mus musculus
ggactaccctttagccaggttcaat

SEQ ID NO: 701253 - DNA, 25 bp, Mus musculus
ggactacccttttgccaggttcaat

SEQ ID NO: 701254 - DNA, 25 bp, Mus musculus
ggactacgagacagccaccctgtca

SEQ ID NO: 701255 - DNA, 25 bp, Mus musculus
ggactacgagactgccaccctgtca

SEQ ID NO: 701256 - DNA, 25 bp, Mus musculus
ggactacggccgacctttcacgtgt

SEQ ID NO: 701257 - DNA, 25 bp, Mus musculus
ggactacggccgtcctttcacgtgt

SEQ ID NO: 701258 - DNA, 25 bp, Mus musculus
ggactacggcgtcttcgcgaccatg

SEQ ID NO: 701259 - DNA, 25 bp, Mus musculus
ggactacggcgtgttcgcgaccatg

SEQ ID NO: 701260 - DNA, 25 bp, Mus musculus
ggactacgtcgaaaaagttctagaa

SEQ ID NO: 701261 - DNA, 25 bp, Mus musculus
ggactacgtcgataaagttctagaa

SEQ ID NO: 701262 - DNA, 25 bp, Mus musculus
ggactactactgcaaaggaagtcta

SEQ ID NO: 701263 - DNA, 25 bp, Mus musculus
ggactactactggaaaggaagtcta

SEQ ID NO: 701264 - DNA, 25 bp, Mus musculus
ggactactatgacctctatggtggg

SEQ ID NO: 701265 - DNA, 25 bp, Mus musculus
ggactactatgagctctatggtggg

SEQ ID NO: 701266 - DNA, 25 bp, Mus musculus
ggactactctccagtgggctccttc

SEQ ID NO: 701267 - DNA, 25 bp, Mus musculus
ggactactctcctgtgggctccttc

SEQ ID NO: 701268 - DNA, 25 bp, Mus musculus
ggactactggacataccctggctct

SEQ ID NO: 701269 - DNA, 25 bp, Mus musculus
ggactactggacttaccctggctct

SEQ ID NO: 701270 - DNA, 25 bp, Mus musculus
ggactagactgaagctgcggttcat

SEQ ID NO: 701271 - DNA, 25 bp, Mus musculus
ggactagactgatgctgcggttcat

SEQ ID NO: 701272 - DNA, 25 bp, Mus musculus
ggactagagtgcaaccaggacaact

SEQ ID NO: 701273 - DNA, 25 bp, Mus musculus
ggactagagtgctaccaggacaact

SEQ ID NO: 701274 - DNA, 25 bp, Mus musculus
ggactagctcatctcatggccctgg

SEQ ID NO: 701275 - DNA, 25 bp, Mus musculus
ggactagctcatgtcatggccctgg

SEQ ID NO: 701276 - DNA, 25 bp, Mus musculus
ggactaggcaccactaatataggaa

SEQ ID NO: 701277 - DNA, 25 bp, Mus musculus
ggactaggcacctctaatataggaa

SEQ ID NO: 701278 - DNA, 25 bp, Mus musculus
ggactaggctctctcttcgagggca

SEQ ID NO: 701279 - DNA, 25 bp, Mus musculus
ggactaggctctgtcttcgagggca

SEQ ID NO: 701280 - DNA, 25 bp, Mus musculus
ggactagtgacgaggccccaatgtt

SEQ ID NO: 701281 - DNA, 25 bp, Mus musculus
ggactagtgacgtggccccaatgtt

SEQ ID NO: 701282 - DNA, 25 bp, Mus musculus
ggactagtgcacaaacagttcagca

SEQ ID NO: 701283 - DNA, 25 bp, Mus musculus
ggactagtgcactaacagttcagca

SEQ ID NO: 701284 - DNA, 25 bp, Mus musculus
ggactataactacccactgtgcgca

SEQ ID NO: 701285 - DNA, 25 bp, Mus musculus
ggactataactagccactgtgcgca

SEQ ID NO: 701286 - DNA, 25 bp, Mus musculus
ggactataatgccaccacacctcta

SEQ ID NO: 701287 - DNA, 25 bp, Mus musculus
ggactataatgcgaccacacctcta

SEQ ID NO: 701288 - DNA, 25 bp, Mus musculus
ggactatagagaaacacacgcggga

SEQ ID NO: 701289 - DNA, 25 bp, Mus musculus
ggactatagagatacacacgcggga

SEQ ID NO: 701290 - DNA, 25 bp, Mus musculus
ggactatatcagcaaagaaaataag

SEQ ID NO: 701291 - DNA, 25 bp, Mus musculus
ggactatatcaggaaagaaaataag

SEQ ID NO: 701292 - DNA, 25 bp, Mus musculus
ggactatccaggaatcgtgaacccc

SEQ ID NO: 701293 - DNA, 25 bp, Mus musculus
ggactatccaggtatcgtgaacccc

SEQ ID NO: 701294 - DNA, 25 bp, Mus musculus
ggactatcccagaatctgttgcctg

SEQ ID NO: 701295 - DNA, 25 bp, Mus musculus
ggactatcccagtatctgttgcctg

SEQ ID NO: 701296 - DNA, 25 bp, Mus musculus
ggactatgaaagaaatttgtagggc

SEQ ID NO: 701297 - DNA, 25 bp, Mus musculus
ggactatgaaagtaatttgtagggc

SEQ ID NO: 701298 - DNA, 25 bp, Mus musculus
ggactatgacttcagccagctccag

SEQ ID NO: 701299 - DNA, 25 bp, Mus musculus
ggactatgacttgagccagctccag

SEQ ID NO: 701300 - DNA, 25 bp, Mus musculus
ggactatgagctcggccgacagaaa

SEQ ID NO: 701301 - DNA, 25 bp, Mus musculus
ggactatgagctgggccgacagaaa

SEQ ID NO: 701302 - DNA, 25 bp, Mus musculus
ggactatgccgaaagtagctgtttt

SEQ ID NO: 701303 - DNA, 25 bp, Mus musculus
ggactatgccgatagtagctgtttt

SEQ ID NO: 701304 - DNA, 25 bp, Mus musculus
ggactatggcaaagatcttgttagt

SEQ ID NO: 701305 - DNA, 25 bp, Mus musculus
ggactatggcaatgatcttgttagt

SEQ ID NO: 701306 - DNA, 25 bp, Mus musculus
ggactatttcccagagatcattgaa

SEQ ID NO: 701307 - DNA, 25 bp, Mus musculus
ggactatttccctgagatcattgaa

SEQ ID NO: 701308 - DNA, 25 bp, Mus musculus
ggactcaaaagacccagaacagaaa

SEQ ID NO: 701309 - DNA, 25 bp, Mus musculus
ggactcaaaagagccagaacagaaa

SEQ ID NO: 701310 - DNA, 25 bp, Mus musculus
ggactcaaccttcaccgttcttaag

SEQ ID NO: 701311 - DNA, 25 bp, Mus musculus
ggactcaaccttgaccgttcttaag

SEQ ID NO: 701312 - DNA, 25 bp, Mus musculus
ggactcaagatacactccgctctac

SEQ ID NO: 701313 - DNA, 25 bp, Mus musculus
ggactcaagatagactccgctctac

SEQ ID NO: 701314 - DNA, 25 bp, Mus musculus
ggactcaatagaacttgataatcca

SEQ ID NO: 701315 - DNA, 25 bp, Mus musculus
ggactcaatagatcttgataatcca

SEQ ID NO: 701316 - DNA, 25 bp, Mus musculus
ggactcaccctcctatcttctgttg

SEQ ID NO: 701317 - DNA, 25 bp, Mus musculus
ggactcaccctcgtatcttctgttg

SEQ ID NO: 701318 - DNA, 25 bp, Mus musculus
ggactcacggagatcgcgccggttt

SEQ ID NO: 701319 - DNA, 25 bp, Mus musculus
ggactcacggagttcgcgccggttt

SEQ ID NO: 701320 - DNA, 25 bp, Mus musculus
ggactcagacttcctgtccccgagg

SEQ ID NO: 701321 - DNA, 25 bp, Mus musculus
ggactcagacttgctgtccccgagg

SEQ ID NO: 701322 - DNA, 25 bp, Mus musculus
ggactcagagaacaccatttggttg

SEQ ID NO: 701323 - DNA, 25 bp, Mus musculus
ggactcagagaagaccatttggttg

SEQ ID NO: 701324 - DNA, 25 bp, Mus musculus
ggactcagatgacttcagggccctg

SEQ ID NO: 701325 - DNA, 25 bp, Mus musculus
ggactcagatgagttcagggccctg

SEQ ID NO: 701326 - DNA, 25 bp, Mus musculus
ggactcagctcaacatgttccagac

SEQ ID NO: 701327 - DNA, 25 bp, Mus musculus
ggactcagctcatcatgttccagac

SEQ ID NO: 701328 - DNA, 25 bp, Mus musculus
ggactcagctcccaattacgtatag

SEQ ID NO: 701329 - DNA, 25 bp, Mus musculus
ggactcagctccgaattacgtatag

SEQ ID NO: 701330 - DNA, 25 bp, Mus musculus
ggactcatcactagcctgactggag

SEQ ID NO: 701331 - DNA, 25 bp, Mus musculus
ggactcatcacttgcctgactggag

SEQ ID NO: 701332 - DNA, 25 bp, Mus musculus
ggactcatctctaaaggcaccatac

SEQ ID NO: 701333 - DNA, 25 bp, Mus musculus
ggactcatctcttaaggcaccatac

SEQ ID NO: 701334 - DNA, 25 bp, Mus musculus
ggactccaagtgctaccagcagtgg

SEQ ID NO: 701335 - DNA, 25 bp, Mus musculus
ggactccaagtggtaccagcagtgg

SEQ ID NO: 701336 - DNA, 25 bp, Mus musculus
ggactccagcccctgttggcagtac

SEQ ID NO: 701337 - DNA, 25 bp, Mus musculus
ggactccagcccgtgttggcagtac

SEQ ID NO: 701338 - DNA, 25 bp, Mus musculus
ggactccagtgcacgcttctgtata

SEQ ID NO: 701339 - DNA, 25 bp, Mus musculus
ggactccagtgctcgcttctgtata

SEQ ID NO: 701340 - DNA, 25 bp, Mus musculus
ggactccatgaaaatcaaggcccat

SEQ ID NO: 701341 - DNA, 25 bp, Mus musculus
ggactccatgaatatcaaggcccat

SEQ ID NO: 701342 - DNA, 25 bp, Mus musculus
ggactccatttaacccagtgactgt

SEQ ID NO: 701343 - DNA, 25 bp, Mus musculus
ggactccatttatcccagtgactgt

SEQ ID NO: 701344 - DNA, 25 bp, Mus musculus
ggactcccagtcaccaatcacttta

SEQ ID NO: 701345 - DNA, 25 bp, Mus musculus
ggactcccagtctccaatcacttta

SEQ ID NO: 701346 - DNA, 25 bp, Mus musculus
ggactcccctaaccatagtggacag

SEQ ID NO: 701347 - DNA, 25 bp, Mus musculus
ggactcccctaagcatagtggacag

SEQ ID NO: 701348 - DNA, 25 bp, Mus musculus
ggactccctgtgagtcttagccgtg

SEQ ID NO: 701349 - DNA, 25 bp, Mus musculus
ggactccctgtgtgtcttagccgtg

SEQ ID NO: 701350 - DNA, 25 bp, Mus musculus
ggactcccttacaattggaatgtgg

SEQ ID NO: 701351 - DNA, 25 bp, Mus musculus
ggactcccttactattggaatgtgg

SEQ ID NO: 701352 - DNA, 25 bp, Mus musculus
ggactccgggctctcacgtttcctg

SEQ ID NO: 701353 - DNA, 25 bp, Mus musculus
ggactccgggctgtcacgtttcctg

SEQ ID NO: 701354 - DNA, 25 bp, Mus musculus
ggactccggtatctatcagtgtgtt

SEQ ID NO: 701355 - DNA, 25 bp, Mus musculus
ggactccggtatgtatcagtgtgtt

SEQ ID NO: 701356 - DNA, 25 bp, Mus musculus
ggactccgtcctagataccgatggg

SEQ ID NO: 701357 - DNA, 25 bp, Mus musculus
ggactccgtccttgataccgatggg

SEQ ID NO: 701358 - DNA, 25 bp, Mus musculus
ggactccgttaccatgaagcataag

SEQ ID NO: 701359 - DNA, 25 bp, Mus musculus
ggactccgttacgatgaagcataag

SEQ ID NO: 701360 - DNA, 25 bp, Mus musculus
ggactcctagtaccgctagaagctg

SEQ ID NO: 701361 - DNA, 25 bp, Mus musculus
ggactcctagtagcgctagaagctg

SEQ ID NO: 701362 - DNA, 25 bp, Mus musculus
ggactcctcaagctgctaggctggc

SEQ ID NO: 701363 - DNA, 25 bp, Mus musculus
ggactcctcaaggtgctaggctggc

SEQ ID NO: 701364 - DNA, 25 bp, Mus musculus
ggactcctcgcacactttataccgg

SEQ ID NO: 701365 - DNA, 25 bp, Mus musculus
ggactcctcgcagactttataccgg

SEQ ID NO: 701366 - DNA, 25 bp, Mus musculus
ggactcctgatgaccctcaagggac

SEQ ID NO: 701367 - DNA, 25 bp, Mus musculus
ggactcctgatgtccctcaagggac

SEQ ID NO: 701368 - DNA, 25 bp, Mus musculus
ggactccttcatcgaagacaatgag

SEQ ID NO: 701369 - DNA, 25 bp, Mus musculus
ggactccttcatggaagacaatgag

SEQ ID NO: 701370 - DNA, 25 bp, Mus musculus
ggactccttccaagaccaagtacag

SEQ ID NO: 701371 - DNA, 25 bp, Mus musculus
ggactccttccatgaccaagtacag

SEQ ID NO: 701372 - DNA, 25 bp, Mus musculus
ggactcgagagaaagctatgctccg

SEQ ID NO: 701373 - DNA, 25 bp, Mus musculus
ggactcgagagatagctatgctccg

SEQ ID NO: 701374 - DNA, 25 bp, Mus musculus
ggactcgagttccagaatgaaaagc

SEQ ID NO: 701375 - DNA, 25 bp, Mus musculus
ggactcgagttcgagaatgaaaagc

SEQ ID NO: 701376 - DNA, 25 bp, Mus musculus
ggactcgcatcgatgtggccggcat

SEQ ID NO: 701377 - DNA, 25 bp, Mus musculus
ggactcgcatcgttgtggccggcat

SEQ ID NO: 701378 - DNA, 25 bp, Mus musculus
ggactcggccagagcacgctgtgtt

SEQ ID NO: 701379 - DNA, 25 bp, Mus musculus
ggactcggccagtgcacgctgtgtt

SEQ ID NO: 701380 - DNA, 25 bp, Mus musculus
ggactcggctcccactgctagtggc

SEQ ID NO: 701381 - DNA, 25 bp, Mus musculus
ggactcggctccgactgctagtggc

SEQ ID NO: 701382 - DNA, 25 bp, Mus musculus
ggactcgggacaccccatgatgacc

SEQ ID NO: 701383 - DNA, 25 bp, Mus musculus
ggactcgggacagcccatgatgacc

SEQ ID NO: 701384 - DNA, 25 bp, Mus musculus
ggactcgggcaaaacggaaatctag

SEQ ID NO: 701385 - DNA, 25 bp, Mus musculus
ggactcgggcaatacggaaatctag

SEQ ID NO: 701386 - DNA, 25 bp, Mus musculus
ggactcggttctactcccacagctg

SEQ ID NO: 701387 - DNA, 25 bp, Mus musculus
ggactcggttcttctcccacagctg

SEQ ID NO: 701388 - DNA, 25 bp, Mus musculus
ggactcgtggagcactgcaaactca

SEQ ID NO: 701389 - DNA, 25 bp, Mus musculus
ggactcgtggaggactgcaaactca

SEQ ID NO: 701390 - DNA, 25 bp, Mus musculus
ggactctacgctattcgagctcaag

SEQ ID NO: 701391 - DNA, 25 bp, Mus musculus
ggactctacgcttttcgagctcaag

SEQ ID NO: 701392 - DNA, 25 bp, Mus musculus
ggactctagggcacggccaccttat

SEQ ID NO: 701393 - DNA, 25 bp, Mus musculus
ggactctagggctcggccaccttat

SEQ ID NO: 701394 - DNA, 25 bp, Mus musculus
ggactctcaagcaggcatcatatta

SEQ ID NO: 701395 - DNA, 25 bp, Mus musculus
ggactctcaagctggcatcatatta

SEQ ID NO: 701396 - DNA, 25 bp, Mus musculus
ggactctcaagtcatgaaccttcat

SEQ ID NO: 701397 - DNA, 25 bp, Mus musculus
ggactctcaagtgatgaaccttcat

SEQ ID NO: 701398 - DNA, 25 bp, Mus musculus
ggactctccgttcctgcaaggcttc

SEQ ID NO: 701399 - DNA, 25 bp, Mus musculus
ggactctccgttgctgcaaggcttc

SEQ ID NO: 701400 - DNA, 25 bp, Mus musculus
ggactctcttccctcattgcctgtt

SEQ ID NO: 701401 - DNA, 25 bp, Mus musculus
ggactctcttccgtcattgcctgtt

SEQ ID NO: 701402 - DNA, 25 bp, Mus musculus
ggactctgacctcctcgcatttggc

SEQ ID NO: 701403 - DNA, 25 bp, Mus musculus
ggactctgacctgctcgcatttggc

SEQ ID NO: 701404 - DNA, 25 bp, Mus musculus
ggactctgcactagagcgggatacg

SEQ ID NO: 701405 - DNA, 25 bp, Mus musculus
ggactctgcacttgagcgggatacg

SEQ ID NO: 701406 - DNA, 25 bp, Mus musculus
ggactctgccatccctggagtctct

SEQ ID NO: 701407 - DNA, 25 bp, Mus musculus
ggactctgccatgcctggagtctct

SEQ ID NO: 701408 - DNA, 25 bp, Mus musculus
ggactctgcctaaagcaatttggta

SEQ ID NO: 701409 - DNA, 25 bp, Mus musculus
ggactctgcctatagcaatttggta

SEQ ID NO: 701410 - DNA, 25 bp, Mus musculus
ggactctgcctgatgaggctgccct

SEQ ID NO: 701411 - DNA, 25 bp, Mus musculus
ggactctgcctgttgaggctgccct

SEQ ID NO: 701412 - DNA, 25 bp, Mus musculus
ggactctgctgtcgcgtcttggccc

SEQ ID NO: 701413 - DNA, 25 bp, Mus musculus
ggactctgctgtggcgtcttggccc

SEQ ID NO: 701414 - DNA, 25 bp, Mus musculus
ggactctgtgccaacacatcccaag

SEQ ID NO: 701415 - DNA, 25 bp, Mus musculus
ggactctgtgcctacacatcccaag

SEQ ID NO: 701416 - DNA, 25 bp, Mus musculus
ggactcttacagatgcccatgtgta

SEQ ID NO: 701417 - DNA, 25 bp, Mus musculus
ggactcttacagttgcccatgtgta

SEQ ID NO: 701418 - DNA, 25 bp, Mus musculus
ggactgaaacacacccggaatctgg

SEQ ID NO: 701419 - DNA, 25 bp, Mus musculus
ggactgaaacactcccggaatctgg

SEQ ID NO: 701420 - DNA, 25 bp, Mus musculus
ggactgaagcccatggattccaatg

SEQ ID NO: 701421 - DNA, 25 bp, Mus musculus
ggactgaagcccttggattccaatg

SEQ ID NO: 701422 - DNA, 25 bp, Mus musculus
ggactgaatgtcatgaggatcatca

SEQ ID NO: 701423 - DNA, 25 bp, Mus musculus
ggactgaatgtcttgaggatcatca

SEQ ID NO: 701424 - DNA, 25 bp, Mus musculus
ggactgaccgccatttagaggaggc

SEQ ID NO: 701425 - DNA, 25 bp, Mus musculus
ggactgaccgccttttagaggaggc

SEQ ID NO: 701426 - DNA, 25 bp, Mus musculus
ggactgagacgcacttcagcgttgg

SEQ ID NO: 701427 - DNA, 25 bp, Mus musculus
ggactgagacgctcttcagcgttgg

SEQ ID NO: 701428 - DNA, 25 bp, Mus musculus
ggactgagccgcaatgctacagtag

SEQ ID NO: 701429 - DNA, 25 bp, Mus musculus
ggactgagccgctatgctacagtag

SEQ ID NO: 701430 - DNA, 25 bp, Mus musculus
ggactgagctgtatcgctaccctag

SEQ ID NO: 701431 - DNA, 25 bp, Mus musculus
ggactgagctgtttcgctaccctag

SEQ ID NO: 701432 - DNA, 25 bp, Mus musculus
ggactgatccctcttctacctcagg

SEQ ID NO: 701433 - DNA, 25 bp, Mus musculus
ggactgatccctgttctacctcagg

SEQ ID NO: 701434 - DNA, 25 bp, Mus musculus
ggactgatcctcaggctgtactcca

SEQ ID NO: 701435 - DNA, 25 bp, Mus musculus
ggactgatcctctggctgtactcca

SEQ ID NO: 701436 - DNA, 25 bp, Mus musculus
ggactgatgcagacatgcccatgga

SEQ ID NO: 701437 - DNA, 25 bp, Mus musculus
ggactgatgcagtcatgcccatgga

SEQ ID NO: 701438 - DNA, 25 bp, Mus musculus
ggactgatggccatgtacgaggcca

SEQ ID NO: 701439 - DNA, 25 bp, Mus musculus
ggactgatggccttgtacgaggcca

SEQ ID NO: 701440 - DNA, 25 bp, Mus musculus
ggactgattgatcccctcctcagaa

SEQ ID NO: 701441 - DNA, 25 bp, Mus musculus
ggactgattgatgccctcctcagaa

SEQ ID NO: 701442 - DNA, 25 bp, Mus musculus
ggactgcaaccccatgctcatgaag

SEQ ID NO: 701443 - DNA, 25 bp, Mus musculus
ggactgcaacccgatgctcatgaag

SEQ ID NO: 701444 - DNA, 25 bp, Mus musculus
ggactgcacagcacgcatctgggac

SEQ ID NO: 701445 - DNA, 25 bp, Mus musculus
ggactgcacagctcgcatctgggac

SEQ ID NO: 701446 - DNA, 25 bp, Mus musculus
ggactgcacaggactgatccatatg

SEQ ID NO: 701447 - DNA, 25 bp, Mus musculus
ggactgcacaggtctgatccatatg

SEQ ID NO: 701448 - DNA, 25 bp, Mus musculus
ggactgcacgccatctacggagagt

SEQ ID NO: 701449 - DNA, 25 bp, Mus musculus
ggactgcacgccttctacggagagt

SEQ ID NO: 701450 - DNA, 25 bp, Mus musculus
ggactgcactctaccactgtaccag

SEQ ID NO: 701451 - DNA, 25 bp, Mus musculus
ggactgcactcttccactgtaccag

SEQ ID NO: 701452 - DNA, 25 bp, Mus musculus
ggactgcacttcagagcgaggcctg

SEQ ID NO: 701453 - DNA, 25 bp, Mus musculus
ggactgcacttctgagcgaggcctg

SEQ ID NO: 701454 - DNA, 25 bp, Mus musculus
ggactgcaggccattgcagagttat

SEQ ID NO: 701455 - DNA, 25 bp, Mus musculus
ggactgcaggcctttgcagagttat

SEQ ID NO: 701456 - DNA, 25 bp, Mus musculus
ggactgcagtttctacacagcaaag

SEQ ID NO: 701457 - DNA, 25 bp, Mus musculus
ggactgcagtttgtacacagcaaag

SEQ ID NO: 701458 - DNA, 25 bp, Mus musculus
ggactgcataatcagcattgtggaa

SEQ ID NO: 701459 - DNA, 25 bp, Mus musculus
ggactgcataatgagcattgtggaa

SEQ ID NO: 701460 - DNA, 25 bp, Mus musculus
ggactgcatggacctcattgccaag

SEQ ID NO: 701461 - DNA, 25 bp, Mus musculus
ggactgcatggagctcattgccaag

SEQ ID NO: 701462 - DNA, 25 bp, Mus musculus
ggactgcccaagaaacccgagatta

SEQ ID NO: 701463 - DNA, 25 bp, Mus musculus
ggactgcccaagtaacccgagatta

SEQ ID NO: 701464 - DNA, 25 bp, Mus musculus
ggactgccgaagaccaattaccgct

SEQ ID NO: 701465 - DNA, 25 bp, Mus musculus
ggactgccgaagtccaattaccgct

SEQ ID NO: 701466 - DNA, 25 bp, Mus musculus
ggactgcctgatcgacaagagacag

SEQ ID NO: 701467 - DNA, 25 bp, Mus musculus
ggactgcctgatggacaagagacag

SEQ ID NO: 701468 - DNA, 25 bp, Mus musculus
ggactgcgagttctggataacctgc

SEQ ID NO: 701469 - DNA, 25 bp, Mus musculus
ggactgcgagttgtggataacctgc

SEQ ID NO: 701470 - DNA, 25 bp, Mus musculus
ggactgcgatggcttttccaccttt

SEQ ID NO: 701471 - DNA, 25 bp, Mus musculus
ggactgcgatgggttttccaccttt

SEQ ID NO: 701472 - DNA, 25 bp, Mus musculus
ggactgcgctttcgaggtcgtctat

SEQ ID NO: 701473 - DNA, 25 bp, Mus musculus
ggactgcgctttggaggtcgtctat

SEQ ID NO: 701474 - DNA, 25 bp, Mus musculus
ggactgcggcgtcatcctgcctata

SEQ ID NO: 701475 - DNA, 25 bp, Mus musculus
ggactgcggcgtgatcctgcctata

SEQ ID NO: 701476 - DNA, 25 bp, Mus musculus
ggactgcggttccagcgacacgttt

SEQ ID NO: 701477 - DNA, 25 bp, Mus musculus
ggactgcggttcgagcgacacgttt

SEQ ID NO: 701478 - DNA, 25 bp, Mus musculus
ggactgctcatccaccagagtaagg

SEQ ID NO: 701479 - DNA, 25 bp, Mus musculus
ggactgctcatcgaccagagtaagg

SEQ ID NO: 701480 - DNA, 25 bp, Mus musculus
ggactgctgtctacaaggtggccga

SEQ ID NO: 701481 - DNA, 25 bp, Mus musculus
ggactgctgtcttcaaggtggccga

SEQ ID NO: 701482 - DNA, 25 bp, Mus musculus
ggactgcttggcctactgcggaata

SEQ ID NO: 701483 - DNA, 25 bp, Mus musculus
ggactgcttggcgtactgcggaata

SEQ ID NO: 701484 - DNA, 25 bp, Mus musculus
ggactggaagttatacctgttactt

SEQ ID NO: 701485 - DNA, 25 bp, Mus musculus
ggactggaagttttacctgttactt

SEQ ID NO: 701486 - DNA, 25 bp, Mus musculus
ggactggacattcttcaatggaagc

SEQ ID NO: 701487 - DNA, 25 bp, Mus musculus
ggactggacattgttcaatggaagc

SEQ ID NO: 701488 - DNA, 25 bp, Mus musculus
ggactggaccaaccagcggcttaac

SEQ ID NO: 701489 - DNA, 25 bp, Mus musculus
ggactggaccaagcagcggcttaac

SEQ ID NO: 701490 - DNA, 25 bp, Mus musculus
ggactggaccatcaaacgatttctg

SEQ ID NO: 701491 - DNA, 25 bp, Mus musculus
ggactggaccatgaaacgatttctg

SEQ ID NO: 701492 - DNA, 25 bp, Mus musculus
ggactggactcccaacacaagctgt

SEQ ID NO: 701493 - DNA, 25 bp, Mus musculus
ggactggactccgaacacaagctgt

SEQ ID NO: 701494 - DNA, 25 bp, Mus musculus
ggactggactctcccaatggcagca

SEQ ID NO: 701495 - DNA, 25 bp, Mus musculus
ggactggactctgccaatggcagca

SEQ ID NO: 701496 - DNA, 25 bp, Mus musculus
ggactggaggctctcagccacttac

SEQ ID NO: 701497 - DNA, 25 bp, Mus musculus
ggactggaggctgtcagccacttac

SEQ ID NO: 701498 - DNA, 25 bp, Mus musculus
ggactggatcaacgaccgtattcga

SEQ ID NO: 701499 - DNA, 25 bp, Mus musculus
ggactggatcaaggaccgtattcga

SEQ ID NO: 701500 - DNA, 25 bp, Mus musculus
ggactggatttaatctggcagctac

SEQ ID NO: 701501 - DNA, 25 bp, Mus musculus
ggactggatttattctggcagctac

SEQ ID NO: 701502 - DNA, 25 bp, Mus musculus
ggactggcaccgactttgtctacaa

SEQ ID NO: 701503 - DNA, 25 bp, Mus musculus
ggactggcaccgtctttgtctacaa

SEQ ID NO: 701504 - DNA, 25 bp, Mus musculus
ggactggcccggactggaataaaca

SEQ ID NO: 701505 - DNA, 25 bp, Mus musculus
ggactggcccggtctggaataaaca

SEQ ID NO: 701506 - DNA, 25 bp, Mus musculus
ggactggctgttcggactgtcattt

SEQ ID NO: 701507 - DNA, 25 bp, Mus musculus
ggactggctgttgggactgtcattt

SEQ ID NO: 701508 - DNA, 25 bp, Mus musculus
ggactgggaactcagcggctctgaa

SEQ ID NO: 701509 - DNA, 25 bp, Mus musculus
ggactgggaactgagcggctctgaa

SEQ ID NO: 701510 - DNA, 25 bp, Mus musculus
ggactgggaggcacagctgcaccaa

SEQ ID NO: 701511 - DNA, 25 bp, Mus musculus
ggactgggaggctcagctgcaccaa

SEQ ID NO: 701512 - DNA, 25 bp, Mus musculus
ggactgggatgtccaccatggtcaa

SEQ ID NO: 701513 - DNA, 25 bp, Mus musculus
ggactgggatgtgcaccatggtcaa

SEQ ID NO: 701514 - DNA, 25 bp, Mus musculus
ggactgggattcacctctgagcatc

SEQ ID NO: 701515 - DNA, 25 bp, Mus musculus
ggactgggattctcctctgagcatc

SEQ ID NO: 701516 - DNA, 25 bp, Mus musculus
ggactgggccctcaacatggaaatc

SEQ ID NO: 701517 - DNA, 25 bp, Mus musculus
ggactgggccctgaacatggaaatc

SEQ ID NO: 701518 - DNA, 25 bp, Mus musculus
ggactggtgactcaactcctaaaag

SEQ ID NO: 701519 - DNA, 25 bp, Mus musculus
ggactggtgactgaactcctaaaag

SEQ ID NO: 701520 - DNA, 25 bp, Mus musculus
ggactggtggcgagcctgccactca

SEQ ID NO: 701521 - DNA, 25 bp, Mus musculus
ggactggtggcgtgcctgccactca

SEQ ID NO: 701522 - DNA, 25 bp, Mus musculus
ggactgtacaagcaccagagaagct

SEQ ID NO: 701523 - DNA, 25 bp, Mus musculus
ggactgtacaaggaccagagaagct

SEQ ID NO: 701524 - DNA, 25 bp, Mus musculus
ggactgtaccgacgctataaaagca

SEQ ID NO: 701525 - DNA, 25 bp, Mus musculus
ggactgtaccgaggctataaaagca

SEQ ID NO: 701526 - DNA, 25 bp, Mus musculus
ggactgtacttacacagcctcatct

SEQ ID NO: 701527 - DNA, 25 bp, Mus musculus
ggactgtacttagacagcctcatct

SEQ ID NO: 701528 - DNA, 25 bp, Mus musculus
ggactgtagcccagctccgtgtaca

SEQ ID NO: 701529 - DNA, 25 bp, Mus musculus
ggactgtagccctgctccgtgtaca

SEQ ID NO: 701530 - DNA, 25 bp, Mus musculus
ggactgtagccgactgtggcgcctc

SEQ ID NO: 701531 - DNA, 25 bp, Mus musculus
ggactgtagccgtctgtggcgcctc

SEQ ID NO: 701532 - DNA, 25 bp, Mus musculus
ggactgtcacatccagctgagaacc

SEQ ID NO: 701533 - DNA, 25 bp, Mus musculus
ggactgtcacatgcagctgagaacc

SEQ ID NO: 701534 - DNA, 25 bp, Mus musculus
ggactgtcatatagtaacccctgtg

SEQ ID NO: 701535 - DNA, 25 bp, Mus musculus
ggactgtcatattgtaacccctgtg

SEQ ID NO: 701536 - DNA, 25 bp, Mus musculus
ggactgtccagccaacgagcaagcc

SEQ ID NO: 701537 - DNA, 25 bp, Mus musculus
ggactgtccagcgaacgagcaagcc

SEQ ID NO: 701538 - DNA, 25 bp, Mus musculus
ggactgtcgcctccacacaagaaag

SEQ ID NO: 701539 - DNA, 25 bp, Mus musculus
ggactgtcgcctgcacacaagaaag

SEQ ID NO: 701540 - DNA, 25 bp, Mus musculus
ggactgtctgatcttgcctctattt

SEQ ID NO: 701541 - DNA, 25 bp, Mus musculus
ggactgtctgatgttgcctctattt

SEQ ID NO: 701542 - DNA, 25 bp, Mus musculus
ggactgtctgtacttgcggacagct

SEQ ID NO: 701543 - DNA, 25 bp, Mus musculus
ggactgtctgtagttgcggacagct

SEQ ID NO: 701544 - DNA, 25 bp, Mus musculus
ggactgtcttggatcaacagcccat

SEQ ID NO: 701545 - DNA, 25 bp, Mus musculus
ggactgtcttggttcaacagcccat

SEQ ID NO: 701546 - DNA, 25 bp, Mus musculus
ggactgtgaatgacacccataccgg

SEQ ID NO: 701547 - DNA, 25 bp, Mus musculus
ggactgtgaatgtcacccataccgg

SEQ ID NO: 701548 - DNA, 25 bp, Mus musculus
ggactgtgcaacctccaggccagag

SEQ ID NO: 701549 - DNA, 25 bp, Mus musculus
ggactgtgcaacgtccaggccagag

SEQ ID NO: 701550 - DNA, 25 bp, Mus musculus
ggactgtgcactctttctgaccact

SEQ ID NO: 701551 - DNA, 25 bp, Mus musculus
ggactgtgcactgtttctgaccact

SEQ ID NO: 701552 - DNA, 25 bp, Mus musculus
ggactgtggatgaagaatcccagaa

SEQ ID NO: 701553 - DNA, 25 bp, Mus musculus
ggactgtggatgtagaatcccagaa

SEQ ID NO: 701554 - DNA, 25 bp, Mus musculus
ggactgtgggtgagaagcttctacc

SEQ ID NO: 701555 - DNA, 25 bp, Mus musculus
ggactgtgggtgtgaagcttctacc

SEQ ID NO: 701556 - DNA, 25 bp, Mus musculus
ggactgttcccacagccaggatgcg

SEQ ID NO: 701557 - DNA, 25 bp, Mus musculus
ggactgttcccactcacatgaacga

SEQ ID NO: 701558 - DNA, 25 bp, Mus musculus
ggactgttcccagagccaggatgcg

SEQ ID NO: 701559 - DNA, 25 bp, Mus musculus
ggactgttcccagtcacatgaacga

SEQ ID NO: 701560 - DNA, 25 bp, Mus musculus
ggactgtttgatcccttgcagatca

SEQ ID NO: 701561 - DNA, 25 bp, Mus musculus
ggactgtttgatgccttgcagatca

SEQ ID NO: 701562 - DNA, 25 bp, Mus musculus
ggacttaaggcccattcaggaggaa

SEQ ID NO: 701563 - DNA, 25 bp, Mus musculus
ggacttaaggccgattcaggaggaa

SEQ ID NO: 701564 - DNA, 25 bp, Mus musculus
ggacttaagtaacatgaagagcctg

SEQ ID NO: 701565 - DNA, 25 bp, Mus musculus
ggacttaagtaagatgaagagcctg

SEQ ID NO: 701566 - DNA, 25 bp, Mus musculus
ggacttaatatgacaaaagcacatt

SEQ ID NO: 701567 - DNA, 25 bp, Mus musculus
ggacttaatatgtcaaaagcacatt

SEQ ID NO: 701568 - DNA, 25 bp, Mus musculus
ggacttaccggcagggctacgatgt

SEQ ID NO: 701569 - DNA, 25 bp, Mus musculus
ggacttaccggctgggctacgatgt

SEQ ID NO: 701570 - DNA, 25 bp, Mus musculus
ggacttactccacagcctattcaga

SEQ ID NO: 701571 - DNA, 25 bp, Mus musculus
ggacttactccagagcctattcaga

SEQ ID NO: 701572 - DNA, 25 bp, Mus musculus
ggacttagaagaactaacctctcca

SEQ ID NO: 701573 - DNA, 25 bp, Mus musculus
ggacttagaagatctaacctctcca

SEQ ID NO: 701574 - DNA, 25 bp, Mus musculus
ggacttagatgtcgagcaacttgga

SEQ ID NO: 701575 - DNA, 25 bp, Mus musculus
ggacttagatgtggagcaacttgga

SEQ ID NO: 701576 - DNA, 25 bp, Mus musculus
ggacttagtctaagaccacaaacaa

SEQ ID NO: 701577 - DNA, 25 bp, Mus musculus
ggacttagtctatgaccacaaacaa

SEQ ID NO: 701578 - DNA, 25 bp, Mus musculus
ggacttatgtacaacttcacccact

SEQ ID NO: 701579 - DNA, 25 bp, Mus musculus
ggacttatgtactacttcacccact

SEQ ID NO: 701580 - DNA, 25 bp, Mus musculus
ggacttattctgcaccacctgttcc

SEQ ID NO: 701581 - DNA, 25 bp, Mus musculus
ggacttattctggaccacctgttcc

SEQ ID NO: 701582 - DNA, 25 bp, Mus musculus
ggacttcaaagaaaacaacgttgta

SEQ ID NO: 701583 - DNA, 25 bp, Mus musculus
ggacttcaaagataacaacgttgta

SEQ ID NO: 701584 - DNA, 25 bp, Mus musculus
ggacttcaacttaagggaagatact

SEQ ID NO: 701585 - DNA, 25 bp, Mus musculus
ggacttcaactttagggaagatact

SEQ ID NO: 701586 - DNA, 25 bp, Mus musculus
ggacttcataaaagaagccatgcaa

SEQ ID NO: 701587 - DNA, 25 bp, Mus musculus
ggacttcataaatgaagccatgcaa

SEQ ID NO: 701588 - DNA, 25 bp, Mus musculus
ggacttcatccgcaggctgctggtc

SEQ ID NO: 701589 - DNA, 25 bp, Mus musculus
ggacttcatccggaggctgctggtc

SEQ ID NO: 701590 - DNA, 25 bp, Mus musculus
ggacttcatctcctgaacatggaaa

SEQ ID NO: 701591 - DNA, 25 bp, Mus musculus
ggacttcatctcgtgaacatggaaa

SEQ ID NO: 701592 - DNA, 25 bp, Mus musculus
ggacttccacccagtcacaatggca

SEQ ID NO: 701593 - DNA, 25 bp, Mus musculus
ggacttccaccctgtcacaatggca

SEQ ID NO: 701594 - DNA, 25 bp, Mus musculus
ggacttccagggagttacatacaaa

SEQ ID NO: 701595 - DNA, 25 bp, Mus musculus
ggacttccagggtgttacatacaaa

SEQ ID NO: 701596 - DNA, 25 bp, Mus musculus
ggacttcccacccagaatctttagg

SEQ ID NO: 701597 - DNA, 25 bp, Mus musculus
ggacttcccaccgagaatctttagg

SEQ ID NO: 701598 - DNA, 25 bp, Mus musculus
ggacttccgatcaggctcacccagt

SEQ ID NO: 701599 - DNA, 25 bp, Mus musculus
ggacttccgatctggctcacccagt

SEQ ID NO: 701600 - DNA, 25 bp, Mus musculus
ggacttccgcagattccggtcagag

SEQ ID NO: 701601 - DNA, 25 bp, Mus musculus
ggacttccgcagtttccggtcagag

SEQ ID NO: 701602 - DNA, 25 bp, Mus musculus
ggacttcctcgtcgtataactacag

SEQ ID NO: 701603 - DNA, 25 bp, Mus musculus
ggacttcctcgtggtataactacag

SEQ ID NO: 701604 - DNA, 25 bp, Mus musculus
ggacttcctgggaccataggtgaag

SEQ ID NO: 701605 - DNA, 25 bp, Mus musculus
ggacttcctgggtccataggtgaag

SEQ ID NO: 701606 - DNA, 25 bp, Mus musculus
ggacttcctttcctgaggctgttgc

SEQ ID NO: 701607 - DNA, 25 bp, Mus musculus
ggacttcctttcgtgaggctgttgc

SEQ ID NO: 701608 - DNA, 25 bp, Mus musculus
ggacttcgacggcaagctcagcttc

SEQ ID NO: 701609 - DNA, 25 bp, Mus musculus
ggacttcgacgggaagctcagcttc

SEQ ID NO: 701610 - DNA, 25 bp, Mus musculus
ggacttctacctcctgcccattgtg

SEQ ID NO: 701611 - DNA, 25 bp, Mus musculus
ggacttctacctgctgcccattgtg

SEQ ID NO: 701612 - DNA, 25 bp, Mus musculus
ggacttctactccttcgcgtgcgga

SEQ ID NO: 701613 - DNA, 25 bp, Mus musculus
ggacttctactcgttcgcgtgcgga

SEQ ID NO: 701614 - DNA, 25 bp, Mus musculus
ggacttctagagatccctcctgtgg

SEQ ID NO: 701615 - DNA, 25 bp, Mus musculus
ggacttctagagttccctcctgtgg

SEQ ID NO: 701616 - DNA, 25 bp, Mus musculus
ggacttctccatcacccagttcaag

SEQ ID NO: 701617 - DNA, 25 bp, Mus musculus
ggacttctccatgacccagttcaag

SEQ ID NO: 701618 - DNA, 25 bp, Mus musculus
ggacttctccgacctgtctaggctg

SEQ ID NO: 701619 - DNA, 25 bp, Mus musculus
ggacttctccgagctgtctaggctg

SEQ ID NO: 701620 - DNA, 25 bp, Mus musculus
ggacttctctgaagagatccccgtg

SEQ ID NO: 701621 - DNA, 25 bp, Mus musculus
ggacttctctgatgagatccccgtg

SEQ ID NO: 701622 - DNA, 25 bp, Mus musculus
ggacttctgcaactgcttccggaga

SEQ ID NO: 701623 - DNA, 25 bp, Mus musculus
ggacttctgcaagtgcttccggaga

SEQ ID NO: 701624 - DNA, 25 bp, Mus musculus
ggacttctggcgcttcctcctcggg

SEQ ID NO: 701625 - DNA, 25 bp, Mus musculus
ggacttctggcggttcctcctcggg

SEQ ID NO: 701626 - DNA, 25 bp, Mus musculus
ggacttctgtcgacattgccaacgg

SEQ ID NO: 701627 - DNA, 25 bp, Mus musculus
ggacttctgtcgtcattgccaacgg

SEQ ID NO: 701628 - DNA, 25 bp, Mus musculus
ggacttcttcagcacctgccgatct

SEQ ID NO: 701629 - DNA, 25 bp, Mus musculus
ggacttcttcaggacctgccgatct

SEQ ID NO: 701630 - DNA, 25 bp, Mus musculus
ggacttcttgtcacctgataaccct

SEQ ID NO: 701631 - DNA, 25 bp, Mus musculus
ggacttcttgtctcctgataaccct

SEQ ID NO: 701632 - DNA, 25 bp, Mus musculus
ggacttgaaaataaaagcacatgtc

SEQ ID NO: 701633 - DNA, 25 bp, Mus musculus
ggacttgaaaattaaagcacatgtc

SEQ ID NO: 701634 - DNA, 25 bp, Mus musculus
ggacttgaacaaccagactcctgta

SEQ ID NO: 701635 - DNA, 25 bp, Mus musculus
ggacttgaacaagcagactcctgta

SEQ ID NO: 701636 - DNA, 25 bp, Mus musculus
ggacttgaacatatgacagactcat

SEQ ID NO: 701637 - DNA, 25 bp, Mus musculus
ggacttgaacatttgacagactcat

SEQ ID NO: 701638 - DNA, 25 bp, Mus musculus
ggacttgacatcagtggacacccaa

SEQ ID NO: 701639 - DNA, 25 bp, Mus musculus
ggacttgacatctgtggacacccaa

SEQ ID NO: 701640 - DNA, 25 bp, Mus musculus
ggacttgagacccacaagactgatc

SEQ ID NO: 701641 - DNA, 25 bp, Mus musculus
ggacttgagaccgacaagactgatc

SEQ ID NO: 701642 - DNA, 25 bp, Mus musculus
ggacttgattgccaaatacatcggg

SEQ ID NO: 701643 - DNA, 25 bp, Mus musculus
ggacttgattgcgaaatacatcggg

SEQ ID NO: 701644 - DNA, 25 bp, Mus musculus
ggacttgccgttactctccttggaa

SEQ ID NO: 701645 - DNA, 25 bp, Mus musculus
ggacttgccgtttctctccttggaa

SEQ ID NO: 701646 - DNA, 25 bp, Mus musculus
ggacttgcctccaatgagcagaacg

SEQ ID NO: 701647 - DNA, 25 bp, Mus musculus
ggacttgcctcctatgagcagaacg

SEQ ID NO: 701648 - DNA, 25 bp, Mus musculus
ggacttgcctggcttatacagaaag

SEQ ID NO: 701649 - DNA, 25 bp, Mus musculus
ggacttgcctgggttatacagaaag

SEQ ID NO: 701650 - DNA, 25 bp, Mus musculus
ggacttgccttgatccgagagctgg

SEQ ID NO: 701651 - DNA, 25 bp, Mus musculus
ggacttgccttgttccgagagctgg

SEQ ID NO: 701652 - DNA, 25 bp, Mus musculus
ggacttgctgatcgccaccaactca

SEQ ID NO: 701653 - DNA, 25 bp, Mus musculus
ggacttgctgatggccaccaactca

SEQ ID NO: 701654 - DNA, 25 bp, Mus musculus
ggacttggacccaggcactagaggt

SEQ ID NO: 701655 - DNA, 25 bp, Mus musculus
ggacttggaccctggcactagaggt

SEQ ID NO: 701656 - DNA, 25 bp, Mus musculus
ggacttggccaccaatgtatttgca

SEQ ID NO: 701657 - DNA, 25 bp, Mus musculus
ggacttggccacgaatgtatttgca

SEQ ID NO: 701658 - DNA, 25 bp, Mus musculus
ggacttggcctcattgtaatctcta

SEQ ID NO: 701659 - DNA, 25 bp, Mus musculus
ggacttggcctctttgtaatctcta

SEQ ID NO: 701660 - DNA, 25 bp, Mus musculus
ggacttgggacacctggaactcaca

SEQ ID NO: 701661 - DNA, 25 bp, Mus musculus
ggacttgggacagctggaactcaca

SEQ ID NO: 701662 - DNA, 25 bp, Mus musculus
ggacttgggctcctcatctctgaag

SEQ ID NO: 701663 - DNA, 25 bp, Mus musculus
ggacttgggctcgtcatctctgaag

SEQ ID NO: 701664 - DNA, 25 bp, Mus musculus
ggacttggtactctcccttcatgcc

SEQ ID NO: 701665 - DNA, 25 bp, Mus musculus
ggacttggtactgtcccttcatgcc

SEQ ID NO: 701666 - DNA, 25 bp, Mus musculus
ggacttgtccctcgagccagtggat

SEQ ID NO: 701667 - DNA, 25 bp, Mus musculus
ggacttgtccctggagccagtggat

SEQ ID NO: 701668 - DNA, 25 bp, Mus musculus
ggacttgtgggtagctgaagcctct

SEQ ID NO: 701669 - DNA, 25 bp, Mus musculus
ggacttgtgggttgctgaagcctct

SEQ ID NO: 701670 - DNA, 25 bp, Mus musculus
ggacttgttcaacgatcccagacta

SEQ ID NO: 701671 - DNA, 25 bp, Mus musculus
ggacttgttcaaggatcccagacta

SEQ ID NO: 701672 - DNA, 25 bp, Mus musculus
ggacttgttgcacacagaaatgtgt

SEQ ID NO: 701673 - DNA, 25 bp, Mus musculus
ggacttgttgcagacagaaatgtgt

SEQ ID NO: 701674 - DNA, 25 bp, Mus musculus
ggactttaaattctcagggcctcga

SEQ ID NO: 701675 - DNA, 25 bp, Mus musculus
ggactttaaattgtcagggcctcga

SEQ ID NO: 701676 - DNA, 25 bp, Mus musculus
ggactttaacggcaatccccattct

SEQ ID NO: 701677 - DNA, 25 bp, Mus musculus
ggactttaacgggaatccccattct

SEQ ID NO: 701678 - DNA, 25 bp, Mus musculus
ggactttagcaccatgacgcacctg

SEQ ID NO: 701679 - DNA, 25 bp, Mus musculus
ggactttagcacgatgacgcacctg

SEQ ID NO: 701680 - DNA, 25 bp, Mus musculus
ggactttaggaaccagggctttctc

SEQ ID NO: 701681 - DNA, 25 bp, Mus musculus
ggactttaggaagcagggctttctc

SEQ ID NO: 701682 - DNA, 25 bp, Mus musculus
ggactttcacaaccctacggaagct

SEQ ID NO: 701683 - DNA, 25 bp, Mus musculus
ggactttcacaagcctacggaagct

SEQ ID NO: 701684 - DNA, 25 bp, Mus musculus
ggactttcaggaccctcaggatcag

SEQ ID NO: 701685 - DNA, 25 bp, Mus musculus
ggactttcaggagcctcaggatcag

SEQ ID NO: 701686 - DNA, 25 bp, Mus musculus
ggactttcagtcaaccaactagata

SEQ ID NO: 701687 - DNA, 25 bp, Mus musculus
ggactttcagtctaccaactagata

SEQ ID NO: 701688 - DNA, 25 bp, Mus musculus
ggactttcagttaccttgacgatgt

SEQ ID NO: 701689 - DNA, 25 bp, Mus musculus
ggactttcagtttccttgacgatgt

SEQ ID NO: 701690 - DNA, 25 bp, Mus musculus
ggactttctgctaaagacctgcatg

SEQ ID NO: 701691 - DNA, 25 bp, Mus musculus
ggactttctgcttaagacctgcatg

SEQ ID NO: 701692 - DNA, 25 bp, Mus musculus
ggactttgcaagagccccaagagga

SEQ ID NO: 701693 - DNA, 25 bp, Mus musculus
ggactttgcaagtgccccaagagga

SEQ ID NO: 701694 - DNA, 25 bp, Mus musculus
ggactttggtccattgtacaggcca

SEQ ID NO: 701695 - DNA, 25 bp, Mus musculus
ggactttggtcctttgtacaggcca

SEQ ID NO: 701696 - DNA, 25 bp, Mus musculus
ggacttttaatgaaaacaccggcag

SEQ ID NO: 701697 - DNA, 25 bp, Mus musculus
ggacttttaatgtaaacaccggcag

SEQ ID NO: 701698 - DNA, 25 bp, Mus musculus
ggactttttgcccattctccccagg

SEQ ID NO: 701699 - DNA, 25 bp, Mus musculus
ggactttttgccgattctccccagg

SEQ ID NO: 701700 - DNA, 25 bp, Mus musculus
ggagaaaaatggaccccttggctca

SEQ ID NO: 701701 - DNA, 25 bp, Mus musculus
ggagaaaaatggtccccttggctca

SEQ ID NO: 701702 - DNA, 25 bp, Mus musculus
ggagaaaataagaccgagtacttct

SEQ ID NO: 701703 - DNA, 25 bp, Mus musculus
ggagaaaataagtccgagtacttct

SEQ ID NO: 701704 - DNA, 25 bp, Mus musculus
ggagaaaatggacccaataaacact

SEQ ID NO: 701705 - DNA, 25 bp, Mus musculus
ggagaaaatggagccaataaacact

SEQ ID NO: 701706 - DNA, 25 bp, Mus musculus
ggagaaaatggcatagtcacataca

SEQ ID NO: 701707 - DNA, 25 bp, Mus musculus
ggagaaaatggcttagtcacataca

SEQ ID NO: 701708 - DNA, 25 bp, Mus musculus
ggagaaaccattagatttccgggtg

SEQ ID NO: 701709 - DNA, 25 bp, Mus musculus
ggagaaaccatttgatttccgggtg

SEQ ID NO: 701710 - DNA, 25 bp, Mus musculus
ggagaaacccataccacattaacaa

SEQ ID NO: 701711 - DNA, 25 bp, Mus musculus
ggagaaacccattccacattaacaa

SEQ ID NO: 701712 - DNA, 25 bp, Mus musculus
ggagaaactatacctgagagaatta

SEQ ID NO: 701713 - DNA, 25 bp, Mus musculus
ggagaaactatagctgagagaatta

SEQ ID NO: 701714 - DNA, 25 bp, Mus musculus
ggagaaactcatcacctttcccaga

SEQ ID NO: 701715 - DNA, 25 bp, Mus musculus
ggagaaactcatgacctttcccaga

SEQ ID NO: 701716 - DNA, 25 bp, Mus musculus
ggagaaactcttccctcatgaggag

SEQ ID NO: 701717 - DNA, 25 bp, Mus musculus
ggagaaactcttgcctcatgaggag

SEQ ID NO: 701718 - DNA, 25 bp, Mus musculus
ggagaaactgaaacaagctaagaag

SEQ ID NO: 701719 - DNA, 25 bp, Mus musculus
ggagaaactgaatcaagctaagaag

SEQ ID NO: 701720 - DNA, 25 bp, Mus musculus
ggagaaacttccagctggccggagt

SEQ ID NO: 701721 - DNA, 25 bp, Mus musculus
ggagaaacttcctgctggccggagt

SEQ ID NO: 701722 - DNA, 25 bp, Mus musculus
ggagaaagaccaatactgtatcacg

SEQ ID NO: 701723 - DNA, 25 bp, Mus musculus
ggagaaagaccattactgtatcacg

SEQ ID NO: 701724 - DNA, 25 bp, Mus musculus
ggagaaagacgaaactgtgagtgac

SEQ ID NO: 701725 - DNA, 25 bp, Mus musculus
ggagaaagacgatactgtgagtgac

SEQ ID NO: 701726 - DNA, 25 bp, Mus musculus
ggagaaagatgtcaagctgcttcaa

SEQ ID NO: 701727 - DNA, 25 bp, Mus musculus
ggagaaagatgtgaagctgcttcaa

SEQ ID NO: 701728 - DNA, 25 bp, Mus musculus
ggagaaagcagaaattgaacgcatg

SEQ ID NO: 701729 - DNA, 25 bp, Mus musculus
ggagaaagcagatattgaacgcatg

SEQ ID NO: 701730 - DNA, 25 bp, Mus musculus
ggagaaagcagccatcatccaccag

SEQ ID NO: 701731 - DNA, 25 bp, Mus musculus
ggagaaagcagcgatcatccaccag

SEQ ID NO: 701732 - DNA, 25 bp, Mus musculus
ggagaaaggaatacttgtggttcag

SEQ ID NO: 701733 - DNA, 25 bp, Mus musculus
ggagaaaggaattcttgtggttcag

SEQ ID NO: 701734 - DNA, 25 bp, Mus musculus
ggagaaatcaaaagctctggaatcc

SEQ ID NO: 701735 - DNA, 25 bp, Mus musculus
ggagaaatcaaatgctctggaatcc

SEQ ID NO: 701736 - DNA, 25 bp, Mus musculus
ggagaaatgtctcccgtcttctagt

SEQ ID NO: 701737 - DNA, 25 bp, Mus musculus
ggagaaatgtctgccgtcttctagt

SEQ ID NO: 701738 - DNA, 25 bp, Mus musculus
ggagaaattaaaatccagctatcga

SEQ ID NO: 701739 - DNA, 25 bp, Mus musculus
ggagaaattaaattccagctatcga

SEQ ID NO: 701740 - DNA, 25 bp, Mus musculus
ggagaaattccaacacctcagctaa

SEQ ID NO: 701741 - DNA, 25 bp, Mus musculus
ggagaaattccatcacctcagctaa

SEQ ID NO: 701742 - DNA, 25 bp, Mus musculus
ggagaaattcttcaatgagatcaac

SEQ ID NO: 701743 - DNA, 25 bp, Mus musculus
ggagaaattcttgaatgagatcaac

SEQ ID NO: 701744 - DNA, 25 bp, Mus musculus
ggagaaattgccagcagggtgatac

SEQ ID NO: 701745 - DNA, 25 bp, Mus musculus
ggagaaattgcccatacacaatgac

SEQ ID NO: 701746 - DNA, 25 bp, Mus musculus
ggagaaattgccgatacacaatgac

SEQ ID NO: 701747 - DNA, 25 bp, Mus musculus
ggagaaattgcctgcagggtgatac

SEQ ID NO: 701748 - DNA, 25 bp, Mus musculus
ggagaacaactgattaatgggaatt

SEQ ID NO: 701749 - DNA, 25 bp, Mus musculus
ggagaacaactgtttaatgggaatt

SEQ ID NO: 701750 - DNA, 25 bp, Mus musculus
ggagaacactgaagaacggcaccac

SEQ ID NO: 701751 - DNA, 25 bp, Mus musculus
ggagaacactgatgaacggcaccac

SEQ ID NO: 701752 - DNA, 25 bp, Mus musculus
ggagaacagcccctacctgaacctg

SEQ ID NO: 701753 - DNA, 25 bp, Mus musculus
ggagaacagcccgtacctgaacctg

SEQ ID NO: 701754 - DNA, 25 bp, Mus musculus
ggagaacaggtgcatgccttcatgt

SEQ ID NO: 701755 - DNA, 25 bp, Mus musculus
ggagaacaggtggatgccttcatgt

SEQ ID NO: 701756 - DNA, 25 bp, Mus musculus
ggagaacattgcaggcttggcccgc

SEQ ID NO: 701757 - DNA, 25 bp, Mus musculus
ggagaacattgcatcaaccctggct

SEQ ID NO: 701758 - DNA, 25 bp, Mus musculus
ggagaacattgctggcttggcccgc

SEQ ID NO: 701759 - DNA, 25 bp, Mus musculus
ggagaacattgcttcaaccctggct

SEQ ID NO: 701760 - DNA, 25 bp, Mus musculus
ggagaaccacccagtgatccgaact

SEQ ID NO: 701761 - DNA, 25 bp, Mus musculus
ggagaaccaccctgtgatccgaact

SEQ ID NO: 701762 - DNA, 25 bp, Mus musculus
ggagaaccagctcgctagccgaaag

SEQ ID NO: 701763 - DNA, 25 bp, Mus musculus
ggagaaccagctggctagccgaaag

SEQ ID NO: 701764 - DNA, 25 bp, Mus musculus
ggagaaccatcacgagattttgaaa

SEQ ID NO: 701765 - DNA, 25 bp, Mus musculus
ggagaaccatcaggagattttgaaa

SEQ ID NO: 701766 - DNA, 25 bp, Mus musculus
ggagaacccagacggccagaccgaa

SEQ ID NO: 701767 - DNA, 25 bp, Mus musculus
ggagaacccagagggccagaccgaa

SEQ ID NO: 701768 - DNA, 25 bp, Mus musculus
ggagaacccagcacatgctgatggg

SEQ ID NO: 701769 - DNA, 25 bp, Mus musculus
ggagaacccagctcatgctgatggg

SEQ ID NO: 701770 - DNA, 25 bp, Mus musculus
ggagaaccctgcatatgataggcct

SEQ ID NO: 701771 - DNA, 25 bp, Mus musculus
ggagaaccctgcttatgataggcct

SEQ ID NO: 701772 - DNA, 25 bp, Mus musculus
ggagaaccgcagatggcctttttca

SEQ ID NO: 701773 - DNA, 25 bp, Mus musculus
ggagaaccgcagttggcctttttca

SEQ ID NO: 701774 - DNA, 25 bp, Mus musculus
ggagaacctaacaacctgggagagg

SEQ ID NO: 701775 - DNA, 25 bp, Mus musculus
ggagaacctaactacctgggagagg

SEQ ID NO: 701776 - DNA, 25 bp, Mus musculus
ggagaacctagaccgcgatatcgct

SEQ ID NO: 701777 - DNA, 25 bp, Mus musculus
ggagaacctagagcgcgatatcgct

SEQ ID NO: 701778 - DNA, 25 bp, Mus musculus
ggagaacctccgaaacttcaacgag

SEQ ID NO: 701779 - DNA, 25 bp, Mus musculus
ggagaacctccgtaacttcaacgag

SEQ ID NO: 701780 - DNA, 25 bp, Mus musculus
ggagaacctggaagactgtgcagct

SEQ ID NO: 701781 - DNA, 25 bp, Mus musculus
ggagaacctggatgactgtgcagct

SEQ ID NO: 701782 - DNA, 25 bp, Mus musculus
ggagaacctggtctacctgggtctc

SEQ ID NO: 701783 - DNA, 25 bp, Mus musculus
ggagaacctggtgtacctgggtctc

SEQ ID NO: 701784 - DNA, 25 bp, Mus musculus
ggagaaccttgactcagagacatcg

SEQ ID NO: 701785 - DNA, 25 bp, Mus musculus
ggagaaccttgagtcagagacatcg

SEQ ID NO: 701786 - DNA, 25 bp, Mus musculus
ggagaaccttttagtcctggaggag

SEQ ID NO: 701787 - DNA, 25 bp, Mus musculus
ggagaacctttttgtcctggaggag

SEQ ID NO: 701788 - DNA, 25 bp, Mus musculus
ggagaacgctcccatctactgcatc

SEQ ID NO: 701789 - DNA, 25 bp, Mus musculus
ggagaacgctccgatctactgcatc

SEQ ID NO: 701790 - DNA, 25 bp, Mus musculus
ggagaacgctgaagatgatccagcc

SEQ ID NO: 701791 - DNA, 25 bp, Mus musculus
ggagaacgctgatgatgatccagcc

SEQ ID NO: 701792 - DNA, 25 bp, Mus musculus
ggagaacggaaacatcgaagtgcta

SEQ ID NO: 701793 - DNA, 25 bp, Mus musculus
ggagaacggaaagatcgaagtgcta

SEQ ID NO: 701794 - DNA, 25 bp, Mus musculus
ggagaacggaacacacactctcact

SEQ ID NO: 701795 - DNA, 25 bp, Mus musculus
ggagaacggaactcacactctcact

SEQ ID NO: 701796 - DNA, 25 bp, Mus musculus
ggagaacgggacagcacgctttgaa

SEQ ID NO: 701797 - DNA, 25 bp, Mus musculus
ggagaacgggactgcacgctttgaa

SEQ ID NO: 701798 - DNA, 25 bp, Mus musculus
ggagaactaactctaatttgtcccg

SEQ ID NO: 701799 - DNA, 25 bp, Mus musculus
ggagaactaactgtaatttgtcccg

SEQ ID NO: 701800 - DNA, 25 bp, Mus musculus
ggagaactcctgattgacattggct

SEQ ID NO: 701801 - DNA, 25 bp, Mus musculus
ggagaactcctgtttgacattggct

SEQ ID NO: 701802 - DNA, 25 bp, Mus musculus
ggagaactcggccttgacagctgaa

SEQ ID NO: 701803 - DNA, 25 bp, Mus musculus
ggagaactcggcgttgacagctgaa

SEQ ID NO: 701804 - DNA, 25 bp, Mus musculus
ggagaactctcgattcaccgactgc

SEQ ID NO: 701805 - DNA, 25 bp, Mus musculus
ggagaactctcgtttcaccgactgc

SEQ ID NO: 701806 - DNA, 25 bp, Mus musculus
ggagaactctgaaatcaccaaagtg

SEQ ID NO: 701807 - DNA, 25 bp, Mus musculus
ggagaactctgatatcaccaaagtg

SEQ ID NO: 701808 - DNA, 25 bp, Mus musculus
ggagaactgcccatgaatgaaatcg

SEQ ID NO: 701809 - DNA, 25 bp, Mus musculus
ggagaactgcccttgaatgaaatcg

SEQ ID NO: 701810 - DNA, 25 bp, Mus musculus
ggagaactgtaactgccgcatggtc

SEQ ID NO: 701811 - DNA, 25 bp, Mus musculus
ggagaactgtaagtgccgcatggtc

SEQ ID NO: 701812 - DNA, 25 bp, Mus musculus
ggagaactgtgtaatgcctggcata

SEQ ID NO: 701813 - DNA, 25 bp, Mus musculus
ggagaactgtgttatgcctggcata

SEQ ID NO: 701814 - DNA, 25 bp, Mus musculus
ggagaacttcggcatccttctgggc

SEQ ID NO: 701815 - DNA, 25 bp, Mus musculus
ggagaacttcgggatccttctgggc

SEQ ID NO: 701816 - DNA, 25 bp, Mus musculus
ggagaagaacaaacagcagaagatg

SEQ ID NO: 701817 - DNA, 25 bp, Mus musculus
ggagaagaacaatcagcagaagatg

SEQ ID NO: 701818 - DNA, 25 bp, Mus musculus
ggagaagaacccaggaaatcagaga

SEQ ID NO: 701819 - DNA, 25 bp, Mus musculus
ggagaagaaccctggaaatcagaga

SEQ ID NO: 701820 - DNA, 25 bp, Mus musculus
ggagaagaatctagatgcctatgat

SEQ ID NO: 701821 - DNA, 25 bp, Mus musculus
ggagaagaatcttgatgcctatgat

SEQ ID NO: 701822 - DNA, 25 bp, Mus musculus
ggagaagaccaccacattccgattg

SEQ ID NO: 701823 - DNA, 25 bp, Mus musculus
ggagaagaccacgacattccgattg

SEQ ID NO: 701824 - DNA, 25 bp, Mus musculus
ggagaagaccagcatgcgccttgaa

SEQ ID NO: 701825 - DNA, 25 bp, Mus musculus
ggagaagaccaggatgcgccttgaa

SEQ ID NO: 701826 - DNA, 25 bp, Mus musculus
ggagaagaccctcatcctggtgaag

SEQ ID NO: 701827 - DNA, 25 bp, Mus musculus
ggagaagaccctgatcctggtgaag

SEQ ID NO: 701828 - DNA, 25 bp, Mus musculus
ggagaagacctcaaacatgactttg

SEQ ID NO: 701829 - DNA, 25 bp, Mus musculus
ggagaagacctctaacatgactttg

SEQ ID NO: 701830 - DNA, 25 bp, Mus musculus
ggagaagacggcaaagctcatcccc

SEQ ID NO: 701831 - DNA, 25 bp, Mus musculus
ggagaagacggcacagcccaatgga

SEQ ID NO: 701832 - DNA, 25 bp, Mus musculus
ggagaagacggctaagctcatcccc

SEQ ID NO: 701833 - DNA, 25 bp, Mus musculus
ggagaagacggctcagcccaatgga

SEQ ID NO: 701834 - DNA, 25 bp, Mus musculus
ggagaagactggcacgcagccctgg

SEQ ID NO: 701835 - DNA, 25 bp, Mus musculus
ggagaagactgggacgcagccctgg

SEQ ID NO: 701836 - DNA, 25 bp, Mus musculus
ggagaagagacgaaaaacgacacgt

SEQ ID NO: 701837 - DNA, 25 bp, Mus musculus
ggagaagagacgtaaaacgacacgt

SEQ ID NO: 701838 - DNA, 25 bp, Mus musculus
ggagaagagctgagctcgcctcacc

SEQ ID NO: 701839 - DNA, 25 bp, Mus musculus
ggagaagagctgtgctcgcctcacc

SEQ ID NO: 701840 - DNA, 25 bp, Mus musculus
ggagaagatactagatgctgtacag

SEQ ID NO: 701841 - DNA, 25 bp, Mus musculus
ggagaagatacttgatgctgtacag

SEQ ID NO: 701842 - DNA, 25 bp, Mus musculus
ggagaagatcaaccaaagcaagttt

SEQ ID NO: 701843 - DNA, 25 bp, Mus musculus
ggagaagatcaagcaaagcaagttt

SEQ ID NO: 701844 - DNA, 25 bp, Mus musculus
ggagaagatcgcagagcagatgcat

SEQ ID NO: 701845 - DNA, 25 bp, Mus musculus
ggagaagatcgctgagcagatgcat

SEQ ID NO: 701846 - DNA, 25 bp, Mus musculus
ggagaagatcttcgcgggcaaggtg

SEQ ID NO: 701847 - DNA, 25 bp, Mus musculus
ggagaagatcttggcgggcaaggtg

SEQ ID NO: 701848 - DNA, 25 bp, Mus musculus
ggagaagatgaccacatttttaaca

SEQ ID NO: 701849 - DNA, 25 bp, Mus musculus
ggagaagatgacgacatttttaaca

SEQ ID NO: 701850 - DNA, 25 bp, Mus musculus
ggagaagcacatcactgtaaagaag

SEQ ID NO: 701851 - DNA, 25 bp, Mus musculus
ggagaagcacatgactgtaaagaag

SEQ ID NO: 701852 - DNA, 25 bp, Mus musculus
ggagaagcagagctcacaaatcagc

SEQ ID NO: 701853 - DNA, 25 bp, Mus musculus
ggagaagcagaggtcacaaatcagc

SEQ ID NO: 701854 - DNA, 25 bp, Mus musculus
ggagaagcagtaacaggtgcacccc

SEQ ID NO: 701855 - DNA, 25 bp, Mus musculus
ggagaagcagtatcaggtgcacccc

SEQ ID NO: 701856 - DNA, 25 bp, Mus musculus
ggagaagccatgcaaaactcggtca

SEQ ID NO: 701857 - DNA, 25 bp, Mus musculus
ggagaagccatggaaaactcggtca

SEQ ID NO: 701858 - DNA, 25 bp, Mus musculus
ggagaagccgccaaatcctatggaa

SEQ ID NO: 701859 - DNA, 25 bp, Mus musculus
ggagaagccgcctaatcctatggaa

SEQ ID NO: 701860 - DNA, 25 bp, Mus musculus
ggagaagcctagaagaactcccagc

SEQ ID NO: 701861 - DNA, 25 bp, Mus musculus
ggagaagcctagtagaactcccagc

SEQ ID NO: 701862 - DNA, 25 bp, Mus musculus
ggagaagcgccaacgcacacggtcc

SEQ ID NO: 701863 - DNA, 25 bp, Mus musculus
ggagaagcgccatcgcacacggtcc

SEQ ID NO: 701864 - DNA, 25 bp, Mus musculus
ggagaagcggaacgtggagccgccc

SEQ ID NO: 701865 - DNA, 25 bp, Mus musculus
ggagaagcggaaggtggagccgccc

SEQ ID NO: 701866 - DNA, 25 bp, Mus musculus
ggagaagcggctccacgctgtccct

SEQ ID NO: 701867 - DNA, 25 bp, Mus musculus
ggagaagcggctgcacgctgtccct

SEQ ID NO: 701868 - DNA, 25 bp, Mus musculus
ggagaagctacacagtcagcatgct

SEQ ID NO: 701869 - DNA, 25 bp, Mus musculus
ggagaagctacagagtcagcatgct

SEQ ID NO: 701870 - DNA, 25 bp, Mus musculus
ggagaagctatccagctcatttcag

SEQ ID NO: 701871 - DNA, 25 bp, Mus musculus
ggagaagctatcgagctcatttcag

SEQ ID NO: 701872 - DNA, 25 bp, Mus musculus
ggagaagctgagcaagcaaaagtac

SEQ ID NO: 701873 - DNA, 25 bp, Mus musculus
ggagaagctgaggaagcaaaagtac

SEQ ID NO: 701874 - DNA, 25 bp, Mus musculus
ggagaagctgcaacttatcacccgg

SEQ ID NO: 701875 - DNA, 25 bp, Mus musculus
ggagaagctgcaatgtctgaaagac

SEQ ID NO: 701876 - DNA, 25 bp, Mus musculus
ggagaagctgcatcttatcacccgg

SEQ ID NO: 701877 - DNA, 25 bp, Mus musculus
ggagaagctgcattgtctgaaagac

SEQ ID NO: 701878 - DNA, 25 bp, Mus musculus
ggagaagctggtattcctggtcgcc

SEQ ID NO: 701879 - DNA, 25 bp, Mus musculus
ggagaagctggttttcctggtcgcc

SEQ ID NO: 701880 - DNA, 25 bp, Mus musculus
ggagaagctgtaaaaggtgtacacc

SEQ ID NO: 701881 - DNA, 25 bp, Mus musculus
ggagaagctgtataaggtgtacacc

SEQ ID NO: 701882 - DNA, 25 bp, Mus musculus
ggagaagctttcagccgacatgggc

SEQ ID NO: 701883 - DNA, 25 bp, Mus musculus
ggagaagctttctgccgacatgggc

SEQ ID NO: 701884 - DNA, 25 bp, Mus musculus
ggagaaggaagcaaaacacctcagc

SEQ ID NO: 701885 - DNA, 25 bp, Mus musculus
ggagaaggaagctaaacacctcagc

SEQ ID NO: 701886 - DNA, 25 bp, Mus musculus
ggagaaggaccaaattcgtcggccc

SEQ ID NO: 701887 - DNA, 25 bp, Mus musculus
ggagaaggaccaccaaggcatcatt

SEQ ID NO: 701888 - DNA, 25 bp, Mus musculus
ggagaaggaccagcaaggcatcatt

SEQ ID NO: 701889 - DNA, 25 bp, Mus musculus
ggagaaggaccatattcgtcggccc

SEQ ID NO: 701890 - DNA, 25 bp, Mus musculus
ggagaaggactacttcggtctgacc

SEQ ID NO: 701891 - DNA, 25 bp, Mus musculus
ggagaaggactagttcggtctgacc

SEQ ID NO: 701892 - DNA, 25 bp, Mus musculus
ggagaaggagagaatagctctgatc

SEQ ID NO: 701893 - DNA, 25 bp, Mus musculus
ggagaaggagagtatagctctgatc

SEQ ID NO: 701894 - DNA, 25 bp, Mus musculus
ggagaaggcaacaacatacctaata

SEQ ID NO: 701895 - DNA, 25 bp, Mus musculus
ggagaaggcaactacatacctaata

SEQ ID NO: 701896 - DNA, 25 bp, Mus musculus
ggagaaggcaccatctattattttc

SEQ ID NO: 701897 - DNA, 25 bp, Mus musculus
ggagaaggcaccttctattattttc

SEQ ID NO: 701898 - DNA, 25 bp, Mus musculus
ggagaaggcataagtgtgactgaat

SEQ ID NO: 701899 - DNA, 25 bp, Mus musculus
ggagaaggcatatgtgtgactgaat

SEQ ID NO: 701900 - DNA, 25 bp, Mus musculus
ggagaaggccgaatacttctaaatt

SEQ ID NO: 701901 - DNA, 25 bp, Mus musculus
ggagaaggccgattacttctaaatt

SEQ ID NO: 701902 - DNA, 25 bp, Mus musculus
ggagaagggccacctctcatcacac

SEQ ID NO: 701903 - DNA, 25 bp, Mus musculus
ggagaagggccagctctcatcacac

SEQ ID NO: 701904 - DNA, 25 bp, Mus musculus
ggagaaggtggacatcatcatcagc

SEQ ID NO: 701905 - DNA, 25 bp, Mus musculus
ggagaaggtggagatcatcatcagc

SEQ ID NO: 701906 - DNA, 25 bp, Mus musculus
ggagaagtcagaaagaaagcatgct

SEQ ID NO: 701907 - DNA, 25 bp, Mus musculus
ggagaagtcagatagaaagcatgct

SEQ ID NO: 701908 - DNA, 25 bp, Mus musculus
ggagaagtcccgagagttcattgga

SEQ ID NO: 701909 - DNA, 25 bp, Mus musculus
ggagaagtcccgtgagttcattgga

SEQ ID NO: 701910 - DNA, 25 bp, Mus musculus
ggagaagtgcagacgtttcattgaa

SEQ ID NO: 701911 - DNA, 25 bp, Mus musculus
ggagaagtgcagtcgtttcattgaa

SEQ ID NO: 701912 - DNA, 25 bp, Mus musculus
ggagaagtgcatccaccacgtgaag

SEQ ID NO: 701913 - DNA, 25 bp, Mus musculus
ggagaagtgcatgcaccacgtgaag

SEQ ID NO: 701914 - DNA, 25 bp, Mus musculus
ggagaagtgctaagtcatactgtga

SEQ ID NO: 701915 - DNA, 25 bp, Mus musculus
ggagaagtgctatgtcatactgtga

SEQ ID NO: 701916 - DNA, 25 bp, Mus musculus
ggagaagtggcaaccatcagctgcc

SEQ ID NO: 701917 - DNA, 25 bp, Mus musculus
ggagaagtggcatccatcagctgcc

SEQ ID NO: 701918 - DNA, 25 bp, Mus musculus
ggagaagttcaacaacaagtccctt

SEQ ID NO: 701919 - DNA, 25 bp, Mus musculus
ggagaagttcaagaacaagtccctt

SEQ ID NO: 701920 - DNA, 25 bp, Mus musculus
ggagaagttccgctacatgtgcatt

SEQ ID NO: 701921 - DNA, 25 bp, Mus musculus
ggagaagttccggtacatgtgcatt

SEQ ID NO: 701922 - DNA, 25 bp, Mus musculus
ggagaagttgacagttgacccaggc

SEQ ID NO: 701923 - DNA, 25 bp, Mus musculus
ggagaagttgactgttgacccaggc

SEQ ID NO: 701924 - DNA, 25 bp, Mus musculus
ggagaagttggccatcaaggacctc

SEQ ID NO: 701925 - DNA, 25 bp, Mus musculus
ggagaagttggcgatcaaggacctc

SEQ ID NO: 701926 - DNA, 25 bp, Mus musculus
ggagaataaaacatccagagttgga

SEQ ID NO: 701927 - DNA, 25 bp, Mus musculus
ggagaataaaacttccagagttgga

SEQ ID NO: 701928 - DNA, 25 bp, Mus musculus
ggagaataaagcaccctgtgtacac

SEQ ID NO: 701929 - DNA, 25 bp, Mus musculus
ggagaataaagctccctgtgtacac

SEQ ID NO: 701930 - DNA, 25 bp, Mus musculus
ggagaatacaggctgagctacagaa

SEQ ID NO: 701931 - DNA, 25 bp, Mus musculus
ggagaatacagggtgagctacagaa

SEQ ID NO: 701932 - DNA, 25 bp, Mus musculus
ggagaatattggcactctagcctct

SEQ ID NO: 701933 - DNA, 25 bp, Mus musculus
ggagaatattgggactctagcctct

SEQ ID NO: 701934 - DNA, 25 bp, Mus musculus
ggagaatcaggaaaaagcaccattg

SEQ ID NO: 701935 - DNA, 25 bp, Mus musculus
ggagaatcaggataaagcaccattg

SEQ ID NO: 701936 - DNA, 25 bp, Mus musculus
ggagaatccatcatgattggtgtca

SEQ ID NO: 701937 - DNA, 25 bp, Mus musculus
ggagaatccatcttgattggtgtca

SEQ ID NO: 701938 - DNA, 25 bp, Mus musculus
ggagaatcggttagtacagcccggc

SEQ ID NO: 701939 - DNA, 25 bp, Mus musculus
ggagaatcggtttgtacagcccggc

SEQ ID NO: 701940 - DNA, 25 bp, Mus musculus
ggagaatcgtataggaggcattcgg

SEQ ID NO: 701941 - DNA, 25 bp, Mus musculus
ggagaatcgtattggaggcattcgg

SEQ ID NO: 701942 - DNA, 25 bp, Mus musculus
ggagaatcgttgaagtcttaagagc

SEQ ID NO: 701943 - DNA, 25 bp, Mus musculus
ggagaatcgttgtagtcttaagagc

SEQ ID NO: 701944 - DNA, 25 bp, Mus musculus
ggagaatctcaaaaactggctgctg

SEQ ID NO: 701945 - DNA, 25 bp, Mus musculus
ggagaatctcaataactggctgctg

SEQ ID NO: 701946 - DNA, 25 bp, Mus musculus
ggagaatctcatcggatcagtacgg

SEQ ID NO: 701947 - DNA, 25 bp, Mus musculus
ggagaatctcatgggatcagtacgg

SEQ ID NO: 701948 - DNA, 25 bp, Mus musculus
ggagaatctccgcacctacaacatc

SEQ ID NO: 701949 - DNA, 25 bp, Mus musculus
ggagaatctccggacctacaacatc

SEQ ID NO: 701950 - DNA, 25 bp, Mus musculus
ggagaatctgaacgacaccatggtc

SEQ ID NO: 701951 - DNA, 25 bp, Mus musculus
ggagaatctgaaggacaccatggtc

SEQ ID NO: 701952 - DNA, 25 bp, Mus musculus
ggagaatgaaacaggagaggtggag

SEQ ID NO: 701953 - DNA, 25 bp, Mus musculus
ggagaatgaaactggagaggtggag

SEQ ID NO: 701954 - DNA, 25 bp, Mus musculus
ggagaatgaaagataccactataag

SEQ ID NO: 701955 - DNA, 25 bp, Mus musculus
ggagaatgaaagttaccactataag

SEQ ID NO: 701956 - DNA, 25 bp, Mus musculus
ggagaatgaccgcacaacactcatg

SEQ ID NO: 701957 - DNA, 25 bp, Mus musculus
ggagaatgaccggacaacactcatg

SEQ ID NO: 701958 - DNA, 25 bp, Mus musculus
ggagaatgcagtcctgtccccatgg

SEQ ID NO: 701959 - DNA, 25 bp, Mus musculus
ggagaatgcagtgctgtccccatgg

SEQ ID NO: 701960 - DNA, 25 bp, Mus musculus
ggagaatgcatccatcctttcagag

SEQ ID NO: 701961 - DNA, 25 bp, Mus musculus
ggagaatgcatcgatcctttcagag

SEQ ID NO: 701962 - DNA, 25 bp, Mus musculus
ggagaatgctggctaccttagagcc

SEQ ID NO: 701963 - DNA, 25 bp, Mus musculus
ggagaatgctgggtaccttagagcc

SEQ ID NO: 701964 - DNA, 25 bp, Mus musculus
ggagaatggcagactggccaatgtt

SEQ ID NO: 701965 - DNA, 25 bp, Mus musculus
ggagaatggcagtctggccaatgtt

SEQ ID NO: 701966 - DNA, 25 bp, Mus musculus
ggagaatgtctacacctgatcgaga

SEQ ID NO: 701967 - DNA, 25 bp, Mus musculus
ggagaatgtctagacctgatcgaga

SEQ ID NO: 701968 - DNA, 25 bp, Mus musculus
ggagaattcacaccgagtcttcagc

SEQ ID NO: 701969 - DNA, 25 bp, Mus musculus
ggagaattcacagcgagtcttcagc

SEQ ID NO: 701970 - DNA, 25 bp, Mus musculus
ggagaattcctacggctctgaacag

SEQ ID NO: 701971 - DNA, 25 bp, Mus musculus
ggagaattcctagggctctgaacag

SEQ ID NO: 701972 - DNA, 25 bp, Mus musculus
ggagaattgtcacctggagcagaat

SEQ ID NO: 701973 - DNA, 25 bp, Mus musculus
ggagaattgtcagctggagcagaat

SEQ ID NO: 701974 - DNA, 25 bp, Mus musculus
ggagaatttagacgactttgcgtat

SEQ ID NO: 701975 - DNA, 25 bp, Mus musculus
ggagaatttagaggactttgcgtat

SEQ ID NO: 701976 - DNA, 25 bp, Mus musculus
ggagaatttcagctccctgactttc

SEQ ID NO: 701977 - DNA, 25 bp, Mus musculus
ggagaatttcaggtccctgactttc

SEQ ID NO: 701978 - DNA, 25 bp, Mus musculus
ggagaatttctaacacttgtgctgc

SEQ ID NO: 701979 - DNA, 25 bp, Mus musculus
ggagaatttctatcacttgtgctgc

SEQ ID NO: 701980 - DNA, 25 bp, Mus musculus
ggagacaaacccaaggactttgtgg

SEQ ID NO: 701981 - DNA, 25 bp, Mus musculus
ggagacaaacccaggacgcctcact

SEQ ID NO: 701982 - DNA, 25 bp, Mus musculus
ggagacaaaccctaggactttgtgg

SEQ ID NO: 701983 - DNA, 25 bp, Mus musculus
ggagacaaaccctggacgcctcact

SEQ ID NO: 701984 - DNA, 25 bp, Mus musculus
ggagacaaattcaaaacaccagcga

SEQ ID NO: 701985 - DNA, 25 bp, Mus musculus
ggagacaaattctaaacaccagcga

SEQ ID NO: 701986 - DNA, 25 bp, Mus musculus
ggagacaacccactacatgaatgaa

SEQ ID NO: 701987 - DNA, 25 bp, Mus musculus
ggagacaacccagtacatgaatgaa

SEQ ID NO: 701988 - DNA, 25 bp, Mus musculus
ggagacaacttacaacaaagaatca

SEQ ID NO: 701989 - DNA, 25 bp, Mus musculus
ggagacaacttagaacaaagaatca

SEQ ID NO: 701990 - DNA, 25 bp, Mus musculus
ggagacaatcccattcccaagaatg

SEQ ID NO: 701991 - DNA, 25 bp, Mus musculus
ggagacaatccctttcccaagaatg

SEQ ID NO: 701992 - DNA, 25 bp, Mus musculus
ggagacaatgacaacttcacttgca

SEQ ID NO: 701993 - DNA, 25 bp, Mus musculus
ggagacaatgactacttcacttgca

SEQ ID NO: 701994 - DNA, 25 bp, Mus musculus
ggagacacacagactgacaccacct

SEQ ID NO: 701995 - DNA, 25 bp, Mus musculus
ggagacacacagcacactgctgagc

SEQ ID NO: 701996 - DNA, 25 bp, Mus musculus
ggagacacacaggacactgctgagc

SEQ ID NO: 701997 - DNA, 25 bp, Mus musculus
ggagacacacagtctgacaccacct

SEQ ID NO: 701998 - DNA, 25 bp, Mus musculus
ggagacacatgccaacatccccgat

SEQ ID NO: 701999 - DNA, 25 bp, Mus musculus
ggagacacatgcgaacatccccgat

SEQ ID NO: 702000 - DNA, 25 bp, Mus musculus
ggagacaccttaaggctcggtcact

SEQ ID NO: 702001 - DNA, 25 bp, Mus musculus
ggagacaccttatggctcggtcact

SEQ ID NO: 702002 - DNA, 25 bp, Mus musculus
ggagacacggaaccctgaaaaagct

SEQ ID NO: 702003 - DNA, 25 bp, Mus musculus
ggagacacggaagcctgaaaaagct

SEQ ID NO: 702004 - DNA, 25 bp, Mus musculus
ggagacactcctataatgaaaacaa

SEQ ID NO: 702005 - DNA, 25 bp, Mus musculus
ggagacactcctttaatgaaaacaa

SEQ ID NO: 702006 - DNA, 25 bp, Mus musculus
ggagacactgacagaaactgtagat

SEQ ID NO: 702007 - DNA, 25 bp, Mus musculus
ggagacactgactgaaactgtagat

SEQ ID NO: 702008 - DNA, 25 bp, Mus musculus
ggagacagagatcgagttctacaga

SEQ ID NO: 702009 - DNA, 25 bp, Mus musculus
ggagacagagatggagttctacaga

SEQ ID NO: 702010 - DNA, 25 bp, Mus musculus
ggagacagagccaaacgcagaggaa

SEQ ID NO: 702011 - DNA, 25 bp, Mus musculus
ggagacagagcctaacgcagaggaa

SEQ ID NO: 702012 - DNA, 25 bp, Mus musculus
ggagacagagctcaccacggatggg

SEQ ID NO: 702013 - DNA, 25 bp, Mus musculus
ggagacagagctgaccacggatggg

SEQ ID NO: 702014 - DNA, 25 bp, Mus musculus
ggagacagcgggatactacatctgc

SEQ ID NO: 702015 - DNA, 25 bp, Mus musculus
ggagacagcgggttactacatctgc

SEQ ID NO: 702016 - DNA, 25 bp, Mus musculus
ggagacaggacaccatttgcctaat

SEQ ID NO: 702017 - DNA, 25 bp, Mus musculus
ggagacaggacagcatttgcctaat

SEQ ID NO: 702018 - DNA, 25 bp, Mus musculus
ggagacagtcacaactctagattat

SEQ ID NO: 702019 - DNA, 25 bp, Mus musculus
ggagacagtcacaaggcagcatccc

SEQ ID NO: 702020 - DNA, 25 bp, Mus musculus
ggagacagtcactactctagattat

SEQ ID NO: 702021 - DNA, 25 bp, Mus musculus
ggagacagtcactaggcagcatccc

SEQ ID NO: 702022 - DNA, 25 bp, Mus musculus
ggagacagtgccagccagctatgac

SEQ ID NO: 702023 - DNA, 25 bp, Mus musculus
ggagacagtgcctgccagctatgac

SEQ ID NO: 702024 - DNA, 25 bp, Mus musculus
ggagacagtggtcaatgcaattttg

SEQ ID NO: 702025 - DNA, 25 bp, Mus musculus
ggagacagtggtgaatgcaattttg

SEQ ID NO: 702026 - DNA, 25 bp, Mus musculus
ggagacatcaagactaacaacggcc

SEQ ID NO: 702027 - DNA, 25 bp, Mus musculus
ggagacatcaagtctaacaacggcc

SEQ ID NO: 702028 - DNA, 25 bp, Mus musculus
ggagacatcaccaccttgtcattac

SEQ ID NO: 702029 - DNA, 25 bp, Mus musculus
ggagacatcacctccttgtcattac

SEQ ID NO: 702030 - DNA, 25 bp, Mus musculus
ggagacatgagaccggcttcaatag

SEQ ID NO: 702031 - DNA, 25 bp, Mus musculus
ggagacatgagagcggcttcaatag

SEQ ID NO: 702032 - DNA, 25 bp, Mus musculus
ggagacatggaccatggcttaaaag

SEQ ID NO: 702033 - DNA, 25 bp, Mus musculus
ggagacatggacgatggcttaaaag

SEQ ID NO: 702034 - DNA, 25 bp, Mus musculus
ggagacatgggccatccaccaaaaa

SEQ ID NO: 702035 - DNA, 25 bp, Mus musculus
ggagacatgggcgatccaccaaaaa

SEQ ID NO: 702036 - DNA, 25 bp, Mus musculus
ggagacattcctacacagcttcata

SEQ ID NO: 702037 - DNA, 25 bp, Mus musculus
ggagacattccttcacagcttcata

SEQ ID NO: 702038 - DNA, 25 bp, Mus musculus
ggagacattggaatccccagtgaga

SEQ ID NO: 702039 - DNA, 25 bp, Mus musculus
ggagacattggattccccagtgaga

SEQ ID NO: 702040 - DNA, 25 bp, Mus musculus
ggagacatttgtcctcacaatggag

SEQ ID NO: 702041 - DNA, 25 bp, Mus musculus
ggagacatttgtgctcacaatggag

SEQ ID NO: 702042 - DNA, 25 bp, Mus musculus
ggagacattttaccttgcccaagac

SEQ ID NO: 702043 - DNA, 25 bp, Mus musculus
ggagacattttagcttgcccaagac

SEQ ID NO: 702044 - DNA, 25 bp, Mus musculus
ggagaccaaaaaccgagttctgtcc

SEQ ID NO: 702045 - DNA, 25 bp, Mus musculus
ggagaccaaaaagcgagttctgtcc

SEQ ID NO: 702046 - DNA, 25 bp, Mus musculus
ggagaccaaaccagacaaggctgta

SEQ ID NO: 702047 - DNA, 25 bp, Mus musculus
ggagaccaaaccagtgataacctgt

SEQ ID NO: 702048 - DNA, 25 bp, Mus musculus
ggagaccaaacctgacaaggctgta

SEQ ID NO: 702049 - DNA, 25 bp, Mus musculus
ggagaccaaacctgtgataacctgt

SEQ ID NO: 702050 - DNA, 25 bp, Mus musculus
ggagaccaaattccagatgttccag

SEQ ID NO: 702051 - DNA, 25 bp, Mus musculus
ggagaccaaattgcagatgttccag

SEQ ID NO: 702052 - DNA, 25 bp, Mus musculus
ggagaccaagatccactgcgagaca

SEQ ID NO: 702053 - DNA, 25 bp, Mus musculus
ggagaccaagatgcactgcgagaca

SEQ ID NO: 702054 - DNA, 25 bp, Mus musculus
ggagaccaaggtagtacagattcgc

SEQ ID NO: 702055 - DNA, 25 bp, Mus musculus
ggagaccaaggttgtacagattcgc

SEQ ID NO: 702056 - DNA, 25 bp, Mus musculus
ggagaccacagcaagtgaaacagca

SEQ ID NO: 702057 - DNA, 25 bp, Mus musculus
ggagaccacagctagtgaaacagca

SEQ ID NO: 702058 - DNA, 25 bp, Mus musculus
ggagaccacagtcagctcattgtga

SEQ ID NO: 702059 - DNA, 25 bp, Mus musculus
ggagaccacagtgagctcattgtga

SEQ ID NO: 702060 - DNA, 25 bp, Mus musculus
ggagaccagaagccagaagcactgt

SEQ ID NO: 702061 - DNA, 25 bp, Mus musculus
ggagaccagaaggcagaagcactgt

SEQ ID NO: 702062 - DNA, 25 bp, Mus musculus
ggagaccagggtcctgtccagcacc

SEQ ID NO: 702063 - DNA, 25 bp, Mus musculus
ggagaccagggtcggaaataacaca

SEQ ID NO: 702064 - DNA, 25 bp, Mus musculus
ggagaccagggtgctgtccagcacc

SEQ ID NO: 702065 - DNA, 25 bp, Mus musculus
ggagaccagggtgggaaataacaca

SEQ ID NO: 702066 - DNA, 25 bp, Mus musculus
ggagaccagtccatattcaacgaag

SEQ ID NO: 702067 - DNA, 25 bp, Mus musculus
ggagaccagtccttattcaacgaag

SEQ ID NO: 702068 - DNA, 25 bp, Mus musculus
ggagaccatacaatcagtgctacag

SEQ ID NO: 702069 - DNA, 25 bp, Mus musculus
ggagaccatacattcagtgctacag

SEQ ID NO: 702070 - DNA, 25 bp, Mus musculus
ggagaccatgatctgagcatgcctg

SEQ ID NO: 702071 - DNA, 25 bp, Mus musculus
ggagaccatgatgtgagcatgcctg

SEQ ID NO: 702072 - DNA, 25 bp, Mus musculus
ggagaccattctccttaaaatttga

SEQ ID NO: 702073 - DNA, 25 bp, Mus musculus
ggagaccattctgcttaaaatttga

SEQ ID NO: 702074 - DNA, 25 bp, Mus musculus
ggagacccaggcaagccaggagcac

SEQ ID NO: 702075 - DNA, 25 bp, Mus musculus
ggagacccaggctagccaggagcac

SEQ ID NO: 702076 - DNA, 25 bp, Mus musculus
ggagaccccacaagctacaagcaca

SEQ ID NO: 702077 - DNA, 25 bp, Mus musculus
ggagaccccacatgctacaagcaca

SEQ ID NO: 702078 - DNA, 25 bp, Mus musculus
ggagaccccattccaaaatttgaag

SEQ ID NO: 702079 - DNA, 25 bp, Mus musculus
ggagaccccattgcaaaatttgaag

SEQ ID NO: 702080 - DNA, 25 bp, Mus musculus
ggagaccccggccaggaagactcta

SEQ ID NO: 702081 - DNA, 25 bp, Mus musculus
ggagaccccggcgaggaagactcta

SEQ ID NO: 702082 - DNA, 25 bp, Mus musculus
ggagacccctggagaccacacagga

SEQ ID NO: 702083 - DNA, 25 bp, Mus musculus
ggagacccctggtgaccacacagga

SEQ ID NO: 702084 - DNA, 25 bp, Mus musculus
ggagacccctgtcagagttcttggt

SEQ ID NO: 702085 - DNA, 25 bp, Mus musculus
ggagacccctgtgagagttcttggt

SEQ ID NO: 702086 - DNA, 25 bp, Mus musculus
ggagacccgcttccatgtcactggt

SEQ ID NO: 702087 - DNA, 25 bp, Mus musculus
ggagacccgcttgcatgtcactggt

SEQ ID NO: 702088 - DNA, 25 bp, Mus musculus
ggagaccctcttccgatggctacag

SEQ ID NO: 702089 - DNA, 25 bp, Mus musculus
ggagaccctcttgcgatggctacag

SEQ ID NO: 702090 - DNA, 25 bp, Mus musculus
ggagacccttttacagagctctttg

SEQ ID NO: 702091 - DNA, 25 bp, Mus musculus
ggagaccctttttcagagctctttg

SEQ ID NO: 702092 - DNA, 25 bp, Mus musculus
ggagaccgaagacactttcatcgct

SEQ ID NO: 702093 - DNA, 25 bp, Mus musculus
ggagaccgaagagactttcatcgct

SEQ ID NO: 702094 - DNA, 25 bp, Mus musculus
ggagaccgaataactgagtctggtg

SEQ ID NO: 702095 - DNA, 25 bp, Mus musculus
ggagaccgaatatctgagtctggtg

SEQ ID NO: 702096 - DNA, 25 bp, Mus musculus
ggagaccgacgcagttatcagctgc

SEQ ID NO: 702097 - DNA, 25 bp, Mus musculus
ggagaccgacgctgttatcagctgc

SEQ ID NO: 702098 - DNA, 25 bp, Mus musculus
ggagaccgctcacttactgtttacc

SEQ ID NO: 702099 - DNA, 25 bp, Mus musculus
ggagaccgctcagttactgtttacc

SEQ ID NO: 702100 - DNA, 25 bp, Mus musculus
ggagaccgggccacaggctatcatt

SEQ ID NO: 702101 - DNA, 25 bp, Mus musculus
ggagaccgggcctcaggctatcatt

SEQ ID NO: 702102 - DNA, 25 bp, Mus musculus
ggagacctatatccgtgaactctcg

SEQ ID NO: 702103 - DNA, 25 bp, Mus musculus
ggagacctatatgcgtgaactctcg

SEQ ID NO: 702104 - DNA, 25 bp, Mus musculus
ggagacctatccactgcctctgcta

SEQ ID NO: 702105 - DNA, 25 bp, Mus musculus
ggagacctatcctctgcctctgcta

SEQ ID NO: 702106 - DNA, 25 bp, Mus musculus
ggagacctcatcagtacttcacctg

SEQ ID NO: 702107 - DNA, 25 bp, Mus musculus
ggagacctcatctgtacttcacctg

SEQ ID NO: 702108 - DNA, 25 bp, Mus musculus
ggagacctcatgaccttcctggtgg

SEQ ID NO: 702109 - DNA, 25 bp, Mus musculus
ggagacctcatgtccttcctggtgg

SEQ ID NO: 702110 - DNA, 25 bp, Mus musculus
ggagacctccgaagctaagagcact

SEQ ID NO: 702111 - DNA, 25 bp, Mus musculus
ggagacctccgatgctaagagcact

SEQ ID NO: 702112 - DNA, 25 bp, Mus musculus
ggagacctcctgattttatgaactt

SEQ ID NO: 702113 - DNA, 25 bp, Mus musculus
ggagacctcctgtttttatgaactt

SEQ ID NO: 702114 - DNA, 25 bp, Mus musculus
ggagacctggctatgtaacagcact

SEQ ID NO: 702115 - DNA, 25 bp, Mus musculus
ggagacctggctttgtaacagcact

SEQ ID NO: 702116 - DNA, 25 bp, Mus musculus
ggagacctggtgacacagtagcctt

SEQ ID NO: 702117 - DNA, 25 bp, Mus musculus
ggagacctggtgtcacagtagcctt

SEQ ID NO: 702118 - DNA, 25 bp, Mus musculus
ggagacctgtgtactgaactcttgc

SEQ ID NO: 702119 - DNA, 25 bp, Mus musculus
ggagacctgtgttctgaactcttgc

SEQ ID NO: 702120 - DNA, 25 bp, Mus musculus
ggagaccttaccacttgaagatggg

SEQ ID NO: 702121 - DNA, 25 bp, Mus musculus
ggagaccttacctcttgaagatggg

SEQ ID NO: 702122 - DNA, 25 bp, Mus musculus
ggagaccttactagaccaacacttg

SEQ ID NO: 702123 - DNA, 25 bp, Mus musculus
ggagaccttactcaagtgccacaca

SEQ ID NO: 702124 - DNA, 25 bp, Mus musculus
ggagaccttactgaagtgccacaca

SEQ ID NO: 702125 - DNA, 25 bp, Mus musculus
ggagaccttacttgaccaacacttg

SEQ ID NO: 702126 - DNA, 25 bp, Mus musculus
ggagacgagaacacgctagctaagg

SEQ ID NO: 702127 - DNA, 25 bp, Mus musculus
ggagacgagaactcgctagctaagg

SEQ ID NO: 702128 - DNA, 25 bp, Mus musculus
ggagacgaggacacccgaatcactg

SEQ ID NO: 702129 - DNA, 25 bp, Mus musculus
ggagacgaggactcccgaatcactg

SEQ ID NO: 702130 - DNA, 25 bp, Mus musculus
ggagacgctcctaattgggaaccca

SEQ ID NO: 702131 - DNA, 25 bp, Mus musculus
ggagacgctccttattgggaaccca

SEQ ID NO: 702132 - DNA, 25 bp, Mus musculus
ggagacgttcatccagatagctcag

SEQ ID NO: 702133 - DNA, 25 bp, Mus musculus
ggagacgttcatgcagatagctcag

SEQ ID NO: 702134 - DNA, 25 bp, Mus musculus
ggagactacaagaccatccacctgt

SEQ ID NO: 702135 - DNA, 25 bp, Mus musculus
ggagactacaagtccatccacctgt

SEQ ID NO: 702136 - DNA, 25 bp, Mus musculus
ggagactataaaacgccagccaatc

SEQ ID NO: 702137 - DNA, 25 bp, Mus musculus
ggagactataaatcgccagccaatc

SEQ ID NO: 702138 - DNA, 25 bp, Mus musculus
ggagactcacggcagccccggactt

SEQ ID NO: 702139 - DNA, 25 bp, Mus musculus
ggagactcacgggagccccggactt

SEQ ID NO: 702140 - DNA, 25 bp, Mus musculus
ggagactcagaaaataacatcatgt

SEQ ID NO: 702141 - DNA, 25 bp, Mus musculus
ggagactcagaatataacatcatgt

SEQ ID NO: 702142 - DNA, 25 bp, Mus musculus
ggagactcatccaggtctcttgagt

SEQ ID NO: 702143 - DNA, 25 bp, Mus musculus
ggagactcatcctggtctcttgagt

SEQ ID NO: 702144 - DNA, 25 bp, Mus musculus
ggagactccaggacatctgtcttct

SEQ ID NO: 702145 - DNA, 25 bp, Mus musculus
ggagactccaggctttcacaggaaa

SEQ ID NO: 702146 - DNA, 25 bp, Mus musculus
ggagactccagggtttcacaggaaa

SEQ ID NO: 702147 - DNA, 25 bp, Mus musculus
ggagactccaggtcatctgtcttct

SEQ ID NO: 702148 - DNA, 25 bp, Mus musculus
ggagactcgggcctcggcaaaacct

SEQ ID NO: 702149 - DNA, 25 bp, Mus musculus
ggagactcgggcgtcggcaaaacct

SEQ ID NO: 702150 - DNA, 25 bp, Mus musculus
ggagactctagcacactgccactgt

SEQ ID NO: 702151 - DNA, 25 bp, Mus musculus
ggagactctagctcactgccactgt

SEQ ID NO: 702152 - DNA, 25 bp, Mus musculus
ggagactgactgacctgcggagcca

SEQ ID NO: 702153 - DNA, 25 bp, Mus musculus
ggagactgactgtcctgcggagcca

SEQ ID NO: 702154 - DNA, 25 bp, Mus musculus
ggagactgggccaaatctggctgat

SEQ ID NO: 702155 - DNA, 25 bp, Mus musculus
ggagactgggcctaatctggctgat

SEQ ID NO: 702156 - DNA, 25 bp, Mus musculus
ggagactgtcgtcgatcttcttaag

SEQ ID NO: 702157 - DNA, 25 bp, Mus musculus
ggagactgtcgtggatcttcttaag

SEQ ID NO: 702158 - DNA, 25 bp, Mus musculus
ggagactgtgcactagacttcccag

SEQ ID NO: 702159 - DNA, 25 bp, Mus musculus
ggagactgtgcagtagacttcccag

SEQ ID NO: 702160 - DNA, 25 bp, Mus musculus
ggagactgttgaatacaagaatatc

SEQ ID NO: 702161 - DNA, 25 bp, Mus musculus
ggagactgttgattacaagaatatc

SEQ ID NO: 702162 - DNA, 25 bp, Mus musculus
ggagacttattcctggaaagagatt

SEQ ID NO: 702163 - DNA, 25 bp, Mus musculus
ggagacttattcgtggaaagagatt

SEQ ID NO: 702164 - DNA, 25 bp, Mus musculus
ggagacttcgatatttcagtgctga

SEQ ID NO: 702165 - DNA, 25 bp, Mus musculus
ggagacttcgatttttcagtgctga

SEQ ID NO: 702166 - DNA, 25 bp, Mus musculus
ggagacttcgttctctccgtgcgca

SEQ ID NO: 702167 - DNA, 25 bp, Mus musculus
ggagacttcgttgtctccgtgcgca

SEQ ID NO: 702168 - DNA, 25 bp, Mus musculus
ggagacttcttcacgggtgatgcct

SEQ ID NO: 702169 - DNA, 25 bp, Mus musculus
ggagacttcttctcgggtgatgcct

SEQ ID NO: 702170 - DNA, 25 bp, Mus musculus
ggagactttccgactgctgcatgca

SEQ ID NO: 702171 - DNA, 25 bp, Mus musculus
ggagactttccgtctgctgcatgca

SEQ ID NO: 702172 - DNA, 25 bp, Mus musculus
ggagagaaaaagaccgagaccgaga

SEQ ID NO: 702173 - DNA, 25 bp, Mus musculus
ggagagaaaaagtccgagaccgaga

SEQ ID NO: 702174 - DNA, 25 bp, Mus musculus
ggagagaaacccctgaatacaggct

SEQ ID NO: 702175 - DNA, 25 bp, Mus musculus
ggagagaaacccgtgaatacaggct

SEQ ID NO: 702176 - DNA, 25 bp, Mus musculus
ggagagaagccgaggagttggaagc

SEQ ID NO: 702177 - DNA, 25 bp, Mus musculus
ggagagaagccgtggagttggaagc

SEQ ID NO: 702178 - DNA, 25 bp, Mus musculus
ggagagaatcggctttctctgcaag

SEQ ID NO: 702179 - DNA, 25 bp, Mus musculus
ggagagaatcgggtttctctgcaag

SEQ ID NO: 702180 - DNA, 25 bp, Mus musculus
ggagagaattcacaagatcctggca

SEQ ID NO: 702181 - DNA, 25 bp, Mus musculus
ggagagaattcagaagatcctggca

SEQ ID NO: 702182 - DNA, 25 bp, Mus musculus
ggagagaccagcagcgatatctatt

SEQ ID NO: 702183 - DNA, 25 bp, Mus musculus
ggagagaccagctgcgatatctatt

SEQ ID NO: 702184 - DNA, 25 bp, Mus musculus
ggagagaccccaacgtggcgcgatc

SEQ ID NO: 702185 - DNA, 25 bp, Mus musculus
ggagagaccccatcgtggcgcgatc

SEQ ID NO: 702186 - DNA, 25 bp, Mus musculus
ggagagaccctaccctcaaacaagt

SEQ ID NO: 702187 - DNA, 25 bp, Mus musculus
ggagagaccctagcctcaaacaagt

SEQ ID NO: 702188 - DNA, 25 bp, Mus musculus
ggagagaccctgaacattggccctg

SEQ ID NO: 702189 - DNA, 25 bp, Mus musculus
ggagagaccctgtacattggccctg

SEQ ID NO: 702190 - DNA, 25 bp, Mus musculus
ggagagacgtggcatagcaaattca

SEQ ID NO: 702191 - DNA, 25 bp, Mus musculus
ggagagacgtgggatagcaaattca

SEQ ID NO: 702192 - DNA, 25 bp, Mus musculus
ggagagactcccagccacttggtgt

SEQ ID NO: 702193 - DNA, 25 bp, Mus musculus
ggagagactccctgccacttggtgt

SEQ ID NO: 702194 - DNA, 25 bp, Mus musculus
ggagagactggacttgttgaatatc

SEQ ID NO: 702195 - DNA, 25 bp, Mus musculus
ggagagactggagttgttgaatatc

SEQ ID NO: 702196 - DNA, 25 bp, Mus musculus
ggagagactgtcagtactgattgca

SEQ ID NO: 702197 - DNA, 25 bp, Mus musculus
ggagagactgtctgtactgattgca

SEQ ID NO: 702198 - DNA, 25 bp, Mus musculus
ggagagactgttccctaagagacaa

SEQ ID NO: 702199 - DNA, 25 bp, Mus musculus
ggagagactgttgcctaagagacaa

SEQ ID NO: 702200 - DNA, 25 bp, Mus musculus
ggagagacttatccccaggtgaaac

SEQ ID NO: 702201 - DNA, 25 bp, Mus musculus
ggagagacttatgcccaggtgaaac

SEQ ID NO: 702202 - DNA, 25 bp, Mus musculus
ggagagactttaccgatgcatcagg

SEQ ID NO: 702203 - DNA, 25 bp, Mus musculus
ggagagactttagcgatgcatcagg

SEQ ID NO: 702204 - DNA, 25 bp, Mus musculus
ggagagagttccagcccatccatac

SEQ ID NO: 702205 - DNA, 25 bp, Mus musculus
ggagagagttcctgcccatccatac

SEQ ID NO: 702206 - DNA, 25 bp, Mus musculus
ggagagagttctcacatctgcgact

SEQ ID NO: 702207 - DNA, 25 bp, Mus musculus
ggagagagttctgacatctgcgact

SEQ ID NO: 702208 - DNA, 25 bp, Mus musculus
ggagagatacggctcaagagcttcc

SEQ ID NO: 702209 - DNA, 25 bp, Mus musculus
ggagagatacgggtcaagagcttcc

SEQ ID NO: 702210 - DNA, 25 bp, Mus musculus
ggagagatatttcctattgaaaaca

SEQ ID NO: 702211 - DNA, 25 bp, Mus musculus
ggagagatatttgctattgaaaaca

SEQ ID NO: 702212 - DNA, 25 bp, Mus musculus
ggagagatcgtaccaccatgaagcc

SEQ ID NO: 702213 - DNA, 25 bp, Mus musculus
ggagagatcgtagcaccatgaagcc

SEQ ID NO: 702214 - DNA, 25 bp, Mus musculus
ggagagatctcgaaaggcaattgtg

SEQ ID NO: 702215 - DNA, 25 bp, Mus musculus
ggagagatctcgtaaggcaattgtg

SEQ ID NO: 702216 - DNA, 25 bp, Mus musculus
ggagagatgctcaacctggctactc

SEQ ID NO: 702217 - DNA, 25 bp, Mus musculus
ggagagatgctctacctggctactc

SEQ ID NO: 702218 - DNA, 25 bp, Mus musculus
ggagagatggctcacagtgtcaaaa

SEQ ID NO: 702219 - DNA, 25 bp, Mus musculus
ggagagatggctgacagtgtcaaaa

SEQ ID NO: 702220 - DNA, 25 bp, Mus musculus
ggagagatggtacaagagttaatcc

SEQ ID NO: 702221 - DNA, 25 bp, Mus musculus
ggagagatggtagaagagttaatcc

SEQ ID NO: 702222 - DNA, 25 bp, Mus musculus
ggagagattcccaacatttactgag

SEQ ID NO: 702223 - DNA, 25 bp, Mus musculus
ggagagattccctacatttactgag

SEQ ID NO: 702224 - DNA, 25 bp, Mus musculus
ggagagcaacgacggcaagtccaaa

SEQ ID NO: 702225 - DNA, 25 bp, Mus musculus
ggagagcaacgagggcaagtccaaa

SEQ ID NO: 702226 - DNA, 25 bp, Mus musculus
ggagagcacagcagcgtcctgcgcc

SEQ ID NO: 702227 - DNA, 25 bp, Mus musculus
ggagagcacagctgcgtcctgcgcc

SEQ ID NO: 702228 - DNA, 25 bp, Mus musculus
ggagagcacggtcagaactattgct

SEQ ID NO: 702229 - DNA, 25 bp, Mus musculus
ggagagcacggtgagaactattgct

SEQ ID NO: 702230 - DNA, 25 bp, Mus musculus
ggagagcagaggagttatgttatac

SEQ ID NO: 702231 - DNA, 25 bp, Mus musculus
ggagagcagaggtgttatgttatac

SEQ ID NO: 702232 - DNA, 25 bp, Mus musculus
ggagagcaggccagaagccaaagaa

SEQ ID NO: 702233 - DNA, 25 bp, Mus musculus
ggagagcaggcctgaagccaaagaa

SEQ ID NO: 702234 - DNA, 25 bp, Mus musculus
ggagagccagctcctggattattct

SEQ ID NO: 702235 - DNA, 25 bp, Mus musculus
ggagagccagctgctggattattct

SEQ ID NO: 702236 - DNA, 25 bp, Mus musculus
ggagagccaggcacctgtaaggacc

SEQ ID NO: 702237 - DNA, 25 bp, Mus musculus
ggagagccaggctcctgtaaggacc

SEQ ID NO: 702238 - DNA, 25 bp, Mus musculus
ggagagccctaaacccaaaccagat

SEQ ID NO: 702239 - DNA, 25 bp, Mus musculus
ggagagccctaatcccaaaccagat

SEQ ID NO: 702240 - DNA, 25 bp, Mus musculus
ggagagcccttcagcggctgccact

SEQ ID NO: 702241 - DNA, 25 bp, Mus musculus
ggagagcccttctgcggctgccact

SEQ ID NO: 702242 - DNA, 25 bp, Mus musculus
ggagagccttatacatcgcttgcaa

SEQ ID NO: 702243 - DNA, 25 bp, Mus musculus
ggagagccttattcatcgcttgcaa

SEQ ID NO: 702244 - DNA, 25 bp, Mus musculus
ggagagcgacctacaccagatcatt

SEQ ID NO: 702245 - DNA, 25 bp, Mus musculus
ggagagcgaccttcaccagatcatt

SEQ ID NO: 702246 - DNA, 25 bp, Mus musculus
ggagagcgagcgcaacgccaaccct

SEQ ID NO: 702247 - DNA, 25 bp, Mus musculus
ggagagcgagcggaacgccaaccct

SEQ ID NO: 702248 - DNA, 25 bp, Mus musculus
ggagagcgctctacccagctccttt

SEQ ID NO: 702249 - DNA, 25 bp, Mus musculus
ggagagcgctcttcccagctccttt

SEQ ID NO: 702250 - DNA, 25 bp, Mus musculus
ggagagcgtcatcgataacccctat

SEQ ID NO: 702251 - DNA, 25 bp, Mus musculus
ggagagcgtcatggataacccctat

SEQ ID NO: 702252 - DNA, 25 bp, Mus musculus
ggagagctcaggatgtcctccccgc

SEQ ID NO: 702253 - DNA, 25 bp, Mus musculus
ggagagctcaggttgtcctccccgc

SEQ ID NO: 702254 - DNA, 25 bp, Mus musculus
ggagagctccggacctctatgctgt

SEQ ID NO: 702255 - DNA, 25 bp, Mus musculus
ggagagctccggtcctctatgctgt

SEQ ID NO: 702256 - DNA, 25 bp, Mus musculus
ggagagctctacctggtacaccact

SEQ ID NO: 702257 - DNA, 25 bp, Mus musculus
ggagagctctacgtggtacaccact

SEQ ID NO: 702258 - DNA, 25 bp, Mus musculus
ggagagctctagagagaagtgaaat

SEQ ID NO: 702259 - DNA, 25 bp, Mus musculus
ggagagctctagtgagaagtgaaat

SEQ ID NO: 702260 - DNA, 25 bp, Mus musculus
ggagagctctttctgacagtgctgc

SEQ ID NO: 702261 - DNA, 25 bp, Mus musculus
ggagagctctttgtgacagtgctgc

SEQ ID NO: 702262 - DNA, 25 bp, Mus musculus
ggagagctgcaacattcccagtaca

SEQ ID NO: 702263 - DNA, 25 bp, Mus musculus
ggagagctgcaagattcccagtaca

SEQ ID NO: 702264 - DNA, 25 bp, Mus musculus
ggagagctgctgctccagcaaacga

SEQ ID NO: 702265 - DNA, 25 bp, Mus musculus
ggagagctgctggtccagcaaacga

SEQ ID NO: 702266 - DNA, 25 bp, Mus musculus
ggagagctgcttctatcatcaacgc

SEQ ID NO: 702267 - DNA, 25 bp, Mus musculus
ggagagctgcttgtatcatcaacgc

SEQ ID NO: 702268 - DNA, 25 bp, Mus musculus
ggagagctgtatccctctggacacg

SEQ ID NO: 702269 - DNA, 25 bp, Mus musculus
ggagagctgtatgcctctggacacg

SEQ ID NO: 702270 - DNA, 25 bp, Mus musculus
ggagagctgtctcctgaacccaacc

SEQ ID NO: 702271 - DNA, 25 bp, Mus musculus
ggagagctgtctgctgaacccaacc

SEQ ID NO: 702272 - DNA, 25 bp, Mus musculus
ggagagcttggcaatgggaacatta

SEQ ID NO: 702273 - DNA, 25 bp, Mus musculus
ggagagcttggctatgggaacatta

SEQ ID NO: 702274 - DNA, 25 bp, Mus musculus
ggagagctttgcaagccctggcgtc

SEQ ID NO: 702275 - DNA, 25 bp, Mus musculus
ggagagctttgctagccctggcgtc

SEQ ID NO: 702276 - DNA, 25 bp, Mus musculus
ggagaggacaccaagcaggcagaca

SEQ ID NO: 702277 - DNA, 25 bp, Mus musculus
ggagaggacacctagcaggcagaca

SEQ ID NO: 702278 - DNA, 25 bp, Mus musculus
ggagaggacccaactagtgtagcta

SEQ ID NO: 702279 - DNA, 25 bp, Mus musculus
ggagaggacccatctagtgtagcta

SEQ ID NO: 702280 - DNA, 25 bp, Mus musculus
ggagaggagacaaacacgactctga

SEQ ID NO: 702281 - DNA, 25 bp, Mus musculus
ggagaggagacatacacgactctga

SEQ ID NO: 702282 - DNA, 25 bp, Mus musculus
ggagaggaggttattctctgcaata

SEQ ID NO: 702283 - DNA, 25 bp, Mus musculus
ggagaggaggtttttctctgcaata

SEQ ID NO: 702284 - DNA, 25 bp, Mus musculus
ggagaggataaaatgtggcttcccc

SEQ ID NO: 702285 - DNA, 25 bp, Mus musculus
ggagaggataaattgtggcttcccc

SEQ ID NO: 702286 - DNA, 25 bp, Mus musculus
ggagaggatcaaccactatatcaag

SEQ ID NO: 702287 - DNA, 25 bp, Mus musculus
ggagaggatcaagcactatatcaag

SEQ ID NO: 702288 - DNA, 25 bp, Mus musculus
ggagaggatccactccatcaaggaa

SEQ ID NO: 702289 - DNA, 25 bp, Mus musculus
ggagaggatccagtccatcaaggaa

SEQ ID NO: 702290 - DNA, 25 bp, Mus musculus
ggagaggcaatcagcccaaggagtc

SEQ ID NO: 702291 - DNA, 25 bp, Mus musculus
ggagaggcaatctgcccaaggagtc

SEQ ID NO: 702292 - DNA, 25 bp, Mus musculus
ggagaggccaccaaagattctctgg

SEQ ID NO: 702293 - DNA, 25 bp, Mus musculus
ggagaggccaccactcttctggcac

SEQ ID NO: 702294 - DNA, 25 bp, Mus musculus
ggagaggccacctaagattctctgg

SEQ ID NO: 702295 - DNA, 25 bp, Mus musculus
ggagaggccacctctcttctggcac

SEQ ID NO: 702296 - DNA, 25 bp, Mus musculus
ggagaggccagtcccatcaccatgg

SEQ ID NO: 702297 - DNA, 25 bp, Mus musculus
ggagaggccagtgccatcaccatgg

SEQ ID NO: 702298 - DNA, 25 bp, Mus musculus
ggagaggccatgctctgcgtctaaa

SEQ ID NO: 702299 - DNA, 25 bp, Mus musculus
ggagaggccatggtctgcgtctaaa

SEQ ID NO: 702300 - DNA, 25 bp, Mus musculus
ggagaggcccgacgacctaaatctg

SEQ ID NO: 702301 - DNA, 25 bp, Mus musculus
ggagaggcccgaggacctaaatctg

SEQ ID NO: 702302 - DNA, 25 bp, Mus musculus
ggagaggcgcatctctttctccacc

SEQ ID NO: 702303 - DNA, 25 bp, Mus musculus
ggagaggcgcatgtctttctccacc

SEQ ID NO: 702304 - DNA, 25 bp, Mus musculus
ggagaggcggtaccctacgcacact

SEQ ID NO: 702305 - DNA, 25 bp, Mus musculus
ggagaggcggtagcctacgcacact

SEQ ID NO: 702306 - DNA, 25 bp, Mus musculus
ggagaggcgtcgactccctcacggc

SEQ ID NO: 702307 - DNA, 25 bp, Mus musculus
ggagaggcgtcgtctccctcacggc

SEQ ID NO: 702308 - DNA, 25 bp, Mus musculus
ggagagggatggcagtgagcgggcc

SEQ ID NO: 702309 - DNA, 25 bp, Mus musculus
ggagagggatgggagtgagcgggcc

SEQ ID NO: 702310 - DNA, 25 bp, Mus musculus
ggagaggtctcgcaacatctacggc

SEQ ID NO: 702311 - DNA, 25 bp, Mus musculus
ggagaggtctcggaacatctacggc

SEQ ID NO: 702312 - DNA, 25 bp, Mus musculus
ggagaggtgcctattgtatccccaa

SEQ ID NO: 702313 - DNA, 25 bp, Mus musculus
ggagaggtgccttttgtatccccaa

SEQ ID NO: 702314 - DNA, 25 bp, Mus musculus
ggagaggtgtcaccggctccaattt

SEQ ID NO: 702315 - DNA, 25 bp, Mus musculus
ggagaggtgtcagcggctccaattt

SEQ ID NO: 702316 - DNA, 25 bp, Mus musculus
ggagaggttcccagctagcacttct

SEQ ID NO: 702317 - DNA, 25 bp, Mus musculus
ggagaggttccctgctagcacttct

SEQ ID NO: 702318 - DNA, 25 bp, Mus musculus
ggagagtacctgatcgtcgccatca

SEQ ID NO: 702319 - DNA, 25 bp, Mus musculus
ggagagtacctgttcgtcgccatca

SEQ ID NO: 702320 - DNA, 25 bp, Mus musculus
ggagagtactgaagtcaaagccatt

SEQ ID NO: 702321 - DNA, 25 bp, Mus musculus
ggagagtactgatgtcaaagccatt

SEQ ID NO: 702322 - DNA, 25 bp, Mus musculus
ggagagtatgaaagtaatgccacca

SEQ ID NO: 702323 - DNA, 25 bp, Mus musculus
ggagagtatgaatgtaatgccacca

SEQ ID NO: 702324 - DNA, 25 bp, Mus musculus
ggagagtatgtactcacattcaact

SEQ ID NO: 702325 - DNA, 25 bp, Mus musculus
ggagagtatgtagtcacattcaact

SEQ ID NO: 702326 - DNA, 25 bp, Mus musculus
ggagagtcatctctgcacaacagtc

SEQ ID NO: 702327 - DNA, 25 bp, Mus musculus
ggagagtcatctgtgcacaacagtc

SEQ ID NO: 702328 - DNA, 25 bp, Mus musculus
ggagagtccaaaaggctgtgctgta

SEQ ID NO: 702329 - DNA, 25 bp, Mus musculus
ggagagtccaaatggctgtgctgta

SEQ ID NO: 702330 - DNA, 25 bp, Mus musculus
ggagagtccactagactcaggctgg

SEQ ID NO: 702331 - DNA, 25 bp, Mus musculus
ggagagtccacttgactcaggctgg

SEQ ID NO: 702332 - DNA, 25 bp, Mus musculus
ggagagtccatcctggttatttcag

SEQ ID NO: 702333 - DNA, 25 bp, Mus musculus
ggagagtccatcgtggttatttcag

SEQ ID NO: 702334 - DNA, 25 bp, Mus musculus
ggagagtgaccacccgaccagtcaa

SEQ ID NO: 702335 - DNA, 25 bp, Mus musculus
ggagagtgaccagccgaccagtcaa

SEQ ID NO: 702336 - DNA, 25 bp, Mus musculus
ggagagtgaggaaggcttgccatca

SEQ ID NO: 702337 - DNA, 25 bp, Mus musculus
ggagagtgaggatggcttgccatca

SEQ ID NO: 702338 - DNA, 25 bp, Mus musculus
ggagagtggcttacaggaacgtcaa

SEQ ID NO: 702339 - DNA, 25 bp, Mus musculus
ggagagtggctttcaggaacgtcaa

SEQ ID NO: 702340 - DNA, 25 bp, Mus musculus
ggagagttattccagtttagaagga

SEQ ID NO: 702341 - DNA, 25 bp, Mus musculus
ggagagttattcgagtttagaagga

SEQ ID NO: 702342 - DNA, 25 bp, Mus musculus
ggagagttcatcacggtaagaagga

SEQ ID NO: 702343 - DNA, 25 bp, Mus musculus
ggagagttcatctcggtaagaagga

SEQ ID NO: 702344 - DNA, 25 bp, Mus musculus
ggagagttccccactcagaatgata

SEQ ID NO: 702345 - DNA, 25 bp, Mus musculus
ggagagttcccctctcagaatgata

SEQ ID NO: 702346 - DNA, 25 bp, Mus musculus
ggagagttcgttcaggaaattcaga

SEQ ID NO: 702347 - DNA, 25 bp, Mus musculus
ggagagttcgttgaggaaattcaga

SEQ ID NO: 702348 - DNA, 25 bp, Mus musculus
ggagagttctcccagtatactgaat

SEQ ID NO: 702349 - DNA, 25 bp, Mus musculus
ggagagttctccgagtatactgaat

SEQ ID NO: 702350 - DNA, 25 bp, Mus musculus
ggagagttgttgactctgcgctatg

SEQ ID NO: 702351 - DNA, 25 bp, Mus musculus
ggagagttgttgtctctgcgctatg

SEQ ID NO: 702352 - DNA, 25 bp, Mus musculus
ggagagttttgtatccagactgcaa

SEQ ID NO: 702353 - DNA, 25 bp, Mus musculus
ggagagttttgtttccagactgcaa

SEQ ID NO: 702354 - DNA, 25 bp, Mus musculus
ggagataaaggtccccttcagagac

SEQ ID NO: 702355 - DNA, 25 bp, Mus musculus
ggagataaaggtgcccttcagagac

SEQ ID NO: 702356 - DNA, 25 bp, Mus musculus
ggagataacaaccaagtcttgcagc

SEQ ID NO: 702357 - DNA, 25 bp, Mus musculus
ggagataacaacgaagtcttgcagc

SEQ ID NO: 702358 - DNA, 25 bp, Mus musculus
ggagataagccccaaagaaatgacc

SEQ ID NO: 702359 - DNA, 25 bp, Mus musculus
ggagataagcccgaaagaaatgacc

SEQ ID NO: 702360 - DNA, 25 bp, Mus musculus
ggagataagtaccagcgagcttcga

SEQ ID NO: 702361 - DNA, 25 bp, Mus musculus
ggagataagtacgagcgagcttcga

SEQ ID NO: 702362 - DNA, 25 bp, Mus musculus
ggagataatcggacattcacactga

SEQ ID NO: 702363 - DNA, 25 bp, Mus musculus
ggagataatcggtcattcacactga

SEQ ID NO: 702364 - DNA, 25 bp, Mus musculus
ggagataattttccatgcactttgg

SEQ ID NO: 702365 - DNA, 25 bp, Mus musculus
ggagataattttgcatgcactttgg

SEQ ID NO: 702366 - DNA, 25 bp, Mus musculus
ggagatacccctagctcttgctgca

SEQ ID NO: 702367 - DNA, 25 bp, Mus musculus
ggagataccccttgctcttgctgca

SEQ ID NO: 702368 - DNA, 25 bp, Mus musculus
ggagatactgccaggaaccttcccc

SEQ ID NO: 702369 - DNA, 25 bp, Mus musculus
ggagatactgcctggaaccttcccc

SEQ ID NO: 702370 - DNA, 25 bp, Mus musculus
ggagatagatccatcagagttggct

SEQ ID NO: 702371 - DNA, 25 bp, Mus musculus
ggagatagatccttcagagttggct

SEQ ID NO: 702372 - DNA, 25 bp, Mus musculus
ggagatagggaaattggaacttgcc

SEQ ID NO: 702373 - DNA, 25 bp, Mus musculus
ggagatagggaatttggaacttgcc

SEQ ID NO: 702374 - DNA, 25 bp, Mus musculus
ggagatatacgtaaatgcccctttt

SEQ ID NO: 702375 - DNA, 25 bp, Mus musculus
ggagatatacgttaatgcccctttt

SEQ ID NO: 702376 - DNA, 25 bp, Mus musculus
ggagatatagatcctgtctctaaac

SEQ ID NO: 702377 - DNA, 25 bp, Mus musculus
ggagatatagatgctgtctctaaac

SEQ ID NO: 702378 - DNA, 25 bp, Mus musculus
ggagatatcaccacctgctcagtgc

SEQ ID NO: 702379 - DNA, 25 bp, Mus musculus
ggagatatcacctcctgctcagtgc

SEQ ID NO: 702380 - DNA, 25 bp, Mus musculus
ggagatatgaatctgttccgaaggt

SEQ ID NO: 702381 - DNA, 25 bp, Mus musculus
ggagatatgaatgtgttccgaaggt

SEQ ID NO: 702382 - DNA, 25 bp, Mus musculus
ggagatatggttcttttagagccgc

SEQ ID NO: 702383 - DNA, 25 bp, Mus musculus
ggagatatggttgttttagagccgc

SEQ ID NO: 702384 - DNA, 25 bp, Mus musculus
ggagatcaaagccaaaccctttcga

SEQ ID NO: 702385 - DNA, 25 bp, Mus musculus
ggagatcaaagcgaaaccctttcga

SEQ ID NO: 702386 - DNA, 25 bp, Mus musculus
ggagatcaaccgacgcacggctgct

SEQ ID NO: 702387 - DNA, 25 bp, Mus musculus
ggagatcaaccgtcgcacggctgct

SEQ ID NO: 702388 - DNA, 25 bp, Mus musculus
ggagatcaacgactgcctgtcccag

SEQ ID NO: 702389 - DNA, 25 bp, Mus musculus
ggagatcaacgagtgcctgtcccag

SEQ ID NO: 702390 - DNA, 25 bp, Mus musculus
ggagatcaaggtactctctgacaag

SEQ ID NO: 702391 - DNA, 25 bp, Mus musculus
ggagatcaaggttctctctgacaag

SEQ ID NO: 702392 - DNA, 25 bp, Mus musculus
ggagatcacaacagccaaaggaaag

SEQ ID NO: 702393 - DNA, 25 bp, Mus musculus
ggagatcacaactgccaaaggaaag

SEQ ID NO: 702394 - DNA, 25 bp, Mus musculus
ggagatcaccaacgggctcaacctg

SEQ ID NO: 702395 - DNA, 25 bp, Mus musculus
ggagatcaccaaggggctcaacctg

SEQ ID NO: 702396 - DNA, 25 bp, Mus musculus
ggagatcaccacctccacagaatca

SEQ ID NO: 702397 - DNA, 25 bp, Mus musculus
ggagatcaccacgtccacagaatca

SEQ ID NO: 702398 - DNA, 25 bp, Mus musculus
ggagatcagcagcacgctgcgcaca

SEQ ID NO: 702399 - DNA, 25 bp, Mus musculus
ggagatcagcaggacgctgcgcaca

SEQ ID NO: 702400 - DNA, 25 bp, Mus musculus
ggagatcaggagagcctacaagagc

SEQ ID NO: 702401 - DNA, 25 bp, Mus musculus
ggagatcaggagtgcctacaagagc

SEQ ID NO: 702402 - DNA, 25 bp, Mus musculus
ggagatcatcaactctgagatcttg

SEQ ID NO: 702403 - DNA, 25 bp, Mus musculus
ggagatcatcaagtctgagatcttg

SEQ ID NO: 702404 - DNA, 25 bp, Mus musculus
ggagatcatgaaccagacagggtac

SEQ ID NO: 702405 - DNA, 25 bp, Mus musculus
ggagatcatgaagcagacagggtac

SEQ ID NO: 702406 - DNA, 25 bp, Mus musculus
ggagatcatgcaccaccggttcttt

SEQ ID NO: 702407 - DNA, 25 bp, Mus musculus
ggagatcatgcagcaccggttcttt

SEQ ID NO: 702408 - DNA, 25 bp, Mus musculus
ggagatcattatctactgcaccggg

SEQ ID NO: 702409 - DNA, 25 bp, Mus musculus
ggagatcattatgtactgcaccggg

SEQ ID NO: 702410 - DNA, 25 bp, Mus musculus
ggagatccagacacagatctcgctc

SEQ ID NO: 702411 - DNA, 25 bp, Mus musculus
ggagatccagactcagatctcgctc

SEQ ID NO: 702412 - DNA, 25 bp, Mus musculus
ggagatccatgcctatcgaaagctg

SEQ ID NO: 702413 - DNA, 25 bp, Mus musculus
ggagatccatgcgtatcgaaagctg

SEQ ID NO: 702414 - DNA, 25 bp, Mus musculus
ggagatccccagatgatgagctgct

SEQ ID NO: 702415 - DNA, 25 bp, Mus musculus
ggagatccccagttgatgagctgct

SEQ ID NO: 702416 - DNA, 25 bp, Mus musculus
ggagatccccgacgaggagttaaat

SEQ ID NO: 702417 - DNA, 25 bp, Mus musculus
ggagatccccgaggaggagttaaat

SEQ ID NO: 702418 - DNA, 25 bp, Mus musculus
ggagatccgccaatgccattgttat

SEQ ID NO: 702419 - DNA, 25 bp, Mus musculus
ggagatccgccattgccattgttat

SEQ ID NO: 702420 - DNA, 25 bp, Mus musculus
ggagatccgtcgaatcaaccagaca

SEQ ID NO: 702421 - DNA, 25 bp, Mus musculus
ggagatccgtcgtatcaaccagaca

SEQ ID NO: 702422 - DNA, 25 bp, Mus musculus
ggagatcctagaccagatgaatgag

SEQ ID NO: 702423 - DNA, 25 bp, Mus musculus
ggagatcctagagcagatgaatgag

SEQ ID NO: 702424 - DNA, 25 bp, Mus musculus
ggagatcctagcagccctgcccgag

SEQ ID NO: 702425 - DNA, 25 bp, Mus musculus
ggagatcctagctgccctgcccgag

SEQ ID NO: 702426 - DNA, 25 bp, Mus musculus
ggagatcctaggctgcacatcccct

SEQ ID NO: 702427 - DNA, 25 bp, Mus musculus
ggagatcctagggtgcacatcccct

SEQ ID NO: 702428 - DNA, 25 bp, Mus musculus
ggagatcctgaaccgtaaggctgct

SEQ ID NO: 702429 - DNA, 25 bp, Mus musculus
ggagatcctgaagcgtaaggctgct

SEQ ID NO: 702430 - DNA, 25 bp, Mus musculus
ggagatcctgtaaactgcaaatgaa

SEQ ID NO: 702431 - DNA, 25 bp, Mus musculus
ggagatcctgtatactgcaaatgaa

SEQ ID NO: 702432 - DNA, 25 bp, Mus musculus
ggagatcgcccacgtacacagcaag

SEQ ID NO: 702433 - DNA, 25 bp, Mus musculus
ggagatcgcccaggtacacagcaag

SEQ ID NO: 702434 - DNA, 25 bp, Mus musculus
ggagatcgttcacaccatgaacagt

SEQ ID NO: 702435 - DNA, 25 bp, Mus musculus
ggagatcgttcagaccatgaacagt

SEQ ID NO: 702436 - DNA, 25 bp, Mus musculus
ggagatctcaccagacaccacactg

SEQ ID NO: 702437 - DNA, 25 bp, Mus musculus
ggagatctcacctgacaccacactg

SEQ ID NO: 702438 - DNA, 25 bp, Mus musculus
ggagatctgaccaccttagcaacgc

SEQ ID NO: 702439 - DNA, 25 bp, Mus musculus
ggagatctgacctccttagcaacgc

SEQ ID NO: 702440 - DNA, 25 bp, Mus musculus
ggagatctgctaagcccttcgggct

SEQ ID NO: 702441 - DNA, 25 bp, Mus musculus
ggagatctgctatgcccttcgggct

SEQ ID NO: 702442 - DNA, 25 bp, Mus musculus
ggagatcttcgaacaaaacgctggg

SEQ ID NO: 702443 - DNA, 25 bp, Mus musculus
ggagatcttcgatcaaaacgctggg

SEQ ID NO: 702444 - DNA, 25 bp, Mus musculus
ggagatcttgctcaaggcagtgaaa

SEQ ID NO: 702445 - DNA, 25 bp, Mus musculus
ggagatcttgctgaaggcagtgaaa

SEQ ID NO: 702446 - DNA, 25 bp, Mus musculus
ggagatgaaccgctctatccagagg

SEQ ID NO: 702447 - DNA, 25 bp, Mus musculus
ggagatgaaccggtctatccagagg

SEQ ID NO: 702448 - DNA, 25 bp, Mus musculus
ggagatgaagctatgcagctggttc

SEQ ID NO: 702449 - DNA, 25 bp, Mus musculus
ggagatgaagctttgcagctggttc

SEQ ID NO: 702450 - DNA, 25 bp, Mus musculus
ggagatgaccacagtgttggctcag

SEQ ID NO: 702451 - DNA, 25 bp, Mus musculus
ggagatgaccactgtgttggctcag

SEQ ID NO: 702452 - DNA, 25 bp, Mus musculus
ggagatgacgttaatcccgaaacac

SEQ ID NO: 702453 - DNA, 25 bp, Mus musculus
ggagatgacgtttatcccgaaacac

SEQ ID NO: 702454 - DNA, 25 bp, Mus musculus
ggagatgactccatccggtacccat

SEQ ID NO: 702455 - DNA, 25 bp, Mus musculus
ggagatgactccttccggtacccat

SEQ ID NO: 702456 - DNA, 25 bp, Mus musculus
ggagatgatccaccactgcgtggac

SEQ ID NO: 702457 - DNA, 25 bp, Mus musculus
ggagatgatccagcactgcgtggac

SEQ ID NO: 702458 - DNA, 25 bp, Mus musculus
ggagatgatgagaatcaaggagacc

SEQ ID NO: 702459 - DNA, 25 bp, Mus musculus
ggagatgatgagtatcaaggagacc

SEQ ID NO: 702460 - DNA, 25 bp, Mus musculus
ggagatgatgccatggaaaatgccc

SEQ ID NO: 702461 - DNA, 25 bp, Mus musculus
ggagatgatgccttggaaaatgccc

SEQ ID NO: 702462 - DNA, 25 bp, Mus musculus
ggagatgattacagggaagatcctg

SEQ ID NO: 702463 - DNA, 25 bp, Mus musculus
ggagatgattactgggaagatcctg

SEQ ID NO: 702464 - DNA, 25 bp, Mus musculus
ggagatgcaaagactctccttcgcc

SEQ ID NO: 702465 - DNA, 25 bp, Mus musculus
ggagatgcaaagtctctccttcgcc

SEQ ID NO: 702466 - DNA, 25 bp, Mus musculus
ggagatgcaactcccattgtgcgaa

SEQ ID NO: 702467 - DNA, 25 bp, Mus musculus
ggagatgcaactgccattgtgcgaa

SEQ ID NO: 702468 - DNA, 25 bp, Mus musculus
ggagatgcatatcccctggtgcagc

SEQ ID NO: 702469 - DNA, 25 bp, Mus musculus
ggagatgcatatgccctggtgcagc

SEQ ID NO: 702470 - DNA, 25 bp, Mus musculus
ggagatgcatccagtgcctgaggca

SEQ ID NO: 702471 - DNA, 25 bp, Mus musculus
ggagatgcatcctgtgcctgaggca

SEQ ID NO: 702472 - DNA, 25 bp, Mus musculus
ggagatgccatacctgaaatgtccg

SEQ ID NO: 702473 - DNA, 25 bp, Mus musculus
ggagatgccatagctgaaatgtccg

SEQ ID NO: 702474 - DNA, 25 bp, Mus musculus
ggagatgcccaaagtaccctggtgg

SEQ ID NO: 702475 - DNA, 25 bp, Mus musculus
ggagatgcccaatgtaccctggtgg

SEQ ID NO: 702476 - DNA, 25 bp, Mus musculus
ggagatgcctgtacgttaaaaagag

SEQ ID NO: 702477 - DNA, 25 bp, Mus musculus
ggagatgcctgttcgttaaaaagag

SEQ ID NO: 702478 - DNA, 25 bp, Mus musculus
ggagatgcgtcaactcccctggctc

SEQ ID NO: 702479 - DNA, 25 bp, Mus musculus
ggagatgcgtcatctcccctggctc

SEQ ID NO: 702480 - DNA, 25 bp, Mus musculus
ggagatgctaacaagggaggtcccc

SEQ ID NO: 702481 - DNA, 25 bp, Mus musculus
ggagatgctaactagggaggtcccc

SEQ ID NO: 702482 - DNA, 25 bp, Mus musculus
ggagatgctggtacttgttttcaaa

SEQ ID NO: 702483 - DNA, 25 bp, Mus musculus
ggagatgctggttcttgttttcaaa

SEQ ID NO: 702484 - DNA, 25 bp, Mus musculus
ggagatggacaccaaagaaaagctg

SEQ ID NO: 702485 - DNA, 25 bp, Mus musculus
ggagatggacacgaaagaaaagctg

SEQ ID NO: 702486 - DNA, 25 bp, Mus musculus
ggagatggacatcaaagacttctgc

SEQ ID NO: 702487 - DNA, 25 bp, Mus musculus
ggagatggacatgaaagacttctgc

SEQ ID NO: 702488 - DNA, 25 bp, Mus musculus
ggagatggacttccctcagctgatg

SEQ ID NO: 702489 - DNA, 25 bp, Mus musculus
ggagatggacttgcctcagctgatg

SEQ ID NO: 702490 - DNA, 25 bp, Mus musculus
ggagatggccaacaaagcaccttca

SEQ ID NO: 702491 - DNA, 25 bp, Mus musculus
ggagatggccaagaaagcaccttca

SEQ ID NO: 702492 - DNA, 25 bp, Mus musculus
ggagatggccacctatttgcgctat

SEQ ID NO: 702493 - DNA, 25 bp, Mus musculus
ggagatggccacgtatttgcgctat

SEQ ID NO: 702494 - DNA, 25 bp, Mus musculus
ggagatggccagctcaattatgaag

SEQ ID NO: 702495 - DNA, 25 bp, Mus musculus
ggagatggccaggtcaattatgaag

SEQ ID NO: 702496 - DNA, 25 bp, Mus musculus
ggagatggtcaaagccctcattgta

SEQ ID NO: 702497 - DNA, 25 bp, Mus musculus
ggagatggtcaatgccctcattgta

SEQ ID NO: 702498 - DNA, 25 bp, Mus musculus
ggagatgtatggagttgacctccat

SEQ ID NO: 702499 - DNA, 25 bp, Mus musculus
ggagatgtatggtgttgacctccat

SEQ ID NO: 702500 - DNA, 25 bp, Mus musculus
ggagatgtcgccaactatgactacc

SEQ ID NO: 702501 - DNA, 25 bp, Mus musculus
ggagatgtcgcctactatgactacc

SEQ ID NO: 702502 - DNA, 25 bp, Mus musculus
ggagatgtgattcctatcaactaca

SEQ ID NO: 702503 - DNA, 25 bp, Mus musculus
ggagatgtgattgctatcaactaca

SEQ ID NO: 702504 - DNA, 25 bp, Mus musculus
ggagatgtggaaacagaaggttttc

SEQ ID NO: 702505 - DNA, 25 bp, Mus musculus
ggagatgtggaatcagaaggttttc

SEQ ID NO: 702506 - DNA, 25 bp, Mus musculus
ggagattaaaggaccccaggctgac

SEQ ID NO: 702507 - DNA, 25 bp, Mus musculus
ggagattaaaggtccccaggctgac

SEQ ID NO: 702508 - DNA, 25 bp, Mus musculus
ggagattacagcatcagttactgtg

SEQ ID NO: 702509 - DNA, 25 bp, Mus musculus
ggagattacagcttcagttactgtg

SEQ ID NO: 702510 - DNA, 25 bp, Mus musculus
ggagattatccacaaaccttctagg

SEQ ID NO: 702511 - DNA, 25 bp, Mus musculus
ggagattatccagaaaccttctagg

SEQ ID NO: 702512 - DNA, 25 bp, Mus musculus
ggagattattccacgacagctatgt

SEQ ID NO: 702513 - DNA, 25 bp, Mus musculus
ggagattattcctcgacagctatgt

SEQ ID NO: 702514 - DNA, 25 bp, Mus musculus
ggagattcagacacctgaggattcc

SEQ ID NO: 702515 - DNA, 25 bp, Mus musculus
ggagattcagactcctgaggattcc

SEQ ID NO: 702516 - DNA, 25 bp, Mus musculus
ggagattcgttaccgccacaaaaag

SEQ ID NO: 702517 - DNA, 25 bp, Mus musculus
ggagattcgttagcgccacaaaaag

SEQ ID NO: 702518 - DNA, 25 bp, Mus musculus
ggagattcttcacatccataccaag

SEQ ID NO: 702519 - DNA, 25 bp, Mus musculus
ggagattcttcagatccataccaag

SEQ ID NO: 702520 - DNA, 25 bp, Mus musculus
ggagattgaagaccccaagaagaag

SEQ ID NO: 702521 - DNA, 25 bp, Mus musculus
ggagattgaagagcccaagaagaag

SEQ ID NO: 702522 - DNA, 25 bp, Mus musculus
ggagattgacgaataccagaactat

SEQ ID NO: 702523 - DNA, 25 bp, Mus musculus
ggagattgacgattaccagaactat

SEQ ID NO: 702524 - DNA, 25 bp, Mus musculus
ggagattgagaccttaaatgaaatg

SEQ ID NO: 702525 - DNA, 25 bp, Mus musculus
ggagattgagacgttaaatgaaatg

SEQ ID NO: 702526 - DNA, 25 bp, Mus musculus
ggagattgagatagacatcgaaccc

SEQ ID NO: 702527 - DNA, 25 bp, Mus musculus
ggagattgagattgacatcgaaccc

SEQ ID NO: 702528 - DNA, 25 bp, Mus musculus
ggagattgatgacaccaaagatgca

SEQ ID NO: 702529 - DNA, 25 bp, Mus musculus
ggagattgatgagaccaaagatgca

SEQ ID NO: 702530 - DNA, 25 bp, Mus musculus
ggagattgcccacattgccctggag

SEQ ID NO: 702531 - DNA, 25 bp, Mus musculus
ggagattgcccagattgccctggag

SEQ ID NO: 702532 - DNA, 25 bp, Mus musculus
ggagattggtgtcctgcagaaaaca

SEQ ID NO: 702533 - DNA, 25 bp, Mus musculus
ggagattggtgtgctgcagaaaaca

SEQ ID NO: 702534 - DNA, 25 bp, Mus musculus
ggagattgttgaagtcgctggacca

SEQ ID NO: 702535 - DNA, 25 bp, Mus musculus
ggagattgttgatgtcgctggacca

SEQ ID NO: 702536 - DNA, 25 bp, Mus musculus
ggagatttactcacagttctttcca

SEQ ID NO: 702537 - DNA, 25 bp, Mus musculus
ggagatttactctcagttctttcca

SEQ ID NO: 702538 - DNA, 25 bp, Mus musculus
ggagatttcaggcaaactggtacag

SEQ ID NO: 702539 - DNA, 25 bp, Mus musculus
ggagatttcagggaaactggtacag

SEQ ID NO: 702540 - DNA, 25 bp, Mus musculus
ggagcaaaaaacaagtatttccaag

SEQ ID NO: 702541 - DNA, 25 bp, Mus musculus
ggagcaaaaaactagtatttccaag

SEQ ID NO: 702542 - DNA, 25 bp, Mus musculus
ggagcaaataaaagcccaggtctga

SEQ ID NO: 702543 - DNA, 25 bp, Mus musculus
ggagcaaataaatgcccaggtctga

SEQ ID NO: 702544 - DNA, 25 bp, Mus musculus
ggagcaaatgtaatttataagcgtg

SEQ ID NO: 702545 - DNA, 25 bp, Mus musculus
ggagcaaatgtattttataagcgtg

SEQ ID NO: 702546 - DNA, 25 bp, Mus musculus
ggagcaaattctccctagtggccat

SEQ ID NO: 702547 - DNA, 25 bp, Mus musculus
ggagcaaattctgcctagtggccat

SEQ ID NO: 702548 - DNA, 25 bp, Mus musculus
ggagcaacaaacctgtcaccatcat

SEQ ID NO: 702549 - DNA, 25 bp, Mus musculus
ggagcaacaaacgtgtcaccatcat

SEQ ID NO: 702550 - DNA, 25 bp, Mus musculus
ggagcaacaacgcaaggcgctggaa

SEQ ID NO: 702551 - DNA, 25 bp, Mus musculus
ggagcaacaacggaaggcgctggaa

SEQ ID NO: 702552 - DNA, 25 bp, Mus musculus
ggagcaacctatcttcagcactcga

SEQ ID NO: 702553 - DNA, 25 bp, Mus musculus
ggagcaacctatgttcagcactcga

SEQ ID NO: 702554 - DNA, 25 bp, Mus musculus
ggagcaagacaacaaagatgttacc

SEQ ID NO: 702555 - DNA, 25 bp, Mus musculus
ggagcaagacaagaaagatgttacc

SEQ ID NO: 702556 - DNA, 25 bp, Mus musculus
ggagcaagaccacattataataatt

SEQ ID NO: 702557 - DNA, 25 bp, Mus musculus
ggagcaagaccaccctgtaaagtcc

SEQ ID NO: 702558 - DNA, 25 bp, Mus musculus
ggagcaagaccagattataataatt

SEQ ID NO: 702559 - DNA, 25 bp, Mus musculus
ggagcaagaccagcctgtaaagtcc

SEQ ID NO: 702560 - DNA, 25 bp, Mus musculus
ggagcaagagaacctacttcctgtg

SEQ ID NO: 702561 - DNA, 25 bp, Mus musculus
ggagcaagagaagctacttcctgtg

SEQ ID NO: 702562 - DNA, 25 bp, Mus musculus
ggagcaagatgccatatctgttaag

SEQ ID NO: 702563 - DNA, 25 bp, Mus musculus
ggagcaagatgcgatatctgttaag

SEQ ID NO: 702564 - DNA, 25 bp, Mus musculus
ggagcaagccttcatacttccagac

SEQ ID NO: 702565 - DNA, 25 bp, Mus musculus
ggagcaagccttgatacttccagac

SEQ ID NO: 702566 - DNA, 25 bp, Mus musculus
ggagcaaggatcccgtgctagctta

SEQ ID NO: 702567 - DNA, 25 bp, Mus musculus
ggagcaaggatcgcgtgctagctta

SEQ ID NO: 702568 - DNA, 25 bp, Mus musculus
ggagcaaggcagcttgtcacgctac

SEQ ID NO: 702569 - DNA, 25 bp, Mus musculus
ggagcaaggcaggttgtcacgctac

SEQ ID NO: 702570 - DNA, 25 bp, Mus musculus
ggagcaagtacacagagttcaactc

SEQ ID NO: 702571 - DNA, 25 bp, Mus musculus
ggagcaagtacagagagttcaactc

SEQ ID NO: 702572 - DNA, 25 bp, Mus musculus
ggagcaagtcagagaatatctgggt

SEQ ID NO: 702573 - DNA, 25 bp, Mus musculus
ggagcaagtcagtgaatatctgggt

SEQ ID NO: 702574 - DNA, 25 bp, Mus musculus
ggagcaatcagtatgtggatcttga

SEQ ID NO: 702575 - DNA, 25 bp, Mus musculus
ggagcaatcagtttgtggatcttga

SEQ ID NO: 702576 - DNA, 25 bp, Mus musculus
ggagcaatccacagcatccagatat

SEQ ID NO: 702577 - DNA, 25 bp, Mus musculus
ggagcaatccactgcatccagatat

SEQ ID NO: 702578 - DNA, 25 bp, Mus musculus
ggagcaatcctgacattaggaggta

SEQ ID NO: 702579 - DNA, 25 bp, Mus musculus
ggagcaatcctgtcattaggaggta

SEQ ID NO: 702580 - DNA, 25 bp, Mus musculus
ggagcaatgaggaggtctctgccca

SEQ ID NO: 702581 - DNA, 25 bp, Mus musculus
ggagcaatgaggtggtctctgccca

SEQ ID NO: 702582 - DNA, 25 bp, Mus musculus
ggagcacaactcctggaggacctgc

SEQ ID NO: 702583 - DNA, 25 bp, Mus musculus
ggagcacaactcgtggaggacctgc

SEQ ID NO: 702584 - DNA, 25 bp, Mus musculus
ggagcacaacttcaaagctgggagt

SEQ ID NO: 702585 - DNA, 25 bp, Mus musculus
ggagcacaacttgaaagctgggagt

SEQ ID NO: 702586 - DNA, 25 bp, Mus musculus
ggagcacaccctctaccagtgtatg

SEQ ID NO: 702587 - DNA, 25 bp, Mus musculus
ggagcacaccctgtaccagtgtatg

SEQ ID NO: 702588 - DNA, 25 bp, Mus musculus
ggagcacacgccactggtggaccct

SEQ ID NO: 702589 - DNA, 25 bp, Mus musculus
ggagcacacgcctctggtggaccct

SEQ ID NO: 702590 - DNA, 25 bp, Mus musculus
ggagcacagataagggaagttcttt

SEQ ID NO: 702591 - DNA, 25 bp, Mus musculus
ggagcacagatatgggaagttcttt

SEQ ID NO: 702592 - DNA, 25 bp, Mus musculus
ggagcaccagttactagtccagaat

SEQ ID NO: 702593 - DNA, 25 bp, Mus musculus
ggagcaccagtttctagtccagaat

SEQ ID NO: 702594 - DNA, 25 bp, Mus musculus
ggagcaccatgcctttcgcctgggc

SEQ ID NO: 702595 - DNA, 25 bp, Mus musculus
ggagcaccatgcgtttcgcctgggc

SEQ ID NO: 702596 - DNA, 25 bp, Mus musculus
ggagcaccccgaattcctgaaggca

SEQ ID NO: 702597 - DNA, 25 bp, Mus musculus
ggagcaccccgatttcctgaaggca

SEQ ID NO: 702598 - DNA, 25 bp, Mus musculus
ggagcacctaccagaccaaattcat

SEQ ID NO: 702599 - DNA, 25 bp, Mus musculus
ggagcacctacctgaccaaattcat

SEQ ID NO: 702600 - DNA, 25 bp, Mus musculus
ggagcacctttaactggccctatgg

SEQ ID NO: 702601 - DNA, 25 bp, Mus musculus
ggagcacctttatctggccctatgg

SEQ ID NO: 702602 - DNA, 25 bp, Mus musculus
ggagcacctttcattgtaactgcac

SEQ ID NO: 702603 - DNA, 25 bp, Mus musculus
ggagcacctttctttgtaactgcac

SEQ ID NO: 702604 - DNA, 25 bp, Mus musculus
ggagcaccttttctcccggctggga

SEQ ID NO: 702605 - DNA, 25 bp, Mus musculus
ggagcaccttttgtcccggctggga

SEQ ID NO: 702606 - DNA, 25 bp, Mus musculus
ggagcacggcccagaaaacattgtg

SEQ ID NO: 702607 - DNA, 25 bp, Mus musculus
ggagcacggccctgaaaacattgtg

SEQ ID NO: 702608 - DNA, 25 bp, Mus musculus
ggagcactgatgatatatttttaca

SEQ ID NO: 702609 - DNA, 25 bp, Mus musculus
ggagcactgatgttatatttttaca

SEQ ID NO: 702610 - DNA, 25 bp, Mus musculus
ggagcactgcacataatctgaaaag

SEQ ID NO: 702611 - DNA, 25 bp, Mus musculus
ggagcactgcacttaatctgaaaag

SEQ ID NO: 702612 - DNA, 25 bp, Mus musculus
ggagcactgcatcttccggagtgac

SEQ ID NO: 702613 - DNA, 25 bp, Mus musculus
ggagcactgcatgttccggagtgac

SEQ ID NO: 702614 - DNA, 25 bp, Mus musculus
ggagcactggcaattctggttggca

SEQ ID NO: 702615 - DNA, 25 bp, Mus musculus
ggagcactggcatttctggttggca

SEQ ID NO: 702616 - DNA, 25 bp, Mus musculus
ggagcacttctcagctcctcaggtc

SEQ ID NO: 702617 - DNA, 25 bp, Mus musculus
ggagcacttctctgctcctcaggtc

SEQ ID NO: 702618 - DNA, 25 bp, Mus musculus
ggagcacttttcaggctcatgtggc

SEQ ID NO: 702619 - DNA, 25 bp, Mus musculus
ggagcacttttctggctcatgtggc

SEQ ID NO: 702620 - DNA, 25 bp, Mus musculus
ggagcagaacttactacagcatgtg

SEQ ID NO: 702621 - DNA, 25 bp, Mus musculus
ggagcagaactttctacagcatgtg

SEQ ID NO: 702622 - DNA, 25 bp, Mus musculus
ggagcagacctgagaaatgtttgta

SEQ ID NO: 702623 - DNA, 25 bp, Mus musculus
ggagcagacctgtgaaatgtttgta

SEQ ID NO: 702624 - DNA, 25 bp, Mus musculus
ggagcagagagtcgccgctactatt

SEQ ID NO: 702625 - DNA, 25 bp, Mus musculus
ggagcagagagtggccgctactatt

SEQ ID NO: 702626 - DNA, 25 bp, Mus musculus
ggagcagaggacaatgatacctgcg

SEQ ID NO: 702627 - DNA, 25 bp, Mus musculus
ggagcagaggactatgatacctgcg

SEQ ID NO: 702628 - DNA, 25 bp, Mus musculus
ggagcagataccctagccttcatgt

SEQ ID NO: 702629 - DNA, 25 bp, Mus musculus
ggagcagataccgtagccttcatgt

SEQ ID NO: 702630 - DNA, 25 bp, Mus musculus
ggagcagatcgcactgaacgtggac

SEQ ID NO: 702631 - DNA, 25 bp, Mus musculus
ggagcagatcgctctgaacgtggac

SEQ ID NO: 702632 - DNA, 25 bp, Mus musculus
ggagcagcaaccacaagagagtaac

SEQ ID NO: 702633 - DNA, 25 bp, Mus musculus
ggagcagcaacctcaagagagtaac

SEQ ID NO: 702634 - DNA, 25 bp, Mus musculus
ggagcagcacgcagatggaattata

SEQ ID NO: 702635 - DNA, 25 bp, Mus musculus
ggagcagcacgctgatggaattata

SEQ ID NO: 702636 - DNA, 25 bp, Mus musculus
ggagcagcagatcgataaagttacc

SEQ ID NO: 702637 - DNA, 25 bp, Mus musculus
ggagcagcagatggataaagttacc

SEQ ID NO: 702638 - DNA, 25 bp, Mus musculus
ggagcagccagtctctgcactgcct

SEQ ID NO: 702639 - DNA, 25 bp, Mus musculus
ggagcagccagtgtctgcactgcct

SEQ ID NO: 702640 - DNA, 25 bp, Mus musculus
ggagcagccatgagatctgaggcca

SEQ ID NO: 702641 - DNA, 25 bp, Mus musculus
ggagcagccatgtgatctgaggcca

SEQ ID NO: 702642 - DNA, 25 bp, Mus musculus
ggagcagcccaacctgtacagctgg

SEQ ID NO: 702643 - DNA, 25 bp, Mus musculus
ggagcagcccaagctgtacagctgg

SEQ ID NO: 702644 - DNA, 25 bp, Mus musculus
ggagcagcccatatgttcataggaa

SEQ ID NO: 702645 - DNA, 25 bp, Mus musculus
ggagcagcccatttgttcataggaa

SEQ ID NO: 702646 - DNA, 25 bp, Mus musculus
ggagcagcgctgatccttgcaggct

SEQ ID NO: 702647 - DNA, 25 bp, Mus musculus
ggagcagcgctgttccttgcaggct

SEQ ID NO: 702648 - DNA, 25 bp, Mus musculus
ggagcagctatcacgaagggcatta

SEQ ID NO: 702649 - DNA, 25 bp, Mus musculus
ggagcagctatctcgaagggcatta

SEQ ID NO: 702650 - DNA, 25 bp, Mus musculus
ggagcagctattcaacatggccaag

SEQ ID NO: 702651 - DNA, 25 bp, Mus musculus
ggagcagctattgaacatggccaag

SEQ ID NO: 702652 - DNA, 25 bp, Mus musculus
ggagcagctcatccgccattactgc

SEQ ID NO: 702653 - DNA, 25 bp, Mus musculus
ggagcagctcatgcgccattactgc

SEQ ID NO: 702654 - DNA, 25 bp, Mus musculus
ggagcagctcttcccctttgatctt

SEQ ID NO: 702655 - DNA, 25 bp, Mus musculus
ggagcagctcttgccctttgatctt

SEQ ID NO: 702656 - DNA, 25 bp, Mus musculus
ggagcagctgccagacctctgcatg

SEQ ID NO: 702657 - DNA, 25 bp, Mus musculus
ggagcagctgcctgacctctgcatg

SEQ ID NO: 702658 - DNA, 25 bp, Mus musculus
ggagcagctggtcaaattgcatatt

SEQ ID NO: 702659 - DNA, 25 bp, Mus musculus
ggagcagctggtgaaattgcatatt

SEQ ID NO: 702660 - DNA, 25 bp, Mus musculus
ggagcaggaattccgggctgtagta

SEQ ID NO: 702661 - DNA, 25 bp, Mus musculus
ggagcaggaattgcgggctgtagta

SEQ ID NO: 702662 - DNA, 25 bp, Mus musculus
ggagcaggagacatcaagtctaaca

SEQ ID NO: 702663 - DNA, 25 bp, Mus musculus
ggagcaggagacttcaagtctaaca

SEQ ID NO: 702664 - DNA, 25 bp, Mus musculus
ggagcaggccgaccggcttctttac

SEQ ID NO: 702665 - DNA, 25 bp, Mus musculus
ggagcaggccgagcggcttctttac

SEQ ID NO: 702666 - DNA, 25 bp, Mus musculus
ggagcaggcgtgctcaatactatct

SEQ ID NO: 702667 - DNA, 25 bp, Mus musculus
ggagcaggcgtggtcaatactatct

SEQ ID NO: 702668 - DNA, 25 bp, Mus musculus
ggagcagggttcctagcaacttata

SEQ ID NO: 702669 - DNA, 25 bp, Mus musculus
ggagcagggttcgtagcaacttata

SEQ ID NO: 702670 - DNA, 25 bp, Mus musculus
ggagcaggtagcacaccagaccatg

SEQ ID NO: 702671 - DNA, 25 bp, Mus musculus
ggagcaggtagctcaccagaccatg

SEQ ID NO: 702672 - DNA, 25 bp, Mus musculus
ggagcagtaacaagatctatttggg

SEQ ID NO: 702673 - DNA, 25 bp, Mus musculus
ggagcagtaacatgatctatttggg

SEQ ID NO: 702674 - DNA, 25 bp, Mus musculus
ggagcagtcagcagatggccacgac

SEQ ID NO: 702675 - DNA, 25 bp, Mus musculus
ggagcagtcagctgatggccacgac

SEQ ID NO: 702676 - DNA, 25 bp, Mus musculus
ggagcagtcctcaatgatccttaca

SEQ ID NO: 702677 - DNA, 25 bp, Mus musculus
ggagcagtcctctatgatccttaca

SEQ ID NO: 702678 - DNA, 25 bp, Mus musculus
ggagcagtctggatctctcaaaggc

SEQ ID NO: 702679 - DNA, 25 bp, Mus musculus
ggagcagtctggttctctcaaaggc

SEQ ID NO: 702680 - DNA, 25 bp, Mus musculus
ggagcagttcttcggcgccttagac

SEQ ID NO: 702681 - DNA, 25 bp, Mus musculus
ggagcagttcttgggcgccttagac

SEQ ID NO: 702682 - DNA, 25 bp, Mus musculus
ggagcagttgccagattgcctcaaa

SEQ ID NO: 702683 - DNA, 25 bp, Mus musculus
ggagcagttgcctgattgcctcaaa

SEQ ID NO: 702684 - DNA, 25 bp, Mus musculus
ggagcatatcacatccgaatacaca

SEQ ID NO: 702685 - DNA, 25 bp, Mus musculus
ggagcatatcacttccgaatacaca

SEQ ID NO: 702686 - DNA, 25 bp, Mus musculus
ggagcatcagtcagctcttgaggaa

SEQ ID NO: 702687 - DNA, 25 bp, Mus musculus
ggagcatcagtctgctcttgaggaa

SEQ ID NO: 702688 - DNA, 25 bp, Mus musculus
ggagcatcagttcgtcaccatcctg

SEQ ID NO: 702689 - DNA, 25 bp, Mus musculus
ggagcatcagttggtcaccatcctg

SEQ ID NO: 702690 - DNA, 25 bp, Mus musculus
ggagcatcccgacgccctttctttg

SEQ ID NO: 702691 - DNA, 25 bp, Mus musculus
ggagcatcccgaggccctttctttg

SEQ ID NO: 702692 - DNA, 25 bp, Mus musculus
ggagcatccggcaaacagctacaat

SEQ ID NO: 702693 - DNA, 25 bp, Mus musculus
ggagcatccggctaacagctacaat

SEQ ID NO: 702694 - DNA, 25 bp, Mus musculus
ggagcatcgcataggaggctataag

SEQ ID NO: 702695 - DNA, 25 bp, Mus musculus
ggagcatcgcattggaggctataag

SEQ ID NO: 702696 - DNA, 25 bp, Mus musculus
ggagcatcggccatgtattcccctg

SEQ ID NO: 702697 - DNA, 25 bp, Mus musculus
ggagcatcggccttgtattcccctg

SEQ ID NO: 702698 - DNA, 25 bp, Mus musculus
ggagcatgacatactcacctgtcac

SEQ ID NO: 702699 - DNA, 25 bp, Mus musculus
ggagcatgacattctcacctgtcac

SEQ ID NO: 702700 - DNA, 25 bp, Mus musculus
ggagcatgcccaccagatacagatg

SEQ ID NO: 702701 - DNA, 25 bp, Mus musculus
ggagcatgcccagcagatacagatg

SEQ ID NO: 702702 - DNA, 25 bp, Mus musculus
ggagcatggcacactcaaccggcac

SEQ ID NO: 702703 - DNA, 25 bp, Mus musculus
ggagcatggcacactggcgagcata

SEQ ID NO: 702704 - DNA, 25 bp, Mus musculus
ggagcatggcactctcaaccggcac

SEQ ID NO: 702705 - DNA, 25 bp, Mus musculus
ggagcatggcactctggcgagcata

SEQ ID NO: 702706 - DNA, 25 bp, Mus musculus
ggagcatggtcgacctgaggataaa

SEQ ID NO: 702707 - DNA, 25 bp, Mus musculus
ggagcatggtcgtcctgaggataaa

SEQ ID NO: 702708 - DNA, 25 bp, Mus musculus
ggagcatgtgccaaccacgtcagca

SEQ ID NO: 702709 - DNA, 25 bp, Mus musculus
ggagcatgtgcctaccacgtcagca

SEQ ID NO: 702710 - DNA, 25 bp, Mus musculus
ggagcatgtggtagttatcctcaac

SEQ ID NO: 702711 - DNA, 25 bp, Mus musculus
ggagcatgtggttgttatcctcaac

SEQ ID NO: 702712 - DNA, 25 bp, Mus musculus
ggagccaaagtcacagtttttccat

SEQ ID NO: 702713 - DNA, 25 bp, Mus musculus
ggagccaaagtctcagtttttccat

SEQ ID NO: 702714 - DNA, 25 bp, Mus musculus
ggagccaaagttcaacattcttgaa

SEQ ID NO: 702715 - DNA, 25 bp, Mus musculus
ggagccaaagttgaacattcttgaa

SEQ ID NO: 702716 - DNA, 25 bp, Mus musculus
ggagccaacaatagactgagtctgt

SEQ ID NO: 702717 - DNA, 25 bp, Mus musculus
ggagccaacaattgactgagtctgt

SEQ ID NO: 702718 - DNA, 25 bp, Mus musculus
ggagccaacttgaggcgttacaatg

SEQ ID NO: 702719 - DNA, 25 bp, Mus musculus
ggagccaacttgtggcgttacaatg

SEQ ID NO: 702720 - DNA, 25 bp, Mus musculus
ggagccaagataactaacaacctct

SEQ ID NO: 702721 - DNA, 25 bp, Mus musculus
ggagccaagatatctaacaacctct

SEQ ID NO: 702722 - DNA, 25 bp, Mus musculus
ggagccaagcgcatgagctgtcact

SEQ ID NO: 702723 - DNA, 25 bp, Mus musculus
ggagccaagcgcttgagctgtcact

SEQ ID NO: 702724 - DNA, 25 bp, Mus musculus
ggagccacaccacgtgaacggatcc

SEQ ID NO: 702725 - DNA, 25 bp, Mus musculus
ggagccacaccaggtgaacggatcc

SEQ ID NO: 702726 - DNA, 25 bp, Mus musculus
ggagccacagctaggcctgggatct

SEQ ID NO: 702727 - DNA, 25 bp, Mus musculus
ggagccacagcttggcctgggatct

SEQ ID NO: 702728 - DNA, 25 bp, Mus musculus
ggagccaccagacgctacagcaaca

SEQ ID NO: 702729 - DNA, 25 bp, Mus musculus
ggagccaccagaggctacagcaaca

SEQ ID NO: 702730 - DNA, 25 bp, Mus musculus
ggagccactggtcggctcatcttca

SEQ ID NO: 702731 - DNA, 25 bp, Mus musculus
ggagccactggtgggctcatcttca

SEQ ID NO: 702732 - DNA, 25 bp, Mus musculus
ggagccagacaacctttgacttaga

SEQ ID NO: 702733 - DNA, 25 bp, Mus musculus
ggagccagacaagctttgacttaga

SEQ ID NO: 702734 - DNA, 25 bp, Mus musculus
ggagccagacctcatgccgtgtgac

SEQ ID NO: 702735 - DNA, 25 bp, Mus musculus
ggagccagacctgatgccgtgtgac

SEQ ID NO: 702736 - DNA, 25 bp, Mus musculus
ggagccagcaaacggccacctgagc

SEQ ID NO: 702737 - DNA, 25 bp, Mus musculus
ggagccagcaaagggccacctgagc

SEQ ID NO: 702738 - DNA, 25 bp, Mus musculus
ggagccagccatacaagagctgttc

SEQ ID NO: 702739 - DNA, 25 bp, Mus musculus
ggagccagccattcaagagctgttc

SEQ ID NO: 702740 - DNA, 25 bp, Mus musculus
ggagccagccctccaagatgcactt

SEQ ID NO: 702741 - DNA, 25 bp, Mus musculus
ggagccagccctgcaagatgcactt

SEQ ID NO: 702742 - DNA, 25 bp, Mus musculus
ggagccagccgtaggcattgcacat

SEQ ID NO: 702743 - DNA, 25 bp, Mus musculus
ggagccagccgttggcattgcacat

SEQ ID NO: 702744 - DNA, 25 bp, Mus musculus
ggagccattaaacttacctacattt

SEQ ID NO: 702745 - DNA, 25 bp, Mus musculus
ggagccattaaagttacctacattt

SEQ ID NO: 702746 - DNA, 25 bp, Mus musculus
ggagccattgacactaggctagact

SEQ ID NO: 702747 - DNA, 25 bp, Mus musculus
ggagccattgactctaggctagact

SEQ ID NO: 702748 - DNA, 25 bp, Mus musculus
ggagcccaaacacatgttctgggtg

SEQ ID NO: 702749 - DNA, 25 bp, Mus musculus
ggagcccaaacagatgttctgggtg

SEQ ID NO: 702750 - DNA, 25 bp, Mus musculus
ggagcccaaagaaccaatatctgac

SEQ ID NO: 702751 - DNA, 25 bp, Mus musculus
ggagcccaaagatccaatatctgac

SEQ ID NO: 702752 - DNA, 25 bp, Mus musculus
ggagcccaacaaagtcggtgatgaa

SEQ ID NO: 702753 - DNA, 25 bp, Mus musculus
ggagcccaacaatgtcggtgatgaa

SEQ ID NO: 702754 - DNA, 25 bp, Mus musculus
ggagcccaaggccattggccatcga

SEQ ID NO: 702755 - DNA, 25 bp, Mus musculus
ggagcccaaggcgattggccatcga

SEQ ID NO: 702756 - DNA, 25 bp, Mus musculus
ggagcccaatggatgcagttcctat

SEQ ID NO: 702757 - DNA, 25 bp, Mus musculus
ggagcccaatggttgcagttcctat

SEQ ID NO: 702758 - DNA, 25 bp, Mus musculus
ggagcccagcccagtagaagtaaga

SEQ ID NO: 702759 - DNA, 25 bp, Mus musculus
ggagcccagccctgtagaagtaaga

SEQ ID NO: 702760 - DNA, 25 bp, Mus musculus
ggagcccagtccacaagttggtgat

SEQ ID NO: 702761 - DNA, 25 bp, Mus musculus
ggagcccagtcctcaagttggtgat

SEQ ID NO: 702762 - DNA, 25 bp, Mus musculus
ggagcccagtctctttgaaacgcaa

SEQ ID NO: 702763 - DNA, 25 bp, Mus musculus
ggagcccagtctgtttgaaacgcaa

SEQ ID NO: 702764 - DNA, 25 bp, Mus musculus
ggagcccatcatccggcggctgcgg

SEQ ID NO: 702765 - DNA, 25 bp, Mus musculus
ggagcccatcatgcggcggctgcgg

SEQ ID NO: 702766 - DNA, 25 bp, Mus musculus
ggagcccatggacacggatcagaat

SEQ ID NO: 702767 - DNA, 25 bp, Mus musculus
ggagcccatggagacggatcagaat

SEQ ID NO: 702768 - DNA, 25 bp, Mus musculus
ggagcccatggtacatctgcagcta

SEQ ID NO: 702769 - DNA, 25 bp, Mus musculus
ggagcccatggttcatctgcagcta

SEQ ID NO: 702770 - DNA, 25 bp, Mus musculus
ggagccccaggcaacttcttcagag

SEQ ID NO: 702771 - DNA, 25 bp, Mus musculus
ggagccccaggctacttcttcagag

SEQ ID NO: 702772 - DNA, 25 bp, Mus musculus
ggagccccagtgaaggtgcttctcc

SEQ ID NO: 702773 - DNA, 25 bp, Mus musculus
ggagccccagtgtaggtgcttctcc

SEQ ID NO: 702774 - DNA, 25 bp, Mus musculus
ggagccccggacatcacctgagcta

SEQ ID NO: 702775 - DNA, 25 bp, Mus musculus
ggagccccggacttcacctgagcta

SEQ ID NO: 702776 - DNA, 25 bp, Mus musculus
ggagccccgggtcatatcctatgtt

SEQ ID NO: 702777 - DNA, 25 bp, Mus musculus
ggagccccgggtgatatcctatgtt

SEQ ID NO: 702778 - DNA, 25 bp, Mus musculus
ggagcccctaacctgactatcatga

SEQ ID NO: 702779 - DNA, 25 bp, Mus musculus
ggagcccctaacgtgactatcatga

SEQ ID NO: 702780 - DNA, 25 bp, Mus musculus
ggagcccctacaacctgaggtccat

SEQ ID NO: 702781 - DNA, 25 bp, Mus musculus
ggagcccctacatcctgaggtccat

SEQ ID NO: 702782 - DNA, 25 bp, Mus musculus
ggagcccctgctagatgtgctacaa

SEQ ID NO: 702783 - DNA, 25 bp, Mus musculus
ggagcccctgcttgatgtgctacaa

SEQ ID NO: 702784 - DNA, 25 bp, Mus musculus
ggagcccctgttacgaatgtgcaga

SEQ ID NO: 702785 - DNA, 25 bp, Mus musculus
ggagcccctgtttcgaatgtgcaga

SEQ ID NO: 702786 - DNA, 25 bp, Mus musculus
ggagcccgagtcatcgaatacatgg

SEQ ID NO: 702787 - DNA, 25 bp, Mus musculus
ggagcccgagtcttcgaatacatgg

SEQ ID NO: 702788 - DNA, 25 bp, Mus musculus
ggagcccgccgcctgttgccagatt

SEQ ID NO: 702789 - DNA, 25 bp, Mus musculus
ggagcccgccgcgtgttgccagatt

SEQ ID NO: 702790 - DNA, 25 bp, Mus musculus
ggagcccgtatgcatttcacacagc

SEQ ID NO: 702791 - DNA, 25 bp, Mus musculus
ggagcccgtatggatttcacacagc

SEQ ID NO: 702792 - DNA, 25 bp, Mus musculus
ggagccctcatcatacatcagtgca

SEQ ID NO: 702793 - DNA, 25 bp, Mus musculus
ggagccctcatcttacatcagtgca

SEQ ID NO: 702794 - DNA, 25 bp, Mus musculus
ggagccctccacagggaaggatgca

SEQ ID NO: 702795 - DNA, 25 bp, Mus musculus
ggagccctccactgggaaggatgca

SEQ ID NO: 702796 - DNA, 25 bp, Mus musculus
ggagccctctggagtcaccagtgaa

SEQ ID NO: 702797 - DNA, 25 bp, Mus musculus
ggagccctctggtgtcaccagtgaa

SEQ ID NO: 702798 - DNA, 25 bp, Mus musculus
ggagccctgcctacggcctgggaca

SEQ ID NO: 702799 - DNA, 25 bp, Mus musculus
ggagccctgccttcggcctgggaca

SEQ ID NO: 702800 - DNA, 25 bp, Mus musculus
ggagccctggtccacctgaatggaa

SEQ ID NO: 702801 - DNA, 25 bp, Mus musculus
ggagccctggtcgacctgaatggaa

SEQ ID NO: 702802 - DNA, 25 bp, Mus musculus
ggagcccttcaaagccctgactcgt

SEQ ID NO: 702803 - DNA, 25 bp, Mus musculus
ggagcccttcaatgccctgactcgt

SEQ ID NO: 702804 - DNA, 25 bp, Mus musculus
ggagccgaaccgaagcctgacactc

SEQ ID NO: 702805 - DNA, 25 bp, Mus musculus
ggagccgaaccgtagcctgacactc

SEQ ID NO: 702806 - DNA, 25 bp, Mus musculus
ggagccgagcttacaaaccgacgca

SEQ ID NO: 702807 - DNA, 25 bp, Mus musculus
ggagccgagctttcaaaccgacgca

SEQ ID NO: 702808 - DNA, 25 bp, Mus musculus
ggagccgaggaacgtctgcttcacc

SEQ ID NO: 702809 - DNA, 25 bp, Mus musculus
ggagccgaggaaggtctgcttcacc

SEQ ID NO: 702810 - DNA, 25 bp, Mus musculus
ggagccgcacttatctgaagcctca

SEQ ID NO: 702811 - DNA, 25 bp, Mus musculus
ggagccgcacttttctgaagcctca

SEQ ID NO: 702812 - DNA, 25 bp, Mus musculus
ggagccgcccgcattgtcatctggc

SEQ ID NO: 702813 - DNA, 25 bp, Mus musculus
ggagccgcccgctttgtcatctggc

SEQ ID NO: 702814 - DNA, 25 bp, Mus musculus
ggagccgcccttaaagcccaaagtg

SEQ ID NO: 702815 - DNA, 25 bp, Mus musculus
ggagccgccctttaagcccaaagtg

SEQ ID NO: 702816 - DNA, 25 bp, Mus musculus
ggagccgcctagaaggcttgtagca

SEQ ID NO: 702817 - DNA, 25 bp, Mus musculus
ggagccgcctagtaggcttgtagca

SEQ ID NO: 702818 - DNA, 25 bp, Mus musculus
ggagccgcctatcgcacagccaaga

SEQ ID NO: 702819 - DNA, 25 bp, Mus musculus
ggagccgcctatggcacagccaaga

SEQ ID NO: 702820 - DNA, 25 bp, Mus musculus
ggagccgcctgcaggcaacttgctc

SEQ ID NO: 702821 - DNA, 25 bp, Mus musculus
ggagccgcctgctggcaacttgctc

SEQ ID NO: 702822 - DNA, 25 bp, Mus musculus
ggagccgccttcagccaccaggaag

SEQ ID NO: 702823 - DNA, 25 bp, Mus musculus
ggagccgccttctgccaccaggaag

SEQ ID NO: 702824 - DNA, 25 bp, Mus musculus
ggagccgctacaccttctggacatt

SEQ ID NO: 702825 - DNA, 25 bp, Mus musculus
ggagccgctacagcttctggacatt

SEQ ID NO: 702826 - DNA, 25 bp, Mus musculus
ggagccgcttctacacagtcatcag

SEQ ID NO: 702827 - DNA, 25 bp, Mus musculus
ggagccgcttcttcacagtcatcag

SEQ ID NO: 702828 - DNA, 25 bp, Mus musculus
ggagccggaggaatgaacttcaccc

SEQ ID NO: 702829 - DNA, 25 bp, Mus musculus
ggagccggaggattgaacttcaccc

SEQ ID NO: 702830 - DNA, 25 bp, Mus musculus
ggagccggcataaatttcaccaaga

SEQ ID NO: 702831 - DNA, 25 bp, Mus musculus
ggagccggcatatatttcaccaaga

SEQ ID NO: 702832 - DNA, 25 bp, Mus musculus
ggagccggtcaccatttgccagcac

SEQ ID NO: 702833 - DNA, 25 bp, Mus musculus
ggagccggtcacgatttgccagcac

SEQ ID NO: 702834 - DNA, 25 bp, Mus musculus
ggagccgttgtgaggtgcgggcacc

SEQ ID NO: 702835 - DNA, 25 bp, Mus musculus
ggagccgttgtgtggtgcgggcacc

SEQ ID NO: 702836 - DNA, 25 bp, Mus musculus
ggagcctacattctcagcagatttg

SEQ ID NO: 702837 - DNA, 25 bp, Mus musculus
ggagcctacattctgtcgcgatatg

SEQ ID NO: 702838 - DNA, 25 bp, Mus musculus
ggagcctacattgtcagcagatttg

SEQ ID NO: 702839 - DNA, 25 bp, Mus musculus
ggagcctacattgtgtcgcgatatg

SEQ ID NO: 702840 - DNA, 25 bp, Mus musculus
ggagcctcaaatatcgggccatgag

SEQ ID NO: 702841 - DNA, 25 bp, Mus musculus
ggagcctcaaatttcgggccatgag

SEQ ID NO: 702842 - DNA, 25 bp, Mus musculus
ggagcctcaacgctactttggatac

SEQ ID NO: 702843 - DNA, 25 bp, Mus musculus
ggagcctcaacggtactttggatac

SEQ ID NO: 702844 - DNA, 25 bp, Mus musculus
ggagcctcaaggcatcatagcttgc

SEQ ID NO: 702845 - DNA, 25 bp, Mus musculus
ggagcctcaagggatcatagcttgc

SEQ ID NO: 702846 - DNA, 25 bp, Mus musculus
ggagcctcatccaaacagatctgct

SEQ ID NO: 702847 - DNA, 25 bp, Mus musculus
ggagcctcatcctaacagatctgct

SEQ ID NO: 702848 - DNA, 25 bp, Mus musculus
ggagcctcatgacagtaccttctac

SEQ ID NO: 702849 - DNA, 25 bp, Mus musculus
ggagcctcatgagagtaccttctac

SEQ ID NO: 702850 - DNA, 25 bp, Mus musculus
ggagcctcatttaaagtgttcattc

SEQ ID NO: 702851 - DNA, 25 bp, Mus musculus
ggagcctcattttaagtgttcattc

SEQ ID NO: 702852 - DNA, 25 bp, Mus musculus
ggagcctccacacctactgcagtta

SEQ ID NO: 702853 - DNA, 25 bp, Mus musculus
ggagcctccacagctactgcagtta

SEQ ID NO: 702854 - DNA, 25 bp, Mus musculus
ggagcctccgagatggccgcctctg

SEQ ID NO: 702855 - DNA, 25 bp, Mus musculus
ggagcctccgagttggccgcctctg

SEQ ID NO: 702856 - DNA, 25 bp, Mus musculus
ggagcctcctccataggaacctcat

SEQ ID NO: 702857 - DNA, 25 bp, Mus musculus
ggagcctcctccttaggaacctcat

SEQ ID NO: 702858 - DNA, 25 bp, Mus musculus
ggagcctcctgtatgccccttggaa

SEQ ID NO: 702859 - DNA, 25 bp, Mus musculus
ggagcctcctgtttgccccttggaa

SEQ ID NO: 702860 - DNA, 25 bp, Mus musculus
ggagcctcgattccaggtccctttc

SEQ ID NO: 702861 - DNA, 25 bp, Mus musculus
ggagcctcgattgcaggtccctttc

SEQ ID NO: 702862 - DNA, 25 bp, Mus musculus
ggagcctcggaaacattttactgga

SEQ ID NO: 702863 - DNA, 25 bp, Mus musculus
ggagcctcggaatcattttactgga

SEQ ID NO: 702864 - DNA, 25 bp, Mus musculus
ggagcctctgatctattgcctgtag

SEQ ID NO: 702865 - DNA, 25 bp, Mus musculus
ggagcctctgatgtattgcctgtag

SEQ ID NO: 702866 - DNA, 25 bp, Mus musculus
ggagcctctgccagaagactattac

SEQ ID NO: 702867 - DNA, 25 bp, Mus musculus
ggagcctctgcctgaagactattac

SEQ ID NO: 702868 - DNA, 25 bp, Mus musculus
ggagcctctgctcaccgaaactcta

SEQ ID NO: 702869 - DNA, 25 bp, Mus musculus
ggagcctctgctgaccgaaactcta

SEQ ID NO: 702870 - DNA, 25 bp, Mus musculus
ggagcctgccccatgcacagagcaa

SEQ ID NO: 702871 - DNA, 25 bp, Mus musculus
ggagcctgccccttgcacagagcaa

SEQ ID NO: 702872 - DNA, 25 bp, Mus musculus
ggagcctggacaattggacaaacca

SEQ ID NO: 702873 - DNA, 25 bp, Mus musculus
ggagcctggacatttggacaaacca

SEQ ID NO: 702874 - DNA, 25 bp, Mus musculus
ggagcctggaccaccctaatgtgct

SEQ ID NO: 702875 - DNA, 25 bp, Mus musculus
ggagcctggacctccctaatgtgct

SEQ ID NO: 702876 - DNA, 25 bp, Mus musculus
ggagcctggcttaagcaacaataaa

SEQ ID NO: 702877 - DNA, 25 bp, Mus musculus
ggagcctggctttagcaacaataaa

SEQ ID NO: 702878 - DNA, 25 bp, Mus musculus
ggagcctgggctcctaaagtcatca

SEQ ID NO: 702879 - DNA, 25 bp, Mus musculus
ggagcctgggctgctaaagtcatca

SEQ ID NO: 702880 - DNA, 25 bp, Mus musculus
ggagcctgtataaggatacactcct

SEQ ID NO: 702881 - DNA, 25 bp, Mus musculus
ggagcctgtatatggatacactcct

SEQ ID NO: 702882 - DNA, 25 bp, Mus musculus
ggagccttaaacctgcacagtcaga

SEQ ID NO: 702883 - DNA, 25 bp, Mus musculus
ggagccttaaacgtgcacagtcaga

SEQ ID NO: 702884 - DNA, 25 bp, Mus musculus
ggagccttcccaacagggactagaa

SEQ ID NO: 702885 - DNA, 25 bp, Mus musculus
ggagccttcccatcagggactagaa

SEQ ID NO: 702886 - DNA, 25 bp, Mus musculus
ggagccttctcgactgcctctgatg

SEQ ID NO: 702887 - DNA, 25 bp, Mus musculus
ggagccttctcgtctgcctctgatg

SEQ ID NO: 702888 - DNA, 25 bp, Mus musculus
ggagccttgccacttgggctgtaca

SEQ ID NO: 702889 - DNA, 25 bp, Mus musculus
ggagccttgccagttgggctgtaca

SEQ ID NO: 702890 - DNA, 25 bp, Mus musculus
ggagccttgttcatcttgggagcgc

SEQ ID NO: 702891 - DNA, 25 bp, Mus musculus
ggagccttgttcttcttgggagcgc

SEQ ID NO: 702892 - DNA, 25 bp, Mus musculus
ggagcctttgacaggtccccagtgg

SEQ ID NO: 702893 - DNA, 25 bp, Mus musculus
ggagcctttgactggtccccagtgg

SEQ ID NO: 702894 - DNA, 25 bp, Mus musculus
ggagcgaccgggacagtttatcaaa

SEQ ID NO: 702895 - DNA, 25 bp, Mus musculus
ggagcgaccgggtcagtttatcaaa

SEQ ID NO: 702896 - DNA, 25 bp, Mus musculus
ggagcgacctccaggccatgtttct

SEQ ID NO: 702897 - DNA, 25 bp, Mus musculus
ggagcgacctcctggccatgtttct

SEQ ID NO: 702898 - DNA, 25 bp, Mus musculus
ggagcgagccttagctgacttcctc

SEQ ID NO: 702899 - DNA, 25 bp, Mus musculus
ggagcgagcctttgctgacttcctc

SEQ ID NO: 702900 - DNA, 25 bp, Mus musculus
ggagcgatgatgagtataagcacat

SEQ ID NO: 702901 - DNA, 25 bp, Mus musculus
ggagcgatgatgtgtataagcacat

SEQ ID NO: 702902 - DNA, 25 bp, Mus musculus
ggagcgattttgagctgtgcagtca

SEQ ID NO: 702903 - DNA, 25 bp, Mus musculus
ggagcgattttgtgctgtgcagtca

SEQ ID NO: 702904 - DNA, 25 bp, Mus musculus
ggagcgcaataaatggaggccaccg

SEQ ID NO: 702905 - DNA, 25 bp, Mus musculus
ggagcgcaataattggaggccaccg

SEQ ID NO: 702906 - DNA, 25 bp, Mus musculus
ggagcgcatgcacagatcccaaggc

SEQ ID NO: 702907 - DNA, 25 bp, Mus musculus
ggagcgcatgcagagatcccaaggc

SEQ ID NO: 702908 - DNA, 25 bp, Mus musculus
ggagcgcatgttacgcctggtgaac

SEQ ID NO: 702909 - DNA, 25 bp, Mus musculus
ggagcgcatgtttcgcctggtgaac

SEQ ID NO: 702910 - DNA, 25 bp, Mus musculus
ggagcgccagacacgcttccagaac

SEQ ID NO: 702911 - DNA, 25 bp, Mus musculus
ggagcgccagactcgcttccagaac

SEQ ID NO: 702912 - DNA, 25 bp, Mus musculus
ggagcgccgaaaacttcaccgtact

SEQ ID NO: 702913 - DNA, 25 bp, Mus musculus
ggagcgccgaaatcttcaccgtact

SEQ ID NO: 702914 - DNA, 25 bp, Mus musculus
ggagcgcctggaatttcagctgaag

SEQ ID NO: 702915 - DNA, 25 bp, Mus musculus
ggagcgcctggattttcagctgaag

SEQ ID NO: 702916 - DNA, 25 bp, Mus musculus
ggagcgcgcttgcagcccagatctt

SEQ ID NO: 702917 - DNA, 25 bp, Mus musculus
ggagcgcgcttggagcccagatctt

SEQ ID NO: 702918 - DNA, 25 bp, Mus musculus
ggagcgcgggccctgctcaaaactc

SEQ ID NO: 702919 - DNA, 25 bp, Mus musculus
ggagcgcgggccgtgctcaaaactc

SEQ ID NO: 702920 - DNA, 25 bp, Mus musculus
ggagcgctaccacaagattggagac

SEQ ID NO: 702921 - DNA, 25 bp, Mus musculus
ggagcgctaccacctgttttcaaga

SEQ ID NO: 702922 - DNA, 25 bp, Mus musculus
ggagcgctaccagaagattggagac

SEQ ID NO: 702923 - DNA, 25 bp, Mus musculus
ggagcgctaccagctgttttcaaga

SEQ ID NO: 702924 - DNA, 25 bp, Mus musculus
ggagcgctcgatccctactacaagc

SEQ ID NO: 702925 - DNA, 25 bp, Mus musculus
ggagcgctcgatgcctactacaagc

SEQ ID NO: 702926 - DNA, 25 bp, Mus musculus
ggagcgctctgccagctacaagccg

SEQ ID NO: 702927 - DNA, 25 bp, Mus musculus
ggagcgctctgcgagctacaagccg

SEQ ID NO: 702928 - DNA, 25 bp, Mus musculus
ggagcgcttccgcagtgtgacccat

SEQ ID NO: 702929 - DNA, 25 bp, Mus musculus
ggagcgcttccggagtgtgacccat

SEQ ID NO: 702930 - DNA, 25 bp, Mus musculus
ggagcggaaggcagccctcaaaaca

SEQ ID NO: 702931 - DNA, 25 bp, Mus musculus
ggagcggaaggctgccctcaaaaca

SEQ ID NO: 702932 - DNA, 25 bp, Mus musculus
ggagcggacatgcacttcgactcgt

SEQ ID NO: 702933 - DNA, 25 bp, Mus musculus
ggagcggacatggacttcgactcgt

SEQ ID NO: 702934 - DNA, 25 bp, Mus musculus
ggagcggacccgatttatcttcatc

SEQ ID NO: 702935 - DNA, 25 bp, Mus musculus
ggagcggacccgttttatcttcatc

SEQ ID NO: 702936 - DNA, 25 bp, Mus musculus
ggagcggactccaagtaccgctaga

SEQ ID NO: 702937 - DNA, 25 bp, Mus musculus
ggagcggactcctagtaccgctaga

SEQ ID NO: 702938 - DNA, 25 bp, Mus musculus
ggagcggagaccctttttcagagct

SEQ ID NO: 702939 - DNA, 25 bp, Mus musculus
ggagcggagaccgtttttcagagct

SEQ ID NO: 702940 - DNA, 25 bp, Mus musculus
ggagcggcatgtcaccatcactggc

SEQ ID NO: 702941 - DNA, 25 bp, Mus musculus
ggagcggcatgtgaccatcactggc

SEQ ID NO: 702942 - DNA, 25 bp, Mus musculus
ggagcggctcctcaagagactcttc

SEQ ID NO: 702943 - DNA, 25 bp, Mus musculus
ggagcggctcctgaagagactcttc

SEQ ID NO: 702944 - DNA, 25 bp, Mus musculus
ggagcggctgtgcaaatattgcata

SEQ ID NO: 702945 - DNA, 25 bp, Mus musculus
ggagcggctgtggaaatattgcata

SEQ ID NO: 702946 - DNA, 25 bp, Mus musculus
ggagcgggtgtgctcacctacatca

SEQ ID NO: 702947 - DNA, 25 bp, Mus musculus
ggagcgggtgtggtcacctacatca

SEQ ID NO: 702948 - DNA, 25 bp, Mus musculus
ggagcggtgccgactcttcccagaa

SEQ ID NO: 702949 - DNA, 25 bp, Mus musculus
ggagcggtgccgtctcttcccagaa

SEQ ID NO: 702950 - DNA, 25 bp, Mus musculus
ggagcggtgttcctccagtcctcat

SEQ ID NO: 702951 - DNA, 25 bp, Mus musculus
ggagcggtgttcgtccagtcctcat

SEQ ID NO: 702952 - DNA, 25 bp, Mus musculus
ggagcgtactgaatccctagtcact

SEQ ID NO: 702953 - DNA, 25 bp, Mus musculus
ggagcgtactgattccctagtcact

SEQ ID NO: 702954 - DNA, 25 bp, Mus musculus
ggagcgtagcaccacaaccatcaag

SEQ ID NO: 702955 - DNA, 25 bp, Mus musculus
ggagcgtagcacgacaaccatcaag

SEQ ID NO: 702956 - DNA, 25 bp, Mus musculus
ggagcgtcagacataacaggaagct

SEQ ID NO: 702957 - DNA, 25 bp, Mus musculus
ggagcgtcagacttaacaggaagct

SEQ ID NO: 702958 - DNA, 25 bp, Mus musculus
ggagcgtccccaatcctgggcgaga

SEQ ID NO: 702959 - DNA, 25 bp, Mus musculus
ggagcgtccccattcctgggcgaga

SEQ ID NO: 702960 - DNA, 25 bp, Mus musculus
ggagcgtgaagaccctaaatgtttc

SEQ ID NO: 702961 - DNA, 25 bp, Mus musculus
ggagcgtgaagagcctaaatgtttc

SEQ ID NO: 702962 - DNA, 25 bp, Mus musculus
ggagcgtgaggaagaaccacatgta

SEQ ID NO: 702963 - DNA, 25 bp, Mus musculus
ggagcgtgaggatgaaccacatgta

SEQ ID NO: 702964 - DNA, 25 bp, Mus musculus
ggagcgtgagtgagccttgacacac

SEQ ID NO: 702965 - DNA, 25 bp, Mus musculus
ggagcgtgagtgtgccttgacacac

SEQ ID NO: 702966 - DNA, 25 bp, Mus musculus
ggagcgtggttaaatctgttaaccc

SEQ ID NO: 702967 - DNA, 25 bp, Mus musculus
ggagcgtggttatatctgttaaccc

SEQ ID NO: 702968 - DNA, 25 bp, Mus musculus
ggagcgtgtcatcaacgaagagtat

SEQ ID NO: 702969 - DNA, 25 bp, Mus musculus
ggagcgtgtcatgaacgaagagtat

SEQ ID NO: 702970 - DNA, 25 bp, Mus musculus
ggagcgttgatacgaccctacccag

SEQ ID NO: 702971 - DNA, 25 bp, Mus musculus
ggagcgttgataggaccctacccag

SEQ ID NO: 702972 - DNA, 25 bp, Mus musculus
ggagcgttggctctatctttgcaga

SEQ ID NO: 702973 - DNA, 25 bp, Mus musculus
ggagcgttggctgtatctttgcaga

SEQ ID NO: 702974 - DNA, 25 bp, Mus musculus
ggagctaaagagctctggttttttc

SEQ ID NO: 702975 - DNA, 25 bp, Mus musculus
ggagctaaagaggtctggttttttc

SEQ ID NO: 702976 - DNA, 25 bp, Mus musculus
ggagctaaagcaacgatcatggctg

SEQ ID NO: 702977 - DNA, 25 bp, Mus musculus
ggagctaaagcatcgatcatggctg

SEQ ID NO: 702978 - DNA, 25 bp, Mus musculus
ggagctaagcccaggaagatacggc

SEQ ID NO: 702979 - DNA, 25 bp, Mus musculus
ggagctaagccctggaagatacggc

SEQ ID NO: 702980 - DNA, 25 bp, Mus musculus
ggagctaaggccaagcgagtacaga

SEQ ID NO: 702981 - DNA, 25 bp, Mus musculus
ggagctaaggcctagcgagtacaga

SEQ ID NO: 702982 - DNA, 25 bp, Mus musculus
ggagctaatcacagggagcctgccc

SEQ ID NO: 702983 - DNA, 25 bp, Mus musculus
ggagctaatcactgggagcctgccc

SEQ ID NO: 702984 - DNA, 25 bp, Mus musculus
ggagctacacaacatctggaaaaag

SEQ ID NO: 702985 - DNA, 25 bp, Mus musculus
ggagctacacaagatctggaaaaag

SEQ ID NO: 702986 - DNA, 25 bp, Mus musculus
ggagctacaccgcaaggcagcactg

SEQ ID NO: 702987 - DNA, 25 bp, Mus musculus
ggagctacaccggaaggcagcactg

SEQ ID NO: 702988 - DNA, 25 bp, Mus musculus
ggagctacagctcgctctggcccta

SEQ ID NO: 702989 - DNA, 25 bp, Mus musculus
ggagctacagctggctctggcccta

SEQ ID NO: 702990 - DNA, 25 bp, Mus musculus
ggagctaccatgacgttcgcgctgg

SEQ ID NO: 702991 - DNA, 25 bp, Mus musculus
ggagctaccatgtcgttcgcgctgg

SEQ ID NO: 702992 - DNA, 25 bp, Mus musculus
ggagctactgagaccaacaacatag

SEQ ID NO: 702993 - DNA, 25 bp, Mus musculus
ggagctactgagtccaacaacatag

SEQ ID NO: 702994 - DNA, 25 bp, Mus musculus
ggagctaggagcatattgtggctac

SEQ ID NO: 702995 - DNA, 25 bp, Mus musculus
ggagctaggagcttattgtggctac

SEQ ID NO: 702996 - DNA, 25 bp, Mus musculus
ggagctaggtacactgatccccaag

SEQ ID NO: 702997 - DNA, 25 bp, Mus musculus
ggagctaggtactctgatccccaag

SEQ ID NO: 702998 - DNA, 25 bp, Mus musculus
ggagctagtggcacatgaacctgct

SEQ ID NO: 702999 - DNA, 25 bp, Mus musculus
ggagctagtggctcatgaacctgct

SEQ ID NO: 703000 - DNA, 25 bp, Mus musculus
ggagctataacccaaatgacacctg

SEQ ID NO: 703001 - DNA, 25 bp, Mus musculus
ggagctataaccgaaatgacacctg

SEQ ID NO: 703002 - DNA, 25 bp, Mus musculus
ggagctatctctagctggcagccag

SEQ ID NO: 703003 - DNA, 25 bp, Mus musculus
ggagctatctcttgctggcagccag

SEQ ID NO: 703004 - DNA, 25 bp, Mus musculus
ggagctatgaatctcgctgcaaaga

SEQ ID NO: 703005 - DNA, 25 bp, Mus musculus
ggagctatgaatgtcgctgcaaaga

SEQ ID NO: 703006 - DNA, 25 bp, Mus musculus
ggagctatggaaagttatgtcgcca

SEQ ID NO: 703007 - DNA, 25 bp, Mus musculus
ggagctatggaatgttatgtcgcca

SEQ ID NO: 703008 - DNA, 25 bp, Mus musculus
ggagctatgtgaccttgaccctgct

SEQ ID NO: 703009 - DNA, 25 bp, Mus musculus
ggagctatgtgagcttgaccctgct

SEQ ID NO: 703010 - DNA, 25 bp, Mus musculus
ggagctcaaaaaatatgaatatggg

SEQ ID NO: 703011 - DNA, 25 bp, Mus musculus
ggagctcaaaaattatgaatatggg

SEQ ID NO: 703012 - DNA, 25 bp, Mus musculus
ggagctcaaagccacattgcccagc

SEQ ID NO: 703013 - DNA, 25 bp, Mus musculus
ggagctcaaagcgacattgcccagc

SEQ ID NO: 703014 - DNA, 25 bp, Mus musculus
ggagctcaacccatatgctgcctgg

SEQ ID NO: 703015 - DNA, 25 bp, Mus musculus
ggagctcaacccttatgctgcctgg

SEQ ID NO: 703016 - DNA, 25 bp, Mus musculus
ggagctcaacctagttcagcgctct

SEQ ID NO: 703017 - DNA, 25 bp, Mus musculus
ggagctcaaccttgttcagcgctct

SEQ ID NO: 703018 - DNA, 25 bp, Mus musculus
ggagctcaagttcacctcagagaaa

SEQ ID NO: 703019 - DNA, 25 bp, Mus musculus
ggagctcaagttgacctcagagaaa

SEQ ID NO: 703020 - DNA, 25 bp, Mus musculus
ggagctcaatgtcagctttatcaac

SEQ ID NO: 703021 - DNA, 25 bp, Mus musculus
ggagctcaatgtgagctttatcaac

SEQ ID NO: 703022 - DNA, 25 bp, Mus musculus
ggagctcacttgatgctgtgatcta

SEQ ID NO: 703023 - DNA, 25 bp, Mus musculus
ggagctcacttgttgctgtgatcta

SEQ ID NO: 703024 - DNA, 25 bp, Mus musculus
ggagctcagaccacgtttgccgaaa

SEQ ID NO: 703025 - DNA, 25 bp, Mus musculus
ggagctcagacctcgtttgccgaaa

SEQ ID NO: 703026 - DNA, 25 bp, Mus musculus
ggagctcatcctacatcagtgcgcg

SEQ ID NO: 703027 - DNA, 25 bp, Mus musculus
ggagctcatccttcatcagtgcgcg

SEQ ID NO: 703028 - DNA, 25 bp, Mus musculus
ggagctcatgcaactgaaggctgaa

SEQ ID NO: 703029 - DNA, 25 bp, Mus musculus
ggagctcatgcatctgaaggctgaa

SEQ ID NO: 703030 - DNA, 25 bp, Mus musculus
ggagctcatgctatccctgcacgag

SEQ ID NO: 703031 - DNA, 25 bp, Mus musculus
ggagctcatgctttccctgcacgag

SEQ ID NO: 703032 - DNA, 25 bp, Mus musculus
ggagctcatggaagcaaatctttgc

SEQ ID NO: 703033 - DNA, 25 bp, Mus musculus
ggagctcatggacacagttcataac

SEQ ID NO: 703034 - DNA, 25 bp, Mus musculus
ggagctcatggagacagttcataac

SEQ ID NO: 703035 - DNA, 25 bp, Mus musculus
ggagctcatggatgcaaatctttgc

SEQ ID NO: 703036 - DNA, 25 bp, Mus musculus
ggagctcatggtctccatggttact

SEQ ID NO: 703037 - DNA, 25 bp, Mus musculus
ggagctcatggtgtccatggttact

SEQ ID NO: 703038 - DNA, 25 bp, Mus musculus
ggagctcattttcttgccaaaagtt

SEQ ID NO: 703039 - DNA, 25 bp, Mus musculus
ggagctcattttgttgccaaaagtt

SEQ ID NO: 703040 - DNA, 25 bp, Mus musculus
ggagctccagaaatggctaccgcga

SEQ ID NO: 703041 - DNA, 25 bp, Mus musculus
ggagctccagaattggctaccgcga

SEQ ID NO: 703042 - DNA, 25 bp, Mus musculus
ggagctccagtcaggcgatctctcc

SEQ ID NO: 703043 - DNA, 25 bp, Mus musculus
ggagctccagtctggcgatctctcc

SEQ ID NO: 703044 - DNA, 25 bp, Mus musculus
ggagctccgaaacggcaacctagag

SEQ ID NO: 703045 - DNA, 25 bp, Mus musculus
ggagctccgaaagggcaacctagag

SEQ ID NO: 703046 - DNA, 25 bp, Mus musculus
ggagctccgagcagcgcatcctgag

SEQ ID NO: 703047 - DNA, 25 bp, Mus musculus
ggagctccgagctgcgcatcctgag

SEQ ID NO: 703048 - DNA, 25 bp, Mus musculus
ggagctccggtgaccggaatcccaa

SEQ ID NO: 703049 - DNA, 25 bp, Mus musculus
ggagctccggtgtccggaatcccaa

SEQ ID NO: 703050 - DNA, 25 bp, Mus musculus
ggagctcctctgattaccagagggt

SEQ ID NO: 703051 - DNA, 25 bp, Mus musculus
ggagctcctctgtttaccagagggt

SEQ ID NO: 703052 - DNA, 25 bp, Mus musculus
ggagctcctggaatgactgggccca

SEQ ID NO: 703053 - DNA, 25 bp, Mus musculus
ggagctcctggattgactgggccca

SEQ ID NO: 703054 - DNA, 25 bp, Mus musculus
ggagctcctggcacaagactacaag

SEQ ID NO: 703055 - DNA, 25 bp, Mus musculus
ggagctcctggcagtagcctgtgaa

SEQ ID NO: 703056 - DNA, 25 bp, Mus musculus
ggagctcctggctcaagactacaag

SEQ ID NO: 703057 - DNA, 25 bp, Mus musculus
ggagctcctggctgtagcctgtgaa

SEQ ID NO: 703058 - DNA, 25 bp, Mus musculus
ggagctcctggtcctcaagcagcag

SEQ ID NO: 703059 - DNA, 25 bp, Mus musculus
ggagctcctggtgctcaagcagcag

SEQ ID NO: 703060 - DNA, 25 bp, Mus musculus
ggagctcgactcagacgtggataaa

SEQ ID NO: 703061 - DNA, 25 bp, Mus musculus
ggagctcgactctgacgtggataaa

SEQ ID NO: 703062 - DNA, 25 bp, Mus musculus
ggagctcgccccattggtagcagct

SEQ ID NO: 703063 - DNA, 25 bp, Mus musculus
ggagctcgcccctttggtagcagct

SEQ ID NO: 703064 - DNA, 25 bp, Mus musculus
ggagctcgtaacctgcatggacata

SEQ ID NO: 703065 - DNA, 25 bp, Mus musculus
ggagctcgtaacgtgcatggacata

SEQ ID NO: 703066 - DNA, 25 bp, Mus musculus
ggagctctacaaaatctctcagcga

SEQ ID NO: 703067 - DNA, 25 bp, Mus musculus
ggagctctacaatatctctcagcga

SEQ ID NO: 703068 - DNA, 25 bp, Mus musculus
ggagctctcatcctactattgccat

SEQ ID NO: 703069 - DNA, 25 bp, Mus musculus
ggagctctcatcgtactattgccat

SEQ ID NO: 703070 - DNA, 25 bp, Mus musculus
ggagctctctagaccacagattcct

SEQ ID NO: 703071 - DNA, 25 bp, Mus musculus
ggagctctctagtccacagattcct

SEQ ID NO: 703072 - DNA, 25 bp, Mus musculus
ggagctcttctgattcctgtgcagc

SEQ ID NO: 703073 - DNA, 25 bp, Mus musculus
ggagctcttctgtttcctgtgcagc

SEQ ID NO: 703074 - DNA, 25 bp, Mus musculus
ggagctcttgtacccattcaaggaa

SEQ ID NO: 703075 - DNA, 25 bp, Mus musculus
ggagctcttgtagccattcaaggaa

SEQ ID NO: 703076 - DNA, 25 bp, Mus musculus
ggagctctttgccatgttgcctgta

SEQ ID NO: 703077 - DNA, 25 bp, Mus musculus
ggagctctttgcgatgttgcctgta

SEQ ID NO: 703078 - DNA, 25 bp, Mus musculus
ggagctcttttacagatccctgcag

SEQ ID NO: 703079 - DNA, 25 bp, Mus musculus
ggagctcttttagagatccctgcag

SEQ ID NO: 703080 - DNA, 25 bp, Mus musculus
ggagctcttttcaaccaggaagaaa

SEQ ID NO: 703081 - DNA, 25 bp, Mus musculus
ggagctcttttctaccaggaagaaa

SEQ ID NO: 703082 - DNA, 25 bp, Mus musculus
ggagctgaaagcagattatcacatc

SEQ ID NO: 703083 - DNA, 25 bp, Mus musculus
ggagctgaaagctgattatcacatc

SEQ ID NO: 703084 - DNA, 25 bp, Mus musculus
ggagctgaacaacaccatctgggag

SEQ ID NO: 703085 - DNA, 25 bp, Mus musculus
ggagctgaacaagaccatctgggag

SEQ ID NO: 703086 - DNA, 25 bp, Mus musculus
ggagctgaagcaacagaagcgctgt

SEQ ID NO: 703087 - DNA, 25 bp, Mus musculus
ggagctgaagcatcagaagcgctgt

SEQ ID NO: 703088 - DNA, 25 bp, Mus musculus
ggagctgaataccacccctttgaaa

SEQ ID NO: 703089 - DNA, 25 bp, Mus musculus
ggagctgaatacgacccctttgaaa

SEQ ID NO: 703090 - DNA, 25 bp, Mus musculus
ggagctgacaatcacaggcctgcct

SEQ ID NO: 703091 - DNA, 25 bp, Mus musculus
ggagctgacaatgacaggcctgcct

SEQ ID NO: 703092 - DNA, 25 bp, Mus musculus
ggagctgacatactgaaggaattag

SEQ ID NO: 703093 - DNA, 25 bp, Mus musculus
ggagctgacatagtgaaggaattag

SEQ ID NO: 703094 - DNA, 25 bp, Mus musculus
ggagctgaccagaaccccttcacag

SEQ ID NO: 703095 - DNA, 25 bp, Mus musculus
ggagctgaccagtaccccttcacag

SEQ ID NO: 703096 - DNA, 25 bp, Mus musculus
ggagctgaccgaagctgagttccca

SEQ ID NO: 703097 - DNA, 25 bp, Mus musculus
ggagctgaccgatgctgagttccca

SEQ ID NO: 703098 - DNA, 25 bp, Mus musculus
ggagctgaccttctgtaagaagact

SEQ ID NO: 703099 - DNA, 25 bp, Mus musculus
ggagctgaccttgtgtaagaagact

SEQ ID NO: 703100 - DNA, 25 bp, Mus musculus
ggagctgagagacgcctttcgggag

SEQ ID NO: 703101 - DNA, 25 bp, Mus musculus
ggagctgagagaggcctttcgggag

SEQ ID NO: 703102 - DNA, 25 bp, Mus musculus
ggagctgatactacggcgcatctca

SEQ ID NO: 703103 - DNA, 25 bp, Mus musculus
ggagctgatacttcggcgcatctca

SEQ ID NO: 703104 - DNA, 25 bp, Mus musculus
ggagctgatggaagacactcagcac

SEQ ID NO: 703105 - DNA, 25 bp, Mus musculus
ggagctgatggatgacactcagcac

SEQ ID NO: 703106 - DNA, 25 bp, Mus musculus
ggagctgattctcatgaagttcatc

SEQ ID NO: 703107 - DNA, 25 bp, Mus musculus
ggagctgattctgatgaagttcatc

SEQ ID NO: 703108 - DNA, 25 bp, Mus musculus
ggagctgatttgacagaaatttgcc

SEQ ID NO: 703109 - DNA, 25 bp, Mus musculus
ggagctgatttgtcagaaatttgcc

SEQ ID NO: 703110 - DNA, 25 bp, Mus musculus
ggagctgcagccatatgatagaaac

SEQ ID NO: 703111 - DNA, 25 bp, Mus musculus
ggagctgcagccttatgatagaaac

SEQ ID NO: 703112 - DNA, 25 bp, Mus musculus
ggagctgcatgtcagttggcacaac

SEQ ID NO: 703113 - DNA, 25 bp, Mus musculus
ggagctgcatgtgagttggcacaac

SEQ ID NO: 703114 - DNA, 25 bp, Mus musculus
ggagctgccaacacttccagaggga

SEQ ID NO: 703115 - DNA, 25 bp, Mus musculus
ggagctgccaactcttccagaggga

SEQ ID NO: 703116 - DNA, 25 bp, Mus musculus
ggagctgccaccctcttggtctacg

SEQ ID NO: 703117 - DNA, 25 bp, Mus musculus
ggagctgccaccgtcttggtctacg

SEQ ID NO: 703118 - DNA, 25 bp, Mus musculus
ggagctgcctccaaagtccctagaa

SEQ ID NO: 703119 - DNA, 25 bp, Mus musculus
ggagctgcctcctaagtccctagaa

SEQ ID NO: 703120 - DNA, 25 bp, Mus musculus
ggagctgcggctagtctttggacct

SEQ ID NO: 703121 - DNA, 25 bp, Mus musculus
ggagctgcggcttgtctttggacct

SEQ ID NO: 703122 - DNA, 25 bp, Mus musculus
ggagctgcgtacacggctggacttc

SEQ ID NO: 703123 - DNA, 25 bp, Mus musculus
ggagctgcgtactcggctggacttc

SEQ ID NO: 703124 - DNA, 25 bp, Mus musculus
ggagctgctccgaggttgcatcgaa

SEQ ID NO: 703125 - DNA, 25 bp, Mus musculus
ggagctgctccgtggttgcatcgaa

SEQ ID NO: 703126 - DNA, 25 bp, Mus musculus
ggagctgctcttagagacgagtgag

SEQ ID NO: 703127 - DNA, 25 bp, Mus musculus
ggagctgctctttgagacgagtgag

SEQ ID NO: 703128 - DNA, 25 bp, Mus musculus
ggagctgctgacatccaagatcgga

SEQ ID NO: 703129 - DNA, 25 bp, Mus musculus
ggagctgctgacttccaagatcgga

SEQ ID NO: 703130 - DNA, 25 bp, Mus musculus
ggagctgctggtagaccagtacttc

SEQ ID NO: 703131 - DNA, 25 bp, Mus musculus
ggagctgctggttgaccagtacttc

SEQ ID NO: 703132 - DNA, 25 bp, Mus musculus
ggagctgcttcgctacctactggat

SEQ ID NO: 703133 - DNA, 25 bp, Mus musculus
ggagctgcttcggtacctactggat

SEQ ID NO: 703134 - DNA, 25 bp, Mus musculus
ggagctgcttttacttagatcccag

SEQ ID NO: 703135 - DNA, 25 bp, Mus musculus
ggagctgctttttcttagatcccag

SEQ ID NO: 703136 - DNA, 25 bp, Mus musculus
ggagctggaaggagaaccgttactt

SEQ ID NO: 703137 - DNA, 25 bp, Mus musculus
ggagctggaaggtgaaccgttactt

SEQ ID NO: 703138 - DNA, 25 bp, Mus musculus
ggagctggacgacttcatatgtgat

SEQ ID NO: 703139 - DNA, 25 bp, Mus musculus
ggagctggacgagttcatatgtgat

SEQ ID NO: 703140 - DNA, 25 bp, Mus musculus
ggagctggcaaaagattgcatcaga

SEQ ID NO: 703141 - DNA, 25 bp, Mus musculus
ggagctggcaaatgattgcatcaga

SEQ ID NO: 703142 - DNA, 25 bp, Mus musculus
ggagctggcaccaaaggctgtgaac

SEQ ID NO: 703143 - DNA, 25 bp, Mus musculus
ggagctggcacctaaggctgtgaac

SEQ ID NO: 703144 - DNA, 25 bp, Mus musculus
ggagctggcacgacatgcagaccac

SEQ ID NO: 703145 - DNA, 25 bp, Mus musculus
ggagctggcacgtcatgcagaccac

SEQ ID NO: 703146 - DNA, 25 bp, Mus musculus
ggagctggcactactgcagaggcaa

SEQ ID NO: 703147 - DNA, 25 bp, Mus musculus
ggagctggcacttctgcagaggcaa

SEQ ID NO: 703148 - DNA, 25 bp, Mus musculus
ggagctggcagactgctgcctccac

SEQ ID NO: 703149 - DNA, 25 bp, Mus musculus
ggagctggcagagtgctgcctccac

SEQ ID NO: 703150 - DNA, 25 bp, Mus musculus
ggagctggccttcactttctgagaa

SEQ ID NO: 703151 - DNA, 25 bp, Mus musculus
ggagctggccttgactttctgagaa

SEQ ID NO: 703152 - DNA, 25 bp, Mus musculus
ggagctggcggtcaatatcatcttc

SEQ ID NO: 703153 - DNA, 25 bp, Mus musculus
ggagctggcggtgaatatcatcttc

SEQ ID NO: 703154 - DNA, 25 bp, Mus musculus
ggagctgggtcccacttcaaaagat

SEQ ID NO: 703155 - DNA, 25 bp, Mus musculus
ggagctgggtccgacttcaaaagat

SEQ ID NO: 703156 - DNA, 25 bp, Mus musculus
ggagctgtattacaagctgctgaag

SEQ ID NO: 703157 - DNA, 25 bp, Mus musculus
ggagctgtattagaagctgctgaag

SEQ ID NO: 703158 - DNA, 25 bp, Mus musculus
ggagctgtccagagagaagccccaa

SEQ ID NO: 703159 - DNA, 25 bp, Mus musculus
ggagctgtccagtgagaagccccaa

SEQ ID NO: 703160 - DNA, 25 bp, Mus musculus
ggagctgtcctacctgaacgtcact

SEQ ID NO: 703161 - DNA, 25 bp, Mus musculus
ggagctgtcctagctgaacgtcact

SEQ ID NO: 703162 - DNA, 25 bp, Mus musculus
ggagctgtgatgagaagttccctat

SEQ ID NO: 703163 - DNA, 25 bp, Mus musculus
ggagctgtgatgtgaagttccctat

SEQ ID NO: 703164 - DNA, 25 bp, Mus musculus
ggagctgtgcaaccccatggctacc

SEQ ID NO: 703165 - DNA, 25 bp, Mus musculus
ggagctgtgcaagcccatggctacc

SEQ ID NO: 703166 - DNA, 25 bp, Mus musculus
ggagctgttacccacatcaagattc

SEQ ID NO: 703167 - DNA, 25 bp, Mus musculus
ggagctgttaccgacatcaagattc

SEQ ID NO: 703168 - DNA, 25 bp, Mus musculus
ggagctgttctcaagatgttacttc

SEQ ID NO: 703169 - DNA, 25 bp, Mus musculus
ggagctgttctctagatgttacttc

SEQ ID NO: 703170 - DNA, 25 bp, Mus musculus
ggagctgttgttaactagcccaaag

SEQ ID NO: 703171 - DNA, 25 bp, Mus musculus
ggagctgttgtttactagcccaaag

SEQ ID NO: 703172 - DNA, 25 bp, Mus musculus
ggagctgtttcccatccacacggag

SEQ ID NO: 703173 - DNA, 25 bp, Mus musculus
ggagctgtttccgatccacacggag

SEQ ID NO: 703174 - DNA, 25 bp, Mus musculus
ggagctgttttcagtgaagagcctc

SEQ ID NO: 703175 - DNA, 25 bp, Mus musculus
ggagctgttttctgtgaagagcctc

SEQ ID NO: 703176 - DNA, 25 bp, Mus musculus
ggagcttaaggaaccataatgtgca

SEQ ID NO: 703177 - DNA, 25 bp, Mus musculus
ggagcttaaggatccataatgtgca

SEQ ID NO: 703178 - DNA, 25 bp, Mus musculus
ggagcttacctgaccatatctaaca

SEQ ID NO: 703179 - DNA, 25 bp, Mus musculus
ggagcttacctgtccatatctaaca

SEQ ID NO: 703180 - DNA, 25 bp, Mus musculus
ggagcttattttctgaccaaggcag

SEQ ID NO: 703181 - DNA, 25 bp, Mus musculus
ggagcttattttgtgaccaaggcag

SEQ ID NO: 703182 - DNA, 25 bp, Mus musculus
ggagcttcaagtcaacttagtccgt

SEQ ID NO: 703183 - DNA, 25 bp, Mus musculus
ggagcttcaagtgaacttagtccgt

SEQ ID NO: 703184 - DNA, 25 bp, Mus musculus
ggagcttcagaaccagggtccccga

SEQ ID NO: 703185 - DNA, 25 bp, Mus musculus
ggagcttcagaagcagggtccccga

SEQ ID NO: 703186 - DNA, 25 bp, Mus musculus
ggagcttcaggtcctccttgcagga

SEQ ID NO: 703187 - DNA, 25 bp, Mus musculus
ggagcttcaggtgctccttgcagga

SEQ ID NO: 703188 - DNA, 25 bp, Mus musculus
ggagcttcccctcggcatgaaagcc

SEQ ID NO: 703189 - DNA, 25 bp, Mus musculus
ggagcttcccctgggcatgaaagcc

SEQ ID NO: 703190 - DNA, 25 bp, Mus musculus
ggagcttcctggacaatcattagca

SEQ ID NO: 703191 - DNA, 25 bp, Mus musculus
ggagcttcctggtcaatcattagca

SEQ ID NO: 703192 - DNA, 25 bp, Mus musculus
ggagcttccttgagcgtgccagcga

SEQ ID NO: 703193 - DNA, 25 bp, Mus musculus
ggagcttccttgtgcgtgccagcga

SEQ ID NO: 703194 - DNA, 25 bp, Mus musculus
ggagcttcgcaactatacctatgcc

SEQ ID NO: 703195 - DNA, 25 bp, Mus musculus
ggagcttcgcaagtatacctatgcc

SEQ ID NO: 703196 - DNA, 25 bp, Mus musculus
ggagcttcgcagaggcatcgtcaga

SEQ ID NO: 703197 - DNA, 25 bp, Mus musculus
ggagcttcgcagtggcatcgtcaga

SEQ ID NO: 703198 - DNA, 25 bp, Mus musculus
ggagcttcggaacccactggaaaaa

SEQ ID NO: 703199 - DNA, 25 bp, Mus musculus
ggagcttcggaagccactggaaaaa

SEQ ID NO: 703200 - DNA, 25 bp, Mus musculus
ggagcttcggcaacctcctctggga

SEQ ID NO: 703201 - DNA, 25 bp, Mus musculus
ggagcttcggcatcctcctctggga

SEQ ID NO: 703202 - DNA, 25 bp, Mus musculus
ggagcttctcacaggagatggagcc

SEQ ID NO: 703203 - DNA, 25 bp, Mus musculus
ggagcttctcactggagatggagcc

SEQ ID NO: 703204 - DNA, 25 bp, Mus musculus
ggagcttgaagacacttggcttcct

SEQ ID NO: 703205 - DNA, 25 bp, Mus musculus
ggagcttgaagagacttggcttcct

SEQ ID NO: 703206 - DNA, 25 bp, Mus musculus
ggagcttgacatactcaaagactgg

SEQ ID NO: 703207 - DNA, 25 bp, Mus musculus
ggagcttgacattctcaaagactgg

SEQ ID NO: 703208 - DNA, 25 bp, Mus musculus
ggagcttgcaaacccggctacgctt

SEQ ID NO: 703209 - DNA, 25 bp, Mus musculus
ggagcttgcaaagccggctacgctt

SEQ ID NO: 703210 - DNA, 25 bp, Mus musculus
ggagcttgcacaaatctatgcacaa

SEQ ID NO: 703211 - DNA, 25 bp, Mus musculus
ggagcttgcacatatctatgcacaa

SEQ ID NO: 703212 - DNA, 25 bp, Mus musculus
ggagcttgccaaatagagagcccca

SEQ ID NO: 703213 - DNA, 25 bp, Mus musculus
ggagcttgccaattagagagcccca

SEQ ID NO: 703214 - DNA, 25 bp, Mus musculus
ggagcttgccatacagttgcataaa

SEQ ID NO: 703215 - DNA, 25 bp, Mus musculus
ggagcttgccattcagttgcataaa

SEQ ID NO: 703216 - DNA, 25 bp, Mus musculus
ggagcttgctttactgcacgctgct

SEQ ID NO: 703217 - DNA, 25 bp, Mus musculus
ggagcttgcttttctgcacgctgct

SEQ ID NO: 703218 - DNA, 25 bp, Mus musculus
ggagcttggtcaacaaatggaccac

SEQ ID NO: 703219 - DNA, 25 bp, Mus musculus
ggagcttggtcatcaaatggaccac

SEQ ID NO: 703220 - DNA, 25 bp, Mus musculus
ggagcttgtttcaatgattaagacc

SEQ ID NO: 703221 - DNA, 25 bp, Mus musculus
ggagcttgtttctatgattaagacc

SEQ ID NO: 703222 - DNA, 25 bp, Mus musculus
ggagctttacatcgatccatcaaaa

SEQ ID NO: 703223 - DNA, 25 bp, Mus musculus
ggagctttacatggatccatcaaaa

SEQ ID NO: 703224 - DNA, 25 bp, Mus musculus
ggagctttactgaagactggagtaa

SEQ ID NO: 703225 - DNA, 25 bp, Mus musculus
ggagctttactgtagactggagtaa

SEQ ID NO: 703226 - DNA, 25 bp, Mus musculus
ggagctttataccaagaaatttgcc

SEQ ID NO: 703227 - DNA, 25 bp, Mus musculus
ggagctttatacgaagaaatttgcc

SEQ ID NO: 703228 - DNA, 25 bp, Mus musculus
ggagctttcaatctgaccacaggac

SEQ ID NO: 703229 - DNA, 25 bp, Mus musculus
ggagctttcaatgtgaccacaggac

SEQ ID NO: 703230 - DNA, 25 bp, Mus musculus
ggagctttcaccagtgacgatgccg

SEQ ID NO: 703231 - DNA, 25 bp, Mus musculus
ggagctttcacctgtgacgatgccg

SEQ ID NO: 703232 - DNA, 25 bp, Mus musculus
ggagctttctggaagcagatggaaa

SEQ ID NO: 703233 - DNA, 25 bp, Mus musculus
ggagctttctggtagcagatggaaa

SEQ ID NO: 703234 - DNA, 25 bp, Mus musculus
ggagctttggcaaactcatgtggga

SEQ ID NO: 703235 - DNA, 25 bp, Mus musculus
ggagctttggcatactcatgtggga

SEQ ID NO: 703236 - DNA, 25 bp, Mus musculus
ggagctttgttcaggttgccttctc

SEQ ID NO: 703237 - DNA, 25 bp, Mus musculus
ggagctttgttctggttgccttctc

SEQ ID NO: 703238 - DNA, 25 bp, Mus musculus
ggagcttttccgaggtatcagtaac

SEQ ID NO: 703239 - DNA, 25 bp, Mus musculus
ggagcttttccgtggtatcagtaac

SEQ ID NO: 703240 - DNA, 25 bp, Mus musculus
ggaggaaaagctccaacggcacaca

SEQ ID NO: 703241 - DNA, 25 bp, Mus musculus
ggaggaaaagctgcaacggcacaca

SEQ ID NO: 703242 - DNA, 25 bp, Mus musculus
ggaggaaacaagacacaagtcctct

SEQ ID NO: 703243 - DNA, 25 bp, Mus musculus
ggaggaaacaagtcacaagtcctct

SEQ ID NO: 703244 - DNA, 25 bp, Mus musculus
ggaggaaacatcaattcgctatgtg

SEQ ID NO: 703245 - DNA, 25 bp, Mus musculus
ggaggaaacatctattcgctatgtg

SEQ ID NO: 703246 - DNA, 25 bp, Mus musculus
ggaggaaacttccatggtgaatacc

SEQ ID NO: 703247 - DNA, 25 bp, Mus musculus
ggaggaaacttcgatggtgaatacc

SEQ ID NO: 703248 - DNA, 25 bp, Mus musculus
ggaggaaagactccctattctgaac

SEQ ID NO: 703249 - DNA, 25 bp, Mus musculus
ggaggaaagactgcctattctgaac

SEQ ID NO: 703250 - DNA, 25 bp, Mus musculus
ggaggaaagatcaatcgtccccgga

SEQ ID NO: 703251 - DNA, 25 bp, Mus musculus
ggaggaaagatctatcgtccccgga

SEQ ID NO: 703252 - DNA, 25 bp, Mus musculus
ggaggaaagcctcggcactttccag

SEQ ID NO: 703253 - DNA, 25 bp, Mus musculus
ggaggaaagcctgggcactttccag

SEQ ID NO: 703254 - DNA, 25 bp, Mus musculus
ggaggaacatgcaaaaaggccaaca

SEQ ID NO: 703255 - DNA, 25 bp, Mus musculus
ggaggaacatgctaaaaggccaaca

SEQ ID NO: 703256 - DNA, 25 bp, Mus musculus
ggaggaaccgcccaacatggcatca

SEQ ID NO: 703257 - DNA, 25 bp, Mus musculus
ggaggaaccgccgaacatggcatca

SEQ ID NO: 703258 - DNA, 25 bp, Mus musculus
ggaggaagaaagaattgaacttcag

SEQ ID NO: 703259 - DNA, 25 bp, Mus musculus
ggaggaagaaagtattgaacttcag

SEQ ID NO: 703260 - DNA, 25 bp, Mus musculus
ggaggaagaagtatccacactgcgc

SEQ ID NO: 703261 - DNA, 25 bp, Mus musculus
ggaggaagaagtttccacactgcgc

SEQ ID NO: 703262 - DNA, 25 bp, Mus musculus
ggaggaagaatgcaactcagcgccc

SEQ ID NO: 703263 - DNA, 25 bp, Mus musculus
ggaggaagaatggaactcagcgccc

SEQ ID NO: 703264 - DNA, 25 bp, Mus musculus
ggaggaagagcgcatcctcactcag

SEQ ID NO: 703265 - DNA, 25 bp, Mus musculus
ggaggaagagcggatcctcactcag

SEQ ID NO: 703266 - DNA, 25 bp, Mus musculus
ggaggaagatgaaccggtccctgcc

SEQ ID NO: 703267 - DNA, 25 bp, Mus musculus
ggaggaagatgatccggtccctgcc

SEQ ID NO: 703268 - DNA, 25 bp, Mus musculus
ggaggaagccccatactgacctcct

SEQ ID NO: 703269 - DNA, 25 bp, Mus musculus
ggaggaagccccttactgacctcct

SEQ ID NO: 703270 - DNA, 25 bp, Mus musculus
ggaggaagcgacatcgctctctgca

SEQ ID NO: 703271 - DNA, 25 bp, Mus musculus
ggaggaagcgacttcgctctctgca

SEQ ID NO: 703272 - DNA, 25 bp, Mus musculus
ggaggaagcgccagtatcttctcac

SEQ ID NO: 703273 - DNA, 25 bp, Mus musculus
ggaggaagcgcctgtatcttctcac

SEQ ID NO: 703274 - DNA, 25 bp, Mus musculus
ggaggaaggaatagagacccaatat

SEQ ID NO: 703275 - DNA, 25 bp, Mus musculus
ggaggaaggaattgagacccaatat

SEQ ID NO: 703276 - DNA, 25 bp, Mus musculus
ggaggaaggttaaagccctgtatga

SEQ ID NO: 703277 - DNA, 25 bp, Mus musculus
ggaggaaggttatagccctgtatga

SEQ ID NO: 703278 - DNA, 25 bp, Mus musculus
ggaggaagtcagaagccgcctgtct

SEQ ID NO: 703279 - DNA, 25 bp, Mus musculus
ggaggaagtcagtagccgcctgtct

SEQ ID NO: 703280 - DNA, 25 bp, Mus musculus
ggaggaagttctcccgagcgctctc

SEQ ID NO: 703281 - DNA, 25 bp, Mus musculus
ggaggaagttctgccgagcgctctc

SEQ ID NO: 703282 - DNA, 25 bp, Mus musculus
ggaggaatatcactccctgatccgg

SEQ ID NO: 703283 - DNA, 25 bp, Mus musculus
ggaggaatatcagtccctgatccgg

SEQ ID NO: 703284 - DNA, 25 bp, Mus musculus
ggaggaatccttcaatgaagtaggc

SEQ ID NO: 703285 - DNA, 25 bp, Mus musculus
ggaggaatccttgaatgaagtaggc

SEQ ID NO: 703286 - DNA, 25 bp, Mus musculus
ggaggaatgtgcaaagtcccagctt

SEQ ID NO: 703287 - DNA, 25 bp, Mus musculus
ggaggaatgtgctaagtcccagctt

SEQ ID NO: 703288 - DNA, 25 bp, Mus musculus
ggaggaattctccttattcaaggtg

SEQ ID NO: 703289 - DNA, 25 bp, Mus musculus
ggaggaattctcgttattcaaggtg

SEQ ID NO: 703290 - DNA, 25 bp, Mus musculus
ggaggaatttctccgcacctatgct

SEQ ID NO: 703291 - DNA, 25 bp, Mus musculus
ggaggaatttctgcgcacctatgct

SEQ ID NO: 703292 - DNA, 25 bp, Mus musculus
ggaggacaagatcccactgctggtc

SEQ ID NO: 703293 - DNA, 25 bp, Mus musculus
ggaggacaagatgccactgctggtc

SEQ ID NO: 703294 - DNA, 25 bp, Mus musculus
ggaggacacaatcgcccaggtactc

SEQ ID NO: 703295 - DNA, 25 bp, Mus musculus
ggaggacacaatggcccaggtactc

SEQ ID NO: 703296 - DNA, 25 bp, Mus musculus
ggaggacactgaatgaacccttcac

SEQ ID NO: 703297 - DNA, 25 bp, Mus musculus
ggaggacactgattgaacccttcac

SEQ ID NO: 703298 - DNA, 25 bp, Mus musculus
ggaggacagcagcaacatgtttgcc

SEQ ID NO: 703299 - DNA, 25 bp, Mus musculus
ggaggacagcaggaacatgtttgcc

SEQ ID NO: 703300 - DNA, 25 bp, Mus musculus
ggaggacatcaactatgcctctcag

SEQ ID NO: 703301 - DNA, 25 bp, Mus musculus
ggaggacatcaagtatgcctctcag

SEQ ID NO: 703302 - DNA, 25 bp, Mus musculus
ggaggacatcacatatcgactgccg

SEQ ID NO: 703303 - DNA, 25 bp, Mus musculus
ggaggacatcacttatcgactgccg

SEQ ID NO: 703304 - DNA, 25 bp, Mus musculus
ggaggacatcttactaatactgtaa

SEQ ID NO: 703305 - DNA, 25 bp, Mus musculus
ggaggacatcttccagctcattaac

SEQ ID NO: 703306 - DNA, 25 bp, Mus musculus
ggaggacatcttgcagctcattaac

SEQ ID NO: 703307 - DNA, 25 bp, Mus musculus
ggaggacatctttctaatactgtaa

SEQ ID NO: 703308 - DNA, 25 bp, Mus musculus
ggaggacatgtaagctcaggactct

SEQ ID NO: 703309 - DNA, 25 bp, Mus musculus
ggaggacatgtatgctcaggactct

SEQ ID NO: 703310 - DNA, 25 bp, Mus musculus
ggaggacattacagccatgcgtaac

SEQ ID NO: 703311 - DNA, 25 bp, Mus musculus
ggaggacattactgccatgcgtaac

SEQ ID NO: 703312 - DNA, 25 bp, Mus musculus
ggaggaccaccacgtcatctcggtc

SEQ ID NO: 703313 - DNA, 25 bp, Mus musculus
ggaggaccaccaggtcatctcggtc

SEQ ID NO: 703314 - DNA, 25 bp, Mus musculus
ggaggaccaggcactaattctactg

SEQ ID NO: 703315 - DNA, 25 bp, Mus musculus
ggaggaccaggctctaattctactg

SEQ ID NO: 703316 - DNA, 25 bp, Mus musculus
ggaggacctctcaaaactcttcaag

SEQ ID NO: 703317 - DNA, 25 bp, Mus musculus
ggaggacctctctaaactcttcaag

SEQ ID NO: 703318 - DNA, 25 bp, Mus musculus
ggaggacctggccactctcattcag

SEQ ID NO: 703319 - DNA, 25 bp, Mus musculus
ggaggacctggcgactctcattcag

SEQ ID NO: 703320 - DNA, 25 bp, Mus musculus
ggaggacgctccatgtcctggaagc

SEQ ID NO: 703321 - DNA, 25 bp, Mus musculus
ggaggacgctccttgtcctggaagc

SEQ ID NO: 703322 - DNA, 25 bp, Mus musculus
ggaggacggagtctttgacatccac

SEQ ID NO: 703323 - DNA, 25 bp, Mus musculus
ggaggacggagtgtttgacatccac

SEQ ID NO: 703324 - DNA, 25 bp, Mus musculus
ggaggactacttaacggccacagag

SEQ ID NO: 703325 - DNA, 25 bp, Mus musculus
ggaggactactttacggccacagag

SEQ ID NO: 703326 - DNA, 25 bp, Mus musculus
ggaggactatccaggaatcgtgaac

SEQ ID NO: 703327 - DNA, 25 bp, Mus musculus
ggaggactatcctggaatcgtgaac

SEQ ID NO: 703328 - DNA, 25 bp, Mus musculus
ggaggactccgccatcaaatgcgag

SEQ ID NO: 703329 - DNA, 25 bp, Mus musculus
ggaggactccgcgatcaaatgcgag

SEQ ID NO: 703330 - DNA, 25 bp, Mus musculus
ggaggactccggaatctatcagtgt

SEQ ID NO: 703331 - DNA, 25 bp, Mus musculus
ggaggactccggtatctatcagtgt

SEQ ID NO: 703332 - DNA, 25 bp, Mus musculus
ggaggactgccaaggtcacacaaag

SEQ ID NO: 703333 - DNA, 25 bp, Mus musculus
ggaggactgccatggtcacacaaag

SEQ ID NO: 703334 - DNA, 25 bp, Mus musculus
ggaggactgtctaccactgcctgga

SEQ ID NO: 703335 - DNA, 25 bp, Mus musculus
ggaggactgtcttccactgcctgga

SEQ ID NO: 703336 - DNA, 25 bp, Mus musculus
ggaggacttagaagatctaacctct

SEQ ID NO: 703337 - DNA, 25 bp, Mus musculus
ggaggacttagatgatctaacctct

SEQ ID NO: 703338 - DNA, 25 bp, Mus musculus
ggaggacttatcaatggcaattact

SEQ ID NO: 703339 - DNA, 25 bp, Mus musculus
ggaggacttatctatggcaattact

SEQ ID NO: 703340 - DNA, 25 bp, Mus musculus
ggaggactttccactgatcgagaca

SEQ ID NO: 703341 - DNA, 25 bp, Mus musculus
ggaggactttcctctgatcgagaca

SEQ ID NO: 703342 - DNA, 25 bp, Mus musculus
ggaggactttgtagacaacgtgaag

SEQ ID NO: 703343 - DNA, 25 bp, Mus musculus
ggaggactttgttgacaacgtgaag

SEQ ID NO: 703344 - DNA, 25 bp, Mus musculus
ggaggagaaactactgcctgtgcta

SEQ ID NO: 703345 - DNA, 25 bp, Mus musculus
ggaggagaaacttctgcctgtgcta

SEQ ID NO: 703346 - DNA, 25 bp, Mus musculus
ggaggagaacccagcatatgatagg

SEQ ID NO: 703347 - DNA, 25 bp, Mus musculus
ggaggagaaccctgcatatgatagg

SEQ ID NO: 703348 - DNA, 25 bp, Mus musculus
ggaggagaagatcacgacattttta

SEQ ID NO: 703349 - DNA, 25 bp, Mus musculus
ggaggagaagatgacgacattttta

SEQ ID NO: 703350 - DNA, 25 bp, Mus musculus
ggaggagaatcaagatgctgcagtt

SEQ ID NO: 703351 - DNA, 25 bp, Mus musculus
ggaggagaatcatgatgctgcagtt

SEQ ID NO: 703352 - DNA, 25 bp, Mus musculus
ggaggagaccaactgcagacttgct

SEQ ID NO: 703353 - DNA, 25 bp, Mus musculus
ggaggagaccaagtgcagacttgct

SEQ ID NO: 703354 - DNA, 25 bp, Mus musculus
ggaggagacccaacacctggtggaa

SEQ ID NO: 703355 - DNA, 25 bp, Mus musculus
ggaggagacccatcacctggtggaa

SEQ ID NO: 703356 - DNA, 25 bp, Mus musculus
ggaggagactcacccacgagtgaaa

SEQ ID NO: 703357 - DNA, 25 bp, Mus musculus
ggaggagactcagccacgagtgaaa

SEQ ID NO: 703358 - DNA, 25 bp, Mus musculus
ggaggagactcgaatccacattcta

SEQ ID NO: 703359 - DNA, 25 bp, Mus musculus
ggaggagactcgtatccacattcta

SEQ ID NO: 703360 - DNA, 25 bp, Mus musculus
ggaggagattgccatagctgctact

SEQ ID NO: 703361 - DNA, 25 bp, Mus musculus
ggaggagattgcgatagctgctact

SEQ ID NO: 703362 - DNA, 25 bp, Mus musculus
ggaggagcacaacagcgttatcatg

SEQ ID NO: 703363 - DNA, 25 bp, Mus musculus
ggaggagcacaagagcgttatcatg

SEQ ID NO: 703364 - DNA, 25 bp, Mus musculus
ggaggagcatgtcccctgccactgt

SEQ ID NO: 703365 - DNA, 25 bp, Mus musculus
ggaggagcatgtgccctgccactgt

SEQ ID NO: 703366 - DNA, 25 bp, Mus musculus
ggaggagccaaaacagaaagcctgg

SEQ ID NO: 703367 - DNA, 25 bp, Mus musculus
ggaggagccaaatcagaaagcctgg

SEQ ID NO: 703368 - DNA, 25 bp, Mus musculus
ggaggagcctcgattccaggtccct

SEQ ID NO: 703369 - DNA, 25 bp, Mus musculus
ggaggagcctcgtttccaggtccct

SEQ ID NO: 703370 - DNA, 25 bp, Mus musculus
ggaggagctagccaacgtcctttga

SEQ ID NO: 703371 - DNA, 25 bp, Mus musculus
ggaggagctagcgaacgtcctttga

SEQ ID NO: 703372 - DNA, 25 bp, Mus musculus
ggaggagctattagagatcatgcat

SEQ ID NO: 703373 - DNA, 25 bp, Mus musculus
ggaggagctatttgagatcatgcat

SEQ ID NO: 703374 - DNA, 25 bp, Mus musculus
ggaggagctgtcagatctctgttct

SEQ ID NO: 703375 - DNA, 25 bp, Mus musculus
ggaggagctgtctgatctctgttct

SEQ ID NO: 703376 - DNA, 25 bp, Mus musculus
ggaggagctgttcggtactaaatca

SEQ ID NO: 703377 - DNA, 25 bp, Mus musculus
ggaggagctgttgggtactaaatca

SEQ ID NO: 703378 - DNA, 25 bp, Mus musculus
ggaggagcttgacttccagaagaac

SEQ ID NO: 703379 - DNA, 25 bp, Mus musculus
ggaggagcttgagttccagaagaac

SEQ ID NO: 703380 - DNA, 25 bp, Mus musculus
ggaggaggccacataccttctggag

SEQ ID NO: 703381 - DNA, 25 bp, Mus musculus
ggaggaggccacttaccttctggag

SEQ ID NO: 703382 - DNA, 25 bp, Mus musculus
ggaggaggcctcaactcactacaga

SEQ ID NO: 703383 - DNA, 25 bp, Mus musculus
ggaggaggcctctactcactacaga

SEQ ID NO: 703384 - DNA, 25 bp, Mus musculus
ggaggaggcggaacccctcagaatc

SEQ ID NO: 703385 - DNA, 25 bp, Mus musculus
ggaggaggcggatcccctcagaatc

SEQ ID NO: 703386 - DNA, 25 bp, Mus musculus
ggaggagggcatcgctttcaccata

SEQ ID NO: 703387 - DNA, 25 bp, Mus musculus
ggaggagggcatggctttcaccata

SEQ ID NO: 703388 - DNA, 25 bp, Mus musculus
ggaggagtcagaaacaccaagcagt

SEQ ID NO: 703389 - DNA, 25 bp, Mus musculus
ggaggagtcagatacaccaagcagt

SEQ ID NO: 703390 - DNA, 25 bp, Mus musculus
ggaggagtccccatttttgttcaat

SEQ ID NO: 703391 - DNA, 25 bp, Mus musculus
ggaggagtccccttttttgttcaat

SEQ ID NO: 703392 - DNA, 25 bp, Mus musculus
ggaggagttaacagggcaaaagcaa

SEQ ID NO: 703393 - DNA, 25 bp, Mus musculus
ggaggagttaactgggcaaaagcaa

SEQ ID NO: 703394 - DNA, 25 bp, Mus musculus
ggaggatagtagatgtgacaaaaac

SEQ ID NO: 703395 - DNA, 25 bp, Mus musculus
ggaggatagtagttgtgacaaaaac

SEQ ID NO: 703396 - DNA, 25 bp, Mus musculus
ggaggatcctgtcagatcacaacag

SEQ ID NO: 703397 - DNA, 25 bp, Mus musculus
ggaggatcctgtgagatcacaacag

SEQ ID NO: 703398 - DNA, 25 bp, Mus musculus
ggaggatcggcaagaagaagacaac

SEQ ID NO: 703399 - DNA, 25 bp, Mus musculus
ggaggatcggcatgaagaagacaac

SEQ ID NO: 703400 - DNA, 25 bp, Mus musculus
ggaggatgaactagagcagtcacag

SEQ ID NO: 703401 - DNA, 25 bp, Mus musculus
ggaggatgaacttgagcagtcacag

SEQ ID NO: 703402 - DNA, 25 bp, Mus musculus
ggaggatgagctaaagccatttgtt

SEQ ID NO: 703403 - DNA, 25 bp, Mus musculus
ggaggatgagcttaagccatttgtt

SEQ ID NO: 703404 - DNA, 25 bp, Mus musculus
ggaggatgcaacattacagcaatac

SEQ ID NO: 703405 - DNA, 25 bp, Mus musculus
ggaggatgcaactttacagcaatac

SEQ ID NO: 703406 - DNA, 25 bp, Mus musculus
ggaggatgccccatccgtggacatt

SEQ ID NO: 703407 - DNA, 25 bp, Mus musculus
ggaggatgccccttccgtggacatt

SEQ ID NO: 703408 - DNA, 25 bp, Mus musculus
ggaggatgccctacagtcgaggcca

SEQ ID NO: 703409 - DNA, 25 bp, Mus musculus
ggaggatgcccttcagtcgaggcca

SEQ ID NO: 703410 - DNA, 25 bp, Mus musculus
ggaggatgccttctatacactagtc

SEQ ID NO: 703411 - DNA, 25 bp, Mus musculus
ggaggatgccttgtatacactagtc

SEQ ID NO: 703412 - DNA, 25 bp, Mus musculus
ggaggattggccatttaccattaaa

SEQ ID NO: 703413 - DNA, 25 bp, Mus musculus
ggaggattggccttttaccattaaa

SEQ ID NO: 703414 - DNA, 25 bp, Mus musculus
ggaggatttcatagcacagccggct

SEQ ID NO: 703415 - DNA, 25 bp, Mus musculus
ggaggatttcattgcacagccggct

SEQ ID NO: 703416 - DNA, 25 bp, Mus musculus
ggaggattttcacacagatctgtct

SEQ ID NO: 703417 - DNA, 25 bp, Mus musculus
ggaggattttcagacagatctgtct

SEQ ID NO: 703418 - DNA, 25 bp, Mus musculus
ggaggcaaaaccataggccagttta

SEQ ID NO: 703419 - DNA, 25 bp, Mus musculus
ggaggcaaaaccttaggccagttta

SEQ ID NO: 703420 - DNA, 25 bp, Mus musculus
ggaggcaaacatctgttttacaggt

SEQ ID NO: 703421 - DNA, 25 bp, Mus musculus
ggaggcaaacatgtgttttacaggt

SEQ ID NO: 703422 - DNA, 25 bp, Mus musculus
ggaggcaagaaactatgccagcagt

SEQ ID NO: 703423 - DNA, 25 bp, Mus musculus
ggaggcaagaaagtatgccagcagt

SEQ ID NO: 703424 - DNA, 25 bp, Mus musculus
ggaggcaagcataagggtaaagacc

SEQ ID NO: 703425 - DNA, 25 bp, Mus musculus
ggaggcaagcattagggtaaagacc

SEQ ID NO: 703426 - DNA, 25 bp, Mus musculus
ggaggcaagttgattctgtccctgg

SEQ ID NO: 703427 - DNA, 25 bp, Mus musculus
ggaggcaagttgtttctgtccctgg

SEQ ID NO: 703428 - DNA, 25 bp, Mus musculus
ggaggcaatatcaagatgttttccc

SEQ ID NO: 703429 - DNA, 25 bp, Mus musculus
ggaggcaatatctagatgttttccc

SEQ ID NO: 703430 - DNA, 25 bp, Mus musculus
ggaggcaatgagacgagcatctact

SEQ ID NO: 703431 - DNA, 25 bp, Mus musculus
ggaggcaatgagtcgagcatctact

SEQ ID NO: 703432 - DNA, 25 bp, Mus musculus
ggaggcacatttaccataccattct

SEQ ID NO: 703433 - DNA, 25 bp, Mus musculus
ggaggcacattttccataccattct

SEQ ID NO: 703434 - DNA, 25 bp, Mus musculus
ggaggcaccaaaccaagacgcacct

SEQ ID NO: 703435 - DNA, 25 bp, Mus musculus
ggaggcaccaaagcaagacgcacct

SEQ ID NO: 703436 - DNA, 25 bp, Mus musculus
ggaggcacctgcctgaggctatctc

SEQ ID NO: 703437 - DNA, 25 bp, Mus musculus
ggaggcacctgcgtgaggctatctc

SEQ ID NO: 703438 - DNA, 25 bp, Mus musculus
ggaggcactttaacatacaatttgt

SEQ ID NO: 703439 - DNA, 25 bp, Mus musculus
ggaggcactttatcatacaatttgt

SEQ ID NO: 703440 - DNA, 25 bp, Mus musculus
ggaggcagataaacctttctcctgg

SEQ ID NO: 703441 - DNA, 25 bp, Mus musculus
ggaggcagataatcctttctcctgg

SEQ ID NO: 703442 - DNA, 25 bp, Mus musculus
ggaggcagccatcactgatttaagc

SEQ ID NO: 703443 - DNA, 25 bp, Mus musculus
ggaggcagccatgactgatttaagc

SEQ ID NO: 703444 - DNA, 25 bp, Mus musculus
ggaggcagctgcaagcctgacctgc

SEQ ID NO: 703445 - DNA, 25 bp, Mus musculus
ggaggcagctgctagcctgacctgc

SEQ ID NO: 703446 - DNA, 25 bp, Mus musculus
ggaggcagggaccacctctatgtct

SEQ ID NO: 703447 - DNA, 25 bp, Mus musculus
ggaggcagggacgacctctatgtct

SEQ ID NO: 703448 - DNA, 25 bp, Mus musculus
ggaggcaggtcactttgcacactta

SEQ ID NO: 703449 - DNA, 25 bp, Mus musculus
ggaggcaggtcagtttgcacactta

SEQ ID NO: 703450 - DNA, 25 bp, Mus musculus
ggaggcagtcgcacttcatttgtgc

SEQ ID NO: 703451 - DNA, 25 bp, Mus musculus
ggaggcagtcgctcttcatttgtgc

SEQ ID NO: 703452 - DNA, 25 bp, Mus musculus
ggaggcagtgttctgcatcctcagt

SEQ ID NO: 703453 - DNA, 25 bp, Mus musculus
ggaggcagtgttgtgcatcctcagt

SEQ ID NO: 703454 - DNA, 25 bp, Mus musculus
ggaggcataagcactgagatggaac

SEQ ID NO: 703455 - DNA, 25 bp, Mus musculus
ggaggcataagctctgagatggaac

SEQ ID NO: 703456 - DNA, 25 bp, Mus musculus
ggaggcatgttgacttctacccaac

SEQ ID NO: 703457 - DNA, 25 bp, Mus musculus
ggaggcatgttgtcttctacccaac

SEQ ID NO: 703458 - DNA, 25 bp, Mus musculus
ggaggccaaaaacgaagtgacatta

SEQ ID NO: 703459 - DNA, 25 bp, Mus musculus
ggaggccaaaaaggaagtgacatta

SEQ ID NO: 703460 - DNA, 25 bp, Mus musculus
ggaggccacagcacacggtctgagc

SEQ ID NO: 703461 - DNA, 25 bp, Mus musculus
ggaggccacagctcacggtctgagc

SEQ ID NO: 703462 - DNA, 25 bp, Mus musculus
ggaggccacataccttctggagcag

SEQ ID NO: 703463 - DNA, 25 bp, Mus musculus
ggaggccacatagcttctggagcag

SEQ ID NO: 703464 - DNA, 25 bp, Mus musculus
ggaggccaccttagcagagtatgaa

SEQ ID NO: 703465 - DNA, 25 bp, Mus musculus
ggaggccacctttgcagagtatgaa

SEQ ID NO: 703466 - DNA, 25 bp, Mus musculus
ggaggccactgcactgcccatggat

SEQ ID NO: 703467 - DNA, 25 bp, Mus musculus
ggaggccactgctctgcccatggat

SEQ ID NO: 703468 - DNA, 25 bp, Mus musculus
ggaggccatgcaaatcttaaggaat

SEQ ID NO: 703469 - DNA, 25 bp, Mus musculus
ggaggccatgcatatcttaaggaat

SEQ ID NO: 703470 - DNA, 25 bp, Mus musculus
ggaggcccacctcgagctgaatgcc

SEQ ID NO: 703471 - DNA, 25 bp, Mus musculus
ggaggcccacctggagctgaatgcc

SEQ ID NO: 703472 - DNA, 25 bp, Mus musculus
ggaggcccagagcaaattcaccaag

SEQ ID NO: 703473 - DNA, 25 bp, Mus musculus
ggaggcccagaggaaattcaccaag

SEQ ID NO: 703474 - DNA, 25 bp, Mus musculus
ggaggcccagtactgtaatccttat

SEQ ID NO: 703475 - DNA, 25 bp, Mus musculus
ggaggcccagtagtgtaatccttat

SEQ ID NO: 703476 - DNA, 25 bp, Mus musculus
ggaggccccacacatgaactatatc

SEQ ID NO: 703477 - DNA, 25 bp, Mus musculus
ggaggccccacagatgaactatatc

SEQ ID NO: 703478 - DNA, 25 bp, Mus musculus
ggaggccccgaactgacagcctgat

SEQ ID NO: 703479 - DNA, 25 bp, Mus musculus
ggaggccccgaagtgacagcctgat

SEQ ID NO: 703480 - DNA, 25 bp, Mus musculus
ggaggccccgtaatccatgacagcg

SEQ ID NO: 703481 - DNA, 25 bp, Mus musculus
ggaggccccgtattccatgacagcg

SEQ ID NO: 703482 - DNA, 25 bp, Mus musculus
ggaggccctacacaaacagatggac

SEQ ID NO: 703483 - DNA, 25 bp, Mus musculus
ggaggccctacagaaacagatggac

SEQ ID NO: 703484 - DNA, 25 bp, Mus musculus
ggaggccctagaagtgtctctgagc

SEQ ID NO: 703485 - DNA, 25 bp, Mus musculus
ggaggccctagatgtgtctctgagc

SEQ ID NO: 703486 - DNA, 25 bp, Mus musculus
ggaggccctcctagagagtaagtaa

SEQ ID NO: 703487 - DNA, 25 bp, Mus musculus
ggaggccctcctattgtgggcccag

SEQ ID NO: 703488 - DNA, 25 bp, Mus musculus
ggaggccctccttgagagtaagtaa

SEQ ID NO: 703489 - DNA, 25 bp, Mus musculus
ggaggccctccttttgtgggcccag

SEQ ID NO: 703490 - DNA, 25 bp, Mus musculus
ggaggccctggaaaacgtgttcttc

SEQ ID NO: 703491 - DNA, 25 bp, Mus musculus
ggaggccctggataacgtgttcttc

SEQ ID NO: 703492 - DNA, 25 bp, Mus musculus
ggaggccgacagaaccaccaaatga

SEQ ID NO: 703493 - DNA, 25 bp, Mus musculus
ggaggccgacagtaccaccaaatga

SEQ ID NO: 703494 - DNA, 25 bp, Mus musculus
ggaggccgcacacagcaaccgcatt

SEQ ID NO: 703495 - DNA, 25 bp, Mus musculus
ggaggccgcacagagcaaccgcatt

SEQ ID NO: 703496 - DNA, 25 bp, Mus musculus
ggaggccgccagaagtacaagcgac

SEQ ID NO: 703497 - DNA, 25 bp, Mus musculus
ggaggccgccagtagtacaagcgac

SEQ ID NO: 703498 - DNA, 25 bp, Mus musculus
ggaggccgcggcacaaaatcagcgt

SEQ ID NO: 703499 - DNA, 25 bp, Mus musculus
ggaggccgcggctcaaaatcagcgt

SEQ ID NO: 703500 - DNA, 25 bp, Mus musculus
ggaggccgctcaagctgccttccag

SEQ ID NO: 703501 - DNA, 25 bp, Mus musculus
ggaggccgctcatgctgccttccag

SEQ ID NO: 703502 - DNA, 25 bp, Mus musculus
ggaggcctatgaagtcaccttacag

SEQ ID NO: 703503 - DNA, 25 bp, Mus musculus
ggaggcctatgatgtcaccttacag

SEQ ID NO: 703504 - DNA, 25 bp, Mus musculus
ggaggcctcgataccgctattatca

SEQ ID NO: 703505 - DNA, 25 bp, Mus musculus
ggaggcctcgattccgctattatca

SEQ ID NO: 703506 - DNA, 25 bp, Mus musculus
ggaggcctctcaatcggttcagttg

SEQ ID NO: 703507 - DNA, 25 bp, Mus musculus
ggaggcctctcattcggttcagttg

SEQ ID NO: 703508 - DNA, 25 bp, Mus musculus
ggaggcctgactacccttgcctgct

SEQ ID NO: 703509 - DNA, 25 bp, Mus musculus
ggaggcctgacttcccttgcctgct

SEQ ID NO: 703510 - DNA, 25 bp, Mus musculus
ggaggcctgtagagccctcaaacca

SEQ ID NO: 703511 - DNA, 25 bp, Mus musculus
ggaggcctgtagtgccctcaaacca

SEQ ID NO: 703512 - DNA, 25 bp, Mus musculus
ggaggcctgtgaacactccagtgag

SEQ ID NO: 703513 - DNA, 25 bp, Mus musculus
ggaggcctgtgatcactccagtgag

SEQ ID NO: 703514 - DNA, 25 bp, Mus musculus
ggaggccttcttcggctctgtagca

SEQ ID NO: 703515 - DNA, 25 bp, Mus musculus
ggaggccttcttgggctctgtagca

SEQ ID NO: 703516 - DNA, 25 bp, Mus musculus
ggaggcgcactgaagaaaggtccct

SEQ ID NO: 703517 - DNA, 25 bp, Mus musculus
ggaggcgcactgtagaaaggtccct

SEQ ID NO: 703518 - DNA, 25 bp, Mus musculus
ggaggcgccttgactttatacactg

SEQ ID NO: 703519 - DNA, 25 bp, Mus musculus
ggaggcgccttgtctttatacactg

SEQ ID NO: 703520 - DNA, 25 bp, Mus musculus
ggaggcgggaaaccctctctccata

SEQ ID NO: 703521 - DNA, 25 bp, Mus musculus
ggaggcgggaaagcctctctccata

SEQ ID NO: 703522 - DNA, 25 bp, Mus musculus
ggaggcgtcgccatcatcgatcagt

SEQ ID NO: 703523 - DNA, 25 bp, Mus musculus
ggaggcgtcgccttcatcgatcagt

SEQ ID NO: 703524 - DNA, 25 bp, Mus musculus
ggaggctaatcaccaatttcttatt

SEQ ID NO: 703525 - DNA, 25 bp, Mus musculus
ggaggctaatcagcaatttcttatt

SEQ ID NO: 703526 - DNA, 25 bp, Mus musculus
ggaggctacagaactacgacagtca

SEQ ID NO: 703527 - DNA, 25 bp, Mus musculus
ggaggctacagatctacgacagtca

SEQ ID NO: 703528 - DNA, 25 bp, Mus musculus
ggaggctacagcctatccgtgccaa

SEQ ID NO: 703529 - DNA, 25 bp, Mus musculus
ggaggctacagcgtatccgtgccaa

SEQ ID NO: 703530 - DNA, 25 bp, Mus musculus
ggaggctatggcctttgtaactgaa

SEQ ID NO: 703531 - DNA, 25 bp, Mus musculus
ggaggctatggcgtttgtaactgaa

SEQ ID NO: 703532 - DNA, 25 bp, Mus musculus
ggaggctcaagccactgtggacatc

SEQ ID NO: 703533 - DNA, 25 bp, Mus musculus
ggaggctcaagcgactgtggacatc

SEQ ID NO: 703534 - DNA, 25 bp, Mus musculus
ggaggctcaatccagaccagtgtga

SEQ ID NO: 703535 - DNA, 25 bp, Mus musculus
ggaggctcaatcgagaccagtgtga

SEQ ID NO: 703536 - DNA, 25 bp, Mus musculus
ggaggctcacgcagcagattctggc

SEQ ID NO: 703537 - DNA, 25 bp, Mus musculus
ggaggctcacgctgcagattctggc

SEQ ID NO: 703538 - DNA, 25 bp, Mus musculus
ggaggctcagatagaccactcagta

SEQ ID NO: 703539 - DNA, 25 bp, Mus musculus
ggaggctcagattgaccactcagta

SEQ ID NO: 703540 - DNA, 25 bp, Mus musculus
ggaggctcatagcaccatcctgagc

SEQ ID NO: 703541 - DNA, 25 bp, Mus musculus
ggaggctcataggaccatcctgagc

SEQ ID NO: 703542 - DNA, 25 bp, Mus musculus
ggaggctcccacaatttcttcagca

SEQ ID NO: 703543 - DNA, 25 bp, Mus musculus
ggaggctcccactatttcttcagca

SEQ ID NO: 703544 - DNA, 25 bp, Mus musculus
ggaggctccctcaatggtgaaaaag

SEQ ID NO: 703545 - DNA, 25 bp, Mus musculus
ggaggctccctctatggtgaaaaag

SEQ ID NO: 703546 - DNA, 25 bp, Mus musculus
ggaggctcctgtcacatttgtcaga

SEQ ID NO: 703547 - DNA, 25 bp, Mus musculus
ggaggctcctgtgacatttgtcaga

SEQ ID NO: 703548 - DNA, 25 bp, Mus musculus
ggaggctccttcatcatcgtcctga

SEQ ID NO: 703549 - DNA, 25 bp, Mus musculus
ggaggctccttcttcatcgtcctga

SEQ ID NO: 703550 - DNA, 25 bp, Mus musculus
ggaggctcttccatgctgccgctgt

SEQ ID NO: 703551 - DNA, 25 bp, Mus musculus
ggaggctcttccttgctgccgctgt

SEQ ID NO: 703552 - DNA, 25 bp, Mus musculus
ggaggctgccctagtgccaatgagc

SEQ ID NO: 703553 - DNA, 25 bp, Mus musculus
ggaggctgcccttgtgccaatgagc

SEQ ID NO: 703554 - DNA, 25 bp, Mus musculus
ggaggctgccttcactctcattgga

SEQ ID NO: 703555 - DNA, 25 bp, Mus musculus
ggaggctgccttgactctcattgga

SEQ ID NO: 703556 - DNA, 25 bp, Mus musculus
ggaggctgcggcacccggaacaaca

SEQ ID NO: 703557 - DNA, 25 bp, Mus musculus
ggaggctgcggctcccggaacaaca

SEQ ID NO: 703558 - DNA, 25 bp, Mus musculus
ggaggctgcttcatcccggatgacc

SEQ ID NO: 703559 - DNA, 25 bp, Mus musculus
ggaggctgcttcttcccggatgacc

SEQ ID NO: 703560 - DNA, 25 bp, Mus musculus
ggaggctgtcctatgacaccaccac

SEQ ID NO: 703561 - DNA, 25 bp, Mus musculus
ggaggctgtcctttgacaccaccac

SEQ ID NO: 703562 - DNA, 25 bp, Mus musculus
ggaggcttatgactgccctgctaac

SEQ ID NO: 703563 - DNA, 25 bp, Mus musculus
ggaggcttatgagtgccctgctaac

SEQ ID NO: 703564 - DNA, 25 bp, Mus musculus
ggaggcttatgtccctggctttgcc

SEQ ID NO: 703565 - DNA, 25 bp, Mus musculus
ggaggcttatgtgcctggctttgcc

SEQ ID NO: 703566 - DNA, 25 bp, Mus musculus
ggaggcttgtatcggccctcatttc

SEQ ID NO: 703567 - DNA, 25 bp, Mus musculus
ggaggcttgtatgggccctcatttc

SEQ ID NO: 703568 - DNA, 25 bp, Mus musculus
ggaggctttttcaggaaccgctgat

SEQ ID NO: 703569 - DNA, 25 bp, Mus musculus
ggaggctttttctggaaccgctgat

SEQ ID NO: 703570 - DNA, 25 bp, Mus musculus
ggagggaaagacagaagtccttgca

SEQ ID NO: 703571 - DNA, 25 bp, Mus musculus
ggagggaaagactgaagtccttgca

SEQ ID NO: 703572 - DNA, 25 bp, Mus musculus
ggagggaactttccgcagctccatc

SEQ ID NO: 703573 - DNA, 25 bp, Mus musculus
ggagggaactttgcgcagctccatc

SEQ ID NO: 703574 - DNA, 25 bp, Mus musculus
ggagggagaccacagtgacccatca

SEQ ID NO: 703575 - DNA, 25 bp, Mus musculus
ggagggagaccagagtgacccatca

SEQ ID NO: 703576 - DNA, 25 bp, Mus musculus
ggagggagatcccaaaccacgtgct

SEQ ID NO: 703577 - DNA, 25 bp, Mus musculus
ggagggagatccgaaaccacgtgct

SEQ ID NO: 703578 - DNA, 25 bp, Mus musculus
ggagggagcctacgatctagcaaat

SEQ ID NO: 703579 - DNA, 25 bp, Mus musculus
ggagggagcctaggatctagcaaat

SEQ ID NO: 703580 - DNA, 25 bp, Mus musculus
ggagggaggctgacctatgacacca

SEQ ID NO: 703581 - DNA, 25 bp, Mus musculus
ggagggaggctgtcctatgacacca

SEQ ID NO: 703582 - DNA, 25 bp, Mus musculus
ggagggatgcgaatccacggcaact

SEQ ID NO: 703583 - DNA, 25 bp, Mus musculus
ggagggatgcgattccacggcaact

SEQ ID NO: 703584 - DNA, 25 bp, Mus musculus
ggagggcaaggacagaggcccctct

SEQ ID NO: 703585 - DNA, 25 bp, Mus musculus
ggagggcaaggagagaggcccctct

SEQ ID NO: 703586 - DNA, 25 bp, Mus musculus
ggagggcaatagattaaacttcacc

SEQ ID NO: 703587 - DNA, 25 bp, Mus musculus
ggagggcaatagtttaaacttcacc

SEQ ID NO: 703588 - DNA, 25 bp, Mus musculus
ggagggcactaactatcactgagga

SEQ ID NO: 703589 - DNA, 25 bp, Mus musculus
ggagggcactaagtatcactgagga

SEQ ID NO: 703590 - DNA, 25 bp, Mus musculus
ggagggcaggccatccatcttggaa

SEQ ID NO: 703591 - DNA, 25 bp, Mus musculus
ggagggcaggccttccatcttggaa

SEQ ID NO: 703592 - DNA, 25 bp, Mus musculus
ggagggcatgttccgcaagctcaac

SEQ ID NO: 703593 - DNA, 25 bp, Mus musculus
ggagggcatgttgcgcaagctcaac

SEQ ID NO: 703594 - DNA, 25 bp, Mus musculus
ggagggccagagatcactcccaaca

SEQ ID NO: 703595 - DNA, 25 bp, Mus musculus
ggagggccagagttcactcccaaca

SEQ ID NO: 703596 - DNA, 25 bp, Mus musculus
ggagggccccaactatcaatggatg

SEQ ID NO: 703597 - DNA, 25 bp, Mus musculus
ggagggccccaagtatcaatggatg

SEQ ID NO: 703598 - DNA, 25 bp, Mus musculus
ggagggcccggactccaaacttcat

SEQ ID NO: 703599 - DNA, 25 bp, Mus musculus
ggagggcccggagtccaaacttcat

SEQ ID NO: 703600 - DNA, 25 bp, Mus musculus
ggagggctctcaataacaaggtcta

SEQ ID NO: 703601 - DNA, 25 bp, Mus musculus
ggagggctctcattaacaaggtcta

SEQ ID NO: 703602 - DNA, 25 bp, Mus musculus
ggagggctgcatacaccatcatcaa

SEQ ID NO: 703603 - DNA, 25 bp, Mus musculus
ggagggctgcattcaccatcatcaa

SEQ ID NO: 703604 - DNA, 25 bp, Mus musculus
ggagggcttcaactatgaactggaa

SEQ ID NO: 703605 - DNA, 25 bp, Mus musculus
ggagggcttcaagtatgaactggaa

SEQ ID NO: 703606 - DNA, 25 bp, Mus musculus
ggagggcttcacaacccaggaggac

SEQ ID NO: 703607 - DNA, 25 bp, Mus musculus
ggagggcttcactacccaggaggac

SEQ ID NO: 703608 - DNA, 25 bp, Mus musculus
ggagggtcctgaatgagctcatcta

SEQ ID NO: 703609 - DNA, 25 bp, Mus musculus
ggagggtcctgattgagctcatcta

SEQ ID NO: 703610 - DNA, 25 bp, Mus musculus
ggagggtgccttacctgtgaccatg

SEQ ID NO: 703611 - DNA, 25 bp, Mus musculus
ggagggtgcctttcctgtgaccatg

SEQ ID NO: 703612 - DNA, 25 bp, Mus musculus
ggagggtgtcttcgttcccaatcta

SEQ ID NO: 703613 - DNA, 25 bp, Mus musculus
ggagggtgtcttggttcccaatcta

SEQ ID NO: 703614 - DNA, 25 bp, Mus musculus
ggagggtttcctactggctcactcg

SEQ ID NO: 703615 - DNA, 25 bp, Mus musculus
ggagggtttccttctggctcactcg

SEQ ID NO: 703616 - DNA, 25 bp, Mus musculus
ggagggtttgcccttcttagcccat

SEQ ID NO: 703617 - DNA, 25 bp, Mus musculus
ggagggtttgccgttcttagcccat

SEQ ID NO: 703618 - DNA, 25 bp, Mus musculus
ggaggtaaatgcaggattggcccat

SEQ ID NO: 703619 - DNA, 25 bp, Mus musculus
ggaggtaaatgctggattggcccat

SEQ ID NO: 703620 - DNA, 25 bp, Mus musculus
ggaggtaagtagcacctctgtataa

SEQ ID NO: 703621 - DNA, 25 bp, Mus musculus
ggaggtaagtaggacctctgtataa

SEQ ID NO: 703622 - DNA, 25 bp, Mus musculus
ggaggtacaactcgctcctcggtga

SEQ ID NO: 703623 - DNA, 25 bp, Mus musculus
ggaggtacaactggctcctcggtga

SEQ ID NO: 703624 - DNA, 25 bp, Mus musculus
ggaggtagccctacggcactcggct

SEQ ID NO: 703625 - DNA, 25 bp, Mus musculus
ggaggtagcccttcggcactcggct

SEQ ID NO: 703626 - DNA, 25 bp, Mus musculus
ggaggtatactacctaattcgttct

SEQ ID NO: 703627 - DNA, 25 bp, Mus musculus
ggaggtatactagctaattcgttct

SEQ ID NO: 703628 - DNA, 25 bp, Mus musculus
ggaggtcacacaatctgtgcgcata

SEQ ID NO: 703629 - DNA, 25 bp, Mus musculus
ggaggtcacacattctgtgcgcata

SEQ ID NO: 703630 - DNA, 25 bp, Mus musculus
ggaggtcatcataggccagtacaca

SEQ ID NO: 703631 - DNA, 25 bp, Mus musculus
ggaggtcatcattggccagtacaca

SEQ ID NO: 703632 - DNA, 25 bp, Mus musculus
ggaggtcatgttcgcccctcaagaa

SEQ ID NO: 703633 - DNA, 25 bp, Mus musculus
ggaggtcatgttggcccctcaagaa

SEQ ID NO: 703634 - DNA, 25 bp, Mus musculus
ggaggtcattctatgcagccctggt

SEQ ID NO: 703635 - DNA, 25 bp, Mus musculus
ggaggtcattctttgcagccctggt

SEQ ID NO: 703636 - DNA, 25 bp, Mus musculus
ggaggtccaccactgactgaactgg

SEQ ID NO: 703637 - DNA, 25 bp, Mus musculus
ggaggtccaccagtgactgaactgg

SEQ ID NO: 703638 - DNA, 25 bp, Mus musculus
ggaggtccatcacccaacagaagtc

SEQ ID NO: 703639 - DNA, 25 bp, Mus musculus
ggaggtccatcagccaacagaagtc

SEQ ID NO: 703640 - DNA, 25 bp, Mus musculus
ggaggtccatctcagttttccacca

SEQ ID NO: 703641 - DNA, 25 bp, Mus musculus
ggaggtccatctgagttttccacca

SEQ ID NO: 703642 - DNA, 25 bp, Mus musculus
ggaggtccgagtactcgtccccacg

SEQ ID NO: 703643 - DNA, 25 bp, Mus musculus
ggaggtccgagttctcgtccccacg

SEQ ID NO: 703644 - DNA, 25 bp, Mus musculus
ggaggtcctcggagcttctgtttcc

SEQ ID NO: 703645 - DNA, 25 bp, Mus musculus
ggaggtcctcggtgcttctgtttcc

SEQ ID NO: 703646 - DNA, 25 bp, Mus musculus
ggaggtcctcttcccctgggactga

SEQ ID NO: 703647 - DNA, 25 bp, Mus musculus
ggaggtcctcttgccctgggactga

SEQ ID NO: 703648 - DNA, 25 bp, Mus musculus
ggaggtcggcggacctctcaacctg

SEQ ID NO: 703649 - DNA, 25 bp, Mus musculus
ggaggtcggcggtcctctcaacctg

SEQ ID NO: 703650 - DNA, 25 bp, Mus musculus
ggaggtctaccaattcaccttggag

SEQ ID NO: 703651 - DNA, 25 bp, Mus musculus
ggaggtctaccatttcaccttggag

SEQ ID NO: 703652 - DNA, 25 bp, Mus musculus
ggaggtctcaatactgggttcatga

SEQ ID NO: 703653 - DNA, 25 bp, Mus musculus
ggaggtctcaattctgggttcatga

SEQ ID NO: 703654 - DNA, 25 bp, Mus musculus
ggaggtctcagtatggcagatgata

SEQ ID NO: 703655 - DNA, 25 bp, Mus musculus
ggaggtctcagtttggcagatgata

SEQ ID NO: 703656 - DNA, 25 bp, Mus musculus
ggaggtctcggcctctgcttcctcg

SEQ ID NO: 703657 - DNA, 25 bp, Mus musculus
ggaggtctcggcgtctgcttcctcg

SEQ ID NO: 703658 - DNA, 25 bp, Mus musculus
ggaggtctctgcaccaactcttggc

SEQ ID NO: 703659 - DNA, 25 bp, Mus musculus
ggaggtctctgctccaactcttggc

SEQ ID NO: 703660 - DNA, 25 bp, Mus musculus
ggaggtctgctgctccctgctgcta

SEQ ID NO: 703661 - DNA, 25 bp, Mus musculus
ggaggtctgctggtccctgctgcta

SEQ ID NO: 703662 - DNA, 25 bp, Mus musculus
ggaggtctgtgcaaccgacctggat

SEQ ID NO: 703663 - DNA, 25 bp, Mus musculus
ggaggtctgtgctaccgacctggat

SEQ ID NO: 703664 - DNA, 25 bp, Mus musculus
ggaggtctttctagctgggaactga

SEQ ID NO: 703665 - DNA, 25 bp, Mus musculus
ggaggtctttcttgctgggaactga

SEQ ID NO: 703666 - DNA, 25 bp, Mus musculus
ggaggtgaaaccaccagggatcgtt

SEQ ID NO: 703667 - DNA, 25 bp, Mus musculus
ggaggtgaaacctccagggatcgtt

SEQ ID NO: 703668 - DNA, 25 bp, Mus musculus
ggaggtgaacacagcatttgaggac

SEQ ID NO: 703669 - DNA, 25 bp, Mus musculus
ggaggtgaacactgcatttgaggac

SEQ ID NO: 703670 - DNA, 25 bp, Mus musculus
ggaggtgctcaacatgtccacggaa

SEQ ID NO: 703671 - DNA, 25 bp, Mus musculus
ggaggtgctcaagatgtccacggaa

SEQ ID NO: 703672 - DNA, 25 bp, Mus musculus
ggaggtggacctccacacagccaag

SEQ ID NO: 703673 - DNA, 25 bp, Mus musculus
ggaggtggacctgcacacagccaag

SEQ ID NO: 703674 - DNA, 25 bp, Mus musculus
ggaggtgtccccacccactgaatag

SEQ ID NO: 703675 - DNA, 25 bp, Mus musculus
ggaggtgtcccctcccactgaatag

SEQ ID NO: 703676 - DNA, 25 bp, Mus musculus
ggaggtgtccttctctgccccgttt

SEQ ID NO: 703677 - DNA, 25 bp, Mus musculus
ggaggtgtccttgtctgccccgttt

SEQ ID NO: 703678 - DNA, 25 bp, Mus musculus
ggaggtgtgcaaaccactgcgtcca

SEQ ID NO: 703679 - DNA, 25 bp, Mus musculus
ggaggtgtgcaatccactgcgtcca

SEQ ID NO: 703680 - DNA, 25 bp, Mus musculus
ggaggttactggctctggataccca

SEQ ID NO: 703681 - DNA, 25 bp, Mus musculus
ggaggttactgggtctggataccca

SEQ ID NO: 703682 - DNA, 25 bp, Mus musculus
ggaggttcagaactttgtcacacag

SEQ ID NO: 703683 - DNA, 25 bp, Mus musculus
ggaggttcagaagtttgtcacacag

SEQ ID NO: 703684 - DNA, 25 bp, Mus musculus
ggaggttccactaaccttagctctg

SEQ ID NO: 703685 - DNA, 25 bp, Mus musculus
ggaggttccacttaccttagctctg

SEQ ID NO: 703686 - DNA, 25 bp, Mus musculus
ggaggttcgcggacatccagaatgt

SEQ ID NO: 703687 - DNA, 25 bp, Mus musculus
ggaggttcgcggtcatccagaatgt

SEQ ID NO: 703688 - DNA, 25 bp, Mus musculus
ggaggttcggcgactgcagaaccac

SEQ ID NO: 703689 - DNA, 25 bp, Mus musculus
ggaggttcggcgtctgcagaaccac

SEQ ID NO: 703690 - DNA, 25 bp, Mus musculus
ggaggttcttcacataactctattg

SEQ ID NO: 703691 - DNA, 25 bp, Mus musculus
ggaggttcttcagataactctattg

SEQ ID NO: 703692 - DNA, 25 bp, Mus musculus
ggaggttgccccatgcaccagcgat

SEQ ID NO: 703693 - DNA, 25 bp, Mus musculus
ggaggttgccccttgcaccagcgat

SEQ ID NO: 703694 - DNA, 25 bp, Mus musculus
ggaggttggacactaatacaacacc

SEQ ID NO: 703695 - DNA, 25 bp, Mus musculus
ggaggttggacagtaatacaacacc

SEQ ID NO: 703696 - DNA, 25 bp, Mus musculus
ggaggttgtatcaggattgctctaa

SEQ ID NO: 703697 - DNA, 25 bp, Mus musculus
ggaggttgtatctggattgctctaa

SEQ ID NO: 703698 - DNA, 25 bp, Mus musculus
ggagtaaaactactgcttactggtt

SEQ ID NO: 703699 - DNA, 25 bp, Mus musculus
ggagtaaaactagtgcttactggtt

SEQ ID NO: 703700 - DNA, 25 bp, Mus musculus
ggagtaaaccttcatatttcgctga

SEQ ID NO: 703701 - DNA, 25 bp, Mus musculus
ggagtaaaccttgatatttcgctga

SEQ ID NO: 703702 - DNA, 25 bp, Mus musculus
ggagtaaatctactctcaaccactc

SEQ ID NO: 703703 - DNA, 25 bp, Mus musculus
ggagtaaatctagtctcaaccactc

SEQ ID NO: 703704 - DNA, 25 bp, Mus musculus
ggagtaactaccataactagtcaag

SEQ ID NO: 703705 - DNA, 25 bp, Mus musculus
ggagtaactaccttaactagtcaag

SEQ ID NO: 703706 - DNA, 25 bp, Mus musculus
ggagtaagtcgcacagctccggagc

SEQ ID NO: 703707 - DNA, 25 bp, Mus musculus
ggagtaagtcgctcagctccggagc

SEQ ID NO: 703708 - DNA, 25 bp, Mus musculus
ggagtaagttctatagcaccgggta

SEQ ID NO: 703709 - DNA, 25 bp, Mus musculus
ggagtaagttctttagcaccgggta

SEQ ID NO: 703710 - DNA, 25 bp, Mus musculus
ggagtacaacccctatgcttggaac

SEQ ID NO: 703711 - DNA, 25 bp, Mus musculus
ggagtacaacccgtatgcttggaac

SEQ ID NO: 703712 - DNA, 25 bp, Mus musculus
ggagtacactaccagtactacctgc

SEQ ID NO: 703713 - DNA, 25 bp, Mus musculus
ggagtacactacgagtactacctgc

SEQ ID NO: 703714 - DNA, 25 bp, Mus musculus
ggagtacattccctctacctttcgg

SEQ ID NO: 703715 - DNA, 25 bp, Mus musculus
ggagtacattccgtctacctttcgg

SEQ ID NO: 703716 - DNA, 25 bp, Mus musculus
ggagtacctcatcggcggtgcctac

SEQ ID NO: 703717 - DNA, 25 bp, Mus musculus
ggagtacctcatgggcggtgcctac

SEQ ID NO: 703718 - DNA, 25 bp, Mus musculus
ggagtacctccacacacgcaggatt

SEQ ID NO: 703719 - DNA, 25 bp, Mus musculus
ggagtacctccagacacgcaggatt

SEQ ID NO: 703720 - DNA, 25 bp, Mus musculus
ggagtacctgaaagacacgctgcag

SEQ ID NO: 703721 - DNA, 25 bp, Mus musculus
ggagtacctgaatgacacgctgcag

SEQ ID NO: 703722 - DNA, 25 bp, Mus musculus
ggagtacctgacaggcttccacaag

SEQ ID NO: 703723 - DNA, 25 bp, Mus musculus
ggagtacctgactggcttccacaag

SEQ ID NO: 703724 - DNA, 25 bp, Mus musculus
ggagtacctggtcacacatcctagt

SEQ ID NO: 703725 - DNA, 25 bp, Mus musculus
ggagtacctggtgacacatcctagt

SEQ ID NO: 703726 - DNA, 25 bp, Mus musculus
ggagtactacgacaaagcctttgac

SEQ ID NO: 703727 - DNA, 25 bp, Mus musculus
ggagtactacgagaaagcctttgac

SEQ ID NO: 703728 - DNA, 25 bp, Mus musculus
ggagtagagagaatcttctaccttg

SEQ ID NO: 703729 - DNA, 25 bp, Mus musculus
ggagtagagagattcttctaccttg

SEQ ID NO: 703730 - DNA, 25 bp, Mus musculus
ggagtagatgccctaggaccctgca

SEQ ID NO: 703731 - DNA, 25 bp, Mus musculus
ggagtagatgccgtaggaccctgca

SEQ ID NO: 703732 - DNA, 25 bp, Mus musculus
ggagtaggcaacatattcattaaaa

SEQ ID NO: 703733 - DNA, 25 bp, Mus musculus
ggagtaggcaacttattcattaaaa

SEQ ID NO: 703734 - DNA, 25 bp, Mus musculus
ggagtaggtctaccccagagcagtc

SEQ ID NO: 703735 - DNA, 25 bp, Mus musculus
ggagtaggtctagcccagagcagtc

SEQ ID NO: 703736 - DNA, 25 bp, Mus musculus
ggagtagtctccatgctgtatcaat

SEQ ID NO: 703737 - DNA, 25 bp, Mus musculus
ggagtagtctccttgctgtatcaat

SEQ ID NO: 703738 - DNA, 25 bp, Mus musculus
ggagtatagctcactggaacatgag

SEQ ID NO: 703739 - DNA, 25 bp, Mus musculus
ggagtatagctctctggaacatgag

SEQ ID NO: 703740 - DNA, 25 bp, Mus musculus
ggagtatcaccaagtcagactacct

SEQ ID NO: 703741 - DNA, 25 bp, Mus musculus
ggagtatcaccatgtcagactacct

SEQ ID NO: 703742 - DNA, 25 bp, Mus musculus
ggagtatcatacaccatggtacctt

SEQ ID NO: 703743 - DNA, 25 bp, Mus musculus
ggagtatcatactccatggtacctt

SEQ ID NO: 703744 - DNA, 25 bp, Mus musculus
ggagtatccaaccatctccattgac

SEQ ID NO: 703745 - DNA, 25 bp, Mus musculus
ggagtatccaacgatctccattgac

SEQ ID NO: 703746 - DNA, 25 bp, Mus musculus
ggagtatcccggcaatcgcagtttt

SEQ ID NO: 703747 - DNA, 25 bp, Mus musculus
ggagtatcccgggaatcgcagtttt

SEQ ID NO: 703748 - DNA, 25 bp, Mus musculus
ggagtatgagcccaaattcaaccag

SEQ ID NO: 703749 - DNA, 25 bp, Mus musculus
ggagtatgagccgaaattcaaccag

SEQ ID NO: 703750 - DNA, 25 bp, Mus musculus
ggagtatgccaaccgggctgcaccc

SEQ ID NO: 703751 - DNA, 25 bp, Mus musculus
ggagtatgccaagcgggctgcaccc

SEQ ID NO: 703752 - DNA, 25 bp, Mus musculus
ggagtatgtcacagtcacgccaacc

SEQ ID NO: 703753 - DNA, 25 bp, Mus musculus
ggagtatgtcactgtcacgccaacc

SEQ ID NO: 703754 - DNA, 25 bp, Mus musculus
ggagtatgtctcaacttcgggcctt

SEQ ID NO: 703755 - DNA, 25 bp, Mus musculus
ggagtatgtctctacttcgggcctt

SEQ ID NO: 703756 - DNA, 25 bp, Mus musculus
ggagtattccgaactcagcgcattg

SEQ ID NO: 703757 - DNA, 25 bp, Mus musculus
ggagtattccgatctcagcgcattg

SEQ ID NO: 703758 - DNA, 25 bp, Mus musculus
ggagtatttcctccacgccatcaaa

SEQ ID NO: 703759 - DNA, 25 bp, Mus musculus
ggagtatttcctgcacgccatcaaa

SEQ ID NO: 703760 - DNA, 25 bp, Mus musculus
ggagtcaaaggaaagctaggcagac

SEQ ID NO: 703761 - DNA, 25 bp, Mus musculus
ggagtcaaaggatagctaggcagac

SEQ ID NO: 703762 - DNA, 25 bp, Mus musculus
ggagtcaaagtgcacacaagagacc

SEQ ID NO: 703763 - DNA, 25 bp, Mus musculus
ggagtcaaagtggacacaagagacc

SEQ ID NO: 703764 - DNA, 25 bp, Mus musculus
ggagtcaagcaaagcctacaacatg

SEQ ID NO: 703765 - DNA, 25 bp, Mus musculus
ggagtcaagcaatgcctacaacatg

SEQ ID NO: 703766 - DNA, 25 bp, Mus musculus
ggagtcaccgagcactatgggatca

SEQ ID NO: 703767 - DNA, 25 bp, Mus musculus
ggagtcaccgaggactatgggatca

SEQ ID NO: 703768 - DNA, 25 bp, Mus musculus
ggagtcaccgtcagtgccatcttct

SEQ ID NO: 703769 - DNA, 25 bp, Mus musculus
ggagtcaccgtctgtgccatcttct

SEQ ID NO: 703770 - DNA, 25 bp, Mus musculus
ggagtcacgccgctgttatctttcg

SEQ ID NO: 703771 - DNA, 25 bp, Mus musculus
ggagtcacgccggtgttatctttcg

SEQ ID NO: 703772 - DNA, 25 bp, Mus musculus
ggagtcactcacaatgtgaaggcga

SEQ ID NO: 703773 - DNA, 25 bp, Mus musculus
ggagtcactcactatgtgaaggcga

SEQ ID NO: 703774 - DNA, 25 bp, Mus musculus
ggagtcactccaattgcatcgatac

SEQ ID NO: 703775 - DNA, 25 bp, Mus musculus
ggagtcactccatttgcatcgatac

SEQ ID NO: 703776 - DNA, 25 bp, Mus musculus
ggagtcactcgaagttatacaaagc

SEQ ID NO: 703777 - DNA, 25 bp, Mus musculus
ggagtcactcgatgttatacaaagc

SEQ ID NO: 703778 - DNA, 25 bp, Mus musculus
ggagtcagaaaaccagctgcacctg

SEQ ID NO: 703779 - DNA, 25 bp, Mus musculus
ggagtcagaaaagcagctgcacctg

SEQ ID NO: 703780 - DNA, 25 bp, Mus musculus
ggagtcagaacgcacgtgctaacag

SEQ ID NO: 703781 - DNA, 25 bp, Mus musculus
ggagtcagaacggacgtgctaacag

SEQ ID NO: 703782 - DNA, 25 bp, Mus musculus
ggagtcagacctagataaatgtgtg

SEQ ID NO: 703783 - DNA, 25 bp, Mus musculus
ggagtcagaccttgataaatgtgtg

SEQ ID NO: 703784 - DNA, 25 bp, Mus musculus
ggagtcagcagaaagtgaacgatgc

SEQ ID NO: 703785 - DNA, 25 bp, Mus musculus
ggagtcagcagatagtgaacgatgc

SEQ ID NO: 703786 - DNA, 25 bp, Mus musculus
ggagtcaggcttaaggctaatggtc

SEQ ID NO: 703787 - DNA, 25 bp, Mus musculus
ggagtcaggctttaggctaatggtc

SEQ ID NO: 703788 - DNA, 25 bp, Mus musculus
ggagtcagtcttccgaacaggcgtc

SEQ ID NO: 703789 - DNA, 25 bp, Mus musculus
ggagtcagtcttgcgaacaggcgtc

SEQ ID NO: 703790 - DNA, 25 bp, Mus musculus
ggagtcagtggaaaagaccacgaac

SEQ ID NO: 703791 - DNA, 25 bp, Mus musculus
ggagtcagtggataagaccacgaac

SEQ ID NO: 703792 - DNA, 25 bp, Mus musculus
ggagtcatcccgcagatttctctga

SEQ ID NO: 703793 - DNA, 25 bp, Mus musculus
ggagtcatcccggagatttctctga

SEQ ID NO: 703794 - DNA, 25 bp, Mus musculus
ggagtcatgctcatcattcgcctct

SEQ ID NO: 703795 - DNA, 25 bp, Mus musculus
ggagtcatgctcttcattcgcctct

SEQ ID NO: 703796 - DNA, 25 bp, Mus musculus
ggagtcatgctgctgtaaagcagaa

SEQ ID NO: 703797 - DNA, 25 bp, Mus musculus
ggagtcatgctggtgtaaagcagaa

SEQ ID NO: 703798 - DNA, 25 bp, Mus musculus
ggagtcatgtgcagcctagtagtta

SEQ ID NO: 703799 - DNA, 25 bp, Mus musculus
ggagtcatgtgctgcctagtagtta

SEQ ID NO: 703800 - DNA, 25 bp, Mus musculus
ggagtcattcccaatgatcctcgtg

SEQ ID NO: 703801 - DNA, 25 bp, Mus musculus
ggagtcattccctatgatcctcgtg

SEQ ID NO: 703802 - DNA, 25 bp, Mus musculus
ggagtccaaagcctcagagtcgttc

SEQ ID NO: 703803 - DNA, 25 bp, Mus musculus
ggagtccaaagcgtcagagtcgttc

SEQ ID NO: 703804 - DNA, 25 bp, Mus musculus
ggagtccaagctagcatcatgcagg

SEQ ID NO: 703805 - DNA, 25 bp, Mus musculus
ggagtccaagcttgcatcatgcagg

SEQ ID NO: 703806 - DNA, 25 bp, Mus musculus
ggagtccaaggcatctcggatgcca

SEQ ID NO: 703807 - DNA, 25 bp, Mus musculus
ggagtccaaggcttctcggatgcca

SEQ ID NO: 703808 - DNA, 25 bp, Mus musculus
ggagtccacagccatgtgagtaccc

SEQ ID NO: 703809 - DNA, 25 bp, Mus musculus
ggagtccacagcgatgtgagtaccc

SEQ ID NO: 703810 - DNA, 25 bp, Mus musculus
ggagtccaccagcatcctgtagtgc

SEQ ID NO: 703811 - DNA, 25 bp, Mus musculus
ggagtccaccaggatcctgtagtgc

SEQ ID NO: 703812 - DNA, 25 bp, Mus musculus
ggagtccaccttaggtgccttggtg

SEQ ID NO: 703813 - DNA, 25 bp, Mus musculus
ggagtccacctttggtgccttggtg

SEQ ID NO: 703814 - DNA, 25 bp, Mus musculus
ggagtccactcgattgcatttgcag

SEQ ID NO: 703815 - DNA, 25 bp, Mus musculus
ggagtccactcgtttgcatttgcag

SEQ ID NO: 703816 - DNA, 25 bp, Mus musculus
ggagtccagaaaagctttccgcaag

SEQ ID NO: 703817 - DNA, 25 bp, Mus musculus
ggagtccagaaatgctttccgcaag

SEQ ID NO: 703818 - DNA, 25 bp, Mus musculus
ggagtccaggacatggctctacact

SEQ ID NO: 703819 - DNA, 25 bp, Mus musculus
ggagtccaggacttggctctacact

SEQ ID NO: 703820 - DNA, 25 bp, Mus musculus
ggagtccaggttccccagaaagtca

SEQ ID NO: 703821 - DNA, 25 bp, Mus musculus
ggagtccaggttgcccagaaagtca

SEQ ID NO: 703822 - DNA, 25 bp, Mus musculus
ggagtccatgccacagctctacaat

SEQ ID NO: 703823 - DNA, 25 bp, Mus musculus
ggagtccatgcctcagctctacaat

SEQ ID NO: 703824 - DNA, 25 bp, Mus musculus
ggagtccatgtaccaggcggcatct

SEQ ID NO: 703825 - DNA, 25 bp, Mus musculus
ggagtccatgtagcaggcggcatct

SEQ ID NO: 703826 - DNA, 25 bp, Mus musculus
ggagtcccaaatcagtttttgactt

SEQ ID NO: 703827 - DNA, 25 bp, Mus musculus
ggagtcccaaatgagtttttgactt

SEQ ID NO: 703828 - DNA, 25 bp, Mus musculus
ggagtccccattcgtccacaacagt

SEQ ID NO: 703829 - DNA, 25 bp, Mus musculus
ggagtccccattggtccacaacagt

SEQ ID NO: 703830 - DNA, 25 bp, Mus musculus
ggagtcccgaaaccagcccatggct

SEQ ID NO: 703831 - DNA, 25 bp, Mus musculus
ggagtcccgaaagcagcccatggct

SEQ ID NO: 703832 - DNA, 25 bp, Mus musculus
ggagtcccgaggacacggatcctct

SEQ ID NO: 703833 - DNA, 25 bp, Mus musculus
ggagtcccgaggtcacggatcctct

SEQ ID NO: 703834 - DNA, 25 bp, Mus musculus
ggagtcccggaaccttattgttcaa

SEQ ID NO: 703835 - DNA, 25 bp, Mus musculus
ggagtcccggaagcttattgttcaa

SEQ ID NO: 703836 - DNA, 25 bp, Mus musculus
ggagtccctgccaaaccagggcgtt

SEQ ID NO: 703837 - DNA, 25 bp, Mus musculus
ggagtccctgcctaaccagggcgtt

SEQ ID NO: 703838 - DNA, 25 bp, Mus musculus
ggagtccctgcgaatgcgaaagcct

SEQ ID NO: 703839 - DNA, 25 bp, Mus musculus
ggagtccctgcgtatgcgaaagcct

SEQ ID NO: 703840 - DNA, 25 bp, Mus musculus
ggagtccgtcaacaatggcttagtc

SEQ ID NO: 703841 - DNA, 25 bp, Mus musculus
ggagtccgtcaagaatggcttagtc

SEQ ID NO: 703842 - DNA, 25 bp, Mus musculus
ggagtcctcaccctgcatcaaggaa

SEQ ID NO: 703843 - DNA, 25 bp, Mus musculus
ggagtcctcaccgtgcatcaaggaa

SEQ ID NO: 703844 - DNA, 25 bp, Mus musculus
ggagtcctcgttctcttcctgctcg

SEQ ID NO: 703845 - DNA, 25 bp, Mus musculus
ggagtcctcgttgtcttcctgctcg

SEQ ID NO: 703846 - DNA, 25 bp, Mus musculus
ggagtcctgaaacgcacaaacctct

SEQ ID NO: 703847 - DNA, 25 bp, Mus musculus
ggagtcctgaaaggcacaaacctct

SEQ ID NO: 703848 - DNA, 25 bp, Mus musculus
ggagtcctgattcgacagtgtcaat

SEQ ID NO: 703849 - DNA, 25 bp, Mus musculus
ggagtcctgattggacagtgtcaat

SEQ ID NO: 703850 - DNA, 25 bp, Mus musculus
ggagtccttcctcattgtggccatg

SEQ ID NO: 703851 - DNA, 25 bp, Mus musculus
ggagtccttcctgattgtggccatg

SEQ ID NO: 703852 - DNA, 25 bp, Mus musculus
ggagtccttcgaactcatccaggag

SEQ ID NO: 703853 - DNA, 25 bp, Mus musculus
ggagtccttcgatctcatccaggag

SEQ ID NO: 703854 - DNA, 25 bp, Mus musculus
ggagtccttctccaatgtgagctac

SEQ ID NO: 703855 - DNA, 25 bp, Mus musculus
ggagtccttctcgaatgtgagctac

SEQ ID NO: 703856 - DNA, 25 bp, Mus musculus
ggagtcgatgcccttggacttaaca

SEQ ID NO: 703857 - DNA, 25 bp, Mus musculus
ggagtcgatgccgttggacttaaca

SEQ ID NO: 703858 - DNA, 25 bp, Mus musculus
ggagtcgcaagtcgaccacagcacc

SEQ ID NO: 703859 - DNA, 25 bp, Mus musculus
ggagtcgcaagtggaccacagcacc

SEQ ID NO: 703860 - DNA, 25 bp, Mus musculus
ggagtcgccggcaagatgtccgcca

SEQ ID NO: 703861 - DNA, 25 bp, Mus musculus
ggagtcgccggctagatgtccgcca

SEQ ID NO: 703862 - DNA, 25 bp, Mus musculus
ggagtcggagccctaatcatccctc

SEQ ID NO: 703863 - DNA, 25 bp, Mus musculus
ggagtcggagccgtaatcatccctc

SEQ ID NO: 703864 - DNA, 25 bp, Mus musculus
ggagtctaagccacaactctatgtg

SEQ ID NO: 703865 - DNA, 25 bp, Mus musculus
ggagtctaagcctcaactctatgtg

SEQ ID NO: 703866 - DNA, 25 bp, Mus musculus
ggagtctacaaaagtcactgacaag

SEQ ID NO: 703867 - DNA, 25 bp, Mus musculus
ggagtctacaaatgtcactgacaag

SEQ ID NO: 703868 - DNA, 25 bp, Mus musculus
ggagtctaccagacagagtcaccac

SEQ ID NO: 703869 - DNA, 25 bp, Mus musculus
ggagtctaccagtcagagtcaccac

SEQ ID NO: 703870 - DNA, 25 bp, Mus musculus
ggagtctatagccaatcttggcgac

SEQ ID NO: 703871 - DNA, 25 bp, Mus musculus
ggagtctatagcgaatcttggcgac

SEQ ID NO: 703872 - DNA, 25 bp, Mus musculus
ggagtctatggtaggattagtcaca

SEQ ID NO: 703873 - DNA, 25 bp, Mus musculus
ggagtctatggttggattagtcaca

SEQ ID NO: 703874 - DNA, 25 bp, Mus musculus
ggagtctatgtcagccgagccaaca

SEQ ID NO: 703875 - DNA, 25 bp, Mus musculus
ggagtctatgtctgccgagccaaca

SEQ ID NO: 703876 - DNA, 25 bp, Mus musculus
ggagtctcagctagtcagtccttga

SEQ ID NO: 703877 - DNA, 25 bp, Mus musculus
ggagtctcagcttgtcagtccttga

SEQ ID NO: 703878 - DNA, 25 bp, Mus musculus
ggagtctccaaacggctgccttctt

SEQ ID NO: 703879 - DNA, 25 bp, Mus musculus
ggagtctccaaagggctgccttctt

SEQ ID NO: 703880 - DNA, 25 bp, Mus musculus
ggagtctccctaagtacagcatatg

SEQ ID NO: 703881 - DNA, 25 bp, Mus musculus
ggagtctccctatgtacagcatatg

SEQ ID NO: 703882 - DNA, 25 bp, Mus musculus
ggagtctccgctcaaattgtcagga

SEQ ID NO: 703883 - DNA, 25 bp, Mus musculus
ggagtctccgctgaaattgtcagga

SEQ ID NO: 703884 - DNA, 25 bp, Mus musculus
ggagtctccttcaggtaatgcctaa

SEQ ID NO: 703885 - DNA, 25 bp, Mus musculus
ggagtctccttctggtaatgcctaa

SEQ ID NO: 703886 - DNA, 25 bp, Mus musculus
ggagtctcgcgtcctggaacctcat

SEQ ID NO: 703887 - DNA, 25 bp, Mus musculus
ggagtctcgcgtgctggaacctcat

SEQ ID NO: 703888 - DNA, 25 bp, Mus musculus
ggagtctctaagacacacactttac

SEQ ID NO: 703889 - DNA, 25 bp, Mus musculus
ggagtctctaagtcacacactttac

SEQ ID NO: 703890 - DNA, 25 bp, Mus musculus
ggagtctctatcatatgccaagagg

SEQ ID NO: 703891 - DNA, 25 bp, Mus musculus
ggagtctctatcttatgccaagagg

SEQ ID NO: 703892 - DNA, 25 bp, Mus musculus
ggagtctctcgcactggtttcccct

SEQ ID NO: 703893 - DNA, 25 bp, Mus musculus
ggagtctctcgctctggtttcccct

SEQ ID NO: 703894 - DNA, 25 bp, Mus musculus
ggagtctctggaatcatgcttttga

SEQ ID NO: 703895 - DNA, 25 bp, Mus musculus
ggagtctctggattcatgcttttga

SEQ ID NO: 703896 - DNA, 25 bp, Mus musculus
ggagtctgacccagagtttgtgcct

SEQ ID NO: 703897 - DNA, 25 bp, Mus musculus
ggagtctgaccctgagtttgtgcct

SEQ ID NO: 703898 - DNA, 25 bp, Mus musculus
ggagtctgcaccctggtcctctgtg

SEQ ID NO: 703899 - DNA, 25 bp, Mus musculus
ggagtctgcaccgtggtcctctgtg

SEQ ID NO: 703900 - DNA, 25 bp, Mus musculus
ggagtctgtgcaatgacttacccgg

SEQ ID NO: 703901 - DNA, 25 bp, Mus musculus
ggagtctgtgcattgacttacccgg

SEQ ID NO: 703902 - DNA, 25 bp, Mus musculus
ggagtcttacccctatgaagcgaag

SEQ ID NO: 703903 - DNA, 25 bp, Mus musculus
ggagtcttacccgtatgaagcgaag

SEQ ID NO: 703904 - DNA, 25 bp, Mus musculus
ggagtcttcccacagatgacattgc

SEQ ID NO: 703905 - DNA, 25 bp, Mus musculus
ggagtcttcccagagatgacattgc

SEQ ID NO: 703906 - DNA, 25 bp, Mus musculus
ggagtctttctgaatctcctgaaga

SEQ ID NO: 703907 - DNA, 25 bp, Mus musculus
ggagtctttctgtatctcctgaaga

SEQ ID NO: 703908 - DNA, 25 bp, Mus musculus
ggagtgaaaccgacctggactgcat

SEQ ID NO: 703909 - DNA, 25 bp, Mus musculus
ggagtgaaaccgtcctggactgcat

SEQ ID NO: 703910 - DNA, 25 bp, Mus musculus
ggagtgaccagacggctgaccctcc

SEQ ID NO: 703911 - DNA, 25 bp, Mus musculus
ggagtgaccagagggctgaccctcc

SEQ ID NO: 703912 - DNA, 25 bp, Mus musculus
ggagtgacctctaacatacgtaagt

SEQ ID NO: 703913 - DNA, 25 bp, Mus musculus
ggagtgacctcttacatacgtaagt

SEQ ID NO: 703914 - DNA, 25 bp, Mus musculus
ggagtgaccttgagccaggcttcaa

SEQ ID NO: 703915 - DNA, 25 bp, Mus musculus
ggagtgaccttgtgccaggcttcaa

SEQ ID NO: 703916 - DNA, 25 bp, Mus musculus
ggagtgagacctacaaggctgctgt

SEQ ID NO: 703917 - DNA, 25 bp, Mus musculus
ggagtgagaccttcaaggctgctgt

SEQ ID NO: 703918 - DNA, 25 bp, Mus musculus
ggagtgatcctacagccacagcaca

SEQ ID NO: 703919 - DNA, 25 bp, Mus musculus
ggagtgatcctagagccacagcaca

SEQ ID NO: 703920 - DNA, 25 bp, Mus musculus
ggagtgatctcgctctacaaggatg

SEQ ID NO: 703921 - DNA, 25 bp, Mus musculus
ggagtgatctcggtctacaaggatg

SEQ ID NO: 703922 - DNA, 25 bp, Mus musculus
ggagtgatgaatcgtgaatactacc

SEQ ID NO: 703923 - DNA, 25 bp, Mus musculus
ggagtgatgaatggtgaatactacc

SEQ ID NO: 703924 - DNA, 25 bp, Mus musculus
ggagtgcaaacaccccagtgtctcc

SEQ ID NO: 703925 - DNA, 25 bp, Mus musculus
ggagtgcaaacagcccagtgtctcc

SEQ ID NO: 703926 - DNA, 25 bp, Mus musculus
ggagtgcccggcacaccggaagtcc

SEQ ID NO: 703927 - DNA, 25 bp, Mus musculus
ggagtgcccggctcaccggaagtcc

SEQ ID NO: 703928 - DNA, 25 bp, Mus musculus
ggagtgccctcgagttctgtgtcag

SEQ ID NO: 703929 - DNA, 25 bp, Mus musculus
ggagtgccctcgtgttctgtgtcag

SEQ ID NO: 703930 - DNA, 25 bp, Mus musculus
ggagtgcctacaagagcaccattgg

SEQ ID NO: 703931 - DNA, 25 bp, Mus musculus
ggagtgcctacatgagcaccattgg

SEQ ID NO: 703932 - DNA, 25 bp, Mus musculus
ggagtgcctctccatcacctcgaaa

SEQ ID NO: 703933 - DNA, 25 bp, Mus musculus
ggagtgcctctcgatcacctcgaaa

SEQ ID NO: 703934 - DNA, 25 bp, Mus musculus
ggagtgcgccctcgagatcatcaaa

SEQ ID NO: 703935 - DNA, 25 bp, Mus musculus
ggagtgcgccctggagatcatcaaa

SEQ ID NO: 703936 - DNA, 25 bp, Mus musculus
ggagtgcgtcccctgatgacatcaa

SEQ ID NO: 703937 - DNA, 25 bp, Mus musculus
ggagtgcgtcccgtgatgacatcaa

SEQ ID NO: 703938 - DNA, 25 bp, Mus musculus
ggagtgctcagtacaaggctgttag

SEQ ID NO: 703939 - DNA, 25 bp, Mus musculus
ggagtgctcagttcaaggctgttag

SEQ ID NO: 703940 - DNA, 25 bp, Mus musculus
ggagtgctgaggcttcctggcggcg

SEQ ID NO: 703941 - DNA, 25 bp, Mus musculus
ggagtgctgagggttcctggcggcg

SEQ ID NO: 703942 - DNA, 25 bp, Mus musculus
ggagtgctgataaaccctgacccat

SEQ ID NO: 703943 - DNA, 25 bp, Mus musculus
ggagtgctgatataccctgacccat

SEQ ID NO: 703944 - DNA, 25 bp, Mus musculus
ggagtgctggcacgcagccccatct

SEQ ID NO: 703945 - DNA, 25 bp, Mus musculus
ggagtgctggcaggcagccccatct

SEQ ID NO: 703946 - DNA, 25 bp, Mus musculus
ggagtggagatcagccgccgccttc

SEQ ID NO: 703947 - DNA, 25 bp, Mus musculus
ggagtggagatctgccgccgccttc

SEQ ID NO: 703948 - DNA, 25 bp, Mus musculus
ggagtggagtcacctctgttcccta

SEQ ID NO: 703949 - DNA, 25 bp, Mus musculus
ggagtggagtcagctctgttcccta

SEQ ID NO: 703950 - DNA, 25 bp, Mus musculus
ggagtggatgaaaagcaagcttaac

SEQ ID NO: 703951 - DNA, 25 bp, Mus musculus
ggagtggatgaatagcaagcttaac

SEQ ID NO: 703952 - DNA, 25 bp, Mus musculus
ggagtggcatagattacgactgtca

SEQ ID NO: 703953 - DNA, 25 bp, Mus musculus
ggagtggcatagtttacgactgtca

SEQ ID NO: 703954 - DNA, 25 bp, Mus musculus
ggagtggcccttatatccttcgaaa

SEQ ID NO: 703955 - DNA, 25 bp, Mus musculus
ggagtggcccttttatccttcgaaa

SEQ ID NO: 703956 - DNA, 25 bp, Mus musculus
ggagtggccttaactatgttcatgc

SEQ ID NO: 703957 - DNA, 25 bp, Mus musculus
ggagtggccttatctatgttcatgc

SEQ ID NO: 703958 - DNA, 25 bp, Mus musculus
ggagtggctctcaccttgtgcagcc

SEQ ID NO: 703959 - DNA, 25 bp, Mus musculus
ggagtggctctctccttgtgcagcc

SEQ ID NO: 703960 - DNA, 25 bp, Mus musculus
ggagtgggaactccgtctttgtttc

SEQ ID NO: 703961 - DNA, 25 bp, Mus musculus
ggagtgggaactgcgtctttgtttc

SEQ ID NO: 703962 - DNA, 25 bp, Mus musculus
ggagtgggccctcacggccatacct

SEQ ID NO: 703963 - DNA, 25 bp, Mus musculus
ggagtgggccctgacggccatacct

SEQ ID NO: 703964 - DNA, 25 bp, Mus musculus
ggagtggtcctgagcacgctgcacc

SEQ ID NO: 703965 - DNA, 25 bp, Mus musculus
ggagtggtcctgtgcacgctgcacc

SEQ ID NO: 703966 - DNA, 25 bp, Mus musculus
ggagtgtacaacagcctgaaccaag

SEQ ID NO: 703967 - DNA, 25 bp, Mus musculus
ggagtgtacaactgcctgaaccaag

SEQ ID NO: 703968 - DNA, 25 bp, Mus musculus
ggagtgtacagtcatcccttagctg

SEQ ID NO: 703969 - DNA, 25 bp, Mus musculus
ggagtgtacagtgatcccttagctg

SEQ ID NO: 703970 - DNA, 25 bp, Mus musculus
ggagtgtatgaacttgtgcctacct

SEQ ID NO: 703971 - DNA, 25 bp, Mus musculus
ggagtgtatgaagttgtgcctacct

SEQ ID NO: 703972 - DNA, 25 bp, Mus musculus
ggagtgtatgttagaaaccccagaa

SEQ ID NO: 703973 - DNA, 25 bp, Mus musculus
ggagtgtatgtttgaaaccccagaa

SEQ ID NO: 703974 - DNA, 25 bp, Mus musculus
ggagtgtcatctaggcccgccagtt

SEQ ID NO: 703975 - DNA, 25 bp, Mus musculus
ggagtgtcatcttggcccgccagtt

SEQ ID NO: 703976 - DNA, 25 bp, Mus musculus
ggagtgtcatgaatacttccgaccc

SEQ ID NO: 703977 - DNA, 25 bp, Mus musculus
ggagtgtcatgattacttccgaccc

SEQ ID NO: 703978 - DNA, 25 bp, Mus musculus
ggagtgtccctgaataggatcttca

SEQ ID NO: 703979 - DNA, 25 bp, Mus musculus
ggagtgtccctgtataggatcttca

SEQ ID NO: 703980 - DNA, 25 bp, Mus musculus
ggagtgtgcatgagcgacctccaac

SEQ ID NO: 703981 - DNA, 25 bp, Mus musculus
ggagtgtgcatgtgcgacctccaac

SEQ ID NO: 703982 - DNA, 25 bp, Mus musculus
ggagtgtttcacaggacccaatatt

SEQ ID NO: 703983 - DNA, 25 bp, Mus musculus
ggagtgtttcactggacccaatatt

SEQ ID NO: 703984 - DNA, 25 bp, Mus musculus
ggagtgtttgacatccacttataaa

SEQ ID NO: 703985 - DNA, 25 bp, Mus musculus
ggagtgtttgacttccacttataaa

SEQ ID NO: 703986 - DNA, 25 bp, Mus musculus
ggagttaaccacctctcgtctacga

SEQ ID NO: 703987 - DNA, 25 bp, Mus musculus
ggagttaaccacgtctcgtctacga

SEQ ID NO: 703988 - DNA, 25 bp, Mus musculus
ggagttaaggtcatctttatcggca

SEQ ID NO: 703989 - DNA, 25 bp, Mus musculus
ggagttaaggtcttctttatcggca

SEQ ID NO: 703990 - DNA, 25 bp, Mus musculus
ggagttaagtatacggagaaacagg

SEQ ID NO: 703991 - DNA, 25 bp, Mus musculus
ggagttaagtattcggagaaacagg

SEQ ID NO: 703992 - DNA, 25 bp, Mus musculus
ggagttaatgctccttccccaagac

SEQ ID NO: 703993 - DNA, 25 bp, Mus musculus
ggagttaatgctgcttccccaagac

SEQ ID NO: 703994 - DNA, 25 bp, Mus musculus
ggagttaatttaaacaattcaccag

SEQ ID NO: 703995 - DNA, 25 bp, Mus musculus
ggagttaatttatacaattcaccag

SEQ ID NO: 703996 - DNA, 25 bp, Mus musculus
ggagttacacccagaggacacgctt

SEQ ID NO: 703997 - DNA, 25 bp, Mus musculus
ggagttacaccctgaggacacgctt

SEQ ID NO: 703998 - DNA, 25 bp, Mus musculus
ggagttacattcagcccaacagtgg

SEQ ID NO: 703999 - DNA, 25 bp, Mus musculus
ggagttacattctgcccaacagtgg

SEQ ID NO: 704000 - DNA, 25 bp, Mus musculus
ggagttaccacgaacactatcagag

SEQ ID NO: 704001 - DNA, 25 bp, Mus musculus
ggagttaccacgtacactatcagag

SEQ ID NO: 704002 - DNA, 25 bp, Mus musculus
ggagttacgcctacgaatgttagtg

SEQ ID NO: 704003 - DNA, 25 bp, Mus musculus
ggagttacgccttcgaatgttagtg

SEQ ID NO: 704004 - DNA, 25 bp, Mus musculus
ggagttacttgtcgttactctcctg

SEQ ID NO: 704005 - DNA, 25 bp, Mus musculus
ggagttacttgtggttactctcctg

SEQ ID NO: 704006 - DNA, 25 bp, Mus musculus
ggagttagagttcctctatgacctg

SEQ ID NO: 704007 - DNA, 25 bp, Mus musculus
ggagttagagttgctctatgacctg

SEQ ID NO: 704008 - DNA, 25 bp, Mus musculus
ggagttagattacgctaccttgtag

SEQ ID NO: 704009 - DNA, 25 bp, Mus musculus
ggagttagattaggctaccttgtag

SEQ ID NO: 704010 - DNA, 25 bp, Mus musculus
ggagttaggcgccatgctttccact

SEQ ID NO: 704011 - DNA, 25 bp, Mus musculus
ggagttaggcgcgatgctttccact

SEQ ID NO: 704012 - DNA, 25 bp, Mus musculus
ggagttatacacagataaggacaca

SEQ ID NO: 704013 - DNA, 25 bp, Mus musculus
ggagttatacactgataaggacaca

SEQ ID NO: 704014 - DNA, 25 bp, Mus musculus
ggagttatgaccagctacccaaaga

SEQ ID NO: 704015 - DNA, 25 bp, Mus musculus
ggagttatgacctgctacccaaaga

SEQ ID NO: 704016 - DNA, 25 bp, Mus musculus
ggagttcaacaacgcggagaaacac

SEQ ID NO: 704017 - DNA, 25 bp, Mus musculus
ggagttcaacaaggcggagaaacac

SEQ ID NO: 704018 - DNA, 25 bp, Mus musculus
ggagttcaacccacgttctttctct

SEQ ID NO: 704019 - DNA, 25 bp, Mus musculus
ggagttcaaccctcgttctttctct

SEQ ID NO: 704020 - DNA, 25 bp, Mus musculus
ggagttcaagctctgcctgcaggac

SEQ ID NO: 704021 - DNA, 25 bp, Mus musculus
ggagttcaagctgtgcctgcaggac

SEQ ID NO: 704022 - DNA, 25 bp, Mus musculus
ggagttcagcttaaatgtcttgcct

SEQ ID NO: 704023 - DNA, 25 bp, Mus musculus
ggagttcagctttaatgtcttgcct

SEQ ID NO: 704024 - DNA, 25 bp, Mus musculus
ggagttcatcatcctgaaccacttc

SEQ ID NO: 704025 - DNA, 25 bp, Mus musculus
ggagttcatcatgctgaaccacttc

SEQ ID NO: 704026 - DNA, 25 bp, Mus musculus
ggagttcatggcagtaggtgccata

SEQ ID NO: 704027 - DNA, 25 bp, Mus musculus
ggagttcatggctgtaggtgccata

SEQ ID NO: 704028 - DNA, 25 bp, Mus musculus
ggagttccactaccttttcagaagc

SEQ ID NO: 704029 - DNA, 25 bp, Mus musculus
ggagttccactagcttttcagaagc

SEQ ID NO: 704030 - DNA, 25 bp, Mus musculus
ggagttccactcaagctgcttagag

SEQ ID NO: 704031 - DNA, 25 bp, Mus musculus
ggagttccactctagctgcttagag

SEQ ID NO: 704032 - DNA, 25 bp, Mus musculus
ggagttccatgacaagagcccagaa

SEQ ID NO: 704033 - DNA, 25 bp, Mus musculus
ggagttccatgagaagagcccagaa

SEQ ID NO: 704034 - DNA, 25 bp, Mus musculus
ggagttcccctacaccatgcttctg

SEQ ID NO: 704035 - DNA, 25 bp, Mus musculus
ggagttcccctagaccatgcttctg

SEQ ID NO: 704036 - DNA, 25 bp, Mus musculus
ggagttccgggcatccttcaaccat

SEQ ID NO: 704037 - DNA, 25 bp, Mus musculus
ggagttccgggcttccttcaaccat

SEQ ID NO: 704038 - DNA, 25 bp, Mus musculus
ggagttccgtgcaccttgtagactt

SEQ ID NO: 704039 - DNA, 25 bp, Mus musculus
ggagttccgtgctccttgtagactt

SEQ ID NO: 704040 - DNA, 25 bp, Mus musculus
ggagttcctagcacatcctcttgca

SEQ ID NO: 704041 - DNA, 25 bp, Mus musculus
ggagttcctagctcatcctcttgca

SEQ ID NO: 704042 - DNA, 25 bp, Mus musculus
ggagttcctatcctcccaaggagtt

SEQ ID NO: 704043 - DNA, 25 bp, Mus musculus
ggagttcctatcgtcccaaggagtt

SEQ ID NO: 704044 - DNA, 25 bp, Mus musculus
ggagttcctgagcatcttcgtacta

SEQ ID NO: 704045 - DNA, 25 bp, Mus musculus
ggagttcctgaggatcttcgtacta

SEQ ID NO: 704046 - DNA, 25 bp, Mus musculus
ggagttcgagtacaacgccactgac

SEQ ID NO: 704047 - DNA, 25 bp, Mus musculus
ggagttcgagtagaacgccactgac

SEQ ID NO: 704048 - DNA, 25 bp, Mus musculus
ggagttctcagcagcaactaggtga

SEQ ID NO: 704049 - DNA, 25 bp, Mus musculus
ggagttctcagctgcaactaggtga

SEQ ID NO: 704050 - DNA, 25 bp, Mus musculus
ggagttctcggacattttccgaaga

SEQ ID NO: 704051 - DNA, 25 bp, Mus musculus
ggagttctcggagattttccgaaga

SEQ ID NO: 704052 - DNA, 25 bp, Mus musculus
ggagttctcgtcagtggtagctgat

SEQ ID NO: 704053 - DNA, 25 bp, Mus musculus
ggagttctcgtctgtggtagctgat

SEQ ID NO: 704054 - DNA, 25 bp, Mus musculus
ggagttctctggagtgccctggaac

SEQ ID NO: 704055 - DNA, 25 bp, Mus musculus
ggagttctctggtgtgccctggaac

SEQ ID NO: 704056 - DNA, 25 bp, Mus musculus
ggagttctgcatacatggctgtgtc

SEQ ID NO: 704057 - DNA, 25 bp, Mus musculus
ggagttctgcatctacaaccgcaac

SEQ ID NO: 704058 - DNA, 25 bp, Mus musculus
ggagttctgcatgtacaaccgcaac

SEQ ID NO: 704059 - DNA, 25 bp, Mus musculus
ggagttctgcattcatggctgtgtc

SEQ ID NO: 704060 - DNA, 25 bp, Mus musculus
ggagttctgtcgacggttggcacac

SEQ ID NO: 704061 - DNA, 25 bp, Mus musculus
ggagttctgtcgtcggttggcacac

SEQ ID NO: 704062 - DNA, 25 bp, Mus musculus
ggagttcttctcatgcctggcgtgg

SEQ ID NO: 704063 - DNA, 25 bp, Mus musculus
ggagttcttctcttgcctggcgtgg

SEQ ID NO: 704064 - DNA, 25 bp, Mus musculus
ggagttgcaaggatccaattcgaga

SEQ ID NO: 704065 - DNA, 25 bp, Mus musculus
ggagttgcaaggttccaattcgaga

SEQ ID NO: 704066 - DNA, 25 bp, Mus musculus
ggagttgcaggccaatttggacctc

SEQ ID NO: 704067 - DNA, 25 bp, Mus musculus
ggagttgcaggcgaatttggacctc

SEQ ID NO: 704068 - DNA, 25 bp, Mus musculus
ggagttgcagtaatatctcactacg

SEQ ID NO: 704069 - DNA, 25 bp, Mus musculus
ggagttgcagtattatctcactacg

SEQ ID NO: 704070 - DNA, 25 bp, Mus musculus
ggagttgcatgaattcgtctttgcc

SEQ ID NO: 704071 - DNA, 25 bp, Mus musculus
ggagttgcatgatttcgtctttgcc

SEQ ID NO: 704072 - DNA, 25 bp, Mus musculus
ggagttggcatccagccttccagga

SEQ ID NO: 704073 - DNA, 25 bp, Mus musculus
ggagttggcatcgagccttccagga

SEQ ID NO: 704074 - DNA, 25 bp, Mus musculus
ggagttggccctctgatgtcccctg

SEQ ID NO: 704075 - DNA, 25 bp, Mus musculus
ggagttggccctgtgatgtcccctg

SEQ ID NO: 704076 - DNA, 25 bp, Mus musculus
ggagttggccgcatgctcccagagc

SEQ ID NO: 704077 - DNA, 25 bp, Mus musculus
ggagttggccgcttgctcccagagc

SEQ ID NO: 704078 - DNA, 25 bp, Mus musculus
ggagttggctgtatcttcgttgaga

SEQ ID NO: 704079 - DNA, 25 bp, Mus musculus
ggagttggctgtttcttcgttgaga

SEQ ID NO: 704080 - DNA, 25 bp, Mus musculus
ggagttgggaagagctcctctcttg

SEQ ID NO: 704081 - DNA, 25 bp, Mus musculus
ggagttgggaagtgctcctctcttg

SEQ ID NO: 704082 - DNA, 25 bp, Mus musculus
ggagttgggcagcttccacatcaga

SEQ ID NO: 704083 - DNA, 25 bp, Mus musculus
ggagttgggcaggttccacatcaga

SEQ ID NO: 704084 - DNA, 25 bp, Mus musculus
ggagttgggctcaccaaacccagat

SEQ ID NO: 704085 - DNA, 25 bp, Mus musculus
ggagttgggctctccaaacccagat

SEQ ID NO: 704086 - DNA, 25 bp, Mus musculus
ggagttggtactattgtccatgaga

SEQ ID NO: 704087 - DNA, 25 bp, Mus musculus
ggagttggtacttttgtccatgaga

SEQ ID NO: 704088 - DNA, 25 bp, Mus musculus
ggagttggtggaatgcttccaaaag

SEQ ID NO: 704089 - DNA, 25 bp, Mus musculus
ggagttggtggattgcttccaaaag

SEQ ID NO: 704090 - DNA, 25 bp, Mus musculus
ggagttgttgcccatcctcctgcag

SEQ ID NO: 704091 - DNA, 25 bp, Mus musculus
ggagttgttgccgatcctcctgcag

SEQ ID NO: 704092 - DNA, 25 bp, Mus musculus
ggagttgtttctcagtgtctaaaaa

SEQ ID NO: 704093 - DNA, 25 bp, Mus musculus
ggagttgtttctgagtgtctaaaaa

SEQ ID NO: 704094 - DNA, 25 bp, Mus musculus
ggagtttaagtaccacccagagtgc

SEQ ID NO: 704095 - DNA, 25 bp, Mus musculus
ggagtttaagtagcacccagagtgc

SEQ ID NO: 704096 - DNA, 25 bp, Mus musculus
ggagtttacacacccatgtggcagc

SEQ ID NO: 704097 - DNA, 25 bp, Mus musculus
ggagtttacacagccatgtggcagc

SEQ ID NO: 704098 - DNA, 25 bp, Mus musculus
ggagtttactcgctacctgcaggaa

SEQ ID NO: 704099 - DNA, 25 bp, Mus musculus
ggagtttactcggtacctgcaggaa

SEQ ID NO: 704100 - DNA, 25 bp, Mus musculus
ggagtttccattacaattgatgacc

SEQ ID NO: 704101 - DNA, 25 bp, Mus musculus
ggagtttccatttcaattgatgacc

SEQ ID NO: 704102 - DNA, 25 bp, Mus musculus
ggagtttccgctccctgcgctttga

SEQ ID NO: 704103 - DNA, 25 bp, Mus musculus
ggagtttccgctgcctgcgctttga

SEQ ID NO: 704104 - DNA, 25 bp, Mus musculus
ggagtttcgaacattggttattgag

SEQ ID NO: 704105 - DNA, 25 bp, Mus musculus
ggagtttcgaactttggttattgag

SEQ ID NO: 704106 - DNA, 25 bp, Mus musculus
ggagtttcggaaaccttctctggga

SEQ ID NO: 704107 - DNA, 25 bp, Mus musculus
ggagtttcggaatccttctctggga

SEQ ID NO: 704108 - DNA, 25 bp, Mus musculus
ggagtttgaagccacacgctagagc

SEQ ID NO: 704109 - DNA, 25 bp, Mus musculus
ggagtttgaagcgacacgctagagc

SEQ ID NO: 704110 - DNA, 25 bp, Mus musculus
ggagtttgatgaactgcgtgatgca

SEQ ID NO: 704111 - DNA, 25 bp, Mus musculus
ggagtttgatgatctgcgtgatgca

SEQ ID NO: 704112 - DNA, 25 bp, Mus musculus
ggagtttgcgttaatgtttgaacag

SEQ ID NO: 704113 - DNA, 25 bp, Mus musculus
ggagtttgcgtttatgtttgaacag

SEQ ID NO: 704114 - DNA, 25 bp, Mus musculus
ggagtttggtggactatcttcgatc

SEQ ID NO: 704115 - DNA, 25 bp, Mus musculus
ggagtttggtggtctatcttcgatc

SEQ ID NO: 704116 - DNA, 25 bp, Mus musculus
ggagtttgtaatagctgccactgac

SEQ ID NO: 704117 - DNA, 25 bp, Mus musculus
ggagtttgtaattgctgccactgac

SEQ ID NO: 704118 - DNA, 25 bp, Mus musculus
ggagtttgtgacatactaggtgaca

SEQ ID NO: 704119 - DNA, 25 bp, Mus musculus
ggagtttgtgacttactaggtgaca

SEQ ID NO: 704120 - DNA, 25 bp, Mus musculus
ggagtttgttgcagatgaaggcatc

SEQ ID NO: 704121 - DNA, 25 bp, Mus musculus
ggagtttgttgctgatgaaggcatc

SEQ ID NO: 704122 - DNA, 25 bp, Mus musculus
ggagttttaaatcagagcagtggaa

SEQ ID NO: 704123 - DNA, 25 bp, Mus musculus
ggagttttaaatgagagcagtggaa

SEQ ID NO: 704124 - DNA, 25 bp, Mus musculus
ggagttttatcacggctctgtcctc

SEQ ID NO: 704125 - DNA, 25 bp, Mus musculus
ggagttttatcagggctctgtcctc

SEQ ID NO: 704126 - DNA, 25 bp, Mus musculus
ggagttttgacactccccgagctga

SEQ ID NO: 704127 - DNA, 25 bp, Mus musculus
ggagttttgacagtccccgagctga

SEQ ID NO: 704128 - DNA, 25 bp, Mus musculus
ggataaaacatcctaccgctggttc

SEQ ID NO: 704129 - DNA, 25 bp, Mus musculus
ggataaaacatcgtaccgctggttc

SEQ ID NO: 704130 - DNA, 25 bp, Mus musculus
ggataaaaccttccatgacctagtt

SEQ ID NO: 704131 - DNA, 25 bp, Mus musculus
ggataaaaccttgcatgacctagtt

SEQ ID NO: 704132 - DNA, 25 bp, Mus musculus
ggataaaagcaacactctacacatc

SEQ ID NO: 704133 - DNA, 25 bp, Mus musculus
ggataaaagcaagactctacacatc

SEQ ID NO: 704134 - DNA, 25 bp, Mus musculus
ggataaacgcccaagcccggaggct

SEQ ID NO: 704135 - DNA, 25 bp, Mus musculus
ggataaacgccctagcccggaggct

SEQ ID NO: 704136 - DNA, 25 bp, Mus musculus
ggataaagactgactgcgcacagga

SEQ ID NO: 704137 - DNA, 25 bp, Mus musculus
ggataaagactgtctgcgcacagga

SEQ ID NO: 704138 - DNA, 25 bp, Mus musculus
ggataaagatttagttaactcacct

SEQ ID NO: 704139 - DNA, 25 bp, Mus musculus
ggataaagattttgttaactcacct

SEQ ID NO: 704140 - DNA, 25 bp, Mus musculus
ggataaagtaaacgttctatttcat

SEQ ID NO: 704141 - DNA, 25 bp, Mus musculus
ggataaagtaaaggttctatttcat

SEQ ID NO: 704142 - DNA, 25 bp, Mus musculus
ggataaagttcaagaatgtgcccat

SEQ ID NO: 704143 - DNA, 25 bp, Mus musculus
ggataaagttcatgaatgtgcccat

SEQ ID NO: 704144 - DNA, 25 bp, Mus musculus
ggataaatggctcgcagtccttctg

SEQ ID NO: 704145 - DNA, 25 bp, Mus musculus
ggataaatggctggcagtccttctg

SEQ ID NO: 704146 - DNA, 25 bp, Mus musculus
ggataacatcatacctttccttagg

SEQ ID NO: 704147 - DNA, 25 bp, Mus musculus
ggataacatcattcctttccttagg

SEQ ID NO: 704148 - DNA, 25 bp, Mus musculus
ggataaccacgaaatgactaatcag

SEQ ID NO: 704149 - DNA, 25 bp, Mus musculus
ggataaccacgatatgactaatcag

SEQ ID NO: 704150 - DNA, 25 bp, Mus musculus
ggataactcagtcataactgttttc

SEQ ID NO: 704151 - DNA, 25 bp, Mus musculus
ggataactcagtgataactgttttc

SEQ ID NO: 704152 - DNA, 25 bp, Mus musculus
ggataacttccactaccaacacagt

SEQ ID NO: 704153 - DNA, 25 bp, Mus musculus
ggataacttccagtaccaacacagt

SEQ ID NO: 704154 - DNA, 25 bp, Mus musculus
ggataagaccatcaggtgggctact

SEQ ID NO: 704155 - DNA, 25 bp, Mus musculus
ggataagaccatgaggtgggctact

SEQ ID NO: 704156 - DNA, 25 bp, Mus musculus
ggataagagtatcgagtgtccccac

SEQ ID NO: 704157 - DNA, 25 bp, Mus musculus
ggataagagtatggagtgtccccac

SEQ ID NO: 704158 - DNA, 25 bp, Mus musculus
ggataagccttcaagtaaaacgagc

SEQ ID NO: 704159 - DNA, 25 bp, Mus musculus
ggataagccttctagtaaaacgagc

SEQ ID NO: 704160 - DNA, 25 bp, Mus musculus
ggataagcttctccgaagtcagacg

SEQ ID NO: 704161 - DNA, 25 bp, Mus musculus
ggataagcttctgcgaagtcagacg

SEQ ID NO: 704162 - DNA, 25 bp, Mus musculus
ggataaggcgtaactccggaggatc

SEQ ID NO: 704163 - DNA, 25 bp, Mus musculus
ggataaggcgtatctccggaggatc

SEQ ID NO: 704164 - DNA, 25 bp, Mus musculus
ggataataagtgattactccagccc

SEQ ID NO: 704165 - DNA, 25 bp, Mus musculus
ggataataagtgtttactccagccc

SEQ ID NO: 704166 - DNA, 25 bp, Mus musculus
ggataataatgtcctcaccctggag

SEQ ID NO: 704167 - DNA, 25 bp, Mus musculus
ggataataatgtgctcaccctggag

SEQ ID NO: 704168 - DNA, 25 bp, Mus musculus
ggataatccacacgtttgtagaaac

SEQ ID NO: 704169 - DNA, 25 bp, Mus musculus
ggataatccacaggtttgtagaaac

SEQ ID NO: 704170 - DNA, 25 bp, Mus musculus
ggataatgcccacgttatcctggct

SEQ ID NO: 704171 - DNA, 25 bp, Mus musculus
ggataatgcccaggttatcctggct

SEQ ID NO: 704172 - DNA, 25 bp, Mus musculus
ggataatttactccctctccaggag

SEQ ID NO: 704173 - DNA, 25 bp, Mus musculus
ggataatttactgcctctccaggag

SEQ ID NO: 704174 - DNA, 25 bp, Mus musculus
ggataatttgccaccacttgctgtg

SEQ ID NO: 704175 - DNA, 25 bp, Mus musculus
ggataatttgcctccacttgctgtg

SEQ ID NO: 704176 - DNA, 25 bp, Mus musculus
ggatacaaaactctttccgaaatgc

SEQ ID NO: 704177 - DNA, 25 bp, Mus musculus
ggatacaaaactgtttccgaaatgc

SEQ ID NO: 704178 - DNA, 25 bp, Mus musculus
ggatacaaactgcagatgattgagg

SEQ ID NO: 704179 - DNA, 25 bp, Mus musculus
ggatacaaactggagatgattgagg

SEQ ID NO: 704180 - DNA, 25 bp, Mus musculus
ggatacaagactcggcacaacaatc

SEQ ID NO: 704181 - DNA, 25 bp, Mus musculus
ggatacaagactgggcacaacaatc

SEQ ID NO: 704182 - DNA, 25 bp, Mus musculus
ggatacacagttcggtttcagaaca

SEQ ID NO: 704183 - DNA, 25 bp, Mus musculus
ggatacacagttgggtttcagaaca

SEQ ID NO: 704184 - DNA, 25 bp, Mus musculus
ggatacaccagcctttgagctaaaa

SEQ ID NO: 704185 - DNA, 25 bp, Mus musculus
ggatacaccagcgtttgagctaaaa

SEQ ID NO: 704186 - DNA, 25 bp, Mus musculus
ggatacactggcagctggatctcat

SEQ ID NO: 704187 - DNA, 25 bp, Mus musculus
ggatacactggctgctggatctcat

SEQ ID NO: 704188 - DNA, 25 bp, Mus musculus
ggatacagagtaattcaagaacaaa

SEQ ID NO: 704189 - DNA, 25 bp, Mus musculus
ggatacagagtatttcaagaacaaa

SEQ ID NO: 704190 - DNA, 25 bp, Mus musculus
ggatacagtctgcagggagtgtgaa

SEQ ID NO: 704191 - DNA, 25 bp, Mus musculus
ggatacagtctggagggagtgtgaa

SEQ ID NO: 704192 - DNA, 25 bp, Mus musculus
ggatacatggccactgctccagaac

SEQ ID NO: 704193 - DNA, 25 bp, Mus musculus
ggatacatggcctctgctccagaac

SEQ ID NO: 704194 - DNA, 25 bp, Mus musculus
ggataccaaagccttaagtgacttc

SEQ ID NO: 704195 - DNA, 25 bp, Mus musculus
ggataccaaagcgttaagtgacttc

SEQ ID NO: 704196 - DNA, 25 bp, Mus musculus
ggataccacactcgactgcaatact

SEQ ID NO: 704197 - DNA, 25 bp, Mus musculus
ggataccacactggactgcaatact

SEQ ID NO: 704198 - DNA, 25 bp, Mus musculus
ggataccaccttctggaaattaaag

SEQ ID NO: 704199 - DNA, 25 bp, Mus musculus
ggataccaccttgtggaaattaaag

SEQ ID NO: 704200 - DNA, 25 bp, Mus musculus
ggataccacttaagtcccaaacctg

SEQ ID NO: 704201 - DNA, 25 bp, Mus musculus
ggataccacttatgtcccaaacctg

SEQ ID NO: 704202 - DNA, 25 bp, Mus musculus
ggataccagaaacgattgccatgca

SEQ ID NO: 704203 - DNA, 25 bp, Mus musculus
ggataccagaaaggattgccatgca

SEQ ID NO: 704204 - DNA, 25 bp, Mus musculus
ggataccagtacatccgccctctct

SEQ ID NO: 704205 - DNA, 25 bp, Mus musculus
ggataccagtacttccgccctctct

SEQ ID NO: 704206 - DNA, 25 bp, Mus musculus
ggataccatcaaccccaattgcctg

SEQ ID NO: 704207 - DNA, 25 bp, Mus musculus
ggataccatcaagcccaattgcctg

SEQ ID NO: 704208 - DNA, 25 bp, Mus musculus
ggataccatgccctgtgaggctctg

SEQ ID NO: 704209 - DNA, 25 bp, Mus musculus
ggataccatgccgtgtgaggctctg

SEQ ID NO: 704210 - DNA, 25 bp, Mus musculus
ggataccccgctactactgggagga

SEQ ID NO: 704211 - DNA, 25 bp, Mus musculus
ggataccccgcttctactgggagga

SEQ ID NO: 704212 - DNA, 25 bp, Mus musculus
ggatacccctatatacaatgacgag

SEQ ID NO: 704213 - DNA, 25 bp, Mus musculus
ggatacccctatttacaatgacgag

SEQ ID NO: 704214 - DNA, 25 bp, Mus musculus
ggataccgatctcggctatctagag

SEQ ID NO: 704215 - DNA, 25 bp, Mus musculus
ggataccgatctgggctatctagag

SEQ ID NO: 704216 - DNA, 25 bp, Mus musculus
ggataccggtacaagctcgaacagg

SEQ ID NO: 704217 - DNA, 25 bp, Mus musculus
ggataccggtactagctcgaacagg

SEQ ID NO: 704218 - DNA, 25 bp, Mus musculus
ggatacctctagatctaccttaaga

SEQ ID NO: 704219 - DNA, 25 bp, Mus musculus
ggatacctctagttctaccttaaga

SEQ ID NO: 704220 - DNA, 25 bp, Mus musculus
ggatacctttgtccctcatctggag

SEQ ID NO: 704221 - DNA, 25 bp, Mus musculus
ggatacctttgtgcctcatctggag

SEQ ID NO: 704222 - DNA, 25 bp, Mus musculus
ggatactaccatcgactgctcgagg

SEQ ID NO: 704223 - DNA, 25 bp, Mus musculus
ggatactaccatggactgctcgagg

SEQ ID NO: 704224 - DNA, 25 bp, Mus musculus
ggatactataagaccctcctggagt

SEQ ID NO: 704225 - DNA, 25 bp, Mus musculus
ggatactataagtccctcctggagt

SEQ ID NO: 704226 - DNA, 25 bp, Mus musculus
ggatactcaatgcaatgtcagccca

SEQ ID NO: 704227 - DNA, 25 bp, Mus musculus
ggatactcaatggaatgtcagccca

SEQ ID NO: 704228 - DNA, 25 bp, Mus musculus
ggatactgcaagacctttgaatcca

SEQ ID NO: 704229 - DNA, 25 bp, Mus musculus
ggatactgcaagtcctttgaatcca

SEQ ID NO: 704230 - DNA, 25 bp, Mus musculus
ggatactgcttgcagcccaagaaag

SEQ ID NO: 704231 - DNA, 25 bp, Mus musculus
ggatactgcttggagcccaagaaag

SEQ ID NO: 704232 - DNA, 25 bp, Mus musculus
ggatactgggctccggcaccctcga

SEQ ID NO: 704233 - DNA, 25 bp, Mus musculus
ggatactgggctgcggcaccctcga

SEQ ID NO: 704234 - DNA, 25 bp, Mus musculus
ggatacttatctccaagtctgttta

SEQ ID NO: 704235 - DNA, 25 bp, Mus musculus
ggatacttatctgcaagtctgttta

SEQ ID NO: 704236 - DNA, 25 bp, Mus musculus
ggatacttcctcattggtcgccatg

SEQ ID NO: 704237 - DNA, 25 bp, Mus musculus
ggatacttcctctttggtcgccatg

SEQ ID NO: 704238 - DNA, 25 bp, Mus musculus
ggatactttgagctcacccacgata

SEQ ID NO: 704239 - DNA, 25 bp, Mus musculus
ggatactttgaggtcacccacgata

SEQ ID NO: 704240 - DNA, 25 bp, Mus musculus
ggatagaaaaggcagatactccctg

SEQ ID NO: 704241 - DNA, 25 bp, Mus musculus
ggatagaaaagggagatactccctg

SEQ ID NO: 704242 - DNA, 25 bp, Mus musculus
ggatagaactgccaatttcagcttt

SEQ ID NO: 704243 - DNA, 25 bp, Mus musculus
ggatagaactgcgaatttcagcttt

SEQ ID NO: 704244 - DNA, 25 bp, Mus musculus
ggatagacccttaaccaagcatctt

SEQ ID NO: 704245 - DNA, 25 bp, Mus musculus
ggatagaccctttaccaagcatctt

SEQ ID NO: 704246 - DNA, 25 bp, Mus musculus
ggatagacttcgaacatttaagcag

SEQ ID NO: 704247 - DNA, 25 bp, Mus musculus
ggatagacttcgtacatttaagcag

SEQ ID NO: 704248 - DNA, 25 bp, Mus musculus
ggatagaggcacaggaactgctgaa

SEQ ID NO: 704249 - DNA, 25 bp, Mus musculus
ggatagaggcactggaactgctgaa

SEQ ID NO: 704250 - DNA, 25 bp, Mus musculus
ggatagataccaccacagggaagaa

SEQ ID NO: 704251 - DNA, 25 bp, Mus musculus
ggatagataccagcacagggaagaa

SEQ ID NO: 704252 - DNA, 25 bp, Mus musculus
ggatagataggtaccgggcatcccc

SEQ ID NO: 704253 - DNA, 25 bp, Mus musculus
ggatagataggttccgggcatcccc

SEQ ID NO: 704254 - DNA, 25 bp, Mus musculus
ggatagatgttacctaagcaaggag

SEQ ID NO: 704255 - DNA, 25 bp, Mus musculus
ggatagatgttagctaagcaaggag

SEQ ID NO: 704256 - DNA, 25 bp, Mus musculus
ggatagcaactcaaaggtctctaac

SEQ ID NO: 704257 - DNA, 25 bp, Mus musculus
ggatagcaactctaaggtctctaac

SEQ ID NO: 704258 - DNA, 25 bp, Mus musculus
ggatagcaagcgagttgcaatttgg

SEQ ID NO: 704259 - DNA, 25 bp, Mus musculus
ggatagcaagcgtgttgcaatttgg

SEQ ID NO: 704260 - DNA, 25 bp, Mus musculus
ggatagcaatacaggaaaccctggg

SEQ ID NO: 704261 - DNA, 25 bp, Mus musculus
ggatagcaatactggaaaccctggg

SEQ ID NO: 704262 - DNA, 25 bp, Mus musculus
ggatagcagtgtcataaccagcggt

SEQ ID NO: 704263 - DNA, 25 bp, Mus musculus
ggatagcagtgtgataaccagcggt

SEQ ID NO: 704264 - DNA, 25 bp, Mus musculus
ggatagcccaccacatgtgccagta

SEQ ID NO: 704265 - DNA, 25 bp, Mus musculus
ggatagcccacctcatgtgccagta

SEQ ID NO: 704266 - DNA, 25 bp, Mus musculus
ggatagcgacacaccagcccaggct

SEQ ID NO: 704267 - DNA, 25 bp, Mus musculus
ggatagcgacactccagcccaggct

SEQ ID NO: 704268 - DNA, 25 bp, Mus musculus
ggatagcgtttccaagaaaatgaga

SEQ ID NO: 704269 - DNA, 25 bp, Mus musculus
ggatagcgtttcgaagaaaatgaga

SEQ ID NO: 704270 - DNA, 25 bp, Mus musculus
ggataggaagccactgttctccagg

SEQ ID NO: 704271 - DNA, 25 bp, Mus musculus
ggataggaagcctctgttctccagg

SEQ ID NO: 704272 - DNA, 25 bp, Mus musculus
ggataggcgttcagttgagccacaa

SEQ ID NO: 704273 - DNA, 25 bp, Mus musculus
ggataggcgttctgttgagccacaa

SEQ ID NO: 704274 - DNA, 25 bp, Mus musculus
ggatagtcatttccattttgaggct

SEQ ID NO: 704275 - DNA, 25 bp, Mus musculus
ggatagtcatttgcattttgaggct

SEQ ID NO: 704276 - DNA, 25 bp, Mus musculus
ggatagtctgccacccgaggaccac

SEQ ID NO: 704277 - DNA, 25 bp, Mus musculus
ggatagtctgcctcccgaggaccac

SEQ ID NO: 704278 - DNA, 25 bp, Mus musculus
ggatagtgagcccttctgcagcagc

SEQ ID NO: 704279 - DNA, 25 bp, Mus musculus
ggatagtgagccgttctgcagcagc

SEQ ID NO: 704280 - DNA, 25 bp, Mus musculus
ggatataaaccaactccaccaaatg

SEQ ID NO: 704281 - DNA, 25 bp, Mus musculus
ggatataaaccatctccaccaaatg

SEQ ID NO: 704282 - DNA, 25 bp, Mus musculus
ggatataaagtaactctcaccactg

SEQ ID NO: 704283 - DNA, 25 bp, Mus musculus
ggatataaagtatctctcaccactg

SEQ ID NO: 704284 - DNA, 25 bp, Mus musculus
ggatataacccacgcctttacgaag

SEQ ID NO: 704285 - DNA, 25 bp, Mus musculus
ggatataacccaggcctttacgaag

SEQ ID NO: 704286 - DNA, 25 bp, Mus musculus
ggatataagcagcactgtactctgc

SEQ ID NO: 704287 - DNA, 25 bp, Mus musculus
ggatataagcaggactgtactctgc

SEQ ID NO: 704288 - DNA, 25 bp, Mus musculus
ggatataatcacagctttttgactt

SEQ ID NO: 704289 - DNA, 25 bp, Mus musculus
ggatataatcactgctttttgactt

SEQ ID NO: 704290 - DNA, 25 bp, Mus musculus
ggatatacaacccatgatttaagat

SEQ ID NO: 704291 - DNA, 25 bp, Mus musculus
ggatatacaaccgatgatttaagat

SEQ ID NO: 704292 - DNA, 25 bp, Mus musculus
ggatatagacagcacttccctgccc

SEQ ID NO: 704293 - DNA, 25 bp, Mus musculus
ggatatagacaggacttccctgccc

SEQ ID NO: 704294 - DNA, 25 bp, Mus musculus
ggatatagaccactgagtccctcca

SEQ ID NO: 704295 - DNA, 25 bp, Mus musculus
ggatatagaccagtgagtccctcca

SEQ ID NO: 704296 - DNA, 25 bp, Mus musculus
ggatatatttttagaggcgctcaat

SEQ ID NO: 704297 - DNA, 25 bp, Mus musculus
ggatatattttttgaggcgctcaat

SEQ ID NO: 704298 - DNA, 25 bp, Mus musculus
ggatatcaacctcagttttaacaag

SEQ ID NO: 704299 - DNA, 25 bp, Mus musculus
ggatatcaacctgagttttaacaag

SEQ ID NO: 704300 - DNA, 25 bp, Mus musculus
ggatatcaccaccaagcacatgctg

SEQ ID NO: 704301 - DNA, 25 bp, Mus musculus
ggatatcaccacgaagcacatgctg

SEQ ID NO: 704302 - DNA, 25 bp, Mus musculus
ggatatcacttacttggaactggtt

SEQ ID NO: 704303 - DNA, 25 bp, Mus musculus
ggatatcacttagttggaactggtt

SEQ ID NO: 704304 - DNA, 25 bp, Mus musculus
ggatatcagagaaagaaatccaaag

SEQ ID NO: 704305 - DNA, 25 bp, Mus musculus
ggatatcagagatagaaatccaaag

SEQ ID NO: 704306 - DNA, 25 bp, Mus musculus
ggatatcatggacccagttaccttc

SEQ ID NO: 704307 - DNA, 25 bp, Mus musculus
ggatatcatggagccagttaccttc

SEQ ID NO: 704308 - DNA, 25 bp, Mus musculus
ggatatcatggcctcctctccaagc

SEQ ID NO: 704309 - DNA, 25 bp, Mus musculus
ggatatcatggcgtcctctccaagc

SEQ ID NO: 704310 - DNA, 25 bp, Mus musculus
ggatatcctttcactctgcatggtt

SEQ ID NO: 704311 - DNA, 25 bp, Mus musculus
ggatatcctttctctctgcatggtt

SEQ ID NO: 704312 - DNA, 25 bp, Mus musculus
ggatatcgaataaggcaactgtaca

SEQ ID NO: 704313 - DNA, 25 bp, Mus musculus
ggatatcgaatatggcaactgtaca

SEQ ID NO: 704314 - DNA, 25 bp, Mus musculus
ggatatctccatattaccatcatga

SEQ ID NO: 704315 - DNA, 25 bp, Mus musculus
ggatatctccattttaccatcatga

SEQ ID NO: 704316 - DNA, 25 bp, Mus musculus
ggatatctccctataagccctgtcg

SEQ ID NO: 704317 - DNA, 25 bp, Mus musculus
ggatatctccctttaagccctgtcg

SEQ ID NO: 704318 - DNA, 25 bp, Mus musculus
ggatatctgctgaactgcatttgga

SEQ ID NO: 704319 - DNA, 25 bp, Mus musculus
ggatatctgctgtactgcatttgga

SEQ ID NO: 704320 - DNA, 25 bp, Mus musculus
ggatatgaagaacgccattgcctgc

SEQ ID NO: 704321 - DNA, 25 bp, Mus musculus
ggatatgaagaaggccattgcctgc

SEQ ID NO: 704322 - DNA, 25 bp, Mus musculus
ggatatgaatgacagcacagctctg

SEQ ID NO: 704323 - DNA, 25 bp, Mus musculus
ggatatgaatgagagcacagctctg

SEQ ID NO: 704324 - DNA, 25 bp, Mus musculus
ggatatgataaacctatcaggccat

SEQ ID NO: 704325 - DNA, 25 bp, Mus musculus
ggatatgataaagctatcaggccat

SEQ ID NO: 704326 - DNA, 25 bp, Mus musculus
ggatatgcccttcactataatgagt

SEQ ID NO: 704327 - DNA, 25 bp, Mus musculus
ggatatgcccttgactataatgagt

SEQ ID NO: 704328 - DNA, 25 bp, Mus musculus
ggatatggagagacatgtgttcctg

SEQ ID NO: 704329 - DNA, 25 bp, Mus musculus
ggatatggagagtcatgtgttcctg

SEQ ID NO: 704330 - DNA, 25 bp, Mus musculus
ggatatgtcactcgccacatctcca

SEQ ID NO: 704331 - DNA, 25 bp, Mus musculus
ggatatgtcactggccacatctcca

SEQ ID NO: 704332 - DNA, 25 bp, Mus musculus
ggatatgttagaagccagtatttta

SEQ ID NO: 704333 - DNA, 25 bp, Mus musculus
ggatatgttagatgccagtatttta

SEQ ID NO: 704334 - DNA, 25 bp, Mus musculus
ggatattacttccacactgaaaatc

SEQ ID NO: 704335 - DNA, 25 bp, Mus musculus
ggatattacttcgacactgaaaatc

SEQ ID NO: 704336 - DNA, 25 bp, Mus musculus
ggatattattcacagagattcatca

SEQ ID NO: 704337 - DNA, 25 bp, Mus musculus
ggatattattcagagagattcatca

SEQ ID NO: 704338 - DNA, 25 bp, Mus musculus
ggatattccagccaccctgaaattt

SEQ ID NO: 704339 - DNA, 25 bp, Mus musculus
ggatattccagcgaccctgaaattt

SEQ ID NO: 704340 - DNA, 25 bp, Mus musculus
ggatattcctaaagttcaacatgtc

SEQ ID NO: 704341 - DNA, 25 bp, Mus musculus
ggatattcctaatgttcaacatgtc

SEQ ID NO: 704342 - DNA, 25 bp, Mus musculus
ggatattggagaaagccgggtactt

SEQ ID NO: 704343 - DNA, 25 bp, Mus musculus
ggatattggagatagccgggtactt

SEQ ID NO: 704344 - DNA, 25 bp, Mus musculus
ggatattttaggacagaatggaaga

SEQ ID NO: 704345 - DNA, 25 bp, Mus musculus
ggatattttaggtcagaatggaaga

SEQ ID NO: 704346 - DNA, 25 bp, Mus musculus
ggatcaaacagtcctcattcttcat

SEQ ID NO: 704347 - DNA, 25 bp, Mus musculus
ggatcaaacagtgctcattcttcat

SEQ ID NO: 704348 - DNA, 25 bp, Mus musculus
ggatcaacagtcaattgtgtactag

SEQ ID NO: 704349 - DNA, 25 bp, Mus musculus
ggatcaacagtctattgtgtactag

SEQ ID NO: 704350 - DNA, 25 bp, Mus musculus
ggatcaacatgtcaattaagtgaaa

SEQ ID NO: 704351 - DNA, 25 bp, Mus musculus
ggatcaacatgtgaattaagtgaaa

SEQ ID NO: 704352 - DNA, 25 bp, Mus musculus
ggatcaactgttacaaagtgtacac

SEQ ID NO: 704353 - DNA, 25 bp, Mus musculus
ggatcaactgtttcaaagtgtacac

SEQ ID NO: 704354 - DNA, 25 bp, Mus musculus
ggatcaacttgaacggatatttctg

SEQ ID NO: 704355 - DNA, 25 bp, Mus musculus
ggatcaacttgatcggatatttctg

SEQ ID NO: 704356 - DNA, 25 bp, Mus musculus
ggatcaagaaaaagttgacaagttc

SEQ ID NO: 704357 - DNA, 25 bp, Mus musculus
ggatcaagaaaatgttgacaagttc

SEQ ID NO: 704358 - DNA, 25 bp, Mus musculus
ggatcaagaaggaaccccagagtcc

SEQ ID NO: 704359 - DNA, 25 bp, Mus musculus
ggatcaagaaggtaccccagagtcc

SEQ ID NO: 704360 - DNA, 25 bp, Mus musculus
ggatcaagatggaaaaattgggctc

SEQ ID NO: 704361 - DNA, 25 bp, Mus musculus
ggatcaagatggtaaaattgggctc

SEQ ID NO: 704362 - DNA, 25 bp, Mus musculus
ggatcaaggacgctgccactatgaa

SEQ ID NO: 704363 - DNA, 25 bp, Mus musculus
ggatcaaggacggtgccactatgaa

SEQ ID NO: 704364 - DNA, 25 bp, Mus musculus
ggatcaagggggacaatgctctcag

SEQ ID NO: 704365 - DNA, 25 bp, Mus musculus
ggatcaagggggtcaatgctctcag

SEQ ID NO: 704366 - DNA, 25 bp, Mus musculus
ggatcaagtcttcctacaatagaga

SEQ ID NO: 704367 - DNA, 25 bp, Mus musculus
ggatcaagtcttgctacaatagaga

SEQ ID NO: 704368 - DNA, 25 bp, Mus musculus
ggatcaatgaggatcagaaagtggc

SEQ ID NO: 704369 - DNA, 25 bp, Mus musculus
ggatcaatgaggttcagaaagtggc

SEQ ID NO: 704370 - DNA, 25 bp, Mus musculus
ggatcaatggctatcccaacgagta

SEQ ID NO: 704371 - DNA, 25 bp, Mus musculus
ggatcaatggctttcccaacgagta

SEQ ID NO: 704372 - DNA, 25 bp, Mus musculus
ggatcaattcacagaccagcagaaa

SEQ ID NO: 704373 - DNA, 25 bp, Mus musculus
ggatcaattcactgaccagcagaaa

SEQ ID NO: 704374 - DNA, 25 bp, Mus musculus
ggatcaattcgcacagaaagaatac

SEQ ID NO: 704375 - DNA, 25 bp, Mus musculus
ggatcaattcgctcagaaagaatac

SEQ ID NO: 704376 - DNA, 25 bp, Mus musculus
ggatcaattggtagaggccgcgctc

SEQ ID NO: 704377 - DNA, 25 bp, Mus musculus
ggatcaattggttgaggccgcgctc

SEQ ID NO: 704378 - DNA, 25 bp, Mus musculus
ggatcacaacaacaacaccattcaa

SEQ ID NO: 704379 - DNA, 25 bp, Mus musculus
ggatcacaacaagaacaccattcaa

SEQ ID NO: 704380 - DNA, 25 bp, Mus musculus
ggatcacacccgagccatcatactg

SEQ ID NO: 704381 - DNA, 25 bp, Mus musculus
ggatcacacccgtgccatcatactg

SEQ ID NO: 704382 - DNA, 25 bp, Mus musculus
ggatcacatcgacgtgtcggacgat

SEQ ID NO: 704383 - DNA, 25 bp, Mus musculus
ggatcacatcgaggtgtcggacgat

SEQ ID NO: 704384 - DNA, 25 bp, Mus musculus
ggatcaccatctcggagggctcctg

SEQ ID NO: 704385 - DNA, 25 bp, Mus musculus
ggatcaccatctgggagggctcctg

SEQ ID NO: 704386 - DNA, 25 bp, Mus musculus
ggatcaccattgaagtctctcctct

SEQ ID NO: 704387 - DNA, 25 bp, Mus musculus
ggatcaccattgtagtctctcctct

SEQ ID NO: 704388 - DNA, 25 bp, Mus musculus
ggatcacctttgactgatagccagt

SEQ ID NO: 704389 - DNA, 25 bp, Mus musculus
ggatcacctttgtctgatagccagt

SEQ ID NO: 704390 - DNA, 25 bp, Mus musculus
ggatcactaaggactatgacctctg

SEQ ID NO: 704391 - DNA, 25 bp, Mus musculus
ggatcactaaggtctatgacctctg

SEQ ID NO: 704392 - DNA, 25 bp, Mus musculus
ggatcactacaacttggctctaggt

SEQ ID NO: 704393 - DNA, 25 bp, Mus musculus
ggatcactacaagttggctctaggt

SEQ ID NO: 704394 - DNA, 25 bp, Mus musculus
ggatcactccaacaccggaaatgag

SEQ ID NO: 704395 - DNA, 25 bp, Mus musculus
ggatcactccaagaccggaaatgag

SEQ ID NO: 704396 - DNA, 25 bp, Mus musculus
ggatcactttacaccgcctcagtcg

SEQ ID NO: 704397 - DNA, 25 bp, Mus musculus
ggatcactttactccgcctcagtcg

SEQ ID NO: 704398 - DNA, 25 bp, Mus musculus
ggatcagacccaagctgatttctgc

SEQ ID NO: 704399 - DNA, 25 bp, Mus musculus
ggatcagacccacttctacctgggc

SEQ ID NO: 704400 - DNA, 25 bp, Mus musculus
ggatcagacccagttctacctgggc

SEQ ID NO: 704401 - DNA, 25 bp, Mus musculus
ggatcagacccatgctgatttctgc

SEQ ID NO: 704402 - DNA, 25 bp, Mus musculus
ggatcagactgacaaaacccatagt

SEQ ID NO: 704403 - DNA, 25 bp, Mus musculus
ggatcagactgagaaaacccatagt

SEQ ID NO: 704404 - DNA, 25 bp, Mus musculus
ggatcagagcatagcacccaaaact

SEQ ID NO: 704405 - DNA, 25 bp, Mus musculus
ggatcagagcattgcacccaaaact

SEQ ID NO: 704406 - DNA, 25 bp, Mus musculus
ggatcagatcctaactgtgctgctg

SEQ ID NO: 704407 - DNA, 25 bp, Mus musculus
ggatcagatccttactgtgctgctg

SEQ ID NO: 704408 - DNA, 25 bp, Mus musculus
ggatcagcattcatgagctggcagc

SEQ ID NO: 704409 - DNA, 25 bp, Mus musculus
ggatcagcattcttgagctggcagc

SEQ ID NO: 704410 - DNA, 25 bp, Mus musculus
ggatcagctcggactcttcctcgga

SEQ ID NO: 704411 - DNA, 25 bp, Mus musculus
ggatcagctcggtctcttcctcgga

SEQ ID NO: 704412 - DNA, 25 bp, Mus musculus
ggatcagctgccctactctgtcacg

SEQ ID NO: 704413 - DNA, 25 bp, Mus musculus
ggatcagctgccgtactctgtcacg

SEQ ID NO: 704414 - DNA, 25 bp, Mus musculus
ggatcagcttgcacacgcttccagc

SEQ ID NO: 704415 - DNA, 25 bp, Mus musculus
ggatcagcttgctcacgcttccagc

SEQ ID NO: 704416 - DNA, 25 bp, Mus musculus
ggatcaggaaaaaattcccccacat

SEQ ID NO: 704417 - DNA, 25 bp, Mus musculus
ggatcaggaaaatattcccccacat

SEQ ID NO: 704418 - DNA, 25 bp, Mus musculus
ggatcaggagcacagcatctccctt

SEQ ID NO: 704419 - DNA, 25 bp, Mus musculus
ggatcaggagcagagcatctccctt

SEQ ID NO: 704420 - DNA, 25 bp, Mus musculus
ggatcaggccaaaaaagggtataag

SEQ ID NO: 704421 - DNA, 25 bp, Mus musculus
ggatcaggccaataaagggtataag

SEQ ID NO: 704422 - DNA, 25 bp, Mus musculus
ggatcaggcctcagaactgcaaaat

SEQ ID NO: 704423 - DNA, 25 bp, Mus musculus
ggatcaggcctctgaactgcaaaat

SEQ ID NO: 704424 - DNA, 25 bp, Mus musculus
ggatcagggctactagtcgcaacag

SEQ ID NO: 704425 - DNA, 25 bp, Mus musculus
ggatcagggctagtagtcgcaacag

SEQ ID NO: 704426 - DNA, 25 bp, Mus musculus
ggatcaggtatgcaatagtaagcat

SEQ ID NO: 704427 - DNA, 25 bp, Mus musculus
ggatcaggtatggaatagtaagcat

SEQ ID NO: 704428 - DNA, 25 bp, Mus musculus
ggatcaggtgcacaaatcctcaaag

SEQ ID NO: 704429 - DNA, 25 bp, Mus musculus
ggatcaggtgcagaaatcctcaaag

SEQ ID NO: 704430 - DNA, 25 bp, Mus musculus
ggatcagtactaaaacccgattctg

SEQ ID NO: 704431 - DNA, 25 bp, Mus musculus
ggatcagtactataacccgattctg

SEQ ID NO: 704432 - DNA, 25 bp, Mus musculus
ggatcagtatgaagctccactttaa

SEQ ID NO: 704433 - DNA, 25 bp, Mus musculus
ggatcagtatgatgctccactttaa

SEQ ID NO: 704434 - DNA, 25 bp, Mus musculus
ggatcagtcactccgccgtaatgtg

SEQ ID NO: 704435 - DNA, 25 bp, Mus musculus
ggatcagtcactgcgccgtaatgtg

SEQ ID NO: 704436 - DNA, 25 bp, Mus musculus
ggatcagtttgaaagaatcaagacc

SEQ ID NO: 704437 - DNA, 25 bp, Mus musculus
ggatcagtttgatagaatcaagacc

SEQ ID NO: 704438 - DNA, 25 bp, Mus musculus
ggatcatacatacaagatgcatgtc

SEQ ID NO: 704439 - DNA, 25 bp, Mus musculus
ggatcatacatagaagatgcatgtc

SEQ ID NO: 704440 - DNA, 25 bp, Mus musculus
ggatcatagttcatttcatgtggga

SEQ ID NO: 704441 - DNA, 25 bp, Mus musculus
ggatcatagttcttttcatgtggga

SEQ ID NO: 704442 - DNA, 25 bp, Mus musculus
ggatcatcactcagatgctgcagta

SEQ ID NO: 704443 - DNA, 25 bp, Mus musculus
ggatcatcactctgatgctgcagta

SEQ ID NO: 704444 - DNA, 25 bp, Mus musculus
ggatcatctcatcaaaggaaggctt

SEQ ID NO: 704445 - DNA, 25 bp, Mus musculus
ggatcatctcatgaaaggaaggctt

SEQ ID NO: 704446 - DNA, 25 bp, Mus musculus
ggatcatggcagcatccaaccgctc

SEQ ID NO: 704447 - DNA, 25 bp, Mus musculus
ggatcatggcaggatccaaccgctc

SEQ ID NO: 704448 - DNA, 25 bp, Mus musculus
ggatcattgcctcccacacgatgaa

SEQ ID NO: 704449 - DNA, 25 bp, Mus musculus
ggatcattgcctgccacacgatgaa

SEQ ID NO: 704450 - DNA, 25 bp, Mus musculus
ggatccaaaatacagaggccctcag

SEQ ID NO: 704451 - DNA, 25 bp, Mus musculus
ggatccaaaatagagaggccctcag

SEQ ID NO: 704452 - DNA, 25 bp, Mus musculus
ggatccaaagctaccctctgatggg

SEQ ID NO: 704453 - DNA, 25 bp, Mus musculus
ggatccaaagcttccctctgatggg

SEQ ID NO: 704454 - DNA, 25 bp, Mus musculus
ggatccaagactcccttacggctgg

SEQ ID NO: 704455 - DNA, 25 bp, Mus musculus
ggatccaagactgccttacggctgg

SEQ ID NO: 704456 - DNA, 25 bp, Mus musculus
ggatccaagtgtaagagccctctag

SEQ ID NO: 704457 - DNA, 25 bp, Mus musculus
ggatccaagtgttagagccctctag

SEQ ID NO: 704458 - DNA, 25 bp, Mus musculus
ggatccaccacccacggttgaagaa

SEQ ID NO: 704459 - DNA, 25 bp, Mus musculus
ggatccaccaccgacggttgaagaa

SEQ ID NO: 704460 - DNA, 25 bp, Mus musculus
ggatccacctgacacctgaggacgc

SEQ ID NO: 704461 - DNA, 25 bp, Mus musculus
ggatccacctgagacctgaggacgc

SEQ ID NO: 704462 - DNA, 25 bp, Mus musculus
ggatccacggatcccagagttgaag

SEQ ID NO: 704463 - DNA, 25 bp, Mus musculus
ggatccacggatgccagagttgaag

SEQ ID NO: 704464 - DNA, 25 bp, Mus musculus
ggatccagactcagtctactgaggc

SEQ ID NO: 704465 - DNA, 25 bp, Mus musculus
ggatccagactctgtctactgaggc

SEQ ID NO: 704466 - DNA, 25 bp, Mus musculus
ggatccagacttaagcttactgcag

SEQ ID NO: 704467 - DNA, 25 bp, Mus musculus
ggatccagactttagcttactgcag

SEQ ID NO: 704468 - DNA, 25 bp, Mus musculus
ggatccagagcccttgcaagccagt

SEQ ID NO: 704469 - DNA, 25 bp, Mus musculus
ggatccagagccgttgcaagccagt

SEQ ID NO: 704470 - DNA, 25 bp, Mus musculus
ggatccagagcgctcaggccaagac

SEQ ID NO: 704471 - DNA, 25 bp, Mus musculus
ggatccagagcggtcaggccaagac

SEQ ID NO: 704472 - DNA, 25 bp, Mus musculus
ggatccagcaaaaagaaaaggacat

SEQ ID NO: 704473 - DNA, 25 bp, Mus musculus
ggatccagcaaatagaaaaggacat

SEQ ID NO: 704474 - DNA, 25 bp, Mus musculus
ggatccagcctccactcctatttta

SEQ ID NO: 704475 - DNA, 25 bp, Mus musculus
ggatccagcctcgactcctatttta

SEQ ID NO: 704476 - DNA, 25 bp, Mus musculus
ggatccaggcagcattagagctgcc

SEQ ID NO: 704477 - DNA, 25 bp, Mus musculus
ggatccaggcaggattagagctgcc

SEQ ID NO: 704478 - DNA, 25 bp, Mus musculus
ggatccaggtcacccctgatgaaga

SEQ ID NO: 704479 - DNA, 25 bp, Mus musculus
ggatccaggtcagccctgatgaaga

SEQ ID NO: 704480 - DNA, 25 bp, Mus musculus
ggatccagtccaacaaggaagagaa

SEQ ID NO: 704481 - DNA, 25 bp, Mus musculus
ggatccagtccatcaaggaagagaa

SEQ ID NO: 704482 - DNA, 25 bp, Mus musculus
ggatccagttgccttgtgacccttc

SEQ ID NO: 704483 - DNA, 25 bp, Mus musculus
ggatccagttgcgttgtgacccttc

SEQ ID NO: 704484 - DNA, 25 bp, Mus musculus
ggatccatgccacaaacaagcctgt

SEQ ID NO: 704485 - DNA, 25 bp, Mus musculus
ggatccatgccagaaacaagcctgt

SEQ ID NO: 704486 - DNA, 25 bp, Mus musculus
ggatcccaaacaagccctcatgaag

SEQ ID NO: 704487 - DNA, 25 bp, Mus musculus
ggatcccaaacatgccctcatgaag

SEQ ID NO: 704488 - DNA, 25 bp, Mus musculus
ggatcccaatctacgatatgctaca

SEQ ID NO: 704489 - DNA, 25 bp, Mus musculus
ggatcccaatcttcgatatgctaca

SEQ ID NO: 704490 - DNA, 25 bp, Mus musculus
ggatcccaatgaccctgtttctgat

SEQ ID NO: 704491 - DNA, 25 bp, Mus musculus
ggatcccaatgagcctgtttctgat

SEQ ID NO: 704492 - DNA, 25 bp, Mus musculus
ggatcccacatcacctttaagaaca

SEQ ID NO: 704493 - DNA, 25 bp, Mus musculus
ggatcccacatctcctttaagaaca

SEQ ID NO: 704494 - DNA, 25 bp, Mus musculus
ggatcccacttgaagaagatgctag

SEQ ID NO: 704495 - DNA, 25 bp, Mus musculus
ggatcccacttgtagaagatgctag

SEQ ID NO: 704496 - DNA, 25 bp, Mus musculus
ggatcccagacacaggctcggcgtc

SEQ ID NO: 704497 - DNA, 25 bp, Mus musculus
ggatcccagacagaggctcggcgtc

SEQ ID NO: 704498 - DNA, 25 bp, Mus musculus
ggatcccagactatcccaaagccag

SEQ ID NO: 704499 - DNA, 25 bp, Mus musculus
ggatcccagactttcccaaagccag

SEQ ID NO: 704500 - DNA, 25 bp, Mus musculus
ggatcccagagacatagcttagctt

SEQ ID NO: 704501 - DNA, 25 bp, Mus musculus
ggatcccagagagatagcttagctt

SEQ ID NO: 704502 - DNA, 25 bp, Mus musculus
ggatcccagaggaccctggtgctac

SEQ ID NO: 704503 - DNA, 25 bp, Mus musculus
ggatcccagaggtccctggtgctac

SEQ ID NO: 704504 - DNA, 25 bp, Mus musculus
ggatcccaggccagcgtaaagcgac

SEQ ID NO: 704505 - DNA, 25 bp, Mus musculus
ggatcccaggcctgcgtaaagcgac

SEQ ID NO: 704506 - DNA, 25 bp, Mus musculus
ggatcccaggctcggagtcccattg

SEQ ID NO: 704507 - DNA, 25 bp, Mus musculus
ggatcccaggctgggagtcccattg

SEQ ID NO: 704508 - DNA, 25 bp, Mus musculus
ggatcccagtgcaccggcgtccggt

SEQ ID NO: 704509 - DNA, 25 bp, Mus musculus
ggatcccagtgctccggcgtccggt

SEQ ID NO: 704510 - DNA, 25 bp, Mus musculus
ggatcccatagccttgaggaccagc

SEQ ID NO: 704511 - DNA, 25 bp, Mus musculus
ggatcccatagcgttgaggaccagc

SEQ ID NO: 704512 - DNA, 25 bp, Mus musculus
ggatccccgaaaccctcacaatgat

SEQ ID NO: 704513 - DNA, 25 bp, Mus musculus
ggatccccgaaagcctcacaatgat

SEQ ID NO: 704514 - DNA, 25 bp, Mus musculus
ggatcccgacctatgagcgcatgct

SEQ ID NO: 704515 - DNA, 25 bp, Mus musculus
ggatcccgacctttgagcgcatgct

SEQ ID NO: 704516 - DNA, 25 bp, Mus musculus
ggatcccgcaaaaacccttgcagaa

SEQ ID NO: 704517 - DNA, 25 bp, Mus musculus
ggatcccgcaaatacccttgcagaa

SEQ ID NO: 704518 - DNA, 25 bp, Mus musculus
ggatcccggcggatgtgattgacat

SEQ ID NO: 704519 - DNA, 25 bp, Mus musculus
ggatcccggcggttgtgattgacat

SEQ ID NO: 704520 - DNA, 25 bp, Mus musculus
ggatcccgttgtagttgttgctgag

SEQ ID NO: 704521 - DNA, 25 bp, Mus musculus
ggatcccgttgttgttgttgctgag

SEQ ID NO: 704522 - DNA, 25 bp, Mus musculus
ggatccctaagtaacaccaatgtgg

SEQ ID NO: 704523 - DNA, 25 bp, Mus musculus
ggatccctaagttacaccaatgtgg

SEQ ID NO: 704524 - DNA, 25 bp, Mus musculus
ggatccctgcatatttcttccacac

SEQ ID NO: 704525 - DNA, 25 bp, Mus musculus
ggatccctgcatttttcttccacac

SEQ ID NO: 704526 - DNA, 25 bp, Mus musculus
ggatccctggagacatgtatgcgag

SEQ ID NO: 704527 - DNA, 25 bp, Mus musculus
ggatccctggagagaccagaggcca

SEQ ID NO: 704528 - DNA, 25 bp, Mus musculus
ggatccctggagtcatgtatgcgag

SEQ ID NO: 704529 - DNA, 25 bp, Mus musculus
ggatccctggagtgaccagaggcca

SEQ ID NO: 704530 - DNA, 25 bp, Mus musculus
ggatccctgttcagactgcatgaga

SEQ ID NO: 704531 - DNA, 25 bp, Mus musculus
ggatccctgttctgactgcatgaga

SEQ ID NO: 704532 - DNA, 25 bp, Mus musculus
ggatcccttactactccttggagaa

SEQ ID NO: 704533 - DNA, 25 bp, Mus musculus
ggatcccttacttctccttggagaa

SEQ ID NO: 704534 - DNA, 25 bp, Mus musculus
ggatccgaaaccactttgcagtcta

SEQ ID NO: 704535 - DNA, 25 bp, Mus musculus
ggatccgaaacctctttgcagtcta

SEQ ID NO: 704536 - DNA, 25 bp, Mus musculus
ggatccgcattgatgatgaacctgc

SEQ ID NO: 704537 - DNA, 25 bp, Mus musculus
ggatccgcattgttgatgaacctgc

SEQ ID NO: 704538 - DNA, 25 bp, Mus musculus
ggatccggccttccaaatggcaaat

SEQ ID NO: 704539 - DNA, 25 bp, Mus musculus
ggatccggccttgcaaatggcaaat

SEQ ID NO: 704540 - DNA, 25 bp, Mus musculus
ggatccgggtcacaattatatattt

SEQ ID NO: 704541 - DNA, 25 bp, Mus musculus
ggatccgggtcagaattatatattt

SEQ ID NO: 704542 - DNA, 25 bp, Mus musculus
ggatccgtcaagcatccggaagtat

SEQ ID NO: 704543 - DNA, 25 bp, Mus musculus
ggatccgtcaaggatccggaagtat

SEQ ID NO: 704544 - DNA, 25 bp, Mus musculus
ggatccgtgtctcacgaagaaatga

SEQ ID NO: 704545 - DNA, 25 bp, Mus musculus
ggatccgtgtctgacgaagaaatga

SEQ ID NO: 704546 - DNA, 25 bp, Mus musculus
ggatcctaaaacaccgccacatctg

SEQ ID NO: 704547 - DNA, 25 bp, Mus musculus
ggatcctaaaactccgccacatctg

SEQ ID NO: 704548 - DNA, 25 bp, Mus musculus
ggatcctacacaagttttcactcgg

SEQ ID NO: 704549 - DNA, 25 bp, Mus musculus
ggatcctacacatgttttcactcgg

SEQ ID NO: 704550 - DNA, 25 bp, Mus musculus
ggatcctaccgcagtgactgcaagc

SEQ ID NO: 704551 - DNA, 25 bp, Mus musculus
ggatcctaccgctgtgactgcaagc

SEQ ID NO: 704552 - DNA, 25 bp, Mus musculus
ggatcctagagcactgtctccctga

SEQ ID NO: 704553 - DNA, 25 bp, Mus musculus
ggatcctagagctctgtctccctga

SEQ ID NO: 704554 - DNA, 25 bp, Mus musculus
ggatcctagatacgccattacagca

SEQ ID NO: 704555 - DNA, 25 bp, Mus musculus
ggatcctagataggccattacagca

SEQ ID NO: 704556 - DNA, 25 bp, Mus musculus
ggatcctatgcacttcccattcgag

SEQ ID NO: 704557 - DNA, 25 bp, Mus musculus
ggatcctatgcagttcccattcgag

SEQ ID NO: 704558 - DNA, 25 bp, Mus musculus
ggatcctatggaacctgtcctccag

SEQ ID NO: 704559 - DNA, 25 bp, Mus musculus
ggatcctatggatcctgtcctccag

SEQ ID NO: 704560 - DNA, 25 bp, Mus musculus
ggatcctatgtgacggcttataccg

SEQ ID NO: 704561 - DNA, 25 bp, Mus musculus
ggatcctatgtgtcggcttataccg

SEQ ID NO: 704562 - DNA, 25 bp, Mus musculus
ggatcctattccagtacatgcaacc

SEQ ID NO: 704563 - DNA, 25 bp, Mus musculus
ggatcctattcctgtacatgcaacc

SEQ ID NO: 704564 - DNA, 25 bp, Mus musculus
ggatcctcaccgaggaggaccacta

SEQ ID NO: 704565 - DNA, 25 bp, Mus musculus
ggatcctcaccgtggaggaccacta

SEQ ID NO: 704566 - DNA, 25 bp, Mus musculus
ggatcctcagaacatgccctacttg

SEQ ID NO: 704567 - DNA, 25 bp, Mus musculus
ggatcctcagaagatgccctacttg

SEQ ID NO: 704568 - DNA, 25 bp, Mus musculus
ggatcctcagagactggtgtgaaaa

SEQ ID NO: 704569 - DNA, 25 bp, Mus musculus
ggatcctcagagtctggtgtgaaaa

SEQ ID NO: 704570 - DNA, 25 bp, Mus musculus
ggatcctctcccaagtcccttgggt

SEQ ID NO: 704571 - DNA, 25 bp, Mus musculus
ggatcctctccctagtcccttgggt

SEQ ID NO: 704572 - DNA, 25 bp, Mus musculus
ggatcctcttcaagcttaaacctgg

SEQ ID NO: 704573 - DNA, 25 bp, Mus musculus
ggatcctcttcatgcttaaacctgg

SEQ ID NO: 704574 - DNA, 25 bp, Mus musculus
ggatcctgaagtcaacatgaatgtg

SEQ ID NO: 704575 - DNA, 25 bp, Mus musculus
ggatcctgaagtgaacatgaatgtg

SEQ ID NO: 704576 - DNA, 25 bp, Mus musculus
ggatcctgaccaaaaacctcaaagg

SEQ ID NO: 704577 - DNA, 25 bp, Mus musculus
ggatcctgaccataaacctcaaagg

SEQ ID NO: 704578 - DNA, 25 bp, Mus musculus
ggatcctgatccatgaacgtctaga

SEQ ID NO: 704579 - DNA, 25 bp, Mus musculus
ggatcctgatccttgaacgtctaga

SEQ ID NO: 704580 - DNA, 25 bp, Mus musculus
ggatcctggagtcccagaatattaa

SEQ ID NO: 704581 - DNA, 25 bp, Mus musculus
ggatcctggagtgccagaatattaa

SEQ ID NO: 704582 - DNA, 25 bp, Mus musculus
ggatcctggccaccgattatgaaaa

SEQ ID NO: 704583 - DNA, 25 bp, Mus musculus
ggatcctggccagcgattatgaaaa

SEQ ID NO: 704584 - DNA, 25 bp, Mus musculus
ggatcctgggcgatgtcttcattgg

SEQ ID NO: 704585 - DNA, 25 bp, Mus musculus
ggatcctgggcgttgtcttcattgg

SEQ ID NO: 704586 - DNA, 25 bp, Mus musculus
ggatcctgtactacgtctacatggg

SEQ ID NO: 704587 - DNA, 25 bp, Mus musculus
ggatcctgtacttcgtctacatggg

SEQ ID NO: 704588 - DNA, 25 bp, Mus musculus
ggatcctgtgaacgagaccctgtac

SEQ ID NO: 704589 - DNA, 25 bp, Mus musculus
ggatcctgtgaaggagaccctgtac

SEQ ID NO: 704590 - DNA, 25 bp, Mus musculus
ggatcctgtgtcagcatagaatttc

SEQ ID NO: 704591 - DNA, 25 bp, Mus musculus
ggatcctgtgtctgcatagaatttc

SEQ ID NO: 704592 - DNA, 25 bp, Mus musculus
ggatccttaacacgatgggtgcagc

SEQ ID NO: 704593 - DNA, 25 bp, Mus musculus
ggatccttaacaggatgggtgcagc

SEQ ID NO: 704594 - DNA, 25 bp, Mus musculus
ggatccttagttctcagtgcgccga

SEQ ID NO: 704595 - DNA, 25 bp, Mus musculus
ggatccttagttgtcagtgcgccga

SEQ ID NO: 704596 - DNA, 25 bp, Mus musculus
ggatccttcctgatggcaccgtgga

SEQ ID NO: 704597 - DNA, 25 bp, Mus musculus
ggatccttcctgttggcaccgtgga

SEQ ID NO: 704598 - DNA, 25 bp, Mus musculus
ggatccttctacagtgtcaaccaca

SEQ ID NO: 704599 - DNA, 25 bp, Mus musculus
ggatccttctactgtgtcaaccaca

SEQ ID NO: 704600 - DNA, 25 bp, Mus musculus
ggatccttgatgatcccctgtgcaa

SEQ ID NO: 704601 - DNA, 25 bp, Mus musculus
ggatccttgatgttcccctgtgcaa

SEQ ID NO: 704602 - DNA, 25 bp, Mus musculus
ggatccttggcacacataaaagatg

SEQ ID NO: 704603 - DNA, 25 bp, Mus musculus
ggatccttggcagacataaaagatg

SEQ ID NO: 704604 - DNA, 25 bp, Mus musculus
ggatcctttaaacataaaccacttg

SEQ ID NO: 704605 - DNA, 25 bp, Mus musculus
ggatcctttaaagataaaccacttg

SEQ ID NO: 704606 - DNA, 25 bp, Mus musculus
ggatcgaaaagccaatcatcattac

SEQ ID NO: 704607 - DNA, 25 bp, Mus musculus
ggatcgaaaagcgaatcatcattac

SEQ ID NO: 704608 - DNA, 25 bp, Mus musculus
ggatcgaaatgtcaagtacaagtga

SEQ ID NO: 704609 - DNA, 25 bp, Mus musculus
ggatcgaaatgtgaagtacaagtga

SEQ ID NO: 704610 - DNA, 25 bp, Mus musculus
ggatcgacaaccacaccaaggaagt

SEQ ID NO: 704611 - DNA, 25 bp, Mus musculus
ggatcgacaacctcaccaaggaagt

SEQ ID NO: 704612 - DNA, 25 bp, Mus musculus
ggatcgacatcaacctggccgacag

SEQ ID NO: 704613 - DNA, 25 bp, Mus musculus
ggatcgacatcatcctggccgacag

SEQ ID NO: 704614 - DNA, 25 bp, Mus musculus
ggatcgactgtgagacccgctacat

SEQ ID NO: 704615 - DNA, 25 bp, Mus musculus
ggatcgactgtgtgacccgctacat

SEQ ID NO: 704616 - DNA, 25 bp, Mus musculus
ggatcgagaaaacctgataaccacg

SEQ ID NO: 704617 - DNA, 25 bp, Mus musculus
ggatcgagaaaagctgataaccacg

SEQ ID NO: 704618 - DNA, 25 bp, Mus musculus
ggatcgaggaacaaatcacctgctg

SEQ ID NO: 704619 - DNA, 25 bp, Mus musculus
ggatcgaggaactaatcacctgctg

SEQ ID NO: 704620 - DNA, 25 bp, Mus musculus
ggatcgatggagaatcatttgagct

SEQ ID NO: 704621 - DNA, 25 bp, Mus musculus
ggatcgatggagtatcatttgagct

SEQ ID NO: 704622 - DNA, 25 bp, Mus musculus
ggatcgatggtgactaagtttccag

SEQ ID NO: 704623 - DNA, 25 bp, Mus musculus
ggatcgatggtgtctaagtttccag

SEQ ID NO: 704624 - DNA, 25 bp, Mus musculus
ggatcgcaagataaaggtttccaac

SEQ ID NO: 704625 - DNA, 25 bp, Mus musculus
ggatcgcaagattaaggtttccaac

SEQ ID NO: 704626 - DNA, 25 bp, Mus musculus
ggatcgccaccaatgaggtgttcct

SEQ ID NO: 704627 - DNA, 25 bp, Mus musculus
ggatcgccaccattgaggtgttcct

SEQ ID NO: 704628 - DNA, 25 bp, Mus musculus
ggatcgcctgtgcttagggatcccc

SEQ ID NO: 704629 - DNA, 25 bp, Mus musculus
ggatcgcctgtggttagggatcccc

SEQ ID NO: 704630 - DNA, 25 bp, Mus musculus
ggatcgctcggtaatggacctcatg

SEQ ID NO: 704631 - DNA, 25 bp, Mus musculus
ggatcgctcggttatggacctcatg

SEQ ID NO: 704632 - DNA, 25 bp, Mus musculus
ggatcgctgcgaagacgccattacc

SEQ ID NO: 704633 - DNA, 25 bp, Mus musculus
ggatcgctgcgatgacgccattacc

SEQ ID NO: 704634 - DNA, 25 bp, Mus musculus
ggatcgctgctccaactctaacgtg

SEQ ID NO: 704635 - DNA, 25 bp, Mus musculus
ggatcgctgctcgaactctaacgtg

SEQ ID NO: 704636 - DNA, 25 bp, Mus musculus
ggatcgctgtctaacctgggactca

SEQ ID NO: 704637 - DNA, 25 bp, Mus musculus
ggatcgctgtcttacctgggactca

SEQ ID NO: 704638 - DNA, 25 bp, Mus musculus
ggatcgcttacacttgagaagaact

SEQ ID NO: 704639 - DNA, 25 bp, Mus musculus
ggatcgcttacagttgagaagaact

SEQ ID NO: 704640 - DNA, 25 bp, Mus musculus
ggatcggatattcgcaaggaaccac

SEQ ID NO: 704641 - DNA, 25 bp, Mus musculus
ggatcggatattggcaaggaaccac

SEQ ID NO: 704642 - DNA, 25 bp, Mus musculus
ggatcggcggccacactatcgctgg

SEQ ID NO: 704643 - DNA, 25 bp, Mus musculus
ggatcggcggcctcactatcgctgg

SEQ ID NO: 704644 - DNA, 25 bp, Mus musculus
ggatcggtgacacgcacaacgacaa

SEQ ID NO: 704645 - DNA, 25 bp, Mus musculus
ggatcggtgacaggcacaacgacaa

SEQ ID NO: 704646 - DNA, 25 bp, Mus musculus
ggatcggtggccaaaaagccgtaca

SEQ ID NO: 704647 - DNA, 25 bp, Mus musculus
ggatcggtggcctaaaagccgtaca

SEQ ID NO: 704648 - DNA, 25 bp, Mus musculus
ggatcgtaggtgctctgattcagaa

SEQ ID NO: 704649 - DNA, 25 bp, Mus musculus
ggatcgtaggtggtctgattcagaa

SEQ ID NO: 704650 - DNA, 25 bp, Mus musculus
ggatcgtcacggcttggagccatta

SEQ ID NO: 704651 - DNA, 25 bp, Mus musculus
ggatcgtcacgggttggagccatta

SEQ ID NO: 704652 - DNA, 25 bp, Mus musculus
ggatcgtgcagaccttatgtacagt

SEQ ID NO: 704653 - DNA, 25 bp, Mus musculus
ggatcgtgcagagcttatgtacagt

SEQ ID NO: 704654 - DNA, 25 bp, Mus musculus
ggatcgtgtcttaaccacatacaag

SEQ ID NO: 704655 - DNA, 25 bp, Mus musculus
ggatcgtgtctttaccacatacaag

SEQ ID NO: 704656 - DNA, 25 bp, Mus musculus
ggatcgttgtggacaagccgccttc

SEQ ID NO: 704657 - DNA, 25 bp, Mus musculus
ggatcgttgtggtcaagccgccttc

SEQ ID NO: 704658 - DNA, 25 bp, Mus musculus
ggatcgttttctagctcctccaaaa

SEQ ID NO: 704659 - DNA, 25 bp, Mus musculus
ggatcgttttcttgctcctccaaaa

SEQ ID NO: 704660 - DNA, 25 bp, Mus musculus
ggatctaaccacatcagcacagcag

SEQ ID NO: 704661 - DNA, 25 bp, Mus musculus
ggatctaaccacttcagcacagcag

SEQ ID NO: 704662 - DNA, 25 bp, Mus musculus
ggatctaagcccatgtacacacctg

SEQ ID NO: 704663 - DNA, 25 bp, Mus musculus
ggatctaagcccttgtacacacctg

SEQ ID NO: 704664 - DNA, 25 bp, Mus musculus
ggatctacaagacttcatgccctga

SEQ ID NO: 704665 - DNA, 25 bp, Mus musculus
ggatctacaagagttcatgccctga

SEQ ID NO: 704666 - DNA, 25 bp, Mus musculus
ggatctacacacaccagagcgatgt

SEQ ID NO: 704667 - DNA, 25 bp, Mus musculus
ggatctacacactccagagcgatgt

SEQ ID NO: 704668 - DNA, 25 bp, Mus musculus
ggatctaccagcaccagtgactccg

SEQ ID NO: 704669 - DNA, 25 bp, Mus musculus
ggatctaccagctccagtgactccg

SEQ ID NO: 704670 - DNA, 25 bp, Mus musculus
ggatctactggtcagcagtgccaca

SEQ ID NO: 704671 - DNA, 25 bp, Mus musculus
ggatctactggtgagcagtgccaca

SEQ ID NO: 704672 - DNA, 25 bp, Mus musculus
ggatctagaggcaatgaaaaacttt

SEQ ID NO: 704673 - DNA, 25 bp, Mus musculus
ggatctagaggctatgaaaaacttt

SEQ ID NO: 704674 - DNA, 25 bp, Mus musculus
ggatctagccatacagaaaacggag

SEQ ID NO: 704675 - DNA, 25 bp, Mus musculus
ggatctagccattcagaaaacggag

SEQ ID NO: 704676 - DNA, 25 bp, Mus musculus
ggatctagggaacaggaaccacaga

SEQ ID NO: 704677 - DNA, 25 bp, Mus musculus
ggatctagggaagaggaaccacaga

SEQ ID NO: 704678 - DNA, 25 bp, Mus musculus
ggatctagtactctgccaccgtgga

SEQ ID NO: 704679 - DNA, 25 bp, Mus musculus
ggatctagtactgtgccaccgtgga

SEQ ID NO: 704680 - DNA, 25 bp, Mus musculus
ggatctatacaaccatcaacgccca

SEQ ID NO: 704681 - DNA, 25 bp, Mus musculus
ggatctatacaagcatcaacgccca

SEQ ID NO: 704682 - DNA, 25 bp, Mus musculus
ggatctatgcgcaccgggagccctg

SEQ ID NO: 704683 - DNA, 25 bp, Mus musculus
ggatctatgcgctccgggagccctg

SEQ ID NO: 704684 - DNA, 25 bp, Mus musculus
ggatctatttggatctgccacagaa

SEQ ID NO: 704685 - DNA, 25 bp, Mus musculus
ggatctatttggttctgccacagaa

SEQ ID NO: 704686 - DNA, 25 bp, Mus musculus
ggatctcacagaaagcatctaagag

SEQ ID NO: 704687 - DNA, 25 bp, Mus musculus
ggatctcacagatagcatctaagag

SEQ ID NO: 704688 - DNA, 25 bp, Mus musculus
ggatctcaccgtcaaatattttgaa

SEQ ID NO: 704689 - DNA, 25 bp, Mus musculus
ggatctcaccgtgaaatattttgaa

SEQ ID NO: 704690 - DNA, 25 bp, Mus musculus
ggatctcagctgaagaatgcatacg

SEQ ID NO: 704691 - DNA, 25 bp, Mus musculus
ggatctcagctgtagaatgcatacg

SEQ ID NO: 704692 - DNA, 25 bp, Mus musculus
ggatctcattgaacgggaccggacc

SEQ ID NO: 704693 - DNA, 25 bp, Mus musculus
ggatctcattgatcgggaccggacc

SEQ ID NO: 704694 - DNA, 25 bp, Mus musculus
ggatctccaaacaggaatacgagga

SEQ ID NO: 704695 - DNA, 25 bp, Mus musculus
ggatctccaaactggaatacgagga

SEQ ID NO: 704696 - DNA, 25 bp, Mus musculus
ggatctccagaaagactttgcacag

SEQ ID NO: 704697 - DNA, 25 bp, Mus musculus
ggatctccagaatgactttgcacag

SEQ ID NO: 704698 - DNA, 25 bp, Mus musculus
ggatctccatgaattacagaccagc

SEQ ID NO: 704699 - DNA, 25 bp, Mus musculus
ggatctccatgatttacagaccagc

SEQ ID NO: 704700 - DNA, 25 bp, Mus musculus
ggatctcgcagtcgccctgggatac

SEQ ID NO: 704701 - DNA, 25 bp, Mus musculus
ggatctcgcagtggccctgggatac

SEQ ID NO: 704702 - DNA, 25 bp, Mus musculus
ggatctcgcgttaccagccttcctg

SEQ ID NO: 704703 - DNA, 25 bp, Mus musculus
ggatctcgcgtttccagccttcctg

SEQ ID NO: 704704 - DNA, 25 bp, Mus musculus
ggatctcggacaccaacctggagga

SEQ ID NO: 704705 - DNA, 25 bp, Mus musculus
ggatctcggacagcaacctggagga

SEQ ID NO: 704706 - DNA, 25 bp, Mus musculus
ggatctcgggaacagcttgctattg

SEQ ID NO: 704707 - DNA, 25 bp, Mus musculus
ggatctcgggaagagcttgctattg

SEQ ID NO: 704708 - DNA, 25 bp, Mus musculus
ggatctctgatacctcatattggcc

SEQ ID NO: 704709 - DNA, 25 bp, Mus musculus
ggatctctgatagctcatattggcc

SEQ ID NO: 704710 - DNA, 25 bp, Mus musculus
ggatctctgctgacgcatctcccta

SEQ ID NO: 704711 - DNA, 25 bp, Mus musculus
ggatctctgctgtcgcatctcccta

SEQ ID NO: 704712 - DNA, 25 bp, Mus musculus
ggatctcttagtccgagactcttcc

SEQ ID NO: 704713 - DNA, 25 bp, Mus musculus
ggatctcttagtgcgagactcttcc

SEQ ID NO: 704714 - DNA, 25 bp, Mus musculus
ggatctcttgttcgcagagaaaatg

SEQ ID NO: 704715 - DNA, 25 bp, Mus musculus
ggatctcttgttggcagagaaaatg

SEQ ID NO: 704716 - DNA, 25 bp, Mus musculus
ggatctgaaagaactcagacacctg

SEQ ID NO: 704717 - DNA, 25 bp, Mus musculus
ggatctgaaagatctcagacacctg

SEQ ID NO: 704718 - DNA, 25 bp, Mus musculus
ggatctgaagacaggaacagtgaaa

SEQ ID NO: 704719 - DNA, 25 bp, Mus musculus
ggatctgaagactggaacagtgaaa

SEQ ID NO: 704720 - DNA, 25 bp, Mus musculus
ggatctgaaggtatcaattagaagg

SEQ ID NO: 704721 - DNA, 25 bp, Mus musculus
ggatctgaaggtttcaattagaagg

SEQ ID NO: 704722 - DNA, 25 bp, Mus musculus
ggatctgaagtaaatcagcccagac

SEQ ID NO: 704723 - DNA, 25 bp, Mus musculus
ggatctgaagtatatcagcccagac

SEQ ID NO: 704724 - DNA, 25 bp, Mus musculus
ggatctgactctcatctgtcggctc

SEQ ID NO: 704725 - DNA, 25 bp, Mus musculus
ggatctgactctgatctgtcggctc

SEQ ID NO: 704726 - DNA, 25 bp, Mus musculus
ggatctgcactaattccccttccga

SEQ ID NO: 704727 - DNA, 25 bp, Mus musculus
ggatctgcactatttccccttccga

SEQ ID NO: 704728 - DNA, 25 bp, Mus musculus
ggatctgcagcaacaggccaaggtg

SEQ ID NO: 704729 - DNA, 25 bp, Mus musculus
ggatctgcagcatcaggccaaggtg

SEQ ID NO: 704730 - DNA, 25 bp, Mus musculus
ggatctgcaggactggctcctttac

SEQ ID NO: 704731 - DNA, 25 bp, Mus musculus
ggatctgcaggagtggctcctttac

SEQ ID NO: 704732 - DNA, 25 bp, Mus musculus
ggatctgctcttcgagttgacccaa

SEQ ID NO: 704733 - DNA, 25 bp, Mus musculus
ggatctgctcttggagttgacccaa

SEQ ID NO: 704734 - DNA, 25 bp, Mus musculus
ggatctgctgcacccgtcatcgtct

SEQ ID NO: 704735 - DNA, 25 bp, Mus musculus
ggatctgctgcagccgtcatcgtct

SEQ ID NO: 704736 - DNA, 25 bp, Mus musculus
ggatctgctgtcaagagaggaacta

SEQ ID NO: 704737 - DNA, 25 bp, Mus musculus
ggatctgctgtctagagaggaacta

SEQ ID NO: 704738 - DNA, 25 bp, Mus musculus
ggatctgctgtgctcacgatcagac

SEQ ID NO: 704739 - DNA, 25 bp, Mus musculus
ggatctgctgtggtcacgatcagac

SEQ ID NO: 704740 - DNA, 25 bp, Mus musculus
ggatctggacatcgagttgtctctg

SEQ ID NO: 704741 - DNA, 25 bp, Mus musculus
ggatctggacatggagttgtctctg

SEQ ID NO: 704742 - DNA, 25 bp, Mus musculus
ggatctggacccctatgttaagaag

SEQ ID NO: 704743 - DNA, 25 bp, Mus musculus
ggatctggacccgtatgttaagaag

SEQ ID NO: 704744 - DNA, 25 bp, Mus musculus
ggatctggagatcaatagggcttaa

SEQ ID NO: 704745 - DNA, 25 bp, Mus musculus
ggatctggagatgaatagggcttaa

SEQ ID NO: 704746 - DNA, 25 bp, Mus musculus
ggatctggccacctttctgtaccac

SEQ ID NO: 704747 - DNA, 25 bp, Mus musculus
ggatctggccacgtttctgtaccac

SEQ ID NO: 704748 - DNA, 25 bp, Mus musculus
ggatctgggttgatgcagaagaaac

SEQ ID NO: 704749 - DNA, 25 bp, Mus musculus
ggatctgggttgttgcagaagaaac

SEQ ID NO: 704750 - DNA, 25 bp, Mus musculus
ggatctggttcaatttctggtggcc

SEQ ID NO: 704751 - DNA, 25 bp, Mus musculus
ggatctggttcattttctggtggcc

SEQ ID NO: 704752 - DNA, 25 bp, Mus musculus
ggatctgtgaccacacgtgcctggg

SEQ ID NO: 704753 - DNA, 25 bp, Mus musculus
ggatctgtgacctcacgtgcctggg

SEQ ID NO: 704754 - DNA, 25 bp, Mus musculus
ggatctgtgcgaatggcggcacctc

SEQ ID NO: 704755 - DNA, 25 bp, Mus musculus
ggatctgtgcgattggcggcacctc

SEQ ID NO: 704756 - DNA, 25 bp, Mus musculus
ggatctgtgctacagggcacctact

SEQ ID NO: 704757 - DNA, 25 bp, Mus musculus
ggatctgtgctagagggcacctact

SEQ ID NO: 704758 - DNA, 25 bp, Mus musculus
ggatcttagaacctgaagggccccg

SEQ ID NO: 704759 - DNA, 25 bp, Mus musculus
ggatcttagaacgtgaagggccccg

SEQ ID NO: 704760 - DNA, 25 bp, Mus musculus
ggatcttagcaacgtccagtccaag

SEQ ID NO: 704761 - DNA, 25 bp, Mus musculus
ggatcttagcaaggtccagtccaag

SEQ ID NO: 704762 - DNA, 25 bp, Mus musculus
ggatcttcaatgctttctccactgg

SEQ ID NO: 704763 - DNA, 25 bp, Mus musculus
ggatcttcaatggtttctccactgg

SEQ ID NO: 704764 - DNA, 25 bp, Mus musculus
ggatcttcagaaatataaagctttc

SEQ ID NO: 704765 - DNA, 25 bp, Mus musculus
ggatcttcagaattataaagctttc

SEQ ID NO: 704766 - DNA, 25 bp, Mus musculus
ggatcttcagagagttcagaactta

SEQ ID NO: 704767 - DNA, 25 bp, Mus musculus
ggatcttcagagtgttcagaactta

SEQ ID NO: 704768 - DNA, 25 bp, Mus musculus
ggatcttccccaatcgtggcttcct

SEQ ID NO: 704769 - DNA, 25 bp, Mus musculus
ggatcttccccattcgtggcttcct

SEQ ID NO: 704770 - DNA, 25 bp, Mus musculus
ggatcttccttgacttgatgcatct

SEQ ID NO: 704771 - DNA, 25 bp, Mus musculus
ggatcttccttgtcttgatgcatct

SEQ ID NO: 704772 - DNA, 25 bp, Mus musculus
ggatcttgaaccctgtaggcaagca

SEQ ID NO: 704773 - DNA, 25 bp, Mus musculus
ggatcttgaaccgtgtaggcaagca

SEQ ID NO: 704774 - DNA, 25 bp, Mus musculus
ggatcttgaaggatcgagcgcttaa

SEQ ID NO: 704775 - DNA, 25 bp, Mus musculus
ggatcttgaaggttcgagcgcttaa

SEQ ID NO: 704776 - DNA, 25 bp, Mus musculus
ggatcttgatcaaggctttgctgga

SEQ ID NO: 704777 - DNA, 25 bp, Mus musculus
ggatcttgatcatggctttgctgga

SEQ ID NO: 704778 - DNA, 25 bp, Mus musculus
ggatcttggtctcgagataacccag

SEQ ID NO: 704779 - DNA, 25 bp, Mus musculus
ggatcttggtctggagataacccag

SEQ ID NO: 704780 - DNA, 25 bp, Mus musculus
ggatcttgtcaacaacatgccattc

SEQ ID NO: 704781 - DNA, 25 bp, Mus musculus
ggatcttgtcaagaacatgccattc

SEQ ID NO: 704782 - DNA, 25 bp, Mus musculus
ggatctttacagctgacgtgcacag

SEQ ID NO: 704783 - DNA, 25 bp, Mus musculus
ggatctttacaggtgacgtgcacag

SEQ ID NO: 704784 - DNA, 25 bp, Mus musculus
ggatctttaccaacctgtatgggcg

SEQ ID NO: 704785 - DNA, 25 bp, Mus musculus
ggatctttaccatcctgtatgggcg

SEQ ID NO: 704786 - DNA, 25 bp, Mus musculus
ggatctttatccacacgatgcaggg

SEQ ID NO: 704787 - DNA, 25 bp, Mus musculus
ggatctttatcctcacgatgcaggg

SEQ ID NO: 704788 - DNA, 25 bp, Mus musculus
ggatctttgcctcgagggttttcaa

SEQ ID NO: 704789 - DNA, 25 bp, Mus musculus
ggatctttgcctggagggttttcaa

SEQ ID NO: 704790 - DNA, 25 bp, Mus musculus
ggatctttgctgcttatgatggcaa

SEQ ID NO: 704791 - DNA, 25 bp, Mus musculus
ggatctttgctggttatgatggcaa

SEQ ID NO: 704792 - DNA, 25 bp, Mus musculus
ggatcttttcggcaacactgtcttc

SEQ ID NO: 704793 - DNA, 25 bp, Mus musculus
ggatcttttcgggaacactgtcttc

SEQ ID NO: 704794 - DNA, 25 bp, Mus musculus
ggatcttttgcacctcctggtgaag

SEQ ID NO: 704795 - DNA, 25 bp, Mus musculus
ggatcttttgcagctcctggtgaag

SEQ ID NO: 704796 - DNA, 25 bp, Mus musculus
ggatcttttggaagagcctatccca

SEQ ID NO: 704797 - DNA, 25 bp, Mus musculus
ggatcttttggatgagcctatccca

SEQ ID NO: 704798 - DNA, 25 bp, Mus musculus
ggatctttttaaccctattcagtca

SEQ ID NO: 704799 - DNA, 25 bp, Mus musculus
ggatctttttaagcctattcagtca

SEQ ID NO: 704800 - DNA, 25 bp, Mus musculus
ggatgaaaaggaaggtgtcaaagtc

SEQ ID NO: 704801 - DNA, 25 bp, Mus musculus
ggatgaaaaggatggtgtcaaagtc

SEQ ID NO: 704802 - DNA, 25 bp, Mus musculus
ggatgaaaagtgatggaagacgtct

SEQ ID NO: 704803 - DNA, 25 bp, Mus musculus
ggatgaaaagtgttggaagacgtct

SEQ ID NO: 704804 - DNA, 25 bp, Mus musculus
ggatgaaagagtatctgcactggaa

SEQ ID NO: 704805 - DNA, 25 bp, Mus musculus
ggatgaaagagtttctgcactggaa

SEQ ID NO: 704806 - DNA, 25 bp, Mus musculus
ggatgaaaggcgcatacttggacca

SEQ ID NO: 704807 - DNA, 25 bp, Mus musculus
ggatgaaaggcggatacttggacca

SEQ ID NO: 704808 - DNA, 25 bp, Mus musculus
ggatgaaagggaccacaccatcgaa

SEQ ID NO: 704809 - DNA, 25 bp, Mus musculus
ggatgaaagggagcacaccatcgaa

SEQ ID NO: 704810 - DNA, 25 bp, Mus musculus
ggatgaaatccacaccgtgcactct

SEQ ID NO: 704811 - DNA, 25 bp, Mus musculus
ggatgaaatccagaccgtgcactct

SEQ ID NO: 704812 - DNA, 25 bp, Mus musculus
ggatgaacctccagatatgctttgt

SEQ ID NO: 704813 - DNA, 25 bp, Mus musculus
ggatgaacctcctgatatgctttgt

SEQ ID NO: 704814 - DNA, 25 bp, Mus musculus
ggatgaactcaaacggtgggtgaca

SEQ ID NO: 704815 - DNA, 25 bp, Mus musculus
ggatgaactcaatcggtgggtgaca

SEQ ID NO: 704816 - DNA, 25 bp, Mus musculus
ggatgaactcgcatcacttcaggta

SEQ ID NO: 704817 - DNA, 25 bp, Mus musculus
ggatgaactcgcttcacttcaggta

SEQ ID NO: 704818 - DNA, 25 bp, Mus musculus
ggatgaactgcgcaggtaacgctct

SEQ ID NO: 704819 - DNA, 25 bp, Mus musculus
ggatgaactgcggaggtaacgctct

SEQ ID NO: 704820 - DNA, 25 bp, Mus musculus
ggatgaagaaacaatcaaagcgcag

SEQ ID NO: 704821 - DNA, 25 bp, Mus musculus
ggatgaagaaactatcaaagcgcag

SEQ ID NO: 704822 - DNA, 25 bp, Mus musculus
ggatgaagaaatatccggaatcaga

SEQ ID NO: 704823 - DNA, 25 bp, Mus musculus
ggatgaagaaatcagcacaaaggtg

SEQ ID NO: 704824 - DNA, 25 bp, Mus musculus
ggatgaagaaatgagcacaaaggtg

SEQ ID NO: 704825 - DNA, 25 bp, Mus musculus
ggatgaagaaatttccggaatcaga

SEQ ID NO: 704826 - DNA, 25 bp, Mus musculus
ggatgaagaactagaaagagatgaa

SEQ ID NO: 704827 - DNA, 25 bp, Mus musculus
ggatgaagaacttgaaagagatgaa

SEQ ID NO: 704828 - DNA, 25 bp, Mus musculus
ggatgaagaccaagcaccgaatcta

SEQ ID NO: 704829 - DNA, 25 bp, Mus musculus
ggatgaagaccatgcaccgaatcta

SEQ ID NO: 704830 - DNA, 25 bp, Mus musculus
ggatgaagaccgcatctttaccaac

SEQ ID NO: 704831 - DNA, 25 bp, Mus musculus
ggatgaagaccggatctttaccaac

SEQ ID NO: 704832 - DNA, 25 bp, Mus musculus
ggatgaagatagacatttgtcagac

SEQ ID NO: 704833 - DNA, 25 bp, Mus musculus
ggatgaagatagtcatttgtcagac

SEQ ID NO: 704834 - DNA, 25 bp, Mus musculus
ggatgaagatcactatgaacaattc

SEQ ID NO: 704835 - DNA, 25 bp, Mus musculus
ggatgaagatcagtatgaacaattc

SEQ ID NO: 704836 - DNA, 25 bp, Mus musculus
ggatgaagatctcacgcccggatgt

SEQ ID NO: 704837 - DNA, 25 bp, Mus musculus
ggatgaagatctctcgaccacctac

SEQ ID NO: 704838 - DNA, 25 bp, Mus musculus
ggatgaagatctgacgcccggatgt

SEQ ID NO: 704839 - DNA, 25 bp, Mus musculus
ggatgaagatctgtcgaccacctac

SEQ ID NO: 704840 - DNA, 25 bp, Mus musculus
ggatgaagatgtcgatcaagaccag

SEQ ID NO: 704841 - DNA, 25 bp, Mus musculus
ggatgaagatgtggatcaagaccag

SEQ ID NO: 704842 - DNA, 25 bp, Mus musculus
ggatgaagcaaacacgaagcccctc

SEQ ID NO: 704843 - DNA, 25 bp, Mus musculus
ggatgaagcaaagacgaagcccctc

SEQ ID NO: 704844 - DNA, 25 bp, Mus musculus
ggatgaagcacgaggagaccaacac

SEQ ID NO: 704845 - DNA, 25 bp, Mus musculus
ggatgaagcacgtggagaccaacac

SEQ ID NO: 704846 - DNA, 25 bp, Mus musculus
ggatgaagccaacagtgaagcccag

SEQ ID NO: 704847 - DNA, 25 bp, Mus musculus
ggatgaagccaagagtgaagcccag

SEQ ID NO: 704848 - DNA, 25 bp, Mus musculus
ggatgaagccttctagacccatgtg

SEQ ID NO: 704849 - DNA, 25 bp, Mus musculus
ggatgaagccttgtagacccatgtg

SEQ ID NO: 704850 - DNA, 25 bp, Mus musculus
ggatgaagtagcacatactaaatgc

SEQ ID NO: 704851 - DNA, 25 bp, Mus musculus
ggatgaagtagctcatactaaatgc

SEQ ID NO: 704852 - DNA, 25 bp, Mus musculus
ggatgaagtttgaggacgtcccaat

SEQ ID NO: 704853 - DNA, 25 bp, Mus musculus
ggatgaagtttgtggacgtcccaat

SEQ ID NO: 704854 - DNA, 25 bp, Mus musculus
ggatgaataccacacagatctctgg

SEQ ID NO: 704855 - DNA, 25 bp, Mus musculus
ggatgaataccagacagatctctgg

SEQ ID NO: 704856 - DNA, 25 bp, Mus musculus
ggatgaatcaggctgcttgtgacca

SEQ ID NO: 704857 - DNA, 25 bp, Mus musculus
ggatgaatcagggtgcttgtgacca

SEQ ID NO: 704858 - DNA, 25 bp, Mus musculus
ggatgaatgtggaggtctccgccct

SEQ ID NO: 704859 - DNA, 25 bp, Mus musculus
ggatgaatgtggtggtctccgccct

SEQ ID NO: 704860 - DNA, 25 bp, Mus musculus
ggatgaatgttccttggaaaggacc

SEQ ID NO: 704861 - DNA, 25 bp, Mus musculus
ggatgaatgttcgttggaaaggacc

SEQ ID NO: 704862 - DNA, 25 bp, Mus musculus
ggatgaattatacctgctggttcgt

SEQ ID NO: 704863 - DNA, 25 bp, Mus musculus
ggatgaattatagctgctggttcgt

SEQ ID NO: 704864 - DNA, 25 bp, Mus musculus
ggatgaatttcaccatgtttcttca

SEQ ID NO: 704865 - DNA, 25 bp, Mus musculus
ggatgaatttcagcatgtttcttca

SEQ ID NO: 704866 - DNA, 25 bp, Mus musculus
ggatgacaaagaacaagacagggag

SEQ ID NO: 704867 - DNA, 25 bp, Mus musculus
ggatgacaaagatcaagacagggag

SEQ ID NO: 704868 - DNA, 25 bp, Mus musculus
ggatgacaaagtcggcaccgacttg

SEQ ID NO: 704869 - DNA, 25 bp, Mus musculus
ggatgacaaagtgggcaccgacttg

SEQ ID NO: 704870 - DNA, 25 bp, Mus musculus
ggatgacaatatccggactgtcgta

SEQ ID NO: 704871 - DNA, 25 bp, Mus musculus
ggatgacaatatgcggactgtcgta

SEQ ID NO: 704872 - DNA, 25 bp, Mus musculus
ggatgacaatcacatagttaccagt

SEQ ID NO: 704873 - DNA, 25 bp, Mus musculus
ggatgacaatcagatagttaccagt

SEQ ID NO: 704874 - DNA, 25 bp, Mus musculus
ggatgacacactccggtgtactgga

SEQ ID NO: 704875 - DNA, 25 bp, Mus musculus
ggatgacacactgcggtgtactgga

SEQ ID NO: 704876 - DNA, 25 bp, Mus musculus
ggatgacaccctagccaaggttccg

SEQ ID NO: 704877 - DNA, 25 bp, Mus musculus
ggatgacacccttgccaaggttccg

SEQ ID NO: 704878 - DNA, 25 bp, Mus musculus
ggatgacaggatacccagtgttagg

SEQ ID NO: 704879 - DNA, 25 bp, Mus musculus
ggatgacaggattcccagtgttagg

SEQ ID NO: 704880 - DNA, 25 bp, Mus musculus
ggatgacagtgaattagacttttca

SEQ ID NO: 704881 - DNA, 25 bp, Mus musculus
ggatgacagtgatttagacttttca

SEQ ID NO: 704882 - DNA, 25 bp, Mus musculus
ggatgacataaacaatgttggactc

SEQ ID NO: 704883 - DNA, 25 bp, Mus musculus
ggatgacataaagaatgttggactc

SEQ ID NO: 704884 - DNA, 25 bp, Mus musculus
ggatgacatgaacctgctggaacag

SEQ ID NO: 704885 - DNA, 25 bp, Mus musculus
ggatgacatgaagctgctggaacag

SEQ ID NO: 704886 - DNA, 25 bp, Mus musculus
ggatgacatttaacagcgtgggaca

SEQ ID NO: 704887 - DNA, 25 bp, Mus musculus
ggatgacatttatcagcgtgggaca

SEQ ID NO: 704888 - DNA, 25 bp, Mus musculus
ggatgaccacccagtgtctcggctg

SEQ ID NO: 704889 - DNA, 25 bp, Mus musculus
ggatgaccaccctgtgtctcggctg

SEQ ID NO: 704890 - DNA, 25 bp, Mus musculus
ggatgaccagctctttgtgtcctac

SEQ ID NO: 704891 - DNA, 25 bp, Mus musculus
ggatgaccagctgtttgtgtcctac

SEQ ID NO: 704892 - DNA, 25 bp, Mus musculus
ggatgaccatcgcacagagcctgga

SEQ ID NO: 704893 - DNA, 25 bp, Mus musculus
ggatgaccatcggacagagcctgga

SEQ ID NO: 704894 - DNA, 25 bp, Mus musculus
ggatgaccccaaaactccacgagtg

SEQ ID NO: 704895 - DNA, 25 bp, Mus musculus
ggatgaccccaatactccacgagtg

SEQ ID NO: 704896 - DNA, 25 bp, Mus musculus
ggatgacctcttccgtaagactaag

SEQ ID NO: 704897 - DNA, 25 bp, Mus musculus
ggatgacctcttgcgtaagactaag

SEQ ID NO: 704898 - DNA, 25 bp, Mus musculus
ggatgacctggaatttaagcaccac

SEQ ID NO: 704899 - DNA, 25 bp, Mus musculus
ggatgacctggattttaagcaccac

SEQ ID NO: 704900 - DNA, 25 bp, Mus musculus
ggatgaccttgacccgagagcgtct

SEQ ID NO: 704901 - DNA, 25 bp, Mus musculus
ggatgaccttgagccgagagcgtct

SEQ ID NO: 704902 - DNA, 25 bp, Mus musculus
ggatgacgcctgacattttacggga

SEQ ID NO: 704903 - DNA, 25 bp, Mus musculus
ggatgacgcctgtcattttacggga

SEQ ID NO: 704904 - DNA, 25 bp, Mus musculus
ggatgacgcggaacttgccacacgt

SEQ ID NO: 704905 - DNA, 25 bp, Mus musculus
ggatgacgcggatcttgccacacgt

SEQ ID NO: 704906 - DNA, 25 bp, Mus musculus
ggatgactacatcgccaacctgcgc

SEQ ID NO: 704907 - DNA, 25 bp, Mus musculus
ggatgactacatggccaacctgcgc

SEQ ID NO: 704908 - DNA, 25 bp, Mus musculus
ggatgactaccaattccttaacctg

SEQ ID NO: 704909 - DNA, 25 bp, Mus musculus
ggatgactaccatttccttaacctg

SEQ ID NO: 704910 - DNA, 25 bp, Mus musculus
ggatgactcgagatgatgacgacga

SEQ ID NO: 704911 - DNA, 25 bp, Mus musculus
ggatgactcgagttgatgacgacga

SEQ ID NO: 704912 - DNA, 25 bp, Mus musculus
ggatgactctgtaccggaagacaac

SEQ ID NO: 704913 - DNA, 25 bp, Mus musculus
ggatgactctgttccggaagacaac

SEQ ID NO: 704914 - DNA, 25 bp, Mus musculus
ggatgactggaaaccatacaagtta

SEQ ID NO: 704915 - DNA, 25 bp, Mus musculus
ggatgactggaatccatacaagtta

SEQ ID NO: 704916 - DNA, 25 bp, Mus musculus
ggatgactgggccacatggacctca

SEQ ID NO: 704917 - DNA, 25 bp, Mus musculus
ggatgactgggcgacatggacctca

SEQ ID NO: 704918 - DNA, 25 bp, Mus musculus
ggatgactgtatctgtactcctgac

SEQ ID NO: 704919 - DNA, 25 bp, Mus musculus
ggatgactgtatgtgtactcctgac

SEQ ID NO: 704920 - DNA, 25 bp, Mus musculus
ggatgactgtgcagctgccacctgt

SEQ ID NO: 704921 - DNA, 25 bp, Mus musculus
ggatgactgtgctgctgccacctgt

SEQ ID NO: 704922 - DNA, 25 bp, Mus musculus
ggatgacttcaaaggcctccagcac

SEQ ID NO: 704923 - DNA, 25 bp, Mus musculus
ggatgacttcaatggcctccagcac

SEQ ID NO: 704924 - DNA, 25 bp, Mus musculus
ggatgacttgttccctcttcaatgg

SEQ ID NO: 704925 - DNA, 25 bp, Mus musculus
ggatgacttgttgcctcttcaatgg

SEQ ID NO: 704926 - DNA, 25 bp, Mus musculus
ggatgagaagatcccgccctatgat

SEQ ID NO: 704927 - DNA, 25 bp, Mus musculus
ggatgagaagatgccgccctatgat

SEQ ID NO: 704928 - DNA, 25 bp, Mus musculus
ggatgagagagtccatgcccgcatt

SEQ ID NO: 704929 - DNA, 25 bp, Mus musculus
ggatgagagagtgcatgcccgcatt

SEQ ID NO: 704930 - DNA, 25 bp, Mus musculus
ggatgagcaagtcttcccgctttct

SEQ ID NO: 704931 - DNA, 25 bp, Mus musculus
ggatgagcaagtgttcccgctttct

SEQ ID NO: 704932 - DNA, 25 bp, Mus musculus
ggatgagcctccagccgcctcttga

SEQ ID NO: 704933 - DNA, 25 bp, Mus musculus
ggatgagcctcctgccgcctcttga

SEQ ID NO: 704934 - DNA, 25 bp, Mus musculus
ggatgagcgcttaccctcccagcag

SEQ ID NO: 704935 - DNA, 25 bp, Mus musculus
ggatgagcgctttccctcccagcag

SEQ ID NO: 704936 - DNA, 25 bp, Mus musculus
ggatgagcttagagacattcaatca

SEQ ID NO: 704937 - DNA, 25 bp, Mus musculus
ggatgagcttagtgacattcaatca

SEQ ID NO: 704938 - DNA, 25 bp, Mus musculus
ggatgagcttgccttgctaacctgc

SEQ ID NO: 704939 - DNA, 25 bp, Mus musculus
ggatgagcttgcgttgctaacctgc

SEQ ID NO: 704940 - DNA, 25 bp, Mus musculus
ggatgaggaagtaaaggacgaccca

SEQ ID NO: 704941 - DNA, 25 bp, Mus musculus
ggatgaggaagttaaggacgaccca

SEQ ID NO: 704942 - DNA, 25 bp, Mus musculus
ggatgaggtagactctgactttgac

SEQ ID NO: 704943 - DNA, 25 bp, Mus musculus
ggatgaggtagagtctgactttgac

SEQ ID NO: 704944 - DNA, 25 bp, Mus musculus
ggatgagtacatcggtatgaccaag

SEQ ID NO: 704945 - DNA, 25 bp, Mus musculus
ggatgagtacatgggtatgaccaag

SEQ ID NO: 704946 - DNA, 25 bp, Mus musculus
ggatgagtctctccctcgcgctgat

SEQ ID NO: 704947 - DNA, 25 bp, Mus musculus
ggatgagtctctgcctcgcgctgat

SEQ ID NO: 704948 - DNA, 25 bp, Mus musculus
ggatgagtgcttcgatgagtctaac

SEQ ID NO: 704949 - DNA, 25 bp, Mus musculus
ggatgagtgcttggatgagtctaac

SEQ ID NO: 704950 - DNA, 25 bp, Mus musculus
ggatgagtgtgcactgggcacccac

SEQ ID NO: 704951 - DNA, 25 bp, Mus musculus
ggatgagtgtgctctgggcacccac

SEQ ID NO: 704952 - DNA, 25 bp, Mus musculus
ggatgagttaagctcttctacaagc

SEQ ID NO: 704953 - DNA, 25 bp, Mus musculus
ggatgagttaaggtcttctacaagc

SEQ ID NO: 704954 - DNA, 25 bp, Mus musculus
ggatgatatcaccactcaggtggca

SEQ ID NO: 704955 - DNA, 25 bp, Mus musculus
ggatgatatcacgactcaggtggca

SEQ ID NO: 704956 - DNA, 25 bp, Mus musculus
ggatgatcacacagctaactgcggg

SEQ ID NO: 704957 - DNA, 25 bp, Mus musculus
ggatgatcacactgctaactgcggg

SEQ ID NO: 704958 - DNA, 25 bp, Mus musculus
ggatgatcactacttgtgtctcaga

SEQ ID NO: 704959 - DNA, 25 bp, Mus musculus
ggatgatcactagttgtgtctcaga

SEQ ID NO: 704960 - DNA, 25 bp, Mus musculus
ggatgatcccttatccattctggat

SEQ ID NO: 704961 - DNA, 25 bp, Mus musculus
ggatgatcccttttccattctggat

SEQ ID NO: 704962 - DNA, 25 bp, Mus musculus
ggatgatctcttcgcccgccgcgtg

SEQ ID NO: 704963 - DNA, 25 bp, Mus musculus
ggatgatctcttggcccgccgcgtg

SEQ ID NO: 704964 - DNA, 25 bp, Mus musculus
ggatgatgaaatcgaggtaaatgct

SEQ ID NO: 704965 - DNA, 25 bp, Mus musculus
ggatgatgaaatggaggtaaatgct

SEQ ID NO: 704966 - DNA, 25 bp, Mus musculus
ggatgatgacatagcgtgtgccaag

SEQ ID NO: 704967 - DNA, 25 bp, Mus musculus
ggatgatgacattgcgtgtgccaag

SEQ ID NO: 704968 - DNA, 25 bp, Mus musculus
ggatgatgacttcacagcccaagat

SEQ ID NO: 704969 - DNA, 25 bp, Mus musculus
ggatgatgacttgacagcccaagat

SEQ ID NO: 704970 - DNA, 25 bp, Mus musculus
ggatgatgctccacaaccagactgg

SEQ ID NO: 704971 - DNA, 25 bp, Mus musculus
ggatgatgctcctcaaccagactgg

SEQ ID NO: 704972 - DNA, 25 bp, Mus musculus
ggatgatgttgacttcttttgagcc

SEQ ID NO: 704973 - DNA, 25 bp, Mus musculus
ggatgatgttgagttcttttgagcc

SEQ ID NO: 704974 - DNA, 25 bp, Mus musculus
ggatgattagttctctcggatctag

SEQ ID NO: 704975 - DNA, 25 bp, Mus musculus
ggatgattagttgtctcggatctag

SEQ ID NO: 704976 - DNA, 25 bp, Mus musculus
ggatgatttgaacagcctgcctgac

SEQ ID NO: 704977 - DNA, 25 bp, Mus musculus
ggatgatttgaagagcctgcctgac

SEQ ID NO: 704978 - DNA, 25 bp, Mus musculus
ggatgcaacattacagcaatacaag

SEQ ID NO: 704979 - DNA, 25 bp, Mus musculus
ggatgcaacatttcagcaatacaag

SEQ ID NO: 704980 - DNA, 25 bp, Mus musculus
ggatgcaactgaattgagcataaga

SEQ ID NO: 704981 - DNA, 25 bp, Mus musculus
ggatgcaactgatttgagcataaga

SEQ ID NO: 704982 - DNA, 25 bp, Mus musculus
ggatgcactcttagcagcccctgga

SEQ ID NO: 704983 - DNA, 25 bp, Mus musculus
ggatgcactctttgcagcccctgga

SEQ ID NO: 704984 - DNA, 25 bp, Mus musculus
ggatgcactttcaggctccagcgac

SEQ ID NO: 704985 - DNA, 25 bp, Mus musculus
ggatgcactttctggctccagcgac

SEQ ID NO: 704986 - DNA, 25 bp, Mus musculus
ggatgcagaaggctctgaaccgcca

SEQ ID NO: 704987 - DNA, 25 bp, Mus musculus
ggatgcagaagggtctgaaccgcca

SEQ ID NO: 704988 - DNA, 25 bp, Mus musculus
ggatgcagacccagaaaacaatagc

SEQ ID NO: 704989 - DNA, 25 bp, Mus musculus
ggatgcagaccctgaaaacaatagc

SEQ ID NO: 704990 - DNA, 25 bp, Mus musculus
ggatgcagagttcggacacaaacga

SEQ ID NO: 704991 - DNA, 25 bp, Mus musculus
ggatgcagagttgggacacaaacga

SEQ ID NO: 704992 - DNA, 25 bp, Mus musculus
ggatgcagctcaaatgcctcaggaa

SEQ ID NO: 704993 - DNA, 25 bp, Mus musculus
ggatgcagctcatatgcctcaggaa

SEQ ID NO: 704994 - DNA, 25 bp, Mus musculus
ggatgcagctgccaatcagggtaaa

SEQ ID NO: 704995 - DNA, 25 bp, Mus musculus
ggatgcagctgcgaatcagggtaaa

SEQ ID NO: 704996 - DNA, 25 bp, Mus musculus
ggatgcaggcacaggggcttcatct

SEQ ID NO: 704997 - DNA, 25 bp, Mus musculus
ggatgcaggcactggggcttcatct

SEQ ID NO: 704998 - DNA, 25 bp, Mus musculus
ggatgcaggcatagaatccagagac

SEQ ID NO: 704999 - DNA, 25 bp, Mus musculus
ggatgcaggcattgaatccagagac

SEQ ID NO: 705000 - DNA, 25 bp, Mus musculus
ggatgcagtagcacctggaaagttc

SEQ ID NO: 705001 - DNA, 25 bp, Mus musculus
ggatgcagtagctcctggaaagttc

SEQ ID NO: 705002 - DNA, 25 bp, Mus musculus
ggatgcagtcacactggcaattgcg

SEQ ID NO: 705003 - DNA, 25 bp, Mus musculus
ggatgcagtcactctggcaattgcg

SEQ ID NO: 705004 - DNA, 25 bp, Mus musculus
ggatgcagttctacggacgcctcgt

SEQ ID NO: 705005 - DNA, 25 bp, Mus musculus
ggatgcagttcttcggacgcctcgt

SEQ ID NO: 705006 - DNA, 25 bp, Mus musculus
ggatgcattactaacacatggaagc

SEQ ID NO: 705007 - DNA, 25 bp, Mus musculus
ggatgcattacttacacatggaagc

SEQ ID NO: 705008 - DNA, 25 bp, Mus musculus
ggatgcatttgccttgtgtggccaa

SEQ ID NO: 705009 - DNA, 25 bp, Mus musculus
ggatgcatttgcgttgtgtggccaa

SEQ ID NO: 705010 - DNA, 25 bp, Mus musculus
ggatgccaaacaccataagacaaag

SEQ ID NO: 705011 - DNA, 25 bp, Mus musculus
ggatgccaaacagcataagacaaag

SEQ ID NO: 705012 - DNA, 25 bp, Mus musculus
ggatgccaaccaaagggttctttca

SEQ ID NO: 705013 - DNA, 25 bp, Mus musculus
ggatgccaaccatagggttctttca

SEQ ID NO: 705014 - DNA, 25 bp, Mus musculus
ggatgccacaaccatcgctcaaatt

SEQ ID NO: 705015 - DNA, 25 bp, Mus musculus
ggatgccacaacgatcgctcaaatt

SEQ ID NO: 705016 - DNA, 25 bp, Mus musculus
ggatgccaccaacgctaaagctcct

SEQ ID NO: 705017 - DNA, 25 bp, Mus musculus
ggatgccaccaaggctaaagctcct

SEQ ID NO: 705018 - DNA, 25 bp, Mus musculus
ggatgccacctgctttcctggaaag

SEQ ID NO: 705019 - DNA, 25 bp, Mus musculus
ggatgccacctggtttcctggaaag

SEQ ID NO: 705020 - DNA, 25 bp, Mus musculus
ggatgccagacaacaagctagagca

SEQ ID NO: 705021 - DNA, 25 bp, Mus musculus
ggatgccagacatcaagctagagca

SEQ ID NO: 705022 - DNA, 25 bp, Mus musculus
ggatgccagcggaaaagaggtacaa

SEQ ID NO: 705023 - DNA, 25 bp, Mus musculus
ggatgccagcggtaaagaggtacaa

SEQ ID NO: 705024 - DNA, 25 bp, Mus musculus
ggatgccatcccaacggaatgagga

SEQ ID NO: 705025 - DNA, 25 bp, Mus musculus
ggatgccatccctacggaatgagga

SEQ ID NO: 705026 - DNA, 25 bp, Mus musculus
ggatgccatcgtacctgcagtaaag

SEQ ID NO: 705027 - DNA, 25 bp, Mus musculus
ggatgccatcgttcctgcagtaaag

SEQ ID NO: 705028 - DNA, 25 bp, Mus musculus
ggatgccatgacagaaatccatgag

SEQ ID NO: 705029 - DNA, 25 bp, Mus musculus
ggatgccatgactgaaatccatgag

SEQ ID NO: 705030 - DNA, 25 bp, Mus musculus
ggatgccatggccactggaagacca

SEQ ID NO: 705031 - DNA, 25 bp, Mus musculus
ggatgccatggcgactggaagacca

SEQ ID NO: 705032 - DNA, 25 bp, Mus musculus
ggatgccattgacaaagcccaggac

SEQ ID NO: 705033 - DNA, 25 bp, Mus musculus
ggatgccattgagaaagcccaggac

SEQ ID NO: 705034 - DNA, 25 bp, Mus musculus
ggatgcccgcacagtgaaactgctg

SEQ ID NO: 705035 - DNA, 25 bp, Mus musculus
ggatgcccgcactgtgaaactgctg

SEQ ID NO: 705036 - DNA, 25 bp, Mus musculus
ggatgcccggatatttcacactgag

SEQ ID NO: 705037 - DNA, 25 bp, Mus musculus
ggatgcccggatttttcacactgag

SEQ ID NO: 705038 - DNA, 25 bp, Mus musculus
ggatgcccgggaccttgccaaaaag

SEQ ID NO: 705039 - DNA, 25 bp, Mus musculus
ggatgcccgggagcttgccaaaaag

SEQ ID NO: 705040 - DNA, 25 bp, Mus musculus
ggatgcccgggtagttaaagacatg

SEQ ID NO: 705041 - DNA, 25 bp, Mus musculus
ggatgcccgggttgttaaagacatg

SEQ ID NO: 705042 - DNA, 25 bp, Mus musculus
ggatgccgttctcagtgcctgactg

SEQ ID NO: 705043 - DNA, 25 bp, Mus musculus
ggatgccgttctgagtgcctgactg

SEQ ID NO: 705044 - DNA, 25 bp, Mus musculus
ggatgcctctgtagagccatgtaca

SEQ ID NO: 705045 - DNA, 25 bp, Mus musculus
ggatgcctctgttgagccatgtaca

SEQ ID NO: 705046 - DNA, 25 bp, Mus musculus
ggatgcctgaacagtggtaccagtt

SEQ ID NO: 705047 - DNA, 25 bp, Mus musculus
ggatgcctgaactgtggtaccagtt

SEQ ID NO: 705048 - DNA, 25 bp, Mus musculus
ggatgcctgctacccgtgctttcgg

SEQ ID NO: 705049 - DNA, 25 bp, Mus musculus
ggatgcctgctagccgtgctttcgg

SEQ ID NO: 705050 - DNA, 25 bp, Mus musculus
ggatgcctgtccaatccctgctttg

SEQ ID NO: 705051 - DNA, 25 bp, Mus musculus
ggatgcctgtcctatccctgctttg

SEQ ID NO: 705052 - DNA, 25 bp, Mus musculus
ggatgccttagtcatcttccagctc

SEQ ID NO: 705053 - DNA, 25 bp, Mus musculus
ggatgccttagtgatcttccagctc

SEQ ID NO: 705054 - DNA, 25 bp, Mus musculus
ggatgcgaacgcagcactgctcagc

SEQ ID NO: 705055 - DNA, 25 bp, Mus musculus
ggatgcgaacgctgcactgctcagc

SEQ ID NO: 705056 - DNA, 25 bp, Mus musculus
ggatgcgagctgacaagaagcatgc

SEQ ID NO: 705057 - DNA, 25 bp, Mus musculus
ggatgcgagctgtcaagaagcatgc

SEQ ID NO: 705058 - DNA, 25 bp, Mus musculus
ggatgcgcgcttactttcctagacc

SEQ ID NO: 705059 - DNA, 25 bp, Mus musculus
ggatgcgcgctttctttcctagacc

SEQ ID NO: 705060 - DNA, 25 bp, Mus musculus
ggatgcgctcctatggcatgatccc

SEQ ID NO: 705061 - DNA, 25 bp, Mus musculus
ggatgcgctcctttggcatgatccc

SEQ ID NO: 705062 - DNA, 25 bp, Mus musculus
ggatgcggagagaccatatatgtca

SEQ ID NO: 705063 - DNA, 25 bp, Mus musculus
ggatgcggagagtccatatatgtca

SEQ ID NO: 705064 - DNA, 25 bp, Mus musculus
ggatgcggccttcgcagcacctgct

SEQ ID NO: 705065 - DNA, 25 bp, Mus musculus
ggatgcggccttggcagcacctgct

SEQ ID NO: 705066 - DNA, 25 bp, Mus musculus
ggatgcgggtgtccggtgcaacctc

SEQ ID NO: 705067 - DNA, 25 bp, Mus musculus
ggatgcgggtgtgcggtgcaacctc

SEQ ID NO: 705068 - DNA, 25 bp, Mus musculus
ggatgcggtttcacaagcccttgat

SEQ ID NO: 705069 - DNA, 25 bp, Mus musculus
ggatgcggtttctcaagcccttgat

SEQ ID NO: 705070 - DNA, 25 bp, Mus musculus
ggatgcgtccttcccctatgaagca

SEQ ID NO: 705071 - DNA, 25 bp, Mus musculus
ggatgcgtccttgccctatgaagca

SEQ ID NO: 705072 - DNA, 25 bp, Mus musculus
ggatgctatgctagcctgaacccca

SEQ ID NO: 705073 - DNA, 25 bp, Mus musculus
ggatgctatgcttgcctgaacccca

SEQ ID NO: 705074 - DNA, 25 bp, Mus musculus
ggatgctcagttcccagaacctaaa

SEQ ID NO: 705075 - DNA, 25 bp, Mus musculus
ggatgctcagttgccagaacctaaa

SEQ ID NO: 705076 - DNA, 25 bp, Mus musculus
ggatgctcccgaccgggctatgtct

SEQ ID NO: 705077 - DNA, 25 bp, Mus musculus
ggatgctcccgagcgggctatgtct

SEQ ID NO: 705078 - DNA, 25 bp, Mus musculus
ggatgctctctaagtcgttcactac

SEQ ID NO: 705079 - DNA, 25 bp, Mus musculus
ggatgctctctatgtcgttcactac

SEQ ID NO: 705080 - DNA, 25 bp, Mus musculus
ggatgctcttttcgaacagcagaac

SEQ ID NO: 705081 - DNA, 25 bp, Mus musculus
ggatgctcttttggaacagcagaac

SEQ ID NO: 705082 - DNA, 25 bp, Mus musculus
ggatgctgataacgacaactgtatg

SEQ ID NO: 705083 - DNA, 25 bp, Mus musculus
ggatgctgataaggacaactgtatg

SEQ ID NO: 705084 - DNA, 25 bp, Mus musculus
ggatgctgatctaatcgtggcaaaa

SEQ ID NO: 705085 - DNA, 25 bp, Mus musculus
ggatgctgatcttatcgtggcaaaa

SEQ ID NO: 705086 - DNA, 25 bp, Mus musculus
ggatgctgccggcaagaccaccatc

SEQ ID NO: 705087 - DNA, 25 bp, Mus musculus
ggatgctgccgggaagaccaccatc

SEQ ID NO: 705088 - DNA, 25 bp, Mus musculus
ggatgctggctactctttttaagga

SEQ ID NO: 705089 - DNA, 25 bp, Mus musculus
ggatgctggctagtctttttaagga

SEQ ID NO: 705090 - DNA, 25 bp, Mus musculus
ggatgctgggcaccccttagctgac

SEQ ID NO: 705091 - DNA, 25 bp, Mus musculus
ggatgctgggcagcccttagctgac

SEQ ID NO: 705092 - DNA, 25 bp, Mus musculus
ggatgctgtcctccctttgtgtctg

SEQ ID NO: 705093 - DNA, 25 bp, Mus musculus
ggatgctgtcctgcctttgtgtctg

SEQ ID NO: 705094 - DNA, 25 bp, Mus musculus
ggatgctgtgctccttgtgtttgca

SEQ ID NO: 705095 - DNA, 25 bp, Mus musculus
ggatgctgtgctgcttgtgtttgca

SEQ ID NO: 705096 - DNA, 25 bp, Mus musculus
ggatgctgtgtcctccatgaacctc

SEQ ID NO: 705097 - DNA, 25 bp, Mus musculus
ggatgctgtgtcgtccatgaacctc

SEQ ID NO: 705098 - DNA, 25 bp, Mus musculus
ggatgctgttccaaccatttttgat

SEQ ID NO: 705099 - DNA, 25 bp, Mus musculus
ggatgctgttcctaccatttttgat

SEQ ID NO: 705100 - DNA, 25 bp, Mus musculus
ggatgcttactactcgtcccaggac

SEQ ID NO: 705101 - DNA, 25 bp, Mus musculus
ggatgcttactagtcgtcccaggac

SEQ ID NO: 705102 - DNA, 25 bp, Mus musculus
ggatgcttagccaggcccggagtct

SEQ ID NO: 705103 - DNA, 25 bp, Mus musculus
ggatgcttagcctggcccggagtct

SEQ ID NO: 705104 - DNA, 25 bp, Mus musculus
ggatgcttccttatcggctgtgcca

SEQ ID NO: 705105 - DNA, 25 bp, Mus musculus
ggatgcttccttttcggctgtgcca

SEQ ID NO: 705106 - DNA, 25 bp, Mus musculus
ggatgcttctctaactcaatggtgg

SEQ ID NO: 705107 - DNA, 25 bp, Mus musculus
ggatgcttctcttactcaatggtgg

SEQ ID NO: 705108 - DNA, 25 bp, Mus musculus
ggatgcttctgtataagccgctgat

SEQ ID NO: 705109 - DNA, 25 bp, Mus musculus
ggatgcttctgtttaagccgctgat

SEQ ID NO: 705110 - DNA, 25 bp, Mus musculus
ggatgcttgtatactttgctccacc

SEQ ID NO: 705111 - DNA, 25 bp, Mus musculus
ggatgcttgtattctttgctccacc

SEQ ID NO: 705112 - DNA, 25 bp, Mus musculus
ggatggaaatcccaaccaaggcaag

SEQ ID NO: 705113 - DNA, 25 bp, Mus musculus
ggatggaaatccgaaccaaggcaag

SEQ ID NO: 705114 - DNA, 25 bp, Mus musculus
ggatggaaggacacatcccaaagaa

SEQ ID NO: 705115 - DNA, 25 bp, Mus musculus
ggatggaaggactcatcccaaagaa

SEQ ID NO: 705116 - DNA, 25 bp, Mus musculus
ggatggaatagactttgcctttaaa

SEQ ID NO: 705117 - DNA, 25 bp, Mus musculus
ggatggaatagagtttgcctttaaa

SEQ ID NO: 705118 - DNA, 25 bp, Mus musculus
ggatggaatattagacttgtttcac

SEQ ID NO: 705119 - DNA, 25 bp, Mus musculus
ggatggaatatttgacttgtttcac

SEQ ID NO: 705120 - DNA, 25 bp, Mus musculus
ggatggaatcccaggtttccgagga

SEQ ID NO: 705121 - DNA, 25 bp, Mus musculus
ggatggaatccctggtttccgagga

SEQ ID NO: 705122 - DNA, 25 bp, Mus musculus
ggatggaattcgaaggcgccatcat

SEQ ID NO: 705123 - DNA, 25 bp, Mus musculus
ggatggaattcgtaggcgccatcat

SEQ ID NO: 705124 - DNA, 25 bp, Mus musculus
ggatggaattctcggacagattcct

SEQ ID NO: 705125 - DNA, 25 bp, Mus musculus
ggatggaattctgggacagattcct

SEQ ID NO: 705126 - DNA, 25 bp, Mus musculus
ggatggacaccaccgcttgcctggc

SEQ ID NO: 705127 - DNA, 25 bp, Mus musculus
ggatggacaccagcgcttgcctggc

SEQ ID NO: 705128 - DNA, 25 bp, Mus musculus
ggatggacatgcactcgcaatgtta

SEQ ID NO: 705129 - DNA, 25 bp, Mus musculus
ggatggacatgctctcgcaatgtta

SEQ ID NO: 705130 - DNA, 25 bp, Mus musculus
ggatggaccatacttactcctccaa

SEQ ID NO: 705131 - DNA, 25 bp, Mus musculus
ggatggaccatagttactcctccaa

SEQ ID NO: 705132 - DNA, 25 bp, Mus musculus
ggatggacccctcttatgtatgccg

SEQ ID NO: 705133 - DNA, 25 bp, Mus musculus
ggatggacccctgttatgtatgccg

SEQ ID NO: 705134 - DNA, 25 bp, Mus musculus
ggatggagaagaagcgtcactattg

SEQ ID NO: 705135 - DNA, 25 bp, Mus musculus
ggatggagaagacctcctccatcac

SEQ ID NO: 705136 - DNA, 25 bp, Mus musculus
ggatggagaagagctcctccatcac

SEQ ID NO: 705137 - DNA, 25 bp, Mus musculus
ggatggagaagatgcgtcactattg

SEQ ID NO: 705138 - DNA, 25 bp, Mus musculus
ggatggagacagacgccaccatttc

SEQ ID NO: 705139 - DNA, 25 bp, Mus musculus
ggatggagacagtcgccaccatttc

SEQ ID NO: 705140 - DNA, 25 bp, Mus musculus
ggatggagcattcccatgaccagga

SEQ ID NO: 705141 - DNA, 25 bp, Mus musculus
ggatggagcattgccatgaccagga

SEQ ID NO: 705142 - DNA, 25 bp, Mus musculus
ggatggagtggtacaagttcccctt

SEQ ID NO: 705143 - DNA, 25 bp, Mus musculus
ggatggagtggttcaagttcccctt

SEQ ID NO: 705144 - DNA, 25 bp, Mus musculus
ggatggatcaggacccctgacctca

SEQ ID NO: 705145 - DNA, 25 bp, Mus musculus
ggatggatcaggtcccctgacctca

SEQ ID NO: 705146 - DNA, 25 bp, Mus musculus
ggatggatggcaatagactgacttt

SEQ ID NO: 705147 - DNA, 25 bp, Mus musculus
ggatggatggcattagactgacttt

SEQ ID NO: 705148 - DNA, 25 bp, Mus musculus
ggatggcaatcacgaagcttctgag

SEQ ID NO: 705149 - DNA, 25 bp, Mus musculus
ggatggcaatcaggaagcttctgag

SEQ ID NO: 705150 - DNA, 25 bp, Mus musculus
ggatggcagaggacctaattctcta

SEQ ID NO: 705151 - DNA, 25 bp, Mus musculus
ggatggcagaggtcctaattctcta

SEQ ID NO: 705152 - DNA, 25 bp, Mus musculus
ggatggcatgtccttccaagagagc

SEQ ID NO: 705153 - DNA, 25 bp, Mus musculus
ggatggcatgtcgttccaagagagc

SEQ ID NO: 705154 - DNA, 25 bp, Mus musculus
ggatggcatgtgaccgctgacatga

SEQ ID NO: 705155 - DNA, 25 bp, Mus musculus
ggatggcatgtgtccgctgacatga

SEQ ID NO: 705156 - DNA, 25 bp, Mus musculus
ggatggccacctagcccatcaagct

SEQ ID NO: 705157 - DNA, 25 bp, Mus musculus
ggatggccaccttgcccatcaagct

SEQ ID NO: 705158 - DNA, 25 bp, Mus musculus
ggatggcccatgcttcacgagtgaa

SEQ ID NO: 705159 - DNA, 25 bp, Mus musculus
ggatggcccatggttcacgagtgaa

SEQ ID NO: 705160 - DNA, 25 bp, Mus musculus
ggatggccccagagagcatcttcaa

SEQ ID NO: 705161 - DNA, 25 bp, Mus musculus
ggatggccccagtgagcatcttcaa

SEQ ID NO: 705162 - DNA, 25 bp, Mus musculus
ggatggccctctaccgtctggtgga

SEQ ID NO: 705163 - DNA, 25 bp, Mus musculus
ggatggccctcttccgtctggtgga

SEQ ID NO: 705164 - DNA, 25 bp, Mus musculus
ggatggcctcttcatgagtactggt

SEQ ID NO: 705165 - DNA, 25 bp, Mus musculus
ggatggcctcttgatgagtactggt

SEQ ID NO: 705166 - DNA, 25 bp, Mus musculus
ggatggcctggaacccgtgtgcttt

SEQ ID NO: 705167 - DNA, 25 bp, Mus musculus
ggatggcctggaagatcccctggaa

SEQ ID NO: 705168 - DNA, 25 bp, Mus musculus
ggatggcctggatcccgtgtgcttt

SEQ ID NO: 705169 - DNA, 25 bp, Mus musculus
ggatggcctggatgatcccctggaa

SEQ ID NO: 705170 - DNA, 25 bp, Mus musculus
ggatggccttcacttcagaccttga

SEQ ID NO: 705171 - DNA, 25 bp, Mus musculus
ggatggccttcagttcagaccttga

SEQ ID NO: 705172 - DNA, 25 bp, Mus musculus
ggatggccttctaggacaatccaac

SEQ ID NO: 705173 - DNA, 25 bp, Mus musculus
ggatggccttcttggacaatccaac

SEQ ID NO: 705174 - DNA, 25 bp, Mus musculus
ggatggcgacagatccacggcccag

SEQ ID NO: 705175 - DNA, 25 bp, Mus musculus
ggatggcgacagttccacggcccag

SEQ ID NO: 705176 - DNA, 25 bp, Mus musculus
ggatggctccagaggcattgttcga

SEQ ID NO: 705177 - DNA, 25 bp, Mus musculus
ggatggctccagtggcattgttcga

SEQ ID NO: 705178 - DNA, 25 bp, Mus musculus
ggatggctccggacatcagctgctt

SEQ ID NO: 705179 - DNA, 25 bp, Mus musculus
ggatggctccggtcatcagctgctt

SEQ ID NO: 705180 - DNA, 25 bp, Mus musculus
ggatggctccttaaaatactcgata

SEQ ID NO: 705181 - DNA, 25 bp, Mus musculus
ggatggctcctttaaatactcgata

SEQ ID NO: 705182 - DNA, 25 bp, Mus musculus
ggatggctctccaccggttttggtt

SEQ ID NO: 705183 - DNA, 25 bp, Mus musculus
ggatggctctcctccggttttggtt

SEQ ID NO: 705184 - DNA, 25 bp, Mus musculus
ggatggctgcagcttcatatgatca

SEQ ID NO: 705185 - DNA, 25 bp, Mus musculus
ggatggctgcaggttcatatgatca

SEQ ID NO: 705186 - DNA, 25 bp, Mus musculus
ggatggctggatctacaacagcacc

SEQ ID NO: 705187 - DNA, 25 bp, Mus musculus
ggatggctggatgtacaacagcacc

SEQ ID NO: 705188 - DNA, 25 bp, Mus musculus
ggatggctgtatactgcggtcagaa

SEQ ID NO: 705189 - DNA, 25 bp, Mus musculus
ggatggctgtattctgcggtcagaa

SEQ ID NO: 705190 - DNA, 25 bp, Mus musculus
ggatggcttcttcagagtttgctac

SEQ ID NO: 705191 - DNA, 25 bp, Mus musculus
ggatggcttcttgagagtttgctac

SEQ ID NO: 705192 - DNA, 25 bp, Mus musculus
ggatgggaccatcaatctttccgag

SEQ ID NO: 705193 - DNA, 25 bp, Mus musculus
ggatgggaccatgaatctttccgag

SEQ ID NO: 705194 - DNA, 25 bp, Mus musculus
ggatgggacccaattacagtgtgcc

SEQ ID NO: 705195 - DNA, 25 bp, Mus musculus
ggatgggacccatttacagtgtgcc

SEQ ID NO: 705196 - DNA, 25 bp, Mus musculus
ggatgggcaactccgtcaagtcgcc

SEQ ID NO: 705197 - DNA, 25 bp, Mus musculus
ggatgggcaactgcgtcaagtcgcc

SEQ ID NO: 705198 - DNA, 25 bp, Mus musculus
ggatgggcagccaggaaagccctca

SEQ ID NO: 705199 - DNA, 25 bp, Mus musculus
ggatgggcagcctggaaagccctca

SEQ ID NO: 705200 - DNA, 25 bp, Mus musculus
ggatgggcctcactaccaccttgct

SEQ ID NO: 705201 - DNA, 25 bp, Mus musculus
ggatgggcctcagtaccaccttgct

SEQ ID NO: 705202 - DNA, 25 bp, Mus musculus
ggatgggctagtcggtaaattctct

SEQ ID NO: 705203 - DNA, 25 bp, Mus musculus
ggatgggctagtgggtaaattctct

SEQ ID NO: 705204 - DNA, 25 bp, Mus musculus
ggatgggctcaaacttatgcttctg

SEQ ID NO: 705205 - DNA, 25 bp, Mus musculus
ggatgggctcaatcttatgcttctg

SEQ ID NO: 705206 - DNA, 25 bp, Mus musculus
ggatgggtacccaccagtacgacaa

SEQ ID NO: 705207 - DNA, 25 bp, Mus musculus
ggatgggtaccctccagtacgacaa

SEQ ID NO: 705208 - DNA, 25 bp, Mus musculus
ggatgggtctctcagacatgcataa

SEQ ID NO: 705209 - DNA, 25 bp, Mus musculus
ggatgggtctctgagacatgcataa

SEQ ID NO: 705210 - DNA, 25 bp, Mus musculus
ggatgggttactccctcttctacga

SEQ ID NO: 705211 - DNA, 25 bp, Mus musculus
ggatgggttactgcctcttctacga

SEQ ID NO: 705212 - DNA, 25 bp, Mus musculus
ggatggtatatgcacaagacaccca

SEQ ID NO: 705213 - DNA, 25 bp, Mus musculus
ggatggtatatggacaagacaccca

SEQ ID NO: 705214 - DNA, 25 bp, Mus musculus
ggatggtatcaacggcatgattcag

SEQ ID NO: 705215 - DNA, 25 bp, Mus musculus
ggatggtatcaagggcatgattcag

SEQ ID NO: 705216 - DNA, 25 bp, Mus musculus
ggatggtcactacgcctctgaggct

SEQ ID NO: 705217 - DNA, 25 bp, Mus musculus
ggatggtcactaggcctctgaggct

SEQ ID NO: 705218 - DNA, 25 bp, Mus musculus
ggatggtcagcgatagttactgcag

SEQ ID NO: 705219 - DNA, 25 bp, Mus musculus
ggatggtcagcgttagttactgcag

SEQ ID NO: 705220 - DNA, 25 bp, Mus musculus
ggatggtcatgcacggcctgaagct

SEQ ID NO: 705221 - DNA, 25 bp, Mus musculus
ggatggtcatgctcggcctgaagct

SEQ ID NO: 705222 - DNA, 25 bp, Mus musculus
ggatggtcgctacaatccctgcgct

SEQ ID NO: 705223 - DNA, 25 bp, Mus musculus
ggatggtcgctagaatccctgcgct

SEQ ID NO: 705224 - DNA, 25 bp, Mus musculus
ggatggtctgcgactgcgaaaaccc

SEQ ID NO: 705225 - DNA, 25 bp, Mus musculus
ggatggtctgcgtctgcgaaaaccc

SEQ ID NO: 705226 - DNA, 25 bp, Mus musculus
ggatggtgcgatcgcccgttaacta

SEQ ID NO: 705227 - DNA, 25 bp, Mus musculus
ggatggtgcgatggcccgttaacta

SEQ ID NO: 705228 - DNA, 25 bp, Mus musculus
ggatggtggctcatatgctatattc

SEQ ID NO: 705229 - DNA, 25 bp, Mus musculus
ggatggtggctcttatgctatattc

SEQ ID NO: 705230 - DNA, 25 bp, Mus musculus
ggatggttcataaacttacgtcagt

SEQ ID NO: 705231 - DNA, 25 bp, Mus musculus
ggatggttcatatacttacgtcagt

SEQ ID NO: 705232 - DNA, 25 bp, Mus musculus
ggatggttcccacccgcggtctctt

SEQ ID NO: 705233 - DNA, 25 bp, Mus musculus
ggatggttcccagccgcggtctctt

SEQ ID NO: 705234 - DNA, 25 bp, Mus musculus
ggatggttgcttcggacttgtcttc

SEQ ID NO: 705235 - DNA, 25 bp, Mus musculus
ggatggttgcttgggacttgtcttc

SEQ ID NO: 705236 - DNA, 25 bp, Mus musculus
ggatggtttccgatcaggcaagaag

SEQ ID NO: 705237 - DNA, 25 bp, Mus musculus
ggatggtttccgttcaggcaagaag

SEQ ID NO: 705238 - DNA, 25 bp, Mus musculus
ggatgtacagaacgcaatggatgaa

SEQ ID NO: 705239 - DNA, 25 bp, Mus musculus
ggatgtacagaaggcaatggatgaa

SEQ ID NO: 705240 - DNA, 25 bp, Mus musculus
ggatgtactctaccttctaaaaagg

SEQ ID NO: 705241 - DNA, 25 bp, Mus musculus
ggatgtactctagcttctaaaaagg

SEQ ID NO: 705242 - DNA, 25 bp, Mus musculus
ggatgtagctcacaatcaacttgaa

SEQ ID NO: 705243 - DNA, 25 bp, Mus musculus
ggatgtagctcagaatcaacttgaa

SEQ ID NO: 705244 - DNA, 25 bp, Mus musculus
ggatgtaggagaaaaatggtcccct

SEQ ID NO: 705245 - DNA, 25 bp, Mus musculus
ggatgtaggagataaatggtcccct

SEQ ID NO: 705246 - DNA, 25 bp, Mus musculus
ggatgtagtggccttcattctgcgc

SEQ ID NO: 705247 - DNA, 25 bp, Mus musculus
ggatgtagtggcgttcattctgcgc

SEQ ID NO: 705248 - DNA, 25 bp, Mus musculus
ggatgtatccttcatgtatctgacc

SEQ ID NO: 705249 - DNA, 25 bp, Mus musculus
ggatgtatccttgatgtatctgacc

SEQ ID NO: 705250 - DNA, 25 bp, Mus musculus
ggatgtattaaacttgatgagctca

SEQ ID NO: 705251 - DNA, 25 bp, Mus musculus
ggatgtattaaagttgatgagctca

SEQ ID NO: 705252 - DNA, 25 bp, Mus musculus
ggatgtattcgcagccacgggtgaa

SEQ ID NO: 705253 - DNA, 25 bp, Mus musculus
ggatgtattcgctgccacgggtgaa

SEQ ID NO: 705254 - DNA, 25 bp, Mus musculus
ggatgtattttgatgctccggcgga

SEQ ID NO: 705255 - DNA, 25 bp, Mus musculus
ggatgtattttgttgctccggcgga

SEQ ID NO: 705256 - DNA, 25 bp, Mus musculus
ggatgtcaccaacacagagagtatt

SEQ ID NO: 705257 - DNA, 25 bp, Mus musculus
ggatgtcaccaagacagagagtatt

SEQ ID NO: 705258 - DNA, 25 bp, Mus musculus
ggatgtcaccagcagtcagagcctc

SEQ ID NO: 705259 - DNA, 25 bp, Mus musculus
ggatgtcaccaggagtcagagcctc

SEQ ID NO: 705260 - DNA, 25 bp, Mus musculus
ggatgtcagattagtcagcaacttg

SEQ ID NO: 705261 - DNA, 25 bp, Mus musculus
ggatgtcagatttgtcagcaacttg

SEQ ID NO: 705262 - DNA, 25 bp, Mus musculus
ggatgtcagcccagattacggtcca

SEQ ID NO: 705263 - DNA, 25 bp, Mus musculus
ggatgtcagccctgattacggtcca

SEQ ID NO: 705264 - DNA, 25 bp, Mus musculus
ggatgtcagtggacagctcaactcc

SEQ ID NO: 705265 - DNA, 25 bp, Mus musculus
ggatgtcagtggtcagctcaactcc

SEQ ID NO: 705266 - DNA, 25 bp, Mus musculus
ggatgtcatccaagaatatgaggac

SEQ ID NO: 705267 - DNA, 25 bp, Mus musculus
ggatgtcatccatgaatatgaggac

SEQ ID NO: 705268 - DNA, 25 bp, Mus musculus
ggatgtcccaccactctgagctctg

SEQ ID NO: 705269 - DNA, 25 bp, Mus musculus
ggatgtcccacctctctgagctctg

SEQ ID NO: 705270 - DNA, 25 bp, Mus musculus
ggatgtccctctaaccatcagtgat

SEQ ID NO: 705271 - DNA, 25 bp, Mus musculus
ggatgtccctcttaccatcagtgat

SEQ ID NO: 705272 - DNA, 25 bp, Mus musculus
ggatgtccgcctccgcgcacttttg

SEQ ID NO: 705273 - DNA, 25 bp, Mus musculus
ggatgtccgcctgcgcgcacttttg

SEQ ID NO: 705274 - DNA, 25 bp, Mus musculus
ggatgtccgcttctcccaaaggatg

SEQ ID NO: 705275 - DNA, 25 bp, Mus musculus
ggatgtccgcttgtcccaaaggatg

SEQ ID NO: 705276 - DNA, 25 bp, Mus musculus
ggatgtccttcacagcaccaagctg

SEQ ID NO: 705277 - DNA, 25 bp, Mus musculus
ggatgtccttcagagcaccaagctg

SEQ ID NO: 705278 - DNA, 25 bp, Mus musculus
ggatgtccttctcactgcatttgcc

SEQ ID NO: 705279 - DNA, 25 bp, Mus musculus
ggatgtccttctgactgcatttgcc

SEQ ID NO: 705280 - DNA, 25 bp, Mus musculus
ggatgtcgatataactgaacttcac

SEQ ID NO: 705281 - DNA, 25 bp, Mus musculus
ggatgtcgatattactgaacttcac

SEQ ID NO: 705282 - DNA, 25 bp, Mus musculus
ggatgtcgggctcattgattctgta

SEQ ID NO: 705283 - DNA, 25 bp, Mus musculus
ggatgtcgggctgattgattctgta

SEQ ID NO: 705284 - DNA, 25 bp, Mus musculus
ggatgtcgtcttacacaaaggcctt

SEQ ID NO: 705285 - DNA, 25 bp, Mus musculus
ggatgtcgtctttcacaaaggcctt

SEQ ID NO: 705286 - DNA, 25 bp, Mus musculus
ggatgtctaaatccccagttgacag

SEQ ID NO: 705287 - DNA, 25 bp, Mus musculus
ggatgtctaaatgcccagttgacag

SEQ ID NO: 705288 - DNA, 25 bp, Mus musculus
ggatgtctctctactgagcactgca

SEQ ID NO: 705289 - DNA, 25 bp, Mus musculus
ggatgtctctcttctgagcactgca

SEQ ID NO: 705290 - DNA, 25 bp, Mus musculus
ggatgtcttctcatttgggatcgtt

SEQ ID NO: 705291 - DNA, 25 bp, Mus musculus
ggatgtcttctcttttgggatcgtt

SEQ ID NO: 705292 - DNA, 25 bp, Mus musculus
ggatgtcttgttcaagcaccaggcc

SEQ ID NO: 705293 - DNA, 25 bp, Mus musculus
ggatgtcttgttgaagcaccaggcc

SEQ ID NO: 705294 - DNA, 25 bp, Mus musculus
ggatgtgaaaatagccttttgtcag

SEQ ID NO: 705295 - DNA, 25 bp, Mus musculus
ggatgtgaaaattgccttttgtcag

SEQ ID NO: 705296 - DNA, 25 bp, Mus musculus
ggatgtgacaacagcaacgagtggt

SEQ ID NO: 705297 - DNA, 25 bp, Mus musculus
ggatgtgacaactgcaacgagtggt

SEQ ID NO: 705298 - DNA, 25 bp, Mus musculus
ggatgtgaccaaaaccactttcctg

SEQ ID NO: 705299 - DNA, 25 bp, Mus musculus
ggatgtgaccaataccactttcctg

SEQ ID NO: 705300 - DNA, 25 bp, Mus musculus
ggatgtgagctcacagccgagattg

SEQ ID NO: 705301 - DNA, 25 bp, Mus musculus
ggatgtgagctctcagccgagattg

SEQ ID NO: 705302 - DNA, 25 bp, Mus musculus
ggatgtgatacaccgcatgtgccag

SEQ ID NO: 705303 - DNA, 25 bp, Mus musculus
ggatgtgatacagcgcatgtgccag

SEQ ID NO: 705304 - DNA, 25 bp, Mus musculus
ggatgtgcacgaaggacagcccctt

SEQ ID NO: 705305 - DNA, 25 bp, Mus musculus
ggatgtgcacgatggacagcccctt

SEQ ID NO: 705306 - DNA, 25 bp, Mus musculus
ggatgtgcatcaatgtacctccacc

SEQ ID NO: 705307 - DNA, 25 bp, Mus musculus
ggatgtgcatcattgtacctccacc

SEQ ID NO: 705308 - DNA, 25 bp, Mus musculus
ggatgtgccctacaggataagcctg

SEQ ID NO: 705309 - DNA, 25 bp, Mus musculus
ggatgtgccctagaggataagcctg

SEQ ID NO: 705310 - DNA, 25 bp, Mus musculus
ggatgtgcctcacccacaggccatt

SEQ ID NO: 705311 - DNA, 25 bp, Mus musculus
ggatgtgcctcagccacaggccatt

SEQ ID NO: 705312 - DNA, 25 bp, Mus musculus
ggatgtgctaccacaccatcaagga

SEQ ID NO: 705313 - DNA, 25 bp, Mus musculus
ggatgtgctacctcaccatcaagga

SEQ ID NO: 705314 - DNA, 25 bp, Mus musculus
ggatgtgctcccactgcctgtctca

SEQ ID NO: 705315 - DNA, 25 bp, Mus musculus
ggatgtgctccctctgcctgtctca

SEQ ID NO: 705316 - DNA, 25 bp, Mus musculus
ggatgtgctcctcgccatgatcata

SEQ ID NO: 705317 - DNA, 25 bp, Mus musculus
ggatgtgctcctggccatgatcata

SEQ ID NO: 705318 - DNA, 25 bp, Mus musculus
ggatgtggaagacatagaccacgca

SEQ ID NO: 705319 - DNA, 25 bp, Mus musculus
ggatgtggaagagatagaccacgca

SEQ ID NO: 705320 - DNA, 25 bp, Mus musculus
ggatgtggacataaccctgtcttca

SEQ ID NO: 705321 - DNA, 25 bp, Mus musculus
ggatgtggacattaccctgtcttca

SEQ ID NO: 705322 - DNA, 25 bp, Mus musculus
ggatgtggagtcaccccttcctgct

SEQ ID NO: 705323 - DNA, 25 bp, Mus musculus
ggatgtggagtctccccttcctgct

SEQ ID NO: 705324 - DNA, 25 bp, Mus musculus
ggatgtggatcaccgagagtcccca

SEQ ID NO: 705325 - DNA, 25 bp, Mus musculus
ggatgtggatcagcgagagtcccca

SEQ ID NO: 705326 - DNA, 25 bp, Mus musculus
ggatgtggcccaacttgtcctctac

SEQ ID NO: 705327 - DNA, 25 bp, Mus musculus
ggatgtggcccatcttgtcctctac

SEQ ID NO: 705328 - DNA, 25 bp, Mus musculus
ggatgtggccgtagtcttcagtgaa

SEQ ID NO: 705329 - DNA, 25 bp, Mus musculus
ggatgtggccgttgtcttcagtgaa

SEQ ID NO: 705330 - DNA, 25 bp, Mus musculus
ggatgtggctaacggctactctgaa

SEQ ID NO: 705331 - DNA, 25 bp, Mus musculus
ggatgtggctaagggctactctgaa

SEQ ID NO: 705332 - DNA, 25 bp, Mus musculus
ggatgtggttttagccaaccgccca

SEQ ID NO: 705333 - DNA, 25 bp, Mus musculus
ggatgtggtttttgccaaccgccca

SEQ ID NO: 705334 - DNA, 25 bp, Mus musculus
ggatgtgttcacacctgatgagtct

SEQ ID NO: 705335 - DNA, 25 bp, Mus musculus
ggatgtgttcactcctgatgagtct

SEQ ID NO: 705336 - DNA, 25 bp, Mus musculus
ggatgttatgacacctatgcggcag

SEQ ID NO: 705337 - DNA, 25 bp, Mus musculus
ggatgttatgactcctatgcggcag

SEQ ID NO: 705338 - DNA, 25 bp, Mus musculus
ggatgttattctctgagagaccccg

SEQ ID NO: 705339 - DNA, 25 bp, Mus musculus
ggatgttattctgtgagagaccccg

SEQ ID NO: 705340 - DNA, 25 bp, Mus musculus
ggatgttccatgacaccagtgtcag

SEQ ID NO: 705341 - DNA, 25 bp, Mus musculus
ggatgttccatgtcaccagtgtcag

SEQ ID NO: 705342 - DNA, 25 bp, Mus musculus
ggatgttcccttcctactacctcta

SEQ ID NO: 705343 - DNA, 25 bp, Mus musculus
ggatgttcccttgctactacctcta

SEQ ID NO: 705344 - DNA, 25 bp, Mus musculus
ggatgttcgtaaaaactttttgcca

SEQ ID NO: 705345 - DNA, 25 bp, Mus musculus
ggatgttcgtaataactttttgcca

SEQ ID NO: 705346 - DNA, 25 bp, Mus musculus
ggatgttctatgaaataagctaaga

SEQ ID NO: 705347 - DNA, 25 bp, Mus musculus
ggatgttctatgtaataagctaaga

SEQ ID NO: 705348 - DNA, 25 bp, Mus musculus
ggatgttgacacagacccactgaag

SEQ ID NO: 705349 - DNA, 25 bp, Mus musculus
ggatgttgacactgacccactgaag

SEQ ID NO: 705350 - DNA, 25 bp, Mus musculus
ggatgttggaacaaggacctgtatt

SEQ ID NO: 705351 - DNA, 25 bp, Mus musculus
ggatgttggaactaggacctgtatt

SEQ ID NO: 705352 - DNA, 25 bp, Mus musculus
ggatgttggagacctcacccaggaa

SEQ ID NO: 705353 - DNA, 25 bp, Mus musculus
ggatgttggagagctcacccaggaa

SEQ ID NO: 705354 - DNA, 25 bp, Mus musculus
ggatgttgtaaccagcctgcagttc

SEQ ID NO: 705355 - DNA, 25 bp, Mus musculus
ggatgttgtaacgagcctgcagttc

SEQ ID NO: 705356 - DNA, 25 bp, Mus musculus
ggatgtttaggtccctaagcttcct

SEQ ID NO: 705357 - DNA, 25 bp, Mus musculus
ggatgtttaggtgcctaagcttcct

SEQ ID NO: 705358 - DNA, 25 bp, Mus musculus
ggatgtttattaactgaaccaagta

SEQ ID NO: 705359 - DNA, 25 bp, Mus musculus
ggatgtttattatctgaaccaagta

SEQ ID NO: 705360 - DNA, 25 bp, Mus musculus
ggatgttttcatccatgcaaaccta

SEQ ID NO: 705361 - DNA, 25 bp, Mus musculus
ggatgttttcatgcatgcaaaccta

SEQ ID NO: 705362 - DNA, 25 bp, Mus musculus
ggatgttttcttccgccagacttgg

SEQ ID NO: 705363 - DNA, 25 bp, Mus musculus
ggatgttttcttgcgccagacttgg

SEQ ID NO: 705364 - DNA, 25 bp, Mus musculus
ggattaaaatatccgggcatgccag

SEQ ID NO: 705365 - DNA, 25 bp, Mus musculus
ggattaaaatatgcgggcatgccag

SEQ ID NO: 705366 - DNA, 25 bp, Mus musculus
ggattaaagcagactctggcgccat

SEQ ID NO: 705367 - DNA, 25 bp, Mus musculus
ggattaaagcagtctctggcgccat

SEQ ID NO: 705368 - DNA, 25 bp, Mus musculus
ggattaacagatcaccaggtttcag

SEQ ID NO: 705369 - DNA, 25 bp, Mus musculus
ggattaacagatgaccaggtttcag

SEQ ID NO: 705370 - DNA, 25 bp, Mus musculus
ggattaacaggacctgatggatccc

SEQ ID NO: 705371 - DNA, 25 bp, Mus musculus
ggattaacaggagctgatggatccc

SEQ ID NO: 705372 - DNA, 25 bp, Mus musculus
ggattaagacaaatgaccttacaga

SEQ ID NO: 705373 - DNA, 25 bp, Mus musculus
ggattaagacaattgaccttacaga

SEQ ID NO: 705374 - DNA, 25 bp, Mus musculus
ggattaatacagcaattttagttgg

SEQ ID NO: 705375 - DNA, 25 bp, Mus musculus
ggattaatacaggaattttagttgg

SEQ ID NO: 705376 - DNA, 25 bp, Mus musculus
ggattacaaaggagcacttcaagga

SEQ ID NO: 705377 - DNA, 25 bp, Mus musculus
ggattacaaaggtgcacttcaagga

SEQ ID NO: 705378 - DNA, 25 bp, Mus musculus
ggattacaagtaccttggcttgtag

SEQ ID NO: 705379 - DNA, 25 bp, Mus musculus
ggattacaagtagcttggcttgtag

SEQ ID NO: 705380 - DNA, 25 bp, Mus musculus
ggattacacaacacctcccagtgag

SEQ ID NO: 705381 - DNA, 25 bp, Mus musculus
ggattacacaactcctcccagtgag

SEQ ID NO: 705382 - DNA, 25 bp, Mus musculus
ggattacactagaaggttacttcca

SEQ ID NO: 705383 - DNA, 25 bp, Mus musculus
ggattacactagtaggttacttcca

SEQ ID NO: 705384 - DNA, 25 bp, Mus musculus
ggattacccaccaggcatcagctgt

SEQ ID NO: 705385 - DNA, 25 bp, Mus musculus
ggattacccacctggcatcagctgt

SEQ ID NO: 705386 - DNA, 25 bp, Mus musculus
ggattaccgaaacctgagcagcaac

SEQ ID NO: 705387 - DNA, 25 bp, Mus musculus
ggattaccgaaagctgagcagcaac

SEQ ID NO: 705388 - DNA, 25 bp, Mus musculus
ggattactggagcaagtccctgtca

SEQ ID NO: 705389 - DNA, 25 bp, Mus musculus
ggattactggaggaagtccctgtca

SEQ ID NO: 705390 - DNA, 25 bp, Mus musculus
ggattactggtgaaggacattgaag

SEQ ID NO: 705391 - DNA, 25 bp, Mus musculus
ggattactggtgtaggacattgaag

SEQ ID NO: 705392 - DNA, 25 bp, Mus musculus
ggattactgtgcaccagggcaagat

SEQ ID NO: 705393 - DNA, 25 bp, Mus musculus
ggattactgtgctccagggcaagat

SEQ ID NO: 705394 - DNA, 25 bp, Mus musculus
ggattactttgtaaacaacacgcct

SEQ ID NO: 705395 - DNA, 25 bp, Mus musculus
ggattactttgttaacaacacgcct

SEQ ID NO: 705396 - DNA, 25 bp, Mus musculus
ggattagagaatcagacatggcagc

SEQ ID NO: 705397 - DNA, 25 bp, Mus musculus
ggattagagaatgagacatggcagc

SEQ ID NO: 705398 - DNA, 25 bp, Mus musculus
ggattagcatggctccaaatgttag

SEQ ID NO: 705399 - DNA, 25 bp, Mus musculus
ggattagcatgggtccaaatgttag

SEQ ID NO: 705400 - DNA, 25 bp, Mus musculus
ggattaggagctagcgtctcccgcc

SEQ ID NO: 705401 - DNA, 25 bp, Mus musculus
ggattaggagcttgcgtctcccgcc

SEQ ID NO: 705402 - DNA, 25 bp, Mus musculus
ggattataagtaactgcgctggcag

SEQ ID NO: 705403 - DNA, 25 bp, Mus musculus
ggattataagtatctgcgctggcag

SEQ ID NO: 705404 - DNA, 25 bp, Mus musculus
ggattatcacgccagaactctaaga

SEQ ID NO: 705405 - DNA, 25 bp, Mus musculus
ggattatcacgcgagaactctaaga

SEQ ID NO: 705406 - DNA, 25 bp, Mus musculus
ggattatctgcactcagagcgcaag

SEQ ID NO: 705407 - DNA, 25 bp, Mus musculus
ggattatctgcagtcagagcgcaag

SEQ ID NO: 705408 - DNA, 25 bp, Mus musculus
ggattatctggaccagtttggaact

SEQ ID NO: 705409 - DNA, 25 bp, Mus musculus
ggattatctggagcagtttggaact

SEQ ID NO: 705410 - DNA, 25 bp, Mus musculus
ggattatggctaccaaattactgca

SEQ ID NO: 705411 - DNA, 25 bp, Mus musculus
ggattatggctagcaaattactgca

SEQ ID NO: 705412 - DNA, 25 bp, Mus musculus
ggattatgggagacagtgttcctac

SEQ ID NO: 705413 - DNA, 25 bp, Mus musculus
ggattatgggagtcagtgttcctac

SEQ ID NO: 705414 - DNA, 25 bp, Mus musculus
ggattatgtgcaagaaccgcctgga

SEQ ID NO: 705415 - DNA, 25 bp, Mus musculus
ggattatgtgcatgaaccgcctgga

SEQ ID NO: 705416 - DNA, 25 bp, Mus musculus
ggattatgtggcacacatcaccaag

SEQ ID NO: 705417 - DNA, 25 bp, Mus musculus
ggattatgtggctcacatcaccaag

SEQ ID NO: 705418 - DNA, 25 bp, Mus musculus
ggattattcttccacaagcttttca

SEQ ID NO: 705419 - DNA, 25 bp, Mus musculus
ggattattcttcgacaagcttttca

SEQ ID NO: 705420 - DNA, 25 bp, Mus musculus
ggattcaaaattcaaactgtggcac

SEQ ID NO: 705421 - DNA, 25 bp, Mus musculus
ggattcaaaattgaaactgtggcac

SEQ ID NO: 705422 - DNA, 25 bp, Mus musculus
ggattcaacaacaccatcacccagt

SEQ ID NO: 705423 - DNA, 25 bp, Mus musculus
ggattcaacaactccatcacccagt

SEQ ID NO: 705424 - DNA, 25 bp, Mus musculus
ggattcaactaaagaaactactgcc

SEQ ID NO: 705425 - DNA, 25 bp, Mus musculus
ggattcaactaatgaaactactgcc

SEQ ID NO: 705426 - DNA, 25 bp, Mus musculus
ggattcaagcaaaggggctctactg

SEQ ID NO: 705427 - DNA, 25 bp, Mus musculus
ggattcaagcaatggggctctactg

SEQ ID NO: 705428 - DNA, 25 bp, Mus musculus
ggattcacaattcaccttgggccag

SEQ ID NO: 705429 - DNA, 25 bp, Mus musculus
ggattcacaattgaccttgggccag

SEQ ID NO: 705430 - DNA, 25 bp, Mus musculus
ggattcactggacctttgaaataca

SEQ ID NO: 705431 - DNA, 25 bp, Mus musculus
ggattcactggagctttgaaataca

SEQ ID NO: 705432 - DNA, 25 bp, Mus musculus
ggattcagcatcactctaccattga

SEQ ID NO: 705433 - DNA, 25 bp, Mus musculus
ggattcagcatctctctaccattga

SEQ ID NO: 705434 - DNA, 25 bp, Mus musculus
ggattcagtgttccctcagaagcaa

SEQ ID NO: 705435 - DNA, 25 bp, Mus musculus
ggattcagtgttgcctcagaagcaa

SEQ ID NO: 705436 - DNA, 25 bp, Mus musculus
ggattcagtttacgcactggcccca

SEQ ID NO: 705437 - DNA, 25 bp, Mus musculus
ggattcagtttaggcactggcccca

SEQ ID NO: 705438 - DNA, 25 bp, Mus musculus
ggattcatagacatcatagctgatg

SEQ ID NO: 705439 - DNA, 25 bp, Mus musculus
ggattcatagacttcatagctgatg

SEQ ID NO: 705440 - DNA, 25 bp, Mus musculus
ggattccaagtactgtaagcagcaa

SEQ ID NO: 705441 - DNA, 25 bp, Mus musculus
ggattccaagtagtgtaagcagcaa

SEQ ID NO: 705442 - DNA, 25 bp, Mus musculus
ggattccaatgaccccattcataag

SEQ ID NO: 705443 - DNA, 25 bp, Mus musculus
ggattccaatgagcccattcataag

SEQ ID NO: 705444 - DNA, 25 bp, Mus musculus
ggattccacaacaatctcctcaaag

SEQ ID NO: 705445 - DNA, 25 bp, Mus musculus
ggattccacaactatctcctcaaag

SEQ ID NO: 705446 - DNA, 25 bp, Mus musculus
ggattcccaactaaccaggagcttg

SEQ ID NO: 705447 - DNA, 25 bp, Mus musculus
ggattcccaacttaccaggagcttg

SEQ ID NO: 705448 - DNA, 25 bp, Mus musculus
ggattccccagtcagatcatctaga

SEQ ID NO: 705449 - DNA, 25 bp, Mus musculus
ggattccccagtgagatcatctaga

SEQ ID NO: 705450 - DNA, 25 bp, Mus musculus
ggattccctgtcatcgagaccagta

SEQ ID NO: 705451 - DNA, 25 bp, Mus musculus
ggattccctgtcttcgagaccagta

SEQ ID NO: 705452 - DNA, 25 bp, Mus musculus
ggattccgccatcttgagtcttgtg

SEQ ID NO: 705453 - DNA, 25 bp, Mus musculus
ggattccgccatgttgagtcttgtg

SEQ ID NO: 705454 - DNA, 25 bp, Mus musculus
ggattccgcctgcagctcgctgctg

SEQ ID NO: 705455 - DNA, 25 bp, Mus musculus
ggattccgcctggagctcgctgctg

SEQ ID NO: 705456 - DNA, 25 bp, Mus musculus
ggattcctcttcaggccagcaactt

SEQ ID NO: 705457 - DNA, 25 bp, Mus musculus
ggattcctcttctggccagcaactt

SEQ ID NO: 705458 - DNA, 25 bp, Mus musculus
ggattcctggaacatccacctatgc

SEQ ID NO: 705459 - DNA, 25 bp, Mus musculus
ggattcctggaagatccacctatgc

SEQ ID NO: 705460 - DNA, 25 bp, Mus musculus
ggattcctgtatatcccagctaagg

SEQ ID NO: 705461 - DNA, 25 bp, Mus musculus
ggattcctgtatttcccagctaagg

SEQ ID NO: 705462 - DNA, 25 bp, Mus musculus
ggattcgaattaacagccctcatta

SEQ ID NO: 705463 - DNA, 25 bp, Mus musculus
ggattcgaattatcagccctcatta

SEQ ID NO: 705464 - DNA, 25 bp, Mus musculus
ggattcgaggccatgtcctatcatt

SEQ ID NO: 705465 - DNA, 25 bp, Mus musculus
ggattcgaggccttgtcctatcatt

SEQ ID NO: 705466 - DNA, 25 bp, Mus musculus
ggattcgttggcaaccgtccccgct

SEQ ID NO: 705467 - DNA, 25 bp, Mus musculus
ggattcgttggctaccgtccccgct

SEQ ID NO: 705468 - DNA, 25 bp, Mus musculus
ggattctaccttctatgaactcaag

SEQ ID NO: 705469 - DNA, 25 bp, Mus musculus
ggattctaccttgtatgaactcaag

SEQ ID NO: 705470 - DNA, 25 bp, Mus musculus
ggattctatccaaagccctgggagg

SEQ ID NO: 705471 - DNA, 25 bp, Mus musculus
ggattctatccatagccctgggagg

SEQ ID NO: 705472 - DNA, 25 bp, Mus musculus
ggattctcgtccctctctgaggcga

SEQ ID NO: 705473 - DNA, 25 bp, Mus musculus
ggattctcgtccgtctctgaggcga

SEQ ID NO: 705474 - DNA, 25 bp, Mus musculus
ggattctcgtcgcaacaagcagcag

SEQ ID NO: 705475 - DNA, 25 bp, Mus musculus
ggattctcgtcggaacaagcagcag

SEQ ID NO: 705476 - DNA, 25 bp, Mus musculus
ggattctctatcacccatcgcctgg

SEQ ID NO: 705477 - DNA, 25 bp, Mus musculus
ggattctctatctcccatcgcctgg

SEQ ID NO: 705478 - DNA, 25 bp, Mus musculus
ggattctctccccataagccttggc

SEQ ID NO: 705479 - DNA, 25 bp, Mus musculus
ggattctctcccgataagccttggc

SEQ ID NO: 705480 - DNA, 25 bp, Mus musculus
ggattctgcattcagaaaggagcag

SEQ ID NO: 705481 - DNA, 25 bp, Mus musculus
ggattctgcattgagaaaggagcag

SEQ ID NO: 705482 - DNA, 25 bp, Mus musculus
ggattctggagtacgcaccttgccg

SEQ ID NO: 705483 - DNA, 25 bp, Mus musculus
ggattctggagttcgcaccttgccg

SEQ ID NO: 705484 - DNA, 25 bp, Mus musculus
ggattctggcttagctgatagtaat

SEQ ID NO: 705485 - DNA, 25 bp, Mus musculus
ggattctggctttgctgatagtaat

SEQ ID NO: 705486 - DNA, 25 bp, Mus musculus
ggattctggtcaaaccagtgattca

SEQ ID NO: 705487 - DNA, 25 bp, Mus musculus
ggattctggtcataccagtgattca

SEQ ID NO: 705488 - DNA, 25 bp, Mus musculus
ggattctgtactcttctacgccatc

SEQ ID NO: 705489 - DNA, 25 bp, Mus musculus
ggattctgtactgttctacgccatc

SEQ ID NO: 705490 - DNA, 25 bp, Mus musculus
ggattctgtcaccaccaatgcctgc

SEQ ID NO: 705491 - DNA, 25 bp, Mus musculus
ggattctgtcacgaccaatgcctgc

SEQ ID NO: 705492 - DNA, 25 bp, Mus musculus
ggattctgtccactacaccctgttg

SEQ ID NO: 705493 - DNA, 25 bp, Mus musculus
ggattctgtccagtacaccctgttg

SEQ ID NO: 705494 - DNA, 25 bp, Mus musculus
ggattcttcgagctccagcgcctat

SEQ ID NO: 705495 - DNA, 25 bp, Mus musculus
ggattcttcgaggtccagcgcctat

SEQ ID NO: 705496 - DNA, 25 bp, Mus musculus
ggattctttctacctcaaggagcag

SEQ ID NO: 705497 - DNA, 25 bp, Mus musculus
ggattctttctagctcaaggagcag

SEQ ID NO: 705498 - DNA, 25 bp, Mus musculus
ggattgaacagcagaaagaacagag

SEQ ID NO: 705499 - DNA, 25 bp, Mus musculus
ggattgaacagctgaaagaacagag

SEQ ID NO: 705500 - DNA, 25 bp, Mus musculus
ggattgaacagtatggcaacgtgga

SEQ ID NO: 705501 - DNA, 25 bp, Mus musculus
ggattgaacagtttggcaacgtgga

SEQ ID NO: 705502 - DNA, 25 bp, Mus musculus
ggattgaagtccctttactcaggca

SEQ ID NO: 705503 - DNA, 25 bp, Mus musculus
ggattgaagtccgtttactcaggca

SEQ ID NO: 705504 - DNA, 25 bp, Mus musculus
ggattgaatgccacaccaggagact

SEQ ID NO: 705505 - DNA, 25 bp, Mus musculus
ggattgaatgcctcaccaggagact

SEQ ID NO: 705506 - DNA, 25 bp, Mus musculus
ggattgagcccacatacttcagaag

SEQ ID NO: 705507 - DNA, 25 bp, Mus musculus
ggattgagcccagatacttcagaag

SEQ ID NO: 705508 - DNA, 25 bp, Mus musculus
ggattgagtgccaagacggtcgccc

SEQ ID NO: 705509 - DNA, 25 bp, Mus musculus
ggattgagtgcctagacggtcgccc

SEQ ID NO: 705510 - DNA, 25 bp, Mus musculus
ggattgatccgacggaccatgaagc

SEQ ID NO: 705511 - DNA, 25 bp, Mus musculus
ggattgatccgagggaccatgaagc

SEQ ID NO: 705512 - DNA, 25 bp, Mus musculus
ggattgatgcatattcctgatcttc

SEQ ID NO: 705513 - DNA, 25 bp, Mus musculus
ggattgatgcattttcctgatcttc

SEQ ID NO: 705514 - DNA, 25 bp, Mus musculus
ggattgccagaactcacaagtattc

SEQ ID NO: 705515 - DNA, 25 bp, Mus musculus
ggattgccagaagtcacaagtattc

SEQ ID NO: 705516 - DNA, 25 bp, Mus musculus
ggattgccgggcagcggacattcct

SEQ ID NO: 705517 - DNA, 25 bp, Mus musculus
ggattgccgggctgcggacattcct

SEQ ID NO: 705518 - DNA, 25 bp, Mus musculus
ggattgccgtcactgccgctgcttg

SEQ ID NO: 705519 - DNA, 25 bp, Mus musculus
ggattgccgtcagtgccgctgcttg

SEQ ID NO: 705520 - DNA, 25 bp, Mus musculus
ggattgcctaccactacaatgaagg

SEQ ID NO: 705521 - DNA, 25 bp, Mus musculus
ggattgcctacctctacaatgaagg

SEQ ID NO: 705522 - DNA, 25 bp, Mus musculus
ggattgcctttcagttcacgcctta

SEQ ID NO: 705523 - DNA, 25 bp, Mus musculus
ggattgcctttctgttcacgcctta

SEQ ID NO: 705524 - DNA, 25 bp, Mus musculus
ggattgcgtgatatattagctgttc

SEQ ID NO: 705525 - DNA, 25 bp, Mus musculus
ggattgcgtgatttattagctgttc

SEQ ID NO: 705526 - DNA, 25 bp, Mus musculus
ggattgctctttcgctgctccactg

SEQ ID NO: 705527 - DNA, 25 bp, Mus musculus
ggattgctctttggctgctccactg

SEQ ID NO: 705528 - DNA, 25 bp, Mus musculus
ggattgctgagaacctcctgtggtt

SEQ ID NO: 705529 - DNA, 25 bp, Mus musculus
ggattgctgagatcctcctgtggtt

SEQ ID NO: 705530 - DNA, 25 bp, Mus musculus
ggattgctggagacgtgccctggtg

SEQ ID NO: 705531 - DNA, 25 bp, Mus musculus
ggattgctggagtcgtgccctggtg

SEQ ID NO: 705532 - DNA, 25 bp, Mus musculus
ggattggagccgctgactaccagcc

SEQ ID NO: 705533 - DNA, 25 bp, Mus musculus
ggattggagccggtgactaccagcc

SEQ ID NO: 705534 - DNA, 25 bp, Mus musculus
ggattggcaagaacggagacctacc

SEQ ID NO: 705535 - DNA, 25 bp, Mus musculus
ggattggcaagatcggagacctacc

SEQ ID NO: 705536 - DNA, 25 bp, Mus musculus
ggattggcacatctccatattcacc

SEQ ID NO: 705537 - DNA, 25 bp, Mus musculus
ggattggcacatgtccatattcacc

SEQ ID NO: 705538 - DNA, 25 bp, Mus musculus
ggattggcccatcaatcacatctaa

SEQ ID NO: 705539 - DNA, 25 bp, Mus musculus
ggattggcccatgaatcacatctaa

SEQ ID NO: 705540 - DNA, 25 bp, Mus musculus
ggattggccgctaccgcatgatcaa

SEQ ID NO: 705541 - DNA, 25 bp, Mus musculus
ggattggccgcttccgcatgatcaa

SEQ ID NO: 705542 - DNA, 25 bp, Mus musculus
ggattggccgggagctttccgccaa

SEQ ID NO: 705543 - DNA, 25 bp, Mus musculus
ggattggccgggtgctttccgccaa

SEQ ID NO: 705544 - DNA, 25 bp, Mus musculus
ggattggcgtgaaaaagaggccaaa

SEQ ID NO: 705545 - DNA, 25 bp, Mus musculus
ggattggcgtgataaagaggccaaa

SEQ ID NO: 705546 - DNA, 25 bp, Mus musculus
ggattggcttttccagtacaacctg

SEQ ID NO: 705547 - DNA, 25 bp, Mus musculus
ggattggcttttgcagtacaacctg

SEQ ID NO: 705548 - DNA, 25 bp, Mus musculus
ggattggttttactcctgcagccca

SEQ ID NO: 705549 - DNA, 25 bp, Mus musculus
ggattggttttagtcctgcagccca

SEQ ID NO: 705550 - DNA, 25 bp, Mus musculus
ggattgtatcccacacttttgcata

SEQ ID NO: 705551 - DNA, 25 bp, Mus musculus
ggattgtatccctcacttttgcata

SEQ ID NO: 705552 - DNA, 25 bp, Mus musculus
ggattgtctgtgcttattaaccctg

SEQ ID NO: 705553 - DNA, 25 bp, Mus musculus
ggattgtctgtggttattaaccctg

SEQ ID NO: 705554 - DNA, 25 bp, Mus musculus
ggattgtgcaatctttgagtcccca

SEQ ID NO: 705555 - DNA, 25 bp, Mus musculus
ggattgtgcaatgtttgagtcccca

SEQ ID NO: 705556 - DNA, 25 bp, Mus musculus
ggattgtggttgaaagccttgcata

SEQ ID NO: 705557 - DNA, 25 bp, Mus musculus
ggattgtggttgtaagccttgcata

SEQ ID NO: 705558 - DNA, 25 bp, Mus musculus
ggattgtgtccactattcaactgag

SEQ ID NO: 705559 - DNA, 25 bp, Mus musculus
ggattgtgtccagtattcaactgag

SEQ ID NO: 705560 - DNA, 25 bp, Mus musculus
ggattgttgccacggttttttccat

SEQ ID NO: 705561 - DNA, 25 bp, Mus musculus
ggattgttgccagggttttttccat

SEQ ID NO: 705562 - DNA, 25 bp, Mus musculus
ggatttaaacggaaggatgtcagta

SEQ ID NO: 705563 - DNA, 25 bp, Mus musculus
ggatttaaacggtaggatgtcagta

SEQ ID NO: 705564 - DNA, 25 bp, Mus musculus
ggatttaaattactaacagacgaga

SEQ ID NO: 705565 - DNA, 25 bp, Mus musculus
ggatttaaattagtaacagacgaga

SEQ ID NO: 705566 - DNA, 25 bp, Mus musculus
ggatttaacgtgctgcggctgatcc

SEQ ID NO: 705567 - DNA, 25 bp, Mus musculus
ggatttaacgtggtgcggctgatcc

SEQ ID NO: 705568 - DNA, 25 bp, Mus musculus
ggatttaagatgaaccccattgatt

SEQ ID NO: 705569 - DNA, 25 bp, Mus musculus
ggatttaagatgtaccccattgatt

SEQ ID NO: 705570 - DNA, 25 bp, Mus musculus
ggatttacaagacaggctccctgct

SEQ ID NO: 705571 - DNA, 25 bp, Mus musculus
ggatttacaagagaggctccctgct

SEQ ID NO: 705572 - DNA, 25 bp, Mus musculus
ggatttacacaacgcaagatctctg

SEQ ID NO: 705573 - DNA, 25 bp, Mus musculus
ggatttacacaaggcaagatctctg

SEQ ID NO: 705574 - DNA, 25 bp, Mus musculus
ggatttacacgaaatataaattgtc

SEQ ID NO: 705575 - DNA, 25 bp, Mus musculus
ggatttacacgatatataaattgtc

SEQ ID NO: 705576 - DNA, 25 bp, Mus musculus
ggatttacccatctgacctcagact

SEQ ID NO: 705577 - DNA, 25 bp, Mus musculus
ggatttacccatgtgacctcagact

SEQ ID NO: 705578 - DNA, 25 bp, Mus musculus
ggatttagaccgcatcctcactgtg

SEQ ID NO: 705579 - DNA, 25 bp, Mus musculus
ggatttagaccggatcctcactgtg

SEQ ID NO: 705580 - DNA, 25 bp, Mus musculus
ggatttagccaacatcatttttaag

SEQ ID NO: 705581 - DNA, 25 bp, Mus musculus
ggatttagccaagatcatttttaag

SEQ ID NO: 705582 - DNA, 25 bp, Mus musculus
ggatttatcaaacatgtccacgaag

SEQ ID NO: 705583 - DNA, 25 bp, Mus musculus
ggatttatcaaagatgtccacgaag

SEQ ID NO: 705584 - DNA, 25 bp, Mus musculus
ggatttatcgcccaaggctgcttgg

SEQ ID NO: 705585 - DNA, 25 bp, Mus musculus
ggatttatcgccgaaggctgcttgg

SEQ ID NO: 705586 - DNA, 25 bp, Mus musculus
ggatttatggttcccgaatgcttgg

SEQ ID NO: 705587 - DNA, 25 bp, Mus musculus
ggatttatggttgccgaatgcttgg

SEQ ID NO: 705588 - DNA, 25 bp, Mus musculus
ggatttcaagaaagcatctatgtgc

SEQ ID NO: 705589 - DNA, 25 bp, Mus musculus
ggatttcaagaatgcatctatgtgc

SEQ ID NO: 705590 - DNA, 25 bp, Mus musculus
ggatttcaagatacgaactatagag

SEQ ID NO: 705591 - DNA, 25 bp, Mus musculus
ggatttcaagattcgaactatagag

SEQ ID NO: 705592 - DNA, 25 bp, Mus musculus
ggatttcacagcatacggtggtgtg

SEQ ID NO: 705593 - DNA, 25 bp, Mus musculus
ggatttcacagcttacggtggtgtg

SEQ ID NO: 705594 - DNA, 25 bp, Mus musculus
ggatttcacttcaagagcggatact

SEQ ID NO: 705595 - DNA, 25 bp, Mus musculus
ggatttcacttctagagcggatact

SEQ ID NO: 705596 - DNA, 25 bp, Mus musculus
ggatttcagaacaacctgtgaggag

SEQ ID NO: 705597 - DNA, 25 bp, Mus musculus
ggatttcagaactacctgtgaggag

SEQ ID NO: 705598 - DNA, 25 bp, Mus musculus
ggatttcattgcacagccggctcag

SEQ ID NO: 705599 - DNA, 25 bp, Mus musculus
ggatttcattgctcagccggctcag

SEQ ID NO: 705600 - DNA, 25 bp, Mus musculus
ggatttccaggtcggccaagccaag

SEQ ID NO: 705601 - DNA, 25 bp, Mus musculus
ggatttccaggtgggccaagccaag

SEQ ID NO: 705602 - DNA, 25 bp, Mus musculus
ggatttctagttccttaagggatca

SEQ ID NO: 705603 - DNA, 25 bp, Mus musculus
ggatttctagttgcttaagggatca

SEQ ID NO: 705604 - DNA, 25 bp, Mus musculus
ggatttctcagcactgcaagccaca

SEQ ID NO: 705605 - DNA, 25 bp, Mus musculus
ggatttctcagctctgcaagccaca

SEQ ID NO: 705606 - DNA, 25 bp, Mus musculus
ggatttctcttgagcagaccgcctg

SEQ ID NO: 705607 - DNA, 25 bp, Mus musculus
ggatttctcttgtgcagaccgcctg

SEQ ID NO: 705608 - DNA, 25 bp, Mus musculus
ggatttctggacctttgtgccttta

SEQ ID NO: 705609 - DNA, 25 bp, Mus musculus
ggatttctggacgtttgtgccttta

SEQ ID NO: 705610 - DNA, 25 bp, Mus musculus
ggatttctggctcgcttacccttca

SEQ ID NO: 705611 - DNA, 25 bp, Mus musculus
ggatttctggctggcttacccttca

SEQ ID NO: 705612 - DNA, 25 bp, Mus musculus
ggatttctgtgaaatgatggccaac

SEQ ID NO: 705613 - DNA, 25 bp, Mus musculus
ggatttctgtgatatgatggccaac

SEQ ID NO: 705614 - DNA, 25 bp, Mus musculus
ggatttgaaattccagacaagtttg

SEQ ID NO: 705615 - DNA, 25 bp, Mus musculus
ggatttgaaattgcagacaagtttg

SEQ ID NO: 705616 - DNA, 25 bp, Mus musculus
ggatttgccattccagccgctctag

SEQ ID NO: 705617 - DNA, 25 bp, Mus musculus
ggatttgccattgcagccgctctag

SEQ ID NO: 705618 - DNA, 25 bp, Mus musculus
ggatttgcccaaagttaggtgtgag

SEQ ID NO: 705619 - DNA, 25 bp, Mus musculus
ggatttgcccaatgttaggtgtgag

SEQ ID NO: 705620 - DNA, 25 bp, Mus musculus
ggatttggacaaaagccaccagtct

SEQ ID NO: 705621 - DNA, 25 bp, Mus musculus
ggatttggacaatagccaccagtct

SEQ ID NO: 705622 - DNA, 25 bp, Mus musculus
ggatttggcccacctcatgaattca

SEQ ID NO: 705623 - DNA, 25 bp, Mus musculus
ggatttggcccagctcatgaattca

SEQ ID NO: 705624 - DNA, 25 bp, Mus musculus
ggatttggcgcaaggcctgccccgc

SEQ ID NO: 705625 - DNA, 25 bp, Mus musculus
ggatttggcgcatggcctgccccgc

SEQ ID NO: 705626 - DNA, 25 bp, Mus musculus
ggatttggctatatcaacagtgaga

SEQ ID NO: 705627 - DNA, 25 bp, Mus musculus
ggatttggctatttcaacagtgaga

SEQ ID NO: 705628 - DNA, 25 bp, Mus musculus
ggatttgtctctacccttgcctcag

SEQ ID NO: 705629 - DNA, 25 bp, Mus musculus
ggatttgtctcttcccttgcctcag

SEQ ID NO: 705630 - DNA, 25 bp, Mus musculus
ggatttgtgacaacatctcaacatg

SEQ ID NO: 705631 - DNA, 25 bp, Mus musculus
ggatttgtgacatcatctcaacatg

SEQ ID NO: 705632 - DNA, 25 bp, Mus musculus
ggattttaaactcatctaccggcaa

SEQ ID NO: 705633 - DNA, 25 bp, Mus musculus
ggattttaaactgatctaccggcaa

SEQ ID NO: 705634 - DNA, 25 bp, Mus musculus
ggattttagtgaattccataacgag

SEQ ID NO: 705635 - DNA, 25 bp, Mus musculus
ggattttagtgatttccataacgag

SEQ ID NO: 705636 - DNA, 25 bp, Mus musculus
ggattttatgccctctcccaagctg

SEQ ID NO: 705637 - DNA, 25 bp, Mus musculus
ggattttatgccgtctcccaagctg

SEQ ID NO: 705638 - DNA, 25 bp, Mus musculus
ggattttatgtccatgcgggacccc

SEQ ID NO: 705639 - DNA, 25 bp, Mus musculus
ggattttatgtcgatgcgggacccc

SEQ ID NO: 705640 - DNA, 25 bp, Mus musculus
ggattttcaccacgaccttatgaaa

SEQ ID NO: 705641 - DNA, 25 bp, Mus musculus
ggattttcaccaggaccttatgaaa

SEQ ID NO: 705642 - DNA, 25 bp, Mus musculus
ggattttcacccaagtccagcagct

SEQ ID NO: 705643 - DNA, 25 bp, Mus musculus
ggattttcaccctagtccagcagct

SEQ ID NO: 705644 - DNA, 25 bp, Mus musculus
ggattttcatatcccttccccaaag

SEQ ID NO: 705645 - DNA, 25 bp, Mus musculus
ggattttcatatgccttccccaaag

SEQ ID NO: 705646 - DNA, 25 bp, Mus musculus
ggattttcatcgagctttgtgctgc

SEQ ID NO: 705647 - DNA, 25 bp, Mus musculus
ggattttcatcgtgctttgtgctgc

SEQ ID NO: 705648 - DNA, 25 bp, Mus musculus
ggattttccccacaacctagattgg

SEQ ID NO: 705649 - DNA, 25 bp, Mus musculus
ggattttccccagaacctagattgg

SEQ ID NO: 705650 - DNA, 25 bp, Mus musculus
ggattttcctgtcgagactttgcca

SEQ ID NO: 705651 - DNA, 25 bp, Mus musculus
ggattttcctgtggagactttgcca

SEQ ID NO: 705652 - DNA, 25 bp, Mus musculus
ggattttctgaacttcagtcgcgcc

SEQ ID NO: 705653 - DNA, 25 bp, Mus musculus
ggattttctgaagttcagtcgcgcc

SEQ ID NO: 705654 - DNA, 25 bp, Mus musculus
ggattttctgttatgcagcatacaa

SEQ ID NO: 705655 - DNA, 25 bp, Mus musculus
ggattttctgttttgcagcatacaa

SEQ ID NO: 705656 - DNA, 25 bp, Mus musculus
ggattttgtcgaaggacatctagag

SEQ ID NO: 705657 - DNA, 25 bp, Mus musculus
ggattttgtcgatggacatctagag

SEQ ID NO: 705658 - DNA, 25 bp, Mus musculus
ggatttttcccgcatgctcccagac

SEQ ID NO: 705659 - DNA, 25 bp, Mus musculus
ggatttttcccggatgctcccagac

SEQ ID NO: 705660 - DNA, 25 bp, Mus musculus
ggatttttctaccacatcagagatg

SEQ ID NO: 705661 - DNA, 25 bp, Mus musculus
ggatttttctacgacatcagagatg

SEQ ID NO: 705662 - DNA, 25 bp, Mus musculus
ggcaaaaaagacctggctcaaattt

SEQ ID NO: 705663 - DNA, 25 bp, Mus musculus
ggcaaaaaagacgtggctcaaattt

SEQ ID NO: 705664 - DNA, 25 bp, Mus musculus
ggcaaaaacattacttgaatggctt

SEQ ID NO: 705665 - DNA, 25 bp, Mus musculus
ggcaaaaacatttcttgaatggctt

SEQ ID NO: 705666 - DNA, 25 bp, Mus musculus
ggcaaaaactatcaactacacccag

SEQ ID NO: 705667 - DNA, 25 bp, Mus musculus
ggcaaaaactatgaactacacccag

SEQ ID NO: 705668 - DNA, 25 bp, Mus musculus
ggcaaaaagcacactcaggatgtga

SEQ ID NO: 705669 - DNA, 25 bp, Mus musculus
ggcaaaaagcactctcaggatgtga

SEQ ID NO: 705670 - DNA, 25 bp, Mus musculus
ggcaaaaagggtaagcctctatcaa

SEQ ID NO: 705671 - DNA, 25 bp, Mus musculus
ggcaaaaagggttagcctctatcaa

SEQ ID NO: 705672 - DNA, 25 bp, Mus musculus
ggcaaaacagaaaaaggttcatagt

SEQ ID NO: 705673 - DNA, 25 bp, Mus musculus
ggcaaaacagaataaggttcatagt

SEQ ID NO: 705674 - DNA, 25 bp, Mus musculus
ggcaaaaccatacgccagtttactc

SEQ ID NO: 705675 - DNA, 25 bp, Mus musculus
ggcaaaaccataggccagtttactc

SEQ ID NO: 705676 - DNA, 25 bp, Mus musculus
ggcaaaacgcctccaccgggaggct

SEQ ID NO: 705677 - DNA, 25 bp, Mus musculus
ggcaaaacgcctgcaccgggaggct

SEQ ID NO: 705678 - DNA, 25 bp, Mus musculus
ggcaaaagctgcaggccgatcttct

SEQ ID NO: 705679 - DNA, 25 bp, Mus musculus
ggcaaaagctgctggccgatcttct

SEQ ID NO: 705680 - DNA, 25 bp, Mus musculus
ggcaaaaggtgtcgcttccgcaata

SEQ ID NO: 705681 - DNA, 25 bp, Mus musculus
ggcaaaaggtgtggcttccgcaata

SEQ ID NO: 705682 - DNA, 25 bp, Mus musculus
ggcaaaatatgacctacctgcttca

SEQ ID NO: 705683 - DNA, 25 bp, Mus musculus
ggcaaaatatgagctacctgcttca

SEQ ID NO: 705684 - DNA, 25 bp, Mus musculus
ggcaaaatttggaatctgcgagagt

SEQ ID NO: 705685 - DNA, 25 bp, Mus musculus
ggcaaaatttggtatctgcgagagt

SEQ ID NO: 705686 - DNA, 25 bp, Mus musculus
ggcaaacaaaccaagctttatatta

SEQ ID NO: 705687 - DNA, 25 bp, Mus musculus
ggcaaacaaacctagctttatatta

SEQ ID NO: 705688 - DNA, 25 bp, Mus musculus
ggcaaacagctacaattctgagcat

SEQ ID NO: 705689 - DNA, 25 bp, Mus musculus
ggcaaacagctagaattctgagcat

SEQ ID NO: 705690 - DNA, 25 bp, Mus musculus
ggcaaacaggcacgtctttatcgct

SEQ ID NO: 705691 - DNA, 25 bp, Mus musculus
ggcaaacaggcaggtctttatcgct

SEQ ID NO: 705692 - DNA, 25 bp, Mus musculus
ggcaaacaggccatatatcaactga

SEQ ID NO: 705693 - DNA, 25 bp, Mus musculus
ggcaaacaggccttatatcaactga

SEQ ID NO: 705694 - DNA, 25 bp, Mus musculus
ggcaaacagtgtctcaaccgcatca

SEQ ID NO: 705695 - DNA, 25 bp, Mus musculus
ggcaaacagtgtgtcaaccgcatca

SEQ ID NO: 705696 - DNA, 25 bp, Mus musculus
ggcaaacattatcggatggtaccaa

SEQ ID NO: 705697 - DNA, 25 bp, Mus musculus
ggcaaacattatgggatggtaccaa

SEQ ID NO: 705698 - DNA, 25 bp, Mus musculus
ggcaaacattcacctgaagcagaag

SEQ ID NO: 705699 - DNA, 25 bp, Mus musculus
ggcaaacattcagctgaagcagaag

SEQ ID NO: 705700 - DNA, 25 bp, Mus musculus
ggcaaacattgacgatgttgtgaac

SEQ ID NO: 705701 - DNA, 25 bp, Mus musculus
ggcaaacattgaggatgttgtgaac

SEQ ID NO: 705702 - DNA, 25 bp, Mus musculus
ggcaaaccaggcctgaatgggaaaa

SEQ ID NO: 705703 - DNA, 25 bp, Mus musculus
ggcaaaccaggcgtgaatgggaaaa

SEQ ID NO: 705704 - DNA, 25 bp, Mus musculus
ggcaaaccattcatcctttcgattg

SEQ ID NO: 705705 - DNA, 25 bp, Mus musculus
ggcaaaccattcttcctttcgattg

SEQ ID NO: 705706 - DNA, 25 bp, Mus musculus
ggcaaaccccacacacttgaactta

SEQ ID NO: 705707 - DNA, 25 bp, Mus musculus
ggcaaaccccactcacttgaactta

SEQ ID NO: 705708 - DNA, 25 bp, Mus musculus
ggcaaaccctacagccaagcaagaa

SEQ ID NO: 705709 - DNA, 25 bp, Mus musculus
ggcaaaccctactgccaagcaagaa

SEQ ID NO: 705710 - DNA, 25 bp, Mus musculus
ggcaaaccctgtctgttcccgttca

SEQ ID NO: 705711 - DNA, 25 bp, Mus musculus
ggcaaaccctgtgtgttcccgttca

SEQ ID NO: 705712 - DNA, 25 bp, Mus musculus
ggcaaaccggaaaaacagctctgag

SEQ ID NO: 705713 - DNA, 25 bp, Mus musculus
ggcaaaccggaataacagctctgag

SEQ ID NO: 705714 - DNA, 25 bp, Mus musculus
ggcaaaccggtccagcacttcatga

SEQ ID NO: 705715 - DNA, 25 bp, Mus musculus
ggcaaaccggtcgagcacttcatga

SEQ ID NO: 705716 - DNA, 25 bp, Mus musculus
ggcaaacgctacaagaattccttgg

SEQ ID NO: 705717 - DNA, 25 bp, Mus musculus
ggcaaacgctactagaattccttgg

SEQ ID NO: 705718 - DNA, 25 bp, Mus musculus
ggcaaactacaacctgcccatcatg

SEQ ID NO: 705719 - DNA, 25 bp, Mus musculus
ggcaaactacaagctgcccatcatg

SEQ ID NO: 705720 - DNA, 25 bp, Mus musculus
ggcaaactggttcgaatctgcggca

SEQ ID NO: 705721 - DNA, 25 bp, Mus musculus
ggcaaactggttggaatctgcggca

SEQ ID NO: 705722 - DNA, 25 bp, Mus musculus
ggcaaactgttcagtgaggcagctg

SEQ ID NO: 705723 - DNA, 25 bp, Mus musculus
ggcaaactgttctgtgaggcagctg

SEQ ID NO: 705724 - DNA, 25 bp, Mus musculus
ggcaaacttcctcatcttatatggg

SEQ ID NO: 705725 - DNA, 25 bp, Mus musculus
ggcaaacttcctgatcttatatggg

SEQ ID NO: 705726 - DNA, 25 bp, Mus musculus
ggcaaagaagctatactatatggct

SEQ ID NO: 705727 - DNA, 25 bp, Mus musculus
ggcaaagaagctttactatatggct

SEQ ID NO: 705728 - DNA, 25 bp, Mus musculus
ggcaaagacacccaaaaatgggcct

SEQ ID NO: 705729 - DNA, 25 bp, Mus musculus
ggcaaagacaccgaaaaatgggcct

SEQ ID NO: 705730 - DNA, 25 bp, Mus musculus
ggcaaagacctaataaacagggctt

SEQ ID NO: 705731 - DNA, 25 bp, Mus musculus
ggcaaagacctattaaacagggctt

SEQ ID NO: 705732 - DNA, 25 bp, Mus musculus
ggcaaagacggcatccgcttcttca

SEQ ID NO: 705733 - DNA, 25 bp, Mus musculus
ggcaaagacggcttccgcttcttca

SEQ ID NO: 705734 - DNA, 25 bp, Mus musculus
ggcaaagacgtgacagatgagaagt

SEQ ID NO: 705735 - DNA, 25 bp, Mus musculus
ggcaaagacgtgtcagatgagaagt

SEQ ID NO: 705736 - DNA, 25 bp, Mus musculus
ggcaaagagattaccctgggatcta

SEQ ID NO: 705737 - DNA, 25 bp, Mus musculus
ggcaaagagatttccctgggatcta

SEQ ID NO: 705738 - DNA, 25 bp, Mus musculus
ggcaaagatgagagagaaggcaata

SEQ ID NO: 705739 - DNA, 25 bp, Mus musculus
ggcaaagatgagtgagaaggcaata

SEQ ID NO: 705740 - DNA, 25 bp, Mus musculus
ggcaaagatgctcccaccgctgaga

SEQ ID NO: 705741 - DNA, 25 bp, Mus musculus
ggcaaagatgctgccaccgctgaga

SEQ ID NO: 705742 - DNA, 25 bp, Mus musculus
ggcaaagatgtgctcaccccagtgt

SEQ ID NO: 705743 - DNA, 25 bp, Mus musculus
ggcaaagatgtggtcaccccagtgt

SEQ ID NO: 705744 - DNA, 25 bp, Mus musculus
ggcaaagcagagactcagtaaggtg

SEQ ID NO: 705745 - DNA, 25 bp, Mus musculus
ggcaaagcagagtctcagtaaggtg

SEQ ID NO: 705746 - DNA, 25 bp, Mus musculus
ggcaaagccctgacatccaccaggt

SEQ ID NO: 705747 - DNA, 25 bp, Mus musculus
ggcaaagccctgtcatccaccaggt

SEQ ID NO: 705748 - DNA, 25 bp, Mus musculus
ggcaaagccttcctctccaagtata

SEQ ID NO: 705749 - DNA, 25 bp, Mus musculus
ggcaaagccttcgtctccaagtata

SEQ ID NO: 705750 - DNA, 25 bp, Mus musculus
ggcaaagctgtgcaaactcagcacc

SEQ ID NO: 705751 - DNA, 25 bp, Mus musculus
ggcaaagctgtggaaactcagcacc

SEQ ID NO: 705752 - DNA, 25 bp, Mus musculus
ggcaaagcttgaagcccggcagtct

SEQ ID NO: 705753 - DNA, 25 bp, Mus musculus
ggcaaagcttgatgcccggcagtct

SEQ ID NO: 705754 - DNA, 25 bp, Mus musculus
ggcaaagctttcctccagtctcagt

SEQ ID NO: 705755 - DNA, 25 bp, Mus musculus
ggcaaagctttcgtccagtctcagt

SEQ ID NO: 705756 - DNA, 25 bp, Mus musculus
ggcaaaggaaatccaccaatcagct

SEQ ID NO: 705757 - DNA, 25 bp, Mus musculus
ggcaaaggaaatgcaccaatcagct

SEQ ID NO: 705758 - DNA, 25 bp, Mus musculus
ggcaaaggacagatttcaataacaa

SEQ ID NO: 705759 - DNA, 25 bp, Mus musculus
ggcaaaggacagttttcaataacaa

SEQ ID NO: 705760 - DNA, 25 bp, Mus musculus
ggcaaaggattacacagcaagaagg

SEQ ID NO: 705761 - DNA, 25 bp, Mus musculus
ggcaaaggattagacagcaagaagg

SEQ ID NO: 705762 - DNA, 25 bp, Mus musculus
ggcaaaggattgacagagaaagaga

SEQ ID NO: 705763 - DNA, 25 bp, Mus musculus
ggcaaaggattgtcagagaaagaga

SEQ ID NO: 705764 - DNA, 25 bp, Mus musculus
ggcaaaggccgtccgggaactggtg

SEQ ID NO: 705765 - DNA, 25 bp, Mus musculus
ggcaaaggccgtgcgggaactggtg

SEQ ID NO: 705766 - DNA, 25 bp, Mus musculus
ggcaaaggctcacatgttatacaga

SEQ ID NO: 705767 - DNA, 25 bp, Mus musculus
ggcaaaggctcagatgttatacaga

SEQ ID NO: 705768 - DNA, 25 bp, Mus musculus
ggcaaagggtccagtgagctccagc

SEQ ID NO: 705769 - DNA, 25 bp, Mus musculus
ggcaaagggtcctgtgagctccagc

SEQ ID NO: 705770 - DNA, 25 bp, Mus musculus
ggcaaaggtttcagtcacagctcaa

SEQ ID NO: 705771 - DNA, 25 bp, Mus musculus
ggcaaaggtttctgtcacagctcaa

SEQ ID NO: 705772 - DNA, 25 bp, Mus musculus
ggcaaagtatatccatttcagaggg

SEQ ID NO: 705773 - DNA, 25 bp, Mus musculus
ggcaaagtatatgcatttcagaggg

SEQ ID NO: 705774 - DNA, 25 bp, Mus musculus
ggcaaagtatcacaagggattgact

SEQ ID NO: 705775 - DNA, 25 bp, Mus musculus
ggcaaagtatcagaagggattgact

SEQ ID NO: 705776 - DNA, 25 bp, Mus musculus
ggcaaagtcattaccaacaaagctg

SEQ ID NO: 705777 - DNA, 25 bp, Mus musculus
ggcaaagtcatttccaacaaagctg

SEQ ID NO: 705778 - DNA, 25 bp, Mus musculus
ggcaaagtccttaaccgagttgtga

SEQ ID NO: 705779 - DNA, 25 bp, Mus musculus
ggcaaagtcctttaccgagttgtga

SEQ ID NO: 705780 - DNA, 25 bp, Mus musculus
ggcaaagtgaaacgcacatagaaat

SEQ ID NO: 705781 - DNA, 25 bp, Mus musculus
ggcaaagtgaaaggcacatagaaat

SEQ ID NO: 705782 - DNA, 25 bp, Mus musculus
ggcaaagtgtcacaagcccgagact

SEQ ID NO: 705783 - DNA, 25 bp, Mus musculus
ggcaaagtgtcagaagcccgagact

SEQ ID NO: 705784 - DNA, 25 bp, Mus musculus
ggcaaatagcatcttctgagcagca

SEQ ID NO: 705785 - DNA, 25 bp, Mus musculus
ggcaaatagcatgttctgagcagca

SEQ ID NO: 705786 - DNA, 25 bp, Mus musculus
ggcaaatagttacagcgacggcgct

SEQ ID NO: 705787 - DNA, 25 bp, Mus musculus
ggcaaatagttagagcgacggcgct

SEQ ID NO: 705788 - DNA, 25 bp, Mus musculus
ggcaaatcagccctgacgcttcagt

SEQ ID NO: 705789 - DNA, 25 bp, Mus musculus
ggcaaatcagccgtgacgcttcagt

SEQ ID NO: 705790 - DNA, 25 bp, Mus musculus
ggcaaatccaaactaccaggcggag

SEQ ID NO: 705791 - DNA, 25 bp, Mus musculus
ggcaaatccaaagtaccaggcggag

SEQ ID NO: 705792 - DNA, 25 bp, Mus musculus
ggcaaatctgaaattcacccagctg

SEQ ID NO: 705793 - DNA, 25 bp, Mus musculus
ggcaaatctgaatttcacccagctg

SEQ ID NO: 705794 - DNA, 25 bp, Mus musculus
ggcaaatcttgcatgcttcatcagt

SEQ ID NO: 705795 - DNA, 25 bp, Mus musculus
ggcaaatcttgcttgcttcatcagt

SEQ ID NO: 705796 - DNA, 25 bp, Mus musculus
ggcaaatgaggacatcgcccaggta

SEQ ID NO: 705797 - DNA, 25 bp, Mus musculus
ggcaaatgaggagatcgcccaggta

SEQ ID NO: 705798 - DNA, 25 bp, Mus musculus
ggcaaatgcaaaagcaagttcagac

SEQ ID NO: 705799 - DNA, 25 bp, Mus musculus
ggcaaatgcaaatgcaagttcagac

SEQ ID NO: 705800 - DNA, 25 bp, Mus musculus
ggcaaatgccgaagtagaactggac

SEQ ID NO: 705801 - DNA, 25 bp, Mus musculus
ggcaaatgccgatgtagaactggac

SEQ ID NO: 705802 - DNA, 25 bp, Mus musculus
ggcaaatgcggaatatatgtctcca

SEQ ID NO: 705803 - DNA, 25 bp, Mus musculus
ggcaaatgcggattatatgtctcca

SEQ ID NO: 705804 - DNA, 25 bp, Mus musculus
ggcaaatggcaaagtcattaccaac

SEQ ID NO: 705805 - DNA, 25 bp, Mus musculus
ggcaaatggcaatgtcattaccaac

SEQ ID NO: 705806 - DNA, 25 bp, Mus musculus
ggcaaatggcttcctgaaaagtaat

SEQ ID NO: 705807 - DNA, 25 bp, Mus musculus
ggcaaatggcttgctgaaaagtaat

SEQ ID NO: 705808 - DNA, 25 bp, Mus musculus
ggcaaattcagcatttgctgttgac

SEQ ID NO: 705809 - DNA, 25 bp, Mus musculus
ggcaaattcagcttttgctgttgac

SEQ ID NO: 705810 - DNA, 25 bp, Mus musculus
ggcaaattcctcaacagtgtcctag

SEQ ID NO: 705811 - DNA, 25 bp, Mus musculus
ggcaaattcctctacagtgtcctag

SEQ ID NO: 705812 - DNA, 25 bp, Mus musculus
ggcaaattgcagatttctctggact

SEQ ID NO: 705813 - DNA, 25 bp, Mus musculus
ggcaaattgcagttttctctggact

SEQ ID NO: 705814 - DNA, 25 bp, Mus musculus
ggcaaatttcacaccgtccggacag

SEQ ID NO: 705815 - DNA, 25 bp, Mus musculus
ggcaaatttcactccgtccggacag

SEQ ID NO: 705816 - DNA, 25 bp, Mus musculus
ggcaacaaacacatcagtcatgtgg

SEQ ID NO: 705817 - DNA, 25 bp, Mus musculus
ggcaacaaacacttcagtcatgtgg

SEQ ID NO: 705818 - DNA, 25 bp, Mus musculus
ggcaacaaagaaacaaatgagagca

SEQ ID NO: 705819 - DNA, 25 bp, Mus musculus
ggcaacaaagaatcaaatgagagca

SEQ ID NO: 705820 - DNA, 25 bp, Mus musculus
ggcaacaaagttccagtcaagtgca

SEQ ID NO: 705821 - DNA, 25 bp, Mus musculus
ggcaacaaagttgcagtcaagtgca

SEQ ID NO: 705822 - DNA, 25 bp, Mus musculus
ggcaacaacatgaccgctccgatgc

SEQ ID NO: 705823 - DNA, 25 bp, Mus musculus
ggcaacaacatgtccgctccgatgc

SEQ ID NO: 705824 - DNA, 25 bp, Mus musculus
ggcaacaagatgaccatccacctta

SEQ ID NO: 705825 - DNA, 25 bp, Mus musculus
ggcaacaagatgtccatccacctta

SEQ ID NO: 705826 - DNA, 25 bp, Mus musculus
ggcaacaagtacatccagcagacca

SEQ ID NO: 705827 - DNA, 25 bp, Mus musculus
ggcaacaagtacttccagcagacca

SEQ ID NO: 705828 - DNA, 25 bp, Mus musculus
ggcaacaatgccaaactcactgcag

SEQ ID NO: 705829 - DNA, 25 bp, Mus musculus
ggcaacaatgcctaactcactgcag

SEQ ID NO: 705830 - DNA, 25 bp, Mus musculus
ggcaacacatgcaggtctaaaccga

SEQ ID NO: 705831 - DNA, 25 bp, Mus musculus
ggcaacacatgctggtctaaaccga

SEQ ID NO: 705832 - DNA, 25 bp, Mus musculus
ggcaacactgggatcgcctctgcct

SEQ ID NO: 705833 - DNA, 25 bp, Mus musculus
ggcaacactgggttcgcctctgcct

SEQ ID NO: 705834 - DNA, 25 bp, Mus musculus
ggcaacagaaaaagcttcaactagc

SEQ ID NO: 705835 - DNA, 25 bp, Mus musculus
ggcaacagaaaatgcttcaactagc

SEQ ID NO: 705836 - DNA, 25 bp, Mus musculus
ggcaacagcaatcacatccgtgtgg

SEQ ID NO: 705837 - DNA, 25 bp, Mus musculus
ggcaacagcaatgacatccgtgtgg

SEQ ID NO: 705838 - DNA, 25 bp, Mus musculus
ggcaacagggacagctaactgttaa

SEQ ID NO: 705839 - DNA, 25 bp, Mus musculus
ggcaacagggactgctaactgttaa

SEQ ID NO: 705840 - DNA, 25 bp, Mus musculus
ggcaacatccccacggaattccagg

SEQ ID NO: 705841 - DNA, 25 bp, Mus musculus
ggcaacatcccctcggaattccagg

SEQ ID NO: 705842 - DNA, 25 bp, Mus musculus
ggcaacatccctcaagtcttcagag

SEQ ID NO: 705843 - DNA, 25 bp, Mus musculus
ggcaacatccctgaagtcttcagag

SEQ ID NO: 705844 - DNA, 25 bp, Mus musculus
ggcaacatggccatgaacggtgcag

SEQ ID NO: 705845 - DNA, 25 bp, Mus musculus
ggcaacatggccttgaacggtgcag

SEQ ID NO: 705846 - DNA, 25 bp, Mus musculus
ggcaacatgtaaagagaattttcag

SEQ ID NO: 705847 - DNA, 25 bp, Mus musculus
ggcaacatgtaatgagaattttcag

SEQ ID NO: 705848 - DNA, 25 bp, Mus musculus
ggcaaccaagctctatcgcacgact

SEQ ID NO: 705849 - DNA, 25 bp, Mus musculus
ggcaaccaagctgtatcgcacgact

SEQ ID NO: 705850 - DNA, 25 bp, Mus musculus
ggcaaccaggccatattcaatacat

SEQ ID NO: 705851 - DNA, 25 bp, Mus musculus
ggcaaccaggccttattcaatacat

SEQ ID NO: 705852 - DNA, 25 bp, Mus musculus
ggcaaccagttccaatgtgatgatc

SEQ ID NO: 705853 - DNA, 25 bp, Mus musculus
ggcaaccagttcgaatgtgatgatc

SEQ ID NO: 705854 - DNA, 25 bp, Mus musculus
ggcaaccataagatcccacagaaag

SEQ ID NO: 705855 - DNA, 25 bp, Mus musculus
ggcaaccataagttcccacagaaag

SEQ ID NO: 705856 - DNA, 25 bp, Mus musculus
ggcaaccattggcagcattctctct

SEQ ID NO: 705857 - DNA, 25 bp, Mus musculus
ggcaaccattgggagcattctctct

SEQ ID NO: 705858 - DNA, 25 bp, Mus musculus
ggcaaccattttacaatagtctggg

SEQ ID NO: 705859 - DNA, 25 bp, Mus musculus
ggcaaccatttttcaatagtctggg

SEQ ID NO: 705860 - DNA, 25 bp, Mus musculus
ggcaacccactgaaaaactctggga

SEQ ID NO: 705861 - DNA, 25 bp, Mus musculus
ggcaacccactgtaaaactctggga

SEQ ID NO: 705862 - DNA, 25 bp, Mus musculus
ggcaacccagagagaagggctcaaa

SEQ ID NO: 705863 - DNA, 25 bp, Mus musculus
ggcaacccagagtgaagggctcaaa

SEQ ID NO: 705864 - DNA, 25 bp, Mus musculus
ggcaaccccttcaggatggatccct

SEQ ID NO: 705865 - DNA, 25 bp, Mus musculus
ggcaaccccttctggatggatccct

SEQ ID NO: 705866 - DNA, 25 bp, Mus musculus
ggcaacccgggcattcaatgcacct

SEQ ID NO: 705867 - DNA, 25 bp, Mus musculus
ggcaacccgggctttcaatgcacct

SEQ ID NO: 705868 - DNA, 25 bp, Mus musculus
ggcaaccctggcagcagatccgact

SEQ ID NO: 705869 - DNA, 25 bp, Mus musculus
ggcaaccctggctgcagatccgact

SEQ ID NO: 705870 - DNA, 25 bp, Mus musculus
ggcaacccttgaccgactgaagaaa

SEQ ID NO: 705871 - DNA, 25 bp, Mus musculus
ggcaacccttgagcgactgaagaaa

SEQ ID NO: 705872 - DNA, 25 bp, Mus musculus
ggcaaccgtaccctgtcatcaagac

SEQ ID NO: 705873 - DNA, 25 bp, Mus musculus
ggcaaccgtaccgtgtcatcaagac

SEQ ID NO: 705874 - DNA, 25 bp, Mus musculus
ggcaacctgaccagtgaagatgact

SEQ ID NO: 705875 - DNA, 25 bp, Mus musculus
ggcaacctgacctgtgaagatgact

SEQ ID NO: 705876 - DNA, 25 bp, Mus musculus
ggcaacctggatcccaaaatcacag

SEQ ID NO: 705877 - DNA, 25 bp, Mus musculus
ggcaacctggatgccaaaatcacag

SEQ ID NO: 705878 - DNA, 25 bp, Mus musculus
ggcaaccttcggagtcaggacggta

SEQ ID NO: 705879 - DNA, 25 bp, Mus musculus
ggcaaccttcggtgtcaggacggta

SEQ ID NO: 705880 - DNA, 25 bp, Mus musculus
ggcaaccttgccagagctggagcta

SEQ ID NO: 705881 - DNA, 25 bp, Mus musculus
ggcaaccttgcctgagctggagcta

SEQ ID NO: 705882 - DNA, 25 bp, Mus musculus
ggcaacctttgcatatgtgcccagc

SEQ ID NO: 705883 - DNA, 25 bp, Mus musculus
ggcaacctttgcttatgtgcccagc

SEQ ID NO: 705884 - DNA, 25 bp, Mus musculus
ggcaacgagacaccactgatcaaca

SEQ ID NO: 705885 - DNA, 25 bp, Mus musculus
ggcaacgagacagcactgatcaaca

SEQ ID NO: 705886 - DNA, 25 bp, Mus musculus
ggcaacgcttcacagcacgggatga

SEQ ID NO: 705887 - DNA, 25 bp, Mus musculus
ggcaacgcttcagagcacgggatga

SEQ ID NO: 705888 - DNA, 25 bp, Mus musculus
ggcaacggcacccagcaagcattct

SEQ ID NO: 705889 - DNA, 25 bp, Mus musculus
ggcaacggcaccgagcaagcattct

SEQ ID NO: 705890 - DNA, 25 bp, Mus musculus
ggcaacgtctctccacagattgcat

SEQ ID NO: 705891 - DNA, 25 bp, Mus musculus
ggcaacgtctctgcacagattgcat

SEQ ID NO: 705892 - DNA, 25 bp, Mus musculus
ggcaacgtgcagctggtaatcccct

SEQ ID NO: 705893 - DNA, 25 bp, Mus musculus
ggcaacgtgcaggtggtaatcccct

SEQ ID NO: 705894 - DNA, 25 bp, Mus musculus
ggcaactatccaatgaaaaataggc

SEQ ID NO: 705895 - DNA, 25 bp, Mus musculus
ggcaactatccattgaaaaataggc

SEQ ID NO: 705896 - DNA, 25 bp, Mus musculus
ggcaactcctatcgtgtccctgatg

SEQ ID NO: 705897 - DNA, 25 bp, Mus musculus
ggcaactcctatggtgtccctgatg

SEQ ID NO: 705898 - DNA, 25 bp, Mus musculus
ggcaactctcgccagaacgcgggct

SEQ ID NO: 705899 - DNA, 25 bp, Mus musculus
ggcaactctcgcgagaacgcgggct

SEQ ID NO: 705900 - DNA, 25 bp, Mus musculus
ggcaactgaacccttctttcttggt

SEQ ID NO: 705901 - DNA, 25 bp, Mus musculus
ggcaactgaaccgttctttcttggt

SEQ ID NO: 705902 - DNA, 25 bp, Mus musculus
ggcaactgccaacttaggtccggag

SEQ ID NO: 705903 - DNA, 25 bp, Mus musculus
ggcaactgccaagttaggtccggag

SEQ ID NO: 705904 - DNA, 25 bp, Mus musculus
ggcaactggaaactccaaaggctat

SEQ ID NO: 705905 - DNA, 25 bp, Mus musculus
ggcaactggaaagtccaaaggctat

SEQ ID NO: 705906 - DNA, 25 bp, Mus musculus
ggcaactggtgccaatgttattcta

SEQ ID NO: 705907 - DNA, 25 bp, Mus musculus
ggcaactggtgcgaatgttattcta

SEQ ID NO: 705908 - DNA, 25 bp, Mus musculus
ggcaactgtaacaagaagccagtct

SEQ ID NO: 705909 - DNA, 25 bp, Mus musculus
ggcaactgtaactagaagccagtct

SEQ ID NO: 705910 - DNA, 25 bp, Mus musculus
ggcaacttacttatttgaagaccag

SEQ ID NO: 705911 - DNA, 25 bp, Mus musculus
ggcaacttacttttttgaagaccag

SEQ ID NO: 705912 - DNA, 25 bp, Mus musculus
ggcaacttcagccaagtggactggt

SEQ ID NO: 705913 - DNA, 25 bp, Mus musculus
ggcaacttcagcgaagtggactggt

SEQ ID NO: 705914 - DNA, 25 bp, Mus musculus
ggcaacttccttagctgcctactgg

SEQ ID NO: 705915 - DNA, 25 bp, Mus musculus
ggcaacttcctttgctgcctactgg

SEQ ID NO: 705916 - DNA, 25 bp, Mus musculus
ggcaacttctaccagggagactgct

SEQ ID NO: 705917 - DNA, 25 bp, Mus musculus
ggcaacttctacgagggagactgct

SEQ ID NO: 705918 - DNA, 25 bp, Mus musculus
ggcaacttctcgctgctcattcgcg

SEQ ID NO: 705919 - DNA, 25 bp, Mus musculus
ggcaacttctcggtgctcattcgcg

SEQ ID NO: 705920 - DNA, 25 bp, Mus musculus
ggcaacttgtctatttcgcacatga

SEQ ID NO: 705921 - DNA, 25 bp, Mus musculus
ggcaacttgtctttttcgcacatga

SEQ ID NO: 705922 - DNA, 25 bp, Mus musculus
ggcaagaaacaccatcgcaagcgtt

SEQ ID NO: 705923 - DNA, 25 bp, Mus musculus
ggcaagaaacacgatcgcaagcgtt

SEQ ID NO: 705924 - DNA, 25 bp, Mus musculus
ggcaagaaaggcaccttgtcctcag

SEQ ID NO: 705925 - DNA, 25 bp, Mus musculus
ggcaagaaaggctccttgtcctcag

SEQ ID NO: 705926 - DNA, 25 bp, Mus musculus
ggcaagaaagtcactgagcccagca

SEQ ID NO: 705927 - DNA, 25 bp, Mus musculus
ggcaagaaagtctctgagcccagca

SEQ ID NO: 705928 - DNA, 25 bp, Mus musculus
ggcaagaacgcgcagacttatcgaa

SEQ ID NO: 705929 - DNA, 25 bp, Mus musculus
ggcaagaacgcggagacttatcgaa

SEQ ID NO: 705930 - DNA, 25 bp, Mus musculus
ggcaagaactatactcatgcaatca

SEQ ID NO: 705931 - DNA, 25 bp, Mus musculus
ggcaagaactattctcatgcaatca

SEQ ID NO: 705932 - DNA, 25 bp, Mus musculus
ggcaagaagactacgatcgcctgcg

SEQ ID NO: 705933 - DNA, 25 bp, Mus musculus
ggcaagaagacttcgatcgcctgcg

SEQ ID NO: 705934 - DNA, 25 bp, Mus musculus
ggcaagacaaagaggtgaccatcaa

SEQ ID NO: 705935 - DNA, 25 bp, Mus musculus
ggcaagacaaagtggtgaccatcaa

SEQ ID NO: 705936 - DNA, 25 bp, Mus musculus
ggcaagacaacacagaagatcggct

SEQ ID NO: 705937 - DNA, 25 bp, Mus musculus
ggcaagacaacagagaagatcggct

SEQ ID NO: 705938 - DNA, 25 bp, Mus musculus
ggcaagacaaccagcatcctctgct

SEQ ID NO: 705939 - DNA, 25 bp, Mus musculus
ggcaagacaacctgcatcctctgct

SEQ ID NO: 705940 - DNA, 25 bp, Mus musculus
ggcaagacataacgaatggcgaccc

SEQ ID NO: 705941 - DNA, 25 bp, Mus musculus
ggcaagacataaggaatggcgaccc

SEQ ID NO: 705942 - DNA, 25 bp, Mus musculus
ggcaagaccctgctgatggcaatct

SEQ ID NO: 705943 - DNA, 25 bp, Mus musculus
ggcaagaccctggtgatggcaatct

SEQ ID NO: 705944 - DNA, 25 bp, Mus musculus
ggcaagaccggcagaggtttattga

SEQ ID NO: 705945 - DNA, 25 bp, Mus musculus
ggcaagaccggctgaggtttattga

SEQ ID NO: 705946 - DNA, 25 bp, Mus musculus
ggcaagacctcgctaatgatgaact

SEQ ID NO: 705947 - DNA, 25 bp, Mus musculus
ggcaagacctcggtaatgatgaact

SEQ ID NO: 705948 - DNA, 25 bp, Mus musculus
ggcaagacggacaatggactcatgg

SEQ ID NO: 705949 - DNA, 25 bp, Mus musculus
ggcaagacggactatggactcatgg

SEQ ID NO: 705950 - DNA, 25 bp, Mus musculus
ggcaagacggcacccttcaaagcca

SEQ ID NO: 705951 - DNA, 25 bp, Mus musculus
ggcaagacggcagccttcaaagcca

SEQ ID NO: 705952 - DNA, 25 bp, Mus musculus
ggcaagagatacattttgatgctga

SEQ ID NO: 705953 - DNA, 25 bp, Mus musculus
ggcaagagatactttttgatgctga

SEQ ID NO: 705954 - DNA, 25 bp, Mus musculus
ggcaagagatctcccatcttgagaa

SEQ ID NO: 705955 - DNA, 25 bp, Mus musculus
ggcaagagatctgccatcttgagaa

SEQ ID NO: 705956 - DNA, 25 bp, Mus musculus
ggcaagaggacacactatacgcctt

SEQ ID NO: 705957 - DNA, 25 bp, Mus musculus
ggcaagaggacagactatacgcctt

SEQ ID NO: 705958 - DNA, 25 bp, Mus musculus
ggcaagaggcggacttgtcctcgct

SEQ ID NO: 705959 - DNA, 25 bp, Mus musculus
ggcaagaggcggtcttgtcctcgct

SEQ ID NO: 705960 - DNA, 25 bp, Mus musculus
ggcaagatcactccttttgaggaaa

SEQ ID NO: 705961 - DNA, 25 bp, Mus musculus
ggcaagatcactgcttttgaggaaa

SEQ ID NO: 705962 - DNA, 25 bp, Mus musculus
ggcaagatccacagggccaaggagc

SEQ ID NO: 705963 - DNA, 25 bp, Mus musculus
ggcaagatccactgggccaaggagc

SEQ ID NO: 705964 - DNA, 25 bp, Mus musculus
ggcaagatcctgctgtccctcatgt

SEQ ID NO: 705965 - DNA, 25 bp, Mus musculus
ggcaagatcctggtgtccctcatgt

SEQ ID NO: 705966 - DNA, 25 bp, Mus musculus
ggcaagatcgcgcaccgctttctgc

SEQ ID NO: 705967 - DNA, 25 bp, Mus musculus
ggcaagatcgcggaccgctttctgc

SEQ ID NO: 705968 - DNA, 25 bp, Mus musculus
ggcaagcaacagaatctgcagtcca

SEQ ID NO: 705969 - DNA, 25 bp, Mus musculus
ggcaagcaacagtatctgcagtcca

SEQ ID NO: 705970 - DNA, 25 bp, Mus musculus
ggcaagcacacacctatctgtatgt

SEQ ID NO: 705971 - DNA, 25 bp, Mus musculus
ggcaagcacacagctatctgtatgt

SEQ ID NO: 705972 - DNA, 25 bp, Mus musculus
ggcaagcacctcaacactttagatg

SEQ ID NO: 705973 - DNA, 25 bp, Mus musculus
ggcaagcacctctacactttagatg

SEQ ID NO: 705974 - DNA, 25 bp, Mus musculus
ggcaagcagggcaactgtttcagaa

SEQ ID NO: 705975 - DNA, 25 bp, Mus musculus
ggcaagcagggctactgtttcagaa

SEQ ID NO: 705976 - DNA, 25 bp, Mus musculus
ggcaagccgaaactcattgacctca

SEQ ID NO: 705977 - DNA, 25 bp, Mus musculus
ggcaagccgaaagtcattgacctca

SEQ ID NO: 705978 - DNA, 25 bp, Mus musculus
ggcaagcgccccattcgaagattgg

SEQ ID NO: 705979 - DNA, 25 bp, Mus musculus
ggcaagcgcccctttcgaagattgg

SEQ ID NO: 705980 - DNA, 25 bp, Mus musculus
ggcaagctgaacattaccaagccag

SEQ ID NO: 705981 - DNA, 25 bp, Mus musculus
ggcaagctgaactttaccaagccag

SEQ ID NO: 705982 - DNA, 25 bp, Mus musculus
ggcaagctgacacaggctttcaagt

SEQ ID NO: 705983 - DNA, 25 bp, Mus musculus
ggcaagctgacagaggctttcaagt

SEQ ID NO: 705984 - DNA, 25 bp, Mus musculus
ggcaagctgactcttgtcattctgg

SEQ ID NO: 705985 - DNA, 25 bp, Mus musculus
ggcaagctgactgttgtcattctgg

SEQ ID NO: 705986 - DNA, 25 bp, Mus musculus
ggcaagctgctgattcaaaagatac

SEQ ID NO: 705987 - DNA, 25 bp, Mus musculus
ggcaagctgctgtttcaaaagatac

SEQ ID NO: 705988 - DNA, 25 bp, Mus musculus
ggcaagctggcaaacggactgttgc

SEQ ID NO: 705989 - DNA, 25 bp, Mus musculus
ggcaagctggcatacggactgttgc

SEQ ID NO: 705990 - DNA, 25 bp, Mus musculus
ggcaagcttactcctccgctctaag

SEQ ID NO: 705991 - DNA, 25 bp, Mus musculus
ggcaagcttactgctccgctctaag

SEQ ID NO: 705992 - DNA, 25 bp, Mus musculus
ggcaagcttttccatcagaagtacc

SEQ ID NO: 705993 - DNA, 25 bp, Mus musculus
ggcaagcttttcgatcagaagtacc

SEQ ID NO: 705994 - DNA, 25 bp, Mus musculus
ggcaaggagaatccgctgttgccaa

SEQ ID NO: 705995 - DNA, 25 bp, Mus musculus
ggcaaggagaatgcgctgttgccaa

SEQ ID NO: 705996 - DNA, 25 bp, Mus musculus
ggcaaggagccacagcacctcagtc

SEQ ID NO: 705997 - DNA, 25 bp, Mus musculus
ggcaaggagccagagcacctcagtc

SEQ ID NO: 705998 - DNA, 25 bp, Mus musculus
ggcaaggagtatcactttcacctgc

SEQ ID NO: 705999 - DNA, 25 bp, Mus musculus
ggcaaggagtatgactttcacctgc

SEQ ID NO: 706000 - DNA, 25 bp, Mus musculus
ggcaaggagtggaccaccacgacag

SEQ ID NO: 706001 - DNA, 25 bp, Mus musculus
ggcaaggagtggtccaccacgacag

SEQ ID NO: 706002 - DNA, 25 bp, Mus musculus
ggcaaggatcttaaacccaaagtat

SEQ ID NO: 706003 - DNA, 25 bp, Mus musculus
ggcaaggatctttaacccaaagtat

SEQ ID NO: 706004 - DNA, 25 bp, Mus musculus
ggcaaggcattaaacccatcaggca

SEQ ID NO: 706005 - DNA, 25 bp, Mus musculus
ggcaaggcattatacccatcaggca

SEQ ID NO: 706006 - DNA, 25 bp, Mus musculus
ggcaaggccagaaaggaggcaacac

SEQ ID NO: 706007 - DNA, 25 bp, Mus musculus
ggcaaggccagataggaggcaacac

SEQ ID NO: 706008 - DNA, 25 bp, Mus musculus
ggcaagggcacccacgtgatcatcc

SEQ ID NO: 706009 - DNA, 25 bp, Mus musculus
ggcaagggcaccgacgtgatcatcc

SEQ ID NO: 706010 - DNA, 25 bp, Mus musculus
ggcaagggttccacgtgaaacctgg

SEQ ID NO: 706011 - DNA, 25 bp, Mus musculus
ggcaagggttcctcgtgaaacctgg

SEQ ID NO: 706012 - DNA, 25 bp, Mus musculus
ggcaagtaaatcagccctggttacc

SEQ ID NO: 706013 - DNA, 25 bp, Mus musculus
ggcaagtaaatctgccctggttacc

SEQ ID NO: 706014 - DNA, 25 bp, Mus musculus
ggcaagtacacgcaggccgtgattc

SEQ ID NO: 706015 - DNA, 25 bp, Mus musculus
ggcaagtacacggaggccgtgattc

SEQ ID NO: 706016 - DNA, 25 bp, Mus musculus
ggcaagtatgagatccctgacaagg

SEQ ID NO: 706017 - DNA, 25 bp, Mus musculus
ggcaagtatgagttccctgacaagg

SEQ ID NO: 706018 - DNA, 25 bp, Mus musculus
ggcaagtatggaacgccctgtacaa

SEQ ID NO: 706019 - DNA, 25 bp, Mus musculus
ggcaagtatggatcgccctgtacaa

SEQ ID NO: 706020 - DNA, 25 bp, Mus musculus
ggcaagtcacccagcatcagcatca

SEQ ID NO: 706021 - DNA, 25 bp, Mus musculus
ggcaagtcaccctgcatcagcatca

SEQ ID NO: 706022 - DNA, 25 bp, Mus musculus
ggcaagtccaaactgacccacgtca

SEQ ID NO: 706023 - DNA, 25 bp, Mus musculus
ggcaagtccaaagtgacccacgtca

SEQ ID NO: 706024 - DNA, 25 bp, Mus musculus
ggcaagtccatactctgctttctcc

SEQ ID NO: 706025 - DNA, 25 bp, Mus musculus
ggcaagtccatagtctgctttctcc

SEQ ID NO: 706026 - DNA, 25 bp, Mus musculus
ggcaagtctccaagcccaaggacaa

SEQ ID NO: 706027 - DNA, 25 bp, Mus musculus
ggcaagtctccatgcccaaggacaa

SEQ ID NO: 706028 - DNA, 25 bp, Mus musculus
ggcaagtgacctacctccatgtctt

SEQ ID NO: 706029 - DNA, 25 bp, Mus musculus
ggcaagtgaccttcctccatgtctt

SEQ ID NO: 706030 - DNA, 25 bp, Mus musculus
ggcaagtgcgtcatcctaagaaaca

SEQ ID NO: 706031 - DNA, 25 bp, Mus musculus
ggcaagtgcgtcttcctaagaaaca

SEQ ID NO: 706032 - DNA, 25 bp, Mus musculus
ggcaagtgctccaccaagtactcca

SEQ ID NO: 706033 - DNA, 25 bp, Mus musculus
ggcaagtgctcctccaagtactcca

SEQ ID NO: 706034 - DNA, 25 bp, Mus musculus
ggcaagtggatcattcgactccgga

SEQ ID NO: 706035 - DNA, 25 bp, Mus musculus
ggcaagtggatctttcgactccgga

SEQ ID NO: 706036 - DNA, 25 bp, Mus musculus
ggcaagttcttcctcgatttccgca

SEQ ID NO: 706037 - DNA, 25 bp, Mus musculus
ggcaagttcttcgtcgatttccgca

SEQ ID NO: 706038 - DNA, 25 bp, Mus musculus
ggcaataaaagtaaccagtcctatc

SEQ ID NO: 706039 - DNA, 25 bp, Mus musculus
ggcaataaaagttaccagtcctatc

SEQ ID NO: 706040 - DNA, 25 bp, Mus musculus
ggcaataacctcagaaatactacag

SEQ ID NO: 706041 - DNA, 25 bp, Mus musculus
ggcaataacctctgaaatactacag

SEQ ID NO: 706042 - DNA, 25 bp, Mus musculus
ggcaataaggtcagcaacctgcagt

SEQ ID NO: 706043 - DNA, 25 bp, Mus musculus
ggcaataaggtctgcaacctgcagt

SEQ ID NO: 706044 - DNA, 25 bp, Mus musculus
ggcaatagatccaaactagcaaggg

SEQ ID NO: 706045 - DNA, 25 bp, Mus musculus
ggcaatagatcctaactagcaaggg

SEQ ID NO: 706046 - DNA, 25 bp, Mus musculus
ggcaatagccttaatagaaaaaacg

SEQ ID NO: 706047 - DNA, 25 bp, Mus musculus
ggcaatagcctttatagaaaaaacg

SEQ ID NO: 706048 - DNA, 25 bp, Mus musculus
ggcaatatctagatgttttcccttc

SEQ ID NO: 706049 - DNA, 25 bp, Mus musculus
ggcaatatctagttgttttcccttc

SEQ ID NO: 706050 - DNA, 25 bp, Mus musculus
ggcaatatgaagctgagagaaataa

SEQ ID NO: 706051 - DNA, 25 bp, Mus musculus
ggcaatatgaaggtgagagaaataa

SEQ ID NO: 706052 - DNA, 25 bp, Mus musculus
ggcaatattttacacctcttatatg

SEQ ID NO: 706053 - DNA, 25 bp, Mus musculus
ggcaatattttagacctcttatatg

SEQ ID NO: 706054 - DNA, 25 bp, Mus musculus
ggcaatcaagaaaggctagtttggg

SEQ ID NO: 706055 - DNA, 25 bp, Mus musculus
ggcaatcaagaatggctagtttggg

SEQ ID NO: 706056 - DNA, 25 bp, Mus musculus
ggcaatcccactaatggcctttcaa

SEQ ID NO: 706057 - DNA, 25 bp, Mus musculus
ggcaatcccacttatggcctttcaa

SEQ ID NO: 706058 - DNA, 25 bp, Mus musculus
ggcaatccttatctttgtgacagtc

SEQ ID NO: 706059 - DNA, 25 bp, Mus musculus
ggcaatccttatgtttgtgacagtc

SEQ ID NO: 706060 - DNA, 25 bp, Mus musculus
ggcaatctctccatcgaccaaatta

SEQ ID NO: 706061 - DNA, 25 bp, Mus musculus
ggcaatctctccttcgaccaaatta

SEQ ID NO: 706062 - DNA, 25 bp, Mus musculus
ggcaatctctcgctcagttttctgg

SEQ ID NO: 706063 - DNA, 25 bp, Mus musculus
ggcaatctctcggtcagttttctgg

SEQ ID NO: 706064 - DNA, 25 bp, Mus musculus
ggcaatctgcagatccatcatgtgg

SEQ ID NO: 706065 - DNA, 25 bp, Mus musculus
ggcaatctgcagttccatcatgtgg

SEQ ID NO: 706066 - DNA, 25 bp, Mus musculus
ggcaatgacatcaaggcaagcccat

SEQ ID NO: 706067 - DNA, 25 bp, Mus musculus
ggcaatgacatcactccagagagca

SEQ ID NO: 706068 - DNA, 25 bp, Mus musculus
ggcaatgacatctaggcaagcccat

SEQ ID NO: 706069 - DNA, 25 bp, Mus musculus
ggcaatgacatctctccagagagca

SEQ ID NO: 706070 - DNA, 25 bp, Mus musculus
ggcaatgaccgtatccttctatgta

SEQ ID NO: 706071 - DNA, 25 bp, Mus musculus
ggcaatgaccgtttccttctatgta

SEQ ID NO: 706072 - DNA, 25 bp, Mus musculus
ggcaatgaccttctaaagaagggca

SEQ ID NO: 706073 - DNA, 25 bp, Mus musculus
ggcaatgaccttgtaaagaagggca

SEQ ID NO: 706074 - DNA, 25 bp, Mus musculus
ggcaatgcaaagatgaccctgggaa

SEQ ID NO: 706075 - DNA, 25 bp, Mus musculus
ggcaatgcaaagttgaccctgggaa

SEQ ID NO: 706076 - DNA, 25 bp, Mus musculus
ggcaatgctaccagccagatagccc

SEQ ID NO: 706077 - DNA, 25 bp, Mus musculus
ggcaatgctacctgccagatagccc

SEQ ID NO: 706078 - DNA, 25 bp, Mus musculus
ggcaatgctgcaactcctacttgaa

SEQ ID NO: 706079 - DNA, 25 bp, Mus musculus
ggcaatgctgcatctcctacttgaa

SEQ ID NO: 706080 - DNA, 25 bp, Mus musculus
ggcaatgctttcaagaaagctgacc

SEQ ID NO: 706081 - DNA, 25 bp, Mus musculus
ggcaatgctttctagaaagctgacc

SEQ ID NO: 706082 - DNA, 25 bp, Mus musculus
ggcaatggacacacgactgatctct

SEQ ID NO: 706083 - DNA, 25 bp, Mus musculus
ggcaatggacactcgactgatctct

SEQ ID NO: 706084 - DNA, 25 bp, Mus musculus
ggcaatggacttactcctgggaaat

SEQ ID NO: 706085 - DNA, 25 bp, Mus musculus
ggcaatggactttctcctgggaaat

SEQ ID NO: 706086 - DNA, 25 bp, Mus musculus
ggcaatggcttgatgctcaaaggtg

SEQ ID NO: 706087 - DNA, 25 bp, Mus musculus
ggcaatggcttgttgctcaaaggtg

SEQ ID NO: 706088 - DNA, 25 bp, Mus musculus
ggcaatgggcttcgagctctacctg

SEQ ID NO: 706089 - DNA, 25 bp, Mus musculus
ggcaatgggcttggagctctacctg

SEQ ID NO: 706090 - DNA, 25 bp, Mus musculus
ggcaatggttccatcattgagcacc

SEQ ID NO: 706091 - DNA, 25 bp, Mus musculus
ggcaatggttccttcattgagcacc

SEQ ID NO: 706092 - DNA, 25 bp, Mus musculus
ggcaatgtgcccaatatcatcattg

SEQ ID NO: 706093 - DNA, 25 bp, Mus musculus
ggcaatgtgccctatatcatcattg

SEQ ID NO: 706094 - DNA, 25 bp, Mus musculus
ggcaatgtgctgatccacttcccct

SEQ ID NO: 706095 - DNA, 25 bp, Mus musculus
ggcaatgtgctgttccacttcccct

SEQ ID NO: 706096 - DNA, 25 bp, Mus musculus
ggcaatgtggcacccatcttagaac

SEQ ID NO: 706097 - DNA, 25 bp, Mus musculus
ggcaatgtggcagccatcttagaac

SEQ ID NO: 706098 - DNA, 25 bp, Mus musculus
ggcaatgttatcacttcctatggaa

SEQ ID NO: 706099 - DNA, 25 bp, Mus musculus
ggcaatgttatctcttcctatggaa

SEQ ID NO: 706100 - DNA, 25 bp, Mus musculus
ggcaatgttgctcaatgtctcaggc

SEQ ID NO: 706101 - DNA, 25 bp, Mus musculus
ggcaatgttgctgaatgtctcaggc

SEQ ID NO: 706102 - DNA, 25 bp, Mus musculus
ggcaattaggatagcccaggagtcc

SEQ ID NO: 706103 - DNA, 25 bp, Mus musculus
ggcaattaggattgcccaggagtcc

SEQ ID NO: 706104 - DNA, 25 bp, Mus musculus
ggcaattatgttattcagcatgtac

SEQ ID NO: 706105 - DNA, 25 bp, Mus musculus
ggcaattatgtttttcagcatgtac

SEQ ID NO: 706106 - DNA, 25 bp, Mus musculus
ggcaattctggacgctcttccggaa

SEQ ID NO: 706107 - DNA, 25 bp, Mus musculus
ggcaattctggaggctcttccggaa

SEQ ID NO: 706108 - DNA, 25 bp, Mus musculus
ggcaattggactcagaggccccagt

SEQ ID NO: 706109 - DNA, 25 bp, Mus musculus
ggcaattggactgagaggccccagt

SEQ ID NO: 706110 - DNA, 25 bp, Mus musculus
ggcaattgtcaacactccagagaaa

SEQ ID NO: 706111 - DNA, 25 bp, Mus musculus
ggcaattgtcaagactccagagaaa

SEQ ID NO: 706112 - DNA, 25 bp, Mus musculus
ggcaatttccaaaattgtatggaag

SEQ ID NO: 706113 - DNA, 25 bp, Mus musculus
ggcaatttccaatattgtatggaag

SEQ ID NO: 706114 - DNA, 25 bp, Mus musculus
ggcacaaaagtacgtgagactgctt

SEQ ID NO: 706115 - DNA, 25 bp, Mus musculus
ggcacaaaagtaggtgagactgctt

SEQ ID NO: 706116 - DNA, 25 bp, Mus musculus
ggcacaaacagcatgtcagggcgtt

SEQ ID NO: 706117 - DNA, 25 bp, Mus musculus
ggcacaaacagcttgtcagggcgtt

SEQ ID NO: 706118 - DNA, 25 bp, Mus musculus
ggcacaaacatcagtaagcttctct

SEQ ID NO: 706119 - DNA, 25 bp, Mus musculus
ggcacaaacatctgtaagcttctct

SEQ ID NO: 706120 - DNA, 25 bp, Mus musculus
ggcacaacattgactacaccgacaa

SEQ ID NO: 706121 - DNA, 25 bp, Mus musculus
ggcacaacattgtctacaccgacaa

SEQ ID NO: 706122 - DNA, 25 bp, Mus musculus
ggcacaaccagcaaaggcgagaaaa

SEQ ID NO: 706123 - DNA, 25 bp, Mus musculus
ggcacaaccagctaaggcgagaaaa

SEQ ID NO: 706124 - DNA, 25 bp, Mus musculus
ggcacaaccttgactggtggccaga

SEQ ID NO: 706125 - DNA, 25 bp, Mus musculus
ggcacaaccttgtctggtggccaga

SEQ ID NO: 706126 - DNA, 25 bp, Mus musculus
ggcacaagaagtcgatcatccaggt

SEQ ID NO: 706127 - DNA, 25 bp, Mus musculus
ggcacaagaagtggatcatccaggt

SEQ ID NO: 706128 - DNA, 25 bp, Mus musculus
ggcacaagctctccttagccttcag

SEQ ID NO: 706129 - DNA, 25 bp, Mus musculus
ggcacaagctctgcttagccttcag

SEQ ID NO: 706130 - DNA, 25 bp, Mus musculus
ggcacaagtcagaaacggacacaca

SEQ ID NO: 706131 - DNA, 25 bp, Mus musculus
ggcacaagtcagtaacggacacaca

SEQ ID NO: 706132 - DNA, 25 bp, Mus musculus
ggcacaagtccaaaaagatgctcgg

SEQ ID NO: 706133 - DNA, 25 bp, Mus musculus
ggcacaagtccataaagatgctcgg

SEQ ID NO: 706134 - DNA, 25 bp, Mus musculus
ggcacaagtgagactgatcgaatcc

SEQ ID NO: 706135 - DNA, 25 bp, Mus musculus
ggcacaagtgagtctgatcgaatcc

SEQ ID NO: 706136 - DNA, 25 bp, Mus musculus
ggcacaagttcacgagacccgaagg

SEQ ID NO: 706137 - DNA, 25 bp, Mus musculus
ggcacaagttcaggagacccgaagg

SEQ ID NO: 706138 - DNA, 25 bp, Mus musculus
ggcacaatcctgatatcttcagaag

SEQ ID NO: 706139 - DNA, 25 bp, Mus musculus
ggcacaatcctgttatcttcagaag

SEQ ID NO: 706140 - DNA, 25 bp, Mus musculus
ggcacaatgaccatcgagatcgact

SEQ ID NO: 706141 - DNA, 25 bp, Mus musculus
ggcacaatgaccttcgagatcgact

SEQ ID NO: 706142 - DNA, 25 bp, Mus musculus
ggcacaatgcagcaaaggatcacca

SEQ ID NO: 706143 - DNA, 25 bp, Mus musculus
ggcacaatgcaggaaaggatcacca

SEQ ID NO: 706144 - DNA, 25 bp, Mus musculus
ggcacaatggagacttctcttcaga

SEQ ID NO: 706145 - DNA, 25 bp, Mus musculus
ggcacaatggagtcttctcttcaga

SEQ ID NO: 706146 - DNA, 25 bp, Mus musculus
ggcacacaaagaaggtgttctcaaa

SEQ ID NO: 706147 - DNA, 25 bp, Mus musculus
ggcacacaaagatggtgttctcaaa

SEQ ID NO: 706148 - DNA, 25 bp, Mus musculus
ggcacacacaacagccaggcaggct

SEQ ID NO: 706149 - DNA, 25 bp, Mus musculus
ggcacacacaactgccaggcaggct

SEQ ID NO: 706150 - DNA, 25 bp, Mus musculus
ggcacacacacgcaaccggtgagca

SEQ ID NO: 706151 - DNA, 25 bp, Mus musculus
ggcacacacacggaaccggtgagca

SEQ ID NO: 706152 - DNA, 25 bp, Mus musculus
ggcacacagccaccacagtgaagag

SEQ ID NO: 706153 - DNA, 25 bp, Mus musculus
ggcacacagccagcacagtgaagag

SEQ ID NO: 706154 - DNA, 25 bp, Mus musculus
ggcacacagggcaacgtgggcctca

SEQ ID NO: 706155 - DNA, 25 bp, Mus musculus
ggcacacagggctacgtgggcctca

SEQ ID NO: 706156 - DNA, 25 bp, Mus musculus
ggcacacatatgaccgttctatcac

SEQ ID NO: 706157 - DNA, 25 bp, Mus musculus
ggcacacatatgtccgttctatcac

SEQ ID NO: 706158 - DNA, 25 bp, Mus musculus
ggcacaccaggaacagcgagccaat

SEQ ID NO: 706159 - DNA, 25 bp, Mus musculus
ggcacaccaggatcagcgagccaat

SEQ ID NO: 706160 - DNA, 25 bp, Mus musculus
ggcacacctttcacagccatcaggg

SEQ ID NO: 706161 - DNA, 25 bp, Mus musculus
ggcacacctttctcagccatcaggg

SEQ ID NO: 706162 - DNA, 25 bp, Mus musculus
ggcacacggtgacacacaacactgt

SEQ ID NO: 706163 - DNA, 25 bp, Mus musculus
ggcacacggtgagacacaacactgt

SEQ ID NO: 706164 - DNA, 25 bp, Mus musculus
ggcacacgttgcatcacagtaaatt

SEQ ID NO: 706165 - DNA, 25 bp, Mus musculus
ggcacacgttgcttcacagtaaatt

SEQ ID NO: 706166 - DNA, 25 bp, Mus musculus
ggcacactgaagcatcccctgggtt

SEQ ID NO: 706167 - DNA, 25 bp, Mus musculus
ggcacactgaaggatcccctgggtt

SEQ ID NO: 706168 - DNA, 25 bp, Mus musculus
ggcacactggagatctacagaacta

SEQ ID NO: 706169 - DNA, 25 bp, Mus musculus
ggcacactggagttctacagaacta

SEQ ID NO: 706170 - DNA, 25 bp, Mus musculus
ggcacacttccacctccatgtaaag

SEQ ID NO: 706171 - DNA, 25 bp, Mus musculus
ggcacacttccagctccatgtaaag

SEQ ID NO: 706172 - DNA, 25 bp, Mus musculus
ggcacacttgcccagaggatccgtg

SEQ ID NO: 706173 - DNA, 25 bp, Mus musculus
ggcacacttgccgagaggatccgtg

SEQ ID NO: 706174 - DNA, 25 bp, Mus musculus
ggcacagaaacgacagtagtgggtt

SEQ ID NO: 706175 - DNA, 25 bp, Mus musculus
ggcacagaaacgtcagtagtgggtt

SEQ ID NO: 706176 - DNA, 25 bp, Mus musculus
ggcacagaaactaccacagtcttct

SEQ ID NO: 706177 - DNA, 25 bp, Mus musculus
ggcacagaaacttccacagtcttct

SEQ ID NO: 706178 - DNA, 25 bp, Mus musculus
ggcacagaacccagctggaaggtcc

SEQ ID NO: 706179 - DNA, 25 bp, Mus musculus
ggcacagaaccctgctggaaggtcc

SEQ ID NO: 706180 - DNA, 25 bp, Mus musculus
ggcacagaagctctggtcttcagca

SEQ ID NO: 706181 - DNA, 25 bp, Mus musculus
ggcacagaagctgtggtcttcagca

SEQ ID NO: 706182 - DNA, 25 bp, Mus musculus
ggcacagaaggaccttttgggacca

SEQ ID NO: 706183 - DNA, 25 bp, Mus musculus
ggcacagaaggagcttttgggacca

SEQ ID NO: 706184 - DNA, 25 bp, Mus musculus
ggcacagacgagaacaacagcggca

SEQ ID NO: 706185 - DNA, 25 bp, Mus musculus
ggcacagacgagtacaacagcggca

SEQ ID NO: 706186 - DNA, 25 bp, Mus musculus
ggcacagagaaccatctccgaattt

SEQ ID NO: 706187 - DNA, 25 bp, Mus musculus
ggcacagagaacgatctccgaattt

SEQ ID NO: 706188 - DNA, 25 bp, Mus musculus
ggcacagagtctccccaagacttca

SEQ ID NO: 706189 - DNA, 25 bp, Mus musculus
ggcacagagtctgcccaagacttca

SEQ ID NO: 706190 - DNA, 25 bp, Mus musculus
ggcacagatcaaatcctcaatgact

SEQ ID NO: 706191 - DNA, 25 bp, Mus musculus
ggcacagatcaattcctcaatgact

SEQ ID NO: 706192 - DNA, 25 bp, Mus musculus
ggcacagatgtcatcacactcctta

SEQ ID NO: 706193 - DNA, 25 bp, Mus musculus
ggcacagatgtcttcacactcctta

SEQ ID NO: 706194 - DNA, 25 bp, Mus musculus
ggcacagcaacgacagcatgggcag

SEQ ID NO: 706195 - DNA, 25 bp, Mus musculus
ggcacagcaacgtcagcatgggcag

SEQ ID NO: 706196 - DNA, 25 bp, Mus musculus
ggcacagcggcaatttggctacaag

SEQ ID NO: 706197 - DNA, 25 bp, Mus musculus
ggcacagcggcattttggctacaag

SEQ ID NO: 706198 - DNA, 25 bp, Mus musculus
ggcacagctactaaaccagggttgg

SEQ ID NO: 706199 - DNA, 25 bp, Mus musculus
ggcacagctacttaaccagggttgg

SEQ ID NO: 706200 - DNA, 25 bp, Mus musculus
ggcacaggaaaaaacatgctataaa

SEQ ID NO: 706201 - DNA, 25 bp, Mus musculus
ggcacaggaaaatacatgctataaa

SEQ ID NO: 706202 - DNA, 25 bp, Mus musculus
ggcacaggcctgagctgattgagta

SEQ ID NO: 706203 - DNA, 25 bp, Mus musculus
ggcacaggcctgtgctgattgagta

SEQ ID NO: 706204 - DNA, 25 bp, Mus musculus
ggcacagggaccagcgtctgcacct

SEQ ID NO: 706205 - DNA, 25 bp, Mus musculus
ggcacagggacctgcgtctgcacct

SEQ ID NO: 706206 - DNA, 25 bp, Mus musculus
ggcacagtctgacccttgcctggcg

SEQ ID NO: 706207 - DNA, 25 bp, Mus musculus
ggcacagtctgagccttgcctggcg

SEQ ID NO: 706208 - DNA, 25 bp, Mus musculus
ggcacagtctgcctcaagtacctgc

SEQ ID NO: 706209 - DNA, 25 bp, Mus musculus
ggcacagtctgcgtcaagtacctgc

SEQ ID NO: 706210 - DNA, 25 bp, Mus musculus
ggcacagttggtcgctacttcctgg

SEQ ID NO: 706211 - DNA, 25 bp, Mus musculus
ggcacagttggtggctacttcctgg

SEQ ID NO: 706212 - DNA, 25 bp, Mus musculus
ggcacatagaaaagactcttcagtt

SEQ ID NO: 706213 - DNA, 25 bp, Mus musculus
ggcacatagaaatgactcttcagtt

SEQ ID NO: 706214 - DNA, 25 bp, Mus musculus
ggcacatcaattcggatgatctctt

SEQ ID NO: 706215 - DNA, 25 bp, Mus musculus
ggcacatcaattgggatgatctctt

SEQ ID NO: 706216 - DNA, 25 bp, Mus musculus
ggcacatcacgcaggagctccatgg

SEQ ID NO: 706217 - DNA, 25 bp, Mus musculus
ggcacatcacgctggagctccatgg

SEQ ID NO: 706218 - DNA, 25 bp, Mus musculus
ggcacatcagcgcttccagttcagc

SEQ ID NO: 706219 - DNA, 25 bp, Mus musculus
ggcacatcagcggttccagttcagc

SEQ ID NO: 706220 - DNA, 25 bp, Mus musculus
ggcacatccgcgaagcacagcgcag

SEQ ID NO: 706221 - DNA, 25 bp, Mus musculus
ggcacatccgcgtagcacagcgcag

SEQ ID NO: 706222 - DNA, 25 bp, Mus musculus
ggcacatctatcaggactggcactc

SEQ ID NO: 706223 - DNA, 25 bp, Mus musculus
ggcacatctatctggactggcactc

SEQ ID NO: 706224 - DNA, 25 bp, Mus musculus
ggcacatctccaaattcaccacgtt

SEQ ID NO: 706225 - DNA, 25 bp, Mus musculus
ggcacatctccatattcaccacgtt

SEQ ID NO: 706226 - DNA, 25 bp, Mus musculus
ggcacatctgatccatacgtcaaag

SEQ ID NO: 706227 - DNA, 25 bp, Mus musculus
ggcacatctgatgcatacgtcaaag

SEQ ID NO: 706228 - DNA, 25 bp, Mus musculus
ggcacatctgctcgataacacggag

SEQ ID NO: 706229 - DNA, 25 bp, Mus musculus
ggcacatctgctggataacacggag

SEQ ID NO: 706230 - DNA, 25 bp, Mus musculus
ggcacatggattataagtatctgcg

SEQ ID NO: 706231 - DNA, 25 bp, Mus musculus
ggcacatggattttaagtatctgcg

SEQ ID NO: 706232 - DNA, 25 bp, Mus musculus
ggcacatgggcaaatagctgtggta

SEQ ID NO: 706233 - DNA, 25 bp, Mus musculus
ggcacatgggcatatagctgtggta

SEQ ID NO: 706234 - DNA, 25 bp, Mus musculus
ggcacatttagacaaagctagcaga

SEQ ID NO: 706235 - DNA, 25 bp, Mus musculus
ggcacatttagagaaagctagcaga

SEQ ID NO: 706236 - DNA, 25 bp, Mus musculus
ggcaccaacagcacgattcctacaa

SEQ ID NO: 706237 - DNA, 25 bp, Mus musculus
ggcaccaacagctcgattcctacaa

SEQ ID NO: 706238 - DNA, 25 bp, Mus musculus
ggcaccaagaagcttcatgtcatct

SEQ ID NO: 706239 - DNA, 25 bp, Mus musculus
ggcaccaagaaggttcatgtcatct

SEQ ID NO: 706240 - DNA, 25 bp, Mus musculus
ggcaccaagatcaacgtgtggaaag

SEQ ID NO: 706241 - DNA, 25 bp, Mus musculus
ggcaccaagatctacgtgtggaaag

SEQ ID NO: 706242 - DNA, 25 bp, Mus musculus
ggcaccaagcacatctgattctgtg

SEQ ID NO: 706243 - DNA, 25 bp, Mus musculus
ggcaccaagcacattacgaccattt

SEQ ID NO: 706244 - DNA, 25 bp, Mus musculus
ggcaccaagcacttctgattctgtg

SEQ ID NO: 706245 - DNA, 25 bp, Mus musculus
ggcaccaagcactttacgaccattt

SEQ ID NO: 706246 - DNA, 25 bp, Mus musculus
ggcaccaagcgaagcgacagagctc

SEQ ID NO: 706247 - DNA, 25 bp, Mus musculus
ggcaccaagcgatgcgacagagctc

SEQ ID NO: 706248 - DNA, 25 bp, Mus musculus
ggcaccaagggcatggccatcacat

SEQ ID NO: 706249 - DNA, 25 bp, Mus musculus
ggcaccaagggcttggccatcacat

SEQ ID NO: 706250 - DNA, 25 bp, Mus musculus
ggcaccaagtcacaagggccattgt

SEQ ID NO: 706251 - DNA, 25 bp, Mus musculus
ggcaccaagtcagaagggccattgt

SEQ ID NO: 706252 - DNA, 25 bp, Mus musculus
ggcaccaatgaaaggaagacagttg

SEQ ID NO: 706253 - DNA, 25 bp, Mus musculus
ggcaccaatgaatggaagacagttg

SEQ ID NO: 706254 - DNA, 25 bp, Mus musculus
ggcaccaccgacattgatctcaagt

SEQ ID NO: 706255 - DNA, 25 bp, Mus musculus
ggcaccaccgactttgatctcaagt

SEQ ID NO: 706256 - DNA, 25 bp, Mus musculus
ggcaccacctggaatttgggaagtt

SEQ ID NO: 706257 - DNA, 25 bp, Mus musculus
ggcaccacctggtatttgggaagtt

SEQ ID NO: 706258 - DNA, 25 bp, Mus musculus
ggcaccactggtaatttcctgatga

SEQ ID NO: 706259 - DNA, 25 bp, Mus musculus
ggcaccactggttatttcctgatga

SEQ ID NO: 706260 - DNA, 25 bp, Mus musculus
ggcaccagcctgagtataatttcag

SEQ ID NO: 706261 - DNA, 25 bp, Mus musculus
ggcaccagcctgtgtataatttcag

SEQ ID NO: 706262 - DNA, 25 bp, Mus musculus
ggcaccagcgccatttataagcaag

SEQ ID NO: 706263 - DNA, 25 bp, Mus musculus
ggcaccagcgccttttataagcaag

SEQ ID NO: 706264 - DNA, 25 bp, Mus musculus
ggcaccagggatataagtcctcaac

SEQ ID NO: 706265 - DNA, 25 bp, Mus musculus
ggcaccagggatttaagtcctcaac

SEQ ID NO: 706266 - DNA, 25 bp, Mus musculus
ggcaccaggtatactgatatcagct

SEQ ID NO: 706267 - DNA, 25 bp, Mus musculus
ggcaccaggtattctgatatcagct

SEQ ID NO: 706268 - DNA, 25 bp, Mus musculus
ggcaccatcacaaccaaggaactgg

SEQ ID NO: 706269 - DNA, 25 bp, Mus musculus
ggcaccatcacatccaaggaactgg

SEQ ID NO: 706270 - DNA, 25 bp, Mus musculus
ggcaccatctgcagtttgctgctac

SEQ ID NO: 706271 - DNA, 25 bp, Mus musculus
ggcaccatctgctgtttgctgctac

SEQ ID NO: 706272 - DNA, 25 bp, Mus musculus
ggcaccatcttgaattacctccgag

SEQ ID NO: 706273 - DNA, 25 bp, Mus musculus
ggcaccatcttgtattacctccgag

SEQ ID NO: 706274 - DNA, 25 bp, Mus musculus
ggcaccatgaagatctggacttcgg

SEQ ID NO: 706275 - DNA, 25 bp, Mus musculus
ggcaccatgaagttctggacttcgg

SEQ ID NO: 706276 - DNA, 25 bp, Mus musculus
ggcaccatgcccatgacactgggtt

SEQ ID NO: 706277 - DNA, 25 bp, Mus musculus
ggcaccatgcccttgacactgggtt

SEQ ID NO: 706278 - DNA, 25 bp, Mus musculus
ggcaccatgggccaatgcggcatca

SEQ ID NO: 706279 - DNA, 25 bp, Mus musculus
ggcaccatgggcgaatgcggcatca

SEQ ID NO: 706280 - DNA, 25 bp, Mus musculus
ggcacccagcgaacactcatcttgg

SEQ ID NO: 706281 - DNA, 25 bp, Mus musculus
ggcacccagcgatcactcatcttgg

SEQ ID NO: 706282 - DNA, 25 bp, Mus musculus
ggcacccagtgccagaagattgtac

SEQ ID NO: 706283 - DNA, 25 bp, Mus musculus
ggcacccagtgcgagaagattgtac

SEQ ID NO: 706284 - DNA, 25 bp, Mus musculus
ggcacccattggacacaaccgaatg

SEQ ID NO: 706285 - DNA, 25 bp, Mus musculus
ggcacccattggtcacaaccgaatg

SEQ ID NO: 706286 - DNA, 25 bp, Mus musculus
ggcaccccgttcatatgtctctggc

SEQ ID NO: 706287 - DNA, 25 bp, Mus musculus
ggcaccccgttcttatgtctctggc

SEQ ID NO: 706288 - DNA, 25 bp, Mus musculus
ggcacccgatacctgtttgttgaat

SEQ ID NO: 706289 - DNA, 25 bp, Mus musculus
ggcacccgatacgtgtttgttgaat

SEQ ID NO: 706290 - DNA, 25 bp, Mus musculus
ggcacccggccactgtctgcaagat

SEQ ID NO: 706291 - DNA, 25 bp, Mus musculus
ggcacccggccagtgtctgcaagat

SEQ ID NO: 706292 - DNA, 25 bp, Mus musculus
ggcaccctgactaacgatgaatacc

SEQ ID NO: 706293 - DNA, 25 bp, Mus musculus
ggcaccctgacttacgatgaatacc

SEQ ID NO: 706294 - DNA, 25 bp, Mus musculus
ggcaccctgtgacagcgcaaaggct

SEQ ID NO: 706295 - DNA, 25 bp, Mus musculus
ggcaccctgtgagagcgcaaaggct

SEQ ID NO: 706296 - DNA, 25 bp, Mus musculus
ggcaccgacacccagacagagatac

SEQ ID NO: 706297 - DNA, 25 bp, Mus musculus
ggcaccgacaccgagacagagatac

SEQ ID NO: 706298 - DNA, 25 bp, Mus musculus
ggcaccgatgcccagtttctaaaag

SEQ ID NO: 706299 - DNA, 25 bp, Mus musculus
ggcaccgatgccgagtttctaaaag

SEQ ID NO: 706300 - DNA, 25 bp, Mus musculus
ggcaccgctctgaggtcccgaggac

SEQ ID NO: 706301 - DNA, 25 bp, Mus musculus
ggcaccgctctgtggtcccgaggac

SEQ ID NO: 706302 - DNA, 25 bp, Mus musculus
ggcaccggctaccttcccgaggatg

SEQ ID NO: 706303 - DNA, 25 bp, Mus musculus
ggcaccggctacgttcccgaggatg

SEQ ID NO: 706304 - DNA, 25 bp, Mus musculus
ggcaccgggtatacttagtggaaga

SEQ ID NO: 706305 - DNA, 25 bp, Mus musculus
ggcaccgggtattcttagtggaaga

SEQ ID NO: 706306 - DNA, 25 bp, Mus musculus
ggcaccgtctttctctacaatataa

SEQ ID NO: 706307 - DNA, 25 bp, Mus musculus
ggcaccgtctttgtctacaatataa

SEQ ID NO: 706308 - DNA, 25 bp, Mus musculus
ggcaccgtggaccttcaacatgtcc

SEQ ID NO: 706309 - DNA, 25 bp, Mus musculus
ggcaccgtggacgttcaacatgtcc

SEQ ID NO: 706310 - DNA, 25 bp, Mus musculus
ggcacctcaattaccagattgagca

SEQ ID NO: 706311 - DNA, 25 bp, Mus musculus
ggcacctcaatttccagattgagca

SEQ ID NO: 706312 - DNA, 25 bp, Mus musculus
ggcacctccatgagtctgtagagtt

SEQ ID NO: 706313 - DNA, 25 bp, Mus musculus
ggcacctccatgtgtctgtagagtt

SEQ ID NO: 706314 - DNA, 25 bp, Mus musculus
ggcacctcggggaccacttcaacag

SEQ ID NO: 706315 - DNA, 25 bp, Mus musculus
ggcacctcggggtccacttcaacag

SEQ ID NO: 706316 - DNA, 25 bp, Mus musculus
ggcacctgatgactacattgagaaa

SEQ ID NO: 706317 - DNA, 25 bp, Mus musculus
ggcacctgatgagtacattgagaaa

SEQ ID NO: 706318 - DNA, 25 bp, Mus musculus
ggcacctgccagcacatggagaagc

SEQ ID NO: 706319 - DNA, 25 bp, Mus musculus
ggcacctgccaggacatggagaagc

SEQ ID NO: 706320 - DNA, 25 bp, Mus musculus
ggcacctgcctgaggctatctcggg

SEQ ID NO: 706321 - DNA, 25 bp, Mus musculus
ggcacctgcctgtggctatctcggg

SEQ ID NO: 706322 - DNA, 25 bp, Mus musculus
ggcacctgccttaccaactcttttg

SEQ ID NO: 706323 - DNA, 25 bp, Mus musculus
ggcacctgcctttccaactcttttg

SEQ ID NO: 706324 - DNA, 25 bp, Mus musculus
ggcacctgcgcaccaagattgagtc

SEQ ID NO: 706325 - DNA, 25 bp, Mus musculus
ggcacctgcgcagcaagattgagtc

SEQ ID NO: 706326 - DNA, 25 bp, Mus musculus
ggcacctggataacccaaccatgcg

SEQ ID NO: 706327 - DNA, 25 bp, Mus musculus
ggcacctggatatcccaaccatgcg

SEQ ID NO: 706328 - DNA, 25 bp, Mus musculus
ggcacctgggctaagcatggacatt

SEQ ID NO: 706329 - DNA, 25 bp, Mus musculus
ggcacctgggcttagcatggacatt

SEQ ID NO: 706330 - DNA, 25 bp, Mus musculus
ggcacctggtccatcagtgctatgg

SEQ ID NO: 706331 - DNA, 25 bp, Mus musculus
ggcacctggtccttcagtgctatgg

SEQ ID NO: 706332 - DNA, 25 bp, Mus musculus
ggcacctgtgccagtatgatgtgga

SEQ ID NO: 706333 - DNA, 25 bp, Mus musculus
ggcacctgtgcctgtatgatgtgga

SEQ ID NO: 706334 - DNA, 25 bp, Mus musculus
ggcacctgtgctcaacgtgttgaca

SEQ ID NO: 706335 - DNA, 25 bp, Mus musculus
ggcacctgtgctgaacgtgttgaca

SEQ ID NO: 706336 - DNA, 25 bp, Mus musculus
ggcacctgtgtcctgtcgacaccgg

SEQ ID NO: 706337 - DNA, 25 bp, Mus musculus
ggcacctgtgtcgtgtcgacaccgg

SEQ ID NO: 706338 - DNA, 25 bp, Mus musculus
ggcaccttcaaaatacatcctaatg

SEQ ID NO: 706339 - DNA, 25 bp, Mus musculus
ggcaccttcaaattacatcctaatg

SEQ ID NO: 706340 - DNA, 25 bp, Mus musculus
ggcaccttctttacagaagtgaagc

SEQ ID NO: 706341 - DNA, 25 bp, Mus musculus
ggcaccttcttttcagaagtgaagc

SEQ ID NO: 706342 - DNA, 25 bp, Mus musculus
ggcaccttgcacatacactctggag

SEQ ID NO: 706343 - DNA, 25 bp, Mus musculus
ggcaccttgcacttacactctggag

SEQ ID NO: 706344 - DNA, 25 bp, Mus musculus
ggcaccttgcagagcaacttctgtt

SEQ ID NO: 706345 - DNA, 25 bp, Mus musculus
ggcaccttgcagtgcaacttctgtt

SEQ ID NO: 706346 - DNA, 25 bp, Mus musculus
ggcacctttgctcgtacctgtgagg

SEQ ID NO: 706347 - DNA, 25 bp, Mus musculus
ggcacctttgctggtacctgtgagg

SEQ ID NO: 706348 - DNA, 25 bp, Mus musculus
ggcacgaagagtccccatgaaggaa

SEQ ID NO: 706349 - DNA, 25 bp, Mus musculus
ggcacgaagagtgcccatgaaggaa

SEQ ID NO: 706350 - DNA, 25 bp, Mus musculus
ggcacgacatgcagaccacgactgc

SEQ ID NO: 706351 - DNA, 25 bp, Mus musculus
ggcacgacatgctgaccacgactgc

SEQ ID NO: 706352 - DNA, 25 bp, Mus musculus
ggcacgacatttccaggcgccatgt

SEQ ID NO: 706353 - DNA, 25 bp, Mus musculus
ggcacgacatttgcaggcgccatgt

SEQ ID NO: 706354 - DNA, 25 bp, Mus musculus
ggcacgagagcaccaaagaagagct

SEQ ID NO: 706355 - DNA, 25 bp, Mus musculus
ggcacgagagcagcaaagaagagct

SEQ ID NO: 706356 - DNA, 25 bp, Mus musculus
ggcacgagccggacaagatgatgaa

SEQ ID NO: 706357 - DNA, 25 bp, Mus musculus
ggcacgagccggtcaagatgatgaa

SEQ ID NO: 706358 - DNA, 25 bp, Mus musculus
ggcacgcactccaacgtggcaagaa

SEQ ID NO: 706359 - DNA, 25 bp, Mus musculus
ggcacgcactcctacgtggcaagaa

SEQ ID NO: 706360 - DNA, 25 bp, Mus musculus
ggcacgcgtgtacacaagaatgaca

SEQ ID NO: 706361 - DNA, 25 bp, Mus musculus
ggcacgcgtgtagacaagaatgaca

SEQ ID NO: 706362 - DNA, 25 bp, Mus musculus
ggcacgctgatcagtctggataagt

SEQ ID NO: 706363 - DNA, 25 bp, Mus musculus
ggcacgctgatctgtctggataagt

SEQ ID NO: 706364 - DNA, 25 bp, Mus musculus
ggcacgctggagaatcacaacgcta

SEQ ID NO: 706365 - DNA, 25 bp, Mus musculus
ggcacgctggagtatcacaacgcta

SEQ ID NO: 706366 - DNA, 25 bp, Mus musculus
ggcacgctggccatgtcttcgagta

SEQ ID NO: 706367 - DNA, 25 bp, Mus musculus
ggcacgctggccttgtcttcgagta

SEQ ID NO: 706368 - DNA, 25 bp, Mus musculus
ggcacgctgtaaaaagcaagcaggt

SEQ ID NO: 706369 - DNA, 25 bp, Mus musculus
ggcacgctgtaataagcaagcaggt

SEQ ID NO: 706370 - DNA, 25 bp, Mus musculus
ggcacgtgactgacttacatctaga

SEQ ID NO: 706371 - DNA, 25 bp, Mus musculus
ggcacgtgactgtcttacatctaga

SEQ ID NO: 706372 - DNA, 25 bp, Mus musculus
ggcacgtgtcacagagctaaactca

SEQ ID NO: 706373 - DNA, 25 bp, Mus musculus
ggcacgtgtcactgagctaaactca

SEQ ID NO: 706374 - DNA, 25 bp, Mus musculus
ggcactaaaatgcaatcctgtacat

SEQ ID NO: 706375 - DNA, 25 bp, Mus musculus
ggcactaaaatggaatcctgtacat

SEQ ID NO: 706376 - DNA, 25 bp, Mus musculus
ggcactaactttcagtgtcccctgt

SEQ ID NO: 706377 - DNA, 25 bp, Mus musculus
ggcactaactttgagtgtcccctgt

SEQ ID NO: 706378 - DNA, 25 bp, Mus musculus
ggcactaagacaacccagcttgagc

SEQ ID NO: 706379 - DNA, 25 bp, Mus musculus
ggcactaagacatcccagcttgagc

SEQ ID NO: 706380 - DNA, 25 bp, Mus musculus
ggcactacctcaaatgtcctgatca

SEQ ID NO: 706381 - DNA, 25 bp, Mus musculus
ggcactacctcatatgtcctgatca

SEQ ID NO: 706382 - DNA, 25 bp, Mus musculus
ggcactacgcatcctacaccatatg

SEQ ID NO: 706383 - DNA, 25 bp, Mus musculus
ggcactacgcatgctacaccatatg

SEQ ID NO: 706384 - DNA, 25 bp, Mus musculus
ggcactatcgttcctggctatgatt

SEQ ID NO: 706385 - DNA, 25 bp, Mus musculus
ggcactatcgttgctggctatgatt

SEQ ID NO: 706386 - DNA, 25 bp, Mus musculus
ggcactatggaacacatgacatttg

SEQ ID NO: 706387 - DNA, 25 bp, Mus musculus
ggcactatggaagacatgacatttg

SEQ ID NO: 706388 - DNA, 25 bp, Mus musculus
ggcactattgctcgactgaatgtca

SEQ ID NO: 706389 - DNA, 25 bp, Mus musculus
ggcactattgctggactgaatgtca

SEQ ID NO: 706390 - DNA, 25 bp, Mus musculus
ggcactcaatgtacctgtgtttgtg

SEQ ID NO: 706391 - DNA, 25 bp, Mus musculus
ggcactcaatgttcctgtgtttgtg

SEQ ID NO: 706392 - DNA, 25 bp, Mus musculus
ggcactcactcgaccatctgctgag

SEQ ID NO: 706393 - DNA, 25 bp, Mus musculus
ggcactcactcgtccatctgctgag

SEQ ID NO: 706394 - DNA, 25 bp, Mus musculus
ggcactcatcaaagggacacagatg

SEQ ID NO: 706395 - DNA, 25 bp, Mus musculus
ggcactcatcaatgggacacagatg

SEQ ID NO: 706396 - DNA, 25 bp, Mus musculus
ggcactcatgctccactggcgtctg

SEQ ID NO: 706397 - DNA, 25 bp, Mus musculus
ggcactcatgctgcactggcgtctg

SEQ ID NO: 706398 - DNA, 25 bp, Mus musculus
ggcactccctgcaagaagtcaccag

SEQ ID NO: 706399 - DNA, 25 bp, Mus musculus
ggcactccctgctagaagtcaccag

SEQ ID NO: 706400 - DNA, 25 bp, Mus musculus
ggcactcctctcacatggtgtggaa

SEQ ID NO: 706401 - DNA, 25 bp, Mus musculus
ggcactcctctctcatggtgtggaa

SEQ ID NO: 706402 - DNA, 25 bp, Mus musculus
ggcactccttgtctatgacatcacc

SEQ ID NO: 706403 - DNA, 25 bp, Mus musculus
ggcactccttgtgtatgacatcacc

SEQ ID NO: 706404 - DNA, 25 bp, Mus musculus
ggcactctcaggcaattttctcgaa

SEQ ID NO: 706405 - DNA, 25 bp, Mus musculus
ggcactctcagggaattttctcgaa

SEQ ID NO: 706406 - DNA, 25 bp, Mus musculus
ggcactctgatgcacactgaatgta

SEQ ID NO: 706407 - DNA, 25 bp, Mus musculus
ggcactctgatggacactgaatgta

SEQ ID NO: 706408 - DNA, 25 bp, Mus musculus
ggcactctggcgagcataccagaga

SEQ ID NO: 706409 - DNA, 25 bp, Mus musculus
ggcactctggcgtgcataccagaga

SEQ ID NO: 706410 - DNA, 25 bp, Mus musculus
ggcactctggtcaacactattaagc

SEQ ID NO: 706411 - DNA, 25 bp, Mus musculus
ggcactctggtcctcaacagcctgt

SEQ ID NO: 706412 - DNA, 25 bp, Mus musculus
ggcactctggtcgtcaacagcctgt

SEQ ID NO: 706413 - DNA, 25 bp, Mus musculus
ggcactctggtctacactattaagc

SEQ ID NO: 706414 - DNA, 25 bp, Mus musculus
ggcactcttctgacgggtacactac

SEQ ID NO: 706415 - DNA, 25 bp, Mus musculus
ggcactcttctgtcgggtacactac

SEQ ID NO: 706416 - DNA, 25 bp, Mus musculus
ggcactgaaatccaacgtcctcatg

SEQ ID NO: 706417 - DNA, 25 bp, Mus musculus
ggcactgaaatcgaacgtcctcatg

SEQ ID NO: 706418 - DNA, 25 bp, Mus musculus
ggcactgaagaactggattaagcaa

SEQ ID NO: 706419 - DNA, 25 bp, Mus musculus
ggcactgaagaagtggattaagcaa

SEQ ID NO: 706420 - DNA, 25 bp, Mus musculus
ggcactgagaacctcatcctcttgg

SEQ ID NO: 706421 - DNA, 25 bp, Mus musculus
ggcactgagaacgtcatcctcttgg

SEQ ID NO: 706422 - DNA, 25 bp, Mus musculus
ggcactgagcaacgctattgagagt

SEQ ID NO: 706423 - DNA, 25 bp, Mus musculus
ggcactgagcaaggctattgagagt

SEQ ID NO: 706424 - DNA, 25 bp, Mus musculus
ggcactgagggcaccaactgggtat

SEQ ID NO: 706425 - DNA, 25 bp, Mus musculus
ggcactgagggctccaactgggtat

SEQ ID NO: 706426 - DNA, 25 bp, Mus musculus
ggcactgatgataagaattctaccc

SEQ ID NO: 706427 - DNA, 25 bp, Mus musculus
ggcactgatgattagaattctaccc

SEQ ID NO: 706428 - DNA, 25 bp, Mus musculus
ggcactgatgccctacgctttggac

SEQ ID NO: 706429 - DNA, 25 bp, Mus musculus
ggcactgatgccgtacgctttggac

SEQ ID NO: 706430 - DNA, 25 bp, Mus musculus
ggcactgatggaattggaaaagcat

SEQ ID NO: 706431 - DNA, 25 bp, Mus musculus
ggcactgatggacgacactatgacg

SEQ ID NO: 706432 - DNA, 25 bp, Mus musculus
ggcactgatggaggacactatgacg

SEQ ID NO: 706433 - DNA, 25 bp, Mus musculus
ggcactgatggatttggaaaagcat

SEQ ID NO: 706434 - DNA, 25 bp, Mus musculus
ggcactgatgtacacagacactgtg

SEQ ID NO: 706435 - DNA, 25 bp, Mus musculus
ggcactgatgtagacagacactgtg

SEQ ID NO: 706436 - DNA, 25 bp, Mus musculus
ggcactgatgttattatcccatgct

SEQ ID NO: 706437 - DNA, 25 bp, Mus musculus
ggcactgatgtttttatcccatgct

SEQ ID NO: 706438 - DNA, 25 bp, Mus musculus
ggcactgcaaaaccaaaccggagct

SEQ ID NO: 706439 - DNA, 25 bp, Mus musculus
ggcactgcaaaagcaaaccggagct

SEQ ID NO: 706440 - DNA, 25 bp, Mus musculus
ggcactgcacgacgcagaattccat

SEQ ID NO: 706441 - DNA, 25 bp, Mus musculus
ggcactgcacgaggcagaattccat

SEQ ID NO: 706442 - DNA, 25 bp, Mus musculus
ggcactgcagcacgctcggctctgt

SEQ ID NO: 706443 - DNA, 25 bp, Mus musculus
ggcactgcagcaggctcggctctgt

SEQ ID NO: 706444 - DNA, 25 bp, Mus musculus
ggcactgccaccaatagccgggaca

SEQ ID NO: 706445 - DNA, 25 bp, Mus musculus
ggcactgccacctatagccgggaca

SEQ ID NO: 706446 - DNA, 25 bp, Mus musculus
ggcactgcccagagtcatgcgtttc

SEQ ID NO: 706447 - DNA, 25 bp, Mus musculus
ggcactgcccagtgtcatgcgtttc

SEQ ID NO: 706448 - DNA, 25 bp, Mus musculus
ggcactgcccgaccctaacaaaggg

SEQ ID NO: 706449 - DNA, 25 bp, Mus musculus
ggcactgcccgagcctaacaaaggg

SEQ ID NO: 706450 - DNA, 25 bp, Mus musculus
ggcactggaaaaccacgcagacaag

SEQ ID NO: 706451 - DNA, 25 bp, Mus musculus
ggcactggaaaagcacgcagacaag

SEQ ID NO: 706452 - DNA, 25 bp, Mus musculus
ggcactggaagcaatgcctctgaaa

SEQ ID NO: 706453 - DNA, 25 bp, Mus musculus
ggcactggaagctatgcctctgaaa

SEQ ID NO: 706454 - DNA, 25 bp, Mus musculus
ggcactggagaacagtatcctatgg

SEQ ID NO: 706455 - DNA, 25 bp, Mus musculus
ggcactggagaagagtatcctatgg

SEQ ID NO: 706456 - DNA, 25 bp, Mus musculus
ggcactggagggagacacaagcccc

SEQ ID NO: 706457 - DNA, 25 bp, Mus musculus
ggcactggagggtgacacaagcccc

SEQ ID NO: 706458 - DNA, 25 bp, Mus musculus
ggcactggcatcctctgcatgtttg

SEQ ID NO: 706459 - DNA, 25 bp, Mus musculus
ggcactggcatcgtctgcatgtttg

SEQ ID NO: 706460 - DNA, 25 bp, Mus musculus
ggcactggcctcctgattgagaacg

SEQ ID NO: 706461 - DNA, 25 bp, Mus musculus
ggcactggcctcgtgattgagaacg

SEQ ID NO: 706462 - DNA, 25 bp, Mus musculus
ggcactggctctcacgctagggctt

SEQ ID NO: 706463 - DNA, 25 bp, Mus musculus
ggcactggctctgacgctagggctt

SEQ ID NO: 706464 - DNA, 25 bp, Mus musculus
ggcactgggacactgcagactttgt

SEQ ID NO: 706465 - DNA, 25 bp, Mus musculus
ggcactgggacagtgcagactttgt

SEQ ID NO: 706466 - DNA, 25 bp, Mus musculus
ggcactgtcctcacgggagctgctg

SEQ ID NO: 706467 - DNA, 25 bp, Mus musculus
ggcactgtcctctcgggagctgctg

SEQ ID NO: 706468 - DNA, 25 bp, Mus musculus
ggcactgtcctgctaccgcagttgc

SEQ ID NO: 706469 - DNA, 25 bp, Mus musculus
ggcactgtcctggtaccgcagttgc

SEQ ID NO: 706470 - DNA, 25 bp, Mus musculus
ggcactgtggagagctgaaaaggag

SEQ ID NO: 706471 - DNA, 25 bp, Mus musculus
ggcactgtggagtgctgaaaaggag

SEQ ID NO: 706472 - DNA, 25 bp, Mus musculus
ggcactgttacccaaggctgctctg

SEQ ID NO: 706473 - DNA, 25 bp, Mus musculus
ggcactgttaccgaaggctgctctg

SEQ ID NO: 706474 - DNA, 25 bp, Mus musculus
ggcactgtttgcacatcattgtaca

SEQ ID NO: 706475 - DNA, 25 bp, Mus musculus
ggcactgtttgctcatcattgtaca

SEQ ID NO: 706476 - DNA, 25 bp, Mus musculus
ggcacttacagtccagagatctcct

SEQ ID NO: 706477 - DNA, 25 bp, Mus musculus
ggcacttacagtgcagagatctcct

SEQ ID NO: 706478 - DNA, 25 bp, Mus musculus
ggcacttaccgacagattaacccag

SEQ ID NO: 706479 - DNA, 25 bp, Mus musculus
ggcacttaccgagagattaacccag

SEQ ID NO: 706480 - DNA, 25 bp, Mus musculus
ggcacttactgtctaaaccaacaga

SEQ ID NO: 706481 - DNA, 25 bp, Mus musculus
ggcacttactgtgtaaaccaacaga

SEQ ID NO: 706482 - DNA, 25 bp, Mus musculus
ggcacttatcttcgagccacagctg

SEQ ID NO: 706483 - DNA, 25 bp, Mus musculus
ggcacttatcttggagccacagctg

SEQ ID NO: 706484 - DNA, 25 bp, Mus musculus
ggcacttccactccaaatcgggcaa

SEQ ID NO: 706485 - DNA, 25 bp, Mus musculus
ggcacttccactgcaaatcgggcaa

SEQ ID NO: 706486 - DNA, 25 bp, Mus musculus
ggcacttcgtctcaatgcatagaaa

SEQ ID NO: 706487 - DNA, 25 bp, Mus musculus
ggcacttcgtctgaatgcatagaaa

SEQ ID NO: 706488 - DNA, 25 bp, Mus musculus
ggcacttctataaagttccaattaa

SEQ ID NO: 706489 - DNA, 25 bp, Mus musculus
ggcacttctatatagttccaattaa

SEQ ID NO: 706490 - DNA, 25 bp, Mus musculus
ggcacttctcacctctgagaatctg

SEQ ID NO: 706491 - DNA, 25 bp, Mus musculus
ggcacttctcacgtctgagaatctg

SEQ ID NO: 706492 - DNA, 25 bp, Mus musculus
ggcacttgacctacgcttatcggag

SEQ ID NO: 706493 - DNA, 25 bp, Mus musculus
ggcacttgaccttcgcttatcggag

SEQ ID NO: 706494 - DNA, 25 bp, Mus musculus
ggcacttgcaatcatctggacgcgt

SEQ ID NO: 706495 - DNA, 25 bp, Mus musculus
ggcacttgcaatgatctggacgcgt

SEQ ID NO: 706496 - DNA, 25 bp, Mus musculus
ggcacttgtgagcatggcatcgcgg

SEQ ID NO: 706497 - DNA, 25 bp, Mus musculus
ggcacttgtgaggatggcatcgcgg

SEQ ID NO: 706498 - DNA, 25 bp, Mus musculus
ggcactttaccaaactcaacagaat

SEQ ID NO: 706499 - DNA, 25 bp, Mus musculus
ggcactttaccatactcaacagaat

SEQ ID NO: 706500 - DNA, 25 bp, Mus musculus
ggcactttatcaaacaatttgtcga

SEQ ID NO: 706501 - DNA, 25 bp, Mus musculus
ggcactttatcatacaatttgtcga

SEQ ID NO: 706502 - DNA, 25 bp, Mus musculus
ggcactttcctgatactttccagcg

SEQ ID NO: 706503 - DNA, 25 bp, Mus musculus
ggcactttcctgttactttccagcg

SEQ ID NO: 706504 - DNA, 25 bp, Mus musculus
ggcactttctgtactagtaaccata

SEQ ID NO: 706505 - DNA, 25 bp, Mus musculus
ggcactttctgttctagtaaccata

SEQ ID NO: 706506 - DNA, 25 bp, Mus musculus
ggcagaaaacagatgcgcagcagca

SEQ ID NO: 706507 - DNA, 25 bp, Mus musculus
ggcagaaaacagttgcgcagcagca

SEQ ID NO: 706508 - DNA, 25 bp, Mus musculus
ggcagaaaaggacagcaattactgt

SEQ ID NO: 706509 - DNA, 25 bp, Mus musculus
ggcagaaaaggagagcaattactgt

SEQ ID NO: 706510 - DNA, 25 bp, Mus musculus
ggcagaaagaaaattcggaagattc

SEQ ID NO: 706511 - DNA, 25 bp, Mus musculus
ggcagaaagaaatttcggaagattc

SEQ ID NO: 706512 - DNA, 25 bp, Mus musculus
ggcagaaagctcctaccgtcagagg

SEQ ID NO: 706513 - DNA, 25 bp, Mus musculus
ggcagaaagctcgtaccgtcagagg

SEQ ID NO: 706514 - DNA, 25 bp, Mus musculus
ggcagaaagtaactcagctgcacct

SEQ ID NO: 706515 - DNA, 25 bp, Mus musculus
ggcagaaagtaagtcagctgcacct

SEQ ID NO: 706516 - DNA, 25 bp, Mus musculus
ggcagaaatcgtaaggatgacttgt

SEQ ID NO: 706517 - DNA, 25 bp, Mus musculus
ggcagaaatcgttaggatgacttgt

SEQ ID NO: 706518 - DNA, 25 bp, Mus musculus
ggcagaacaatcaggctggagttgc

SEQ ID NO: 706519 - DNA, 25 bp, Mus musculus
ggcagaacaatctggctggagttgc

SEQ ID NO: 706520 - DNA, 25 bp, Mus musculus
ggcagaaccaagagcagtttctgct

SEQ ID NO: 706521 - DNA, 25 bp, Mus musculus
ggcagaaccaagtgcagtttctgct

SEQ ID NO: 706522 - DNA, 25 bp, Mus musculus
ggcagaactaccagattggaaagac

SEQ ID NO: 706523 - DNA, 25 bp, Mus musculus
ggcagaactacctgattggaaagac

SEQ ID NO: 706524 - DNA, 25 bp, Mus musculus
ggcagaagaagacgttaagcagatc

SEQ ID NO: 706525 - DNA, 25 bp, Mus musculus
ggcagaagaagaggttaagcagatc

SEQ ID NO: 706526 - DNA, 25 bp, Mus musculus
ggcagaagaggacatcgcggcgtct

SEQ ID NO: 706527 - DNA, 25 bp, Mus musculus
ggcagaagaggagatcgcggcgtct

SEQ ID NO: 706528 - DNA, 25 bp, Mus musculus
ggcagaagatttatacagataaagc

SEQ ID NO: 706529 - DNA, 25 bp, Mus musculus
ggcagaagatttttacagataaagc

SEQ ID NO: 706530 - DNA, 25 bp, Mus musculus
ggcagaagccttagcaggtatcaaa

SEQ ID NO: 706531 - DNA, 25 bp, Mus musculus
ggcagaagcctttgcaggtatcaaa

SEQ ID NO: 706532 - DNA, 25 bp, Mus musculus
ggcagaagcgagacttcagccagta

SEQ ID NO: 706533 - DNA, 25 bp, Mus musculus
ggcagaagcgagtcttcagccagta

SEQ ID NO: 706534 - DNA, 25 bp, Mus musculus
ggcagaagcggaatgaacagcagaa

SEQ ID NO: 706535 - DNA, 25 bp, Mus musculus
ggcagaagcggattgaacagcagaa

SEQ ID NO: 706536 - DNA, 25 bp, Mus musculus
ggcagaagggaacgcttcctctacc

SEQ ID NO: 706537 - DNA, 25 bp, Mus musculus
ggcagaagggaaggcttcctctacc

SEQ ID NO: 706538 - DNA, 25 bp, Mus musculus
ggcagaaggttaacagaatccgcgt

SEQ ID NO: 706539 - DNA, 25 bp, Mus musculus
ggcagaaggttatcagaatccgcgt

SEQ ID NO: 706540 - DNA, 25 bp, Mus musculus
ggcagaatcgccacctatgtcatgg

SEQ ID NO: 706541 - DNA, 25 bp, Mus musculus
ggcagaatcgcctcctatgtcatgg

SEQ ID NO: 706542 - DNA, 25 bp, Mus musculus
ggcagaatctctcgccaagagctca

SEQ ID NO: 706543 - DNA, 25 bp, Mus musculus
ggcagaatctctggccaagagctca

SEQ ID NO: 706544 - DNA, 25 bp, Mus musculus
ggcagaatgctacgtaagtaaaaac

SEQ ID NO: 706545 - DNA, 25 bp, Mus musculus
ggcagaatgctaggtaagtaaaaac

SEQ ID NO: 706546 - DNA, 25 bp, Mus musculus
ggcagaattgctcagccctgcagtt

SEQ ID NO: 706547 - DNA, 25 bp, Mus musculus
ggcagaattgctgagccctgcagtt

SEQ ID NO: 706548 - DNA, 25 bp, Mus musculus
ggcagaatttaccagctcgtcctag

SEQ ID NO: 706549 - DNA, 25 bp, Mus musculus
ggcagaatttacgagctcgtcctag

SEQ ID NO: 706550 - DNA, 25 bp, Mus musculus
ggcagacaactaaatccctatctct

SEQ ID NO: 706551 - DNA, 25 bp, Mus musculus
ggcagacaactatatccctatctct

SEQ ID NO: 706552 - DNA, 25 bp, Mus musculus
ggcagacaatgaagccagtctcacc

SEQ ID NO: 706553 - DNA, 25 bp, Mus musculus
ggcagacaatgatgccagtctcacc

SEQ ID NO: 706554 - DNA, 25 bp, Mus musculus
ggcagacacctcacactattgtcct

SEQ ID NO: 706555 - DNA, 25 bp, Mus musculus
ggcagacacctctcactattgtcct

SEQ ID NO: 706556 - DNA, 25 bp, Mus musculus
ggcagacagcatcagcgtaaccact

SEQ ID NO: 706557 - DNA, 25 bp, Mus musculus
ggcagacagcatgagcgtaaccact

SEQ ID NO: 706558 - DNA, 25 bp, Mus musculus
ggcagacagctcctgccagtatccg

SEQ ID NO: 706559 - DNA, 25 bp, Mus musculus
ggcagacagctcgtgccagtatccg

SEQ ID NO: 706560 - DNA, 25 bp, Mus musculus
ggcagacatcacaggacgatactca

SEQ ID NO: 706561 - DNA, 25 bp, Mus musculus
ggcagacatcactggacgatactca

SEQ ID NO: 706562 - DNA, 25 bp, Mus musculus
ggcagacatgtcatcgagtgtcaag

SEQ ID NO: 706563 - DNA, 25 bp, Mus musculus
ggcagacatgtcttcgagtgtcaag

SEQ ID NO: 706564 - DNA, 25 bp, Mus musculus
ggcagaccaccgaggatcaaaaatt

SEQ ID NO: 706565 - DNA, 25 bp, Mus musculus
ggcagaccaccgtggatcaaaaatt

SEQ ID NO: 706566 - DNA, 25 bp, Mus musculus
ggcagaccacgcacacggtggaata

SEQ ID NO: 706567 - DNA, 25 bp, Mus musculus
ggcagaccacgctcacggtggaata

SEQ ID NO: 706568 - DNA, 25 bp, Mus musculus
ggcagaccctgtcaatataactcca

SEQ ID NO: 706569 - DNA, 25 bp, Mus musculus
ggcagaccctgtgaatataactcca

SEQ ID NO: 706570 - DNA, 25 bp, Mus musculus
ggcagaccgaaaccacgagaagaat

SEQ ID NO: 706571 - DNA, 25 bp, Mus musculus
ggcagaccgaaagcacgagaagaat

SEQ ID NO: 706572 - DNA, 25 bp, Mus musculus
ggcagacctcaactagcaatcctct

SEQ ID NO: 706573 - DNA, 25 bp, Mus musculus
ggcagacctcaagtagcaatcctct

SEQ ID NO: 706574 - DNA, 25 bp, Mus musculus
ggcagacctggccttgcctatggca

SEQ ID NO: 706575 - DNA, 25 bp, Mus musculus
ggcagacctggcgttgcctatggca

SEQ ID NO: 706576 - DNA, 25 bp, Mus musculus
ggcagaccttggagtagccgcagcc

SEQ ID NO: 706577 - DNA, 25 bp, Mus musculus
ggcagaccttggtgtagccgcagcc

SEQ ID NO: 706578 - DNA, 25 bp, Mus musculus
ggcagacgccatcacggctctgttg

SEQ ID NO: 706579 - DNA, 25 bp, Mus musculus
ggcagacgccatgacggctctgttg

SEQ ID NO: 706580 - DNA, 25 bp, Mus musculus
ggcagactcaatcaaaatttgccac

SEQ ID NO: 706581 - DNA, 25 bp, Mus musculus
ggcagactcaatgaaaatttgccac

SEQ ID NO: 706582 - DNA, 25 bp, Mus musculus
ggcagactcctacatggccggcact

SEQ ID NO: 706583 - DNA, 25 bp, Mus musculus
ggcagactcctagatggccggcact

SEQ ID NO: 706584 - DNA, 25 bp, Mus musculus
ggcagactgcctcagacactgtgat

SEQ ID NO: 706585 - DNA, 25 bp, Mus musculus
ggcagactgcctgagacactgtgat

SEQ ID NO: 706586 - DNA, 25 bp, Mus musculus
ggcagacttccacagagttagaggt

SEQ ID NO: 706587 - DNA, 25 bp, Mus musculus
ggcagacttccagagagttagaggt

SEQ ID NO: 706588 - DNA, 25 bp, Mus musculus
ggcagagaaatgaccaaatcttacc

SEQ ID NO: 706589 - DNA, 25 bp, Mus musculus
ggcagagaaatgtccaaatcttacc

SEQ ID NO: 706590 - DNA, 25 bp, Mus musculus
ggcagagaagcaccactgtttatcg

SEQ ID NO: 706591 - DNA, 25 bp, Mus musculus
ggcagagaagcagcactgtttatcg

SEQ ID NO: 706592 - DNA, 25 bp, Mus musculus
ggcagagaatacacaggaagaactc

SEQ ID NO: 706593 - DNA, 25 bp, Mus musculus
ggcagagaatactcaggaagaactc

SEQ ID NO: 706594 - DNA, 25 bp, Mus musculus
ggcagagaatctatgaccaccaccg

SEQ ID NO: 706595 - DNA, 25 bp, Mus musculus
ggcagagaatctttgaccaccaccg

SEQ ID NO: 706596 - DNA, 25 bp, Mus musculus
ggcagagacattcccatttgtagat

SEQ ID NO: 706597 - DNA, 25 bp, Mus musculus
ggcagagacattgccatttgtagat

SEQ ID NO: 706598 - DNA, 25 bp, Mus musculus
ggcagagactacaaagtaacacttg

SEQ ID NO: 706599 - DNA, 25 bp, Mus musculus
ggcagagactactaagtaacacttg

SEQ ID NO: 706600 - DNA, 25 bp, Mus musculus
ggcagagactgaccacctatttgac

SEQ ID NO: 706601 - DNA, 25 bp, Mus musculus
ggcagagactgagcacctatttgac

SEQ ID NO: 706602 - DNA, 25 bp, Mus musculus
ggcagagactgcagcccggcagcct

SEQ ID NO: 706603 - DNA, 25 bp, Mus musculus
ggcagagactgctgcccggcagcct

SEQ ID NO: 706604 - DNA, 25 bp, Mus musculus
ggcagagactggacccttcctgatc

SEQ ID NO: 706605 - DNA, 25 bp, Mus musculus
ggcagagactggtcccttcctgatc

SEQ ID NO: 706606 - DNA, 25 bp, Mus musculus
ggcagagagaaaaattgacaaatct

SEQ ID NO: 706607 - DNA, 25 bp, Mus musculus
ggcagagagaaatattgacaaatct

SEQ ID NO: 706608 - DNA, 25 bp, Mus musculus
ggcagagatcgacgcgctctacgat

SEQ ID NO: 706609 - DNA, 25 bp, Mus musculus
ggcagagatcgaggcgctctacgat

SEQ ID NO: 706610 - DNA, 25 bp, Mus musculus
ggcagagatgcaacgcctcttccag

SEQ ID NO: 706611 - DNA, 25 bp, Mus musculus
ggcagagatgcatcgcctcttccag

SEQ ID NO: 706612 - DNA, 25 bp, Mus musculus
ggcagagcccttcaggtatccctga

SEQ ID NO: 706613 - DNA, 25 bp, Mus musculus
ggcagagcccttgaggtatccctga

SEQ ID NO: 706614 - DNA, 25 bp, Mus musculus
ggcagagctctgaaggcaccaacgg

SEQ ID NO: 706615 - DNA, 25 bp, Mus musculus
ggcagagctctgtaggcaccaacgg

SEQ ID NO: 706616 - DNA, 25 bp, Mus musculus
ggcagagctgcacatgttactagag

SEQ ID NO: 706617 - DNA, 25 bp, Mus musculus
ggcagagctgcagatgttactagag

SEQ ID NO: 706618 - DNA, 25 bp, Mus musculus
ggcagaggacatatcttgaccctgg

SEQ ID NO: 706619 - DNA, 25 bp, Mus musculus
ggcagaggacatttcttgaccctgg

SEQ ID NO: 706620 - DNA, 25 bp, Mus musculus
ggcagaggatcgagaaaagctgata

SEQ ID NO: 706621 - DNA, 25 bp, Mus musculus
ggcagaggatcgtgaaaagctgata

SEQ ID NO: 706622 - DNA, 25 bp, Mus musculus
ggcagaggccatcatccagaagatc

SEQ ID NO: 706623 - DNA, 25 bp, Mus musculus
ggcagaggccatgatccagaagatc

SEQ ID NO: 706624 - DNA, 25 bp, Mus musculus
ggcagaggcctgaacatagaaccag

SEQ ID NO: 706625 - DNA, 25 bp, Mus musculus
ggcagaggcctgtacatagaaccag

SEQ ID NO: 706626 - DNA, 25 bp, Mus musculus
ggcagagtacctcccttcagcaggg

SEQ ID NO: 706627 - DNA, 25 bp, Mus musculus
ggcagagtacctgccttcagcaggg

SEQ ID NO: 706628 - DNA, 25 bp, Mus musculus
ggcagagtctcaccccgatgtctca

SEQ ID NO: 706629 - DNA, 25 bp, Mus musculus
ggcagagtctcagcccgatgtctca

SEQ ID NO: 706630 - DNA, 25 bp, Mus musculus
ggcagagtctgcacatcacaggcaa

SEQ ID NO: 706631 - DNA, 25 bp, Mus musculus
ggcagagtctgctcatcacaggcaa

SEQ ID NO: 706632 - DNA, 25 bp, Mus musculus
ggcagagttcctagcgggtcacgac

SEQ ID NO: 706633 - DNA, 25 bp, Mus musculus
ggcagagttccttgcgggtcacgac

SEQ ID NO: 706634 - DNA, 25 bp, Mus musculus
ggcagagttctgcagcttgctcaac

SEQ ID NO: 706635 - DNA, 25 bp, Mus musculus
ggcagagttctggagcttgctcaac

SEQ ID NO: 706636 - DNA, 25 bp, Mus musculus
ggcagatactatagaggaaggcaca

SEQ ID NO: 706637 - DNA, 25 bp, Mus musculus
ggcagatactattgaggaaggcaca

SEQ ID NO: 706638 - DNA, 25 bp, Mus musculus
ggcagatatggaagagctcttctct

SEQ ID NO: 706639 - DNA, 25 bp, Mus musculus
ggcagatatggatgagctcttctct

SEQ ID NO: 706640 - DNA, 25 bp, Mus musculus
ggcagatcaatgacatccagttgtc

SEQ ID NO: 706641 - DNA, 25 bp, Mus musculus
ggcagatcaatgtcatccagttgtc

SEQ ID NO: 706642 - DNA, 25 bp, Mus musculus
ggcagatccaaacggataccatgaa

SEQ ID NO: 706643 - DNA, 25 bp, Mus musculus
ggcagatccaaagggataccatgaa

SEQ ID NO: 706644 - DNA, 25 bp, Mus musculus
ggcagatccctaagtgaagcttcat

SEQ ID NO: 706645 - DNA, 25 bp, Mus musculus
ggcagatccctatgtgaagcttcat

SEQ ID NO: 706646 - DNA, 25 bp, Mus musculus
ggcagatcctgacctgcctcagctg

SEQ ID NO: 706647 - DNA, 25 bp, Mus musculus
ggcagatcctgagctgcctcagctg

SEQ ID NO: 706648 - DNA, 25 bp, Mus musculus
ggcagatctcggagagctcaacttc

SEQ ID NO: 706649 - DNA, 25 bp, Mus musculus
ggcagatctcggtgagctcaacttc

SEQ ID NO: 706650 - DNA, 25 bp, Mus musculus
ggcagatgacccactccaagtagat

SEQ ID NO: 706651 - DNA, 25 bp, Mus musculus
ggcagatgaccctctccaagtagat

SEQ ID NO: 706652 - DNA, 25 bp, Mus musculus
ggcagatgattaaggcctctgtcag

SEQ ID NO: 706653 - DNA, 25 bp, Mus musculus
ggcagatgattatggcctctgtcag

SEQ ID NO: 706654 - DNA, 25 bp, Mus musculus
ggcagatgcaccctgacacgagtgt

SEQ ID NO: 706655 - DNA, 25 bp, Mus musculus
ggcagatgcaccgtgacacgagtgt

SEQ ID NO: 706656 - DNA, 25 bp, Mus musculus
ggcagatggagcaagacaccgcctt

SEQ ID NO: 706657 - DNA, 25 bp, Mus musculus
ggcagatggagctagacaccgcctt

SEQ ID NO: 706658 - DNA, 25 bp, Mus musculus
ggcagatgtcgtcccaaagactgca

SEQ ID NO: 706659 - DNA, 25 bp, Mus musculus
ggcagatgtcgtgccaaagactgca

SEQ ID NO: 706660 - DNA, 25 bp, Mus musculus
ggcagatgtctgaggaatggtttaa

SEQ ID NO: 706661 - DNA, 25 bp, Mus musculus
ggcagatgtctgtggaatggtttaa

SEQ ID NO: 706662 - DNA, 25 bp, Mus musculus
ggcagatgtttgaccagagagtcaa

SEQ ID NO: 706663 - DNA, 25 bp, Mus musculus
ggcagatgtttgtccagagagtcaa

SEQ ID NO: 706664 - DNA, 25 bp, Mus musculus
ggcagattaacaaaacagtagttgg

SEQ ID NO: 706665 - DNA, 25 bp, Mus musculus
ggcagattaacataacagtagttgg

SEQ ID NO: 706666 - DNA, 25 bp, Mus musculus
ggcagattccgtctctagctggtcg

SEQ ID NO: 706667 - DNA, 25 bp, Mus musculus
ggcagattccgtgtctagctggtcg

SEQ ID NO: 706668 - DNA, 25 bp, Mus musculus
ggcagattcgaaaccgaggcttgga

SEQ ID NO: 706669 - DNA, 25 bp, Mus musculus
ggcagattcgaatccgaggcttgga

SEQ ID NO: 706670 - DNA, 25 bp, Mus musculus
ggcagattctagaaactgggtcaca

SEQ ID NO: 706671 - DNA, 25 bp, Mus musculus
ggcagattctagtaactgggtcaca

SEQ ID NO: 706672 - DNA, 25 bp, Mus musculus
ggcagattgaagagatgcagagaca

SEQ ID NO: 706673 - DNA, 25 bp, Mus musculus
ggcagattgaagtgatgcagagaca

SEQ ID NO: 706674 - DNA, 25 bp, Mus musculus
ggcagatttactcggccaaagatat

SEQ ID NO: 706675 - DNA, 25 bp, Mus musculus
ggcagatttactgggccaaagatat

SEQ ID NO: 706676 - DNA, 25 bp, Mus musculus
ggcagatttcaaagcccagggccca

SEQ ID NO: 706677 - DNA, 25 bp, Mus musculus
ggcagatttcaatgcccagggccca

SEQ ID NO: 706678 - DNA, 25 bp, Mus musculus
ggcagatttcatccatcagcagcga

SEQ ID NO: 706679 - DNA, 25 bp, Mus musculus
ggcagatttcatgcatcagcagcga

SEQ ID NO: 706680 - DNA, 25 bp, Mus musculus
ggcagatttgtacttccagaaaggt

SEQ ID NO: 706681 - DNA, 25 bp, Mus musculus
ggcagatttgtagttccagaaaggt

SEQ ID NO: 706682 - DNA, 25 bp, Mus musculus
ggcagcaagatcagcgagatccggc

SEQ ID NO: 706683 - DNA, 25 bp, Mus musculus
ggcagcaagatctgcgagatccggc

SEQ ID NO: 706684 - DNA, 25 bp, Mus musculus
ggcagcaatcccaacaccactgtta

SEQ ID NO: 706685 - DNA, 25 bp, Mus musculus
ggcagcaatccctacaccactgtta

SEQ ID NO: 706686 - DNA, 25 bp, Mus musculus
ggcagcaatgaacatagtcaacttc

SEQ ID NO: 706687 - DNA, 25 bp, Mus musculus
ggcagcaatgaagatagtcaacttc

SEQ ID NO: 706688 - DNA, 25 bp, Mus musculus
ggcagcaatgtgcagttcatgtgta

SEQ ID NO: 706689 - DNA, 25 bp, Mus musculus
ggcagcaatgtggagttcatgtgta

SEQ ID NO: 706690 - DNA, 25 bp, Mus musculus
ggcagcacacacattggaccctggt

SEQ ID NO: 706691 - DNA, 25 bp, Mus musculus
ggcagcacacactttggaccctggt

SEQ ID NO: 706692 - DNA, 25 bp, Mus musculus
ggcagcacatgaccgagcaattctc

SEQ ID NO: 706693 - DNA, 25 bp, Mus musculus
ggcagcacatgagcgagcaattctc

SEQ ID NO: 706694 - DNA, 25 bp, Mus musculus
ggcagcacatggagcgctgcaccag

SEQ ID NO: 706695 - DNA, 25 bp, Mus musculus
ggcagcacatggtgcgctgcaccag

SEQ ID NO: 706696 - DNA, 25 bp, Mus musculus
ggcagcaccctacttgggctcagaa

SEQ ID NO: 706697 - DNA, 25 bp, Mus musculus
ggcagcaccctagttgggctcagaa

SEQ ID NO: 706698 - DNA, 25 bp, Mus musculus
ggcagcaccgagagaccaagatgga

SEQ ID NO: 706699 - DNA, 25 bp, Mus musculus
ggcagcaccgagtgaccaagatgga

SEQ ID NO: 706700 - DNA, 25 bp, Mus musculus
ggcagcacctggagaaataccctga

SEQ ID NO: 706701 - DNA, 25 bp, Mus musculus
ggcagcacctggtgaaataccctga

SEQ ID NO: 706702 - DNA, 25 bp, Mus musculus
ggcagcacgaatctctcagatcaag

SEQ ID NO: 706703 - DNA, 25 bp, Mus musculus
ggcagcacgaatgtctcagatcaag

SEQ ID NO: 706704 - DNA, 25 bp, Mus musculus
ggcagcacggcacggtcataaaaat

SEQ ID NO: 706705 - DNA, 25 bp, Mus musculus
ggcagcacggcagggtcataaaaat

SEQ ID NO: 706706 - DNA, 25 bp, Mus musculus
ggcagcacggctattccatggagat

SEQ ID NO: 706707 - DNA, 25 bp, Mus musculus
ggcagcacggcttttccatggagat

SEQ ID NO: 706708 - DNA, 25 bp, Mus musculus
ggcagcactgcaactgatctctcca

SEQ ID NO: 706709 - DNA, 25 bp, Mus musculus
ggcagcactgcatctgatctctcca

SEQ ID NO: 706710 - DNA, 25 bp, Mus musculus
ggcagcacttccaagacaccaatga

SEQ ID NO: 706711 - DNA, 25 bp, Mus musculus
ggcagcacttcctagacaccaatga

SEQ ID NO: 706712 - DNA, 25 bp, Mus musculus
ggcagcagaaagagatcactcagct

SEQ ID NO: 706713 - DNA, 25 bp, Mus musculus
ggcagcagaaagtgatcactcagct

SEQ ID NO: 706714 - DNA, 25 bp, Mus musculus
ggcagcagactgaagagattgacct

SEQ ID NO: 706715 - DNA, 25 bp, Mus musculus
ggcagcagactgtagagattgacct

SEQ ID NO: 706716 - DNA, 25 bp, Mus musculus
ggcagcagcaaaacctattgagtct

SEQ ID NO: 706717 - DNA, 25 bp, Mus musculus
ggcagcagcaaatcctattgagtct

SEQ ID NO: 706718 - DNA, 25 bp, Mus musculus
ggcagcagcaagacccttcgagtga

SEQ ID NO: 706719 - DNA, 25 bp, Mus musculus
ggcagcagcaagtcccttcgagtga

SEQ ID NO: 706720 - DNA, 25 bp, Mus musculus
ggcagcagcattcctcaatgaaaac

SEQ ID NO: 706721 - DNA, 25 bp, Mus musculus
ggcagcagcattgctcaatgaaaac

SEQ ID NO: 706722 - DNA, 25 bp, Mus musculus
ggcagcagccatctctggatcacat

SEQ ID NO: 706723 - DNA, 25 bp, Mus musculus
ggcagcagccatgtctggatcacat

SEQ ID NO: 706724 - DNA, 25 bp, Mus musculus
ggcagcagccctagagattgagcta

SEQ ID NO: 706725 - DNA, 25 bp, Mus musculus
ggcagcagcccttgagattgagcta

SEQ ID NO: 706726 - DNA, 25 bp, Mus musculus
ggcagcagcgtgactttctccaact

SEQ ID NO: 706727 - DNA, 25 bp, Mus musculus
ggcagcagcgtgtctttctccaact

SEQ ID NO: 706728 - DNA, 25 bp, Mus musculus
ggcagcagctacagaagccacagag

SEQ ID NO: 706729 - DNA, 25 bp, Mus musculus
ggcagcagctactgaagccacagag

SEQ ID NO: 706730 - DNA, 25 bp, Mus musculus
ggcagcagttataaacacgggaaca

SEQ ID NO: 706731 - DNA, 25 bp, Mus musculus
ggcagcagttattaacacgggaaca

SEQ ID NO: 706732 - DNA, 25 bp, Mus musculus
ggcagcagttccagacagtagcaga

SEQ ID NO: 706733 - DNA, 25 bp, Mus musculus
ggcagcagttcctgacagtagcaga

SEQ ID NO: 706734 - DNA, 25 bp, Mus musculus
ggcagcagttgcatcccggtggaca

SEQ ID NO: 706735 - DNA, 25 bp, Mus musculus
ggcagcagttgcttcccggtggaca

SEQ ID NO: 706736 - DNA, 25 bp, Mus musculus
ggcagcatagtgagcccactgataa

SEQ ID NO: 706737 - DNA, 25 bp, Mus musculus
ggcagcatagtgtgcccactgataa

SEQ ID NO: 706738 - DNA, 25 bp, Mus musculus
ggcagcatatgtcaatcctcatgga

SEQ ID NO: 706739 - DNA, 25 bp, Mus musculus
ggcagcatatgtgaatcctcatgga

SEQ ID NO: 706740 - DNA, 25 bp, Mus musculus
ggcagcatccccaggctgggccatg

SEQ ID NO: 706741 - DNA, 25 bp, Mus musculus
ggcagcatcccctggctgggccatg

SEQ ID NO: 706742 - DNA, 25 bp, Mus musculus
ggcagcatcctgagttatgtcgtca

SEQ ID NO: 706743 - DNA, 25 bp, Mus musculus
ggcagcatcctgtgttatgtcgtca

SEQ ID NO: 706744 - DNA, 25 bp, Mus musculus
ggcagcatcttcagcaagttcacct

SEQ ID NO: 706745 - DNA, 25 bp, Mus musculus
ggcagcatcttctgcaagttcacct

SEQ ID NO: 706746 - DNA, 25 bp, Mus musculus
ggcagcatggccagctctggttccc

SEQ ID NO: 706747 - DNA, 25 bp, Mus musculus
ggcagcatggcctgctctggttccc

SEQ ID NO: 706748 - DNA, 25 bp, Mus musculus
ggcagcattcctctgatgcagagat

SEQ ID NO: 706749 - DNA, 25 bp, Mus musculus
ggcagcattcctgtgatgcagagat

SEQ ID NO: 706750 - DNA, 25 bp, Mus musculus
ggcagcattctcactgcacaaggtg

SEQ ID NO: 706751 - DNA, 25 bp, Mus musculus
ggcagcattctctctgcacaaggtg

SEQ ID NO: 706752 - DNA, 25 bp, Mus musculus
ggcagcattgatctgatgtactttc

SEQ ID NO: 706753 - DNA, 25 bp, Mus musculus
ggcagcattgatgtgatgtactttc

SEQ ID NO: 706754 - DNA, 25 bp, Mus musculus
ggcagcatttgtataaggaaaaacc

SEQ ID NO: 706755 - DNA, 25 bp, Mus musculus
ggcagcatttgtttaaggaaaaacc

SEQ ID NO: 706756 - DNA, 25 bp, Mus musculus
ggcagccacgttcgcagaactggat

SEQ ID NO: 706757 - DNA, 25 bp, Mus musculus
ggcagccacgttggcagaactggat

SEQ ID NO: 706758 - DNA, 25 bp, Mus musculus
ggcagccaggacaacaatgccacag

SEQ ID NO: 706759 - DNA, 25 bp, Mus musculus
ggcagccaggactacaatgccacag

SEQ ID NO: 706760 - DNA, 25 bp, Mus musculus
ggcagccagggaagttcatttccat

SEQ ID NO: 706761 - DNA, 25 bp, Mus musculus
ggcagccagggatgttcatttccat

SEQ ID NO: 706762 - DNA, 25 bp, Mus musculus
ggcagccagtgccttccaggaactt

SEQ ID NO: 706763 - DNA, 25 bp, Mus musculus
ggcagccagtgcgttccaggaactt

SEQ ID NO: 706764 - DNA, 25 bp, Mus musculus
ggcagccatggaacgtgctcgccag

SEQ ID NO: 706765 - DNA, 25 bp, Mus musculus
ggcagccatggatcgtgctcgccag

SEQ ID NO: 706766 - DNA, 25 bp, Mus musculus
ggcagccattcccacgcttgaagaa

SEQ ID NO: 706767 - DNA, 25 bp, Mus musculus
ggcagccattccgacgcttgaagaa

SEQ ID NO: 706768 - DNA, 25 bp, Mus musculus
ggcagccattgtcgtgaggctttcc

SEQ ID NO: 706769 - DNA, 25 bp, Mus musculus
ggcagccattgtggtgaggctttcc

SEQ ID NO: 706770 - DNA, 25 bp, Mus musculus
ggcagccctacaaaaaacaccacat

SEQ ID NO: 706771 - DNA, 25 bp, Mus musculus
ggcagccctacataaaacaccacat

SEQ ID NO: 706772 - DNA, 25 bp, Mus musculus
ggcagccctgcccaagtggtccagt

SEQ ID NO: 706773 - DNA, 25 bp, Mus musculus
ggcagccctgccgaagtggtccagt

SEQ ID NO: 706774 - DNA, 25 bp, Mus musculus
ggcagccgctgtagaagctatgaca

SEQ ID NO: 706775 - DNA, 25 bp, Mus musculus
ggcagccgctgttgaagctatgaca

SEQ ID NO: 706776 - DNA, 25 bp, Mus musculus
ggcagccgtacaacctttactgtga

SEQ ID NO: 706777 - DNA, 25 bp, Mus musculus
ggcagccgtacatcctttactgtga

SEQ ID NO: 706778 - DNA, 25 bp, Mus musculus
ggcagcctatcaattaatgacagat

SEQ ID NO: 706779 - DNA, 25 bp, Mus musculus
ggcagcctatcatttaatgacagat

SEQ ID NO: 706780 - DNA, 25 bp, Mus musculus
ggcagcctctggatacctttagaag

SEQ ID NO: 706781 - DNA, 25 bp, Mus musculus
ggcagcctctggttacctttagaag

SEQ ID NO: 706782 - DNA, 25 bp, Mus musculus
ggcagcctctgtaccatatgtcaaa

SEQ ID NO: 706783 - DNA, 25 bp, Mus musculus
ggcagcctctgttccatatgtcaaa

SEQ ID NO: 706784 - DNA, 25 bp, Mus musculus
ggcagcctgagaacctcccagctaa

SEQ ID NO: 706785 - DNA, 25 bp, Mus musculus
ggcagcctgagatcctcccagctaa

SEQ ID NO: 706786 - DNA, 25 bp, Mus musculus
ggcagcctggacctgctgcagtcct

SEQ ID NO: 706787 - DNA, 25 bp, Mus musculus
ggcagcctggacgtgctgcagtcct

SEQ ID NO: 706788 - DNA, 25 bp, Mus musculus
ggcagcctggttatcacaagctaga

SEQ ID NO: 706789 - DNA, 25 bp, Mus musculus
ggcagcctggttttcacaagctaga

SEQ ID NO: 706790 - DNA, 25 bp, Mus musculus
ggcagccttcttagcaagccagtga

SEQ ID NO: 706791 - DNA, 25 bp, Mus musculus
ggcagccttctttgcaagccagtga

SEQ ID NO: 706792 - DNA, 25 bp, Mus musculus
ggcagcgacggtataaagccggcca

SEQ ID NO: 706793 - DNA, 25 bp, Mus musculus
ggcagcgacggtttaaagccggcca

SEQ ID NO: 706794 - DNA, 25 bp, Mus musculus
ggcagcgcctcaagggtggcggcgg

SEQ ID NO: 706795 - DNA, 25 bp, Mus musculus
ggcagcgcctcatgggtggcggcgg

SEQ ID NO: 706796 - DNA, 25 bp, Mus musculus
ggcagcgcgctacggtctcaagttt

SEQ ID NO: 706797 - DNA, 25 bp, Mus musculus
ggcagcgcgctagggtctcaagttt

SEQ ID NO: 706798 - DNA, 25 bp, Mus musculus
ggcagcgctcaccactgaatgactt

SEQ ID NO: 706799 - DNA, 25 bp, Mus musculus
ggcagcgctcacgactgaatgactt

SEQ ID NO: 706800 - DNA, 25 bp, Mus musculus
ggcagcgctgtgagaacagcaccag

SEQ ID NO: 706801 - DNA, 25 bp, Mus musculus
ggcagcgctgtgtgaacagcaccag

SEQ ID NO: 706802 - DNA, 25 bp, Mus musculus
ggcagcggtgtgcaacatcgctcac

SEQ ID NO: 706803 - DNA, 25 bp, Mus musculus
ggcagcggtgtggaacatcgctcac

SEQ ID NO: 706804 - DNA, 25 bp, Mus musculus
ggcagcgtggaacccctccttcaga

SEQ ID NO: 706805 - DNA, 25 bp, Mus musculus
ggcagcgtggaagccctccttcaga

SEQ ID NO: 706806 - DNA, 25 bp, Mus musculus
ggcagcgttggacactgtcagcccc

SEQ ID NO: 706807 - DNA, 25 bp, Mus musculus
ggcagcgttggagactgtcagcccc

SEQ ID NO: 706808 - DNA, 25 bp, Mus musculus
ggcagctatcctcgctgagccttag

SEQ ID NO: 706809 - DNA, 25 bp, Mus musculus
ggcagctatcctggctgagccttag

SEQ ID NO: 706810 - DNA, 25 bp, Mus musculus
ggcagctcacagctctgactacagc

SEQ ID NO: 706811 - DNA, 25 bp, Mus musculus
ggcagctcacaggtctgactacagc

SEQ ID NO: 706812 - DNA, 25 bp, Mus musculus
ggcagctcacatattcaatgagagt

SEQ ID NO: 706813 - DNA, 25 bp, Mus musculus
ggcagctcacattttcaatgagagt

SEQ ID NO: 706814 - DNA, 25 bp, Mus musculus
ggcagctccttacggccatggacag

SEQ ID NO: 706815 - DNA, 25 bp, Mus musculus
ggcagctccttagggccatggacag

SEQ ID NO: 706816 - DNA, 25 bp, Mus musculus
ggcagctctaccaggaccaagaggt

SEQ ID NO: 706817 - DNA, 25 bp, Mus musculus
ggcagctctacctggaccaagaggt

SEQ ID NO: 706818 - DNA, 25 bp, Mus musculus
ggcagctctactcagtagggctatc

SEQ ID NO: 706819 - DNA, 25 bp, Mus musculus
ggcagctctactgagtagggctatc

SEQ ID NO: 706820 - DNA, 25 bp, Mus musculus
ggcagctctcacacagatgtcatcg

SEQ ID NO: 706821 - DNA, 25 bp, Mus musculus
ggcagctctcactcagatgtcatcg

SEQ ID NO: 706822 - DNA, 25 bp, Mus musculus
ggcagctctctaaaagcaagtggga

SEQ ID NO: 706823 - DNA, 25 bp, Mus musculus
ggcagctctctataagcaagtggga

SEQ ID NO: 706824 - DNA, 25 bp, Mus musculus
ggcagctctgatctctccactgcaa

SEQ ID NO: 706825 - DNA, 25 bp, Mus musculus
ggcagctctgatgtctccactgcaa

SEQ ID NO: 706826 - DNA, 25 bp, Mus musculus
ggcagctctgcacacggcagctgat

SEQ ID NO: 706827 - DNA, 25 bp, Mus musculus
ggcagctctgcagacggcagctgat

SEQ ID NO: 706828 - DNA, 25 bp, Mus musculus
ggcagctcttcacggtccagcaact

SEQ ID NO: 706829 - DNA, 25 bp, Mus musculus
ggcagctcttcagggtccagcaact

SEQ ID NO: 706830 - DNA, 25 bp, Mus musculus
ggcagctgacagacctgtgcaccaa

SEQ ID NO: 706831 - DNA, 25 bp, Mus musculus
ggcagctgacagtcctgtgcaccaa

SEQ ID NO: 706832 - DNA, 25 bp, Mus musculus
ggcagctgatgccttctacaaagcc

SEQ ID NO: 706833 - DNA, 25 bp, Mus musculus
ggcagctgatgcgttctacaaagcc

SEQ ID NO: 706834 - DNA, 25 bp, Mus musculus
ggcagctgctggaccatcagctaga

SEQ ID NO: 706835 - DNA, 25 bp, Mus musculus
ggcagctgctggtccatcagctaga

SEQ ID NO: 706836 - DNA, 25 bp, Mus musculus
ggcagctggcagaaattgattttcg

SEQ ID NO: 706837 - DNA, 25 bp, Mus musculus
ggcagctggcagtaattgattttcg

SEQ ID NO: 706838 - DNA, 25 bp, Mus musculus
ggcagctgggaaaactagttcattt

SEQ ID NO: 706839 - DNA, 25 bp, Mus musculus
ggcagctgggaatactagttcattt

SEQ ID NO: 706840 - DNA, 25 bp, Mus musculus
ggcagctgggatctacctaacttgg

SEQ ID NO: 706841 - DNA, 25 bp, Mus musculus
ggcagctgggatgtacctaacttgg

SEQ ID NO: 706842 - DNA, 25 bp, Mus musculus
ggcagctgtcaaaaacaaggatggg

SEQ ID NO: 706843 - DNA, 25 bp, Mus musculus
ggcagctgtcaataacaaggatggg

SEQ ID NO: 706844 - DNA, 25 bp, Mus musculus
ggcagcttagatccgccacggcttc

SEQ ID NO: 706845 - DNA, 25 bp, Mus musculus
ggcagcttagatgcgccacggcttc

SEQ ID NO: 706846 - DNA, 25 bp, Mus musculus
ggcagcttcaacagcttgagaagaa

SEQ ID NO: 706847 - DNA, 25 bp, Mus musculus
ggcagcttcaactgcttgagaagaa

SEQ ID NO: 706848 - DNA, 25 bp, Mus musculus
ggcagcttcaagagcatcgcctgcc

SEQ ID NO: 706849 - DNA, 25 bp, Mus musculus
ggcagcttcaagtgcatcgcctgcc

SEQ ID NO: 706850 - DNA, 25 bp, Mus musculus
ggcagcttcagtacattccatcaga

SEQ ID NO: 706851 - DNA, 25 bp, Mus musculus
ggcagcttcagttcattccatcaga

SEQ ID NO: 706852 - DNA, 25 bp, Mus musculus
ggcagcttcatgcagagcgacatgt

SEQ ID NO: 706853 - DNA, 25 bp, Mus musculus
ggcagcttcatggagagcgacatgt

SEQ ID NO: 706854 - DNA, 25 bp, Mus musculus
ggcagcttccatagcggacaccgca

SEQ ID NO: 706855 - DNA, 25 bp, Mus musculus
ggcagcttccattgcggacaccgca

SEQ ID NO: 706856 - DNA, 25 bp, Mus musculus
ggcagcttcgggcacaacctagtca

SEQ ID NO: 706857 - DNA, 25 bp, Mus musculus
ggcagcttcggggacaacctagtca

SEQ ID NO: 706858 - DNA, 25 bp, Mus musculus
ggcagcttgaggagaggtttttcct

SEQ ID NO: 706859 - DNA, 25 bp, Mus musculus
ggcagcttgaggtgaggtttttcct

SEQ ID NO: 706860 - DNA, 25 bp, Mus musculus
ggcagctttccgactcggattccga

SEQ ID NO: 706861 - DNA, 25 bp, Mus musculus
ggcagctttccgtctcggattccga

SEQ ID NO: 706862 - DNA, 25 bp, Mus musculus
ggcagctttgggatcaccctgttca

SEQ ID NO: 706863 - DNA, 25 bp, Mus musculus
ggcagctttgggttcaccctgttca

SEQ ID NO: 706864 - DNA, 25 bp, Mus musculus
ggcagctttttcactgtcgctcaag

SEQ ID NO: 706865 - DNA, 25 bp, Mus musculus
ggcagctttttctctgtcgctcaag

SEQ ID NO: 706866 - DNA, 25 bp, Mus musculus
ggcaggaaccagcaattactgggaa

SEQ ID NO: 706867 - DNA, 25 bp, Mus musculus
ggcaggaaccaggaattactgggaa

SEQ ID NO: 706868 - DNA, 25 bp, Mus musculus
ggcaggaagtctacattcatgaagg

SEQ ID NO: 706869 - DNA, 25 bp, Mus musculus
ggcaggaagtcttcattcatgaagg

SEQ ID NO: 706870 - DNA, 25 bp, Mus musculus
ggcaggaatatacccaaccccacag

SEQ ID NO: 706871 - DNA, 25 bp, Mus musculus
ggcaggaatatagccaaccccacag

SEQ ID NO: 706872 - DNA, 25 bp, Mus musculus
ggcaggaatgacattgctactgtct

SEQ ID NO: 706873 - DNA, 25 bp, Mus musculus
ggcaggaatgactttgctactgtct

SEQ ID NO: 706874 - DNA, 25 bp, Mus musculus
ggcaggaatgtcctttattgtttgc

SEQ ID NO: 706875 - DNA, 25 bp, Mus musculus
ggcaggaatgtcgtttattgtttgc

SEQ ID NO: 706876 - DNA, 25 bp, Mus musculus
ggcaggaattctcgagcttcaatca

SEQ ID NO: 706877 - DNA, 25 bp, Mus musculus
ggcaggaattctggagcttcaatca

SEQ ID NO: 706878 - DNA, 25 bp, Mus musculus
ggcaggacactgagcagaagaccca

SEQ ID NO: 706879 - DNA, 25 bp, Mus musculus
ggcaggacactgtgcagaagaccca

SEQ ID NO: 706880 - DNA, 25 bp, Mus musculus
ggcaggaccagacaaagcaacagat

SEQ ID NO: 706881 - DNA, 25 bp, Mus musculus
ggcaggaccagagaaagcaacagat

SEQ ID NO: 706882 - DNA, 25 bp, Mus musculus
ggcaggacgtagatctcacagcatg

SEQ ID NO: 706883 - DNA, 25 bp, Mus musculus
ggcaggacgtagttctcacagcatg

SEQ ID NO: 706884 - DNA, 25 bp, Mus musculus
ggcaggactcatcctagtgcagaac

SEQ ID NO: 706885 - DNA, 25 bp, Mus musculus
ggcaggactcatgctagtgcagaac

SEQ ID NO: 706886 - DNA, 25 bp, Mus musculus
ggcaggagagctcgtacttacctct

SEQ ID NO: 706887 - DNA, 25 bp, Mus musculus
ggcaggagagctggtacttacctct

SEQ ID NO: 706888 - DNA, 25 bp, Mus musculus
ggcaggagatcgaaagcctgtatga

SEQ ID NO: 706889 - DNA, 25 bp, Mus musculus
ggcaggagatcgtaagcctgtatga

SEQ ID NO: 706890 - DNA, 25 bp, Mus musculus
ggcaggagcatcacaaatactggct

SEQ ID NO: 706891 - DNA, 25 bp, Mus musculus
ggcaggagcatctcaaatactggct

SEQ ID NO: 706892 - DNA, 25 bp, Mus musculus
ggcaggagctatattccattcccga

SEQ ID NO: 706893 - DNA, 25 bp, Mus musculus
ggcaggagctattttccattcccga

SEQ ID NO: 706894 - DNA, 25 bp, Mus musculus
ggcaggagctcaacagacatcagat

SEQ ID NO: 706895 - DNA, 25 bp, Mus musculus
ggcaggagctcatcagacatcagat

SEQ ID NO: 706896 - DNA, 25 bp, Mus musculus
ggcaggaggcatatccctctcggaa

SEQ ID NO: 706897 - DNA, 25 bp, Mus musculus
ggcaggaggcatttccctctcggaa

SEQ ID NO: 706898 - DNA, 25 bp, Mus musculus
ggcaggagtaccaggccagtctact

SEQ ID NO: 706899 - DNA, 25 bp, Mus musculus
ggcaggagtacctggccagtctact

SEQ ID NO: 706900 - DNA, 25 bp, Mus musculus
ggcaggagtggcatagtttacgact

SEQ ID NO: 706901 - DNA, 25 bp, Mus musculus
ggcaggagtggcttagtttacgact

SEQ ID NO: 706902 - DNA, 25 bp, Mus musculus
ggcaggatctccaactgagcaacag

SEQ ID NO: 706903 - DNA, 25 bp, Mus musculus
ggcaggatctcctactgagcaacag

SEQ ID NO: 706904 - DNA, 25 bp, Mus musculus
ggcaggatgcgtctctgccagccca

SEQ ID NO: 706905 - DNA, 25 bp, Mus musculus
ggcaggatgcgtgtctgccagccca

SEQ ID NO: 706906 - DNA, 25 bp, Mus musculus
ggcaggatgctaagatgtactgcaa

SEQ ID NO: 706907 - DNA, 25 bp, Mus musculus
ggcaggatgctatgatgtactgcaa

SEQ ID NO: 706908 - DNA, 25 bp, Mus musculus
ggcaggatttcaacgctggagcaat

SEQ ID NO: 706909 - DNA, 25 bp, Mus musculus
ggcaggatttcatcgctggagcaat

SEQ ID NO: 706910 - DNA, 25 bp, Mus musculus
ggcaggcaaacaagcctctcacatc

SEQ ID NO: 706911 - DNA, 25 bp, Mus musculus
ggcaggcaaacatgcctctcacatc

SEQ ID NO: 706912 - DNA, 25 bp, Mus musculus
ggcaggcaccaaaatcaaggagatc

SEQ ID NO: 706913 - DNA, 25 bp, Mus musculus
ggcaggcaccaatatcaaggagatc

SEQ ID NO: 706914 - DNA, 25 bp, Mus musculus
ggcaggcacttccaagatttggtca

SEQ ID NO: 706915 - DNA, 25 bp, Mus musculus
ggcaggcacttcgaagatttggtca

SEQ ID NO: 706916 - DNA, 25 bp, Mus musculus
ggcaggcagagcaccctaaccgttc

SEQ ID NO: 706917 - DNA, 25 bp, Mus musculus
ggcaggcagagctccctaaccgttc

SEQ ID NO: 706918 - DNA, 25 bp, Mus musculus
ggcaggcagcgcatcaattaattca

SEQ ID NO: 706919 - DNA, 25 bp, Mus musculus
ggcaggcagcgcttcaattaattca

SEQ ID NO: 706920 - DNA, 25 bp, Mus musculus
ggcaggcagtgaacgagccgactcc

SEQ ID NO: 706921 - DNA, 25 bp, Mus musculus
ggcaggcagtgatcgagccgactcc

SEQ ID NO: 706922 - DNA, 25 bp, Mus musculus
ggcaggcatgtaatcccagcgttca

SEQ ID NO: 706923 - DNA, 25 bp, Mus musculus
ggcaggcatgtattcccagcgttca

SEQ ID NO: 706924 - DNA, 25 bp, Mus musculus
ggcaggcatttaactccaaagctgg

SEQ ID NO: 706925 - DNA, 25 bp, Mus musculus
ggcaggcatttatctccaaagctgg

SEQ ID NO: 706926 - DNA, 25 bp, Mus musculus
ggcaggcctagtcgcagctaagacc

SEQ ID NO: 706927 - DNA, 25 bp, Mus musculus
ggcaggcctagtggcagctaagacc

SEQ ID NO: 706928 - DNA, 25 bp, Mus musculus
ggcaggccttaaccctgggaagaga

SEQ ID NO: 706929 - DNA, 25 bp, Mus musculus
ggcaggccttaagcctgggaagaga

SEQ ID NO: 706930 - DNA, 25 bp, Mus musculus
ggcaggcgaaggcatctccatcaat

SEQ ID NO: 706931 - DNA, 25 bp, Mus musculus
ggcaggcgaagggatctccatcaat

SEQ ID NO: 706932 - DNA, 25 bp, Mus musculus
ggcaggctctgcaagacacaagtaa

SEQ ID NO: 706933 - DNA, 25 bp, Mus musculus
ggcaggctctgctagacacaagtaa

SEQ ID NO: 706934 - DNA, 25 bp, Mus musculus
ggcaggctctgtactggtcctggga

SEQ ID NO: 706935 - DNA, 25 bp, Mus musculus
ggcaggctctgttctggtcctggga

SEQ ID NO: 706936 - DNA, 25 bp, Mus musculus
ggcagggaaccaagtcaagccgagc

SEQ ID NO: 706937 - DNA, 25 bp, Mus musculus
ggcagggaaccatgtcaagccgagc

SEQ ID NO: 706938 - DNA, 25 bp, Mus musculus
ggcagggacatgcacaaaatacgat

SEQ ID NO: 706939 - DNA, 25 bp, Mus musculus
ggcagggacatggacaaaatacgat

SEQ ID NO: 706940 - DNA, 25 bp, Mus musculus
ggcagggaccccaccttagtggtag

SEQ ID NO: 706941 - DNA, 25 bp, Mus musculus
ggcagggacccctccttagtggtag

SEQ ID NO: 706942 - DNA, 25 bp, Mus musculus
ggcagggatgaaatccctggacaag

SEQ ID NO: 706943 - DNA, 25 bp, Mus musculus
ggcagggatgaattccctggacaag

SEQ ID NO: 706944 - DNA, 25 bp, Mus musculus
ggcagggcagtgagatctatttgac

SEQ ID NO: 706945 - DNA, 25 bp, Mus musculus
ggcagggcagtgtgatctatttgac

SEQ ID NO: 706946 - DNA, 25 bp, Mus musculus
ggcagggccatccaatacaattaaa

SEQ ID NO: 706947 - DNA, 25 bp, Mus musculus
ggcagggccatcgaatacaattaaa

SEQ ID NO: 706948 - DNA, 25 bp, Mus musculus
ggcagggcctatcccagacctgaga

SEQ ID NO: 706949 - DNA, 25 bp, Mus musculus
ggcagggcctatgccagacctgaga

SEQ ID NO: 706950 - DNA, 25 bp, Mus musculus
ggcagggctcagaacacccctgagc

SEQ ID NO: 706951 - DNA, 25 bp, Mus musculus
ggcagggctcagtacacccctgagc

SEQ ID NO: 706952 - DNA, 25 bp, Mus musculus
ggcagggtaccacacttgtgtttct

SEQ ID NO: 706953 - DNA, 25 bp, Mus musculus
ggcagggtaccagacttgtgtttct

SEQ ID NO: 706954 - DNA, 25 bp, Mus musculus
ggcagggtcaaacatttgcagacac

SEQ ID NO: 706955 - DNA, 25 bp, Mus musculus
ggcagggtcaaagatttgcagacac

SEQ ID NO: 706956 - DNA, 25 bp, Mus musculus
ggcagggtcataaaaatgtaattct

SEQ ID NO: 706957 - DNA, 25 bp, Mus musculus
ggcagggtcatataaatgtaattct

SEQ ID NO: 706958 - DNA, 25 bp, Mus musculus
ggcagggtcatcaaaccgcaggtca

SEQ ID NO: 706959 - DNA, 25 bp, Mus musculus
ggcagggtcatctaaccgcaggtca

SEQ ID NO: 706960 - DNA, 25 bp, Mus musculus
ggcagggtctccatgtctgccctag

SEQ ID NO: 706961 - DNA, 25 bp, Mus musculus
ggcagggtctccttgtctgccctag

SEQ ID NO: 706962 - DNA, 25 bp, Mus musculus
ggcaggtagaccacttactctttca

SEQ ID NO: 706963 - DNA, 25 bp, Mus musculus
ggcaggtagacctcttactctttca

SEQ ID NO: 706964 - DNA, 25 bp, Mus musculus
ggcaggtcagccatgttctttggcc

SEQ ID NO: 706965 - DNA, 25 bp, Mus musculus
ggcaggtcagccttgttctttggcc

SEQ ID NO: 706966 - DNA, 25 bp, Mus musculus
ggcaggtgctttactgtaccccgaa

SEQ ID NO: 706967 - DNA, 25 bp, Mus musculus
ggcaggtgcttttctgtaccccgaa

SEQ ID NO: 706968 - DNA, 25 bp, Mus musculus
ggcaggtggagacctgatcatctct

SEQ ID NO: 706969 - DNA, 25 bp, Mus musculus
ggcaggtggagagctgatcatctct

SEQ ID NO: 706970 - DNA, 25 bp, Mus musculus
ggcaggtgtatcagtcttcttccct

SEQ ID NO: 706971 - DNA, 25 bp, Mus musculus
ggcaggtgtatctgtcttcttccct

SEQ ID NO: 706972 - DNA, 25 bp, Mus musculus
ggcaggtgtcctcctgcgttgcaaa

SEQ ID NO: 706973 - DNA, 25 bp, Mus musculus
ggcaggtgtcctgctgcgttgcaaa

SEQ ID NO: 706974 - DNA, 25 bp, Mus musculus
ggcaggtgtgcccttgacagtcttt

SEQ ID NO: 706975 - DNA, 25 bp, Mus musculus
ggcaggtgtgccgttgacagtcttt

SEQ ID NO: 706976 - DNA, 25 bp, Mus musculus
ggcaggtgtgttccatatgacaaga

SEQ ID NO: 706977 - DNA, 25 bp, Mus musculus
ggcaggtgtgttgcatatgacaaga

SEQ ID NO: 706978 - DNA, 25 bp, Mus musculus
ggcaggttcgaaaccagcttaagga

SEQ ID NO: 706979 - DNA, 25 bp, Mus musculus
ggcaggttcgaatccagcttaagga

SEQ ID NO: 706980 - DNA, 25 bp, Mus musculus
ggcaggttgtcacgctactcaatga

SEQ ID NO: 706981 - DNA, 25 bp, Mus musculus
ggcaggttgtcaggctactcaatga

SEQ ID NO: 706982 - DNA, 25 bp, Mus musculus
ggcaggtttcctcaggacgttcaca

SEQ ID NO: 706983 - DNA, 25 bp, Mus musculus
ggcaggtttcctgaggacgttcaca

SEQ ID NO: 706984 - DNA, 25 bp, Mus musculus
ggcaggttttgcatgaaatattttc

SEQ ID NO: 706985 - DNA, 25 bp, Mus musculus
ggcaggttttgcttgaaatattttc

SEQ ID NO: 706986 - DNA, 25 bp, Mus musculus
ggcagtaactgtatacaagacagcg

SEQ ID NO: 706987 - DNA, 25 bp, Mus musculus
ggcagtaactgtttacaagacagcg

SEQ ID NO: 706988 - DNA, 25 bp, Mus musculus
ggcagtaagaagcatcagttccagg

SEQ ID NO: 706989 - DNA, 25 bp, Mus musculus
ggcagtaagaaggatcagttccagg

SEQ ID NO: 706990 - DNA, 25 bp, Mus musculus
ggcagtaatggaactgtcttataca

SEQ ID NO: 706991 - DNA, 25 bp, Mus musculus
ggcagtaatggatctgtcttataca

SEQ ID NO: 706992 - DNA, 25 bp, Mus musculus
ggcagtaccgcaacgaggtgcacac

SEQ ID NO: 706993 - DNA, 25 bp, Mus musculus
ggcagtaccgcatcgaggtgcacac

SEQ ID NO: 706994 - DNA, 25 bp, Mus musculus
ggcagtactgctatgagctagatga

SEQ ID NO: 706995 - DNA, 25 bp, Mus musculus
ggcagtactgctttgagctagatga

SEQ ID NO: 706996 - DNA, 25 bp, Mus musculus
ggcagtactggcagaacgtcccgac

SEQ ID NO: 706997 - DNA, 25 bp, Mus musculus
ggcagtactggctgaacgtcccgac

SEQ ID NO: 706998 - DNA, 25 bp, Mus musculus
ggcagtacttggcatcagggctact

SEQ ID NO: 706999 - DNA, 25 bp, Mus musculus
ggcagtacttgggatcagggctact

SEQ ID NO: 707000 - DNA, 25 bp, Mus musculus
ggcagtatggctaatcttctttgtg

SEQ ID NO: 707001 - DNA, 25 bp, Mus musculus
ggcagtatggcttatcttctttgtg

SEQ ID NO: 707002 - DNA, 25 bp, Mus musculus
ggcagtatgtggagaacttggattc

SEQ ID NO: 707003 - DNA, 25 bp, Mus musculus
ggcagtatgtggtgaacttggattc

SEQ ID NO: 707004 - DNA, 25 bp, Mus musculus
ggcagtatttgtccctagacccaag

SEQ ID NO: 707005 - DNA, 25 bp, Mus musculus
ggcagtatttgtgcctagacccaag

SEQ ID NO: 707006 - DNA, 25 bp, Mus musculus
ggcagtcatgctcgctgccctcatg

SEQ ID NO: 707007 - DNA, 25 bp, Mus musculus
ggcagtcatgctggctgccctcatg

SEQ ID NO: 707008 - DNA, 25 bp, Mus musculus
ggcagtccagcccacatagcttatc

SEQ ID NO: 707009 - DNA, 25 bp, Mus musculus
ggcagtccagccgacatagcttatc

SEQ ID NO: 707010 - DNA, 25 bp, Mus musculus
ggcagtcccaagaaatgttttgaag

SEQ ID NO: 707011 - DNA, 25 bp, Mus musculus
ggcagtcccaagtaatgttttgaag

SEQ ID NO: 707012 - DNA, 25 bp, Mus musculus
ggcagtccctccagggttctcggcg

SEQ ID NO: 707013 - DNA, 25 bp, Mus musculus
ggcagtccctcctgggttctcggcg

SEQ ID NO: 707014 - DNA, 25 bp, Mus musculus
ggcagtcctacccaccttggcaggg

SEQ ID NO: 707015 - DNA, 25 bp, Mus musculus
ggcagtcctaccgaccttggcaggg

SEQ ID NO: 707016 - DNA, 25 bp, Mus musculus
ggcagtccttctcggtacttcacgg

SEQ ID NO: 707017 - DNA, 25 bp, Mus musculus
ggcagtccttctgggtacttcacgg

SEQ ID NO: 707018 - DNA, 25 bp, Mus musculus
ggcagtcgcgaaagtttctgcttga

SEQ ID NO: 707019 - DNA, 25 bp, Mus musculus
ggcagtcgcgaatgtttctgcttga

SEQ ID NO: 707020 - DNA, 25 bp, Mus musculus
ggcagtcggaggacacctgctccga

SEQ ID NO: 707021 - DNA, 25 bp, Mus musculus
ggcagtcggaggtcacctgctccga

SEQ ID NO: 707022 - DNA, 25 bp, Mus musculus
ggcagtctactcctgcctagtgaca

SEQ ID NO: 707023 - DNA, 25 bp, Mus musculus
ggcagtctactcgtgcctagtgaca

SEQ ID NO: 707024 - DNA, 25 bp, Mus musculus
ggcagtctctatatgaaaggatcga

SEQ ID NO: 707025 - DNA, 25 bp, Mus musculus
ggcagtctctatttgaaaggatcga

SEQ ID NO: 707026 - DNA, 25 bp, Mus musculus
ggcagtctgctcaagccaggaggct

SEQ ID NO: 707027 - DNA, 25 bp, Mus musculus
ggcagtctgctctagccaggaggct

SEQ ID NO: 707028 - DNA, 25 bp, Mus musculus
ggcagtctggccaatgttcctcatc

SEQ ID NO: 707029 - DNA, 25 bp, Mus musculus
ggcagtctggcctatgttcctcatc

SEQ ID NO: 707030 - DNA, 25 bp, Mus musculus
ggcagtcttgacaagagctccataa

SEQ ID NO: 707031 - DNA, 25 bp, Mus musculus
ggcagtcttgactagagctccataa

SEQ ID NO: 707032 - DNA, 25 bp, Mus musculus
ggcagtgaacgacccgactccacag

SEQ ID NO: 707033 - DNA, 25 bp, Mus musculus
ggcagtgaacgagccgactccacag

SEQ ID NO: 707034 - DNA, 25 bp, Mus musculus
ggcagtgaagaacacgaagggcccc

SEQ ID NO: 707035 - DNA, 25 bp, Mus musculus
ggcagtgaagaagacgaagggcccc

SEQ ID NO: 707036 - DNA, 25 bp, Mus musculus
ggcagtgacaatacgggaaacaggc

SEQ ID NO: 707037 - DNA, 25 bp, Mus musculus
ggcagtgacaattcgggaaacaggc

SEQ ID NO: 707038 - DNA, 25 bp, Mus musculus
ggcagtgacataactctgtcccgag

SEQ ID NO: 707039 - DNA, 25 bp, Mus musculus
ggcagtgacatatctctgtcccgag

SEQ ID NO: 707040 - DNA, 25 bp, Mus musculus
ggcagtgactaactggccaccttct

SEQ ID NO: 707041 - DNA, 25 bp, Mus musculus
ggcagtgactaagtggccaccttct

SEQ ID NO: 707042 - DNA, 25 bp, Mus musculus
ggcagtgactccactctcagcgtac

SEQ ID NO: 707043 - DNA, 25 bp, Mus musculus
ggcagtgactcctctctcagcgtac

SEQ ID NO: 707044 - DNA, 25 bp, Mus musculus
ggcagtgagccacccctcaagatga

SEQ ID NO: 707045 - DNA, 25 bp, Mus musculus
ggcagtgagccagccctcaagatga

SEQ ID NO: 707046 - DNA, 25 bp, Mus musculus
ggcagtgagcgaccctctcagtcat

SEQ ID NO: 707047 - DNA, 25 bp, Mus musculus
ggcagtgagcgagcctctcagtcat

SEQ ID NO: 707048 - DNA, 25 bp, Mus musculus
ggcagtgagctgacccacagaatgc

SEQ ID NO: 707049 - DNA, 25 bp, Mus musculus
ggcagtgagctgtcccacagaatgc

SEQ ID NO: 707050 - DNA, 25 bp, Mus musculus
ggcagtgaggtaacagatccccagg

SEQ ID NO: 707051 - DNA, 25 bp, Mus musculus
ggcagtgaggtatcagatccccagg

SEQ ID NO: 707052 - DNA, 25 bp, Mus musculus
ggcagtgcacttctacactcgggca

SEQ ID NO: 707053 - DNA, 25 bp, Mus musculus
ggcagtgcacttgtacactcgggca

SEQ ID NO: 707054 - DNA, 25 bp, Mus musculus
ggcagtgcccatcatgctgctcagc

SEQ ID NO: 707055 - DNA, 25 bp, Mus musculus
ggcagtgcccatgatgctgctcagc

SEQ ID NO: 707056 - DNA, 25 bp, Mus musculus
ggcagtgcccgcagtaaggccttca

SEQ ID NO: 707057 - DNA, 25 bp, Mus musculus
ggcagtgcccgctgtaaggccttca

SEQ ID NO: 707058 - DNA, 25 bp, Mus musculus
ggcagtgccctaagctgttcaacaa

SEQ ID NO: 707059 - DNA, 25 bp, Mus musculus
ggcagtgccctatgctgttcaacaa

SEQ ID NO: 707060 - DNA, 25 bp, Mus musculus
ggcagtgcctatatgaacatgtttg

SEQ ID NO: 707061 - DNA, 25 bp, Mus musculus
ggcagtgcctatttgaacatgtttg

SEQ ID NO: 707062 - DNA, 25 bp, Mus musculus
ggcagtgcctggagtgttcttcatc

SEQ ID NO: 707063 - DNA, 25 bp, Mus musculus
ggcagtgcctggtgtgttcttcatc

SEQ ID NO: 707064 - DNA, 25 bp, Mus musculus
ggcagtgccttgaaactcacaacgg

SEQ ID NO: 707065 - DNA, 25 bp, Mus musculus
ggcagtgccttgtaactcacaacgg

SEQ ID NO: 707066 - DNA, 25 bp, Mus musculus
ggcagtgcgtcaactacgggttgac

SEQ ID NO: 707067 - DNA, 25 bp, Mus musculus
ggcagtgcgtcatctacgggttgac

SEQ ID NO: 707068 - DNA, 25 bp, Mus musculus
ggcagtgctattcaacggcttcgct

SEQ ID NO: 707069 - DNA, 25 bp, Mus musculus
ggcagtgctattgaacggcttcgct

SEQ ID NO: 707070 - DNA, 25 bp, Mus musculus
ggcagtgcttgacaaagagaatatt

SEQ ID NO: 707071 - DNA, 25 bp, Mus musculus
ggcagtgcttgagaaagagaatatt

SEQ ID NO: 707072 - DNA, 25 bp, Mus musculus
ggcagtggagccaactcagatccag

SEQ ID NO: 707073 - DNA, 25 bp, Mus musculus
ggcagtggagcctactcagatccag

SEQ ID NO: 707074 - DNA, 25 bp, Mus musculus
ggcagtggagttagcagccaacaca

SEQ ID NO: 707075 - DNA, 25 bp, Mus musculus
ggcagtggagtttgcagccaacaca

SEQ ID NO: 707076 - DNA, 25 bp, Mus musculus
ggcagtggccttatcaatgtaacat

SEQ ID NO: 707077 - DNA, 25 bp, Mus musculus
ggcagtggccttttcaatgtaacat

SEQ ID NO: 707078 - DNA, 25 bp, Mus musculus
ggcagtggctcacagatgcccaaca

SEQ ID NO: 707079 - DNA, 25 bp, Mus musculus
ggcagtggctcagagatgcccaaca

SEQ ID NO: 707080 - DNA, 25 bp, Mus musculus
ggcagtgggcagcaatatagccaac

SEQ ID NO: 707081 - DNA, 25 bp, Mus musculus
ggcagtgggcaggaatatagccaac

SEQ ID NO: 707082 - DNA, 25 bp, Mus musculus
ggcagtggtcacctcagtggcaaat

SEQ ID NO: 707083 - DNA, 25 bp, Mus musculus
ggcagtggtcacgtcagtggcaaat

SEQ ID NO: 707084 - DNA, 25 bp, Mus musculus
ggcagtgtgcatagtggtgttcatc

SEQ ID NO: 707085 - DNA, 25 bp, Mus musculus
ggcagtgtgcattgtggtgttcatc

SEQ ID NO: 707086 - DNA, 25 bp, Mus musculus
ggcagtgtggagagcctacccgaca

SEQ ID NO: 707087 - DNA, 25 bp, Mus musculus
ggcagtgtggagtgcctacccgaca

SEQ ID NO: 707088 - DNA, 25 bp, Mus musculus
ggcagtgttcataagcttttggttc

SEQ ID NO: 707089 - DNA, 25 bp, Mus musculus
ggcagtgttcattagcttttggttc

SEQ ID NO: 707090 - DNA, 25 bp, Mus musculus
ggcagttaccgaatcagcctgaaga

SEQ ID NO: 707091 - DNA, 25 bp, Mus musculus
ggcagttaccgattcagcctgaaga

SEQ ID NO: 707092 - DNA, 25 bp, Mus musculus
ggcagttactatcgatgacttccgg

SEQ ID NO: 707093 - DNA, 25 bp, Mus musculus
ggcagttactatggatgacttccgg

SEQ ID NO: 707094 - DNA, 25 bp, Mus musculus
ggcagttatgaaaaattacctcctc

SEQ ID NO: 707095 - DNA, 25 bp, Mus musculus
ggcagttatgaataattacctcctc

SEQ ID NO: 707096 - DNA, 25 bp, Mus musculus
ggcagttcaactcaggaaggaaaga

SEQ ID NO: 707097 - DNA, 25 bp, Mus musculus
ggcagttcaactgaggaaggaaaga

SEQ ID NO: 707098 - DNA, 25 bp, Mus musculus
ggcagttcccgaacgcgaattaact

SEQ ID NO: 707099 - DNA, 25 bp, Mus musculus
ggcagttcccgatcgcgaattaact

SEQ ID NO: 707100 - DNA, 25 bp, Mus musculus
ggcagttctggcacgtcagctcttg

SEQ ID NO: 707101 - DNA, 25 bp, Mus musculus
ggcagttctggctcgtcagctcttg

SEQ ID NO: 707102 - DNA, 25 bp, Mus musculus
ggcagttgagatcgacattcaggct

SEQ ID NO: 707103 - DNA, 25 bp, Mus musculus
ggcagttgagatggacattcaggct

SEQ ID NO: 707104 - DNA, 25 bp, Mus musculus
ggcagttgtctcaattttgcctgaa

SEQ ID NO: 707105 - DNA, 25 bp, Mus musculus
ggcagttgtctctattttgcctgaa

SEQ ID NO: 707106 - DNA, 25 bp, Mus musculus
ggcagttgtgccctcattacggaca

SEQ ID NO: 707107 - DNA, 25 bp, Mus musculus
ggcagttgtgccgtcattacggaca

SEQ ID NO: 707108 - DNA, 25 bp, Mus musculus
ggcagtttcagccagaatgtggaac

SEQ ID NO: 707109 - DNA, 25 bp, Mus musculus
ggcagtttcagcgagaatgtggaac

SEQ ID NO: 707110 - DNA, 25 bp, Mus musculus
ggcagtttctggaactcctatgcaa

SEQ ID NO: 707111 - DNA, 25 bp, Mus musculus
ggcagtttctggtactcctatgcaa

SEQ ID NO: 707112 - DNA, 25 bp, Mus musculus
ggcagtttcttgctataacccaggc

SEQ ID NO: 707113 - DNA, 25 bp, Mus musculus
ggcagtttcttggtataacccaggc

SEQ ID NO: 707114 - DNA, 25 bp, Mus musculus
ggcagtttggacagcaagactggaa

SEQ ID NO: 707115 - DNA, 25 bp, Mus musculus
ggcagtttggactgcaagactggaa

SEQ ID NO: 707116 - DNA, 25 bp, Mus musculus
ggcataaatttgacctgcacgtcta

SEQ ID NO: 707117 - DNA, 25 bp, Mus musculus
ggcataaatttgtcctgcacgtcta

SEQ ID NO: 707118 - DNA, 25 bp, Mus musculus
ggcataacctcaaactcgtcccagg

SEQ ID NO: 707119 - DNA, 25 bp, Mus musculus
ggcataacctcatactcgtcccagg

SEQ ID NO: 707120 - DNA, 25 bp, Mus musculus
ggcatacaacatctcttcacggaga

SEQ ID NO: 707121 - DNA, 25 bp, Mus musculus
ggcatacaacatgtcttcacggaga

SEQ ID NO: 707122 - DNA, 25 bp, Mus musculus
ggcatacacaggcaaatactttgac

SEQ ID NO: 707123 - DNA, 25 bp, Mus musculus
ggcatacacagggaaatactttgac

SEQ ID NO: 707124 - DNA, 25 bp, Mus musculus
ggcatacaccagaaaacgctgtcct

SEQ ID NO: 707125 - DNA, 25 bp, Mus musculus
ggcatacaccagtaaacgctgtcct

SEQ ID NO: 707126 - DNA, 25 bp, Mus musculus
ggcatacagtttaacagttaaggct

SEQ ID NO: 707127 - DNA, 25 bp, Mus musculus
ggcatacagttttacagttaaggct

SEQ ID NO: 707128 - DNA, 25 bp, Mus musculus
ggcataccagagcatattattccag

SEQ ID NO: 707129 - DNA, 25 bp, Mus musculus
ggcataccagaggatattattccag

SEQ ID NO: 707130 - DNA, 25 bp, Mus musculus
ggcataccagggacaagagtttttc

SEQ ID NO: 707131 - DNA, 25 bp, Mus musculus
ggcataccagggtcaagagtttttc

SEQ ID NO: 707132 - DNA, 25 bp, Mus musculus
ggcatactccgtaggactagcattg

SEQ ID NO: 707133 - DNA, 25 bp, Mus musculus
ggcatactccgttggactagcattg

SEQ ID NO: 707134 - DNA, 25 bp, Mus musculus
ggcatactgcggagcctaggcgccc

SEQ ID NO: 707135 - DNA, 25 bp, Mus musculus
ggcatactgcggtgcctaggcgccc

SEQ ID NO: 707136 - DNA, 25 bp, Mus musculus
ggcatacttcagagatttggttcag

SEQ ID NO: 707137 - DNA, 25 bp, Mus musculus
ggcatacttcagtgatttggttcag

SEQ ID NO: 707138 - DNA, 25 bp, Mus musculus
ggcatagatggtcacaaaggacctc

SEQ ID NO: 707139 - DNA, 25 bp, Mus musculus
ggcatagatggtgacaaaggacctc

SEQ ID NO: 707140 - DNA, 25 bp, Mus musculus
ggcatagcatcaaccgcctgcagag

SEQ ID NO: 707141 - DNA, 25 bp, Mus musculus
ggcatagcatcatccgcctgcagag

SEQ ID NO: 707142 - DNA, 25 bp, Mus musculus
ggcatatctgctaatctatgtcagt

SEQ ID NO: 707143 - DNA, 25 bp, Mus musculus
ggcatatctgcttatctatgtcagt

SEQ ID NO: 707144 - DNA, 25 bp, Mus musculus
ggcatatgccaacgccctggagatt

SEQ ID NO: 707145 - DNA, 25 bp, Mus musculus
ggcatatgccaaggccctggagatt

SEQ ID NO: 707146 - DNA, 25 bp, Mus musculus
ggcatatgccagcaacctgtcggct

SEQ ID NO: 707147 - DNA, 25 bp, Mus musculus
ggcatatgccaggaacctgtcggct

SEQ ID NO: 707148 - DNA, 25 bp, Mus musculus
ggcatatgcggcagtccaaaacaga

SEQ ID NO: 707149 - DNA, 25 bp, Mus musculus
ggcatatgcggctgtccaaaacaga

SEQ ID NO: 707150 - DNA, 25 bp, Mus musculus
ggcatatggtgcagggctcttgtca

SEQ ID NO: 707151 - DNA, 25 bp, Mus musculus
ggcatatggtgctgggctcttgtca

SEQ ID NO: 707152 - DNA, 25 bp, Mus musculus
ggcatattcagcaccacgacctcga

SEQ ID NO: 707153 - DNA, 25 bp, Mus musculus
ggcatattcagctccacgacctcga

SEQ ID NO: 707154 - DNA, 25 bp, Mus musculus
ggcatattccataggccctgctcca

SEQ ID NO: 707155 - DNA, 25 bp, Mus musculus
ggcatattccattggccctgctcca

SEQ ID NO: 707156 - DNA, 25 bp, Mus musculus
ggcatattggacaatgtagtagaaa

SEQ ID NO: 707157 - DNA, 25 bp, Mus musculus
ggcatattggactatgtagtagaaa

SEQ ID NO: 707158 - DNA, 25 bp, Mus musculus
ggcatcaacgtcaatcttgtaacaa

SEQ ID NO: 707159 - DNA, 25 bp, Mus musculus
ggcatcaacgtctatcttgtaacaa

SEQ ID NO: 707160 - DNA, 25 bp, Mus musculus
ggcatcaaggcccagatttgctctt

SEQ ID NO: 707161 - DNA, 25 bp, Mus musculus
ggcatcaaggccgagatttgctctt

SEQ ID NO: 707162 - DNA, 25 bp, Mus musculus
ggcatcacacacactcgagcaattg

SEQ ID NO: 707163 - DNA, 25 bp, Mus musculus
ggcatcacacactctcgagcaattg

SEQ ID NO: 707164 - DNA, 25 bp, Mus musculus
ggcatcaccaaacgctgtcagtcat

SEQ ID NO: 707165 - DNA, 25 bp, Mus musculus
ggcatcaccaaaggctgtcagtcat

SEQ ID NO: 707166 - DNA, 25 bp, Mus musculus
ggcatcactggcatagttggagaca

SEQ ID NO: 707167 - DNA, 25 bp, Mus musculus
ggcatcactggcttagttggagaca

SEQ ID NO: 707168 - DNA, 25 bp, Mus musculus
ggcatcagaaatcggtcttatgaca

SEQ ID NO: 707169 - DNA, 25 bp, Mus musculus
ggcatcagaaatgggtcttatgaca

SEQ ID NO: 707170 - DNA, 25 bp, Mus musculus
ggcatcagatttctgttacgaatgt

SEQ ID NO: 707171 - DNA, 25 bp, Mus musculus
ggcatcagatttgtgttacgaatgt

SEQ ID NO: 707172 - DNA, 25 bp, Mus musculus
ggcatcagcatcctgggccagagca

SEQ ID NO: 707173 - DNA, 25 bp, Mus musculus
ggcatcagcatcgtgggccagagca

SEQ ID NO: 707174 - DNA, 25 bp, Mus musculus
ggcatcagctttcccatccatggca

SEQ ID NO: 707175 - DNA, 25 bp, Mus musculus
ggcatcagctttgccatccatggca

SEQ ID NO: 707176 - DNA, 25 bp, Mus musculus
ggcatcatagctagctgtaacccag

SEQ ID NO: 707177 - DNA, 25 bp, Mus musculus
ggcatcatagcttgctgtaacccag

SEQ ID NO: 707178 - DNA, 25 bp, Mus musculus
ggcatcatcatcatccttgtgcaga

SEQ ID NO: 707179 - DNA, 25 bp, Mus musculus
ggcatcatcatcttccttgtgcaga

SEQ ID NO: 707180 - DNA, 25 bp, Mus musculus
ggcatcatcgagaccaagttttctg

SEQ ID NO: 707181 - DNA, 25 bp, Mus musculus
ggcatcatcgagtccaagttttctg

SEQ ID NO: 707182 - DNA, 25 bp, Mus musculus
ggcatcatggacaccctcttccagt

SEQ ID NO: 707183 - DNA, 25 bp, Mus musculus
ggcatcatggactccctcttccagt

SEQ ID NO: 707184 - DNA, 25 bp, Mus musculus
ggcatcatgtctacagactcagctg

SEQ ID NO: 707185 - DNA, 25 bp, Mus musculus
ggcatcatgtcttcagactcagctg

SEQ ID NO: 707186 - DNA, 25 bp, Mus musculus
ggcatcatgttgcacgagctcatca

SEQ ID NO: 707187 - DNA, 25 bp, Mus musculus
ggcatcatgttggacgagctcatca

SEQ ID NO: 707188 - DNA, 25 bp, Mus musculus
ggcatccaatggaggtcattttgat

SEQ ID NO: 707189 - DNA, 25 bp, Mus musculus
ggcatccaatggtggtcattttgat

SEQ ID NO: 707190 - DNA, 25 bp, Mus musculus
ggcatccagagacggataactgtga

SEQ ID NO: 707191 - DNA, 25 bp, Mus musculus
ggcatccagagagggataactgtga

SEQ ID NO: 707192 - DNA, 25 bp, Mus musculus
ggcatccagggacctccacttgtca

SEQ ID NO: 707193 - DNA, 25 bp, Mus musculus
ggcatccagggagctccacttgtca

SEQ ID NO: 707194 - DNA, 25 bp, Mus musculus
ggcatccccatcacggtagaggaca

SEQ ID NO: 707195 - DNA, 25 bp, Mus musculus
ggcatccccatctcggtagaggaca

SEQ ID NO: 707196 - DNA, 25 bp, Mus musculus
ggcatccccgacagttattacaatg

SEQ ID NO: 707197 - DNA, 25 bp, Mus musculus
ggcatccccgactgttattacaatg

SEQ ID NO: 707198 - DNA, 25 bp, Mus musculus
ggcatcccctacattgaaacatcag

SEQ ID NO: 707199 - DNA, 25 bp, Mus musculus
ggcatcccctactttgaaacatcag

SEQ ID NO: 707200 - DNA, 25 bp, Mus musculus
ggcatcccctccaaaaagccagtgg

SEQ ID NO: 707201 - DNA, 25 bp, Mus musculus
ggcatcccctcctaaaagccagtgg

SEQ ID NO: 707202 - DNA, 25 bp, Mus musculus
ggcatccctcagctcgtgagtaaca

SEQ ID NO: 707203 - DNA, 25 bp, Mus musculus
ggcatccctcaggtcgtgagtaaca

SEQ ID NO: 707204 - DNA, 25 bp, Mus musculus
ggcatccctctacagaacaactaat

SEQ ID NO: 707205 - DNA, 25 bp, Mus musculus
ggcatccctctagagaacaactaat

SEQ ID NO: 707206 - DNA, 25 bp, Mus musculus
ggcatcccttgcatcaggatctgca

SEQ ID NO: 707207 - DNA, 25 bp, Mus musculus
ggcatcccttgcttcaggatctgca

SEQ ID NO: 707208 - DNA, 25 bp, Mus musculus
ggcatccggataccacagagcaaag

SEQ ID NO: 707209 - DNA, 25 bp, Mus musculus
ggcatccggatagcacagagcaaag

SEQ ID NO: 707210 - DNA, 25 bp, Mus musculus
ggcatccggttgaacaccaaggcct

SEQ ID NO: 707211 - DNA, 25 bp, Mus musculus
ggcatccggttgtacaccaaggcct

SEQ ID NO: 707212 - DNA, 25 bp, Mus musculus
ggcatcctcaaacatctggagccgg

SEQ ID NO: 707213 - DNA, 25 bp, Mus musculus
ggcatcctcaaagatctggagccgg

SEQ ID NO: 707214 - DNA, 25 bp, Mus musculus
ggcatcctcttgatgctatcactga

SEQ ID NO: 707215 - DNA, 25 bp, Mus musculus
ggcatcctcttgttgctatcactga

SEQ ID NO: 707216 - DNA, 25 bp, Mus musculus
ggcatcctgggcattgatgcgctct

SEQ ID NO: 707217 - DNA, 25 bp, Mus musculus
ggcatcctgggctttgatgcgctct

SEQ ID NO: 707218 - DNA, 25 bp, Mus musculus
ggcatccttcagcagttcttctgag

SEQ ID NO: 707219 - DNA, 25 bp, Mus musculus
ggcatccttcaggagttcttctgag

SEQ ID NO: 707220 - DNA, 25 bp, Mus musculus
ggcatcgacttcaaggtcaagacgg

SEQ ID NO: 707221 - DNA, 25 bp, Mus musculus
ggcatcgacttctaggtcaagacgg

SEQ ID NO: 707222 - DNA, 25 bp, Mus musculus
ggcatcgagaacaacacatctaagt

SEQ ID NO: 707223 - DNA, 25 bp, Mus musculus
ggcatcgagaactacacatctaagt

SEQ ID NO: 707224 - DNA, 25 bp, Mus musculus
ggcatcgatccgctttccttagaaa

SEQ ID NO: 707225 - DNA, 25 bp, Mus musculus
ggcatcgatccggtttccttagaaa

SEQ ID NO: 707226 - DNA, 25 bp, Mus musculus
ggcatcgatgtgctgaggaataaaa

SEQ ID NO: 707227 - DNA, 25 bp, Mus musculus
ggcatcgatgtggtgaggaataaaa

SEQ ID NO: 707228 - DNA, 25 bp, Mus musculus
ggcatcgattctctccgcatcactg

SEQ ID NO: 707229 - DNA, 25 bp, Mus musculus
ggcatcgattctgtccgcatcactg

SEQ ID NO: 707230 - DNA, 25 bp, Mus musculus
ggcatcgcaggacaagacctcaatg

SEQ ID NO: 707231 - DNA, 25 bp, Mus musculus
ggcatcgcaggagaagacctcaatg

SEQ ID NO: 707232 - DNA, 25 bp, Mus musculus
ggcatcgcattgactcaggcacggt

SEQ ID NO: 707233 - DNA, 25 bp, Mus musculus
ggcatcgcattgtctcaggcacggt

SEQ ID NO: 707234 - DNA, 25 bp, Mus musculus
ggcatcgcgggcatcacttgccgct

SEQ ID NO: 707235 - DNA, 25 bp, Mus musculus
ggcatcgcgggcttcacttgccgct

SEQ ID NO: 707236 - DNA, 25 bp, Mus musculus
ggcatcgctattctctctgtcagtt

SEQ ID NO: 707237 - DNA, 25 bp, Mus musculus
ggcatcgctattgtctctgtcagtt

SEQ ID NO: 707238 - DNA, 25 bp, Mus musculus
ggcatcggctttcggctgatctcca

SEQ ID NO: 707239 - DNA, 25 bp, Mus musculus
ggcatcggctttgggctgatctcca

SEQ ID NO: 707240 - DNA, 25 bp, Mus musculus
ggcatcgtttctatccagcggacaa

SEQ ID NO: 707241 - DNA, 25 bp, Mus musculus
ggcatcgtttctttccagcggacaa

SEQ ID NO: 707242 - DNA, 25 bp, Mus musculus
ggcatctaactgaccaggcccacta

SEQ ID NO: 707243 - DNA, 25 bp, Mus musculus
ggcatctaactgtccaggcccacta

SEQ ID NO: 707244 - DNA, 25 bp, Mus musculus
ggcatctacaagcagggccttaaat

SEQ ID NO: 707245 - DNA, 25 bp, Mus musculus
ggcatctacaaggagggccttaaat

SEQ ID NO: 707246 - DNA, 25 bp, Mus musculus
ggcatctactgcagcatagccaaca

SEQ ID NO: 707247 - DNA, 25 bp, Mus musculus
ggcatctactgctgcatagccaaca

SEQ ID NO: 707248 - DNA, 25 bp, Mus musculus
ggcatctatagcagtggcagccaca

SEQ ID NO: 707249 - DNA, 25 bp, Mus musculus
ggcatctatagctgtggcagccaca

SEQ ID NO: 707250 - DNA, 25 bp, Mus musculus
ggcatctcctataacctggcagctc

SEQ ID NO: 707251 - DNA, 25 bp, Mus musculus
ggcatctcctattacctggcagctc

SEQ ID NO: 707252 - DNA, 25 bp, Mus musculus
ggcatctctgagaactccatcattt

SEQ ID NO: 707253 - DNA, 25 bp, Mus musculus
ggcatctctgagtactccatcattt

SEQ ID NO: 707254 - DNA, 25 bp, Mus musculus
ggcatctctggtcactggtgactgt

SEQ ID NO: 707255 - DNA, 25 bp, Mus musculus
ggcatctctggtgactggtgactgt

SEQ ID NO: 707256 - DNA, 25 bp, Mus musculus
ggcatctgacacagcgggtggctca

SEQ ID NO: 707257 - DNA, 25 bp, Mus musculus
ggcatctgacactgcgggtggctca

SEQ ID NO: 707258 - DNA, 25 bp, Mus musculus
ggcatctgcacgaacacaccaggct

SEQ ID NO: 707259 - DNA, 25 bp, Mus musculus
ggcatctgcacgtacacaccaggct

SEQ ID NO: 707260 - DNA, 25 bp, Mus musculus
ggcatctgcattatcctcaacgtgg

SEQ ID NO: 707261 - DNA, 25 bp, Mus musculus
ggcatctgcattttcctcaacgtgg

SEQ ID NO: 707262 - DNA, 25 bp, Mus musculus
ggcatctgcccgcagtacaatgtgc

SEQ ID NO: 707263 - DNA, 25 bp, Mus musculus
ggcatctgcccggagtacaatgtgc

SEQ ID NO: 707264 - DNA, 25 bp, Mus musculus
ggcatctgcctcatcttaatagtca

SEQ ID NO: 707265 - DNA, 25 bp, Mus musculus
ggcatctgcctcttcttaatagtca

SEQ ID NO: 707266 - DNA, 25 bp, Mus musculus
ggcatctggaggacctgttgatatt

SEQ ID NO: 707267 - DNA, 25 bp, Mus musculus
ggcatctggaggtcctgttgatatt

SEQ ID NO: 707268 - DNA, 25 bp, Mus musculus
ggcatctggcatcctcttgttgcta

SEQ ID NO: 707269 - DNA, 25 bp, Mus musculus
ggcatctggcatgctcttgttgcta

SEQ ID NO: 707270 - DNA, 25 bp, Mus musculus
ggcatctgtagcacacaggatcaga

SEQ ID NO: 707271 - DNA, 25 bp, Mus musculus
ggcatctgtagctcacaggatcaga

SEQ ID NO: 707272 - DNA, 25 bp, Mus musculus
ggcatctgtcttacaagtgctgaag

SEQ ID NO: 707273 - DNA, 25 bp, Mus musculus
ggcatctgtctttcaagtgctgaag

SEQ ID NO: 707274 - DNA, 25 bp, Mus musculus
ggcatcttcaaacctgagctgaatg

SEQ ID NO: 707275 - DNA, 25 bp, Mus musculus
ggcatcttcaaagctgagctgaatg

SEQ ID NO: 707276 - DNA, 25 bp, Mus musculus
ggcatcttccttccttgctatagca

SEQ ID NO: 707277 - DNA, 25 bp, Mus musculus
ggcatcttccttgcttgctatagca

SEQ ID NO: 707278 - DNA, 25 bp, Mus musculus
ggcatctttcatcaccaaaaccgtg

SEQ ID NO: 707279 - DNA, 25 bp, Mus musculus
ggcatctttcatgaccaaaaccgtg

SEQ ID NO: 707280 - DNA, 25 bp, Mus musculus
ggcatctttcgcatcgtgcgcgcat

SEQ ID NO: 707281 - DNA, 25 bp, Mus musculus
ggcatctttcgcttcgtgcgcgcat

SEQ ID NO: 707282 - DNA, 25 bp, Mus musculus
ggcatctttgtcacccctaagggtg

SEQ ID NO: 707283 - DNA, 25 bp, Mus musculus
ggcatctttgtctcccctaagggtg

SEQ ID NO: 707284 - DNA, 25 bp, Mus musculus
ggcatgaaagatatggaccgccatc

SEQ ID NO: 707285 - DNA, 25 bp, Mus musculus
ggcatgaaagatttggaccgccatc

SEQ ID NO: 707286 - DNA, 25 bp, Mus musculus
ggcatgaaagtcattgaaagccgag

SEQ ID NO: 707287 - DNA, 25 bp, Mus musculus
ggcatgaaagtctttgaaagccgag

SEQ ID NO: 707288 - DNA, 25 bp, Mus musculus
ggcatgaacgtgcagttggcctttc

SEQ ID NO: 707289 - DNA, 25 bp, Mus musculus
ggcatgaacgtggagttggcctttc

SEQ ID NO: 707290 - DNA, 25 bp, Mus musculus
ggcatgaactctcccaacgagtcgg

SEQ ID NO: 707291 - DNA, 25 bp, Mus musculus
ggcatgaactctgccaacgagtcgg

SEQ ID NO: 707292 - DNA, 25 bp, Mus musculus
ggcatgaacttcagtggcccagctc

SEQ ID NO: 707293 - DNA, 25 bp, Mus musculus
ggcatgaacttctgtggcccagctc

SEQ ID NO: 707294 - DNA, 25 bp, Mus musculus
ggcatgaatgctaacatggcatata

SEQ ID NO: 707295 - DNA, 25 bp, Mus musculus
ggcatgaatgcttacatggcatata

SEQ ID NO: 707296 - DNA, 25 bp, Mus musculus
ggcatgaatttaaagccctcttcta

SEQ ID NO: 707297 - DNA, 25 bp, Mus musculus
ggcatgaatttatagccctcttcta

SEQ ID NO: 707298 - DNA, 25 bp, Mus musculus
ggcatgaccctaacaaggagagtgt

SEQ ID NO: 707299 - DNA, 25 bp, Mus musculus
ggcatgaccctatcaaggagagtgt

SEQ ID NO: 707300 - DNA, 25 bp, Mus musculus
ggcatgacggttagagctctcgtgc

SEQ ID NO: 707301 - DNA, 25 bp, Mus musculus
ggcatgacggtttgagctctcgtgc

SEQ ID NO: 707302 - DNA, 25 bp, Mus musculus
ggcatgaggatccttagatcagaga

SEQ ID NO: 707303 - DNA, 25 bp, Mus musculus
ggcatgaggatcgttagatcagaga

SEQ ID NO: 707304 - DNA, 25 bp, Mus musculus
ggcatgataaggcacaccataaggc

SEQ ID NO: 707305 - DNA, 25 bp, Mus musculus
ggcatgataagggacaccataaggc

SEQ ID NO: 707306 - DNA, 25 bp, Mus musculus
ggcatgatccgtacatcgagcatct

SEQ ID NO: 707307 - DNA, 25 bp, Mus musculus
ggcatgatccgttcatcgagcatct

SEQ ID NO: 707308 - DNA, 25 bp, Mus musculus
ggcatgatgagtacctagtgcttgg

SEQ ID NO: 707309 - DNA, 25 bp, Mus musculus
ggcatgatgagttcctagtgcttgg

SEQ ID NO: 707310 - DNA, 25 bp, Mus musculus
ggcatgcaacctcgcctccatgaga

SEQ ID NO: 707311 - DNA, 25 bp, Mus musculus
ggcatgcaacctggcctccatgaga

SEQ ID NO: 707312 - DNA, 25 bp, Mus musculus
ggcatgcatcggcaggtctatgctt

SEQ ID NO: 707313 - DNA, 25 bp, Mus musculus
ggcatgcatcgggaggtctatgctt

SEQ ID NO: 707314 - DNA, 25 bp, Mus musculus
ggcatgccccttatggacaaagtga

SEQ ID NO: 707315 - DNA, 25 bp, Mus musculus
ggcatgccccttttggacaaagtga

SEQ ID NO: 707316 - DNA, 25 bp, Mus musculus
ggcatgcctgctcaggtgctctgca

SEQ ID NO: 707317 - DNA, 25 bp, Mus musculus
ggcatgcctgctgaggtgctctgca

SEQ ID NO: 707318 - DNA, 25 bp, Mus musculus
ggcatgcgccatacactgcccaatt

SEQ ID NO: 707319 - DNA, 25 bp, Mus musculus
ggcatgcgccattcactgcccaatt

SEQ ID NO: 707320 - DNA, 25 bp, Mus musculus
ggcatgctcagcaggccatacagaa

SEQ ID NO: 707321 - DNA, 25 bp, Mus musculus
ggcatgctcagctggccatacagaa

SEQ ID NO: 707322 - DNA, 25 bp, Mus musculus
ggcatgctcatgctattaccgttcc

SEQ ID NO: 707323 - DNA, 25 bp, Mus musculus
ggcatgctcatggtattaccgttcc

SEQ ID NO: 707324 - DNA, 25 bp, Mus musculus
ggcatgctcccacttccattgttga

SEQ ID NO: 707325 - DNA, 25 bp, Mus musculus
ggcatgctcccagttccattgttga

SEQ ID NO: 707326 - DNA, 25 bp, Mus musculus
ggcatgctgagcattggattagagc

SEQ ID NO: 707327 - DNA, 25 bp, Mus musculus
ggcatgctgagctttggattagagc

SEQ ID NO: 707328 - DNA, 25 bp, Mus musculus
ggcatgctgcgtcccaaggctttga

SEQ ID NO: 707329 - DNA, 25 bp, Mus musculus
ggcatgctgcgtgccaaggctttga

SEQ ID NO: 707330 - DNA, 25 bp, Mus musculus
ggcatgctgctacaataaggctcat

SEQ ID NO: 707331 - DNA, 25 bp, Mus musculus
ggcatgctgctagaataaggctcat

SEQ ID NO: 707332 - DNA, 25 bp, Mus musculus
ggcatgctttaaactcccgagaagc

SEQ ID NO: 707333 - DNA, 25 bp, Mus musculus
ggcatgctttaatctcccgagaagc

SEQ ID NO: 707334 - DNA, 25 bp, Mus musculus
ggcatggaccagcacaaaaacccaa

SEQ ID NO: 707335 - DNA, 25 bp, Mus musculus
ggcatggaccaggacaaaaacccaa

SEQ ID NO: 707336 - DNA, 25 bp, Mus musculus
ggcatggacttcatagcctctaaga

SEQ ID NO: 707337 - DNA, 25 bp, Mus musculus
ggcatggacttcttagcctctaaga

SEQ ID NO: 707338 - DNA, 25 bp, Mus musculus
ggcatggagtgcaggacctgccaac

SEQ ID NO: 707339 - DNA, 25 bp, Mus musculus
ggcatggagtgctggacctgccaac

SEQ ID NO: 707340 - DNA, 25 bp, Mus musculus
ggcatggatattcagcgtgtgaaca

SEQ ID NO: 707341 - DNA, 25 bp, Mus musculus
ggcatggatattgagcgtgtgaaca

SEQ ID NO: 707342 - DNA, 25 bp, Mus musculus
ggcatggatcccacagggcggccca

SEQ ID NO: 707343 - DNA, 25 bp, Mus musculus
ggcatggatccctcagggcggccca

SEQ ID NO: 707344 - DNA, 25 bp, Mus musculus
ggcatggcatttcgtcctgagcgca

SEQ ID NO: 707345 - DNA, 25 bp, Mus musculus
ggcatggcatttggtcctgagcgca

SEQ ID NO: 707346 - DNA, 25 bp, Mus musculus
ggcatggcctctcattgaactcaga

SEQ ID NO: 707347 - DNA, 25 bp, Mus musculus
ggcatggcctctgattgaactcaga

SEQ ID NO: 707348 - DNA, 25 bp, Mus musculus
ggcatggcgcataacaacttcaaga

SEQ ID NO: 707349 - DNA, 25 bp, Mus musculus
ggcatggcgcattacaacttcaaga

SEQ ID NO: 707350 - DNA, 25 bp, Mus musculus
ggcatggcgctcacgcttctttgag

SEQ ID NO: 707351 - DNA, 25 bp, Mus musculus
ggcatggcgctctcgcttctttgag

SEQ ID NO: 707352 - DNA, 25 bp, Mus musculus
ggcatggctccaactctgtgaccct

SEQ ID NO: 707353 - DNA, 25 bp, Mus musculus
ggcatggctccatctctgtgaccct

SEQ ID NO: 707354 - DNA, 25 bp, Mus musculus
ggcatggctcttcccgaggtcatga

SEQ ID NO: 707355 - DNA, 25 bp, Mus musculus
ggcatggctcttgccgaggtcatga

SEQ ID NO: 707356 - DNA, 25 bp, Mus musculus
ggcatggctgtgctgtctacagcaa

SEQ ID NO: 707357 - DNA, 25 bp, Mus musculus
ggcatggctgtggtgtctacagcaa

SEQ ID NO: 707358 - DNA, 25 bp, Mus musculus
ggcatggctgttagctccgttttca

SEQ ID NO: 707359 - DNA, 25 bp, Mus musculus
ggcatggctgtttgctccgttttca

SEQ ID NO: 707360 - DNA, 25 bp, Mus musculus
ggcatgggacacagacattcttcaa

SEQ ID NO: 707361 - DNA, 25 bp, Mus musculus
ggcatgggacactgacattcttcaa

SEQ ID NO: 707362 - DNA, 25 bp, Mus musculus
ggcatgggttatcttcatgcaaaag

SEQ ID NO: 707363 - DNA, 25 bp, Mus musculus
ggcatgggttatgttcatgcaaaag

SEQ ID NO: 707364 - DNA, 25 bp, Mus musculus
ggcatgggtttcaccgagttctctg

SEQ ID NO: 707365 - DNA, 25 bp, Mus musculus
ggcatgggtttctccgagttctctg

SEQ ID NO: 707366 - DNA, 25 bp, Mus musculus
ggcatggtgatgctttccccacgcc

SEQ ID NO: 707367 - DNA, 25 bp, Mus musculus
ggcatggtgatggtttccccacgcc

SEQ ID NO: 707368 - DNA, 25 bp, Mus musculus
ggcatgtaacctattatggtacagg

SEQ ID NO: 707369 - DNA, 25 bp, Mus musculus
ggcatgtaaccttttatggtacagg

SEQ ID NO: 707370 - DNA, 25 bp, Mus musculus
ggcatgtattcgctcagccggtcaa

SEQ ID NO: 707371 - DNA, 25 bp, Mus musculus
ggcatgtattcggtcagccggtcaa

SEQ ID NO: 707372 - DNA, 25 bp, Mus musculus
ggcatgtattgcatgttgttcctgg

SEQ ID NO: 707373 - DNA, 25 bp, Mus musculus
ggcatgtattgcttgttgttcctgg

SEQ ID NO: 707374 - DNA, 25 bp, Mus musculus
ggcatgtccaaccaggagggacccc

SEQ ID NO: 707375 - DNA, 25 bp, Mus musculus
ggcatgtccaacgaggagggacccc

SEQ ID NO: 707376 - DNA, 25 bp, Mus musculus
ggcatgtctacaaaaaagaatgtgt

SEQ ID NO: 707377 - DNA, 25 bp, Mus musculus
ggcatgtctacataaaagaatgtgt

SEQ ID NO: 707378 - DNA, 25 bp, Mus musculus
ggcatgtgctaccaaaaccttccca

SEQ ID NO: 707379 - DNA, 25 bp, Mus musculus
ggcatgtgctacgaaaaccttccca

SEQ ID NO: 707380 - DNA, 25 bp, Mus musculus
ggcatgtggcacatgggtctataac

SEQ ID NO: 707381 - DNA, 25 bp, Mus musculus
ggcatgtggcacttgggtctataac

SEQ ID NO: 707382 - DNA, 25 bp, Mus musculus
ggcatgtgtttcatttggtcctaag

SEQ ID NO: 707383 - DNA, 25 bp, Mus musculus
ggcatgtgtttcttttggtcctaag

SEQ ID NO: 707384 - DNA, 25 bp, Mus musculus
ggcatgttggccatcccaccagaca

SEQ ID NO: 707385 - DNA, 25 bp, Mus musculus
ggcatgttggccttcccaccagaca

SEQ ID NO: 707386 - DNA, 25 bp, Mus musculus
ggcatgttgtctactacccaactct

SEQ ID NO: 707387 - DNA, 25 bp, Mus musculus
ggcatgttgtcttctacccaactct

SEQ ID NO: 707388 - DNA, 25 bp, Mus musculus
ggcatgtttcacaggtgcagagcaa

SEQ ID NO: 707389 - DNA, 25 bp, Mus musculus
ggcatgtttcactggtgcagagcaa

SEQ ID NO: 707390 - DNA, 25 bp, Mus musculus
ggcattaacagcaagcggcgaggcc

SEQ ID NO: 707391 - DNA, 25 bp, Mus musculus
ggcattaacagctagcggcgaggcc

SEQ ID NO: 707392 - DNA, 25 bp, Mus musculus
ggcattaagaacctactaagtgaag

SEQ ID NO: 707393 - DNA, 25 bp, Mus musculus
ggcattaagaacgtactaagtgaag

SEQ ID NO: 707394 - DNA, 25 bp, Mus musculus
ggcattacagagcaggacatgcaga

SEQ ID NO: 707395 - DNA, 25 bp, Mus musculus
ggcattacagaggaggacatgcaga

SEQ ID NO: 707396 - DNA, 25 bp, Mus musculus
ggcattatattaccctgagctatat

SEQ ID NO: 707397 - DNA, 25 bp, Mus musculus
ggcattatattagcctgagctatat

SEQ ID NO: 707398 - DNA, 25 bp, Mus musculus
ggcattatgacgcttgaggacctca

SEQ ID NO: 707399 - DNA, 25 bp, Mus musculus
ggcattatgacggttgaggacctca

SEQ ID NO: 707400 - DNA, 25 bp, Mus musculus
ggcattatgcacctgtacaagacaa

SEQ ID NO: 707401 - DNA, 25 bp, Mus musculus
ggcattatgcacgtgtacaagacaa

SEQ ID NO: 707402 - DNA, 25 bp, Mus musculus
ggcattcaaagaagaagtcctgaat

SEQ ID NO: 707403 - DNA, 25 bp, Mus musculus
ggcattcaaagatgaagtcctgaat

SEQ ID NO: 707404 - DNA, 25 bp, Mus musculus
ggcattcaaggactgtaccgaggct

SEQ ID NO: 707405 - DNA, 25 bp, Mus musculus
ggcattcaaggagtgtaccgaggct

SEQ ID NO: 707406 - DNA, 25 bp, Mus musculus
ggcattcaccacactgtcttcagca

SEQ ID NO: 707407 - DNA, 25 bp, Mus musculus
ggcattcaccactctgtcttcagca

SEQ ID NO: 707408 - DNA, 25 bp, Mus musculus
ggcattcaggctatgtccgtccgta

SEQ ID NO: 707409 - DNA, 25 bp, Mus musculus
ggcattcaggctttgtccgtccgta

SEQ ID NO: 707410 - DNA, 25 bp, Mus musculus
ggcattcatcctacgtccccttcac

SEQ ID NO: 707411 - DNA, 25 bp, Mus musculus
ggcattcatccttcgtccccttcac

SEQ ID NO: 707412 - DNA, 25 bp, Mus musculus
ggcattcccatgaacaaacgcaacg

SEQ ID NO: 707413 - DNA, 25 bp, Mus musculus
ggcattcccatgtacaaacgcaacg

SEQ ID NO: 707414 - DNA, 25 bp, Mus musculus
ggcattccggtgcaggagctcttct

SEQ ID NO: 707415 - DNA, 25 bp, Mus musculus
ggcattccggtggaggagctcttct

SEQ ID NO: 707416 - DNA, 25 bp, Mus musculus
ggcattcgccgtagtctagagcctt

SEQ ID NO: 707417 - DNA, 25 bp, Mus musculus
ggcattcgccgttgtctagagcctt

SEQ ID NO: 707418 - DNA, 25 bp, Mus musculus
ggcattcgctcaacatttacaagtg

SEQ ID NO: 707419 - DNA, 25 bp, Mus musculus
ggcattcgctcatcatttacaagtg

SEQ ID NO: 707420 - DNA, 25 bp, Mus musculus
ggcattctcattccccgcggagtta

SEQ ID NO: 707421 - DNA, 25 bp, Mus musculus
ggcattctcattgcccgcggagtta

SEQ ID NO: 707422 - DNA, 25 bp, Mus musculus
ggcattctctgtaccttccgctgtg

SEQ ID NO: 707423 - DNA, 25 bp, Mus musculus
ggcattctctgttccttccgctgtg

SEQ ID NO: 707424 - DNA, 25 bp, Mus musculus
ggcattgaacggaatcttctgacga

SEQ ID NO: 707425 - DNA, 25 bp, Mus musculus
ggcattgaacggtatcttctgacga

SEQ ID NO: 707426 - DNA, 25 bp, Mus musculus
ggcattgaatcaagcccttctcgct

SEQ ID NO: 707427 - DNA, 25 bp, Mus musculus
ggcattgaatcatgcccttctcgct

SEQ ID NO: 707428 - DNA, 25 bp, Mus musculus
ggcattgagcagctccggatacact

SEQ ID NO: 707429 - DNA, 25 bp, Mus musculus
ggcattgagcaggtccggatacact

SEQ ID NO: 707430 - DNA, 25 bp, Mus musculus
ggcattgcaggtagcccatggtctc

SEQ ID NO: 707431 - DNA, 25 bp, Mus musculus
ggcattgcaggttgcccatggtctc

SEQ ID NO: 707432 - DNA, 25 bp, Mus musculus
ggcattgcagtactgcgccctccag

SEQ ID NO: 707433 - DNA, 25 bp, Mus musculus
ggcattgcagtagtgcgccctccag

SEQ ID NO: 707434 - DNA, 25 bp, Mus musculus
ggcattgccttcaggtccctggtga

SEQ ID NO: 707435 - DNA, 25 bp, Mus musculus
ggcattgccttctggtccctggtga

SEQ ID NO: 707436 - DNA, 25 bp, Mus musculus
ggcattgcttaaccaggaactggcc

SEQ ID NO: 707437 - DNA, 25 bp, Mus musculus
ggcattgcttaagcaggaactggcc

SEQ ID NO: 707438 - DNA, 25 bp, Mus musculus
ggcattggcactcaatgtacctgtg

SEQ ID NO: 707439 - DNA, 25 bp, Mus musculus
ggcattggcactgaatgtacctgtg

SEQ ID NO: 707440 - DNA, 25 bp, Mus musculus
ggcattggtgaccatgtgactcagc

SEQ ID NO: 707441 - DNA, 25 bp, Mus musculus
ggcattggtgacgatgtgactcagc

SEQ ID NO: 707442 - DNA, 25 bp, Mus musculus
ggcattgttcgaccgcgtgtacaca

SEQ ID NO: 707443 - DNA, 25 bp, Mus musculus
ggcattgttcgagcgcgtgtacaca

SEQ ID NO: 707444 - DNA, 25 bp, Mus musculus
ggcatttacaccaggctgttctaag

SEQ ID NO: 707445 - DNA, 25 bp, Mus musculus
ggcatttacacctggctgttctaag

SEQ ID NO: 707446 - DNA, 25 bp, Mus musculus
ggcatttatctccaaagctgggccc

SEQ ID NO: 707447 - DNA, 25 bp, Mus musculus
ggcatttatctcgaaagctgggccc

SEQ ID NO: 707448 - DNA, 25 bp, Mus musculus
ggcatttcagttatttgcggaagag

SEQ ID NO: 707449 - DNA, 25 bp, Mus musculus
ggcatttcagttttttgcggaagag

SEQ ID NO: 707450 - DNA, 25 bp, Mus musculus
ggcatttcatcccaggagctaggtc

SEQ ID NO: 707451 - DNA, 25 bp, Mus musculus
ggcatttcatccgaggagctaggtc

SEQ ID NO: 707452 - DNA, 25 bp, Mus musculus
ggcatttcattcagtagccaaactg

SEQ ID NO: 707453 - DNA, 25 bp, Mus musculus
ggcatttcattctgtagccaaactg

SEQ ID NO: 707454 - DNA, 25 bp, Mus musculus
ggcatttctgctcttaatgaggtca

SEQ ID NO: 707455 - DNA, 25 bp, Mus musculus
ggcatttctgctgttaatgaggtca

SEQ ID NO: 707456 - DNA, 25 bp, Mus musculus
ggcatttgacaacgcagaccgggaa

SEQ ID NO: 707457 - DNA, 25 bp, Mus musculus
ggcatttgacaaggcagaccgggaa

SEQ ID NO: 707458 - DNA, 25 bp, Mus musculus
ggcatttgactgcaacacgcccaag

SEQ ID NO: 707459 - DNA, 25 bp, Mus musculus
ggcatttgactggaacacgcccaag

SEQ ID NO: 707460 - DNA, 25 bp, Mus musculus
ggcatttgaggacactacgttcctg

SEQ ID NO: 707461 - DNA, 25 bp, Mus musculus
ggcatttgaggagactacgttcctg

SEQ ID NO: 707462 - DNA, 25 bp, Mus musculus
ggcatttgagggaggtatctctgta

SEQ ID NO: 707463 - DNA, 25 bp, Mus musculus
ggcatttgagggtggtatctctgta

SEQ ID NO: 707464 - DNA, 25 bp, Mus musculus
ggcatttgcaaaacatcagactgca

SEQ ID NO: 707465 - DNA, 25 bp, Mus musculus
ggcatttgcaaatcatcagactgca

SEQ ID NO: 707466 - DNA, 25 bp, Mus musculus
ggcatttggaggctgacgatttcct

SEQ ID NO: 707467 - DNA, 25 bp, Mus musculus
ggcatttggagggtgacgatttcct

SEQ ID NO: 707468 - DNA, 25 bp, Mus musculus
ggcatttgggtgatcattagccact

SEQ ID NO: 707469 - DNA, 25 bp, Mus musculus
ggcatttgggtgttcattagccact

SEQ ID NO: 707470 - DNA, 25 bp, Mus musculus
ggcatttggtccctccctagatcag

SEQ ID NO: 707471 - DNA, 25 bp, Mus musculus
ggcatttggtccgtccctagatcag

SEQ ID NO: 707472 - DNA, 25 bp, Mus musculus
ggcatttgtacaagccgcacgggca

SEQ ID NO: 707473 - DNA, 25 bp, Mus musculus
ggcatttgtacatgccgcacgggca

SEQ ID NO: 707474 - DNA, 25 bp, Mus musculus
ggcattttacccacatttacaacca

SEQ ID NO: 707475 - DNA, 25 bp, Mus musculus
ggcattttaccctcatttacaacca

SEQ ID NO: 707476 - DNA, 25 bp, Mus musculus
ggcatttttaaaaggctggctacac

SEQ ID NO: 707477 - DNA, 25 bp, Mus musculus
ggcatttttaaatggctggctacac

SEQ ID NO: 707478 - DNA, 25 bp, Mus musculus
ggcatttttgagctgttgcggacac

SEQ ID NO: 707479 - DNA, 25 bp, Mus musculus
ggcatttttgaggtgttgcggacac

SEQ ID NO: 707480 - DNA, 25 bp, Mus musculus
ggccaaaaagctctcaggctctgat

SEQ ID NO: 707481 - DNA, 25 bp, Mus musculus
ggccaaaaagctgtcaggctctgat

SEQ ID NO: 707482 - DNA, 25 bp, Mus musculus
ggccaaaatctgacatcaaattgag

SEQ ID NO: 707483 - DNA, 25 bp, Mus musculus
ggccaaaatctgtcatcaaattgag

SEQ ID NO: 707484 - DNA, 25 bp, Mus musculus
ggccaaacattcaatcacatgagtt

SEQ ID NO: 707485 - DNA, 25 bp, Mus musculus
ggccaaacattctatcacatgagtt

SEQ ID NO: 707486 - DNA, 25 bp, Mus musculus
ggccaaactcgacccagagaggata

SEQ ID NO: 707487 - DNA, 25 bp, Mus musculus
ggccaaactcgagccagagaggata

SEQ ID NO: 707488 - DNA, 25 bp, Mus musculus
ggccaaagaacacattgaaaattac

SEQ ID NO: 707489 - DNA, 25 bp, Mus musculus
ggccaaagaacagattgaaaattac

SEQ ID NO: 707490 - DNA, 25 bp, Mus musculus
ggccaaagctgcagtgccctggcca

SEQ ID NO: 707491 - DNA, 25 bp, Mus musculus
ggccaaagctgctgtgccctggcca

SEQ ID NO: 707492 - DNA, 25 bp, Mus musculus
ggccaaagtcaacgccctggaggaa

SEQ ID NO: 707493 - DNA, 25 bp, Mus musculus
ggccaaagtcaaggccctggaggaa

SEQ ID NO: 707494 - DNA, 25 bp, Mus musculus
ggccaaagtcttcctcatctatgag

SEQ ID NO: 707495 - DNA, 25 bp, Mus musculus
ggccaaagtcttgctcatctatgag

SEQ ID NO: 707496 - DNA, 25 bp, Mus musculus
ggccaaattgggatcctaacctaag

SEQ ID NO: 707497 - DNA, 25 bp, Mus musculus
ggccaaattgggttcctaacctaag

SEQ ID NO: 707498 - DNA, 25 bp, Mus musculus
ggccaacaatgtcctccagctgctg

SEQ ID NO: 707499 - DNA, 25 bp, Mus musculus
ggccaacaatgtcttggccgtgttg

SEQ ID NO: 707500 - DNA, 25 bp, Mus musculus
ggccaacaatgtgctccagctgctg

SEQ ID NO: 707501 - DNA, 25 bp, Mus musculus
ggccaacaatgtgttggccgtgttg

SEQ ID NO: 707502 - DNA, 25 bp, Mus musculus
ggccaacaccagaatgtattatata

SEQ ID NO: 707503 - DNA, 25 bp, Mus musculus
ggccaacaccagtatgtattatata

SEQ ID NO: 707504 - DNA, 25 bp, Mus musculus
ggccaacaggcaagcttctcaggag

SEQ ID NO: 707505 - DNA, 25 bp, Mus musculus
ggccaacaggcatgcttctcaggag

SEQ ID NO: 707506 - DNA, 25 bp, Mus musculus
ggccaacatgagaaagaagctggag

SEQ ID NO: 707507 - DNA, 25 bp, Mus musculus
ggccaacatgagtaagaagctggag

SEQ ID NO: 707508 - DNA, 25 bp, Mus musculus
ggccaaccaatccacattgtgtacg

SEQ ID NO: 707509 - DNA, 25 bp, Mus musculus
ggccaaccaatcgacattgtgtacg

SEQ ID NO: 707510 - DNA, 25 bp, Mus musculus
ggccaaccgcctcatcaaaaagtaa

SEQ ID NO: 707511 - DNA, 25 bp, Mus musculus
ggccaaccgcctgatcaaaaagtaa

SEQ ID NO: 707512 - DNA, 25 bp, Mus musculus
ggccaaccgtttccagaccaggaat

SEQ ID NO: 707513 - DNA, 25 bp, Mus musculus
ggccaaccgtttgcagaccaggaat

SEQ ID NO: 707514 - DNA, 25 bp, Mus musculus
ggccaacctcttctatgatgtgcag

SEQ ID NO: 707515 - DNA, 25 bp, Mus musculus
ggccaacctcttgtatgatgtgcag

SEQ ID NO: 707516 - DNA, 25 bp, Mus musculus
ggccaacgagagcaacgtgtccacg

SEQ ID NO: 707517 - DNA, 25 bp, Mus musculus
ggccaacgagaggaacgtgtccacg

SEQ ID NO: 707518 - DNA, 25 bp, Mus musculus
ggccaacggcatcgacttcttagcc

SEQ ID NO: 707519 - DNA, 25 bp, Mus musculus
ggccaacggcatggacttcttagcc

SEQ ID NO: 707520 - DNA, 25 bp, Mus musculus
ggccaactgtgcaataacctccctg

SEQ ID NO: 707521 - DNA, 25 bp, Mus musculus
ggccaactgtgctataacctccctg

SEQ ID NO: 707522 - DNA, 25 bp, Mus musculus
ggccaagaaaatccgcttccgcaat

SEQ ID NO: 707523 - DNA, 25 bp, Mus musculus
ggccaagaaaatgcgcttccgcaat

SEQ ID NO: 707524 - DNA, 25 bp, Mus musculus
ggccaagaaactacccgaggtgtga

SEQ ID NO: 707525 - DNA, 25 bp, Mus musculus
ggccaagaaacttcccgaggtgtga

SEQ ID NO: 707526 - DNA, 25 bp, Mus musculus
ggccaagaagtcctaccccatgttt

SEQ ID NO: 707527 - DNA, 25 bp, Mus musculus
ggccaagaagtcctcagctatttcc

SEQ ID NO: 707528 - DNA, 25 bp, Mus musculus
ggccaagaagtcgtaccccatgttt

SEQ ID NO: 707529 - DNA, 25 bp, Mus musculus
ggccaagaagtcgtcagctatttcc

SEQ ID NO: 707530 - DNA, 25 bp, Mus musculus
ggccaagaagtgactaaatcacacc

SEQ ID NO: 707531 - DNA, 25 bp, Mus musculus
ggccaagaagtgtctaaatcacacc

SEQ ID NO: 707532 - DNA, 25 bp, Mus musculus
ggccaagaccgtcacttcaggaagg

SEQ ID NO: 707533 - DNA, 25 bp, Mus musculus
ggccaagaccgtgacttcaggaagg

SEQ ID NO: 707534 - DNA, 25 bp, Mus musculus
ggccaagacgaaccagcagatcgag

SEQ ID NO: 707535 - DNA, 25 bp, Mus musculus
ggccaagacgaagcagcagatcgag

SEQ ID NO: 707536 - DNA, 25 bp, Mus musculus
ggccaagacgctcatctcagctgca

SEQ ID NO: 707537 - DNA, 25 bp, Mus musculus
ggccaagacgctgatctcagctgca

SEQ ID NO: 707538 - DNA, 25 bp, Mus musculus
ggccaagagtctcaaggtcgacccc

SEQ ID NO: 707539 - DNA, 25 bp, Mus musculus
ggccaagagtctgaaggtcgacccc

SEQ ID NO: 707540 - DNA, 25 bp, Mus musculus
ggccaagatcaaaaagcaacctcag

SEQ ID NO: 707541 - DNA, 25 bp, Mus musculus
ggccaagatcaataagcaacctcag

SEQ ID NO: 707542 - DNA, 25 bp, Mus musculus
ggccaagatcttcgctgaactcctc

SEQ ID NO: 707543 - DNA, 25 bp, Mus musculus
ggccaagatcttggctgaactcctc

SEQ ID NO: 707544 - DNA, 25 bp, Mus musculus
ggccaagattgacaacctgctgcag

SEQ ID NO: 707545 - DNA, 25 bp, Mus musculus
ggccaagattgagaacctgctgcag

SEQ ID NO: 707546 - DNA, 25 bp, Mus musculus
ggccaagcacctcctagcaagtcga

SEQ ID NO: 707547 - DNA, 25 bp, Mus musculus
ggccaagcacctgctagcaagtcga

SEQ ID NO: 707548 - DNA, 25 bp, Mus musculus
ggccaagcatggagatcctggtgat

SEQ ID NO: 707549 - DNA, 25 bp, Mus musculus
ggccaagcatggtgatcctggtgat

SEQ ID NO: 707550 - DNA, 25 bp, Mus musculus
ggccaagccgccatccgtggaggat

SEQ ID NO: 707551 - DNA, 25 bp, Mus musculus
ggccaagccgccttccgtggaggat

SEQ ID NO: 707552 - DNA, 25 bp, Mus musculus
ggccaagccttacgctgcatggcct

SEQ ID NO: 707553 - DNA, 25 bp, Mus musculus
ggccaagccttaggctgcatggcct

SEQ ID NO: 707554 - DNA, 25 bp, Mus musculus
ggccaagcgcgcagatttcgtcgcc

SEQ ID NO: 707555 - DNA, 25 bp, Mus musculus
ggccaagcgcgctgatttcgtcgcc

SEQ ID NO: 707556 - DNA, 25 bp, Mus musculus
ggccaagctgcacggctcctacttt

SEQ ID NO: 707557 - DNA, 25 bp, Mus musculus
ggccaagctgcagggctcctacttt

SEQ ID NO: 707558 - DNA, 25 bp, Mus musculus
ggccaaggacttcatccgcaggctg

SEQ ID NO: 707559 - DNA, 25 bp, Mus musculus
ggccaaggacttgatccgcaggctg

SEQ ID NO: 707560 - DNA, 25 bp, Mus musculus
ggccaaggcccaacacctttatcat

SEQ ID NO: 707561 - DNA, 25 bp, Mus musculus
ggccaaggcccatcacctttatcat

SEQ ID NO: 707562 - DNA, 25 bp, Mus musculus
ggccaaggcgaacctgagcatctcc

SEQ ID NO: 707563 - DNA, 25 bp, Mus musculus
ggccaaggcgaagctgagcatctcc

SEQ ID NO: 707564 - DNA, 25 bp, Mus musculus
ggccaagggactctggtcactgtct

SEQ ID NO: 707565 - DNA, 25 bp, Mus musculus
ggccaagggactgtggtcactgtct

SEQ ID NO: 707566 - DNA, 25 bp, Mus musculus
ggccaaggtcctccgcttatttgag

SEQ ID NO: 707567 - DNA, 25 bp, Mus musculus
ggccaaggtcctgcgcttatttgag

SEQ ID NO: 707568 - DNA, 25 bp, Mus musculus
ggccaaggttatccctgcggtgtca

SEQ ID NO: 707569 - DNA, 25 bp, Mus musculus
ggccaaggttatgcctgcggtgtca

SEQ ID NO: 707570 - DNA, 25 bp, Mus musculus
ggccaagtatggcaaggacgccacc

SEQ ID NO: 707571 - DNA, 25 bp, Mus musculus
ggccaagtatgggaaggacgccacc

SEQ ID NO: 707572 - DNA, 25 bp, Mus musculus
ggccaagtccacatagcaagctgca

SEQ ID NO: 707573 - DNA, 25 bp, Mus musculus
ggccaagtccacttagcaagctgca

SEQ ID NO: 707574 - DNA, 25 bp, Mus musculus
ggccaagtccctatacagtgcccta

SEQ ID NO: 707575 - DNA, 25 bp, Mus musculus
ggccaagtccctttacagtgcccta

SEQ ID NO: 707576 - DNA, 25 bp, Mus musculus
ggccaagtctaaccgctgatttccc

SEQ ID NO: 707577 - DNA, 25 bp, Mus musculus
ggccaagtctaagcgctgatttccc

SEQ ID NO: 707578 - DNA, 25 bp, Mus musculus
ggccaagtgcagacgctgtgtcctg

SEQ ID NO: 707579 - DNA, 25 bp, Mus musculus
ggccaagtgcagtcgctgtgtcctg

SEQ ID NO: 707580 - DNA, 25 bp, Mus musculus
ggccaagtgctcacagttctgcact

SEQ ID NO: 707581 - DNA, 25 bp, Mus musculus
ggccaagtgctctcagttctgcact

SEQ ID NO: 707582 - DNA, 25 bp, Mus musculus
ggccaagtgcttaaggaaacatcat

SEQ ID NO: 707583 - DNA, 25 bp, Mus musculus
ggccaagtgctttaggaaacatcat

SEQ ID NO: 707584 - DNA, 25 bp, Mus musculus
ggccaagttcaaccagcagcatgag

SEQ ID NO: 707585 - DNA, 25 bp, Mus musculus
ggccaagttcaagcagcagcatgag

SEQ ID NO: 707586 - DNA, 25 bp, Mus musculus
ggccaagttctacaatgacccggga

SEQ ID NO: 707587 - DNA, 25 bp, Mus musculus
ggccaagttctaccccgaagacgtg

SEQ ID NO: 707588 - DNA, 25 bp, Mus musculus
ggccaagttctagaatgacccggga

SEQ ID NO: 707589 - DNA, 25 bp, Mus musculus
ggccaagttctagcccgaagacgtg

SEQ ID NO: 707590 - DNA, 25 bp, Mus musculus
ggccaagtttgacagctgcctttct

SEQ ID NO: 707591 - DNA, 25 bp, Mus musculus
ggccaagtttgagagctgcctttct

SEQ ID NO: 707592 - DNA, 25 bp, Mus musculus
ggccaatcacaaatgcgaagatgaa

SEQ ID NO: 707593 - DNA, 25 bp, Mus musculus
ggccaatcacaattgcgaagatgaa

SEQ ID NO: 707594 - DNA, 25 bp, Mus musculus
ggccaatcccttccgggctgtggct

SEQ ID NO: 707595 - DNA, 25 bp, Mus musculus
ggccaatcccttgcgggctgtggct

SEQ ID NO: 707596 - DNA, 25 bp, Mus musculus
ggccaatcctgaagctaccctgagg

SEQ ID NO: 707597 - DNA, 25 bp, Mus musculus
ggccaatcctgatgctaccctgagg

SEQ ID NO: 707598 - DNA, 25 bp, Mus musculus
ggccaatcctggctgccagatctag

SEQ ID NO: 707599 - DNA, 25 bp, Mus musculus
ggccaatcctgggtgccagatctag

SEQ ID NO: 707600 - DNA, 25 bp, Mus musculus
ggccaatgaagtacggaaggtcaag

SEQ ID NO: 707601 - DNA, 25 bp, Mus musculus
ggccaatgaagttcggaaggtcaag

SEQ ID NO: 707602 - DNA, 25 bp, Mus musculus
ggccaatgacccctgggtacagcaa

SEQ ID NO: 707603 - DNA, 25 bp, Mus musculus
ggccaatgacccgtgggtacagcaa

SEQ ID NO: 707604 - DNA, 25 bp, Mus musculus
ggccaatgccggaggccccaataac

SEQ ID NO: 707605 - DNA, 25 bp, Mus musculus
ggccaatgccggtggccccaataac

SEQ ID NO: 707606 - DNA, 25 bp, Mus musculus
ggccaatgctctcgacaacatagat

SEQ ID NO: 707607 - DNA, 25 bp, Mus musculus
ggccaatgctctggacaacatagat

SEQ ID NO: 707608 - DNA, 25 bp, Mus musculus
ggccaatgtcacagggaaagctgtc

SEQ ID NO: 707609 - DNA, 25 bp, Mus musculus
ggccaatgtcactgggaaagctgtc

SEQ ID NO: 707610 - DNA, 25 bp, Mus musculus
ggccaattcgttcccttgctcagaa

SEQ ID NO: 707611 - DNA, 25 bp, Mus musculus
ggccaattcgttgccttgctcagaa

SEQ ID NO: 707612 - DNA, 25 bp, Mus musculus
ggccaatttggaaggcgaagaaact

SEQ ID NO: 707613 - DNA, 25 bp, Mus musculus
ggccaatttggatggcgaagaaact

SEQ ID NO: 707614 - DNA, 25 bp, Mus musculus
ggccacaaaagcacagagaaagcag

SEQ ID NO: 707615 - DNA, 25 bp, Mus musculus
ggccacaaaagctcagagaaagcag

SEQ ID NO: 707616 - DNA, 25 bp, Mus musculus
ggccacaacacccatacttgtctga

SEQ ID NO: 707617 - DNA, 25 bp, Mus musculus
ggccacaacaccgatacttgtctga

SEQ ID NO: 707618 - DNA, 25 bp, Mus musculus
ggccacaacagaactggtgcccatg

SEQ ID NO: 707619 - DNA, 25 bp, Mus musculus
ggccacaacagatctggtgcccatg

SEQ ID NO: 707620 - DNA, 25 bp, Mus musculus
ggccacaacctacggcatggctgat

SEQ ID NO: 707621 - DNA, 25 bp, Mus musculus
ggccacaacctagggcatggctgat

SEQ ID NO: 707622 - DNA, 25 bp, Mus musculus
ggccacaaccttagaaaacgtctct

SEQ ID NO: 707623 - DNA, 25 bp, Mus musculus
ggccacaacctttgaaaacgtctct

SEQ ID NO: 707624 - DNA, 25 bp, Mus musculus
ggccacaatttgcagtaggagctga

SEQ ID NO: 707625 - DNA, 25 bp, Mus musculus
ggccacaatttggagtaggagctga

SEQ ID NO: 707626 - DNA, 25 bp, Mus musculus
ggccacacaaatcaggtgtccagga

SEQ ID NO: 707627 - DNA, 25 bp, Mus musculus
ggccacacaaatgaggtgtccagga

SEQ ID NO: 707628 - DNA, 25 bp, Mus musculus
ggccacacaagcctggctcctggga

SEQ ID NO: 707629 - DNA, 25 bp, Mus musculus
ggccacacaagcgtggctcctggga

SEQ ID NO: 707630 - DNA, 25 bp, Mus musculus
ggccacacaggcagccctattgttc

SEQ ID NO: 707631 - DNA, 25 bp, Mus musculus
ggccacacaggctgccctattgttc

SEQ ID NO: 707632 - DNA, 25 bp, Mus musculus
ggccacacgttcatcaccattaaca

SEQ ID NO: 707633 - DNA, 25 bp, Mus musculus
ggccacacgttcttcaccattaaca

SEQ ID NO: 707634 - DNA, 25 bp, Mus musculus
ggccacactggcaaacaagacatga

SEQ ID NO: 707635 - DNA, 25 bp, Mus musculus
ggccacactggctaacaagacatga

SEQ ID NO: 707636 - DNA, 25 bp, Mus musculus
ggccacagattgaactcagtgtcta

SEQ ID NO: 707637 - DNA, 25 bp, Mus musculus
ggccacagattgtactcagtgtcta

SEQ ID NO: 707638 - DNA, 25 bp, Mus musculus
ggccacagcatcatcaatgtcattg

SEQ ID NO: 707639 - DNA, 25 bp, Mus musculus
ggccacagcatcttcaatgtcattg

SEQ ID NO: 707640 - DNA, 25 bp, Mus musculus
ggccacagcctgagcaaacaaatgg

SEQ ID NO: 707641 - DNA, 25 bp, Mus musculus
ggccacagcctgtgcaaacaaatgg

SEQ ID NO: 707642 - DNA, 25 bp, Mus musculus
ggccacagcgacaggtcatccctgt

SEQ ID NO: 707643 - DNA, 25 bp, Mus musculus
ggccacagcgactggtcatccctgt

SEQ ID NO: 707644 - DNA, 25 bp, Mus musculus
ggccacagctcacggtctgagccat

SEQ ID NO: 707645 - DNA, 25 bp, Mus musculus
ggccacagctcagggtctgagccat

SEQ ID NO: 707646 - DNA, 25 bp, Mus musculus
ggccacagcttcctaaccaaagagg

SEQ ID NO: 707647 - DNA, 25 bp, Mus musculus
ggccacagcttcgtaaccaaagagg

SEQ ID NO: 707648 - DNA, 25 bp, Mus musculus
ggccacagggagacctccatggtgc

SEQ ID NO: 707649 - DNA, 25 bp, Mus musculus
ggccacagggagtcctccatggtgc

SEQ ID NO: 707650 - DNA, 25 bp, Mus musculus
ggccacaggtgaactggaccaagat

SEQ ID NO: 707651 - DNA, 25 bp, Mus musculus
ggccacaggtgatctggaccaagat

SEQ ID NO: 707652 - DNA, 25 bp, Mus musculus
ggccacagtgacattcatctcttca

SEQ ID NO: 707653 - DNA, 25 bp, Mus musculus
ggccacagtgactttcatctcttca

SEQ ID NO: 707654 - DNA, 25 bp, Mus musculus
ggccacatacctactggagcagcag

SEQ ID NO: 707655 - DNA, 25 bp, Mus musculus
ggccacataccttctggagcagcag

SEQ ID NO: 707656 - DNA, 25 bp, Mus musculus
ggccacatccatcagagccaaaggg

SEQ ID NO: 707657 - DNA, 25 bp, Mus musculus
ggccacatccatgagagccaaaggg

SEQ ID NO: 707658 - DNA, 25 bp, Mus musculus
ggccacatccgcagcagggtgttcc

SEQ ID NO: 707659 - DNA, 25 bp, Mus musculus
ggccacatccgctgcagggtgttcc

SEQ ID NO: 707660 - DNA, 25 bp, Mus musculus
ggccacatctatcgcttccaggtgc

SEQ ID NO: 707661 - DNA, 25 bp, Mus musculus
ggccacatctatggcttccaggtgc

SEQ ID NO: 707662 - DNA, 25 bp, Mus musculus
ggccaccaaagaatctctggatgac

SEQ ID NO: 707663 - DNA, 25 bp, Mus musculus
ggccaccaaagattctctggatgac

SEQ ID NO: 707664 - DNA, 25 bp, Mus musculus
ggccaccaattcatgcaaatgttgg

SEQ ID NO: 707665 - DNA, 25 bp, Mus musculus
ggccaccaattcttgcaaatgttgg

SEQ ID NO: 707666 - DNA, 25 bp, Mus musculus
ggccaccagcagattatccagcaga

SEQ ID NO: 707667 - DNA, 25 bp, Mus musculus
ggccaccagcagtttatccagcaga

SEQ ID NO: 707668 - DNA, 25 bp, Mus musculus
ggccaccagccgaatcatcaaatac

SEQ ID NO: 707669 - DNA, 25 bp, Mus musculus
ggccaccagccgtatcatcaaatac

SEQ ID NO: 707670 - DNA, 25 bp, Mus musculus
ggccacccggatagagggtctgcca

SEQ ID NO: 707671 - DNA, 25 bp, Mus musculus
ggccacccggattgagggtctgcca

SEQ ID NO: 707672 - DNA, 25 bp, Mus musculus
ggccaccctccactgacatgaggag

SEQ ID NO: 707673 - DNA, 25 bp, Mus musculus
ggccaccctccagtgacatgaggag

SEQ ID NO: 707674 - DNA, 25 bp, Mus musculus
ggccaccctgataaggcacatgtga

SEQ ID NO: 707675 - DNA, 25 bp, Mus musculus
ggccaccctgattaggcacatgtga

SEQ ID NO: 707676 - DNA, 25 bp, Mus musculus
ggccaccttatactgtagcagctga

SEQ ID NO: 707677 - DNA, 25 bp, Mus musculus
ggccaccttatagtgtagcagctga

SEQ ID NO: 707678 - DNA, 25 bp, Mus musculus
ggccaccttcgtcctagaactgctt

SEQ ID NO: 707679 - DNA, 25 bp, Mus musculus
ggccaccttcgtgctagaactgctt

SEQ ID NO: 707680 - DNA, 25 bp, Mus musculus
ggccaccttggcaaacctactgcat

SEQ ID NO: 707681 - DNA, 25 bp, Mus musculus
ggccaccttggctaacctactgcat

SEQ ID NO: 707682 - DNA, 25 bp, Mus musculus
ggccacgccgggaagacgatcatcc

SEQ ID NO: 707683 - DNA, 25 bp, Mus musculus
ggccacgccgggtagacgatcatcc

SEQ ID NO: 707684 - DNA, 25 bp, Mus musculus
ggccacgctttcagtgcctgctggt

SEQ ID NO: 707685 - DNA, 25 bp, Mus musculus
ggccacgctttctgtgcctgctggt

SEQ ID NO: 707686 - DNA, 25 bp, Mus musculus
ggccacggaaatccgttctctttca

SEQ ID NO: 707687 - DNA, 25 bp, Mus musculus
ggccacggaaatgcgttctctttca

SEQ ID NO: 707688 - DNA, 25 bp, Mus musculus
ggccacggccggaacgctggtcact

SEQ ID NO: 707689 - DNA, 25 bp, Mus musculus
ggccacggccggtacgctggtcact

SEQ ID NO: 707690 - DNA, 25 bp, Mus musculus
ggccacgggcaccttctcatctgtg

SEQ ID NO: 707691 - DNA, 25 bp, Mus musculus
ggccacgggcacgttctcatctgtg

SEQ ID NO: 707692 - DNA, 25 bp, Mus musculus
ggccacggtcgaccatcaagaaaac

SEQ ID NO: 707693 - DNA, 25 bp, Mus musculus
ggccacggtcgagcatcaagaaaac

SEQ ID NO: 707694 - DNA, 25 bp, Mus musculus
ggccacgtgggcctcacttatatga

SEQ ID NO: 707695 - DNA, 25 bp, Mus musculus
ggccacgtgggcgtcacttatatga

SEQ ID NO: 707696 - DNA, 25 bp, Mus musculus
ggccactacattatatccagatcag

SEQ ID NO: 707697 - DNA, 25 bp, Mus musculus
ggccactacattttatccagatcag

SEQ ID NO: 707698 - DNA, 25 bp, Mus musculus
ggccactacttaagctctgtgtatg

SEQ ID NO: 707699 - DNA, 25 bp, Mus musculus
ggccactacttatgctctgtgtatg

SEQ ID NO: 707700 - DNA, 25 bp, Mus musculus
ggccactagtatacgcattgaggaa

SEQ ID NO: 707701 - DNA, 25 bp, Mus musculus
ggccactagtattcgcattgaggaa

SEQ ID NO: 707702 - DNA, 25 bp, Mus musculus
ggccactcaggcaagacgctgttga

SEQ ID NO: 707703 - DNA, 25 bp, Mus musculus
ggccactcaggctagacgctgttga

SEQ ID NO: 707704 - DNA, 25 bp, Mus musculus
ggccactgcgagcatcttctacaag

SEQ ID NO: 707705 - DNA, 25 bp, Mus musculus
ggccactgcgaggatcttctacaag

SEQ ID NO: 707706 - DNA, 25 bp, Mus musculus
ggccactgtcctacaagacgttctt

SEQ ID NO: 707707 - DNA, 25 bp, Mus musculus
ggccactgtccttcaagacgttctt

SEQ ID NO: 707708 - DNA, 25 bp, Mus musculus
ggccactgtcgtcttgggaaaagaa

SEQ ID NO: 707709 - DNA, 25 bp, Mus musculus
ggccactgtcgtgttgggaaaagaa

SEQ ID NO: 707710 - DNA, 25 bp, Mus musculus
ggccactgttaactagcctgaagaa

SEQ ID NO: 707711 - DNA, 25 bp, Mus musculus
ggccactgttaagtagcctgaagaa

SEQ ID NO: 707712 - DNA, 25 bp, Mus musculus
ggccactgtttaacctgaaccccaa

SEQ ID NO: 707713 - DNA, 25 bp, Mus musculus
ggccactgtttatcctgaaccccaa

SEQ ID NO: 707714 - DNA, 25 bp, Mus musculus
ggccacttaattcacagcagccttg

SEQ ID NO: 707715 - DNA, 25 bp, Mus musculus
ggccacttaattgacagcagccttg

SEQ ID NO: 707716 - DNA, 25 bp, Mus musculus
ggccacttagttcagcatcttccct

SEQ ID NO: 707717 - DNA, 25 bp, Mus musculus
ggccacttagttgagcatcttccct

SEQ ID NO: 707718 - DNA, 25 bp, Mus musculus
ggccacttcagacagggcccagcag

SEQ ID NO: 707719 - DNA, 25 bp, Mus musculus
ggccacttcagagagggcccagcag

SEQ ID NO: 707720 - DNA, 25 bp, Mus musculus
ggccacttctctatctctaggcgag

SEQ ID NO: 707721 - DNA, 25 bp, Mus musculus
ggccacttctctttctctaggcgag

SEQ ID NO: 707722 - DNA, 25 bp, Mus musculus
ggccacttctttatcaacatcaaca

SEQ ID NO: 707723 - DNA, 25 bp, Mus musculus
ggccacttctttttcaacatcaaca

SEQ ID NO: 707724 - DNA, 25 bp, Mus musculus
ggccacttgaccaggcagctcatga

SEQ ID NO: 707725 - DNA, 25 bp, Mus musculus
ggccacttgacctggcagctcatga

SEQ ID NO: 707726 - DNA, 25 bp, Mus musculus
ggccacttgtaccatgcacctagag

SEQ ID NO: 707727 - DNA, 25 bp, Mus musculus
ggccacttgtacgatgcacctagag

SEQ ID NO: 707728 - DNA, 25 bp, Mus musculus
ggccactttattagagaccctttca

SEQ ID NO: 707729 - DNA, 25 bp, Mus musculus
ggccactttatttgagaccctttca

SEQ ID NO: 707730 - DNA, 25 bp, Mus musculus
ggccagaaagacatgttcttcagaa

SEQ ID NO: 707731 - DNA, 25 bp, Mus musculus
ggccagaaagacttgttcttcagaa

SEQ ID NO: 707732 - DNA, 25 bp, Mus musculus
ggccagaaaggacgcaacacatctc

SEQ ID NO: 707733 - DNA, 25 bp, Mus musculus
ggccagaaaggaggcaacacatctc

SEQ ID NO: 707734 - DNA, 25 bp, Mus musculus
ggccagaacggcatgtgtaactgca

SEQ ID NO: 707735 - DNA, 25 bp, Mus musculus
ggccagaacggcttgtgtaactgca

SEQ ID NO: 707736 - DNA, 25 bp, Mus musculus
ggccagaagcacagttataaacagt

SEQ ID NO: 707737 - DNA, 25 bp, Mus musculus
ggccagaagcactgttataaacagt

SEQ ID NO: 707738 - DNA, 25 bp, Mus musculus
ggccagaaggctctcgaacccttgt

SEQ ID NO: 707739 - DNA, 25 bp, Mus musculus
ggccagaaggctgtcgaacccttgt

SEQ ID NO: 707740 - DNA, 25 bp, Mus musculus
ggccagaatgcgaggttcctccctg

SEQ ID NO: 707741 - DNA, 25 bp, Mus musculus
ggccagaatgcgtggttcctccctg

SEQ ID NO: 707742 - DNA, 25 bp, Mus musculus
ggccagacccggaggtgctgtccct

SEQ ID NO: 707743 - DNA, 25 bp, Mus musculus
ggccagacccggtggtgctgtccct

SEQ ID NO: 707744 - DNA, 25 bp, Mus musculus
ggccagagactgcatggaaatcgaa

SEQ ID NO: 707745 - DNA, 25 bp, Mus musculus
ggccagagactggatggaaatcgaa

SEQ ID NO: 707746 - DNA, 25 bp, Mus musculus
ggccagagatgaccctgccttctta

SEQ ID NO: 707747 - DNA, 25 bp, Mus musculus
ggccagagatgagcctgccttctta

SEQ ID NO: 707748 - DNA, 25 bp, Mus musculus
ggccagagccctcaacaagtctcaa

SEQ ID NO: 707749 - DNA, 25 bp, Mus musculus
ggccagagccctgaacaagtctcaa

SEQ ID NO: 707750 - DNA, 25 bp, Mus musculus
ggccagagctcgacagaactcggtt

SEQ ID NO: 707751 - DNA, 25 bp, Mus musculus
ggccagagctcgtcagaactcggtt

SEQ ID NO: 707752 - DNA, 25 bp, Mus musculus
ggccagaggttgaaagtgatctatg

SEQ ID NO: 707753 - DNA, 25 bp, Mus musculus
ggccagaggttgtaagtgatctatg

SEQ ID NO: 707754 - DNA, 25 bp, Mus musculus
ggccagatgggtccagcttcaacat

SEQ ID NO: 707755 - DNA, 25 bp, Mus musculus
ggccagatgggtgcagcttcaacat

SEQ ID NO: 707756 - DNA, 25 bp, Mus musculus
ggccagatgtggatgagcatacgca

SEQ ID NO: 707757 - DNA, 25 bp, Mus musculus
ggccagatgtggttgagcatacgca

SEQ ID NO: 707758 - DNA, 25 bp, Mus musculus
ggccagcaaaggcattggaagagaa

SEQ ID NO: 707759 - DNA, 25 bp, Mus musculus
ggccagcaaagggattggaagagaa

SEQ ID NO: 707760 - DNA, 25 bp, Mus musculus
ggccagcaacacacctagtcacatt

SEQ ID NO: 707761 - DNA, 25 bp, Mus musculus
ggccagcaacactcctagtcacatt

SEQ ID NO: 707762 - DNA, 25 bp, Mus musculus
ggccagcaagcacggtcgccatgat

SEQ ID NO: 707763 - DNA, 25 bp, Mus musculus
ggccagcaagcagggtcgccatgat

SEQ ID NO: 707764 - DNA, 25 bp, Mus musculus
ggccagcaagctcgtcatgtcctat

SEQ ID NO: 707765 - DNA, 25 bp, Mus musculus
ggccagcaagctggtcatgtcctat

SEQ ID NO: 707766 - DNA, 25 bp, Mus musculus
ggccagcacttgagtaccagacaaa

SEQ ID NO: 707767 - DNA, 25 bp, Mus musculus
ggccagcacttgtgtaccagacaaa

SEQ ID NO: 707768 - DNA, 25 bp, Mus musculus
ggccagcagacaaccacatttactg

SEQ ID NO: 707769 - DNA, 25 bp, Mus musculus
ggccagcagacatccacatttactg

SEQ ID NO: 707770 - DNA, 25 bp, Mus musculus
ggccagcagtaccaaaggaaagata

SEQ ID NO: 707771 - DNA, 25 bp, Mus musculus
ggccagcagtacgaaaggaaagata

SEQ ID NO: 707772 - DNA, 25 bp, Mus musculus
ggccagcattttccgagtactgtaa

SEQ ID NO: 707773 - DNA, 25 bp, Mus musculus
ggccagcattttgcgagtactgtaa

SEQ ID NO: 707774 - DNA, 25 bp, Mus musculus
ggccagccaggacccttgaccgagt

SEQ ID NO: 707775 - DNA, 25 bp, Mus musculus
ggccagccaggagccttgaccgagt

SEQ ID NO: 707776 - DNA, 25 bp, Mus musculus
ggccagccccgacggtactgttttg

SEQ ID NO: 707777 - DNA, 25 bp, Mus musculus
ggccagccccgagggtactgttttg

SEQ ID NO: 707778 - DNA, 25 bp, Mus musculus
ggccagccgaggcaacgaaatcgtt

SEQ ID NO: 707779 - DNA, 25 bp, Mus musculus
ggccagccgaggcatttccctgagc

SEQ ID NO: 707780 - DNA, 25 bp, Mus musculus
ggccagccgagggaacgaaatcgtt

SEQ ID NO: 707781 - DNA, 25 bp, Mus musculus
ggccagccgagggatttccctgagc

SEQ ID NO: 707782 - DNA, 25 bp, Mus musculus
ggccagccgctgacctacaagttag

SEQ ID NO: 707783 - DNA, 25 bp, Mus musculus
ggccagccgctgtcctacaagttag

SEQ ID NO: 707784 - DNA, 25 bp, Mus musculus
ggccagccgggaaatcaagcagcta

SEQ ID NO: 707785 - DNA, 25 bp, Mus musculus
ggccagccgggatatcaagcagcta

SEQ ID NO: 707786 - DNA, 25 bp, Mus musculus
ggccagcctatcaagagcagaggac

SEQ ID NO: 707787 - DNA, 25 bp, Mus musculus
ggccagcctatctagagcagaggac

SEQ ID NO: 707788 - DNA, 25 bp, Mus musculus
ggccagcctcgcaatccagtcaatt

SEQ ID NO: 707789 - DNA, 25 bp, Mus musculus
ggccagcctcgctatccagtcaatt

SEQ ID NO: 707790 - DNA, 25 bp, Mus musculus
ggccagcgagctcgttcagctcaga

SEQ ID NO: 707791 - DNA, 25 bp, Mus musculus
ggccagcgagctggttcagctcaga

SEQ ID NO: 707792 - DNA, 25 bp, Mus musculus
ggccagcgcaaaaatctccggtgtt

SEQ ID NO: 707793 - DNA, 25 bp, Mus musculus
ggccagcgcaaatatctccggtgtt

SEQ ID NO: 707794 - DNA, 25 bp, Mus musculus
ggccagcgtaaaccgacttcgagca

SEQ ID NO: 707795 - DNA, 25 bp, Mus musculus
ggccagcgtaaagcgacttcgagca

SEQ ID NO: 707796 - DNA, 25 bp, Mus musculus
ggccagcgtgcccttacaagtgctg

SEQ ID NO: 707797 - DNA, 25 bp, Mus musculus
ggccagcgtgccgttacaagtgctg

SEQ ID NO: 707798 - DNA, 25 bp, Mus musculus
ggccagctctgtacaaggaacaatg

SEQ ID NO: 707799 - DNA, 25 bp, Mus musculus
ggccagctctgttcaaggaacaatg

SEQ ID NO: 707800 - DNA, 25 bp, Mus musculus
ggccagctttagcaaagaccccgtg

SEQ ID NO: 707801 - DNA, 25 bp, Mus musculus
ggccagctttaggaaagaccccgtg

SEQ ID NO: 707802 - DNA, 25 bp, Mus musculus
ggccaggagcatatcttcaaaaaga

SEQ ID NO: 707803 - DNA, 25 bp, Mus musculus
ggccaggagcatttcttcaaaaaga

SEQ ID NO: 707804 - DNA, 25 bp, Mus musculus
ggccaggataacaccaccaactatg

SEQ ID NO: 707805 - DNA, 25 bp, Mus musculus
ggccaggataactccaccaactatg

SEQ ID NO: 707806 - DNA, 25 bp, Mus musculus
ggccaggataccaaagccttaagtg

SEQ ID NO: 707807 - DNA, 25 bp, Mus musculus
ggccaggatacctaagccttaagtg

SEQ ID NO: 707808 - DNA, 25 bp, Mus musculus
ggccaggcagccagacccttatctg

SEQ ID NO: 707809 - DNA, 25 bp, Mus musculus
ggccaggcagcctgacccttatctg

SEQ ID NO: 707810 - DNA, 25 bp, Mus musculus
ggccaggccatgagccccaggagat

SEQ ID NO: 707811 - DNA, 25 bp, Mus musculus
ggccaggccatgtgccccaggagat

SEQ ID NO: 707812 - DNA, 25 bp, Mus musculus
ggccaggcccggagtgaagacaccc

SEQ ID NO: 707813 - DNA, 25 bp, Mus musculus
ggccaggcccggtgtgaagacaccc

SEQ ID NO: 707814 - DNA, 25 bp, Mus musculus
ggccagggatctctaagcctcagaa

SEQ ID NO: 707815 - DNA, 25 bp, Mus musculus
ggccagggatctgtaagcctcagaa

SEQ ID NO: 707816 - DNA, 25 bp, Mus musculus
ggccagggccttaagcgagttgtca

SEQ ID NO: 707817 - DNA, 25 bp, Mus musculus
ggccagggcctttagcgagttgtca

SEQ ID NO: 707818 - DNA, 25 bp, Mus musculus
ggccagggctatagctcaggacctg

SEQ ID NO: 707819 - DNA, 25 bp, Mus musculus
ggccagggctattgctcaggacctg

SEQ ID NO: 707820 - DNA, 25 bp, Mus musculus
ggccagggtgtcatggtccatagac

SEQ ID NO: 707821 - DNA, 25 bp, Mus musculus
ggccagggtgtcttggtccatagac

SEQ ID NO: 707822 - DNA, 25 bp, Mus musculus
ggccaggtcagccacgcctacgtga

SEQ ID NO: 707823 - DNA, 25 bp, Mus musculus
ggccaggtcagcgacgcctacgtga

SEQ ID NO: 707824 - DNA, 25 bp, Mus musculus
ggccaggtgattcctgatcccgtca

SEQ ID NO: 707825 - DNA, 25 bp, Mus musculus
ggccaggtgattgctgatcccgtca

SEQ ID NO: 707826 - DNA, 25 bp, Mus musculus
ggccaggtgctgattgacctggtct

SEQ ID NO: 707827 - DNA, 25 bp, Mus musculus
ggccaggtgctgtttgacctggtct

SEQ ID NO: 707828 - DNA, 25 bp, Mus musculus
ggccagtactgccactgcgatcaca

SEQ ID NO: 707829 - DNA, 25 bp, Mus musculus
ggccagtactgcgactgcgatcaca

SEQ ID NO: 707830 - DNA, 25 bp, Mus musculus
ggccagtactggagatctactctgc

SEQ ID NO: 707831 - DNA, 25 bp, Mus musculus
ggccagtactggtgatctactctgc

SEQ ID NO: 707832 - DNA, 25 bp, Mus musculus
ggccagtatgttcctggcaatggct

SEQ ID NO: 707833 - DNA, 25 bp, Mus musculus
ggccagtatgttgctggcaatggct

SEQ ID NO: 707834 - DNA, 25 bp, Mus musculus
ggccagtattccacacttatctctt

SEQ ID NO: 707835 - DNA, 25 bp, Mus musculus
ggccagtattcctcacttatctctt

SEQ ID NO: 707836 - DNA, 25 bp, Mus musculus
ggccagtccctaatactgttaagag

SEQ ID NO: 707837 - DNA, 25 bp, Mus musculus
ggccagtccctattactgttaagag

SEQ ID NO: 707838 - DNA, 25 bp, Mus musculus
ggccagtcctacagtgtcaacatca

SEQ ID NO: 707839 - DNA, 25 bp, Mus musculus
ggccagtcctactgtgtcaacatca

SEQ ID NO: 707840 - DNA, 25 bp, Mus musculus
ggccagtgatgacggtcaccttgac

SEQ ID NO: 707841 - DNA, 25 bp, Mus musculus
ggccagtgatgagggtcaccttgac

SEQ ID NO: 707842 - DNA, 25 bp, Mus musculus
ggccagtgcctcaggaagtcattgt

SEQ ID NO: 707843 - DNA, 25 bp, Mus musculus
ggccagtgcctctggaagtcattgt

SEQ ID NO: 707844 - DNA, 25 bp, Mus musculus
ggccagtggcacatcgggttcttca

SEQ ID NO: 707845 - DNA, 25 bp, Mus musculus
ggccagtggcacttcgggttcttca

SEQ ID NO: 707846 - DNA, 25 bp, Mus musculus
ggccagttcggacccaccagaggct

SEQ ID NO: 707847 - DNA, 25 bp, Mus musculus
ggccagttcggagccaccagaggct

SEQ ID NO: 707848 - DNA, 25 bp, Mus musculus
ggccagttctacactaccaaagcaa

SEQ ID NO: 707849 - DNA, 25 bp, Mus musculus
ggccagttctacatcttaatccgga

SEQ ID NO: 707850 - DNA, 25 bp, Mus musculus
ggccagttctactctaccaaagcaa

SEQ ID NO: 707851 - DNA, 25 bp, Mus musculus
ggccagttctacttcttaatccgga

SEQ ID NO: 707852 - DNA, 25 bp, Mus musculus
ggccagttgacaaccagcatggtgg

SEQ ID NO: 707853 - DNA, 25 bp, Mus musculus
ggccagttgacatccagcatggtgg

SEQ ID NO: 707854 - DNA, 25 bp, Mus musculus
ggccagttgccccagttcgagtgtt

SEQ ID NO: 707855 - DNA, 25 bp, Mus musculus
ggccagttgcccgagttcgagtgtt

SEQ ID NO: 707856 - DNA, 25 bp, Mus musculus
ggccagttggccactgccattttca

SEQ ID NO: 707857 - DNA, 25 bp, Mus musculus
ggccagttggcctctgccattttca

SEQ ID NO: 707858 - DNA, 25 bp, Mus musculus
ggccagtttacccagtgacttcaga

SEQ ID NO: 707859 - DNA, 25 bp, Mus musculus
ggccagtttaccgagtgacttcaga

SEQ ID NO: 707860 - DNA, 25 bp, Mus musculus
ggccagtttactctcacctctgtcc

SEQ ID NO: 707861 - DNA, 25 bp, Mus musculus
ggccagtttactgtcacctctgtcc

SEQ ID NO: 707862 - DNA, 25 bp, Mus musculus
ggccagtttattatggcggttcaat

SEQ ID NO: 707863 - DNA, 25 bp, Mus musculus
ggccagtttattccgtctggatcac

SEQ ID NO: 707864 - DNA, 25 bp, Mus musculus
ggccagtttattgcgtctggatcac

SEQ ID NO: 707865 - DNA, 25 bp, Mus musculus
ggccagtttattttggcggttcaat

SEQ ID NO: 707866 - DNA, 25 bp, Mus musculus
ggccataaaaaaccccgaaatgctt

SEQ ID NO: 707867 - DNA, 25 bp, Mus musculus
ggccataaaaaagcccgaaatgctt

SEQ ID NO: 707868 - DNA, 25 bp, Mus musculus
ggccataagcaacgctgagctccac

SEQ ID NO: 707869 - DNA, 25 bp, Mus musculus
ggccataagcaaggctgagctccac

SEQ ID NO: 707870 - DNA, 25 bp, Mus musculus
ggccataagggaccccggagacggt

SEQ ID NO: 707871 - DNA, 25 bp, Mus musculus
ggccataagggagcccggagacggt

SEQ ID NO: 707872 - DNA, 25 bp, Mus musculus
ggccataatgacatatgtgtccagc

SEQ ID NO: 707873 - DNA, 25 bp, Mus musculus
ggccataatgacttatgtgtccagc

SEQ ID NO: 707874 - DNA, 25 bp, Mus musculus
ggccatactaatcttgtttcttatc

SEQ ID NO: 707875 - DNA, 25 bp, Mus musculus
ggccatactaatgttgtttcttatc

SEQ ID NO: 707876 - DNA, 25 bp, Mus musculus
ggccatactttgcatccctgcattt

SEQ ID NO: 707877 - DNA, 25 bp, Mus musculus
ggccatactttggatccctgcattt

SEQ ID NO: 707878 - DNA, 25 bp, Mus musculus
ggccatagcagaagttgagcaaaag

SEQ ID NO: 707879 - DNA, 25 bp, Mus musculus
ggccatagcagatgttgagcaaaag

SEQ ID NO: 707880 - DNA, 25 bp, Mus musculus
ggccatagtcgcagagaagtttgct

SEQ ID NO: 707881 - DNA, 25 bp, Mus musculus
ggccatagtcgctgagaagtttgct

SEQ ID NO: 707882 - DNA, 25 bp, Mus musculus
ggccatatcatcacagtaagactca

SEQ ID NO: 707883 - DNA, 25 bp, Mus musculus
ggccatatcatctcagtaagactca

SEQ ID NO: 707884 - DNA, 25 bp, Mus musculus
ggccatcaaccgcaaactcatggaa

SEQ ID NO: 707885 - DNA, 25 bp, Mus musculus
ggccatcaaccggaaactcatggaa

SEQ ID NO: 707886 - DNA, 25 bp, Mus musculus
ggccatcaagaacatacctaatgct

SEQ ID NO: 707887 - DNA, 25 bp, Mus musculus
ggccatcaagaagatacctaatgct

SEQ ID NO: 707888 - DNA, 25 bp, Mus musculus
ggccatcaagatccagttcacatcg

SEQ ID NO: 707889 - DNA, 25 bp, Mus musculus
ggccatcaagatgcagttcacatcg

SEQ ID NO: 707890 - DNA, 25 bp, Mus musculus
ggccatcacattctggccctctgtg

SEQ ID NO: 707891 - DNA, 25 bp, Mus musculus
ggccatcacattgtggccctctgtg

SEQ ID NO: 707892 - DNA, 25 bp, Mus musculus
ggccatcacgttagtgtccacggga

SEQ ID NO: 707893 - DNA, 25 bp, Mus musculus
ggccatcacgtttgtgtccacggga

SEQ ID NO: 707894 - DNA, 25 bp, Mus musculus
ggccatcagtttcgtgtgtgaagct

SEQ ID NO: 707895 - DNA, 25 bp, Mus musculus
ggccatcagtttggtgtgtgaagct

SEQ ID NO: 707896 - DNA, 25 bp, Mus musculus
ggccatcattgaatacatgcctctg

SEQ ID NO: 707897 - DNA, 25 bp, Mus musculus
ggccatcattgattacatgcctctg

SEQ ID NO: 707898 - DNA, 25 bp, Mus musculus
ggccatccaggactcccagtgtctg

SEQ ID NO: 707899 - DNA, 25 bp, Mus musculus
ggccatccaggagtcccagtgtctg

SEQ ID NO: 707900 - DNA, 25 bp, Mus musculus
ggccatccgctgcagttcgtgttcg

SEQ ID NO: 707901 - DNA, 25 bp, Mus musculus
ggccatccgctggagttcgtgttcg

SEQ ID NO: 707902 - DNA, 25 bp, Mus musculus
ggccatccggtacagaatgtattgc

SEQ ID NO: 707903 - DNA, 25 bp, Mus musculus
ggccatccggtagagaatgtattgc

SEQ ID NO: 707904 - DNA, 25 bp, Mus musculus
ggccatccgtgacaactacttccga

SEQ ID NO: 707905 - DNA, 25 bp, Mus musculus
ggccatccgtgagaactacttccga

SEQ ID NO: 707906 - DNA, 25 bp, Mus musculus
ggccatcctaagacggaatatccat

SEQ ID NO: 707907 - DNA, 25 bp, Mus musculus
ggccatcctaagtcggaatatccat

SEQ ID NO: 707908 - DNA, 25 bp, Mus musculus
ggccatcgggccatggctgtcagca

SEQ ID NO: 707909 - DNA, 25 bp, Mus musculus
ggccatcgggccttggctgtcagca

SEQ ID NO: 707910 - DNA, 25 bp, Mus musculus
ggccatcgtctgagccggatacaat

SEQ ID NO: 707911 - DNA, 25 bp, Mus musculus
ggccatcgtctgtgccggatacaat

SEQ ID NO: 707912 - DNA, 25 bp, Mus musculus
ggccatcgttcaagcaaatcatttc

SEQ ID NO: 707913 - DNA, 25 bp, Mus musculus
ggccatcgttcatgcaaatcatttc

SEQ ID NO: 707914 - DNA, 25 bp, Mus musculus
ggccatctataccacacagctggat

SEQ ID NO: 707915 - DNA, 25 bp, Mus musculus
ggccatctatacgacacagctggat

SEQ ID NO: 707916 - DNA, 25 bp, Mus musculus
ggccatctcagaacaaagcagtgga

SEQ ID NO: 707917 - DNA, 25 bp, Mus musculus
ggccatctcagatcaaagcagtgga

SEQ ID NO: 707918 - DNA, 25 bp, Mus musculus
ggccatctcttcagcgacatcgttt

SEQ ID NO: 707919 - DNA, 25 bp, Mus musculus
ggccatctcttctgcgacatcgttt

SEQ ID NO: 707920 - DNA, 25 bp, Mus musculus
ggccatcttcaaaggaaagctggtt

SEQ ID NO: 707921 - DNA, 25 bp, Mus musculus
ggccatcttcaatggaaagctggtt

SEQ ID NO: 707922 - DNA, 25 bp, Mus musculus
ggccatcttcctcattcagctggag

SEQ ID NO: 707923 - DNA, 25 bp, Mus musculus
ggccatcttcctgattcagctggag

SEQ ID NO: 707924 - DNA, 25 bp, Mus musculus
ggccatctttctagctgacgggaag

SEQ ID NO: 707925 - DNA, 25 bp, Mus musculus
ggccatctttcttgctgacgggaag

SEQ ID NO: 707926 - DNA, 25 bp, Mus musculus
ggccatctttgcctgctactgctag

SEQ ID NO: 707927 - DNA, 25 bp, Mus musculus
ggccatctttgcgtgctactgctag

SEQ ID NO: 707928 - DNA, 25 bp, Mus musculus
ggccatgaacgtcggtgacgcaaaa

SEQ ID NO: 707929 - DNA, 25 bp, Mus musculus
ggccatgaacgtgggtgacgcaaaa

SEQ ID NO: 707930 - DNA, 25 bp, Mus musculus
ggccatgaagatcgtagtcactgac

SEQ ID NO: 707931 - DNA, 25 bp, Mus musculus
ggccatgaagatggtagtcactgac

SEQ ID NO: 707932 - DNA, 25 bp, Mus musculus
ggccatgaaggaagtcattgacgct

SEQ ID NO: 707933 - DNA, 25 bp, Mus musculus
ggccatgaaggatgtcattgacgct

SEQ ID NO: 707934 - DNA, 25 bp, Mus musculus
ggccatgaatcacgacggcaccttc

SEQ ID NO: 707935 - DNA, 25 bp, Mus musculus
ggccatgaatcaggacggcaccttc

SEQ ID NO: 707936 - DNA, 25 bp, Mus musculus
ggccatgaatccacacataaagcag

SEQ ID NO: 707937 - DNA, 25 bp, Mus musculus
ggccatgaatcctcacataaagcag

SEQ ID NO: 707938 - DNA, 25 bp, Mus musculus
ggccatgacctgaagcacgacttca

SEQ ID NO: 707939 - DNA, 25 bp, Mus musculus
ggccatgacctgtagcacgacttca

SEQ ID NO: 707940 - DNA, 25 bp, Mus musculus
ggccatgacttgaccgccatctgtg

SEQ ID NO: 707941 - DNA, 25 bp, Mus musculus
ggccatgacttgtccgccatctgtg

SEQ ID NO: 707942 - DNA, 25 bp, Mus musculus
ggccatgagataattgtgcagtatt

SEQ ID NO: 707943 - DNA, 25 bp, Mus musculus
ggccatgagatatttgtgcagtatt

SEQ ID NO: 707944 - DNA, 25 bp, Mus musculus
ggccatgaggagctaactatttaaa

SEQ ID NO: 707945 - DNA, 25 bp, Mus musculus
ggccatgaggaggtaactatttaaa

SEQ ID NO: 707946 - DNA, 25 bp, Mus musculus
ggccatgaggttcgatgcctcatct

SEQ ID NO: 707947 - DNA, 25 bp, Mus musculus
ggccatgaggttggatgcctcatct

SEQ ID NO: 707948 - DNA, 25 bp, Mus musculus
ggccatgataggacacaccgactca

SEQ ID NO: 707949 - DNA, 25 bp, Mus musculus
ggccatgataggtcacaccgactca

SEQ ID NO: 707950 - DNA, 25 bp, Mus musculus
ggccatgcagctcccattttatatg

SEQ ID NO: 707951 - DNA, 25 bp, Mus musculus
ggccatgcagctgccattttatatg

SEQ ID NO: 707952 - DNA, 25 bp, Mus musculus
ggccatgcatatcttaaggaatggt

SEQ ID NO: 707953 - DNA, 25 bp, Mus musculus
ggccatgcatatgttaaggaatggt

SEQ ID NO: 707954 - DNA, 25 bp, Mus musculus
ggccatgccatcagctcggctcaga

SEQ ID NO: 707955 - DNA, 25 bp, Mus musculus
ggccatgccatctgctcggctcaga

SEQ ID NO: 707956 - DNA, 25 bp, Mus musculus
ggccatgcgcgaagatgccgcttca

SEQ ID NO: 707957 - DNA, 25 bp, Mus musculus
ggccatgcgcgatgatgccgcttca

SEQ ID NO: 707958 - DNA, 25 bp, Mus musculus
ggccatggacagagaactacggtcg

SEQ ID NO: 707959 - DNA, 25 bp, Mus musculus
ggccatggacagcaagtcctcatcg

SEQ ID NO: 707960 - DNA, 25 bp, Mus musculus
ggccatggacaggaagtcctcatcg

SEQ ID NO: 707961 - DNA, 25 bp, Mus musculus
ggccatggacagtgaactacggtcg

SEQ ID NO: 707962 - DNA, 25 bp, Mus musculus
ggccatggccaaaccaatggccaaa

SEQ ID NO: 707963 - DNA, 25 bp, Mus musculus
ggccatggccaatccaatggccaaa

SEQ ID NO: 707964 - DNA, 25 bp, Mus musculus
ggccatggcgaaccacgagcagatc

SEQ ID NO: 707965 - DNA, 25 bp, Mus musculus
ggccatggcgaagcacgagcagatc

SEQ ID NO: 707966 - DNA, 25 bp, Mus musculus
ggccatggtgatccgagctcacatc

SEQ ID NO: 707967 - DNA, 25 bp, Mus musculus
ggccatggtgatgcgagctcacatc

SEQ ID NO: 707968 - DNA, 25 bp, Mus musculus
ggccatggtgggacagccttagctc

SEQ ID NO: 707969 - DNA, 25 bp, Mus musculus
ggccatggtgggtcagccttagctc

SEQ ID NO: 707970 - DNA, 25 bp, Mus musculus
ggccatgtattgcaacgggaacaag

SEQ ID NO: 707971 - DNA, 25 bp, Mus musculus
ggccatgtattggaacgggaacaag

SEQ ID NO: 707972 - DNA, 25 bp, Mus musculus
ggccatgtcctgatacagctcaata

SEQ ID NO: 707973 - DNA, 25 bp, Mus musculus
ggccatgtcctgttacagctcaata

SEQ ID NO: 707974 - DNA, 25 bp, Mus musculus
ggccatgtgaaactttccgactttg

SEQ ID NO: 707975 - DNA, 25 bp, Mus musculus
ggccatgtgaaagtttccgactttg

SEQ ID NO: 707976 - DNA, 25 bp, Mus musculus
ggccatgtgaagatttacagtgtgg

SEQ ID NO: 707977 - DNA, 25 bp, Mus musculus
ggccatgtgaagttttacagtgtgg

SEQ ID NO: 707978 - DNA, 25 bp, Mus musculus
ggccatgtgctcagaacggtgacaa

SEQ ID NO: 707979 - DNA, 25 bp, Mus musculus
ggccatgtgctcagccacccagaag

SEQ ID NO: 707980 - DNA, 25 bp, Mus musculus
ggccatgtgctctgaacggtgacaa

SEQ ID NO: 707981 - DNA, 25 bp, Mus musculus
ggccatgtgctctgccacccagaag

SEQ ID NO: 707982 - DNA, 25 bp, Mus musculus
ggccatgtggagaatgagcccaaat

SEQ ID NO: 707983 - DNA, 25 bp, Mus musculus
ggccatgtggagtatgagcccaaat

SEQ ID NO: 707984 - DNA, 25 bp, Mus musculus
ggccatgttcaaacagttgttccag

SEQ ID NO: 707985 - DNA, 25 bp, Mus musculus
ggccatgttcaatcagttgttccag

SEQ ID NO: 707986 - DNA, 25 bp, Mus musculus
ggccatgtttctccggttccttggg

SEQ ID NO: 707987 - DNA, 25 bp, Mus musculus
ggccatgtttctgcggttccttggg

SEQ ID NO: 707988 - DNA, 25 bp, Mus musculus
ggccattagtgaagatgagctagca

SEQ ID NO: 707989 - DNA, 25 bp, Mus musculus
ggccattagtgacgaacttccctat

SEQ ID NO: 707990 - DNA, 25 bp, Mus musculus
ggccattagtgaggaacttccctat

SEQ ID NO: 707991 - DNA, 25 bp, Mus musculus
ggccattagtgatgatgagctagca

SEQ ID NO: 707992 - DNA, 25 bp, Mus musculus
ggccattcaataacgcctgagtatc

SEQ ID NO: 707993 - DNA, 25 bp, Mus musculus
ggccattcaatatcgcctgagtatc

SEQ ID NO: 707994 - DNA, 25 bp, Mus musculus
ggccattcataaccccagtccgtgg

SEQ ID NO: 707995 - DNA, 25 bp, Mus musculus
ggccattcataagcccagtccgtgg

SEQ ID NO: 707996 - DNA, 25 bp, Mus musculus
ggccattcctgtccgccatggacga

SEQ ID NO: 707997 - DNA, 25 bp, Mus musculus
ggccattcctgtgcgccatggacga

SEQ ID NO: 707998 - DNA, 25 bp, Mus musculus
ggccattcctttaggcctgggtgct

SEQ ID NO: 707999 - DNA, 25 bp, Mus musculus
ggccattccttttggcctgggtgct

SEQ ID NO: 708000 - DNA, 25 bp, Mus musculus
ggccattcgaacaccacgctgtggt

SEQ ID NO: 708001 - DNA, 25 bp, Mus musculus
ggccattcgaactccacgctgtggt

SEQ ID NO: 708002 - DNA, 25 bp, Mus musculus
ggccattcgaccctcatagtggtgg

SEQ ID NO: 708003 - DNA, 25 bp, Mus musculus
ggccattcgaccgtcatagtggtgg

SEQ ID NO: 708004 - DNA, 25 bp, Mus musculus
ggccattctcttattaccaccagtt

SEQ ID NO: 708005 - DNA, 25 bp, Mus musculus
ggccattctctttttaccaccagtt

SEQ ID NO: 708006 - DNA, 25 bp, Mus musculus
ggccattgaagacccaggccctgga

SEQ ID NO: 708007 - DNA, 25 bp, Mus musculus
ggccattgaagagccaggccctgga

SEQ ID NO: 708008 - DNA, 25 bp, Mus musculus
ggccattgacctctaccaggcctgt

SEQ ID NO: 708009 - DNA, 25 bp, Mus musculus
ggccattgacctgtaccaggcctgt

SEQ ID NO: 708010 - DNA, 25 bp, Mus musculus
ggccattgcaggcaaccctctgggt

SEQ ID NO: 708011 - DNA, 25 bp, Mus musculus
ggccattgcagggaaccctctgggt

SEQ ID NO: 708012 - DNA, 25 bp, Mus musculus
ggccattggatacgtgagctccgat

SEQ ID NO: 708013 - DNA, 25 bp, Mus musculus
ggccattggataggtgagctccgat

SEQ ID NO: 708014 - DNA, 25 bp, Mus musculus
ggccattggccaacgaaactaccat

SEQ ID NO: 708015 - DNA, 25 bp, Mus musculus
ggccattggccatcgaaactaccat

SEQ ID NO: 708016 - DNA, 25 bp, Mus musculus
ggccattgtgccctcctcagggaag

SEQ ID NO: 708017 - DNA, 25 bp, Mus musculus
ggccattgtgccgtcctcagggaag

SEQ ID NO: 708018 - DNA, 25 bp, Mus musculus
ggccattgtggacaatctccgcacc

SEQ ID NO: 708019 - DNA, 25 bp, Mus musculus
ggccattgtggagaatctccgcacc

SEQ ID NO: 708020 - DNA, 25 bp, Mus musculus
ggccattgtggcagacatcctgttg

SEQ ID NO: 708021 - DNA, 25 bp, Mus musculus
ggccattgtggctgacatcctgttg

SEQ ID NO: 708022 - DNA, 25 bp, Mus musculus
ggccattgttttcaagaacacctgg

SEQ ID NO: 708023 - DNA, 25 bp, Mus musculus
ggccattgttttgaagaacacctgg

SEQ ID NO: 708024 - DNA, 25 bp, Mus musculus
ggccatttaatcacagctgtgcaga

SEQ ID NO: 708025 - DNA, 25 bp, Mus musculus
ggccatttaatctcagctgtgcaga

SEQ ID NO: 708026 - DNA, 25 bp, Mus musculus
ggccatttaggacgaatcagtcact

SEQ ID NO: 708027 - DNA, 25 bp, Mus musculus
ggccatttaggaggaatcagtcact

SEQ ID NO: 708028 - DNA, 25 bp, Mus musculus
ggccatttataccttgggctacagt

SEQ ID NO: 708029 - DNA, 25 bp, Mus musculus
ggccatttatacgttgggctacagt

SEQ ID NO: 708030 - DNA, 25 bp, Mus musculus
ggccatttcagaatcagacccatgc

SEQ ID NO: 708031 - DNA, 25 bp, Mus musculus
ggccatttcagattcagacccatgc

SEQ ID NO: 708032 - DNA, 25 bp, Mus musculus
ggccatttgaatacacttcagagca

SEQ ID NO: 708033 - DNA, 25 bp, Mus musculus
ggccatttgaattcacttcagagca

SEQ ID NO: 708034 - DNA, 25 bp, Mus musculus
ggccatttggcactggttgaactgc

SEQ ID NO: 708035 - DNA, 25 bp, Mus musculus
ggccatttggcagtggttgaactgc

SEQ ID NO: 708036 - DNA, 25 bp, Mus musculus
ggcccaaacccgagagagaccaact

SEQ ID NO: 708037 - DNA, 25 bp, Mus musculus
ggcccaaacccgtgagagaccaact

SEQ ID NO: 708038 - DNA, 25 bp, Mus musculus
ggcccaaagaagacgtaaggctaca

SEQ ID NO: 708039 - DNA, 25 bp, Mus musculus
ggcccaaagaagtcgtaaggctaca

SEQ ID NO: 708040 - DNA, 25 bp, Mus musculus
ggcccaaagtgtacatcaagaccag

SEQ ID NO: 708041 - DNA, 25 bp, Mus musculus
ggcccaaagtgttcatcaagaccag

SEQ ID NO: 708042 - DNA, 25 bp, Mus musculus
ggcccaaattgcattgtagtagtca

SEQ ID NO: 708043 - DNA, 25 bp, Mus musculus
ggcccaaattgctttgtagtagtca

SEQ ID NO: 708044 - DNA, 25 bp, Mus musculus
ggcccaacatctacatcctgaacaa

SEQ ID NO: 708045 - DNA, 25 bp, Mus musculus
ggcccaacatcttcatcctgaacaa

SEQ ID NO: 708046 - DNA, 25 bp, Mus musculus
ggcccaacgcataggctgatctgtt

SEQ ID NO: 708047 - DNA, 25 bp, Mus musculus
ggcccaacgcattggctgatctgtt

SEQ ID NO: 708048 - DNA, 25 bp, Mus musculus
ggcccaactgctcactcattcttgt

SEQ ID NO: 708049 - DNA, 25 bp, Mus musculus
ggcccaactgctgactcattcttgt

SEQ ID NO: 708050 - DNA, 25 bp, Mus musculus
ggcccaactgggaccgcaactttgt

SEQ ID NO: 708051 - DNA, 25 bp, Mus musculus
ggcccaactgggtccgcaactttgt

SEQ ID NO: 708052 - DNA, 25 bp, Mus musculus
ggcccaagagaaacaccagagctgt

SEQ ID NO: 708053 - DNA, 25 bp, Mus musculus
ggcccaagagaatcaccagagctgt

SEQ ID NO: 708054 - DNA, 25 bp, Mus musculus
ggcccaagagatagatcaaaccaat

SEQ ID NO: 708055 - DNA, 25 bp, Mus musculus
ggcccaagagattgatcaaaccaat

SEQ ID NO: 708056 - DNA, 25 bp, Mus musculus
ggcccaagcccgacgtgggcaaata

SEQ ID NO: 708057 - DNA, 25 bp, Mus musculus
ggcccaagcccgtcgtgggcaaata

SEQ ID NO: 708058 - DNA, 25 bp, Mus musculus
ggcccaaggcaccttcaaattacat

SEQ ID NO: 708059 - DNA, 25 bp, Mus musculus
ggcccaaggcacgttcaaattacat

SEQ ID NO: 708060 - DNA, 25 bp, Mus musculus
ggcccaagtagcagtgactactcag

SEQ ID NO: 708061 - DNA, 25 bp, Mus musculus
ggcccaagtagctgtgactactcag

SEQ ID NO: 708062 - DNA, 25 bp, Mus musculus
ggcccaatagtccaatttgttaaag

SEQ ID NO: 708063 - DNA, 25 bp, Mus musculus
ggcccaatagtcgaatttgttaaag

SEQ ID NO: 708064 - DNA, 25 bp, Mus musculus
ggcccacacagcatcgatgtgtcct

SEQ ID NO: 708065 - DNA, 25 bp, Mus musculus
ggcccacacagcttcgatgtgtcct

SEQ ID NO: 708066 - DNA, 25 bp, Mus musculus
ggcccacagactatgatttcctcaa

SEQ ID NO: 708067 - DNA, 25 bp, Mus musculus
ggcccacagactttgatttcctcaa

SEQ ID NO: 708068 - DNA, 25 bp, Mus musculus
ggcccacagctcatccctggatgat

SEQ ID NO: 708069 - DNA, 25 bp, Mus musculus
ggcccacagctcttccctggatgat

SEQ ID NO: 708070 - DNA, 25 bp, Mus musculus
ggcccacatgagagacatccgagat

SEQ ID NO: 708071 - DNA, 25 bp, Mus musculus
ggcccacatgagtgacatccgagat

SEQ ID NO: 708072 - DNA, 25 bp, Mus musculus
ggcccaccagctctgtagctctggg

SEQ ID NO: 708073 - DNA, 25 bp, Mus musculus
ggcccaccagctgtgtagctctggg

SEQ ID NO: 708074 - DNA, 25 bp, Mus musculus
ggcccaccatttcatttcagtttgg

SEQ ID NO: 708075 - DNA, 25 bp, Mus musculus
ggcccaccatttgatttcagtttgg

SEQ ID NO: 708076 - DNA, 25 bp, Mus musculus
ggcccacgaggacgtcatttactat

SEQ ID NO: 708077 - DNA, 25 bp, Mus musculus
ggcccacgaggaggtcatttactat

SEQ ID NO: 708078 - DNA, 25 bp, Mus musculus
ggcccacgcgctaggctaagtacag

SEQ ID NO: 708079 - DNA, 25 bp, Mus musculus
ggcccacgcgcttggctaagtacag

SEQ ID NO: 708080 - DNA, 25 bp, Mus musculus
ggcccacgctggagacgctgcgcaa

SEQ ID NO: 708081 - DNA, 25 bp, Mus musculus
ggcccacgctggtgacgctgcgcaa

SEQ ID NO: 708082 - DNA, 25 bp, Mus musculus
ggcccacggagcaatacagtgacat

SEQ ID NO: 708083 - DNA, 25 bp, Mus musculus
ggcccacggagctatacagtgacat

SEQ ID NO: 708084 - DNA, 25 bp, Mus musculus
ggcccacgggacagaatcgccttaa

SEQ ID NO: 708085 - DNA, 25 bp, Mus musculus
ggcccacgggactgaatcgccttaa

SEQ ID NO: 708086 - DNA, 25 bp, Mus musculus
ggcccacgggagaagagaaacctca

SEQ ID NO: 708087 - DNA, 25 bp, Mus musculus
ggcccacgggagtagagaaacctca

SEQ ID NO: 708088 - DNA, 25 bp, Mus musculus
ggcccacgttctaccggcaggagct

SEQ ID NO: 708089 - DNA, 25 bp, Mus musculus
ggcccacgttcttccggcaggagct

SEQ ID NO: 708090 - DNA, 25 bp, Mus musculus
ggcccactgtggcagcagcaatttc

SEQ ID NO: 708091 - DNA, 25 bp, Mus musculus
ggcccactgtgggagcagcaatttc

SEQ ID NO: 708092 - DNA, 25 bp, Mus musculus
ggcccactgttcaatggacttcaca

SEQ ID NO: 708093 - DNA, 25 bp, Mus musculus
ggcccactgttctatggacttcaca

SEQ ID NO: 708094 - DNA, 25 bp, Mus musculus
ggcccagaaatacccgccttggcgg

SEQ ID NO: 708095 - DNA, 25 bp, Mus musculus
ggcccagaaatagccgccttggcgg

SEQ ID NO: 708096 - DNA, 25 bp, Mus musculus
ggcccagaaggtaccctcatcattg

SEQ ID NO: 708097 - DNA, 25 bp, Mus musculus
ggcccagaaggttccctcatcattg

SEQ ID NO: 708098 - DNA, 25 bp, Mus musculus
ggcccagaccctaagatgataactt

SEQ ID NO: 708099 - DNA, 25 bp, Mus musculus
ggcccagacccttagatgataactt

SEQ ID NO: 708100 - DNA, 25 bp, Mus musculus
ggcccagacgtcactggtggttcag

SEQ ID NO: 708101 - DNA, 25 bp, Mus musculus
ggcccagacgtctctggtggttcag

SEQ ID NO: 708102 - DNA, 25 bp, Mus musculus
ggcccagacgtgaccttcgaatgct

SEQ ID NO: 708103 - DNA, 25 bp, Mus musculus
ggcccagacgtgtccttcgaatgct

SEQ ID NO: 708104 - DNA, 25 bp, Mus musculus
ggcccagatattacactgtcaaagc

SEQ ID NO: 708105 - DNA, 25 bp, Mus musculus
ggcccagatatttcactgtcaaagc

SEQ ID NO: 708106 - DNA, 25 bp, Mus musculus
ggcccagatcaacggtcctgtagat

SEQ ID NO: 708107 - DNA, 25 bp, Mus musculus
ggcccagatcaagggtcctgtagat

SEQ ID NO: 708108 - DNA, 25 bp, Mus musculus
ggcccagatgcccaagatgaacttc

SEQ ID NO: 708109 - DNA, 25 bp, Mus musculus
ggcccagatgccgaagatgaacttc

SEQ ID NO: 708110 - DNA, 25 bp, Mus musculus
ggcccagatggcaaaccaggaccct

SEQ ID NO: 708111 - DNA, 25 bp, Mus musculus
ggcccagatggctaaccaggaccct

SEQ ID NO: 708112 - DNA, 25 bp, Mus musculus
ggcccagcaccgagaccttgacgtg

SEQ ID NO: 708113 - DNA, 25 bp, Mus musculus
ggcccagcaccgtgaccttgacgtg

SEQ ID NO: 708114 - DNA, 25 bp, Mus musculus
ggcccagcagggagtcgtatttata

SEQ ID NO: 708115 - DNA, 25 bp, Mus musculus
ggcccagcagggtgtcgtatttata

SEQ ID NO: 708116 - DNA, 25 bp, Mus musculus
ggcccagcagtacctcatggataac

SEQ ID NO: 708117 - DNA, 25 bp, Mus musculus
ggcccagcagtagctcatggataac

SEQ ID NO: 708118 - DNA, 25 bp, Mus musculus
ggcccagccacgcaaaatagggaag

SEQ ID NO: 708119 - DNA, 25 bp, Mus musculus
ggcccagccacggaaaatagggaag

SEQ ID NO: 708120 - DNA, 25 bp, Mus musculus
ggcccagcctgactagacacttcag

SEQ ID NO: 708121 - DNA, 25 bp, Mus musculus
ggcccagcctgagtagacacttcag

SEQ ID NO: 708122 - DNA, 25 bp, Mus musculus
ggcccagctgatcatgcaggcagaa

SEQ ID NO: 708123 - DNA, 25 bp, Mus musculus
ggcccagctgatgatgcaggcagaa

SEQ ID NO: 708124 - DNA, 25 bp, Mus musculus
ggcccagctgcgaacattgcctctg

SEQ ID NO: 708125 - DNA, 25 bp, Mus musculus
ggcccagctgcgtacattgcctctg

SEQ ID NO: 708126 - DNA, 25 bp, Mus musculus
ggcccagcttctcctaccttgataa

SEQ ID NO: 708127 - DNA, 25 bp, Mus musculus
ggcccagcttctgctaccttgataa

SEQ ID NO: 708128 - DNA, 25 bp, Mus musculus
ggcccagcttgacatctacctggct

SEQ ID NO: 708129 - DNA, 25 bp, Mus musculus
ggcccagcttgagatctacctggct

SEQ ID NO: 708130 - DNA, 25 bp, Mus musculus
ggcccagcttgtcccaatgctttgg

SEQ ID NO: 708131 - DNA, 25 bp, Mus musculus
ggcccagcttgtgccaatgctttgg

SEQ ID NO: 708132 - DNA, 25 bp, Mus musculus
ggcccaggagcacggatggttgctt

SEQ ID NO: 708133 - DNA, 25 bp, Mus musculus
ggcccaggagcagggatggttgctt

SEQ ID NO: 708134 - DNA, 25 bp, Mus musculus
ggcccaggcagtattcaacaataca

SEQ ID NO: 708135 - DNA, 25 bp, Mus musculus
ggcccaggcagttttcaacaataca

SEQ ID NO: 708136 - DNA, 25 bp, Mus musculus
ggcccaggctctacaagaatacaat

SEQ ID NO: 708137 - DNA, 25 bp, Mus musculus
ggcccaggctcttcaagaatacaat

SEQ ID NO: 708138 - DNA, 25 bp, Mus musculus
ggcccagggcttcgcaaccgtagtc

SEQ ID NO: 708139 - DNA, 25 bp, Mus musculus
ggcccagggcttggcaaccgtagtc

SEQ ID NO: 708140 - DNA, 25 bp, Mus musculus
ggcccagtacccaaacatatcgcgt

SEQ ID NO: 708141 - DNA, 25 bp, Mus musculus
ggcccagtaccctaacatatcgcgt

SEQ ID NO: 708142 - DNA, 25 bp, Mus musculus
ggcccagtactgaaatccttattat

SEQ ID NO: 708143 - DNA, 25 bp, Mus musculus
ggcccagtactgtaatccttattat

SEQ ID NO: 708144 - DNA, 25 bp, Mus musculus
ggcccagtcgtaccaagaactgctg

SEQ ID NO: 708145 - DNA, 25 bp, Mus musculus
ggcccagtcgtagcaagaactgctg

SEQ ID NO: 708146 - DNA, 25 bp, Mus musculus
ggcccagtcttaccgttcagtggct

SEQ ID NO: 708147 - DNA, 25 bp, Mus musculus
ggcccagtcttagcgttcagtggct

SEQ ID NO: 708148 - DNA, 25 bp, Mus musculus
ggcccagtgaacctgtccaacaaat

SEQ ID NO: 708149 - DNA, 25 bp, Mus musculus
ggcccagtgaacgtgtccaacaaat

SEQ ID NO: 708150 - DNA, 25 bp, Mus musculus
ggcccagtgctgatcgttacctttc

SEQ ID NO: 708151 - DNA, 25 bp, Mus musculus
ggcccagtgctgttcgttacctttc

SEQ ID NO: 708152 - DNA, 25 bp, Mus musculus
ggcccagttgtgcagccaagtctaa

SEQ ID NO: 708153 - DNA, 25 bp, Mus musculus
ggcccagttgtggagccaagtctaa

SEQ ID NO: 708154 - DNA, 25 bp, Mus musculus
ggcccataaaacattgcctgatgtt

SEQ ID NO: 708155 - DNA, 25 bp, Mus musculus
ggcccataaaactttgcctgatgtt

SEQ ID NO: 708156 - DNA, 25 bp, Mus musculus
ggcccatatatgcattcaaaccgtg

SEQ ID NO: 708157 - DNA, 25 bp, Mus musculus
ggcccatatatggattcaaaccgtg

SEQ ID NO: 708158 - DNA, 25 bp, Mus musculus
ggcccatcaacgcacgtggcattct

SEQ ID NO: 708159 - DNA, 25 bp, Mus musculus
ggcccatcaacggacgtggcattct

SEQ ID NO: 708160 - DNA, 25 bp, Mus musculus
ggcccatcctgaaggagctccagac

SEQ ID NO: 708161 - DNA, 25 bp, Mus musculus
ggcccatcctgatggagctccagac

SEQ ID NO: 708162 - DNA, 25 bp, Mus musculus
ggcccatctgtcatagccctggagc

SEQ ID NO: 708163 - DNA, 25 bp, Mus musculus
ggcccatctgtcttagccctggagc

SEQ ID NO: 708164 - DNA, 25 bp, Mus musculus
ggcccatcttttactacacagggaa

SEQ ID NO: 708165 - DNA, 25 bp, Mus musculus
ggcccatctttttctacacagggaa

SEQ ID NO: 708166 - DNA, 25 bp, Mus musculus
ggcccatgaatcacatctaatgctg

SEQ ID NO: 708167 - DNA, 25 bp, Mus musculus
ggcccatgaatctcatctaatgctg

SEQ ID NO: 708168 - DNA, 25 bp, Mus musculus
ggcccatgctaactattttctttac

SEQ ID NO: 708169 - DNA, 25 bp, Mus musculus
ggcccatgctaagtattttctttac

SEQ ID NO: 708170 - DNA, 25 bp, Mus musculus
ggcccatggaagacaaaagagagca

SEQ ID NO: 708171 - DNA, 25 bp, Mus musculus
ggcccatggaagtcaaaagagagca

SEQ ID NO: 708172 - DNA, 25 bp, Mus musculus
ggcccatgggccagtcccagcggta

SEQ ID NO: 708173 - DNA, 25 bp, Mus musculus
ggcccatgggcctgtcccagcggta

SEQ ID NO: 708174 - DNA, 25 bp, Mus musculus
ggcccatgtcaacccacaggagaag

SEQ ID NO: 708175 - DNA, 25 bp, Mus musculus
ggcccatgtcaagccacaggagaag

SEQ ID NO: 708176 - DNA, 25 bp, Mus musculus
ggcccattaccaagacaactacgga

SEQ ID NO: 708177 - DNA, 25 bp, Mus musculus
ggcccattaccatgacaactacgga

SEQ ID NO: 708178 - DNA, 25 bp, Mus musculus
ggcccattctatcttcaccagtggt

SEQ ID NO: 708179 - DNA, 25 bp, Mus musculus
ggcccattctatgttcaccagtggt

SEQ ID NO: 708180 - DNA, 25 bp, Mus musculus
ggccccaaaggacatgacattttta

SEQ ID NO: 708181 - DNA, 25 bp, Mus musculus
ggccccaaaggagatgacattttta

SEQ ID NO: 708182 - DNA, 25 bp, Mus musculus
ggccccaacaagatccggcagaagt

SEQ ID NO: 708183 - DNA, 25 bp, Mus musculus
ggccccaacaagttccggcagaagt

SEQ ID NO: 708184 - DNA, 25 bp, Mus musculus
ggccccacacatagtctagaggtaa

SEQ ID NO: 708185 - DNA, 25 bp, Mus musculus
ggccccacacattgtctagaggtaa

SEQ ID NO: 708186 - DNA, 25 bp, Mus musculus
ggccccacagggaatagcaaataaa

SEQ ID NO: 708187 - DNA, 25 bp, Mus musculus
ggccccacagggtatagcaaataaa

SEQ ID NO: 708188 - DNA, 25 bp, Mus musculus
ggccccacagtgaaaccagctcttt

SEQ ID NO: 708189 - DNA, 25 bp, Mus musculus
ggccccacagtgtaaccagctcttt

SEQ ID NO: 708190 - DNA, 25 bp, Mus musculus
ggccccacggtgagaaatgtcgcct

SEQ ID NO: 708191 - DNA, 25 bp, Mus musculus
ggccccacggtgtgaaatgtcgcct

SEQ ID NO: 708192 - DNA, 25 bp, Mus musculus
ggccccactcatcccgtggaatgag

SEQ ID NO: 708193 - DNA, 25 bp, Mus musculus
ggccccactcatgccgtggaatgag

SEQ ID NO: 708194 - DNA, 25 bp, Mus musculus
ggccccagaacaaagcttgagaaaa

SEQ ID NO: 708195 - DNA, 25 bp, Mus musculus
ggccccagaacatagcttgagaaaa

SEQ ID NO: 708196 - DNA, 25 bp, Mus musculus
ggccccagagagcatcttcaacagc

SEQ ID NO: 708197 - DNA, 25 bp, Mus musculus
ggccccagagaggatcttcaacagc

SEQ ID NO: 708198 - DNA, 25 bp, Mus musculus
ggccccagagatactagtgcgcact

SEQ ID NO: 708199 - DNA, 25 bp, Mus musculus
ggccccagagattctagtgcgcact

SEQ ID NO: 708200 - DNA, 25 bp, Mus musculus
ggccccaggatgcaggtaaagcaat

SEQ ID NO: 708201 - DNA, 25 bp, Mus musculus
ggccccaggatggaggtaaagcaat

SEQ ID NO: 708202 - DNA, 25 bp, Mus musculus
ggccccaggtgtcctccagtgcaga

SEQ ID NO: 708203 - DNA, 25 bp, Mus musculus
ggccccaggtgtgctccagtgcaga

SEQ ID NO: 708204 - DNA, 25 bp, Mus musculus
ggccccagtttgctatcatctatta

SEQ ID NO: 708205 - DNA, 25 bp, Mus musculus
ggccccagtttggtatcatctatta

SEQ ID NO: 708206 - DNA, 25 bp, Mus musculus
ggccccataggactcatctcttaag

SEQ ID NO: 708207 - DNA, 25 bp, Mus musculus
ggccccataggagtcatctcttaag

SEQ ID NO: 708208 - DNA, 25 bp, Mus musculus
ggccccatgctgattgactttaata

SEQ ID NO: 708209 - DNA, 25 bp, Mus musculus
ggccccatgctgtttgactttaata

SEQ ID NO: 708210 - DNA, 25 bp, Mus musculus
ggccccatgggcaaatcaaatagat

SEQ ID NO: 708211 - DNA, 25 bp, Mus musculus
ggccccatgggctaatcaaatagat

SEQ ID NO: 708212 - DNA, 25 bp, Mus musculus
ggccccatgtatccggaatcaacca

SEQ ID NO: 708213 - DNA, 25 bp, Mus musculus
ggccccatgtatgcggaatcaacca

SEQ ID NO: 708214 - DNA, 25 bp, Mus musculus
ggccccattttaacacttgcacagt

SEQ ID NO: 708215 - DNA, 25 bp, Mus musculus
ggccccattttatcacttgcacagt

SEQ ID NO: 708216 - DNA, 25 bp, Mus musculus
ggccccgagtcaaagtctcgtcttt

SEQ ID NO: 708217 - DNA, 25 bp, Mus musculus
ggccccgagtcatagtctcgtcttt

SEQ ID NO: 708218 - DNA, 25 bp, Mus musculus
ggccccgcatggctgatgctgatta

SEQ ID NO: 708219 - DNA, 25 bp, Mus musculus
ggccccgcatgggtgatgctgatta

SEQ ID NO: 708220 - DNA, 25 bp, Mus musculus
ggccccgcgctaaggagttcctttg

SEQ ID NO: 708221 - DNA, 25 bp, Mus musculus
ggccccgcgctatggagttcctttg

SEQ ID NO: 708222 - DNA, 25 bp, Mus musculus
ggccccggattaatctgcctttgaa

SEQ ID NO: 708223 - DNA, 25 bp, Mus musculus
ggccccggattattctgcctttgaa

SEQ ID NO: 708224 - DNA, 25 bp, Mus musculus
ggccccggctcgatctcaactttga

SEQ ID NO: 708225 - DNA, 25 bp, Mus musculus
ggccccggctcgttctcaactttga

SEQ ID NO: 708226 - DNA, 25 bp, Mus musculus
ggccccgggaaacgcatctgtatga

SEQ ID NO: 708227 - DNA, 25 bp, Mus musculus
ggccccgggaaaggcatctgtatga

SEQ ID NO: 708228 - DNA, 25 bp, Mus musculus
ggccccgggatcatcgtactggact

SEQ ID NO: 708229 - DNA, 25 bp, Mus musculus
ggccccgggatcttcgtactggact

SEQ ID NO: 708230 - DNA, 25 bp, Mus musculus
ggccccgggccgagcgttctctgta

SEQ ID NO: 708231 - DNA, 25 bp, Mus musculus
ggccccgggccgtgcgttctctgta

SEQ ID NO: 708232 - DNA, 25 bp, Mus musculus
ggccccgtcatcctcggctggagat

SEQ ID NO: 708233 - DNA, 25 bp, Mus musculus
ggccccgtcatcgtcggctggagat

SEQ ID NO: 708234 - DNA, 25 bp, Mus musculus
ggccccgtgaggcttgtgcctcctg

SEQ ID NO: 708235 - DNA, 25 bp, Mus musculus
ggccccgtgagggttgtgcctcctg

SEQ ID NO: 708236 - DNA, 25 bp, Mus musculus
ggcccctagtcaccaggaaacaatg

SEQ ID NO: 708237 - DNA, 25 bp, Mus musculus
ggcccctagtcagcaggaaacaatg

SEQ ID NO: 708238 - DNA, 25 bp, Mus musculus
ggcccctctctcagcaagtgttaca

SEQ ID NO: 708239 - DNA, 25 bp, Mus musculus
ggcccctctctctgcaagtgttaca

SEQ ID NO: 708240 - DNA, 25 bp, Mus musculus
ggcccctgagaaaaccctgatgtcc

SEQ ID NO: 708241 - DNA, 25 bp, Mus musculus
ggcccctgagaataccctgatgtcc

SEQ ID NO: 708242 - DNA, 25 bp, Mus musculus
ggcccctgcactacagtggctacag

SEQ ID NO: 708243 - DNA, 25 bp, Mus musculus
ggcccctgcacttcagtggctacag

SEQ ID NO: 708244 - DNA, 25 bp, Mus musculus
ggcccctgcagtcactctgtccttg

SEQ ID NO: 708245 - DNA, 25 bp, Mus musculus
ggcccctgcagtgactctgtccttg

SEQ ID NO: 708246 - DNA, 25 bp, Mus musculus
ggcccctggaagctagagcttttac

SEQ ID NO: 708247 - DNA, 25 bp, Mus musculus
ggcccctggaaggtagagcttttac

SEQ ID NO: 708248 - DNA, 25 bp, Mus musculus
ggcccctggagcactgctgttagag

SEQ ID NO: 708249 - DNA, 25 bp, Mus musculus
ggcccctggagctctgctgttagag

SEQ ID NO: 708250 - DNA, 25 bp, Mus musculus
ggcccctggcttcctgccttatgaa

SEQ ID NO: 708251 - DNA, 25 bp, Mus musculus
ggcccctggcttgctgccttatgaa

SEQ ID NO: 708252 - DNA, 25 bp, Mus musculus
ggcccctgggctatgtgtagccttc

SEQ ID NO: 708253 - DNA, 25 bp, Mus musculus
ggcccctgggctttgtgtagccttc

SEQ ID NO: 708254 - DNA, 25 bp, Mus musculus
ggcccctggtccaggacctactgaa

SEQ ID NO: 708255 - DNA, 25 bp, Mus musculus
ggcccctggtcctggacctactgaa

SEQ ID NO: 708256 - DNA, 25 bp, Mus musculus
ggcccctgtacgagattgtggaatg

SEQ ID NO: 708257 - DNA, 25 bp, Mus musculus
ggcccctgtacgtgattgtggaatg

SEQ ID NO: 708258 - DNA, 25 bp, Mus musculus
ggccccttatcaagcccaagcgaag

SEQ ID NO: 708259 - DNA, 25 bp, Mus musculus
ggccccttatcatgcccaagcgaag

SEQ ID NO: 708260 - DNA, 25 bp, Mus musculus
ggccccttgattaatatccagaatt

SEQ ID NO: 708261 - DNA, 25 bp, Mus musculus
ggccccttgatttatatccagaatt

SEQ ID NO: 708262 - DNA, 25 bp, Mus musculus
ggcccgacagagacaatgacctccg

SEQ ID NO: 708263 - DNA, 25 bp, Mus musculus
ggcccgacagagtcaatgacctccg

SEQ ID NO: 708264 - DNA, 25 bp, Mus musculus
ggcccgactcataatccatttccga

SEQ ID NO: 708265 - DNA, 25 bp, Mus musculus
ggcccgactcattatccatttccga

SEQ ID NO: 708266 - DNA, 25 bp, Mus musculus
ggcccgactccaaggcggcttcgat

SEQ ID NO: 708267 - DNA, 25 bp, Mus musculus
ggcccgactccatggcggcttcgat

SEQ ID NO: 708268 - DNA, 25 bp, Mus musculus
ggcccgagaactatcatatctgcgt

SEQ ID NO: 708269 - DNA, 25 bp, Mus musculus
ggcccgagaactttcatatctgcgt

SEQ ID NO: 708270 - DNA, 25 bp, Mus musculus
ggcccgagatccagtgtgtgacaca

SEQ ID NO: 708271 - DNA, 25 bp, Mus musculus
ggcccgagatcctgtgtgtgacaca

SEQ ID NO: 708272 - DNA, 25 bp, Mus musculus
ggcccgaggaccaaaatctgcccaa

SEQ ID NO: 708273 - DNA, 25 bp, Mus musculus
ggcccgaggacctaaatctgcccaa

SEQ ID NO: 708274 - DNA, 25 bp, Mus musculus
ggcccgatgcagagggtgacccctc

SEQ ID NO: 708275 - DNA, 25 bp, Mus musculus
ggcccgatgcagtgggtgacccctc

SEQ ID NO: 708276 - DNA, 25 bp, Mus musculus
ggcccgcagcgaccatttaactgca

SEQ ID NO: 708277 - DNA, 25 bp, Mus musculus
ggcccgcagcgagcatttaactgca

SEQ ID NO: 708278 - DNA, 25 bp, Mus musculus
ggcccgcagtatactcaacaacaag

SEQ ID NO: 708279 - DNA, 25 bp, Mus musculus
ggcccgcagtattctcaacaacaag

SEQ ID NO: 708280 - DNA, 25 bp, Mus musculus
ggcccgcatcccagcaaattttgta

SEQ ID NO: 708281 - DNA, 25 bp, Mus musculus
ggcccgcatccctgcaaattttgta

SEQ ID NO: 708282 - DNA, 25 bp, Mus musculus
ggcccgcgatccagtgtttgcagcg

SEQ ID NO: 708283 - DNA, 25 bp, Mus musculus
ggcccgcgatcctgtgtttgcagcg

SEQ ID NO: 708284 - DNA, 25 bp, Mus musculus
ggcccgctgctgcatcgtgtcttta

SEQ ID NO: 708285 - DNA, 25 bp, Mus musculus
ggcccgctgctggatcgtgtcttta

SEQ ID NO: 708286 - DNA, 25 bp, Mus musculus
ggcccggaccctataccctattcat

SEQ ID NO: 708287 - DNA, 25 bp, Mus musculus
ggcccggaccctttaccctattcat

SEQ ID NO: 708288 - DNA, 25 bp, Mus musculus
ggcccggagcttctctgagaccaca

SEQ ID NO: 708289 - DNA, 25 bp, Mus musculus
ggcccggagcttgtctgagaccaca

SEQ ID NO: 708290 - DNA, 25 bp, Mus musculus
ggcccggagtttctgcgcaagcata

SEQ ID NO: 708291 - DNA, 25 bp, Mus musculus
ggcccggagtttgtgcgcaagcata

SEQ ID NO: 708292 - DNA, 25 bp, Mus musculus
ggcccggcaactacgagagtaccag

SEQ ID NO: 708293 - DNA, 25 bp, Mus musculus
ggcccggcaacttcgagagtaccag

SEQ ID NO: 708294 - DNA, 25 bp, Mus musculus
ggcccggctcttaaccaaggtgcag

SEQ ID NO: 708295 - DNA, 25 bp, Mus musculus
ggcccggctctttaccaaggtgcag

SEQ ID NO: 708296 - DNA, 25 bp, Mus musculus
ggcccggctgctcgtagtcgatcct

SEQ ID NO: 708297 - DNA, 25 bp, Mus musculus
ggcccggctgctggtagtcgatcct

SEQ ID NO: 708298 - DNA, 25 bp, Mus musculus
ggcccggctggaacagaaacagccc

SEQ ID NO: 708299 - DNA, 25 bp, Mus musculus
ggcccggctggatcagaaacagccc

SEQ ID NO: 708300 - DNA, 25 bp, Mus musculus
ggcccgggaaccagaggccttgcaa

SEQ ID NO: 708301 - DNA, 25 bp, Mus musculus
ggcccgggaacctgaggccttgcaa

SEQ ID NO: 708302 - DNA, 25 bp, Mus musculus
ggcccgggccatctctgatccttag

SEQ ID NO: 708303 - DNA, 25 bp, Mus musculus
ggcccgggccatgtctgatccttag

SEQ ID NO: 708304 - DNA, 25 bp, Mus musculus
ggcccggtcatgctgcagatctcta

SEQ ID NO: 708305 - DNA, 25 bp, Mus musculus
ggcccggtcatggtgcagatctcta

SEQ ID NO: 708306 - DNA, 25 bp, Mus musculus
ggcccggttgctaggacttggataa

SEQ ID NO: 708307 - DNA, 25 bp, Mus musculus
ggcccggttgcttggacttggataa

SEQ ID NO: 708308 - DNA, 25 bp, Mus musculus
ggcccgtcaagcaccatctctttgg

SEQ ID NO: 708309 - DNA, 25 bp, Mus musculus
ggcccgtcaagctccatctctttgg

SEQ ID NO: 708310 - DNA, 25 bp, Mus musculus
ggcccgtgatccatactgcgcctgg

SEQ ID NO: 708311 - DNA, 25 bp, Mus musculus
ggcccgtgatccttactgcgcctgg

SEQ ID NO: 708312 - DNA, 25 bp, Mus musculus
ggcccgtgcatcctgttcaggcaag

SEQ ID NO: 708313 - DNA, 25 bp, Mus musculus
ggcccgtgcatcgtgttcaggcaag

SEQ ID NO: 708314 - DNA, 25 bp, Mus musculus
ggcccgtggacaactacccttcgag

SEQ ID NO: 708315 - DNA, 25 bp, Mus musculus
ggcccgtggacatctacccttcgag

SEQ ID NO: 708316 - DNA, 25 bp, Mus musculus
ggcccgtggcatcgctctctatgag

SEQ ID NO: 708317 - DNA, 25 bp, Mus musculus
ggcccgtggcatggctctctatgag

SEQ ID NO: 708318 - DNA, 25 bp, Mus musculus
ggcccgtgggtgaacatcttcatgg

SEQ ID NO: 708319 - DNA, 25 bp, Mus musculus
ggcccgtgggtgtacatcttcatgg

SEQ ID NO: 708320 - DNA, 25 bp, Mus musculus
ggcccgtgtcctcgagagcttcaga

SEQ ID NO: 708321 - DNA, 25 bp, Mus musculus
ggcccgtgtcctggagagcttcaga

SEQ ID NO: 708322 - DNA, 25 bp, Mus musculus
ggcccgtgtgacacggcggttcatc

SEQ ID NO: 708323 - DNA, 25 bp, Mus musculus
ggcccgtgtgactcggcggttcatc

SEQ ID NO: 708324 - DNA, 25 bp, Mus musculus
ggcccgtgttgcagcggtccctctt

SEQ ID NO: 708325 - DNA, 25 bp, Mus musculus
ggcccgtgttgctgcggtccctctt

SEQ ID NO: 708326 - DNA, 25 bp, Mus musculus
ggcccgttctctactgcagatcatt

SEQ ID NO: 708327 - DNA, 25 bp, Mus musculus
ggcccgttctcttctgcagatcatt

SEQ ID NO: 708328 - DNA, 25 bp, Mus musculus
ggccctaatcctctccacaaagtag

SEQ ID NO: 708329 - DNA, 25 bp, Mus musculus
ggccctaatcctgtccacaaagtag

SEQ ID NO: 708330 - DNA, 25 bp, Mus musculus
ggccctaattacacctccggttatg

SEQ ID NO: 708331 - DNA, 25 bp, Mus musculus
ggccctaattactcctccggttatg

SEQ ID NO: 708332 - DNA, 25 bp, Mus musculus
ggccctacagaaacagatggactcc

SEQ ID NO: 708333 - DNA, 25 bp, Mus musculus
ggccctacagaatcagatggactcc

SEQ ID NO: 708334 - DNA, 25 bp, Mus musculus
ggccctactaggagctggcttgcta

SEQ ID NO: 708335 - DNA, 25 bp, Mus musculus
ggccctactaggtgctggcttgcta

SEQ ID NO: 708336 - DNA, 25 bp, Mus musculus
ggccctagaaatatctcaccagtgg

SEQ ID NO: 708337 - DNA, 25 bp, Mus musculus
ggccctagaaatttctcaccagtgg

SEQ ID NO: 708338 - DNA, 25 bp, Mus musculus
ggccctagacaacaagattgagcag

SEQ ID NO: 708339 - DNA, 25 bp, Mus musculus
ggccctagacaagaagattgagcag

SEQ ID NO: 708340 - DNA, 25 bp, Mus musculus
ggccctagcctgcatggacgagaat

SEQ ID NO: 708341 - DNA, 25 bp, Mus musculus
ggccctagcctggatggacgagaat

SEQ ID NO: 708342 - DNA, 25 bp, Mus musculus
ggccctatcacactcagaggctgag

SEQ ID NO: 708343 - DNA, 25 bp, Mus musculus
ggccctatcacagtcagaggctgag

SEQ ID NO: 708344 - DNA, 25 bp, Mus musculus
ggccctcagaaacctgcagctgtca

SEQ ID NO: 708345 - DNA, 25 bp, Mus musculus
ggccctcagaaactccctcagaaaa

SEQ ID NO: 708346 - DNA, 25 bp, Mus musculus
ggccctcagaaagctgcagctgtca

SEQ ID NO: 708347 - DNA, 25 bp, Mus musculus
ggccctcagaaagtccctcagaaaa

SEQ ID NO: 708348 - DNA, 25 bp, Mus musculus
ggccctcagaggacgacatgctgga

SEQ ID NO: 708349 - DNA, 25 bp, Mus musculus
ggccctcagaggtcgacatgctgga

SEQ ID NO: 708350 - DNA, 25 bp, Mus musculus
ggccctcagtaacatgaaactgcag

SEQ ID NO: 708351 - DNA, 25 bp, Mus musculus
ggccctcagtaagatgaaactgcag

SEQ ID NO: 708352 - DNA, 25 bp, Mus musculus
ggccctcagtatccagtgctgccag

SEQ ID NO: 708353 - DNA, 25 bp, Mus musculus
ggccctcagtatgcagtgctgccag

SEQ ID NO: 708354 - DNA, 25 bp, Mus musculus
ggccctcagtgcctacgacatggtg

SEQ ID NO: 708355 - DNA, 25 bp, Mus musculus
ggccctcagtgcgtacgacatggtg

SEQ ID NO: 708356 - DNA, 25 bp, Mus musculus
ggccctcatacaccttcaagtttct

SEQ ID NO: 708357 - DNA, 25 bp, Mus musculus
ggccctcatacagcttcaagtttct

SEQ ID NO: 708358 - DNA, 25 bp, Mus musculus
ggccctcatgctctgttaccttggt

SEQ ID NO: 708359 - DNA, 25 bp, Mus musculus
ggccctcatgctgtgttaccttggt

SEQ ID NO: 708360 - DNA, 25 bp, Mus musculus
ggccctcatggactgcatgaacaag

SEQ ID NO: 708361 - DNA, 25 bp, Mus musculus
ggccctcatggagtgcatgaacaag

SEQ ID NO: 708362 - DNA, 25 bp, Mus musculus
ggccctcattgacccttttgacctg

SEQ ID NO: 708363 - DNA, 25 bp, Mus musculus
ggccctcattgagccttttgacctg

SEQ ID NO: 708364 - DNA, 25 bp, Mus musculus
ggccctcattggaagctgcccagat

SEQ ID NO: 708365 - DNA, 25 bp, Mus musculus
ggccctcattggtagctgcccagat

SEQ ID NO: 708366 - DNA, 25 bp, Mus musculus
ggccctccatcgaggacggcatcgg

SEQ ID NO: 708367 - DNA, 25 bp, Mus musculus
ggccctccatcgtggacggcatcgg

SEQ ID NO: 708368 - DNA, 25 bp, Mus musculus
ggccctcccatgaataatcctgttt

SEQ ID NO: 708369 - DNA, 25 bp, Mus musculus
ggccctcccatgtataatcctgttt

SEQ ID NO: 708370 - DNA, 25 bp, Mus musculus
ggccctcctcggatggtgctataaa

SEQ ID NO: 708371 - DNA, 25 bp, Mus musculus
ggccctcctcggttggtgctataaa

SEQ ID NO: 708372 - DNA, 25 bp, Mus musculus
ggccctcctgcaacaacagtgcgaa

SEQ ID NO: 708373 - DNA, 25 bp, Mus musculus
ggccctcctgcatcaacagtgcgaa

SEQ ID NO: 708374 - DNA, 25 bp, Mus musculus
ggccctcctggaacctgaaccaggt

SEQ ID NO: 708375 - DNA, 25 bp, Mus musculus
ggccctcctggatcctgaaccaggt

SEQ ID NO: 708376 - DNA, 25 bp, Mus musculus
ggccctctaaagctctgctgctgtt

SEQ ID NO: 708377 - DNA, 25 bp, Mus musculus
ggccctctaaaggtctgctgctgtt

SEQ ID NO: 708378 - DNA, 25 bp, Mus musculus
ggccctctacctctcagatgcagaa

SEQ ID NO: 708379 - DNA, 25 bp, Mus musculus
ggccctctacctgtcagatgcagaa

SEQ ID NO: 708380 - DNA, 25 bp, Mus musculus
ggccctctctgtacgtgtacccgga

SEQ ID NO: 708381 - DNA, 25 bp, Mus musculus
ggccctctctgttcgtgtacccgga

SEQ ID NO: 708382 - DNA, 25 bp, Mus musculus
ggccctctctttcatgggaatgagt

SEQ ID NO: 708383 - DNA, 25 bp, Mus musculus
ggccctctctttgatgggaatgagt

SEQ ID NO: 708384 - DNA, 25 bp, Mus musculus
ggccctcttagacttggcgtcctac

SEQ ID NO: 708385 - DNA, 25 bp, Mus musculus
ggccctcttagagttggcgtcctac

SEQ ID NO: 708386 - DNA, 25 bp, Mus musculus
ggccctcttccgactggtggagcta

SEQ ID NO: 708387 - DNA, 25 bp, Mus musculus
ggccctcttccgtctggtggagcta

SEQ ID NO: 708388 - DNA, 25 bp, Mus musculus
ggccctgaaccgcttctgggattac

SEQ ID NO: 708389 - DNA, 25 bp, Mus musculus
ggccctgaaccggttctgggattac

SEQ ID NO: 708390 - DNA, 25 bp, Mus musculus
ggccctgaacctacatggcatgata

SEQ ID NO: 708391 - DNA, 25 bp, Mus musculus
ggccctgaaccttcatggcatgata

SEQ ID NO: 708392 - DNA, 25 bp, Mus musculus
ggccctgaatgcaacatatatcttc

SEQ ID NO: 708393 - DNA, 25 bp, Mus musculus
ggccctgaatgctacatatatcttc

SEQ ID NO: 708394 - DNA, 25 bp, Mus musculus
ggccctgagcttactgctgccctag

SEQ ID NO: 708395 - DNA, 25 bp, Mus musculus
ggccctgagctttctgctgccctag

SEQ ID NO: 708396 - DNA, 25 bp, Mus musculus
ggccctgatcttcattactctcctg

SEQ ID NO: 708397 - DNA, 25 bp, Mus musculus
ggccctgatcttgattactctcctg

SEQ ID NO: 708398 - DNA, 25 bp, Mus musculus
ggccctgatgctcatatcctagtcg

SEQ ID NO: 708399 - DNA, 25 bp, Mus musculus
ggccctgatgctgatatcctagtcg

SEQ ID NO: 708400 - DNA, 25 bp, Mus musculus
ggccctgattgtcgcctatcagcgg

SEQ ID NO: 708401 - DNA, 25 bp, Mus musculus
ggccctgattgtggcctatcagcgg

SEQ ID NO: 708402 - DNA, 25 bp, Mus musculus
ggccctgcaggaagcgtactgagca

SEQ ID NO: 708403 - DNA, 25 bp, Mus musculus
ggccctgcaggatgcgtactgagca

SEQ ID NO: 708404 - DNA, 25 bp, Mus musculus
ggccctgctgcgagagacccagaag

SEQ ID NO: 708405 - DNA, 25 bp, Mus musculus
ggccctgctgcgtgagacccagaag

SEQ ID NO: 708406 - DNA, 25 bp, Mus musculus
ggccctgcttgcaagggaggccacc

SEQ ID NO: 708407 - DNA, 25 bp, Mus musculus
ggccctgcttgctagggaggccacc

SEQ ID NO: 708408 - DNA, 25 bp, Mus musculus
ggccctggagataattccacgacag

SEQ ID NO: 708409 - DNA, 25 bp, Mus musculus
ggccctggagattattccacgacag

SEQ ID NO: 708410 - DNA, 25 bp, Mus musculus
ggccctggagccattttccgctata

SEQ ID NO: 708411 - DNA, 25 bp, Mus musculus
ggccctggagcctttttccgctata

SEQ ID NO: 708412 - DNA, 25 bp, Mus musculus
ggccctggatctaatatcatgaact

SEQ ID NO: 708413 - DNA, 25 bp, Mus musculus
ggccctggatcttatatcatgaact

SEQ ID NO: 708414 - DNA, 25 bp, Mus musculus
ggccctggatgaactcgcttcactt

SEQ ID NO: 708415 - DNA, 25 bp, Mus musculus
ggccctggatgatctcgcttcactt

SEQ ID NO: 708416 - DNA, 25 bp, Mus musculus
ggccctgggctgactacgacaattt

SEQ ID NO: 708417 - DNA, 25 bp, Mus musculus
ggccctgggctgtctacgacaattt

SEQ ID NO: 708418 - DNA, 25 bp, Mus musculus
ggccctggtagtcttttcattcaag

SEQ ID NO: 708419 - DNA, 25 bp, Mus musculus
ggccctggtagtgttttcattcaag

SEQ ID NO: 708420 - DNA, 25 bp, Mus musculus
ggccctggtggcagcagccaagtct

SEQ ID NO: 708421 - DNA, 25 bp, Mus musculus
ggccctggtggctgcagccaagtct

SEQ ID NO: 708422 - DNA, 25 bp, Mus musculus
ggccctgtacgtctaccagcgaggt

SEQ ID NO: 708423 - DNA, 25 bp, Mus musculus
ggccctgtacgtgtaccagcgaggt

SEQ ID NO: 708424 - DNA, 25 bp, Mus musculus
ggccctgtagccacggtttggttcg

SEQ ID NO: 708425 - DNA, 25 bp, Mus musculus
ggccctgtagcctcggtttggttcg

SEQ ID NO: 708426 - DNA, 25 bp, Mus musculus
ggccctgtattgaccctctgctgta

SEQ ID NO: 708427 - DNA, 25 bp, Mus musculus
ggccctgtattgtccctctgctgta

SEQ ID NO: 708428 - DNA, 25 bp, Mus musculus
ggccctgtcctgctggaagatacct

SEQ ID NO: 708429 - DNA, 25 bp, Mus musculus
ggccctgtcctggtggaagatacct

SEQ ID NO: 708430 - DNA, 25 bp, Mus musculus
ggccctgtttgcaggtgacattgaa

SEQ ID NO: 708431 - DNA, 25 bp, Mus musculus
ggccctgtttgctggtgacattgaa

SEQ ID NO: 708432 - DNA, 25 bp, Mus musculus
ggcccttacacaagtgtctctctgc

SEQ ID NO: 708433 - DNA, 25 bp, Mus musculus
ggcccttacacatgtgtctctctgc

SEQ ID NO: 708434 - DNA, 25 bp, Mus musculus
ggcccttagggcaggtacacttgta

SEQ ID NO: 708435 - DNA, 25 bp, Mus musculus
ggcccttagggctggtacacttgta

SEQ ID NO: 708436 - DNA, 25 bp, Mus musculus
ggcccttcagctagggatgcttgcc

SEQ ID NO: 708437 - DNA, 25 bp, Mus musculus
ggcccttcagcttgggatgcttgcc

SEQ ID NO: 708438 - DNA, 25 bp, Mus musculus
ggcccttctgggaacaactagttat

SEQ ID NO: 708439 - DNA, 25 bp, Mus musculus
ggcccttctgggtacaactagttat

SEQ ID NO: 708440 - DNA, 25 bp, Mus musculus
ggcccttggcaaagttcggactgtg

SEQ ID NO: 708441 - DNA, 25 bp, Mus musculus
ggcccttggcaatgttcggactgtg

SEQ ID NO: 708442 - DNA, 25 bp, Mus musculus
ggcccttggcctactctaaattacg

SEQ ID NO: 708443 - DNA, 25 bp, Mus musculus
ggcccttggccttctctaaattacg

SEQ ID NO: 708444 - DNA, 25 bp, Mus musculus
ggcccttgggatataattttcagca

SEQ ID NO: 708445 - DNA, 25 bp, Mus musculus
ggcccttgggatttaattttcagca

SEQ ID NO: 708446 - DNA, 25 bp, Mus musculus
ggcccttgggctaaagaggcactcc

SEQ ID NO: 708447 - DNA, 25 bp, Mus musculus
ggcccttgggcttaagaggcactcc

SEQ ID NO: 708448 - DNA, 25 bp, Mus musculus
ggcccttgtgagcacagaacacagt

SEQ ID NO: 708449 - DNA, 25 bp, Mus musculus
ggcccttgtgaggacagaacacagt

SEQ ID NO: 708450 - DNA, 25 bp, Mus musculus
ggccctttatccaatgcaccagcag

SEQ ID NO: 708451 - DNA, 25 bp, Mus musculus
ggccctttatcctatgcaccagcag

SEQ ID NO: 708452 - DNA, 25 bp, Mus musculus
ggccctttgaagacattcagttctg

SEQ ID NO: 708453 - DNA, 25 bp, Mus musculus
ggccctttgaagtcattcagttctg

SEQ ID NO: 708454 - DNA, 25 bp, Mus musculus
ggccctttgaggcttcctcgcatgg

SEQ ID NO: 708455 - DNA, 25 bp, Mus musculus
ggccctttgagggttcctcgcatgg

SEQ ID NO: 708456 - DNA, 25 bp, Mus musculus
ggccctttggcactctggtctacac

SEQ ID NO: 708457 - DNA, 25 bp, Mus musculus
ggccctttggcagtctggtctacac

SEQ ID NO: 708458 - DNA, 25 bp, Mus musculus
ggccctttggctccgtcgtagaacg

SEQ ID NO: 708459 - DNA, 25 bp, Mus musculus
ggccctttggctgcgtcgtagaacg

SEQ ID NO: 708460 - DNA, 25 bp, Mus musculus
ggccctttgttacgctgaactgggt

SEQ ID NO: 708461 - DNA, 25 bp, Mus musculus
ggccctttgttaggctgaactgggt

SEQ ID NO: 708462 - DNA, 25 bp, Mus musculus
ggcccttttcgtaggctgcagtata

SEQ ID NO: 708463 - DNA, 25 bp, Mus musculus
ggcccttttcgttggctgcagtata

SEQ ID NO: 708464 - DNA, 25 bp, Mus musculus
ggccgaagatgcaggtacccataga

SEQ ID NO: 708465 - DNA, 25 bp, Mus musculus
ggccgaagatgctggtacccataga

SEQ ID NO: 708466 - DNA, 25 bp, Mus musculus
ggccgaagcattctatactcctgtg

SEQ ID NO: 708467 - DNA, 25 bp, Mus musculus
ggccgaagcattgtatactcctgtg

SEQ ID NO: 708468 - DNA, 25 bp, Mus musculus
ggccgaaggtacaccgagtaccgct

SEQ ID NO: 708469 - DNA, 25 bp, Mus musculus
ggccgaaggtactccgagtaccgct

SEQ ID NO: 708470 - DNA, 25 bp, Mus musculus
ggccgacaggatacgttggctaccg

SEQ ID NO: 708471 - DNA, 25 bp, Mus musculus
ggccgacaggattcgttggctaccg

SEQ ID NO: 708472 - DNA, 25 bp, Mus musculus
ggccgacagtaccaccaaatgacag

SEQ ID NO: 708473 - DNA, 25 bp, Mus musculus
ggccgacagtacgaccaaatgacag

SEQ ID NO: 708474 - DNA, 25 bp, Mus musculus
ggccgaccaagtatgacatctatga

SEQ ID NO: 708475 - DNA, 25 bp, Mus musculus
ggccgaccaagtttgacatctatga

SEQ ID NO: 708476 - DNA, 25 bp, Mus musculus
ggccgaccggatcaaggcgttttat

SEQ ID NO: 708477 - DNA, 25 bp, Mus musculus
ggccgaccggatgaaggcgttttat

SEQ ID NO: 708478 - DNA, 25 bp, Mus musculus
ggccgactctggaggtcagccacag

SEQ ID NO: 708479 - DNA, 25 bp, Mus musculus
ggccgactctggtggtcagccacag

SEQ ID NO: 708480 - DNA, 25 bp, Mus musculus
ggccgacttcaacaacgtgctcagc

SEQ ID NO: 708481 - DNA, 25 bp, Mus musculus
ggccgacttcaagaacgtgctcagc

SEQ ID NO: 708482 - DNA, 25 bp, Mus musculus
ggccgacttcatccccatcagattg

SEQ ID NO: 708483 - DNA, 25 bp, Mus musculus
ggccgacttcatgcccatcagattg

SEQ ID NO: 708484 - DNA, 25 bp, Mus musculus
ggccgagagtgtcggcctctacctc

SEQ ID NO: 708485 - DNA, 25 bp, Mus musculus
ggccgagagtgtgggcctctacctc

SEQ ID NO: 708486 - DNA, 25 bp, Mus musculus
ggccgagatggactactgagtccca

SEQ ID NO: 708487 - DNA, 25 bp, Mus musculus
ggccgagatggagtactgagtccca

SEQ ID NO: 708488 - DNA, 25 bp, Mus musculus
ggccgagattcgaaagctcaagttt

SEQ ID NO: 708489 - DNA, 25 bp, Mus musculus
ggccgagattcgtaagctcaagttt

SEQ ID NO: 708490 - DNA, 25 bp, Mus musculus
ggccgagcaactcaagaaccaaatt

SEQ ID NO: 708491 - DNA, 25 bp, Mus musculus
ggccgagcaactgaagaaccaaatt

SEQ ID NO: 708492 - DNA, 25 bp, Mus musculus
ggccgagcagataatccaggagatt

SEQ ID NO: 708493 - DNA, 25 bp, Mus musculus
ggccgagcagattatccaggagatt

SEQ ID NO: 708494 - DNA, 25 bp, Mus musculus
ggccgagccttgaggacaccaccaa

SEQ ID NO: 708495 - DNA, 25 bp, Mus musculus
ggccgagccttgtggacaccaccaa

SEQ ID NO: 708496 - DNA, 25 bp, Mus musculus
ggccgagcgcggctccatgttttcc

SEQ ID NO: 708497 - DNA, 25 bp, Mus musculus
ggccgagcgcgggtccatgttttcc

SEQ ID NO: 708498 - DNA, 25 bp, Mus musculus
ggccgaggaatacaaataggtctga

SEQ ID NO: 708499 - DNA, 25 bp, Mus musculus
ggccgaggaatagaaataggtctga

SEQ ID NO: 708500 - DNA, 25 bp, Mus musculus
ggccgaggacagcttccatctcctt

SEQ ID NO: 708501 - DNA, 25 bp, Mus musculus
ggccgaggacaggttccatctcctt

SEQ ID NO: 708502 - DNA, 25 bp, Mus musculus
ggccgaggcgcaaaccccgtctttt

SEQ ID NO: 708503 - DNA, 25 bp, Mus musculus
ggccgaggcgcataccccgtctttt

SEQ ID NO: 708504 - DNA, 25 bp, Mus musculus
ggccgagggctcattgacatggttc

SEQ ID NO: 708505 - DNA, 25 bp, Mus musculus
ggccgagggctctttgacatggttc

SEQ ID NO: 708506 - DNA, 25 bp, Mus musculus
ggccgaggttttcttctttatccag

SEQ ID NO: 708507 - DNA, 25 bp, Mus musculus
ggccgaggttttgttctttatccag

SEQ ID NO: 708508 - DNA, 25 bp, Mus musculus
ggccgagtgtttctcctaccctgca

SEQ ID NO: 708509 - DNA, 25 bp, Mus musculus
ggccgagtgtttgtcctaccctgca

SEQ ID NO: 708510 - DNA, 25 bp, Mus musculus
ggccgatataatccccgccgcagtc

SEQ ID NO: 708511 - DNA, 25 bp, Mus musculus
ggccgatataatgcccgccgcagtc

SEQ ID NO: 708512 - DNA, 25 bp, Mus musculus
ggccgatgccaaattggtattgcag

SEQ ID NO: 708513 - DNA, 25 bp, Mus musculus
ggccgatgccaatttggtattgcag

SEQ ID NO: 708514 - DNA, 25 bp, Mus musculus
ggccgatgtggtagcaaatgatgca

SEQ ID NO: 708515 - DNA, 25 bp, Mus musculus
ggccgatgtggttgcaaatgatgca

SEQ ID NO: 708516 - DNA, 25 bp, Mus musculus
ggccgcaagcttagctcacatctct

SEQ ID NO: 708517 - DNA, 25 bp, Mus musculus
ggccgcaagcttcttatcatcggga

SEQ ID NO: 708518 - DNA, 25 bp, Mus musculus
ggccgcaagcttgttatcatcggga

SEQ ID NO: 708519 - DNA, 25 bp, Mus musculus
ggccgcaagctttgctcacatctct

SEQ ID NO: 708520 - DNA, 25 bp, Mus musculus
ggccgcacgagcattgacaggaaca

SEQ ID NO: 708521 - DNA, 25 bp, Mus musculus
ggccgcacgagctttgacaggaaca

SEQ ID NO: 708522 - DNA, 25 bp, Mus musculus
ggccgcacgggcagcagtgatcacc

SEQ ID NO: 708523 - DNA, 25 bp, Mus musculus
ggccgcacgggctgcagtgatcacc

SEQ ID NO: 708524 - DNA, 25 bp, Mus musculus
ggccgcacttctaggctatctgtaa

SEQ ID NO: 708525 - DNA, 25 bp, Mus musculus
ggccgcacttcttggctatctgtaa

SEQ ID NO: 708526 - DNA, 25 bp, Mus musculus
ggccgcattgacaaggcctacccga

SEQ ID NO: 708527 - DNA, 25 bp, Mus musculus
ggccgcattgactaggcctacccga

SEQ ID NO: 708528 - DNA, 25 bp, Mus musculus
ggccgccaagaactataacatgcga

SEQ ID NO: 708529 - DNA, 25 bp, Mus musculus
ggccgccaagaagtataacatgcga

SEQ ID NO: 708530 - DNA, 25 bp, Mus musculus
ggccgccattctaggtgataagaca

SEQ ID NO: 708531 - DNA, 25 bp, Mus musculus
ggccgccattcttggtgataagaca

SEQ ID NO: 708532 - DNA, 25 bp, Mus musculus
ggccgcccagccagtactaaatgct

SEQ ID NO: 708533 - DNA, 25 bp, Mus musculus
ggccgcccagcctgtactaaatgct

SEQ ID NO: 708534 - DNA, 25 bp, Mus musculus
ggccgcctacctctatctttggcag

SEQ ID NO: 708535 - DNA, 25 bp, Mus musculus
ggccgcctacctgtatctttggcag

SEQ ID NO: 708536 - DNA, 25 bp, Mus musculus
ggccgcctccccattgcttggcttg

SEQ ID NO: 708537 - DNA, 25 bp, Mus musculus
ggccgcctcccctttgcttggcttg

SEQ ID NO: 708538 - DNA, 25 bp, Mus musculus
ggccgcgagagcagctgactacgtc

SEQ ID NO: 708539 - DNA, 25 bp, Mus musculus
ggccgcgagagctgctgactacgtc

SEQ ID NO: 708540 - DNA, 25 bp, Mus musculus
ggccgcgagatcaccaggtccttct

SEQ ID NO: 708541 - DNA, 25 bp, Mus musculus
ggccgcgagatctccaggtccttct

SEQ ID NO: 708542 - DNA, 25 bp, Mus musculus
ggccgcgggcttcgccagtggcgtg

SEQ ID NO: 708543 - DNA, 25 bp, Mus musculus
ggccgcgggcttggccagtggcgtg

SEQ ID NO: 708544 - DNA, 25 bp, Mus musculus
ggccgcgttcttccatttgtgtact

SEQ ID NO: 708545 - DNA, 25 bp, Mus musculus
ggccgcgttcttgcatttgtgtact

SEQ ID NO: 708546 - DNA, 25 bp, Mus musculus
ggccgctattttcccagacataaag

SEQ ID NO: 708547 - DNA, 25 bp, Mus musculus
ggccgctattttgccagacataaag

SEQ ID NO: 708548 - DNA, 25 bp, Mus musculus
ggccgctgagatccgagagcaattc

SEQ ID NO: 708549 - DNA, 25 bp, Mus musculus
ggccgctgagatgcgagagcaattc

SEQ ID NO: 708550 - DNA, 25 bp, Mus musculus
ggccgctgatgtccctctcattgag

SEQ ID NO: 708551 - DNA, 25 bp, Mus musculus
ggccgctgatgtgcctctcattgag

SEQ ID NO: 708552 - DNA, 25 bp, Mus musculus
ggccgctgcctgatagaagacccgg

SEQ ID NO: 708553 - DNA, 25 bp, Mus musculus
ggccgctgcctgttagaagacccgg

SEQ ID NO: 708554 - DNA, 25 bp, Mus musculus
ggccgcttacagcagtctaatgaga

SEQ ID NO: 708555 - DNA, 25 bp, Mus musculus
ggccgcttacaggagtctaatgaga

SEQ ID NO: 708556 - DNA, 25 bp, Mus musculus
ggccgcttcattccccggaagacgt

SEQ ID NO: 708557 - DNA, 25 bp, Mus musculus
ggccgcttcattgcccggaagacgt

SEQ ID NO: 708558 - DNA, 25 bp, Mus musculus
ggccgcttcgaactctaccgggcta

SEQ ID NO: 708559 - DNA, 25 bp, Mus musculus
ggccgcttcgaagtctaccgggcta

SEQ ID NO: 708560 - DNA, 25 bp, Mus musculus
ggccggaaacagagcccattttggg

SEQ ID NO: 708561 - DNA, 25 bp, Mus musculus
ggccggaaacagtgcccattttggg

SEQ ID NO: 708562 - DNA, 25 bp, Mus musculus
ggccggaacctgactgaccgctgct

SEQ ID NO: 708563 - DNA, 25 bp, Mus musculus
ggccggaacctgtctgaccgctgct

SEQ ID NO: 708564 - DNA, 25 bp, Mus musculus
ggccggacacgcagtgcttcgataa

SEQ ID NO: 708565 - DNA, 25 bp, Mus musculus
ggccggacacgctgtgcttcgataa

SEQ ID NO: 708566 - DNA, 25 bp, Mus musculus
ggccggacgtgtcccactaattggc

SEQ ID NO: 708567 - DNA, 25 bp, Mus musculus
ggccggacgtgtgccactaattggc

SEQ ID NO: 708568 - DNA, 25 bp, Mus musculus
ggccggatctttatgcagggaaata

SEQ ID NO: 708569 - DNA, 25 bp, Mus musculus
ggccggatctttttgcagggaaata

SEQ ID NO: 708570 - DNA, 25 bp, Mus musculus
ggccggattcctacgtccgagacat

SEQ ID NO: 708571 - DNA, 25 bp, Mus musculus
ggccggattccttcgtccgagacat

SEQ ID NO: 708572 - DNA, 25 bp, Mus musculus
ggccggcaagctcaacattaccaag

SEQ ID NO: 708573 - DNA, 25 bp, Mus musculus
ggccggcaagctgaacattaccaag

SEQ ID NO: 708574 - DNA, 25 bp, Mus musculus
ggccggcacttcacctacaagagta

SEQ ID NO: 708575 - DNA, 25 bp, Mus musculus
ggccggcacttctcctacaagagta

SEQ ID NO: 708576 - DNA, 25 bp, Mus musculus
ggccggcagttcaggctcgtcagct

SEQ ID NO: 708577 - DNA, 25 bp, Mus musculus
ggccggcagttctggctcgtcagct

SEQ ID NO: 708578 - DNA, 25 bp, Mus musculus
ggccggccacaacagatctggtgcc

SEQ ID NO: 708579 - DNA, 25 bp, Mus musculus
ggccggccacaagagatctggtgcc

SEQ ID NO: 708580 - DNA, 25 bp, Mus musculus
ggccggccgtgtcgttattccaacg

SEQ ID NO: 708581 - DNA, 25 bp, Mus musculus
ggccggccgtgtggttattccaacg

SEQ ID NO: 708582 - DNA, 25 bp, Mus musculus
ggccggcggccaatttcttggtgtc

SEQ ID NO: 708583 - DNA, 25 bp, Mus musculus
ggccggcggccattttcttggtgtc

SEQ ID NO: 708584 - DNA, 25 bp, Mus musculus
ggccggctatacaggtcgcaactgt

SEQ ID NO: 708585 - DNA, 25 bp, Mus musculus
ggccggctatactggtcgcaactgt

SEQ ID NO: 708586 - DNA, 25 bp, Mus musculus
ggccggctatgaaatcgccctggtg

SEQ ID NO: 708587 - DNA, 25 bp, Mus musculus
ggccggctatgatatcgccctggtg

SEQ ID NO: 708588 - DNA, 25 bp, Mus musculus
ggccggctcctcatcaattctgtct

SEQ ID NO: 708589 - DNA, 25 bp, Mus musculus
ggccggctcctcttcaattctgtct

SEQ ID NO: 708590 - DNA, 25 bp, Mus musculus
ggccggctctatcctcctttgaata

SEQ ID NO: 708591 - DNA, 25 bp, Mus musculus
ggccggctctatgctcctttgaata

SEQ ID NO: 708592 - DNA, 25 bp, Mus musculus
ggccggctctgtcctataggaattg

SEQ ID NO: 708593 - DNA, 25 bp, Mus musculus
ggccggctctgtgctataggaattg

SEQ ID NO: 708594 - DNA, 25 bp, Mus musculus
ggccgggatgccaaactctatgcta

SEQ ID NO: 708595 - DNA, 25 bp, Mus musculus
ggccgggatgcctaactctatgcta

SEQ ID NO: 708596 - DNA, 25 bp, Mus musculus
ggccgggccagcacattctgcggca

SEQ ID NO: 708597 - DNA, 25 bp, Mus musculus
ggccgggccagctcattctgcggca

SEQ ID NO: 708598 - DNA, 25 bp, Mus musculus
ggccgggcgagacccgaagcaatgt

SEQ ID NO: 708599 - DNA, 25 bp, Mus musculus
ggccgggcgagagccgaagcaatgt

SEQ ID NO: 708600 - DNA, 25 bp, Mus musculus
ggccgggtcatcactacttggatcc

SEQ ID NO: 708601 - DNA, 25 bp, Mus musculus
ggccgggtcatctctacttggatcc

SEQ ID NO: 708602 - DNA, 25 bp, Mus musculus
ggccgggtctacagcagttccatca

SEQ ID NO: 708603 - DNA, 25 bp, Mus musculus
ggccgggtctactgcagttccatca

SEQ ID NO: 708604 - DNA, 25 bp, Mus musculus
ggccgggtgcctatctttgcaacct

SEQ ID NO: 708605 - DNA, 25 bp, Mus musculus
ggccgggtgcctttctttgcaacct

SEQ ID NO: 708606 - DNA, 25 bp, Mus musculus
ggccggtggtctacatcatgccaag

SEQ ID NO: 708607 - DNA, 25 bp, Mus musculus
ggccggtggtcttcatcatgccaag

SEQ ID NO: 708608 - DNA, 25 bp, Mus musculus
ggccgtaccattacagcttgctagt

SEQ ID NO: 708609 - DNA, 25 bp, Mus musculus
ggccgtaccatttcagcttgctagt

SEQ ID NO: 708610 - DNA, 25 bp, Mus musculus
ggccgtactccgatacatgcagcag

SEQ ID NO: 708611 - DNA, 25 bp, Mus musculus
ggccgtactccgttacatgcagcag

SEQ ID NO: 708612 - DNA, 25 bp, Mus musculus
ggccgtactgcccattacaagttga

SEQ ID NO: 708613 - DNA, 25 bp, Mus musculus
ggccgtactgccgattacaagttga

SEQ ID NO: 708614 - DNA, 25 bp, Mus musculus
ggccgtcaaccacaacctacaggtg

SEQ ID NO: 708615 - DNA, 25 bp, Mus musculus
ggccgtcaaccagaacctacaggtg

SEQ ID NO: 708616 - DNA, 25 bp, Mus musculus
ggccgtcagccaaatcatgttggaa

SEQ ID NO: 708617 - DNA, 25 bp, Mus musculus
ggccgtcagccatatcatgttggaa

SEQ ID NO: 708618 - DNA, 25 bp, Mus musculus
ggccgtcattggcaaagcatcgaga

SEQ ID NO: 708619 - DNA, 25 bp, Mus musculus
ggccgtcattgggaaagcatcgaga

SEQ ID NO: 708620 - DNA, 25 bp, Mus musculus
ggccgtccctgactcgcactaaatt

SEQ ID NO: 708621 - DNA, 25 bp, Mus musculus
ggccgtccctgagtcgcactaaatt

SEQ ID NO: 708622 - DNA, 25 bp, Mus musculus
ggccgtcgcctcagtctccggaaag

SEQ ID NO: 708623 - DNA, 25 bp, Mus musculus
ggccgtcgcctctgtctccggaaag

SEQ ID NO: 708624 - DNA, 25 bp, Mus musculus
ggccgtcggtttactgagggaacat

SEQ ID NO: 708625 - DNA, 25 bp, Mus musculus
ggccgtcggttttctgagggaacat

SEQ ID NO: 708626 - DNA, 25 bp, Mus musculus
ggccgtctggatccgaggttaccct

SEQ ID NO: 708627 - DNA, 25 bp, Mus musculus
ggccgtctggatgcgaggttaccct

SEQ ID NO: 708628 - DNA, 25 bp, Mus musculus
ggccgtcttaggctcagagcatgct

SEQ ID NO: 708629 - DNA, 25 bp, Mus musculus
ggccgtcttagggtcagagcatgct

SEQ ID NO: 708630 - DNA, 25 bp, Mus musculus
ggccgtgaagcccaccggtttgact

SEQ ID NO: 708631 - DNA, 25 bp, Mus musculus
ggccgtgaagccgaccggtttgact

SEQ ID NO: 708632 - DNA, 25 bp, Mus musculus
ggccgtgacctcctcaccttgaaga

SEQ ID NO: 708633 - DNA, 25 bp, Mus musculus
ggccgtgacctcgtcaccttgaaga

SEQ ID NO: 708634 - DNA, 25 bp, Mus musculus
ggccgtggactacctcaataatcat

SEQ ID NO: 708635 - DNA, 25 bp, Mus musculus
ggccgtggactagctcaataatcat

SEQ ID NO: 708636 - DNA, 25 bp, Mus musculus
ggccgttctctcagctgtcatctgt

SEQ ID NO: 708637 - DNA, 25 bp, Mus musculus
ggccgttctctctgctgtcatctgt

SEQ ID NO: 708638 - DNA, 25 bp, Mus musculus
ggccgttgacttctctccggatgag

SEQ ID NO: 708639 - DNA, 25 bp, Mus musculus
ggccgttgacttgtctccggatgag

SEQ ID NO: 708640 - DNA, 25 bp, Mus musculus
ggccgttgcaggctttgcagacact

SEQ ID NO: 708641 - DNA, 25 bp, Mus musculus
ggccgttgcagggtttgcagacact

SEQ ID NO: 708642 - DNA, 25 bp, Mus musculus
ggccgttttggaacgcagcttcctt

SEQ ID NO: 708643 - DNA, 25 bp, Mus musculus
ggccgttttggatcgcagcttcctt

SEQ ID NO: 708644 - DNA, 25 bp, Mus musculus
ggcctacaaatcatatggctcccac

SEQ ID NO: 708645 - DNA, 25 bp, Mus musculus
ggcctacaaatcttatggctcccac

SEQ ID NO: 708646 - DNA, 25 bp, Mus musculus
ggcctacagacgacaggaatacgag

SEQ ID NO: 708647 - DNA, 25 bp, Mus musculus
ggcctacagacgtcaggaatacgag

SEQ ID NO: 708648 - DNA, 25 bp, Mus musculus
ggcctacagggcatctcagtaaaac

SEQ ID NO: 708649 - DNA, 25 bp, Mus musculus
ggcctacagggcttctcagtaaaac

SEQ ID NO: 708650 - DNA, 25 bp, Mus musculus
ggcctacagtgtattcaacatcggt

SEQ ID NO: 708651 - DNA, 25 bp, Mus musculus
ggcctacagtgttttcaacatcggt

SEQ ID NO: 708652 - DNA, 25 bp, Mus musculus
ggcctacagtttccaatcgaaccct

SEQ ID NO: 708653 - DNA, 25 bp, Mus musculus
ggcctacagtttgcaatcgaaccct

SEQ ID NO: 708654 - DNA, 25 bp, Mus musculus
ggcctacataggagttgctatttgc

SEQ ID NO: 708655 - DNA, 25 bp, Mus musculus
ggcctacataggtgttgctatttgc

SEQ ID NO: 708656 - DNA, 25 bp, Mus musculus
ggcctacatcgaccagtgccaggat

SEQ ID NO: 708657 - DNA, 25 bp, Mus musculus
ggcctacatcgagcagtgccaggat

SEQ ID NO: 708658 - DNA, 25 bp, Mus musculus
ggcctactaactcggctgctgcagg

SEQ ID NO: 708659 - DNA, 25 bp, Mus musculus
ggcctactaactgggctgctgcagg

SEQ ID NO: 708660 - DNA, 25 bp, Mus musculus
ggcctactatagatctcctcaggat

SEQ ID NO: 708661 - DNA, 25 bp, Mus musculus
ggcctactatagttctcctcaggat

SEQ ID NO: 708662 - DNA, 25 bp, Mus musculus
ggcctactgacaaaatattccataa

SEQ ID NO: 708663 - DNA, 25 bp, Mus musculus
ggcctactgacaacccgagctactt

SEQ ID NO: 708664 - DNA, 25 bp, Mus musculus
ggcctactgacataatattccataa

SEQ ID NO: 708665 - DNA, 25 bp, Mus musculus
ggcctactgacatcccgagctactt

SEQ ID NO: 708666 - DNA, 25 bp, Mus musculus
ggcctactgcccaggaacttctttg

SEQ ID NO: 708667 - DNA, 25 bp, Mus musculus
ggcctactgccctggaacttctttg

SEQ ID NO: 708668 - DNA, 25 bp, Mus musculus
ggcctacttccaagccaacaacaag

SEQ ID NO: 708669 - DNA, 25 bp, Mus musculus
ggcctacttccatgccaacaacaag

SEQ ID NO: 708670 - DNA, 25 bp, Mus musculus
ggcctagagagaaaggaatacatcc

SEQ ID NO: 708671 - DNA, 25 bp, Mus musculus
ggcctagagagataggaatacatcc

SEQ ID NO: 708672 - DNA, 25 bp, Mus musculus
ggcctagagggcaatgcccttccca

SEQ ID NO: 708673 - DNA, 25 bp, Mus musculus
ggcctagagggctatgcccttccca

SEQ ID NO: 708674 - DNA, 25 bp, Mus musculus
ggcctagcaattactctgtctgtgg

SEQ ID NO: 708675 - DNA, 25 bp, Mus musculus
ggcctagcaatttctctgtctgtgg

SEQ ID NO: 708676 - DNA, 25 bp, Mus musculus
ggcctagcgagtacagagtgctgtt

SEQ ID NO: 708677 - DNA, 25 bp, Mus musculus
ggcctagcgagttcagagtgctgtt

SEQ ID NO: 708678 - DNA, 25 bp, Mus musculus
ggcctagctgtgatagccgtcttgt

SEQ ID NO: 708679 - DNA, 25 bp, Mus musculus
ggcctagctgtgttagccgtcttgt

SEQ ID NO: 708680 - DNA, 25 bp, Mus musculus
ggcctagcttttcgtctacaatcca

SEQ ID NO: 708681 - DNA, 25 bp, Mus musculus
ggcctagcttttggtctacaatcca

SEQ ID NO: 708682 - DNA, 25 bp, Mus musculus
ggcctagggaaaaccttgctcacag

SEQ ID NO: 708683 - DNA, 25 bp, Mus musculus
ggcctagggaaatccttgctcacag

SEQ ID NO: 708684 - DNA, 25 bp, Mus musculus
ggcctagtcggtcgcctgcctttct

SEQ ID NO: 708685 - DNA, 25 bp, Mus musculus
ggcctagtcggtggcctgcctttct

SEQ ID NO: 708686 - DNA, 25 bp, Mus musculus
ggcctagtctaactccactttttct

SEQ ID NO: 708687 - DNA, 25 bp, Mus musculus
ggcctagtctaagtccactttttct

SEQ ID NO: 708688 - DNA, 25 bp, Mus musculus
ggcctatacctcattacactgctgg

SEQ ID NO: 708689 - DNA, 25 bp, Mus musculus
ggcctatacctctttacactgctgg

SEQ ID NO: 708690 - DNA, 25 bp, Mus musculus
ggcctatagagaacacatatcgagc

SEQ ID NO: 708691 - DNA, 25 bp, Mus musculus
ggcctatagagatcacatatcgagc

SEQ ID NO: 708692 - DNA, 25 bp, Mus musculus
ggcctatccagaccacatgtgccaa

SEQ ID NO: 708693 - DNA, 25 bp, Mus musculus
ggcctatccagagcacatgtgccaa

SEQ ID NO: 708694 - DNA, 25 bp, Mus musculus
ggcctatgacaacaagatagctgag

SEQ ID NO: 708695 - DNA, 25 bp, Mus musculus
ggcctatgacaagaagatagctgag

SEQ ID NO: 708696 - DNA, 25 bp, Mus musculus
ggcctatggctgaggccgcactgaa

SEQ ID NO: 708697 - DNA, 25 bp, Mus musculus
ggcctatggctgtggccgcactgaa

SEQ ID NO: 708698 - DNA, 25 bp, Mus musculus
ggcctatggtcacattctctactca

SEQ ID NO: 708699 - DNA, 25 bp, Mus musculus
ggcctatggtcagattctctactca

SEQ ID NO: 708700 - DNA, 25 bp, Mus musculus
ggcctatgtcttccttcatctctcg

SEQ ID NO: 708701 - DNA, 25 bp, Mus musculus
ggcctatgtcttgcttcatctctcg

SEQ ID NO: 708702 - DNA, 25 bp, Mus musculus
ggcctattacagagtgctagacata

SEQ ID NO: 708703 - DNA, 25 bp, Mus musculus
ggcctattacagtgtgctagacata

SEQ ID NO: 708704 - DNA, 25 bp, Mus musculus
ggcctcaaacttactgtgtcaccaa

SEQ ID NO: 708705 - DNA, 25 bp, Mus musculus
ggcctcaaactttctgtgtcaccaa

SEQ ID NO: 708706 - DNA, 25 bp, Mus musculus
ggcctcaacaagcaaggctacaaat

SEQ ID NO: 708707 - DNA, 25 bp, Mus musculus
ggcctcaacaaggaaggctacaaat

SEQ ID NO: 708708 - DNA, 25 bp, Mus musculus
ggcctcaaccataccttggtgctga

SEQ ID NO: 708709 - DNA, 25 bp, Mus musculus
ggcctcaaccattccttggtgctga

SEQ ID NO: 708710 - DNA, 25 bp, Mus musculus
ggcctcaactcaaacccgaagggct

SEQ ID NO: 708711 - DNA, 25 bp, Mus musculus
ggcctcaactcatacccgaagggct

SEQ ID NO: 708712 - DNA, 25 bp, Mus musculus
ggcctcaagctacaagtcaacaaat

SEQ ID NO: 708713 - DNA, 25 bp, Mus musculus
ggcctcaagctagaagtcaacaaat

SEQ ID NO: 708714 - DNA, 25 bp, Mus musculus
ggcctcaaggataggcgctccccga

SEQ ID NO: 708715 - DNA, 25 bp, Mus musculus
ggcctcaaggattggcgctccccga

SEQ ID NO: 708716 - DNA, 25 bp, Mus musculus
ggcctcaagtggagcttcatgaata

SEQ ID NO: 708717 - DNA, 25 bp, Mus musculus
ggcctcaagtggcaccatcataaca

SEQ ID NO: 708718 - DNA, 25 bp, Mus musculus
ggcctcaagtgggaccatcataaca

SEQ ID NO: 708719 - DNA, 25 bp, Mus musculus
ggcctcaagtggtgcttcatgaata

SEQ ID NO: 708720 - DNA, 25 bp, Mus musculus
ggcctcacgcctaggtcctgactgg

SEQ ID NO: 708721 - DNA, 25 bp, Mus musculus
ggcctcacgccttggtcctgactgg

SEQ ID NO: 708722 - DNA, 25 bp, Mus musculus
ggcctcacgggaatgcagcagccat

SEQ ID NO: 708723 - DNA, 25 bp, Mus musculus
ggcctcacgggattgcagcagccat

SEQ ID NO: 708724 - DNA, 25 bp, Mus musculus
ggcctcacgtggacctggccggact

SEQ ID NO: 708725 - DNA, 25 bp, Mus musculus
ggcctcacgtggtcctggccggact

SEQ ID NO: 708726 - DNA, 25 bp, Mus musculus
ggcctcagaggcagcaagtgctaaa

SEQ ID NO: 708727 - DNA, 25 bp, Mus musculus
ggcctcagaggctgcaagtgctaaa

SEQ ID NO: 708728 - DNA, 25 bp, Mus musculus
ggcctcagatttcttctagtacttg

SEQ ID NO: 708729 - DNA, 25 bp, Mus musculus
ggcctcagatttgttctagtacttg

SEQ ID NO: 708730 - DNA, 25 bp, Mus musculus
ggcctcagcggtctctattccagaa

SEQ ID NO: 708731 - DNA, 25 bp, Mus musculus
ggcctcagcggtgtctattccagaa

SEQ ID NO: 708732 - DNA, 25 bp, Mus musculus
ggcctcaggatgcagaatggtctct

SEQ ID NO: 708733 - DNA, 25 bp, Mus musculus
ggcctcaggatggagaatggtctct

SEQ ID NO: 708734 - DNA, 25 bp, Mus musculus
ggcctcaggcacattatagtcaaac

SEQ ID NO: 708735 - DNA, 25 bp, Mus musculus
ggcctcaggcactttatagtcaaac

SEQ ID NO: 708736 - DNA, 25 bp, Mus musculus
ggcctcagtgaaacccaagcacttc

SEQ ID NO: 708737 - DNA, 25 bp, Mus musculus
ggcctcagtgaatcccaagcacttc

SEQ ID NO: 708738 - DNA, 25 bp, Mus musculus
ggcctcatacttcctatttggctga

SEQ ID NO: 708739 - DNA, 25 bp, Mus musculus
ggcctcatacttgctatttggctga

SEQ ID NO: 708740 - DNA, 25 bp, Mus musculus
ggcctcatgctgcatccgtcaagga

SEQ ID NO: 708741 - DNA, 25 bp, Mus musculus
ggcctcatgctggatccgtcaagga

SEQ ID NO: 708742 - DNA, 25 bp, Mus musculus
ggcctcatggctccggtaagttcca

SEQ ID NO: 708743 - DNA, 25 bp, Mus musculus
ggcctcatggctgcggtaagttcca

SEQ ID NO: 708744 - DNA, 25 bp, Mus musculus
ggcctcatgtatcatttgaaggatc

SEQ ID NO: 708745 - DNA, 25 bp, Mus musculus
ggcctcatgtatgatttgaaggatc

SEQ ID NO: 708746 - DNA, 25 bp, Mus musculus
ggcctcattcgactcgttgcgtcgg

SEQ ID NO: 708747 - DNA, 25 bp, Mus musculus
ggcctcattcgagtcgttgcgtcgg

SEQ ID NO: 708748 - DNA, 25 bp, Mus musculus
ggcctccaacaaccttggaagagct

SEQ ID NO: 708749 - DNA, 25 bp, Mus musculus
ggcctccaacaagcttggaagagct

SEQ ID NO: 708750 - DNA, 25 bp, Mus musculus
ggcctccagaccattaacctcagtg

SEQ ID NO: 708751 - DNA, 25 bp, Mus musculus
ggcctccagacctttaacctcagtg

SEQ ID NO: 708752 - DNA, 25 bp, Mus musculus
ggcctccagccaatgtgaacctaat

SEQ ID NO: 708753 - DNA, 25 bp, Mus musculus
ggcctccagccattgtgaacctaat

SEQ ID NO: 708754 - DNA, 25 bp, Mus musculus
ggcctccagcccagttggagttcct

SEQ ID NO: 708755 - DNA, 25 bp, Mus musculus
ggcctccagccctgttggagttcct

SEQ ID NO: 708756 - DNA, 25 bp, Mus musculus
ggcctccagtatctagacaataaag

SEQ ID NO: 708757 - DNA, 25 bp, Mus musculus
ggcctccagtatgtagacaataaag

SEQ ID NO: 708758 - DNA, 25 bp, Mus musculus
ggcctccatcatcaatctcctagag

SEQ ID NO: 708759 - DNA, 25 bp, Mus musculus
ggcctccatcatgaatctcctagag

SEQ ID NO: 708760 - DNA, 25 bp, Mus musculus
ggcctcccagatcagctgaaactct

SEQ ID NO: 708761 - DNA, 25 bp, Mus musculus
ggcctcccagatgagctgaaactct

SEQ ID NO: 708762 - DNA, 25 bp, Mus musculus
ggcctccctgcaaggatagttctgg

SEQ ID NO: 708763 - DNA, 25 bp, Mus musculus
ggcctccctgcatggatagttctgg

SEQ ID NO: 708764 - DNA, 25 bp, Mus musculus
ggcctccggtgccatgatccggaac

SEQ ID NO: 708765 - DNA, 25 bp, Mus musculus
ggcctccggtgcgatgatccggaac

SEQ ID NO: 708766 - DNA, 25 bp, Mus musculus
ggcctcctcgccatgatcaatgaag

SEQ ID NO: 708767 - DNA, 25 bp, Mus musculus
ggcctcctcgccttgatcaatgaag

SEQ ID NO: 708768 - DNA, 25 bp, Mus musculus
ggcctcctcggcctgagggctggag

SEQ ID NO: 708769 - DNA, 25 bp, Mus musculus
ggcctcctcggcgtgagggctggag

SEQ ID NO: 708770 - DNA, 25 bp, Mus musculus
ggcctcctctggatgtaaatcctaa

SEQ ID NO: 708771 - DNA, 25 bp, Mus musculus
ggcctcctctggttgtaaatcctaa

SEQ ID NO: 708772 - DNA, 25 bp, Mus musculus
ggcctcctgagacatgtgcagcctc

SEQ ID NO: 708773 - DNA, 25 bp, Mus musculus
ggcctcctgagagatgtgcagcctc

SEQ ID NO: 708774 - DNA, 25 bp, Mus musculus
ggcctcctggatctaccttgtgtga

SEQ ID NO: 708775 - DNA, 25 bp, Mus musculus
ggcctcctggatgtaccttgtgtga

SEQ ID NO: 708776 - DNA, 25 bp, Mus musculus
ggcctcctggccctgctattgctgt

SEQ ID NO: 708777 - DNA, 25 bp, Mus musculus
ggcctcctggccgtgctattgctgt

SEQ ID NO: 708778 - DNA, 25 bp, Mus musculus
ggcctcctgtagctgccttgttcct

SEQ ID NO: 708779 - DNA, 25 bp, Mus musculus
ggcctcctgtaggtgccttgttcct

SEQ ID NO: 708780 - DNA, 25 bp, Mus musculus
ggcctccttactaaccactggctgt

SEQ ID NO: 708781 - DNA, 25 bp, Mus musculus
ggcctccttacttaccactggctgt

SEQ ID NO: 708782 - DNA, 25 bp, Mus musculus
ggcctcgaaagacgtaaggtctcct

SEQ ID NO: 708783 - DNA, 25 bp, Mus musculus
ggcctcgaaagaggtaaggtctcct

SEQ ID NO: 708784 - DNA, 25 bp, Mus musculus
ggcctcgaaatcagagcctttgaga

SEQ ID NO: 708785 - DNA, 25 bp, Mus musculus
ggcctcgaaatctgagcctttgaga

SEQ ID NO: 708786 - DNA, 25 bp, Mus musculus
ggcctcgaatacagcagtgcatgca

SEQ ID NO: 708787 - DNA, 25 bp, Mus musculus
ggcctcgaatactgcagtgcatgca

SEQ ID NO: 708788 - DNA, 25 bp, Mus musculus
ggcctcgctagccaatcgctgctga

SEQ ID NO: 708789 - DNA, 25 bp, Mus musculus
ggcctcgctagcgaatcgctgctga

SEQ ID NO: 708790 - DNA, 25 bp, Mus musculus
ggcctcgctgaactacttaaaccaa

SEQ ID NO: 708791 - DNA, 25 bp, Mus musculus
ggcctcgctgaagtacttaaaccaa

SEQ ID NO: 708792 - DNA, 25 bp, Mus musculus
ggcctcgctggaagcttactactcg

SEQ ID NO: 708793 - DNA, 25 bp, Mus musculus
ggcctcgctggatgcttactactcg

SEQ ID NO: 708794 - DNA, 25 bp, Mus musculus
ggcctcggtgtgctaggcaccatca

SEQ ID NO: 708795 - DNA, 25 bp, Mus musculus
ggcctcggtgtgctgtctagcattc

SEQ ID NO: 708796 - DNA, 25 bp, Mus musculus
ggcctcggtgtggtaggcaccatca

SEQ ID NO: 708797 - DNA, 25 bp, Mus musculus
ggcctcggtgtggtgtctagcattc

SEQ ID NO: 708798 - DNA, 25 bp, Mus musculus
ggcctcgtgtacctccagtcattgt

SEQ ID NO: 708799 - DNA, 25 bp, Mus musculus
ggcctcgtgtacgtccagtcattgt

SEQ ID NO: 708800 - DNA, 25 bp, Mus musculus
ggcctcgttgcaaacctaccgtgga

SEQ ID NO: 708801 - DNA, 25 bp, Mus musculus
ggcctcgttgcatacctaccgtgga

SEQ ID NO: 708802 - DNA, 25 bp, Mus musculus
ggcctctcaaacaccaggtgctgtg

SEQ ID NO: 708803 - DNA, 25 bp, Mus musculus
ggcctctcaaactccaggtgctgtg

SEQ ID NO: 708804 - DNA, 25 bp, Mus musculus
ggcctctcagaacgtacttgacttt

SEQ ID NO: 708805 - DNA, 25 bp, Mus musculus
ggcctctcagaaggtacttgacttt

SEQ ID NO: 708806 - DNA, 25 bp, Mus musculus
ggcctctcggccacctgttgaggag

SEQ ID NO: 708807 - DNA, 25 bp, Mus musculus
ggcctctcggcctcctgttgaggag

SEQ ID NO: 708808 - DNA, 25 bp, Mus musculus
ggcctctcggtacctggaagcacat

SEQ ID NO: 708809 - DNA, 25 bp, Mus musculus
ggcctctcggtagctggaagcacat

SEQ ID NO: 708810 - DNA, 25 bp, Mus musculus
ggcctctctagcacgcggcctgtgt

SEQ ID NO: 708811 - DNA, 25 bp, Mus musculus
ggcctctctagctcgcggcctgtgt

SEQ ID NO: 708812 - DNA, 25 bp, Mus musculus
ggcctctgaaagatatgctgtctcg

SEQ ID NO: 708813 - DNA, 25 bp, Mus musculus
ggcctctgaaagttatgctgtctcg

SEQ ID NO: 708814 - DNA, 25 bp, Mus musculus
ggcctctgacaacccacagtttggg

SEQ ID NO: 708815 - DNA, 25 bp, Mus musculus
ggcctctgacaagccacagtttggg

SEQ ID NO: 708816 - DNA, 25 bp, Mus musculus
ggcctctgacttcagactactgctg

SEQ ID NO: 708817 - DNA, 25 bp, Mus musculus
ggcctctgacttgagactactgctg

SEQ ID NO: 708818 - DNA, 25 bp, Mus musculus
ggcctctgaggcacggatgagtaca

SEQ ID NO: 708819 - DNA, 25 bp, Mus musculus
ggcctctgaggctcggatgagtaca

SEQ ID NO: 708820 - DNA, 25 bp, Mus musculus
ggcctctgcacaagatgccaggttt

SEQ ID NO: 708821 - DNA, 25 bp, Mus musculus
ggcctctgcacatgatgccaggttt

SEQ ID NO: 708822 - DNA, 25 bp, Mus musculus
ggcctctgcctcaacacggagggct

SEQ ID NO: 708823 - DNA, 25 bp, Mus musculus
ggcctctgcctctacacggagggct

SEQ ID NO: 708824 - DNA, 25 bp, Mus musculus
ggcctctggagactggcttaccatc

SEQ ID NO: 708825 - DNA, 25 bp, Mus musculus
ggcctctggagagtggcttaccatc

SEQ ID NO: 708826 - DNA, 25 bp, Mus musculus
ggcctctgtctacttttacaccatg

SEQ ID NO: 708827 - DNA, 25 bp, Mus musculus
ggcctctgtctagttttacaccatg

SEQ ID NO: 708828 - DNA, 25 bp, Mus musculus
ggcctctgtgatacgggtgatgaac

SEQ ID NO: 708829 - DNA, 25 bp, Mus musculus
ggcctctgtgattcgggtgatgaac

SEQ ID NO: 708830 - DNA, 25 bp, Mus musculus
ggcctctgtggtctccctctggata

SEQ ID NO: 708831 - DNA, 25 bp, Mus musculus
ggcctctgtggtgtccctctggata

SEQ ID NO: 708832 - DNA, 25 bp, Mus musculus
ggcctcttccgccaagggatgcagt

SEQ ID NO: 708833 - DNA, 25 bp, Mus musculus
ggcctcttccgcgaagggatgcagt

SEQ ID NO: 708834 - DNA, 25 bp, Mus musculus
ggcctcttgatgagtactggtgaca

SEQ ID NO: 708835 - DNA, 25 bp, Mus musculus
ggcctcttgatgtgtactggtgaca

SEQ ID NO: 708836 - DNA, 25 bp, Mus musculus
ggcctcttgcctacgagaaggacaa

SEQ ID NO: 708837 - DNA, 25 bp, Mus musculus
ggcctcttgccttcgagaaggacaa

SEQ ID NO: 708838 - DNA, 25 bp, Mus musculus
ggcctcttgtcgaggacttccttag

SEQ ID NO: 708839 - DNA, 25 bp, Mus musculus
ggcctcttgtcgtggacttccttag

SEQ ID NO: 708840 - DNA, 25 bp, Mus musculus
ggcctctttcagatagcaggtcaaa

SEQ ID NO: 708841 - DNA, 25 bp, Mus musculus
ggcctctttcagttagcaggtcaaa

SEQ ID NO: 708842 - DNA, 25 bp, Mus musculus
ggcctcttttcgcaccaagggctct

SEQ ID NO: 708843 - DNA, 25 bp, Mus musculus
ggcctcttttcggaccaagggctct

SEQ ID NO: 708844 - DNA, 25 bp, Mus musculus
ggcctgaaaccaattaccaagtacg

SEQ ID NO: 708845 - DNA, 25 bp, Mus musculus
ggcctgaaaccatttaccaagtacg

SEQ ID NO: 708846 - DNA, 25 bp, Mus musculus
ggcctgaaacctaggcccctggaag

SEQ ID NO: 708847 - DNA, 25 bp, Mus musculus
ggcctgaaaccttggcccctggaag

SEQ ID NO: 708848 - DNA, 25 bp, Mus musculus
ggcctgaacatacaaccagaatact

SEQ ID NO: 708849 - DNA, 25 bp, Mus musculus
ggcctgaacatagaaccagaatact

SEQ ID NO: 708850 - DNA, 25 bp, Mus musculus
ggcctgaacctcagtcgggacagct

SEQ ID NO: 708851 - DNA, 25 bp, Mus musculus
ggcctgaacctctgtcgggacagct

SEQ ID NO: 708852 - DNA, 25 bp, Mus musculus
ggcctgaacttgaactgagccccag

SEQ ID NO: 708853 - DNA, 25 bp, Mus musculus
ggcctgaacttgtactgagccccag

SEQ ID NO: 708854 - DNA, 25 bp, Mus musculus
ggcctgaagaacatgaatgtaacag

SEQ ID NO: 708855 - DNA, 25 bp, Mus musculus
ggcctgaagaacttgaatgtaacag

SEQ ID NO: 708856 - DNA, 25 bp, Mus musculus
ggcctgaaggaaacagagggcttcc

SEQ ID NO: 708857 - DNA, 25 bp, Mus musculus
ggcctgaaggaatcagagggcttcc

SEQ ID NO: 708858 - DNA, 25 bp, Mus musculus
ggcctgacaaaaaatccaacgagat

SEQ ID NO: 708859 - DNA, 25 bp, Mus musculus
ggcctgacaaaatatccaacgagat

SEQ ID NO: 708860 - DNA, 25 bp, Mus musculus
ggcctgacaataaccagcattcaca

SEQ ID NO: 708861 - DNA, 25 bp, Mus musculus
ggcctgacaatatccagcattcaca

SEQ ID NO: 708862 - DNA, 25 bp, Mus musculus
ggcctgacagaacggcctcagagac

SEQ ID NO: 708863 - DNA, 25 bp, Mus musculus
ggcctgacagaagggcctcagagac

SEQ ID NO: 708864 - DNA, 25 bp, Mus musculus
ggcctgaccacactgccagaaactg

SEQ ID NO: 708865 - DNA, 25 bp, Mus musculus
ggcctgaccacagtgccagaaactg

SEQ ID NO: 708866 - DNA, 25 bp, Mus musculus
ggcctgagcaagaggtaccatattt

SEQ ID NO: 708867 - DNA, 25 bp, Mus musculus
ggcctgagcaagtggtaccatattt

SEQ ID NO: 708868 - DNA, 25 bp, Mus musculus
ggcctgagccgaactggaacgttgt

SEQ ID NO: 708869 - DNA, 25 bp, Mus musculus
ggcctgagccgatctggaacgttgt

SEQ ID NO: 708870 - DNA, 25 bp, Mus musculus
ggcctgagctacagtgaccgccagg

SEQ ID NO: 708871 - DNA, 25 bp, Mus musculus
ggcctgagctactgtgaccgccagg

SEQ ID NO: 708872 - DNA, 25 bp, Mus musculus
ggcctgagctgtatgaacaaggatc

SEQ ID NO: 708873 - DNA, 25 bp, Mus musculus
ggcctgagctgtttgaacaaggatc

SEQ ID NO: 708874 - DNA, 25 bp, Mus musculus
ggcctgaggaagatctctgcctata

SEQ ID NO: 708875 - DNA, 25 bp, Mus musculus
ggcctgaggaagttctctgcctata

SEQ ID NO: 708876 - DNA, 25 bp, Mus musculus
ggcctgagggtacagctcaaccgta

SEQ ID NO: 708877 - DNA, 25 bp, Mus musculus
ggcctgagggtagagctcaaccgta

SEQ ID NO: 708878 - DNA, 25 bp, Mus musculus
ggcctgaggtccaaggcttgtcccc

SEQ ID NO: 708879 - DNA, 25 bp, Mus musculus
ggcctgaggtcctaggcttgtcccc

SEQ ID NO: 708880 - DNA, 25 bp, Mus musculus
ggcctgagtccacccgtcacaggaa

SEQ ID NO: 708881 - DNA, 25 bp, Mus musculus
ggcctgagtccagccgtcacaggaa

SEQ ID NO: 708882 - DNA, 25 bp, Mus musculus
ggcctgatccaaagccgggttctaa

SEQ ID NO: 708883 - DNA, 25 bp, Mus musculus
ggcctgatccaatgccgggttctaa

SEQ ID NO: 708884 - DNA, 25 bp, Mus musculus
ggcctgatgaaactatgggaccctt

SEQ ID NO: 708885 - DNA, 25 bp, Mus musculus
ggcctgatgaaagtatgggaccctt

SEQ ID NO: 708886 - DNA, 25 bp, Mus musculus
ggcctgatgaatcatttgatgaaat

SEQ ID NO: 708887 - DNA, 25 bp, Mus musculus
ggcctgatgaatgatttgatgaaat

SEQ ID NO: 708888 - DNA, 25 bp, Mus musculus
ggcctgatgcatacacaaggtgaac

SEQ ID NO: 708889 - DNA, 25 bp, Mus musculus
ggcctgatgcattcacaaggtgaac

SEQ ID NO: 708890 - DNA, 25 bp, Mus musculus
ggcctgatgtccagcatcaactcag

SEQ ID NO: 708891 - DNA, 25 bp, Mus musculus
ggcctgatgtcctgcatcaactcag

SEQ ID NO: 708892 - DNA, 25 bp, Mus musculus
ggcctgatgtgtcttcactctctca

SEQ ID NO: 708893 - DNA, 25 bp, Mus musculus
ggcctgatgtgtgttcactctctca

SEQ ID NO: 708894 - DNA, 25 bp, Mus musculus
ggcctgcaagttattccaaacacag

SEQ ID NO: 708895 - DNA, 25 bp, Mus musculus
ggcctgcaagtttttccaaacacag

SEQ ID NO: 708896 - DNA, 25 bp, Mus musculus
ggcctgcaatgaagccacgctggtt

SEQ ID NO: 708897 - DNA, 25 bp, Mus musculus
ggcctgcaatgatgccacgctggtt

SEQ ID NO: 708898 - DNA, 25 bp, Mus musculus
ggcctgcacccactgtctgagcaag

SEQ ID NO: 708899 - DNA, 25 bp, Mus musculus
ggcctgcacccagtgtctgagcaag

SEQ ID NO: 708900 - DNA, 25 bp, Mus musculus
ggcctgcaccctagaatcataactg

SEQ ID NO: 708901 - DNA, 25 bp, Mus musculus
ggcctgcacccttgaatcataactg

SEQ ID NO: 708902 - DNA, 25 bp, Mus musculus
ggcctgcacgtacaccggaacagcg

SEQ ID NO: 708903 - DNA, 25 bp, Mus musculus
ggcctgcacgtagaccggaacagcg

SEQ ID NO: 708904 - DNA, 25 bp, Mus musculus
ggcctgcagagtcatacagaatgta

SEQ ID NO: 708905 - DNA, 25 bp, Mus musculus
ggcctgcagagtgatacagaatgta

SEQ ID NO: 708906 - DNA, 25 bp, Mus musculus
ggcctgcatctgacggcttcccagt

SEQ ID NO: 708907 - DNA, 25 bp, Mus musculus
ggcctgcatctgtcggcttcccagt

SEQ ID NO: 708908 - DNA, 25 bp, Mus musculus
ggcctgcatgatagtgaactttgct

SEQ ID NO: 708909 - DNA, 25 bp, Mus musculus
ggcctgcatgattgtgaactttgct

SEQ ID NO: 708910 - DNA, 25 bp, Mus musculus
ggcctgcattgaaggtgtagtcctg

SEQ ID NO: 708911 - DNA, 25 bp, Mus musculus
ggcctgcattgatggtgtagtcctg

SEQ ID NO: 708912 - DNA, 25 bp, Mus musculus
ggcctgccacagatcggtgacgagt

SEQ ID NO: 708913 - DNA, 25 bp, Mus musculus
ggcctgccacagttcggtgacgagt

SEQ ID NO: 708914 - DNA, 25 bp, Mus musculus
ggcctgcccgggatagtgtaacatg

SEQ ID NO: 708915 - DNA, 25 bp, Mus musculus
ggcctgcccgggttagtgtaacatg

SEQ ID NO: 708916 - DNA, 25 bp, Mus musculus
ggcctgccgattaccatgtatggag

SEQ ID NO: 708917 - DNA, 25 bp, Mus musculus
ggcctgccgatttccatgtatggag

SEQ ID NO: 708918 - DNA, 25 bp, Mus musculus
ggcctgcctaaaagatactgagttt

SEQ ID NO: 708919 - DNA, 25 bp, Mus musculus
ggcctgcctaaatgatactgagttt

SEQ ID NO: 708920 - DNA, 25 bp, Mus musculus
ggcctgcgagacctttcaatatggg

SEQ ID NO: 708921 - DNA, 25 bp, Mus musculus
ggcctgcgagacgtttcaatatggg

SEQ ID NO: 708922 - DNA, 25 bp, Mus musculus
ggcctgcgctgtctcctgatctttg

SEQ ID NO: 708923 - DNA, 25 bp, Mus musculus
ggcctgcgctgtgtcctgatctttg

SEQ ID NO: 708924 - DNA, 25 bp, Mus musculus
ggcctgcgcttgaagacggagaaat

SEQ ID NO: 708925 - DNA, 25 bp, Mus musculus
ggcctgcgcttgtagacggagaaat

SEQ ID NO: 708926 - DNA, 25 bp, Mus musculus
ggcctgcgtatgagagctcttaact

SEQ ID NO: 708927 - DNA, 25 bp, Mus musculus
ggcctgcgtatgtgagctcttaact

SEQ ID NO: 708928 - DNA, 25 bp, Mus musculus
ggcctgctacatagcctccctggtg

SEQ ID NO: 708929 - DNA, 25 bp, Mus musculus
ggcctgctacattgcctccctggtg

SEQ ID NO: 708930 - DNA, 25 bp, Mus musculus
ggcctgctagcaaggatcttctgca

SEQ ID NO: 708931 - DNA, 25 bp, Mus musculus
ggcctgctagcatggatcttctgca

SEQ ID NO: 708932 - DNA, 25 bp, Mus musculus
ggcctgctccgactctgcttcgtgt

SEQ ID NO: 708933 - DNA, 25 bp, Mus musculus
ggcctgctccgagtctgcttcgtgt

SEQ ID NO: 708934 - DNA, 25 bp, Mus musculus
ggcctgctccggcacgcaagtgcta

SEQ ID NO: 708935 - DNA, 25 bp, Mus musculus
ggcctgctccgggacgcaagtgcta

SEQ ID NO: 708936 - DNA, 25 bp, Mus musculus
ggcctgctcctgcaactctgtggac

SEQ ID NO: 708937 - DNA, 25 bp, Mus musculus
ggcctgctcctggaactctgtggac

SEQ ID NO: 708938 - DNA, 25 bp, Mus musculus
ggcctgctggctcgcaggaatcatc

SEQ ID NO: 708939 - DNA, 25 bp, Mus musculus
ggcctgctggctggcaggaatcatc

SEQ ID NO: 708940 - DNA, 25 bp, Mus musculus
ggcctgctggtgatcgaccaccgca

SEQ ID NO: 708941 - DNA, 25 bp, Mus musculus
ggcctgctggtgttcgaccaccgca

SEQ ID NO: 708942 - DNA, 25 bp, Mus musculus
ggcctgctgtgactactccttacat

SEQ ID NO: 708943 - DNA, 25 bp, Mus musculus
ggcctgctgtgagtactccttacat

SEQ ID NO: 708944 - DNA, 25 bp, Mus musculus
ggcctgcttgatacgagttccttct

SEQ ID NO: 708945 - DNA, 25 bp, Mus musculus
ggcctgcttgattcgagttccttct

SEQ ID NO: 708946 - DNA, 25 bp, Mus musculus
ggcctggacctacaagtgagtgttt

SEQ ID NO: 708947 - DNA, 25 bp, Mus musculus
ggcctggacctagaagtgagtgttt

SEQ ID NO: 708948 - DNA, 25 bp, Mus musculus
ggcctggactataatactggagtga

SEQ ID NO: 708949 - DNA, 25 bp, Mus musculus
ggcctggactattatactggagtga

SEQ ID NO: 708950 - DNA, 25 bp, Mus musculus
ggcctggagtgtcgcgggaccggga

SEQ ID NO: 708951 - DNA, 25 bp, Mus musculus
ggcctggagtgtggcgggaccggga

SEQ ID NO: 708952 - DNA, 25 bp, Mus musculus
ggcctggagttcattctttaccaca

SEQ ID NO: 708953 - DNA, 25 bp, Mus musculus
ggcctggagttctttctttaccaca

SEQ ID NO: 708954 - DNA, 25 bp, Mus musculus
ggcctggatatacaacttaaagtct

SEQ ID NO: 708955 - DNA, 25 bp, Mus musculus
ggcctggatatagaacttaaagtct

SEQ ID NO: 708956 - DNA, 25 bp, Mus musculus
ggcctggatatcaatgtgacacagc

SEQ ID NO: 708957 - DNA, 25 bp, Mus musculus
ggcctggatatctatgtgacacagc

SEQ ID NO: 708958 - DNA, 25 bp, Mus musculus
ggcctggatccaccagtccttgaag

SEQ ID NO: 708959 - DNA, 25 bp, Mus musculus
ggcctggatccagcagtccttgaag

SEQ ID NO: 708960 - DNA, 25 bp, Mus musculus
ggcctggccaggcatatcaacaaca

SEQ ID NO: 708961 - DNA, 25 bp, Mus musculus
ggcctggccagggatatcaacaaca

SEQ ID NO: 708962 - DNA, 25 bp, Mus musculus
ggcctggcctatctgaatggttcac

SEQ ID NO: 708963 - DNA, 25 bp, Mus musculus
ggcctggcctatgtgaatggttcac

SEQ ID NO: 708964 - DNA, 25 bp, Mus musculus
ggcctggccttcaaaacataggcta

SEQ ID NO: 708965 - DNA, 25 bp, Mus musculus
ggcctggccttctaaacataggcta

SEQ ID NO: 708966 - DNA, 25 bp, Mus musculus
ggcctggctattcggaaactgtcca

SEQ ID NO: 708967 - DNA, 25 bp, Mus musculus
ggcctggctattgggaaactgtcca

SEQ ID NO: 708968 - DNA, 25 bp, Mus musculus
ggcctggctgccaacatcttagaga

SEQ ID NO: 708969 - DNA, 25 bp, Mus musculus
ggcctggctgcctacatcttagaga

SEQ ID NO: 708970 - DNA, 25 bp, Mus musculus
ggcctggctgtcatggcagtgggca

SEQ ID NO: 708971 - DNA, 25 bp, Mus musculus
ggcctggctgtcttggcagtgggca

SEQ ID NO: 708972 - DNA, 25 bp, Mus musculus
ggcctgggacacctgttgacccttg

SEQ ID NO: 708973 - DNA, 25 bp, Mus musculus
ggcctgggacacgtgttgacccttg

SEQ ID NO: 708974 - DNA, 25 bp, Mus musculus
ggcctgggatttcccattgcagccg

SEQ ID NO: 708975 - DNA, 25 bp, Mus musculus
ggcctgggatttgccattgcagccg

SEQ ID NO: 708976 - DNA, 25 bp, Mus musculus
ggcctgggcagtccccgtaatagca

SEQ ID NO: 708977 - DNA, 25 bp, Mus musculus
ggcctgggcagtgcccgtaatagca

SEQ ID NO: 708978 - DNA, 25 bp, Mus musculus
ggcctgggccttatacttcgatcca

SEQ ID NO: 708979 - DNA, 25 bp, Mus musculus
ggcctgggccttttacttcgatcca

SEQ ID NO: 708980 - DNA, 25 bp, Mus musculus
ggcctgggtgccatctgtaacttca

SEQ ID NO: 708981 - DNA, 25 bp, Mus musculus
ggcctgggtgccttctgtaacttca

SEQ ID NO: 708982 - DNA, 25 bp, Mus musculus
ggcctggtgcgcaaagggaagaaaa

SEQ ID NO: 708983 - DNA, 25 bp, Mus musculus
ggcctggtgcgcaaggccccgaaca

SEQ ID NO: 708984 - DNA, 25 bp, Mus musculus
ggcctggtgcgctaagggaagaaaa

SEQ ID NO: 708985 - DNA, 25 bp, Mus musculus
ggcctggtgcgctaggccccgaaca

SEQ ID NO: 708986 - DNA, 25 bp, Mus musculus
ggcctggtggtgaatctcggacact

SEQ ID NO: 708987 - DNA, 25 bp, Mus musculus
ggcctggtggtgtatctcggacact

SEQ ID NO: 708988 - DNA, 25 bp, Mus musculus
ggcctgtagataatgccagcaagtc

SEQ ID NO: 708989 - DNA, 25 bp, Mus musculus
ggcctgtagatattgccagcaagtc

SEQ ID NO: 708990 - DNA, 25 bp, Mus musculus
ggcctgtaggccatttcttgattga

SEQ ID NO: 708991 - DNA, 25 bp, Mus musculus
ggcctgtaggccttttcttgattga

SEQ ID NO: 708992 - DNA, 25 bp, Mus musculus
ggcctgtatgatcacaacaaccaag

SEQ ID NO: 708993 - DNA, 25 bp, Mus musculus
ggcctgtatgatgacaacaaccaag

SEQ ID NO: 708994 - DNA, 25 bp, Mus musculus
ggcctgtcatgaagacgtcacagat

SEQ ID NO: 708995 - DNA, 25 bp, Mus musculus
ggcctgtcatgatgacgtcacagat

SEQ ID NO: 708996 - DNA, 25 bp, Mus musculus
ggcctgtccgggaataccatgctag

SEQ ID NO: 708997 - DNA, 25 bp, Mus musculus
ggcctgtccgggtataccatgctag

SEQ ID NO: 708998 - DNA, 25 bp, Mus musculus
ggcctgtgaacactccagtgaggcc

SEQ ID NO: 708999 - DNA, 25 bp, Mus musculus
ggcctgtgaacagtccagtgaggcc

SEQ ID NO: 709000 - DNA, 25 bp, Mus musculus
ggcctgtgatagacctcagcggata

SEQ ID NO: 709001 - DNA, 25 bp, Mus musculus
ggcctgtgatagtcctcagcggata

SEQ ID NO: 709002 - DNA, 25 bp, Mus musculus
ggcctgtgcatgaagtgatgttacc

SEQ ID NO: 709003 - DNA, 25 bp, Mus musculus
ggcctgtgcatgtagtgatgttacc

SEQ ID NO: 709004 - DNA, 25 bp, Mus musculus
ggcctgtggaggaggtcatgcctgt

SEQ ID NO: 709005 - DNA, 25 bp, Mus musculus
ggcctgtggaggtggtcatgcctgt

SEQ ID NO: 709006 - DNA, 25 bp, Mus musculus
ggcctgtggattatgtcgatggaca

SEQ ID NO: 709007 - DNA, 25 bp, Mus musculus
ggcctgtggattttgtcgatggaca

SEQ ID NO: 709008 - DNA, 25 bp, Mus musculus
ggcctgtggcacaggacctgctaca

SEQ ID NO: 709009 - DNA, 25 bp, Mus musculus
ggcctgtggcactggacctgctaca

SEQ ID NO: 709010 - DNA, 25 bp, Mus musculus
ggcctgtggctgataccttctaccg

SEQ ID NO: 709011 - DNA, 25 bp, Mus musculus
ggcctgtggctgttaccttctaccg

SEQ ID NO: 709012 - DNA, 25 bp, Mus musculus
ggcctgtggtgtccgcctacagttt

SEQ ID NO: 709013 - DNA, 25 bp, Mus musculus
ggcctgtggtgtgcgcctacagttt

SEQ ID NO: 709014 - DNA, 25 bp, Mus musculus
ggcctgttcaccagattccgtcctt

SEQ ID NO: 709015 - DNA, 25 bp, Mus musculus
ggcctgttcacctgattccgtcctt

SEQ ID NO: 709016 - DNA, 25 bp, Mus musculus
ggcctgttccaaacgtgctgggcag

SEQ ID NO: 709017 - DNA, 25 bp, Mus musculus
ggcctgttccaatcgtgctgggcag

SEQ ID NO: 709018 - DNA, 25 bp, Mus musculus
ggcctgtttgatccctctaatgtca

SEQ ID NO: 709019 - DNA, 25 bp, Mus musculus
ggcctgtttgatgcctctaatgtca

SEQ ID NO: 709020 - DNA, 25 bp, Mus musculus
ggccttaaagcaagcactgcactgc

SEQ ID NO: 709021 - DNA, 25 bp, Mus musculus
ggccttaaagcatgcactgcactgc

SEQ ID NO: 709022 - DNA, 25 bp, Mus musculus
ggccttacgtaacctctcagcatgc

SEQ ID NO: 709023 - DNA, 25 bp, Mus musculus
ggccttacgtaagctctcagcatgc

SEQ ID NO: 709024 - DNA, 25 bp, Mus musculus
ggccttacgtctaccattccggaca

SEQ ID NO: 709025 - DNA, 25 bp, Mus musculus
ggccttacgtcttccattccggaca

SEQ ID NO: 709026 - DNA, 25 bp, Mus musculus
ggccttactgggaattcttcggatg

SEQ ID NO: 709027 - DNA, 25 bp, Mus musculus
ggccttactgggtattcttcggatg

SEQ ID NO: 709028 - DNA, 25 bp, Mus musculus
ggccttagagctccaaccggcagtg

SEQ ID NO: 709029 - DNA, 25 bp, Mus musculus
ggccttagagctgcaaccggcagtg

SEQ ID NO: 709030 - DNA, 25 bp, Mus musculus
ggccttagctgcacaaataggatgc

SEQ ID NO: 709031 - DNA, 25 bp, Mus musculus
ggccttagctgctcaaataggatgc

SEQ ID NO: 709032 - DNA, 25 bp, Mus musculus
ggccttatagatacccgactcctga

SEQ ID NO: 709033 - DNA, 25 bp, Mus musculus
ggccttatagattcccgactcctga

SEQ ID NO: 709034 - DNA, 25 bp, Mus musculus
ggccttatctatcttcatgcaaaac

SEQ ID NO: 709035 - DNA, 25 bp, Mus musculus
ggccttatctatgttcatgcaaaac

SEQ ID NO: 709036 - DNA, 25 bp, Mus musculus
ggccttatggagcaaggacaccatg

SEQ ID NO: 709037 - DNA, 25 bp, Mus musculus
ggccttatggaggaaggacaccatg

SEQ ID NO: 709038 - DNA, 25 bp, Mus musculus
ggccttcagagtcagatgtcttcat

SEQ ID NO: 709039 - DNA, 25 bp, Mus musculus
ggccttcagagtgagatgtcttcat

SEQ ID NO: 709040 - DNA, 25 bp, Mus musculus
ggccttcagctgatctaaccaacag

SEQ ID NO: 709041 - DNA, 25 bp, Mus musculus
ggccttcagctgttctaaccaacag

SEQ ID NO: 709042 - DNA, 25 bp, Mus musculus
ggccttcaggcactgctatgtcaaa

SEQ ID NO: 709043 - DNA, 25 bp, Mus musculus
ggccttcaggcagtgctatgtcaaa

SEQ ID NO: 709044 - DNA, 25 bp, Mus musculus
ggccttcataccacagctgctgtca

SEQ ID NO: 709045 - DNA, 25 bp, Mus musculus
ggccttcatacctcagctgctgtca

SEQ ID NO: 709046 - DNA, 25 bp, Mus musculus
ggccttccagatagtgctgtcccac

SEQ ID NO: 709047 - DNA, 25 bp, Mus musculus
ggccttccagattgtgctgtcccac

SEQ ID NO: 709048 - DNA, 25 bp, Mus musculus
ggccttccatgtcaagggaaccgca

SEQ ID NO: 709049 - DNA, 25 bp, Mus musculus
ggccttccatgtgaagggaaccgca

SEQ ID NO: 709050 - DNA, 25 bp, Mus musculus
ggccttccgagaatttgacaaagac

SEQ ID NO: 709051 - DNA, 25 bp, Mus musculus
ggccttccgagattttgacaaagac

SEQ ID NO: 709052 - DNA, 25 bp, Mus musculus
ggccttccgcgcatttcattaccgt

SEQ ID NO: 709053 - DNA, 25 bp, Mus musculus
ggccttccgcgcttttcattaccgt

SEQ ID NO: 709054 - DNA, 25 bp, Mus musculus
ggccttccgtcaagagatgctgcaa

SEQ ID NO: 709055 - DNA, 25 bp, Mus musculus
ggccttccgtcatgagatgctgcaa

SEQ ID NO: 709056 - DNA, 25 bp, Mus musculus
ggccttcctctgattcagctatgga

SEQ ID NO: 709057 - DNA, 25 bp, Mus musculus
ggccttcctctgtttcagctatgga

SEQ ID NO: 709058 - DNA, 25 bp, Mus musculus
ggccttcctgcccttgttaacacaa

SEQ ID NO: 709059 - DNA, 25 bp, Mus musculus
ggccttcctgccgttgttaacacaa

SEQ ID NO: 709060 - DNA, 25 bp, Mus musculus
ggccttcgatatcattctccttggt

SEQ ID NO: 709061 - DNA, 25 bp, Mus musculus
ggccttcgatatgattctccttggt

SEQ ID NO: 709062 - DNA, 25 bp, Mus musculus
ggccttcgtatacctgagcaacctg

SEQ ID NO: 709063 - DNA, 25 bp, Mus musculus
ggccttcgtatagctgagcaacctg

SEQ ID NO: 709064 - DNA, 25 bp, Mus musculus
ggccttctacaaagggagcctcaca

SEQ ID NO: 709065 - DNA, 25 bp, Mus musculus
ggccttctacaatgggagcctcaca

SEQ ID NO: 709066 - DNA, 25 bp, Mus musculus
ggccttctcttgatgcacgggcaga

SEQ ID NO: 709067 - DNA, 25 bp, Mus musculus
ggccttctcttgttgcacgggcaga

SEQ ID NO: 709068 - DNA, 25 bp, Mus musculus
ggccttctgaagcagccaagctcag

SEQ ID NO: 709069 - DNA, 25 bp, Mus musculus
ggccttctgaaggagccaagctcag

SEQ ID NO: 709070 - DNA, 25 bp, Mus musculus
ggccttctggacaagtgtgctgcaa

SEQ ID NO: 709071 - DNA, 25 bp, Mus musculus
ggccttctggactagtgtgctgcaa

SEQ ID NO: 709072 - DNA, 25 bp, Mus musculus
ggccttctggagattctacaacccc

SEQ ID NO: 709073 - DNA, 25 bp, Mus musculus
ggccttctggagtttctacaacccc

SEQ ID NO: 709074 - DNA, 25 bp, Mus musculus
ggccttctggatagacaagatcaaa

SEQ ID NO: 709075 - DNA, 25 bp, Mus musculus
ggccttctggattgacaagatcaaa

SEQ ID NO: 709076 - DNA, 25 bp, Mus musculus
ggccttctgtgaatttgctaggaga

SEQ ID NO: 709077 - DNA, 25 bp, Mus musculus
ggccttctgtgaccccggcaatgtg

SEQ ID NO: 709078 - DNA, 25 bp, Mus musculus
ggccttctgtgagcccggcaatgtg

SEQ ID NO: 709079 - DNA, 25 bp, Mus musculus
ggccttctgtgattttgctaggaga

SEQ ID NO: 709080 - DNA, 25 bp, Mus musculus
ggccttgaagctcagaaaccctgca

SEQ ID NO: 709081 - DNA, 25 bp, Mus musculus
ggccttgaagctgagaaaccctgca

SEQ ID NO: 709082 - DNA, 25 bp, Mus musculus
ggccttgaaggtcgtaagactcgct

SEQ ID NO: 709083 - DNA, 25 bp, Mus musculus
ggccttgaaggtggtaagactcgct

SEQ ID NO: 709084 - DNA, 25 bp, Mus musculus
ggccttgactgtcaagctcatgcag

SEQ ID NO: 709085 - DNA, 25 bp, Mus musculus
ggccttgactgtgaagctcatgcag

SEQ ID NO: 709086 - DNA, 25 bp, Mus musculus
ggccttgatcctcggaaactctaca

SEQ ID NO: 709087 - DNA, 25 bp, Mus musculus
ggccttgatcctgggaaactctaca

SEQ ID NO: 709088 - DNA, 25 bp, Mus musculus
ggccttgcgttgatgtagaagacat

SEQ ID NO: 709089 - DNA, 25 bp, Mus musculus
ggccttgcgttgttgtagaagacat

SEQ ID NO: 709090 - DNA, 25 bp, Mus musculus
ggccttgctcaaaccacgggtacga

SEQ ID NO: 709091 - DNA, 25 bp, Mus musculus
ggccttgctcaatccacgggtacga

SEQ ID NO: 709092 - DNA, 25 bp, Mus musculus
ggccttggagcaaactcactgtaca

SEQ ID NO: 709093 - DNA, 25 bp, Mus musculus
ggccttggagcatactcactgtaca

SEQ ID NO: 709094 - DNA, 25 bp, Mus musculus
ggccttggagctcactggtttaaaa

SEQ ID NO: 709095 - DNA, 25 bp, Mus musculus
ggccttggagctgactggtttaaaa

SEQ ID NO: 709096 - DNA, 25 bp, Mus musculus
ggccttggatatcgcgaagcgcaca

SEQ ID NO: 709097 - DNA, 25 bp, Mus musculus
ggccttggatatggcgaagcgcaca

SEQ ID NO: 709098 - DNA, 25 bp, Mus musculus
ggccttggatgacagcctcgccgaa

SEQ ID NO: 709099 - DNA, 25 bp, Mus musculus
ggccttggatgagagcctcgccgaa

SEQ ID NO: 709100 - DNA, 25 bp, Mus musculus
ggccttggcccgagccttgatccgg

SEQ ID NO: 709101 - DNA, 25 bp, Mus musculus
ggccttggcccgtgccttgatccgg

SEQ ID NO: 709102 - DNA, 25 bp, Mus musculus
ggccttgggccaatggatcagcttt

SEQ ID NO: 709103 - DNA, 25 bp, Mus musculus
ggccttgggccattggatcagcttt

SEQ ID NO: 709104 - DNA, 25 bp, Mus musculus
ggccttggtccacggcatcctggaa

SEQ ID NO: 709105 - DNA, 25 bp, Mus musculus
ggccttggtccagggcatcctggaa

SEQ ID NO: 709106 - DNA, 25 bp, Mus musculus
ggccttggtgctccctaactatcta

SEQ ID NO: 709107 - DNA, 25 bp, Mus musculus
ggccttggtgctgcctaactatcta

SEQ ID NO: 709108 - DNA, 25 bp, Mus musculus
ggccttggttgcaagacctctgaga

SEQ ID NO: 709109 - DNA, 25 bp, Mus musculus
ggccttggttgctagacctctgaga

SEQ ID NO: 709110 - DNA, 25 bp, Mus musculus
ggccttgtacgacgccatgtttaca

SEQ ID NO: 709111 - DNA, 25 bp, Mus musculus
ggccttgtacgaggccatgtttaca

SEQ ID NO: 709112 - DNA, 25 bp, Mus musculus
ggccttgtacttaatcctcactgct

SEQ ID NO: 709113 - DNA, 25 bp, Mus musculus
ggccttgtactttatcctcactgct

SEQ ID NO: 709114 - DNA, 25 bp, Mus musculus
ggccttgtataaaacacatgcctgc

SEQ ID NO: 709115 - DNA, 25 bp, Mus musculus
ggccttgtataatacacatgcctgc

SEQ ID NO: 709116 - DNA, 25 bp, Mus musculus
ggccttgtcgcccttagcttgatca

SEQ ID NO: 709117 - DNA, 25 bp, Mus musculus
ggccttgtcgccgttagcttgatca

SEQ ID NO: 709118 - DNA, 25 bp, Mus musculus
ggccttgtgagaaccgtgagcatct

SEQ ID NO: 709119 - DNA, 25 bp, Mus musculus
ggccttgtgagatccgtgagcatct

SEQ ID NO: 709120 - DNA, 25 bp, Mus musculus
ggccttgtggtcattgcccctgata

SEQ ID NO: 709121 - DNA, 25 bp, Mus musculus
ggccttgtggtctttgcccctgata

SEQ ID NO: 709122 - DNA, 25 bp, Mus musculus
ggccttgtgtgtctggagctctaca

SEQ ID NO: 709123 - DNA, 25 bp, Mus musculus
ggccttgtgtgtgtggagctctaca

SEQ ID NO: 709124 - DNA, 25 bp, Mus musculus
ggccttgttagaagtcctcctggcg

SEQ ID NO: 709125 - DNA, 25 bp, Mus musculus
ggccttgttagatgtcctcctggcg

SEQ ID NO: 709126 - DNA, 25 bp, Mus musculus
ggccttgttgatacccacatccatg

SEQ ID NO: 709127 - DNA, 25 bp, Mus musculus
ggccttgttgattcccacatccatg

SEQ ID NO: 709128 - DNA, 25 bp, Mus musculus
ggcctttaccgcaagtcaggagctg

SEQ ID NO: 709129 - DNA, 25 bp, Mus musculus
ggcctttaccgctagtcaggagctg

SEQ ID NO: 709130 - DNA, 25 bp, Mus musculus
ggcctttactttactctgttctcaa

SEQ ID NO: 709131 - DNA, 25 bp, Mus musculus
ggcctttacttttctctgttctcaa

SEQ ID NO: 709132 - DNA, 25 bp, Mus musculus
ggcctttagcgcatcatccttggtt

SEQ ID NO: 709133 - DNA, 25 bp, Mus musculus
ggcctttagcgcttcatccttggtt

SEQ ID NO: 709134 - DNA, 25 bp, Mus musculus
ggcctttccgatcctgtactccagg

SEQ ID NO: 709135 - DNA, 25 bp, Mus musculus
ggcctttccgatgctgtactccagg

SEQ ID NO: 709136 - DNA, 25 bp, Mus musculus
ggcctttgataccatggtgacttcc

SEQ ID NO: 709137 - DNA, 25 bp, Mus musculus
ggcctttgatacgatggtgacttcc

SEQ ID NO: 709138 - DNA, 25 bp, Mus musculus
ggcctttgcaatagtcctcatctgc

SEQ ID NO: 709139 - DNA, 25 bp, Mus musculus
ggcctttgcaattgtcctcatctgc

SEQ ID NO: 709140 - DNA, 25 bp, Mus musculus
ggcctttgctataggtgcccgcgct

SEQ ID NO: 709141 - DNA, 25 bp, Mus musculus
ggcctttgctattggtgcccgcgct

SEQ ID NO: 709142 - DNA, 25 bp, Mus musculus
ggcctttggtatcgatccctcccgg

SEQ ID NO: 709143 - DNA, 25 bp, Mus musculus
ggcctttggtatggatccctcccgg

SEQ ID NO: 709144 - DNA, 25 bp, Mus musculus
ggcctttggtcacgccaagcaccaa

SEQ ID NO: 709145 - DNA, 25 bp, Mus musculus
ggcctttggtcaggccaagcaccaa

SEQ ID NO: 709146 - DNA, 25 bp, Mus musculus
ggcctttgtagtcgctgtcaagcag

SEQ ID NO: 709147 - DNA, 25 bp, Mus musculus
ggcctttgtagtggctgtcaagcag

SEQ ID NO: 709148 - DNA, 25 bp, Mus musculus
ggcctttgtctcaacctccggaatc

SEQ ID NO: 709149 - DNA, 25 bp, Mus musculus
ggcctttgtctctacctccggaatc

SEQ ID NO: 709150 - DNA, 25 bp, Mus musculus
ggcctttgtgaaccgagccaacaat

SEQ ID NO: 709151 - DNA, 25 bp, Mus musculus
ggcctttgtgaagcgagccaacaat

SEQ ID NO: 709152 - DNA, 25 bp, Mus musculus
ggccttttacttcgatccaagcaga

SEQ ID NO: 709153 - DNA, 25 bp, Mus musculus
ggccttttacttggatccaagcaga

SEQ ID NO: 709154 - DNA, 25 bp, Mus musculus
ggccttttcaagcagccagcagaaa

SEQ ID NO: 709155 - DNA, 25 bp, Mus musculus
ggccttttcaaggagccagcagaaa

SEQ ID NO: 709156 - DNA, 25 bp, Mus musculus
ggccttttgtaaagcccagcatgcc

SEQ ID NO: 709157 - DNA, 25 bp, Mus musculus
ggccttttgtaatgcccagcatgcc

SEQ ID NO: 709158 - DNA, 25 bp, Mus musculus
ggcgaaaactcaccaccagaaagga

SEQ ID NO: 709159 - DNA, 25 bp, Mus musculus
ggcgaaaactcagcaccagaaagga

SEQ ID NO: 709160 - DNA, 25 bp, Mus musculus
ggcgaaaagatgacaaaagtccgcg

SEQ ID NO: 709161 - DNA, 25 bp, Mus musculus
ggcgaaaagatgtcaaaagtccgcg

SEQ ID NO: 709162 - DNA, 25 bp, Mus musculus
ggcgaaaaggcaccccgccatgtct

SEQ ID NO: 709163 - DNA, 25 bp, Mus musculus
ggcgaaaaggcagcccgccatgtct

SEQ ID NO: 709164 - DNA, 25 bp, Mus musculus
ggcgaacctcaacccacaatcaaat

SEQ ID NO: 709165 - DNA, 25 bp, Mus musculus
ggcgaacctcaagccacaatcaaat

SEQ ID NO: 709166 - DNA, 25 bp, Mus musculus
ggcgaacgactcacccgcgaagagc

SEQ ID NO: 709167 - DNA, 25 bp, Mus musculus
ggcgaacgactctcccgcgaagagc

SEQ ID NO: 709168 - DNA, 25 bp, Mus musculus
ggcgaagactcacatctcaagcaga

SEQ ID NO: 709169 - DNA, 25 bp, Mus musculus
ggcgaagactcagatctcaagcaga

SEQ ID NO: 709170 - DNA, 25 bp, Mus musculus
ggcgaagcacgaccagatcctggtc

SEQ ID NO: 709171 - DNA, 25 bp, Mus musculus
ggcgaagcacgagcagatcctggtc

SEQ ID NO: 709172 - DNA, 25 bp, Mus musculus
ggcgaagctgagacacgaaacccaa

SEQ ID NO: 709173 - DNA, 25 bp, Mus musculus
ggcgaagctgagtcacgaaacccaa

SEQ ID NO: 709174 - DNA, 25 bp, Mus musculus
ggcgaaggactccttaccgtcactc

SEQ ID NO: 709175 - DNA, 25 bp, Mus musculus
ggcgaaggactcgttaccgtcactc

SEQ ID NO: 709176 - DNA, 25 bp, Mus musculus
ggcgaaggcatcaccatcaatacag

SEQ ID NO: 709177 - DNA, 25 bp, Mus musculus
ggcgaaggcatctccatcaatacag

SEQ ID NO: 709178 - DNA, 25 bp, Mus musculus
ggcgaagggaccacatctcccactt

SEQ ID NO: 709179 - DNA, 25 bp, Mus musculus
ggcgaagggacctcatctcccactt

SEQ ID NO: 709180 - DNA, 25 bp, Mus musculus
ggcgaagggcccatctttttctaca

SEQ ID NO: 709181 - DNA, 25 bp, Mus musculus
ggcgaagggcccttctttttctaca

SEQ ID NO: 709182 - DNA, 25 bp, Mus musculus
ggcgaagtgcttatctcctgccccg

SEQ ID NO: 709183 - DNA, 25 bp, Mus musculus
ggcgaagtgcttttctcctgccccg

SEQ ID NO: 709184 - DNA, 25 bp, Mus musculus
ggcgaagttgtgacctggcaggagt

SEQ ID NO: 709185 - DNA, 25 bp, Mus musculus
ggcgaagttgtgtcctggcaggagt

SEQ ID NO: 709186 - DNA, 25 bp, Mus musculus
ggcgacacgtcgacctgacgctcta

SEQ ID NO: 709187 - DNA, 25 bp, Mus musculus
ggcgacacgtcgtcctgacgctcta

SEQ ID NO: 709188 - DNA, 25 bp, Mus musculus
ggcgacagaccaccgactcgagcgt

SEQ ID NO: 709189 - DNA, 25 bp, Mus musculus
ggcgacagaccagcgactcgagcgt

SEQ ID NO: 709190 - DNA, 25 bp, Mus musculus
ggcgacagccatcaataccgggtgt

SEQ ID NO: 709191 - DNA, 25 bp, Mus musculus
ggcgacagccatgaataccgggtgt

SEQ ID NO: 709192 - DNA, 25 bp, Mus musculus
ggcgacagtatgacatcacgggact

SEQ ID NO: 709193 - DNA, 25 bp, Mus musculus
ggcgacagtatgtcatcacgggact

SEQ ID NO: 709194 - DNA, 25 bp, Mus musculus
ggcgacagttccacggcccagggac

SEQ ID NO: 709195 - DNA, 25 bp, Mus musculus
ggcgacagttcctcggcccagggac

SEQ ID NO: 709196 - DNA, 25 bp, Mus musculus
ggcgacatcctccaccagatcatga

SEQ ID NO: 709197 - DNA, 25 bp, Mus musculus
ggcgacatcctcgaccagatcatga

SEQ ID NO: 709198 - DNA, 25 bp, Mus musculus
ggcgacattggcacgtcctgttaca

SEQ ID NO: 709199 - DNA, 25 bp, Mus musculus
ggcgacattggctcgtcctgttaca

SEQ ID NO: 709200 - DNA, 25 bp, Mus musculus
ggcgaccagacgacaggctgccagc

SEQ ID NO: 709201 - DNA, 25 bp, Mus musculus
ggcgaccagacgtcaggctgccagc

SEQ ID NO: 709202 - DNA, 25 bp, Mus musculus
ggcgaccctggcacacttgtgctct

SEQ ID NO: 709203 - DNA, 25 bp, Mus musculus
ggcgaccctggctcacttgtgctct

SEQ ID NO: 709204 - DNA, 25 bp, Mus musculus
ggcgaccgctccagttgcagctgta

SEQ ID NO: 709205 - DNA, 25 bp, Mus musculus
ggcgaccgctcctgttgcagctgta

SEQ ID NO: 709206 - DNA, 25 bp, Mus musculus
ggcgaccggtcaagatccgcaggat

SEQ ID NO: 709207 - DNA, 25 bp, Mus musculus
ggcgaccggtcatgatccgcaggat

SEQ ID NO: 709208 - DNA, 25 bp, Mus musculus
ggcgacgaagtcacctataagatgt

SEQ ID NO: 709209 - DNA, 25 bp, Mus musculus
ggcgacgaagtctcctataagatgt

SEQ ID NO: 709210 - DNA, 25 bp, Mus musculus
ggcgacgctttaaacttgagcttca

SEQ ID NO: 709211 - DNA, 25 bp, Mus musculus
ggcgacgctttatacttgagcttca

SEQ ID NO: 709212 - DNA, 25 bp, Mus musculus
ggcgacggacaactcaactatgaag

SEQ ID NO: 709213 - DNA, 25 bp, Mus musculus
ggcgacggacaagtcaactatgaag

SEQ ID NO: 709214 - DNA, 25 bp, Mus musculus
ggcgactaggtgctccagcgccatc

SEQ ID NO: 709215 - DNA, 25 bp, Mus musculus
ggcgactaggtggtccagcgccatc

SEQ ID NO: 709216 - DNA, 25 bp, Mus musculus
ggcgactcaggcatgtccagcagag

SEQ ID NO: 709217 - DNA, 25 bp, Mus musculus
ggcgactcaggcttgtccagcagag

SEQ ID NO: 709218 - DNA, 25 bp, Mus musculus
ggcgactctttaccctgatcaaata

SEQ ID NO: 709219 - DNA, 25 bp, Mus musculus
ggcgactctttagcctgatcaaata

SEQ ID NO: 709220 - DNA, 25 bp, Mus musculus
ggcgacttcaccaaccacaatggca

SEQ ID NO: 709221 - DNA, 25 bp, Mus musculus
ggcgacttcacctaccacaatggca

SEQ ID NO: 709222 - DNA, 25 bp, Mus musculus
ggcgacttccagacaagtggatggc

SEQ ID NO: 709223 - DNA, 25 bp, Mus musculus
ggcgacttccagtcaagtggatggc

SEQ ID NO: 709224 - DNA, 25 bp, Mus musculus
ggcgacttcgcaaggaagaaaacaa

SEQ ID NO: 709225 - DNA, 25 bp, Mus musculus
ggcgacttcgcatggaagaaaacaa

SEQ ID NO: 709226 - DNA, 25 bp, Mus musculus
ggcgagaaaagcactctagagtcca

SEQ ID NO: 709227 - DNA, 25 bp, Mus musculus
ggcgagaaaagctctctagagtcca

SEQ ID NO: 709228 - DNA, 25 bp, Mus musculus
ggcgagaacgagagaggcagacaaa

SEQ ID NO: 709229 - DNA, 25 bp, Mus musculus
ggcgagaacgagtgaggcagacaaa

SEQ ID NO: 709230 - DNA, 25 bp, Mus musculus
ggcgagaacgtccaagaggctttca

SEQ ID NO: 709231 - DNA, 25 bp, Mus musculus
ggcgagaacgtcgaagaggctttca

SEQ ID NO: 709232 - DNA, 25 bp, Mus musculus
ggcgagaccaacaggatcattgcct

SEQ ID NO: 709233 - DNA, 25 bp, Mus musculus
ggcgagaccaactggatcattgcct

SEQ ID NO: 709234 - DNA, 25 bp, Mus musculus
ggcgagagagcccagctatagccca

SEQ ID NO: 709235 - DNA, 25 bp, Mus musculus
ggcgagagagccgagctatagccca

SEQ ID NO: 709236 - DNA, 25 bp, Mus musculus
ggcgagagcatcaccatccggtgca

SEQ ID NO: 709237 - DNA, 25 bp, Mus musculus
ggcgagagcatctccatccggtgca

SEQ ID NO: 709238 - DNA, 25 bp, Mus musculus
ggcgagaggaagacgcagcttccac

SEQ ID NO: 709239 - DNA, 25 bp, Mus musculus
ggcgagaggaagtcgcagcttccac

SEQ ID NO: 709240 - DNA, 25 bp, Mus musculus
ggcgagagtcatctattacctctag

SEQ ID NO: 709241 - DNA, 25 bp, Mus musculus
ggcgagagtcatgtattacctctag

SEQ ID NO: 709242 - DNA, 25 bp, Mus musculus
ggcgagatagctctcatcagcttag

SEQ ID NO: 709243 - DNA, 25 bp, Mus musculus
ggcgagatagctgtcatcagcttag

SEQ ID NO: 709244 - DNA, 25 bp, Mus musculus
ggcgagcacattcgatatgcaacag

SEQ ID NO: 709245 - DNA, 25 bp, Mus musculus
ggcgagcacattggatatgcaacag

SEQ ID NO: 709246 - DNA, 25 bp, Mus musculus
ggcgagcccaagactcaggcctgct

SEQ ID NO: 709247 - DNA, 25 bp, Mus musculus
ggcgagcccaagtctcaggcctgct

SEQ ID NO: 709248 - DNA, 25 bp, Mus musculus
ggcgagcccatgatcgccctgacta

SEQ ID NO: 709249 - DNA, 25 bp, Mus musculus
ggcgagcccatgttcgccctgacta

SEQ ID NO: 709250 - DNA, 25 bp, Mus musculus
ggcgagccggccatctatgctgaaa

SEQ ID NO: 709251 - DNA, 25 bp, Mus musculus
ggcgagccggccttctatgctgaaa

SEQ ID NO: 709252 - DNA, 25 bp, Mus musculus
ggcgagcctgccactcatctttgac

SEQ ID NO: 709253 - DNA, 25 bp, Mus musculus
ggcgagcctgcctctcatctttgac

SEQ ID NO: 709254 - DNA, 25 bp, Mus musculus
ggcgagcgcagactcgccggaggct

SEQ ID NO: 709255 - DNA, 25 bp, Mus musculus
ggcgagcgcagagtcgccggaggct

SEQ ID NO: 709256 - DNA, 25 bp, Mus musculus
ggcgagcgccttagttcactgcggc

SEQ ID NO: 709257 - DNA, 25 bp, Mus musculus
ggcgagcgcctttgttcactgcggc

SEQ ID NO: 709258 - DNA, 25 bp, Mus musculus
ggcgagcgcgctaatgacatatact

SEQ ID NO: 709259 - DNA, 25 bp, Mus musculus
ggcgagcgcgcttatgacatatact

SEQ ID NO: 709260 - DNA, 25 bp, Mus musculus
ggcgagctacctattcctggagttg

SEQ ID NO: 709261 - DNA, 25 bp, Mus musculus
ggcgagctaccttttcctggagttg

SEQ ID NO: 709262 - DNA, 25 bp, Mus musculus
ggcgagctgactagtacgatcatgt

SEQ ID NO: 709263 - DNA, 25 bp, Mus musculus
ggcgagctgacttgtacgatcatgt

SEQ ID NO: 709264 - DNA, 25 bp, Mus musculus
ggcgaggaagacaagcctaagcctg

SEQ ID NO: 709265 - DNA, 25 bp, Mus musculus
ggcgaggaagactagcctaagcctg

SEQ ID NO: 709266 - DNA, 25 bp, Mus musculus
ggcgaggtgggcaccactctctaca

SEQ ID NO: 709267 - DNA, 25 bp, Mus musculus
ggcgaggtgggctccactctctaca

SEQ ID NO: 709268 - DNA, 25 bp, Mus musculus
ggcgagtaccacaaagtgtagcagc

SEQ ID NO: 709269 - DNA, 25 bp, Mus musculus
ggcgagtaccactaagtgtagcagc

SEQ ID NO: 709270 - DNA, 25 bp, Mus musculus
ggcgagtactatctcaatgggcact

SEQ ID NO: 709271 - DNA, 25 bp, Mus musculus
ggcgagtactatgtcaatgggcact

SEQ ID NO: 709272 - DNA, 25 bp, Mus musculus
ggcgagtatttaagatgcggatgaa

SEQ ID NO: 709273 - DNA, 25 bp, Mus musculus
ggcgagtatttatgatgcggatgaa

SEQ ID NO: 709274 - DNA, 25 bp, Mus musculus
ggcgagtcgcagacttgctgcgtct

SEQ ID NO: 709275 - DNA, 25 bp, Mus musculus
ggcgagtcgcagtcttgctgcgtct

SEQ ID NO: 709276 - DNA, 25 bp, Mus musculus
ggcgagtcttttagagtgtcctgtc

SEQ ID NO: 709277 - DNA, 25 bp, Mus musculus
ggcgagtctttttgagtgtcctgtc

SEQ ID NO: 709278 - DNA, 25 bp, Mus musculus
ggcgagtgcctcaacagcctgggct

SEQ ID NO: 709279 - DNA, 25 bp, Mus musculus
ggcgagtgcctctacagcctgggct

SEQ ID NO: 709280 - DNA, 25 bp, Mus musculus
ggcgagtggaaaccacgtcaaattg

SEQ ID NO: 709281 - DNA, 25 bp, Mus musculus
ggcgagtggaaagcacgtcaaattg

SEQ ID NO: 709282 - DNA, 25 bp, Mus musculus
ggcgataagaagaacaccaaagcta

SEQ ID NO: 709283 - DNA, 25 bp, Mus musculus
ggcgataagaagtacaccaaagcta

SEQ ID NO: 709284 - DNA, 25 bp, Mus musculus
ggcgatcactgaagagtctaaggct

SEQ ID NO: 709285 - DNA, 25 bp, Mus musculus
ggcgatcactgatgagtctaaggct

SEQ ID NO: 709286 - DNA, 25 bp, Mus musculus
ggcgatcagattacaggcactccat

SEQ ID NO: 709287 - DNA, 25 bp, Mus musculus
ggcgatcagatttcaggcactccat

SEQ ID NO: 709288 - DNA, 25 bp, Mus musculus
ggcgatcagctgaaaaacagggtca

SEQ ID NO: 709289 - DNA, 25 bp, Mus musculus
ggcgatcagctgtaaaacagggtca

SEQ ID NO: 709290 - DNA, 25 bp, Mus musculus
ggcgatccactccaacaatcgagag

SEQ ID NO: 709291 - DNA, 25 bp, Mus musculus
ggcgatccactcgaacaatcgagag

SEQ ID NO: 709292 - DNA, 25 bp, Mus musculus
ggcgatctttccagtgaagatggct

SEQ ID NO: 709293 - DNA, 25 bp, Mus musculus
ggcgatctttcctgtgaagatggct

SEQ ID NO: 709294 - DNA, 25 bp, Mus musculus
ggcgatctttgaaccttcaggatcc

SEQ ID NO: 709295 - DNA, 25 bp, Mus musculus
ggcgatctttgatccttcaggatcc

SEQ ID NO: 709296 - DNA, 25 bp, Mus musculus
ggcgatgatggcaaaccaggcctga

SEQ ID NO: 709297 - DNA, 25 bp, Mus musculus
ggcgatgatggctaaccaggcctga

SEQ ID NO: 709298 - DNA, 25 bp, Mus musculus
ggcgatggcatcattcggcgccctg

SEQ ID NO: 709299 - DNA, 25 bp, Mus musculus
ggcgatggcatctttcggcgccctg

SEQ ID NO: 709300 - DNA, 25 bp, Mus musculus
ggcgattccagcatccggtactttg

SEQ ID NO: 709301 - DNA, 25 bp, Mus musculus
ggcgattccagcttccggtactttg

SEQ ID NO: 709302 - DNA, 25 bp, Mus musculus
ggcgattccctacacccaggatgga

SEQ ID NO: 709303 - DNA, 25 bp, Mus musculus
ggcgattccctagacccaggatgga

SEQ ID NO: 709304 - DNA, 25 bp, Mus musculus
ggcgattgctgacttggacaccctg

SEQ ID NO: 709305 - DNA, 25 bp, Mus musculus
ggcgattgctgagttggacaccctg

SEQ ID NO: 709306 - DNA, 25 bp, Mus musculus
ggcgattgctgcaatgctgtctacc

SEQ ID NO: 709307 - DNA, 25 bp, Mus musculus
ggcgattgctgctatgctgtctacc

SEQ ID NO: 709308 - DNA, 25 bp, Mus musculus
ggcgatttacagatgcgggatcaga

SEQ ID NO: 709309 - DNA, 25 bp, Mus musculus
ggcgatttacagttgcgggatcaga

SEQ ID NO: 709310 - DNA, 25 bp, Mus musculus
ggcgatttcgttacttctcacgctc

SEQ ID NO: 709311 - DNA, 25 bp, Mus musculus
ggcgatttcgtttcttctcacgctc

SEQ ID NO: 709312 - DNA, 25 bp, Mus musculus
ggcgatttctttcgaacagcttgct

SEQ ID NO: 709313 - DNA, 25 bp, Mus musculus
ggcgatttctttggaacagcttgct

SEQ ID NO: 709314 - DNA, 25 bp, Mus musculus
ggcgcaacatctagccaaacttgaa

SEQ ID NO: 709315 - DNA, 25 bp, Mus musculus
ggcgcaacatcttgccaaacttgaa

SEQ ID NO: 709316 - DNA, 25 bp, Mus musculus
ggcgcaacgtgacactcttctcacg

SEQ ID NO: 709317 - DNA, 25 bp, Mus musculus
ggcgcaacgtgagactcttctcacg

SEQ ID NO: 709318 - DNA, 25 bp, Mus musculus
ggcgcaagaactaggtagccccgag

SEQ ID NO: 709319 - DNA, 25 bp, Mus musculus
ggcgcaagaacttggtagccccgag

SEQ ID NO: 709320 - DNA, 25 bp, Mus musculus
ggcgcaagaggaaacctccagttcc

SEQ ID NO: 709321 - DNA, 25 bp, Mus musculus
ggcgcaagaggatacctccagttcc

SEQ ID NO: 709322 - DNA, 25 bp, Mus musculus
ggcgcaatgactacagccgggacag

SEQ ID NO: 709323 - DNA, 25 bp, Mus musculus
ggcgcaatgacttcagccgggacag

SEQ ID NO: 709324 - DNA, 25 bp, Mus musculus
ggcgcaatgtgacaagctgctcaag

SEQ ID NO: 709325 - DNA, 25 bp, Mus musculus
ggcgcaatgtgagaagctgctcaag

SEQ ID NO: 709326 - DNA, 25 bp, Mus musculus
ggcgcacagctcatctcgctgcaaa

SEQ ID NO: 709327 - DNA, 25 bp, Mus musculus
ggcgcacagctcttctcgctgcaaa

SEQ ID NO: 709328 - DNA, 25 bp, Mus musculus
ggcgcacatacgacgtcatcagcca

SEQ ID NO: 709329 - DNA, 25 bp, Mus musculus
ggcgcacatacgtcgtcatcagcca

SEQ ID NO: 709330 - DNA, 25 bp, Mus musculus
ggcgcacatctcactcgtctaggag

SEQ ID NO: 709331 - DNA, 25 bp, Mus musculus
ggcgcacatctctctcgtctaggag

SEQ ID NO: 709332 - DNA, 25 bp, Mus musculus
ggcgcacatttcacagacaccttag

SEQ ID NO: 709333 - DNA, 25 bp, Mus musculus
ggcgcacatttctcagacaccttag

SEQ ID NO: 709334 - DNA, 25 bp, Mus musculus
ggcgcacctggaatggctcttcctg

SEQ ID NO: 709335 - DNA, 25 bp, Mus musculus
ggcgcacctggattggctcttcctg

SEQ ID NO: 709336 - DNA, 25 bp, Mus musculus
ggcgcactgaagaaaggtccctatg

SEQ ID NO: 709337 - DNA, 25 bp, Mus musculus
ggcgcactgaagtaaggtccctatg

SEQ ID NO: 709338 - DNA, 25 bp, Mus musculus
ggcgcactgactcggcacctcaaat

SEQ ID NO: 709339 - DNA, 25 bp, Mus musculus
ggcgcactgactgggcacctcaaat

SEQ ID NO: 709340 - DNA, 25 bp, Mus musculus
ggcgcagaagaaatatcttcaagca

SEQ ID NO: 709341 - DNA, 25 bp, Mus musculus
ggcgcagaagaattatcttcaagca

SEQ ID NO: 709342 - DNA, 25 bp, Mus musculus
ggcgcagacggcaccaaagccctga

SEQ ID NO: 709343 - DNA, 25 bp, Mus musculus
ggcgcagacggcatgtatgataaac

SEQ ID NO: 709344 - DNA, 25 bp, Mus musculus
ggcgcagacggctccaaagccctga

SEQ ID NO: 709345 - DNA, 25 bp, Mus musculus
ggcgcagacggcttgtatgataaac

SEQ ID NO: 709346 - DNA, 25 bp, Mus musculus
ggcgcagagagcagcgcccatttcc

SEQ ID NO: 709347 - DNA, 25 bp, Mus musculus
ggcgcagagagctgcgcccatttcc

SEQ ID NO: 709348 - DNA, 25 bp, Mus musculus
ggcgcagatccacagcgatatccag

SEQ ID NO: 709349 - DNA, 25 bp, Mus musculus
ggcgcagatccagagcgatatccag

SEQ ID NO: 709350 - DNA, 25 bp, Mus musculus
ggcgcagcagttacgtctgctggcc

SEQ ID NO: 709351 - DNA, 25 bp, Mus musculus
ggcgcagcagtttcgtctgctggcc

SEQ ID NO: 709352 - DNA, 25 bp, Mus musculus
ggcgcagccgctagtggccttacgt

SEQ ID NO: 709353 - DNA, 25 bp, Mus musculus
ggcgcagccgcttgtggccttacgt

SEQ ID NO: 709354 - DNA, 25 bp, Mus musculus
ggcgcagcgcgactacctttctgca

SEQ ID NO: 709355 - DNA, 25 bp, Mus musculus
ggcgcagcgcgagtacctttctgca

SEQ ID NO: 709356 - DNA, 25 bp, Mus musculus
ggcgcaggcaccaccgagggaacat

SEQ ID NO: 709357 - DNA, 25 bp, Mus musculus
ggcgcaggcacctccgagggaacat

SEQ ID NO: 709358 - DNA, 25 bp, Mus musculus
ggcgcagtgcggagtttgtctaccc

SEQ ID NO: 709359 - DNA, 25 bp, Mus musculus
ggcgcagtgcggtgtttgtctaccc

SEQ ID NO: 709360 - DNA, 25 bp, Mus musculus
ggcgcagtggccaggcttggcggta

SEQ ID NO: 709361 - DNA, 25 bp, Mus musculus
ggcgcagtggcctggcttggcggta

SEQ ID NO: 709362 - DNA, 25 bp, Mus musculus
ggcgcatctcttactccaccagtga

SEQ ID NO: 709363 - DNA, 25 bp, Mus musculus
ggcgcatctctttctccaccagtga

SEQ ID NO: 709364 - DNA, 25 bp, Mus musculus
ggcgcatgtacaccgatatccagga

SEQ ID NO: 709365 - DNA, 25 bp, Mus musculus
ggcgcatgtacagcgatatccagga

SEQ ID NO: 709366 - DNA, 25 bp, Mus musculus
ggcgcatgttgactgagacctaccg

SEQ ID NO: 709367 - DNA, 25 bp, Mus musculus
ggcgcatgttgagtgagacctaccg

SEQ ID NO: 709368 - DNA, 25 bp, Mus musculus
ggcgcattacaacttcaagaagatt

SEQ ID NO: 709369 - DNA, 25 bp, Mus musculus
ggcgcattacaagttcaagaagatt

SEQ ID NO: 709370 - DNA, 25 bp, Mus musculus
ggcgcattggatatgctgaaagagc

SEQ ID NO: 709371 - DNA, 25 bp, Mus musculus
ggcgcattggatttgctgaaagagc

SEQ ID NO: 709372 - DNA, 25 bp, Mus musculus
ggcgcattttctactttggctaagg

SEQ ID NO: 709373 - DNA, 25 bp, Mus musculus
ggcgcattttcttctttggctaagg

SEQ ID NO: 709374 - DNA, 25 bp, Mus musculus
ggcgccacctaaaggcagcatttca

SEQ ID NO: 709375 - DNA, 25 bp, Mus musculus
ggcgccacctaatggcagcatttca

SEQ ID NO: 709376 - DNA, 25 bp, Mus musculus
ggcgccagagtcacatttaccatgt

SEQ ID NO: 709377 - DNA, 25 bp, Mus musculus
ggcgccagagtctcatttaccatgt

SEQ ID NO: 709378 - DNA, 25 bp, Mus musculus
ggcgccagtcccaggacaagcttct

SEQ ID NO: 709379 - DNA, 25 bp, Mus musculus
ggcgccagtccctggacaagcttct

SEQ ID NO: 709380 - DNA, 25 bp, Mus musculus
ggcgccatcgacaactgcacgtcaa

SEQ ID NO: 709381 - DNA, 25 bp, Mus musculus
ggcgccatcgactactgcacgtcaa

SEQ ID NO: 709382 - DNA, 25 bp, Mus musculus
ggcgccatcgagcaagctttttaca

SEQ ID NO: 709383 - DNA, 25 bp, Mus musculus
ggcgccatcgaggaagctttttaca

SEQ ID NO: 709384 - DNA, 25 bp, Mus musculus
ggcgccatgacaacccagaaagaca

SEQ ID NO: 709385 - DNA, 25 bp, Mus musculus
ggcgccatgacatcccagaaagaca

SEQ ID NO: 709386 - DNA, 25 bp, Mus musculus
ggcgccatgactcctggaattccca

SEQ ID NO: 709387 - DNA, 25 bp, Mus musculus
ggcgccatgactgctggaattccca

SEQ ID NO: 709388 - DNA, 25 bp, Mus musculus
ggcgccattgccatctcgctcggtg

SEQ ID NO: 709389 - DNA, 25 bp, Mus musculus
ggcgccattgccttctcgctcggtg

SEQ ID NO: 709390 - DNA, 25 bp, Mus musculus
ggcgcccagctcattaagtcagcac

SEQ ID NO: 709391 - DNA, 25 bp, Mus musculus
ggcgcccagctctttaagtcagcac

SEQ ID NO: 709392 - DNA, 25 bp, Mus musculus
ggcgccccactgaagatacacaaga

SEQ ID NO: 709393 - DNA, 25 bp, Mus musculus
ggcgccccactgtagatacacaaga

SEQ ID NO: 709394 - DNA, 25 bp, Mus musculus
ggcgccctgcgaacgacttctaact

SEQ ID NO: 709395 - DNA, 25 bp, Mus musculus
ggcgccctgcgatcgacttctaact

SEQ ID NO: 709396 - DNA, 25 bp, Mus musculus
ggcgccctggtccaattagaattta

SEQ ID NO: 709397 - DNA, 25 bp, Mus musculus
ggcgccctggtcgaattagaattta

SEQ ID NO: 709398 - DNA, 25 bp, Mus musculus
ggcgccctgtacacctactgggttc

SEQ ID NO: 709399 - DNA, 25 bp, Mus musculus
ggcgccctgtactcctactgggttc

SEQ ID NO: 709400 - DNA, 25 bp, Mus musculus
ggcgccgaacctcgacaagatggct

SEQ ID NO: 709401 - DNA, 25 bp, Mus musculus
ggcgccgaacctggacaagatggct

SEQ ID NO: 709402 - DNA, 25 bp, Mus musculus
ggcgccgcagaacacgtcgcattta

SEQ ID NO: 709403 - DNA, 25 bp, Mus musculus
ggcgccgcagaagacgtcgcattta

SEQ ID NO: 709404 - DNA, 25 bp, Mus musculus
ggcgccggaacaatggacagcttct

SEQ ID NO: 709405 - DNA, 25 bp, Mus musculus
ggcgccggaacattggacagcttct

SEQ ID NO: 709406 - DNA, 25 bp, Mus musculus
ggcgccggacccagattctctctgt

SEQ ID NO: 709407 - DNA, 25 bp, Mus musculus
ggcgccggaccctgattctctctgt

SEQ ID NO: 709408 - DNA, 25 bp, Mus musculus
ggcgccggcgtcatgtgactgccca

SEQ ID NO: 709409 - DNA, 25 bp, Mus musculus
ggcgccggcgtcttgtgactgccca

SEQ ID NO: 709410 - DNA, 25 bp, Mus musculus
ggcgccggcgttacaaagccggcct

SEQ ID NO: 709411 - DNA, 25 bp, Mus musculus
ggcgccggcgtttcaaagccggcct

SEQ ID NO: 709412 - DNA, 25 bp, Mus musculus
ggcgccgtcgtgaagacttccatga

SEQ ID NO: 709413 - DNA, 25 bp, Mus musculus
ggcgccgtcgtgtagacttccatga

SEQ ID NO: 709414 - DNA, 25 bp, Mus musculus
ggcgccgtcttgatagtttcagaaa

SEQ ID NO: 709415 - DNA, 25 bp, Mus musculus
ggcgccgtcttgttagtttcagaaa

SEQ ID NO: 709416 - DNA, 25 bp, Mus musculus
ggcgcctacgtgcttgtctactaca

SEQ ID NO: 709417 - DNA, 25 bp, Mus musculus
ggcgcctacgtggttgtctactaca

SEQ ID NO: 709418 - DNA, 25 bp, Mus musculus
ggcgcctcattgaatctgcctatgg

SEQ ID NO: 709419 - DNA, 25 bp, Mus musculus
ggcgcctcattgtatctgcctatgg

SEQ ID NO: 709420 - DNA, 25 bp, Mus musculus
ggcgcctcggagattgtgctcaaaa

SEQ ID NO: 709421 - DNA, 25 bp, Mus musculus
ggcgcctcggagtttgtgctcaaaa

SEQ ID NO: 709422 - DNA, 25 bp, Mus musculus
ggcgcctctctgagctagttgacga

SEQ ID NO: 709423 - DNA, 25 bp, Mus musculus
ggcgcctctctgtgctagttgacga

SEQ ID NO: 709424 - DNA, 25 bp, Mus musculus
ggcgcctctgatctaaccagaagat

SEQ ID NO: 709425 - DNA, 25 bp, Mus musculus
ggcgcctctgatgtaaccagaagat

SEQ ID NO: 709426 - DNA, 25 bp, Mus musculus
ggcgcctgcctccacagcagattga

SEQ ID NO: 709427 - DNA, 25 bp, Mus musculus
ggcgcctgcctcgacagcagattga

SEQ ID NO: 709428 - DNA, 25 bp, Mus musculus
ggcgcctggtgaatacttcttctca

SEQ ID NO: 709429 - DNA, 25 bp, Mus musculus
ggcgcctggtgattacttcttctca

SEQ ID NO: 709430 - DNA, 25 bp, Mus musculus
ggcgcctgtactccttcttttcttc

SEQ ID NO: 709431 - DNA, 25 bp, Mus musculus
ggcgcctgtactgcttcttttcttc

SEQ ID NO: 709432 - DNA, 25 bp, Mus musculus
ggcgcctgtcatcaacacatggttt

SEQ ID NO: 709433 - DNA, 25 bp, Mus musculus
ggcgcctgtcatgaacacatggttt

SEQ ID NO: 709434 - DNA, 25 bp, Mus musculus
ggcgccttccaccttgcagtacagg

SEQ ID NO: 709435 - DNA, 25 bp, Mus musculus
ggcgccttccacgttgcagtacagg

SEQ ID NO: 709436 - DNA, 25 bp, Mus musculus
ggcgcgacttgcaccagcttctggg

SEQ ID NO: 709437 - DNA, 25 bp, Mus musculus
ggcgcgacttgctccagcttctggg

SEQ ID NO: 709438 - DNA, 25 bp, Mus musculus
ggcgcgatgcttaccactgctgctt

SEQ ID NO: 709439 - DNA, 25 bp, Mus musculus
ggcgcgatgctttccactgctgctt

SEQ ID NO: 709440 - DNA, 25 bp, Mus musculus
ggcgcggtctccatcacagcggcga

SEQ ID NO: 709441 - DNA, 25 bp, Mus musculus
ggcgcggtctccttcacagcggcga

SEQ ID NO: 709442 - DNA, 25 bp, Mus musculus
ggcgcggtgagaagaaagccatcaa

SEQ ID NO: 709443 - DNA, 25 bp, Mus musculus
ggcgcggtgagatgaaagccatcaa

SEQ ID NO: 709444 - DNA, 25 bp, Mus musculus
ggcgcggtgcacagtgctcttctga

SEQ ID NO: 709445 - DNA, 25 bp, Mus musculus
ggcgcggtgcactgtgctcttctga

SEQ ID NO: 709446 - DNA, 25 bp, Mus musculus
ggcgcgtcgcagactctctaagctc

SEQ ID NO: 709447 - DNA, 25 bp, Mus musculus
ggcgcgtcgcagtctctctaagctc

SEQ ID NO: 709448 - DNA, 25 bp, Mus musculus
ggcgcgttcatcagagcactaggct

SEQ ID NO: 709449 - DNA, 25 bp, Mus musculus
ggcgcgttcatctgagcactaggct

SEQ ID NO: 709450 - DNA, 25 bp, Mus musculus
ggcgctaacaccaccgacaaggagc

SEQ ID NO: 709451 - DNA, 25 bp, Mus musculus
ggcgctaacacctccgacaaggagc

SEQ ID NO: 709452 - DNA, 25 bp, Mus musculus
ggcgctaacgacacttgcctgttcg

SEQ ID NO: 709453 - DNA, 25 bp, Mus musculus
ggcgctaacgactcttgcctgttcg

SEQ ID NO: 709454 - DNA, 25 bp, Mus musculus
ggcgctacagaaaatcaccgcgggc

SEQ ID NO: 709455 - DNA, 25 bp, Mus musculus
ggcgctacagaatatcaccgcgggc

SEQ ID NO: 709456 - DNA, 25 bp, Mus musculus
ggcgctaccgacagctcaatgagaa

SEQ ID NO: 709457 - DNA, 25 bp, Mus musculus
ggcgctaccgactgctcaatgagaa

SEQ ID NO: 709458 - DNA, 25 bp, Mus musculus
ggcgctacgttcctgagaactgcaa

SEQ ID NO: 709459 - DNA, 25 bp, Mus musculus
ggcgctacgttcgtgagaactgcaa

SEQ ID NO: 709460 - DNA, 25 bp, Mus musculus
ggcgctactgtactgagatctttga

SEQ ID NO: 709461 - DNA, 25 bp, Mus musculus
ggcgctactgtagtgagatctttga

SEQ ID NO: 709462 - DNA, 25 bp, Mus musculus
ggcgctagcggacatgaataacgat

SEQ ID NO: 709463 - DNA, 25 bp, Mus musculus
ggcgctagcggagatgaataacgat

SEQ ID NO: 709464 - DNA, 25 bp, Mus musculus
ggcgctagggaaacaagaagcgatc

SEQ ID NO: 709465 - DNA, 25 bp, Mus musculus
ggcgctagggaatcaagaagcgatc

SEQ ID NO: 709466 - DNA, 25 bp, Mus musculus
ggcgctattcttagcttcattctca

SEQ ID NO: 709467 - DNA, 25 bp, Mus musculus
ggcgctattctttgcttcattctca

SEQ ID NO: 709468 - DNA, 25 bp, Mus musculus
ggcgctcaattacgagacaattgaa

SEQ ID NO: 709469 - DNA, 25 bp, Mus musculus
ggcgctcaattaggagacaattgaa

SEQ ID NO: 709470 - DNA, 25 bp, Mus musculus
ggcgctcactcaaacgcatcctgga

SEQ ID NO: 709471 - DNA, 25 bp, Mus musculus
ggcgctcactcatacgcatcctgga

SEQ ID NO: 709472 - DNA, 25 bp, Mus musculus
ggcgctcagcgaactctgatccaga

SEQ ID NO: 709473 - DNA, 25 bp, Mus musculus
ggcgctcagcgatctctgatccaga

SEQ ID NO: 709474 - DNA, 25 bp, Mus musculus
ggcgctcatagaaagcacccgggat

SEQ ID NO: 709475 - DNA, 25 bp, Mus musculus
ggcgctcatagatagcacccgggat

SEQ ID NO: 709476 - DNA, 25 bp, Mus musculus
ggcgctcatcctactggtgcaggac

SEQ ID NO: 709477 - DNA, 25 bp, Mus musculus
ggcgctcatccttctggtgcaggac

SEQ ID NO: 709478 - DNA, 25 bp, Mus musculus
ggcgctcccctcagcgttgtgcaga

SEQ ID NO: 709479 - DNA, 25 bp, Mus musculus
ggcgctcccctctgcgttgtgcaga

SEQ ID NO: 709480 - DNA, 25 bp, Mus musculus
ggcgctcgcttcaccatgggctggc

SEQ ID NO: 709481 - DNA, 25 bp, Mus musculus
ggcgctcgcttctccatgggctggc

SEQ ID NO: 709482 - DNA, 25 bp, Mus musculus
ggcgctgaatttctcagtcttttac

SEQ ID NO: 709483 - DNA, 25 bp, Mus musculus
ggcgctgaatttgtcagtcttttac

SEQ ID NO: 709484 - DNA, 25 bp, Mus musculus
ggcgctgatagacagttaccagaac

SEQ ID NO: 709485 - DNA, 25 bp, Mus musculus
ggcgctgatagagagttaccagaac

SEQ ID NO: 709486 - DNA, 25 bp, Mus musculus
ggcgctgattctcaacaaccacatt

SEQ ID NO: 709487 - DNA, 25 bp, Mus musculus
ggcgctgattctgaacaaccacatt

SEQ ID NO: 709488 - DNA, 25 bp, Mus musculus
ggcgctgcaggtcagctccactaac

SEQ ID NO: 709489 - DNA, 25 bp, Mus musculus
ggcgctgcaggtgagctccactaac

SEQ ID NO: 709490 - DNA, 25 bp, Mus musculus
ggcgctgcatcacctgtatctatta

SEQ ID NO: 709491 - DNA, 25 bp, Mus musculus
ggcgctgcatcagctgtatctatta

SEQ ID NO: 709492 - DNA, 25 bp, Mus musculus
ggcgctgctgctcctttctggagtc

SEQ ID NO: 709493 - DNA, 25 bp, Mus musculus
ggcgctgctgctgctttctggagtc

SEQ ID NO: 709494 - DNA, 25 bp, Mus musculus
ggcgctggacatagtcaatcagttc

SEQ ID NO: 709495 - DNA, 25 bp, Mus musculus
ggcgctggacattgtcaatcagttc

SEQ ID NO: 709496 - DNA, 25 bp, Mus musculus
ggcgctggatcaacaactctgtgtt

SEQ ID NO: 709497 - DNA, 25 bp, Mus musculus
ggcgctggatcatcaactctgtgtt

SEQ ID NO: 709498 - DNA, 25 bp, Mus musculus
ggcgctggccagctttcctgcagaa

SEQ ID NO: 709499 - DNA, 25 bp, Mus musculus
ggcgctggccaggtttcctgcagaa

SEQ ID NO: 709500 - DNA, 25 bp, Mus musculus
ggcgctgggacacatgttcatgtac

SEQ ID NO: 709501 - DNA, 25 bp, Mus musculus
ggcgctgggacagatgttcatgtac

SEQ ID NO: 709502 - DNA, 25 bp, Mus musculus
ggcgctgtaactcttgggcccagca

SEQ ID NO: 709503 - DNA, 25 bp, Mus musculus
ggcgctgtaactgttgggcccagca

SEQ ID NO: 709504 - DNA, 25 bp, Mus musculus
ggcgctgtccggcacattgtcctgc

SEQ ID NO: 709505 - DNA, 25 bp, Mus musculus
ggcgctgtccgggacattgtcctgc

SEQ ID NO: 709506 - DNA, 25 bp, Mus musculus
ggcgctgtcctcagaataaacctgt

SEQ ID NO: 709507 - DNA, 25 bp, Mus musculus
ggcgctgtcctctgaataaacctgt

SEQ ID NO: 709508 - DNA, 25 bp, Mus musculus
ggcgcttaaggactacgcgatcgaa

SEQ ID NO: 709509 - DNA, 25 bp, Mus musculus
ggcgcttaaggagtacgcgatcgaa

SEQ ID NO: 709510 - DNA, 25 bp, Mus musculus
ggcgcttcaggactatcgcaagaag

SEQ ID NO: 709511 - DNA, 25 bp, Mus musculus
ggcgcttcaggagtatcgcaagaag

SEQ ID NO: 709512 - DNA, 25 bp, Mus musculus
ggcgcttcatctccagctggaagag

SEQ ID NO: 709513 - DNA, 25 bp, Mus musculus
ggcgcttcatctgcagctggaagag

SEQ ID NO: 709514 - DNA, 25 bp, Mus musculus
ggcgcttctgtccttgttcttgaag

SEQ ID NO: 709515 - DNA, 25 bp, Mus musculus
ggcgcttctgtcgttgttcttgaag

SEQ ID NO: 709516 - DNA, 25 bp, Mus musculus
ggcgcttcttctactaggctccgag

SEQ ID NO: 709517 - DNA, 25 bp, Mus musculus
ggcgcttcttcttctaggctccgag

SEQ ID NO: 709518 - DNA, 25 bp, Mus musculus
ggcgcttgctgcaccaacttcctgt

SEQ ID NO: 709519 - DNA, 25 bp, Mus musculus
ggcgcttgctgctccaacttcctgt

SEQ ID NO: 709520 - DNA, 25 bp, Mus musculus
ggcgcttgtcagcactgtaaagtca

SEQ ID NO: 709521 - DNA, 25 bp, Mus musculus
ggcgcttgtcaggactgtaaagtca

SEQ ID NO: 709522 - DNA, 25 bp, Mus musculus
ggcgctttgtgaagggacccactgt

SEQ ID NO: 709523 - DNA, 25 bp, Mus musculus
ggcgctttgtgatgggacccactgt

SEQ ID NO: 709524 - DNA, 25 bp, Mus musculus
ggcgctttgttgaattctactactg

SEQ ID NO: 709525 - DNA, 25 bp, Mus musculus
ggcgctttgttgtattctactactg

SEQ ID NO: 709526 - DNA, 25 bp, Mus musculus
ggcggaaaaagccagcaccgagctt

SEQ ID NO: 709527 - DNA, 25 bp, Mus musculus
ggcggaaaaagcgagcaccgagctt

SEQ ID NO: 709528 - DNA, 25 bp, Mus musculus
ggcggaacacttacgtttgcagcga

SEQ ID NO: 709529 - DNA, 25 bp, Mus musculus
ggcggaacactttcgtttgcagcga

SEQ ID NO: 709530 - DNA, 25 bp, Mus musculus
ggcggaacccctcagaatctggctc

SEQ ID NO: 709531 - DNA, 25 bp, Mus musculus
ggcggaacccctgagaatctggctc

SEQ ID NO: 709532 - DNA, 25 bp, Mus musculus
ggcggaaccgaacgatctgctccaa

SEQ ID NO: 709533 - DNA, 25 bp, Mus musculus
ggcggaaccgaaggatctgctccaa

SEQ ID NO: 709534 - DNA, 25 bp, Mus musculus
ggcggaagtcctatcccgagaggtc

SEQ ID NO: 709535 - DNA, 25 bp, Mus musculus
ggcggaagtcctttcccgagaggtc

SEQ ID NO: 709536 - DNA, 25 bp, Mus musculus
ggcggaataattagtccaagaaaca

SEQ ID NO: 709537 - DNA, 25 bp, Mus musculus
ggcggaataatttgtccaagaaaca

SEQ ID NO: 709538 - DNA, 25 bp, Mus musculus
ggcggaataccaagcttacatcgac

SEQ ID NO: 709539 - DNA, 25 bp, Mus musculus
ggcggaataccatgcttacatcgac

SEQ ID NO: 709540 - DNA, 25 bp, Mus musculus
ggcggacaacctctactcaaactgt

SEQ ID NO: 709541 - DNA, 25 bp, Mus musculus
ggcggacaacctgtactcaaactgt

SEQ ID NO: 709542 - DNA, 25 bp, Mus musculus
ggcggacaacgccttcagtttcaga

SEQ ID NO: 709543 - DNA, 25 bp, Mus musculus
ggcggacaacgcgttcagtttcaga

SEQ ID NO: 709544 - DNA, 25 bp, Mus musculus
ggcggacaccaaaagcgcctgctag

SEQ ID NO: 709545 - DNA, 25 bp, Mus musculus
ggcggacaccaatagcgcctgctag

SEQ ID NO: 709546 - DNA, 25 bp, Mus musculus
ggcggacaccgtattccagccaagc

SEQ ID NO: 709547 - DNA, 25 bp, Mus musculus
ggcggacaccgttttccagccaagc

SEQ ID NO: 709548 - DNA, 25 bp, Mus musculus
ggcggacagcatcccttcgctgcga

SEQ ID NO: 709549 - DNA, 25 bp, Mus musculus
ggcggacagcatgccttcgctgcga

SEQ ID NO: 709550 - DNA, 25 bp, Mus musculus
ggcggacctaagacaaaggcaagtg

SEQ ID NO: 709551 - DNA, 25 bp, Mus musculus
ggcggacctaagtcaaaggcaagtg

SEQ ID NO: 709552 - DNA, 25 bp, Mus musculus
ggcggacgtagtcgaatcctggata

SEQ ID NO: 709553 - DNA, 25 bp, Mus musculus
ggcggacgtagtggaatcctggata

SEQ ID NO: 709554 - DNA, 25 bp, Mus musculus
ggcggactccgacgcccgctatttg

SEQ ID NO: 709555 - DNA, 25 bp, Mus musculus
ggcggactccgaggcccgctatttg

SEQ ID NO: 709556 - DNA, 25 bp, Mus musculus
ggcggactggatcgaatgctcaaag

SEQ ID NO: 709557 - DNA, 25 bp, Mus musculus
ggcggactggatggaatgctcaaag

SEQ ID NO: 709558 - DNA, 25 bp, Mus musculus
ggcggacttgtcctcgcttgcgtca

SEQ ID NO: 709559 - DNA, 25 bp, Mus musculus
ggcggacttgtcgtcgcttgcgtca

SEQ ID NO: 709560 - DNA, 25 bp, Mus musculus
ggcggagacaacaaccactcctgat

SEQ ID NO: 709561 - DNA, 25 bp, Mus musculus
ggcggagacaactaccactcctgat

SEQ ID NO: 709562 - DNA, 25 bp, Mus musculus
ggcggagacattccccttctcggag

SEQ ID NO: 709563 - DNA, 25 bp, Mus musculus
ggcggagacattgcccttctcggag

SEQ ID NO: 709564 - DNA, 25 bp, Mus musculus
ggcggagagaatatatctgttgcta

SEQ ID NO: 709565 - DNA, 25 bp, Mus musculus
ggcggagagaatttatctgttgcta

SEQ ID NO: 709566 - DNA, 25 bp, Mus musculus
ggcggagcccacaatgccagacact

SEQ ID NO: 709567 - DNA, 25 bp, Mus musculus
ggcggagcccactatgccagacact

SEQ ID NO: 709568 - DNA, 25 bp, Mus musculus
ggcggagctggtcccaattttggcc

SEQ ID NO: 709569 - DNA, 25 bp, Mus musculus
ggcggagctggtgccaattttggcc

SEQ ID NO: 709570 - DNA, 25 bp, Mus musculus
ggcggataagcacgaattgctcagt

SEQ ID NO: 709571 - DNA, 25 bp, Mus musculus
ggcggataagcaggaattgctcagt

SEQ ID NO: 709572 - DNA, 25 bp, Mus musculus
ggcggataatctcccttcggacttt

SEQ ID NO: 709573 - DNA, 25 bp, Mus musculus
ggcggataatctgccttcggacttt

SEQ ID NO: 709574 - DNA, 25 bp, Mus musculus
ggcggatgtgctacctcaccatcaa

SEQ ID NO: 709575 - DNA, 25 bp, Mus musculus
ggcggatgtgcttcctcaccatcaa

SEQ ID NO: 709576 - DNA, 25 bp, Mus musculus
ggcggcaaagcacaactttcctcgg

SEQ ID NO: 709577 - DNA, 25 bp, Mus musculus
ggcggcaaagcagaactttcctcgg

SEQ ID NO: 709578 - DNA, 25 bp, Mus musculus
ggcggcacatgaaggtggctttttt

SEQ ID NO: 709579 - DNA, 25 bp, Mus musculus
ggcggcacatgatggtggctttttt

SEQ ID NO: 709580 - DNA, 25 bp, Mus musculus
ggcggcactaaaagacctcttgctc

SEQ ID NO: 709581 - DNA, 25 bp, Mus musculus
ggcggcactaaatgacctcttgctc

SEQ ID NO: 709582 - DNA, 25 bp, Mus musculus
ggcggcagacatctcgattatgtag

SEQ ID NO: 709583 - DNA, 25 bp, Mus musculus
ggcggcagacatgtcgattatgtag

SEQ ID NO: 709584 - DNA, 25 bp, Mus musculus
ggcggcagcactctgcggctgcgcg

SEQ ID NO: 709585 - DNA, 25 bp, Mus musculus
ggcggcagcactgtgcggctgcgcg

SEQ ID NO: 709586 - DNA, 25 bp, Mus musculus
ggcggcaggtcaagtctgcccttcc

SEQ ID NO: 709587 - DNA, 25 bp, Mus musculus
ggcggcaggtcatgtctgcccttcc

SEQ ID NO: 709588 - DNA, 25 bp, Mus musculus
ggcggcagtgacctggagtcgggct

SEQ ID NO: 709589 - DNA, 25 bp, Mus musculus
ggcggcagtgacgtggagtcgggct

SEQ ID NO: 709590 - DNA, 25 bp, Mus musculus
ggcggccactgtcctacaagacgtt

SEQ ID NO: 709591 - DNA, 25 bp, Mus musculus
ggcggccactgtgctacaagacgtt

SEQ ID NO: 709592 - DNA, 25 bp, Mus musculus
ggcggcccactgacagctcgcagtt

SEQ ID NO: 709593 - DNA, 25 bp, Mus musculus
ggcggcccactgtcagctcgcagtt

SEQ ID NO: 709594 - DNA, 25 bp, Mus musculus
ggcggccctcagacagtttgtgatc

SEQ ID NO: 709595 - DNA, 25 bp, Mus musculus
ggcggccctcagtcagtttgtgatc

SEQ ID NO: 709596 - DNA, 25 bp, Mus musculus
ggcggccgcactcttgaacaacatg

SEQ ID NO: 709597 - DNA, 25 bp, Mus musculus
ggcggccgcactgttgaacaacatg

SEQ ID NO: 709598 - DNA, 25 bp, Mus musculus
ggcggcctactgacatcccgagcta

SEQ ID NO: 709599 - DNA, 25 bp, Mus musculus
ggcggcctactgtcatcccgagcta

SEQ ID NO: 709600 - DNA, 25 bp, Mus musculus
ggcggcctcgctcaactacttaaac

SEQ ID NO: 709601 - DNA, 25 bp, Mus musculus
ggcggcctcgctgaactacttaaac

SEQ ID NO: 709602 - DNA, 25 bp, Mus musculus
ggcggcctggtacaggttatcaaca

SEQ ID NO: 709603 - DNA, 25 bp, Mus musculus
ggcggcctggtagaggttatcaaca

SEQ ID NO: 709604 - DNA, 25 bp, Mus musculus
ggcggccttgaccatctcagacggt

SEQ ID NO: 709605 - DNA, 25 bp, Mus musculus
ggcggccttgacgatctcagacggt

SEQ ID NO: 709606 - DNA, 25 bp, Mus musculus
ggcggccttggactataatttaatc

SEQ ID NO: 709607 - DNA, 25 bp, Mus musculus
ggcggccttggagtataatttaatc

SEQ ID NO: 709608 - DNA, 25 bp, Mus musculus
ggcggcgaacttcgtgactacacag

SEQ ID NO: 709609 - DNA, 25 bp, Mus musculus
ggcggcgaacttggtgactacacag

SEQ ID NO: 709610 - DNA, 25 bp, Mus musculus
ggcggcgattgcaggatctccaaca

SEQ ID NO: 709611 - DNA, 25 bp, Mus musculus
ggcggcgattgctggatctccaaca

SEQ ID NO: 709612 - DNA, 25 bp, Mus musculus
ggcggcgcccagctctttaagtcag

SEQ ID NO: 709613 - DNA, 25 bp, Mus musculus
ggcggcgcccaggtctttaagtcag

SEQ ID NO: 709614 - DNA, 25 bp, Mus musculus
ggcggcgctcacagcagtctcggat

SEQ ID NO: 709615 - DNA, 25 bp, Mus musculus
ggcggcgctcactgcagtctcggat

SEQ ID NO: 709616 - DNA, 25 bp, Mus musculus
ggcggcgtcacaacccggcgtatga

SEQ ID NO: 709617 - DNA, 25 bp, Mus musculus
ggcggcgtcacatcccggcgtatga

SEQ ID NO: 709618 - DNA, 25 bp, Mus musculus
ggcggcgtctgacctctacatagag

SEQ ID NO: 709619 - DNA, 25 bp, Mus musculus
ggcggcgtctgagctctacatagag

SEQ ID NO: 709620 - DNA, 25 bp, Mus musculus
ggcggcgtgtctacgatgccttaaa

SEQ ID NO: 709621 - DNA, 25 bp, Mus musculus
ggcggcgtgtcttcgatgccttaaa

SEQ ID NO: 709622 - DNA, 25 bp, Mus musculus
ggcggcgttgttcgctgcggtggac

SEQ ID NO: 709623 - DNA, 25 bp, Mus musculus
ggcggcgttgttggctgcggtggac

SEQ ID NO: 709624 - DNA, 25 bp, Mus musculus
ggcggctaccatctgcaggtctaac

SEQ ID NO: 709625 - DNA, 25 bp, Mus musculus
ggcggctaccatgtgcaggtctaac

SEQ ID NO: 709626 - DNA, 25 bp, Mus musculus
ggcggctacgtgaagctgtttccga

SEQ ID NO: 709627 - DNA, 25 bp, Mus musculus
ggcggctacgtgtagctgtttccga

SEQ ID NO: 709628 - DNA, 25 bp, Mus musculus
ggcggctactatagctcctgcagag

SEQ ID NO: 709629 - DNA, 25 bp, Mus musculus
ggcggctactattgctcctgcagag

SEQ ID NO: 709630 - DNA, 25 bp, Mus musculus
ggcggctatgataatactgggtata

SEQ ID NO: 709631 - DNA, 25 bp, Mus musculus
ggcggctatgattatactgggtata

SEQ ID NO: 709632 - DNA, 25 bp, Mus musculus
ggcggctcaagtactaattctcaaa

SEQ ID NO: 709633 - DNA, 25 bp, Mus musculus
ggcggctcaagttctaattctcaaa

SEQ ID NO: 709634 - DNA, 25 bp, Mus musculus
ggcggctcacacactatcacgaggg

SEQ ID NO: 709635 - DNA, 25 bp, Mus musculus
ggcggctcacactctatcacgaggg

SEQ ID NO: 709636 - DNA, 25 bp, Mus musculus
ggcggctcactcaaacgttctcaga

SEQ ID NO: 709637 - DNA, 25 bp, Mus musculus
ggcggctcactctaacgttctcaga

SEQ ID NO: 709638 - DNA, 25 bp, Mus musculus
ggcggctgaaccaagcggactagct

SEQ ID NO: 709639 - DNA, 25 bp, Mus musculus
ggcggctgaacctagcggactagct

SEQ ID NO: 709640 - DNA, 25 bp, Mus musculus
ggcggctgcgcaacaactttcctta

SEQ ID NO: 709641 - DNA, 25 bp, Mus musculus
ggcggctgcgcatcaactttcctta

SEQ ID NO: 709642 - DNA, 25 bp, Mus musculus
ggcggctgctctccgctggcaaaaa

SEQ ID NO: 709643 - DNA, 25 bp, Mus musculus
ggcggctgctctgcgctggcaaaaa

SEQ ID NO: 709644 - DNA, 25 bp, Mus musculus
ggcggctggacgaaacaggtcacct

SEQ ID NO: 709645 - DNA, 25 bp, Mus musculus
ggcggctggacgtaacaggtcacct

SEQ ID NO: 709646 - DNA, 25 bp, Mus musculus
ggcggctgtaccaacagactcgtgg

SEQ ID NO: 709647 - DNA, 25 bp, Mus musculus
ggcggctgtacctacagactcgtgg

SEQ ID NO: 709648 - DNA, 25 bp, Mus musculus
ggcggctgtcacacggagaccaaat

SEQ ID NO: 709649 - DNA, 25 bp, Mus musculus
ggcggctgtcactcggagaccaaat

SEQ ID NO: 709650 - DNA, 25 bp, Mus musculus
ggcggctgtcatcgcaacgccaata

SEQ ID NO: 709651 - DNA, 25 bp, Mus musculus
ggcggctgtcatggcaacgccaata

SEQ ID NO: 709652 - DNA, 25 bp, Mus musculus
ggcggctttagtagcagcatgaagc

SEQ ID NO: 709653 - DNA, 25 bp, Mus musculus
ggcggctttagttgcagcatgaagc

SEQ ID NO: 709654 - DNA, 25 bp, Mus musculus
ggcgggaagactccctaccgcacat

SEQ ID NO: 709655 - DNA, 25 bp, Mus musculus
ggcgggaagactgcctaccgcacat

SEQ ID NO: 709656 - DNA, 25 bp, Mus musculus
ggcgggaagcccatgatcatctaca

SEQ ID NO: 709657 - DNA, 25 bp, Mus musculus
ggcgggaagcccttgatcatctaca

SEQ ID NO: 709658 - DNA, 25 bp, Mus musculus
ggcgggaggcatcttgtcttctacc

SEQ ID NO: 709659 - DNA, 25 bp, Mus musculus
ggcgggaggcatgttgtcttctacc

SEQ ID NO: 709660 - DNA, 25 bp, Mus musculus
ggcgggcaccacaacccttatggta

SEQ ID NO: 709661 - DNA, 25 bp, Mus musculus
ggcgggcaccactacccttatggta

SEQ ID NO: 709662 - DNA, 25 bp, Mus musculus
ggcgggcacgttcgttatcgtattc

SEQ ID NO: 709663 - DNA, 25 bp, Mus musculus
ggcgggcacgttggttatcgtattc

SEQ ID NO: 709664 - DNA, 25 bp, Mus musculus
ggcgggcactgaactataaagcaca

SEQ ID NO: 709665 - DNA, 25 bp, Mus musculus
ggcgggcactgatctataaagcaca

SEQ ID NO: 709666 - DNA, 25 bp, Mus musculus
ggcgggcccactcgatattgcctgt

SEQ ID NO: 709667 - DNA, 25 bp, Mus musculus
ggcgggcccactggatattgcctgt

SEQ ID NO: 709668 - DNA, 25 bp, Mus musculus
ggcgggccctttatcgaccaggtgt

SEQ ID NO: 709669 - DNA, 25 bp, Mus musculus
ggcgggccctttttcgaccaggtgt

SEQ ID NO: 709670 - DNA, 25 bp, Mus musculus
ggcgggcgccagacatggacaatca

SEQ ID NO: 709671 - DNA, 25 bp, Mus musculus
ggcgggcgccagtcatggacaatca

SEQ ID NO: 709672 - DNA, 25 bp, Mus musculus
ggcgggctctatacagagcttatcc

SEQ ID NO: 709673 - DNA, 25 bp, Mus musculus
ggcgggctctattcagagcttatcc

SEQ ID NO: 709674 - DNA, 25 bp, Mus musculus
ggcgggctctccacgggcaatctct

SEQ ID NO: 709675 - DNA, 25 bp, Mus musculus
ggcgggctctcctcgggcaatctct

SEQ ID NO: 709676 - DNA, 25 bp, Mus musculus
ggcgggctctgtccagctctaacat

SEQ ID NO: 709677 - DNA, 25 bp, Mus musculus
ggcgggctctgtgcagctctaacat

SEQ ID NO: 709678 - DNA, 25 bp, Mus musculus
ggcggggaccccatctatgaccgct

SEQ ID NO: 709679 - DNA, 25 bp, Mus musculus
ggcggggaccccttctatgaccgct

SEQ ID NO: 709680 - DNA, 25 bp, Mus musculus
ggcgggtgggcaagaaactccaatc

SEQ ID NO: 709681 - DNA, 25 bp, Mus musculus
ggcgggtgggcatgaaactccaatc

SEQ ID NO: 709682 - DNA, 25 bp, Mus musculus
ggcggtatccatcgactggcatcct

SEQ ID NO: 709683 - DNA, 25 bp, Mus musculus
ggcggtatccatggactggcatcct

SEQ ID NO: 709684 - DNA, 25 bp, Mus musculus
ggcggtcagggcagcccttcgcact

SEQ ID NO: 709685 - DNA, 25 bp, Mus musculus
ggcggtcagggctgcccttcgcact

SEQ ID NO: 709686 - DNA, 25 bp, Mus musculus
ggcggtccctggctgataactgaca

SEQ ID NO: 709687 - DNA, 25 bp, Mus musculus
ggcggtccctgggtgataactgaca

SEQ ID NO: 709688 - DNA, 25 bp, Mus musculus
ggcggtcgccttcttccaagtgtta

SEQ ID NO: 709689 - DNA, 25 bp, Mus musculus
ggcggtcgccttgttccaagtgtta

SEQ ID NO: 709690 - DNA, 25 bp, Mus musculus
ggcggtctgcagattgacaaggaac

SEQ ID NO: 709691 - DNA, 25 bp, Mus musculus
ggcggtctgcagtttgacaaggaac

SEQ ID NO: 709692 - DNA, 25 bp, Mus musculus
ggcggtgacttaagcagacagttgc

SEQ ID NO: 709693 - DNA, 25 bp, Mus musculus
ggcggtgacttatgcagacagttgc

SEQ ID NO: 709694 - DNA, 25 bp, Mus musculus
ggcggtgacttgatgccaccctgca

SEQ ID NO: 709695 - DNA, 25 bp, Mus musculus
ggcggtgacttgttgccaccctgca

SEQ ID NO: 709696 - DNA, 25 bp, Mus musculus
ggcggtgagcatcaagtctcccact

SEQ ID NO: 709697 - DNA, 25 bp, Mus musculus
ggcggtgagcatgaagtctcccact

SEQ ID NO: 709698 - DNA, 25 bp, Mus musculus
ggcggtgcctatcaagccgagcttc

SEQ ID NO: 709699 - DNA, 25 bp, Mus musculus
ggcggtgcctatgaagccgagcttc

SEQ ID NO: 709700 - DNA, 25 bp, Mus musculus
ggcggtggagatcccaggtcgctca

SEQ ID NO: 709701 - DNA, 25 bp, Mus musculus
ggcggtggagatgccaggtcgctca

SEQ ID NO: 709702 - DNA, 25 bp, Mus musculus
ggcggtggcgccagtggctgtgcac

SEQ ID NO: 709703 - DNA, 25 bp, Mus musculus
ggcggtggcgcctgtggctgtgcac

SEQ ID NO: 709704 - DNA, 25 bp, Mus musculus
ggcggtgggtgacgcagtgaggccc

SEQ ID NO: 709705 - DNA, 25 bp, Mus musculus
ggcggtgggtgaggcagtgaggccc

SEQ ID NO: 709706 - DNA, 25 bp, Mus musculus
ggcggtggtctaacgcctccctcgg

SEQ ID NO: 709707 - DNA, 25 bp, Mus musculus
ggcggtggtctatcgcctccctcgg

SEQ ID NO: 709708 - DNA, 25 bp, Mus musculus
ggcggtgtgaacacttgtgcacctg

SEQ ID NO: 709709 - DNA, 25 bp, Mus musculus
ggcggtgtgaactcttgtgcacctg

SEQ ID NO: 709710 - DNA, 25 bp, Mus musculus
ggcggtgtgctcctcgattttacag

SEQ ID NO: 709711 - DNA, 25 bp, Mus musculus
ggcggtgtgctcgtcgattttacag

SEQ ID NO: 709712 - DNA, 25 bp, Mus musculus
ggcggttcaattacaacatggctga

SEQ ID NO: 709713 - DNA, 25 bp, Mus musculus
ggcggttcaatttcaacatggctga

SEQ ID NO: 709714 - DNA, 25 bp, Mus musculus
ggcggttgactacatacagtacaca

SEQ ID NO: 709715 - DNA, 25 bp, Mus musculus
ggcggttgactagatacagtacaca

SEQ ID NO: 709716 - DNA, 25 bp, Mus musculus
ggcgtaactgtaataggcaaagacc

SEQ ID NO: 709717 - DNA, 25 bp, Mus musculus
ggcgtaactgtattaggcaaagacc

SEQ ID NO: 709718 - DNA, 25 bp, Mus musculus
ggcgtaacttcactaaacaggctac

SEQ ID NO: 709719 - DNA, 25 bp, Mus musculus
ggcgtaacttcagtaaacaggctac

SEQ ID NO: 709720 - DNA, 25 bp, Mus musculus
ggcgtaagtcttccctgtttgctgt

SEQ ID NO: 709721 - DNA, 25 bp, Mus musculus
ggcgtaagtcttgcctgtttgctgt

SEQ ID NO: 709722 - DNA, 25 bp, Mus musculus
ggcgtacacaggctccaagtgcaca

SEQ ID NO: 709723 - DNA, 25 bp, Mus musculus
ggcgtacacagggtccaagtgcaca

SEQ ID NO: 709724 - DNA, 25 bp, Mus musculus
ggcgtacacccacatggaacttcca

SEQ ID NO: 709725 - DNA, 25 bp, Mus musculus
ggcgtacacccagatggaacttcca

SEQ ID NO: 709726 - DNA, 25 bp, Mus musculus
ggcgtacagactcactcctaaactg

SEQ ID NO: 709727 - DNA, 25 bp, Mus musculus
ggcgtacagactgactcctaaactg

SEQ ID NO: 709728 - DNA, 25 bp, Mus musculus
ggcgtacccatcagttactcgtcta

SEQ ID NO: 709729 - DNA, 25 bp, Mus musculus
ggcgtacccatctgttactcgtcta

SEQ ID NO: 709730 - DNA, 25 bp, Mus musculus
ggcgtagaactcacgactacttctc

SEQ ID NO: 709731 - DNA, 25 bp, Mus musculus
ggcgtagaactctcgactacttctc

SEQ ID NO: 709732 - DNA, 25 bp, Mus musculus
ggcgtaggttcactgaccgctctct

SEQ ID NO: 709733 - DNA, 25 bp, Mus musculus
ggcgtaggttcagtgaccgctctct

SEQ ID NO: 709734 - DNA, 25 bp, Mus musculus
ggcgtagttctaccctcggcttccg

SEQ ID NO: 709735 - DNA, 25 bp, Mus musculus
ggcgtagttctagcctcggcttccg

SEQ ID NO: 709736 - DNA, 25 bp, Mus musculus
ggcgtatcagtcatccaaggtgtcc

SEQ ID NO: 709737 - DNA, 25 bp, Mus musculus
ggcgtatcagtcttccaaggtgtcc

SEQ ID NO: 709738 - DNA, 25 bp, Mus musculus
ggcgtatgctgcagccgttcagttc

SEQ ID NO: 709739 - DNA, 25 bp, Mus musculus
ggcgtatgctgctgccgttcagttc

SEQ ID NO: 709740 - DNA, 25 bp, Mus musculus
ggcgtatttctacgaccccgatgtg

SEQ ID NO: 709741 - DNA, 25 bp, Mus musculus
ggcgtatttctaggaccccgatgtg

SEQ ID NO: 709742 - DNA, 25 bp, Mus musculus
ggcgtcactcaacatcaaatctatg

SEQ ID NO: 709743 - DNA, 25 bp, Mus musculus
ggcgtcactcaagatcaaatctatg

SEQ ID NO: 709744 - DNA, 25 bp, Mus musculus
ggcgtcatagcccataagctacagt

SEQ ID NO: 709745 - DNA, 25 bp, Mus musculus
ggcgtcatagccgataagctacagt

SEQ ID NO: 709746 - DNA, 25 bp, Mus musculus
ggcgtcatcgttaatgtgagcctca

SEQ ID NO: 709747 - DNA, 25 bp, Mus musculus
ggcgtcatcgtttatgtgagcctca

SEQ ID NO: 709748 - DNA, 25 bp, Mus musculus
ggcgtccaaacgattccgtgctgag

SEQ ID NO: 709749 - DNA, 25 bp, Mus musculus
ggcgtccaaacgtttccgtgctgag

SEQ ID NO: 709750 - DNA, 25 bp, Mus musculus
ggcgtccaacgacttatgcaggaac

SEQ ID NO: 709751 - DNA, 25 bp, Mus musculus
ggcgtccaacgagttatgcaggaac

SEQ ID NO: 709752 - DNA, 25 bp, Mus musculus
ggcgtccacgctacaagttctacca

SEQ ID NO: 709753 - DNA, 25 bp, Mus musculus
ggcgtccacgcttcaagttctacca

SEQ ID NO: 709754 - DNA, 25 bp, Mus musculus
ggcgtccacgtcagcggaggctcca

SEQ ID NO: 709755 - DNA, 25 bp, Mus musculus
ggcgtccacgtctgcggaggctcca

SEQ ID NO: 709756 - DNA, 25 bp, Mus musculus
ggcgtccagctcagccgctaaagaa

SEQ ID NO: 709757 - DNA, 25 bp, Mus musculus
ggcgtccagctctgccgctaaagaa

SEQ ID NO: 709758 - DNA, 25 bp, Mus musculus
ggcgtcccagaaagctgagcaagga

SEQ ID NO: 709759 - DNA, 25 bp, Mus musculus
ggcgtcccagaatgctgagcaagga

SEQ ID NO: 709760 - DNA, 25 bp, Mus musculus
ggcgtcccagcacgagcggcttcaa

SEQ ID NO: 709761 - DNA, 25 bp, Mus musculus
ggcgtcccagcaggagcggcttcaa

SEQ ID NO: 709762 - DNA, 25 bp, Mus musculus
ggcgtccctttcagaccgggctctt

SEQ ID NO: 709763 - DNA, 25 bp, Mus musculus
ggcgtccctttctgaccgggctctt

SEQ ID NO: 709764 - DNA, 25 bp, Mus musculus
ggcgtcctacatctgctaatggcct

SEQ ID NO: 709765 - DNA, 25 bp, Mus musculus
ggcgtcctacatgtgctaatggcct

SEQ ID NO: 709766 - DNA, 25 bp, Mus musculus
ggcgtcctctttcttcgagggtcaa

SEQ ID NO: 709767 - DNA, 25 bp, Mus musculus
ggcgtcctctttgttcgagggtcaa

SEQ ID NO: 709768 - DNA, 25 bp, Mus musculus
ggcgtcctgagcagattcagtggcc

SEQ ID NO: 709769 - DNA, 25 bp, Mus musculus
ggcgtcctgagctgattcagtggcc

SEQ ID NO: 709770 - DNA, 25 bp, Mus musculus
ggcgtcctgtccctgcgaaagcgct

SEQ ID NO: 709771 - DNA, 25 bp, Mus musculus
ggcgtcctgtccgtgcgaaagcgct

SEQ ID NO: 709772 - DNA, 25 bp, Mus musculus
ggcgtcgagggccacttcctcatta

SEQ ID NO: 709773 - DNA, 25 bp, Mus musculus
ggcgtcgagggcgacttcctcatta

SEQ ID NO: 709774 - DNA, 25 bp, Mus musculus
ggcgtcgtccctccatctaaacttt

SEQ ID NO: 709775 - DNA, 25 bp, Mus musculus
ggcgtcgtccctgcatctaaacttt

SEQ ID NO: 709776 - DNA, 25 bp, Mus musculus
ggcgtctataccagtaccgcccgga

SEQ ID NO: 709777 - DNA, 25 bp, Mus musculus
ggcgtctatacctgtaccgcccgga

SEQ ID NO: 709778 - DNA, 25 bp, Mus musculus
ggcgtctcctttcaagggtcccgca

SEQ ID NO: 709779 - DNA, 25 bp, Mus musculus
ggcgtctcctttgaagggtcccgca

SEQ ID NO: 709780 - DNA, 25 bp, Mus musculus
ggcgtctgagggaccacagcgctcc

SEQ ID NO: 709781 - DNA, 25 bp, Mus musculus
ggcgtctgagggtccacagcgctcc

SEQ ID NO: 709782 - DNA, 25 bp, Mus musculus
ggcgtctgagtaccccaaccttggc

SEQ ID NO: 709783 - DNA, 25 bp, Mus musculus
ggcgtctgagtagcccaaccttggc

SEQ ID NO: 709784 - DNA, 25 bp, Mus musculus
ggcgtcttccaccatcgggcctttg

SEQ ID NO: 709785 - DNA, 25 bp, Mus musculus
ggcgtcttccacgatcgggcctttg

SEQ ID NO: 709786 - DNA, 25 bp, Mus musculus
ggcgtgaactctcagacccttgaag

SEQ ID NO: 709787 - DNA, 25 bp, Mus musculus
ggcgtgaactctgagacccttgaag

SEQ ID NO: 709788 - DNA, 25 bp, Mus musculus
ggcgtgaaggccaatgaagttatct

SEQ ID NO: 709789 - DNA, 25 bp, Mus musculus
ggcgtgaaggcctatgaagttatct

SEQ ID NO: 709790 - DNA, 25 bp, Mus musculus
ggcgtgacactcagggaaatgtttt

SEQ ID NO: 709791 - DNA, 25 bp, Mus musculus
ggcgtgacactctgggaaatgtttt

SEQ ID NO: 709792 - DNA, 25 bp, Mus musculus
ggcgtgaccatgacccaccactggg

SEQ ID NO: 709793 - DNA, 25 bp, Mus musculus
ggcgtgaccatgtcccaccactggg

SEQ ID NO: 709794 - DNA, 25 bp, Mus musculus
ggcgtgaccgctaggatctcaccgt

SEQ ID NO: 709795 - DNA, 25 bp, Mus musculus
ggcgtgaccgcttggatctcaccgt

SEQ ID NO: 709796 - DNA, 25 bp, Mus musculus
ggcgtgactcgaagacacggctgta

SEQ ID NO: 709797 - DNA, 25 bp, Mus musculus
ggcgtgactcgatgacacggctgta

SEQ ID NO: 709798 - DNA, 25 bp, Mus musculus
ggcgtgcatgaaaccctcagtgaga

SEQ ID NO: 709799 - DNA, 25 bp, Mus musculus
ggcgtgcatgaatccctcagtgaga

SEQ ID NO: 709800 - DNA, 25 bp, Mus musculus
ggcgtgctggctcctaacgacacgt

SEQ ID NO: 709801 - DNA, 25 bp, Mus musculus
ggcgtgctggctgctaacgacacgt

SEQ ID NO: 709802 - DNA, 25 bp, Mus musculus
ggcgtgctttcccagccggcttctt

SEQ ID NO: 709803 - DNA, 25 bp, Mus musculus
ggcgtgctttccgagccggcttctt

SEQ ID NO: 709804 - DNA, 25 bp, Mus musculus
ggcgtggaggatcccttctatacac

SEQ ID NO: 709805 - DNA, 25 bp, Mus musculus
ggcgtggaggatgccttctatacac

SEQ ID NO: 709806 - DNA, 25 bp, Mus musculus
ggcgtggatgtgactcaagtgactt

SEQ ID NO: 709807 - DNA, 25 bp, Mus musculus
ggcgtggatgtgtctcaagtgactt

SEQ ID NO: 709808 - DNA, 25 bp, Mus musculus
ggcgtggattacacctttgagtgca

SEQ ID NO: 709809 - DNA, 25 bp, Mus musculus
ggcgtggattactcctttgagtgca

SEQ ID NO: 709810 - DNA, 25 bp, Mus musculus
ggcgtggcgcggaaacaaactttgc

SEQ ID NO: 709811 - DNA, 25 bp, Mus musculus
ggcgtggcgcggtaacaaactttgc

SEQ ID NO: 709812 - DNA, 25 bp, Mus musculus
ggcgtgggactcacctatccatcca

SEQ ID NO: 709813 - DNA, 25 bp, Mus musculus
ggcgtgggactctcctatccatcca

SEQ ID NO: 709814 - DNA, 25 bp, Mus musculus
ggcgtgggactgaccttcgctaagt

SEQ ID NO: 709815 - DNA, 25 bp, Mus musculus
ggcgtgggactgtccttcgctaagt

SEQ ID NO: 709816 - DNA, 25 bp, Mus musculus
ggcgtgggcagcacttctgccccga

SEQ ID NO: 709817 - DNA, 25 bp, Mus musculus
ggcgtgggcagctcttctgccccga

SEQ ID NO: 709818 - DNA, 25 bp, Mus musculus
ggcgtggtcatgaacaactgcagct

SEQ ID NO: 709819 - DNA, 25 bp, Mus musculus
ggcgtggtcatgtacaactgcagct

SEQ ID NO: 709820 - DNA, 25 bp, Mus musculus
ggcgtggtctgtctccttttaccca

SEQ ID NO: 709821 - DNA, 25 bp, Mus musculus
ggcgtggtctgtgtccttttaccca

SEQ ID NO: 709822 - DNA, 25 bp, Mus musculus
ggcgtggtgaatccctgcttagcat

SEQ ID NO: 709823 - DNA, 25 bp, Mus musculus
ggcgtggtgaatgcctgcttagcat

SEQ ID NO: 709824 - DNA, 25 bp, Mus musculus
ggcgtgtgagtaactgaataaaata

SEQ ID NO: 709825 - DNA, 25 bp, Mus musculus
ggcgtgtgagtatctgaataaaata

SEQ ID NO: 709826 - DNA, 25 bp, Mus musculus
ggcgttacggccatgacatggcttc

SEQ ID NO: 709827 - DNA, 25 bp, Mus musculus
ggcgttacggccttgacatggcttc

SEQ ID NO: 709828 - DNA, 25 bp, Mus musculus
ggcgttaggctcatccacccttggt

SEQ ID NO: 709829 - DNA, 25 bp, Mus musculus
ggcgttaggctcttccacccttggt

SEQ ID NO: 709830 - DNA, 25 bp, Mus musculus
ggcgttatcactccctggcaatcta

SEQ ID NO: 709831 - DNA, 25 bp, Mus musculus
ggcgttatcactgcctggcaatcta

SEQ ID NO: 709832 - DNA, 25 bp, Mus musculus
ggcgttatgcaaagcctacacgtta

SEQ ID NO: 709833 - DNA, 25 bp, Mus musculus
ggcgttatgcaatgcctacacgtta

SEQ ID NO: 709834 - DNA, 25 bp, Mus musculus
ggcgttcacgctcttgctgcctctg

SEQ ID NO: 709835 - DNA, 25 bp, Mus musculus
ggcgttcacgctgttgctgcctctg

SEQ ID NO: 709836 - DNA, 25 bp, Mus musculus
ggcgttccgaacaccaaccctagat

SEQ ID NO: 709837 - DNA, 25 bp, Mus musculus
ggcgttccgaactccaaccctagat

SEQ ID NO: 709838 - DNA, 25 bp, Mus musculus
ggcgttcgggttaccagtgcaatcc

SEQ ID NO: 709839 - DNA, 25 bp, Mus musculus
ggcgttcgggtttccagtgcaatcc

SEQ ID NO: 709840 - DNA, 25 bp, Mus musculus
ggcgttctgttgagccacaaatgct

SEQ ID NO: 709841 - DNA, 25 bp, Mus musculus
ggcgttctgttgtgccacaaatgct

SEQ ID NO: 709842 - DNA, 25 bp, Mus musculus
ggcgttgaatgactgtcttaatctc

SEQ ID NO: 709843 - DNA, 25 bp, Mus musculus
ggcgttgaatgagtgtcttaatctc

SEQ ID NO: 709844 - DNA, 25 bp, Mus musculus
ggcgttgaccccaccaaagatatat

SEQ ID NO: 709845 - DNA, 25 bp, Mus musculus
ggcgttgacccctccaaagatatat

SEQ ID NO: 709846 - DNA, 25 bp, Mus musculus
ggcgttggcaccagcatctgcagaa

SEQ ID NO: 709847 - DNA, 25 bp, Mus musculus
ggcgttggcacctgcatctgcagaa

SEQ ID NO: 709848 - DNA, 25 bp, Mus musculus
ggcgttggtcatccccagactgcct

SEQ ID NO: 709849 - DNA, 25 bp, Mus musculus
ggcgttggtcatgcccagactgcct

SEQ ID NO: 709850 - DNA, 25 bp, Mus musculus
ggcgttgttaaacggcttcaagatc

SEQ ID NO: 709851 - DNA, 25 bp, Mus musculus
ggcgttgttaaagggcttcaagatc

SEQ ID NO: 709852 - DNA, 25 bp, Mus musculus
ggcgttgttctcaacactggcagag

SEQ ID NO: 709853 - DNA, 25 bp, Mus musculus
ggcgttgttctctacactggcagag

SEQ ID NO: 709854 - DNA, 25 bp, Mus musculus
ggcgttgttgcaagacccattggag

SEQ ID NO: 709855 - DNA, 25 bp, Mus musculus
ggcgttgttgcatgacccattggag

SEQ ID NO: 709856 - DNA, 25 bp, Mus musculus
ggcgttgtttgaccggatctacaca

SEQ ID NO: 709857 - DNA, 25 bp, Mus musculus
ggcgttgtttgagcggatctacaca

SEQ ID NO: 709858 - DNA, 25 bp, Mus musculus
ggcgtttatgtcagtaaagtatcaa

SEQ ID NO: 709859 - DNA, 25 bp, Mus musculus
ggcgtttatgtctgtaaagtatcaa

SEQ ID NO: 709860 - DNA, 25 bp, Mus musculus
ggcgtttctcacacatgacgctgcg

SEQ ID NO: 709861 - DNA, 25 bp, Mus musculus
ggcgtttctcactcatgacgctgcg

SEQ ID NO: 709862 - DNA, 25 bp, Mus musculus
ggcgtttgtgccacgtgagccccgt

SEQ ID NO: 709863 - DNA, 25 bp, Mus musculus
ggcgtttgtgcctcgtgagccccgt

SEQ ID NO: 709864 - DNA, 25 bp, Mus musculus
ggcgttttacagacgggctcaagcc

SEQ ID NO: 709865 - DNA, 25 bp, Mus musculus
ggcgttttacagtcgggctcaagcc

SEQ ID NO: 709866 - DNA, 25 bp, Mus musculus
ggcgttttttctatcagcggctggt

SEQ ID NO: 709867 - DNA, 25 bp, Mus musculus
ggcgttttttctttcagcggctggt

SEQ ID NO: 709868 - DNA, 25 bp, Mus musculus
ggctaaaagttaatgatcaatcgct

SEQ ID NO: 709869 - DNA, 25 bp, Mus musculus
ggctaaaagttattgatcaatcgct

SEQ ID NO: 709870 - DNA, 25 bp, Mus musculus
ggctaaaatccccagactgccgggt

SEQ ID NO: 709871 - DNA, 25 bp, Mus musculus
ggctaaaatcccgagactgccgggt

SEQ ID NO: 709872 - DNA, 25 bp, Mus musculus
ggctaaacaggacaatcggtccagg

SEQ ID NO: 709873 - DNA, 25 bp, Mus musculus
ggctaaacaggagaatcggtccagg

SEQ ID NO: 709874 - DNA, 25 bp, Mus musculus
ggctaaacctgtaccacttctggag

SEQ ID NO: 709875 - DNA, 25 bp, Mus musculus
ggctaaacctgttccacttctggag

SEQ ID NO: 709876 - DNA, 25 bp, Mus musculus
ggctaaagaaacaattcccatggac

SEQ ID NO: 709877 - DNA, 25 bp, Mus musculus
ggctaaagaaactattcccatggac

SEQ ID NO: 709878 - DNA, 25 bp, Mus musculus
ggctaaagatcaccaggctgcagaa

SEQ ID NO: 709879 - DNA, 25 bp, Mus musculus
ggctaaagatcagcaggctgcagaa

SEQ ID NO: 709880 - DNA, 25 bp, Mus musculus
ggctaaagtaaaagggatgtggcaa

SEQ ID NO: 709881 - DNA, 25 bp, Mus musculus
ggctaaagtaaatgggatgtggcaa

SEQ ID NO: 709882 - DNA, 25 bp, Mus musculus
ggctaaagttgaaaataaaaggtgt

SEQ ID NO: 709883 - DNA, 25 bp, Mus musculus
ggctaaagttgataataaaaggtgt

SEQ ID NO: 709884 - DNA, 25 bp, Mus musculus
ggctaaatccaaccagcccaagtca

SEQ ID NO: 709885 - DNA, 25 bp, Mus musculus
ggctaaatccaagcagcccaagtca

SEQ ID NO: 709886 - DNA, 25 bp, Mus musculus
ggctaaattcatcggttccccagaa

SEQ ID NO: 709887 - DNA, 25 bp, Mus musculus
ggctaaattcatgggttccccagaa

SEQ ID NO: 709888 - DNA, 25 bp, Mus musculus
ggctaaatttctcaagtcccacata

SEQ ID NO: 709889 - DNA, 25 bp, Mus musculus
ggctaaatttctgaagtcccacata

SEQ ID NO: 709890 - DNA, 25 bp, Mus musculus
ggctaacaagctatgccagagtttc

SEQ ID NO: 709891 - DNA, 25 bp, Mus musculus
ggctaacaagctttgccagagtttc

SEQ ID NO: 709892 - DNA, 25 bp, Mus musculus
ggctaacagtacagggccacacgct

SEQ ID NO: 709893 - DNA, 25 bp, Mus musculus
ggctaacagtactgggccacacgct

SEQ ID NO: 709894 - DNA, 25 bp, Mus musculus
ggctaacccgcgcaagcctgtggaa

SEQ ID NO: 709895 - DNA, 25 bp, Mus musculus
ggctaacccgcggaagcctgtggaa

SEQ ID NO: 709896 - DNA, 25 bp, Mus musculus
ggctaacctttcctaccgaatcttg

SEQ ID NO: 709897 - DNA, 25 bp, Mus musculus
ggctaacctttcgtaccgaatcttg

SEQ ID NO: 709898 - DNA, 25 bp, Mus musculus
ggctaactacaacctacggttcaca

SEQ ID NO: 709899 - DNA, 25 bp, Mus musculus
ggctaactacaagctacggttcaca

SEQ ID NO: 709900 - DNA, 25 bp, Mus musculus
ggctaactgcaacctaaagaccaac

SEQ ID NO: 709901 - DNA, 25 bp, Mus musculus
ggctaactgcaagctaaagaccaac

SEQ ID NO: 709902 - DNA, 25 bp, Mus musculus
ggctaagaagccagcatccaatggg

SEQ ID NO: 709903 - DNA, 25 bp, Mus musculus
ggctaagaagcctgcatccaatggg

SEQ ID NO: 709904 - DNA, 25 bp, Mus musculus
ggctaagactctccaccattgaaat

SEQ ID NO: 709905 - DNA, 25 bp, Mus musculus
ggctaagactctgcaccattgaaat

SEQ ID NO: 709906 - DNA, 25 bp, Mus musculus
ggctaagagaaaatggccagcattt

SEQ ID NO: 709907 - DNA, 25 bp, Mus musculus
ggctaagagaaattggccagcattt

SEQ ID NO: 709908 - DNA, 25 bp, Mus musculus
ggctaagagtaacgcatttttctgg

SEQ ID NO: 709909 - DNA, 25 bp, Mus musculus
ggctaagagtaaggcatttttctgg

SEQ ID NO: 709910 - DNA, 25 bp, Mus musculus
ggctaagcatcgaaggctgccagcc

SEQ ID NO: 709911 - DNA, 25 bp, Mus musculus
ggctaagcatcgtaggctgccagcc

SEQ ID NO: 709912 - DNA, 25 bp, Mus musculus
ggctaagggttcaagctctcaggac

SEQ ID NO: 709913 - DNA, 25 bp, Mus musculus
ggctaagggttctagctctcaggac

SEQ ID NO: 709914 - DNA, 25 bp, Mus musculus
ggctaaggtcctcaactaaataaat

SEQ ID NO: 709915 - DNA, 25 bp, Mus musculus
ggctaaggtcctgaactaaataaat

SEQ ID NO: 709916 - DNA, 25 bp, Mus musculus
ggctaaggtgatcccagctactcag

SEQ ID NO: 709917 - DNA, 25 bp, Mus musculus
ggctaaggtgatgccagctactcag

SEQ ID NO: 709918 - DNA, 25 bp, Mus musculus
ggctaagtcaacaggatatgatcca

SEQ ID NO: 709919 - DNA, 25 bp, Mus musculus
ggctaagtcaactggatatgatcca

SEQ ID NO: 709920 - DNA, 25 bp, Mus musculus
ggctaatagcaaactaatgatcctg

SEQ ID NO: 709921 - DNA, 25 bp, Mus musculus
ggctaatagcaatctaatgatcctg

SEQ ID NO: 709922 - DNA, 25 bp, Mus musculus
ggctaatcaagactgaaaaacctga

SEQ ID NO: 709923 - DNA, 25 bp, Mus musculus
ggctaatcaagagtgaaaaacctga

SEQ ID NO: 709924 - DNA, 25 bp, Mus musculus
ggctaatcagaaactttcattcagt

SEQ ID NO: 709925 - DNA, 25 bp, Mus musculus
ggctaatcagaatctttcattcagt

SEQ ID NO: 709926 - DNA, 25 bp, Mus musculus
ggctaatctgttccaaggaattaaa

SEQ ID NO: 709927 - DNA, 25 bp, Mus musculus
ggctaatctgttgcaaggaattaaa

SEQ ID NO: 709928 - DNA, 25 bp, Mus musculus
ggctaatgagtacgtcccagacagg

SEQ ID NO: 709929 - DNA, 25 bp, Mus musculus
ggctaatgagtaggtcccagacagg

SEQ ID NO: 709930 - DNA, 25 bp, Mus musculus
ggctaatgggatcagcctccagccg

SEQ ID NO: 709931 - DNA, 25 bp, Mus musculus
ggctaatgggatgagcctccagccg

SEQ ID NO: 709932 - DNA, 25 bp, Mus musculus
ggctaattgcacaggactgcgggcc

SEQ ID NO: 709933 - DNA, 25 bp, Mus musculus
ggctaattgcactggactgcgggcc

SEQ ID NO: 709934 - DNA, 25 bp, Mus musculus
ggctacaaacttactagcgcatgag

SEQ ID NO: 709935 - DNA, 25 bp, Mus musculus
ggctacaaactttctagcgcatgag

SEQ ID NO: 709936 - DNA, 25 bp, Mus musculus
ggctacaacataaactatacaccca

SEQ ID NO: 709937 - DNA, 25 bp, Mus musculus
ggctacaacatatactatacaccca

SEQ ID NO: 709938 - DNA, 25 bp, Mus musculus
ggctacaactgtacctgccctgcag

SEQ ID NO: 709939 - DNA, 25 bp, Mus musculus
ggctacaactgttcctgccctgcag

SEQ ID NO: 709940 - DNA, 25 bp, Mus musculus
ggctacaagaggctcaacagcaccc

SEQ ID NO: 709941 - DNA, 25 bp, Mus musculus
ggctacaagagggtcaacagcaccc

SEQ ID NO: 709942 - DNA, 25 bp, Mus musculus
ggctacaaggaaaaaagagcagaag

SEQ ID NO: 709943 - DNA, 25 bp, Mus musculus
ggctacaaggaataaagagcagaag

SEQ ID NO: 709944 - DNA, 25 bp, Mus musculus
ggctacaagggccttcaggccctgc

SEQ ID NO: 709945 - DNA, 25 bp, Mus musculus
ggctacaagggcgttcaggccctgc

SEQ ID NO: 709946 - DNA, 25 bp, Mus musculus
ggctacaagtttctctattgttcgg

SEQ ID NO: 709947 - DNA, 25 bp, Mus musculus
ggctacaagtttgtctattgttcgg

SEQ ID NO: 709948 - DNA, 25 bp, Mus musculus
ggctacaatcctaaacctagagcgg

SEQ ID NO: 709949 - DNA, 25 bp, Mus musculus
ggctacaatccttaacctagagcgg

SEQ ID NO: 709950 - DNA, 25 bp, Mus musculus
ggctacaatgtgagcatctttgcct

SEQ ID NO: 709951 - DNA, 25 bp, Mus musculus
ggctacaatgtgtgcatctttgcct

SEQ ID NO: 709952 - DNA, 25 bp, Mus musculus
ggctacacagaacaactgcaacaat

SEQ ID NO: 709953 - DNA, 25 bp, Mus musculus
ggctacacagaagaactgcaacaat

SEQ ID NO: 709954 - DNA, 25 bp, Mus musculus
ggctacaccccaatggatctcgcag

SEQ ID NO: 709955 - DNA, 25 bp, Mus musculus
ggctacaccccattggatctcgcag

SEQ ID NO: 709956 - DNA, 25 bp, Mus musculus
ggctacaccgtgaaaggcatccaga

SEQ ID NO: 709957 - DNA, 25 bp, Mus musculus
ggctacaccgtgtaaggcatccaga

SEQ ID NO: 709958 - DNA, 25 bp, Mus musculus
ggctacacctacacgagctcagaca

SEQ ID NO: 709959 - DNA, 25 bp, Mus musculus
ggctacacctactcgagctcagaca

SEQ ID NO: 709960 - DNA, 25 bp, Mus musculus
ggctacacctatcaagatagtactg

SEQ ID NO: 709961 - DNA, 25 bp, Mus musculus
ggctacacctatgaagatagtactg

SEQ ID NO: 709962 - DNA, 25 bp, Mus musculus
ggctacacctttcaatacccagaca

SEQ ID NO: 709963 - DNA, 25 bp, Mus musculus
ggctacacctttgaatacccagaca

SEQ ID NO: 709964 - DNA, 25 bp, Mus musculus
ggctacacgacccttcaggacgaag

SEQ ID NO: 709965 - DNA, 25 bp, Mus musculus
ggctacacgaccgttcaggacgaag

SEQ ID NO: 709966 - DNA, 25 bp, Mus musculus
ggctacacttgtattccctcatgat

SEQ ID NO: 709967 - DNA, 25 bp, Mus musculus
ggctacacttgttttccctcatgat

SEQ ID NO: 709968 - DNA, 25 bp, Mus musculus
ggctacagcaacatccctaatcctg

SEQ ID NO: 709969 - DNA, 25 bp, Mus musculus
ggctacagcaacttccctaatcctg

SEQ ID NO: 709970 - DNA, 25 bp, Mus musculus
ggctacagcaccacaactgacttca

SEQ ID NO: 709971 - DNA, 25 bp, Mus musculus
ggctacagcacctcaactgacttca

SEQ ID NO: 709972 - DNA, 25 bp, Mus musculus
ggctacagcactccgcagacattgg

SEQ ID NO: 709973 - DNA, 25 bp, Mus musculus
ggctacagcactgcgcagacattgg

SEQ ID NO: 709974 - DNA, 25 bp, Mus musculus
ggctacagcgctatcttacactgcg

SEQ ID NO: 709975 - DNA, 25 bp, Mus musculus
ggctacagcgctttcttacactgcg

SEQ ID NO: 709976 - DNA, 25 bp, Mus musculus
ggctacatcaaaacgggacaacaag

SEQ ID NO: 709977 - DNA, 25 bp, Mus musculus
ggctacatcaaatcgggacaacaag

SEQ ID NO: 709978 - DNA, 25 bp, Mus musculus
ggctacatcaagacttggcaccctc

SEQ ID NO: 709979 - DNA, 25 bp, Mus musculus
ggctacatcaagtcttggcaccctc

SEQ ID NO: 709980 - DNA, 25 bp, Mus musculus
ggctacatgcccaaacgtggcctgg

SEQ ID NO: 709981 - DNA, 25 bp, Mus musculus
ggctacatgccctaacgtggcctgg

SEQ ID NO: 709982 - DNA, 25 bp, Mus musculus
ggctacatggatatgagcaaggatg

SEQ ID NO: 709983 - DNA, 25 bp, Mus musculus
ggctacatggatttgagcaaggatg

SEQ ID NO: 709984 - DNA, 25 bp, Mus musculus
ggctacatgtatatccgtgaccgca

SEQ ID NO: 709985 - DNA, 25 bp, Mus musculus
ggctacatgtatttccgtgaccgca

SEQ ID NO: 709986 - DNA, 25 bp, Mus musculus
ggctacattttacagtgagactcgg

SEQ ID NO: 709987 - DNA, 25 bp, Mus musculus
ggctacattttagagtgagactcgg

SEQ ID NO: 709988 - DNA, 25 bp, Mus musculus
ggctaccaaattactgcaatggcaa

SEQ ID NO: 709989 - DNA, 25 bp, Mus musculus
ggctaccaaatttctgcaatggcaa

SEQ ID NO: 709990 - DNA, 25 bp, Mus musculus
ggctaccacctaaggaaggccctga

SEQ ID NO: 709991 - DNA, 25 bp, Mus musculus
ggctaccacctatggaaggccctga

SEQ ID NO: 709992 - DNA, 25 bp, Mus musculus
ggctaccagtatctccgtgtctaac

SEQ ID NO: 709993 - DNA, 25 bp, Mus musculus
ggctaccagtatgtccgtgtctaac

SEQ ID NO: 709994 - DNA, 25 bp, Mus musculus
ggctaccataccattgtctgtggat

SEQ ID NO: 709995 - DNA, 25 bp, Mus musculus
ggctaccatacctttgtctgtggat

SEQ ID NO: 709996 - DNA, 25 bp, Mus musculus
ggctaccatctgcaggtctaacttt

SEQ ID NO: 709997 - DNA, 25 bp, Mus musculus
ggctaccatctggaggtctaacttt

SEQ ID NO: 709998 - DNA, 25 bp, Mus musculus
ggctaccatggacacacctctgaaa

SEQ ID NO: 709999 - DNA, 25 bp, Mus musculus
ggctaccatggagacacctctgaaa

SEQ ID NO: 710000 - DNA, 25 bp, Mus musculus
ggctacccaggaagtagcactacac

SEQ ID NO: 710001 - DNA, 25 bp, Mus musculus
ggctacccaggatgtagcactacac

SEQ ID NO: 710002 - DNA, 25 bp, Mus musculus
ggctaccccatgatctatgcttttg

SEQ ID NO: 710003 - DNA, 25 bp, Mus musculus
ggctaccccatgttctatgcttttg

SEQ ID NO: 710004 - DNA, 25 bp, Mus musculus
ggctacccgactcttctgtgatgtc

SEQ ID NO: 710005 - DNA, 25 bp, Mus musculus
ggctacccgactgttctgtgatgtc

SEQ ID NO: 710006 - DNA, 25 bp, Mus musculus
ggctaccgactcaacattctccatg

SEQ ID NO: 710007 - DNA, 25 bp, Mus musculus
ggctaccgactctacattctccatg

SEQ ID NO: 710008 - DNA, 25 bp, Mus musculus
ggctaccgcgatcacagtttccagt

SEQ ID NO: 710009 - DNA, 25 bp, Mus musculus
ggctaccgcgatgacagtttccagt

SEQ ID NO: 710010 - DNA, 25 bp, Mus musculus
ggctaccggaaacaggacttcctgg

SEQ ID NO: 710011 - DNA, 25 bp, Mus musculus
ggctaccggaaagaggacttcctgg

SEQ ID NO: 710012 - DNA, 25 bp, Mus musculus
ggctacctgattcccacagtctgtg

SEQ ID NO: 710013 - DNA, 25 bp, Mus musculus
ggctacctgattgccacagtctgtg

SEQ ID NO: 710014 - DNA, 25 bp, Mus musculus
ggctacctgcacagggtcaacgaga

SEQ ID NO: 710015 - DNA, 25 bp, Mus musculus
ggctacctgcactgggtcaacgaga

SEQ ID NO: 710016 - DNA, 25 bp, Mus musculus
ggctacctgggcaatctcaagtctg

SEQ ID NO: 710017 - DNA, 25 bp, Mus musculus
ggctacctgggctatctcaagtctg

SEQ ID NO: 710018 - DNA, 25 bp, Mus musculus
ggctaccttggtccactgtgcggca

SEQ ID NO: 710019 - DNA, 25 bp, Mus musculus
ggctaccttggtgcactgtgcggca

SEQ ID NO: 710020 - DNA, 25 bp, Mus musculus
ggctaccttgtacggaaacatttca

SEQ ID NO: 710021 - DNA, 25 bp, Mus musculus
ggctaccttgtagggaaacatttca

SEQ ID NO: 710022 - DNA, 25 bp, Mus musculus
ggctacgaaaacaacggcaagcgat

SEQ ID NO: 710023 - DNA, 25 bp, Mus musculus
ggctacgaaaacctgcccactatcg

SEQ ID NO: 710024 - DNA, 25 bp, Mus musculus
ggctacgaaaacgtgcccactatcg

SEQ ID NO: 710025 - DNA, 25 bp, Mus musculus
ggctacgaaaactacggcaagcgat

SEQ ID NO: 710026 - DNA, 25 bp, Mus musculus
ggctacgaatgtccctgtgaaccag

SEQ ID NO: 710027 - DNA, 25 bp, Mus musculus
ggctacgaatgtgcctgtgaaccag

SEQ ID NO: 710028 - DNA, 25 bp, Mus musculus
ggctacgacagaaaagactaaactc

SEQ ID NO: 710029 - DNA, 25 bp, Mus musculus
ggctacgacagataagactaaactc

SEQ ID NO: 710030 - DNA, 25 bp, Mus musculus
ggctacgactctcaccctgtgaaag

SEQ ID NO: 710031 - DNA, 25 bp, Mus musculus
ggctacgactctgaccctgtgaaag

SEQ ID NO: 710032 - DNA, 25 bp, Mus musculus
ggctacgagtatatattcaccaacc

SEQ ID NO: 710033 - DNA, 25 bp, Mus musculus
ggctacgagtatttattcaccaacc

SEQ ID NO: 710034 - DNA, 25 bp, Mus musculus
ggctacgcagatcaaaacctattcc

SEQ ID NO: 710035 - DNA, 25 bp, Mus musculus
ggctacgcagatgaaaacctattcc

SEQ ID NO: 710036 - DNA, 25 bp, Mus musculus
ggctacggaaatcttgaatgaatat

SEQ ID NO: 710037 - DNA, 25 bp, Mus musculus
ggctacggaaatgttgaatgaatat

SEQ ID NO: 710038 - DNA, 25 bp, Mus musculus
ggctacggatttagcagagaacgag

SEQ ID NO: 710039 - DNA, 25 bp, Mus musculus
ggctacggattttgcagagaacgag

SEQ ID NO: 710040 - DNA, 25 bp, Mus musculus
ggctacggcaacaactggaaccagg

SEQ ID NO: 710041 - DNA, 25 bp, Mus musculus
ggctacggcaactactggaaccagg

SEQ ID NO: 710042 - DNA, 25 bp, Mus musculus
ggctacgggcctagccacccgagat

SEQ ID NO: 710043 - DNA, 25 bp, Mus musculus
ggctacgggccttgccacccgagat

SEQ ID NO: 710044 - DNA, 25 bp, Mus musculus
ggctacgtccttccaccagtgaatt

SEQ ID NO: 710045 - DNA, 25 bp, Mus musculus
ggctacgtccttgcaccagtgaatt

SEQ ID NO: 710046 - DNA, 25 bp, Mus musculus
ggctacgttccccaggatgggctca

SEQ ID NO: 710047 - DNA, 25 bp, Mus musculus
ggctacgttcccgaggatgggctca

SEQ ID NO: 710048 - DNA, 25 bp, Mus musculus
ggctactatacccttaagtttgact

SEQ ID NO: 710049 - DNA, 25 bp, Mus musculus
ggctactataccgttaagtttgact

SEQ ID NO: 710050 - DNA, 25 bp, Mus musculus
ggctactatgacatctctgtccgag

SEQ ID NO: 710051 - DNA, 25 bp, Mus musculus
ggctactatgacttctctgtccgag

SEQ ID NO: 710052 - DNA, 25 bp, Mus musculus
ggctactcaggccttctcagaaaag

SEQ ID NO: 710053 - DNA, 25 bp, Mus musculus
ggctactcaggcgttctcagaaaag

SEQ ID NO: 710054 - DNA, 25 bp, Mus musculus
ggctactcatcacgaccaggaatgg

SEQ ID NO: 710055 - DNA, 25 bp, Mus musculus
ggctactcatcaggaccaggaatgg

SEQ ID NO: 710056 - DNA, 25 bp, Mus musculus
ggctactcctataccatgcttgatg

SEQ ID NO: 710057 - DNA, 25 bp, Mus musculus
ggctactcctattccatgcttgatg

SEQ ID NO: 710058 - DNA, 25 bp, Mus musculus
ggctactgccaaagctggattttta

SEQ ID NO: 710059 - DNA, 25 bp, Mus musculus
ggctactgccaatgctggattttta

SEQ ID NO: 710060 - DNA, 25 bp, Mus musculus
ggctactggactacagcagaaccat

SEQ ID NO: 710061 - DNA, 25 bp, Mus musculus
ggctactggacttcagcagaaccat

SEQ ID NO: 710062 - DNA, 25 bp, Mus musculus
ggctactggagacgacccaactagt

SEQ ID NO: 710063 - DNA, 25 bp, Mus musculus
ggctactggagaggacccaactagt

SEQ ID NO: 710064 - DNA, 25 bp, Mus musculus
ggctactggttgcagatctttgaca

SEQ ID NO: 710065 - DNA, 25 bp, Mus musculus
ggctactggttggagatctttgaca

SEQ ID NO: 710066 - DNA, 25 bp, Mus musculus
ggctactgttggctaccagccacag

SEQ ID NO: 710067 - DNA, 25 bp, Mus musculus
ggctactgttgggtaccagccacag

SEQ ID NO: 710068 - DNA, 25 bp, Mus musculus
ggctacttcatcacagcctgtgcag

SEQ ID NO: 710069 - DNA, 25 bp, Mus musculus
ggctacttcatctcagcctgtgcag

SEQ ID NO: 710070 - DNA, 25 bp, Mus musculus
ggctacttcttcagagctcccgggc

SEQ ID NO: 710071 - DNA, 25 bp, Mus musculus
ggctacttcttctgagctcccgggc

SEQ ID NO: 710072 - DNA, 25 bp, Mus musculus
ggctacttgaaacacccagcaagaa

SEQ ID NO: 710073 - DNA, 25 bp, Mus musculus
ggctacttgaaagacccagcaagaa

SEQ ID NO: 710074 - DNA, 25 bp, Mus musculus
ggctacttggataattggtatcggg

SEQ ID NO: 710075 - DNA, 25 bp, Mus musculus
ggctacttggattattggtatcggg

SEQ ID NO: 710076 - DNA, 25 bp, Mus musculus
ggctactttatccagcccaccgtgt

SEQ ID NO: 710077 - DNA, 25 bp, Mus musculus
ggctactttatcgagcccaccgtgt

SEQ ID NO: 710078 - DNA, 25 bp, Mus musculus
ggctacttttgacattgataagaag

SEQ ID NO: 710079 - DNA, 25 bp, Mus musculus
ggctacttttgagattgataagaag

SEQ ID NO: 710080 - DNA, 25 bp, Mus musculus
ggctactttttgcaacatctggctt

SEQ ID NO: 710081 - DNA, 25 bp, Mus musculus
ggctactttttggaacatctggctt

SEQ ID NO: 710082 - DNA, 25 bp, Mus musculus
ggctagaaagtcagcaagcattgaa

SEQ ID NO: 710083 - DNA, 25 bp, Mus musculus
ggctagaaagtctgcaagcattgaa

SEQ ID NO: 710084 - DNA, 25 bp, Mus musculus
ggctagactagccagtcaattccaa

SEQ ID NO: 710085 - DNA, 25 bp, Mus musculus
ggctagactagcgagtcaattccaa

SEQ ID NO: 710086 - DNA, 25 bp, Mus musculus
ggctagactggtcacacaattttac

SEQ ID NO: 710087 - DNA, 25 bp, Mus musculus
ggctagactggtgacacaattttac

SEQ ID NO: 710088 - DNA, 25 bp, Mus musculus
ggctagagcagaccagcgatgactc

SEQ ID NO: 710089 - DNA, 25 bp, Mus musculus
ggctagagcagagcagcgatgactc

SEQ ID NO: 710090 - DNA, 25 bp, Mus musculus
ggctagataacactctgcatcatgt

SEQ ID NO: 710091 - DNA, 25 bp, Mus musculus
ggctagataacagtctgcatcatgt

SEQ ID NO: 710092 - DNA, 25 bp, Mus musculus
ggctagatcacacaccctatcctga

SEQ ID NO: 710093 - DNA, 25 bp, Mus musculus
ggctagatcacagaccctatcctga

SEQ ID NO: 710094 - DNA, 25 bp, Mus musculus
ggctagatgaccaatgcagcagcat

SEQ ID NO: 710095 - DNA, 25 bp, Mus musculus
ggctagatgacctatgcagcagcat

SEQ ID NO: 710096 - DNA, 25 bp, Mus musculus
ggctagatggccaggatctcatcag

SEQ ID NO: 710097 - DNA, 25 bp, Mus musculus
ggctagatggcctggatctcatcag

SEQ ID NO: 710098 - DNA, 25 bp, Mus musculus
ggctagcaaggaacacagctccgat

SEQ ID NO: 710099 - DNA, 25 bp, Mus musculus
ggctagcaaggatcacagctccgat

SEQ ID NO: 710100 - DNA, 25 bp, Mus musculus
ggctagcccagacgactccattcat

SEQ ID NO: 710101 - DNA, 25 bp, Mus musculus
ggctagcccagaggactccattcat

SEQ ID NO: 710102 - DNA, 25 bp, Mus musculus
ggctagccttatctccaccttgtag

SEQ ID NO: 710103 - DNA, 25 bp, Mus musculus
ggctagccttatgtccaccttgtag

SEQ ID NO: 710104 - DNA, 25 bp, Mus musculus
ggctaggaataaccacgctattgca

SEQ ID NO: 710105 - DNA, 25 bp, Mus musculus
ggctaggaataagcacgctattgca

SEQ ID NO: 710106 - DNA, 25 bp, Mus musculus
ggctaggcacctacatgggccacac

SEQ ID NO: 710107 - DNA, 25 bp, Mus musculus
ggctaggcaccttcatgggccacac

SEQ ID NO: 710108 - DNA, 25 bp, Mus musculus
ggctaggcgtaaccatgcagttgct

SEQ ID NO: 710109 - DNA, 25 bp, Mus musculus
ggctaggcgtaagcatgcagttgct

SEQ ID NO: 710110 - DNA, 25 bp, Mus musculus
ggctaggttctgcagtagaagactc

SEQ ID NO: 710111 - DNA, 25 bp, Mus musculus
ggctaggttctggagtagaagactc

SEQ ID NO: 710112 - DNA, 25 bp, Mus musculus
ggctaggtttctccggtcgcgtcat

SEQ ID NO: 710113 - DNA, 25 bp, Mus musculus
ggctaggtttctgcggtcgcgtcat

SEQ ID NO: 710114 - DNA, 25 bp, Mus musculus
ggctagtactgactggatcctccta

SEQ ID NO: 710115 - DNA, 25 bp, Mus musculus
ggctagtactgagtggatcctccta

SEQ ID NO: 710116 - DNA, 25 bp, Mus musculus
ggctagtcgcccctgtcactatgca

SEQ ID NO: 710117 - DNA, 25 bp, Mus musculus
ggctagtcgcccgtgtcactatgca

SEQ ID NO: 710118 - DNA, 25 bp, Mus musculus
ggctagtcttatctctatagtcttt

SEQ ID NO: 710119 - DNA, 25 bp, Mus musculus
ggctagtcttatgtctatagtcttt

SEQ ID NO: 710120 - DNA, 25 bp, Mus musculus
ggctagtgagaaaaagagctttgac

SEQ ID NO: 710121 - DNA, 25 bp, Mus musculus
ggctagtgagaataagagctttgac

SEQ ID NO: 710122 - DNA, 25 bp, Mus musculus
ggctagtgattgcaggaaaccccgt

SEQ ID NO: 710123 - DNA, 25 bp, Mus musculus
ggctagtgattggaggaaaccccgt

SEQ ID NO: 710124 - DNA, 25 bp, Mus musculus
ggctagtggatcatggtaagttccc

SEQ ID NO: 710125 - DNA, 25 bp, Mus musculus
ggctagtggatcttggtaagttccc

SEQ ID NO: 710126 - DNA, 25 bp, Mus musculus
ggctagtggcctatccagctttgag

SEQ ID NO: 710127 - DNA, 25 bp, Mus musculus
ggctagtggcctttccagctttgag

SEQ ID NO: 710128 - DNA, 25 bp, Mus musculus
ggctagtggtggagaatcattacct

SEQ ID NO: 710129 - DNA, 25 bp, Mus musculus
ggctagtggtggtgaatcattacct

SEQ ID NO: 710130 - DNA, 25 bp, Mus musculus
ggctataacgtcagctctcgcgtcg

SEQ ID NO: 710131 - DNA, 25 bp, Mus musculus
ggctataacgtctgctctcgcgtcg

SEQ ID NO: 710132 - DNA, 25 bp, Mus musculus
ggctataaggagcttcggaagccac

SEQ ID NO: 710133 - DNA, 25 bp, Mus musculus
ggctataaggaggttcggaagccac

SEQ ID NO: 710134 - DNA, 25 bp, Mus musculus
ggctataattctatggacctagctg

SEQ ID NO: 710135 - DNA, 25 bp, Mus musculus
ggctataattctttggacctagctg

SEQ ID NO: 710136 - DNA, 25 bp, Mus musculus
ggctatagcactatgagactttgaa

SEQ ID NO: 710137 - DNA, 25 bp, Mus musculus
ggctatagcactttgagactttgaa

SEQ ID NO: 710138 - DNA, 25 bp, Mus musculus
ggctatagtcttcaaaatggtcaag

SEQ ID NO: 710139 - DNA, 25 bp, Mus musculus
ggctatagtcttgaaaatggtcaag

SEQ ID NO: 710140 - DNA, 25 bp, Mus musculus
ggctatatcaacagtgagaatgtat

SEQ ID NO: 710141 - DNA, 25 bp, Mus musculus
ggctatatcaactgtgagaatgtat

SEQ ID NO: 710142 - DNA, 25 bp, Mus musculus
ggctatatccgacagggtagcgtaa

SEQ ID NO: 710143 - DNA, 25 bp, Mus musculus
ggctatatccgagagggtagcgtaa

SEQ ID NO: 710144 - DNA, 25 bp, Mus musculus
ggctatcacggacgctgtgaaagct

SEQ ID NO: 710145 - DNA, 25 bp, Mus musculus
ggctatcacggaggctgtgaaagct

SEQ ID NO: 710146 - DNA, 25 bp, Mus musculus
ggctatcagagacccccagtgttct

SEQ ID NO: 710147 - DNA, 25 bp, Mus musculus
ggctatcagagagccccagtgttct

SEQ ID NO: 710148 - DNA, 25 bp, Mus musculus
ggctatcagtgcagcgtatgagaga

SEQ ID NO: 710149 - DNA, 25 bp, Mus musculus
ggctatcagtgctgcgtatgagaga

SEQ ID NO: 710150 - DNA, 25 bp, Mus musculus
ggctatcatctcctgctgcaaggta

SEQ ID NO: 710151 - DNA, 25 bp, Mus musculus
ggctatcatctcgtgctgcaaggta

SEQ ID NO: 710152 - DNA, 25 bp, Mus musculus
ggctatcattacctgcgttcaactg

SEQ ID NO: 710153 - DNA, 25 bp, Mus musculus
ggctatcattacgtgcgttcaactg

SEQ ID NO: 710154 - DNA, 25 bp, Mus musculus
ggctatcattctctttctaagcata

SEQ ID NO: 710155 - DNA, 25 bp, Mus musculus
ggctatcattctgtttctaagcata

SEQ ID NO: 710156 - DNA, 25 bp, Mus musculus
ggctatccaaatatgagtctattcg

SEQ ID NO: 710157 - DNA, 25 bp, Mus musculus
ggctatccaaatttgagtctattcg

SEQ ID NO: 710158 - DNA, 25 bp, Mus musculus
ggctatccaggcatccattagacga

SEQ ID NO: 710159 - DNA, 25 bp, Mus musculus
ggctatccaggcttccattagacga

SEQ ID NO: 710160 - DNA, 25 bp, Mus musculus
ggctatcccaggcagccagaccagg

SEQ ID NO: 710161 - DNA, 25 bp, Mus musculus
ggctatcccaggctttgcaaacttg

SEQ ID NO: 710162 - DNA, 25 bp, Mus musculus
ggctatcccagggagccagaccagg

SEQ ID NO: 710163 - DNA, 25 bp, Mus musculus
ggctatcccagggtttgcaaacttg

SEQ ID NO: 710164 - DNA, 25 bp, Mus musculus
ggctatccccagagacgcctgagag

SEQ ID NO: 710165 - DNA, 25 bp, Mus musculus
ggctatccccagtgacgcctgagag

SEQ ID NO: 710166 - DNA, 25 bp, Mus musculus
ggctatcctcggctcctaccgaaag

SEQ ID NO: 710167 - DNA, 25 bp, Mus musculus
ggctatcctcgggtcctaccgaaag

SEQ ID NO: 710168 - DNA, 25 bp, Mus musculus
ggctatcctgggattcgtgaacaag

SEQ ID NO: 710169 - DNA, 25 bp, Mus musculus
ggctatcctgggtttcgtgaacaag

SEQ ID NO: 710170 - DNA, 25 bp, Mus musculus
ggctatcctggtactcttgagagtt

SEQ ID NO: 710171 - DNA, 25 bp, Mus musculus
ggctatcctggttctcttgagagtt

SEQ ID NO: 710172 - DNA, 25 bp, Mus musculus
ggctatcgggaacacttcctaaata

SEQ ID NO: 710173 - DNA, 25 bp, Mus musculus
ggctatcgggaagacttcctaaata

SEQ ID NO: 710174 - DNA, 25 bp, Mus musculus
ggctatctgacgcaactgctgctaa

SEQ ID NO: 710175 - DNA, 25 bp, Mus musculus
ggctatctgacggaactgctgctaa

SEQ ID NO: 710176 - DNA, 25 bp, Mus musculus
ggctatctgagaaacagctgtgaga

SEQ ID NO: 710177 - DNA, 25 bp, Mus musculus
ggctatctgagatacagctgtgaga

SEQ ID NO: 710178 - DNA, 25 bp, Mus musculus
ggctatcttcagcagctctctgaca

SEQ ID NO: 710179 - DNA, 25 bp, Mus musculus
ggctatcttcaggagctctctgaca

SEQ ID NO: 710180 - DNA, 25 bp, Mus musculus
ggctatcttgccacagttgttcatg

SEQ ID NO: 710181 - DNA, 25 bp, Mus musculus
ggctatcttgcctcagttgttcatg

SEQ ID NO: 710182 - DNA, 25 bp, Mus musculus
ggctatcttgctctacctggcacac

SEQ ID NO: 710183 - DNA, 25 bp, Mus musculus
ggctatcttgctgtacctggcacac

SEQ ID NO: 710184 - DNA, 25 bp, Mus musculus
ggctatgaaaaaacccttcgaccat

SEQ ID NO: 710185 - DNA, 25 bp, Mus musculus
ggctatgaaaaatcccttcgaccat

SEQ ID NO: 710186 - DNA, 25 bp, Mus musculus
ggctatgacccgaatgcgaatccac

SEQ ID NO: 710187 - DNA, 25 bp, Mus musculus
ggctatgacccgtatgcgaatccac

SEQ ID NO: 710188 - DNA, 25 bp, Mus musculus
ggctatgatgacatcggtggttgca

SEQ ID NO: 710189 - DNA, 25 bp, Mus musculus
ggctatgatgacttcggtggttgca

SEQ ID NO: 710190 - DNA, 25 bp, Mus musculus
ggctatgcaggcatcatcatgctca

SEQ ID NO: 710191 - DNA, 25 bp, Mus musculus
ggctatgcaggcttcatcatgctca

SEQ ID NO: 710192 - DNA, 25 bp, Mus musculus
ggctatgcgcccataatggagacag

SEQ ID NO: 710193 - DNA, 25 bp, Mus musculus
ggctatgcgcccttaatggagacag

SEQ ID NO: 710194 - DNA, 25 bp, Mus musculus
ggctatgctcacacttaactccaac

SEQ ID NO: 710195 - DNA, 25 bp, Mus musculus
ggctatgctcactcttaactccaac

SEQ ID NO: 710196 - DNA, 25 bp, Mus musculus
ggctatgctgttaatgaaactccca

SEQ ID NO: 710197 - DNA, 25 bp, Mus musculus
ggctatgctgtttatgaaactccca

SEQ ID NO: 710198 - DNA, 25 bp, Mus musculus
ggctatggaactcgcatgcggcccc

SEQ ID NO: 710199 - DNA, 25 bp, Mus musculus
ggctatggaactggcatgcggcccc

SEQ ID NO: 710200 - DNA, 25 bp, Mus musculus
ggctatggaggcagaggcttccttc

SEQ ID NO: 710201 - DNA, 25 bp, Mus musculus
ggctatggaggctgaggcttccttc

SEQ ID NO: 710202 - DNA, 25 bp, Mus musculus
ggctatggatttctacactttgaaa

SEQ ID NO: 710203 - DNA, 25 bp, Mus musculus
ggctatggatttgtacactttgaaa

SEQ ID NO: 710204 - DNA, 25 bp, Mus musculus
ggctatggccagcataacaccacca

SEQ ID NO: 710205 - DNA, 25 bp, Mus musculus
ggctatggccaggataacaccacca

SEQ ID NO: 710206 - DNA, 25 bp, Mus musculus
ggctatggcggcaacgactactcgc

SEQ ID NO: 710207 - DNA, 25 bp, Mus musculus
ggctatggcggctacgactactcgc

SEQ ID NO: 710208 - DNA, 25 bp, Mus musculus
ggctatggctatcgccaggataaca

SEQ ID NO: 710209 - DNA, 25 bp, Mus musculus
ggctatggctatggccaggataaca

SEQ ID NO: 710210 - DNA, 25 bp, Mus musculus
ggctatgggctcacctaccgcctga

SEQ ID NO: 710211 - DNA, 25 bp, Mus musculus
ggctatgggctctcctaccgcctga

SEQ ID NO: 710212 - DNA, 25 bp, Mus musculus
ggctatggtgttcgcactcccatgg

SEQ ID NO: 710213 - DNA, 25 bp, Mus musculus
ggctatggtgttggcactcccatgg

SEQ ID NO: 710214 - DNA, 25 bp, Mus musculus
ggctatgtacccaataatatcctga

SEQ ID NO: 710215 - DNA, 25 bp, Mus musculus
ggctatgtaccctataatatcctga

SEQ ID NO: 710216 - DNA, 25 bp, Mus musculus
ggctatgtgagtagctccactggag

SEQ ID NO: 710217 - DNA, 25 bp, Mus musculus
ggctatgtgagttgctccactggag

SEQ ID NO: 710218 - DNA, 25 bp, Mus musculus
ggctatgtgcagactacatccacag

SEQ ID NO: 710219 - DNA, 25 bp, Mus musculus
ggctatgtgcagtctacatccacag

SEQ ID NO: 710220 - DNA, 25 bp, Mus musculus
ggctatgtggaccacatgcaggtcc

SEQ ID NO: 710221 - DNA, 25 bp, Mus musculus
ggctatgtggacgacatgcaggtcc

SEQ ID NO: 710222 - DNA, 25 bp, Mus musculus
ggctatgttcgaatctcagggtgaa

SEQ ID NO: 710223 - DNA, 25 bp, Mus musculus
ggctatgttcgattctcagggtgaa

SEQ ID NO: 710224 - DNA, 25 bp, Mus musculus
ggctatgtttccatcaggttaaatg

SEQ ID NO: 710225 - DNA, 25 bp, Mus musculus
ggctatgtttccttcaggttaaatg

SEQ ID NO: 710226 - DNA, 25 bp, Mus musculus
ggctattaccaacctaatgagcgtg

SEQ ID NO: 710227 - DNA, 25 bp, Mus musculus
ggctattaccaagctaatgagcgtg

SEQ ID NO: 710228 - DNA, 25 bp, Mus musculus
ggctattatatcaatgtgaccttcc

SEQ ID NO: 710229 - DNA, 25 bp, Mus musculus
ggctattatatctatgtgaccttcc

SEQ ID NO: 710230 - DNA, 25 bp, Mus musculus
ggctattcacgaagccgagaccccg

SEQ ID NO: 710231 - DNA, 25 bp, Mus musculus
ggctattcacgatgccgagaccccg

SEQ ID NO: 710232 - DNA, 25 bp, Mus musculus
ggctattgccagaggcaatggcttg

SEQ ID NO: 710233 - DNA, 25 bp, Mus musculus
ggctattgccagtggcaatggcttg

SEQ ID NO: 710234 - DNA, 25 bp, Mus musculus
ggctatttaatcaaaattctgacca

SEQ ID NO: 710235 - DNA, 25 bp, Mus musculus
ggctatttaatctaaattctgacca

SEQ ID NO: 710236 - DNA, 25 bp, Mus musculus
ggctatttatccaactctatcattc

SEQ ID NO: 710237 - DNA, 25 bp, Mus musculus
ggctatttatcctactctatcattc

SEQ ID NO: 710238 - DNA, 25 bp, Mus musculus
ggctcaaaacaactctacaaacgcg

SEQ ID NO: 710239 - DNA, 25 bp, Mus musculus
ggctcaaaacaagtctacaaacgcg

SEQ ID NO: 710240 - DNA, 25 bp, Mus musculus
ggctcaacagatctaaggtggaaaa

SEQ ID NO: 710241 - DNA, 25 bp, Mus musculus
ggctcaacagatgtaaggtggaaaa

SEQ ID NO: 710242 - DNA, 25 bp, Mus musculus
ggctcaacctgcctcactgtggctg

SEQ ID NO: 710243 - DNA, 25 bp, Mus musculus
ggctcaacctgcgtcactgtggctg

SEQ ID NO: 710244 - DNA, 25 bp, Mus musculus
ggctcaagcctacaaggcactcaag

SEQ ID NO: 710245 - DNA, 25 bp, Mus musculus
ggctcaagcctagaaggcactcaag

SEQ ID NO: 710246 - DNA, 25 bp, Mus musculus
ggctcaaggaccacgaggctcttct

SEQ ID NO: 710247 - DNA, 25 bp, Mus musculus
ggctcaaggacctcgaggctcttct

SEQ ID NO: 710248 - DNA, 25 bp, Mus musculus
ggctcaaggagtcctgatataccct

SEQ ID NO: 710249 - DNA, 25 bp, Mus musculus
ggctcaaggagtgctgatataccct

SEQ ID NO: 710250 - DNA, 25 bp, Mus musculus
ggctcaaggcatcctggagtataaa

SEQ ID NO: 710251 - DNA, 25 bp, Mus musculus
ggctcaaggcatgctggagtataaa

SEQ ID NO: 710252 - DNA, 25 bp, Mus musculus
ggctcaagtgatccccatttatgct

SEQ ID NO: 710253 - DNA, 25 bp, Mus musculus
ggctcaagtgatgcccatttatgct

SEQ ID NO: 710254 - DNA, 25 bp, Mus musculus
ggctcaagtggcatttgaatgtgat

SEQ ID NO: 710255 - DNA, 25 bp, Mus musculus
ggctcaagtggcttttgaatgtgat

SEQ ID NO: 710256 - DNA, 25 bp, Mus musculus
ggctcaatacccaggaatctgtatt

SEQ ID NO: 710257 - DNA, 25 bp, Mus musculus
ggctcaataccctggaatctgtatt

SEQ ID NO: 710258 - DNA, 25 bp, Mus musculus
ggctcaatccagaccagtgtgaatg

SEQ ID NO: 710259 - DNA, 25 bp, Mus musculus
ggctcaatccagtccagtgtgaatg

SEQ ID NO: 710260 - DNA, 25 bp, Mus musculus
ggctcaatgtctctgctccgttcct

SEQ ID NO: 710261 - DNA, 25 bp, Mus musculus
ggctcaatgtctgtgctccgttcct

SEQ ID NO: 710262 - DNA, 25 bp, Mus musculus
ggctcaattggaaacgcgcctgtca

SEQ ID NO: 710263 - DNA, 25 bp, Mus musculus
ggctcaattggatacgcgcctgtca

SEQ ID NO: 710264 - DNA, 25 bp, Mus musculus
ggctcacaagatacatgtgtatgaa

SEQ ID NO: 710265 - DNA, 25 bp, Mus musculus
ggctcacaagattcatgtgtatgaa

SEQ ID NO: 710266 - DNA, 25 bp, Mus musculus
ggctcacaatatagtatacaaagac

SEQ ID NO: 710267 - DNA, 25 bp, Mus musculus
ggctcacaatattgtatacaaagac

SEQ ID NO: 710268 - DNA, 25 bp, Mus musculus
ggctcacagacaacacgtataaata

SEQ ID NO: 710269 - DNA, 25 bp, Mus musculus
ggctcacagacatcacgtataaata

SEQ ID NO: 710270 - DNA, 25 bp, Mus musculus
ggctcacagactctgaaaagggaca

SEQ ID NO: 710271 - DNA, 25 bp, Mus musculus
ggctcacagactgtgaaaagggaca

SEQ ID NO: 710272 - DNA, 25 bp, Mus musculus
ggctcacagcccaactctaatgtca

SEQ ID NO: 710273 - DNA, 25 bp, Mus musculus
ggctcacagccctactctaatgtca

SEQ ID NO: 710274 - DNA, 25 bp, Mus musculus
ggctcacagcctcggtttagttcca

SEQ ID NO: 710275 - DNA, 25 bp, Mus musculus
ggctcacagcctgggtttagttcca

SEQ ID NO: 710276 - DNA, 25 bp, Mus musculus
ggctcacagtggaatctgcactcga

SEQ ID NO: 710277 - DNA, 25 bp, Mus musculus
ggctcacagtggtatctgcactcga

SEQ ID NO: 710278 - DNA, 25 bp, Mus musculus
ggctcaccagtcagcggatgcagca

SEQ ID NO: 710279 - DNA, 25 bp, Mus musculus
ggctcaccagtctgcggatgcagca

SEQ ID NO: 710280 - DNA, 25 bp, Mus musculus
ggctcaccgagtagaaacgaaaatg

SEQ ID NO: 710281 - DNA, 25 bp, Mus musculus
ggctcaccgagttgaaacgaaaatg

SEQ ID NO: 710282 - DNA, 25 bp, Mus musculus
ggctcacctcagagagcagggccag

SEQ ID NO: 710283 - DNA, 25 bp, Mus musculus
ggctcacctcagtgagcagggccag

SEQ ID NO: 710284 - DNA, 25 bp, Mus musculus
ggctcacctgctccgagcactagtt

SEQ ID NO: 710285 - DNA, 25 bp, Mus musculus
ggctcacctgctgcgagcactagtt

SEQ ID NO: 710286 - DNA, 25 bp, Mus musculus
ggctcacctgttcattggtcctcag

SEQ ID NO: 710287 - DNA, 25 bp, Mus musculus
ggctcacctgttgattggtcctcag

SEQ ID NO: 710288 - DNA, 25 bp, Mus musculus
ggctcacgcgcactatcagttcagt

SEQ ID NO: 710289 - DNA, 25 bp, Mus musculus
ggctcacgcgcagtatcagttcagt

SEQ ID NO: 710290 - DNA, 25 bp, Mus musculus
ggctcacgctggattatgtctcgga

SEQ ID NO: 710291 - DNA, 25 bp, Mus musculus
ggctcacgctggtttatgtctcgga

SEQ ID NO: 710292 - DNA, 25 bp, Mus musculus
ggctcacggcccaatgagtctgggc

SEQ ID NO: 710293 - DNA, 25 bp, Mus musculus
ggctcacggccctatgagtctgggc

SEQ ID NO: 710294 - DNA, 25 bp, Mus musculus
ggctcacgggatcgaggacgcgata

SEQ ID NO: 710295 - DNA, 25 bp, Mus musculus
ggctcacgggatggaggacgcgata

SEQ ID NO: 710296 - DNA, 25 bp, Mus musculus
ggctcactcgtgcaggaacaagact

SEQ ID NO: 710297 - DNA, 25 bp, Mus musculus
ggctcactcgtggaggaacaagact

SEQ ID NO: 710298 - DNA, 25 bp, Mus musculus
ggctcactctgaatctgatgctgat

SEQ ID NO: 710299 - DNA, 25 bp, Mus musculus
ggctcactctgattctgatgctgat

SEQ ID NO: 710300 - DNA, 25 bp, Mus musculus
ggctcactggcaaagtcccttcctg

SEQ ID NO: 710301 - DNA, 25 bp, Mus musculus
ggctcactggcatagtcccttcctg

SEQ ID NO: 710302 - DNA, 25 bp, Mus musculus
ggctcacttgaacagtgttacagaa

SEQ ID NO: 710303 - DNA, 25 bp, Mus musculus
ggctcacttgaagagtgttacagaa

SEQ ID NO: 710304 - DNA, 25 bp, Mus musculus
ggctcagaaagacactacacatatg

SEQ ID NO: 710305 - DNA, 25 bp, Mus musculus
ggctcagaaagagactacacatatg

SEQ ID NO: 710306 - DNA, 25 bp, Mus musculus
ggctcagaaaggaagcacattcgga

SEQ ID NO: 710307 - DNA, 25 bp, Mus musculus
ggctcagaaaggtagcacattcgga

SEQ ID NO: 710308 - DNA, 25 bp, Mus musculus
ggctcagaatctaccaacaggcgtt

SEQ ID NO: 710309 - DNA, 25 bp, Mus musculus
ggctcagaatcttccaacaggcgtt

SEQ ID NO: 710310 - DNA, 25 bp, Mus musculus
ggctcagaccacaggtagtgcggac

SEQ ID NO: 710311 - DNA, 25 bp, Mus musculus
ggctcagaccactggtagtgcggac

SEQ ID NO: 710312 - DNA, 25 bp, Mus musculus
ggctcagacctgcaacctccggatg

SEQ ID NO: 710313 - DNA, 25 bp, Mus musculus
ggctcagacctggaacctccggatg

SEQ ID NO: 710314 - DNA, 25 bp, Mus musculus
ggctcagacttaagtcaatagataa

SEQ ID NO: 710315 - DNA, 25 bp, Mus musculus
ggctcagacttatgtcaatagataa

SEQ ID NO: 710316 - DNA, 25 bp, Mus musculus
ggctcagaggacaatagggtcccct

SEQ ID NO: 710317 - DNA, 25 bp, Mus musculus
ggctcagaggactatagggtcccct

SEQ ID NO: 710318 - DNA, 25 bp, Mus musculus
ggctcagagtcccttgtctatacca

SEQ ID NO: 710319 - DNA, 25 bp, Mus musculus
ggctcagagtccgttgtctatacca

SEQ ID NO: 710320 - DNA, 25 bp, Mus musculus
ggctcagcaacactctccaggatca

SEQ ID NO: 710321 - DNA, 25 bp, Mus musculus
ggctcagcaacagtctccaggatca

SEQ ID NO: 710322 - DNA, 25 bp, Mus musculus
ggctcagcagatcagtcatctgtca

SEQ ID NO: 710323 - DNA, 25 bp, Mus musculus
ggctcagcagatgagtcatctgtca

SEQ ID NO: 710324 - DNA, 25 bp, Mus musculus
ggctcagcagcactcttgcaagatg

SEQ ID NO: 710325 - DNA, 25 bp, Mus musculus
ggctcagcagcagtcttgcaagatg

SEQ ID NO: 710326 - DNA, 25 bp, Mus musculus
ggctcagccagaatggccaccctgg

SEQ ID NO: 710327 - DNA, 25 bp, Mus musculus
ggctcagccagattggccaccctgg

SEQ ID NO: 710328 - DNA, 25 bp, Mus musculus
ggctcagccgaacgtttgcatttcc

SEQ ID NO: 710329 - DNA, 25 bp, Mus musculus
ggctcagccgaaggtttgcatttcc

SEQ ID NO: 710330 - DNA, 25 bp, Mus musculus
ggctcagcctgcctaggaaacgcaa

SEQ ID NO: 710331 - DNA, 25 bp, Mus musculus
ggctcagcctgcgtaggaaacgcaa

SEQ ID NO: 710332 - DNA, 25 bp, Mus musculus
ggctcagctccactgcccgagaaaa

SEQ ID NO: 710333 - DNA, 25 bp, Mus musculus
ggctcagctccagtgcccgagaaaa

SEQ ID NO: 710334 - DNA, 25 bp, Mus musculus
ggctcagctgcgaccagcctgcgag

SEQ ID NO: 710335 - DNA, 25 bp, Mus musculus
ggctcagctgcgtccagcctgcgag

SEQ ID NO: 710336 - DNA, 25 bp, Mus musculus
ggctcagcttgtagaagaggccaca

SEQ ID NO: 710337 - DNA, 25 bp, Mus musculus
ggctcagcttgttgaagaggccaca

SEQ ID NO: 710338 - DNA, 25 bp, Mus musculus
ggctcaggacaacgcctgcgtatga

SEQ ID NO: 710339 - DNA, 25 bp, Mus musculus
ggctcaggacaaggcctgcgtatga

SEQ ID NO: 710340 - DNA, 25 bp, Mus musculus
ggctcaggattgcatctgaagatgc

SEQ ID NO: 710341 - DNA, 25 bp, Mus musculus
ggctcaggattggatctgaagatgc

SEQ ID NO: 710342 - DNA, 25 bp, Mus musculus
ggctcaggctggaaatgagaagctt

SEQ ID NO: 710343 - DNA, 25 bp, Mus musculus
ggctcaggctggtaatgagaagctt

SEQ ID NO: 710344 - DNA, 25 bp, Mus musculus
ggctcagggatactcaggcctgtct

SEQ ID NO: 710345 - DNA, 25 bp, Mus musculus
ggctcagggatagtcaggcctgtct

SEQ ID NO: 710346 - DNA, 25 bp, Mus musculus
ggctcaggtataacagagtcacact

SEQ ID NO: 710347 - DNA, 25 bp, Mus musculus
ggctcaggtatatcagagtcacact

SEQ ID NO: 710348 - DNA, 25 bp, Mus musculus
ggctcaggtgatcagaatagctgaa

SEQ ID NO: 710349 - DNA, 25 bp, Mus musculus
ggctcaggtgatgagaatagctgaa

SEQ ID NO: 710350 - DNA, 25 bp, Mus musculus
ggctcagtatgacaccccaaaaggt

SEQ ID NO: 710351 - DNA, 25 bp, Mus musculus
ggctcagtatgagaccccaaaaggt

SEQ ID NO: 710352 - DNA, 25 bp, Mus musculus
ggctcagtcccaaacagtcatcgga

SEQ ID NO: 710353 - DNA, 25 bp, Mus musculus
ggctcagtcccatacagtcatcgga

SEQ ID NO: 710354 - DNA, 25 bp, Mus musculus
ggctcagtgaccacctgaaggagaa

SEQ ID NO: 710355 - DNA, 25 bp, Mus musculus
ggctcagtgacctcctgaaggagaa

SEQ ID NO: 710356 - DNA, 25 bp, Mus musculus
ggctcagtggcacaatttgggcaca

SEQ ID NO: 710357 - DNA, 25 bp, Mus musculus
ggctcagtggcagaatttgggcaca

SEQ ID NO: 710358 - DNA, 25 bp, Mus musculus
ggctcagttctgacaccagggatgg

SEQ ID NO: 710359 - DNA, 25 bp, Mus musculus
ggctcagttctgtcaccagggatgg

SEQ ID NO: 710360 - DNA, 25 bp, Mus musculus
ggctcagtttgaccacagtatctag

SEQ ID NO: 710361 - DNA, 25 bp, Mus musculus
ggctcagtttgagcacagtatctag

SEQ ID NO: 710362 - DNA, 25 bp, Mus musculus
ggctcagttttgaggcgccttctga

SEQ ID NO: 710363 - DNA, 25 bp, Mus musculus
ggctcagttttgtggcgccttctga

SEQ ID NO: 710364 - DNA, 25 bp, Mus musculus
ggctcatattccagtctcatggaca

SEQ ID NO: 710365 - DNA, 25 bp, Mus musculus
ggctcatattcctgtctcatggaca

SEQ ID NO: 710366 - DNA, 25 bp, Mus musculus
ggctcatcagatcacggcaaaagca

SEQ ID NO: 710367 - DNA, 25 bp, Mus musculus
ggctcatcagatgacggcaaaagca

SEQ ID NO: 710368 - DNA, 25 bp, Mus musculus
ggctcatcagctccggcaacaagta

SEQ ID NO: 710369 - DNA, 25 bp, Mus musculus
ggctcatcagctgcggcaacaagta

SEQ ID NO: 710370 - DNA, 25 bp, Mus musculus
ggctcatccaaaatagaggaagcat

SEQ ID NO: 710371 - DNA, 25 bp, Mus musculus
ggctcatccaaattagaggaagcat

SEQ ID NO: 710372 - DNA, 25 bp, Mus musculus
ggctcatccacaactttgctattca

SEQ ID NO: 710373 - DNA, 25 bp, Mus musculus
ggctcatccacatctttgctattca

SEQ ID NO: 710374 - DNA, 25 bp, Mus musculus
ggctcatccaccatttcaagctcga

SEQ ID NO: 710375 - DNA, 25 bp, Mus musculus
ggctcatccaccttttcaagctcga

SEQ ID NO: 710376 - DNA, 25 bp, Mus musculus
ggctcatcccggactctgtactttg

SEQ ID NO: 710377 - DNA, 25 bp, Mus musculus
ggctcatcccggtctctgtactttg

SEQ ID NO: 710378 - DNA, 25 bp, Mus musculus
ggctcatcctttccaatgggtgaca

SEQ ID NO: 710379 - DNA, 25 bp, Mus musculus
ggctcatcctttgcaatgggtgaca

SEQ ID NO: 710380 - DNA, 25 bp, Mus musculus
ggctcatcggatacttcctatttca

SEQ ID NO: 710381 - DNA, 25 bp, Mus musculus
ggctcatcggattcttcctatttca

SEQ ID NO: 710382 - DNA, 25 bp, Mus musculus
ggctcatctacactggcaagcaaat

SEQ ID NO: 710383 - DNA, 25 bp, Mus musculus
ggctcatctacagtggcaagcaaat

SEQ ID NO: 710384 - DNA, 25 bp, Mus musculus
ggctcatctcctatgacctacggga

SEQ ID NO: 710385 - DNA, 25 bp, Mus musculus
ggctcatctcctttgacctacggga

SEQ ID NO: 710386 - DNA, 25 bp, Mus musculus
ggctcatctgatcgccagggctctg

SEQ ID NO: 710387 - DNA, 25 bp, Mus musculus
ggctcatctgatggccagggctctg

SEQ ID NO: 710388 - DNA, 25 bp, Mus musculus
ggctcatgaacgaaaacttgcttta

SEQ ID NO: 710389 - DNA, 25 bp, Mus musculus
ggctcatgaacgtaaacttgcttta

SEQ ID NO: 710390 - DNA, 25 bp, Mus musculus
ggctcatgatctacaggaacaacaa

SEQ ID NO: 710391 - DNA, 25 bp, Mus musculus
ggctcatgatcttcaggaacaacaa

SEQ ID NO: 710392 - DNA, 25 bp, Mus musculus
ggctcatgccagaaaccgagactta

SEQ ID NO: 710393 - DNA, 25 bp, Mus musculus
ggctcatgccagtaaccgagactta

SEQ ID NO: 710394 - DNA, 25 bp, Mus musculus
ggctcattctgcaggcgggctccct

SEQ ID NO: 710395 - DNA, 25 bp, Mus musculus
ggctcattctgctggcgggctccct

SEQ ID NO: 710396 - DNA, 25 bp, Mus musculus
ggctcattgacaaggttcggaacca

SEQ ID NO: 710397 - DNA, 25 bp, Mus musculus
ggctcattgacatggttcggaacca

SEQ ID NO: 710398 - DNA, 25 bp, Mus musculus
ggctccaaacgtactgtactgtcca

SEQ ID NO: 710399 - DNA, 25 bp, Mus musculus
ggctccaaacgttctgtactgtcca

SEQ ID NO: 710400 - DNA, 25 bp, Mus musculus
ggctccaaagaaatcaagaaacaat

SEQ ID NO: 710401 - DNA, 25 bp, Mus musculus
ggctccaaagaattcaagaaacaat

SEQ ID NO: 710402 - DNA, 25 bp, Mus musculus
ggctccaaagccctgaaacagatcg

SEQ ID NO: 710403 - DNA, 25 bp, Mus musculus
ggctccaaagccgtgaaacagatcg

SEQ ID NO: 710404 - DNA, 25 bp, Mus musculus
ggctccaaatgtaagtgtgaaaata

SEQ ID NO: 710405 - DNA, 25 bp, Mus musculus
ggctccaaatgttagtgtgaaaata

SEQ ID NO: 710406 - DNA, 25 bp, Mus musculus
ggctccaacttccaaggttttatct

SEQ ID NO: 710407 - DNA, 25 bp, Mus musculus
ggctccaacttcgaaggttttatct

SEQ ID NO: 710408 - DNA, 25 bp, Mus musculus
ggctccaattttctgccttcaaaga

SEQ ID NO: 710409 - DNA, 25 bp, Mus musculus
ggctccaattttgtgccttcaaaga

SEQ ID NO: 710410 - DNA, 25 bp, Mus musculus
ggctccaccaccaaaacctgttaga

SEQ ID NO: 710411 - DNA, 25 bp, Mus musculus
ggctccaccacctaaacctgttaga

SEQ ID NO: 710412 - DNA, 25 bp, Mus musculus
ggctccacctgccattcaaacggtt

SEQ ID NO: 710413 - DNA, 25 bp, Mus musculus
ggctccacctgcgattcaaacggtt

SEQ ID NO: 710414 - DNA, 25 bp, Mus musculus
ggctccacgaagagactcaacatta

SEQ ID NO: 710415 - DNA, 25 bp, Mus musculus
ggctccacgaagtgactcaacatta

SEQ ID NO: 710416 - DNA, 25 bp, Mus musculus
ggctccacgggccagaattttctgg

SEQ ID NO: 710417 - DNA, 25 bp, Mus musculus
ggctccacgggcgagaattttctgg

SEQ ID NO: 710418 - DNA, 25 bp, Mus musculus
ggctccactctacccgggaggatga

SEQ ID NO: 710419 - DNA, 25 bp, Mus musculus
ggctccactctagccgggaggatga

SEQ ID NO: 710420 - DNA, 25 bp, Mus musculus
ggctccactctgacgttctggtctt

SEQ ID NO: 710421 - DNA, 25 bp, Mus musculus
ggctccactctgtcgttctggtctt

SEQ ID NO: 710422 - DNA, 25 bp, Mus musculus
ggctccagaaacaacttctgcggca

SEQ ID NO: 710423 - DNA, 25 bp, Mus musculus
ggctccagaaactacttctgcggca

SEQ ID NO: 710424 - DNA, 25 bp, Mus musculus
ggctccagaaggcacacaatgctcg

SEQ ID NO: 710425 - DNA, 25 bp, Mus musculus
ggctccagaagggacacaatgctcg

SEQ ID NO: 710426 - DNA, 25 bp, Mus musculus
ggctccagaagtccttcgtaaagag

SEQ ID NO: 710427 - DNA, 25 bp, Mus musculus
ggctccagaagtgcttcgtaaagag

SEQ ID NO: 710428 - DNA, 25 bp, Mus musculus
ggctccagacaaagatgctattctt

SEQ ID NO: 710429 - DNA, 25 bp, Mus musculus
ggctccagacaatgatgctattctt

SEQ ID NO: 710430 - DNA, 25 bp, Mus musculus
ggctccagagggacgccttcggacc

SEQ ID NO: 710431 - DNA, 25 bp, Mus musculus
ggctccagagggtcgccttcggacc

SEQ ID NO: 710432 - DNA, 25 bp, Mus musculus
ggctccagaggtcatcgcctgtgat

SEQ ID NO: 710433 - DNA, 25 bp, Mus musculus
ggctccagaggtgatcgcctgtgat

SEQ ID NO: 710434 - DNA, 25 bp, Mus musculus
ggctccagagtccaccaagtgcttg

SEQ ID NO: 710435 - DNA, 25 bp, Mus musculus
ggctccagagtcgaccaagtgcttg

SEQ ID NO: 710436 - DNA, 25 bp, Mus musculus
ggctccagccacaggtaagcagggc

SEQ ID NO: 710437 - DNA, 25 bp, Mus musculus
ggctccagccactggtaagcagggc

SEQ ID NO: 710438 - DNA, 25 bp, Mus musculus
ggctccagctatcgcaaccaagagc

SEQ ID NO: 710439 - DNA, 25 bp, Mus musculus
ggctccagctatggcaaccaagagc

SEQ ID NO: 710440 - DNA, 25 bp, Mus musculus
ggctccagggtacgctccattcttt

SEQ ID NO: 710441 - DNA, 25 bp, Mus musculus
ggctccagggtaggctccattcttt

SEQ ID NO: 710442 - DNA, 25 bp, Mus musculus
ggctccagtgatcatgaggcgaacc

SEQ ID NO: 710443 - DNA, 25 bp, Mus musculus
ggctccagtgatgatgaggcgaacc

SEQ ID NO: 710444 - DNA, 25 bp, Mus musculus
ggctccatcatcaaagacccaaacg

SEQ ID NO: 710445 - DNA, 25 bp, Mus musculus
ggctccatcatctaagacccaaacg

SEQ ID NO: 710446 - DNA, 25 bp, Mus musculus
ggctccatcctgaagaaggtgctgg

SEQ ID NO: 710447 - DNA, 25 bp, Mus musculus
ggctccatcctgtagaaggtgctgg

SEQ ID NO: 710448 - DNA, 25 bp, Mus musculus
ggctccatgctaccaagagaaaccc

SEQ ID NO: 710449 - DNA, 25 bp, Mus musculus
ggctccatgctagcaagagaaaccc

SEQ ID NO: 710450 - DNA, 25 bp, Mus musculus
ggctccattgccatgcctgttcaga

SEQ ID NO: 710451 - DNA, 25 bp, Mus musculus
ggctccattgccttgcctgttcaga

SEQ ID NO: 710452 - DNA, 25 bp, Mus musculus
ggctccatttccagatttgaaaaga

SEQ ID NO: 710453 - DNA, 25 bp, Mus musculus
ggctccatttcctgatttgaaaaga

SEQ ID NO: 710454 - DNA, 25 bp, Mus musculus
ggctcccacgaacccagtgtgttaa

SEQ ID NO: 710455 - DNA, 25 bp, Mus musculus
ggctcccacgaagccagtgtgttaa

SEQ ID NO: 710456 - DNA, 25 bp, Mus musculus
ggctcccaggacatggccgactttg

SEQ ID NO: 710457 - DNA, 25 bp, Mus musculus
ggctcccaggacttggccgactttg

SEQ ID NO: 710458 - DNA, 25 bp, Mus musculus
ggctcccatccgagagtgccatgac

SEQ ID NO: 710459 - DNA, 25 bp, Mus musculus
ggctcccatccgtgagtgccatgac

SEQ ID NO: 710460 - DNA, 25 bp, Mus musculus
ggctcccatgataaccctgaagcgg

SEQ ID NO: 710461 - DNA, 25 bp, Mus musculus
ggctcccatgattaccctgaagcgg

SEQ ID NO: 710462 - DNA, 25 bp, Mus musculus
ggctccccgggaatgcccctggaag

SEQ ID NO: 710463 - DNA, 25 bp, Mus musculus
ggctccccgggattgcccctggaag

SEQ ID NO: 710464 - DNA, 25 bp, Mus musculus
ggctcccctggcatagagtacccgt

SEQ ID NO: 710465 - DNA, 25 bp, Mus musculus
ggctcccctggcttagagtacccgt

SEQ ID NO: 710466 - DNA, 25 bp, Mus musculus
ggctcccggaccatcgtgcaggaga

SEQ ID NO: 710467 - DNA, 25 bp, Mus musculus
ggctcccggaccttcgtgcaggaga

SEQ ID NO: 710468 - DNA, 25 bp, Mus musculus
ggctcccggcgcaatgttgcagatc

SEQ ID NO: 710469 - DNA, 25 bp, Mus musculus
ggctcccggcgctatgttgcagatc

SEQ ID NO: 710470 - DNA, 25 bp, Mus musculus
ggctcccgtaccattatactctacg

SEQ ID NO: 710471 - DNA, 25 bp, Mus musculus
ggctcccgtacctttatactctacg

SEQ ID NO: 710472 - DNA, 25 bp, Mus musculus
ggctccctcatcatggccacggata

SEQ ID NO: 710473 - DNA, 25 bp, Mus musculus
ggctccctcatcttggccacggata

SEQ ID NO: 710474 - DNA, 25 bp, Mus musculus
ggctccctgaaacctgtcagatgtg

SEQ ID NO: 710475 - DNA, 25 bp, Mus musculus
ggctccctgaaagctgtcagatgtg

SEQ ID NO: 710476 - DNA, 25 bp, Mus musculus
ggctccctgatgaggtgctgctgaa

SEQ ID NO: 710477 - DNA, 25 bp, Mus musculus
ggctccctgatgtggtgctgctgaa

SEQ ID NO: 710478 - DNA, 25 bp, Mus musculus
ggctccctggcactacttctgatga

SEQ ID NO: 710479 - DNA, 25 bp, Mus musculus
ggctccctggcagtacttctgatga

SEQ ID NO: 710480 - DNA, 25 bp, Mus musculus
ggctccctggtgaagaacctcaagg

SEQ ID NO: 710481 - DNA, 25 bp, Mus musculus
ggctccctggtgtagaacctcaagg

SEQ ID NO: 710482 - DNA, 25 bp, Mus musculus
ggctcccttagtcgccgctgtgcgg

SEQ ID NO: 710483 - DNA, 25 bp, Mus musculus
ggctcccttagtggccgctgtgcgg

SEQ ID NO: 710484 - DNA, 25 bp, Mus musculus
ggctcccttcagattggctataaca

SEQ ID NO: 710485 - DNA, 25 bp, Mus musculus
ggctcccttcagtttggctataaca

SEQ ID NO: 710486 - DNA, 25 bp, Mus musculus
ggctcccttcgactccaattcaaaa

SEQ ID NO: 710487 - DNA, 25 bp, Mus musculus
ggctcccttcgagtccaattcaaaa

SEQ ID NO: 710488 - DNA, 25 bp, Mus musculus
ggctccgactatcattttgatgtgt

SEQ ID NO: 710489 - DNA, 25 bp, Mus musculus
ggctccgactatgattttgatgtgt

SEQ ID NO: 710490 - DNA, 25 bp, Mus musculus
ggctccgagaccagcctgctgagtt

SEQ ID NO: 710491 - DNA, 25 bp, Mus musculus
ggctccgagacctgcctgctgagtt

SEQ ID NO: 710492 - DNA, 25 bp, Mus musculus
ggctccgcgagtaaccagtctctgg

SEQ ID NO: 710493 - DNA, 25 bp, Mus musculus
ggctccgcgagttaccagtctctgg

SEQ ID NO: 710494 - DNA, 25 bp, Mus musculus
ggctccgcgctgctccattcattaa

SEQ ID NO: 710495 - DNA, 25 bp, Mus musculus
ggctccgcgctggtccattcattaa

SEQ ID NO: 710496 - DNA, 25 bp, Mus musculus
ggctccgcggttctgcatcatctct

SEQ ID NO: 710497 - DNA, 25 bp, Mus musculus
ggctccgcggttgtgcatcatctct

SEQ ID NO: 710498 - DNA, 25 bp, Mus musculus
ggctccggagaaagtgcacgccgtc

SEQ ID NO: 710499 - DNA, 25 bp, Mus musculus
ggctccggagaatgtgcacgccgtc

SEQ ID NO: 710500 - DNA, 25 bp, Mus musculus
ggctccgggtggaagaccagggttg

SEQ ID NO: 710501 - DNA, 25 bp, Mus musculus
ggctccgggtggtagaccagggttg

SEQ ID NO: 710502 - DNA, 25 bp, Mus musculus
ggctccgtgaccatgctctgttgaa

SEQ ID NO: 710503 - DNA, 25 bp, Mus musculus
ggctccgtgaccttgctctgttgaa

SEQ ID NO: 710504 - DNA, 25 bp, Mus musculus
ggctccgtgcaacgcatctgtgagt

SEQ ID NO: 710505 - DNA, 25 bp, Mus musculus
ggctccgtgcaaggcatctgtgagt

SEQ ID NO: 710506 - DNA, 25 bp, Mus musculus
ggctccgttccgctttgagtctaaa

SEQ ID NO: 710507 - DNA, 25 bp, Mus musculus
ggctccgttccggtttgagtctaaa

SEQ ID NO: 710508 - DNA, 25 bp, Mus musculus
ggctcctaaagccagggtccctgat

SEQ ID NO: 710509 - DNA, 25 bp, Mus musculus
ggctcctaaagcgagggtccctgat

SEQ ID NO: 710510 - DNA, 25 bp, Mus musculus
ggctcctaccgaaagaagaggaaga

SEQ ID NO: 710511 - DNA, 25 bp, Mus musculus
ggctcctaccgatagaagaggaaga

SEQ ID NO: 710512 - DNA, 25 bp, Mus musculus
ggctcctacgcgctagctaggaaat

SEQ ID NO: 710513 - DNA, 25 bp, Mus musculus
ggctcctacgcggtagctaggaaat

SEQ ID NO: 710514 - DNA, 25 bp, Mus musculus
ggctcctaggataccgaaaccatgg

SEQ ID NO: 710515 - DNA, 25 bp, Mus musculus
ggctcctaggattccgaaaccatgg

SEQ ID NO: 710516 - DNA, 25 bp, Mus musculus
ggctcctcatggctcacctttggtg

SEQ ID NO: 710517 - DNA, 25 bp, Mus musculus
ggctcctcatgggtcacctttggtg

SEQ ID NO: 710518 - DNA, 25 bp, Mus musculus
ggctcctccaccacaaaggtgacaa

SEQ ID NO: 710519 - DNA, 25 bp, Mus musculus
ggctcctccacctcaaaggtgacaa

SEQ ID NO: 710520 - DNA, 25 bp, Mus musculus
ggctcctgcagccattcaccaagta

SEQ ID NO: 710521 - DNA, 25 bp, Mus musculus
ggctcctgcagcgattcaccaagta

SEQ ID NO: 710522 - DNA, 25 bp, Mus musculus
ggctcctgcccacggtcaaaaggca

SEQ ID NO: 710523 - DNA, 25 bp, Mus musculus
ggctcctgcccagggtcaaaaggca

SEQ ID NO: 710524 - DNA, 25 bp, Mus musculus
ggctcctgcggcatcaacagccgta

SEQ ID NO: 710525 - DNA, 25 bp, Mus musculus
ggctcctgcggcttcaacagccgta

SEQ ID NO: 710526 - DNA, 25 bp, Mus musculus
ggctcctggatcctggctgttattt

SEQ ID NO: 710527 - DNA, 25 bp, Mus musculus
ggctcctggatcgtggctgttattt

SEQ ID NO: 710528 - DNA, 25 bp, Mus musculus
ggctcctggattctgcaaagcggat

SEQ ID NO: 710529 - DNA, 25 bp, Mus musculus
ggctcctggattgtgcaaagcggat

SEQ ID NO: 710530 - DNA, 25 bp, Mus musculus
ggctcctggctcacttgccaaagga

SEQ ID NO: 710531 - DNA, 25 bp, Mus musculus
ggctcctggctcatggtttttcttc

SEQ ID NO: 710532 - DNA, 25 bp, Mus musculus
ggctcctggctctcttgccaaagga

SEQ ID NO: 710533 - DNA, 25 bp, Mus musculus
ggctcctggctcttggtttttcttc

SEQ ID NO: 710534 - DNA, 25 bp, Mus musculus
ggctcctgtgcaatcttctccaaaa

SEQ ID NO: 710535 - DNA, 25 bp, Mus musculus
ggctcctgtgcattcttctccaaaa

SEQ ID NO: 710536 - DNA, 25 bp, Mus musculus
ggctcctgtgtaccgcagcttcgac

SEQ ID NO: 710537 - DNA, 25 bp, Mus musculus
ggctcctgtgtagcgcagcttcgac

SEQ ID NO: 710538 - DNA, 25 bp, Mus musculus
ggctccttattgcactcgcccggag

SEQ ID NO: 710539 - DNA, 25 bp, Mus musculus
ggctccttattggactcgcccggag

SEQ ID NO: 710540 - DNA, 25 bp, Mus musculus
ggctccttccatcccatgataaact

SEQ ID NO: 710541 - DNA, 25 bp, Mus musculus
ggctccttccatgccatgataaact

SEQ ID NO: 710542 - DNA, 25 bp, Mus musculus
ggctccttccgaagctgagctgaat

SEQ ID NO: 710543 - DNA, 25 bp, Mus musculus
ggctccttccgatgctgagctgaat

SEQ ID NO: 710544 - DNA, 25 bp, Mus musculus
ggctccttctcgctcctagatggca

SEQ ID NO: 710545 - DNA, 25 bp, Mus musculus
ggctccttctcggtcctagatggca

SEQ ID NO: 710546 - DNA, 25 bp, Mus musculus
ggctccttcttcaccacctgtggtg

SEQ ID NO: 710547 - DNA, 25 bp, Mus musculus
ggctccttcttctccacctgtggtg

SEQ ID NO: 710548 - DNA, 25 bp, Mus musculus
ggctccttggataatatcacccacg

SEQ ID NO: 710549 - DNA, 25 bp, Mus musculus
ggctccttggattatatcacccacg

SEQ ID NO: 710550 - DNA, 25 bp, Mus musculus
ggctccttgtgtacgggctgagcct

SEQ ID NO: 710551 - DNA, 25 bp, Mus musculus
ggctccttgtgttcgggctgagcct

SEQ ID NO: 710552 - DNA, 25 bp, Mus musculus
ggctccttgttcagcacagcaacct

SEQ ID NO: 710553 - DNA, 25 bp, Mus musculus
ggctccttgttctgcacagcaacct

SEQ ID NO: 710554 - DNA, 25 bp, Mus musculus
ggctcgagatgtccacaacctggac

SEQ ID NO: 710555 - DNA, 25 bp, Mus musculus
ggctcgagatgtgcacaacctggac

SEQ ID NO: 710556 - DNA, 25 bp, Mus musculus
ggctcgaggaacatcctgaagctgt

SEQ ID NO: 710557 - DNA, 25 bp, Mus musculus
ggctcgaggaacttcctgaagctgt

SEQ ID NO: 710558 - DNA, 25 bp, Mus musculus
ggctcgatgcacagaccaggcaggt

SEQ ID NO: 710559 - DNA, 25 bp, Mus musculus
ggctcgatgcactgaccaggcaggt

SEQ ID NO: 710560 - DNA, 25 bp, Mus musculus
ggctcgattccacgatgagaagaag

SEQ ID NO: 710561 - DNA, 25 bp, Mus musculus
ggctcgattccaggatgagaagaag

SEQ ID NO: 710562 - DNA, 25 bp, Mus musculus
ggctcgattctcagccctgatctag

SEQ ID NO: 710563 - DNA, 25 bp, Mus musculus
ggctcgattctctgccctgatctag

SEQ ID NO: 710564 - DNA, 25 bp, Mus musculus
ggctcgcactgcaccgacgttaatg

SEQ ID NO: 710565 - DNA, 25 bp, Mus musculus
ggctcgcactgctccgacgttaatg

SEQ ID NO: 710566 - DNA, 25 bp, Mus musculus
ggctcgcagcagagctactcctaga

SEQ ID NO: 710567 - DNA, 25 bp, Mus musculus
ggctcgcagcagtgctactcctaga

SEQ ID NO: 710568 - DNA, 25 bp, Mus musculus
ggctcgcagtcactggacgacttct

SEQ ID NO: 710569 - DNA, 25 bp, Mus musculus
ggctcgcagtcagtggacgacttct

SEQ ID NO: 710570 - DNA, 25 bp, Mus musculus
ggctcgccctgaatggttgctccac

SEQ ID NO: 710571 - DNA, 25 bp, Mus musculus
ggctcgccctgattggttgctccac

SEQ ID NO: 710572 - DNA, 25 bp, Mus musculus
ggctcgcctagaacacaagtttgat

SEQ ID NO: 710573 - DNA, 25 bp, Mus musculus
ggctcgcctagatcacaagtttgat

SEQ ID NO: 710574 - DNA, 25 bp, Mus musculus
ggctcgcggctaacgggactggaga

SEQ ID NO: 710575 - DNA, 25 bp, Mus musculus
ggctcgcggctatcgggactggaga

SEQ ID NO: 710576 - DNA, 25 bp, Mus musculus
ggctcgctccagcactagcatgctg

SEQ ID NO: 710577 - DNA, 25 bp, Mus musculus
ggctcgctccaggactagcatgctg

SEQ ID NO: 710578 - DNA, 25 bp, Mus musculus
ggctcgctttggagaccgaataact

SEQ ID NO: 710579 - DNA, 25 bp, Mus musculus
ggctcgctttggtgaccgaataact

SEQ ID NO: 710580 - DNA, 25 bp, Mus musculus
ggctcggaagctcgagttcaacaag

SEQ ID NO: 710581 - DNA, 25 bp, Mus musculus
ggctcggaagctggagttcaacaag

SEQ ID NO: 710582 - DNA, 25 bp, Mus musculus
ggctcggaggaaagcatgcgcctct

SEQ ID NO: 710583 - DNA, 25 bp, Mus musculus
ggctcggaggaatgcatgcgcctct

SEQ ID NO: 710584 - DNA, 25 bp, Mus musculus
ggctcggcgtccaggtcctgcgtct

SEQ ID NO: 710585 - DNA, 25 bp, Mus musculus
ggctcggcgtcctggtcctgcgtct

SEQ ID NO: 710586 - DNA, 25 bp, Mus musculus
ggctcggctacaaaagaggtcggct

SEQ ID NO: 710587 - DNA, 25 bp, Mus musculus
ggctcggctacataagaggtcggct

SEQ ID NO: 710588 - DNA, 25 bp, Mus musculus
ggctcggctttgcactcctgcatct

SEQ ID NO: 710589 - DNA, 25 bp, Mus musculus
ggctcggctttggactcctgcatct

SEQ ID NO: 710590 - DNA, 25 bp, Mus musculus
ggctcgggactgaccagagaacgct

SEQ ID NO: 710591 - DNA, 25 bp, Mus musculus
ggctcgggactgtccagagaacgct

SEQ ID NO: 710592 - DNA, 25 bp, Mus musculus
ggctcgggccatcaagtaccgtcag

SEQ ID NO: 710593 - DNA, 25 bp, Mus musculus
ggctcgggccatgaagtaccgtcag

SEQ ID NO: 710594 - DNA, 25 bp, Mus musculus
ggctcgggctgtcccaaggcactca

SEQ ID NO: 710595 - DNA, 25 bp, Mus musculus
ggctcgggctgtgccaaggcactca

SEQ ID NO: 710596 - DNA, 25 bp, Mus musculus
ggctcgggtgcaccgggaaagggta

SEQ ID NO: 710597 - DNA, 25 bp, Mus musculus
ggctcgggtgcagcgggaaagggta

SEQ ID NO: 710598 - DNA, 25 bp, Mus musculus
ggctcggtacctccttactgggagc

SEQ ID NO: 710599 - DNA, 25 bp, Mus musculus
ggctcggtacctgcttactgggagc

SEQ ID NO: 710600 - DNA, 25 bp, Mus musculus
ggctcggttgatagaagacaatgaa

SEQ ID NO: 710601 - DNA, 25 bp, Mus musculus
ggctcggttgattgaagacaatgaa

SEQ ID NO: 710602 - DNA, 25 bp, Mus musculus
ggctcgtcagctcttgctttttctt

SEQ ID NO: 710603 - DNA, 25 bp, Mus musculus
ggctcgtcagctgttgctttttctt

SEQ ID NO: 710604 - DNA, 25 bp, Mus musculus
ggctcgtccataaagaacggcccat

SEQ ID NO: 710605 - DNA, 25 bp, Mus musculus
ggctcgtccatatagaacggcccat

SEQ ID NO: 710606 - DNA, 25 bp, Mus musculus
ggctcgtcgagcacatgaggacaga

SEQ ID NO: 710607 - DNA, 25 bp, Mus musculus
ggctcgtcgagctcatgaggacaga

SEQ ID NO: 710608 - DNA, 25 bp, Mus musculus
ggctcgtgcgcactcccagtttcgg

SEQ ID NO: 710609 - DNA, 25 bp, Mus musculus
ggctcgtgcgcagtcccagtttcgg

SEQ ID NO: 710610 - DNA, 25 bp, Mus musculus
ggctcgtgggctccatctgcttgtc

SEQ ID NO: 710611 - DNA, 25 bp, Mus musculus
ggctcgtgggctgcatctgcttgtc

SEQ ID NO: 710612 - DNA, 25 bp, Mus musculus
ggctcgtgggttacagcttcttcct

SEQ ID NO: 710613 - DNA, 25 bp, Mus musculus
ggctcgtgggtttcagcttcttcct

SEQ ID NO: 710614 - DNA, 25 bp, Mus musculus
ggctcgtggtgaagctcatgcccaa

SEQ ID NO: 710615 - DNA, 25 bp, Mus musculus
ggctcgtggtgatgctcatgcccaa

SEQ ID NO: 710616 - DNA, 25 bp, Mus musculus
ggctcgttagggaacatccatcaca

SEQ ID NO: 710617 - DNA, 25 bp, Mus musculus
ggctcgttagggtacatccatcaca

SEQ ID NO: 710618 - DNA, 25 bp, Mus musculus
ggctcgttggcaccctcaaacatga

SEQ ID NO: 710619 - DNA, 25 bp, Mus musculus
ggctcgttggcagcctcaaacatga

SEQ ID NO: 710620 - DNA, 25 bp, Mus musculus
ggctctaaactcatctttgacaaga

SEQ ID NO: 710621 - DNA, 25 bp, Mus musculus
ggctctaaactcttctttgacaaga

SEQ ID NO: 710622 - DNA, 25 bp, Mus musculus
ggctctacagagaggtcctgctatt

SEQ ID NO: 710623 - DNA, 25 bp, Mus musculus
ggctctacagagtggtcctgctatt

SEQ ID NO: 710624 - DNA, 25 bp, Mus musculus
ggctctacatcgacacagagtacat

SEQ ID NO: 710625 - DNA, 25 bp, Mus musculus
ggctctacatcgtcacagagtacat

SEQ ID NO: 710626 - DNA, 25 bp, Mus musculus
ggctctacccgacgccacgagtcag

SEQ ID NO: 710627 - DNA, 25 bp, Mus musculus
ggctctacccgaggccacgagtcag

SEQ ID NO: 710628 - DNA, 25 bp, Mus musculus
ggctctaccgccatggaatgttgca

SEQ ID NO: 710629 - DNA, 25 bp, Mus musculus
ggctctaccgccttggaatgttgca

SEQ ID NO: 710630 - DNA, 25 bp, Mus musculus
ggctctacgcttatgaaccttctga

SEQ ID NO: 710631 - DNA, 25 bp, Mus musculus
ggctctacgcttttgaaccttctga

SEQ ID NO: 710632 - DNA, 25 bp, Mus musculus
ggctctactgcccttttatgaccca

SEQ ID NO: 710633 - DNA, 25 bp, Mus musculus
ggctctactgccgttttatgaccca

SEQ ID NO: 710634 - DNA, 25 bp, Mus musculus
ggctctacttggagcagctcaagca

SEQ ID NO: 710635 - DNA, 25 bp, Mus musculus
ggctctacttggtgcagctcaagca

SEQ ID NO: 710636 - DNA, 25 bp, Mus musculus
ggctctagaagtccccaacctgttg

SEQ ID NO: 710637 - DNA, 25 bp, Mus musculus
ggctctagaagtgcccaacctgttg

SEQ ID NO: 710638 - DNA, 25 bp, Mus musculus
ggctctagggatatgttagccacag

SEQ ID NO: 710639 - DNA, 25 bp, Mus musculus
ggctctagggatttgttagccacag

SEQ ID NO: 710640 - DNA, 25 bp, Mus musculus
ggctctatgatgaccgttcttgcac

SEQ ID NO: 710641 - DNA, 25 bp, Mus musculus
ggctctatgatgtccgttcttgcac

SEQ ID NO: 710642 - DNA, 25 bp, Mus musculus
ggctctatggggcaatcttaaagat

SEQ ID NO: 710643 - DNA, 25 bp, Mus musculus
ggctctatgggggaatcttaaagat

SEQ ID NO: 710644 - DNA, 25 bp, Mus musculus
ggctctatttgaccgcatgcgcaaa

SEQ ID NO: 710645 - DNA, 25 bp, Mus musculus
ggctctatttgagcgcatgcgcaaa

SEQ ID NO: 710646 - DNA, 25 bp, Mus musculus
ggctctcaaaccctgctgaggtgga

SEQ ID NO: 710647 - DNA, 25 bp, Mus musculus
ggctctcaaaccgtgctgaggtgga

SEQ ID NO: 710648 - DNA, 25 bp, Mus musculus
ggctctcacaggacatcttattcca

SEQ ID NO: 710649 - DNA, 25 bp, Mus musculus
ggctctcacaggtcatcttattcca

SEQ ID NO: 710650 - DNA, 25 bp, Mus musculus
ggctctcagatgaatggcttggact

SEQ ID NO: 710651 - DNA, 25 bp, Mus musculus
ggctctcagatgtatggcttggact

SEQ ID NO: 710652 - DNA, 25 bp, Mus musculus
ggctctcaggataaactcccagtgt

SEQ ID NO: 710653 - DNA, 25 bp, Mus musculus
ggctctcaggattaactcccagtgt

SEQ ID NO: 710654 - DNA, 25 bp, Mus musculus
ggctctcaggccacgaaaaaattaa

SEQ ID NO: 710655 - DNA, 25 bp, Mus musculus
ggctctcaggcctcgaaaaaattaa

SEQ ID NO: 710656 - DNA, 25 bp, Mus musculus
ggctctcatcatctgcaacaaaaag

SEQ ID NO: 710657 - DNA, 25 bp, Mus musculus
ggctctcatcatgtgcaacaaaaag

SEQ ID NO: 710658 - DNA, 25 bp, Mus musculus
ggctctcatctgagagaccggtatc

SEQ ID NO: 710659 - DNA, 25 bp, Mus musculus
ggctctcatctgtgagaccggtatc

SEQ ID NO: 710660 - DNA, 25 bp, Mus musculus
ggctctccacacctgtagctcatag

SEQ ID NO: 710661 - DNA, 25 bp, Mus musculus
ggctctccacacgtgtagctcatag

SEQ ID NO: 710662 - DNA, 25 bp, Mus musculus
ggctctccacgtcgactgcgtggca

SEQ ID NO: 710663 - DNA, 25 bp, Mus musculus
ggctctccacgtggactgcgtggca

SEQ ID NO: 710664 - DNA, 25 bp, Mus musculus
ggctctccgatgcatggtgtgtata

SEQ ID NO: 710665 - DNA, 25 bp, Mus musculus
ggctctccgatggatggtgtgtata

SEQ ID NO: 710666 - DNA, 25 bp, Mus musculus
ggctctcctggaagggtataacaag

SEQ ID NO: 710667 - DNA, 25 bp, Mus musculus
ggctctcctggatgggtataacaag

SEQ ID NO: 710668 - DNA, 25 bp, Mus musculus
ggctctccttcacggcagcaacggt

SEQ ID NO: 710669 - DNA, 25 bp, Mus musculus
ggctctccttcagggcagcaacggt

SEQ ID NO: 710670 - DNA, 25 bp, Mus musculus
ggctctcgaagacgatgcgttagac

SEQ ID NO: 710671 - DNA, 25 bp, Mus musculus
ggctctcgaagaggatgcgttagac

SEQ ID NO: 710672 - DNA, 25 bp, Mus musculus
ggctctcgccttcgtcctggtttgg

SEQ ID NO: 710673 - DNA, 25 bp, Mus musculus
ggctctcgccttggtcctggtttgg

SEQ ID NO: 710674 - DNA, 25 bp, Mus musculus
ggctctcgcgtcagtggcaatggca

SEQ ID NO: 710675 - DNA, 25 bp, Mus musculus
ggctctcgcgtctgtggcaatggca

SEQ ID NO: 710676 - DNA, 25 bp, Mus musculus
ggctctcggatgctaatggtcctgt

SEQ ID NO: 710677 - DNA, 25 bp, Mus musculus
ggctctcggatggtaatggtcctgt

SEQ ID NO: 710678 - DNA, 25 bp, Mus musculus
ggctctcggccgaggtcaagaaccg

SEQ ID NO: 710679 - DNA, 25 bp, Mus musculus
ggctctcggccgtggtcaagaaccg

SEQ ID NO: 710680 - DNA, 25 bp, Mus musculus
ggctctcggctgaacatcatcatca

SEQ ID NO: 710681 - DNA, 25 bp, Mus musculus
ggctctcggctgtacatcatcatca

SEQ ID NO: 710682 - DNA, 25 bp, Mus musculus
ggctctctacgtcgccgctgtcagg

SEQ ID NO: 710683 - DNA, 25 bp, Mus musculus
ggctctctacgtggccgctgtcagg

SEQ ID NO: 710684 - DNA, 25 bp, Mus musculus
ggctctctagtaagaccaagtagca

SEQ ID NO: 710685 - DNA, 25 bp, Mus musculus
ggctctctagtatgaccaagtagca

SEQ ID NO: 710686 - DNA, 25 bp, Mus musculus
ggctctctagtgacccgggaagcca

SEQ ID NO: 710687 - DNA, 25 bp, Mus musculus
ggctctctagtgtcccgggaagcca

SEQ ID NO: 710688 - DNA, 25 bp, Mus musculus
ggctctctattgagtgcttgttaca

SEQ ID NO: 710689 - DNA, 25 bp, Mus musculus
ggctctctattgtgtgcttgttaca

SEQ ID NO: 710690 - DNA, 25 bp, Mus musculus
ggctctctcaagctcgataccgagt

SEQ ID NO: 710691 - DNA, 25 bp, Mus musculus
ggctctctcaaggtcgataccgagt

SEQ ID NO: 710692 - DNA, 25 bp, Mus musculus
ggctctctcaggaaactcagcgata

SEQ ID NO: 710693 - DNA, 25 bp, Mus musculus
ggctctctcaggtaactcagcgata

SEQ ID NO: 710694 - DNA, 25 bp, Mus musculus
ggctctctcggaagagaccgctcca

SEQ ID NO: 710695 - DNA, 25 bp, Mus musculus
ggctctctcggatgagaccgctcca

SEQ ID NO: 710696 - DNA, 25 bp, Mus musculus
ggctctctgatgcacgactacttgg

SEQ ID NO: 710697 - DNA, 25 bp, Mus musculus
ggctctctgatggacgactacttgg

SEQ ID NO: 710698 - DNA, 25 bp, Mus musculus
ggctctctgggacttcacggccatc

SEQ ID NO: 710699 - DNA, 25 bp, Mus musculus
ggctctctgggagttcacggccatc

SEQ ID NO: 710700 - DNA, 25 bp, Mus musculus
ggctctctgtggaaatctacgaccg

SEQ ID NO: 710701 - DNA, 25 bp, Mus musculus
ggctctctgtggtaatctacgaccg

SEQ ID NO: 710702 - DNA, 25 bp, Mus musculus
ggctctctgtgtatggactgagttt

SEQ ID NO: 710703 - DNA, 25 bp, Mus musculus
ggctctctgtgtttggactgagttt

SEQ ID NO: 710704 - DNA, 25 bp, Mus musculus
ggctctcttccaataacgtctctgg

SEQ ID NO: 710705 - DNA, 25 bp, Mus musculus
ggctctcttccacttgtcacacatt

SEQ ID NO: 710706 - DNA, 25 bp, Mus musculus
ggctctcttccagttgtcacacatt

SEQ ID NO: 710707 - DNA, 25 bp, Mus musculus
ggctctcttccattaacgtctctgg

SEQ ID NO: 710708 - DNA, 25 bp, Mus musculus
ggctctctttctcgatcaaccctga

SEQ ID NO: 710709 - DNA, 25 bp, Mus musculus
ggctctctttctggatcaaccctga

SEQ ID NO: 710710 - DNA, 25 bp, Mus musculus
ggctctctttgcatatctgtcacag

SEQ ID NO: 710711 - DNA, 25 bp, Mus musculus
ggctctctttgcttatctgtcacag

SEQ ID NO: 710712 - DNA, 25 bp, Mus musculus
ggctctgaaatcagatcctcatgct

SEQ ID NO: 710713 - DNA, 25 bp, Mus musculus
ggctctgaaatctgatcctcatgct

SEQ ID NO: 710714 - DNA, 25 bp, Mus musculus
ggctctgaaccactatccggcatta

SEQ ID NO: 710715 - DNA, 25 bp, Mus musculus
ggctctgaaccagtatccggcatta

SEQ ID NO: 710716 - DNA, 25 bp, Mus musculus
ggctctgaccgaagtgcagcggcta

SEQ ID NO: 710717 - DNA, 25 bp, Mus musculus
ggctctgaccgatgtgcagcggcta

SEQ ID NO: 710718 - DNA, 25 bp, Mus musculus
ggctctgacggacccgaacagccta

SEQ ID NO: 710719 - DNA, 25 bp, Mus musculus
ggctctgacggagccgaacagccta

SEQ ID NO: 710720 - DNA, 25 bp, Mus musculus
ggctctgataccctggtgggtacct

SEQ ID NO: 710721 - DNA, 25 bp, Mus musculus
ggctctgataccgtggtgggtacct

SEQ ID NO: 710722 - DNA, 25 bp, Mus musculus
ggctctgatcagaaaccatcaggct

SEQ ID NO: 710723 - DNA, 25 bp, Mus musculus
ggctctgatcagtaaccatcaggct

SEQ ID NO: 710724 - DNA, 25 bp, Mus musculus
ggctctgatcggcacactggattca

SEQ ID NO: 710725 - DNA, 25 bp, Mus musculus
ggctctgatcgggacactggattca

SEQ ID NO: 710726 - DNA, 25 bp, Mus musculus
ggctctgcaactccgagcacagtgg

SEQ ID NO: 710727 - DNA, 25 bp, Mus musculus
ggctctgcaactgcgagcacagtgg

SEQ ID NO: 710728 - DNA, 25 bp, Mus musculus
ggctctgccagtatgctactcttgc

SEQ ID NO: 710729 - DNA, 25 bp, Mus musculus
ggctctgccagtcacgtgcagcaga

SEQ ID NO: 710730 - DNA, 25 bp, Mus musculus
ggctctgccagtgacgtgcagcaga

SEQ ID NO: 710731 - DNA, 25 bp, Mus musculus
ggctctgccagtttgctactcttgc

SEQ ID NO: 710732 - DNA, 25 bp, Mus musculus
ggctctgccattaaaagttgtgatc

SEQ ID NO: 710733 - DNA, 25 bp, Mus musculus
ggctctgccatttaaagttgtgatc

SEQ ID NO: 710734 - DNA, 25 bp, Mus musculus
ggctctgccgatagttactgaactg

SEQ ID NO: 710735 - DNA, 25 bp, Mus musculus
ggctctgccgattgttactgaactg

SEQ ID NO: 710736 - DNA, 25 bp, Mus musculus
ggctctgccgctagaggatcctggc

SEQ ID NO: 710737 - DNA, 25 bp, Mus musculus
ggctctgccgcttgaggatcctggc

SEQ ID NO: 710738 - DNA, 25 bp, Mus musculus
ggctctgcgttcagggatacaaaca

SEQ ID NO: 710739 - DNA, 25 bp, Mus musculus
ggctctgcgttctgggatacaaaca

SEQ ID NO: 710740 - DNA, 25 bp, Mus musculus
ggctctgctgtgaaaccacctcttc

SEQ ID NO: 710741 - DNA, 25 bp, Mus musculus
ggctctgctgtgtaaccacctcttc

SEQ ID NO: 710742 - DNA, 25 bp, Mus musculus
ggctctggaaatccaccagtgttca

SEQ ID NO: 710743 - DNA, 25 bp, Mus musculus
ggctctggaaatgcaccagtgttca

SEQ ID NO: 710744 - DNA, 25 bp, Mus musculus
ggctctggaagaaagacggtatcca

SEQ ID NO: 710745 - DNA, 25 bp, Mus musculus
ggctctggaagatagacggtatcca

SEQ ID NO: 710746 - DNA, 25 bp, Mus musculus
ggctctggacatattcaacacttcc

SEQ ID NO: 710747 - DNA, 25 bp, Mus musculus
ggctctggacattttcaacacttcc

SEQ ID NO: 710748 - DNA, 25 bp, Mus musculus
ggctctggacctattgcacgctgga

SEQ ID NO: 710749 - DNA, 25 bp, Mus musculus
ggctctggaccttttgcacgctgga

SEQ ID NO: 710750 - DNA, 25 bp, Mus musculus
ggctctggcaagacaaagaggtgac

SEQ ID NO: 710751 - DNA, 25 bp, Mus musculus
ggctctggcaagtcaaagaggtgac

SEQ ID NO: 710752 - DNA, 25 bp, Mus musculus
ggctctggccatagtaaaatcccca

SEQ ID NO: 710753 - DNA, 25 bp, Mus musculus
ggctctggccattgtaaaatcccca

SEQ ID NO: 710754 - DNA, 25 bp, Mus musculus
ggctctggcgagagcattcacaaaa

SEQ ID NO: 710755 - DNA, 25 bp, Mus musculus
ggctctggcgagtgcattcacaaaa

SEQ ID NO: 710756 - DNA, 25 bp, Mus musculus
ggctctggcgccatcagtggttacc

SEQ ID NO: 710757 - DNA, 25 bp, Mus musculus
ggctctggcgccttcagtggttacc

SEQ ID NO: 710758 - DNA, 25 bp, Mus musculus
ggctctgggacacctcaatcctgtc

SEQ ID NO: 710759 - DNA, 25 bp, Mus musculus
ggctctgggacagctcaatcctgtc

SEQ ID NO: 710760 - DNA, 25 bp, Mus musculus
ggctctggtattaattcatcctcag

SEQ ID NO: 710761 - DNA, 25 bp, Mus musculus
ggctctggtatttattcatcctcag

SEQ ID NO: 710762 - DNA, 25 bp, Mus musculus
ggctctggtctgacaagacatgttt

SEQ ID NO: 710763 - DNA, 25 bp, Mus musculus
ggctctggtctgtcaagacatgttt

SEQ ID NO: 710764 - DNA, 25 bp, Mus musculus
ggctctgtaccgactactccagtag

SEQ ID NO: 710765 - DNA, 25 bp, Mus musculus
ggctctgtaccgtctactccagtag

SEQ ID NO: 710766 - DNA, 25 bp, Mus musculus
ggctctgtcacccactatggataca

SEQ ID NO: 710767 - DNA, 25 bp, Mus musculus
ggctctgtcaccgactatggataca

SEQ ID NO: 710768 - DNA, 25 bp, Mus musculus
ggctctgtgtgcacatcccgaagtg

SEQ ID NO: 710769 - DNA, 25 bp, Mus musculus
ggctctgtgtgctcatcccgaagtg

SEQ ID NO: 710770 - DNA, 25 bp, Mus musculus
ggctctgttcccattcttacggtgg

SEQ ID NO: 710771 - DNA, 25 bp, Mus musculus
ggctctgttccctttcttacggtgg

SEQ ID NO: 710772 - DNA, 25 bp, Mus musculus
ggctctgttcgtccaagaatagtca

SEQ ID NO: 710773 - DNA, 25 bp, Mus musculus
ggctctgttcgtgcaagaatagtca

SEQ ID NO: 710774 - DNA, 25 bp, Mus musculus
ggctctgttgtcatcacgcagcagg

SEQ ID NO: 710775 - DNA, 25 bp, Mus musculus
ggctctgttgtcttcacgcagcagg

SEQ ID NO: 710776 - DNA, 25 bp, Mus musculus
ggctcttaaaacattaattgcgcaa

SEQ ID NO: 710777 - DNA, 25 bp, Mus musculus
ggctcttaaaactttaattgcgcaa

SEQ ID NO: 710778 - DNA, 25 bp, Mus musculus
ggctcttactcaaggcacttgcagg

SEQ ID NO: 710779 - DNA, 25 bp, Mus musculus
ggctcttactcatggcacttgcagg

SEQ ID NO: 710780 - DNA, 25 bp, Mus musculus
ggctcttacttcagagtatgtgaca

SEQ ID NO: 710781 - DNA, 25 bp, Mus musculus
ggctcttacttctgagtatgtgaca

SEQ ID NO: 710782 - DNA, 25 bp, Mus musculus
ggctcttagggtatgctaggaaact

SEQ ID NO: 710783 - DNA, 25 bp, Mus musculus
ggctcttagggtttgctaggaaact

SEQ ID NO: 710784 - DNA, 25 bp, Mus musculus
ggctcttatcgcagtgtctgcccgc

SEQ ID NO: 710785 - DNA, 25 bp, Mus musculus
ggctcttatcgctgtgtctgcccgc

SEQ ID NO: 710786 - DNA, 25 bp, Mus musculus
ggctcttattgcctacgccggttcg

SEQ ID NO: 710787 - DNA, 25 bp, Mus musculus
ggctcttattgcgtacgccggttcg

SEQ ID NO: 710788 - DNA, 25 bp, Mus musculus
ggctcttcatgcattccaaggtcat

SEQ ID NO: 710789 - DNA, 25 bp, Mus musculus
ggctcttcatgctttccaaggtcat

SEQ ID NO: 710790 - DNA, 25 bp, Mus musculus
ggctcttccatgctgccgctgtcat

SEQ ID NO: 710791 - DNA, 25 bp, Mus musculus
ggctcttccatggtgccgctgtcat

SEQ ID NO: 710792 - DNA, 25 bp, Mus musculus
ggctcttcccgacgtcatgatggta

SEQ ID NO: 710793 - DNA, 25 bp, Mus musculus
ggctcttcccgaggtcatgatggta

SEQ ID NO: 710794 - DNA, 25 bp, Mus musculus
ggctcttccggcaccgacaaagtct

SEQ ID NO: 710795 - DNA, 25 bp, Mus musculus
ggctcttccggctccgacaaagtct

SEQ ID NO: 710796 - DNA, 25 bp, Mus musculus
ggctcttcctgcacaaagccaagga

SEQ ID NO: 710797 - DNA, 25 bp, Mus musculus
ggctcttcctgctcaaagccaagga

SEQ ID NO: 710798 - DNA, 25 bp, Mus musculus
ggctcttcgcccattactgcctggg

SEQ ID NO: 710799 - DNA, 25 bp, Mus musculus
ggctcttcgccctttactgcctggg

SEQ ID NO: 710800 - DNA, 25 bp, Mus musculus
ggctcttcgtgtcgtactctagcca

SEQ ID NO: 710801 - DNA, 25 bp, Mus musculus
ggctcttcgtgtggtactctagcca

SEQ ID NO: 710802 - DNA, 25 bp, Mus musculus
ggctcttgagtgcacagacttcccc

SEQ ID NO: 710803 - DNA, 25 bp, Mus musculus
ggctcttgagtggacagacttcccc

SEQ ID NO: 710804 - DNA, 25 bp, Mus musculus
ggctcttgccccacttggaagtgga

SEQ ID NO: 710805 - DNA, 25 bp, Mus musculus
ggctcttgcccctcttggaagtgga

SEQ ID NO: 710806 - DNA, 25 bp, Mus musculus
ggctcttggccaagctgagtgtaca

SEQ ID NO: 710807 - DNA, 25 bp, Mus musculus
ggctcttggccatgctgagtgtaca

SEQ ID NO: 710808 - DNA, 25 bp, Mus musculus
ggctcttgtagtcaccacaccacag

SEQ ID NO: 710809 - DNA, 25 bp, Mus musculus
ggctcttgtagtgaccacaccacag

SEQ ID NO: 710810 - DNA, 25 bp, Mus musculus
ggctcttgtggtcagcccagtccag

SEQ ID NO: 710811 - DNA, 25 bp, Mus musculus
ggctcttgtggtgagcccagtccag

SEQ ID NO: 710812 - DNA, 25 bp, Mus musculus
ggctcttgttcgaaccggtagcatc

SEQ ID NO: 710813 - DNA, 25 bp, Mus musculus
ggctcttgttcgtaccggtagcatc

SEQ ID NO: 710814 - DNA, 25 bp, Mus musculus
ggctcttgttgtcaagaagctacaa

SEQ ID NO: 710815 - DNA, 25 bp, Mus musculus
ggctcttgttgtgaagaagctacaa

SEQ ID NO: 710816 - DNA, 25 bp, Mus musculus
ggctctttccagagtcagtgcctct

SEQ ID NO: 710817 - DNA, 25 bp, Mus musculus
ggctctttccagattggctacaaca

SEQ ID NO: 710818 - DNA, 25 bp, Mus musculus
ggctctttccagtgtcagtgcctct

SEQ ID NO: 710819 - DNA, 25 bp, Mus musculus
ggctctttccagtttggctacaaca

SEQ ID NO: 710820 - DNA, 25 bp, Mus musculus
ggctctttctcactccgagctgggt

SEQ ID NO: 710821 - DNA, 25 bp, Mus musculus
ggctctttctcagtccgagctgggt

SEQ ID NO: 710822 - DNA, 25 bp, Mus musculus
ggctctttcttgaggatatatcaca

SEQ ID NO: 710823 - DNA, 25 bp, Mus musculus
ggctctttcttgtggatatatcaca

SEQ ID NO: 710824 - DNA, 25 bp, Mus musculus
ggctctttgactcgtggcatccgca

SEQ ID NO: 710825 - DNA, 25 bp, Mus musculus
ggctctttgactggtggcatccgca

SEQ ID NO: 710826 - DNA, 25 bp, Mus musculus
ggctctttgtccaagtcaccatgat

SEQ ID NO: 710827 - DNA, 25 bp, Mus musculus
ggctctttgtcctagtcaccatgat

SEQ ID NO: 710828 - DNA, 25 bp, Mus musculus
ggctctttttacctatgaaggcaac

SEQ ID NO: 710829 - DNA, 25 bp, Mus musculus
ggctctttttacgtatgaaggcaac

SEQ ID NO: 710830 - DNA, 25 bp, Mus musculus
ggctgaaaaccccaaagtgtccaga

SEQ ID NO: 710831 - DNA, 25 bp, Mus musculus
ggctgaaaacccgaaagtgtccaga

SEQ ID NO: 710832 - DNA, 25 bp, Mus musculus
ggctgaaaacctcttgtccccggag

SEQ ID NO: 710833 - DNA, 25 bp, Mus musculus
ggctgaaaacctgttgtccccggag

SEQ ID NO: 710834 - DNA, 25 bp, Mus musculus
ggctgaaaatagaccccgtgaatgg

SEQ ID NO: 710835 - DNA, 25 bp, Mus musculus
ggctgaaaatagtccccgtgaatgg

SEQ ID NO: 710836 - DNA, 25 bp, Mus musculus
ggctgaaagctgagtcgttgccaga

SEQ ID NO: 710837 - DNA, 25 bp, Mus musculus
ggctgaaagctgtgtcgttgccaga

SEQ ID NO: 710838 - DNA, 25 bp, Mus musculus
ggctgaaaggcacgcacaaactgca

SEQ ID NO: 710839 - DNA, 25 bp, Mus musculus
ggctgaaaggcaggcacaaactgca

SEQ ID NO: 710840 - DNA, 25 bp, Mus musculus
ggctgaaattgccagctacctggaa

SEQ ID NO: 710841 - DNA, 25 bp, Mus musculus
ggctgaaattgcgagctacctggaa

SEQ ID NO: 710842 - DNA, 25 bp, Mus musculus
ggctgaacagctacggaatcagatc

SEQ ID NO: 710843 - DNA, 25 bp, Mus musculus
ggctgaacagcttcggaatcagatc

SEQ ID NO: 710844 - DNA, 25 bp, Mus musculus
ggctgaaccgagatgctgcccagga

SEQ ID NO: 710845 - DNA, 25 bp, Mus musculus
ggctgaaccgagttgctgcccagga

SEQ ID NO: 710846 - DNA, 25 bp, Mus musculus
ggctgaacctgaatgtgtacacctg

SEQ ID NO: 710847 - DNA, 25 bp, Mus musculus
ggctgaacctgattgtgtacacctg

SEQ ID NO: 710848 - DNA, 25 bp, Mus musculus
ggctgaactcagaaaccacacacgg

SEQ ID NO: 710849 - DNA, 25 bp, Mus musculus
ggctgaactcagtaaccacacacgg

SEQ ID NO: 710850 - DNA, 25 bp, Mus musculus
ggctgaactcttccctttcatcctg

SEQ ID NO: 710851 - DNA, 25 bp, Mus musculus
ggctgaactcttgcctttcatcctg

SEQ ID NO: 710852 - DNA, 25 bp, Mus musculus
ggctgaactgcccaatagcctgccg

SEQ ID NO: 710853 - DNA, 25 bp, Mus musculus
ggctgaactgccgaatagcctgccg

SEQ ID NO: 710854 - DNA, 25 bp, Mus musculus
ggctgaagagccagacatgcacctg

SEQ ID NO: 710855 - DNA, 25 bp, Mus musculus
ggctgaagagcccatgccaagactt

SEQ ID NO: 710856 - DNA, 25 bp, Mus musculus
ggctgaagagccgatgccaagactt

SEQ ID NO: 710857 - DNA, 25 bp, Mus musculus
ggctgaagagcctgacatgcacctg

SEQ ID NO: 710858 - DNA, 25 bp, Mus musculus
ggctgaagataaagcagacacctta

SEQ ID NO: 710859 - DNA, 25 bp, Mus musculus
ggctgaagataatgcagacacctta

SEQ ID NO: 710860 - DNA, 25 bp, Mus musculus
ggctgaagatggactactgtttaaa

SEQ ID NO: 710861 - DNA, 25 bp, Mus musculus
ggctgaagatggtctactgtttaaa

SEQ ID NO: 710862 - DNA, 25 bp, Mus musculus
ggctgaagcagtcggaatcgataaa

SEQ ID NO: 710863 - DNA, 25 bp, Mus musculus
ggctgaagcagtgggaatcgataaa

SEQ ID NO: 710864 - DNA, 25 bp, Mus musculus
ggctgaagccatacagaaaataata

SEQ ID NO: 710865 - DNA, 25 bp, Mus musculus
ggctgaagccattcagaaaataata

SEQ ID NO: 710866 - DNA, 25 bp, Mus musculus
ggctgaagctccagcagtcagagga

SEQ ID NO: 710867 - DNA, 25 bp, Mus musculus
ggctgaagctcctgcagtcagagga

SEQ ID NO: 710868 - DNA, 25 bp, Mus musculus
ggctgaagctgcactaagggtgttt

SEQ ID NO: 710869 - DNA, 25 bp, Mus musculus
ggctgaagctgctctaagggtgttt

SEQ ID NO: 710870 - DNA, 25 bp, Mus musculus
ggctgaagcttgctaccagaccaag

SEQ ID NO: 710871 - DNA, 25 bp, Mus musculus
ggctgaagcttggtaccagaccaag

SEQ ID NO: 710872 - DNA, 25 bp, Mus musculus
ggctgaaggattccctgtcatcgag

SEQ ID NO: 710873 - DNA, 25 bp, Mus musculus
ggctgaaggattgcctgtcatcgag

SEQ ID NO: 710874 - DNA, 25 bp, Mus musculus
ggctgaagtggcatggacccgccat

SEQ ID NO: 710875 - DNA, 25 bp, Mus musculus
ggctgaagtggcttggacccgccat

SEQ ID NO: 710876 - DNA, 25 bp, Mus musculus
ggctgaagttgaagttttcctgaaa

SEQ ID NO: 710877 - DNA, 25 bp, Mus musculus
ggctgaagttgatgttttcctgaaa

SEQ ID NO: 710878 - DNA, 25 bp, Mus musculus
ggctgaataagtatacatttcccac

SEQ ID NO: 710879 - DNA, 25 bp, Mus musculus
ggctgaataagtttacatttcccac

SEQ ID NO: 710880 - DNA, 25 bp, Mus musculus
ggctgaatgaacaacagatcatcaa

SEQ ID NO: 710881 - DNA, 25 bp, Mus musculus
ggctgaatgaactacagatcatcaa

SEQ ID NO: 710882 - DNA, 25 bp, Mus musculus
ggctgaatgcgacccaccctgtgac

SEQ ID NO: 710883 - DNA, 25 bp, Mus musculus
ggctgaatgcgagccaccctgtgac

SEQ ID NO: 710884 - DNA, 25 bp, Mus musculus
ggctgacaacgtcgtcctcgggact

SEQ ID NO: 710885 - DNA, 25 bp, Mus musculus
ggctgacaacgtggtcctcgggact

SEQ ID NO: 710886 - DNA, 25 bp, Mus musculus
ggctgacaagtaccatgggaaaacc

SEQ ID NO: 710887 - DNA, 25 bp, Mus musculus
ggctgacaagtagcatgggaaaacc

SEQ ID NO: 710888 - DNA, 25 bp, Mus musculus
ggctgacacacgattccaagtggaa

SEQ ID NO: 710889 - DNA, 25 bp, Mus musculus
ggctgacacacgtttccaagtggaa

SEQ ID NO: 710890 - DNA, 25 bp, Mus musculus
ggctgacactttacagagagaaggc

SEQ ID NO: 710891 - DNA, 25 bp, Mus musculus
ggctgacacttttcagagagaaggc

SEQ ID NO: 710892 - DNA, 25 bp, Mus musculus
ggctgacatacaagccacacctaca

SEQ ID NO: 710893 - DNA, 25 bp, Mus musculus
ggctgacatacatgccacacctaca

SEQ ID NO: 710894 - DNA, 25 bp, Mus musculus
ggctgacatcaacttcaagagcgcg

SEQ ID NO: 710895 - DNA, 25 bp, Mus musculus
ggctgacatcaagttcaagagcgcg

SEQ ID NO: 710896 - DNA, 25 bp, Mus musculus
ggctgacatctccaccaccgtttgg

SEQ ID NO: 710897 - DNA, 25 bp, Mus musculus
ggctgacatctcgaccaccgtttgg

SEQ ID NO: 710898 - DNA, 25 bp, Mus musculus
ggctgacatgatcaaactcagaact

SEQ ID NO: 710899 - DNA, 25 bp, Mus musculus
ggctgacatgatgaaactcagaact

SEQ ID NO: 710900 - DNA, 25 bp, Mus musculus
ggctgacattgtagccaccaaaatg

SEQ ID NO: 710901 - DNA, 25 bp, Mus musculus
ggctgacattgttgccaccaaaatg

SEQ ID NO: 710902 - DNA, 25 bp, Mus musculus
ggctgacccagaactatgaggcgta

SEQ ID NO: 710903 - DNA, 25 bp, Mus musculus
ggctgacccagatctatgaggcgta

SEQ ID NO: 710904 - DNA, 25 bp, Mus musculus
ggctgaccccacaggagcctttggg

SEQ ID NO: 710905 - DNA, 25 bp, Mus musculus
ggctgaccccactggagcctttggg

SEQ ID NO: 710906 - DNA, 25 bp, Mus musculus
ggctgacctggtcgatactattata

SEQ ID NO: 710907 - DNA, 25 bp, Mus musculus
ggctgacctggtggatactattata

SEQ ID NO: 710908 - DNA, 25 bp, Mus musculus
ggctgacgaactcctctttgaagag

SEQ ID NO: 710909 - DNA, 25 bp, Mus musculus
ggctgacgaactgctctttgaagag

SEQ ID NO: 710910 - DNA, 25 bp, Mus musculus
ggctgactacacacaggacctgtat

SEQ ID NO: 710911 - DNA, 25 bp, Mus musculus
ggctgactacactcaggacctgtat

SEQ ID NO: 710912 - DNA, 25 bp, Mus musculus
ggctgactacgaagcaccacctcaa

SEQ ID NO: 710913 - DNA, 25 bp, Mus musculus
ggctgactacgatgcaccacctcaa

SEQ ID NO: 710914 - DNA, 25 bp, Mus musculus
ggctgactatttaacgagaccacat

SEQ ID NO: 710915 - DNA, 25 bp, Mus musculus
ggctgactattttacgagaccacat

SEQ ID NO: 710916 - DNA, 25 bp, Mus musculus
ggctgactccaaagttctatgacct

SEQ ID NO: 710917 - DNA, 25 bp, Mus musculus
ggctgactccaatgttctatgacct

SEQ ID NO: 710918 - DNA, 25 bp, Mus musculus
ggctgactctggctacaccccaatg

SEQ ID NO: 710919 - DNA, 25 bp, Mus musculus
ggctgactctggctgactcttcagt

SEQ ID NO: 710920 - DNA, 25 bp, Mus musculus
ggctgactctgggtacaccccaatg

SEQ ID NO: 710921 - DNA, 25 bp, Mus musculus
ggctgactctgggtgactcttcagt

SEQ ID NO: 710922 - DNA, 25 bp, Mus musculus
ggctgactgaaactcaggatgcaga

SEQ ID NO: 710923 - DNA, 25 bp, Mus musculus
ggctgactgaaagtcaggatgcaga

SEQ ID NO: 710924 - DNA, 25 bp, Mus musculus
ggctgactgagtcctacccctgaat

SEQ ID NO: 710925 - DNA, 25 bp, Mus musculus
ggctgactgagtgctacccctgaat

SEQ ID NO: 710926 - DNA, 25 bp, Mus musculus
ggctgactgcagctggattcatcca

SEQ ID NO: 710927 - DNA, 25 bp, Mus musculus
ggctgactgcaggtggattcatcca

SEQ ID NO: 710928 - DNA, 25 bp, Mus musculus
ggctgacttactatccctctggaca

SEQ ID NO: 710929 - DNA, 25 bp, Mus musculus
ggctgacttactttccctctggaca

SEQ ID NO: 710930 - DNA, 25 bp, Mus musculus
ggctgacttcacagtatggctcata

SEQ ID NO: 710931 - DNA, 25 bp, Mus musculus
ggctgacttcactgtatggctcata

SEQ ID NO: 710932 - DNA, 25 bp, Mus musculus
ggctgacttccaagctgagaggcat

SEQ ID NO: 710933 - DNA, 25 bp, Mus musculus
ggctgacttccatgctgagaggcat

SEQ ID NO: 710934 - DNA, 25 bp, Mus musculus
ggctgacttcgaacttgcaatgatt

SEQ ID NO: 710935 - DNA, 25 bp, Mus musculus
ggctgacttcgatcttgcaatgatt

SEQ ID NO: 710936 - DNA, 25 bp, Mus musculus
ggctgactttctagtgtgtactttt

SEQ ID NO: 710937 - DNA, 25 bp, Mus musculus
ggctgactttcttgtgtgtactttt

SEQ ID NO: 710938 - DNA, 25 bp, Mus musculus
ggctgagaaatacctcgatatcccc

SEQ ID NO: 710939 - DNA, 25 bp, Mus musculus
ggctgagaaatagctcgatatcccc

SEQ ID NO: 710940 - DNA, 25 bp, Mus musculus
ggctgagaagcgaccacctacattg

SEQ ID NO: 710941 - DNA, 25 bp, Mus musculus
ggctgagaagcgtccacctacattg

SEQ ID NO: 710942 - DNA, 25 bp, Mus musculus
ggctgagaaggaactccagcttttg

SEQ ID NO: 710943 - DNA, 25 bp, Mus musculus
ggctgagaaggatctccagcttttg

SEQ ID NO: 710944 - DNA, 25 bp, Mus musculus
ggctgagaatcacaccataccagca

SEQ ID NO: 710945 - DNA, 25 bp, Mus musculus
ggctgagaatcagaccataccagca

SEQ ID NO: 710946 - DNA, 25 bp, Mus musculus
ggctgagaccacagataaagtcaag

SEQ ID NO: 710947 - DNA, 25 bp, Mus musculus
ggctgagaccactgataaagtcaag

SEQ ID NO: 710948 - DNA, 25 bp, Mus musculus
ggctgagagaccagctgtatgccca

SEQ ID NO: 710949 - DNA, 25 bp, Mus musculus
ggctgagagacctgctgtatgccca

SEQ ID NO: 710950 - DNA, 25 bp, Mus musculus
ggctgagatggcaattcaccctgac

SEQ ID NO: 710951 - DNA, 25 bp, Mus musculus
ggctgagatggctattcaccctgac

SEQ ID NO: 710952 - DNA, 25 bp, Mus musculus
ggctgagcaagtatcccaccatccg

SEQ ID NO: 710953 - DNA, 25 bp, Mus musculus
ggctgagcaagtttcccaccatccg

SEQ ID NO: 710954 - DNA, 25 bp, Mus musculus
ggctgagcaccacgcagcaagcttc

SEQ ID NO: 710955 - DNA, 25 bp, Mus musculus
ggctgagcaccaggcagcaagcttc

SEQ ID NO: 710956 - DNA, 25 bp, Mus musculus
ggctgagcattcacgtttgcaccca

SEQ ID NO: 710957 - DNA, 25 bp, Mus musculus
ggctgagcattctcgtttgcaccca

SEQ ID NO: 710958 - DNA, 25 bp, Mus musculus
ggctgagccgcaataaggacaagat

SEQ ID NO: 710959 - DNA, 25 bp, Mus musculus
ggctgagccgcattaaggacaagat

SEQ ID NO: 710960 - DNA, 25 bp, Mus musculus
ggctgagcgctaagatgacatggct

SEQ ID NO: 710961 - DNA, 25 bp, Mus musculus
ggctgagcgctatgatgacatggct

SEQ ID NO: 710962 - DNA, 25 bp, Mus musculus
ggctgagctagcaaccctcaaaggc

SEQ ID NO: 710963 - DNA, 25 bp, Mus musculus
ggctgagctagctaccctcaaaggc

SEQ ID NO: 710964 - DNA, 25 bp, Mus musculus
ggctgagctatccaccggctgtaat

SEQ ID NO: 710965 - DNA, 25 bp, Mus musculus
ggctgagctatcgaccggctgtaat

SEQ ID NO: 710966 - DNA, 25 bp, Mus musculus
ggctgaggaaatacaatccttctga

SEQ ID NO: 710967 - DNA, 25 bp, Mus musculus
ggctgaggaaattcaatccttctga

SEQ ID NO: 710968 - DNA, 25 bp, Mus musculus
ggctgaggaatcctgtcctggcatc

SEQ ID NO: 710969 - DNA, 25 bp, Mus musculus
ggctgaggaatcgtgtcctggcatc

SEQ ID NO: 710970 - DNA, 25 bp, Mus musculus
ggctgaggatatctccagcttttgt

SEQ ID NO: 710971 - DNA, 25 bp, Mus musculus
ggctgaggatatgtccagcttttgt

SEQ ID NO: 710972 - DNA, 25 bp, Mus musculus
ggctgaggcataccctgctaacctc

SEQ ID NO: 710973 - DNA, 25 bp, Mus musculus
ggctgaggcatagcctgctaacctc

SEQ ID NO: 710974 - DNA, 25 bp, Mus musculus
ggctgagggcacagcagacccctac

SEQ ID NO: 710975 - DNA, 25 bp, Mus musculus
ggctgagggcaccacactcatatat

SEQ ID NO: 710976 - DNA, 25 bp, Mus musculus
ggctgagggcacgacactcatatat

SEQ ID NO: 710977 - DNA, 25 bp, Mus musculus
ggctgagggcactgcagacccctac

SEQ ID NO: 710978 - DNA, 25 bp, Mus musculus
ggctgagggccacaaagctagtttc

SEQ ID NO: 710979 - DNA, 25 bp, Mus musculus
ggctgagggccagaaagctagtttc

SEQ ID NO: 710980 - DNA, 25 bp, Mus musculus
ggctgaggtgatcggcaaacattat

SEQ ID NO: 710981 - DNA, 25 bp, Mus musculus
ggctgaggtgatgggcaaacattat

SEQ ID NO: 710982 - DNA, 25 bp, Mus musculus
ggctgagtaatgaacctctggataa

SEQ ID NO: 710983 - DNA, 25 bp, Mus musculus
ggctgagtaatgtacctctggataa

SEQ ID NO: 710984 - DNA, 25 bp, Mus musculus
ggctgagtatcaaccccatcaatgg

SEQ ID NO: 710985 - DNA, 25 bp, Mus musculus
ggctgagtatcatccccatcaatgg

SEQ ID NO: 710986 - DNA, 25 bp, Mus musculus
ggctgagtcaccctacctggtgcgt

SEQ ID NO: 710987 - DNA, 25 bp, Mus musculus
ggctgagtcaccgtacctggtgcgt

SEQ ID NO: 710988 - DNA, 25 bp, Mus musculus
ggctgagtccaaatccccagagatg

SEQ ID NO: 710989 - DNA, 25 bp, Mus musculus
ggctgagtccaattccccagagatg

SEQ ID NO: 710990 - DNA, 25 bp, Mus musculus
ggctgataaacactaaacgctgttc

SEQ ID NO: 710991 - DNA, 25 bp, Mus musculus
ggctgataaacagtaaacgctgttc

SEQ ID NO: 710992 - DNA, 25 bp, Mus musculus
ggctgataaatcactggctactaga

SEQ ID NO: 710993 - DNA, 25 bp, Mus musculus
ggctgataaatctctggctactaga

SEQ ID NO: 710994 - DNA, 25 bp, Mus musculus
ggctgatatctacctacagacatag

SEQ ID NO: 710995 - DNA, 25 bp, Mus musculus
ggctgatatctagctacagacatag

SEQ ID NO: 710996 - DNA, 25 bp, Mus musculus
ggctgatctcaaaaagcaggccaca

SEQ ID NO: 710997 - DNA, 25 bp, Mus musculus
ggctgatctcaataagcaggccaca

SEQ ID NO: 710998 - DNA, 25 bp, Mus musculus
ggctgatgaaggatcagtgatacac

SEQ ID NO: 710999 - DNA, 25 bp, Mus musculus
ggctgatgaaggttcagtgatacac

SEQ ID NO: 711000 - DNA, 25 bp, Mus musculus
ggctgatgacctatgttggtgctgt

SEQ ID NO: 711001 - DNA, 25 bp, Mus musculus
ggctgatgacctttgttggtgctgt

SEQ ID NO: 711002 - DNA, 25 bp, Mus musculus
ggctgatgcccgctctatctacgtt

SEQ ID NO: 711003 - DNA, 25 bp, Mus musculus
ggctgatgcccggtctatctacgtt

SEQ ID NO: 711004 - DNA, 25 bp, Mus musculus
ggctgatggctcaactgtcggcaca

SEQ ID NO: 711005 - DNA, 25 bp, Mus musculus
ggctgatggctctactgtcggcaca

SEQ ID NO: 711006 - DNA, 25 bp, Mus musculus
ggctgatgtgtcagacgcactagct

SEQ ID NO: 711007 - DNA, 25 bp, Mus musculus
ggctgatgtgtctgacgcactagct

SEQ ID NO: 711008 - DNA, 25 bp, Mus musculus
ggctgattccgaacacattcctgac

SEQ ID NO: 711009 - DNA, 25 bp, Mus musculus
ggctgattccgatcacattcctgac

SEQ ID NO: 711010 - DNA, 25 bp, Mus musculus
ggctgattgcctcccaaaagactat

SEQ ID NO: 711011 - DNA, 25 bp, Mus musculus
ggctgattgcctgccaaaagactat

SEQ ID NO: 711012 - DNA, 25 bp, Mus musculus
ggctgcaaaataaatagactctgaa

SEQ ID NO: 711013 - DNA, 25 bp, Mus musculus
ggctgcaaaatatatagactctgaa

SEQ ID NO: 711014 - DNA, 25 bp, Mus musculus
ggctgcaacataagccgctgggtag

SEQ ID NO: 711015 - DNA, 25 bp, Mus musculus
ggctgcaacatatgccgctgggtag

SEQ ID NO: 711016 - DNA, 25 bp, Mus musculus
ggctgcaactggacgagacctgtgc

SEQ ID NO: 711017 - DNA, 25 bp, Mus musculus
ggctgcaactggtcgagacctgtgc

SEQ ID NO: 711018 - DNA, 25 bp, Mus musculus
ggctgcaagaccctatgtcctgata

SEQ ID NO: 711019 - DNA, 25 bp, Mus musculus
ggctgcaagaccgtatgtcctgata

SEQ ID NO: 711020 - DNA, 25 bp, Mus musculus
ggctgcaatgccatatgggagctgc

SEQ ID NO: 711021 - DNA, 25 bp, Mus musculus
ggctgcaatgccttatgggagctgc

SEQ ID NO: 711022 - DNA, 25 bp, Mus musculus
ggctgcacaaagcaattcctcacac

SEQ ID NO: 711023 - DNA, 25 bp, Mus musculus
ggctgcacaaaggaattcctcacac

SEQ ID NO: 711024 - DNA, 25 bp, Mus musculus
ggctgcaccaaaatcaccaacttca

SEQ ID NO: 711025 - DNA, 25 bp, Mus musculus
ggctgcaccaaattcaccaacttca

SEQ ID NO: 711026 - DNA, 25 bp, Mus musculus
ggctgcaccgctacctgcgtgactt

SEQ ID NO: 711027 - DNA, 25 bp, Mus musculus
ggctgcaccgcttcctgcgtgactt

SEQ ID NO: 711028 - DNA, 25 bp, Mus musculus
ggctgcacgctgcacaacagcttaa

SEQ ID NO: 711029 - DNA, 25 bp, Mus musculus
ggctgcacgctggacaacagcttaa

SEQ ID NO: 711030 - DNA, 25 bp, Mus musculus
ggctgcagaagcaaataaaaatgca

SEQ ID NO: 711031 - DNA, 25 bp, Mus musculus
ggctgcagaagctaataaaaatgca

SEQ ID NO: 711032 - DNA, 25 bp, Mus musculus
ggctgcagacagcagcatctctcca

SEQ ID NO: 711033 - DNA, 25 bp, Mus musculus
ggctgcagacaggagcatctctcca

SEQ ID NO: 711034 - DNA, 25 bp, Mus musculus
ggctgcagcagcattaccattctgt

SEQ ID NO: 711035 - DNA, 25 bp, Mus musculus
ggctgcagcagctttaccattctgt

SEQ ID NO: 711036 - DNA, 25 bp, Mus musculus
ggctgcagcagtatcacaaccactg

SEQ ID NO: 711037 - DNA, 25 bp, Mus musculus
ggctgcagcagtttcacaaccactg

SEQ ID NO: 711038 - DNA, 25 bp, Mus musculus
ggctgcagcccacattcatcgttac

SEQ ID NO: 711039 - DNA, 25 bp, Mus musculus
ggctgcagcccagattcatcgttac

SEQ ID NO: 711040 - DNA, 25 bp, Mus musculus
ggctgcagccggcaggcatttatct

SEQ ID NO: 711041 - DNA, 25 bp, Mus musculus
ggctgcagccgggaggcatttatct

SEQ ID NO: 711042 - DNA, 25 bp, Mus musculus
ggctgcagcctacaatctgctccaa

SEQ ID NO: 711043 - DNA, 25 bp, Mus musculus
ggctgcagcctagaatctgctccaa

SEQ ID NO: 711044 - DNA, 25 bp, Mus musculus
ggctgcagcgatacctgcccggttg

SEQ ID NO: 711045 - DNA, 25 bp, Mus musculus
ggctgcagcgattcctgcccggttg

SEQ ID NO: 711046 - DNA, 25 bp, Mus musculus
ggctgcagcgtcagcaaacggagca

SEQ ID NO: 711047 - DNA, 25 bp, Mus musculus
ggctgcagcgtctgcaaacggagca

SEQ ID NO: 711048 - DNA, 25 bp, Mus musculus
ggctgcagcttcatatgatcagttg

SEQ ID NO: 711049 - DNA, 25 bp, Mus musculus
ggctgcagcttcttatgatcagttg

SEQ ID NO: 711050 - DNA, 25 bp, Mus musculus
ggctgcaggagaaagatcgctacgc

SEQ ID NO: 711051 - DNA, 25 bp, Mus musculus
ggctgcaggagatagatcgctacgc

SEQ ID NO: 711052 - DNA, 25 bp, Mus musculus
ggctgcaggagtacggtgtccctca

SEQ ID NO: 711053 - DNA, 25 bp, Mus musculus
ggctgcaggagttcggtgtccctca

SEQ ID NO: 711054 - DNA, 25 bp, Mus musculus
ggctgcaggatgagctgcgtcccac

SEQ ID NO: 711055 - DNA, 25 bp, Mus musculus
ggctgcaggatgtgctgcgtcccac

SEQ ID NO: 711056 - DNA, 25 bp, Mus musculus
ggctgcaggcagagattgacacctt

SEQ ID NO: 711057 - DNA, 25 bp, Mus musculus
ggctgcaggcagtgattgacacctt

SEQ ID NO: 711058 - DNA, 25 bp, Mus musculus
ggctgcaggccactgtcactgtcac

SEQ ID NO: 711059 - DNA, 25 bp, Mus musculus
ggctgcaggccagtgtcactgtcac

SEQ ID NO: 711060 - DNA, 25 bp, Mus musculus
ggctgcagtctgaccaggccaccat

SEQ ID NO: 711061 - DNA, 25 bp, Mus musculus
ggctgcagtctgtccaggccaccat

SEQ ID NO: 711062 - DNA, 25 bp, Mus musculus
ggctgcatacttaccatcgagctaa

SEQ ID NO: 711063 - DNA, 25 bp, Mus musculus
ggctgcatactttccatcgagctaa

SEQ ID NO: 711064 - DNA, 25 bp, Mus musculus
ggctgcatgagccaagttcctgaga

SEQ ID NO: 711065 - DNA, 25 bp, Mus musculus
ggctgcatgagcgaagttcctgaga

SEQ ID NO: 711066 - DNA, 25 bp, Mus musculus
ggctgcatgctgcatggcccgctct

SEQ ID NO: 711067 - DNA, 25 bp, Mus musculus
ggctgcatgctggatggcccgctct

SEQ ID NO: 711068 - DNA, 25 bp, Mus musculus
ggctgcattgcccttcgcttggaga

SEQ ID NO: 711069 - DNA, 25 bp, Mus musculus
ggctgcattgccgttcgcttggaga

SEQ ID NO: 711070 - DNA, 25 bp, Mus musculus
ggctgccaaaatcatcaagggatac

SEQ ID NO: 711071 - DNA, 25 bp, Mus musculus
ggctgccaaaatgatcaagggatac

SEQ ID NO: 711072 - DNA, 25 bp, Mus musculus
ggctgccaaagcctcccctgtgttc

SEQ ID NO: 711073 - DNA, 25 bp, Mus musculus
ggctgccaaagcgtcccctgtgttc

SEQ ID NO: 711074 - DNA, 25 bp, Mus musculus
ggctgccaacacctgtgtgtcaacg

SEQ ID NO: 711075 - DNA, 25 bp, Mus musculus
ggctgccaacacgtgtgtgtcaacg

SEQ ID NO: 711076 - DNA, 25 bp, Mus musculus
ggctgccaagaacaacgtctccatc

SEQ ID NO: 711077 - DNA, 25 bp, Mus musculus
ggctgccaagaagaacgtctccatc

SEQ ID NO: 711078 - DNA, 25 bp, Mus musculus
ggctgccaagtaacaccggagggtt

SEQ ID NO: 711079 - DNA, 25 bp, Mus musculus
ggctgccaagtatcaccggagggtt

SEQ ID NO: 711080 - DNA, 25 bp, Mus musculus
ggctgccactcgatatgaacccgtg

SEQ ID NO: 711081 - DNA, 25 bp, Mus musculus
ggctgccactcgttatgaacccgtg

SEQ ID NO: 711082 - DNA, 25 bp, Mus musculus
ggctgccactgaaaccaatggagat

SEQ ID NO: 711083 - DNA, 25 bp, Mus musculus
ggctgccactgataccaatggagat

SEQ ID NO: 711084 - DNA, 25 bp, Mus musculus
ggctgccagaaacgtgttggtaaca

SEQ ID NO: 711085 - DNA, 25 bp, Mus musculus
ggctgccagaaaggtgttggtaaca

SEQ ID NO: 711086 - DNA, 25 bp, Mus musculus
ggctgccagaggctttgtcactgct

SEQ ID NO: 711087 - DNA, 25 bp, Mus musculus
ggctgccagagggtttgtcactgct

SEQ ID NO: 711088 - DNA, 25 bp, Mus musculus
ggctgccagccacctataccagaga

SEQ ID NO: 711089 - DNA, 25 bp, Mus musculus
ggctgccagccagctataccagaga

SEQ ID NO: 711090 - DNA, 25 bp, Mus musculus
ggctgccatcgcatcccatgagggt

SEQ ID NO: 711091 - DNA, 25 bp, Mus musculus
ggctgccatcgcttcccatgagggt

SEQ ID NO: 711092 - DNA, 25 bp, Mus musculus
ggctgccatggtaaggtctcccgct

SEQ ID NO: 711093 - DNA, 25 bp, Mus musculus
ggctgccatggttaggtctcccgct

SEQ ID NO: 711094 - DNA, 25 bp, Mus musculus
ggctgcccaagcagaaccggcggct

SEQ ID NO: 711095 - DNA, 25 bp, Mus musculus
ggctgcccaagctgaaccggcggct

SEQ ID NO: 711096 - DNA, 25 bp, Mus musculus
ggctgcccaccaaaatatgccaaga

SEQ ID NO: 711097 - DNA, 25 bp, Mus musculus
ggctgcccaccataatatgccaaga

SEQ ID NO: 711098 - DNA, 25 bp, Mus musculus
ggctgcccgaccactgagaagtagg

SEQ ID NO: 711099 - DNA, 25 bp, Mus musculus
ggctgcccgacctctgagaagtagg

SEQ ID NO: 711100 - DNA, 25 bp, Mus musculus
ggctgcccgacgagagcagcgctac

SEQ ID NO: 711101 - DNA, 25 bp, Mus musculus
ggctgcccgacgtgagcagcgctac

SEQ ID NO: 711102 - DNA, 25 bp, Mus musculus
ggctgcccgctaagcgcaaaagaag

SEQ ID NO: 711103 - DNA, 25 bp, Mus musculus
ggctgcccgctatgcgcaaaagaag

SEQ ID NO: 711104 - DNA, 25 bp, Mus musculus
ggctgcccgcttagagcttccagct

SEQ ID NO: 711105 - DNA, 25 bp, Mus musculus
ggctgcccgctttgagcttccagct

SEQ ID NO: 711106 - DNA, 25 bp, Mus musculus
ggctgccctccccaacatatatgag

SEQ ID NO: 711107 - DNA, 25 bp, Mus musculus
ggctgccctcccgaacatatatgag

SEQ ID NO: 711108 - DNA, 25 bp, Mus musculus
ggctgccctggcataccatgcgggc

SEQ ID NO: 711109 - DNA, 25 bp, Mus musculus
ggctgccctggcttaccatgcgggc

SEQ ID NO: 711110 - DNA, 25 bp, Mus musculus
ggctgcccttgtcccaatgagcctt

SEQ ID NO: 711111 - DNA, 25 bp, Mus musculus
ggctgcccttgtgccaatgagcctt

SEQ ID NO: 711112 - DNA, 25 bp, Mus musculus
ggctgccgacgcagtcaacaaaatg

SEQ ID NO: 711113 - DNA, 25 bp, Mus musculus
ggctgccgacgctgtcaacaaaatg

SEQ ID NO: 711114 - DNA, 25 bp, Mus musculus
ggctgccgccacattgattaatctg

SEQ ID NO: 711115 - DNA, 25 bp, Mus musculus
ggctgccgccactttgattaatctg

SEQ ID NO: 711116 - DNA, 25 bp, Mus musculus
ggctgccggcttagaggaacacaag

SEQ ID NO: 711117 - DNA, 25 bp, Mus musculus
ggctgccggctttgaggaacacaag

SEQ ID NO: 711118 - DNA, 25 bp, Mus musculus
ggctgccggtgtcaggaccctttct

SEQ ID NO: 711119 - DNA, 25 bp, Mus musculus
ggctgccggtgtgaggaccctttct

SEQ ID NO: 711120 - DNA, 25 bp, Mus musculus
ggctgcctgggcaaatcagtgtcat

SEQ ID NO: 711121 - DNA, 25 bp, Mus musculus
ggctgcctgggctaatcagtgtcat

SEQ ID NO: 711122 - DNA, 25 bp, Mus musculus
ggctgccttcacactcattggactg

SEQ ID NO: 711123 - DNA, 25 bp, Mus musculus
ggctgccttcactctcattggactg

SEQ ID NO: 711124 - DNA, 25 bp, Mus musculus
ggctgccttcctaggtgctcttgcg

SEQ ID NO: 711125 - DNA, 25 bp, Mus musculus
ggctgccttccttggtgctcttgcg

SEQ ID NO: 711126 - DNA, 25 bp, Mus musculus
ggctgccttctcctgaggctgtaca

SEQ ID NO: 711127 - DNA, 25 bp, Mus musculus
ggctgccttctcgtgaggctgtaca

SEQ ID NO: 711128 - DNA, 25 bp, Mus musculus
ggctgcgaccgcacctgtaaggaca

SEQ ID NO: 711129 - DNA, 25 bp, Mus musculus
ggctgcgaccgctcctgtaaggaca

SEQ ID NO: 711130 - DNA, 25 bp, Mus musculus
ggctgcgactagatgttccccgaga

SEQ ID NO: 711131 - DNA, 25 bp, Mus musculus
ggctgcgactagttgttccccgaga

SEQ ID NO: 711132 - DNA, 25 bp, Mus musculus
ggctgcgactgcaccgtgtgaatct

SEQ ID NO: 711133 - DNA, 25 bp, Mus musculus
ggctgcgactgctccgtgtgaatct

SEQ ID NO: 711134 - DNA, 25 bp, Mus musculus
ggctgcgagaaaacatcctcttcca

SEQ ID NO: 711135 - DNA, 25 bp, Mus musculus
ggctgcgagaaatcatcctcttcca

SEQ ID NO: 711136 - DNA, 25 bp, Mus musculus
ggctgcgcgcgcactgggacttctg

SEQ ID NO: 711137 - DNA, 25 bp, Mus musculus
ggctgcgcgcgctctgggacttctg

SEQ ID NO: 711138 - DNA, 25 bp, Mus musculus
ggctgcgctccaacagaaggaactt

SEQ ID NO: 711139 - DNA, 25 bp, Mus musculus
ggctgcgctccatcagaaggaactt

SEQ ID NO: 711140 - DNA, 25 bp, Mus musculus
ggctgcggcacaagggcaaatagct

SEQ ID NO: 711141 - DNA, 25 bp, Mus musculus
ggctgcggcacatgggcaaatagct

SEQ ID NO: 711142 - DNA, 25 bp, Mus musculus
ggctgcggcttgaactgacctcttg

SEQ ID NO: 711143 - DNA, 25 bp, Mus musculus
ggctgcggcttgtactgacctcttg

SEQ ID NO: 711144 - DNA, 25 bp, Mus musculus
ggctgcgggactcctagtcccacag

SEQ ID NO: 711145 - DNA, 25 bp, Mus musculus
ggctgcgggactgctagtcccacag

SEQ ID NO: 711146 - DNA, 25 bp, Mus musculus
ggctgcgggatgcaccaatgcctct

SEQ ID NO: 711147 - DNA, 25 bp, Mus musculus
ggctgcgggatggaccaatgcctct

SEQ ID NO: 711148 - DNA, 25 bp, Mus musculus
ggctgcggtcccagcggctccttgt

SEQ ID NO: 711149 - DNA, 25 bp, Mus musculus
ggctgcggtccctgcggctccttgt

SEQ ID NO: 711150 - DNA, 25 bp, Mus musculus
ggctgcgtagcacctcgtggcttca

SEQ ID NO: 711151 - DNA, 25 bp, Mus musculus
ggctgcgtagcagctcgtggcttca

SEQ ID NO: 711152 - DNA, 25 bp, Mus musculus
ggctgcgtatgaacgaggcgtcaaa

SEQ ID NO: 711153 - DNA, 25 bp, Mus musculus
ggctgcgtatgatcgaggcgtcaaa

SEQ ID NO: 711154 - DNA, 25 bp, Mus musculus
ggctgctaagacagttgaggaagat

SEQ ID NO: 711155 - DNA, 25 bp, Mus musculus
ggctgctaagactgttgaggaagat

SEQ ID NO: 711156 - DNA, 25 bp, Mus musculus
ggctgctactggaagtttccttgca

SEQ ID NO: 711157 - DNA, 25 bp, Mus musculus
ggctgctactggtagtttccttgca

SEQ ID NO: 711158 - DNA, 25 bp, Mus musculus
ggctgctaggtcagcccctgcctga

SEQ ID NO: 711159 - DNA, 25 bp, Mus musculus
ggctgctaggtctgcccctgcctga

SEQ ID NO: 711160 - DNA, 25 bp, Mus musculus
ggctgctatggtcctgagttccccg

SEQ ID NO: 711161 - DNA, 25 bp, Mus musculus
ggctgctatggtgctgagttccccg

SEQ ID NO: 711162 - DNA, 25 bp, Mus musculus
ggctgctcaccaaacacacgggtac

SEQ ID NO: 711163 - DNA, 25 bp, Mus musculus
ggctgctcaccatacacacgggtac

SEQ ID NO: 711164 - DNA, 25 bp, Mus musculus
ggctgctcagcccagtgatacttaa

SEQ ID NO: 711165 - DNA, 25 bp, Mus musculus
ggctgctcagccgagtgatacttaa

SEQ ID NO: 711166 - DNA, 25 bp, Mus musculus
ggctgctcagctccctgacaaggga

SEQ ID NO: 711167 - DNA, 25 bp, Mus musculus
ggctgctcagctgcctgacaaggga

SEQ ID NO: 711168 - DNA, 25 bp, Mus musculus
ggctgctcatgaaagtgatcttctt

SEQ ID NO: 711169 - DNA, 25 bp, Mus musculus
ggctgctcatgatagtgatcttctt

SEQ ID NO: 711170 - DNA, 25 bp, Mus musculus
ggctgctctccgctggcaaaaacgg

SEQ ID NO: 711171 - DNA, 25 bp, Mus musculus
ggctgctctccggtggcaaaaacgg

SEQ ID NO: 711172 - DNA, 25 bp, Mus musculus
ggctgctctttgaccctccacgagt

SEQ ID NO: 711173 - DNA, 25 bp, Mus musculus
ggctgctctttgtccctccacgagt

SEQ ID NO: 711174 - DNA, 25 bp, Mus musculus
ggctgctgaagacgcgttttcaccg

SEQ ID NO: 711175 - DNA, 25 bp, Mus musculus
ggctgctgaagaggcgttttcaccg

SEQ ID NO: 711176 - DNA, 25 bp, Mus musculus
ggctgctgaattacaccatgaacga

SEQ ID NO: 711177 - DNA, 25 bp, Mus musculus
ggctgctgaatttcaccatgaacga

SEQ ID NO: 711178 - DNA, 25 bp, Mus musculus
ggctgctgaccaacttagctgcaaa

SEQ ID NO: 711179 - DNA, 25 bp, Mus musculus
ggctgctgaccatcttagctgcaaa

SEQ ID NO: 711180 - DNA, 25 bp, Mus musculus
ggctgctgcaagacctcggcgccaa

SEQ ID NO: 711181 - DNA, 25 bp, Mus musculus
ggctgctgcaagtcctcggcgccaa

SEQ ID NO: 711182 - DNA, 25 bp, Mus musculus
ggctgctgccaacctttttgcccag

SEQ ID NO: 711183 - DNA, 25 bp, Mus musculus
ggctgctgccaagctttttgcccag

SEQ ID NO: 711184 - DNA, 25 bp, Mus musculus
ggctgctgccctcactaaaaatggt

SEQ ID NO: 711185 - DNA, 25 bp, Mus musculus
ggctgctgccctgactaaaaatggt

SEQ ID NO: 711186 - DNA, 25 bp, Mus musculus
ggctgctgcgccaggccgcgttctt

SEQ ID NO: 711187 - DNA, 25 bp, Mus musculus
ggctgctgcgcctggccgcgttctt

SEQ ID NO: 711188 - DNA, 25 bp, Mus musculus
ggctgctgctcactctttaaatgta

SEQ ID NO: 711189 - DNA, 25 bp, Mus musculus
ggctgctgctcagtctttaaatgta

SEQ ID NO: 711190 - DNA, 25 bp, Mus musculus
ggctgctgctccacaagtgtttcgg

SEQ ID NO: 711191 - DNA, 25 bp, Mus musculus
ggctgctgctcctcaagtgtttcgg

SEQ ID NO: 711192 - DNA, 25 bp, Mus musculus
ggctgctggcaccagtgttcgactt

SEQ ID NO: 711193 - DNA, 25 bp, Mus musculus
ggctgctggcacgagtgttcgactt

SEQ ID NO: 711194 - DNA, 25 bp, Mus musculus
ggctgctggctcctagaaaccccag

SEQ ID NO: 711195 - DNA, 25 bp, Mus musculus
ggctgctggctcgtagaaaccccag

SEQ ID NO: 711196 - DNA, 25 bp, Mus musculus
ggctgctgggataccatccacgtgg

SEQ ID NO: 711197 - DNA, 25 bp, Mus musculus
ggctgctgggattccatccacgtgg

SEQ ID NO: 711198 - DNA, 25 bp, Mus musculus
ggctgctggtctacttcccgtacga

SEQ ID NO: 711199 - DNA, 25 bp, Mus musculus
ggctgctggtcttcttcccgtacga

SEQ ID NO: 711200 - DNA, 25 bp, Mus musculus
ggctgctgttccactgaacaatcta

SEQ ID NO: 711201 - DNA, 25 bp, Mus musculus
ggctgctgttccagcctagaccata

SEQ ID NO: 711202 - DNA, 25 bp, Mus musculus
ggctgctgttcctctgaacaatcta

SEQ ID NO: 711203 - DNA, 25 bp, Mus musculus
ggctgctgttcctgcctagaccata

SEQ ID NO: 711204 - DNA, 25 bp, Mus musculus
ggctgcttctcactgtccttcctgg

SEQ ID NO: 711205 - DNA, 25 bp, Mus musculus
ggctgcttctcagtgtccttcctgg

SEQ ID NO: 711206 - DNA, 25 bp, Mus musculus
ggctgctttggacccgcgtgctcca

SEQ ID NO: 711207 - DNA, 25 bp, Mus musculus
ggctgctttggagccgcgtgctcca

SEQ ID NO: 711208 - DNA, 25 bp, Mus musculus
ggctgcttttaccagattctgcttt

SEQ ID NO: 711209 - DNA, 25 bp, Mus musculus
ggctgcttttacgagattctgcttt

SEQ ID NO: 711210 - DNA, 25 bp, Mus musculus
ggctgctttttaatggagatgcaat

SEQ ID NO: 711211 - DNA, 25 bp, Mus musculus
ggctgctttttattggagatgcaat

SEQ ID NO: 711212 - DNA, 25 bp, Mus musculus
ggctggaaaaccacaatggaccctg

SEQ ID NO: 711213 - DNA, 25 bp, Mus musculus
ggctggaaaacctcaatggaccctg

SEQ ID NO: 711214 - DNA, 25 bp, Mus musculus
ggctggaaagaaactgactcacatc

SEQ ID NO: 711215 - DNA, 25 bp, Mus musculus
ggctggaaagaatctgactcacatc

SEQ ID NO: 711216 - DNA, 25 bp, Mus musculus
ggctggaacagaaacagccccgagc

SEQ ID NO: 711217 - DNA, 25 bp, Mus musculus
ggctggaacagatacagccccgagc

SEQ ID NO: 711218 - DNA, 25 bp, Mus musculus
ggctggaacattaacgcttcggtca

SEQ ID NO: 711219 - DNA, 25 bp, Mus musculus
ggctggaacatttacgcttcggtca

SEQ ID NO: 711220 - DNA, 25 bp, Mus musculus
ggctggaacgccatcatcatctgct

SEQ ID NO: 711221 - DNA, 25 bp, Mus musculus
ggctggaacgccttcatcatctgct

SEQ ID NO: 711222 - DNA, 25 bp, Mus musculus
ggctggaactgcctctgcgtacccg

SEQ ID NO: 711223 - DNA, 25 bp, Mus musculus
ggctggaactgcgtctgcgtacccg

SEQ ID NO: 711224 - DNA, 25 bp, Mus musculus
ggctggaagagacctgctgtacctc

SEQ ID NO: 711225 - DNA, 25 bp, Mus musculus
ggctggaagagagctgctgtacctc

SEQ ID NO: 711226 - DNA, 25 bp, Mus musculus
ggctggaagtgaattcagtagtaga

SEQ ID NO: 711227 - DNA, 25 bp, Mus musculus
ggctggaagtgatttcagtagtaga

SEQ ID NO: 711228 - DNA, 25 bp, Mus musculus
ggctggaataggcaatacttgcaat

SEQ ID NO: 711229 - DNA, 25 bp, Mus musculus
ggctggaatagggaatacttgcaat

SEQ ID NO: 711230 - DNA, 25 bp, Mus musculus
ggctggaattccaatttcttctgcc

SEQ ID NO: 711231 - DNA, 25 bp, Mus musculus
ggctggaattccagccgtctggtaa

SEQ ID NO: 711232 - DNA, 25 bp, Mus musculus
ggctggaattcctatttcttctgcc

SEQ ID NO: 711233 - DNA, 25 bp, Mus musculus
ggctggaattcctgccgtctggtaa

SEQ ID NO: 711234 - DNA, 25 bp, Mus musculus
ggctggacaaatcatgagaataaaa

SEQ ID NO: 711235 - DNA, 25 bp, Mus musculus
ggctggacaaatgatgagaataaaa

SEQ ID NO: 711236 - DNA, 25 bp, Mus musculus
ggctggacaactacaggagctataa

SEQ ID NO: 711237 - DNA, 25 bp, Mus musculus
ggctggacaacttcaggagctataa

SEQ ID NO: 711238 - DNA, 25 bp, Mus musculus
ggctggacacagcagagaaatccga

SEQ ID NO: 711239 - DNA, 25 bp, Mus musculus
ggctggacacaggagagaaatccga

SEQ ID NO: 711240 - DNA, 25 bp, Mus musculus
ggctggacagaaaacatcagctgcc

SEQ ID NO: 711241 - DNA, 25 bp, Mus musculus
ggctggacagaatacatcagctgcc

SEQ ID NO: 711242 - DNA, 25 bp, Mus musculus
ggctggacccctccaaggaaatcaa

SEQ ID NO: 711243 - DNA, 25 bp, Mus musculus
ggctggacccctgcaaggaaatcaa

SEQ ID NO: 711244 - DNA, 25 bp, Mus musculus
ggctggacctgaagatcctccgata

SEQ ID NO: 711245 - DNA, 25 bp, Mus musculus
ggctggacctgatgatcctccgata

SEQ ID NO: 711246 - DNA, 25 bp, Mus musculus
ggctggactgaaaactcaggtccga

SEQ ID NO: 711247 - DNA, 25 bp, Mus musculus
ggctggactgaatactcaggtccga

SEQ ID NO: 711248 - DNA, 25 bp, Mus musculus
ggctggactgcactcttccactgta

SEQ ID NO: 711249 - DNA, 25 bp, Mus musculus
ggctggactgcagtcttccactgta

SEQ ID NO: 711250 - DNA, 25 bp, Mus musculus
ggctggactggtatctgaacacttc

SEQ ID NO: 711251 - DNA, 25 bp, Mus musculus
ggctggactggtttctgaacacttc

SEQ ID NO: 711252 - DNA, 25 bp, Mus musculus
ggctggactgtgagatgaacccaga

SEQ ID NO: 711253 - DNA, 25 bp, Mus musculus
ggctggactgtgtgatgaacccaga

SEQ ID NO: 711254 - DNA, 25 bp, Mus musculus
ggctggacttctagttggagccctg

SEQ ID NO: 711255 - DNA, 25 bp, Mus musculus
ggctggacttcttgttggagccctg

SEQ ID NO: 711256 - DNA, 25 bp, Mus musculus
ggctggactttcaattggacaggac

SEQ ID NO: 711257 - DNA, 25 bp, Mus musculus
ggctggactttctattggacaggac

SEQ ID NO: 711258 - DNA, 25 bp, Mus musculus
ggctggagagacagcatgtaagctc

SEQ ID NO: 711259 - DNA, 25 bp, Mus musculus
ggctggagagactgcatgtaagctc

SEQ ID NO: 711260 - DNA, 25 bp, Mus musculus
ggctggagatggacaaattcccctt

SEQ ID NO: 711261 - DNA, 25 bp, Mus musculus
ggctggagatggtcaaattcccctt

SEQ ID NO: 711262 - DNA, 25 bp, Mus musculus
ggctggagcatgaagtataaatggc

SEQ ID NO: 711263 - DNA, 25 bp, Mus musculus
ggctggagcatgtagtataaatggc

SEQ ID NO: 711264 - DNA, 25 bp, Mus musculus
ggctggagccataatggcacgcatc

SEQ ID NO: 711265 - DNA, 25 bp, Mus musculus
ggctggagccattatggcacgcatc

SEQ ID NO: 711266 - DNA, 25 bp, Mus musculus
ggctggagccggacacagagtatat

SEQ ID NO: 711267 - DNA, 25 bp, Mus musculus
ggctggagccggtcacagagtatat

SEQ ID NO: 711268 - DNA, 25 bp, Mus musculus
ggctggagctccagtggagcctgga

SEQ ID NO: 711269 - DNA, 25 bp, Mus musculus
ggctggagctcctgtggagcctgga

SEQ ID NO: 711270 - DNA, 25 bp, Mus musculus
ggctggagggaacttgtcaatacct

SEQ ID NO: 711271 - DNA, 25 bp, Mus musculus
ggctggagggaagttgtcaatacct

SEQ ID NO: 711272 - DNA, 25 bp, Mus musculus
ggctggagggtcctttcaacattga

SEQ ID NO: 711273 - DNA, 25 bp, Mus musculus
ggctggagggtcgtttcaacattga

SEQ ID NO: 711274 - DNA, 25 bp, Mus musculus
ggctggagtattacaacctggaacg

SEQ ID NO: 711275 - DNA, 25 bp, Mus musculus
ggctggagtatttcaacctggaacg

SEQ ID NO: 711276 - DNA, 25 bp, Mus musculus
ggctggagttataaccgtagcacta

SEQ ID NO: 711277 - DNA, 25 bp, Mus musculus
ggctggagttattaccgtagcacta

SEQ ID NO: 711278 - DNA, 25 bp, Mus musculus
ggctggagttgcactacctcgggat

SEQ ID NO: 711279 - DNA, 25 bp, Mus musculus
ggctggagttgctctacctcgggat

SEQ ID NO: 711280 - DNA, 25 bp, Mus musculus
ggctggagtttaacactcaaacgtc

SEQ ID NO: 711281 - DNA, 25 bp, Mus musculus
ggctggagtttatcactcaaacgtc

SEQ ID NO: 711282 - DNA, 25 bp, Mus musculus
ggctggatcccgcaaaaacccttgc

SEQ ID NO: 711283 - DNA, 25 bp, Mus musculus
ggctggatcccggaaaaacccttgc

SEQ ID NO: 711284 - DNA, 25 bp, Mus musculus
ggctggatccctcttccaagatgta

SEQ ID NO: 711285 - DNA, 25 bp, Mus musculus
ggctggatccctgttccaagatgta

SEQ ID NO: 711286 - DNA, 25 bp, Mus musculus
ggctggatgaagcaaaagactgctc

SEQ ID NO: 711287 - DNA, 25 bp, Mus musculus
ggctggatgaagcagccctccgaaa

SEQ ID NO: 711288 - DNA, 25 bp, Mus musculus
ggctggatgaaggaaaagactgctc

SEQ ID NO: 711289 - DNA, 25 bp, Mus musculus
ggctggatgaaggagccctccgaaa

SEQ ID NO: 711290 - DNA, 25 bp, Mus musculus
ggctggattccaagttgcacatgct

SEQ ID NO: 711291 - DNA, 25 bp, Mus musculus
ggctggattccatgttgcacatgct

SEQ ID NO: 711292 - DNA, 25 bp, Mus musculus
ggctggattcctaccctcgtcacag

SEQ ID NO: 711293 - DNA, 25 bp, Mus musculus
ggctggattccttccctcgtcacag

SEQ ID NO: 711294 - DNA, 25 bp, Mus musculus
ggctggattctcaggtacaccggca

SEQ ID NO: 711295 - DNA, 25 bp, Mus musculus
ggctggattctctggtacaccggca

SEQ ID NO: 711296 - DNA, 25 bp, Mus musculus
ggctggatttttagacagctccagg

SEQ ID NO: 711297 - DNA, 25 bp, Mus musculus
ggctggattttttgacagctccagg

SEQ ID NO: 711298 - DNA, 25 bp, Mus musculus
ggctggcaatcaaacctacatatac

SEQ ID NO: 711299 - DNA, 25 bp, Mus musculus
ggctggcaatcatacctacatatac

SEQ ID NO: 711300 - DNA, 25 bp, Mus musculus
ggctggcacagcataagtatatcca

SEQ ID NO: 711301 - DNA, 25 bp, Mus musculus
ggctggcacagcttaagtatatcca

SEQ ID NO: 711302 - DNA, 25 bp, Mus musculus
ggctggcacaggcagggagatggag

SEQ ID NO: 711303 - DNA, 25 bp, Mus musculus
ggctggcacagggagggagatggag

SEQ ID NO: 711304 - DNA, 25 bp, Mus musculus
ggctggcaccccagtgactgacaga

SEQ ID NO: 711305 - DNA, 25 bp, Mus musculus
ggctggcacccctgtgactgacaga

SEQ ID NO: 711306 - DNA, 25 bp, Mus musculus
ggctggcacgagcatcccgtgacat

SEQ ID NO: 711307 - DNA, 25 bp, Mus musculus
ggctggcacgaggatcccgtgacat

SEQ ID NO: 711308 - DNA, 25 bp, Mus musculus
ggctggcactcacatcgagaatatc

SEQ ID NO: 711309 - DNA, 25 bp, Mus musculus
ggctggcactcagatcgagaatatc

SEQ ID NO: 711310 - DNA, 25 bp, Mus musculus
ggctggcactttaggacctgggtca

SEQ ID NO: 711311 - DNA, 25 bp, Mus musculus
ggctggcacttttggacctgggtca

SEQ ID NO: 711312 - DNA, 25 bp, Mus musculus
ggctggcatatgaatagtccactgc

SEQ ID NO: 711313 - DNA, 25 bp, Mus musculus
ggctggcatatgtatagtccactgc

SEQ ID NO: 711314 - DNA, 25 bp, Mus musculus
ggctggcatcatctacatcattatc

SEQ ID NO: 711315 - DNA, 25 bp, Mus musculus
ggctggcatcatgtacatcattatc

SEQ ID NO: 711316 - DNA, 25 bp, Mus musculus
ggctggcatcctagcttacacagag

SEQ ID NO: 711317 - DNA, 25 bp, Mus musculus
ggctggcatccttgcttacacagag

SEQ ID NO: 711318 - DNA, 25 bp, Mus musculus
ggctggcatttcacatttggctggc

SEQ ID NO: 711319 - DNA, 25 bp, Mus musculus
ggctggcatttctcatttggctggc

SEQ ID NO: 711320 - DNA, 25 bp, Mus musculus
ggctggccctcaagaagcaagattc

SEQ ID NO: 711321 - DNA, 25 bp, Mus musculus
ggctggccctcatgaagcaagattc

SEQ ID NO: 711322 - DNA, 25 bp, Mus musculus
ggctggccctgaacatgacaagttc

SEQ ID NO: 711323 - DNA, 25 bp, Mus musculus
ggctggccctgatcatgacaagttc

SEQ ID NO: 711324 - DNA, 25 bp, Mus musculus
ggctggcctacaagtcacggtataa

SEQ ID NO: 711325 - DNA, 25 bp, Mus musculus
ggctggcctacatgtcacggtataa

SEQ ID NO: 711326 - DNA, 25 bp, Mus musculus
ggctggcctggcaccttctatgagt

SEQ ID NO: 711327 - DNA, 25 bp, Mus musculus
ggctggcctggctccttctatgagt

SEQ ID NO: 711328 - DNA, 25 bp, Mus musculus
ggctggccttaaccttccgtgtgag

SEQ ID NO: 711329 - DNA, 25 bp, Mus musculus
ggctggccttaagcttccgtgtgag

SEQ ID NO: 711330 - DNA, 25 bp, Mus musculus
ggctggcggcacagatgtacacaga

SEQ ID NO: 711331 - DNA, 25 bp, Mus musculus
ggctggcggcactgatgtacacaga

SEQ ID NO: 711332 - DNA, 25 bp, Mus musculus
ggctggcgggaaacgcttcaccctg

SEQ ID NO: 711333 - DNA, 25 bp, Mus musculus
ggctggcgggaatcgcttcaccctg

SEQ ID NO: 711334 - DNA, 25 bp, Mus musculus
ggctggctacctcgcgcttttgaca

SEQ ID NO: 711335 - DNA, 25 bp, Mus musculus
ggctggctacctggcgcttttgaca

SEQ ID NO: 711336 - DNA, 25 bp, Mus musculus
ggctggctatcaacaccataccctg

SEQ ID NO: 711337 - DNA, 25 bp, Mus musculus
ggctggctatcatcaccataccctg

SEQ ID NO: 711338 - DNA, 25 bp, Mus musculus
ggctggctatccctactctaacgtg

SEQ ID NO: 711339 - DNA, 25 bp, Mus musculus
ggctggctatccgtactctaacgtg

SEQ ID NO: 711340 - DNA, 25 bp, Mus musculus
ggctggctccatcctagcaagagaa

SEQ ID NO: 711341 - DNA, 25 bp, Mus musculus
ggctggctccatgctagcaagagaa

SEQ ID NO: 711342 - DNA, 25 bp, Mus musculus
ggctggctcccacggaaaatatgct

SEQ ID NO: 711343 - DNA, 25 bp, Mus musculus
ggctggctcccagggaaaatatgct

SEQ ID NO: 711344 - DNA, 25 bp, Mus musculus
ggctggctccgaacacattgacaac

SEQ ID NO: 711345 - DNA, 25 bp, Mus musculus
ggctggctccgatcacattgacaac

SEQ ID NO: 711346 - DNA, 25 bp, Mus musculus
ggctggctcgaactcagatccacag

SEQ ID NO: 711347 - DNA, 25 bp, Mus musculus
ggctggctcgaagtcagatccacag

SEQ ID NO: 711348 - DNA, 25 bp, Mus musculus
ggctggctcggcacactgatgatga

SEQ ID NO: 711349 - DNA, 25 bp, Mus musculus
ggctggctcggctcactgatgatga

SEQ ID NO: 711350 - DNA, 25 bp, Mus musculus
ggctggctgaataattgaattgtgg

SEQ ID NO: 711351 - DNA, 25 bp, Mus musculus
ggctggctgaattattgaattgtgg

SEQ ID NO: 711352 - DNA, 25 bp, Mus musculus
ggctggctgcatagggaacgtttca

SEQ ID NO: 711353 - DNA, 25 bp, Mus musculus
ggctggctgcattgggaacgtttca

SEQ ID NO: 711354 - DNA, 25 bp, Mus musculus
ggctggctggacctgatgatcctcc

SEQ ID NO: 711355 - DNA, 25 bp, Mus musculus
ggctggctggacgtgatgatcctcc

SEQ ID NO: 711356 - DNA, 25 bp, Mus musculus
ggctggctgtgaagggctcccttac

SEQ ID NO: 711357 - DNA, 25 bp, Mus musculus
ggctggctgtgatgggctcccttac

SEQ ID NO: 711358 - DNA, 25 bp, Mus musculus
ggctggcttcggcaaattaatcaca

SEQ ID NO: 711359 - DNA, 25 bp, Mus musculus
ggctggcttcgggaaattaatcaca

SEQ ID NO: 711360 - DNA, 25 bp, Mus musculus
ggctgggaacgtccacacggacttc

SEQ ID NO: 711361 - DNA, 25 bp, Mus musculus
ggctgggaacgtgcacacggacttc

SEQ ID NO: 711362 - DNA, 25 bp, Mus musculus
ggctgggaccaaagaggacctctac

SEQ ID NO: 711363 - DNA, 25 bp, Mus musculus
ggctgggaccaatgaggacctctac

SEQ ID NO: 711364 - DNA, 25 bp, Mus musculus
ggctgggagctcaccgtgtacagtt

SEQ ID NO: 711365 - DNA, 25 bp, Mus musculus
ggctgggagctctccgtgtacagtt

SEQ ID NO: 711366 - DNA, 25 bp, Mus musculus
ggctgggcaatgcttccttcattga

SEQ ID NO: 711367 - DNA, 25 bp, Mus musculus
ggctgggcaatggttccttcattga

SEQ ID NO: 711368 - DNA, 25 bp, Mus musculus
ggctgggcactgaacatgaaggaac

SEQ ID NO: 711369 - DNA, 25 bp, Mus musculus
ggctgggcactgtacatgaaggaac

SEQ ID NO: 711370 - DNA, 25 bp, Mus musculus
ggctgggccagactttatgcgcaca

SEQ ID NO: 711371 - DNA, 25 bp, Mus musculus
ggctgggccagagtttatgcgcaca

SEQ ID NO: 711372 - DNA, 25 bp, Mus musculus
ggctgggcccctccagcgttaagca

SEQ ID NO: 711373 - DNA, 25 bp, Mus musculus
ggctgggcccctgcagcgttaagca

SEQ ID NO: 711374 - DNA, 25 bp, Mus musculus
ggctgggcgccactcaatgtgtcca

SEQ ID NO: 711375 - DNA, 25 bp, Mus musculus
ggctgggcgccagtcaatgtgtcca

SEQ ID NO: 711376 - DNA, 25 bp, Mus musculus
ggctgggctaagagactacgaatga

SEQ ID NO: 711377 - DNA, 25 bp, Mus musculus
ggctgggctaagtgactacgaatga

SEQ ID NO: 711378 - DNA, 25 bp, Mus musculus
ggctgggcttcgatacacgagtgac

SEQ ID NO: 711379 - DNA, 25 bp, Mus musculus
ggctgggcttcgttacacgagtgac

SEQ ID NO: 711380 - DNA, 25 bp, Mus musculus
ggctggggcctcatgtcttcagagc

SEQ ID NO: 711381 - DNA, 25 bp, Mus musculus
ggctggggcctcttgtcttcagagc

SEQ ID NO: 711382 - DNA, 25 bp, Mus musculus
ggctgggtacctatggaaacaatga

SEQ ID NO: 711383 - DNA, 25 bp, Mus musculus
ggctgggtacctttggaaacaatga

SEQ ID NO: 711384 - DNA, 25 bp, Mus musculus
ggctgggtatctccaggacttagtc

SEQ ID NO: 711385 - DNA, 25 bp, Mus musculus
ggctgggtatctgcaggacttagtc

SEQ ID NO: 711386 - DNA, 25 bp, Mus musculus
ggctgggtcagccactacaactgga

SEQ ID NO: 711387 - DNA, 25 bp, Mus musculus
ggctgggtcagcgactacaactgga

SEQ ID NO: 711388 - DNA, 25 bp, Mus musculus
ggctgggtcttcatctgcatgattc

SEQ ID NO: 711389 - DNA, 25 bp, Mus musculus
ggctgggtcttcttctgcatgattc

SEQ ID NO: 711390 - DNA, 25 bp, Mus musculus
ggctgggtgagcacgcagccaggag

SEQ ID NO: 711391 - DNA, 25 bp, Mus musculus
ggctgggtgagctcgcagccaggag

SEQ ID NO: 711392 - DNA, 25 bp, Mus musculus
ggctgggttgctccagttcctccgc

SEQ ID NO: 711393 - DNA, 25 bp, Mus musculus
ggctgggttgctgcagttcctccgc

SEQ ID NO: 711394 - DNA, 25 bp, Mus musculus
ggctgggttgtaaatcattatctga

SEQ ID NO: 711395 - DNA, 25 bp, Mus musculus
ggctgggttgtatatcattatctga

SEQ ID NO: 711396 - DNA, 25 bp, Mus musculus
ggctggtacaaacttttagaccact

SEQ ID NO: 711397 - DNA, 25 bp, Mus musculus
ggctggtacaaagttttagaccact

SEQ ID NO: 711398 - DNA, 25 bp, Mus musculus
ggctggtacatcctcttcagctgca

SEQ ID NO: 711399 - DNA, 25 bp, Mus musculus
ggctggtacatcgtcttcagctgca

SEQ ID NO: 711400 - DNA, 25 bp, Mus musculus
ggctggtactggatcctatcatcat

SEQ ID NO: 711401 - DNA, 25 bp, Mus musculus
ggctggtactggttcctatcatcat

SEQ ID NO: 711402 - DNA, 25 bp, Mus musculus
ggctggtcatgaactcggatatact

SEQ ID NO: 711403 - DNA, 25 bp, Mus musculus
ggctggtcatgatctcggatatact

SEQ ID NO: 711404 - DNA, 25 bp, Mus musculus
ggctggtccttcaggtatgcttgga

SEQ ID NO: 711405 - DNA, 25 bp, Mus musculus
ggctggtccttctggtatgcttgga

SEQ ID NO: 711406 - DNA, 25 bp, Mus musculus
ggctggtgagcacagccaagccaaa

SEQ ID NO: 711407 - DNA, 25 bp, Mus musculus
ggctggtgagcagagccaagccaaa

SEQ ID NO: 711408 - DNA, 25 bp, Mus musculus
ggctggtgcagacagacacttcgct

SEQ ID NO: 711409 - DNA, 25 bp, Mus musculus
ggctggtgcagagagacacttcgct

SEQ ID NO: 711410 - DNA, 25 bp, Mus musculus
ggctggtgcccaatcctgaccagaa

SEQ ID NO: 711411 - DNA, 25 bp, Mus musculus
ggctggtgcccattcctgaccagaa

SEQ ID NO: 711412 - DNA, 25 bp, Mus musculus
ggctggtgctttccgctccgtttct

SEQ ID NO: 711413 - DNA, 25 bp, Mus musculus
ggctggtgctttgcgctccgtttct

SEQ ID NO: 711414 - DNA, 25 bp, Mus musculus
ggctggtgtgttcgcctcccgctct

SEQ ID NO: 711415 - DNA, 25 bp, Mus musculus
ggctggtgtgttggcctcccgctct

SEQ ID NO: 711416 - DNA, 25 bp, Mus musculus
ggctggttaaacaatctactgcggc

SEQ ID NO: 711417 - DNA, 25 bp, Mus musculus
ggctggttaaactatctactgcggc

SEQ ID NO: 711418 - DNA, 25 bp, Mus musculus
ggctgtaaatgtacctcctgaagat

SEQ ID NO: 711419 - DNA, 25 bp, Mus musculus
ggctgtaaatgttcctcctgaagat

SEQ ID NO: 711420 - DNA, 25 bp, Mus musculus
ggctgtaagctcacaaagggatgtt

SEQ ID NO: 711421 - DNA, 25 bp, Mus musculus
ggctgtaagctctcaaagggatgtt

SEQ ID NO: 711422 - DNA, 25 bp, Mus musculus
ggctgtaagtccatcaccactgagg

SEQ ID NO: 711423 - DNA, 25 bp, Mus musculus
ggctgtaagtccttcaccactgagg

SEQ ID NO: 711424 - DNA, 25 bp, Mus musculus
ggctgtaccgcaacagtgggaacct

SEQ ID NO: 711425 - DNA, 25 bp, Mus musculus
ggctgtaccgcatcagtgggaacct

SEQ ID NO: 711426 - DNA, 25 bp, Mus musculus
ggctgtaccgctcagccaagacagg

SEQ ID NO: 711427 - DNA, 25 bp, Mus musculus
ggctgtaccgctgagccaagacagg

SEQ ID NO: 711428 - DNA, 25 bp, Mus musculus
ggctgtacctccatggattgaatac

SEQ ID NO: 711429 - DNA, 25 bp, Mus musculus
ggctgtacctccttggattgaatac

SEQ ID NO: 711430 - DNA, 25 bp, Mus musculus
ggctgtactctactgcttcctgaat

SEQ ID NO: 711431 - DNA, 25 bp, Mus musculus
ggctgtactctagtgcttcctgaat

SEQ ID NO: 711432 - DNA, 25 bp, Mus musculus
ggctgtagacacctggacacagctg

SEQ ID NO: 711433 - DNA, 25 bp, Mus musculus
ggctgtagacacgtggacacagctg

SEQ ID NO: 711434 - DNA, 25 bp, Mus musculus
ggctgtaggataaagataccagatc

SEQ ID NO: 711435 - DNA, 25 bp, Mus musculus
ggctgtaggatatagataccagatc

SEQ ID NO: 711436 - DNA, 25 bp, Mus musculus
ggctgtagttccacagggtgctgta

SEQ ID NO: 711437 - DNA, 25 bp, Mus musculus
ggctgtagttcctcagggtgctgta

SEQ ID NO: 711438 - DNA, 25 bp, Mus musculus
ggctgtatcttccttgagatgatcc

SEQ ID NO: 711439 - DNA, 25 bp, Mus musculus
ggctgtatcttcgttgagatgatcc

SEQ ID NO: 711440 - DNA, 25 bp, Mus musculus
ggctgtatgcacacactgccctggc

SEQ ID NO: 711441 - DNA, 25 bp, Mus musculus
ggctgtatgcactcactgccctggc

SEQ ID NO: 711442 - DNA, 25 bp, Mus musculus
ggctgtatgctcaacccacctctga

SEQ ID NO: 711443 - DNA, 25 bp, Mus musculus
ggctgtatgctctacccacctctga

SEQ ID NO: 711444 - DNA, 25 bp, Mus musculus
ggctgtattaagaccttcagatatt

SEQ ID NO: 711445 - DNA, 25 bp, Mus musculus
ggctgtattaagtccttcagatatt

SEQ ID NO: 711446 - DNA, 25 bp, Mus musculus
ggctgtcagactacaacaagggttg

SEQ ID NO: 711447 - DNA, 25 bp, Mus musculus
ggctgtcagacttcaacaagggttg

SEQ ID NO: 711448 - DNA, 25 bp, Mus musculus
ggctgtcagccaagtaccacgaagt

SEQ ID NO: 711449 - DNA, 25 bp, Mus musculus
ggctgtcagccatgtaccacgaagt

SEQ ID NO: 711450 - DNA, 25 bp, Mus musculus
ggctgtcagcccacttattggattg

SEQ ID NO: 711451 - DNA, 25 bp, Mus musculus
ggctgtcagccctcttattggattg

SEQ ID NO: 711452 - DNA, 25 bp, Mus musculus
ggctgtcatcacagaggactctgac

SEQ ID NO: 711453 - DNA, 25 bp, Mus musculus
ggctgtcatcactgaggactctgac

SEQ ID NO: 711454 - DNA, 25 bp, Mus musculus
ggctgtcatcgccactgaattgaag

SEQ ID NO: 711455 - DNA, 25 bp, Mus musculus
ggctgtcatcgcgactgaattgaag

SEQ ID NO: 711456 - DNA, 25 bp, Mus musculus
ggctgtcccagaattagctatgtag

SEQ ID NO: 711457 - DNA, 25 bp, Mus musculus
ggctgtcccagatttagctatgtag

SEQ ID NO: 711458 - DNA, 25 bp, Mus musculus
ggctgtcccgtcactctgggtgtca

SEQ ID NO: 711459 - DNA, 25 bp, Mus musculus
ggctgtcccgtctctctgggtgtca

SEQ ID NO: 711460 - DNA, 25 bp, Mus musculus
ggctgtcctaaaccctgattaccgg

SEQ ID NO: 711461 - DNA, 25 bp, Mus musculus
ggctgtcctaaagcctgattaccgg

SEQ ID NO: 711462 - DNA, 25 bp, Mus musculus
ggctgtcctcggatcctgggtaccg

SEQ ID NO: 711463 - DNA, 25 bp, Mus musculus
ggctgtcctcggttcctgggtaccg

SEQ ID NO: 711464 - DNA, 25 bp, Mus musculus
ggctgtcgaacccttgtatacagag

SEQ ID NO: 711465 - DNA, 25 bp, Mus musculus
ggctgtcgaaccgttgtatacagag

SEQ ID NO: 711466 - DNA, 25 bp, Mus musculus
ggctgtcgacagcaattcgtgcacc

SEQ ID NO: 711467 - DNA, 25 bp, Mus musculus
ggctgtcgacaggaattcgtgcacc

SEQ ID NO: 711468 - DNA, 25 bp, Mus musculus
ggctgtcgcgcacagacttgactga

SEQ ID NO: 711469 - DNA, 25 bp, Mus musculus
ggctgtcgcgcagagacttgactga

SEQ ID NO: 711470 - DNA, 25 bp, Mus musculus
ggctgtcgctggatgcagagactac

SEQ ID NO: 711471 - DNA, 25 bp, Mus musculus
ggctgtcgctggattctccaactgg

SEQ ID NO: 711472 - DNA, 25 bp, Mus musculus
ggctgtcgctggttgcagagactac

SEQ ID NO: 711473 - DNA, 25 bp, Mus musculus
ggctgtcgctggtttctccaactgg

SEQ ID NO: 711474 - DNA, 25 bp, Mus musculus
ggctgtcgcttgcatgcccttcaca

SEQ ID NO: 711475 - DNA, 25 bp, Mus musculus
ggctgtcgcttggatgcccttcaca

SEQ ID NO: 711476 - DNA, 25 bp, Mus musculus
ggctgtctgtctagacccatcgatc

SEQ ID NO: 711477 - DNA, 25 bp, Mus musculus
ggctgtctgtcttgacccatcgatc

SEQ ID NO: 711478 - DNA, 25 bp, Mus musculus
ggctgtctgtgcactccctcagaga

SEQ ID NO: 711479 - DNA, 25 bp, Mus musculus
ggctgtctgtgctctccctcagaga

SEQ ID NO: 711480 - DNA, 25 bp, Mus musculus
ggctgtgaacccagtggaaatgaca

SEQ ID NO: 711481 - DNA, 25 bp, Mus musculus
ggctgtgaaccctgtggaaatgaca

SEQ ID NO: 711482 - DNA, 25 bp, Mus musculus
ggctgtgaactaacttgatttccca

SEQ ID NO: 711483 - DNA, 25 bp, Mus musculus
ggctgtgaactatcttgatttccca

SEQ ID NO: 711484 - DNA, 25 bp, Mus musculus
ggctgtgaagcactacagctcttac

SEQ ID NO: 711485 - DNA, 25 bp, Mus musculus
ggctgtgaagcagtacagctcttac

SEQ ID NO: 711486 - DNA, 25 bp, Mus musculus
ggctgtgaaggtacagtcattccag

SEQ ID NO: 711487 - DNA, 25 bp, Mus musculus
ggctgtgaaggttcagtcattccag

SEQ ID NO: 711488 - DNA, 25 bp, Mus musculus
ggctgtgaattgctcaagaactttg

SEQ ID NO: 711489 - DNA, 25 bp, Mus musculus
ggctgtgaattggtcaagaactttg

SEQ ID NO: 711490 - DNA, 25 bp, Mus musculus
ggctgtgaccatccaggcattgcca

SEQ ID NO: 711491 - DNA, 25 bp, Mus musculus
ggctgtgaccatgcaggcattgcca

SEQ ID NO: 711492 - DNA, 25 bp, Mus musculus
ggctgtgacccgaatgggcatatat

SEQ ID NO: 711493 - DNA, 25 bp, Mus musculus
ggctgtgacccgtatgggcatatat

SEQ ID NO: 711494 - DNA, 25 bp, Mus musculus
ggctgtgacctaaggagcagactca

SEQ ID NO: 711495 - DNA, 25 bp, Mus musculus
ggctgtgacctatggagcagactca

SEQ ID NO: 711496 - DNA, 25 bp, Mus musculus
ggctgtgaccttatgctcctgtgca

SEQ ID NO: 711497 - DNA, 25 bp, Mus musculus
ggctgtgaccttttgctcctgtgca

SEQ ID NO: 711498 - DNA, 25 bp, Mus musculus
ggctgtgactacagccagaatcctg

SEQ ID NO: 711499 - DNA, 25 bp, Mus musculus
ggctgtgactactgccagaatcctg

SEQ ID NO: 711500 - DNA, 25 bp, Mus musculus
ggctgtgactttcggcacctggaca

SEQ ID NO: 711501 - DNA, 25 bp, Mus musculus
ggctgtgactttgggcacctggaca

SEQ ID NO: 711502 - DNA, 25 bp, Mus musculus
ggctgtgatcatctttggagttccc

SEQ ID NO: 711503 - DNA, 25 bp, Mus musculus
ggctgtgatcatgtttggagttccc

SEQ ID NO: 711504 - DNA, 25 bp, Mus musculus
ggctgtgcactcctcttgtgctaaa

SEQ ID NO: 711505 - DNA, 25 bp, Mus musculus
ggctgtgcactcgtcttgtgctaaa

SEQ ID NO: 711506 - DNA, 25 bp, Mus musculus
ggctgtgcagccagttaagtgttca

SEQ ID NO: 711507 - DNA, 25 bp, Mus musculus
ggctgtgcagcctgttaagtgttca

SEQ ID NO: 711508 - DNA, 25 bp, Mus musculus
ggctgtgcctgtacgaagatggcac

SEQ ID NO: 711509 - DNA, 25 bp, Mus musculus
ggctgtgcctgttcgaagatggcac

SEQ ID NO: 711510 - DNA, 25 bp, Mus musculus
ggctgtgcgctacctcctttcaaca

SEQ ID NO: 711511 - DNA, 25 bp, Mus musculus
ggctgtgcgctagctcctttcaaca

SEQ ID NO: 711512 - DNA, 25 bp, Mus musculus
ggctgtgctagccttccagaggtac

SEQ ID NO: 711513 - DNA, 25 bp, Mus musculus
ggctgtgctagcgttccagaggtac

SEQ ID NO: 711514 - DNA, 25 bp, Mus musculus
ggctgtgctgacagactacccatct

SEQ ID NO: 711515 - DNA, 25 bp, Mus musculus
ggctgtgctgactgactacccatct

SEQ ID NO: 711516 - DNA, 25 bp, Mus musculus
ggctgtggagcacgcccactttgcc

SEQ ID NO: 711517 - DNA, 25 bp, Mus musculus
ggctgtggagcaggcccactttgcc

SEQ ID NO: 711518 - DNA, 25 bp, Mus musculus
ggctgtggagcgaacccggaccatc

SEQ ID NO: 711519 - DNA, 25 bp, Mus musculus
ggctgtggagcgtacccggaccatc

SEQ ID NO: 711520 - DNA, 25 bp, Mus musculus
ggctgtggcaatcggacgggcttga

SEQ ID NO: 711521 - DNA, 25 bp, Mus musculus
ggctgtggcaatgggacgggcttga

SEQ ID NO: 711522 - DNA, 25 bp, Mus musculus
ggctgtgggaaaacattaattgcca

SEQ ID NO: 711523 - DNA, 25 bp, Mus musculus
ggctgtgggaaatcattaattgcca

SEQ ID NO: 711524 - DNA, 25 bp, Mus musculus
ggctgtgggacaatggccctgctaa

SEQ ID NO: 711525 - DNA, 25 bp, Mus musculus
ggctgtgggacattggccctgctaa

SEQ ID NO: 711526 - DNA, 25 bp, Mus musculus
ggctgtgggatgagttttgtcccac

SEQ ID NO: 711527 - DNA, 25 bp, Mus musculus
ggctgtgggatgtgttttgtcccac

SEQ ID NO: 711528 - DNA, 25 bp, Mus musculus
ggctgtgggcttccccatgatgatt

SEQ ID NO: 711529 - DNA, 25 bp, Mus musculus
ggctgtgggcttgcccatgatgatt

SEQ ID NO: 711530 - DNA, 25 bp, Mus musculus
ggctgtggtagacctgcttcacccg

SEQ ID NO: 711531 - DNA, 25 bp, Mus musculus
ggctgtggtagagctgcttcacccg

SEQ ID NO: 711532 - DNA, 25 bp, Mus musculus
ggctgtggtcagacgccagagttct

SEQ ID NO: 711533 - DNA, 25 bp, Mus musculus
ggctgtggtcagtcgccagagttct

SEQ ID NO: 711534 - DNA, 25 bp, Mus musculus
ggctgtggtctcagtccgctttcag

SEQ ID NO: 711535 - DNA, 25 bp, Mus musculus
ggctgtggtctctgtccgctttcag

SEQ ID NO: 711536 - DNA, 25 bp, Mus musculus
ggctgtggttctcgtatttgtcatc

SEQ ID NO: 711537 - DNA, 25 bp, Mus musculus
ggctgtggttctggtatttgtcatc

SEQ ID NO: 711538 - DNA, 25 bp, Mus musculus
ggctgtgtatagaaatatacaggcc

SEQ ID NO: 711539 - DNA, 25 bp, Mus musculus
ggctgtgtatagtaatatacaggcc

SEQ ID NO: 711540 - DNA, 25 bp, Mus musculus
ggctgtgtgaccctaggcatatccg

SEQ ID NO: 711541 - DNA, 25 bp, Mus musculus
ggctgtgtgaccgtaggcatatccg

SEQ ID NO: 711542 - DNA, 25 bp, Mus musculus
ggctgtgtgcttaatgccatgatgt

SEQ ID NO: 711543 - DNA, 25 bp, Mus musculus
ggctgtgtgcttcgaacccattcat

SEQ ID NO: 711544 - DNA, 25 bp, Mus musculus
ggctgtgtgcttggaacccattcat

SEQ ID NO: 711545 - DNA, 25 bp, Mus musculus
ggctgtgtgctttatgccatgatgt

SEQ ID NO: 711546 - DNA, 25 bp, Mus musculus
ggctgtgtggtaatccagagaatct

SEQ ID NO: 711547 - DNA, 25 bp, Mus musculus
ggctgtgtggtattccagagaatct

SEQ ID NO: 711548 - DNA, 25 bp, Mus musculus
ggctgtgttcgactaccacaagaag

SEQ ID NO: 711549 - DNA, 25 bp, Mus musculus
ggctgtgttcgagtaccacaagaag

SEQ ID NO: 711550 - DNA, 25 bp, Mus musculus
ggctgttactcacgcccaactgctg

SEQ ID NO: 711551 - DNA, 25 bp, Mus musculus
ggctgttactcaggcccaactgctg

SEQ ID NO: 711552 - DNA, 25 bp, Mus musculus
ggctgttatgatctggtgaccagtt

SEQ ID NO: 711553 - DNA, 25 bp, Mus musculus
ggctgttatgatgtggtgaccagtt

SEQ ID NO: 711554 - DNA, 25 bp, Mus musculus
ggctgttcagtgaccggacatagga

SEQ ID NO: 711555 - DNA, 25 bp, Mus musculus
ggctgttcagtgtccggacatagga

SEQ ID NO: 711556 - DNA, 25 bp, Mus musculus
ggctgttcatcaaacccacggtctt

SEQ ID NO: 711557 - DNA, 25 bp, Mus musculus
ggctgttcatcatacccacggtctt

SEQ ID NO: 711558 - DNA, 25 bp, Mus musculus
ggctgttcatccagcgcctggccga

SEQ ID NO: 711559 - DNA, 25 bp, Mus musculus
ggctgttcatcctgcgcctggccga

SEQ ID NO: 711560 - DNA, 25 bp, Mus musculus
ggctgttcatctacttcaggaacca

SEQ ID NO: 711561 - DNA, 25 bp, Mus musculus
ggctgttcatcttcttcaggaacca

SEQ ID NO: 711562 - DNA, 25 bp, Mus musculus
ggctgttcccaacgacatggagcaa

SEQ ID NO: 711563 - DNA, 25 bp, Mus musculus
ggctgttcccaaggacatggagcaa

SEQ ID NO: 711564 - DNA, 25 bp, Mus musculus
ggctgttccctgaatgcaaacaaaa

SEQ ID NO: 711565 - DNA, 25 bp, Mus musculus
ggctgttccctgtatgcaaacaaaa

SEQ ID NO: 711566 - DNA, 25 bp, Mus musculus
ggctgttcctctcaggttgcctgta

SEQ ID NO: 711567 - DNA, 25 bp, Mus musculus
ggctgttcctctgaggttgcctgta

SEQ ID NO: 711568 - DNA, 25 bp, Mus musculus
ggctgttctaagctgagacttctcc

SEQ ID NO: 711569 - DNA, 25 bp, Mus musculus
ggctgttctaaggtgagacttctcc

SEQ ID NO: 711570 - DNA, 25 bp, Mus musculus
ggctgttctcctcaacctggtgcga

SEQ ID NO: 711571 - DNA, 25 bp, Mus musculus
ggctgttctcctgaacctggtgcga

SEQ ID NO: 711572 - DNA, 25 bp, Mus musculus
ggctgttgtacccattggcggatct

SEQ ID NO: 711573 - DNA, 25 bp, Mus musculus
ggctgttgtaccgattggcggatct

SEQ ID NO: 711574 - DNA, 25 bp, Mus musculus
ggctgttgtgtacactccagggcaa

SEQ ID NO: 711575 - DNA, 25 bp, Mus musculus
ggctgttgtgtagactccagggcaa

SEQ ID NO: 711576 - DNA, 25 bp, Mus musculus
ggctgtttcctcatatccaagccat

SEQ ID NO: 711577 - DNA, 25 bp, Mus musculus
ggctgtttcctcttatccaagccat

SEQ ID NO: 711578 - DNA, 25 bp, Mus musculus
ggctgtttctgacctccctggtaac

SEQ ID NO: 711579 - DNA, 25 bp, Mus musculus
ggctgtttctgagctccctggtaac

SEQ ID NO: 711580 - DNA, 25 bp, Mus musculus
ggctgttttgctagagacctggtta

SEQ ID NO: 711581 - DNA, 25 bp, Mus musculus
ggctgttttgcttgagacctggtta

SEQ ID NO: 711582 - DNA, 25 bp, Mus musculus
ggcttaaaaagcaccgaggttgcca

SEQ ID NO: 711583 - DNA, 25 bp, Mus musculus
ggcttaaaaagctccgaggttgcca

SEQ ID NO: 711584 - DNA, 25 bp, Mus musculus
ggcttaactgctctcataaaatttg

SEQ ID NO: 711585 - DNA, 25 bp, Mus musculus
ggcttaactgctgtcataaaatttg

SEQ ID NO: 711586 - DNA, 25 bp, Mus musculus
ggcttaagagacaaacagttggatc

SEQ ID NO: 711587 - DNA, 25 bp, Mus musculus
ggcttaagagactaacagttggatc

SEQ ID NO: 711588 - DNA, 25 bp, Mus musculus
ggcttaaggtgtcctcattcttgga

SEQ ID NO: 711589 - DNA, 25 bp, Mus musculus
ggcttaaggtgtgctcattcttgga

SEQ ID NO: 711590 - DNA, 25 bp, Mus musculus
ggcttaagtggcaggccgtcctcag

SEQ ID NO: 711591 - DNA, 25 bp, Mus musculus
ggcttaagtggctggccgtcctcag

SEQ ID NO: 711592 - DNA, 25 bp, Mus musculus
ggcttaatgctgaattactgaaggg

SEQ ID NO: 711593 - DNA, 25 bp, Mus musculus
ggcttaatgctgtattactgaaggg

SEQ ID NO: 711594 - DNA, 25 bp, Mus musculus
ggcttaattgtcctacttttggatg

SEQ ID NO: 711595 - DNA, 25 bp, Mus musculus
ggcttaattgtcgtacttttggatg

SEQ ID NO: 711596 - DNA, 25 bp, Mus musculus
ggcttacaaaaacgagctggaggaa

SEQ ID NO: 711597 - DNA, 25 bp, Mus musculus
ggcttacaaaaaggagctggaggaa

SEQ ID NO: 711598 - DNA, 25 bp, Mus musculus
ggcttacataccaagaaactcatca

SEQ ID NO: 711599 - DNA, 25 bp, Mus musculus
ggcttacatacctagaaactcatca

SEQ ID NO: 711600 - DNA, 25 bp, Mus musculus
ggcttacccacacagctcaagagaa

SEQ ID NO: 711601 - DNA, 25 bp, Mus musculus
ggcttacccacagagctcaagagaa

SEQ ID NO: 711602 - DNA, 25 bp, Mus musculus
ggcttaccgcagatttgtgccagca

SEQ ID NO: 711603 - DNA, 25 bp, Mus musculus
ggcttaccgcagttttgtgccagca

SEQ ID NO: 711604 - DNA, 25 bp, Mus musculus
ggcttacctctacgattccttccag

SEQ ID NO: 711605 - DNA, 25 bp, Mus musculus
ggcttacctctaggattccttccag

SEQ ID NO: 711606 - DNA, 25 bp, Mus musculus
ggcttactctcacaaacttacctgg

SEQ ID NO: 711607 - DNA, 25 bp, Mus musculus
ggcttactctcagaaacttacctgg

SEQ ID NO: 711608 - DNA, 25 bp, Mus musculus
ggcttactgagcaggctgatccatc

SEQ ID NO: 711609 - DNA, 25 bp, Mus musculus
ggcttactgagctggctgatccatc

SEQ ID NO: 711610 - DNA, 25 bp, Mus musculus
ggcttacttggtcggtgtactcctg

SEQ ID NO: 711611 - DNA, 25 bp, Mus musculus
ggcttacttggtgggtgtactcctg

SEQ ID NO: 711612 - DNA, 25 bp, Mus musculus
ggcttactttggagtgtcttcagca

SEQ ID NO: 711613 - DNA, 25 bp, Mus musculus
ggcttactttggtgtgtcttcagca

SEQ ID NO: 711614 - DNA, 25 bp, Mus musculus
ggcttactttgtacccatgtccaag

SEQ ID NO: 711615 - DNA, 25 bp, Mus musculus
ggcttactttgttcccatgtccaag

SEQ ID NO: 711616 - DNA, 25 bp, Mus musculus
ggcttagaccttcagttcccacgga

SEQ ID NO: 711617 - DNA, 25 bp, Mus musculus
ggcttagaccttgagttcccacgga

SEQ ID NO: 711618 - DNA, 25 bp, Mus musculus
ggcttagctcgacacattcatcata

SEQ ID NO: 711619 - DNA, 25 bp, Mus musculus
ggcttagctcgagacattcatcata

SEQ ID NO: 711620 - DNA, 25 bp, Mus musculus
ggcttaggcactcatgacaacaccc

SEQ ID NO: 711621 - DNA, 25 bp, Mus musculus
ggcttaggcactgatgacaacaccc

SEQ ID NO: 711622 - DNA, 25 bp, Mus musculus
ggcttaggtcagaagatcagtgaca

SEQ ID NO: 711623 - DNA, 25 bp, Mus musculus
ggcttaggtcagtagatcagtgaca

SEQ ID NO: 711624 - DNA, 25 bp, Mus musculus
ggcttagtcaacatgaaaatttacg

SEQ ID NO: 711625 - DNA, 25 bp, Mus musculus
ggcttagtcaacttgaaaatttacg

SEQ ID NO: 711626 - DNA, 25 bp, Mus musculus
ggcttagttgatcccctcattttca

SEQ ID NO: 711627 - DNA, 25 bp, Mus musculus
ggcttagttgatgccctcattttca

SEQ ID NO: 711628 - DNA, 25 bp, Mus musculus
ggcttatcaccacgctctcagcagg

SEQ ID NO: 711629 - DNA, 25 bp, Mus musculus
ggcttatcaccaggctctcagcagg

SEQ ID NO: 711630 - DNA, 25 bp, Mus musculus
ggcttatcaggtaggtcacaatctg

SEQ ID NO: 711631 - DNA, 25 bp, Mus musculus
ggcttatcaggttggtcacaatctg

SEQ ID NO: 711632 - DNA, 25 bp, Mus musculus
ggcttatcatgaaaaaccagtcctg

SEQ ID NO: 711633 - DNA, 25 bp, Mus musculus
ggcttatcatgataaaccagtcctg

SEQ ID NO: 711634 - DNA, 25 bp, Mus musculus
ggcttatccgatcccttctgtcctg

SEQ ID NO: 711635 - DNA, 25 bp, Mus musculus
ggcttatccgatgccttctgtcctg

SEQ ID NO: 711636 - DNA, 25 bp, Mus musculus
ggcttatcttcgaggatcacagaag

SEQ ID NO: 711637 - DNA, 25 bp, Mus musculus
ggcttatcttcgtggatcacagaag

SEQ ID NO: 711638 - DNA, 25 bp, Mus musculus
ggcttatgaagacagaatgaaagag

SEQ ID NO: 711639 - DNA, 25 bp, Mus musculus
ggcttatgaagagagaatgaaagag

SEQ ID NO: 711640 - DNA, 25 bp, Mus musculus
ggcttatgtcctcatcctcagttct

SEQ ID NO: 711641 - DNA, 25 bp, Mus musculus
ggcttatgtcctgatcctcagttct

SEQ ID NO: 711642 - DNA, 25 bp, Mus musculus
ggcttattactcaactgtggatcga

SEQ ID NO: 711643 - DNA, 25 bp, Mus musculus
ggcttattactctactgtggatcga

SEQ ID NO: 711644 - DNA, 25 bp, Mus musculus
ggcttattattacgaggcagttgta

SEQ ID NO: 711645 - DNA, 25 bp, Mus musculus
ggcttattattaggaggcagttgta

SEQ ID NO: 711646 - DNA, 25 bp, Mus musculus
ggcttattgcttaacatcctacaaa

SEQ ID NO: 711647 - DNA, 25 bp, Mus musculus
ggcttattgctttacatcctacaaa

SEQ ID NO: 711648 - DNA, 25 bp, Mus musculus
ggcttatttccacctgtttgtgatc

SEQ ID NO: 711649 - DNA, 25 bp, Mus musculus
ggcttatttccagctgtttgtgatc

SEQ ID NO: 711650 - DNA, 25 bp, Mus musculus
ggcttcaaacctatatgtctagtca

SEQ ID NO: 711651 - DNA, 25 bp, Mus musculus
ggcttcaaacctttatgtctagtca

SEQ ID NO: 711652 - DNA, 25 bp, Mus musculus
ggcttcaactatctgagtgacactg

SEQ ID NO: 711653 - DNA, 25 bp, Mus musculus
ggcttcaactatgtgagtgacactg

SEQ ID NO: 711654 - DNA, 25 bp, Mus musculus
ggcttcaagcagcaagatcccgaag

SEQ ID NO: 711655 - DNA, 25 bp, Mus musculus
ggcttcaagcaggaagatcccgaag

SEQ ID NO: 711656 - DNA, 25 bp, Mus musculus
ggcttcaaggttacttcgcggagtg

SEQ ID NO: 711657 - DNA, 25 bp, Mus musculus
ggcttcaaggtttcttcgcggagtg

SEQ ID NO: 711658 - DNA, 25 bp, Mus musculus
ggcttcaatgccaggtgaggaagca

SEQ ID NO: 711659 - DNA, 25 bp, Mus musculus
ggcttcaatgcctggtgaggaagca

SEQ ID NO: 711660 - DNA, 25 bp, Mus musculus
ggcttcaatggcatccactgcgaga

SEQ ID NO: 711661 - DNA, 25 bp, Mus musculus
ggcttcaatggcttccactgcgaga

SEQ ID NO: 711662 - DNA, 25 bp, Mus musculus
ggcttcacacctaccagagaatgat

SEQ ID NO: 711663 - DNA, 25 bp, Mus musculus
ggcttcacaccttccagagaatgat

SEQ ID NO: 711664 - DNA, 25 bp, Mus musculus
ggcttcacggaacagtctaccaaga

SEQ ID NO: 711665 - DNA, 25 bp, Mus musculus
ggcttcacggaagagtctaccaaga

SEQ ID NO: 711666 - DNA, 25 bp, Mus musculus
ggcttcactgcaatggctcttctgc

SEQ ID NO: 711667 - DNA, 25 bp, Mus musculus
ggcttcactgcattggctcttctgc

SEQ ID NO: 711668 - DNA, 25 bp, Mus musculus
ggcttcactgtcagccctgcctagg

SEQ ID NO: 711669 - DNA, 25 bp, Mus musculus
ggcttcactgtctgccctgcctagg

SEQ ID NO: 711670 - DNA, 25 bp, Mus musculus
ggcttcacttctcagcaaatttaga

SEQ ID NO: 711671 - DNA, 25 bp, Mus musculus
ggcttcacttctgagcaaatttaga

SEQ ID NO: 711672 - DNA, 25 bp, Mus musculus
ggcttcagaagcagcggccgcagca

SEQ ID NO: 711673 - DNA, 25 bp, Mus musculus
ggcttcagaagctgcggccgcagca

SEQ ID NO: 711674 - DNA, 25 bp, Mus musculus
ggcttcaggactcgctacgttttca

SEQ ID NO: 711675 - DNA, 25 bp, Mus musculus
ggcttcaggactggctacgttttca

SEQ ID NO: 711676 - DNA, 25 bp, Mus musculus
ggcttcaggagaacttcggcatcct

SEQ ID NO: 711677 - DNA, 25 bp, Mus musculus
ggcttcaggagatcttcggcatcct

SEQ ID NO: 711678 - DNA, 25 bp, Mus musculus
ggcttcagggtcactaacgggcctc

SEQ ID NO: 711679 - DNA, 25 bp, Mus musculus
ggcttcagggtctctaacgggcctc

SEQ ID NO: 711680 - DNA, 25 bp, Mus musculus
ggcttcagtggaccagtaagttctg

SEQ ID NO: 711681 - DNA, 25 bp, Mus musculus
ggcttcagtggagcagtaagttctg

SEQ ID NO: 711682 - DNA, 25 bp, Mus musculus
ggcttcagtgtcaggtgaccagtct

SEQ ID NO: 711683 - DNA, 25 bp, Mus musculus
ggcttcagtgtctggtgaccagtct

SEQ ID NO: 711684 - DNA, 25 bp, Mus musculus
ggcttcagttgaccccttctatcga

SEQ ID NO: 711685 - DNA, 25 bp, Mus musculus
ggcttcagttgagcccttctatcga

SEQ ID NO: 711686 - DNA, 25 bp, Mus musculus
ggcttcataacgcattctaacggaa

SEQ ID NO: 711687 - DNA, 25 bp, Mus musculus
ggcttcataacggattctaacggaa

SEQ ID NO: 711688 - DNA, 25 bp, Mus musculus
ggcttcatagaaacagagatgctgt

SEQ ID NO: 711689 - DNA, 25 bp, Mus musculus
ggcttcatagaatcagagatgctgt

SEQ ID NO: 711690 - DNA, 25 bp, Mus musculus
ggcttcatctaccagagaagtagga

SEQ ID NO: 711691 - DNA, 25 bp, Mus musculus
ggcttcatctacgagagaagtagga

SEQ ID NO: 711692 - DNA, 25 bp, Mus musculus
ggcttcatctatctccaggcttcac

SEQ ID NO: 711693 - DNA, 25 bp, Mus musculus
ggcttcatctatgtccaggcttcac

SEQ ID NO: 711694 - DNA, 25 bp, Mus musculus
ggcttcatctctctttctctcaagg

SEQ ID NO: 711695 - DNA, 25 bp, Mus musculus
ggcttcatctctgtttctctcaagg

SEQ ID NO: 711696 - DNA, 25 bp, Mus musculus
ggcttcatctgcattgacgcagcaa

SEQ ID NO: 711697 - DNA, 25 bp, Mus musculus
ggcttcatctgctttgacgcagcaa

SEQ ID NO: 711698 - DNA, 25 bp, Mus musculus
ggcttcatgggaatggacatacccc

SEQ ID NO: 711699 - DNA, 25 bp, Mus musculus
ggcttcatgggattggacatacccc

SEQ ID NO: 711700 - DNA, 25 bp, Mus musculus
ggcttcattgacaccagaactggcc

SEQ ID NO: 711701 - DNA, 25 bp, Mus musculus
ggcttcattgactccagaactggcc

SEQ ID NO: 711702 - DNA, 25 bp, Mus musculus
ggcttccaaacaaattctggattca

SEQ ID NO: 711703 - DNA, 25 bp, Mus musculus
ggcttccaaacatattctggattca

SEQ ID NO: 711704 - DNA, 25 bp, Mus musculus
ggcttccaatgccttgcttcttccg

SEQ ID NO: 711705 - DNA, 25 bp, Mus musculus
ggcttccaatgcgttgcttcttccg

SEQ ID NO: 711706 - DNA, 25 bp, Mus musculus
ggcttccagctcaaatagaactccg

SEQ ID NO: 711707 - DNA, 25 bp, Mus musculus
ggcttccagctctaatagaactccg

SEQ ID NO: 711708 - DNA, 25 bp, Mus musculus
ggcttccaggagagataccagcttt

SEQ ID NO: 711709 - DNA, 25 bp, Mus musculus
ggcttccaggagtgataccagcttt

SEQ ID NO: 711710 - DNA, 25 bp, Mus musculus
ggcttccaggctaacgatttcccgg

SEQ ID NO: 711711 - DNA, 25 bp, Mus musculus
ggcttccaggcttacgatttcccgg

SEQ ID NO: 711712 - DNA, 25 bp, Mus musculus
ggcttcccacaactctatcttgcga

SEQ ID NO: 711713 - DNA, 25 bp, Mus musculus
ggcttcccacaagtctatcttgcga

SEQ ID NO: 711714 - DNA, 25 bp, Mus musculus
ggcttcccagtaaagcagtcatgtc

SEQ ID NO: 711715 - DNA, 25 bp, Mus musculus
ggcttcccagtatagcagtcatgtc

SEQ ID NO: 711716 - DNA, 25 bp, Mus musculus
ggcttccccaaaattctatattcag

SEQ ID NO: 711717 - DNA, 25 bp, Mus musculus
ggcttccccaaatttctatattcag

SEQ ID NO: 711718 - DNA, 25 bp, Mus musculus
ggcttcccctgaatggcctctgaca

SEQ ID NO: 711719 - DNA, 25 bp, Mus musculus
ggcttcccctgattggcctctgaca

SEQ ID NO: 711720 - DNA, 25 bp, Mus musculus
ggcttccccttgactgctctgcttt

SEQ ID NO: 711721 - DNA, 25 bp, Mus musculus
ggcttccccttgtctgctctgcttt

SEQ ID NO: 711722 - DNA, 25 bp, Mus musculus
ggcttcccctttccatgcacagtag

SEQ ID NO: 711723 - DNA, 25 bp, Mus musculus
ggcttcccctttgcatgcacagtag

SEQ ID NO: 711724 - DNA, 25 bp, Mus musculus
ggcttcccgggaattgcatacttgc

SEQ ID NO: 711725 - DNA, 25 bp, Mus musculus
ggcttcccgggatttgcatacttgc

SEQ ID NO: 711726 - DNA, 25 bp, Mus musculus
ggcttccctgggactaagtctccga

SEQ ID NO: 711727 - DNA, 25 bp, Mus musculus
ggcttccctgggtctaagtctccga

SEQ ID NO: 711728 - DNA, 25 bp, Mus musculus
ggcttccctggtcatttctgccaca

SEQ ID NO: 711729 - DNA, 25 bp, Mus musculus
ggcttccctggtgatttctgccaca

SEQ ID NO: 711730 - DNA, 25 bp, Mus musculus
ggcttccctgtgcagctgagcactc

SEQ ID NO: 711731 - DNA, 25 bp, Mus musculus
ggcttccctgtggagctgagcactc

SEQ ID NO: 711732 - DNA, 25 bp, Mus musculus
ggcttccgagccaccgtaatgctag

SEQ ID NO: 711733 - DNA, 25 bp, Mus musculus
ggcttccgagcctccgtaatgctag

SEQ ID NO: 711734 - DNA, 25 bp, Mus musculus
ggcttccgagtgcaccttccaatca

SEQ ID NO: 711735 - DNA, 25 bp, Mus musculus
ggcttccgagtggaccttccaatca

SEQ ID NO: 711736 - DNA, 25 bp, Mus musculus
ggcttccgagttcgaacttgtagct

SEQ ID NO: 711737 - DNA, 25 bp, Mus musculus
ggcttccgagttggaacttgtagct

SEQ ID NO: 711738 - DNA, 25 bp, Mus musculus
ggcttccgctgtcgcctgtctagaa

SEQ ID NO: 711739 - DNA, 25 bp, Mus musculus
ggcttccgctgtggcctgtctagaa

SEQ ID NO: 711740 - DNA, 25 bp, Mus musculus
ggcttccgcttcatcactaactacg

SEQ ID NO: 711741 - DNA, 25 bp, Mus musculus
ggcttccgcttcttcactaactacg

SEQ ID NO: 711742 - DNA, 25 bp, Mus musculus
ggcttccgctttcctatcctgggag

SEQ ID NO: 711743 - DNA, 25 bp, Mus musculus
ggcttccgctttgctatcctgggag

SEQ ID NO: 711744 - DNA, 25 bp, Mus musculus
ggcttccggagcaataacccaaatg

SEQ ID NO: 711745 - DNA, 25 bp, Mus musculus
ggcttccggagctataacccaaatg

SEQ ID NO: 711746 - DNA, 25 bp, Mus musculus
ggcttccggttgctggacctccaca

SEQ ID NO: 711747 - DNA, 25 bp, Mus musculus
ggcttccggttggtggacctccaca

SEQ ID NO: 711748 - DNA, 25 bp, Mus musculus
ggcttccgttatcagtgcgctccga

SEQ ID NO: 711749 - DNA, 25 bp, Mus musculus
ggcttccgttatgagtgcgctccga

SEQ ID NO: 711750 - DNA, 25 bp, Mus musculus
ggcttcctaacactgacaatgatct

SEQ ID NO: 711751 - DNA, 25 bp, Mus musculus
ggcttcctaacagtgacaatgatct

SEQ ID NO: 711752 - DNA, 25 bp, Mus musculus
ggcttcctagcacgttctcacagta

SEQ ID NO: 711753 - DNA, 25 bp, Mus musculus
ggcttcctagcaggttctcacagta

SEQ ID NO: 711754 - DNA, 25 bp, Mus musculus
ggcttcctatatccgtcctgaggac

SEQ ID NO: 711755 - DNA, 25 bp, Mus musculus
ggcttcctatatgcgtcctgaggac

SEQ ID NO: 711756 - DNA, 25 bp, Mus musculus
ggcttcctctccatacagtacatga

SEQ ID NO: 711757 - DNA, 25 bp, Mus musculus
ggcttcctctccttacagtacatga

SEQ ID NO: 711758 - DNA, 25 bp, Mus musculus
ggcttcctggatattggccagaatc

SEQ ID NO: 711759 - DNA, 25 bp, Mus musculus
ggcttcctggatctaagcacaggat

SEQ ID NO: 711760 - DNA, 25 bp, Mus musculus
ggcttcctggatgtaagcacaggat

SEQ ID NO: 711761 - DNA, 25 bp, Mus musculus
ggcttcctggattttggccagaatc

SEQ ID NO: 711762 - DNA, 25 bp, Mus musculus
ggcttcctgggaacagcggttttta

SEQ ID NO: 711763 - DNA, 25 bp, Mus musculus
ggcttcctgggatcagcggttttta

SEQ ID NO: 711764 - DNA, 25 bp, Mus musculus
ggcttcctggttcaagactactttg

SEQ ID NO: 711765 - DNA, 25 bp, Mus musculus
ggcttcctggttgaagactactttg

SEQ ID NO: 711766 - DNA, 25 bp, Mus musculus
ggcttcctgtacagggtgggcgcga

SEQ ID NO: 711767 - DNA, 25 bp, Mus musculus
ggcttcctgtactgggtgggcgcga

SEQ ID NO: 711768 - DNA, 25 bp, Mus musculus
ggcttccttcggcttgggctttgct

SEQ ID NO: 711769 - DNA, 25 bp, Mus musculus
ggcttccttcgggttgggctttgct

SEQ ID NO: 711770 - DNA, 25 bp, Mus musculus
ggcttcctttggctgcagccagcta

SEQ ID NO: 711771 - DNA, 25 bp, Mus musculus
ggcttcctttgggtgcagccagcta

SEQ ID NO: 711772 - DNA, 25 bp, Mus musculus
ggcttcgacatcaacaaaactttca

SEQ ID NO: 711773 - DNA, 25 bp, Mus musculus
ggcttcgacatctacaaaactttca

SEQ ID NO: 711774 - DNA, 25 bp, Mus musculus
ggcttcgcaattatttccatcctgg

SEQ ID NO: 711775 - DNA, 25 bp, Mus musculus
ggcttcgcaattttttccatcctgg

SEQ ID NO: 711776 - DNA, 25 bp, Mus musculus
ggcttcgcggctagtccaacgtccg

SEQ ID NO: 711777 - DNA, 25 bp, Mus musculus
ggcttcgcggcttgtccaacgtccg

SEQ ID NO: 711778 - DNA, 25 bp, Mus musculus
ggcttcgcggtcagcggcatcgttt

SEQ ID NO: 711779 - DNA, 25 bp, Mus musculus
ggcttcgcggtctgcggcatcgttt

SEQ ID NO: 711780 - DNA, 25 bp, Mus musculus
ggcttcggcagcagaagctggacaa

SEQ ID NO: 711781 - DNA, 25 bp, Mus musculus
ggcttcggcagctgaagctggacaa

SEQ ID NO: 711782 - DNA, 25 bp, Mus musculus
ggcttcggctggcacctttcgttca

SEQ ID NO: 711783 - DNA, 25 bp, Mus musculus
ggcttcggctgggacctttcgttca

SEQ ID NO: 711784 - DNA, 25 bp, Mus musculus
ggcttcggcttgactccagaaggaa

SEQ ID NO: 711785 - DNA, 25 bp, Mus musculus
ggcttcggcttgtctccagaaggaa

SEQ ID NO: 711786 - DNA, 25 bp, Mus musculus
ggcttcgggcttctccaacaatagt

SEQ ID NO: 711787 - DNA, 25 bp, Mus musculus
ggcttcgggcttgtccaacaatagt

SEQ ID NO: 711788 - DNA, 25 bp, Mus musculus
ggcttcggtgatcccgcactcatca

SEQ ID NO: 711789 - DNA, 25 bp, Mus musculus
ggcttcggtgatgccgcactcatca

SEQ ID NO: 711790 - DNA, 25 bp, Mus musculus
ggcttcgtggccaacagtgttttca

SEQ ID NO: 711791 - DNA, 25 bp, Mus musculus
ggcttcgtggcctacagtgttttca

SEQ ID NO: 711792 - DNA, 25 bp, Mus musculus
ggcttcgtgtttccctgttatgtga

SEQ ID NO: 711793 - DNA, 25 bp, Mus musculus
ggcttcgtgtttgcctgttatgtga

SEQ ID NO: 711794 - DNA, 25 bp, Mus musculus
ggcttctacaataaccgactgcagg

SEQ ID NO: 711795 - DNA, 25 bp, Mus musculus
ggcttctacaattaccgactgcagg

SEQ ID NO: 711796 - DNA, 25 bp, Mus musculus
ggcttctactaccatggcaacctgc

SEQ ID NO: 711797 - DNA, 25 bp, Mus musculus
ggcttctactacgatggcaacctgc

SEQ ID NO: 711798 - DNA, 25 bp, Mus musculus
ggcttctagacaacatggccgaatt

SEQ ID NO: 711799 - DNA, 25 bp, Mus musculus
ggcttctagacatcatggccgaatt

SEQ ID NO: 711800 - DNA, 25 bp, Mus musculus
ggcttctcatcgcagtcaatcttgg

SEQ ID NO: 711801 - DNA, 25 bp, Mus musculus
ggcttctcatcggagtcaatcttgg

SEQ ID NO: 711802 - DNA, 25 bp, Mus musculus
ggcttctccctgcaggtgcctggct

SEQ ID NO: 711803 - DNA, 25 bp, Mus musculus
ggcttctccctggaggtgcctggct

SEQ ID NO: 711804 - DNA, 25 bp, Mus musculus
ggcttctcctacacggatgacaaga

SEQ ID NO: 711805 - DNA, 25 bp, Mus musculus
ggcttctcctactcggatgacaaga

SEQ ID NO: 711806 - DNA, 25 bp, Mus musculus
ggcttctcgggcaagttctatcata

SEQ ID NO: 711807 - DNA, 25 bp, Mus musculus
ggcttctcgggctagttctatcata

SEQ ID NO: 711808 - DNA, 25 bp, Mus musculus
ggcttctcttgaagatgggctgtaa

SEQ ID NO: 711809 - DNA, 25 bp, Mus musculus
ggcttctcttgatgatgggctgtaa

SEQ ID NO: 711810 - DNA, 25 bp, Mus musculus
ggcttctgcaacctaccatagtgaa

SEQ ID NO: 711811 - DNA, 25 bp, Mus musculus
ggcttctgcaacgtaccatagtgaa

SEQ ID NO: 711812 - DNA, 25 bp, Mus musculus
ggcttctgcgacaatgcaccttcct

SEQ ID NO: 711813 - DNA, 25 bp, Mus musculus
ggcttctgcgactatgcaccttcct

SEQ ID NO: 711814 - DNA, 25 bp, Mus musculus
ggcttctgctatccggaacctcaag

SEQ ID NO: 711815 - DNA, 25 bp, Mus musculus
ggcttctgctatgcggaacctcaag

SEQ ID NO: 711816 - DNA, 25 bp, Mus musculus
ggcttctgctgaacattctgatcct

SEQ ID NO: 711817 - DNA, 25 bp, Mus musculus
ggcttctgctgatcattctgatcct

SEQ ID NO: 711818 - DNA, 25 bp, Mus musculus
ggcttctgcttcagccgcagtctct

SEQ ID NO: 711819 - DNA, 25 bp, Mus musculus
ggcttctgcttctgccgcagtctct

SEQ ID NO: 711820 - DNA, 25 bp, Mus musculus
ggcttctggaaccatcagtggatca

SEQ ID NO: 711821 - DNA, 25 bp, Mus musculus
ggcttctggaacgatcagtggatca

SEQ ID NO: 711822 - DNA, 25 bp, Mus musculus
ggcttctggaagatcccagatccca

SEQ ID NO: 711823 - DNA, 25 bp, Mus musculus
ggcttctggaagttcccagatccca

SEQ ID NO: 711824 - DNA, 25 bp, Mus musculus
ggcttctgggacaacatccggctgg

SEQ ID NO: 711825 - DNA, 25 bp, Mus musculus
ggcttctgggactacatccggctgg

SEQ ID NO: 711826 - DNA, 25 bp, Mus musculus
ggcttctgtcccaaggaaggacaga

SEQ ID NO: 711827 - DNA, 25 bp, Mus musculus
ggcttctgtccctaggaaggacaga

SEQ ID NO: 711828 - DNA, 25 bp, Mus musculus
ggcttctgtggcattcagctcccga

SEQ ID NO: 711829 - DNA, 25 bp, Mus musculus
ggcttctgtggctttcagctcccga

SEQ ID NO: 711830 - DNA, 25 bp, Mus musculus
ggcttcttacagcaacagcgtgata

SEQ ID NO: 711831 - DNA, 25 bp, Mus musculus
ggcttcttacaggaacagcgtgata

SEQ ID NO: 711832 - DNA, 25 bp, Mus musculus
ggcttcttcacaagtcttggccgtg

SEQ ID NO: 711833 - DNA, 25 bp, Mus musculus
ggcttcttcacatgtcttggccgtg

SEQ ID NO: 711834 - DNA, 25 bp, Mus musculus
ggcttcttcaccactgtcgccatga

SEQ ID NO: 711835 - DNA, 25 bp, Mus musculus
ggcttcttcacctctgtcgccatga

SEQ ID NO: 711836 - DNA, 25 bp, Mus musculus
ggcttcttcactactgtggcagcga

SEQ ID NO: 711837 - DNA, 25 bp, Mus musculus
ggcttcttcacttctgtggcagcga

SEQ ID NO: 711838 - DNA, 25 bp, Mus musculus
ggcttcttcctgaccggtgtgacca

SEQ ID NO: 711839 - DNA, 25 bp, Mus musculus
ggcttcttcctgtccggtgtgacca

SEQ ID NO: 711840 - DNA, 25 bp, Mus musculus
ggcttcttccttaaccgcgcttcag

SEQ ID NO: 711841 - DNA, 25 bp, Mus musculus
ggcttcttcctttaccgcgcttcag

SEQ ID NO: 711842 - DNA, 25 bp, Mus musculus
ggcttcttgcagcaccccgagggca

SEQ ID NO: 711843 - DNA, 25 bp, Mus musculus
ggcttcttgcaggaccccgagggca

SEQ ID NO: 711844 - DNA, 25 bp, Mus musculus
ggcttcttggcacagcagtttacaa

SEQ ID NO: 711845 - DNA, 25 bp, Mus musculus
ggcttcttggcagagcagtttacaa

SEQ ID NO: 711846 - DNA, 25 bp, Mus musculus
ggcttcttgtcgagtgtgtctctaa

SEQ ID NO: 711847 - DNA, 25 bp, Mus musculus
ggcttcttgtcgtgtgtgtctctaa

SEQ ID NO: 711848 - DNA, 25 bp, Mus musculus
ggcttcttttggacttttggagcag

SEQ ID NO: 711849 - DNA, 25 bp, Mus musculus
ggcttcttttggtcttttggagcag

SEQ ID NO: 711850 - DNA, 25 bp, Mus musculus
ggcttgaactcccagctggctgttc

SEQ ID NO: 711851 - DNA, 25 bp, Mus musculus
ggcttgaactccgagctggctgttc

SEQ ID NO: 711852 - DNA, 25 bp, Mus musculus
ggcttgaactctacccacattgctg

SEQ ID NO: 711853 - DNA, 25 bp, Mus musculus
ggcttgaactcttcccacattgctg

SEQ ID NO: 711854 - DNA, 25 bp, Mus musculus
ggcttgaatcgtacccagctggtca

SEQ ID NO: 711855 - DNA, 25 bp, Mus musculus
ggcttgaatcgttcccagctggtca

SEQ ID NO: 711856 - DNA, 25 bp, Mus musculus
ggcttgaccaggagtcactaaatcc

SEQ ID NO: 711857 - DNA, 25 bp, Mus musculus
ggcttgaccaggtgtcactaaatcc

SEQ ID NO: 711858 - DNA, 25 bp, Mus musculus
ggcttgacctgaccaacaatgatat

SEQ ID NO: 711859 - DNA, 25 bp, Mus musculus
ggcttgacctgagcaacaatgatat

SEQ ID NO: 711860 - DNA, 25 bp, Mus musculus
ggcttgactaaccaactccatgtgg

SEQ ID NO: 711861 - DNA, 25 bp, Mus musculus
ggcttgactaacgaactccatgtgg

SEQ ID NO: 711862 - DNA, 25 bp, Mus musculus
ggcttgatggatccggccttgcaaa

SEQ ID NO: 711863 - DNA, 25 bp, Mus musculus
ggcttgatggatgcggccttgcaaa

SEQ ID NO: 711864 - DNA, 25 bp, Mus musculus
ggcttgcaaagaccctaaccctatc

SEQ ID NO: 711865 - DNA, 25 bp, Mus musculus
ggcttgcaaagagcctaaccctatc

SEQ ID NO: 711866 - DNA, 25 bp, Mus musculus
ggcttgcaacctccagcactgtgca

SEQ ID NO: 711867 - DNA, 25 bp, Mus musculus
ggcttgcaacctgcagcactgtgca

SEQ ID NO: 711868 - DNA, 25 bp, Mus musculus
ggcttgcaccacaggacaggttacg

SEQ ID NO: 711869 - DNA, 25 bp, Mus musculus
ggcttgcaccactggacaggttacg

SEQ ID NO: 711870 - DNA, 25 bp, Mus musculus
ggcttgcaggtactgttcgtgggct

SEQ ID NO: 711871 - DNA, 25 bp, Mus musculus
ggcttgcaggtagtgttcgtgggct

SEQ ID NO: 711872 - DNA, 25 bp, Mus musculus
ggcttgccaagccatgttcctgagg

SEQ ID NO: 711873 - DNA, 25 bp, Mus musculus
ggcttgccaagcgatgttcctgagg

SEQ ID NO: 711874 - DNA, 25 bp, Mus musculus
ggcttgccgacaagcatcttcacct

SEQ ID NO: 711875 - DNA, 25 bp, Mus musculus
ggcttgccgacatgcatcttcacct

SEQ ID NO: 711876 - DNA, 25 bp, Mus musculus
ggcttgcgcttcatcatccagtcag

SEQ ID NO: 711877 - DNA, 25 bp, Mus musculus
ggcttgcgcttcttcatccagtcag

SEQ ID NO: 711878 - DNA, 25 bp, Mus musculus
ggcttgctcggtcgcctcgtcgctt

SEQ ID NO: 711879 - DNA, 25 bp, Mus musculus
ggcttgctcggtggcctcgtcgctt

SEQ ID NO: 711880 - DNA, 25 bp, Mus musculus
ggcttgctctctctcggattatgaa

SEQ ID NO: 711881 - DNA, 25 bp, Mus musculus
ggcttgctctctgtcggattatgaa

SEQ ID NO: 711882 - DNA, 25 bp, Mus musculus
ggcttgctctttactaccctggaga

SEQ ID NO: 711883 - DNA, 25 bp, Mus musculus
ggcttgctcttttctaccctggaga

SEQ ID NO: 711884 - DNA, 25 bp, Mus musculus
ggcttgctgaatatcttgctgcaga

SEQ ID NO: 711885 - DNA, 25 bp, Mus musculus
ggcttgctgaatttcttgctgcaga

SEQ ID NO: 711886 - DNA, 25 bp, Mus musculus
ggcttgctgatcaattttatccatc

SEQ ID NO: 711887 - DNA, 25 bp, Mus musculus
ggcttgctgatctattttatccatc

SEQ ID NO: 711888 - DNA, 25 bp, Mus musculus
ggcttgctgcctaatgaacctttca

SEQ ID NO: 711889 - DNA, 25 bp, Mus musculus
ggcttgctgccttatgaacctttca

SEQ ID NO: 711890 - DNA, 25 bp, Mus musculus
ggcttgctgtgaactgactctacag

SEQ ID NO: 711891 - DNA, 25 bp, Mus musculus
ggcttgctgtgatctgactctacag

SEQ ID NO: 711892 - DNA, 25 bp, Mus musculus
ggcttggaaaaaactgtctcctgag

SEQ ID NO: 711893 - DNA, 25 bp, Mus musculus
ggcttggaaaaatctgtctcctgag

SEQ ID NO: 711894 - DNA, 25 bp, Mus musculus
ggcttggaacctctctgctttgaaa

SEQ ID NO: 711895 - DNA, 25 bp, Mus musculus
ggcttggaacctgtctgctttgaaa

SEQ ID NO: 711896 - DNA, 25 bp, Mus musculus
ggcttggaagccagcatagtccagg

SEQ ID NO: 711897 - DNA, 25 bp, Mus musculus
ggcttggaagcctgcatagtccagg

SEQ ID NO: 711898 - DNA, 25 bp, Mus musculus
ggcttggaagcgacccaggttcctg

SEQ ID NO: 711899 - DNA, 25 bp, Mus musculus
ggcttggaagcgtcccaggttcctg

SEQ ID NO: 711900 - DNA, 25 bp, Mus musculus
ggcttggagaagcaaaccgcctggg

SEQ ID NO: 711901 - DNA, 25 bp, Mus musculus
ggcttggagaaggaaaccgcctggg

SEQ ID NO: 711902 - DNA, 25 bp, Mus musculus
ggcttggagaatacacaccgagtct

SEQ ID NO: 711903 - DNA, 25 bp, Mus musculus
ggcttggagaattcacaccgagtct

SEQ ID NO: 711904 - DNA, 25 bp, Mus musculus
ggcttggagacacgactaaatcaga

SEQ ID NO: 711905 - DNA, 25 bp, Mus musculus
ggcttggagacaggactaaatcaga

SEQ ID NO: 711906 - DNA, 25 bp, Mus musculus
ggcttggagagaccagacgtcctct

SEQ ID NO: 711907 - DNA, 25 bp, Mus musculus
ggcttggagagagcagacgtcctct

SEQ ID NO: 711908 - DNA, 25 bp, Mus musculus
ggcttggaggtcacaaaagacccag

SEQ ID NO: 711909 - DNA, 25 bp, Mus musculus
ggcttggaggtctcaaaagacccag

SEQ ID NO: 711910 - DNA, 25 bp, Mus musculus
ggcttggagtcgatgcccttggact

SEQ ID NO: 711911 - DNA, 25 bp, Mus musculus
ggcttggagtcgttgcccttggact

SEQ ID NO: 711912 - DNA, 25 bp, Mus musculus
ggcttggatgcacttctgcccatga

SEQ ID NO: 711913 - DNA, 25 bp, Mus musculus
ggcttggatgcagttctgcccatga

SEQ ID NO: 711914 - DNA, 25 bp, Mus musculus
ggcttggcaagtccatactctgctt

SEQ ID NO: 711915 - DNA, 25 bp, Mus musculus
ggcttggcaagtgcatactctgctt

SEQ ID NO: 711916 - DNA, 25 bp, Mus musculus
ggcttggccaatcctcgagatttct

SEQ ID NO: 711917 - DNA, 25 bp, Mus musculus
ggcttggccaatgctcgagatttct

SEQ ID NO: 711918 - DNA, 25 bp, Mus musculus
ggcttggcctgaattgctcttccca

SEQ ID NO: 711919 - DNA, 25 bp, Mus musculus
ggcttggcctgatttgctcttccca

SEQ ID NO: 711920 - DNA, 25 bp, Mus musculus
ggcttggccttacggactaatcaga

SEQ ID NO: 711921 - DNA, 25 bp, Mus musculus
ggcttggccttagggactaatcaga

SEQ ID NO: 711922 - DNA, 25 bp, Mus musculus
ggcttggcggctccgcatcaacttt

SEQ ID NO: 711923 - DNA, 25 bp, Mus musculus
ggcttggcggctgcgcatcaacttt

SEQ ID NO: 711924 - DNA, 25 bp, Mus musculus
ggcttggctgctcatgtaggaacac

SEQ ID NO: 711925 - DNA, 25 bp, Mus musculus
ggcttggctgctgatgtaggaacac

SEQ ID NO: 711926 - DNA, 25 bp, Mus musculus
ggcttgggctgaacgaatcggacac

SEQ ID NO: 711927 - DNA, 25 bp, Mus musculus
ggcttgggctgatcgaatcggacac

SEQ ID NO: 711928 - DNA, 25 bp, Mus musculus
ggcttgggcttcacacactgtcaga

SEQ ID NO: 711929 - DNA, 25 bp, Mus musculus
ggcttgggcttctcacactgtcaga

SEQ ID NO: 711930 - DNA, 25 bp, Mus musculus
ggcttgggttgcacacatcagtgct

SEQ ID NO: 711931 - DNA, 25 bp, Mus musculus
ggcttgggttgctcacatcagtgct

SEQ ID NO: 711932 - DNA, 25 bp, Mus musculus
ggcttggtccatctctcctctaggt

SEQ ID NO: 711933 - DNA, 25 bp, Mus musculus
ggcttggtccatgtctcctctaggt

SEQ ID NO: 711934 - DNA, 25 bp, Mus musculus
ggcttggtgcaaacacattgctaga

SEQ ID NO: 711935 - DNA, 25 bp, Mus musculus
ggcttggtgcaatcacattgctaga

SEQ ID NO: 711936 - DNA, 25 bp, Mus musculus
ggcttggtgttcagggtctcccctg

SEQ ID NO: 711937 - DNA, 25 bp, Mus musculus
ggcttggtgttctgggtctcccctg

SEQ ID NO: 711938 - DNA, 25 bp, Mus musculus
ggcttggttacacgcacagagaatc

SEQ ID NO: 711939 - DNA, 25 bp, Mus musculus
ggcttggttacaggcacagagaatc

SEQ ID NO: 711940 - DNA, 25 bp, Mus musculus
ggcttgtaaacacatccggccgcac

SEQ ID NO: 711941 - DNA, 25 bp, Mus musculus
ggcttgtaaacagatccggccgcac

SEQ ID NO: 711942 - DNA, 25 bp, Mus musculus
ggcttgtaagtgagtcctttctctg

SEQ ID NO: 711943 - DNA, 25 bp, Mus musculus
ggcttgtaagtgtgtcctttctctg

SEQ ID NO: 711944 - DNA, 25 bp, Mus musculus
ggcttgtatcttattgaaacctaga

SEQ ID NO: 711945 - DNA, 25 bp, Mus musculus
ggcttgtatctttttgaaacctaga

SEQ ID NO: 711946 - DNA, 25 bp, Mus musculus
ggcttgtcaccaaagcaccgtgtca

SEQ ID NO: 711947 - DNA, 25 bp, Mus musculus
ggcttgtcaccatagcaccgtgtca

SEQ ID NO: 711948 - DNA, 25 bp, Mus musculus
ggcttgtcacccctggctgtttatc

SEQ ID NO: 711949 - DNA, 25 bp, Mus musculus
ggcttgtcacccgtggctgtttatc

SEQ ID NO: 711950 - DNA, 25 bp, Mus musculus
ggcttgtcgcttactctgaggaacc

SEQ ID NO: 711951 - DNA, 25 bp, Mus musculus
ggcttgtcgctttctctgaggaacc

SEQ ID NO: 711952 - DNA, 25 bp, Mus musculus
ggcttgtctgcacaactcatggatt

SEQ ID NO: 711953 - DNA, 25 bp, Mus musculus
ggcttgtctgcagaactcatggatt

SEQ ID NO: 711954 - DNA, 25 bp, Mus musculus
ggcttgtcttctccttgtgacacgc

SEQ ID NO: 711955 - DNA, 25 bp, Mus musculus
ggcttgtcttctgcttgtgacacgc

SEQ ID NO: 711956 - DNA, 25 bp, Mus musculus
ggcttgtggtctagcggatccctga

SEQ ID NO: 711957 - DNA, 25 bp, Mus musculus
ggcttgtggtcttgcggatccctga

SEQ ID NO: 711958 - DNA, 25 bp, Mus musculus
ggcttgtgttcccagtttatacttt

SEQ ID NO: 711959 - DNA, 25 bp, Mus musculus
ggcttgtgttccgagtttatacttt

SEQ ID NO: 711960 - DNA, 25 bp, Mus musculus
ggcttgttcaccaacgatgagggaa

SEQ ID NO: 711961 - DNA, 25 bp, Mus musculus
ggcttgttcacctacgatgagggaa

SEQ ID NO: 711962 - DNA, 25 bp, Mus musculus
ggcttgtttactatggctgatgatc

SEQ ID NO: 711963 - DNA, 25 bp, Mus musculus
ggcttgtttactttggctgatgatc

SEQ ID NO: 711964 - DNA, 25 bp, Mus musculus
ggcttgtttattaccctccatttca

SEQ ID NO: 711965 - DNA, 25 bp, Mus musculus
ggcttgtttatttccctccatttca

SEQ ID NO: 711966 - DNA, 25 bp, Mus musculus
ggctttaaaagaatccatgggcgtg

SEQ ID NO: 711967 - DNA, 25 bp, Mus musculus
ggctttaaaagattccatgggcgtg

SEQ ID NO: 711968 - DNA, 25 bp, Mus musculus
ggctttaaagatcctgtgtaccggg

SEQ ID NO: 711969 - DNA, 25 bp, Mus musculus
ggctttaaagatgctgtgtaccggg

SEQ ID NO: 711970 - DNA, 25 bp, Mus musculus
ggctttaaagccagagcccggcgct

SEQ ID NO: 711971 - DNA, 25 bp, Mus musculus
ggctttaaagcctgagcccggcgct

SEQ ID NO: 711972 - DNA, 25 bp, Mus musculus
ggctttaagcccacggtgatgctga

SEQ ID NO: 711973 - DNA, 25 bp, Mus musculus
ggctttaagccctcggtgatgctga

SEQ ID NO: 711974 - DNA, 25 bp, Mus musculus
ggctttaagggaaacgtgtgcctga

SEQ ID NO: 711975 - DNA, 25 bp, Mus musculus
ggctttaagggatacgtgtgcctga

SEQ ID NO: 711976 - DNA, 25 bp, Mus musculus
ggctttaatcgccttcggcaggaac

SEQ ID NO: 711977 - DNA, 25 bp, Mus musculus
ggctttaatcgcgttcggcaggaac

SEQ ID NO: 711978 - DNA, 25 bp, Mus musculus
ggctttacatcgaatctccacgtgg

SEQ ID NO: 711979 - DNA, 25 bp, Mus musculus
ggctttacatcgtatctccacgtgg

SEQ ID NO: 711980 - DNA, 25 bp, Mus musculus
ggctttaccacgctaggctgactgg

SEQ ID NO: 711981 - DNA, 25 bp, Mus musculus
ggctttaccacggtaggctgactgg

SEQ ID NO: 711982 - DNA, 25 bp, Mus musculus
ggctttaccctgacatggacccaga

SEQ ID NO: 711983 - DNA, 25 bp, Mus musculus
ggctttaccctgtcatggacccaga

SEQ ID NO: 711984 - DNA, 25 bp, Mus musculus
ggctttacctgtctaagaaccaact

SEQ ID NO: 711985 - DNA, 25 bp, Mus musculus
ggctttacctgtgtaagaaccaact

SEQ ID NO: 711986 - DNA, 25 bp, Mus musculus
ggctttacggacagtgactgcatcg

SEQ ID NO: 711987 - DNA, 25 bp, Mus musculus
ggctttacggactgtgactgcatcg

SEQ ID NO: 711988 - DNA, 25 bp, Mus musculus
ggctttactgctaaagctgtcttta

SEQ ID NO: 711989 - DNA, 25 bp, Mus musculus
ggctttactgcttaagctgtcttta

SEQ ID NO: 711990 - DNA, 25 bp, Mus musculus
ggctttactgtacgcctgcgctttg

SEQ ID NO: 711991 - DNA, 25 bp, Mus musculus
ggctttactgtaggcctgcgctttg

SEQ ID NO: 711992 - DNA, 25 bp, Mus musculus
ggctttacttacaagcattaccatg

SEQ ID NO: 711993 - DNA, 25 bp, Mus musculus
ggctttacttactagcattaccatg

SEQ ID NO: 711994 - DNA, 25 bp, Mus musculus
ggctttagttctcctgtctccagta

SEQ ID NO: 711995 - DNA, 25 bp, Mus musculus
ggctttagttctgctgtctccagta

SEQ ID NO: 711996 - DNA, 25 bp, Mus musculus
ggctttatgtggaagcggcttttgc

SEQ ID NO: 711997 - DNA, 25 bp, Mus musculus
ggctttatgtggtagcggcttttgc

SEQ ID NO: 711998 - DNA, 25 bp, Mus musculus
ggctttcagcccaacactcaagtga

SEQ ID NO: 711999 - DNA, 25 bp, Mus musculus
ggctttcagccctacactcaagtga

SEQ ID NO: 712000 - DNA, 25 bp, Mus musculus
ggctttcaggtaccttatgtggtgt

SEQ ID NO: 712001 - DNA, 25 bp, Mus musculus
ggctttcaggtagcttatgtggtgt

SEQ ID NO: 712002 - DNA, 25 bp, Mus musculus
ggctttccaactacagctacagtgt

SEQ ID NO: 712003 - DNA, 25 bp, Mus musculus
ggctttccaacttcagctacagtgt

SEQ ID NO: 712004 - DNA, 25 bp, Mus musculus
ggctttccagaaacctttgccaaag

SEQ ID NO: 712005 - DNA, 25 bp, Mus musculus
ggctttccagaatcctttgccaaag

SEQ ID NO: 712006 - DNA, 25 bp, Mus musculus
ggctttcccatgaatgcacatgtgg

SEQ ID NO: 712007 - DNA, 25 bp, Mus musculus
ggctttcccatgtatgcacatgtgg

SEQ ID NO: 712008 - DNA, 25 bp, Mus musculus
ggctttccctggatatctctgtgca

SEQ ID NO: 712009 - DNA, 25 bp, Mus musculus
ggctttccctggttatctctgtgca

SEQ ID NO: 712010 - DNA, 25 bp, Mus musculus
ggctttcctagacccttacatcctt

SEQ ID NO: 712011 - DNA, 25 bp, Mus musculus
ggctttcctagagccttacatcctt

SEQ ID NO: 712012 - DNA, 25 bp, Mus musculus
ggctttcctcagagcagttgaaccc

SEQ ID NO: 712013 - DNA, 25 bp, Mus musculus
ggctttcctcagtgcagttgaaccc

SEQ ID NO: 712014 - DNA, 25 bp, Mus musculus
ggctttcctgataaaacctccattg

SEQ ID NO: 712015 - DNA, 25 bp, Mus musculus
ggctttcctgattaaacctccattg

SEQ ID NO: 712016 - DNA, 25 bp, Mus musculus
ggctttcgaagaccaagaccaaaat

SEQ ID NO: 712017 - DNA, 25 bp, Mus musculus
ggctttcgaagagcaagaccaaaat

SEQ ID NO: 712018 - DNA, 25 bp, Mus musculus
ggctttcgagtgattttcaagcaga

SEQ ID NO: 712019 - DNA, 25 bp, Mus musculus
ggctttcgagtgtttttcaagcaga

SEQ ID NO: 712020 - DNA, 25 bp, Mus musculus
ggctttcgatctccaggagagaccc

SEQ ID NO: 712021 - DNA, 25 bp, Mus musculus
ggctttcgatctgcaggagagaccc

SEQ ID NO: 712022 - DNA, 25 bp, Mus musculus
ggctttcgcagaccaatcacctctg

SEQ ID NO: 712023 - DNA, 25 bp, Mus musculus
ggctttcgcagagcaatcacctctg

SEQ ID NO: 712024 - DNA, 25 bp, Mus musculus
ggctttcggctccttgcttttcgtt

SEQ ID NO: 712025 - DNA, 25 bp, Mus musculus
ggctttcggctcgttgcttttcgtt

SEQ ID NO: 712026 - DNA, 25 bp, Mus musculus
ggctttcgtccgcatggactctgga

SEQ ID NO: 712027 - DNA, 25 bp, Mus musculus
ggctttcgtccggatggactctgga

SEQ ID NO: 712028 - DNA, 25 bp, Mus musculus
ggctttcgtgttcggtcgccataaa

SEQ ID NO: 712029 - DNA, 25 bp, Mus musculus
ggctttcgtgttgggtcgccataaa

SEQ ID NO: 712030 - DNA, 25 bp, Mus musculus
ggctttctctggagcttttcgggac

SEQ ID NO: 712031 - DNA, 25 bp, Mus musculus
ggctttctctggtgcttttcgggac

SEQ ID NO: 712032 - DNA, 25 bp, Mus musculus
ggctttctgaaaacgctgagctgaa

SEQ ID NO: 712033 - DNA, 25 bp, Mus musculus
ggctttctgaaacaactggtggttg

SEQ ID NO: 712034 - DNA, 25 bp, Mus musculus
ggctttctgaaagaactggtggttg

SEQ ID NO: 712035 - DNA, 25 bp, Mus musculus
ggctttctgaaatcgctgagctgaa

SEQ ID NO: 712036 - DNA, 25 bp, Mus musculus
ggctttctgctcatctagggtggca

SEQ ID NO: 712037 - DNA, 25 bp, Mus musculus
ggctttctgctcttctagggtggca

SEQ ID NO: 712038 - DNA, 25 bp, Mus musculus
ggctttctggagctctggcctgcaa

SEQ ID NO: 712039 - DNA, 25 bp, Mus musculus
ggctttctggaggtctggcctgcaa

SEQ ID NO: 712040 - DNA, 25 bp, Mus musculus
ggctttctggtgatgggctccaagt

SEQ ID NO: 712041 - DNA, 25 bp, Mus musculus
ggctttctggtgttgggctccaagt

SEQ ID NO: 712042 - DNA, 25 bp, Mus musculus
ggctttctgttgactatggcaaaaa

SEQ ID NO: 712043 - DNA, 25 bp, Mus musculus
ggctttctgttgctgccatctagtg

SEQ ID NO: 712044 - DNA, 25 bp, Mus musculus
ggctttctgttggtgccatctagtg

SEQ ID NO: 712045 - DNA, 25 bp, Mus musculus
ggctttctgttgtctatggcaaaaa

SEQ ID NO: 712046 - DNA, 25 bp, Mus musculus
ggctttcttgtcacttttggtcatg

SEQ ID NO: 712047 - DNA, 25 bp, Mus musculus
ggctttcttgtctcttttggtcatg

SEQ ID NO: 712048 - DNA, 25 bp, Mus musculus
ggctttctttctcatcacctacacg

SEQ ID NO: 712049 - DNA, 25 bp, Mus musculus
ggctttctttctgatcacctacacg

SEQ ID NO: 712050 - DNA, 25 bp, Mus musculus
ggctttgaaaacatacccagtaaat

SEQ ID NO: 712051 - DNA, 25 bp, Mus musculus
ggctttgaaaacttacccagtaaat

SEQ ID NO: 712052 - DNA, 25 bp, Mus musculus
ggctttgaagacaaatcggcctatg

SEQ ID NO: 712053 - DNA, 25 bp, Mus musculus
ggctttgaagactaatcggcctatg

SEQ ID NO: 712054 - DNA, 25 bp, Mus musculus
ggctttgaatcaaggtgaagagcag

SEQ ID NO: 712055 - DNA, 25 bp, Mus musculus
ggctttgaatcatggtgaagagcag

SEQ ID NO: 712056 - DNA, 25 bp, Mus musculus
ggctttgacaaacttgacctttgga

SEQ ID NO: 712057 - DNA, 25 bp, Mus musculus
ggctttgacaaagttgacctttgga

SEQ ID NO: 712058 - DNA, 25 bp, Mus musculus
ggctttgacatgcaagaggttgttc

SEQ ID NO: 712059 - DNA, 25 bp, Mus musculus
ggctttgacatggaagaggttgttc

SEQ ID NO: 712060 - DNA, 25 bp, Mus musculus
ggctttgacctgcaccgccagtcag

SEQ ID NO: 712061 - DNA, 25 bp, Mus musculus
ggctttgacctggaccgccagtcag

SEQ ID NO: 712062 - DNA, 25 bp, Mus musculus
ggctttgaccttccccaaaaccaga

SEQ ID NO: 712063 - DNA, 25 bp, Mus musculus
ggctttgaccttgcccaaaaccaga

SEQ ID NO: 712064 - DNA, 25 bp, Mus musculus
ggctttgactcactcttcctgcttc

SEQ ID NO: 712065 - DNA, 25 bp, Mus musculus
ggctttgactcagtcttcctgcttc

SEQ ID NO: 712066 - DNA, 25 bp, Mus musculus
ggctttgactccagggcccaagata

SEQ ID NO: 712067 - DNA, 25 bp, Mus musculus
ggctttgactcctgggcccaagata

SEQ ID NO: 712068 - DNA, 25 bp, Mus musculus
ggctttgactgcatcgccaccacag

SEQ ID NO: 712069 - DNA, 25 bp, Mus musculus
ggctttgactgcttcgccaccacag

SEQ ID NO: 712070 - DNA, 25 bp, Mus musculus
ggctttgagagtcgtgtatacaaca

SEQ ID NO: 712071 - DNA, 25 bp, Mus musculus
ggctttgagagtggtgtatacaaca

SEQ ID NO: 712072 - DNA, 25 bp, Mus musculus
ggctttgaggctcacatctccccag

SEQ ID NO: 712073 - DNA, 25 bp, Mus musculus
ggctttgaggctgacatctccccag

SEQ ID NO: 712074 - DNA, 25 bp, Mus musculus
ggctttgagtcccaagtcagctgct

SEQ ID NO: 712075 - DNA, 25 bp, Mus musculus
ggctttgagtccgaagtcagctgct

SEQ ID NO: 712076 - DNA, 25 bp, Mus musculus
ggctttgagtttagcctttcttgca

SEQ ID NO: 712077 - DNA, 25 bp, Mus musculus
ggctttgagttttgcctttcttgca

SEQ ID NO: 712078 - DNA, 25 bp, Mus musculus
ggctttgatctgcaggaattcttaa

SEQ ID NO: 712079 - DNA, 25 bp, Mus musculus
ggctttgatctggaggaattcttaa

SEQ ID NO: 712080 - DNA, 25 bp, Mus musculus
ggctttgatgctctcatctgccttg

SEQ ID NO: 712081 - DNA, 25 bp, Mus musculus
ggctttgatgctgtcatctgccttg

SEQ ID NO: 712082 - DNA, 25 bp, Mus musculus
ggctttgcagccagagacctttaat

SEQ ID NO: 712083 - DNA, 25 bp, Mus musculus
ggctttgcagcctgagacctttaat

SEQ ID NO: 712084 - DNA, 25 bp, Mus musculus
ggctttgcataaaccaagagacagt

SEQ ID NO: 712085 - DNA, 25 bp, Mus musculus
ggctttgcataatccaagagacagt

SEQ ID NO: 712086 - DNA, 25 bp, Mus musculus
ggctttgcccagatgctcaaggatg

SEQ ID NO: 712087 - DNA, 25 bp, Mus musculus
ggctttgcccagttgctcaaggatg

SEQ ID NO: 712088 - DNA, 25 bp, Mus musculus
ggctttgcccctacaaactggtctc

SEQ ID NO: 712089 - DNA, 25 bp, Mus musculus
ggctttgccccttcaaactggtctc

SEQ ID NO: 712090 - DNA, 25 bp, Mus musculus
ggctttgccctacccaggttgacga

SEQ ID NO: 712091 - DNA, 25 bp, Mus musculus
ggctttgccctagccaggttgacga

SEQ ID NO: 712092 - DNA, 25 bp, Mus musculus
ggctttgccttcaggccatctccgg

SEQ ID NO: 712093 - DNA, 25 bp, Mus musculus
ggctttgccttctggccatctccgg

SEQ ID NO: 712094 - DNA, 25 bp, Mus musculus
ggctttgcgctccagcaggaccaga

SEQ ID NO: 712095 - DNA, 25 bp, Mus musculus
ggctttgcgctcgagcaggaccaga

SEQ ID NO: 712096 - DNA, 25 bp, Mus musculus
ggctttgcttctcctgccgttcctg

SEQ ID NO: 712097 - DNA, 25 bp, Mus musculus
ggctttgcttctgctgccgttcctg

SEQ ID NO: 712098 - DNA, 25 bp, Mus musculus
ggctttggagacacgcgcccgattt

SEQ ID NO: 712099 - DNA, 25 bp, Mus musculus
ggctttggagactcgcgcccgattt

SEQ ID NO: 712100 - DNA, 25 bp, Mus musculus
ggctttggagttctacaccccagag

SEQ ID NO: 712101 - DNA, 25 bp, Mus musculus
ggctttggagttgtacaccccagag

SEQ ID NO: 712102 - DNA, 25 bp, Mus musculus
ggctttggcaaacacggcttccgct

SEQ ID NO: 712103 - DNA, 25 bp, Mus musculus
ggctttggcaaagacggcttccgct

SEQ ID NO: 712104 - DNA, 25 bp, Mus musculus
ggctttggcaagaccgaatctgttg

SEQ ID NO: 712105 - DNA, 25 bp, Mus musculus
ggctttggcaagtccgaatctgttg

SEQ ID NO: 712106 - DNA, 25 bp, Mus musculus
ggctttggcgctcacgagatattga

SEQ ID NO: 712107 - DNA, 25 bp, Mus musculus
ggctttggcgctgacgagatattga

SEQ ID NO: 712108 - DNA, 25 bp, Mus musculus
ggctttgtagttacccctgatggca

SEQ ID NO: 712109 - DNA, 25 bp, Mus musculus
ggctttgtagtttcccctgatggca

SEQ ID NO: 712110 - DNA, 25 bp, Mus musculus
ggctttgtgccaccggtttatgtca

SEQ ID NO: 712111 - DNA, 25 bp, Mus musculus
ggctttgtgccacctttccgtacag

SEQ ID NO: 712112 - DNA, 25 bp, Mus musculus
ggctttgtgccagcggtttatgtca

SEQ ID NO: 712113 - DNA, 25 bp, Mus musculus
ggctttgtgccagctttccgtacag

SEQ ID NO: 712114 - DNA, 25 bp, Mus musculus
ggctttgtgtatacgtacaagcttg

SEQ ID NO: 712115 - DNA, 25 bp, Mus musculus
ggctttgtgtattcgtacaagcttg

SEQ ID NO: 712116 - DNA, 25 bp, Mus musculus
ggctttgttcctccacacttcattg

SEQ ID NO: 712117 - DNA, 25 bp, Mus musculus
ggctttgttcctgcacacttcattg

SEQ ID NO: 712118 - DNA, 25 bp, Mus musculus
ggcttttaaaaaaggttctgctttg

SEQ ID NO: 712119 - DNA, 25 bp, Mus musculus
ggcttttaaaaatggttctgctttg

SEQ ID NO: 712120 - DNA, 25 bp, Mus musculus
ggcttttaacggacttcaaatatgg

SEQ ID NO: 712121 - DNA, 25 bp, Mus musculus
ggcttttaacggtcttcaaatatgg

SEQ ID NO: 712122 - DNA, 25 bp, Mus musculus
ggcttttaccgccaggaggtgacca

SEQ ID NO: 712123 - DNA, 25 bp, Mus musculus
ggcttttaccgcgaggaggtgacca

SEQ ID NO: 712124 - DNA, 25 bp, Mus musculus
ggcttttactgcacccggtgcttgg

SEQ ID NO: 712125 - DNA, 25 bp, Mus musculus
ggcttttactgctcccggtgcttgg

SEQ ID NO: 712126 - DNA, 25 bp, Mus musculus
ggcttttagggcatgtggacgcctt

SEQ ID NO: 712127 - DNA, 25 bp, Mus musculus
ggcttttagggcttgtggacgcctt

SEQ ID NO: 712128 - DNA, 25 bp, Mus musculus
ggcttttcaacgcaggtagaactga

SEQ ID NO: 712129 - DNA, 25 bp, Mus musculus
ggcttttcaacggaggtagaactga

SEQ ID NO: 712130 - DNA, 25 bp, Mus musculus
ggcttttcagatcagcaaggaatat

SEQ ID NO: 712131 - DNA, 25 bp, Mus musculus
ggcttttcagatgagcaaggaatat

SEQ ID NO: 712132 - DNA, 25 bp, Mus musculus
ggcttttctagaagtactaagtgaa

SEQ ID NO: 712133 - DNA, 25 bp, Mus musculus
ggcttttctagatgtactaagtgaa

SEQ ID NO: 712134 - DNA, 25 bp, Mus musculus
ggcttttctcggatcagtctccgtg

SEQ ID NO: 712135 - DNA, 25 bp, Mus musculus
ggcttttctcggttcagtctccgtg

SEQ ID NO: 712136 - DNA, 25 bp, Mus musculus
ggcttttctgccctgcagaccacga

SEQ ID NO: 712137 - DNA, 25 bp, Mus musculus
ggcttttctgccgtgcagaccacga

SEQ ID NO: 712138 - DNA, 25 bp, Mus musculus
ggcttttgcccgactctcaatcaca

SEQ ID NO: 712139 - DNA, 25 bp, Mus musculus
ggcttttgcccgtctctcaatcaca

SEQ ID NO: 712140 - DNA, 25 bp, Mus musculus
ggcttttgtaatcaagaggaggaaa

SEQ ID NO: 712141 - DNA, 25 bp, Mus musculus
ggcttttgtaatgaagaggaggaaa

SEQ ID NO: 712142 - DNA, 25 bp, Mus musculus
ggctttttcaggaaccgctgatgct

SEQ ID NO: 712143 - DNA, 25 bp, Mus musculus
ggctttttcaggtaccgctgatgct

SEQ ID NO: 712144 - DNA, 25 bp, Mus musculus
ggctttttctgtactgacaacagcg

SEQ ID NO: 712145 - DNA, 25 bp, Mus musculus
ggctttttctgttctgacaacagcg

SEQ ID NO: 712146 - DNA, 25 bp, Mus musculus
ggctttttgtagaaagcacccacaa

SEQ ID NO: 712147 - DNA, 25 bp, Mus musculus
ggctttttgtagtaagcacccacaa

SEQ ID NO: 712148 - DNA, 25 bp, Mus musculus
ggcttttttgccacaattgtgttcg

SEQ ID NO: 712149 - DNA, 25 bp, Mus musculus
ggcttttttgcctcaattgtgttcg

SEQ ID NO: 712150 - DNA, 25 bp, Mus musculus
gggaaaaaactccactgtatatgga

SEQ ID NO: 712151 - DNA, 25 bp, Mus musculus
gggaaaaaactcgactgtatatgga

SEQ ID NO: 712152 - DNA, 25 bp, Mus musculus
gggaaaaagataaccctttggatcg

SEQ ID NO: 712153 - DNA, 25 bp, Mus musculus
gggaaaaagatatccctttggatcg

SEQ ID NO: 712154 - DNA, 25 bp, Mus musculus
gggaaaaatataagccatgaaggtc

SEQ ID NO: 712155 - DNA, 25 bp, Mus musculus
gggaaaaatatatgccatgaaggtc

SEQ ID NO: 712156 - DNA, 25 bp, Mus musculus
gggaaaacagcccagcgttgactcc

SEQ ID NO: 712157 - DNA, 25 bp, Mus musculus
gggaaaacagccctttcatcaataa

SEQ ID NO: 712158 - DNA, 25 bp, Mus musculus
gggaaaacagccgagcgttgactcc

SEQ ID NO: 712159 - DNA, 25 bp, Mus musculus
gggaaaacagccgtttcatcaataa

SEQ ID NO: 712160 - DNA, 25 bp, Mus musculus
gggaaaacataaaggcttctcctga

SEQ ID NO: 712161 - DNA, 25 bp, Mus musculus
gggaaaacataatggcttctcctga

SEQ ID NO: 712162 - DNA, 25 bp, Mus musculus
gggaaaacattcctacacatgaaat

SEQ ID NO: 712163 - DNA, 25 bp, Mus musculus
gggaaaacattcgtacacatgaaat

SEQ ID NO: 712164 - DNA, 25 bp, Mus musculus
gggaaaacattgcagagtcgctagt

SEQ ID NO: 712165 - DNA, 25 bp, Mus musculus
gggaaaacattggagagtcgctagt

SEQ ID NO: 712166 - DNA, 25 bp, Mus musculus
gggaaaaccattcccatcgacggcg

SEQ ID NO: 712167 - DNA, 25 bp, Mus musculus
gggaaaaccattgccatcgacggcg

SEQ ID NO: 712168 - DNA, 25 bp, Mus musculus
gggaaaacggaaagcaccaagctga

SEQ ID NO: 712169 - DNA, 25 bp, Mus musculus
gggaaaacggaatgcaccaagctga

SEQ ID NO: 712170 - DNA, 25 bp, Mus musculus
gggaaaactgcaattttggagcaac

SEQ ID NO: 712171 - DNA, 25 bp, Mus musculus
gggaaaactgcatttttggagcaac

SEQ ID NO: 712172 - DNA, 25 bp, Mus musculus
gggaaaagaaacatccaagccacgg

SEQ ID NO: 712173 - DNA, 25 bp, Mus musculus
gggaaaagaaacttccaagccacgg

SEQ ID NO: 712174 - DNA, 25 bp, Mus musculus
gggaaaagaagaccttacaatcaag

SEQ ID NO: 712175 - DNA, 25 bp, Mus musculus
gggaaaagaagagcttacaatcaag

SEQ ID NO: 712176 - DNA, 25 bp, Mus musculus
gggaaaagagtgaagagagtcttct

SEQ ID NO: 712177 - DNA, 25 bp, Mus musculus
gggaaaagagtgtagagagtcttct

SEQ ID NO: 712178 - DNA, 25 bp, Mus musculus
gggaaaagccgcacgcttggtgtta

SEQ ID NO: 712179 - DNA, 25 bp, Mus musculus
gggaaaagccgctcgcttggtgtta

SEQ ID NO: 712180 - DNA, 25 bp, Mus musculus
gggaaaagcgccctcaactctgagt

SEQ ID NO: 712181 - DNA, 25 bp, Mus musculus
gggaaaagcgccgtcaactctgagt

SEQ ID NO: 712182 - DNA, 25 bp, Mus musculus
gggaaaagctttcgaaccacaatct

SEQ ID NO: 712183 - DNA, 25 bp, Mus musculus
gggaaaagctttggaaccacaatct

SEQ ID NO: 712184 - DNA, 25 bp, Mus musculus
gggaaaagtaatcctgttgatgctg

SEQ ID NO: 712185 - DNA, 25 bp, Mus musculus
gggaaaagtaatgctgttgatgctg

SEQ ID NO: 712186 - DNA, 25 bp, Mus musculus
gggaaaagtcataacacattgccag

SEQ ID NO: 712187 - DNA, 25 bp, Mus musculus
gggaaaagtcattacacattgccag

SEQ ID NO: 712188 - DNA, 25 bp, Mus musculus
gggaaaagtcttaatttcactcaag

SEQ ID NO: 712189 - DNA, 25 bp, Mus musculus
gggaaaagtctttatttcactcaag

SEQ ID NO: 712190 - DNA, 25 bp, Mus musculus
gggaaaagtgtccagaaacgtctgt

SEQ ID NO: 712191 - DNA, 25 bp, Mus musculus
gggaaaagtgtcgagaaacgtctgt

SEQ ID NO: 712192 - DNA, 25 bp, Mus musculus
gggaaaatacagattggttcaaaga

SEQ ID NO: 712193 - DNA, 25 bp, Mus musculus
gggaaaatacagtttggttcaaaga

SEQ ID NO: 712194 - DNA, 25 bp, Mus musculus
gggaaaatattcagcactggtaaaa

SEQ ID NO: 712195 - DNA, 25 bp, Mus musculus
gggaaaatattctgcactggtaaaa

SEQ ID NO: 712196 - DNA, 25 bp, Mus musculus
gggaaaatcatccagcagacttgga

SEQ ID NO: 712197 - DNA, 25 bp, Mus musculus
gggaaaatcatcgagcagacttgga

SEQ ID NO: 712198 - DNA, 25 bp, Mus musculus
gggaaaatcccacttgacgtcaatg

SEQ ID NO: 712199 - DNA, 25 bp, Mus musculus
gggaaaatcccagttgacgtcaatg

SEQ ID NO: 712200 - DNA, 25 bp, Mus musculus
gggaaaatgcctacccgtgcagctc

SEQ ID NO: 712201 - DNA, 25 bp, Mus musculus
gggaaaatgccttcccgtgcagctc

SEQ ID NO: 712202 - DNA, 25 bp, Mus musculus
gggaaaatgtgtctcaggcccctca

SEQ ID NO: 712203 - DNA, 25 bp, Mus musculus
gggaaaatgtgtgtcaggcccctca

SEQ ID NO: 712204 - DNA, 25 bp, Mus musculus
gggaaacaagcgcatcgactattca

SEQ ID NO: 712205 - DNA, 25 bp, Mus musculus
gggaaacaagcggatcgactattca

SEQ ID NO: 712206 - DNA, 25 bp, Mus musculus
gggaaacacccgcatctgaagtata

SEQ ID NO: 712207 - DNA, 25 bp, Mus musculus
gggaaacacccggatctgaagtata

SEQ ID NO: 712208 - DNA, 25 bp, Mus musculus
gggaaacacgtgaacgtagaaggat

SEQ ID NO: 712209 - DNA, 25 bp, Mus musculus
gggaaacacgtgtacgtagaaggat

SEQ ID NO: 712210 - DNA, 25 bp, Mus musculus
gggaaacagattcatactttgtatc

SEQ ID NO: 712211 - DNA, 25 bp, Mus musculus
gggaaacagattgatactttgtatc

SEQ ID NO: 712212 - DNA, 25 bp, Mus musculus
gggaaacagctcagtcttcaccctc

SEQ ID NO: 712213 - DNA, 25 bp, Mus musculus
gggaaacagctctgtcttcaccctc

SEQ ID NO: 712214 - DNA, 25 bp, Mus musculus
gggaaacaggtcaactttacagtgg

SEQ ID NO: 712215 - DNA, 25 bp, Mus musculus
gggaaacaggtctactttacagtgg

SEQ ID NO: 712216 - DNA, 25 bp, Mus musculus
gggaaaccatcacgctaaggtgcca

SEQ ID NO: 712217 - DNA, 25 bp, Mus musculus
gggaaaccatcaggctaaggtgcca

SEQ ID NO: 712218 - DNA, 25 bp, Mus musculus
gggaaaccattgagctgcggctagt

SEQ ID NO: 712219 - DNA, 25 bp, Mus musculus
gggaaaccattgtgctgcggctagt

SEQ ID NO: 712220 - DNA, 25 bp, Mus musculus
gggaaacccagccaatacgaactgc

SEQ ID NO: 712221 - DNA, 25 bp, Mus musculus
gggaaacccagcgaatacgaactgc

SEQ ID NO: 712222 - DNA, 25 bp, Mus musculus
gggaaaccccagcagctcctatgtg

SEQ ID NO: 712223 - DNA, 25 bp, Mus musculus
gggaaaccccaggagctcctatgtg

SEQ ID NO: 712224 - DNA, 25 bp, Mus musculus
gggaaaccccataacatcttgtaca

SEQ ID NO: 712225 - DNA, 25 bp, Mus musculus
gggaaaccccattacatcttgtaca

SEQ ID NO: 712226 - DNA, 25 bp, Mus musculus
gggaaacccttccagcccttgcttg

SEQ ID NO: 712227 - DNA, 25 bp, Mus musculus
gggaaacccttcgagcccttgcttg

SEQ ID NO: 712228 - DNA, 25 bp, Mus musculus
gggaaaccctttcagctttcacatc

SEQ ID NO: 712229 - DNA, 25 bp, Mus musculus
gggaaaccctttgagctttcacatc

SEQ ID NO: 712230 - DNA, 25 bp, Mus musculus
gggaaacctacactcagaagcagct

SEQ ID NO: 712231 - DNA, 25 bp, Mus musculus
gggaaacctacagtcagaagcagct

SEQ ID NO: 712232 - DNA, 25 bp, Mus musculus
gggaaacctatgactatggaagaac

SEQ ID NO: 712233 - DNA, 25 bp, Mus musculus
gggaaacctatgtctatggaagaac

SEQ ID NO: 712234 - DNA, 25 bp, Mus musculus
gggaaacctgaacacctataagcgt

SEQ ID NO: 712235 - DNA, 25 bp, Mus musculus
gggaaacctgaagacctataagcgt

SEQ ID NO: 712236 - DNA, 25 bp, Mus musculus
gggaaacctgatctgtgatgccatg

SEQ ID NO: 712237 - DNA, 25 bp, Mus musculus
gggaaacctgatgtgtgatgccatg

SEQ ID NO: 712238 - DNA, 25 bp, Mus musculus
gggaaacgacagaagctcactacca

SEQ ID NO: 712239 - DNA, 25 bp, Mus musculus
gggaaacgacagtagctcactacca

SEQ ID NO: 712240 - DNA, 25 bp, Mus musculus
gggaaacgaggtctctaccacacct

SEQ ID NO: 712241 - DNA, 25 bp, Mus musculus
gggaaacgaggtgtctaccacacct

SEQ ID NO: 712242 - DNA, 25 bp, Mus musculus
gggaaacggaggcaaataaagctga

SEQ ID NO: 712243 - DNA, 25 bp, Mus musculus
gggaaacggagggaaataaagctga

SEQ ID NO: 712244 - DNA, 25 bp, Mus musculus
gggaaacggcatacaaagccatgat

SEQ ID NO: 712245 - DNA, 25 bp, Mus musculus
gggaaacggcattcaaagccatgat

SEQ ID NO: 712246 - DNA, 25 bp, Mus musculus
gggaaactctacaccctggtcctca

SEQ ID NO: 712247 - DNA, 25 bp, Mus musculus
gggaaactctactccctggtcctca

SEQ ID NO: 712248 - DNA, 25 bp, Mus musculus
gggaaactgtaaaatggtcctcgtg

SEQ ID NO: 712249 - DNA, 25 bp, Mus musculus
gggaaactgtaatatggtcctcgtg

SEQ ID NO: 712250 - DNA, 25 bp, Mus musculus
gggaaactgtataatacctgctctg

SEQ ID NO: 712251 - DNA, 25 bp, Mus musculus
gggaaactgtattatacctgctctg

SEQ ID NO: 712252 - DNA, 25 bp, Mus musculus
gggaaactgtgccacctgggcacaa

SEQ ID NO: 712253 - DNA, 25 bp, Mus musculus
gggaaactgtgcgacctgggcacaa

SEQ ID NO: 712254 - DNA, 25 bp, Mus musculus
gggaaacttctcatttacaccgagt

SEQ ID NO: 712255 - DNA, 25 bp, Mus musculus
gggaaacttctcttttacaccgagt

SEQ ID NO: 712256 - DNA, 25 bp, Mus musculus
gggaaacttctgcatattattcaca

SEQ ID NO: 712257 - DNA, 25 bp, Mus musculus
gggaaacttctggatattattcaca

SEQ ID NO: 712258 - DNA, 25 bp, Mus musculus
gggaaacttgccctgtggttcatac

SEQ ID NO: 712259 - DNA, 25 bp, Mus musculus
gggaaacttgccgtgtggttcatac

SEQ ID NO: 712260 - DNA, 25 bp, Mus musculus
gggaaagaaccaattactatgtgga

SEQ ID NO: 712261 - DNA, 25 bp, Mus musculus
gggaaagaaccatttactatgtgga

SEQ ID NO: 712262 - DNA, 25 bp, Mus musculus
gggaaagagctgaaagtacctcatg

SEQ ID NO: 712263 - DNA, 25 bp, Mus musculus
gggaaagagctgtaagtacctcatg

SEQ ID NO: 712264 - DNA, 25 bp, Mus musculus
gggaaagagtcccaacatcatcatg

SEQ ID NO: 712265 - DNA, 25 bp, Mus musculus
gggaaagagtccgaacatcatcatg

SEQ ID NO: 712266 - DNA, 25 bp, Mus musculus
gggaaagatggcctaccagagcctc

SEQ ID NO: 712267 - DNA, 25 bp, Mus musculus
gggaaagatggcgtaccagagcctc

SEQ ID NO: 712268 - DNA, 25 bp, Mus musculus
gggaaagatggtactagacctgacc

SEQ ID NO: 712269 - DNA, 25 bp, Mus musculus
gggaaagatggttctagacctgacc

SEQ ID NO: 712270 - DNA, 25 bp, Mus musculus
gggaaagcaccaactaccctggaga

SEQ ID NO: 712271 - DNA, 25 bp, Mus musculus
gggaaagcaccatctaccctggaga

SEQ ID NO: 712272 - DNA, 25 bp, Mus musculus
gggaaagcatttctagcatgcccaa

SEQ ID NO: 712273 - DNA, 25 bp, Mus musculus
gggaaagcatttgtagcatgcccaa

SEQ ID NO: 712274 - DNA, 25 bp, Mus musculus
gggaaagccagtcatgattttcacg

SEQ ID NO: 712275 - DNA, 25 bp, Mus musculus
gggaaagccagtgatgattttcacg

SEQ ID NO: 712276 - DNA, 25 bp, Mus musculus
gggaaagccttccagcgcagttcat

SEQ ID NO: 712277 - DNA, 25 bp, Mus musculus
gggaaagccttcgagcgcagttcat

SEQ ID NO: 712278 - DNA, 25 bp, Mus musculus
gggaaagcgattccggaaatcaaga

SEQ ID NO: 712279 - DNA, 25 bp, Mus musculus
gggaaagcgattgcggaaatcaaga

SEQ ID NO: 712280 - DNA, 25 bp, Mus musculus
gggaaagcgtcaacaagctcaggta

SEQ ID NO: 712281 - DNA, 25 bp, Mus musculus
gggaaagcgtcatcaagctcaggta

SEQ ID NO: 712282 - DNA, 25 bp, Mus musculus
gggaaagcttcaacacacccttcct

SEQ ID NO: 712283 - DNA, 25 bp, Mus musculus
gggaaagcttcaatattcactggac

SEQ ID NO: 712284 - DNA, 25 bp, Mus musculus
gggaaagcttcatcacacccttcct

SEQ ID NO: 712285 - DNA, 25 bp, Mus musculus
gggaaagcttcattattcactggac

SEQ ID NO: 712286 - DNA, 25 bp, Mus musculus
gggaaagcttccagcccaactgtaa

SEQ ID NO: 712287 - DNA, 25 bp, Mus musculus
gggaaagcttcctgcccaactgtaa

SEQ ID NO: 712288 - DNA, 25 bp, Mus musculus
gggaaaggaagcatgaacttggcca

SEQ ID NO: 712289 - DNA, 25 bp, Mus musculus
gggaaaggaagcttgaacttggcca

SEQ ID NO: 712290 - DNA, 25 bp, Mus musculus
gggaaaggacatcatcccatcaaat

SEQ ID NO: 712291 - DNA, 25 bp, Mus musculus
gggaaaggacatgatcccatcaaat

SEQ ID NO: 712292 - DNA, 25 bp, Mus musculus
gggaaaggagccaatagaaaccctg

SEQ ID NO: 712293 - DNA, 25 bp, Mus musculus
gggaaaggagcctatagaaaccctg

SEQ ID NO: 712294 - DNA, 25 bp, Mus musculus
gggaaaggattcagtcagtctagga

SEQ ID NO: 712295 - DNA, 25 bp, Mus musculus
gggaaaggattctgtcagtctagga

SEQ ID NO: 712296 - DNA, 25 bp, Mus musculus
gggaaagtacatcaattgtggtcaa

SEQ ID NO: 712297 - DNA, 25 bp, Mus musculus
gggaaagtacatgaattgtggtcaa

SEQ ID NO: 712298 - DNA, 25 bp, Mus musculus
gggaaagtcattacagtgccacaca

SEQ ID NO: 712299 - DNA, 25 bp, Mus musculus
gggaaagtcatttcagtgccacaca

SEQ ID NO: 712300 - DNA, 25 bp, Mus musculus
gggaaagttttccttgccgagtgct

SEQ ID NO: 712301 - DNA, 25 bp, Mus musculus
gggaaagttttcgttgccgagtgct

SEQ ID NO: 712302 - DNA, 25 bp, Mus musculus
gggaaatacacacagttggcaagag

SEQ ID NO: 712303 - DNA, 25 bp, Mus musculus
gggaaatacacagagttggcaagag

SEQ ID NO: 712304 - DNA, 25 bp, Mus musculus
gggaaatacttgcagagccagccag

SEQ ID NO: 712305 - DNA, 25 bp, Mus musculus
gggaaatacttggagagccagccag

SEQ ID NO: 712306 - DNA, 25 bp, Mus musculus
gggaaatatcagaagcacgaatcct

SEQ ID NO: 712307 - DNA, 25 bp, Mus musculus
gggaaatatcagtagcacgaatcct

SEQ ID NO: 712308 - DNA, 25 bp, Mus musculus
gggaaatatctcactgcgtgctttt

SEQ ID NO: 712309 - DNA, 25 bp, Mus musculus
gggaaatatctctctgcgtgctttt

SEQ ID NO: 712310 - DNA, 25 bp, Mus musculus
gggaaatatctgatcagccctcaca

SEQ ID NO: 712311 - DNA, 25 bp, Mus musculus
gggaaatatctgttcagccctcaca

SEQ ID NO: 712312 - DNA, 25 bp, Mus musculus
gggaaatcacgtactacatgaaggg

SEQ ID NO: 712313 - DNA, 25 bp, Mus musculus
gggaaatcacgttctacatgaaggg

SEQ ID NO: 712314 - DNA, 25 bp, Mus musculus
gggaaatcactaagcccagacgtga

SEQ ID NO: 712315 - DNA, 25 bp, Mus musculus
gggaaatcactatgcccagacgtga

SEQ ID NO: 712316 - DNA, 25 bp, Mus musculus
gggaaatcatctcgcagcagtacaa

SEQ ID NO: 712317 - DNA, 25 bp, Mus musculus
gggaaatcatctggcagcagtacaa

SEQ ID NO: 712318 - DNA, 25 bp, Mus musculus
gggaaatcatttctcctggacttca

SEQ ID NO: 712319 - DNA, 25 bp, Mus musculus
gggaaatcatttgtcctggacttca

SEQ ID NO: 712320 - DNA, 25 bp, Mus musculus
gggaaatcctacagtcagagctcaa

SEQ ID NO: 712321 - DNA, 25 bp, Mus musculus
gggaaatcctactgtcagagctcaa

SEQ ID NO: 712322 - DNA, 25 bp, Mus musculus
gggaaatccttcaacacaaaagcag

SEQ ID NO: 712323 - DNA, 25 bp, Mus musculus
gggaaatccttctacacaaaagcag

SEQ ID NO: 712324 - DNA, 25 bp, Mus musculus
gggaaatcttcaaagccatcttgtg

SEQ ID NO: 712325 - DNA, 25 bp, Mus musculus
gggaaatcttcatagccatcttgtg

SEQ ID NO: 712326 - DNA, 25 bp, Mus musculus
gggaaatgagcccagactccaagtg

SEQ ID NO: 712327 - DNA, 25 bp, Mus musculus
gggaaatgagccgagactccaagtg

SEQ ID NO: 712328 - DNA, 25 bp, Mus musculus
gggaaatgatgaagacctttgggca

SEQ ID NO: 712329 - DNA, 25 bp, Mus musculus
gggaaatgatgatgacctttgggca

SEQ ID NO: 712330 - DNA, 25 bp, Mus musculus
gggaaatgcacaaacccggtcctca

SEQ ID NO: 712331 - DNA, 25 bp, Mus musculus
gggaaatgcacatacccggtcctca

SEQ ID NO: 712332 - DNA, 25 bp, Mus musculus
gggaaattgttaactgtgcgtggca

SEQ ID NO: 712333 - DNA, 25 bp, Mus musculus
gggaaattgttatctgtgcgtggca

SEQ ID NO: 712334 - DNA, 25 bp, Mus musculus
gggaaattttgaagctgctgtgaag

SEQ ID NO: 712335 - DNA, 25 bp, Mus musculus
gggaaattttgatgctgctgtgaag

SEQ ID NO: 712336 - DNA, 25 bp, Mus musculus
gggaacaaaccgactgataaggcca

SEQ ID NO: 712337 - DNA, 25 bp, Mus musculus
gggaacaaaccgtctgataaggcca

SEQ ID NO: 712338 - DNA, 25 bp, Mus musculus
gggaacaaatcccacatgtgccggg

SEQ ID NO: 712339 - DNA, 25 bp, Mus musculus
gggaacaaatccgacatgtgccggg

SEQ ID NO: 712340 - DNA, 25 bp, Mus musculus
gggaacaaattgacaacctagctac

SEQ ID NO: 712341 - DNA, 25 bp, Mus musculus
gggaacaaattgtcaacctagctac

SEQ ID NO: 712342 - DNA, 25 bp, Mus musculus
gggaacaacggacgcccctcctgag

SEQ ID NO: 712343 - DNA, 25 bp, Mus musculus
gggaacaacggaggcccctcctgag

SEQ ID NO: 712344 - DNA, 25 bp, Mus musculus
gggaacaagatcagcatcctcctta

SEQ ID NO: 712345 - DNA, 25 bp, Mus musculus
gggaacaagatctgcatcctcctta

SEQ ID NO: 712346 - DNA, 25 bp, Mus musculus
gggaacaatatcatgcactctatca

SEQ ID NO: 712347 - DNA, 25 bp, Mus musculus
gggaacaatatcttgcactctatca

SEQ ID NO: 712348 - DNA, 25 bp, Mus musculus
gggaacacaaccatacttcttcaat

SEQ ID NO: 712349 - DNA, 25 bp, Mus musculus
gggaacacaaccttacttcttcaat

SEQ ID NO: 712350 - DNA, 25 bp, Mus musculus
gggaacacccgccaagatcaagaaa

SEQ ID NO: 712351 - DNA, 25 bp, Mus musculus
gggaacacccgcgaagatcaagaaa

SEQ ID NO: 712352 - DNA, 25 bp, Mus musculus
gggaacaccgggagcctcccactgc

SEQ ID NO: 712353 - DNA, 25 bp, Mus musculus
gggaacaccgggtgcctcccactgc

SEQ ID NO: 712354 - DNA, 25 bp, Mus musculus
gggaacacctagcttggaagttctg

SEQ ID NO: 712355 - DNA, 25 bp, Mus musculus
gggaacacctaggttggaagttctg

SEQ ID NO: 712356 - DNA, 25 bp, Mus musculus
gggaacacgaccctttgtgatctcc

SEQ ID NO: 712357 - DNA, 25 bp, Mus musculus
gggaacacgaccgtttgtgatctcc

SEQ ID NO: 712358 - DNA, 25 bp, Mus musculus
gggaacactcatcactgggttggca

SEQ ID NO: 712359 - DNA, 25 bp, Mus musculus
gggaacactcatgactgggttggca

SEQ ID NO: 712360 - DNA, 25 bp, Mus musculus
gggaacactctcaaagaagactgga

SEQ ID NO: 712361 - DNA, 25 bp, Mus musculus
gggaacactctctaagaagactgga

SEQ ID NO: 712362 - DNA, 25 bp, Mus musculus
gggaacagaactccaagcaacactt

SEQ ID NO: 712363 - DNA, 25 bp, Mus musculus
gggaacagaactgcaagcaacactt

SEQ ID NO: 712364 - DNA, 25 bp, Mus musculus
gggaacagatgtcaatgtggcaaca

SEQ ID NO: 712365 - DNA, 25 bp, Mus musculus
gggaacagatgtgaatgtggcaaca

SEQ ID NO: 712366 - DNA, 25 bp, Mus musculus
gggaacagattcaggacacagagat

SEQ ID NO: 712367 - DNA, 25 bp, Mus musculus
gggaacagattctggacacagagat

SEQ ID NO: 712368 - DNA, 25 bp, Mus musculus
gggaacagcagacgagaccaggaga

SEQ ID NO: 712369 - DNA, 25 bp, Mus musculus
gggaacagcagaggagaccaggaga

SEQ ID NO: 712370 - DNA, 25 bp, Mus musculus
gggaacagctcccaaacgcactgtg

SEQ ID NO: 712371 - DNA, 25 bp, Mus musculus
gggaacagctccgaaacgcactgtg

SEQ ID NO: 712372 - DNA, 25 bp, Mus musculus
gggaacaggcctctcccaactctga

SEQ ID NO: 712373 - DNA, 25 bp, Mus musculus
gggaacaggcctgtcccaactctga

SEQ ID NO: 712374 - DNA, 25 bp, Mus musculus
gggaacaggctcaggccaagtttga

SEQ ID NO: 712375 - DNA, 25 bp, Mus musculus
gggaacaggctctggccaagtttga

SEQ ID NO: 712376 - DNA, 25 bp, Mus musculus
gggaacagggccatttcatgttaat

SEQ ID NO: 712377 - DNA, 25 bp, Mus musculus
gggaacagggccttttcatgttaat

SEQ ID NO: 712378 - DNA, 25 bp, Mus musculus
gggaacagtcatctaagaccctctt

SEQ ID NO: 712379 - DNA, 25 bp, Mus musculus
gggaacagtcatgtaagaccctctt

SEQ ID NO: 712380 - DNA, 25 bp, Mus musculus
gggaacatcattaagaagaagggat

SEQ ID NO: 712381 - DNA, 25 bp, Mus musculus
gggaacatcatttagaagaagggat

SEQ ID NO: 712382 - DNA, 25 bp, Mus musculus
gggaacatcgagatcaagcctgaat

SEQ ID NO: 712383 - DNA, 25 bp, Mus musculus
gggaacatcgagttcaagcctgaat

SEQ ID NO: 712384 - DNA, 25 bp, Mus musculus
gggaacatcgctacctaaagagacg

SEQ ID NO: 712385 - DNA, 25 bp, Mus musculus
gggaacatcgcttcctaaagagacg

SEQ ID NO: 712386 - DNA, 25 bp, Mus musculus
gggaacatggctctaaaacggatcc

SEQ ID NO: 712387 - DNA, 25 bp, Mus musculus
gggaacatggctgtaaaacggatcc

SEQ ID NO: 712388 - DNA, 25 bp, Mus musculus
gggaacatggttcaccagcacagcc

SEQ ID NO: 712389 - DNA, 25 bp, Mus musculus
gggaacatggttgaccagcacagcc

SEQ ID NO: 712390 - DNA, 25 bp, Mus musculus
gggaacattaagatgtcacaaacaa

SEQ ID NO: 712391 - DNA, 25 bp, Mus musculus
gggaacattaagttgtcacaaacaa

SEQ ID NO: 712392 - DNA, 25 bp, Mus musculus
gggaacattcacatacctcgcttgg

SEQ ID NO: 712393 - DNA, 25 bp, Mus musculus
gggaacattcacttacctcgcttgg

SEQ ID NO: 712394 - DNA, 25 bp, Mus musculus
gggaacattgccaatcacttcttca

SEQ ID NO: 712395 - DNA, 25 bp, Mus musculus
gggaacattgcctatcacttcttca

SEQ ID NO: 712396 - DNA, 25 bp, Mus musculus
gggaacattggtacctcacaaactc

SEQ ID NO: 712397 - DNA, 25 bp, Mus musculus
gggaacattggttcctcacaaactc

SEQ ID NO: 712398 - DNA, 25 bp, Mus musculus
gggaacatttctccccaatggaaga

SEQ ID NO: 712399 - DNA, 25 bp, Mus musculus
gggaacatttctgcccaatggaaga

SEQ ID NO: 712400 - DNA, 25 bp, Mus musculus
gggaaccacacacgctggaagatac

SEQ ID NO: 712401 - DNA, 25 bp, Mus musculus
gggaaccacacaggctggaagatac

SEQ ID NO: 712402 - DNA, 25 bp, Mus musculus
gggaaccaccttaagatccaagaag

SEQ ID NO: 712403 - DNA, 25 bp, Mus musculus
gggaaccacctttagatccaagaag

SEQ ID NO: 712404 - DNA, 25 bp, Mus musculus
gggaaccatcgacggcctagagcct

SEQ ID NO: 712405 - DNA, 25 bp, Mus musculus
gggaaccatcgagggcctagagcct

SEQ ID NO: 712406 - DNA, 25 bp, Mus musculus
gggaaccatggaaaacatccctaca

SEQ ID NO: 712407 - DNA, 25 bp, Mus musculus
gggaaccatggataacatccctaca

SEQ ID NO: 712408 - DNA, 25 bp, Mus musculus
gggaaccattctcaaggcctctgtg

SEQ ID NO: 712409 - DNA, 25 bp, Mus musculus
gggaaccattctgaaggcctctgtg

SEQ ID NO: 712410 - DNA, 25 bp, Mus musculus
gggaacccaaatagtgctgtcttcc

SEQ ID NO: 712411 - DNA, 25 bp, Mus musculus
gggaacccaaattgtgctgtcttcc

SEQ ID NO: 712412 - DNA, 25 bp, Mus musculus
gggaacccagcgctcttgactgttt

SEQ ID NO: 712413 - DNA, 25 bp, Mus musculus
gggaacccagcggtcttgactgttt

SEQ ID NO: 712414 - DNA, 25 bp, Mus musculus
gggaacccccatcaaatgcgggcag

SEQ ID NO: 712415 - DNA, 25 bp, Mus musculus
gggaacccccatgaaatgcgggcag

SEQ ID NO: 712416 - DNA, 25 bp, Mus musculus
gggaacccgacactcgctggaaatt

SEQ ID NO: 712417 - DNA, 25 bp, Mus musculus
gggaacccgacagtcgctggaaatt

SEQ ID NO: 712418 - DNA, 25 bp, Mus musculus
gggaaccctatcagacagtgccgtg

SEQ ID NO: 712419 - DNA, 25 bp, Mus musculus
gggaaccctatctgacagtgccgtg

SEQ ID NO: 712420 - DNA, 25 bp, Mus musculus
gggaaccctattactgttcagttgt

SEQ ID NO: 712421 - DNA, 25 bp, Mus musculus
gggaaccctatttctgttcagttgt

SEQ ID NO: 712422 - DNA, 25 bp, Mus musculus
gggaaccctcatactcggactcatg

SEQ ID NO: 712423 - DNA, 25 bp, Mus musculus
gggaaccctcattctcggactcatg

SEQ ID NO: 712424 - DNA, 25 bp, Mus musculus
gggaaccctctcaacgtgattcaaa

SEQ ID NO: 712425 - DNA, 25 bp, Mus musculus
gggaaccctctctacgtgattcaaa

SEQ ID NO: 712426 - DNA, 25 bp, Mus musculus
gggaaccctgcaatacacccagtgg

SEQ ID NO: 712427 - DNA, 25 bp, Mus musculus
gggaaccctgcattacacccagtgg

SEQ ID NO: 712428 - DNA, 25 bp, Mus musculus
gggaaccctgctccttgctattttc

SEQ ID NO: 712429 - DNA, 25 bp, Mus musculus
gggaaccctgctgcttgctattttc

SEQ ID NO: 712430 - DNA, 25 bp, Mus musculus
gggaacccttctctcaacaccaaga

SEQ ID NO: 712431 - DNA, 25 bp, Mus musculus
gggaacccttctgtcaacaccaaga

SEQ ID NO: 712432 - DNA, 25 bp, Mus musculus
gggaaccgaagcacacggagctgct

SEQ ID NO: 712433 - DNA, 25 bp, Mus musculus
gggaaccgaagctcacggagctgct

SEQ ID NO: 712434 - DNA, 25 bp, Mus musculus
gggaaccgacacaaggcatcacaca

SEQ ID NO: 712435 - DNA, 25 bp, Mus musculus
gggaaccgacactaggcatcacaca

SEQ ID NO: 712436 - DNA, 25 bp, Mus musculus
gggaacctcaaaccaaggcaagaag

SEQ ID NO: 712437 - DNA, 25 bp, Mus musculus
gggaacctcaaagcaaggcaagaag

SEQ ID NO: 712438 - DNA, 25 bp, Mus musculus
gggaacctcttcctacgggagctga

SEQ ID NO: 712439 - DNA, 25 bp, Mus musculus
gggaacctcttcgtacgggagctga

SEQ ID NO: 712440 - DNA, 25 bp, Mus musculus
gggaacctggatccctgtgccttgt

SEQ ID NO: 712441 - DNA, 25 bp, Mus musculus
gggaacctggatgcctgtgccttgt

SEQ ID NO: 712442 - DNA, 25 bp, Mus musculus
gggaacctgtctaccggcttggcgt

SEQ ID NO: 712443 - DNA, 25 bp, Mus musculus
gggaacctgtctctcctaaatgaga

SEQ ID NO: 712444 - DNA, 25 bp, Mus musculus
gggaacctgtctgtcctaaatgaga

SEQ ID NO: 712445 - DNA, 25 bp, Mus musculus
gggaacctgtcttccggcttggcgt

SEQ ID NO: 712446 - DNA, 25 bp, Mus musculus
gggaaccttggcagcaactgggtta

SEQ ID NO: 712447 - DNA, 25 bp, Mus musculus
gggaaccttggctgcaactgggtta

SEQ ID NO: 712448 - DNA, 25 bp, Mus musculus
gggaacgagttcatttttgcaataa

SEQ ID NO: 712449 - DNA, 25 bp, Mus musculus
gggaacgagttcttttttgcaataa

SEQ ID NO: 712450 - DNA, 25 bp, Mus musculus
gggaacgccaatatagccgccagag

SEQ ID NO: 712451 - DNA, 25 bp, Mus musculus
gggaacgccaatttagccgccagag

SEQ ID NO: 712452 - DNA, 25 bp, Mus musculus
gggaacgctttgcttatccaatgcc

SEQ ID NO: 712453 - DNA, 25 bp, Mus musculus
gggaacgctttggttatccaatgcc

SEQ ID NO: 712454 - DNA, 25 bp, Mus musculus
gggaacggcctccagaaagccaagt

SEQ ID NO: 712455 - DNA, 25 bp, Mus musculus
gggaacggcctcgagaaagccaagt

SEQ ID NO: 712456 - DNA, 25 bp, Mus musculus
gggaacggtgttcaggactctgaag

SEQ ID NO: 712457 - DNA, 25 bp, Mus musculus
gggaacggtgttgaggactctgaag

SEQ ID NO: 712458 - DNA, 25 bp, Mus musculus
gggaacgttaacctctccacagcca

SEQ ID NO: 712459 - DNA, 25 bp, Mus musculus
gggaacgttaacgtctccacagcca

SEQ ID NO: 712460 - DNA, 25 bp, Mus musculus
gggaactacaagcatccagcagcta

SEQ ID NO: 712461 - DNA, 25 bp, Mus musculus
gggaactacaaggatccagcagcta

SEQ ID NO: 712462 - DNA, 25 bp, Mus musculus
gggaactcaattatagtggaccttt

SEQ ID NO: 712463 - DNA, 25 bp, Mus musculus
gggaactcaattttagtggaccttt

SEQ ID NO: 712464 - DNA, 25 bp, Mus musculus
gggaactcaccacctagcagcagtc

SEQ ID NO: 712465 - DNA, 25 bp, Mus musculus
gggaactcaccagctagcagcagtc

SEQ ID NO: 712466 - DNA, 25 bp, Mus musculus
gggaactcagtgaatcagatcgcca

SEQ ID NO: 712467 - DNA, 25 bp, Mus musculus
gggaactcagtgtatcagatcgcca

SEQ ID NO: 712468 - DNA, 25 bp, Mus musculus
gggaactccactctctgaggcactg

SEQ ID NO: 712469 - DNA, 25 bp, Mus musculus
gggaactccactgtctgaggcactg

SEQ ID NO: 712470 - DNA, 25 bp, Mus musculus
gggaactcggatacggcctgggaca

SEQ ID NO: 712471 - DNA, 25 bp, Mus musculus
gggaactcggattcggcctgggaca

SEQ ID NO: 712472 - DNA, 25 bp, Mus musculus
gggaactgcacacattgcatcaaag

SEQ ID NO: 712473 - DNA, 25 bp, Mus musculus
gggaactgcacagattgcatcaaag

SEQ ID NO: 712474 - DNA, 25 bp, Mus musculus
gggaactgccgaatcacaatgggaa

SEQ ID NO: 712475 - DNA, 25 bp, Mus musculus
gggaactgccgattcacaatgggaa

SEQ ID NO: 712476 - DNA, 25 bp, Mus musculus
gggaactgcctaattaacaaaatgt

SEQ ID NO: 712477 - DNA, 25 bp, Mus musculus
gggaactgcctatttaacaaaatgt

SEQ ID NO: 712478 - DNA, 25 bp, Mus musculus
gggaactgcctcaaatccccgactt

SEQ ID NO: 712479 - DNA, 25 bp, Mus musculus
gggaactgcctctaatccccgactt

SEQ ID NO: 712480 - DNA, 25 bp, Mus musculus
gggaactgctggatatgcctaatgt

SEQ ID NO: 712481 - DNA, 25 bp, Mus musculus
gggaactgctggttatgcctaatgt

SEQ ID NO: 712482 - DNA, 25 bp, Mus musculus
gggaactgtcatcattgacaataag

SEQ ID NO: 712483 - DNA, 25 bp, Mus musculus
gggaactgtcatgattgacaataag

SEQ ID NO: 712484 - DNA, 25 bp, Mus musculus
gggaactgttcaccggcatcgatga

SEQ ID NO: 712485 - DNA, 25 bp, Mus musculus
gggaactgttcagcggcatcgatga

SEQ ID NO: 712486 - DNA, 25 bp, Mus musculus
gggaacttcgatcaattgtactggc

SEQ ID NO: 712487 - DNA, 25 bp, Mus musculus
gggaacttcgatgaattgtactggc

SEQ ID NO: 712488 - DNA, 25 bp, Mus musculus
gggaagaaacgaatacagcctttgt

SEQ ID NO: 712489 - DNA, 25 bp, Mus musculus
gggaagaaacgattacagcctttgt

SEQ ID NO: 712490 - DNA, 25 bp, Mus musculus
gggaagaaatctccactcgtccatt

SEQ ID NO: 712491 - DNA, 25 bp, Mus musculus
gggaagaaatctgcactcgtccatt

SEQ ID NO: 712492 - DNA, 25 bp, Mus musculus
gggaagaagactcaggtaaattcct

SEQ ID NO: 712493 - DNA, 25 bp, Mus musculus
gggaagaagactgaggtaaattcct

SEQ ID NO: 712494 - DNA, 25 bp, Mus musculus
gggaagacaccgctggtcatcgatt

SEQ ID NO: 712495 - DNA, 25 bp, Mus musculus
gggaagacaccggtggtcatcgatt

SEQ ID NO: 712496 - DNA, 25 bp, Mus musculus
gggaagacatccaccttccgcatgg

SEQ ID NO: 712497 - DNA, 25 bp, Mus musculus
gggaagacatcctccttccgcatgg

SEQ ID NO: 712498 - DNA, 25 bp, Mus musculus
gggaagacatggagatctcacctca

SEQ ID NO: 712499 - DNA, 25 bp, Mus musculus
gggaagacatggtgatctcacctca

SEQ ID NO: 712500 - DNA, 25 bp, Mus musculus
gggaagaccctgattgctcgagctg

SEQ ID NO: 712501 - DNA, 25 bp, Mus musculus
gggaagaccctgtttgctcgagctg

SEQ ID NO: 712502 - DNA, 25 bp, Mus musculus
gggaagacctatctaacacaaacat

SEQ ID NO: 712503 - DNA, 25 bp, Mus musculus
gggaagacctatgtaacacaaacat

SEQ ID NO: 712504 - DNA, 25 bp, Mus musculus
gggaagacgtgaagcagtacaagcc

SEQ ID NO: 712505 - DNA, 25 bp, Mus musculus
gggaagacgtgatgcagtacaagcc

SEQ ID NO: 712506 - DNA, 25 bp, Mus musculus
gggaagacgtggctctccaccatcc

SEQ ID NO: 712507 - DNA, 25 bp, Mus musculus
gggaagacgtgggtctccaccatcc

SEQ ID NO: 712508 - DNA, 25 bp, Mus musculus
gggaagagatcaccccttccagaac

SEQ ID NO: 712509 - DNA, 25 bp, Mus musculus
gggaagagatcagcccttccagaac

SEQ ID NO: 712510 - DNA, 25 bp, Mus musculus
gggaagagcctcctcaagttctgct

SEQ ID NO: 712511 - DNA, 25 bp, Mus musculus
gggaagagcctcgtcaagttctgct

SEQ ID NO: 712512 - DNA, 25 bp, Mus musculus
gggaagaggagaaagtcattccgat

SEQ ID NO: 712513 - DNA, 25 bp, Mus musculus
gggaagaggagatagtcattccgat

SEQ ID NO: 712514 - DNA, 25 bp, Mus musculus
gggaagagtcatcgccagcgctcct

SEQ ID NO: 712515 - DNA, 25 bp, Mus musculus
gggaagagtcatggccagcgctcct

SEQ ID NO: 712516 - DNA, 25 bp, Mus musculus
gggaagagttatcccatcaacagca

SEQ ID NO: 712517 - DNA, 25 bp, Mus musculus
gggaagagttatgccatcaacagca

SEQ ID NO: 712518 - DNA, 25 bp, Mus musculus
gggaagatactcaggcaaggaacag

SEQ ID NO: 712519 - DNA, 25 bp, Mus musculus
gggaagatactctggcaaggaacag

SEQ ID NO: 712520 - DNA, 25 bp, Mus musculus
gggaagatagcccaagaccttatga

SEQ ID NO: 712521 - DNA, 25 bp, Mus musculus
gggaagatagccgaagaccttatga

SEQ ID NO: 712522 - DNA, 25 bp, Mus musculus
gggaagatcgtgaccacaaaggcga

SEQ ID NO: 712523 - DNA, 25 bp, Mus musculus
gggaagatcgtgtccacaaaggcga

SEQ ID NO: 712524 - DNA, 25 bp, Mus musculus
gggaagatgaccatctgtttaggtg

SEQ ID NO: 712525 - DNA, 25 bp, Mus musculus
gggaagatgaccctgttgcaatcca

SEQ ID NO: 712526 - DNA, 25 bp, Mus musculus
gggaagatgaccgtgttgcaatcca

SEQ ID NO: 712527 - DNA, 25 bp, Mus musculus
gggaagatgaccttctgtttaggtg

SEQ ID NO: 712528 - DNA, 25 bp, Mus musculus
gggaagatgcgactgcacaagatca

SEQ ID NO: 712529 - DNA, 25 bp, Mus musculus
gggaagatgcgagtgcacaagatca

SEQ ID NO: 712530 - DNA, 25 bp, Mus musculus
gggaagatggcgaacgactctcccg

SEQ ID NO: 712531 - DNA, 25 bp, Mus musculus
gggaagatggcgtacgactctcccg

SEQ ID NO: 712532 - DNA, 25 bp, Mus musculus
gggaagattataacccagagtgctt

SEQ ID NO: 712533 - DNA, 25 bp, Mus musculus
gggaagattatatcccagagtgctt

SEQ ID NO: 712534 - DNA, 25 bp, Mus musculus
gggaagcactgactccctggaccaa

SEQ ID NO: 712535 - DNA, 25 bp, Mus musculus
gggaagcactgagtccctggaccaa

SEQ ID NO: 712536 - DNA, 25 bp, Mus musculus
gggaagcatggtatcaccatggaaa

SEQ ID NO: 712537 - DNA, 25 bp, Mus musculus
gggaagcatggtttcaccatggaaa

SEQ ID NO: 712538 - DNA, 25 bp, Mus musculus
gggaagccagagaacaatactatga

SEQ ID NO: 712539 - DNA, 25 bp, Mus musculus
gggaagccagagtacaatactatga

SEQ ID NO: 712540 - DNA, 25 bp, Mus musculus
gggaagccagtccttcattactttg

SEQ ID NO: 712541 - DNA, 25 bp, Mus musculus
gggaagccagtcgttcattactttg

SEQ ID NO: 712542 - DNA, 25 bp, Mus musculus
gggaagccagtgacccatttcttct

SEQ ID NO: 712543 - DNA, 25 bp, Mus musculus
gggaagccagtgtcccatttcttct

SEQ ID NO: 712544 - DNA, 25 bp, Mus musculus
gggaagccatatatctacaacccag

SEQ ID NO: 712545 - DNA, 25 bp, Mus musculus
gggaagccatatttctacaacccag

SEQ ID NO: 712546 - DNA, 25 bp, Mus musculus
gggaagccattaaacaccctggcta

SEQ ID NO: 712547 - DNA, 25 bp, Mus musculus
gggaagccattatacaccctggcta

SEQ ID NO: 712548 - DNA, 25 bp, Mus musculus
gggaagccattgaacactggacaga

SEQ ID NO: 712549 - DNA, 25 bp, Mus musculus
gggaagccattgtacactggacaga

SEQ ID NO: 712550 - DNA, 25 bp, Mus musculus
gggaagcccgtcactgcctccaggg

SEQ ID NO: 712551 - DNA, 25 bp, Mus musculus
gggaagcccgtctctgcctccaggg

SEQ ID NO: 712552 - DNA, 25 bp, Mus musculus
gggaagccgctgatctttatgtgtc

SEQ ID NO: 712553 - DNA, 25 bp, Mus musculus
gggaagccgctgttctttatgtgtc

SEQ ID NO: 712554 - DNA, 25 bp, Mus musculus
gggaagcctgcaatgctacatctgc

SEQ ID NO: 712555 - DNA, 25 bp, Mus musculus
gggaagcctgcattgctacatctgc

SEQ ID NO: 712556 - DNA, 25 bp, Mus musculus
gggaagcgctacaggacgtgacact

SEQ ID NO: 712557 - DNA, 25 bp, Mus musculus
gggaagcgctactggacgtgacact

SEQ ID NO: 712558 - DNA, 25 bp, Mus musculus
gggaagctaataaaagcactattga

SEQ ID NO: 712559 - DNA, 25 bp, Mus musculus
gggaagctaatataagcactattga

SEQ ID NO: 712560 - DNA, 25 bp, Mus musculus
gggaagctcaccctctgtatcctgg

SEQ ID NO: 712561 - DNA, 25 bp, Mus musculus
gggaagctcaccgtctgtatcctgg

SEQ ID NO: 712562 - DNA, 25 bp, Mus musculus
gggaagctctcaccatctcaaaggc

SEQ ID NO: 712563 - DNA, 25 bp, Mus musculus
gggaagctctcagcatctcaaaggc

SEQ ID NO: 712564 - DNA, 25 bp, Mus musculus
gggaagctgaggagacccaaaactc

SEQ ID NO: 712565 - DNA, 25 bp, Mus musculus
gggaagctgaggtgacccaaaactc

SEQ ID NO: 712566 - DNA, 25 bp, Mus musculus
gggaaggacaccactgcatgtctgt

SEQ ID NO: 712567 - DNA, 25 bp, Mus musculus
gggaaggacacctctgcatgtctgt

SEQ ID NO: 712568 - DNA, 25 bp, Mus musculus
gggaaggactgcaacactcgccgcg

SEQ ID NO: 712569 - DNA, 25 bp, Mus musculus
gggaaggactgctacactcgccgcg

SEQ ID NO: 712570 - DNA, 25 bp, Mus musculus
gggaaggagctcaatggaaaacaga

SEQ ID NO: 712571 - DNA, 25 bp, Mus musculus
gggaaggagctctatggaaaacaga

SEQ ID NO: 712572 - DNA, 25 bp, Mus musculus
gggaaggatcatcaaatcttaagaa

SEQ ID NO: 712573 - DNA, 25 bp, Mus musculus
gggaaggatcatgaaatcttaagaa

SEQ ID NO: 712574 - DNA, 25 bp, Mus musculus
gggaaggatcttatgcaacagtgta

SEQ ID NO: 712575 - DNA, 25 bp, Mus musculus
gggaaggatcttttgcaacagtgta

SEQ ID NO: 712576 - DNA, 25 bp, Mus musculus
gggaaggcagctacaacagcttgag

SEQ ID NO: 712577 - DNA, 25 bp, Mus musculus
gggaaggcagcttcaacagcttgag

SEQ ID NO: 712578 - DNA, 25 bp, Mus musculus
gggaaggctcttccatcctgctgca

SEQ ID NO: 712579 - DNA, 25 bp, Mus musculus
gggaaggctcttgcatcctgctgca

SEQ ID NO: 712580 - DNA, 25 bp, Mus musculus
gggaaggctgcacaaaggaattcct

SEQ ID NO: 712581 - DNA, 25 bp, Mus musculus
gggaaggctgcagaaaggaattcct

SEQ ID NO: 712582 - DNA, 25 bp, Mus musculus
gggaaggctgtaaagcagccatcag

SEQ ID NO: 712583 - DNA, 25 bp, Mus musculus
gggaaggctgtatagcagccatcag

SEQ ID NO: 712584 - DNA, 25 bp, Mus musculus
gggaagggtgctaaatctttttgag

SEQ ID NO: 712585 - DNA, 25 bp, Mus musculus
gggaagggtgcttaatctttttgag

SEQ ID NO: 712586 - DNA, 25 bp, Mus musculus
gggaaggtcaccactcccttccgag

SEQ ID NO: 712587 - DNA, 25 bp, Mus musculus
gggaaggtcacctctcccttccgag

SEQ ID NO: 712588 - DNA, 25 bp, Mus musculus
gggaaggtccaaagcccgcacgctg

SEQ ID NO: 712589 - DNA, 25 bp, Mus musculus
gggaaggtccaatgcccgcacgctg

SEQ ID NO: 712590 - DNA, 25 bp, Mus musculus
gggaaggtgaatctagccaagctta

SEQ ID NO: 712591 - DNA, 25 bp, Mus musculus
gggaaggtgaatgtagccaagctta

SEQ ID NO: 712592 - DNA, 25 bp, Mus musculus
gggaagtaatccctgctcccacact

SEQ ID NO: 712593 - DNA, 25 bp, Mus musculus
gggaagtaatccgtgctcccacact

SEQ ID NO: 712594 - DNA, 25 bp, Mus musculus
gggaagtagacacccaagcacttca

SEQ ID NO: 712595 - DNA, 25 bp, Mus musculus
gggaagtagacagccaagcacttca

SEQ ID NO: 712596 - DNA, 25 bp, Mus musculus
gggaagtatacccagggaagctcat

SEQ ID NO: 712597 - DNA, 25 bp, Mus musculus
gggaagtataccgagggaagctcat

SEQ ID NO: 712598 - DNA, 25 bp, Mus musculus
gggaagtcacttctggagttagcca

SEQ ID NO: 712599 - DNA, 25 bp, Mus musculus
gggaagtcacttgtggagttagcca

SEQ ID NO: 712600 - DNA, 25 bp, Mus musculus
gggaagtcagctatggctcaccatt

SEQ ID NO: 712601 - DNA, 25 bp, Mus musculus
gggaagtcagctttggctcaccatt

SEQ ID NO: 712602 - DNA, 25 bp, Mus musculus
gggaagtccagcaaccagacaggca

SEQ ID NO: 712603 - DNA, 25 bp, Mus musculus
gggaagtccagctaccagacaggca

SEQ ID NO: 712604 - DNA, 25 bp, Mus musculus
gggaagtccattcagcagcgagcac

SEQ ID NO: 712605 - DNA, 25 bp, Mus musculus
gggaagtccattgagcagcgagcac

SEQ ID NO: 712606 - DNA, 25 bp, Mus musculus
gggaagtcgcctcacagtcagatga

SEQ ID NO: 712607 - DNA, 25 bp, Mus musculus
gggaagtcgcctgacagtcagatga

SEQ ID NO: 712608 - DNA, 25 bp, Mus musculus
gggaagtctctgagctatcaactcc

SEQ ID NO: 712609 - DNA, 25 bp, Mus musculus
gggaagtctctgtgctatcaactcc

SEQ ID NO: 712610 - DNA, 25 bp, Mus musculus
gggaagtgaacaagtaccatcacct

SEQ ID NO: 712611 - DNA, 25 bp, Mus musculus
gggaagtgaacatgtaccatcacct

SEQ ID NO: 712612 - DNA, 25 bp, Mus musculus
gggaagtgcttacgagtctaccaga

SEQ ID NO: 712613 - DNA, 25 bp, Mus musculus
gggaagtgcttaggagtctaccaga

SEQ ID NO: 712614 - DNA, 25 bp, Mus musculus
gggaagtggtagactgcacaattaa

SEQ ID NO: 712615 - DNA, 25 bp, Mus musculus
gggaagtggtagtctgcacaattaa

SEQ ID NO: 712616 - DNA, 25 bp, Mus musculus
gggaagtgtcacagcctaacggcgt

SEQ ID NO: 712617 - DNA, 25 bp, Mus musculus
gggaagtgtcactgcctaacggcgt

SEQ ID NO: 712618 - DNA, 25 bp, Mus musculus
gggaagttcatccaagtcaactacc

SEQ ID NO: 712619 - DNA, 25 bp, Mus musculus
gggaagttcatcgaagtcaactacc

SEQ ID NO: 712620 - DNA, 25 bp, Mus musculus
gggaagttggtgcttgcccctctca

SEQ ID NO: 712621 - DNA, 25 bp, Mus musculus
gggaagttggtggttgcccctctca

SEQ ID NO: 712622 - DNA, 25 bp, Mus musculus
gggaagttggttcctacaagatctg

SEQ ID NO: 712623 - DNA, 25 bp, Mus musculus
gggaagttggttgctacaagatctg

SEQ ID NO: 712624 - DNA, 25 bp, Mus musculus
gggaagttgtcaatacctgtaaaga

SEQ ID NO: 712625 - DNA, 25 bp, Mus musculus
gggaagttgtcattacctgtaaaga

SEQ ID NO: 712626 - DNA, 25 bp, Mus musculus
gggaataaaaagcacctgaggcaag

SEQ ID NO: 712627 - DNA, 25 bp, Mus musculus
gggaataaaaaggacctgaggcaag

SEQ ID NO: 712628 - DNA, 25 bp, Mus musculus
gggaataacaacaggatgtgcaacc

SEQ ID NO: 712629 - DNA, 25 bp, Mus musculus
gggaataacaactggatgtgcaacc

SEQ ID NO: 712630 - DNA, 25 bp, Mus musculus
gggaataacacaccggagacttttg

SEQ ID NO: 712631 - DNA, 25 bp, Mus musculus
gggaataacacagcggagacttttg

SEQ ID NO: 712632 - DNA, 25 bp, Mus musculus
gggaataagaatatccatgaggtca

SEQ ID NO: 712633 - DNA, 25 bp, Mus musculus
gggaataagaatttccatgaggtca

SEQ ID NO: 712634 - DNA, 25 bp, Mus musculus
gggaatacacctcaaaccagaggaa

SEQ ID NO: 712635 - DNA, 25 bp, Mus musculus
gggaatacacctgaaaccagaggaa

SEQ ID NO: 712636 - DNA, 25 bp, Mus musculus
gggaatacactacaccttgtccagt

SEQ ID NO: 712637 - DNA, 25 bp, Mus musculus
gggaatacactagaccttgtccagt

SEQ ID NO: 712638 - DNA, 25 bp, Mus musculus
gggaataccagccaacagatgaaag

SEQ ID NO: 712639 - DNA, 25 bp, Mus musculus
gggaataccagccatttagccttca

SEQ ID NO: 712640 - DNA, 25 bp, Mus musculus
gggaataccagcgaacagatgaaag

SEQ ID NO: 712641 - DNA, 25 bp, Mus musculus
gggaataccagcgatttagccttca

SEQ ID NO: 712642 - DNA, 25 bp, Mus musculus
gggaatacttgtatcttcaatgcag

SEQ ID NO: 712643 - DNA, 25 bp, Mus musculus
gggaatacttgtttcttcaatgcag

SEQ ID NO: 712644 - DNA, 25 bp, Mus musculus
gggaatacttttctgtctacaacaa

SEQ ID NO: 712645 - DNA, 25 bp, Mus musculus
gggaatacttttgtgtctacaacaa

SEQ ID NO: 712646 - DNA, 25 bp, Mus musculus
gggaatagcatgaaatccacatctc

SEQ ID NO: 712647 - DNA, 25 bp, Mus musculus
gggaatagcatgtaatccacatctc

SEQ ID NO: 712648 - DNA, 25 bp, Mus musculus
gggaatatatatctaaggtctccaa

SEQ ID NO: 712649 - DNA, 25 bp, Mus musculus
gggaatatatatgtaaggtctccaa

SEQ ID NO: 712650 - DNA, 25 bp, Mus musculus
gggaatatctgtcgcctgcaaggcc

SEQ ID NO: 712651 - DNA, 25 bp, Mus musculus
gggaatatctgtggcctgcaaggcc

SEQ ID NO: 712652 - DNA, 25 bp, Mus musculus
gggaatatgactcggccctgcaagc

SEQ ID NO: 712653 - DNA, 25 bp, Mus musculus
gggaatatgactgggccctgcaagc

SEQ ID NO: 712654 - DNA, 25 bp, Mus musculus
gggaatatgggtcccacggccttct

SEQ ID NO: 712655 - DNA, 25 bp, Mus musculus
gggaatatgggtgccacggccttct

SEQ ID NO: 712656 - DNA, 25 bp, Mus musculus
gggaatcaacagcagtgctgacttc

SEQ ID NO: 712657 - DNA, 25 bp, Mus musculus
gggaatcaacaggagtgctgacttc

SEQ ID NO: 712658 - DNA, 25 bp, Mus musculus
gggaatcagcagaactgccctgcga

SEQ ID NO: 712659 - DNA, 25 bp, Mus musculus
gggaatcagcagtactgccctgcga

SEQ ID NO: 712660 - DNA, 25 bp, Mus musculus
gggaatcattaccaagtagcctgtc

SEQ ID NO: 712661 - DNA, 25 bp, Mus musculus
gggaatcattacgaagtagcctgtc

SEQ ID NO: 712662 - DNA, 25 bp, Mus musculus
gggaatcattttaataggtcctcct

SEQ ID NO: 712663 - DNA, 25 bp, Mus musculus
gggaatcatttttataggtcctcct

SEQ ID NO: 712664 - DNA, 25 bp, Mus musculus
gggaatccaaaactatcacagtgga

SEQ ID NO: 712665 - DNA, 25 bp, Mus musculus
gggaatccaaaagtatcacagtgga

SEQ ID NO: 712666 - DNA, 25 bp, Mus musculus
gggaatccctctcgtgaatattggc

SEQ ID NO: 712667 - DNA, 25 bp, Mus musculus
gggaatccctctggtgaatattggc

SEQ ID NO: 712668 - DNA, 25 bp, Mus musculus
gggaatccgctgaggaaattcaagc

SEQ ID NO: 712669 - DNA, 25 bp, Mus musculus
gggaatccgctgtggaaattcaagc

SEQ ID NO: 712670 - DNA, 25 bp, Mus musculus
gggaatcggctcaccactgggctcg

SEQ ID NO: 712671 - DNA, 25 bp, Mus musculus
gggaatcggctctccactgggctcg

SEQ ID NO: 712672 - DNA, 25 bp, Mus musculus
gggaatctatataaccggctcatcc

SEQ ID NO: 712673 - DNA, 25 bp, Mus musculus
gggaatctatattaccggctcatcc

SEQ ID NO: 712674 - DNA, 25 bp, Mus musculus
gggaatctctgtcacccttctggga

SEQ ID NO: 712675 - DNA, 25 bp, Mus musculus
gggaatctctgtgacccttctggga

SEQ ID NO: 712676 - DNA, 25 bp, Mus musculus
gggaatctctttcagagtagagctc

SEQ ID NO: 712677 - DNA, 25 bp, Mus musculus
gggaatctctttgagagtagagctc

SEQ ID NO: 712678 - DNA, 25 bp, Mus musculus
gggaatctgaccaggtgcgcaagtc

SEQ ID NO: 712679 - DNA, 25 bp, Mus musculus
gggaatctgacctggtgcgcaagtc

SEQ ID NO: 712680 - DNA, 25 bp, Mus musculus
gggaatctgtctcgcaccctgtgag

SEQ ID NO: 712681 - DNA, 25 bp, Mus musculus
gggaatctgtctggcaccctgtgag

SEQ ID NO: 712682 - DNA, 25 bp, Mus musculus
gggaatcttgacatcctcaagcctt

SEQ ID NO: 712683 - DNA, 25 bp, Mus musculus
gggaatcttgacttcctcaagcctt

SEQ ID NO: 712684 - DNA, 25 bp, Mus musculus
gggaatcttgccacaggaccatgta

SEQ ID NO: 712685 - DNA, 25 bp, Mus musculus
gggaatcttgcctcaggaccatgta

SEQ ID NO: 712686 - DNA, 25 bp, Mus musculus
gggaatgacgacaaacacacgcttc

SEQ ID NO: 712687 - DNA, 25 bp, Mus musculus
gggaatgacgactaacacacgcttc

SEQ ID NO: 712688 - DNA, 25 bp, Mus musculus
gggaatgagacactagcagccgttt

SEQ ID NO: 712689 - DNA, 25 bp, Mus musculus
gggaatgagacagtagcagccgttt

SEQ ID NO: 712690 - DNA, 25 bp, Mus musculus
gggaatgatgacagaatactaccac

SEQ ID NO: 712691 - DNA, 25 bp, Mus musculus
gggaatgatgactgaatactaccac

SEQ ID NO: 712692 - DNA, 25 bp, Mus musculus
gggaatgcatagacatgagcaaagt

SEQ ID NO: 712693 - DNA, 25 bp, Mus musculus
gggaatgcatagtcatgagcaaagt

SEQ ID NO: 712694 - DNA, 25 bp, Mus musculus
gggaatgccatacacctctgggaca

SEQ ID NO: 712695 - DNA, 25 bp, Mus musculus
gggaatgccatagacctctgggaca

SEQ ID NO: 712696 - DNA, 25 bp, Mus musculus
gggaatgccctcatcgtgtgccccg

SEQ ID NO: 712697 - DNA, 25 bp, Mus musculus
gggaatgccctcttcgtgtgccccg

SEQ ID NO: 712698 - DNA, 25 bp, Mus musculus
gggaatgctcctcgccgccttcagg

SEQ ID NO: 712699 - DNA, 25 bp, Mus musculus
gggaatgctcctggccgccttcagg

SEQ ID NO: 712700 - DNA, 25 bp, Mus musculus
gggaatggaatgctatcatgtatgc

SEQ ID NO: 712701 - DNA, 25 bp, Mus musculus
gggaatggaatggtatcatgtatgc

SEQ ID NO: 712702 - DNA, 25 bp, Mus musculus
gggaatggactaatttgcaagattg

SEQ ID NO: 712703 - DNA, 25 bp, Mus musculus
gggaatggactattttgcaagattg

SEQ ID NO: 712704 - DNA, 25 bp, Mus musculus
gggaatggcttccatcctgagctgt

SEQ ID NO: 712705 - DNA, 25 bp, Mus musculus
gggaatggcttcgatcctgagctgt

SEQ ID NO: 712706 - DNA, 25 bp, Mus musculus
gggaatggctttaccatcaccagca

SEQ ID NO: 712707 - DNA, 25 bp, Mus musculus
gggaatggcttttccatcaccagca

SEQ ID NO: 712708 - DNA, 25 bp, Mus musculus
gggaatgggataatcccaagaagaa

SEQ ID NO: 712709 - DNA, 25 bp, Mus musculus
gggaatgggatattcccaagaagaa

SEQ ID NO: 712710 - DNA, 25 bp, Mus musculus
gggaatgggcctattgaactctctg

SEQ ID NO: 712711 - DNA, 25 bp, Mus musculus
gggaatgggccttttgaactctctg

SEQ ID NO: 712712 - DNA, 25 bp, Mus musculus
gggaatggtgaccatctctgcaccc

SEQ ID NO: 712713 - DNA, 25 bp, Mus musculus
gggaatggtgacgatctctgcaccc

SEQ ID NO: 712714 - DNA, 25 bp, Mus musculus
gggaatggttgaatacagtgtttaa

SEQ ID NO: 712715 - DNA, 25 bp, Mus musculus
gggaatggttgattacagtgtttaa

SEQ ID NO: 712716 - DNA, 25 bp, Mus musculus
gggaatgtatgaattgccacatctg

SEQ ID NO: 712717 - DNA, 25 bp, Mus musculus
gggaatgtatgatttgccacatctg

SEQ ID NO: 712718 - DNA, 25 bp, Mus musculus
gggaatgtggtcatgtacttcgcat

SEQ ID NO: 712719 - DNA, 25 bp, Mus musculus
gggaatgtggtcttgtacttcgcat

SEQ ID NO: 712720 - DNA, 25 bp, Mus musculus
gggaatgttcccagttcaccgtgtc

SEQ ID NO: 712721 - DNA, 25 bp, Mus musculus
gggaatgttccctgttcaccgtgtc

SEQ ID NO: 712722 - DNA, 25 bp, Mus musculus
gggaattaaacacatacttgtatgc

SEQ ID NO: 712723 - DNA, 25 bp, Mus musculus
gggaattaaacagatacttgtatgc

SEQ ID NO: 712724 - DNA, 25 bp, Mus musculus
gggaattaacccaagtgctgtgcta

SEQ ID NO: 712725 - DNA, 25 bp, Mus musculus
gggaattaaccctagtgctgtgcta

SEQ ID NO: 712726 - DNA, 25 bp, Mus musculus
gggaattacgccaggcactgcagac

SEQ ID NO: 712727 - DNA, 25 bp, Mus musculus
gggaattacgcctggcactgcagac

SEQ ID NO: 712728 - DNA, 25 bp, Mus musculus
gggaattcatggatgaccgtcttcc

SEQ ID NO: 712729 - DNA, 25 bp, Mus musculus
gggaattcatggttgaccgtcttcc

SEQ ID NO: 712730 - DNA, 25 bp, Mus musculus
gggaattcccaaaaacactgcacga

SEQ ID NO: 712731 - DNA, 25 bp, Mus musculus
gggaattcccaataacactgcacga

SEQ ID NO: 712732 - DNA, 25 bp, Mus musculus
gggaattctacaacgaggcctccaa

SEQ ID NO: 712733 - DNA, 25 bp, Mus musculus
gggaattctacatcgaggcctccaa

SEQ ID NO: 712734 - DNA, 25 bp, Mus musculus
gggaattctggcagaaatcatcatc

SEQ ID NO: 712735 - DNA, 25 bp, Mus musculus
gggaattctggctgaaatcatcatc

SEQ ID NO: 712736 - DNA, 25 bp, Mus musculus
gggaattgcagaagttactgggatt

SEQ ID NO: 712737 - DNA, 25 bp, Mus musculus
gggaattgcagatgttactgggatt

SEQ ID NO: 712738 - DNA, 25 bp, Mus musculus
gggaatttgcaacagagatctcctg

SEQ ID NO: 712739 - DNA, 25 bp, Mus musculus
gggaatttgcaagagagatctcctg

SEQ ID NO: 712740 - DNA, 25 bp, Mus musculus
gggaatttgcacaccataccaacca

SEQ ID NO: 712741 - DNA, 25 bp, Mus musculus
gggaatttgcactccataccaacca

SEQ ID NO: 712742 - DNA, 25 bp, Mus musculus
gggaatttgccccaaatagtgtgca

SEQ ID NO: 712743 - DNA, 25 bp, Mus musculus
gggaatttgcccgaaatagtgtgca

SEQ ID NO: 712744 - DNA, 25 bp, Mus musculus
gggaatttgtgaatgccaccttcat

SEQ ID NO: 712745 - DNA, 25 bp, Mus musculus
gggaatttgtgattgccaccttcat

SEQ ID NO: 712746 - DNA, 25 bp, Mus musculus
gggacaaaatgcaccacccaaacct

SEQ ID NO: 712747 - DNA, 25 bp, Mus musculus
gggacaaaatgctccacccaaacct

SEQ ID NO: 712748 - DNA, 25 bp, Mus musculus
gggacaaactgcacagcgtctgcat

SEQ ID NO: 712749 - DNA, 25 bp, Mus musculus
gggacaaactgctcagcgtctgcat

SEQ ID NO: 712750 - DNA, 25 bp, Mus musculus
gggacaaagtgcaaatgacctgcgt

SEQ ID NO: 712751 - DNA, 25 bp, Mus musculus
gggacaaagtgctaatgacctgcgt

SEQ ID NO: 712752 - DNA, 25 bp, Mus musculus
gggacaaatataagctgagcaagaa

SEQ ID NO: 712753 - DNA, 25 bp, Mus musculus
gggacaaatatatgctgagcaagaa

SEQ ID NO: 712754 - DNA, 25 bp, Mus musculus
gggacaacaaacagatccccttgta

SEQ ID NO: 712755 - DNA, 25 bp, Mus musculus
gggacaacaaactgatccccttgta

SEQ ID NO: 712756 - DNA, 25 bp, Mus musculus
gggacaacagagagaccttaacgat

SEQ ID NO: 712757 - DNA, 25 bp, Mus musculus
gggacaacagagtgaccttaacgat

SEQ ID NO: 712758 - DNA, 25 bp, Mus musculus
gggacaacagcaaggtgacatcaga

SEQ ID NO: 712759 - DNA, 25 bp, Mus musculus
gggacaacagcatggtgacatcaga

SEQ ID NO: 712760 - DNA, 25 bp, Mus musculus
gggacaacagccatggtccctgttc

SEQ ID NO: 712761 - DNA, 25 bp, Mus musculus
gggacaacagccttggtccctgttc

SEQ ID NO: 712762 - DNA, 25 bp, Mus musculus
gggacaagacttcgagtctcatatc

SEQ ID NO: 712763 - DNA, 25 bp, Mus musculus
gggacaagacttggagtctcatatc

SEQ ID NO: 712764 - DNA, 25 bp, Mus musculus
gggacaagcccaagtcgccattctc

SEQ ID NO: 712765 - DNA, 25 bp, Mus musculus
gggacaagcccatgtcgccattctc

SEQ ID NO: 712766 - DNA, 25 bp, Mus musculus
gggacaaggaggagaccttaccact

SEQ ID NO: 712767 - DNA, 25 bp, Mus musculus
gggacaaggaggtgaccttaccact

SEQ ID NO: 712768 - DNA, 25 bp, Mus musculus
gggacaagtcatccccaacgggatt

SEQ ID NO: 712769 - DNA, 25 bp, Mus musculus
gggacaagtcatgcccaacgggatt

SEQ ID NO: 712770 - DNA, 25 bp, Mus musculus
gggacaagtcgaccggcaagcacta

SEQ ID NO: 712771 - DNA, 25 bp, Mus musculus
gggacaagtcgagcggcaagcacta

SEQ ID NO: 712772 - DNA, 25 bp, Mus musculus
gggacaagtgcaccaggagccttcc

SEQ ID NO: 712773 - DNA, 25 bp, Mus musculus
gggacaagtgcagcaggagccttcc

SEQ ID NO: 712774 - DNA, 25 bp, Mus musculus
gggacaagtttacaggctgctgctc

SEQ ID NO: 712775 - DNA, 25 bp, Mus musculus
gggacaagtttagaggctgctgctc

SEQ ID NO: 712776 - DNA, 25 bp, Mus musculus
gggacaatatggaaaatagtcaaag

SEQ ID NO: 712777 - DNA, 25 bp, Mus musculus
gggacaatatggtaaatagtcaaag

SEQ ID NO: 712778 - DNA, 25 bp, Mus musculus
gggacaatccgcagcaatacccgca

SEQ ID NO: 712779 - DNA, 25 bp, Mus musculus
gggacaatccgctgcaatacccgca

SEQ ID NO: 712780 - DNA, 25 bp, Mus musculus
gggacaatcgatactgcgaccagag

SEQ ID NO: 712781 - DNA, 25 bp, Mus musculus
gggacaatcgattctgcgaccagag

SEQ ID NO: 712782 - DNA, 25 bp, Mus musculus
gggacaatttctacttcactggagt

SEQ ID NO: 712783 - DNA, 25 bp, Mus musculus
gggacaatttcttcttcactggagt

SEQ ID NO: 712784 - DNA, 25 bp, Mus musculus
gggacacaaaaaccatcaccttctc

SEQ ID NO: 712785 - DNA, 25 bp, Mus musculus
gggacacaaaaagcatcaccttctc

SEQ ID NO: 712786 - DNA, 25 bp, Mus musculus
gggacacaccttccctaggcctgag

SEQ ID NO: 712787 - DNA, 25 bp, Mus musculus
gggacacaccttgcctaggcctgag

SEQ ID NO: 712788 - DNA, 25 bp, Mus musculus
gggacacacggtccaatcaagccag

SEQ ID NO: 712789 - DNA, 25 bp, Mus musculus
gggacacacggtgcaatcaagccag

SEQ ID NO: 712790 - DNA, 25 bp, Mus musculus
gggacacacttcaaggtcttacaag

SEQ ID NO: 712791 - DNA, 25 bp, Mus musculus
gggacacacttctaggtcttacaag

SEQ ID NO: 712792 - DNA, 25 bp, Mus musculus
gggacacagctaagtgctcctgctt

SEQ ID NO: 712793 - DNA, 25 bp, Mus musculus
gggacacagctatgtgctcctgctt

SEQ ID NO: 712794 - DNA, 25 bp, Mus musculus
gggacacagtgtcaggagcctcact

SEQ ID NO: 712795 - DNA, 25 bp, Mus musculus
gggacacagtgtgaggagcctcact

SEQ ID NO: 712796 - DNA, 25 bp, Mus musculus
gggacacatcacaatccagctgtgt

SEQ ID NO: 712797 - DNA, 25 bp, Mus musculus
gggacacatcactatccagctgtgt

SEQ ID NO: 712798 - DNA, 25 bp, Mus musculus
gggacaccaaaccatgaccaccttg

SEQ ID NO: 712799 - DNA, 25 bp, Mus musculus
gggacaccaaacgatgaccaccttg

SEQ ID NO: 712800 - DNA, 25 bp, Mus musculus
gggacaccacccacgagtgtgcctg

SEQ ID NO: 712801 - DNA, 25 bp, Mus musculus
gggacaccaccctcgagtgtgcctg

SEQ ID NO: 712802 - DNA, 25 bp, Mus musculus
gggacaccatccacagcctcagagg

SEQ ID NO: 712803 - DNA, 25 bp, Mus musculus
gggacaccatcctcagcctcagagg

SEQ ID NO: 712804 - DNA, 25 bp, Mus musculus
gggacaccatcgagagctgggccca

SEQ ID NO: 712805 - DNA, 25 bp, Mus musculus
gggacaccatcgtgagctgggccca

SEQ ID NO: 712806 - DNA, 25 bp, Mus musculus
gggacaccccgaaagaccgagctct

SEQ ID NO: 712807 - DNA, 25 bp, Mus musculus
gggacaccccgatagaccgagctct

SEQ ID NO: 712808 - DNA, 25 bp, Mus musculus
gggacaccgatcaaaattgaagacc

SEQ ID NO: 712809 - DNA, 25 bp, Mus musculus
gggacaccgatctaaattgaagacc

SEQ ID NO: 712810 - DNA, 25 bp, Mus musculus
gggacacctaacacaagagacctcc

SEQ ID NO: 712811 - DNA, 25 bp, Mus musculus
gggacacctaactcaagagacctcc

SEQ ID NO: 712812 - DNA, 25 bp, Mus musculus
gggacacctctactctgtccgctgg

SEQ ID NO: 712813 - DNA, 25 bp, Mus musculus
gggacacctctagtctgtccgctgg

SEQ ID NO: 712814 - DNA, 25 bp, Mus musculus
gggacacctttcacatgctatggag

SEQ ID NO: 712815 - DNA, 25 bp, Mus musculus
gggacacctttctcatgctatggag

SEQ ID NO: 712816 - DNA, 25 bp, Mus musculus
gggacacgccgaatgtgaccgcaac

SEQ ID NO: 712817 - DNA, 25 bp, Mus musculus
gggacacgccgattgtgaccgcaac

SEQ ID NO: 712818 - DNA, 25 bp, Mus musculus
gggacactataacatggtgaagcac

SEQ ID NO: 712819 - DNA, 25 bp, Mus musculus
gggacactataagatggtgaagcac

SEQ ID NO: 712820 - DNA, 25 bp, Mus musculus
gggacactctgaaccatcgatgcgg

SEQ ID NO: 712821 - DNA, 25 bp, Mus musculus
gggacactctgatccatcgatgcgg

SEQ ID NO: 712822 - DNA, 25 bp, Mus musculus
gggacactcttcattctctatgtac

SEQ ID NO: 712823 - DNA, 25 bp, Mus musculus
gggacactcttctttctctatgtac

SEQ ID NO: 712824 - DNA, 25 bp, Mus musculus
gggacactgatccaggtgccgtcct

SEQ ID NO: 712825 - DNA, 25 bp, Mus musculus
gggacactgatcgaggtgccgtcct

SEQ ID NO: 712826 - DNA, 25 bp, Mus musculus
gggacactggatcaccaccctgtgt

SEQ ID NO: 712827 - DNA, 25 bp, Mus musculus
gggacactggatgaccaccctgtgt

SEQ ID NO: 712828 - DNA, 25 bp, Mus musculus
gggacacttcatagatgagaatggc

SEQ ID NO: 712829 - DNA, 25 bp, Mus musculus
gggacacttcattgatgagaatggc

SEQ ID NO: 712830 - DNA, 25 bp, Mus musculus
gggacagaacagacctactcaacgt

SEQ ID NO: 712831 - DNA, 25 bp, Mus musculus
gggacagaacagtcctactcaacgt

SEQ ID NO: 712832 - DNA, 25 bp, Mus musculus
gggacagaacgaagcctcaggatga

SEQ ID NO: 712833 - DNA, 25 bp, Mus musculus
gggacagaacgatgcctcaggatga

SEQ ID NO: 712834 - DNA, 25 bp, Mus musculus
gggacagacaaactacccagcagac

SEQ ID NO: 712835 - DNA, 25 bp, Mus musculus
gggacagacaaagtacccagcagac

SEQ ID NO: 712836 - DNA, 25 bp, Mus musculus
gggacagacagaatctaggcctagc

SEQ ID NO: 712837 - DNA, 25 bp, Mus musculus
gggacagacagattctaggcctagc

SEQ ID NO: 712838 - DNA, 25 bp, Mus musculus
gggacagagcatagacactaccaga

SEQ ID NO: 712839 - DNA, 25 bp, Mus musculus
gggacagagcattgacactaccaga

SEQ ID NO: 712840 - DNA, 25 bp, Mus musculus
gggacagaggacagtacatacactt

SEQ ID NO: 712841 - DNA, 25 bp, Mus musculus
gggacagaggactgtacatacactt

SEQ ID NO: 712842 - DNA, 25 bp, Mus musculus
gggacagagttcacggaccattaca

SEQ ID NO: 712843 - DNA, 25 bp, Mus musculus
gggacagagttctcggaccattaca

SEQ ID NO: 712844 - DNA, 25 bp, Mus musculus
gggacagagttgaaacagcaggtct

SEQ ID NO: 712845 - DNA, 25 bp, Mus musculus
gggacagagttgtaacagcaggtct

SEQ ID NO: 712846 - DNA, 25 bp, Mus musculus
gggacagataaaaccacagcaggct

SEQ ID NO: 712847 - DNA, 25 bp, Mus musculus
gggacagataaatccacagcaggct

SEQ ID NO: 712848 - DNA, 25 bp, Mus musculus
gggacagatgacaggtcaatcagaa

SEQ ID NO: 712849 - DNA, 25 bp, Mus musculus
gggacagatgactggtcaatcagaa

SEQ ID NO: 712850 - DNA, 25 bp, Mus musculus
gggacagcaactcttctacgtctga

SEQ ID NO: 712851 - DNA, 25 bp, Mus musculus
gggacagcaactgttctacgtctga

SEQ ID NO: 712852 - DNA, 25 bp, Mus musculus
gggacagcacctactgcgcagtcaa

SEQ ID NO: 712853 - DNA, 25 bp, Mus musculus
gggacagcacctataaaaccatcac

SEQ ID NO: 712854 - DNA, 25 bp, Mus musculus
gggacagcaccttctgcgcagtcaa

SEQ ID NO: 712855 - DNA, 25 bp, Mus musculus
gggacagcacctttaaaaccatcac

SEQ ID NO: 712856 - DNA, 25 bp, Mus musculus
gggacagcggccctcttcagccaat

SEQ ID NO: 712857 - DNA, 25 bp, Mus musculus
gggacagcggccgtcttcagccaat

SEQ ID NO: 712858 - DNA, 25 bp, Mus musculus
gggacagctggacctgtgtccctca

SEQ ID NO: 712859 - DNA, 25 bp, Mus musculus
gggacagctggagctgtgtccctca

SEQ ID NO: 712860 - DNA, 25 bp, Mus musculus
gggacagctgttctaaccccatgag

SEQ ID NO: 712861 - DNA, 25 bp, Mus musculus
gggacagctgttgtaaccccatgag

SEQ ID NO: 712862 - DNA, 25 bp, Mus musculus
gggacaggaacactgcaaatctatt

SEQ ID NO: 712863 - DNA, 25 bp, Mus musculus
gggacaggaacagtgcaaatctatt

SEQ ID NO: 712864 - DNA, 25 bp, Mus musculus
gggacaggattgatgcatattcctg

SEQ ID NO: 712865 - DNA, 25 bp, Mus musculus
gggacaggattgttgcatattcctg

SEQ ID NO: 712866 - DNA, 25 bp, Mus musculus
gggacaggcaaccttgacgtctgat

SEQ ID NO: 712867 - DNA, 25 bp, Mus musculus
gggacaggcaacgttgacgtctgat

SEQ ID NO: 712868 - DNA, 25 bp, Mus musculus
gggacaggccagaatacgcatgcgt

SEQ ID NO: 712869 - DNA, 25 bp, Mus musculus
gggacaggccagtatacgcatgcgt

SEQ ID NO: 712870 - DNA, 25 bp, Mus musculus
gggacaggcctcatgatgatacaga

SEQ ID NO: 712871 - DNA, 25 bp, Mus musculus
gggacaggcctcttgatgatacaga

SEQ ID NO: 712872 - DNA, 25 bp, Mus musculus
gggacagggcctactgaagcagcca

SEQ ID NO: 712873 - DNA, 25 bp, Mus musculus
gggacagggccttctgaagcagcca

SEQ ID NO: 712874 - DNA, 25 bp, Mus musculus
gggacagggcttacggctccttgct

SEQ ID NO: 712875 - DNA, 25 bp, Mus musculus
gggacagggctttcggctccttgct

SEQ ID NO: 712876 - DNA, 25 bp, Mus musculus
gggacagtaaatccaagccttcctc

SEQ ID NO: 712877 - DNA, 25 bp, Mus musculus
gggacagtaaatgcaagccttcctc

SEQ ID NO: 712878 - DNA, 25 bp, Mus musculus
gggacagtacaaacctgacaatagg

SEQ ID NO: 712879 - DNA, 25 bp, Mus musculus
gggacagtacaatcctgacaatagg

SEQ ID NO: 712880 - DNA, 25 bp, Mus musculus
gggacagtatctactacctggaaga

SEQ ID NO: 712881 - DNA, 25 bp, Mus musculus
gggacagtatcttctacctggaaga

SEQ ID NO: 712882 - DNA, 25 bp, Mus musculus
gggacagtatgaccgctcaggaaac

SEQ ID NO: 712883 - DNA, 25 bp, Mus musculus
gggacagtatgagcgctcaggaaac

SEQ ID NO: 712884 - DNA, 25 bp, Mus musculus
gggacagtgtcgctcagccaatgct

SEQ ID NO: 712885 - DNA, 25 bp, Mus musculus
gggacagtgtcggtcagccaatgct

SEQ ID NO: 712886 - DNA, 25 bp, Mus musculus
gggacagttcgtaatgcatcaatca

SEQ ID NO: 712887 - DNA, 25 bp, Mus musculus
gggacagttcgttatgcatcaatca

SEQ ID NO: 712888 - DNA, 25 bp, Mus musculus
gggacatactcacccccattcgtga

SEQ ID NO: 712889 - DNA, 25 bp, Mus musculus
gggacatactcagccccattcgtga

SEQ ID NO: 712890 - DNA, 25 bp, Mus musculus
gggacatcaaggcttccagtcaaaa

SEQ ID NO: 712891 - DNA, 25 bp, Mus musculus
gggacatcaagggttccagtcaaaa

SEQ ID NO: 712892 - DNA, 25 bp, Mus musculus
gggacatcacagacagcctcattga

SEQ ID NO: 712893 - DNA, 25 bp, Mus musculus
gggacatcacagtcagcctcattga

SEQ ID NO: 712894 - DNA, 25 bp, Mus musculus
gggacatcccctatgaacaggtgga

SEQ ID NO: 712895 - DNA, 25 bp, Mus musculus
gggacatcccctttgaacaggtgga

SEQ ID NO: 712896 - DNA, 25 bp, Mus musculus
gggacatccttccagtgagcacgat

SEQ ID NO: 712897 - DNA, 25 bp, Mus musculus
gggacatccttcgagtgagcacgat

SEQ ID NO: 712898 - DNA, 25 bp, Mus musculus
gggacatcgaccacatcagctttga

SEQ ID NO: 712899 - DNA, 25 bp, Mus musculus
gggacatcgacctcatcagctttga

SEQ ID NO: 712900 - DNA, 25 bp, Mus musculus
gggacatcgtcccagccttgagaag

SEQ ID NO: 712901 - DNA, 25 bp, Mus musculus
gggacatcgtccgagccttgagaag

SEQ ID NO: 712902 - DNA, 25 bp, Mus musculus
gggacatgcagtatgaattgaatcg

SEQ ID NO: 712903 - DNA, 25 bp, Mus musculus
gggacatgcagtttgaattgaatcg

SEQ ID NO: 712904 - DNA, 25 bp, Mus musculus
gggacatggagcagctagagacctg

SEQ ID NO: 712905 - DNA, 25 bp, Mus musculus
gggacatggagctgctagagacctg

SEQ ID NO: 712906 - DNA, 25 bp, Mus musculus
gggacatggcctactatgacttcaa

SEQ ID NO: 712907 - DNA, 25 bp, Mus musculus
gggacatggccttctatgacttcaa

SEQ ID NO: 712908 - DNA, 25 bp, Mus musculus
gggacatgttcaagaacatgcagag

SEQ ID NO: 712909 - DNA, 25 bp, Mus musculus
gggacatgttcatgaacatgcagag

SEQ ID NO: 712910 - DNA, 25 bp, Mus musculus
gggacattgtgcaacctgatggccg

SEQ ID NO: 712911 - DNA, 25 bp, Mus musculus
gggacattgtgctacctgatggccg

SEQ ID NO: 712912 - DNA, 25 bp, Mus musculus
gggacatttcaactgctcctacagc

SEQ ID NO: 712913 - DNA, 25 bp, Mus musculus
gggacatttcaagtgctcctacagc

SEQ ID NO: 712914 - DNA, 25 bp, Mus musculus
gggaccaaacaccaatccaggaaga

SEQ ID NO: 712915 - DNA, 25 bp, Mus musculus
gggaccaaacacgaatccaggaaga

SEQ ID NO: 712916 - DNA, 25 bp, Mus musculus
gggaccaagaacctacgcatccagt

SEQ ID NO: 712917 - DNA, 25 bp, Mus musculus
gggaccaagaacgtacgcatccagt

SEQ ID NO: 712918 - DNA, 25 bp, Mus musculus
gggaccaagtcaatctggacatcct

SEQ ID NO: 712919 - DNA, 25 bp, Mus musculus
gggaccaagtcattctggacatcct

SEQ ID NO: 712920 - DNA, 25 bp, Mus musculus
gggaccaagttcacagtgtatgacc

SEQ ID NO: 712921 - DNA, 25 bp, Mus musculus
gggaccaagttctcagtgtatgacc

SEQ ID NO: 712922 - DNA, 25 bp, Mus musculus
gggaccaattttccctattggaatg

SEQ ID NO: 712923 - DNA, 25 bp, Mus musculus
gggaccaattttgcctattggaatg

SEQ ID NO: 712924 - DNA, 25 bp, Mus musculus
gggaccacactgaatttgtcaagaa

SEQ ID NO: 712925 - DNA, 25 bp, Mus musculus
gggaccacactgtatttgtcaagaa

SEQ ID NO: 712926 - DNA, 25 bp, Mus musculus
gggaccaccaccatcgaggcggtaa

SEQ ID NO: 712927 - DNA, 25 bp, Mus musculus
gggaccaccaccttcgaggcggtaa

SEQ ID NO: 712928 - DNA, 25 bp, Mus musculus
gggaccacctgaacttctggagtca

SEQ ID NO: 712929 - DNA, 25 bp, Mus musculus
gggaccacctgacctttcgttctta

SEQ ID NO: 712930 - DNA, 25 bp, Mus musculus
gggaccacctgagctttcgttctta

SEQ ID NO: 712931 - DNA, 25 bp, Mus musculus
gggaccacctgatcttctggagtca

SEQ ID NO: 712932 - DNA, 25 bp, Mus musculus
gggaccactggccaccaggactgtt

SEQ ID NO: 712933 - DNA, 25 bp, Mus musculus
gggaccactggcgaccaggactgtt

SEQ ID NO: 712934 - DNA, 25 bp, Mus musculus
gggaccagagacaacagctgagtca

SEQ ID NO: 712935 - DNA, 25 bp, Mus musculus
gggaccagagactacagctgagtca

SEQ ID NO: 712936 - DNA, 25 bp, Mus musculus
gggaccagcaatattaaggagcagc

SEQ ID NO: 712937 - DNA, 25 bp, Mus musculus
gggaccagcaattttaaggagcagc

SEQ ID NO: 712938 - DNA, 25 bp, Mus musculus
gggaccagcagcagtcgccgccgtt

SEQ ID NO: 712939 - DNA, 25 bp, Mus musculus
gggaccagcagctgtcgccgccgtt

SEQ ID NO: 712940 - DNA, 25 bp, Mus musculus
gggaccagccacagggctcattaca

SEQ ID NO: 712941 - DNA, 25 bp, Mus musculus
gggaccagccactgggctcattaca

SEQ ID NO: 712942 - DNA, 25 bp, Mus musculus
gggaccagcggtaccctcgaaatgt

SEQ ID NO: 712943 - DNA, 25 bp, Mus musculus
gggaccagcggttccctcgaaatgt

SEQ ID NO: 712944 - DNA, 25 bp, Mus musculus
gggaccagctatctggtccagctgt

SEQ ID NO: 712945 - DNA, 25 bp, Mus musculus
gggaccagctatgtggtccagctgt

SEQ ID NO: 712946 - DNA, 25 bp, Mus musculus
gggaccaggtcaataagtgtgtgct

SEQ ID NO: 712947 - DNA, 25 bp, Mus musculus
gggaccaggtcattaagtgtgtgct

SEQ ID NO: 712948 - DNA, 25 bp, Mus musculus
gggaccaggtccaactttgccaagg

SEQ ID NO: 712949 - DNA, 25 bp, Mus musculus
gggaccaggtcctactttgccaagg

SEQ ID NO: 712950 - DNA, 25 bp, Mus musculus
gggaccagttccagatccgagagaa

SEQ ID NO: 712951 - DNA, 25 bp, Mus musculus
gggaccagttcctgatccgagagaa

SEQ ID NO: 712952 - DNA, 25 bp, Mus musculus
gggaccagtttcatgtgagtttcaa

SEQ ID NO: 712953 - DNA, 25 bp, Mus musculus
gggaccagtttcttgtgagtttcaa

SEQ ID NO: 712954 - DNA, 25 bp, Mus musculus
gggaccatagaaccaagatgcactt

SEQ ID NO: 712955 - DNA, 25 bp, Mus musculus
gggaccatagaagcaagatgcactt

SEQ ID NO: 712956 - DNA, 25 bp, Mus musculus
gggaccatcataacatcacatactg

SEQ ID NO: 712957 - DNA, 25 bp, Mus musculus
gggaccatcatatcatcacatactg

SEQ ID NO: 712958 - DNA, 25 bp, Mus musculus
gggaccatccaccttcagcatattg

SEQ ID NO: 712959 - DNA, 25 bp, Mus musculus
gggaccatccacgttcagcatattg

SEQ ID NO: 712960 - DNA, 25 bp, Mus musculus
gggaccatccagagcgagactctgg

SEQ ID NO: 712961 - DNA, 25 bp, Mus musculus
gggaccatccagtgcgagactctgg

SEQ ID NO: 712962 - DNA, 25 bp, Mus musculus
gggaccatgagaacctgatgaatgt

SEQ ID NO: 712963 - DNA, 25 bp, Mus musculus
gggaccatgagatcctgatgaatgt

SEQ ID NO: 712964 - DNA, 25 bp, Mus musculus
gggaccatgcctccaacatctataa

SEQ ID NO: 712965 - DNA, 25 bp, Mus musculus
gggaccatgcctgcaacatctataa

SEQ ID NO: 712966 - DNA, 25 bp, Mus musculus
gggaccatgctcagaactccttcat

SEQ ID NO: 712967 - DNA, 25 bp, Mus musculus
gggaccatgctctgaactccttcat

SEQ ID NO: 712968 - DNA, 25 bp, Mus musculus
gggaccattctgactgggatgcagc

SEQ ID NO: 712969 - DNA, 25 bp, Mus musculus
gggaccattctgtctgggatgcagc

SEQ ID NO: 712970 - DNA, 25 bp, Mus musculus
gggaccattttaaccctgatggagc

SEQ ID NO: 712971 - DNA, 25 bp, Mus musculus
gggaccattttatccctgatggagc

SEQ ID NO: 712972 - DNA, 25 bp, Mus musculus
gggacccacatcacagcctcagaag

SEQ ID NO: 712973 - DNA, 25 bp, Mus musculus
gggacccacatctcagcctcagaag

SEQ ID NO: 712974 - DNA, 25 bp, Mus musculus
gggacccagagaatcccttagtgtc

SEQ ID NO: 712975 - DNA, 25 bp, Mus musculus
gggacccagagattcccttagtgtc

SEQ ID NO: 712976 - DNA, 25 bp, Mus musculus
gggacccagcagcaaacattctctt

SEQ ID NO: 712977 - DNA, 25 bp, Mus musculus
gggacccagcaggaaacattctctt

SEQ ID NO: 712978 - DNA, 25 bp, Mus musculus
gggacccagcccactctattttttg

SEQ ID NO: 712979 - DNA, 25 bp, Mus musculus
gggacccagccctctctattttttg

SEQ ID NO: 712980 - DNA, 25 bp, Mus musculus
gggacccaggcaatgtcagaagtct

SEQ ID NO: 712981 - DNA, 25 bp, Mus musculus
gggacccaggcattgtcagaagtct

SEQ ID NO: 712982 - DNA, 25 bp, Mus musculus
gggacccaggctaggacccaatgtg

SEQ ID NO: 712983 - DNA, 25 bp, Mus musculus
gggacccaggcttggacccaatgtg

SEQ ID NO: 712984 - DNA, 25 bp, Mus musculus
gggacccatgttcatcattattagc

SEQ ID NO: 712985 - DNA, 25 bp, Mus musculus
gggacccatgttgatcattattagc

SEQ ID NO: 712986 - DNA, 25 bp, Mus musculus
gggaccccaagacgtctctggacat

SEQ ID NO: 712987 - DNA, 25 bp, Mus musculus
gggaccccaagaggtctctggacat

SEQ ID NO: 712988 - DNA, 25 bp, Mus musculus
gggaccccacaactggcaagcacaa

SEQ ID NO: 712989 - DNA, 25 bp, Mus musculus
gggaccccacaagtggcaagcacaa

SEQ ID NO: 712990 - DNA, 25 bp, Mus musculus
gggaccccagatcttcaacttcatg

SEQ ID NO: 712991 - DNA, 25 bp, Mus musculus
gggaccccagatgttcaacttcatg

SEQ ID NO: 712992 - DNA, 25 bp, Mus musculus
gggaccccggagacccatgctcagg

SEQ ID NO: 712993 - DNA, 25 bp, Mus musculus
gggaccccggagtcccatgctcagg

SEQ ID NO: 712994 - DNA, 25 bp, Mus musculus
gggacccctcatctcgaaacttcat

SEQ ID NO: 712995 - DNA, 25 bp, Mus musculus
gggacccctcatgtcgaaacttcat

SEQ ID NO: 712996 - DNA, 25 bp, Mus musculus
gggaccccttacatgcagtgcccga

SEQ ID NO: 712997 - DNA, 25 bp, Mus musculus
gggaccccttacttgcagtgcccga

SEQ ID NO: 712998 - DNA, 25 bp, Mus musculus
gggacccgaaagagccagtgctgta

SEQ ID NO: 712999 - DNA, 25 bp, Mus musculus
gggacccgaaagtgccagtgctgta

SEQ ID NO: 713000 - DNA, 25 bp, Mus musculus
gggacccgaactcaatgttatggga

SEQ ID NO: 713001 - DNA, 25 bp, Mus musculus
gggacccgaactgaatgttatggga

SEQ ID NO: 713002 - DNA, 25 bp, Mus musculus
gggacccgatccactgtccgatgga

SEQ ID NO: 713003 - DNA, 25 bp, Mus musculus
gggacccgatcctctgtccgatgga

SEQ ID NO: 713004 - DNA, 25 bp, Mus musculus
gggacccggtggagccatcaccaac

SEQ ID NO: 713005 - DNA, 25 bp, Mus musculus
gggacccggtggtgccatcaccaac

SEQ ID NO: 713006 - DNA, 25 bp, Mus musculus
gggaccctacccactatggttacag

SEQ ID NO: 713007 - DNA, 25 bp, Mus musculus
gggaccctaccctctatggttacag

SEQ ID NO: 713008 - DNA, 25 bp, Mus musculus
gggaccctgcatcggctcccaagaa

SEQ ID NO: 713009 - DNA, 25 bp, Mus musculus
gggaccctgcatgggctcccaagaa

SEQ ID NO: 713010 - DNA, 25 bp, Mus musculus
gggaccctgcctagctgcatctctt

SEQ ID NO: 713011 - DNA, 25 bp, Mus musculus
gggaccctgccttgctgcatctctt

SEQ ID NO: 713012 - DNA, 25 bp, Mus musculus
gggaccctggatcttcgtgaatttg

SEQ ID NO: 713013 - DNA, 25 bp, Mus musculus
gggaccctggatgttcgtgaatttg

SEQ ID NO: 713014 - DNA, 25 bp, Mus musculus
gggaccctgggtatccgcaactctt

SEQ ID NO: 713015 - DNA, 25 bp, Mus musculus
gggaccctgggtttccgcaactctt

SEQ ID NO: 713016 - DNA, 25 bp, Mus musculus
gggaccgagaatattggcagctcct

SEQ ID NO: 713017 - DNA, 25 bp, Mus musculus
gggaccgagaattttggcagctcct

SEQ ID NO: 713018 - DNA, 25 bp, Mus musculus
gggaccgcatctaggagatcaatgg

SEQ ID NO: 713019 - DNA, 25 bp, Mus musculus
gggaccgcatcttggagatcaatgg

SEQ ID NO: 713020 - DNA, 25 bp, Mus musculus
gggaccggactcctacaggcctgca

SEQ ID NO: 713021 - DNA, 25 bp, Mus musculus
gggaccggactcgtacaggcctgca

SEQ ID NO: 713022 - DNA, 25 bp, Mus musculus
gggaccggattccatcccacaaggc

SEQ ID NO: 713023 - DNA, 25 bp, Mus musculus
gggaccggattcgatcccacaaggc

SEQ ID NO: 713024 - DNA, 25 bp, Mus musculus
gggaccggtcttccccagagcagct

SEQ ID NO: 713025 - DNA, 25 bp, Mus musculus
gggaccggtcttgcccagagcagct

SEQ ID NO: 713026 - DNA, 25 bp, Mus musculus
gggaccgtccacagttggagaccgc

SEQ ID NO: 713027 - DNA, 25 bp, Mus musculus
gggaccgtccactgttggagaccgc

SEQ ID NO: 713028 - DNA, 25 bp, Mus musculus
gggaccgtgagacaatctggtatta

SEQ ID NO: 713029 - DNA, 25 bp, Mus musculus
gggaccgtgagagaatctggtatta

SEQ ID NO: 713030 - DNA, 25 bp, Mus musculus
gggaccgtggctaggctccattcct

SEQ ID NO: 713031 - DNA, 25 bp, Mus musculus
gggaccgtggcttggctccattcct

SEQ ID NO: 713032 - DNA, 25 bp, Mus musculus
gggaccgtggttcgttccagcacaa

SEQ ID NO: 713033 - DNA, 25 bp, Mus musculus
gggaccgtggttggttccagcacaa

SEQ ID NO: 713034 - DNA, 25 bp, Mus musculus
gggacctaactcagtactcaccgga

SEQ ID NO: 713035 - DNA, 25 bp, Mus musculus
gggacctaactctgtactcaccgga

SEQ ID NO: 713036 - DNA, 25 bp, Mus musculus
gggacctacctcacccaagatgaga

SEQ ID NO: 713037 - DNA, 25 bp, Mus musculus
gggacctacctctcccaagatgaga

SEQ ID NO: 713038 - DNA, 25 bp, Mus musculus
gggacctaggaaatgcccgcgtctt

SEQ ID NO: 713039 - DNA, 25 bp, Mus musculus
gggacctaggaattgcccgcgtctt

SEQ ID NO: 713040 - DNA, 25 bp, Mus musculus
gggacctcaaagacgcccagaagtc

SEQ ID NO: 713041 - DNA, 25 bp, Mus musculus
gggacctcaaagtcgcccagaagtc

SEQ ID NO: 713042 - DNA, 25 bp, Mus musculus
gggacctcaagcacccacagagtga

SEQ ID NO: 713043 - DNA, 25 bp, Mus musculus
gggacctcaagctcccacagagtga

SEQ ID NO: 713044 - DNA, 25 bp, Mus musculus
gggacctcaaggaccaagatgccaa

SEQ ID NO: 713045 - DNA, 25 bp, Mus musculus
gggacctcaaggtccaagatgccaa

SEQ ID NO: 713046 - DNA, 25 bp, Mus musculus
gggacctcactaagaagtattttgc

SEQ ID NO: 713047 - DNA, 25 bp, Mus musculus
gggacctcactacagccactttatt

SEQ ID NO: 713048 - DNA, 25 bp, Mus musculus
gggacctcactagagccactttatt

SEQ ID NO: 713049 - DNA, 25 bp, Mus musculus
gggacctcactatgaagtattttgc

SEQ ID NO: 713050 - DNA, 25 bp, Mus musculus
gggacctcacttctagatgctgata

SEQ ID NO: 713051 - DNA, 25 bp, Mus musculus
gggacctcacttgtagatgctgata

SEQ ID NO: 713052 - DNA, 25 bp, Mus musculus
gggacctcagacacatgacatggaa

SEQ ID NO: 713053 - DNA, 25 bp, Mus musculus
gggacctcagactcatgacatggaa

SEQ ID NO: 713054 - DNA, 25 bp, Mus musculus
gggacctctcccaccaggaaaggtg

SEQ ID NO: 713055 - DNA, 25 bp, Mus musculus
gggacctctccctccaggaaaggtg

SEQ ID NO: 713056 - DNA, 25 bp, Mus musculus
gggacctctgatcagcacatggcca

SEQ ID NO: 713057 - DNA, 25 bp, Mus musculus
gggacctctgatgagcacatggcca

SEQ ID NO: 713058 - DNA, 25 bp, Mus musculus
gggacctctgtacccgctctatctg

SEQ ID NO: 713059 - DNA, 25 bp, Mus musculus
gggacctctgtagccgctctatctg

SEQ ID NO: 713060 - DNA, 25 bp, Mus musculus
gggacctgaaccatctggctccaga

SEQ ID NO: 713061 - DNA, 25 bp, Mus musculus
gggacctgaaccttctggctccaga

SEQ ID NO: 713062 - DNA, 25 bp, Mus musculus
gggacctgaattacagggaccagtg

SEQ ID NO: 713063 - DNA, 25 bp, Mus musculus
gggacctgaatttcagggaccagtg

SEQ ID NO: 713064 - DNA, 25 bp, Mus musculus
gggacctgcagcaaacttgaaggta

SEQ ID NO: 713065 - DNA, 25 bp, Mus musculus
gggacctgcagctaacttgaaggta

SEQ ID NO: 713066 - DNA, 25 bp, Mus musculus
gggacctgccctcacttttgatgac

SEQ ID NO: 713067 - DNA, 25 bp, Mus musculus
gggacctgccctgacttttgatgac

SEQ ID NO: 713068 - DNA, 25 bp, Mus musculus
gggacctgcgtaatctgaaactaaa

SEQ ID NO: 713069 - DNA, 25 bp, Mus musculus
gggacctgcgtattctgaaactaaa

SEQ ID NO: 713070 - DNA, 25 bp, Mus musculus
gggacctgctcccaaattccacaga

SEQ ID NO: 713071 - DNA, 25 bp, Mus musculus
gggacctgctccgaaattccacaga

SEQ ID NO: 713072 - DNA, 25 bp, Mus musculus
gggacctgctgaagcccgacttggt

SEQ ID NO: 713073 - DNA, 25 bp, Mus musculus
gggacctgctgatgcccgacttggt

SEQ ID NO: 713074 - DNA, 25 bp, Mus musculus
gggacctggcagctcatcctcttct

SEQ ID NO: 713075 - DNA, 25 bp, Mus musculus
gggacctggcaggtcatcctcttct

SEQ ID NO: 713076 - DNA, 25 bp, Mus musculus
gggacctggccgcttacctgctcta

SEQ ID NO: 713077 - DNA, 25 bp, Mus musculus
gggacctggccggttacctgctcta

SEQ ID NO: 713078 - DNA, 25 bp, Mus musculus
gggacctggcctacagacgacagga

SEQ ID NO: 713079 - DNA, 25 bp, Mus musculus
gggacctggccttcagacgacagga

SEQ ID NO: 713080 - DNA, 25 bp, Mus musculus
gggacctggctgaacatatgtgaat

SEQ ID NO: 713081 - DNA, 25 bp, Mus musculus
gggacctggctgtacatatgtgaat

SEQ ID NO: 713082 - DNA, 25 bp, Mus musculus
gggacctgggacaacctccagacag

SEQ ID NO: 713083 - DNA, 25 bp, Mus musculus
gggacctgggactacctccagacag

SEQ ID NO: 713084 - DNA, 25 bp, Mus musculus
gggacctggtaaacctacagatgga

SEQ ID NO: 713085 - DNA, 25 bp, Mus musculus
gggacctggtaatcctacagatgga

SEQ ID NO: 713086 - DNA, 25 bp, Mus musculus
gggacctggtagaagttgtcctgtc

SEQ ID NO: 713087 - DNA, 25 bp, Mus musculus
gggacctggtagtagttgtcctgtc

SEQ ID NO: 713088 - DNA, 25 bp, Mus musculus
gggacctgtattctgcggcaccaga

SEQ ID NO: 713089 - DNA, 25 bp, Mus musculus
gggacctgtattgtgcggcaccaga

SEQ ID NO: 713090 - DNA, 25 bp, Mus musculus
gggaccttacgacggactgcaatag

SEQ ID NO: 713091 - DNA, 25 bp, Mus musculus
gggaccttacgagggactgcaatag

SEQ ID NO: 713092 - DNA, 25 bp, Mus musculus
gggaccttcagtccgggatatgcag

SEQ ID NO: 713093 - DNA, 25 bp, Mus musculus
gggaccttcagtgcgggatatgcag

SEQ ID NO: 713094 - DNA, 25 bp, Mus musculus
gggacgaagttgcaatcacgtacat

SEQ ID NO: 713095 - DNA, 25 bp, Mus musculus
gggacgaagttggaatcacgtacat

SEQ ID NO: 713096 - DNA, 25 bp, Mus musculus
gggacgaccaagcttccatctctgg

SEQ ID NO: 713097 - DNA, 25 bp, Mus musculus
gggacgaccaaggttccatctctgg

SEQ ID NO: 713098 - DNA, 25 bp, Mus musculus
gggacgactgccacatgaagctctc

SEQ ID NO: 713099 - DNA, 25 bp, Mus musculus
gggacgactgcctcatgaagctctc

SEQ ID NO: 713100 - DNA, 25 bp, Mus musculus
gggacgagacaacgttcacctgtca

SEQ ID NO: 713101 - DNA, 25 bp, Mus musculus
gggacgagacaaggttcacctgtca

SEQ ID NO: 713102 - DNA, 25 bp, Mus musculus
gggacgagtacgagatcatcgagac

SEQ ID NO: 713103 - DNA, 25 bp, Mus musculus
gggacgagtacgtgatcatcgagac

SEQ ID NO: 713104 - DNA, 25 bp, Mus musculus
gggacgagttctccaccaagtgtaa

SEQ ID NO: 713105 - DNA, 25 bp, Mus musculus
gggacgagttctgcaccaagtgtaa

SEQ ID NO: 713106 - DNA, 25 bp, Mus musculus
gggacgatgcaacaagaatactaat

SEQ ID NO: 713107 - DNA, 25 bp, Mus musculus
gggacgatgcaagaagaatactaat

SEQ ID NO: 713108 - DNA, 25 bp, Mus musculus
gggacgatgccacttcttgcctaat

SEQ ID NO: 713109 - DNA, 25 bp, Mus musculus
gggacgatgccagttcttgcctaat

SEQ ID NO: 713110 - DNA, 25 bp, Mus musculus
gggacgattgtgactgtcatcctga

SEQ ID NO: 713111 - DNA, 25 bp, Mus musculus
gggacgattgtgtctgtcatcctga

SEQ ID NO: 713112 - DNA, 25 bp, Mus musculus
gggacgcatgggaaacttgcacacc

SEQ ID NO: 713113 - DNA, 25 bp, Mus musculus
gggacgcatgggtaacttgcacacc

SEQ ID NO: 713114 - DNA, 25 bp, Mus musculus
gggacgccagcaacccagtggacgc

SEQ ID NO: 713115 - DNA, 25 bp, Mus musculus
gggacgccagcatcccagtggacgc

SEQ ID NO: 713116 - DNA, 25 bp, Mus musculus
gggacgccgatcagaggctgaagaa

SEQ ID NO: 713117 - DNA, 25 bp, Mus musculus
gggacgccgatctgaggctgaagaa

SEQ ID NO: 713118 - DNA, 25 bp, Mus musculus
gggacgcctctgctggcaggcagcc

SEQ ID NO: 713119 - DNA, 25 bp, Mus musculus
gggacgcctctggtggcaggcagcc

SEQ ID NO: 713120 - DNA, 25 bp, Mus musculus
gggacgcgccatcgaaattctactt

SEQ ID NO: 713121 - DNA, 25 bp, Mus musculus
gggacgcgccatggaaattctactt

SEQ ID NO: 713122 - DNA, 25 bp, Mus musculus
gggacgctctctcccatgtttgaag

SEQ ID NO: 713123 - DNA, 25 bp, Mus musculus
gggacgctctctgccatgtttgaag

SEQ ID NO: 713124 - DNA, 25 bp, Mus musculus
gggacgcttactcgctcttaaaact

SEQ ID NO: 713125 - DNA, 25 bp, Mus musculus
gggacgcttactggctcttaaaact

SEQ ID NO: 713126 - DNA, 25 bp, Mus musculus
gggacggatcaaagagatcgtctac

SEQ ID NO: 713127 - DNA, 25 bp, Mus musculus
gggacggatcaatgagatcgtctac

SEQ ID NO: 713128 - DNA, 25 bp, Mus musculus
gggacggccacaacaagatcgctga

SEQ ID NO: 713129 - DNA, 25 bp, Mus musculus
gggacggccacatcaagatcgctga

SEQ ID NO: 713130 - DNA, 25 bp, Mus musculus
gggacgggcctaattttcttggatg

SEQ ID NO: 713131 - DNA, 25 bp, Mus musculus
gggacgggcctatttttcttggatg

SEQ ID NO: 713132 - DNA, 25 bp, Mus musculus
gggacgggtatccattgaaatgcct

SEQ ID NO: 713133 - DNA, 25 bp, Mus musculus
gggacgggtatcgattgaaatgcct

SEQ ID NO: 713134 - DNA, 25 bp, Mus musculus
gggacggtatctctgcatggcatct

SEQ ID NO: 713135 - DNA, 25 bp, Mus musculus
gggacggtatctgtgcatggcatct

SEQ ID NO: 713136 - DNA, 25 bp, Mus musculus
gggacggtcacaactcccaggagga

SEQ ID NO: 713137 - DNA, 25 bp, Mus musculus
gggacggtcacatctcccaggagga

SEQ ID NO: 713138 - DNA, 25 bp, Mus musculus
gggacggtcctcaccttttctgccg

SEQ ID NO: 713139 - DNA, 25 bp, Mus musculus
gggacggtcctctccttttctgccg

SEQ ID NO: 713140 - DNA, 25 bp, Mus musculus
gggacggtgctcacatctgcacctc

SEQ ID NO: 713141 - DNA, 25 bp, Mus musculus
gggacggtgctctcatctgcacctc

SEQ ID NO: 713142 - DNA, 25 bp, Mus musculus
gggacgtaaaagacggcatgaccat

SEQ ID NO: 713143 - DNA, 25 bp, Mus musculus
gggacgtaaaagtcggcatgaccat

SEQ ID NO: 713144 - DNA, 25 bp, Mus musculus
gggacgtagcaaagcttgaacttac

SEQ ID NO: 713145 - DNA, 25 bp, Mus musculus
gggacgtagcaatgcttgaacttac

SEQ ID NO: 713146 - DNA, 25 bp, Mus musculus
gggacgtcattccaagaaccactca

SEQ ID NO: 713147 - DNA, 25 bp, Mus musculus
gggacgtcattcgaagaaccactca

SEQ ID NO: 713148 - DNA, 25 bp, Mus musculus
gggacgttgacccatatagtcaaat

SEQ ID NO: 713149 - DNA, 25 bp, Mus musculus
gggacgttgaccgatatagtcaaat

SEQ ID NO: 713150 - DNA, 25 bp, Mus musculus
gggacgtttatgcaaaaaccacact

SEQ ID NO: 713151 - DNA, 25 bp, Mus musculus
gggacgtttatggaaaaaccacact

SEQ ID NO: 713152 - DNA, 25 bp, Mus musculus
gggactaaagatctgaacaaccact

SEQ ID NO: 713153 - DNA, 25 bp, Mus musculus
gggactaaagatgtgaacaaccact

SEQ ID NO: 713154 - DNA, 25 bp, Mus musculus
gggactacatatacacgacataatg

SEQ ID NO: 713155 - DNA, 25 bp, Mus musculus
gggactacatattcacgacataatg

SEQ ID NO: 713156 - DNA, 25 bp, Mus musculus
gggactacatccctgcggcggaaaa

SEQ ID NO: 713157 - DNA, 25 bp, Mus musculus
gggactacatccgtgcggcggaaaa

SEQ ID NO: 713158 - DNA, 25 bp, Mus musculus
gggactacattcctggcacggagac

SEQ ID NO: 713159 - DNA, 25 bp, Mus musculus
gggactacattcgtggcacggagac

SEQ ID NO: 713160 - DNA, 25 bp, Mus musculus
gggactaccaagagttttgcacaaa

SEQ ID NO: 713161 - DNA, 25 bp, Mus musculus
gggactaccaagtgttttgcacaaa

SEQ ID NO: 713162 - DNA, 25 bp, Mus musculus
gggactacctcaacgtgggtgtgca

SEQ ID NO: 713163 - DNA, 25 bp, Mus musculus
gggactacctcatcgtgggtgtgca

SEQ ID NO: 713164 - DNA, 25 bp, Mus musculus
gggactacctgcaccgtggttaccg

SEQ ID NO: 713165 - DNA, 25 bp, Mus musculus
gggactacctgctccgtggttaccg

SEQ ID NO: 713166 - DNA, 25 bp, Mus musculus
gggactactactccaaaggaagtct

SEQ ID NO: 713167 - DNA, 25 bp, Mus musculus
gggactactactgcaaaggaagtct

SEQ ID NO: 713168 - DNA, 25 bp, Mus musculus
gggactagacgaagccaagtcctcc

SEQ ID NO: 713169 - DNA, 25 bp, Mus musculus
gggactagacgatgccaagtcctcc

SEQ ID NO: 713170 - DNA, 25 bp, Mus musculus
gggactagcacaatttccgagtaca

SEQ ID NO: 713171 - DNA, 25 bp, Mus musculus
gggactagcacattttccgagtaca

SEQ ID NO: 713172 - DNA, 25 bp, Mus musculus
gggactatactcattgtttacaaca

SEQ ID NO: 713173 - DNA, 25 bp, Mus musculus
gggactatactctttgtttacaaca

SEQ ID NO: 713174 - DNA, 25 bp, Mus musculus
gggactatgccgctataaaggcttg

SEQ ID NO: 713175 - DNA, 25 bp, Mus musculus
gggactatgccggtataaaggcttg

SEQ ID NO: 713176 - DNA, 25 bp, Mus musculus
gggactattacccttacctggcaga

SEQ ID NO: 713177 - DNA, 25 bp, Mus musculus
gggactattaccgttacctggcaga

SEQ ID NO: 713178 - DNA, 25 bp, Mus musculus
gggactattatgcaaggagagaaaa

SEQ ID NO: 713179 - DNA, 25 bp, Mus musculus
gggactattatggaaggagagaaaa

SEQ ID NO: 713180 - DNA, 25 bp, Mus musculus
gggactcaaggacctgtggcactct

SEQ ID NO: 713181 - DNA, 25 bp, Mus musculus
gggactcaaggagctgtggcactct

SEQ ID NO: 713182 - DNA, 25 bp, Mus musculus
gggactcaagtgactgattccagag

SEQ ID NO: 713183 - DNA, 25 bp, Mus musculus
gggactcaagtgtctgattccagag

SEQ ID NO: 713184 - DNA, 25 bp, Mus musculus
gggactcacaccatcaccctagtgg

SEQ ID NO: 713185 - DNA, 25 bp, Mus musculus
gggactcacaccttcaccctagtgg

SEQ ID NO: 713186 - DNA, 25 bp, Mus musculus
gggactcaggtccaacaggacagcc

SEQ ID NO: 713187 - DNA, 25 bp, Mus musculus
gggactcaggtcgaacaggacagcc

SEQ ID NO: 713188 - DNA, 25 bp, Mus musculus
gggactccatgcacttccagcaact

SEQ ID NO: 713189 - DNA, 25 bp, Mus musculus
gggactccatgctcttccagcaact

SEQ ID NO: 713190 - DNA, 25 bp, Mus musculus
gggactccatggcttcagaagaagt

SEQ ID NO: 713191 - DNA, 25 bp, Mus musculus
gggactccatgggttcagaagaagt

SEQ ID NO: 713192 - DNA, 25 bp, Mus musculus
gggactcctaccaattcttccgaga

SEQ ID NO: 713193 - DNA, 25 bp, Mus musculus
gggactcctacctattcttccgaga

SEQ ID NO: 713194 - DNA, 25 bp, Mus musculus
gggactcctagtcccacagagcttc

SEQ ID NO: 713195 - DNA, 25 bp, Mus musculus
gggactcctagtgccacagagcttc

SEQ ID NO: 713196 - DNA, 25 bp, Mus musculus
gggactcctatgagatctattggag

SEQ ID NO: 713197 - DNA, 25 bp, Mus musculus
gggactcctatgtgatctattggag

SEQ ID NO: 713198 - DNA, 25 bp, Mus musculus
gggactcctcaacgaaatcctgtgt

SEQ ID NO: 713199 - DNA, 25 bp, Mus musculus
gggactcctcaactgatggtttacg

SEQ ID NO: 713200 - DNA, 25 bp, Mus musculus
gggactcctcaaggaaatcctgtgt

SEQ ID NO: 713201 - DNA, 25 bp, Mus musculus
gggactcctcaagtgatggtttacg

SEQ ID NO: 713202 - DNA, 25 bp, Mus musculus
gggactcctgaaccagggcctctcg

SEQ ID NO: 713203 - DNA, 25 bp, Mus musculus
gggactcctgaagcagggcctctcg

SEQ ID NO: 713204 - DNA, 25 bp, Mus musculus
gggactcctgcgacacggtacgagt

SEQ ID NO: 713205 - DNA, 25 bp, Mus musculus
gggactcctgcgtcacggtacgagt

SEQ ID NO: 713206 - DNA, 25 bp, Mus musculus
gggactcctttcaattacctacata

SEQ ID NO: 713207 - DNA, 25 bp, Mus musculus
gggactcctttccttggccctgagg

SEQ ID NO: 713208 - DNA, 25 bp, Mus musculus
gggactcctttcgttggccctgagg

SEQ ID NO: 713209 - DNA, 25 bp, Mus musculus
gggactcctttctattacctacata

SEQ ID NO: 713210 - DNA, 25 bp, Mus musculus
gggactcgacctcttctggtttctc

SEQ ID NO: 713211 - DNA, 25 bp, Mus musculus
gggactcgacctgttctggtttctc

SEQ ID NO: 713212 - DNA, 25 bp, Mus musculus
gggactcgcttcatgagcctaatta

SEQ ID NO: 713213 - DNA, 25 bp, Mus musculus
gggactcgcttcttgagcctaatta

SEQ ID NO: 713214 - DNA, 25 bp, Mus musculus
gggactcggattattgctggacatt

SEQ ID NO: 713215 - DNA, 25 bp, Mus musculus
gggactcggatttttgctggacatt

SEQ ID NO: 713216 - DNA, 25 bp, Mus musculus
gggactctacatacagaccctgctt

SEQ ID NO: 713217 - DNA, 25 bp, Mus musculus
gggactctacattcagaccctgctt

SEQ ID NO: 713218 - DNA, 25 bp, Mus musculus
gggactctatctattgctgtcccaa

SEQ ID NO: 713219 - DNA, 25 bp, Mus musculus
gggactctatcttttgctgtcccaa

SEQ ID NO: 713220 - DNA, 25 bp, Mus musculus
gggactctccttcacagactccttt

SEQ ID NO: 713221 - DNA, 25 bp, Mus musculus
gggactctccttgacagactccttt

SEQ ID NO: 713222 - DNA, 25 bp, Mus musculus
gggactctgcacaagagcgggatac

SEQ ID NO: 713223 - DNA, 25 bp, Mus musculus
gggactctgcactagagcgggatac

SEQ ID NO: 713224 - DNA, 25 bp, Mus musculus
gggactctgcgacacatacctcctg

SEQ ID NO: 713225 - DNA, 25 bp, Mus musculus
gggactctgcgagacatacctcctg

SEQ ID NO: 713226 - DNA, 25 bp, Mus musculus
gggactctgggcagtgctctcagcc

SEQ ID NO: 713227 - DNA, 25 bp, Mus musculus
gggactctgggctgtgctctcagcc

SEQ ID NO: 713228 - DNA, 25 bp, Mus musculus
gggactctggtcactgtctctgcag

SEQ ID NO: 713229 - DNA, 25 bp, Mus musculus
gggactctggtctctgtctctgcag

SEQ ID NO: 713230 - DNA, 25 bp, Mus musculus
gggactcttcttcttgggcactgaa

SEQ ID NO: 713231 - DNA, 25 bp, Mus musculus
gggactcttcttgttgggcactgaa

SEQ ID NO: 713232 - DNA, 25 bp, Mus musculus
gggactcttggtagatcggccatct

SEQ ID NO: 713233 - DNA, 25 bp, Mus musculus
gggactcttggttgatcggccatct

SEQ ID NO: 713234 - DNA, 25 bp, Mus musculus
gggactgaccttcccctgggtgcta

SEQ ID NO: 713235 - DNA, 25 bp, Mus musculus
gggactgaccttgccctgggtgcta

SEQ ID NO: 713236 - DNA, 25 bp, Mus musculus
gggactgactcaccctgatgactct

SEQ ID NO: 713237 - DNA, 25 bp, Mus musculus
gggactgactcagcctgatgactct

SEQ ID NO: 713238 - DNA, 25 bp, Mus musculus
gggactgagccactaataactggga

SEQ ID NO: 713239 - DNA, 25 bp, Mus musculus
gggactgagccagtaataactggga

SEQ ID NO: 713240 - DNA, 25 bp, Mus musculus
gggactgatcccacttctacctcag

SEQ ID NO: 713241 - DNA, 25 bp, Mus musculus
gggactgatccctcttctacctcag

SEQ ID NO: 713242 - DNA, 25 bp, Mus musculus
gggactgcaagaagatgccctacag

SEQ ID NO: 713243 - DNA, 25 bp, Mus musculus
gggactgcaagatgatgccctacag

SEQ ID NO: 713244 - DNA, 25 bp, Mus musculus
gggactgccgcgatggcggctgcgg

SEQ ID NO: 713245 - DNA, 25 bp, Mus musculus
gggactgccgcgttggcggctgcgg

SEQ ID NO: 713246 - DNA, 25 bp, Mus musculus
gggactgcctcacagaagaaaagcc

SEQ ID NO: 713247 - DNA, 25 bp, Mus musculus
gggactgcctcagagaagaaaagcc

SEQ ID NO: 713248 - DNA, 25 bp, Mus musculus
gggactggactccagcagagaaaac

SEQ ID NO: 713249 - DNA, 25 bp, Mus musculus
gggactggactcgagcagagaaaac

SEQ ID NO: 713250 - DNA, 25 bp, Mus musculus
gggactggagatcctggcggagaga

SEQ ID NO: 713251 - DNA, 25 bp, Mus musculus
gggactggagatgctggcggagaga

SEQ ID NO: 713252 - DNA, 25 bp, Mus musculus
gggactgggtgcacatcttcccaga

SEQ ID NO: 713253 - DNA, 25 bp, Mus musculus
gggactgggtgcagctcaacgtcta

SEQ ID NO: 713254 - DNA, 25 bp, Mus musculus
gggactgggtgctcatcttcccaga

SEQ ID NO: 713255 - DNA, 25 bp, Mus musculus
gggactgggtgctgctcaacgtcta

SEQ ID NO: 713256 - DNA, 25 bp, Mus musculus
gggactgtaaccaggctggacctcc

SEQ ID NO: 713257 - DNA, 25 bp, Mus musculus
gggactgtaacctggctggacctcc

SEQ ID NO: 713258 - DNA, 25 bp, Mus musculus
gggactgtatcaaccccaagtaccg

SEQ ID NO: 713259 - DNA, 25 bp, Mus musculus
gggactgtatcatccccaagtaccg

SEQ ID NO: 713260 - DNA, 25 bp, Mus musculus
gggactgtcatgaagattggcattg

SEQ ID NO: 713261 - DNA, 25 bp, Mus musculus
gggactgtcatgtagattggcattg

SEQ ID NO: 713262 - DNA, 25 bp, Mus musculus
gggactgtcattctcagtatcatgt

SEQ ID NO: 713263 - DNA, 25 bp, Mus musculus
gggactgtcattgtcagtatcatgt

SEQ ID NO: 713264 - DNA, 25 bp, Mus musculus
gggactgtcgagctctcctggcttt

SEQ ID NO: 713265 - DNA, 25 bp, Mus musculus
gggactgtcgaggtctcctggcttt

SEQ ID NO: 713266 - DNA, 25 bp, Mus musculus
gggactgtgatacaacgctttgaga

SEQ ID NO: 713267 - DNA, 25 bp, Mus musculus
gggactgtgatagaacgctttgaga

SEQ ID NO: 713268 - DNA, 25 bp, Mus musculus
gggactgtgggcatctccaactgct

SEQ ID NO: 713269 - DNA, 25 bp, Mus musculus
gggactgtgggcttctccaactgct

SEQ ID NO: 713270 - DNA, 25 bp, Mus musculus
gggactgttctccatctatactgga

SEQ ID NO: 713271 - DNA, 25 bp, Mus musculus
gggactgttctcgatctatactgga

SEQ ID NO: 713272 - DNA, 25 bp, Mus musculus
gggactgttgtaccctgtcctcact

SEQ ID NO: 713273 - DNA, 25 bp, Mus musculus
gggactgttgtagcctgtcctcact

SEQ ID NO: 713274 - DNA, 25 bp, Mus musculus
gggacttaatgaattcatctgagaa

SEQ ID NO: 713275 - DNA, 25 bp, Mus musculus
gggacttaatgatttcatctgagaa

SEQ ID NO: 713276 - DNA, 25 bp, Mus musculus
gggacttacatcaatttggaccaaa

SEQ ID NO: 713277 - DNA, 25 bp, Mus musculus
gggacttacatctatttggaccaaa

SEQ ID NO: 713278 - DNA, 25 bp, Mus musculus
gggacttaccacaaggagccggatt

SEQ ID NO: 713279 - DNA, 25 bp, Mus musculus
gggacttaccactaggagccggatt

SEQ ID NO: 713280 - DNA, 25 bp, Mus musculus
gggacttacctgcatctgtcgcctc

SEQ ID NO: 713281 - DNA, 25 bp, Mus musculus
gggacttacctggatctgtcgcctc

SEQ ID NO: 713282 - DNA, 25 bp, Mus musculus
gggacttacgaacatctgctgctga

SEQ ID NO: 713283 - DNA, 25 bp, Mus musculus
gggacttacgaagatctgctgctga

SEQ ID NO: 713284 - DNA, 25 bp, Mus musculus
gggacttacgccatctttgcctgtt

SEQ ID NO: 713285 - DNA, 25 bp, Mus musculus
gggacttacgccttctttgcctgtt

SEQ ID NO: 713286 - DNA, 25 bp, Mus musculus
gggacttacttcaaactccaaccag

SEQ ID NO: 713287 - DNA, 25 bp, Mus musculus
gggacttacttcctctacagtgagc

SEQ ID NO: 713288 - DNA, 25 bp, Mus musculus
gggacttacttcgtctacagtgagc

SEQ ID NO: 713289 - DNA, 25 bp, Mus musculus
gggacttacttctaactccaaccag

SEQ ID NO: 713290 - DNA, 25 bp, Mus musculus
gggacttcaactaccgcctgagtgg

SEQ ID NO: 713291 - DNA, 25 bp, Mus musculus
gggacttcaacttccgcctgagtgg

SEQ ID NO: 713292 - DNA, 25 bp, Mus musculus
gggacttcagagcaatattcactca

SEQ ID NO: 713293 - DNA, 25 bp, Mus musculus
gggacttcagaggaatattcactca

SEQ ID NO: 713294 - DNA, 25 bp, Mus musculus
gggacttcagtaccagggcaaccca

SEQ ID NO: 713295 - DNA, 25 bp, Mus musculus
gggacttcagtagcagggcaaccca

SEQ ID NO: 713296 - DNA, 25 bp, Mus musculus
gggacttcatctccatgcagtgccg

SEQ ID NO: 713297 - DNA, 25 bp, Mus musculus
gggacttcatctgcatgcagtgccg

SEQ ID NO: 713298 - DNA, 25 bp, Mus musculus
gggacttccacccaggctttgaggc

SEQ ID NO: 713299 - DNA, 25 bp, Mus musculus
gggacttccaccgaggctttgaggc

SEQ ID NO: 713300 - DNA, 25 bp, Mus musculus
gggacttccagtcatttgtcaaaga

SEQ ID NO: 713301 - DNA, 25 bp, Mus musculus
gggacttccagtgatttgtcaaaga

SEQ ID NO: 713302 - DNA, 25 bp, Mus musculus
gggacttccggccaaagcatccctg

SEQ ID NO: 713303 - DNA, 25 bp, Mus musculus
gggacttccggcgaaagcatccctg

SEQ ID NO: 713304 - DNA, 25 bp, Mus musculus
gggacttgagctagagccacaacac

SEQ ID NO: 713305 - DNA, 25 bp, Mus musculus
gggacttgagcttgagccacaacac

SEQ ID NO: 713306 - DNA, 25 bp, Mus musculus
gggacttggtacagtcccttcatgc

SEQ ID NO: 713307 - DNA, 25 bp, Mus musculus
gggacttggtactgtcccttcatgc

SEQ ID NO: 713308 - DNA, 25 bp, Mus musculus
gggactttagcaccaagaagccatc

SEQ ID NO: 713309 - DNA, 25 bp, Mus musculus
gggactttagcacgtttcttaatcg

SEQ ID NO: 713310 - DNA, 25 bp, Mus musculus
gggactttagcagcaagaagccatc

SEQ ID NO: 713311 - DNA, 25 bp, Mus musculus
gggactttagcaggtttcttaatcg

SEQ ID NO: 713312 - DNA, 25 bp, Mus musculus
gggactttcgtccactccacctgga

SEQ ID NO: 713313 - DNA, 25 bp, Mus musculus
gggactttcgtcgactccacctgga

SEQ ID NO: 713314 - DNA, 25 bp, Mus musculus
gggactttctctacagcagtgacca

SEQ ID NO: 713315 - DNA, 25 bp, Mus musculus
gggactttctcttcagcagtgacca

SEQ ID NO: 713316 - DNA, 25 bp, Mus musculus
gggactttggtccattgtacaggcc

SEQ ID NO: 713317 - DNA, 25 bp, Mus musculus
gggactttggtcctgcatcccagca

SEQ ID NO: 713318 - DNA, 25 bp, Mus musculus
gggactttggtcgattgtacaggcc

SEQ ID NO: 713319 - DNA, 25 bp, Mus musculus
gggactttggtcgtgcatcccagca

SEQ ID NO: 713320 - DNA, 25 bp, Mus musculus
gggacttttgatcgttttgtgcaga

SEQ ID NO: 713321 - DNA, 25 bp, Mus musculus
gggacttttgatggttttgtgcaga

SEQ ID NO: 713322 - DNA, 25 bp, Mus musculus
gggacttttgtcacacgccacttca

SEQ ID NO: 713323 - DNA, 25 bp, Mus musculus
gggacttttgtctcacgccacttca

SEQ ID NO: 713324 - DNA, 25 bp, Mus musculus
gggagaaaagtgctgtcctcgccca

SEQ ID NO: 713325 - DNA, 25 bp, Mus musculus
gggagaaaagtggtgtcctcgccca

SEQ ID NO: 713326 - DNA, 25 bp, Mus musculus
gggagaaacctacctagccaagtct

SEQ ID NO: 713327 - DNA, 25 bp, Mus musculus
gggagaaacctagctagccaagtct

SEQ ID NO: 713328 - DNA, 25 bp, Mus musculus
gggagaaactgacacagcacacaca

SEQ ID NO: 713329 - DNA, 25 bp, Mus musculus
gggagaaactgagacagcacacaca

SEQ ID NO: 713330 - DNA, 25 bp, Mus musculus
gggagaaagaggagcagcgggagct

SEQ ID NO: 713331 - DNA, 25 bp, Mus musculus
gggagaaagaggtgcagcgggagct

SEQ ID NO: 713332 - DNA, 25 bp, Mus musculus
gggagaaaggaacacggtatactca

SEQ ID NO: 713333 - DNA, 25 bp, Mus musculus
gggagaaaggaagacggtatactca

SEQ ID NO: 713334 - DNA, 25 bp, Mus musculus
gggagaaaggatcgtttcctctcat

SEQ ID NO: 713335 - DNA, 25 bp, Mus musculus
gggagaaaggatggtttcctctcat

SEQ ID NO: 713336 - DNA, 25 bp, Mus musculus
gggagaaatctgagccatttccaag

SEQ ID NO: 713337 - DNA, 25 bp, Mus musculus
gggagaaatctgtgccatttccaag

SEQ ID NO: 713338 - DNA, 25 bp, Mus musculus
gggagaaatgaccaaagtaccatgc

SEQ ID NO: 713339 - DNA, 25 bp, Mus musculus
gggagaaatgacgaaagtaccatgc

SEQ ID NO: 713340 - DNA, 25 bp, Mus musculus
gggagaaattgcacctcttaaagag

SEQ ID NO: 713341 - DNA, 25 bp, Mus musculus
gggagaaattgctcctcttaaagag

SEQ ID NO: 713342 - DNA, 25 bp, Mus musculus
gggagaaccaccatctccgtcacgg

SEQ ID NO: 713343 - DNA, 25 bp, Mus musculus
gggagaaccaccttctccgtcacgg

SEQ ID NO: 713344 - DNA, 25 bp, Mus musculus
gggagaaccgtaccatgaactgcat

SEQ ID NO: 713345 - DNA, 25 bp, Mus musculus
gggagaaccgtagcatgaactgcat

SEQ ID NO: 713346 - DNA, 25 bp, Mus musculus
gggagaacctgaaagcccgtgccta

SEQ ID NO: 713347 - DNA, 25 bp, Mus musculus
gggagaacctgatagcccgtgccta

SEQ ID NO: 713348 - DNA, 25 bp, Mus musculus
gggagaacgaagatgagctctcttt

SEQ ID NO: 713349 - DNA, 25 bp, Mus musculus
gggagaacgaagttgagctctcttt

SEQ ID NO: 713350 - DNA, 25 bp, Mus musculus
gggagaagagggattaccttcgcac

SEQ ID NO: 713351 - DNA, 25 bp, Mus musculus
gggagaagagggtttaccttcgcac

SEQ ID NO: 713352 - DNA, 25 bp, Mus musculus
gggagaagcagtatcaggtgcaccc

SEQ ID NO: 713353 - DNA, 25 bp, Mus musculus
gggagaagcagtttcaggtgcaccc

SEQ ID NO: 713354 - DNA, 25 bp, Mus musculus
gggagaaggacaccaatctggtcct

SEQ ID NO: 713355 - DNA, 25 bp, Mus musculus
gggagaaggacagcaatctggtcct

SEQ ID NO: 713356 - DNA, 25 bp, Mus musculus
gggagaaggatgacgtctttcacaa

SEQ ID NO: 713357 - DNA, 25 bp, Mus musculus
gggagaaggatgtcgtctttcacaa

SEQ ID NO: 713358 - DNA, 25 bp, Mus musculus
gggagaaggcgaaaagatgacaaaa

SEQ ID NO: 713359 - DNA, 25 bp, Mus musculus
gggagaaggcgataagatgacaaaa

SEQ ID NO: 713360 - DNA, 25 bp, Mus musculus
gggagaagtccaccctgacactcta

SEQ ID NO: 713361 - DNA, 25 bp, Mus musculus
gggagaagtccagcctgacactcta

SEQ ID NO: 713362 - DNA, 25 bp, Mus musculus
gggagaagtgcacacgtttcattga

SEQ ID NO: 713363 - DNA, 25 bp, Mus musculus
gggagaagtgcagacgtttcattga

SEQ ID NO: 713364 - DNA, 25 bp, Mus musculus
gggagaagttagacctgccagagtt

SEQ ID NO: 713365 - DNA, 25 bp, Mus musculus
gggagaagttagtcctgccagagtt

SEQ ID NO: 713366 - DNA, 25 bp, Mus musculus
gggagaatgaagcaaccaccaagat

SEQ ID NO: 713367 - DNA, 25 bp, Mus musculus
gggagaatgaaggaaccaccaagat

SEQ ID NO: 713368 - DNA, 25 bp, Mus musculus
gggagaatgcgcctagcccaccagt

SEQ ID NO: 713369 - DNA, 25 bp, Mus musculus
gggagaatgcgcgtagcccaccagt

SEQ ID NO: 713370 - DNA, 25 bp, Mus musculus
gggagaatggtcagctcctcaccat

SEQ ID NO: 713371 - DNA, 25 bp, Mus musculus
gggagaatggtctgctcctcaccat

SEQ ID NO: 713372 - DNA, 25 bp, Mus musculus
gggagaatgtccagccctccaccat

SEQ ID NO: 713373 - DNA, 25 bp, Mus musculus
gggagaatgtcctgccctccaccat

SEQ ID NO: 713374 - DNA, 25 bp, Mus musculus
gggagacaacacacctgtccttgag

SEQ ID NO: 713375 - DNA, 25 bp, Mus musculus
gggagacaacactcctgtccttgag

SEQ ID NO: 713376 - DNA, 25 bp, Mus musculus
gggagacaccacagtcataagttct

SEQ ID NO: 713377 - DNA, 25 bp, Mus musculus
gggagacaccactgtcataagttct

SEQ ID NO: 713378 - DNA, 25 bp, Mus musculus
gggagacacgccagcaggagacact

SEQ ID NO: 713379 - DNA, 25 bp, Mus musculus
gggagacacgcctgcaggagacact

SEQ ID NO: 713380 - DNA, 25 bp, Mus musculus
gggagacagcctctaccactggagt

SEQ ID NO: 713381 - DNA, 25 bp, Mus musculus
gggagacagcctgtaccactggagt

SEQ ID NO: 713382 - DNA, 25 bp, Mus musculus
gggagacagggtaggcaattcttcc

SEQ ID NO: 713383 - DNA, 25 bp, Mus musculus
gggagacagggttggcaattcttcc

SEQ ID NO: 713384 - DNA, 25 bp, Mus musculus
gggagacatgagaccggcttcaata

SEQ ID NO: 713385 - DNA, 25 bp, Mus musculus
gggagacatgagtccggcttcaata

SEQ ID NO: 713386 - DNA, 25 bp, Mus musculus
gggagacatgtcaactggacatctt

SEQ ID NO: 713387 - DNA, 25 bp, Mus musculus
gggagacatgtctactggacatctt

SEQ ID NO: 713388 - DNA, 25 bp, Mus musculus
gggagacatttactgaacgctcttc

SEQ ID NO: 713389 - DNA, 25 bp, Mus musculus
gggagacatttagtgaacgctcttc

SEQ ID NO: 713390 - DNA, 25 bp, Mus musculus
gggagaccacacctatgccgagtgc

SEQ ID NO: 713391 - DNA, 25 bp, Mus musculus
gggagaccacacgtatgccgagtgc

SEQ ID NO: 713392 - DNA, 25 bp, Mus musculus
gggagaccacagagacccatcaaga

SEQ ID NO: 713393 - DNA, 25 bp, Mus musculus
gggagaccacagtgacccatcaaga

SEQ ID NO: 713394 - DNA, 25 bp, Mus musculus
gggagaccacccaatggaacccagg

SEQ ID NO: 713395 - DNA, 25 bp, Mus musculus
gggagaccacccctcttgtttgcta

SEQ ID NO: 713396 - DNA, 25 bp, Mus musculus
gggagaccacccgtcttgtttgcta

SEQ ID NO: 713397 - DNA, 25 bp, Mus musculus
gggagaccaccctatggaacccagg

SEQ ID NO: 713398 - DNA, 25 bp, Mus musculus
gggagaccagctccatgcccagctt

SEQ ID NO: 713399 - DNA, 25 bp, Mus musculus
gggagaccagctgcatgcccagctt

SEQ ID NO: 713400 - DNA, 25 bp, Mus musculus
gggagaccatggcaatccccaccat

SEQ ID NO: 713401 - DNA, 25 bp, Mus musculus
gggagaccatgggaatccccaccat

SEQ ID NO: 713402 - DNA, 25 bp, Mus musculus
gggagaccccataggctctgccacg

SEQ ID NO: 713403 - DNA, 25 bp, Mus musculus
gggagaccccattggctctgccacg

SEQ ID NO: 713404 - DNA, 25 bp, Mus musculus
gggagaccctccacctattgtctct

SEQ ID NO: 713405 - DNA, 25 bp, Mus musculus
gggagaccctcctcctattgtctct

SEQ ID NO: 713406 - DNA, 25 bp, Mus musculus
gggagaccctgtagtccatgaactg

SEQ ID NO: 713407 - DNA, 25 bp, Mus musculus
gggagaccctgttgtccatgaactg

SEQ ID NO: 713408 - DNA, 25 bp, Mus musculus
gggagaccgtgcagactcatctttg

SEQ ID NO: 713409 - DNA, 25 bp, Mus musculus
gggagaccgtgctgactcatctttg

SEQ ID NO: 713410 - DNA, 25 bp, Mus musculus
gggagacctactcattggccatgat

SEQ ID NO: 713411 - DNA, 25 bp, Mus musculus
gggagacctactgattggccatgat

SEQ ID NO: 713412 - DNA, 25 bp, Mus musculus
gggagacctcatctccttcctggtg

SEQ ID NO: 713413 - DNA, 25 bp, Mus musculus
gggagacctcatgtccttcctggtg

SEQ ID NO: 713414 - DNA, 25 bp, Mus musculus
gggagacctccaaggtgcatgagct

SEQ ID NO: 713415 - DNA, 25 bp, Mus musculus
gggagacctccatggtgcatgagct

SEQ ID NO: 713416 - DNA, 25 bp, Mus musculus
gggagacctgtcactgtcaactgca

SEQ ID NO: 713417 - DNA, 25 bp, Mus musculus
gggagacctgtctctgtcaactgca

SEQ ID NO: 713418 - DNA, 25 bp, Mus musculus
gggagacgaggacacccgaatcact

SEQ ID NO: 713419 - DNA, 25 bp, Mus musculus
gggagacgaggagacccgaatcact

SEQ ID NO: 713420 - DNA, 25 bp, Mus musculus
gggagacggaaacctgcccacgtca

SEQ ID NO: 713421 - DNA, 25 bp, Mus musculus
gggagacggaaagctgcccacgtca

SEQ ID NO: 713422 - DNA, 25 bp, Mus musculus
gggagactaaagaacaggatcattt

SEQ ID NO: 713423 - DNA, 25 bp, Mus musculus
gggagactaaagtacaggatcattt

SEQ ID NO: 713424 - DNA, 25 bp, Mus musculus
gggagactcctgcattgatagcctc

SEQ ID NO: 713425 - DNA, 25 bp, Mus musculus
gggagactcctggattgatagcctc

SEQ ID NO: 713426 - DNA, 25 bp, Mus musculus
gggagactcgccacactactgtgga

SEQ ID NO: 713427 - DNA, 25 bp, Mus musculus
gggagactcgcctcactactgtgga

SEQ ID NO: 713428 - DNA, 25 bp, Mus musculus
gggagactctttcaggacactaagt

SEQ ID NO: 713429 - DNA, 25 bp, Mus musculus
gggagactctttgaggacactaagt

SEQ ID NO: 713430 - DNA, 25 bp, Mus musculus
gggagactgctaactggttctctac

SEQ ID NO: 713431 - DNA, 25 bp, Mus musculus
gggagactgctacatcgtcctctcg

SEQ ID NO: 713432 - DNA, 25 bp, Mus musculus
gggagactgctagatcgtcctctcg

SEQ ID NO: 713433 - DNA, 25 bp, Mus musculus
gggagactgctatctggttctctac

SEQ ID NO: 713434 - DNA, 25 bp, Mus musculus
gggagacttactagaggctatcaga

SEQ ID NO: 713435 - DNA, 25 bp, Mus musculus
gggagacttacttgaggctatcaga

SEQ ID NO: 713436 - DNA, 25 bp, Mus musculus
gggagacttagcctggaacccactg

SEQ ID NO: 713437 - DNA, 25 bp, Mus musculus
gggagacttagcgtggaacccactg

SEQ ID NO: 713438 - DNA, 25 bp, Mus musculus
gggagagaagccaatgcagtcctcc

SEQ ID NO: 713439 - DNA, 25 bp, Mus musculus
gggagagaagcctatgcagtcctcc

SEQ ID NO: 713440 - DNA, 25 bp, Mus musculus
gggagagaatcgatagtcactttga

SEQ ID NO: 713441 - DNA, 25 bp, Mus musculus
gggagagaatcgttagtcactttga

SEQ ID NO: 713442 - DNA, 25 bp, Mus musculus
gggagagagccacatgttcccagca

SEQ ID NO: 713443 - DNA, 25 bp, Mus musculus
gggagagagccagatgttcccagca

SEQ ID NO: 713444 - DNA, 25 bp, Mus musculus
gggagagatgctctacctggctact

SEQ ID NO: 713445 - DNA, 25 bp, Mus musculus
gggagagatgctgtacctggctact

SEQ ID NO: 713446 - DNA, 25 bp, Mus musculus
gggagagattaacctgcagacctcc

SEQ ID NO: 713447 - DNA, 25 bp, Mus musculus
gggagagattaagctgcagacctcc

SEQ ID NO: 713448 - DNA, 25 bp, Mus musculus
gggagagatttacacacatgttata

SEQ ID NO: 713449 - DNA, 25 bp, Mus musculus
gggagagatttagacacatgttata

SEQ ID NO: 713450 - DNA, 25 bp, Mus musculus
gggagagcacggacagaactattgc

SEQ ID NO: 713451 - DNA, 25 bp, Mus musculus
gggagagcacggtcagaactattgc

SEQ ID NO: 713452 - DNA, 25 bp, Mus musculus
gggagagccatcattgacctcttcc

SEQ ID NO: 713453 - DNA, 25 bp, Mus musculus
gggagagccatctttgacctcttcc

SEQ ID NO: 713454 - DNA, 25 bp, Mus musculus
gggagagcgctcatcccagctcctt

SEQ ID NO: 713455 - DNA, 25 bp, Mus musculus
gggagagcgctcttcccagctcctt

SEQ ID NO: 713456 - DNA, 25 bp, Mus musculus
gggagaggaattatcacatattcta

SEQ ID NO: 713457 - DNA, 25 bp, Mus musculus
gggagaggaattttcacatattcta

SEQ ID NO: 713458 - DNA, 25 bp, Mus musculus
gggagaggccaccaaagattctctg

SEQ ID NO: 713459 - DNA, 25 bp, Mus musculus
gggagaggccacgaaagattctctg

SEQ ID NO: 713460 - DNA, 25 bp, Mus musculus
gggagaggccatacatgtgtaattg

SEQ ID NO: 713461 - DNA, 25 bp, Mus musculus
gggagaggccattcatgtgtaattg

SEQ ID NO: 713462 - DNA, 25 bp, Mus musculus
gggagaggccctcatcagtgcccac

SEQ ID NO: 713463 - DNA, 25 bp, Mus musculus
gggagaggccctgatcagtgcccac

SEQ ID NO: 713464 - DNA, 25 bp, Mus musculus
gggagagggcttcatcatctgctat

SEQ ID NO: 713465 - DNA, 25 bp, Mus musculus
gggagagggcttgatcatctgctat

SEQ ID NO: 713466 - DNA, 25 bp, Mus musculus
gggagagtgacgctggctacatgga

SEQ ID NO: 713467 - DNA, 25 bp, Mus musculus
gggagagtgacggtggctacatgga

SEQ ID NO: 713468 - DNA, 25 bp, Mus musculus
gggagagttctgcattgccaaattt

SEQ ID NO: 713469 - DNA, 25 bp, Mus musculus
gggagagttctggattgccaaattt

SEQ ID NO: 713470 - DNA, 25 bp, Mus musculus
gggagataatcgcacattcacactg

SEQ ID NO: 713471 - DNA, 25 bp, Mus musculus
gggagataatcggacattcacactg

SEQ ID NO: 713472 - DNA, 25 bp, Mus musculus
gggagatagataacaatccgaaagt

SEQ ID NO: 713473 - DNA, 25 bp, Mus musculus
gggagatagatatcaatccgaaagt

SEQ ID NO: 713474 - DNA, 25 bp, Mus musculus
gggagatattcacataacttaagac

SEQ ID NO: 713475 - DNA, 25 bp, Mus musculus
gggagatattcagataacttaagac

SEQ ID NO: 713476 - DNA, 25 bp, Mus musculus
gggagatcacaaccttcgcagccct

SEQ ID NO: 713477 - DNA, 25 bp, Mus musculus
gggagatcacaagcttcgcagccct

SEQ ID NO: 713478 - DNA, 25 bp, Mus musculus
gggagatcagctacaggacaaatgt

SEQ ID NO: 713479 - DNA, 25 bp, Mus musculus
gggagatcagcttcaggacaaatgt

SEQ ID NO: 713480 - DNA, 25 bp, Mus musculus
gggagatcatttacactagtggagc

SEQ ID NO: 713481 - DNA, 25 bp, Mus musculus
gggagatcattttcactagtggagc

SEQ ID NO: 713482 - DNA, 25 bp, Mus musculus
gggagatccaagatattcatccgaa

SEQ ID NO: 713483 - DNA, 25 bp, Mus musculus
gggagatccaagttattcatccgaa

SEQ ID NO: 713484 - DNA, 25 bp, Mus musculus
gggagatccggtactccgctcctag

SEQ ID NO: 713485 - DNA, 25 bp, Mus musculus
gggagatccggttctccgctcctag

SEQ ID NO: 713486 - DNA, 25 bp, Mus musculus
gggagatcgttgatttcaggataga

SEQ ID NO: 713487 - DNA, 25 bp, Mus musculus
gggagatcgttgttttcaggataga

SEQ ID NO: 713488 - DNA, 25 bp, Mus musculus
gggagatctatgaccgctatggccg

SEQ ID NO: 713489 - DNA, 25 bp, Mus musculus
gggagatctatgtccgctatggccg

SEQ ID NO: 713490 - DNA, 25 bp, Mus musculus
gggagatgcaaacactctccttcgc

SEQ ID NO: 713491 - DNA, 25 bp, Mus musculus
gggagatgcaaagactctccttcgc

SEQ ID NO: 713492 - DNA, 25 bp, Mus musculus
gggagatgccttcgactttaatgtt

SEQ ID NO: 713493 - DNA, 25 bp, Mus musculus
gggagatgccttggactttaatgtt

SEQ ID NO: 713494 - DNA, 25 bp, Mus musculus
gggagatgcgctctccaatggcatc

SEQ ID NO: 713495 - DNA, 25 bp, Mus musculus
gggagatgcgctgtccaatggcatc

SEQ ID NO: 713496 - DNA, 25 bp, Mus musculus
gggagattgactagcttcagacccg

SEQ ID NO: 713497 - DNA, 25 bp, Mus musculus
gggagattgacttgcttcagacccg

SEQ ID NO: 713498 - DNA, 25 bp, Mus musculus
gggagattttatcacctgtacagag

SEQ ID NO: 713499 - DNA, 25 bp, Mus musculus
gggagattttatgacctgtacagag

SEQ ID NO: 713500 - DNA, 25 bp, Mus musculus
gggagcaaattcagcctagtggcca

SEQ ID NO: 713501 - DNA, 25 bp, Mus musculus
gggagcaaattctgcctagtggcca

SEQ ID NO: 713502 - DNA, 25 bp, Mus musculus
gggagcaatgacatcactgacggtg

SEQ ID NO: 713503 - DNA, 25 bp, Mus musculus
gggagcaatgacttcactgacggtg

SEQ ID NO: 713504 - DNA, 25 bp, Mus musculus
gggagcacaccaacgaagaatggaa

SEQ ID NO: 713505 - DNA, 25 bp, Mus musculus
gggagcacaccaagatgacagatgt

SEQ ID NO: 713506 - DNA, 25 bp, Mus musculus
gggagcacaccatcgaagaatggaa

SEQ ID NO: 713507 - DNA, 25 bp, Mus musculus
gggagcacaccatgatgacagatgt

SEQ ID NO: 713508 - DNA, 25 bp, Mus musculus
gggagcacacttcgcagagactttt

SEQ ID NO: 713509 - DNA, 25 bp, Mus musculus
gggagcacacttggcagagactttt

SEQ ID NO: 713510 - DNA, 25 bp, Mus musculus
gggagcaccaccatcggctgctgct

SEQ ID NO: 713511 - DNA, 25 bp, Mus musculus
gggagcaccaccttcggctgctgct

SEQ ID NO: 713512 - DNA, 25 bp, Mus musculus
gggagcaccactcgagagctgctgt

SEQ ID NO: 713513 - DNA, 25 bp, Mus musculus
gggagcaccactggagagctgctgt

SEQ ID NO: 713514 - DNA, 25 bp, Mus musculus
gggagcaccagccattagttccaca

SEQ ID NO: 713515 - DNA, 25 bp, Mus musculus
gggagcaccagcgattagttccaca

SEQ ID NO: 713516 - DNA, 25 bp, Mus musculus
gggagcaccgtcaccattcgatagg

SEQ ID NO: 713517 - DNA, 25 bp, Mus musculus
gggagcaccgtctccattcgatagg

SEQ ID NO: 713518 - DNA, 25 bp, Mus musculus
gggagcactacaaacgcaacgagac

SEQ ID NO: 713519 - DNA, 25 bp, Mus musculus
gggagcactacatacgcaacgagac

SEQ ID NO: 713520 - DNA, 25 bp, Mus musculus
gggagcactcagagagcctatgagc

SEQ ID NO: 713521 - DNA, 25 bp, Mus musculus
gggagcactcagtgagcctatgagc

SEQ ID NO: 713522 - DNA, 25 bp, Mus musculus
gggagcactgatctgaaaatcgacc

SEQ ID NO: 713523 - DNA, 25 bp, Mus musculus
gggagcactgatgtgaaaatcgacc

SEQ ID NO: 713524 - DNA, 25 bp, Mus musculus
gggagcagaaacacaagaccttcgt

SEQ ID NO: 713525 - DNA, 25 bp, Mus musculus
gggagcagaaactcaagaccttcgt

SEQ ID NO: 713526 - DNA, 25 bp, Mus musculus
gggagcagaagtattccagccttcc

SEQ ID NO: 713527 - DNA, 25 bp, Mus musculus
gggagcagaagttttccagccttcc

SEQ ID NO: 713528 - DNA, 25 bp, Mus musculus
gggagcagcaatatcctcccatccg

SEQ ID NO: 713529 - DNA, 25 bp, Mus musculus
gggagcagcaatttcctcccatccg

SEQ ID NO: 713530 - DNA, 25 bp, Mus musculus
gggagcagctaaacaccatgtcctg

SEQ ID NO: 713531 - DNA, 25 bp, Mus musculus
gggagcagctaatcaccatgtcctg

SEQ ID NO: 713532 - DNA, 25 bp, Mus musculus
gggagcagctatctatcacttgagg

SEQ ID NO: 713533 - DNA, 25 bp, Mus musculus
gggagcagctatctgagcaccctgt

SEQ ID NO: 713534 - DNA, 25 bp, Mus musculus
gggagcagctatgtatcacttgagg

SEQ ID NO: 713535 - DNA, 25 bp, Mus musculus
gggagcagctatgtgagcaccctgt

SEQ ID NO: 713536 - DNA, 25 bp, Mus musculus
gggagcatagagattgtctggaaca

SEQ ID NO: 713537 - DNA, 25 bp, Mus musculus
gggagcatagagtttgtctggaaca

SEQ ID NO: 713538 - DNA, 25 bp, Mus musculus
gggagcatcaagatgcccttcatca

SEQ ID NO: 713539 - DNA, 25 bp, Mus musculus
gggagcatcaagttgcccttcatca

SEQ ID NO: 713540 - DNA, 25 bp, Mus musculus
gggagcatcacaagaaaattacctg

SEQ ID NO: 713541 - DNA, 25 bp, Mus musculus
gggagcatcacatgaaaattacctg

SEQ ID NO: 713542 - DNA, 25 bp, Mus musculus
gggagcatcctacgtcactggcttt

SEQ ID NO: 713543 - DNA, 25 bp, Mus musculus
gggagcatcctaggtcactggcttt

SEQ ID NO: 713544 - DNA, 25 bp, Mus musculus
gggagccaacatacaacgttgctgt

SEQ ID NO: 713545 - DNA, 25 bp, Mus musculus
gggagccaacattcaacgttgctgt

SEQ ID NO: 713546 - DNA, 25 bp, Mus musculus
gggagccaacctcttccgaaaggag

SEQ ID NO: 713547 - DNA, 25 bp, Mus musculus
gggagccaacctgttccgaaaggag

SEQ ID NO: 713548 - DNA, 25 bp, Mus musculus
gggagccacggaactcactcatgag

SEQ ID NO: 713549 - DNA, 25 bp, Mus musculus
gggagccacggatctcactcatgag

SEQ ID NO: 713550 - DNA, 25 bp, Mus musculus
gggagccagccaatgtccatgggct

SEQ ID NO: 713551 - DNA, 25 bp, Mus musculus
gggagccagccattgtccatgggct

SEQ ID NO: 713552 - DNA, 25 bp, Mus musculus
gggagccagccgcattcttaaggat

SEQ ID NO: 713553 - DNA, 25 bp, Mus musculus
gggagccagccggattcttaaggat

SEQ ID NO: 713554 - DNA, 25 bp, Mus musculus
gggagcccaccacgcttctttggac

SEQ ID NO: 713555 - DNA, 25 bp, Mus musculus
gggagcccaccaggcttctttggac

SEQ ID NO: 713556 - DNA, 25 bp, Mus musculus
gggagcccactcctggcagaacaga

SEQ ID NO: 713557 - DNA, 25 bp, Mus musculus
gggagcccactcgtggcagaacaga

SEQ ID NO: 713558 - DNA, 25 bp, Mus musculus
gggagcccagctactactgcagtca

SEQ ID NO: 713559 - DNA, 25 bp, Mus musculus
gggagcccagcttctactgcagtca

SEQ ID NO: 713560 - DNA, 25 bp, Mus musculus
gggagcccagtgacgtcgctacata

SEQ ID NO: 713561 - DNA, 25 bp, Mus musculus
gggagcccagtgtcgtcgctacata

SEQ ID NO: 713562 - DNA, 25 bp, Mus musculus
gggagccccggacttcacctgagct

SEQ ID NO: 713563 - DNA, 25 bp, Mus musculus
gggagccccggagttcacctgagct

SEQ ID NO: 713564 - DNA, 25 bp, Mus musculus
gggagcccctttctagacttcacgg

SEQ ID NO: 713565 - DNA, 25 bp, Mus musculus
gggagcccctttgtagacttcacgg

SEQ ID NO: 713566 - DNA, 25 bp, Mus musculus
gggagcccgcccacgcttcaggatg

SEQ ID NO: 713567 - DNA, 25 bp, Mus musculus
gggagcccgccctcgcttcaggatg

SEQ ID NO: 713568 - DNA, 25 bp, Mus musculus
gggagcccttagacgtcatcaatgg

SEQ ID NO: 713569 - DNA, 25 bp, Mus musculus
gggagcccttagtcgtcatcaatgg

SEQ ID NO: 713570 - DNA, 25 bp, Mus musculus
gggagccgccaaactctgatctcca

SEQ ID NO: 713571 - DNA, 25 bp, Mus musculus
gggagccgccaatctctgatctcca

SEQ ID NO: 713572 - DNA, 25 bp, Mus musculus
gggagccgccgcattgagcagccac

SEQ ID NO: 713573 - DNA, 25 bp, Mus musculus
gggagccgccgctttgagcagccac

SEQ ID NO: 713574 - DNA, 25 bp, Mus musculus
gggagccgccgtatccgttattcag

SEQ ID NO: 713575 - DNA, 25 bp, Mus musculus
gggagccgccgtttccgttattcag

SEQ ID NO: 713576 - DNA, 25 bp, Mus musculus
gggagccggcaccttatttatgtaa

SEQ ID NO: 713577 - DNA, 25 bp, Mus musculus
gggagccggcacgttatttatgtaa

SEQ ID NO: 713578 - DNA, 25 bp, Mus musculus
gggagcctatcactacatgctggag

SEQ ID NO: 713579 - DNA, 25 bp, Mus musculus
gggagcctatcagtacatgctggag

SEQ ID NO: 713580 - DNA, 25 bp, Mus musculus
gggagcctcatcagctttatctgcc

SEQ ID NO: 713581 - DNA, 25 bp, Mus musculus
gggagcctcatctgctttatctgcc

SEQ ID NO: 713582 - DNA, 25 bp, Mus musculus
gggagcctctcgaacagtcacgcct

SEQ ID NO: 713583 - DNA, 25 bp, Mus musculus
gggagcctctcgtacagtcacgcct

SEQ ID NO: 713584 - DNA, 25 bp, Mus musculus
gggagcctgatccattctctgtaca

SEQ ID NO: 713585 - DNA, 25 bp, Mus musculus
gggagcctgatcgattctctgtaca

SEQ ID NO: 713586 - DNA, 25 bp, Mus musculus
gggagcctgcttaggtactacagaa

SEQ ID NO: 713587 - DNA, 25 bp, Mus musculus
gggagcctgctttggtactacagaa

SEQ ID NO: 713588 - DNA, 25 bp, Mus musculus
gggagcctggatataactggcgact

SEQ ID NO: 713589 - DNA, 25 bp, Mus musculus
gggagcctggatttaactggcgact

SEQ ID NO: 713590 - DNA, 25 bp, Mus musculus
gggagcctgggcagctaaagtcatc

SEQ ID NO: 713591 - DNA, 25 bp, Mus musculus
gggagcctgggctgctaaagtcatc

SEQ ID NO: 713592 - DNA, 25 bp, Mus musculus
gggagcctgtgcacggcggccgcgg

SEQ ID NO: 713593 - DNA, 25 bp, Mus musculus
gggagcctgtgctcggcggccgcgg

SEQ ID NO: 713594 - DNA, 25 bp, Mus musculus
gggagcgcaccgcaaagcccttcaa

SEQ ID NO: 713595 - DNA, 25 bp, Mus musculus
gggagcgcaccggaaagcccttcaa

SEQ ID NO: 713596 - DNA, 25 bp, Mus musculus
gggagcgcctgtacagcatctgcca

SEQ ID NO: 713597 - DNA, 25 bp, Mus musculus
gggagcgcctgttcagcatctgcca

SEQ ID NO: 713598 - DNA, 25 bp, Mus musculus
gggagcgcttccaaggtcactttga

SEQ ID NO: 713599 - DNA, 25 bp, Mus musculus
gggagcgcttcctaggtcactttga

SEQ ID NO: 713600 - DNA, 25 bp, Mus musculus
gggagcggacaacgctccttttact

SEQ ID NO: 713601 - DNA, 25 bp, Mus musculus
gggagcggacaaggctccttttact

SEQ ID NO: 713602 - DNA, 25 bp, Mus musculus
gggagcgggtgtcctcacctacatc

SEQ ID NO: 713603 - DNA, 25 bp, Mus musculus
gggagcgggtgtgctcacctacatc

SEQ ID NO: 713604 - DNA, 25 bp, Mus musculus
gggagctaatcacattctgtcgtgc

SEQ ID NO: 713605 - DNA, 25 bp, Mus musculus
gggagctaatcagattctgtcgtgc

SEQ ID NO: 713606 - DNA, 25 bp, Mus musculus
gggagctacaccacttacaaccaga

SEQ ID NO: 713607 - DNA, 25 bp, Mus musculus
gggagctacacctcttacaaccaga

SEQ ID NO: 713608 - DNA, 25 bp, Mus musculus
gggagctaccaaacgccctcaagac

SEQ ID NO: 713609 - DNA, 25 bp, Mus musculus
gggagctaccaatcgccctcaagac

SEQ ID NO: 713610 - DNA, 25 bp, Mus musculus
gggagctatgtgagcttgaccctgc

SEQ ID NO: 713611 - DNA, 25 bp, Mus musculus
gggagctatgtgtgcttgaccctgc

SEQ ID NO: 713612 - DNA, 25 bp, Mus musculus
gggagctcaacacccggctcacaga

SEQ ID NO: 713613 - DNA, 25 bp, Mus musculus
gggagctcaacagccggctcacaga

SEQ ID NO: 713614 - DNA, 25 bp, Mus musculus
gggagctcaagaagacgctcataga

SEQ ID NO: 713615 - DNA, 25 bp, Mus musculus
gggagctcaagatgacgctcataga

SEQ ID NO: 713616 - DNA, 25 bp, Mus musculus
gggagctcacgccatgtttaacaaa

SEQ ID NO: 713617 - DNA, 25 bp, Mus musculus
gggagctcacgcgatgtttaacaaa

SEQ ID NO: 713618 - DNA, 25 bp, Mus musculus
gggagctccctgaggctagacattt

SEQ ID NO: 713619 - DNA, 25 bp, Mus musculus
gggagctccctgtggctagacattt

SEQ ID NO: 713620 - DNA, 25 bp, Mus musculus
gggagctcgtgacgtccctcaaagc

SEQ ID NO: 713621 - DNA, 25 bp, Mus musculus
gggagctcgtgaggtccctcaaagc

SEQ ID NO: 713622 - DNA, 25 bp, Mus musculus
gggagctgacccactgctctacgaa

SEQ ID NO: 713623 - DNA, 25 bp, Mus musculus
gggagctgaccctctgctctacgaa

SEQ ID NO: 713624 - DNA, 25 bp, Mus musculus
gggagctgacctactgtaagaagac

SEQ ID NO: 713625 - DNA, 25 bp, Mus musculus
gggagctgaccttctgtaagaagac

SEQ ID NO: 713626 - DNA, 25 bp, Mus musculus
gggagctgagccaactgaaggatca

SEQ ID NO: 713627 - DNA, 25 bp, Mus musculus
gggagctgagcctactgaaggatca

SEQ ID NO: 713628 - DNA, 25 bp, Mus musculus
gggagctggcaaacaaggatgctca

SEQ ID NO: 713629 - DNA, 25 bp, Mus musculus
gggagctggcaatcaaggatgctca

SEQ ID NO: 713630 - DNA, 25 bp, Mus musculus
gggagctgtgctactcactacgcta

SEQ ID NO: 713631 - DNA, 25 bp, Mus musculus
gggagctgtgcttctcactacgcta

SEQ ID NO: 713632 - DNA, 25 bp, Mus musculus
gggagcttcgagaactggcagaaac

SEQ ID NO: 713633 - DNA, 25 bp, Mus musculus
gggagcttcgagtactggcagaaac

SEQ ID NO: 713634 - DNA, 25 bp, Mus musculus
gggagcttgacaatctcaaagactg

SEQ ID NO: 713635 - DNA, 25 bp, Mus musculus
gggagcttgacattctcaaagactg

SEQ ID NO: 713636 - DNA, 25 bp, Mus musculus
gggaggacaataatgacttcatgcc

SEQ ID NO: 713637 - DNA, 25 bp, Mus musculus
gggaggacaatattgacttcatgcc

SEQ ID NO: 713638 - DNA, 25 bp, Mus musculus
gggaggacctcactataatcaacag

SEQ ID NO: 713639 - DNA, 25 bp, Mus musculus
gggaggacctcagtataatcaacag

SEQ ID NO: 713640 - DNA, 25 bp, Mus musculus
gggaggactctgaccgacaatgtag

SEQ ID NO: 713641 - DNA, 25 bp, Mus musculus
gggaggactctgtccgacaatgtag

SEQ ID NO: 713642 - DNA, 25 bp, Mus musculus
gggaggagacacacttgatctgcct

SEQ ID NO: 713643 - DNA, 25 bp, Mus musculus
gggaggagacactcttgatctgcct

SEQ ID NO: 713644 - DNA, 25 bp, Mus musculus
gggaggagaccgactcagagcccca

SEQ ID NO: 713645 - DNA, 25 bp, Mus musculus
gggaggagaccgtctcagagcccca

SEQ ID NO: 713646 - DNA, 25 bp, Mus musculus
gggaggagattgaagtcaactgtac

SEQ ID NO: 713647 - DNA, 25 bp, Mus musculus
gggaggagattgtagtcaactgtac

SEQ ID NO: 713648 - DNA, 25 bp, Mus musculus
gggaggagtcacagaaaagttctat

SEQ ID NO: 713649 - DNA, 25 bp, Mus musculus
gggaggagtcactgaaaagttctat

SEQ ID NO: 713650 - DNA, 25 bp, Mus musculus
gggaggagttgcatccacacatcca

SEQ ID NO: 713651 - DNA, 25 bp, Mus musculus
gggaggagttgcttccacacatcca

SEQ ID NO: 713652 - DNA, 25 bp, Mus musculus
gggaggatcctgacctgtctctgca

SEQ ID NO: 713653 - DNA, 25 bp, Mus musculus
gggaggatcctgtcctgtctctgca

SEQ ID NO: 713654 - DNA, 25 bp, Mus musculus
gggaggatctcactttcgctgatgt

SEQ ID NO: 713655 - DNA, 25 bp, Mus musculus
gggaggatctcagtttcgctgatgt

SEQ ID NO: 713656 - DNA, 25 bp, Mus musculus
gggaggcatgttctcttctacccaa

SEQ ID NO: 713657 - DNA, 25 bp, Mus musculus
gggaggcatgttgtcttctacccaa

SEQ ID NO: 713658 - DNA, 25 bp, Mus musculus
gggaggcattacctgtgtgtctggt

SEQ ID NO: 713659 - DNA, 25 bp, Mus musculus
gggaggcattacgtgtgtgtctggt

SEQ ID NO: 713660 - DNA, 25 bp, Mus musculus
gggaggccaaccagcatgagttgca

SEQ ID NO: 713661 - DNA, 25 bp, Mus musculus
gggaggccaacctgcatgagttgca

SEQ ID NO: 713662 - DNA, 25 bp, Mus musculus
gggaggccaagaacactgaagagct

SEQ ID NO: 713663 - DNA, 25 bp, Mus musculus
gggaggccaagatcactgaagagct

SEQ ID NO: 713664 - DNA, 25 bp, Mus musculus
gggaggccagttactccaccattgc

SEQ ID NO: 713665 - DNA, 25 bp, Mus musculus
gggaggccagtttctccaccattgc

SEQ ID NO: 713666 - DNA, 25 bp, Mus musculus
gggaggccatcccttatccaagatc

SEQ ID NO: 713667 - DNA, 25 bp, Mus musculus
gggaggccatccgttatccaagatc

SEQ ID NO: 713668 - DNA, 25 bp, Mus musculus
gggaggccattgacctgtaccaggc

SEQ ID NO: 713669 - DNA, 25 bp, Mus musculus
gggaggccattgtcctgtaccaggc

SEQ ID NO: 713670 - DNA, 25 bp, Mus musculus
gggaggcctcaacctggcctactat

SEQ ID NO: 713671 - DNA, 25 bp, Mus musculus
gggaggcctcaagctggcctactat

SEQ ID NO: 713672 - DNA, 25 bp, Mus musculus
gggaggcctgtacagccctcaaacc

SEQ ID NO: 713673 - DNA, 25 bp, Mus musculus
gggaggcctgtagagccctcaaacc

SEQ ID NO: 713674 - DNA, 25 bp, Mus musculus
gggaggcctgtgaacactccagtga

SEQ ID NO: 713675 - DNA, 25 bp, Mus musculus
gggaggcctgtgtacactccagtga

SEQ ID NO: 713676 - DNA, 25 bp, Mus musculus
gggaggctcagaccttctagacaag

SEQ ID NO: 713677 - DNA, 25 bp, Mus musculus
gggaggctcagagcttctagacaag

SEQ ID NO: 713678 - DNA, 25 bp, Mus musculus
gggaggctgtccaatgacaccacca

SEQ ID NO: 713679 - DNA, 25 bp, Mus musculus
gggaggctgtcctatgacaccacca

SEQ ID NO: 713680 - DNA, 25 bp, Mus musculus
gggaggcttactacgacacagactt

SEQ ID NO: 713681 - DNA, 25 bp, Mus musculus
gggaggcttacttcgacacagactt

SEQ ID NO: 713682 - DNA, 25 bp, Mus musculus
gggaggcttctcctttcacccaggg

SEQ ID NO: 713683 - DNA, 25 bp, Mus musculus
gggaggcttctcgtttcacccaggg

SEQ ID NO: 713684 - DNA, 25 bp, Mus musculus
gggaggcttcttatcacaaatagga

SEQ ID NO: 713685 - DNA, 25 bp, Mus musculus
gggaggcttcttttcacaaatagga

SEQ ID NO: 713686 - DNA, 25 bp, Mus musculus
gggagggatgctaattcgacagccc

SEQ ID NO: 713687 - DNA, 25 bp, Mus musculus
gggagggatgcttattcgacagccc

SEQ ID NO: 713688 - DNA, 25 bp, Mus musculus
gggagggccgagacacctgatctaa

SEQ ID NO: 713689 - DNA, 25 bp, Mus musculus
gggagggccgagtcacctgatctaa

SEQ ID NO: 713690 - DNA, 25 bp, Mus musculus
gggaggggtacaacataccgctgca

SEQ ID NO: 713691 - DNA, 25 bp, Mus musculus
gggaggggtacatcataccgctgca

SEQ ID NO: 713692 - DNA, 25 bp, Mus musculus
gggaggtacagaaccctggaccttc

SEQ ID NO: 713693 - DNA, 25 bp, Mus musculus
gggaggtacagatccctggaccttc

SEQ ID NO: 713694 - DNA, 25 bp, Mus musculus
gggaggtccagtatcgaggactcaa

SEQ ID NO: 713695 - DNA, 25 bp, Mus musculus
gggaggtccagtttcgaggactcaa

SEQ ID NO: 713696 - DNA, 25 bp, Mus musculus
gggaggtccatcaacggaagccgct

SEQ ID NO: 713697 - DNA, 25 bp, Mus musculus
gggaggtccatctacggaagccgct

SEQ ID NO: 713698 - DNA, 25 bp, Mus musculus
gggaggtcgcagacctccctgcaca

SEQ ID NO: 713699 - DNA, 25 bp, Mus musculus
gggaggtcgcagtcctccctgcaca

SEQ ID NO: 713700 - DNA, 25 bp, Mus musculus
gggaggttatgaagcttctgaaaac

SEQ ID NO: 713701 - DNA, 25 bp, Mus musculus
gggaggttatgatgcttctgaaaac

SEQ ID NO: 713702 - DNA, 25 bp, Mus musculus
gggagtaatccacccagacattgtt

SEQ ID NO: 713703 - DNA, 25 bp, Mus musculus
gggagtaatccagccagacattgtt

SEQ ID NO: 713704 - DNA, 25 bp, Mus musculus
gggagtacacgtcctccatcttcac

SEQ ID NO: 713705 - DNA, 25 bp, Mus musculus
gggagtacacgtgctccatcttcac

SEQ ID NO: 713706 - DNA, 25 bp, Mus musculus
gggagtacgtcccacttgggccatt

SEQ ID NO: 713707 - DNA, 25 bp, Mus musculus
gggagtacgtccgacttgggccatt

SEQ ID NO: 713708 - DNA, 25 bp, Mus musculus
gggagtactaaccaatccaaattgt

SEQ ID NO: 713709 - DNA, 25 bp, Mus musculus
gggagtactaacgaatccaaattgt

SEQ ID NO: 713710 - DNA, 25 bp, Mus musculus
gggagtactacacctgttgttacca

SEQ ID NO: 713711 - DNA, 25 bp, Mus musculus
gggagtactacagctgttgttacca

SEQ ID NO: 713712 - DNA, 25 bp, Mus musculus
gggagtactgaacccctggcacacg

SEQ ID NO: 713713 - DNA, 25 bp, Mus musculus
gggagtactgaagccctggcacacg

SEQ ID NO: 713714 - DNA, 25 bp, Mus musculus
gggagtagccataaccctaggttct

SEQ ID NO: 713715 - DNA, 25 bp, Mus musculus
gggagtagccattaccctaggttct

SEQ ID NO: 713716 - DNA, 25 bp, Mus musculus
gggagtatgtgtctaaggtttccaa

SEQ ID NO: 713717 - DNA, 25 bp, Mus musculus
gggagtatgtgtgtaaggtttccaa

SEQ ID NO: 713718 - DNA, 25 bp, Mus musculus
gggagtcagtgcataccaacactgc

SEQ ID NO: 713719 - DNA, 25 bp, Mus musculus
gggagtcagtgcatcactccacacc

SEQ ID NO: 713720 - DNA, 25 bp, Mus musculus
gggagtcagtgcttaccaacactgc

SEQ ID NO: 713721 - DNA, 25 bp, Mus musculus
gggagtcagtgcttcactccacacc

SEQ ID NO: 713722 - DNA, 25 bp, Mus musculus
gggagtcatgctcttcattcgcctc

SEQ ID NO: 713723 - DNA, 25 bp, Mus musculus
gggagtcatgctgttcattcgcctc

SEQ ID NO: 713724 - DNA, 25 bp, Mus musculus
gggagtccagccagtaatgctctgt

SEQ ID NO: 713725 - DNA, 25 bp, Mus musculus
gggagtccagcctgtaatgctctgt

SEQ ID NO: 713726 - DNA, 25 bp, Mus musculus
gggagtccgtggatttgcacatgaa

SEQ ID NO: 713727 - DNA, 25 bp, Mus musculus
gggagtccgtggttttgcacatgaa

SEQ ID NO: 713728 - DNA, 25 bp, Mus musculus
gggagtcctataattggaccggtct

SEQ ID NO: 713729 - DNA, 25 bp, Mus musculus
gggagtcctatatttggaccggtct

SEQ ID NO: 713730 - DNA, 25 bp, Mus musculus
gggagtcctgccagtcacctgtctc

SEQ ID NO: 713731 - DNA, 25 bp, Mus musculus
gggagtcctgcctgtcacctgtctc

SEQ ID NO: 713732 - DNA, 25 bp, Mus musculus
gggagtcgcaagaggaccacagcac

SEQ ID NO: 713733 - DNA, 25 bp, Mus musculus
gggagtcgcaagtggaccacagcac

SEQ ID NO: 713734 - DNA, 25 bp, Mus musculus
gggagtcggaggagagccatgagca

SEQ ID NO: 713735 - DNA, 25 bp, Mus musculus
gggagtcggaggtgagccatgagca

SEQ ID NO: 713736 - DNA, 25 bp, Mus musculus
gggagtctcctacaccaggctacat

SEQ ID NO: 713737 - DNA, 25 bp, Mus musculus
gggagtctcctagaccaggctacat

SEQ ID NO: 713738 - DNA, 25 bp, Mus musculus
gggagtctcttcctggatttccgta

SEQ ID NO: 713739 - DNA, 25 bp, Mus musculus
gggagtctcttcgtggatttccgta

SEQ ID NO: 713740 - DNA, 25 bp, Mus musculus
gggagtctgcaacgtaaggaaccat

SEQ ID NO: 713741 - DNA, 25 bp, Mus musculus
gggagtctgcaaggtaaggaaccat

SEQ ID NO: 713742 - DNA, 25 bp, Mus musculus
gggagtgacccacatcagagtcgta

SEQ ID NO: 713743 - DNA, 25 bp, Mus musculus
gggagtgacccagatcagagtcgta

SEQ ID NO: 713744 - DNA, 25 bp, Mus musculus
gggagtgactcaaatgattccatct

SEQ ID NO: 713745 - DNA, 25 bp, Mus musculus
gggagtgactcatatgattccatct

SEQ ID NO: 713746 - DNA, 25 bp, Mus musculus
gggagtgcacacatcctgctaagtc

SEQ ID NO: 713747 - DNA, 25 bp, Mus musculus
gggagtgcacacttcctgctaagtc

SEQ ID NO: 713748 - DNA, 25 bp, Mus musculus
gggagtggagatactgaccaaactg

SEQ ID NO: 713749 - DNA, 25 bp, Mus musculus
gggagtggagattctgaccaaactg

SEQ ID NO: 713750 - DNA, 25 bp, Mus musculus
gggagtgtctttctggccctcatca

SEQ ID NO: 713751 - DNA, 25 bp, Mus musculus
gggagtgtctttgtggccctcatca

SEQ ID NO: 713752 - DNA, 25 bp, Mus musculus
gggagttacaccagcgtctgtaacc

SEQ ID NO: 713753 - DNA, 25 bp, Mus musculus
gggagttacacctgcgtctgtaacc

SEQ ID NO: 713754 - DNA, 25 bp, Mus musculus
gggagttcaataatgtcaactgttc

SEQ ID NO: 713755 - DNA, 25 bp, Mus musculus
gggagttcaatattgtcaactgttc

SEQ ID NO: 713756 - DNA, 25 bp, Mus musculus
gggagttccaatccatatgtatgcc

SEQ ID NO: 713757 - DNA, 25 bp, Mus musculus
gggagttccaatgcatatgtatgcc

SEQ ID NO: 713758 - DNA, 25 bp, Mus musculus
gggagttcccgcactgtgactcatg

SEQ ID NO: 713759 - DNA, 25 bp, Mus musculus
gggagttcccgctctgtgactcatg

SEQ ID NO: 713760 - DNA, 25 bp, Mus musculus
gggagttccgtgctccttgtagact

SEQ ID NO: 713761 - DNA, 25 bp, Mus musculus
gggagttccgtggtccttgtagact

SEQ ID NO: 713762 - DNA, 25 bp, Mus musculus
gggagttcctctccaaagttctcag

SEQ ID NO: 713763 - DNA, 25 bp, Mus musculus
gggagttcctctgcaaagttctcag

SEQ ID NO: 713764 - DNA, 25 bp, Mus musculus
gggagttctgtcatagccgtggtat

SEQ ID NO: 713765 - DNA, 25 bp, Mus musculus
gggagttctgtcttagccgtggtat

SEQ ID NO: 713766 - DNA, 25 bp, Mus musculus
gggagttctgttctccagttgaacc

SEQ ID NO: 713767 - DNA, 25 bp, Mus musculus
gggagttctgttgtccagttgaacc

SEQ ID NO: 713768 - DNA, 25 bp, Mus musculus
gggagttgacccaagaagagaagct

SEQ ID NO: 713769 - DNA, 25 bp, Mus musculus
gggagttgaccctagaagagaagct

SEQ ID NO: 713770 - DNA, 25 bp, Mus musculus
gggagttgacgtacacacccggctg

SEQ ID NO: 713771 - DNA, 25 bp, Mus musculus
gggagttgacgttcacacccggctg

SEQ ID NO: 713772 - DNA, 25 bp, Mus musculus
gggagttgcagaaaaaaccttcaga

SEQ ID NO: 713773 - DNA, 25 bp, Mus musculus
gggagttgcagataaaaccttcaga

SEQ ID NO: 713774 - DNA, 25 bp, Mus musculus
gggagtttacatcagtctttagaaa

SEQ ID NO: 713775 - DNA, 25 bp, Mus musculus
gggagtttacatgagtctttagaaa

SEQ ID NO: 713776 - DNA, 25 bp, Mus musculus
gggagtttccagaccctttctgatg

SEQ ID NO: 713777 - DNA, 25 bp, Mus musculus
gggagtttccagtccctttctgatg

SEQ ID NO: 713778 - DNA, 25 bp, Mus musculus
gggagtttcttaatcacaccatcgc

SEQ ID NO: 713779 - DNA, 25 bp, Mus musculus
gggagtttcttattcacaccatcgc

SEQ ID NO: 713780 - DNA, 25 bp, Mus musculus
gggataaagaagacggaacttcatg

SEQ ID NO: 713781 - DNA, 25 bp, Mus musculus
gggataaagaagtcggaacttcatg

SEQ ID NO: 713782 - DNA, 25 bp, Mus musculus
gggataacttccactaccaacacag

SEQ ID NO: 713783 - DNA, 25 bp, Mus musculus
gggataacttcctctaccaacacag

SEQ ID NO: 713784 - DNA, 25 bp, Mus musculus
gggataagccctcaagataaatggg

SEQ ID NO: 713785 - DNA, 25 bp, Mus musculus
gggataagccctgaagataaatggg

SEQ ID NO: 713786 - DNA, 25 bp, Mus musculus
gggataaggtgcaaacatagattta

SEQ ID NO: 713787 - DNA, 25 bp, Mus musculus
gggataaggtgctaacatagattta

SEQ ID NO: 713788 - DNA, 25 bp, Mus musculus
gggatacaaaagctgttcaaagcag

SEQ ID NO: 713789 - DNA, 25 bp, Mus musculus
gggatacaaaaggtgttcaaagcag

SEQ ID NO: 713790 - DNA, 25 bp, Mus musculus
gggatacaaagaaccagaaagacca

SEQ ID NO: 713791 - DNA, 25 bp, Mus musculus
gggatacaaagatccagaaagacca

SEQ ID NO: 713792 - DNA, 25 bp, Mus musculus
gggatacaagcaagaaagatctgac

SEQ ID NO: 713793 - DNA, 25 bp, Mus musculus
gggatacaagcatgaaagatctgac

SEQ ID NO: 713794 - DNA, 25 bp, Mus musculus
gggatacacagtagggtttcagaac

SEQ ID NO: 713795 - DNA, 25 bp, Mus musculus
gggatacacagttgggtttcagaac

SEQ ID NO: 713796 - DNA, 25 bp, Mus musculus
gggatacactatagctcgagtgttt

SEQ ID NO: 713797 - DNA, 25 bp, Mus musculus
gggatacactattgctcgagtgttt

SEQ ID NO: 713798 - DNA, 25 bp, Mus musculus
gggatacaggccatcggcaatggca

SEQ ID NO: 713799 - DNA, 25 bp, Mus musculus
gggatacaggccttcggcaatggca

SEQ ID NO: 713800 - DNA, 25 bp, Mus musculus
gggatacagtacacaagcaccacca

SEQ ID NO: 713801 - DNA, 25 bp, Mus musculus
gggatacagtactcaagcaccacca

SEQ ID NO: 713802 - DNA, 25 bp, Mus musculus
gggataccagaaaacccactgtgat

SEQ ID NO: 713803 - DNA, 25 bp, Mus musculus
gggataccagaatacccactgtgat

SEQ ID NO: 713804 - DNA, 25 bp, Mus musculus
gggataccagctcccaaaatcctgt

SEQ ID NO: 713805 - DNA, 25 bp, Mus musculus
gggataccagctgccaaaatcctgt

SEQ ID NO: 713806 - DNA, 25 bp, Mus musculus
gggatacgattgccggtgtccccat

SEQ ID NO: 713807 - DNA, 25 bp, Mus musculus
gggatacgattggcggtgtccccat

SEQ ID NO: 713808 - DNA, 25 bp, Mus musculus
gggatacgcgcgctcagcgcaactc

SEQ ID NO: 713809 - DNA, 25 bp, Mus musculus
gggatacgcgcggtcagcgcaactc

SEQ ID NO: 713810 - DNA, 25 bp, Mus musculus
gggatactacgaacaaaagtaatga

SEQ ID NO: 713811 - DNA, 25 bp, Mus musculus
gggatactacgatcaaaagtaatga

SEQ ID NO: 713812 - DNA, 25 bp, Mus musculus
gggatactccagctgactcactcct

SEQ ID NO: 713813 - DNA, 25 bp, Mus musculus
gggatactccaggtgactcactcct

SEQ ID NO: 713814 - DNA, 25 bp, Mus musculus
gggatactgcaactcctttgaatcc

SEQ ID NO: 713815 - DNA, 25 bp, Mus musculus
gggatactgcaagtcctttgaatcc

SEQ ID NO: 713816 - DNA, 25 bp, Mus musculus
gggatactgcttcgagcccaagaaa

SEQ ID NO: 713817 - DNA, 25 bp, Mus musculus
gggatactgcttggagcccaagaaa

SEQ ID NO: 713818 - DNA, 25 bp, Mus musculus
gggatacttatcagcaagtctgttt

SEQ ID NO: 713819 - DNA, 25 bp, Mus musculus
gggatacttatctgcaagtctgttt

SEQ ID NO: 713820 - DNA, 25 bp, Mus musculus
gggatagagtccagcaacatcaccg

SEQ ID NO: 713821 - DNA, 25 bp, Mus musculus
gggatagagtcctgcaacatcaccg

SEQ ID NO: 713822 - DNA, 25 bp, Mus musculus
gggatagcagatccttctcaaagta

SEQ ID NO: 713823 - DNA, 25 bp, Mus musculus
gggatagcagatgcttctcaaagta

SEQ ID NO: 713824 - DNA, 25 bp, Mus musculus
gggatagcctgtcccgctcccaaga

SEQ ID NO: 713825 - DNA, 25 bp, Mus musculus
gggatagcctgtgccgctcccaaga

SEQ ID NO: 713826 - DNA, 25 bp, Mus musculus
gggatagcctttcccttcaatgcca

SEQ ID NO: 713827 - DNA, 25 bp, Mus musculus
gggatagcctttgccttcaatgcca

SEQ ID NO: 713828 - DNA, 25 bp, Mus musculus
gggatagctttgagacgtaagattc

SEQ ID NO: 713829 - DNA, 25 bp, Mus musculus
gggatagctttgtgacgtaagattc

SEQ ID NO: 713830 - DNA, 25 bp, Mus musculus
gggatagggcagacataccacagca

SEQ ID NO: 713831 - DNA, 25 bp, Mus musculus
gggatagggcagtcataccacagca

SEQ ID NO: 713832 - DNA, 25 bp, Mus musculus
gggataggtcatcgctgctcacttc

SEQ ID NO: 713833 - DNA, 25 bp, Mus musculus
gggataggtcatggctgctcacttc

SEQ ID NO: 713834 - DNA, 25 bp, Mus musculus
gggatatacacacctgctgactgtg

SEQ ID NO: 713835 - DNA, 25 bp, Mus musculus
gggatatacacagctgctgactgtg

SEQ ID NO: 713836 - DNA, 25 bp, Mus musculus
gggatatactgtcgtcgtgtgcatt

SEQ ID NO: 713837 - DNA, 25 bp, Mus musculus
gggatatactgtggtcgtgtgcatt

SEQ ID NO: 713838 - DNA, 25 bp, Mus musculus
gggatataggcccttccaaatctcg

SEQ ID NO: 713839 - DNA, 25 bp, Mus musculus
gggatataggccgttccaaatctcg

SEQ ID NO: 713840 - DNA, 25 bp, Mus musculus
gggatatccatcaccgcctgaagga

SEQ ID NO: 713841 - DNA, 25 bp, Mus musculus
gggatatccatctccgcctgaagga

SEQ ID NO: 713842 - DNA, 25 bp, Mus musculus
gggatatccctgcttgaggacttgt

SEQ ID NO: 713843 - DNA, 25 bp, Mus musculus
gggatatccctggttgaggacttgt

SEQ ID NO: 713844 - DNA, 25 bp, Mus musculus
gggatatcctgacaggcttcaaact

SEQ ID NO: 713845 - DNA, 25 bp, Mus musculus
gggatatcctgagaggcttcaaact

SEQ ID NO: 713846 - DNA, 25 bp, Mus musculus
gggatatcctttcactctgcatggt

SEQ ID NO: 713847 - DNA, 25 bp, Mus musculus
gggatatcctttgactctgcatggt

SEQ ID NO: 713848 - DNA, 25 bp, Mus musculus
gggatatctggtccttcgctaacaa

SEQ ID NO: 713849 - DNA, 25 bp, Mus musculus
gggatatctggtgcttcgctaacaa

SEQ ID NO: 713850 - DNA, 25 bp, Mus musculus
gggatatgagtgatcctgagccacc

SEQ ID NO: 713851 - DNA, 25 bp, Mus musculus
gggatatgagtgttcctgagccacc

SEQ ID NO: 713852 - DNA, 25 bp, Mus musculus
gggatatgccctaccagccattcag

SEQ ID NO: 713853 - DNA, 25 bp, Mus musculus
gggatatgcccttccagccattcag

SEQ ID NO: 713854 - DNA, 25 bp, Mus musculus
gggatatgctgcatcgatgagtttg

SEQ ID NO: 713855 - DNA, 25 bp, Mus musculus
gggatatgctgcttcgatgagtttg

SEQ ID NO: 713856 - DNA, 25 bp, Mus musculus
gggatatggcttccccaactgacat

SEQ ID NO: 713857 - DNA, 25 bp, Mus musculus
gggatatggcttgcccaactgacat

SEQ ID NO: 713858 - DNA, 25 bp, Mus musculus
gggatattcagactttgtcctaaca

SEQ ID NO: 713859 - DNA, 25 bp, Mus musculus
gggatattcagagtttgtcctaaca

SEQ ID NO: 713860 - DNA, 25 bp, Mus musculus
gggatattctctcgactgcatggaa

SEQ ID NO: 713861 - DNA, 25 bp, Mus musculus
gggatattctctggactgcatggaa

SEQ ID NO: 713862 - DNA, 25 bp, Mus musculus
gggatattgggtatctcgaccggtc

SEQ ID NO: 713863 - DNA, 25 bp, Mus musculus
gggatattgggtttctcgaccggtc

SEQ ID NO: 713864 - DNA, 25 bp, Mus musculus
gggatcaaacacctccatgcattca

SEQ ID NO: 713865 - DNA, 25 bp, Mus musculus
gggatcaaacacgtccatgcattca

SEQ ID NO: 713866 - DNA, 25 bp, Mus musculus
gggatcaaacagagctcattcttca

SEQ ID NO: 713867 - DNA, 25 bp, Mus musculus
gggatcaaacagtgctcattcttca

SEQ ID NO: 713868 - DNA, 25 bp, Mus musculus
gggatcaaatgtcccaggacatgga

SEQ ID NO: 713869 - DNA, 25 bp, Mus musculus
gggatcaaatgtgccaggacatgga

SEQ ID NO: 713870 - DNA, 25 bp, Mus musculus
gggatcaccacgagagcaccatcca

SEQ ID NO: 713871 - DNA, 25 bp, Mus musculus
gggatcaccacgtgagcaccatcca

SEQ ID NO: 713872 - DNA, 25 bp, Mus musculus
gggatcaccccacatctggtgcaaa

SEQ ID NO: 713873 - DNA, 25 bp, Mus musculus
gggatcaccccagatctggtgcaaa

SEQ ID NO: 713874 - DNA, 25 bp, Mus musculus
gggatcaccgtcattcaacacttgg

SEQ ID NO: 713875 - DNA, 25 bp, Mus musculus
gggatcaccgtctttcaacacttgg

SEQ ID NO: 713876 - DNA, 25 bp, Mus musculus
gggatcacctgtcgcttatttatac

SEQ ID NO: 713877 - DNA, 25 bp, Mus musculus
gggatcacctgtggcttatttatac

SEQ ID NO: 713878 - DNA, 25 bp, Mus musculus
gggatcactctaagccgagcgctaa

SEQ ID NO: 713879 - DNA, 25 bp, Mus musculus
gggatcactctatgccgagcgctaa

SEQ ID NO: 713880 - DNA, 25 bp, Mus musculus
gggatcaggcacctttttctttgtg

SEQ ID NO: 713881 - DNA, 25 bp, Mus musculus
gggatcaggcacgtttttctttgtg

SEQ ID NO: 713882 - DNA, 25 bp, Mus musculus
gggatcagggctagacgcttactct

SEQ ID NO: 713883 - DNA, 25 bp, Mus musculus
gggatcagggcttgacgcttactct

SEQ ID NO: 713884 - DNA, 25 bp, Mus musculus
gggatcatagctctagcagaactac

SEQ ID NO: 713885 - DNA, 25 bp, Mus musculus
gggatcatagctgtagcagaactac

SEQ ID NO: 713886 - DNA, 25 bp, Mus musculus
gggatcatcacaaagaagaacattt

SEQ ID NO: 713887 - DNA, 25 bp, Mus musculus
gggatcatcacatagaagaacattt

SEQ ID NO: 713888 - DNA, 25 bp, Mus musculus
gggatcatgtgacaatcaggtgtct

SEQ ID NO: 713889 - DNA, 25 bp, Mus musculus
gggatcatgtgagaatcaggtgtct

SEQ ID NO: 713890 - DNA, 25 bp, Mus musculus
gggatccaaaatacagaggccctca

SEQ ID NO: 713891 - DNA, 25 bp, Mus musculus
gggatccaaaattcagaggccctca

SEQ ID NO: 713892 - DNA, 25 bp, Mus musculus
gggatccaaagcatcaataaacaag

SEQ ID NO: 713893 - DNA, 25 bp, Mus musculus
gggatccaaagcttcaataaacaag

SEQ ID NO: 713894 - DNA, 25 bp, Mus musculus
gggatccaagctccctgatcatgca

SEQ ID NO: 713895 - DNA, 25 bp, Mus musculus
gggatccaagctgcctgatcatgca

SEQ ID NO: 713896 - DNA, 25 bp, Mus musculus
gggatccacctacctctgtctctga

SEQ ID NO: 713897 - DNA, 25 bp, Mus musculus
gggatccacctagctctgtctctga

SEQ ID NO: 713898 - DNA, 25 bp, Mus musculus
gggatccagcacatcttccgggtcc

SEQ ID NO: 713899 - DNA, 25 bp, Mus musculus
gggatccagcacttcttccgggtcc

SEQ ID NO: 713900 - DNA, 25 bp, Mus musculus
gggatccagctgagttccttagaac

SEQ ID NO: 713901 - DNA, 25 bp, Mus musculus
gggatccagctgtgttccttagaac

SEQ ID NO: 713902 - DNA, 25 bp, Mus musculus
gggatccaggagagcttcaaccgat

SEQ ID NO: 713903 - DNA, 25 bp, Mus musculus
gggatccaggagtgcttcaaccgat

SEQ ID NO: 713904 - DNA, 25 bp, Mus musculus
gggatccagttcataatcgagaatg

SEQ ID NO: 713905 - DNA, 25 bp, Mus musculus
gggatccagttcttaatcgagaatg

SEQ ID NO: 713906 - DNA, 25 bp, Mus musculus
gggatccatgaaagagccacctttt

SEQ ID NO: 713907 - DNA, 25 bp, Mus musculus
gggatccatgaatgagccacctttt

SEQ ID NO: 713908 - DNA, 25 bp, Mus musculus
gggatcccaagacctcctcacatat

SEQ ID NO: 713909 - DNA, 25 bp, Mus musculus
gggatcccaagagctcctcacatat

SEQ ID NO: 713910 - DNA, 25 bp, Mus musculus
gggatcccaatgagcctgtttctga

SEQ ID NO: 713911 - DNA, 25 bp, Mus musculus
gggatcccaatgtgcctgtttctga

SEQ ID NO: 713912 - DNA, 25 bp, Mus musculus
gggatcccagctactcctggtgttg

SEQ ID NO: 713913 - DNA, 25 bp, Mus musculus
gggatcccagcttctcctggtgttg

SEQ ID NO: 713914 - DNA, 25 bp, Mus musculus
gggatcccagggagctgccatccac

SEQ ID NO: 713915 - DNA, 25 bp, Mus musculus
gggatcccagggtgctgccatccac

SEQ ID NO: 713916 - DNA, 25 bp, Mus musculus
gggatccccggcagcaactgtggca

SEQ ID NO: 713917 - DNA, 25 bp, Mus musculus
gggatccccggctgcaactgtggca

SEQ ID NO: 713918 - DNA, 25 bp, Mus musculus
gggatcccctgactcacatcctgag

SEQ ID NO: 713919 - DNA, 25 bp, Mus musculus
gggatcccctgagtcacatcctgag

SEQ ID NO: 713920 - DNA, 25 bp, Mus musculus
gggatcccgtgtctttttgctgaac

SEQ ID NO: 713921 - DNA, 25 bp, Mus musculus
gggatcccgtgtgtttttgctgaac

SEQ ID NO: 713922 - DNA, 25 bp, Mus musculus
gggatccgaacaagctcagaatgaa

SEQ ID NO: 713923 - DNA, 25 bp, Mus musculus
gggatccgaacatgctcagaatgaa

SEQ ID NO: 713924 - DNA, 25 bp, Mus musculus
gggatccggaagaagtaaagcttgc

SEQ ID NO: 713925 - DNA, 25 bp, Mus musculus
gggatccggaagtagtaaagcttgc

SEQ ID NO: 713926 - DNA, 25 bp, Mus musculus
gggatcctaggtacaaggctgcagt

SEQ ID NO: 713927 - DNA, 25 bp, Mus musculus
gggatcctaggttcaaggctgcagt

SEQ ID NO: 713928 - DNA, 25 bp, Mus musculus
gggatcctatgccttcttttgactt

SEQ ID NO: 713929 - DNA, 25 bp, Mus musculus
gggatcctatgcgttcttttgactt

SEQ ID NO: 713930 - DNA, 25 bp, Mus musculus
gggatcctcaggctatcattacctg

SEQ ID NO: 713931 - DNA, 25 bp, Mus musculus
gggatcctcagggtatcattacctg

SEQ ID NO: 713932 - DNA, 25 bp, Mus musculus
gggatcctgattccgaagacggttc

SEQ ID NO: 713933 - DNA, 25 bp, Mus musculus
gggatcctgattgcgaagacggttc

SEQ ID NO: 713934 - DNA, 25 bp, Mus musculus
gggatcctgcccctattcagttgat

SEQ ID NO: 713935 - DNA, 25 bp, Mus musculus
gggatcctgcccgtattcagttgat

SEQ ID NO: 713936 - DNA, 25 bp, Mus musculus
gggatcctgctcagcgtctccagct

SEQ ID NO: 713937 - DNA, 25 bp, Mus musculus
gggatcctgctctgcgtctccagct

SEQ ID NO: 713938 - DNA, 25 bp, Mus musculus
gggatcctgctgagggaaatcttca

SEQ ID NO: 713939 - DNA, 25 bp, Mus musculus
gggatcctgctgtgggaaatcttca

SEQ ID NO: 713940 - DNA, 25 bp, Mus musculus
gggatcctgcttactcgggtgccca

SEQ ID NO: 713941 - DNA, 25 bp, Mus musculus
gggatcctgctttctcgggtgccca

SEQ ID NO: 713942 - DNA, 25 bp, Mus musculus
gggatcctgtcaccttatttgaggt

SEQ ID NO: 713943 - DNA, 25 bp, Mus musculus
gggatcctgtcagcttatttgaggt

SEQ ID NO: 713944 - DNA, 25 bp, Mus musculus
gggatccttccaatttcccaagagt

SEQ ID NO: 713945 - DNA, 25 bp, Mus musculus
gggatccttccattttcccaagagt

SEQ ID NO: 713946 - DNA, 25 bp, Mus musculus
gggatcgagcctccttcaccatgga

SEQ ID NO: 713947 - DNA, 25 bp, Mus musculus
gggatcgagcctgcttcaccatgga

SEQ ID NO: 713948 - DNA, 25 bp, Mus musculus
gggatcgcaagaaaaaggtttccaa

SEQ ID NO: 713949 - DNA, 25 bp, Mus musculus
gggatcgcaagataaaggtttccaa

SEQ ID NO: 713950 - DNA, 25 bp, Mus musculus
gggatcgccaaaccctgggagctct

SEQ ID NO: 713951 - DNA, 25 bp, Mus musculus
gggatcgccaaagcctgggagctct

SEQ ID NO: 713952 - DNA, 25 bp, Mus musculus
gggatcggaacaactggatcgtgaa

SEQ ID NO: 713953 - DNA, 25 bp, Mus musculus
gggatcggaacatctggatcgtgaa

SEQ ID NO: 713954 - DNA, 25 bp, Mus musculus
gggatcgtccagatctaattctgca

SEQ ID NO: 713955 - DNA, 25 bp, Mus musculus
gggatcgtccagttctaattctgca

SEQ ID NO: 713956 - DNA, 25 bp, Mus musculus
gggatcgtccccaaaattgccttct

SEQ ID NO: 713957 - DNA, 25 bp, Mus musculus
gggatcgtcccctaaattgccttct

SEQ ID NO: 713958 - DNA, 25 bp, Mus musculus
gggatcgttgtgcacaagccgcctt

SEQ ID NO: 713959 - DNA, 25 bp, Mus musculus
gggatcgttgtggacaagccgcctt

SEQ ID NO: 713960 - DNA, 25 bp, Mus musculus
gggatctaccctctgtgttttcaag

SEQ ID NO: 713961 - DNA, 25 bp, Mus musculus
gggatctaccctgtgtgttttcaag

SEQ ID NO: 713962 - DNA, 25 bp, Mus musculus
gggatctacctaacttggaggcaag

SEQ ID NO: 713963 - DNA, 25 bp, Mus musculus
gggatctacctatcttggaggcaag

SEQ ID NO: 713964 - DNA, 25 bp, Mus musculus
gggatctagtcaagcttagggtcag

SEQ ID NO: 713965 - DNA, 25 bp, Mus musculus
gggatctagtcatgcttagggtcag

SEQ ID NO: 713966 - DNA, 25 bp, Mus musculus
gggatctcaaagacatgcttgcacg

SEQ ID NO: 713967 - DNA, 25 bp, Mus musculus
gggatctcaaagtcatgcttgcacg

SEQ ID NO: 713968 - DNA, 25 bp, Mus musculus
gggatctcaactaccgcgtggagct

SEQ ID NO: 713969 - DNA, 25 bp, Mus musculus
gggatctcaacttccgcgtggagct

SEQ ID NO: 713970 - DNA, 25 bp, Mus musculus
gggatctcacctcggacaagattgc

SEQ ID NO: 713971 - DNA, 25 bp, Mus musculus
gggatctcacctgggacaagattgc

SEQ ID NO: 713972 - DNA, 25 bp, Mus musculus
gggatctcctttacctcacgaaccg

SEQ ID NO: 713973 - DNA, 25 bp, Mus musculus
gggatctccttttcctcacgaaccg

SEQ ID NO: 713974 - DNA, 25 bp, Mus musculus
gggatctctgttctacctcacattg

SEQ ID NO: 713975 - DNA, 25 bp, Mus musculus
gggatctctgttgtacctcacattg

SEQ ID NO: 713976 - DNA, 25 bp, Mus musculus
gggatctcttagagttgagttgcaa

SEQ ID NO: 713977 - DNA, 25 bp, Mus musculus
gggatctcttagtgttgagttgcaa

SEQ ID NO: 713978 - DNA, 25 bp, Mus musculus
gggatctcttctagtgcagtccaga

SEQ ID NO: 713979 - DNA, 25 bp, Mus musculus
gggatctcttcttgtgcagtccaga

SEQ ID NO: 713980 - DNA, 25 bp, Mus musculus
gggatctgaaccaaagcccaagccc

SEQ ID NO: 713981 - DNA, 25 bp, Mus musculus
gggatctgaacctaagcccaagccc

SEQ ID NO: 713982 - DNA, 25 bp, Mus musculus
gggatctgcaccctgaaggtgccaa

SEQ ID NO: 713983 - DNA, 25 bp, Mus musculus
gggatctgcaccgtgaaggtgccaa

SEQ ID NO: 713984 - DNA, 25 bp, Mus musculus
gggatctgcagtcaaatttgtatca

SEQ ID NO: 713985 - DNA, 25 bp, Mus musculus
gggatctgcagtgaaatttgtatca

SEQ ID NO: 713986 - DNA, 25 bp, Mus musculus
gggatctgctcaccagacactcaca

SEQ ID NO: 713987 - DNA, 25 bp, Mus musculus
gggatctgctcagcagacactcaca

SEQ ID NO: 713988 - DNA, 25 bp, Mus musculus
gggatctgctctacaatgttgtgtg

SEQ ID NO: 713989 - DNA, 25 bp, Mus musculus
gggatctgctcttcaatgttgtgtg

SEQ ID NO: 713990 - DNA, 25 bp, Mus musculus
gggatctgggtcaacaagtcttgct

SEQ ID NO: 713991 - DNA, 25 bp, Mus musculus
gggatctgggtctacaagtcttgct

SEQ ID NO: 713992 - DNA, 25 bp, Mus musculus
gggatctgggtgatatggaaccatt

SEQ ID NO: 713993 - DNA, 25 bp, Mus musculus
gggatctgggtgttatggaaccatt

SEQ ID NO: 713994 - DNA, 25 bp, Mus musculus
gggatcttcattaaaggcttgtcag

SEQ ID NO: 713995 - DNA, 25 bp, Mus musculus
gggatcttcatttaaggcttgtcag

SEQ ID NO: 713996 - DNA, 25 bp, Mus musculus
gggatcttgataatgtgctacacac

SEQ ID NO: 713997 - DNA, 25 bp, Mus musculus
gggatcttgatattgtgctacacac

SEQ ID NO: 713998 - DNA, 25 bp, Mus musculus
gggatcttgttacaatggaatacag

SEQ ID NO: 713999 - DNA, 25 bp, Mus musculus
gggatcttgttagaatggaatacag

SEQ ID NO: 714000 - DNA, 25 bp, Mus musculus
gggatgaaaatcacaaagatgattc

SEQ ID NO: 714001 - DNA, 25 bp, Mus musculus
gggatgaaaatctcaaagatgattc

SEQ ID NO: 714002 - DNA, 25 bp, Mus musculus
gggatgaacagacaaattggattag

SEQ ID NO: 714003 - DNA, 25 bp, Mus musculus
gggatgaacagagaaattggattag

SEQ ID NO: 714004 - DNA, 25 bp, Mus musculus
gggatgaacatgaaccatgagcgca

SEQ ID NO: 714005 - DNA, 25 bp, Mus musculus
gggatgaacatgtaccatgagcgca

SEQ ID NO: 714006 - DNA, 25 bp, Mus musculus
gggatgacaaaaagtagccaggaca

SEQ ID NO: 714007 - DNA, 25 bp, Mus musculus
gggatgacaaaatgtagccaggaca

SEQ ID NO: 714008 - DNA, 25 bp, Mus musculus
gggatgacacccattacctgctcta

SEQ ID NO: 714009 - DNA, 25 bp, Mus musculus
gggatgacaccctttacctgctcta

SEQ ID NO: 714010 - DNA, 25 bp, Mus musculus
gggatgacagacaggttaacagaaa

SEQ ID NO: 714011 - DNA, 25 bp, Mus musculus
gggatgacagactggttaacagaaa

SEQ ID NO: 714012 - DNA, 25 bp, Mus musculus
gggatgacatttccccaggtctccc

SEQ ID NO: 714013 - DNA, 25 bp, Mus musculus
gggatgacatttgcccaggtctccc

SEQ ID NO: 714014 - DNA, 25 bp, Mus musculus
gggatgacccccatgtcctgtatgt

SEQ ID NO: 714015 - DNA, 25 bp, Mus musculus
gggatgacccccttgtcctgtatgt

SEQ ID NO: 714016 - DNA, 25 bp, Mus musculus
gggatgaccggaatagtgccaaaat

SEQ ID NO: 714017 - DNA, 25 bp, Mus musculus
gggatgaccggattagtgccaaaat

SEQ ID NO: 714018 - DNA, 25 bp, Mus musculus
gggatgactacccagatagccagtt

SEQ ID NO: 714019 - DNA, 25 bp, Mus musculus
gggatgactaccgagatagccagtt

SEQ ID NO: 714020 - DNA, 25 bp, Mus musculus
gggatgagagagacctaccacagtg

SEQ ID NO: 714021 - DNA, 25 bp, Mus musculus
gggatgagagagtcctaccacagtg

SEQ ID NO: 714022 - DNA, 25 bp, Mus musculus
gggatgatattcctagtgcccttcg

SEQ ID NO: 714023 - DNA, 25 bp, Mus musculus
gggatgatattcgtagtgcccttcg

SEQ ID NO: 714024 - DNA, 25 bp, Mus musculus
gggatgatgaggagacaaacaccct

SEQ ID NO: 714025 - DNA, 25 bp, Mus musculus
gggatgatgaggtgacaaacaccct

SEQ ID NO: 714026 - DNA, 25 bp, Mus musculus
gggatgattgacaagaacgagctca

SEQ ID NO: 714027 - DNA, 25 bp, Mus musculus
gggatgattgactagaacgagctca

SEQ ID NO: 714028 - DNA, 25 bp, Mus musculus
gggatgcaacagaccacagggatgc

SEQ ID NO: 714029 - DNA, 25 bp, Mus musculus
gggatgcaacagtccacagggatgc

SEQ ID NO: 714030 - DNA, 25 bp, Mus musculus
gggatgcaaccgctaaccctgatga

SEQ ID NO: 714031 - DNA, 25 bp, Mus musculus
gggatgcaaccggtaaccctgatga

SEQ ID NO: 714032 - DNA, 25 bp, Mus musculus
gggatgcaccaaagcctctgtcctc

SEQ ID NO: 714033 - DNA, 25 bp, Mus musculus
gggatgcaccaatgcctctgtcctc

SEQ ID NO: 714034 - DNA, 25 bp, Mus musculus
gggatgcacgtaagagcccggttcc

SEQ ID NO: 714035 - DNA, 25 bp, Mus musculus
gggatgcacgtatgagcccggttcc

SEQ ID NO: 714036 - DNA, 25 bp, Mus musculus
gggatgcaggcacagaccacatcca

SEQ ID NO: 714037 - DNA, 25 bp, Mus musculus
gggatgcaggcagagaccacatcca

SEQ ID NO: 714038 - DNA, 25 bp, Mus musculus
gggatgcagggaagcacccctctta

SEQ ID NO: 714039 - DNA, 25 bp, Mus musculus
gggatgcagggatgcacccctctta

SEQ ID NO: 714040 - DNA, 25 bp, Mus musculus
gggatgcagtacaccaactgccaca

SEQ ID NO: 714041 - DNA, 25 bp, Mus musculus
gggatgcagtactccaactgccaca

SEQ ID NO: 714042 - DNA, 25 bp, Mus musculus
gggatgcatgccacatccttggctc

SEQ ID NO: 714043 - DNA, 25 bp, Mus musculus
gggatgcatgcctcatccttggctc

SEQ ID NO: 714044 - DNA, 25 bp, Mus musculus
gggatgccaagcaacccctgcttat

SEQ ID NO: 714045 - DNA, 25 bp, Mus musculus
gggatgccaagctacccctgcttat

SEQ ID NO: 714046 - DNA, 25 bp, Mus musculus
gggatgccacatagaagaacccaat

SEQ ID NO: 714047 - DNA, 25 bp, Mus musculus
gggatgccacattgaagaacccaat

SEQ ID NO: 714048 - DNA, 25 bp, Mus musculus
gggatgcccacaacaagcaggccat

SEQ ID NO: 714049 - DNA, 25 bp, Mus musculus
gggatgcccacatcaagcaggccat

SEQ ID NO: 714050 - DNA, 25 bp, Mus musculus
gggatgcccgcacaaaacagctgag

SEQ ID NO: 714051 - DNA, 25 bp, Mus musculus
gggatgcccgcagaaaacagctgag

SEQ ID NO: 714052 - DNA, 25 bp, Mus musculus
gggatgccctttcagctttgcttcc

SEQ ID NO: 714053 - DNA, 25 bp, Mus musculus
gggatgccctttgagctttgcttcc

SEQ ID NO: 714054 - DNA, 25 bp, Mus musculus
gggatgcctccaaggagctgttcag

SEQ ID NO: 714055 - DNA, 25 bp, Mus musculus
gggatgcctccatggagctgttcag

SEQ ID NO: 714056 - DNA, 25 bp, Mus musculus
gggatgcctttcagcaaatcaaaga

SEQ ID NO: 714057 - DNA, 25 bp, Mus musculus
gggatgcctttctgcaaatcaaaga

SEQ ID NO: 714058 - DNA, 25 bp, Mus musculus
gggatgcgattccacggcaactttg

SEQ ID NO: 714059 - DNA, 25 bp, Mus musculus
gggatgcgattcgacggcaactttg

SEQ ID NO: 714060 - DNA, 25 bp, Mus musculus
gggatgctcatactaccccttctac

SEQ ID NO: 714061 - DNA, 25 bp, Mus musculus
gggatgctcatagtaccccttctac

SEQ ID NO: 714062 - DNA, 25 bp, Mus musculus
gggatgctcgcgatcgggagccagg

SEQ ID NO: 714063 - DNA, 25 bp, Mus musculus
gggatgctcgcgttcgggagccagg

SEQ ID NO: 714064 - DNA, 25 bp, Mus musculus
gggatgctgggcaccccttagctga

SEQ ID NO: 714065 - DNA, 25 bp, Mus musculus
gggatgctgggctccccttagctga

SEQ ID NO: 714066 - DNA, 25 bp, Mus musculus
gggatggacttcattttggagaagc

SEQ ID NO: 714067 - DNA, 25 bp, Mus musculus
gggatggacttctttttggagaagc

SEQ ID NO: 714068 - DNA, 25 bp, Mus musculus
gggatggcactacctcaaatgtcct

SEQ ID NO: 714069 - DNA, 25 bp, Mus musculus
gggatggcactagctcaaatgtcct

SEQ ID NO: 714070 - DNA, 25 bp, Mus musculus
gggatggcagctacggctcgggacg

SEQ ID NO: 714071 - DNA, 25 bp, Mus musculus
gggatggcagcttcggctcgggacg

SEQ ID NO: 714072 - DNA, 25 bp, Mus musculus
gggatgggaacaatatcttgcactc

SEQ ID NO: 714073 - DNA, 25 bp, Mus musculus
gggatgggaacattatcttgcactc

SEQ ID NO: 714074 - DNA, 25 bp, Mus musculus
gggatgggaagcacatttattgttc

SEQ ID NO: 714075 - DNA, 25 bp, Mus musculus
gggatgggaagctcatttattgttc

SEQ ID NO: 714076 - DNA, 25 bp, Mus musculus
gggatgggagccaactgcccagcac

SEQ ID NO: 714077 - DNA, 25 bp, Mus musculus
gggatgggagcctactgcccagcac

SEQ ID NO: 714078 - DNA, 25 bp, Mus musculus
gggatgggagctacactgcttcttt

SEQ ID NO: 714079 - DNA, 25 bp, Mus musculus
gggatgggagcttcactgcttcttt

SEQ ID NO: 714080 - DNA, 25 bp, Mus musculus
gggatggtcactatggcttctcaga

SEQ ID NO: 714081 - DNA, 25 bp, Mus musculus
gggatggtcactttggcttctcaga

SEQ ID NO: 714082 - DNA, 25 bp, Mus musculus
gggatggtggtcagtagcactcttc

SEQ ID NO: 714083 - DNA, 25 bp, Mus musculus
gggatggtggtctgtagcactcttc

SEQ ID NO: 714084 - DNA, 25 bp, Mus musculus
gggatgtaccttcgtcctttcacac

SEQ ID NO: 714085 - DNA, 25 bp, Mus musculus
gggatgtaccttggtcctttcacac

SEQ ID NO: 714086 - DNA, 25 bp, Mus musculus
gggatgtagccccaacctggaaaca

SEQ ID NO: 714087 - DNA, 25 bp, Mus musculus
gggatgtagcccgaacctggaaaca

SEQ ID NO: 714088 - DNA, 25 bp, Mus musculus
gggatgtatacaccttgcgagagac

SEQ ID NO: 714089 - DNA, 25 bp, Mus musculus
gggatgtatacagcttgcgagagac

SEQ ID NO: 714090 - DNA, 25 bp, Mus musculus
gggatgtatcggctcctttccacaa

SEQ ID NO: 714091 - DNA, 25 bp, Mus musculus
gggatgtatcgggtcctttccacaa

SEQ ID NO: 714092 - DNA, 25 bp, Mus musculus
gggatgtcactacccggtttgatga

SEQ ID NO: 714093 - DNA, 25 bp, Mus musculus
gggatgtcactagccggtttgatga

SEQ ID NO: 714094 - DNA, 25 bp, Mus musculus
gggatgtcccatatgttcaatagga

SEQ ID NO: 714095 - DNA, 25 bp, Mus musculus
gggatgtcccatttgttcaatagga

SEQ ID NO: 714096 - DNA, 25 bp, Mus musculus
gggatgtccgtcataagctcttctt

SEQ ID NO: 714097 - DNA, 25 bp, Mus musculus
gggatgtccgtcttaagctcttctt

SEQ ID NO: 714098 - DNA, 25 bp, Mus musculus
gggatgtccttgagatcttgaagca

SEQ ID NO: 714099 - DNA, 25 bp, Mus musculus
gggatgtccttgtgatcttgaagca

SEQ ID NO: 714100 - DNA, 25 bp, Mus musculus
gggatgtgattgaggttaccaagaa

SEQ ID NO: 714101 - DNA, 25 bp, Mus musculus
gggatgtgattgtggttaccaagaa

SEQ ID NO: 714102 - DNA, 25 bp, Mus musculus
gggatgtgcaatattccaaggtgga

SEQ ID NO: 714103 - DNA, 25 bp, Mus musculus
gggatgtgcaattttccaaggtgga

SEQ ID NO: 714104 - DNA, 25 bp, Mus musculus
gggatgtgctagacctcagggactt

SEQ ID NO: 714105 - DNA, 25 bp, Mus musculus
gggatgtgctagtcctcagggactt

SEQ ID NO: 714106 - DNA, 25 bp, Mus musculus
gggatgtggctaataaagtgattga

SEQ ID NO: 714107 - DNA, 25 bp, Mus musculus
gggatgtggctattaaagtgattga

SEQ ID NO: 714108 - DNA, 25 bp, Mus musculus
gggatgtgtctgctcagtcgcctcc

SEQ ID NO: 714109 - DNA, 25 bp, Mus musculus
gggatgtgtctggtcagtcgcctcc

SEQ ID NO: 714110 - DNA, 25 bp, Mus musculus
gggatgttacgccagccgtccatca

SEQ ID NO: 714111 - DNA, 25 bp, Mus musculus
gggatgttacgcgagccgtccatca

SEQ ID NO: 714112 - DNA, 25 bp, Mus musculus
gggatgttagctagcctatgcacgg

SEQ ID NO: 714113 - DNA, 25 bp, Mus musculus
gggatgttagcttgcctatgcacgg

SEQ ID NO: 714114 - DNA, 25 bp, Mus musculus
gggatgtttgatcaccccaccagaa

SEQ ID NO: 714115 - DNA, 25 bp, Mus musculus
gggatgtttgatgaccccaccagaa

SEQ ID NO: 714116 - DNA, 25 bp, Mus musculus
gggatgttttttcagtccataacca

SEQ ID NO: 714117 - DNA, 25 bp, Mus musculus
gggatgttttttgagtccataacca

SEQ ID NO: 714118 - DNA, 25 bp, Mus musculus
gggattaaacaaaacagaagactct

SEQ ID NO: 714119 - DNA, 25 bp, Mus musculus
gggattaaacaatacagaagactct

SEQ ID NO: 714120 - DNA, 25 bp, Mus musculus
gggattaaagaactggcacgtcgtt

SEQ ID NO: 714121 - DNA, 25 bp, Mus musculus
gggattaaagaagtggcacgtcgtt

SEQ ID NO: 714122 - DNA, 25 bp, Mus musculus
gggattacaactatcttctgcagag

SEQ ID NO: 714123 - DNA, 25 bp, Mus musculus
gggattacaactttcttctgcagag

SEQ ID NO: 714124 - DNA, 25 bp, Mus musculus
gggattactcaccaagcagggcctg

SEQ ID NO: 714125 - DNA, 25 bp, Mus musculus
gggattactcacgaagcagggcctg

SEQ ID NO: 714126 - DNA, 25 bp, Mus musculus
gggattactcgacgaccattcctgg

SEQ ID NO: 714127 - DNA, 25 bp, Mus musculus
gggattactcgaggaccattcctgg

SEQ ID NO: 714128 - DNA, 25 bp, Mus musculus
gggattagtacaatcacagatgaag

SEQ ID NO: 714129 - DNA, 25 bp, Mus musculus
gggattagtacattcacagatgaag

SEQ ID NO: 714130 - DNA, 25 bp, Mus musculus
gggattatacttcataactcgtctt

SEQ ID NO: 714131 - DNA, 25 bp, Mus musculus
gggattatacttgataactcgtctt

SEQ ID NO: 714132 - DNA, 25 bp, Mus musculus
gggattatggctcctccaaagcctg

SEQ ID NO: 714133 - DNA, 25 bp, Mus musculus
gggattatggctgctccaaagcctg

SEQ ID NO: 714134 - DNA, 25 bp, Mus musculus
gggattcaactcatagagcaggtgt

SEQ ID NO: 714135 - DNA, 25 bp, Mus musculus
gggattcaactcttagagcaggtgt

SEQ ID NO: 714136 - DNA, 25 bp, Mus musculus
gggattcaagggatacttcagttca

SEQ ID NO: 714137 - DNA, 25 bp, Mus musculus
gggattcaagggttacttcagttca

SEQ ID NO: 714138 - DNA, 25 bp, Mus musculus
gggattcacgcaccccgggctcgaa

SEQ ID NO: 714139 - DNA, 25 bp, Mus musculus
gggattcacgcagcccgggctcgaa

SEQ ID NO: 714140 - DNA, 25 bp, Mus musculus
gggattcagccaaccagactggttt

SEQ ID NO: 714141 - DNA, 25 bp, Mus musculus
gggattcagccatccagactggttt

SEQ ID NO: 714142 - DNA, 25 bp, Mus musculus
gggattccaggacgtcctgcacccg

SEQ ID NO: 714143 - DNA, 25 bp, Mus musculus
gggattccaggaggtcctgcacccg

SEQ ID NO: 714144 - DNA, 25 bp, Mus musculus
gggattcggcagaactgcagcccag

SEQ ID NO: 714145 - DNA, 25 bp, Mus musculus
gggattcggcagtactgcagcccag

SEQ ID NO: 714146 - DNA, 25 bp, Mus musculus
gggattctcatccacccaaggaaag

SEQ ID NO: 714147 - DNA, 25 bp, Mus musculus
gggattctcatcgacccaaggaaag

SEQ ID NO: 714148 - DNA, 25 bp, Mus musculus
gggattctggctatgctgatagtaa

SEQ ID NO: 714149 - DNA, 25 bp, Mus musculus
gggattctggctttgctgatagtaa

SEQ ID NO: 714150 - DNA, 25 bp, Mus musculus
gggattctggttccactcacgctta

SEQ ID NO: 714151 - DNA, 25 bp, Mus musculus
gggattctggttgcactcacgctta

SEQ ID NO: 714152 - DNA, 25 bp, Mus musculus
gggattcttccaaagaccttcaggg

SEQ ID NO: 714153 - DNA, 25 bp, Mus musculus
gggattcttccatagaccttcaggg

SEQ ID NO: 714154 - DNA, 25 bp, Mus musculus
gggattcttctcaggacgaggcaga

SEQ ID NO: 714155 - DNA, 25 bp, Mus musculus
gggattcttctctggacgaggcaga

SEQ ID NO: 714156 - DNA, 25 bp, Mus musculus
gggattcttctgcaactcgagtcag

SEQ ID NO: 714157 - DNA, 25 bp, Mus musculus
gggattcttctggaactcgagtcag

SEQ ID NO: 714158 - DNA, 25 bp, Mus musculus
gggattgaaaacacaccatatgttc

SEQ ID NO: 714159 - DNA, 25 bp, Mus musculus
gggattgaaaactcaccatatgttc

SEQ ID NO: 714160 - DNA, 25 bp, Mus musculus
gggattgaacaaagggccccagaca

SEQ ID NO: 714161 - DNA, 25 bp, Mus musculus
gggattgaacaatgggccccagaca

SEQ ID NO: 714162 - DNA, 25 bp, Mus musculus
gggattgcccggcatcagaccaagt

SEQ ID NO: 714163 - DNA, 25 bp, Mus musculus
gggattgcccgggatcagaccaagt

SEQ ID NO: 714164 - DNA, 25 bp, Mus musculus
gggattgcctacctctacaatgaag

SEQ ID NO: 714165 - DNA, 25 bp, Mus musculus
gggattgcctacgtctacaatgaag

SEQ ID NO: 714166 - DNA, 25 bp, Mus musculus
gggattgcctttccccacctttgcg

SEQ ID NO: 714167 - DNA, 25 bp, Mus musculus
gggattgcctttgcccacctttgcg

SEQ ID NO: 714168 - DNA, 25 bp, Mus musculus
gggattgctagcatgccaccactca

SEQ ID NO: 714169 - DNA, 25 bp, Mus musculus
gggattgctagcttgccaccactca

SEQ ID NO: 714170 - DNA, 25 bp, Mus musculus
gggattgtccctcctctggtccttg

SEQ ID NO: 714171 - DNA, 25 bp, Mus musculus
gggattgtccctgctctggtccttg

SEQ ID NO: 714172 - DNA, 25 bp, Mus musculus
gggatttacgtcctgtctctagaga

SEQ ID NO: 714173 - DNA, 25 bp, Mus musculus
gggatttacgtcgtgtctctagaga

SEQ ID NO: 714174 - DNA, 25 bp, Mus musculus
gggatttcaaatcctgtcatctctg

SEQ ID NO: 714175 - DNA, 25 bp, Mus musculus
gggatttcaaatgctgtcatctctg

SEQ ID NO: 714176 - DNA, 25 bp, Mus musculus
gggatttcccagagtcgccaggtcc

SEQ ID NO: 714177 - DNA, 25 bp, Mus musculus
gggatttcccagtgtcgccaggtcc

SEQ ID NO: 714178 - DNA, 25 bp, Mus musculus
gggatttccccaattcatgtcagta

SEQ ID NO: 714179 - DNA, 25 bp, Mus musculus
gggatttccccatttcatgtcagta

SEQ ID NO: 714180 - DNA, 25 bp, Mus musculus
gggatttccctccacgcctggagca

SEQ ID NO: 714181 - DNA, 25 bp, Mus musculus
gggatttccctcgacgcctggagca

SEQ ID NO: 714182 - DNA, 25 bp, Mus musculus
gggatttggatgatgcactacccca

SEQ ID NO: 714183 - DNA, 25 bp, Mus musculus
gggatttggatgttgcactacccca

SEQ ID NO: 714184 - DNA, 25 bp, Mus musculus
gggattttcgtcatggcttcaaatc

SEQ ID NO: 714185 - DNA, 25 bp, Mus musculus
gggattttcgtcttggcttcaaatc

SEQ ID NO: 714186 - DNA, 25 bp, Mus musculus
gggattttgcagagactcttgagct

SEQ ID NO: 714187 - DNA, 25 bp, Mus musculus
gggattttgcagtgactcttgagct

SEQ ID NO: 714188 - DNA, 25 bp, Mus musculus
gggcaaaaacatccttaggaatgct

SEQ ID NO: 714189 - DNA, 25 bp, Mus musculus
gggcaaaaacatgcttaggaatgct

SEQ ID NO: 714190 - DNA, 25 bp, Mus musculus
gggcaaaaagggaaagcctctatca

SEQ ID NO: 714191 - DNA, 25 bp, Mus musculus
gggcaaaaagggtaagcctctatca

SEQ ID NO: 714192 - DNA, 25 bp, Mus musculus
gggcaaaaccatagccaccaatcca

SEQ ID NO: 714193 - DNA, 25 bp, Mus musculus
gggcaaaaccattgccaccaatcca

SEQ ID NO: 714194 - DNA, 25 bp, Mus musculus
gggcaaaacttcatacctccaaaga

SEQ ID NO: 714195 - DNA, 25 bp, Mus musculus
gggcaaaacttcttacctccaaaga

SEQ ID NO: 714196 - DNA, 25 bp, Mus musculus
gggcaaacaccaaggacatcggacg

SEQ ID NO: 714197 - DNA, 25 bp, Mus musculus
gggcaaacaccatggacatcggacg

SEQ ID NO: 714198 - DNA, 25 bp, Mus musculus
gggcaaaccgttagaagtcttccag

SEQ ID NO: 714199 - DNA, 25 bp, Mus musculus
gggcaaaccgtttgaagtcttccag

SEQ ID NO: 714200 - DNA, 25 bp, Mus musculus
gggcaaagatctcgtccaggcgtct

SEQ ID NO: 714201 - DNA, 25 bp, Mus musculus
gggcaaagatctggtccaggcgtct

SEQ ID NO: 714202 - DNA, 25 bp, Mus musculus
gggcaaaggagtacaccaatgttta

SEQ ID NO: 714203 - DNA, 25 bp, Mus musculus
gggcaaaggagttcaccaatgttta

SEQ ID NO: 714204 - DNA, 25 bp, Mus musculus
gggcaaagtatcagaagggattgac

SEQ ID NO: 714205 - DNA, 25 bp, Mus musculus
gggcaaagtatctgaagggattgac

SEQ ID NO: 714206 - DNA, 25 bp, Mus musculus
gggcaaagtctgaaactgcagagct

SEQ ID NO: 714207 - DNA, 25 bp, Mus musculus
gggcaaagtctgtaactgcagagct

SEQ ID NO: 714208 - DNA, 25 bp, Mus musculus
gggcaaagtgctaacgcccacccag

SEQ ID NO: 714209 - DNA, 25 bp, Mus musculus
gggcaaagtgcttacgcccacccag

SEQ ID NO: 714210 - DNA, 25 bp, Mus musculus
gggcaaatagctctggtagagttcc

SEQ ID NO: 714211 - DNA, 25 bp, Mus musculus
gggcaaatagctgtggtagagttcc

SEQ ID NO: 714212 - DNA, 25 bp, Mus musculus
gggcaaatccacctttgtgaagtta

SEQ ID NO: 714213 - DNA, 25 bp, Mus musculus
gggcaaatccacgtttgtgaagtta

SEQ ID NO: 714214 - DNA, 25 bp, Mus musculus
gggcaacaacaccaagtagccagaa

SEQ ID NO: 714215 - DNA, 25 bp, Mus musculus
gggcaacaacacgaagtagccagaa

SEQ ID NO: 714216 - DNA, 25 bp, Mus musculus
gggcaacaacccagaagtccaggtt

SEQ ID NO: 714217 - DNA, 25 bp, Mus musculus
gggcaacaacccatagcagtcaaaa

SEQ ID NO: 714218 - DNA, 25 bp, Mus musculus
gggcaacaaccctgaagtccaggtt

SEQ ID NO: 714219 - DNA, 25 bp, Mus musculus
gggcaacaacccttagcagtcaaaa

SEQ ID NO: 714220 - DNA, 25 bp, Mus musculus
gggcaacaggagacactgcacgttc

SEQ ID NO: 714221 - DNA, 25 bp, Mus musculus
gggcaacaggagtcactgcacgttc

SEQ ID NO: 714222 - DNA, 25 bp, Mus musculus
gggcaaccacaaccaggaactgact

SEQ ID NO: 714223 - DNA, 25 bp, Mus musculus
gggcaaccacaagcaggaactgact

SEQ ID NO: 714224 - DNA, 25 bp, Mus musculus
gggcaaccggatcggcacctctcat

SEQ ID NO: 714225 - DNA, 25 bp, Mus musculus
gggcaaccggatgggcacctctcat

SEQ ID NO: 714226 - DNA, 25 bp, Mus musculus
gggcaacgagctatatgaagctgaa

SEQ ID NO: 714227 - DNA, 25 bp, Mus musculus
gggcaacgagctttatgaagctgaa

SEQ ID NO: 714228 - DNA, 25 bp, Mus musculus
gggcaacggagaattacaagcaccg

SEQ ID NO: 714229 - DNA, 25 bp, Mus musculus
gggcaacggagatttacaagcaccg

SEQ ID NO: 714230 - DNA, 25 bp, Mus musculus
gggcaacggcccagcggtccgtcat

SEQ ID NO: 714231 - DNA, 25 bp, Mus musculus
gggcaacggccctgcggtccgtcat

SEQ ID NO: 714232 - DNA, 25 bp, Mus musculus
gggcaactacacctgcatcgtggag

SEQ ID NO: 714233 - DNA, 25 bp, Mus musculus
gggcaactacacgtgcatcgtggag

SEQ ID NO: 714234 - DNA, 25 bp, Mus musculus
gggcaactacatacctcgattctgg

SEQ ID NO: 714235 - DNA, 25 bp, Mus musculus
gggcaactacattcctcgattctgg

SEQ ID NO: 714236 - DNA, 25 bp, Mus musculus
gggcaactagccaaatgtcaatttc

SEQ ID NO: 714237 - DNA, 25 bp, Mus musculus
gggcaactagcctaatgtcaatttc

SEQ ID NO: 714238 - DNA, 25 bp, Mus musculus
gggcaactcggcaggagagctgtgc

SEQ ID NO: 714239 - DNA, 25 bp, Mus musculus
gggcaactcggctggagagctgtgc

SEQ ID NO: 714240 - DNA, 25 bp, Mus musculus
gggcaactgcaaatggttctgtgag

SEQ ID NO: 714241 - DNA, 25 bp, Mus musculus
gggcaactgcaattggttctgtgag

SEQ ID NO: 714242 - DNA, 25 bp, Mus musculus
gggcaactgcctcatctatgatgct

SEQ ID NO: 714243 - DNA, 25 bp, Mus musculus
gggcaactgcctgatctatgatgct

SEQ ID NO: 714244 - DNA, 25 bp, Mus musculus
gggcaactgcgtcatggacatgtac

SEQ ID NO: 714245 - DNA, 25 bp, Mus musculus
gggcaactgcgtgatggacatgtac

SEQ ID NO: 714246 - DNA, 25 bp, Mus musculus
gggcaactgctgcatccagctccag

SEQ ID NO: 714247 - DNA, 25 bp, Mus musculus
gggcaactgctggatccagctccag

SEQ ID NO: 714248 - DNA, 25 bp, Mus musculus
gggcaactgtgaagtggatgtatcc

SEQ ID NO: 714249 - DNA, 25 bp, Mus musculus
gggcaactgtgatgtggatgtatcc

SEQ ID NO: 714250 - DNA, 25 bp, Mus musculus
gggcaagaaacaccatcgcaagcgt

SEQ ID NO: 714251 - DNA, 25 bp, Mus musculus
gggcaagaaacagcatcgcaagcgt

SEQ ID NO: 714252 - DNA, 25 bp, Mus musculus
gggcaagaagcgctttgaagttaaa

SEQ ID NO: 714253 - DNA, 25 bp, Mus musculus
gggcaagaagcggtttgaagttaaa

SEQ ID NO: 714254 - DNA, 25 bp, Mus musculus
gggcaagaatttccgtccgccttct

SEQ ID NO: 714255 - DNA, 25 bp, Mus musculus
gggcaagaatttgcgtccgccttct

SEQ ID NO: 714256 - DNA, 25 bp, Mus musculus
gggcaagacatccttcctgttccgc

SEQ ID NO: 714257 - DNA, 25 bp, Mus musculus
gggcaagacatcgttcctgttccgc

SEQ ID NO: 714258 - DNA, 25 bp, Mus musculus
gggcaagaccagcttctacatgggc

SEQ ID NO: 714259 - DNA, 25 bp, Mus musculus
gggcaagaccaggttctacatgggc

SEQ ID NO: 714260 - DNA, 25 bp, Mus musculus
gggcaagactcgcagcatcagcctc

SEQ ID NO: 714261 - DNA, 25 bp, Mus musculus
gggcaagactcggagcatcagcctc

SEQ ID NO: 714262 - DNA, 25 bp, Mus musculus
gggcaagactctaacgacccatgct

SEQ ID NO: 714263 - DNA, 25 bp, Mus musculus
gggcaagactcttacgacccatgct

SEQ ID NO: 714264 - DNA, 25 bp, Mus musculus
gggcaagactgtctcttaacaatgt

SEQ ID NO: 714265 - DNA, 25 bp, Mus musculus
gggcaagactgtgtcttaacaatgt

SEQ ID NO: 714266 - DNA, 25 bp, Mus musculus
gggcaagattgtctgcctgtgcacc

SEQ ID NO: 714267 - DNA, 25 bp, Mus musculus
gggcaagattgtgtgcctgtgcacc

SEQ ID NO: 714268 - DNA, 25 bp, Mus musculus
gggcaagccccaccgtctgtattag

SEQ ID NO: 714269 - DNA, 25 bp, Mus musculus
gggcaagccccagcgtctgtattag

SEQ ID NO: 714270 - DNA, 25 bp, Mus musculus
gggcaagcttccattatcacctaaa

SEQ ID NO: 714271 - DNA, 25 bp, Mus musculus
gggcaagcttcctttatcacctaaa

SEQ ID NO: 714272 - DNA, 25 bp, Mus musculus
gggcaaggacctcttccacagagcc

SEQ ID NO: 714273 - DNA, 25 bp, Mus musculus
gggcaaggacctgttccacagagcc

SEQ ID NO: 714274 - DNA, 25 bp, Mus musculus
gggcaaggagaacgccgaatacttc

SEQ ID NO: 714275 - DNA, 25 bp, Mus musculus
gggcaaggagaaggccgaatacttc

SEQ ID NO: 714276 - DNA, 25 bp, Mus musculus
gggcaagggacgatacaagataaag

SEQ ID NO: 714277 - DNA, 25 bp, Mus musculus
gggcaagggacgttacaagataaag

SEQ ID NO: 714278 - DNA, 25 bp, Mus musculus
gggcaaggtcttcccgctttactag

SEQ ID NO: 714279 - DNA, 25 bp, Mus musculus
gggcaaggtcttgccgctttactag

SEQ ID NO: 714280 - DNA, 25 bp, Mus musculus
gggcaagtacctcatcctcaaggac

SEQ ID NO: 714281 - DNA, 25 bp, Mus musculus
gggcaagtacctgatcctcaaggac

SEQ ID NO: 714282 - DNA, 25 bp, Mus musculus
gggcaagtccttagagatccagaaa

SEQ ID NO: 714283 - DNA, 25 bp, Mus musculus
gggcaagtcctttgagatccagaaa

SEQ ID NO: 714284 - DNA, 25 bp, Mus musculus
gggcaagtgaccatcctccatgtct

SEQ ID NO: 714285 - DNA, 25 bp, Mus musculus
gggcaagtgaccttcctccatgtct

SEQ ID NO: 714286 - DNA, 25 bp, Mus musculus
gggcaataagctccggtctgtccct

SEQ ID NO: 714287 - DNA, 25 bp, Mus musculus
gggcaataagctgcggtctgtccct

SEQ ID NO: 714288 - DNA, 25 bp, Mus musculus
gggcaatacataccttgcattgcac

SEQ ID NO: 714289 - DNA, 25 bp, Mus musculus
gggcaatacatagcttgcattgcac

SEQ ID NO: 714290 - DNA, 25 bp, Mus musculus
gggcaatatcgcagttattgttaca

SEQ ID NO: 714291 - DNA, 25 bp, Mus musculus
gggcaatatcgctgttattgttaca

SEQ ID NO: 714292 - DNA, 25 bp, Mus musculus
gggcaatatctgctctacactaggg

SEQ ID NO: 714293 - DNA, 25 bp, Mus musculus
gggcaatatctggtctacactaggg

SEQ ID NO: 714294 - DNA, 25 bp, Mus musculus
gggcaatcaagaatggctagtttgg

SEQ ID NO: 714295 - DNA, 25 bp, Mus musculus
gggcaatcaagattggctagtttgg

SEQ ID NO: 714296 - DNA, 25 bp, Mus musculus
gggcaatcatgactactggccacag

SEQ ID NO: 714297 - DNA, 25 bp, Mus musculus
gggcaatcatgagtactggccacag

SEQ ID NO: 714298 - DNA, 25 bp, Mus musculus
gggcaatcggaaaaccattttggag

SEQ ID NO: 714299 - DNA, 25 bp, Mus musculus
gggcaatcggaataccattttggag

SEQ ID NO: 714300 - DNA, 25 bp, Mus musculus
gggcaatgaaatagacctgcacact

SEQ ID NO: 714301 - DNA, 25 bp, Mus musculus
gggcaatgaaattgacctgcacact

SEQ ID NO: 714302 - DNA, 25 bp, Mus musculus
gggcaatgaagaaaccccatatgag

SEQ ID NO: 714303 - DNA, 25 bp, Mus musculus
gggcaatgaagataccccatatgag

SEQ ID NO: 714304 - DNA, 25 bp, Mus musculus
gggcaatgccatattaaacactatg

SEQ ID NO: 714305 - DNA, 25 bp, Mus musculus
gggcaatgccattttaaacactatg

SEQ ID NO: 714306 - DNA, 25 bp, Mus musculus
gggcaatggcccagttacccagtgg

SEQ ID NO: 714307 - DNA, 25 bp, Mus musculus
gggcaatggccctgttacccagtgg

SEQ ID NO: 714308 - DNA, 25 bp, Mus musculus
gggcaatggtggcaagcttatcttc

SEQ ID NO: 714309 - DNA, 25 bp, Mus musculus
gggcaatggtgggaagcttatcttc

SEQ ID NO: 714310 - DNA, 25 bp, Mus musculus
gggcaatgtcaaaaccctaaacctg

SEQ ID NO: 714311 - DNA, 25 bp, Mus musculus
gggcaatgtcaataccctaaacctg

SEQ ID NO: 714312 - DNA, 25 bp, Mus musculus
gggcaatgtgacacgctggtttaac

SEQ ID NO: 714313 - DNA, 25 bp, Mus musculus
gggcaatgtgactcgctggtttaac

SEQ ID NO: 714314 - DNA, 25 bp, Mus musculus
gggcaattaacacctggcatcaggg

SEQ ID NO: 714315 - DNA, 25 bp, Mus musculus
gggcaattaacagctggcatcaggg

SEQ ID NO: 714316 - DNA, 25 bp, Mus musculus
gggcaattatctcgtggcttctgaa

SEQ ID NO: 714317 - DNA, 25 bp, Mus musculus
gggcaattatctggtggcttctgaa

SEQ ID NO: 714318 - DNA, 25 bp, Mus musculus
gggcaattctatagggttttcccat

SEQ ID NO: 714319 - DNA, 25 bp, Mus musculus
gggcaattctattgggttttcccat

SEQ ID NO: 714320 - DNA, 25 bp, Mus musculus
gggcacaaacacactggtggagaat

SEQ ID NO: 714321 - DNA, 25 bp, Mus musculus
gggcacaaacactctggtggagaat

SEQ ID NO: 714322 - DNA, 25 bp, Mus musculus
gggcacaacggactcccaccttggg

SEQ ID NO: 714323 - DNA, 25 bp, Mus musculus
gggcacaacggagtcccaccttggg

SEQ ID NO: 714324 - DNA, 25 bp, Mus musculus
gggcacaatttcataacattctaat

SEQ ID NO: 714325 - DNA, 25 bp, Mus musculus
gggcacaatttcttaacattctaat

SEQ ID NO: 714326 - DNA, 25 bp, Mus musculus
gggcacacagctcatgcatgagaat

SEQ ID NO: 714327 - DNA, 25 bp, Mus musculus
gggcacacagctgatgcatgagaat

SEQ ID NO: 714328 - DNA, 25 bp, Mus musculus
gggcacacatagaggcctctaccac

SEQ ID NO: 714329 - DNA, 25 bp, Mus musculus
gggcacacatagtggcctctaccac

SEQ ID NO: 714330 - DNA, 25 bp, Mus musculus
gggcacacgcccaggttggtatccc

SEQ ID NO: 714331 - DNA, 25 bp, Mus musculus
gggcacacgccctggttggtatccc

SEQ ID NO: 714332 - DNA, 25 bp, Mus musculus
gggcacagaaacacgagtaaatgct

SEQ ID NO: 714333 - DNA, 25 bp, Mus musculus
gggcacagaaactcgagtaaatgct

SEQ ID NO: 714334 - DNA, 25 bp, Mus musculus
gggcacagagttaaggaacctgtta

SEQ ID NO: 714335 - DNA, 25 bp, Mus musculus
gggcacagagtttaggaacctgtta

SEQ ID NO: 714336 - DNA, 25 bp, Mus musculus
gggcacagcaaccacagcatgggca

SEQ ID NO: 714337 - DNA, 25 bp, Mus musculus
gggcacagcaacgacagcatgggca

SEQ ID NO: 714338 - DNA, 25 bp, Mus musculus
gggcacagccagcttccttcaagaa

SEQ ID NO: 714339 - DNA, 25 bp, Mus musculus
gggcacagccaggttccttcaagaa

SEQ ID NO: 714340 - DNA, 25 bp, Mus musculus
gggcacagccttcgagaaatacgcc

SEQ ID NO: 714341 - DNA, 25 bp, Mus musculus
gggcacagccttggagaaatacgcc

SEQ ID NO: 714342 - DNA, 25 bp, Mus musculus
gggcacaggaccctgttctagagtc

SEQ ID NO: 714343 - DNA, 25 bp, Mus musculus
gggcacaggaccgtgttctagagtc

SEQ ID NO: 714344 - DNA, 25 bp, Mus musculus
gggcacaggcaactcctattctagc

SEQ ID NO: 714345 - DNA, 25 bp, Mus musculus
gggcacaggcaagtcctattctagc

SEQ ID NO: 714346 - DNA, 25 bp, Mus musculus
gggcacaggcttacaacaacgccat

SEQ ID NO: 714347 - DNA, 25 bp, Mus musculus
gggcacaggctttcaacaacgccat

SEQ ID NO: 714348 - DNA, 25 bp, Mus musculus
gggcacaggttccaggactctcaga

SEQ ID NO: 714349 - DNA, 25 bp, Mus musculus
gggcacaggttcgaggactctcaga

SEQ ID NO: 714350 - DNA, 25 bp, Mus musculus
gggcacatattaagatcgggaacca

SEQ ID NO: 714351 - DNA, 25 bp, Mus musculus
gggcacatattatgatcgggaacca

SEQ ID NO: 714352 - DNA, 25 bp, Mus musculus
gggcacatcaagataacggacttcg

SEQ ID NO: 714353 - DNA, 25 bp, Mus musculus
gggcacatcaagttaacggacttcg

SEQ ID NO: 714354 - DNA, 25 bp, Mus musculus
gggcacatcacgctggagctccatg

SEQ ID NO: 714355 - DNA, 25 bp, Mus musculus
gggcacatcacggtggagctccatg

SEQ ID NO: 714356 - DNA, 25 bp, Mus musculus
gggcacatgcctaccggaacgaacc

SEQ ID NO: 714357 - DNA, 25 bp, Mus musculus
gggcacatgccttccggaacgaacc

SEQ ID NO: 714358 - DNA, 25 bp, Mus musculus
gggcacatggtcaacaggactcccc

SEQ ID NO: 714359 - DNA, 25 bp, Mus musculus
gggcacatggtctacaggactcccc

SEQ ID NO: 714360 - DNA, 25 bp, Mus musculus
gggcacattcacaattagcactacc

SEQ ID NO: 714361 - DNA, 25 bp, Mus musculus
gggcacattcactattagcactacc

SEQ ID NO: 714362 - DNA, 25 bp, Mus musculus
gggcaccaccacaaggcgatttgtc

SEQ ID NO: 714363 - DNA, 25 bp, Mus musculus
gggcaccaccactaggcgatttgtc

SEQ ID NO: 714364 - DNA, 25 bp, Mus musculus
gggcaccactgcactaaatgatgaa

SEQ ID NO: 714365 - DNA, 25 bp, Mus musculus
gggcaccactgctctaaatgatgaa

SEQ ID NO: 714366 - DNA, 25 bp, Mus musculus
gggcaccagcaaaatagatcagtat

SEQ ID NO: 714367 - DNA, 25 bp, Mus musculus
gggcaccagcaatatagatcagtat

SEQ ID NO: 714368 - DNA, 25 bp, Mus musculus
gggcaccagttgagacatctctctc

SEQ ID NO: 714369 - DNA, 25 bp, Mus musculus
gggcaccagttgtgacatctctctc

SEQ ID NO: 714370 - DNA, 25 bp, Mus musculus
gggcaccataccacctatacagaat

SEQ ID NO: 714371 - DNA, 25 bp, Mus musculus
gggcaccatacctcctatacagaat

SEQ ID NO: 714372 - DNA, 25 bp, Mus musculus
gggcaccatactccgtgacagcgga

SEQ ID NO: 714373 - DNA, 25 bp, Mus musculus
gggcaccatactgcgtgacagcgga

SEQ ID NO: 714374 - DNA, 25 bp, Mus musculus
gggcacccacaaatgagcacataca

SEQ ID NO: 714375 - DNA, 25 bp, Mus musculus
gggcacccacaattgagcacataca

SEQ ID NO: 714376 - DNA, 25 bp, Mus musculus
gggcacccctacaaagggatgatcc

SEQ ID NO: 714377 - DNA, 25 bp, Mus musculus
gggcacccctactaagggatgatcc

SEQ ID NO: 714378 - DNA, 25 bp, Mus musculus
gggcacctacagacaacttccaaca

SEQ ID NO: 714379 - DNA, 25 bp, Mus musculus
gggcacctacagtcaacttccaaca

SEQ ID NO: 714380 - DNA, 25 bp, Mus musculus
gggcacctccccaggcagcgaattg

SEQ ID NO: 714381 - DNA, 25 bp, Mus musculus
gggcacctcccctggcagcgaattg

SEQ ID NO: 714382 - DNA, 25 bp, Mus musculus
gggcacctgatgagtacattgagaa

SEQ ID NO: 714383 - DNA, 25 bp, Mus musculus
gggcacctgatgtgtacattgagaa

SEQ ID NO: 714384 - DNA, 25 bp, Mus musculus
gggcacctttctaatccgcgacagc

SEQ ID NO: 714385 - DNA, 25 bp, Mus musculus
gggcacctttcttatccgcgacagc

SEQ ID NO: 714386 - DNA, 25 bp, Mus musculus
gggcacgattcgctcctccattttt

SEQ ID NO: 714387 - DNA, 25 bp, Mus musculus
gggcacgattcggtcctccattttt

SEQ ID NO: 714388 - DNA, 25 bp, Mus musculus
gggcacgcctgtcaacaagctgcta

SEQ ID NO: 714389 - DNA, 25 bp, Mus musculus
gggcacgcctgtgaacaagctgcta

SEQ ID NO: 714390 - DNA, 25 bp, Mus musculus
gggcacgctggcatacctctacgat

SEQ ID NO: 714391 - DNA, 25 bp, Mus musculus
gggcacgctggcttacctctacgat

SEQ ID NO: 714392 - DNA, 25 bp, Mus musculus
gggcacggacacagactcttcaggg

SEQ ID NO: 714393 - DNA, 25 bp, Mus musculus
gggcacggacactgactcttcaggg

SEQ ID NO: 714394 - DNA, 25 bp, Mus musculus
gggcacggcattatgatgacgctgt

SEQ ID NO: 714395 - DNA, 25 bp, Mus musculus
gggcacggcattttgatgacgctgt

SEQ ID NO: 714396 - DNA, 25 bp, Mus musculus
gggcacgttcgtaatcgtattcctt

SEQ ID NO: 714397 - DNA, 25 bp, Mus musculus
gggcacgttcgttatcgtattcctt

SEQ ID NO: 714398 - DNA, 25 bp, Mus musculus
gggcactacgcaagctacaccatat

SEQ ID NO: 714399 - DNA, 25 bp, Mus musculus
gggcactacgcatgctacaccatat

SEQ ID NO: 714400 - DNA, 25 bp, Mus musculus
gggcactagctgcattgatagacat

SEQ ID NO: 714401 - DNA, 25 bp, Mus musculus
gggcactagctggattgatagacat

SEQ ID NO: 714402 - DNA, 25 bp, Mus musculus
gggcactcaaacagcttccctgcag

SEQ ID NO: 714403 - DNA, 25 bp, Mus musculus
gggcactcaaactgcttccctgcag

SEQ ID NO: 714404 - DNA, 25 bp, Mus musculus
gggcactcagaacgagactatcccc

SEQ ID NO: 714405 - DNA, 25 bp, Mus musculus
gggcactcagaaggagactatcccc

SEQ ID NO: 714406 - DNA, 25 bp, Mus musculus
gggcactcctggaatttgacctgac

SEQ ID NO: 714407 - DNA, 25 bp, Mus musculus
gggcactcctggtatttgacctgac

SEQ ID NO: 714408 - DNA, 25 bp, Mus musculus
gggcactccttgactatgacatcac

SEQ ID NO: 714409 - DNA, 25 bp, Mus musculus
gggcactccttgtctatgacatcac

SEQ ID NO: 714410 - DNA, 25 bp, Mus musculus
gggcactgaacaagaaggaactgaa

SEQ ID NO: 714411 - DNA, 25 bp, Mus musculus
gggcactgaacatgaaggaactgaa

SEQ ID NO: 714412 - DNA, 25 bp, Mus musculus
gggcactgatggctcacactactgg

SEQ ID NO: 714413 - DNA, 25 bp, Mus musculus
gggcactgatgggtcacactactgg

SEQ ID NO: 714414 - DNA, 25 bp, Mus musculus
gggcactgcacgaggcagaattcca

SEQ ID NO: 714415 - DNA, 25 bp, Mus musculus
gggcactgcacgtggcagaattcca

SEQ ID NO: 714416 - DNA, 25 bp, Mus musculus
gggcactgcagcatgccactcttta

SEQ ID NO: 714417 - DNA, 25 bp, Mus musculus
gggcactgcagcttgccactcttta

SEQ ID NO: 714418 - DNA, 25 bp, Mus musculus
gggcactggactctccagacacgga

SEQ ID NO: 714419 - DNA, 25 bp, Mus musculus
gggcactggactgtccagacacgga

SEQ ID NO: 714420 - DNA, 25 bp, Mus musculus
gggcactgtagacaacaacattcgc

SEQ ID NO: 714421 - DNA, 25 bp, Mus musculus
gggcactgtagagaacaacattcgc

SEQ ID NO: 714422 - DNA, 25 bp, Mus musculus
gggcactgtctaatcactaataaag

SEQ ID NO: 714423 - DNA, 25 bp, Mus musculus
gggcactgtctattcactaataaag

SEQ ID NO: 714424 - DNA, 25 bp, Mus musculus
gggcacttcattaagccagacaagc

SEQ ID NO: 714425 - DNA, 25 bp, Mus musculus
gggcacttcatttagccagacaagc

SEQ ID NO: 714426 - DNA, 25 bp, Mus musculus
gggcacttctcacctctgagaatct

SEQ ID NO: 714427 - DNA, 25 bp, Mus musculus
gggcacttctcagctctgagaatct

SEQ ID NO: 714428 - DNA, 25 bp, Mus musculus
gggcagaaaggcaatgcactactca

SEQ ID NO: 714429 - DNA, 25 bp, Mus musculus
gggcagaaaggctatgcactactca

SEQ ID NO: 714430 - DNA, 25 bp, Mus musculus
gggcagaagtggacaccccaaacga

SEQ ID NO: 714431 - DNA, 25 bp, Mus musculus
gggcagaagtggtcaccccaaacga

SEQ ID NO: 714432 - DNA, 25 bp, Mus musculus
gggcagaatcccatctgctgtaggc

SEQ ID NO: 714433 - DNA, 25 bp, Mus musculus
gggcagaatcccttctgctgtaggc

SEQ ID NO: 714434 - DNA, 25 bp, Mus musculus
gggcagaatcctatcgagttggcct

SEQ ID NO: 714435 - DNA, 25 bp, Mus musculus
gggcagaatcctttcgagttggcct

SEQ ID NO: 714436 - DNA, 25 bp, Mus musculus
gggcagacacagctctgaacactat

SEQ ID NO: 714437 - DNA, 25 bp, Mus musculus
gggcagacacaggtctgaacactat

SEQ ID NO: 714438 - DNA, 25 bp, Mus musculus
gggcagacagcaagagcgtaaccac

SEQ ID NO: 714439 - DNA, 25 bp, Mus musculus
gggcagacagcatgagcgtaaccac

SEQ ID NO: 714440 - DNA, 25 bp, Mus musculus
gggcagaccaagaaattggctctgc

SEQ ID NO: 714441 - DNA, 25 bp, Mus musculus
gggcagaccaagtaattggctctgc

SEQ ID NO: 714442 - DNA, 25 bp, Mus musculus
gggcagagacagaggtctcacttga

SEQ ID NO: 714443 - DNA, 25 bp, Mus musculus
gggcagagacagtggtctcacttga

SEQ ID NO: 714444 - DNA, 25 bp, Mus musculus
gggcagagacatcgccaacatcgcg

SEQ ID NO: 714445 - DNA, 25 bp, Mus musculus
gggcagagacatggccaacatcgcg

SEQ ID NO: 714446 - DNA, 25 bp, Mus musculus
gggcagagagaaagccccttgtccc

SEQ ID NO: 714447 - DNA, 25 bp, Mus musculus
gggcagagagaatgccccttgtccc

SEQ ID NO: 714448 - DNA, 25 bp, Mus musculus
gggcagagctcacttgcttagcatg

SEQ ID NO: 714449 - DNA, 25 bp, Mus musculus
gggcagagctcagttgcttagcatg

SEQ ID NO: 714450 - DNA, 25 bp, Mus musculus
gggcagaggtctccaatactacatt

SEQ ID NO: 714451 - DNA, 25 bp, Mus musculus
gggcagaggtctccattcctcaagg

SEQ ID NO: 714452 - DNA, 25 bp, Mus musculus
gggcagaggtctgcaatactacatt

SEQ ID NO: 714453 - DNA, 25 bp, Mus musculus
gggcagaggtctgcattcctcaagg

SEQ ID NO: 714454 - DNA, 25 bp, Mus musculus
gggcagagtctgatttctatacaga

SEQ ID NO: 714455 - DNA, 25 bp, Mus musculus
gggcagagtctgttttctatacaga

SEQ ID NO: 714456 - DNA, 25 bp, Mus musculus
gggcagatacgtcactgttctcctg

SEQ ID NO: 714457 - DNA, 25 bp, Mus musculus
gggcagatacgtgactgttctcctg

SEQ ID NO: 714458 - DNA, 25 bp, Mus musculus
gggcagatgccacctaaaacttcct

SEQ ID NO: 714459 - DNA, 25 bp, Mus musculus
gggcagatgccagctaaaacttcct

SEQ ID NO: 714460 - DNA, 25 bp, Mus musculus
gggcagcaacctaacgtcttcaacc

SEQ ID NO: 714461 - DNA, 25 bp, Mus musculus
gggcagcaaccttacgtcttcaacc

SEQ ID NO: 714462 - DNA, 25 bp, Mus musculus
gggcagcaagatcccttttggtcag

SEQ ID NO: 714463 - DNA, 25 bp, Mus musculus
gggcagcaagatgccttttggtcag

SEQ ID NO: 714464 - DNA, 25 bp, Mus musculus
gggcagcacaatagcgttcccaact

SEQ ID NO: 714465 - DNA, 25 bp, Mus musculus
gggcagcacaattgcgttcccaact

SEQ ID NO: 714466 - DNA, 25 bp, Mus musculus
gggcagcacaggaattgtgaatgct

SEQ ID NO: 714467 - DNA, 25 bp, Mus musculus
gggcagcacaggtattgtgaatgct

SEQ ID NO: 714468 - DNA, 25 bp, Mus musculus
gggcagcacggcatttccatggaga

SEQ ID NO: 714469 - DNA, 25 bp, Mus musculus
gggcagcacggcttttccatggaga

SEQ ID NO: 714470 - DNA, 25 bp, Mus musculus
gggcagcactacattgaccggttct

SEQ ID NO: 714471 - DNA, 25 bp, Mus musculus
gggcagcactactttgaccggttct

SEQ ID NO: 714472 - DNA, 25 bp, Mus musculus
gggcagcacttcagccccgatgggt

SEQ ID NO: 714473 - DNA, 25 bp, Mus musculus
gggcagcacttctgccccgatgggt

SEQ ID NO: 714474 - DNA, 25 bp, Mus musculus
gggcagcatcacacaccagatcttg

SEQ ID NO: 714475 - DNA, 25 bp, Mus musculus
gggcagcatcactcaccagatcttg

SEQ ID NO: 714476 - DNA, 25 bp, Mus musculus
gggcagcatcatcaagagcctgagg

SEQ ID NO: 714477 - DNA, 25 bp, Mus musculus
gggcagcatcatgaagagcctgagg

SEQ ID NO: 714478 - DNA, 25 bp, Mus musculus
gggcagcatgacacaattgtaccag

SEQ ID NO: 714479 - DNA, 25 bp, Mus musculus
gggcagcatgactcaattgtaccag

SEQ ID NO: 714480 - DNA, 25 bp, Mus musculus
gggcagcatggcaaaggtgtattaa

SEQ ID NO: 714481 - DNA, 25 bp, Mus musculus
gggcagcatggctaaggtgtattaa

SEQ ID NO: 714482 - DNA, 25 bp, Mus musculus
gggcagccagttctagcacagctca

SEQ ID NO: 714483 - DNA, 25 bp, Mus musculus
gggcagccagttgtagcacagctca

SEQ ID NO: 714484 - DNA, 25 bp, Mus musculus
gggcagccccttcgtgagcaacttt

SEQ ID NO: 714485 - DNA, 25 bp, Mus musculus
gggcagccccttggtgagcaacttt

SEQ ID NO: 714486 - DNA, 25 bp, Mus musculus
gggcagccctgcaaatgtcacggag

SEQ ID NO: 714487 - DNA, 25 bp, Mus musculus
gggcagccctgctaatgtcacggag

SEQ ID NO: 714488 - DNA, 25 bp, Mus musculus
gggcagccctgtctcttcatcaaaa

SEQ ID NO: 714489 - DNA, 25 bp, Mus musculus
gggcagccctgtgtcttcatcaaaa

SEQ ID NO: 714490 - DNA, 25 bp, Mus musculus
gggcagcccttccacatgatccttt

SEQ ID NO: 714491 - DNA, 25 bp, Mus musculus
gggcagcccttcgacatgatccttt

SEQ ID NO: 714492 - DNA, 25 bp, Mus musculus
gggcagccgaccagacagccttgag

SEQ ID NO: 714493 - DNA, 25 bp, Mus musculus
gggcagccgacctgacagccttgag

SEQ ID NO: 714494 - DNA, 25 bp, Mus musculus
gggcagccgagtaagtcccaagtcg

SEQ ID NO: 714495 - DNA, 25 bp, Mus musculus
gggcagccgagttagtcccaagtcg

SEQ ID NO: 714496 - DNA, 25 bp, Mus musculus
gggcagcctctgcatacctttagaa

SEQ ID NO: 714497 - DNA, 25 bp, Mus musculus
gggcagcctctggatacctttagaa

SEQ ID NO: 714498 - DNA, 25 bp, Mus musculus
gggcagcctggccactttgaatact

SEQ ID NO: 714499 - DNA, 25 bp, Mus musculus
gggcagcctggcgactttgaatact

SEQ ID NO: 714500 - DNA, 25 bp, Mus musculus
gggcagccttctaagcaagccagtg

SEQ ID NO: 714501 - DNA, 25 bp, Mus musculus
gggcagccttcttagcaagccagtg

SEQ ID NO: 714502 - DNA, 25 bp, Mus musculus
gggcagcgacctccttttatgcctt

SEQ ID NO: 714503 - DNA, 25 bp, Mus musculus
gggcagcgacctgcttttatgcctt

SEQ ID NO: 714504 - DNA, 25 bp, Mus musculus
gggcagcgctgtctgaacagcacca

SEQ ID NO: 714505 - DNA, 25 bp, Mus musculus
gggcagcgctgtgtgaacagcacca

SEQ ID NO: 714506 - DNA, 25 bp, Mus musculus
gggcagcggcctacataccatgggt

SEQ ID NO: 714507 - DNA, 25 bp, Mus musculus
gggcagcggccttcataccatgggt

SEQ ID NO: 714508 - DNA, 25 bp, Mus musculus
gggcagcgttcccagcgcaaaaagt

SEQ ID NO: 714509 - DNA, 25 bp, Mus musculus
gggcagcgttccgagcgcaaaaagt

SEQ ID NO: 714510 - DNA, 25 bp, Mus musculus
gggcagctacctctgcacctgcagg

SEQ ID NO: 714511 - DNA, 25 bp, Mus musculus
gggcagctacctgtgcacctgcagg

SEQ ID NO: 714512 - DNA, 25 bp, Mus musculus
gggcagctctgactactgccgttcc

SEQ ID NO: 714513 - DNA, 25 bp, Mus musculus
gggcagctctgacttgggccccact

SEQ ID NO: 714514 - DNA, 25 bp, Mus musculus
gggcagctctgagtactgccgttcc

SEQ ID NO: 714515 - DNA, 25 bp, Mus musculus
gggcagctctgagttgggccccact

SEQ ID NO: 714516 - DNA, 25 bp, Mus musculus
gggcagctgatcctgttacagaatg

SEQ ID NO: 714517 - DNA, 25 bp, Mus musculus
gggcagctgatcgtgttacagaatg

SEQ ID NO: 714518 - DNA, 25 bp, Mus musculus
gggcagctgcctcttcgaacggcaa

SEQ ID NO: 714519 - DNA, 25 bp, Mus musculus
gggcagctgcctgttcgaacggcaa

SEQ ID NO: 714520 - DNA, 25 bp, Mus musculus
gggcagctgcttctcttaaaaaatg

SEQ ID NO: 714521 - DNA, 25 bp, Mus musculus
gggcagctgcttgtcttaaaaaatg

SEQ ID NO: 714522 - DNA, 25 bp, Mus musculus
gggcagcttagaagcgccacggctt

SEQ ID NO: 714523 - DNA, 25 bp, Mus musculus
gggcagcttagatgcgccacggctt

SEQ ID NO: 714524 - DNA, 25 bp, Mus musculus
gggcagcttcgactctgtcaacagc

SEQ ID NO: 714525 - DNA, 25 bp, Mus musculus
gggcagcttcgagtctgtcaacagc

SEQ ID NO: 714526 - DNA, 25 bp, Mus musculus
gggcagctttgacagcagaattgct

SEQ ID NO: 714527 - DNA, 25 bp, Mus musculus
gggcagctttgagagcagaattgct

SEQ ID NO: 714528 - DNA, 25 bp, Mus musculus
gggcaggaccagacctccttctgga

SEQ ID NO: 714529 - DNA, 25 bp, Mus musculus
gggcaggaccagtcctccttctgga

SEQ ID NO: 714530 - DNA, 25 bp, Mus musculus
gggcaggagacccagaatctcacgt

SEQ ID NO: 714531 - DNA, 25 bp, Mus musculus
gggcaggagaccgagaatctcacgt

SEQ ID NO: 714532 - DNA, 25 bp, Mus musculus
gggcaggagactaactgctgtttct

SEQ ID NO: 714533 - DNA, 25 bp, Mus musculus
gggcaggagacttactgctgtttct

SEQ ID NO: 714534 - DNA, 25 bp, Mus musculus
gggcaggaggaaaagcagatttgcc

SEQ ID NO: 714535 - DNA, 25 bp, Mus musculus
gggcaggaggaatagcagatttgcc

SEQ ID NO: 714536 - DNA, 25 bp, Mus musculus
gggcaggcacaaatgtttttctggg

SEQ ID NO: 714537 - DNA, 25 bp, Mus musculus
gggcaggcacaattgtttttctggg

SEQ ID NO: 714538 - DNA, 25 bp, Mus musculus
gggcaggccatccatcttggaaatg

SEQ ID NO: 714539 - DNA, 25 bp, Mus musculus
gggcaggccatcgatcttggaaatg

SEQ ID NO: 714540 - DNA, 25 bp, Mus musculus
gggcaggctatacgacagacgacaa

SEQ ID NO: 714541 - DNA, 25 bp, Mus musculus
gggcaggctataggacagacgacaa

SEQ ID NO: 714542 - DNA, 25 bp, Mus musculus
gggcaggcttcacatcctctttagg

SEQ ID NO: 714543 - DNA, 25 bp, Mus musculus
gggcaggcttcacgcagatccccaa

SEQ ID NO: 714544 - DNA, 25 bp, Mus musculus
gggcaggcttcagatcctctttagg

SEQ ID NO: 714545 - DNA, 25 bp, Mus musculus
gggcaggcttcaggcagatccccaa

SEQ ID NO: 714546 - DNA, 25 bp, Mus musculus
gggcagggacttatgtacaacttca

SEQ ID NO: 714547 - DNA, 25 bp, Mus musculus
gggcagggacttttgtacaacttca

SEQ ID NO: 714548 - DNA, 25 bp, Mus musculus
gggcagggcactcaccatttcagaa

SEQ ID NO: 714549 - DNA, 25 bp, Mus musculus
gggcagggcactgaccatttcagaa

SEQ ID NO: 714550 - DNA, 25 bp, Mus musculus
gggcagggccagcaatctaagtact

SEQ ID NO: 714551 - DNA, 25 bp, Mus musculus
gggcagggccaggaatctaagtact

SEQ ID NO: 714552 - DNA, 25 bp, Mus musculus
gggcagggccgcaggactaggtggg

SEQ ID NO: 714553 - DNA, 25 bp, Mus musculus
gggcagggccgctggactaggtggg

SEQ ID NO: 714554 - DNA, 25 bp, Mus musculus
gggcaggggtcacccactgtcccaa

SEQ ID NO: 714555 - DNA, 25 bp, Mus musculus
gggcaggggtcagccactgtcccaa

SEQ ID NO: 714556 - DNA, 25 bp, Mus musculus
gggcaggtcctaaccaaagctggca

SEQ ID NO: 714557 - DNA, 25 bp, Mus musculus
gggcaggtcctatccaaagctggca

SEQ ID NO: 714558 - DNA, 25 bp, Mus musculus
gggcaggtgacaacaaactcaccaa

SEQ ID NO: 714559 - DNA, 25 bp, Mus musculus
gggcaggtgacatcaaactcaccaa

SEQ ID NO: 714560 - DNA, 25 bp, Mus musculus
gggcaggtgcttatctgtaccccga

SEQ ID NO: 714561 - DNA, 25 bp, Mus musculus
gggcaggtgcttttctgtaccccga

SEQ ID NO: 714562 - DNA, 25 bp, Mus musculus
gggcaggttcctagacctatctcta

SEQ ID NO: 714563 - DNA, 25 bp, Mus musculus
gggcaggttccttgacctatctcta

SEQ ID NO: 714564 - DNA, 25 bp, Mus musculus
gggcagtaaatcagacatggtacaa

SEQ ID NO: 714565 - DNA, 25 bp, Mus musculus
gggcagtaaatctgacatggtacaa

SEQ ID NO: 714566 - DNA, 25 bp, Mus musculus
gggcagtacaaacccttctaaatcc

SEQ ID NO: 714567 - DNA, 25 bp, Mus musculus
gggcagtacaaagccttctaaatcc

SEQ ID NO: 714568 - DNA, 25 bp, Mus musculus
gggcagtagatgatggagttaatac

SEQ ID NO: 714569 - DNA, 25 bp, Mus musculus
gggcagtagatgttggagttaatac

SEQ ID NO: 714570 - DNA, 25 bp, Mus musculus
gggcagtccacaaatcagttcgaag

SEQ ID NO: 714571 - DNA, 25 bp, Mus musculus
gggcagtccacatatcagttcgaag

SEQ ID NO: 714572 - DNA, 25 bp, Mus musculus
gggcagtcgcctccctcttgcgttg

SEQ ID NO: 714573 - DNA, 25 bp, Mus musculus
gggcagtcgcctgcctcttgcgttg

SEQ ID NO: 714574 - DNA, 25 bp, Mus musculus
gggcagtgcctaattgaacatgttt

SEQ ID NO: 714575 - DNA, 25 bp, Mus musculus
gggcagtgcctatttgaacatgttt

SEQ ID NO: 714576 - DNA, 25 bp, Mus musculus
gggcagtgctcacatcctgtcagta

SEQ ID NO: 714577 - DNA, 25 bp, Mus musculus
gggcagtgctcagatcctgtcagta

SEQ ID NO: 714578 - DNA, 25 bp, Mus musculus
gggcagtggtttcacatcagcgata

SEQ ID NO: 714579 - DNA, 25 bp, Mus musculus
gggcagtggtttgacatcagcgata

SEQ ID NO: 714580 - DNA, 25 bp, Mus musculus
gggcagttactaagagagtagaact

SEQ ID NO: 714581 - DNA, 25 bp, Mus musculus
gggcagttactatgagagtagaact

SEQ ID NO: 714582 - DNA, 25 bp, Mus musculus
gggcagttgaaaatatacagattaa

SEQ ID NO: 714583 - DNA, 25 bp, Mus musculus
gggcagttgaaattatacagattaa

SEQ ID NO: 714584 - DNA, 25 bp, Mus musculus
gggcagtttctacgcccaggtcaag

SEQ ID NO: 714585 - DNA, 25 bp, Mus musculus
gggcagtttctaggcccaggtcaag

SEQ ID NO: 714586 - DNA, 25 bp, Mus musculus
gggcagttttatccaacgggagata

SEQ ID NO: 714587 - DNA, 25 bp, Mus musculus
gggcagttttatgcaacgggagata

SEQ ID NO: 714588 - DNA, 25 bp, Mus musculus
gggcataactaaccccgaaggcaag

SEQ ID NO: 714589 - DNA, 25 bp, Mus musculus
gggcataactaagcccgaaggcaag

SEQ ID NO: 714590 - DNA, 25 bp, Mus musculus
gggcataatctgacagcctgcttct

SEQ ID NO: 714591 - DNA, 25 bp, Mus musculus
gggcataatctgtcagcctgcttct

SEQ ID NO: 714592 - DNA, 25 bp, Mus musculus
gggcataccttcctctgctgcaaga

SEQ ID NO: 714593 - DNA, 25 bp, Mus musculus
gggcataccttcgtctgctgcaaga

SEQ ID NO: 714594 - DNA, 25 bp, Mus musculus
gggcatagatggagacaaaggacct

SEQ ID NO: 714595 - DNA, 25 bp, Mus musculus
gggcatagatggtgacaaaggacct

SEQ ID NO: 714596 - DNA, 25 bp, Mus musculus
gggcatagcctcagatatacctaag

SEQ ID NO: 714597 - DNA, 25 bp, Mus musculus
gggcatagcctctgatatacctaag

SEQ ID NO: 714598 - DNA, 25 bp, Mus musculus
gggcatatctgtattgaatcccaac

SEQ ID NO: 714599 - DNA, 25 bp, Mus musculus
gggcatatctgttttgaatcccaac

SEQ ID NO: 714600 - DNA, 25 bp, Mus musculus
gggcatatgacaaattcttgtcact

SEQ ID NO: 714601 - DNA, 25 bp, Mus musculus
gggcatatgacatattcttgtcact

SEQ ID NO: 714602 - DNA, 25 bp, Mus musculus
gggcatatttcaaacggcaaatctt

SEQ ID NO: 714603 - DNA, 25 bp, Mus musculus
gggcatatttcatacggcaaatctt

SEQ ID NO: 714604 - DNA, 25 bp, Mus musculus
gggcatcaaaacaacagaaaattct

SEQ ID NO: 714605 - DNA, 25 bp, Mus musculus
gggcatcaaaaccatcgatgctcat

SEQ ID NO: 714606 - DNA, 25 bp, Mus musculus
gggcatcaaaacgatcgatgctcat

SEQ ID NO: 714607 - DNA, 25 bp, Mus musculus
gggcatcaaaactacagaaaattct

SEQ ID NO: 714608 - DNA, 25 bp, Mus musculus
gggcatcaccatagcttggaagttt

SEQ ID NO: 714609 - DNA, 25 bp, Mus musculus
gggcatcaccattgcttggaagttt

SEQ ID NO: 714610 - DNA, 25 bp, Mus musculus
gggcatcacctgctgggagaagatc

SEQ ID NO: 714611 - DNA, 25 bp, Mus musculus
gggcatcacctggtgggagaagatc

SEQ ID NO: 714612 - DNA, 25 bp, Mus musculus
gggcatcattcccagagccttcgag

SEQ ID NO: 714613 - DNA, 25 bp, Mus musculus
gggcatcattccgagagccttcgag

SEQ ID NO: 714614 - DNA, 25 bp, Mus musculus
gggcatccaaacactcgaatcaaag

SEQ ID NO: 714615 - DNA, 25 bp, Mus musculus
gggcatccaaactctcgaatcaaag

SEQ ID NO: 714616 - DNA, 25 bp, Mus musculus
gggcatccaggtcaccagcactgag

SEQ ID NO: 714617 - DNA, 25 bp, Mus musculus
gggcatccaggtgaccagcactgag

SEQ ID NO: 714618 - DNA, 25 bp, Mus musculus
gggcatccagttatatcttgtcctg

SEQ ID NO: 714619 - DNA, 25 bp, Mus musculus
gggcatccagttttatcttgtcctg

SEQ ID NO: 714620 - DNA, 25 bp, Mus musculus
gggcatcccatcaacccacgagttg

SEQ ID NO: 714621 - DNA, 25 bp, Mus musculus
gggcatcccatctacccacgagttg

SEQ ID NO: 714622 - DNA, 25 bp, Mus musculus
gggcatcctcaaacatctggagccg

SEQ ID NO: 714623 - DNA, 25 bp, Mus musculus
gggcatcctcaatcatctggagccg

SEQ ID NO: 714624 - DNA, 25 bp, Mus musculus
gggcatcgcccaacactagtagacc

SEQ ID NO: 714625 - DNA, 25 bp, Mus musculus
gggcatcgcccatcactagtagacc

SEQ ID NO: 714626 - DNA, 25 bp, Mus musculus
gggcatcgccttcttccaagggctc

SEQ ID NO: 714627 - DNA, 25 bp, Mus musculus
gggcatcgccttgttccaagggctc

SEQ ID NO: 714628 - DNA, 25 bp, Mus musculus
gggcatcgctccagtccacaggaat

SEQ ID NO: 714629 - DNA, 25 bp, Mus musculus
gggcatcgctcctgtccacaggaat

SEQ ID NO: 714630 - DNA, 25 bp, Mus musculus
gggcatcggcatcgtcattggacat

SEQ ID NO: 714631 - DNA, 25 bp, Mus musculus
gggcatcggcatggtcattggacat

SEQ ID NO: 714632 - DNA, 25 bp, Mus musculus
gggcatcgtggaaacacacttcacc

SEQ ID NO: 714633 - DNA, 25 bp, Mus musculus
gggcatcgtggatacacacttcacc

SEQ ID NO: 714634 - DNA, 25 bp, Mus musculus
gggcatctacaaccagggccttaaa

SEQ ID NO: 714635 - DNA, 25 bp, Mus musculus
gggcatctacaacctggatgacctg

SEQ ID NO: 714636 - DNA, 25 bp, Mus musculus
gggcatctacaagcagggccttaaa

SEQ ID NO: 714637 - DNA, 25 bp, Mus musculus
gggcatctacaagctggatgacctg

SEQ ID NO: 714638 - DNA, 25 bp, Mus musculus
gggcatctagctattatctaataaa

SEQ ID NO: 714639 - DNA, 25 bp, Mus musculus
gggcatctagcttttatctaataaa

SEQ ID NO: 714640 - DNA, 25 bp, Mus musculus
gggcatctggcaaagatttatgcca

SEQ ID NO: 714641 - DNA, 25 bp, Mus musculus
gggcatctggcatagatttatgcca

SEQ ID NO: 714642 - DNA, 25 bp, Mus musculus
gggcatctgtccagacttgggtgta

SEQ ID NO: 714643 - DNA, 25 bp, Mus musculus
gggcatctgtcctgacttgggtgta

SEQ ID NO: 714644 - DNA, 25 bp, Mus musculus
gggcatcttacacgcccaggttagc

SEQ ID NO: 714645 - DNA, 25 bp, Mus musculus
gggcatcttacaggcccaggttagc

SEQ ID NO: 714646 - DNA, 25 bp, Mus musculus
gggcatcttcccagcagtgtttgtg

SEQ ID NO: 714647 - DNA, 25 bp, Mus musculus
gggcatcttccctgcagtgtttgtg

SEQ ID NO: 714648 - DNA, 25 bp, Mus musculus
gggcatcttgctatggaaccgtcgg

SEQ ID NO: 714649 - DNA, 25 bp, Mus musculus
gggcatcttgctttggaaccgtcgg

SEQ ID NO: 714650 - DNA, 25 bp, Mus musculus
gggcatgaatgccaagagtatcact

SEQ ID NO: 714651 - DNA, 25 bp, Mus musculus
gggcatgaatgcgaagagtatcact

SEQ ID NO: 714652 - DNA, 25 bp, Mus musculus
gggcatgctgctacaataaggctca

SEQ ID NO: 714653 - DNA, 25 bp, Mus musculus
gggcatgctgcttcaataaggctca

SEQ ID NO: 714654 - DNA, 25 bp, Mus musculus
gggcatgctgtcaactcacttgacg

SEQ ID NO: 714655 - DNA, 25 bp, Mus musculus
gggcatgctgtctactcacttgacg

SEQ ID NO: 714656 - DNA, 25 bp, Mus musculus
gggcatggataaacagtacagtacc

SEQ ID NO: 714657 - DNA, 25 bp, Mus musculus
gggcatggataatcagtacagtacc

SEQ ID NO: 714658 - DNA, 25 bp, Mus musculus
gggcatggatgaatcagaaatcata

SEQ ID NO: 714659 - DNA, 25 bp, Mus musculus
gggcatggatgattcagaaatcata

SEQ ID NO: 714660 - DNA, 25 bp, Mus musculus
gggcatgtcatacgagtatccggaa

SEQ ID NO: 714661 - DNA, 25 bp, Mus musculus
gggcatgtcataggagtatccggaa

SEQ ID NO: 714662 - DNA, 25 bp, Mus musculus
gggcatgtccaaaggatgccacatg

SEQ ID NO: 714663 - DNA, 25 bp, Mus musculus
gggcatgtccaatggatgccacatg

SEQ ID NO: 714664 - DNA, 25 bp, Mus musculus
gggcatgtgtgaccatgtctccctg

SEQ ID NO: 714665 - DNA, 25 bp, Mus musculus
gggcatgtgtgagcatgtctccctg

SEQ ID NO: 714666 - DNA, 25 bp, Mus musculus
gggcatgttccgcaagctcaaccac

SEQ ID NO: 714667 - DNA, 25 bp, Mus musculus
gggcatgttccggaagctcaaccac

SEQ ID NO: 714668 - DNA, 25 bp, Mus musculus
gggcatgttgacaggattcaaacca

SEQ ID NO: 714669 - DNA, 25 bp, Mus musculus
gggcatgttgactggattcaaacca

SEQ ID NO: 714670 - DNA, 25 bp, Mus musculus
gggcatgttgtcaacatccttggct

SEQ ID NO: 714671 - DNA, 25 bp, Mus musculus
gggcatgttgtctacatccttggct

SEQ ID NO: 714672 - DNA, 25 bp, Mus musculus
gggcatgtttaacgaactctggaag

SEQ ID NO: 714673 - DNA, 25 bp, Mus musculus
gggcatgtttaaggaactctggaag

SEQ ID NO: 714674 - DNA, 25 bp, Mus musculus
gggcatgtttacacacaaggagttt

SEQ ID NO: 714675 - DNA, 25 bp, Mus musculus
gggcatgtttactcacaaggagttt

SEQ ID NO: 714676 - DNA, 25 bp, Mus musculus
gggcattatatcacctgtaaatgga

SEQ ID NO: 714677 - DNA, 25 bp, Mus musculus
gggcattatatctcctgtaaatgga

SEQ ID NO: 714678 - DNA, 25 bp, Mus musculus
gggcattatcccagctacaggatca

SEQ ID NO: 714679 - DNA, 25 bp, Mus musculus
gggcattatccctgctacaggatca

SEQ ID NO: 714680 - DNA, 25 bp, Mus musculus
gggcattatcctctacctgcttttt

SEQ ID NO: 714681 - DNA, 25 bp, Mus musculus
gggcattatcctgtacctgcttttt

SEQ ID NO: 714682 - DNA, 25 bp, Mus musculus
gggcattcccaaattcctggctgca

SEQ ID NO: 714683 - DNA, 25 bp, Mus musculus
gggcattcccaatttcctggctgca

SEQ ID NO: 714684 - DNA, 25 bp, Mus musculus
gggcattccttccatcggcatcatg

SEQ ID NO: 714685 - DNA, 25 bp, Mus musculus
gggcattccttcgatcggcatcatg

SEQ ID NO: 714686 - DNA, 25 bp, Mus musculus
gggcattctggaccgtaaccctcgc

SEQ ID NO: 714687 - DNA, 25 bp, Mus musculus
gggcattctggagcgtaaccctcgc

SEQ ID NO: 714688 - DNA, 25 bp, Mus musculus
gggcattgacatcagccctgccatg

SEQ ID NO: 714689 - DNA, 25 bp, Mus musculus
gggcattgacatgagccctgccatg

SEQ ID NO: 714690 - DNA, 25 bp, Mus musculus
gggcattgcactagtctcggtctga

SEQ ID NO: 714691 - DNA, 25 bp, Mus musculus
gggcattgcacttgtctcggtctga

SEQ ID NO: 714692 - DNA, 25 bp, Mus musculus
gggcattggcctagcaatttctctg

SEQ ID NO: 714693 - DNA, 25 bp, Mus musculus
gggcattggccttgcaatttctctg

SEQ ID NO: 714694 - DNA, 25 bp, Mus musculus
gggcattggctccaaactcctcgtc

SEQ ID NO: 714695 - DNA, 25 bp, Mus musculus
gggcattggctcgaaactcctcgtc

SEQ ID NO: 714696 - DNA, 25 bp, Mus musculus
gggcattgggaaacatccagatagc

SEQ ID NO: 714697 - DNA, 25 bp, Mus musculus
gggcattgggaatcatccagatagc

SEQ ID NO: 714698 - DNA, 25 bp, Mus musculus
gggcattgggcaacccctttcactc

SEQ ID NO: 714699 - DNA, 25 bp, Mus musculus
gggcattgggcatcccctttcactc

SEQ ID NO: 714700 - DNA, 25 bp, Mus musculus
gggcattgtcgcagcttacagctga

SEQ ID NO: 714701 - DNA, 25 bp, Mus musculus
gggcattgtcgctgcttacagctga

SEQ ID NO: 714702 - DNA, 25 bp, Mus musculus
gggcatttacacctggctgttctaa

SEQ ID NO: 714703 - DNA, 25 bp, Mus musculus
gggcatttacacgtggctgttctaa

SEQ ID NO: 714704 - DNA, 25 bp, Mus musculus
gggcatttccagacagttgcatcct

SEQ ID NO: 714705 - DNA, 25 bp, Mus musculus
gggcatttccagtcagttgcatcct

SEQ ID NO: 714706 - DNA, 25 bp, Mus musculus
gggccaaaactccaagtccgagaag

SEQ ID NO: 714707 - DNA, 25 bp, Mus musculus
gggccaaaactcgaagtccgagaag

SEQ ID NO: 714708 - DNA, 25 bp, Mus musculus
gggccaaaatgcagagttctaaaga

SEQ ID NO: 714709 - DNA, 25 bp, Mus musculus
gggccaaaatgctgagttctaaaga

SEQ ID NO: 714710 - DNA, 25 bp, Mus musculus
gggccaaagtctacctcatctatga

SEQ ID NO: 714711 - DNA, 25 bp, Mus musculus
gggccaaagtcttcctcatctatga

SEQ ID NO: 714712 - DNA, 25 bp, Mus musculus
gggccaaataagcatactctcatac

SEQ ID NO: 714713 - DNA, 25 bp, Mus musculus
gggccaaataaggatactctcatac

SEQ ID NO: 714714 - DNA, 25 bp, Mus musculus
gggccaaatgtcatccttacagtac

SEQ ID NO: 714715 - DNA, 25 bp, Mus musculus
gggccaaatgtcttccttacagtac

SEQ ID NO: 714716 - DNA, 25 bp, Mus musculus
gggccaaattgcactgttgctctaa

SEQ ID NO: 714717 - DNA, 25 bp, Mus musculus
gggccaaattgctctgttgctctaa

SEQ ID NO: 714718 - DNA, 25 bp, Mus musculus
gggccaacagctacccatatacagc

SEQ ID NO: 714719 - DNA, 25 bp, Mus musculus
gggccaacagcttcccatatacagc

SEQ ID NO: 714720 - DNA, 25 bp, Mus musculus
gggccaacatcaacaagtctttgac

SEQ ID NO: 714721 - DNA, 25 bp, Mus musculus
gggccaacatcatcaagtctttgac

SEQ ID NO: 714722 - DNA, 25 bp, Mus musculus
gggccaacatctaccgcaacgagtg

SEQ ID NO: 714723 - DNA, 25 bp, Mus musculus
gggccaacatcttccgcaacgagtg

SEQ ID NO: 714724 - DNA, 25 bp, Mus musculus
gggccaacctctcaaatcttagtag

SEQ ID NO: 714725 - DNA, 25 bp, Mus musculus
gggccaacctctgaaatcttagtag

SEQ ID NO: 714726 - DNA, 25 bp, Mus musculus
gggccaacggggaagtgtccttcat

SEQ ID NO: 714727 - DNA, 25 bp, Mus musculus
gggccaacggggtagtgtccttcat

SEQ ID NO: 714728 - DNA, 25 bp, Mus musculus
gggccaagaagtcttcagtgacagc

SEQ ID NO: 714729 - DNA, 25 bp, Mus musculus
gggccaagaagtgttcagtgacagc

SEQ ID NO: 714730 - DNA, 25 bp, Mus musculus
gggccaaggcatcaaggaacaccgc

SEQ ID NO: 714731 - DNA, 25 bp, Mus musculus
gggccaaggcatgaaggaacaccgc

SEQ ID NO: 714732 - DNA, 25 bp, Mus musculus
gggccaagggacactggtcactgtc

SEQ ID NO: 714733 - DNA, 25 bp, Mus musculus
gggccaagggactctggtcactgtc

SEQ ID NO: 714734 - DNA, 25 bp, Mus musculus
gggccaagtccaagaagtttgtgga

SEQ ID NO: 714735 - DNA, 25 bp, Mus musculus
gggccaagtccatgaagtttgtgga

SEQ ID NO: 714736 - DNA, 25 bp, Mus musculus
gggccaatccgaccctatatccttg

SEQ ID NO: 714737 - DNA, 25 bp, Mus musculus
gggccaatccgagcctatatccttg

SEQ ID NO: 714738 - DNA, 25 bp, Mus musculus
gggccacaaagcaagtttctgtcta

SEQ ID NO: 714739 - DNA, 25 bp, Mus musculus
gggccacaaagctagtttctgtcta

SEQ ID NO: 714740 - DNA, 25 bp, Mus musculus
gggccacaattcagaaactcctcga

SEQ ID NO: 714741 - DNA, 25 bp, Mus musculus
gggccacaattctgaaactcctcga

SEQ ID NO: 714742 - DNA, 25 bp, Mus musculus
gggccacacagtcacgagcttgaag

SEQ ID NO: 714743 - DNA, 25 bp, Mus musculus
gggccacacagtgacgagcttgaag

SEQ ID NO: 714744 - DNA, 25 bp, Mus musculus
gggccacaccaacagggttggcatc

SEQ ID NO: 714745 - DNA, 25 bp, Mus musculus
gggccacaccaagagggttggcatc

SEQ ID NO: 714746 - DNA, 25 bp, Mus musculus
gggccacactccagacagataccag

SEQ ID NO: 714747 - DNA, 25 bp, Mus musculus
gggccacactcctgacagataccag

SEQ ID NO: 714748 - DNA, 25 bp, Mus musculus
gggccacaggctatcatttccacgc

SEQ ID NO: 714749 - DNA, 25 bp, Mus musculus
gggccacaggctttcatttccacgc

SEQ ID NO: 714750 - DNA, 25 bp, Mus musculus
gggccacagtgcaccagatgtgaaa

SEQ ID NO: 714751 - DNA, 25 bp, Mus musculus
gggccacagtgctccagatgtgaaa

SEQ ID NO: 714752 - DNA, 25 bp, Mus musculus
gggccacatacaagcagcaagaaag

SEQ ID NO: 714753 - DNA, 25 bp, Mus musculus
gggccacatacatgcagcaagaaag

SEQ ID NO: 714754 - DNA, 25 bp, Mus musculus
gggccacatcaacccagcggtgtct

SEQ ID NO: 714755 - DNA, 25 bp, Mus musculus
gggccacatcaagccagcggtgtct

SEQ ID NO: 714756 - DNA, 25 bp, Mus musculus
gggccacattatcttagttccagaa

SEQ ID NO: 714757 - DNA, 25 bp, Mus musculus
gggccacattatgttagttccagaa

SEQ ID NO: 714758 - DNA, 25 bp, Mus musculus
gggccaccacttatgaggagaatcg

SEQ ID NO: 714759 - DNA, 25 bp, Mus musculus
gggccaccacttttgaggagaatcg

SEQ ID NO: 714760 - DNA, 25 bp, Mus musculus
gggccacccgcccttgaacttgaag

SEQ ID NO: 714761 - DNA, 25 bp, Mus musculus
gggccacccgccgttgaacttgaag

SEQ ID NO: 714762 - DNA, 25 bp, Mus musculus
gggccaccgtgtcatcggacactat

SEQ ID NO: 714763 - DNA, 25 bp, Mus musculus
gggccaccgtgtgatcggacactat

SEQ ID NO: 714764 - DNA, 25 bp, Mus musculus
gggccacctgagcaagtccaggact

SEQ ID NO: 714765 - DNA, 25 bp, Mus musculus
gggccacctgaggaagtccaggact

SEQ ID NO: 714766 - DNA, 25 bp, Mus musculus
gggccacgccagagaccgtatcatt

SEQ ID NO: 714767 - DNA, 25 bp, Mus musculus
gggccacgccagtgaccgtatcatt

SEQ ID NO: 714768 - DNA, 25 bp, Mus musculus
gggccacgctgtacccgcctggaga

SEQ ID NO: 714769 - DNA, 25 bp, Mus musculus
gggccacgctgttcccgcctggaga

SEQ ID NO: 714770 - DNA, 25 bp, Mus musculus
gggccacggataccatgaacgacgt

SEQ ID NO: 714771 - DNA, 25 bp, Mus musculus
gggccacggatagcatgaacgacgt

SEQ ID NO: 714772 - DNA, 25 bp, Mus musculus
gggccactagtaatcgcattgagga

SEQ ID NO: 714773 - DNA, 25 bp, Mus musculus
gggccactagtattcgcattgagga

SEQ ID NO: 714774 - DNA, 25 bp, Mus musculus
gggccactataaccatcgctacttc

SEQ ID NO: 714775 - DNA, 25 bp, Mus musculus
gggccactataagcatcgctacttc

SEQ ID NO: 714776 - DNA, 25 bp, Mus musculus
gggccactgagtaccgtttcactgt

SEQ ID NO: 714777 - DNA, 25 bp, Mus musculus
gggccactgagttccgtttcactgt

SEQ ID NO: 714778 - DNA, 25 bp, Mus musculus
gggccacttcttcaggatccttcct

SEQ ID NO: 714779 - DNA, 25 bp, Mus musculus
gggccacttcttgaggatccttcct

SEQ ID NO: 714780 - DNA, 25 bp, Mus musculus
gggccagaacatcactcaactgcaa

SEQ ID NO: 714781 - DNA, 25 bp, Mus musculus
gggccagaacatgactcaactgcaa

SEQ ID NO: 714782 - DNA, 25 bp, Mus musculus
gggccagaatacaactacattcacc

SEQ ID NO: 714783 - DNA, 25 bp, Mus musculus
gggccagaatactactacattcacc

SEQ ID NO: 714784 - DNA, 25 bp, Mus musculus
gggccagagagtacaccacaagtaa

SEQ ID NO: 714785 - DNA, 25 bp, Mus musculus
gggccagagagttcaccacaagtaa

SEQ ID NO: 714786 - DNA, 25 bp, Mus musculus
gggccagagctcatgcatgctgtca

SEQ ID NO: 714787 - DNA, 25 bp, Mus musculus
gggccagagctcttgcatgctgtca

SEQ ID NO: 714788 - DNA, 25 bp, Mus musculus
gggccagaggataccatcccatcac

SEQ ID NO: 714789 - DNA, 25 bp, Mus musculus
gggccagaggattccatcccatcac

SEQ ID NO: 714790 - DNA, 25 bp, Mus musculus
gggccagatcaaccagcaggaccct

SEQ ID NO: 714791 - DNA, 25 bp, Mus musculus
gggccagatcaagcagcaggaccct

SEQ ID NO: 714792 - DNA, 25 bp, Mus musculus
gggccagatcgcatttgatgacttc

SEQ ID NO: 714793 - DNA, 25 bp, Mus musculus
gggccagatcgcttttgatgacttc

SEQ ID NO: 714794 - DNA, 25 bp, Mus musculus
gggccagcacttatgtttctcatga

SEQ ID NO: 714795 - DNA, 25 bp, Mus musculus
gggccagcacttttgtttctcatga

SEQ ID NO: 714796 - DNA, 25 bp, Mus musculus
gggccagcagctctgtatcaaagga

SEQ ID NO: 714797 - DNA, 25 bp, Mus musculus
gggccagcagctgtgtatcaaagga

SEQ ID NO: 714798 - DNA, 25 bp, Mus musculus
gggccagccacaatctagaagtggt

SEQ ID NO: 714799 - DNA, 25 bp, Mus musculus
gggccagccacattctagaagtggt

SEQ ID NO: 714800 - DNA, 25 bp, Mus musculus
gggccagccgaaatctgcaggatca

SEQ ID NO: 714801 - DNA, 25 bp, Mus musculus
gggccagccgaattctgcaggatca

SEQ ID NO: 714802 - DNA, 25 bp, Mus musculus
gggccaggacaaatctcggcagaag

SEQ ID NO: 714803 - DNA, 25 bp, Mus musculus
gggccaggacaactggttgtcttcc

SEQ ID NO: 714804 - DNA, 25 bp, Mus musculus
gggccaggacaagtggttgtcttcc

SEQ ID NO: 714805 - DNA, 25 bp, Mus musculus
gggccaggacaattctcggcagaag

SEQ ID NO: 714806 - DNA, 25 bp, Mus musculus
gggccaggagaaatctattgaaata

SEQ ID NO: 714807 - DNA, 25 bp, Mus musculus
gggccaggagaattctattgaaata

SEQ ID NO: 714808 - DNA, 25 bp, Mus musculus
gggccaggagctatactcctgatct

SEQ ID NO: 714809 - DNA, 25 bp, Mus musculus
gggccaggagctttactcctgatct

SEQ ID NO: 714810 - DNA, 25 bp, Mus musculus
gggccaggcctgctcacaactaaag

SEQ ID NO: 714811 - DNA, 25 bp, Mus musculus
gggccaggcctggtcacaactaaag

SEQ ID NO: 714812 - DNA, 25 bp, Mus musculus
gggccaggctgaagtactgaacttt

SEQ ID NO: 714813 - DNA, 25 bp, Mus musculus
gggccaggctgatgtactgaacttt

SEQ ID NO: 714814 - DNA, 25 bp, Mus musculus
gggccaggctggaactacgcaatcg

SEQ ID NO: 714815 - DNA, 25 bp, Mus musculus
gggccaggctggtactacgcaatcg

SEQ ID NO: 714816 - DNA, 25 bp, Mus musculus
gggccagggatcagtaagcctcaga

SEQ ID NO: 714817 - DNA, 25 bp, Mus musculus
gggccagggatctgtaagcctcaga

SEQ ID NO: 714818 - DNA, 25 bp, Mus musculus
gggccaggtcacagtctagctaatg

SEQ ID NO: 714819 - DNA, 25 bp, Mus musculus
gggccaggtcactgtctagctaatg

SEQ ID NO: 714820 - DNA, 25 bp, Mus musculus
gggccaggtcataggtttcatcagc

SEQ ID NO: 714821 - DNA, 25 bp, Mus musculus
gggccaggtcattggtttcatcagc

SEQ ID NO: 714822 - DNA, 25 bp, Mus musculus
gggccagtatgtacctggcaatggc

SEQ ID NO: 714823 - DNA, 25 bp, Mus musculus
gggccagtatgttcctggcaatggc

SEQ ID NO: 714824 - DNA, 25 bp, Mus musculus
gggccagtatttaccagtccgtggt

SEQ ID NO: 714825 - DNA, 25 bp, Mus musculus
gggccagtattttccagtccgtggt

SEQ ID NO: 714826 - DNA, 25 bp, Mus musculus
gggccagtgctgcagccactacctc

SEQ ID NO: 714827 - DNA, 25 bp, Mus musculus
gggccagtgctggagccactacctc

SEQ ID NO: 714828 - DNA, 25 bp, Mus musculus
gggccagttggcatggataaaatgt

SEQ ID NO: 714829 - DNA, 25 bp, Mus musculus
gggccagttggcttggataaaatgt

SEQ ID NO: 714830 - DNA, 25 bp, Mus musculus
gggccagtttatagcgtctggatca

SEQ ID NO: 714831 - DNA, 25 bp, Mus musculus
gggccagtttattgcgtctggatca

SEQ ID NO: 714832 - DNA, 25 bp, Mus musculus
gggccataaaatccactaccccatg

SEQ ID NO: 714833 - DNA, 25 bp, Mus musculus
gggccataaaatgcactaccccatg

SEQ ID NO: 714834 - DNA, 25 bp, Mus musculus
gggccatacctaagaaccatcacag

SEQ ID NO: 714835 - DNA, 25 bp, Mus musculus
gggccatacctatgaaccatcacag

SEQ ID NO: 714836 - DNA, 25 bp, Mus musculus
gggccatagctgacaagattcagcg

SEQ ID NO: 714837 - DNA, 25 bp, Mus musculus
gggccatagctgtcaagattcagcg

SEQ ID NO: 714838 - DNA, 25 bp, Mus musculus
gggccatcactcacaacagcatgga

SEQ ID NO: 714839 - DNA, 25 bp, Mus musculus
gggccatcactctcaacagcatgga

SEQ ID NO: 714840 - DNA, 25 bp, Mus musculus
gggccatcagctactatatgcgttt

SEQ ID NO: 714841 - DNA, 25 bp, Mus musculus
gggccatcagcttctatatgcgttt

SEQ ID NO: 714842 - DNA, 25 bp, Mus musculus
gggccatccaggagtcccagtgtct

SEQ ID NO: 714843 - DNA, 25 bp, Mus musculus
gggccatccaggtgtcccagtgtct

SEQ ID NO: 714844 - DNA, 25 bp, Mus musculus
gggccatccgctccagttcgtgttc

SEQ ID NO: 714845 - DNA, 25 bp, Mus musculus
gggccatccgctgcagttcgtgttc

SEQ ID NO: 714846 - DNA, 25 bp, Mus musculus
gggccatctctgatccttagccact

SEQ ID NO: 714847 - DNA, 25 bp, Mus musculus
gggccatctctgttccttagccact

SEQ ID NO: 714848 - DNA, 25 bp, Mus musculus
gggccatgacctcactgggaagcta

SEQ ID NO: 714849 - DNA, 25 bp, Mus musculus
gggccatgacctgactgggaagcta

SEQ ID NO: 714850 - DNA, 25 bp, Mus musculus
gggccatgccaacatagtagaagtt

SEQ ID NO: 714851 - DNA, 25 bp, Mus musculus
gggccatgccaagatagtagaagtt

SEQ ID NO: 714852 - DNA, 25 bp, Mus musculus
gggccatgggcgctatccatcgact

SEQ ID NO: 714853 - DNA, 25 bp, Mus musculus
gggccatgggcggtatccatcgact

SEQ ID NO: 714854 - DNA, 25 bp, Mus musculus
gggccatgtgctcagccacccagaa

SEQ ID NO: 714855 - DNA, 25 bp, Mus musculus
gggccatgtgctccctcgcttgctg

SEQ ID NO: 714856 - DNA, 25 bp, Mus musculus
gggccatgtgctgagccacccagaa

SEQ ID NO: 714857 - DNA, 25 bp, Mus musculus
gggccatgtgctgcctcgcttgctg

SEQ ID NO: 714858 - DNA, 25 bp, Mus musculus
gggccatgttttaaattgcattacg

SEQ ID NO: 714859 - DNA, 25 bp, Mus musculus
gggccatgtttttaattgcattacg

SEQ ID NO: 714860 - DNA, 25 bp, Mus musculus
gggccattacaccagtgagtaagaa

SEQ ID NO: 714861 - DNA, 25 bp, Mus musculus
gggccattacacgagtgagtaagaa

SEQ ID NO: 714862 - DNA, 25 bp, Mus musculus
gggccattccttatggcctgggtgc

SEQ ID NO: 714863 - DNA, 25 bp, Mus musculus
gggccattccttttggcctgggtgc

SEQ ID NO: 714864 - DNA, 25 bp, Mus musculus
gggccattctggactccttttggtg

SEQ ID NO: 714865 - DNA, 25 bp, Mus musculus
gggccattctggtctccttttggtg

SEQ ID NO: 714866 - DNA, 25 bp, Mus musculus
gggccattgagacactcatcaagaa

SEQ ID NO: 714867 - DNA, 25 bp, Mus musculus
gggccattgagagactcatcaagaa

SEQ ID NO: 714868 - DNA, 25 bp, Mus musculus
gggccattgtttagaagaacacctg

SEQ ID NO: 714869 - DNA, 25 bp, Mus musculus
gggccattgttttgaagaacacctg

SEQ ID NO: 714870 - DNA, 25 bp, Mus musculus
gggccatttctccacaaccctggtg

SEQ ID NO: 714871 - DNA, 25 bp, Mus musculus
gggccatttctcgacaaccctggtg

SEQ ID NO: 714872 - DNA, 25 bp, Mus musculus
gggccattttctcatatgtttgatg

SEQ ID NO: 714873 - DNA, 25 bp, Mus musculus
gggccattttctgatatgtttgatg

SEQ ID NO: 714874 - DNA, 25 bp, Mus musculus
gggcccaaactaaagaccttgatct

SEQ ID NO: 714875 - DNA, 25 bp, Mus musculus
gggcccaaactatagaccttgatct

SEQ ID NO: 714876 - DNA, 25 bp, Mus musculus
gggcccaaagccaatctgtcctgcg

SEQ ID NO: 714877 - DNA, 25 bp, Mus musculus
gggcccaaagcctatctgtcctgcg

SEQ ID NO: 714878 - DNA, 25 bp, Mus musculus
gggcccaaatgactgtttgccaggc

SEQ ID NO: 714879 - DNA, 25 bp, Mus musculus
gggcccaaatgagtgtttgccaggc

SEQ ID NO: 714880 - DNA, 25 bp, Mus musculus
gggcccaacaataggacagtgctta

SEQ ID NO: 714881 - DNA, 25 bp, Mus musculus
gggcccaacaattggacagtgctta

SEQ ID NO: 714882 - DNA, 25 bp, Mus musculus
gggcccaacattcgactattctcat

SEQ ID NO: 714883 - DNA, 25 bp, Mus musculus
gggcccaacattggactattctcat

SEQ ID NO: 714884 - DNA, 25 bp, Mus musculus
gggcccaagagcagcgtcatcacct

SEQ ID NO: 714885 - DNA, 25 bp, Mus musculus
gggcccaagagctgcgtcatcacct

SEQ ID NO: 714886 - DNA, 25 bp, Mus musculus
gggcccaagccccagaaggattagc

SEQ ID NO: 714887 - DNA, 25 bp, Mus musculus
gggcccaagcccgagaaggattagc

SEQ ID NO: 714888 - DNA, 25 bp, Mus musculus
gggcccaagtggagtttgcagacat

SEQ ID NO: 714889 - DNA, 25 bp, Mus musculus
gggcccaagtggtgtttgcagacat

SEQ ID NO: 714890 - DNA, 25 bp, Mus musculus
gggcccacatgaatgccgcagtgac

SEQ ID NO: 714891 - DNA, 25 bp, Mus musculus
gggcccacatgattgccgcagtgac

SEQ ID NO: 714892 - DNA, 25 bp, Mus musculus
gggcccaccaatcacctttatttag

SEQ ID NO: 714893 - DNA, 25 bp, Mus musculus
gggcccaccaatgacctttatttag

SEQ ID NO: 714894 - DNA, 25 bp, Mus musculus
gggcccacgtgcagttttgaacata

SEQ ID NO: 714895 - DNA, 25 bp, Mus musculus
gggcccacgtgctgttttgaacata

SEQ ID NO: 714896 - DNA, 25 bp, Mus musculus
gggcccagagcaagatcttctttgt

SEQ ID NO: 714897 - DNA, 25 bp, Mus musculus
gggcccagagcatgatcttctttgt

SEQ ID NO: 714898 - DNA, 25 bp, Mus musculus
gggcccaggcatccagaattattct

SEQ ID NO: 714899 - DNA, 25 bp, Mus musculus
gggcccaggcatgcagaattattct

SEQ ID NO: 714900 - DNA, 25 bp, Mus musculus
gggcccaggcctcggaacctgttct

SEQ ID NO: 714901 - DNA, 25 bp, Mus musculus
gggcccaggcctgggaacctgttct

SEQ ID NO: 714902 - DNA, 25 bp, Mus musculus
gggcccagggtcaaagccatcagcc

SEQ ID NO: 714903 - DNA, 25 bp, Mus musculus
gggcccagggtctaagccatcagcc

SEQ ID NO: 714904 - DNA, 25 bp, Mus musculus
gggcccatcaggaagtgatctccct

SEQ ID NO: 714905 - DNA, 25 bp, Mus musculus
gggcccatcaggtagtgatctccct

SEQ ID NO: 714906 - DNA, 25 bp, Mus musculus
gggcccatcctgatggagctccaga

SEQ ID NO: 714907 - DNA, 25 bp, Mus musculus
gggcccatcctgttggagctccaga

SEQ ID NO: 714908 - DNA, 25 bp, Mus musculus
gggcccatgaagaggttgactatac

SEQ ID NO: 714909 - DNA, 25 bp, Mus musculus
gggcccatgaagtggttgactatac

SEQ ID NO: 714910 - DNA, 25 bp, Mus musculus
gggcccatgtgacgtcatgttccaa

SEQ ID NO: 714911 - DNA, 25 bp, Mus musculus
gggcccatgtgaggtcatgttccaa

SEQ ID NO: 714912 - DNA, 25 bp, Mus musculus
gggcccattgggatccattcgcaac

SEQ ID NO: 714913 - DNA, 25 bp, Mus musculus
gggcccattgggttccattcgcaac

SEQ ID NO: 714914 - DNA, 25 bp, Mus musculus
gggccccactgaagaggcacagatg

SEQ ID NO: 714915 - DNA, 25 bp, Mus musculus
gggccccactgatgaggcacagatg

SEQ ID NO: 714916 - DNA, 25 bp, Mus musculus
gggccccactgcattgagctactga

SEQ ID NO: 714917 - DNA, 25 bp, Mus musculus
gggccccactgcctgcgttctagtg

SEQ ID NO: 714918 - DNA, 25 bp, Mus musculus
gggccccactgcgtgcgttctagtg

SEQ ID NO: 714919 - DNA, 25 bp, Mus musculus
gggccccactgctttgagctactga

SEQ ID NO: 714920 - DNA, 25 bp, Mus musculus
gggccccaggcaagccaaatcttta

SEQ ID NO: 714921 - DNA, 25 bp, Mus musculus
gggccccaggcatgccaaatcttta

SEQ ID NO: 714922 - DNA, 25 bp, Mus musculus
gggccccatcaaagcatctctgttt

SEQ ID NO: 714923 - DNA, 25 bp, Mus musculus
gggccccatcaatgcatctctgttt

SEQ ID NO: 714924 - DNA, 25 bp, Mus musculus
gggccccggtgaagatcatcgactt

SEQ ID NO: 714925 - DNA, 25 bp, Mus musculus
gggccccggtgatgatcatcgactt

SEQ ID NO: 714926 - DNA, 25 bp, Mus musculus
gggccccgtctacaaaggagtctgt

SEQ ID NO: 714927 - DNA, 25 bp, Mus musculus
gggccccgtctagaaaggagtctgt

SEQ ID NO: 714928 - DNA, 25 bp, Mus musculus
gggcccctcatcactgcagggatct

SEQ ID NO: 714929 - DNA, 25 bp, Mus musculus
gggcccctcatctctgcagggatct

SEQ ID NO: 714930 - DNA, 25 bp, Mus musculus
gggcccctcatgcactggtgatgac

SEQ ID NO: 714931 - DNA, 25 bp, Mus musculus
gggcccctcatggactggtgatgac

SEQ ID NO: 714932 - DNA, 25 bp, Mus musculus
gggcccctctctagggtctgtgctg

SEQ ID NO: 714933 - DNA, 25 bp, Mus musculus
gggcccctctcttgggtctgtgctg

SEQ ID NO: 714934 - DNA, 25 bp, Mus musculus
gggcccctggaacgtgctcagtctc

SEQ ID NO: 714935 - DNA, 25 bp, Mus musculus
gggcccctggaaggtgctcagtctc

SEQ ID NO: 714936 - DNA, 25 bp, Mus musculus
gggcccctggatcattcaggatggg

SEQ ID NO: 714937 - DNA, 25 bp, Mus musculus
gggcccctggatgattcaggatggg

SEQ ID NO: 714938 - DNA, 25 bp, Mus musculus
gggccccttggacatgatgtttgat

SEQ ID NO: 714939 - DNA, 25 bp, Mus musculus
gggccccttggagatgatgtttgat

SEQ ID NO: 714940 - DNA, 25 bp, Mus musculus
gggcccgacccacagcacatgatgg

SEQ ID NO: 714941 - DNA, 25 bp, Mus musculus
gggcccgacccagagcacatgatgg

SEQ ID NO: 714942 - DNA, 25 bp, Mus musculus
gggcccgagcttagtatcaccctca

SEQ ID NO: 714943 - DNA, 25 bp, Mus musculus
gggcccgagctttgtatcaccctca

SEQ ID NO: 714944 - DNA, 25 bp, Mus musculus
gggcccgcaggcagttcggcatcaa

SEQ ID NO: 714945 - DNA, 25 bp, Mus musculus
gggcccgcaggctgttcggcatcaa

SEQ ID NO: 714946 - DNA, 25 bp, Mus musculus
gggcccgcgttgactgcgcgtctac

SEQ ID NO: 714947 - DNA, 25 bp, Mus musculus
gggcccgcgttgtctgcgcgtctac

SEQ ID NO: 714948 - DNA, 25 bp, Mus musculus
gggcccgctatccacaggaaccttt

SEQ ID NO: 714949 - DNA, 25 bp, Mus musculus
gggcccgctatcgacaggaaccttt

SEQ ID NO: 714950 - DNA, 25 bp, Mus musculus
gggcccggccagaagcttacggatt

SEQ ID NO: 714951 - DNA, 25 bp, Mus musculus
gggcccggccagtagcttacggatt

SEQ ID NO: 714952 - DNA, 25 bp, Mus musculus
gggcccggttctacactgcagaggt

SEQ ID NO: 714953 - DNA, 25 bp, Mus musculus
gggcccggttcttcactgcagaggt

SEQ ID NO: 714954 - DNA, 25 bp, Mus musculus
gggcccgtgcggctgaagaagaaag

SEQ ID NO: 714955 - DNA, 25 bp, Mus musculus
gggcccgtgcgggtgaagaagaaag

SEQ ID NO: 714956 - DNA, 25 bp, Mus musculus
gggccctactagctgctggcttgct

SEQ ID NO: 714957 - DNA, 25 bp, Mus musculus
gggccctactaggtgctggcttgct

SEQ ID NO: 714958 - DNA, 25 bp, Mus musculus
gggccctagaaacgccatatcgggc

SEQ ID NO: 714959 - DNA, 25 bp, Mus musculus
gggccctagaaaggccatatcgggc

SEQ ID NO: 714960 - DNA, 25 bp, Mus musculus
gggccctatcagaacgtgagtgcac

SEQ ID NO: 714961 - DNA, 25 bp, Mus musculus
gggccctatcagtacgtgagtgcac

SEQ ID NO: 714962 - DNA, 25 bp, Mus musculus
gggccctcaacaaggaaatctgtga

SEQ ID NO: 714963 - DNA, 25 bp, Mus musculus
gggccctcaacatggaaatctgtga

SEQ ID NO: 714964 - DNA, 25 bp, Mus musculus
gggccctcagtaagtactgctgtca

SEQ ID NO: 714965 - DNA, 25 bp, Mus musculus
gggccctcagtatgtactgctgtca

SEQ ID NO: 714966 - DNA, 25 bp, Mus musculus
gggccctccgacagatcgcggactt

SEQ ID NO: 714967 - DNA, 25 bp, Mus musculus
gggccctccgactgatcgcggactt

SEQ ID NO: 714968 - DNA, 25 bp, Mus musculus
gggccctcttagagttggcgtccta

SEQ ID NO: 714969 - DNA, 25 bp, Mus musculus
gggccctcttagtgttggcgtccta

SEQ ID NO: 714970 - DNA, 25 bp, Mus musculus
gggccctgaagacacttgttttgag

SEQ ID NO: 714971 - DNA, 25 bp, Mus musculus
gggccctgaagagacttgttttgag

SEQ ID NO: 714972 - DNA, 25 bp, Mus musculus
gggccctgacataagagtcaattga

SEQ ID NO: 714973 - DNA, 25 bp, Mus musculus
gggccctgacattagagtcaattga

SEQ ID NO: 714974 - DNA, 25 bp, Mus musculus
gggccctgcctgaccttctgtagag

SEQ ID NO: 714975 - DNA, 25 bp, Mus musculus
gggccctgcctgtccttctgtagag

SEQ ID NO: 714976 - DNA, 25 bp, Mus musculus
gggccctgcttaactccacaggata

SEQ ID NO: 714977 - DNA, 25 bp, Mus musculus
gggccctgcttatctccacaggata

SEQ ID NO: 714978 - DNA, 25 bp, Mus musculus
gggcccttcgtcagaaaatgggacg

SEQ ID NO: 714979 - DNA, 25 bp, Mus musculus
gggcccttcgtctgaaaatgggacg

SEQ ID NO: 714980 - DNA, 25 bp, Mus musculus
gggcccttggccatgatgctcggaa

SEQ ID NO: 714981 - DNA, 25 bp, Mus musculus
gggcccttggccttgatgctcggaa

SEQ ID NO: 714982 - DNA, 25 bp, Mus musculus
gggcccttggtgactttatcttgca

SEQ ID NO: 714983 - DNA, 25 bp, Mus musculus
gggcccttggtgtctttatcttgca

SEQ ID NO: 714984 - DNA, 25 bp, Mus musculus
gggccctttggcactctggtctaca

SEQ ID NO: 714985 - DNA, 25 bp, Mus musculus
gggccctttggctctctggtctaca

SEQ ID NO: 714986 - DNA, 25 bp, Mus musculus
gggccgaaatcaagaaccggagttt

SEQ ID NO: 714987 - DNA, 25 bp, Mus musculus
gggccgaaatcatgaaccggagttt

SEQ ID NO: 714988 - DNA, 25 bp, Mus musculus
gggccgaatcaaaggacgattggtt

SEQ ID NO: 714989 - DNA, 25 bp, Mus musculus
gggccgaatcaatggacgattggtt

SEQ ID NO: 714990 - DNA, 25 bp, Mus musculus
gggccgagagatcatgctggtgacc

SEQ ID NO: 714991 - DNA, 25 bp, Mus musculus
gggccgagagatgatgctggtgacc

SEQ ID NO: 714992 - DNA, 25 bp, Mus musculus
gggccgagcgttctctgtactccga

SEQ ID NO: 714993 - DNA, 25 bp, Mus musculus
gggccgagcgttgtctgtactccga

SEQ ID NO: 714994 - DNA, 25 bp, Mus musculus
gggccgataagtccagcagtttctt

SEQ ID NO: 714995 - DNA, 25 bp, Mus musculus
gggccgataagtgcagcagtttctt

SEQ ID NO: 714996 - DNA, 25 bp, Mus musculus
gggccgcaccctatgactggcgtct

SEQ ID NO: 714997 - DNA, 25 bp, Mus musculus
gggccgcaccctttgactggcgtct

SEQ ID NO: 714998 - DNA, 25 bp, Mus musculus
gggccgcctataactacatccgagg

SEQ ID NO: 714999 - DNA, 25 bp, Mus musculus
gggccgcctatatctacatccgagg

SEQ ID NO: 715000 - DNA, 25 bp, Mus musculus
gggccgctacccagggacttgccag

SEQ ID NO: 715001 - DNA, 25 bp, Mus musculus
gggccgctaccctgggacttgccag

SEQ ID NO: 715002 - DNA, 25 bp, Mus musculus
gggccgctctgaaggtaccagagca

SEQ ID NO: 715003 - DNA, 25 bp, Mus musculus
gggccgctctgatggtaccagagca

SEQ ID NO: 715004 - DNA, 25 bp, Mus musculus
gggccgctcttcaccacgtttctga

SEQ ID NO: 715005 - DNA, 25 bp, Mus musculus
gggccgctcttctccacgtttctga

SEQ ID NO: 715006 - DNA, 25 bp, Mus musculus
gggccgctgcttccaggacacattg

SEQ ID NO: 715007 - DNA, 25 bp, Mus musculus
gggccgctgcttgcaggacacattg

SEQ ID NO: 715008 - DNA, 25 bp, Mus musculus
gggccgcttacgagaataccttcca

SEQ ID NO: 715009 - DNA, 25 bp, Mus musculus
gggccgcttacgtgaataccttcca

SEQ ID NO: 715010 - DNA, 25 bp, Mus musculus
gggccgctttctacgagatgccaaa

SEQ ID NO: 715011 - DNA, 25 bp, Mus musculus
gggccgctttcttcgagatgccaaa

SEQ ID NO: 715012 - DNA, 25 bp, Mus musculus
gggccggaatccatcttcatcctac

SEQ ID NO: 715013 - DNA, 25 bp, Mus musculus
gggccggaatccttcttcatcctac

SEQ ID NO: 715014 - DNA, 25 bp, Mus musculus
gggccggcagtgagccccgggatga

SEQ ID NO: 715015 - DNA, 25 bp, Mus musculus
gggccggcagtgtgccccgggatga

SEQ ID NO: 715016 - DNA, 25 bp, Mus musculus
gggccgggaaaaccatccgatctcg

SEQ ID NO: 715017 - DNA, 25 bp, Mus musculus
gggccgggaaaagcatccgatctcg

SEQ ID NO: 715018 - DNA, 25 bp, Mus musculus
gggccggtggttacaagtgacattt

SEQ ID NO: 715019 - DNA, 25 bp, Mus musculus
gggccggtggtttcaagtgacattt

SEQ ID NO: 715020 - DNA, 25 bp, Mus musculus
gggccggttcgcaagccaagccgtc

SEQ ID NO: 715021 - DNA, 25 bp, Mus musculus
gggccggttcgctagccaagccgtc

SEQ ID NO: 715022 - DNA, 25 bp, Mus musculus
gggccgtaacgtctatgacagcata

SEQ ID NO: 715023 - DNA, 25 bp, Mus musculus
gggccgtaacgtgtatgacagcata

SEQ ID NO: 715024 - DNA, 25 bp, Mus musculus
gggccgtgccctactgttatttatt

SEQ ID NO: 715025 - DNA, 25 bp, Mus musculus
gggccgtgcccttctgttatttatt

SEQ ID NO: 715026 - DNA, 25 bp, Mus musculus
gggccgtgctgtaggtcacattgct

SEQ ID NO: 715027 - DNA, 25 bp, Mus musculus
gggccgtgctgttggtcacattgct

SEQ ID NO: 715028 - DNA, 25 bp, Mus musculus
gggccgtgtctcagccaagaaagcc

SEQ ID NO: 715029 - DNA, 25 bp, Mus musculus
gggccgtgtctctgccaagaaagcc

SEQ ID NO: 715030 - DNA, 25 bp, Mus musculus
gggcctaatagcaaacagtctattt

SEQ ID NO: 715031 - DNA, 25 bp, Mus musculus
gggcctaatagctaacagtctattt

SEQ ID NO: 715032 - DNA, 25 bp, Mus musculus
gggcctacacaccagtgggtgtcct

SEQ ID NO: 715033 - DNA, 25 bp, Mus musculus
gggcctacacacgagtgggtgtcct

SEQ ID NO: 715034 - DNA, 25 bp, Mus musculus
gggcctacatccaagagagcgccag

SEQ ID NO: 715035 - DNA, 25 bp, Mus musculus
gggcctacatcctagagagcgccag

SEQ ID NO: 715036 - DNA, 25 bp, Mus musculus
gggcctacggtcataccatgagact

SEQ ID NO: 715037 - DNA, 25 bp, Mus musculus
gggcctacggtcttaccatgagact

SEQ ID NO: 715038 - DNA, 25 bp, Mus musculus
gggcctactaacacggctgctgcag

SEQ ID NO: 715039 - DNA, 25 bp, Mus musculus
gggcctactaactcggctgctgcag

SEQ ID NO: 715040 - DNA, 25 bp, Mus musculus
gggcctactgtccaatgtcaaccgg

SEQ ID NO: 715041 - DNA, 25 bp, Mus musculus
gggcctactgtcgaatgtcaaccgg

SEQ ID NO: 715042 - DNA, 25 bp, Mus musculus
gggcctagcccgatatgtcttccag

SEQ ID NO: 715043 - DNA, 25 bp, Mus musculus
gggcctagcccgttatgtcttccag

SEQ ID NO: 715044 - DNA, 25 bp, Mus musculus
gggcctatagagatcacatatcgag

SEQ ID NO: 715045 - DNA, 25 bp, Mus musculus
gggcctatagagttcacatatcgag

SEQ ID NO: 715046 - DNA, 25 bp, Mus musculus
gggcctatcagtcccaccctggtga

SEQ ID NO: 715047 - DNA, 25 bp, Mus musculus
gggcctatcagtgccaccctggtga

SEQ ID NO: 715048 - DNA, 25 bp, Mus musculus
gggcctatctaaactgcgaacggta

SEQ ID NO: 715049 - DNA, 25 bp, Mus musculus
gggcctatctaatctgcgaacggta

SEQ ID NO: 715050 - DNA, 25 bp, Mus musculus
gggcctatttctcttgctatggacg

SEQ ID NO: 715051 - DNA, 25 bp, Mus musculus
gggcctatttctgttgctatggacg

SEQ ID NO: 715052 - DNA, 25 bp, Mus musculus
gggcctattttgagacatgagaatg

SEQ ID NO: 715053 - DNA, 25 bp, Mus musculus
gggcctattttgtgacatgagaatg

SEQ ID NO: 715054 - DNA, 25 bp, Mus musculus
gggcctcaaatgaatttatccagat

SEQ ID NO: 715055 - DNA, 25 bp, Mus musculus
gggcctcaaatgtatttatccagat

SEQ ID NO: 715056 - DNA, 25 bp, Mus musculus
gggcctcaacaaccaaggctacaaa

SEQ ID NO: 715057 - DNA, 25 bp, Mus musculus
gggcctcaacaagcaaggctacaaa

SEQ ID NO: 715058 - DNA, 25 bp, Mus musculus
gggcctcaaggtcgccttgactgtc

SEQ ID NO: 715059 - DNA, 25 bp, Mus musculus
gggcctcaaggtggccttgactgtc

SEQ ID NO: 715060 - DNA, 25 bp, Mus musculus
gggcctcacaagagctcggcaagca

SEQ ID NO: 715061 - DNA, 25 bp, Mus musculus
gggcctcacaagtgctcggcaagca

SEQ ID NO: 715062 - DNA, 25 bp, Mus musculus
gggcctcacagactgctgcctcaag

SEQ ID NO: 715063 - DNA, 25 bp, Mus musculus
gggcctcacagagtgctgcctcaag

SEQ ID NO: 715064 - DNA, 25 bp, Mus musculus
gggcctcaccaaagcagacatcgaa

SEQ ID NO: 715065 - DNA, 25 bp, Mus musculus
gggcctcaccaaagcctggagcatc

SEQ ID NO: 715066 - DNA, 25 bp, Mus musculus
gggcctcaccaatgcagacatcgaa

SEQ ID NO: 715067 - DNA, 25 bp, Mus musculus
gggcctcaccaatgcctggagcatc

SEQ ID NO: 715068 - DNA, 25 bp, Mus musculus
gggcctcactatagacttcagcaca

SEQ ID NO: 715069 - DNA, 25 bp, Mus musculus
gggcctcactattgacttcagcaca

SEQ ID NO: 715070 - DNA, 25 bp, Mus musculus
gggcctcacttgaacccatcttgaa

SEQ ID NO: 715071 - DNA, 25 bp, Mus musculus
gggcctcacttgtacccatcttgaa

SEQ ID NO: 715072 - DNA, 25 bp, Mus musculus
gggcctcaggataaccgcaggttca

SEQ ID NO: 715073 - DNA, 25 bp, Mus musculus
gggcctcaggattaccgcaggttca

SEQ ID NO: 715074 - DNA, 25 bp, Mus musculus
gggcctcattgacattctgacacag

SEQ ID NO: 715075 - DNA, 25 bp, Mus musculus
gggcctcattgagattctgacacag

SEQ ID NO: 715076 - DNA, 25 bp, Mus musculus
gggcctccagctataggctttatag

SEQ ID NO: 715077 - DNA, 25 bp, Mus musculus
gggcctccagctttaggctttatag

SEQ ID NO: 715078 - DNA, 25 bp, Mus musculus
gggcctccataaagttcatgcaaaa

SEQ ID NO: 715079 - DNA, 25 bp, Mus musculus
gggcctccataatgttcatgcaaaa

SEQ ID NO: 715080 - DNA, 25 bp, Mus musculus
gggcctccatctcgactggagccaa

SEQ ID NO: 715081 - DNA, 25 bp, Mus musculus
gggcctccatctggactggagccaa

SEQ ID NO: 715082 - DNA, 25 bp, Mus musculus
gggcctcccagaacagctgaaactc

SEQ ID NO: 715083 - DNA, 25 bp, Mus musculus
gggcctcccagatcagctgaaactc

SEQ ID NO: 715084 - DNA, 25 bp, Mus musculus
gggcctccccaacttgccaattaga

SEQ ID NO: 715085 - DNA, 25 bp, Mus musculus
gggcctccccaagttgccaattaga

SEQ ID NO: 715086 - DNA, 25 bp, Mus musculus
gggcctccggctactgctacgctgt

SEQ ID NO: 715087 - DNA, 25 bp, Mus musculus
gggcctccggcttctgctacgctgt

SEQ ID NO: 715088 - DNA, 25 bp, Mus musculus
gggcctcctacaagacggtcagatt

SEQ ID NO: 715089 - DNA, 25 bp, Mus musculus
gggcctcctacaaggaaacactatg

SEQ ID NO: 715090 - DNA, 25 bp, Mus musculus
gggcctcctacatgacggtcagatt

SEQ ID NO: 715091 - DNA, 25 bp, Mus musculus
gggcctcctacatggaaacactatg

SEQ ID NO: 715092 - DNA, 25 bp, Mus musculus
gggcctcctcagagttccacaagct

SEQ ID NO: 715093 - DNA, 25 bp, Mus musculus
gggcctcctcagtgttccacaagct

SEQ ID NO: 715094 - DNA, 25 bp, Mus musculus
gggcctcctgagactgtaaagaaga

SEQ ID NO: 715095 - DNA, 25 bp, Mus musculus
gggcctcctgagtctgtaaagaaga

SEQ ID NO: 715096 - DNA, 25 bp, Mus musculus
gggcctcctgccagaacaccaatgg

SEQ ID NO: 715097 - DNA, 25 bp, Mus musculus
gggcctcctgcctgaacaccaatgg

SEQ ID NO: 715098 - DNA, 25 bp, Mus musculus
gggcctccttccagcgactggctat

SEQ ID NO: 715099 - DNA, 25 bp, Mus musculus
gggcctccttcctgcgactggctat

SEQ ID NO: 715100 - DNA, 25 bp, Mus musculus
gggcctcgagccatgcgtcagaaga

SEQ ID NO: 715101 - DNA, 25 bp, Mus musculus
gggcctcgagccttgcgtcagaaga

SEQ ID NO: 715102 - DNA, 25 bp, Mus musculus
gggcctcggccaatcgtacatggaa

SEQ ID NO: 715103 - DNA, 25 bp, Mus musculus
gggcctcggccattcgtacatggaa

SEQ ID NO: 715104 - DNA, 25 bp, Mus musculus
gggcctctacagatctgggatgcat

SEQ ID NO: 715105 - DNA, 25 bp, Mus musculus
gggcctctacagttctgggatgcat

SEQ ID NO: 715106 - DNA, 25 bp, Mus musculus
gggcctctagcacatcagatatctg

SEQ ID NO: 715107 - DNA, 25 bp, Mus musculus
gggcctctagcagatcagatatctg

SEQ ID NO: 715108 - DNA, 25 bp, Mus musculus
gggcctctcatacttaatgaaagac

SEQ ID NO: 715109 - DNA, 25 bp, Mus musculus
gggcctctcatagttaatgaaagac

SEQ ID NO: 715110 - DNA, 25 bp, Mus musculus
gggcctctggatcctcaacatggat

SEQ ID NO: 715111 - DNA, 25 bp, Mus musculus
gggcctctggatgctcaacatggat

SEQ ID NO: 715112 - DNA, 25 bp, Mus musculus
gggcctctggccatgaaaatcgctg

SEQ ID NO: 715113 - DNA, 25 bp, Mus musculus
gggcctctggccttgaaaatcgctg

SEQ ID NO: 715114 - DNA, 25 bp, Mus musculus
gggcctctggtgagagctcctgaca

SEQ ID NO: 715115 - DNA, 25 bp, Mus musculus
gggcctctggtgtgagctcctgaca

SEQ ID NO: 715116 - DNA, 25 bp, Mus musculus
gggcctgaatcaatttagtgacttg

SEQ ID NO: 715117 - DNA, 25 bp, Mus musculus
gggcctgaatcattttagtgacttg

SEQ ID NO: 715118 - DNA, 25 bp, Mus musculus
gggcctgacacacagcacctgattc

SEQ ID NO: 715119 - DNA, 25 bp, Mus musculus
gggcctgacacagagcacctgattc

SEQ ID NO: 715120 - DNA, 25 bp, Mus musculus
gggcctgactgcaacgccaaagcct

SEQ ID NO: 715121 - DNA, 25 bp, Mus musculus
gggcctgactgctacgccaaagcct

SEQ ID NO: 715122 - DNA, 25 bp, Mus musculus
gggcctgagcaacaggtaccatatt

SEQ ID NO: 715123 - DNA, 25 bp, Mus musculus
gggcctgagcaagaggtaccatatt

SEQ ID NO: 715124 - DNA, 25 bp, Mus musculus
gggcctgaggcaaggctccatctct

SEQ ID NO: 715125 - DNA, 25 bp, Mus musculus
gggcctgaggcatggctccatctct

SEQ ID NO: 715126 - DNA, 25 bp, Mus musculus
gggcctgaggtacgaaaactgctat

SEQ ID NO: 715127 - DNA, 25 bp, Mus musculus
gggcctgaggtaggaaaactgctat

SEQ ID NO: 715128 - DNA, 25 bp, Mus musculus
gggcctgagtatctgcactgtctgc

SEQ ID NO: 715129 - DNA, 25 bp, Mus musculus
gggcctgagtatgtgcactgtctgc

SEQ ID NO: 715130 - DNA, 25 bp, Mus musculus
gggcctgagtctcgccatctctgac

SEQ ID NO: 715131 - DNA, 25 bp, Mus musculus
gggcctgagtctggccatctctgac

SEQ ID NO: 715132 - DNA, 25 bp, Mus musculus
gggcctgatcaaactgaacgacaca

SEQ ID NO: 715133 - DNA, 25 bp, Mus musculus
gggcctgatcaatctgaacgacaca

SEQ ID NO: 715134 - DNA, 25 bp, Mus musculus
gggcctgatggaagtttactggtaa

SEQ ID NO: 715135 - DNA, 25 bp, Mus musculus
gggcctgatggatgtttactggtaa

SEQ ID NO: 715136 - DNA, 25 bp, Mus musculus
gggcctgatttcatatctcatccgg

SEQ ID NO: 715137 - DNA, 25 bp, Mus musculus
gggcctgatttcttatctcatccgg

SEQ ID NO: 715138 - DNA, 25 bp, Mus musculus
gggcctgcattgaaggtgtagtcct

SEQ ID NO: 715139 - DNA, 25 bp, Mus musculus
gggcctgcattgtaggtgtagtcct

SEQ ID NO: 715140 - DNA, 25 bp, Mus musculus
gggcctgccggtagagaccattaag

SEQ ID NO: 715141 - DNA, 25 bp, Mus musculus
gggcctgccggttgagaccattaag

SEQ ID NO: 715142 - DNA, 25 bp, Mus musculus
gggcctgcctcacacacgtttgact

SEQ ID NO: 715143 - DNA, 25 bp, Mus musculus
gggcctgcctcagacacgtttgact

SEQ ID NO: 715144 - DNA, 25 bp, Mus musculus
gggcctgcctgtccgagcaattctt

SEQ ID NO: 715145 - DNA, 25 bp, Mus musculus
gggcctgcctgtgcgagcaattctt

SEQ ID NO: 715146 - DNA, 25 bp, Mus musculus
gggcctgcgagaacctccagggctc

SEQ ID NO: 715147 - DNA, 25 bp, Mus musculus
gggcctgcgagatcctccagggctc

SEQ ID NO: 715148 - DNA, 25 bp, Mus musculus
gggcctgctcctccaactctgtgga

SEQ ID NO: 715149 - DNA, 25 bp, Mus musculus
gggcctgctcctgcaactctgtgga

SEQ ID NO: 715150 - DNA, 25 bp, Mus musculus
gggcctgctctcaagaaggcagatg

SEQ ID NO: 715151 - DNA, 25 bp, Mus musculus
gggcctgctctctagaaggcagatg

SEQ ID NO: 715152 - DNA, 25 bp, Mus musculus
gggcctggaaaacttgagcatcttg

SEQ ID NO: 715153 - DNA, 25 bp, Mus musculus
gggcctggaaaagttgagcatcttg

SEQ ID NO: 715154 - DNA, 25 bp, Mus musculus
gggcctggctcaccctacttgagaa

SEQ ID NO: 715155 - DNA, 25 bp, Mus musculus
gggcctggctcacgctgtaaacgct

SEQ ID NO: 715156 - DNA, 25 bp, Mus musculus
gggcctggctcagcctacttgagaa

SEQ ID NO: 715157 - DNA, 25 bp, Mus musculus
gggcctggctcaggctgtaaacgct

SEQ ID NO: 715158 - DNA, 25 bp, Mus musculus
gggcctgggccaccacgcattttgc

SEQ ID NO: 715159 - DNA, 25 bp, Mus musculus
gggcctgggccagcacgcattttgc

SEQ ID NO: 715160 - DNA, 25 bp, Mus musculus
gggcctggttcccactcatgcctat

SEQ ID NO: 715161 - DNA, 25 bp, Mus musculus
gggcctggttccgactcatgcctat

SEQ ID NO: 715162 - DNA, 25 bp, Mus musculus
gggcctgtccctcaattggtacgaa

SEQ ID NO: 715163 - DNA, 25 bp, Mus musculus
gggcctgtccctgaattggtacgaa

SEQ ID NO: 715164 - DNA, 25 bp, Mus musculus
gggcctgttctgcatattgactggt

SEQ ID NO: 715165 - DNA, 25 bp, Mus musculus
gggcctgttctggatattgactggt

SEQ ID NO: 715166 - DNA, 25 bp, Mus musculus
gggccttaaccgacaaggtcactga

SEQ ID NO: 715167 - DNA, 25 bp, Mus musculus
gggccttaaccgtcaaggtcactga

SEQ ID NO: 715168 - DNA, 25 bp, Mus musculus
gggccttaatgaccaccatagggag

SEQ ID NO: 715169 - DNA, 25 bp, Mus musculus
gggccttaatgagcaccatagggag

SEQ ID NO: 715170 - DNA, 25 bp, Mus musculus
gggccttaggctattcctacctgga

SEQ ID NO: 715171 - DNA, 25 bp, Mus musculus
gggccttaggcttttcctacctgga

SEQ ID NO: 715172 - DNA, 25 bp, Mus musculus
gggccttatagaaacccgactcctg

SEQ ID NO: 715173 - DNA, 25 bp, Mus musculus
gggccttatagatacccgactcctg

SEQ ID NO: 715174 - DNA, 25 bp, Mus musculus
gggccttatcttcactgtgaacaat

SEQ ID NO: 715175 - DNA, 25 bp, Mus musculus
gggccttatcttgactgtgaacaat

SEQ ID NO: 715176 - DNA, 25 bp, Mus musculus
gggccttcaagacttcccacaatct

SEQ ID NO: 715177 - DNA, 25 bp, Mus musculus
gggccttcaagagttcccacaatct

SEQ ID NO: 715178 - DNA, 25 bp, Mus musculus
gggccttcaccaataccctaagaag

SEQ ID NO: 715179 - DNA, 25 bp, Mus musculus
gggccttcaccattaccctaagaag

SEQ ID NO: 715180 - DNA, 25 bp, Mus musculus
gggccttcacgtactatggagtgtc

SEQ ID NO: 715181 - DNA, 25 bp, Mus musculus
gggccttcacgttctatggagtgtc

SEQ ID NO: 715182 - DNA, 25 bp, Mus musculus
gggccttcagatacttatgtgaatc

SEQ ID NO: 715183 - DNA, 25 bp, Mus musculus
gggccttcagattcttatgtgaatc

SEQ ID NO: 715184 - DNA, 25 bp, Mus musculus
gggccttccaaaatcctctgatgat

SEQ ID NO: 715185 - DNA, 25 bp, Mus musculus
gggccttccaaattcctctgatgat

SEQ ID NO: 715186 - DNA, 25 bp, Mus musculus
gggccttccccacggagcagatcaa

SEQ ID NO: 715187 - DNA, 25 bp, Mus musculus
gggccttccccagggagcagatcaa

SEQ ID NO: 715188 - DNA, 25 bp, Mus musculus
gggccttcctagctatgcagaccga

SEQ ID NO: 715189 - DNA, 25 bp, Mus musculus
gggccttcctaggtatgcagaccga

SEQ ID NO: 715190 - DNA, 25 bp, Mus musculus
gggccttcctgaactcctgcatgtt

SEQ ID NO: 715191 - DNA, 25 bp, Mus musculus
gggccttcctgatctcctgcatgtt

SEQ ID NO: 715192 - DNA, 25 bp, Mus musculus
gggccttcctgtccggaaccttcat

SEQ ID NO: 715193 - DNA, 25 bp, Mus musculus
gggccttcctgtgcggaaccttcat

SEQ ID NO: 715194 - DNA, 25 bp, Mus musculus
gggccttcgtgcaagtgcattcaag

SEQ ID NO: 715195 - DNA, 25 bp, Mus musculus
gggccttcgtgctagtgcattcaag

SEQ ID NO: 715196 - DNA, 25 bp, Mus musculus
gggccttctaccccttcatgcggaa

SEQ ID NO: 715197 - DNA, 25 bp, Mus musculus
gggccttctaccgcttcatgcggaa

SEQ ID NO: 715198 - DNA, 25 bp, Mus musculus
gggccttctgaaccagccaagctca

SEQ ID NO: 715199 - DNA, 25 bp, Mus musculus
gggccttctgaagcagccaagctca

SEQ ID NO: 715200 - DNA, 25 bp, Mus musculus
gggccttctggaattggtgagcaca

SEQ ID NO: 715201 - DNA, 25 bp, Mus musculus
gggccttctggatttggtgagcaca

SEQ ID NO: 715202 - DNA, 25 bp, Mus musculus
gggccttgagcgcacttcattttta

SEQ ID NO: 715203 - DNA, 25 bp, Mus musculus
gggccttgagcggacttcattttta

SEQ ID NO: 715204 - DNA, 25 bp, Mus musculus
gggccttgcggcacgctgtctcatc

SEQ ID NO: 715205 - DNA, 25 bp, Mus musculus
gggccttgcggctcgctgtctcatc

SEQ ID NO: 715206 - DNA, 25 bp, Mus musculus
gggccttggcctaccttctactggc

SEQ ID NO: 715207 - DNA, 25 bp, Mus musculus
gggccttggccttccttctactggc

SEQ ID NO: 715208 - DNA, 25 bp, Mus musculus
gggcctttccgaacctgtactccag

SEQ ID NO: 715209 - DNA, 25 bp, Mus musculus
gggcctttccgatcctgtactccag

SEQ ID NO: 715210 - DNA, 25 bp, Mus musculus
gggcctttgtagaggctgtcaagca

SEQ ID NO: 715211 - DNA, 25 bp, Mus musculus
gggcctttgtagtggctgtcaagca

SEQ ID NO: 715212 - DNA, 25 bp, Mus musculus
gggccttttggacagcccctgcatg

SEQ ID NO: 715213 - DNA, 25 bp, Mus musculus
gggccttttggagagcccctgcatg

SEQ ID NO: 715214 - DNA, 25 bp, Mus musculus
gggcgaatcatcaactccagggtcc

SEQ ID NO: 715215 - DNA, 25 bp, Mus musculus
gggcgaatcatctactccagggtcc

SEQ ID NO: 715216 - DNA, 25 bp, Mus musculus
gggcgaatccccatccgcctggaga

SEQ ID NO: 715217 - DNA, 25 bp, Mus musculus
gggcgaatccccttccgcctggaga

SEQ ID NO: 715218 - DNA, 25 bp, Mus musculus
gggcgacacccaagttatacgtgaa

SEQ ID NO: 715219 - DNA, 25 bp, Mus musculus
gggcgacacccatgttatacgtgaa

SEQ ID NO: 715220 - DNA, 25 bp, Mus musculus
gggcgacatcaaagcagcaatcgaa

SEQ ID NO: 715221 - DNA, 25 bp, Mus musculus
gggcgacatcaatgcagcaatcgaa

SEQ ID NO: 715222 - DNA, 25 bp, Mus musculus
gggcgacattcgacatgaacgcggc

SEQ ID NO: 715223 - DNA, 25 bp, Mus musculus
gggcgacattcgtcatgaacgcggc

SEQ ID NO: 715224 - DNA, 25 bp, Mus musculus
gggcgacgtcctcatcgacattggc

SEQ ID NO: 715225 - DNA, 25 bp, Mus musculus
gggcgacgtcctgatcgacattggc

SEQ ID NO: 715226 - DNA, 25 bp, Mus musculus
gggcgagatgttccttatgcttttg

SEQ ID NO: 715227 - DNA, 25 bp, Mus musculus
gggcgagatgttgcttatgcttttg

SEQ ID NO: 715228 - DNA, 25 bp, Mus musculus
gggcgagccagcaaaaatagaaaaa

SEQ ID NO: 715229 - DNA, 25 bp, Mus musculus
gggcgagccagctaaaatagaaaaa

SEQ ID NO: 715230 - DNA, 25 bp, Mus musculus
gggcgagtacctctgtcgagccacc

SEQ ID NO: 715231 - DNA, 25 bp, Mus musculus
gggcgagtacctgtgtcgagccacc

SEQ ID NO: 715232 - DNA, 25 bp, Mus musculus
gggcgatcagctcatctggactcag

SEQ ID NO: 715233 - DNA, 25 bp, Mus musculus
gggcgatcagctgatctggactcag

SEQ ID NO: 715234 - DNA, 25 bp, Mus musculus
gggcgatgctggattctacacatgc

SEQ ID NO: 715235 - DNA, 25 bp, Mus musculus
gggcgatgctggtttctacacatgc

SEQ ID NO: 715236 - DNA, 25 bp, Mus musculus
gggcgatggtgtactccccacggac

SEQ ID NO: 715237 - DNA, 25 bp, Mus musculus
gggcgatggtgttctccccacggac

SEQ ID NO: 715238 - DNA, 25 bp, Mus musculus
gggcgatgtaccaaagcctggccat

SEQ ID NO: 715239 - DNA, 25 bp, Mus musculus
gggcgatgtacctaagcctggccat

SEQ ID NO: 715240 - DNA, 25 bp, Mus musculus
gggcgattgctgcaatgctgtctac

SEQ ID NO: 715241 - DNA, 25 bp, Mus musculus
gggcgattgctggaatgctgtctac

SEQ ID NO: 715242 - DNA, 25 bp, Mus musculus
gggcgattgtttatcatttccacta

SEQ ID NO: 715243 - DNA, 25 bp, Mus musculus
gggcgattgtttttcatttccacta

SEQ ID NO: 715244 - DNA, 25 bp, Mus musculus
gggcgcacatctccagactctttag

SEQ ID NO: 715245 - DNA, 25 bp, Mus musculus
gggcgcacatctgcagactctttag

SEQ ID NO: 715246 - DNA, 25 bp, Mus musculus
gggcgcagggcacaaccagtgcctg

SEQ ID NO: 715247 - DNA, 25 bp, Mus musculus
gggcgcagggcagaaccagtgcctg

SEQ ID NO: 715248 - DNA, 25 bp, Mus musculus
gggcgcagtaccagcctcagcgacg

SEQ ID NO: 715249 - DNA, 25 bp, Mus musculus
gggcgcagtacctgcctcagcgacg

SEQ ID NO: 715250 - DNA, 25 bp, Mus musculus
gggcgccacgctacagactctgctt

SEQ ID NO: 715251 - DNA, 25 bp, Mus musculus
gggcgccacgcttcagactctgctt

SEQ ID NO: 715252 - DNA, 25 bp, Mus musculus
gggcgccattacagccgtgagaaca

SEQ ID NO: 715253 - DNA, 25 bp, Mus musculus
gggcgccattactgccgtgagaaca

SEQ ID NO: 715254 - DNA, 25 bp, Mus musculus
gggcgccccgaaagtacatgttcca

SEQ ID NO: 715255 - DNA, 25 bp, Mus musculus
gggcgccccgaatgtacatgttcca

SEQ ID NO: 715256 - DNA, 25 bp, Mus musculus
gggcgcctacctaggtggtattgta

SEQ ID NO: 715257 - DNA, 25 bp, Mus musculus
gggcgcctaccttggtggtattgta

SEQ ID NO: 715258 - DNA, 25 bp, Mus musculus
gggcgcctgcgtaccttgcagcacg

SEQ ID NO: 715259 - DNA, 25 bp, Mus musculus
gggcgcctgcgttccttgcagcacg

SEQ ID NO: 715260 - DNA, 25 bp, Mus musculus
gggcgcctgtcaagaacacatggtt

SEQ ID NO: 715261 - DNA, 25 bp, Mus musculus
gggcgcctgtcatgaacacatggtt

SEQ ID NO: 715262 - DNA, 25 bp, Mus musculus
gggcgcgctaaaaatgtgagatgcc

SEQ ID NO: 715263 - DNA, 25 bp, Mus musculus
gggcgcgctaaatatgtgagatgcc

SEQ ID NO: 715264 - DNA, 25 bp, Mus musculus
gggcgcggagccaaagaccctcgca

SEQ ID NO: 715265 - DNA, 25 bp, Mus musculus
gggcgcggagcctaagaccctcgca

SEQ ID NO: 715266 - DNA, 25 bp, Mus musculus
gggcgctacagaatatcaccgcggg

SEQ ID NO: 715267 - DNA, 25 bp, Mus musculus
gggcgctacagattatcaccgcggg

SEQ ID NO: 715268 - DNA, 25 bp, Mus musculus
gggcgctacgagcaactctgcattg

SEQ ID NO: 715269 - DNA, 25 bp, Mus musculus
gggcgctacgaggaactctgcattg

SEQ ID NO: 715270 - DNA, 25 bp, Mus musculus
gggcgctccagccattgagaacgaa

SEQ ID NO: 715271 - DNA, 25 bp, Mus musculus
gggcgctccagcgattgagaacgaa

SEQ ID NO: 715272 - DNA, 25 bp, Mus musculus
gggcgctcctagagcagccttcctg

SEQ ID NO: 715273 - DNA, 25 bp, Mus musculus
gggcgctcctagtgcagccttcctg

SEQ ID NO: 715274 - DNA, 25 bp, Mus musculus
gggcgctcgtctatgacattggctc

SEQ ID NO: 715275 - DNA, 25 bp, Mus musculus
gggcgctcgtctttgacattggctc

SEQ ID NO: 715276 - DNA, 25 bp, Mus musculus
gggcgctcttctctttggccaaccg

SEQ ID NO: 715277 - DNA, 25 bp, Mus musculus
gggcgctcttctgtttggccaaccg

SEQ ID NO: 715278 - DNA, 25 bp, Mus musculus
gggcgctgacgcatgcttgcgcaca

SEQ ID NO: 715279 - DNA, 25 bp, Mus musculus
gggcgctgacgcttgcttgcgcaca

SEQ ID NO: 715280 - DNA, 25 bp, Mus musculus
gggcgctgttccaagagtgcacgtc

SEQ ID NO: 715281 - DNA, 25 bp, Mus musculus
gggcgctgttcctagagtgcacgtc

SEQ ID NO: 715282 - DNA, 25 bp, Mus musculus
gggcgctttgttcaattctactact

SEQ ID NO: 715283 - DNA, 25 bp, Mus musculus
gggcgctttgttcgctaccagttca

SEQ ID NO: 715284 - DNA, 25 bp, Mus musculus
gggcgctttgttgaattctactact

SEQ ID NO: 715285 - DNA, 25 bp, Mus musculus
gggcgctttgttggctaccagttca

SEQ ID NO: 715286 - DNA, 25 bp, Mus musculus
gggcggaacatcactagaattaagc

SEQ ID NO: 715287 - DNA, 25 bp, Mus musculus
gggcggaacatctctagaattaagc

SEQ ID NO: 715288 - DNA, 25 bp, Mus musculus
gggcggaagtctacagctagccgac

SEQ ID NO: 715289 - DNA, 25 bp, Mus musculus
gggcggaagtcttcagctagccgac

SEQ ID NO: 715290 - DNA, 25 bp, Mus musculus
gggcggaatcccacaacttctgaga

SEQ ID NO: 715291 - DNA, 25 bp, Mus musculus
gggcggaatccctcaacttctgaga

SEQ ID NO: 715292 - DNA, 25 bp, Mus musculus
gggcggacattgcattcattcgtga

SEQ ID NO: 715293 - DNA, 25 bp, Mus musculus
gggcggacattggattcattcgtga

SEQ ID NO: 715294 - DNA, 25 bp, Mus musculus
gggcggacccagcatatgaaatgac

SEQ ID NO: 715295 - DNA, 25 bp, Mus musculus
gggcggacccaggatatgaaatgac

SEQ ID NO: 715296 - DNA, 25 bp, Mus musculus
gggcggactgaaaaatgcctcaagg

SEQ ID NO: 715297 - DNA, 25 bp, Mus musculus
gggcggactgaataatgcctcaagg

SEQ ID NO: 715298 - DNA, 25 bp, Mus musculus
gggcggactgagacaatcctgcaga

SEQ ID NO: 715299 - DNA, 25 bp, Mus musculus
gggcggactgagtcaatcctgcaga

SEQ ID NO: 715300 - DNA, 25 bp, Mus musculus
gggcggagagaccaagtcccaccca

SEQ ID NO: 715301 - DNA, 25 bp, Mus musculus
gggcggagagacgaagtcccaccca

SEQ ID NO: 715302 - DNA, 25 bp, Mus musculus
gggcggaggcttcaagacaccatct

SEQ ID NO: 715303 - DNA, 25 bp, Mus musculus
gggcggaggcttgaagacaccatct

SEQ ID NO: 715304 - DNA, 25 bp, Mus musculus
gggcggattccacaacatcgcctgt

SEQ ID NO: 715305 - DNA, 25 bp, Mus musculus
gggcggattccagaacatcgcctgt

SEQ ID NO: 715306 - DNA, 25 bp, Mus musculus
gggcggcaacccactgaaaaactct

SEQ ID NO: 715307 - DNA, 25 bp, Mus musculus
gggcggcaaccctctgaaaaactct

SEQ ID NO: 715308 - DNA, 25 bp, Mus musculus
gggcggcagatcaacgatcccaagt

SEQ ID NO: 715309 - DNA, 25 bp, Mus musculus
gggcggcagatctacgatcccaagt

SEQ ID NO: 715310 - DNA, 25 bp, Mus musculus
gggcggcccatcatatctgccagcg

SEQ ID NO: 715311 - DNA, 25 bp, Mus musculus
gggcggcccatcttatctgccagcg

SEQ ID NO: 715312 - DNA, 25 bp, Mus musculus
gggcggcctcgcagaactacttaaa

SEQ ID NO: 715313 - DNA, 25 bp, Mus musculus
gggcggcctcgctgaactacttaaa

SEQ ID NO: 715314 - DNA, 25 bp, Mus musculus
gggcggcgttccaccaacgcgcagt

SEQ ID NO: 715315 - DNA, 25 bp, Mus musculus
gggcggcgttcctccaacgcgcagt

SEQ ID NO: 715316 - DNA, 25 bp, Mus musculus
gggcggctcgccattactactactt

SEQ ID NO: 715317 - DNA, 25 bp, Mus musculus
gggcggctcgcctttactactactt

SEQ ID NO: 715318 - DNA, 25 bp, Mus musculus
gggcgggccaatcattctaagtatg

SEQ ID NO: 715319 - DNA, 25 bp, Mus musculus
gggcgggccaatgattctaagtatg

SEQ ID NO: 715320 - DNA, 25 bp, Mus musculus
gggcgggcgctaaggccaccaacta

SEQ ID NO: 715321 - DNA, 25 bp, Mus musculus
gggcgggcgctatggccaccaacta

SEQ ID NO: 715322 - DNA, 25 bp, Mus musculus
gggcgggctccaatccggttccatc

SEQ ID NO: 715323 - DNA, 25 bp, Mus musculus
gggcgggctccattccggttccatc

SEQ ID NO: 715324 - DNA, 25 bp, Mus musculus
gggcgggttgacagcagcagcggca

SEQ ID NO: 715325 - DNA, 25 bp, Mus musculus
gggcgggttgactgcagcagcggca

SEQ ID NO: 715326 - DNA, 25 bp, Mus musculus
gggcggtcggtgcatgcgcagagcc

SEQ ID NO: 715327 - DNA, 25 bp, Mus musculus
gggcggtcggtggatgcgcagagcc

SEQ ID NO: 715328 - DNA, 25 bp, Mus musculus
gggcggttctccatcctctctgaag

SEQ ID NO: 715329 - DNA, 25 bp, Mus musculus
gggcggttctccttcctctctgaag

SEQ ID NO: 715330 - DNA, 25 bp, Mus musculus
gggcgtaccagaagacggacatcga

SEQ ID NO: 715331 - DNA, 25 bp, Mus musculus
gggcgtaccagatgacggacatcga

SEQ ID NO: 715332 - DNA, 25 bp, Mus musculus
gggcgtacttgtctgcaacaatcaa

SEQ ID NO: 715333 - DNA, 25 bp, Mus musculus
gggcgtacttgtgtgcaacaatcaa

SEQ ID NO: 715334 - DNA, 25 bp, Mus musculus
gggcgtagatctcctaaaatttgat

SEQ ID NO: 715335 - DNA, 25 bp, Mus musculus
gggcgtagatctgctaaaatttgat

SEQ ID NO: 715336 - DNA, 25 bp, Mus musculus
gggcgtaggttcagtgaccgctctc

SEQ ID NO: 715337 - DNA, 25 bp, Mus musculus
gggcgtaggttctgtgaccgctctc

SEQ ID NO: 715338 - DNA, 25 bp, Mus musculus
gggcgtcggcaaaacctgtttcctg

SEQ ID NO: 715339 - DNA, 25 bp, Mus musculus
gggcgtcggcaatacctgtttcctg

SEQ ID NO: 715340 - DNA, 25 bp, Mus musculus
gggcgtcgtcgtccgatcccaactt

SEQ ID NO: 715341 - DNA, 25 bp, Mus musculus
gggcgtcgtcgtgcgatcccaactt

SEQ ID NO: 715342 - DNA, 25 bp, Mus musculus
gggcgtgatcctattcatgctggtg

SEQ ID NO: 715343 - DNA, 25 bp, Mus musculus
gggcgtgatccttttcatgctggtg

SEQ ID NO: 715344 - DNA, 25 bp, Mus musculus
gggcgtgcattcaccgatccatttg

SEQ ID NO: 715345 - DNA, 25 bp, Mus musculus
gggcgtgcattctccgatccatttg

SEQ ID NO: 715346 - DNA, 25 bp, Mus musculus
gggcgtgctccacacgattttgtct

SEQ ID NO: 715347 - DNA, 25 bp, Mus musculus
gggcgtgctccagacgattttgtct

SEQ ID NO: 715348 - DNA, 25 bp, Mus musculus
gggcgtgtgaacaatggcagattca

SEQ ID NO: 715349 - DNA, 25 bp, Mus musculus
gggcgtgtgaactatggcagattca

SEQ ID NO: 715350 - DNA, 25 bp, Mus musculus
gggcgtgttatcatgcagatcatca

SEQ ID NO: 715351 - DNA, 25 bp, Mus musculus
gggcgtgttatcttgcagatcatca

SEQ ID NO: 715352 - DNA, 25 bp, Mus musculus
gggcgtttcatcaccagggttgtga

SEQ ID NO: 715353 - DNA, 25 bp, Mus musculus
gggcgtttcatctccagggttgtga

SEQ ID NO: 715354 - DNA, 25 bp, Mus musculus
gggctaacccagacaacgtgaccct

SEQ ID NO: 715355 - DNA, 25 bp, Mus musculus
gggctaacccagatgcgaaggacca

SEQ ID NO: 715356 - DNA, 25 bp, Mus musculus
gggctaacccagtcaacgtgaccct

SEQ ID NO: 715357 - DNA, 25 bp, Mus musculus
gggctaacccagttgcgaaggacca

SEQ ID NO: 715358 - DNA, 25 bp, Mus musculus
gggctaacccttatgctcgtaaccg

SEQ ID NO: 715359 - DNA, 25 bp, Mus musculus
gggctaacccttttgctcgtaaccg

SEQ ID NO: 715360 - DNA, 25 bp, Mus musculus
gggctaacctgaacctcagaaatgc

SEQ ID NO: 715361 - DNA, 25 bp, Mus musculus
gggctaacctgatcctcagaaatgc

SEQ ID NO: 715362 - DNA, 25 bp, Mus musculus
gggctaactaccagccggagagtga

SEQ ID NO: 715363 - DNA, 25 bp, Mus musculus
gggctaactacctgccggagagtga

SEQ ID NO: 715364 - DNA, 25 bp, Mus musculus
gggctaagagtaaggcatttttctg

SEQ ID NO: 715365 - DNA, 25 bp, Mus musculus
gggctaagagtatggcatttttctg

SEQ ID NO: 715366 - DNA, 25 bp, Mus musculus
gggctaatctcaacatccctgtctc

SEQ ID NO: 715367 - DNA, 25 bp, Mus musculus
gggctaatctcatcatccctgtctc

SEQ ID NO: 715368 - DNA, 25 bp, Mus musculus
gggctaattggacctgtaaaacacc

SEQ ID NO: 715369 - DNA, 25 bp, Mus musculus
gggctaattggagctgtaaaacacc

SEQ ID NO: 715370 - DNA, 25 bp, Mus musculus
gggctacaaaaaagagtcggtacaa

SEQ ID NO: 715371 - DNA, 25 bp, Mus musculus
gggctacaaaaatgagtcggtacaa

SEQ ID NO: 715372 - DNA, 25 bp, Mus musculus
gggctacaacataaactatacaccc

SEQ ID NO: 715373 - DNA, 25 bp, Mus musculus
gggctacaacattaactatacaccc

SEQ ID NO: 715374 - DNA, 25 bp, Mus musculus
gggctacaagcccttcgtctgcgag

SEQ ID NO: 715375 - DNA, 25 bp, Mus musculus
gggctacaagccgttcgtctgcgag

SEQ ID NO: 715376 - DNA, 25 bp, Mus musculus
gggctacacatacaacggacccacg

SEQ ID NO: 715377 - DNA, 25 bp, Mus musculus
gggctacacatagaacggacccacg

SEQ ID NO: 715378 - DNA, 25 bp, Mus musculus
gggctacagtgtatctctgatgtct

SEQ ID NO: 715379 - DNA, 25 bp, Mus musculus
gggctacagtgtttctctgatgtct

SEQ ID NO: 715380 - DNA, 25 bp, Mus musculus
gggctaccagccctacaatatgcag

SEQ ID NO: 715381 - DNA, 25 bp, Mus musculus
gggctaccagccgtacaatatgcag

SEQ ID NO: 715382 - DNA, 25 bp, Mus musculus
gggctaccatacctttgtctgtgga

SEQ ID NO: 715383 - DNA, 25 bp, Mus musculus
gggctaccatacgtttgtctgtgga

SEQ ID NO: 715384 - DNA, 25 bp, Mus musculus
gggctaccgtgtcgcctaaccgtga

SEQ ID NO: 715385 - DNA, 25 bp, Mus musculus
gggctaccgtgtggcctaaccgtga

SEQ ID NO: 715386 - DNA, 25 bp, Mus musculus
gggctacctacaccatgtcaccggg

SEQ ID NO: 715387 - DNA, 25 bp, Mus musculus
gggctacctacagcatgtcaccggg

SEQ ID NO: 715388 - DNA, 25 bp, Mus musculus
gggctacctcaactgatggtatact

SEQ ID NO: 715389 - DNA, 25 bp, Mus musculus
gggctacctcaagtgatggtatact

SEQ ID NO: 715390 - DNA, 25 bp, Mus musculus
gggctacctgcacagacaggcctac

SEQ ID NO: 715391 - DNA, 25 bp, Mus musculus
gggctacctgcagagacaggcctac

SEQ ID NO: 715392 - DNA, 25 bp, Mus musculus
gggctacgacttctcaagatgtcaa

SEQ ID NO: 715393 - DNA, 25 bp, Mus musculus
gggctacgacttgtcaagatgtcaa

SEQ ID NO: 715394 - DNA, 25 bp, Mus musculus
gggctacgggttcaacctgcatagt

SEQ ID NO: 715395 - DNA, 25 bp, Mus musculus
gggctacgggttgaacctgcatagt

SEQ ID NO: 715396 - DNA, 25 bp, Mus musculus
gggctacgtgacactcctagaagaa

SEQ ID NO: 715397 - DNA, 25 bp, Mus musculus
gggctacgtgactctcctagaagaa

SEQ ID NO: 715398 - DNA, 25 bp, Mus musculus
gggctacgttctccaccagaacaag

SEQ ID NO: 715399 - DNA, 25 bp, Mus musculus
gggctacgttctgcaccagaacaag

SEQ ID NO: 715400 - DNA, 25 bp, Mus musculus
gggctactacttctctggcaactgt

SEQ ID NO: 715401 - DNA, 25 bp, Mus musculus
gggctactacttgtctggcaactgt

SEQ ID NO: 715402 - DNA, 25 bp, Mus musculus
gggctactcaccagaagatgtcatc

SEQ ID NO: 715403 - DNA, 25 bp, Mus musculus
gggctactcacctgaagatgtcatc

SEQ ID NO: 715404 - DNA, 25 bp, Mus musculus
gggctactgcatccccaacaaggac

SEQ ID NO: 715405 - DNA, 25 bp, Mus musculus
gggctactgcatgcccaacaaggac

SEQ ID NO: 715406 - DNA, 25 bp, Mus musculus
gggctactggtcaaccagggcaaag

SEQ ID NO: 715407 - DNA, 25 bp, Mus musculus
gggctactggtctaccagggcaaag

SEQ ID NO: 715408 - DNA, 25 bp, Mus musculus
gggctacttaatcagttactagaaa

SEQ ID NO: 715409 - DNA, 25 bp, Mus musculus
gggctacttaatgagttactagaaa

SEQ ID NO: 715410 - DNA, 25 bp, Mus musculus
gggctactttctcgagtccagcgag

SEQ ID NO: 715411 - DNA, 25 bp, Mus musculus
gggctactttctggagtccagcgag

SEQ ID NO: 715412 - DNA, 25 bp, Mus musculus
gggctagaattgagcctccagaaca

SEQ ID NO: 715413 - DNA, 25 bp, Mus musculus
gggctagaattgtgcctccagaaca

SEQ ID NO: 715414 - DNA, 25 bp, Mus musculus
gggctagactggcaaccacctctta

SEQ ID NO: 715415 - DNA, 25 bp, Mus musculus
gggctagactgggaaccacctctta

SEQ ID NO: 715416 - DNA, 25 bp, Mus musculus
gggctagcatagacctaaaatgaga

SEQ ID NO: 715417 - DNA, 25 bp, Mus musculus
gggctagcatagtcctaaaatgaga

SEQ ID NO: 715418 - DNA, 25 bp, Mus musculus
gggctagccaacaccttaccaggtt

SEQ ID NO: 715419 - DNA, 25 bp, Mus musculus
gggctagccaactccttaccaggtt

SEQ ID NO: 715420 - DNA, 25 bp, Mus musculus
gggctagccaggagtctccatcaga

SEQ ID NO: 715421 - DNA, 25 bp, Mus musculus
gggctagccaggtgtctccatcaga

SEQ ID NO: 715422 - DNA, 25 bp, Mus musculus
gggctagcccctagcatgtggatct

SEQ ID NO: 715423 - DNA, 25 bp, Mus musculus
gggctagccccttgcatgtggatct

SEQ ID NO: 715424 - DNA, 25 bp, Mus musculus
gggctagcctaacccctggcttaca

SEQ ID NO: 715425 - DNA, 25 bp, Mus musculus
gggctagcctaagccctggcttaca

SEQ ID NO: 715426 - DNA, 25 bp, Mus musculus
gggctaggaatgagaatctacagtg

SEQ ID NO: 715427 - DNA, 25 bp, Mus musculus
gggctaggaatgtgaatctacagtg

SEQ ID NO: 715428 - DNA, 25 bp, Mus musculus
gggctaggctgtcccttccagcaaa

SEQ ID NO: 715429 - DNA, 25 bp, Mus musculus
gggctaggctgtgccttccagcaaa

SEQ ID NO: 715430 - DNA, 25 bp, Mus musculus
gggctagtcaccactgctggtcgga

SEQ ID NO: 715431 - DNA, 25 bp, Mus musculus
gggctagtcacctctgctggtcgga

SEQ ID NO: 715432 - DNA, 25 bp, Mus musculus
gggctagtgggtaaattctcttgct

SEQ ID NO: 715433 - DNA, 25 bp, Mus musculus
gggctagtgggttaattctcttgct

SEQ ID NO: 715434 - DNA, 25 bp, Mus musculus
gggctataatgccttacggcgcatg

SEQ ID NO: 715435 - DNA, 25 bp, Mus musculus
gggctataatgcgttacggcgcatg

SEQ ID NO: 715436 - DNA, 25 bp, Mus musculus
gggctatactggagatatttattcc

SEQ ID NO: 715437 - DNA, 25 bp, Mus musculus
gggctatactggtgatatttattcc

SEQ ID NO: 715438 - DNA, 25 bp, Mus musculus
gggctatatcctcaacgcacatagg

SEQ ID NO: 715439 - DNA, 25 bp, Mus musculus
gggctatatcctgaacgcacatagg

SEQ ID NO: 715440 - DNA, 25 bp, Mus musculus
gggctatccctgcaaccatgtcatg

SEQ ID NO: 715441 - DNA, 25 bp, Mus musculus
gggctatccctggaaccatgtcatg

SEQ ID NO: 715442 - DNA, 25 bp, Mus musculus
gggctatctaataggcgaccttcag

SEQ ID NO: 715443 - DNA, 25 bp, Mus musculus
gggctatctaattggcgaccttcag

SEQ ID NO: 715444 - DNA, 25 bp, Mus musculus
gggctatgagaacggccagccagat

SEQ ID NO: 715445 - DNA, 25 bp, Mus musculus
gggctatgagaagggccagccagat

SEQ ID NO: 715446 - DNA, 25 bp, Mus musculus
gggctatgcagcagtcactgacgca

SEQ ID NO: 715447 - DNA, 25 bp, Mus musculus
gggctatgcagctgtcactgacgca

SEQ ID NO: 715448 - DNA, 25 bp, Mus musculus
gggctatgccttacctttgcctcag

SEQ ID NO: 715449 - DNA, 25 bp, Mus musculus
gggctatgcctttcctttgcctcag

SEQ ID NO: 715450 - DNA, 25 bp, Mus musculus
gggctatggattagtacactttgaa

SEQ ID NO: 715451 - DNA, 25 bp, Mus musculus
gggctatggatttgtacactttgaa

SEQ ID NO: 715452 - DNA, 25 bp, Mus musculus
gggctatggcttagtcagcttcaaa

SEQ ID NO: 715453 - DNA, 25 bp, Mus musculus
gggctatggctttgtcagcttcaaa

SEQ ID NO: 715454 - DNA, 25 bp, Mus musculus
gggctatgtaccctataatatcctg

SEQ ID NO: 715455 - DNA, 25 bp, Mus musculus
gggctatgtaccgtataatatcctg

SEQ ID NO: 715456 - DNA, 25 bp, Mus musculus
gggctattcaccaattgtccaacca

SEQ ID NO: 715457 - DNA, 25 bp, Mus musculus
gggctattcacctattgtccaacca

SEQ ID NO: 715458 - DNA, 25 bp, Mus musculus
gggctattgatgacacatggcttca

SEQ ID NO: 715459 - DNA, 25 bp, Mus musculus
gggctattgatgtcacatggcttca

SEQ ID NO: 715460 - DNA, 25 bp, Mus musculus
gggctatttgatcgtgccaccttag

SEQ ID NO: 715461 - DNA, 25 bp, Mus musculus
gggctatttgatggtgccaccttag

SEQ ID NO: 715462 - DNA, 25 bp, Mus musculus
gggctcaacgccaccatcgtggctg

SEQ ID NO: 715463 - DNA, 25 bp, Mus musculus
gggctcaacgcctccatcgtggctg

SEQ ID NO: 715464 - DNA, 25 bp, Mus musculus
gggctcaacttgaggtcatcaagag

SEQ ID NO: 715465 - DNA, 25 bp, Mus musculus
gggctcaacttgtggtcatcaagag

SEQ ID NO: 715466 - DNA, 25 bp, Mus musculus
gggctcaagctcagagccatttgaa

SEQ ID NO: 715467 - DNA, 25 bp, Mus musculus
gggctcaagctctgagccatttgaa

SEQ ID NO: 715468 - DNA, 25 bp, Mus musculus
gggctcacaagtcattctttgtcca

SEQ ID NO: 715469 - DNA, 25 bp, Mus musculus
gggctcacaagtgattctttgtcca

SEQ ID NO: 715470 - DNA, 25 bp, Mus musculus
gggctcacacctaccagtctgttaa

SEQ ID NO: 715471 - DNA, 25 bp, Mus musculus
gggctcacaccttccagtctgttaa

SEQ ID NO: 715472 - DNA, 25 bp, Mus musculus
gggctcacatcacaactgcttcagt

SEQ ID NO: 715473 - DNA, 25 bp, Mus musculus
gggctcacatcagaactgcttcagt

SEQ ID NO: 715474 - DNA, 25 bp, Mus musculus
gggctcaccatcattcctcactttg

SEQ ID NO: 715475 - DNA, 25 bp, Mus musculus
gggctcaccatctttcctcactttg

SEQ ID NO: 715476 - DNA, 25 bp, Mus musculus
gggctcacgagcagacgcacgccat

SEQ ID NO: 715477 - DNA, 25 bp, Mus musculus
gggctcacgagctgacgcacgccat

SEQ ID NO: 715478 - DNA, 25 bp, Mus musculus
gggctcacggcaacaggaccagagc

SEQ ID NO: 715479 - DNA, 25 bp, Mus musculus
gggctcacggcatcaggaccagagc

SEQ ID NO: 715480 - DNA, 25 bp, Mus musculus
gggctcactactcttcatccataca

SEQ ID NO: 715481 - DNA, 25 bp, Mus musculus
gggctcactactgttcatccataca

SEQ ID NO: 715482 - DNA, 25 bp, Mus musculus
gggctcactcgcactagggaaccgg

SEQ ID NO: 715483 - DNA, 25 bp, Mus musculus
gggctcactcgctctagggaaccgg

SEQ ID NO: 715484 - DNA, 25 bp, Mus musculus
gggctcacttttcattgagtcactc

SEQ ID NO: 715485 - DNA, 25 bp, Mus musculus
gggctcacttttgattgagtcactc

SEQ ID NO: 715486 - DNA, 25 bp, Mus musculus
gggctcagacgcactgactcttctg

SEQ ID NO: 715487 - DNA, 25 bp, Mus musculus
gggctcagacgctctgactcttctg

SEQ ID NO: 715488 - DNA, 25 bp, Mus musculus
gggctcagatgcaaatgacgtggtt

SEQ ID NO: 715489 - DNA, 25 bp, Mus musculus
gggctcagatgctaatgacgtggtt

SEQ ID NO: 715490 - DNA, 25 bp, Mus musculus
gggctcagccgaaggtttgcatttc

SEQ ID NO: 715491 - DNA, 25 bp, Mus musculus
gggctcagccgatggtttgcatttc

SEQ ID NO: 715492 - DNA, 25 bp, Mus musculus
gggctcagctgcaccatgaaattca

SEQ ID NO: 715493 - DNA, 25 bp, Mus musculus
gggctcagctgctccatgaaattca

SEQ ID NO: 715494 - DNA, 25 bp, Mus musculus
gggctcagtgcgcatactcagtcat

SEQ ID NO: 715495 - DNA, 25 bp, Mus musculus
gggctcagtgcggatactcagtcat

SEQ ID NO: 715496 - DNA, 25 bp, Mus musculus
gggctcatacttcatgatttccaga

SEQ ID NO: 715497 - DNA, 25 bp, Mus musculus
gggctcatacttctgctcgtgccct

SEQ ID NO: 715498 - DNA, 25 bp, Mus musculus
gggctcatacttgatgatttccaga

SEQ ID NO: 715499 - DNA, 25 bp, Mus musculus
gggctcatacttgtgctcgtgccct

SEQ ID NO: 715500 - DNA, 25 bp, Mus musculus
gggctcatcatacagagcaggtctg

SEQ ID NO: 715501 - DNA, 25 bp, Mus musculus
gggctcatcatagagagcaggtctg

SEQ ID NO: 715502 - DNA, 25 bp, Mus musculus
gggctcatctgaaggccagggctct

SEQ ID NO: 715503 - DNA, 25 bp, Mus musculus
gggctcatctgatggccagggctct

SEQ ID NO: 715504 - DNA, 25 bp, Mus musculus
gggctcatctgtaggcagtacacga

SEQ ID NO: 715505 - DNA, 25 bp, Mus musculus
gggctcatctgttggcagtacacga

SEQ ID NO: 715506 - DNA, 25 bp, Mus musculus
gggctcatcttaatgcctacagcac

SEQ ID NO: 715507 - DNA, 25 bp, Mus musculus
gggctcatcttattgcctacagcac

SEQ ID NO: 715508 - DNA, 25 bp, Mus musculus
gggctcatgataaatgttccttcta

SEQ ID NO: 715509 - DNA, 25 bp, Mus musculus
gggctcatgatatatgttccttcta

SEQ ID NO: 715510 - DNA, 25 bp, Mus musculus
gggctcattacacgcccagatggga

SEQ ID NO: 715511 - DNA, 25 bp, Mus musculus
gggctcattacaggcccagatggga

SEQ ID NO: 715512 - DNA, 25 bp, Mus musculus
gggctcattaccaaacaggttccaa

SEQ ID NO: 715513 - DNA, 25 bp, Mus musculus
gggctcattacctaacaggttccaa

SEQ ID NO: 715514 - DNA, 25 bp, Mus musculus
gggctcattcttcccctaggaacct

SEQ ID NO: 715515 - DNA, 25 bp, Mus musculus
gggctcattcttgccctaggaacct

SEQ ID NO: 715516 - DNA, 25 bp, Mus musculus
gggctcatttgtccagggattctct

SEQ ID NO: 715517 - DNA, 25 bp, Mus musculus
gggctcatttgtgcagggattctct

SEQ ID NO: 715518 - DNA, 25 bp, Mus musculus
gggctccaacacctgcgagctggtc

SEQ ID NO: 715519 - DNA, 25 bp, Mus musculus
gggctccaacacgtgcgagctggtc

SEQ ID NO: 715520 - DNA, 25 bp, Mus musculus
gggctccaacgcctgctgcttctgt

SEQ ID NO: 715521 - DNA, 25 bp, Mus musculus
gggctccaacgcgtgctgcttctgt

SEQ ID NO: 715522 - DNA, 25 bp, Mus musculus
gggctccacccgatcatctctgggt

SEQ ID NO: 715523 - DNA, 25 bp, Mus musculus
gggctccacccgttcatctctgggt

SEQ ID NO: 715524 - DNA, 25 bp, Mus musculus
gggctccacgaacagactcaacatt

SEQ ID NO: 715525 - DNA, 25 bp, Mus musculus
gggctccacgaagagactcaacatt

SEQ ID NO: 715526 - DNA, 25 bp, Mus musculus
gggctccagcctcaaaacagtggaa

SEQ ID NO: 715527 - DNA, 25 bp, Mus musculus
gggctccagcctgaaaacagtggaa

SEQ ID NO: 715528 - DNA, 25 bp, Mus musculus
gggctccagcgacggacgaatctca

SEQ ID NO: 715529 - DNA, 25 bp, Mus musculus
gggctccagcgagggacgaatctca

SEQ ID NO: 715530 - DNA, 25 bp, Mus musculus
gggctccagtgaacgggctcaatga

SEQ ID NO: 715531 - DNA, 25 bp, Mus musculus
gggctccagtgatcgggctcaatga

SEQ ID NO: 715532 - DNA, 25 bp, Mus musculus
gggctccatcatctacaaccttttc

SEQ ID NO: 715533 - DNA, 25 bp, Mus musculus
gggctccatcatgtacaaccttttc

SEQ ID NO: 715534 - DNA, 25 bp, Mus musculus
gggctccatctgcaaaccgaggccg

SEQ ID NO: 715535 - DNA, 25 bp, Mus musculus
gggctccatctggaaaccgaggccg

SEQ ID NO: 715536 - DNA, 25 bp, Mus musculus
gggctccattgacaatgacttctgt

SEQ ID NO: 715537 - DNA, 25 bp, Mus musculus
gggctccattgacgcccataagagg

SEQ ID NO: 715538 - DNA, 25 bp, Mus musculus
gggctccattgagaatgacttctgt

SEQ ID NO: 715539 - DNA, 25 bp, Mus musculus
gggctccattgaggcccataagagg

SEQ ID NO: 715540 - DNA, 25 bp, Mus musculus
gggctcccacccaagacagttgatg

SEQ ID NO: 715541 - DNA, 25 bp, Mus musculus
gggctcccaccctagacagttgatg

SEQ ID NO: 715542 - DNA, 25 bp, Mus musculus
gggctcccagggaatatcagtgatc

SEQ ID NO: 715543 - DNA, 25 bp, Mus musculus
gggctcccagggtatatcagtgatc

SEQ ID NO: 715544 - DNA, 25 bp, Mus musculus
gggctccccaccacagccagttgtc

SEQ ID NO: 715545 - DNA, 25 bp, Mus musculus
gggctccccacctcagccagttgtc

SEQ ID NO: 715546 - DNA, 25 bp, Mus musculus
gggctccccggtctcttcgaagcat

SEQ ID NO: 715547 - DNA, 25 bp, Mus musculus
gggctccccggtgtcttcgaagcat

SEQ ID NO: 715548 - DNA, 25 bp, Mus musculus
gggctcccgcttctggattcaggac

SEQ ID NO: 715549 - DNA, 25 bp, Mus musculus
gggctcccgcttgtggattcaggac

SEQ ID NO: 715550 - DNA, 25 bp, Mus musculus
gggctccctggtacaaagggccgca

SEQ ID NO: 715551 - DNA, 25 bp, Mus musculus
gggctccctggttcaaagggccgca

SEQ ID NO: 715552 - DNA, 25 bp, Mus musculus
gggctccctgtaagattacattaac

SEQ ID NO: 715553 - DNA, 25 bp, Mus musculus
gggctccctgtatgattacattaac

SEQ ID NO: 715554 - DNA, 25 bp, Mus musculus
gggctcccttacacactatgtgcaa

SEQ ID NO: 715555 - DNA, 25 bp, Mus musculus
gggctcccttactcactatgtgcaa

SEQ ID NO: 715556 - DNA, 25 bp, Mus musculus
gggctcccttctataactacctagg

SEQ ID NO: 715557 - DNA, 25 bp, Mus musculus
gggctcccttctttaactacctagg

SEQ ID NO: 715558 - DNA, 25 bp, Mus musculus
gggctccgacaaagcctggtgacac

SEQ ID NO: 715559 - DNA, 25 bp, Mus musculus
gggctccgacaatgcctggtgacac

SEQ ID NO: 715560 - DNA, 25 bp, Mus musculus
gggctcctaagaccgaccgtattgt

SEQ ID NO: 715561 - DNA, 25 bp, Mus musculus
gggctcctaagagcgaccgtattgt

SEQ ID NO: 715562 - DNA, 25 bp, Mus musculus
gggctcctagcaacgggcctgggcg

SEQ ID NO: 715563 - DNA, 25 bp, Mus musculus
gggctcctagcatcgggcctgggcg

SEQ ID NO: 715564 - DNA, 25 bp, Mus musculus
gggctcctccctaaagctagcatgt

SEQ ID NO: 715565 - DNA, 25 bp, Mus musculus
gggctcctcccttaagctagcatgt

SEQ ID NO: 715566 - DNA, 25 bp, Mus musculus
gggctcctcgctatcagcgcagagc

SEQ ID NO: 715567 - DNA, 25 bp, Mus musculus
gggctcctcgctttcagcgcagagc

SEQ ID NO: 715568 - DNA, 25 bp, Mus musculus
gggctcctgcaaaccctgagaactc

SEQ ID NO: 715569 - DNA, 25 bp, Mus musculus
gggctcctgcaatccctgagaactc

SEQ ID NO: 715570 - DNA, 25 bp, Mus musculus
gggctcctgctgattggagagaaca

SEQ ID NO: 715571 - DNA, 25 bp, Mus musculus
gggctcctgctgtttggagagaaca

SEQ ID NO: 715572 - DNA, 25 bp, Mus musculus
gggctccttggaacaggtctgaagt

SEQ ID NO: 715573 - DNA, 25 bp, Mus musculus
gggctccttggatcaggtctgaagt

SEQ ID NO: 715574 - DNA, 25 bp, Mus musculus
gggctccttggcataaccatcattc

SEQ ID NO: 715575 - DNA, 25 bp, Mus musculus
gggctccttggcttaaccatcattc

SEQ ID NO: 715576 - DNA, 25 bp, Mus musculus
gggctcgaaggaatcgtcccctcag

SEQ ID NO: 715577 - DNA, 25 bp, Mus musculus
gggctcgaaggattcgtcccctcag

SEQ ID NO: 715578 - DNA, 25 bp, Mus musculus
gggctcgacctccaatctccgaggg

SEQ ID NO: 715579 - DNA, 25 bp, Mus musculus
gggctcgacctcgaatctccgaggg

SEQ ID NO: 715580 - DNA, 25 bp, Mus musculus
gggctcgcctagatcacaagtttga

SEQ ID NO: 715581 - DNA, 25 bp, Mus musculus
gggctcgcctagttcacaagtttga

SEQ ID NO: 715582 - DNA, 25 bp, Mus musculus
gggctcgcctatattgcgctctatc

SEQ ID NO: 715583 - DNA, 25 bp, Mus musculus
gggctcgcctattttgcgctctatc

SEQ ID NO: 715584 - DNA, 25 bp, Mus musculus
gggctcggctttcgactcctgcatc

SEQ ID NO: 715585 - DNA, 25 bp, Mus musculus
gggctcggctttggactcctgcatc

SEQ ID NO: 715586 - DNA, 25 bp, Mus musculus
gggctcgtcctacctgtgcagcctt

SEQ ID NO: 715587 - DNA, 25 bp, Mus musculus
gggctcgtcctagctgtgcagcctt

SEQ ID NO: 715588 - DNA, 25 bp, Mus musculus
gggctcgttttgacagattctgtga

SEQ ID NO: 715589 - DNA, 25 bp, Mus musculus
gggctcgttttgtcagattctgtga

SEQ ID NO: 715590 - DNA, 25 bp, Mus musculus
gggctctaagccagaggtcccaggc

SEQ ID NO: 715591 - DNA, 25 bp, Mus musculus
gggctctaagcctgaggtcccaggc

SEQ ID NO: 715592 - DNA, 25 bp, Mus musculus
gggctctaatgacacaacgtttgaa

SEQ ID NO: 715593 - DNA, 25 bp, Mus musculus
gggctctaatgagacaacgtttgaa

SEQ ID NO: 715594 - DNA, 25 bp, Mus musculus
gggctctactacatgcagaaaaacg

SEQ ID NO: 715595 - DNA, 25 bp, Mus musculus
gggctctactacttgcagaaaaacg

SEQ ID NO: 715596 - DNA, 25 bp, Mus musculus
gggctctagaggctaggtcttctct

SEQ ID NO: 715597 - DNA, 25 bp, Mus musculus
gggctctagagggtaggtcttctct

SEQ ID NO: 715598 - DNA, 25 bp, Mus musculus
gggctctagggaaatgttagccaca

SEQ ID NO: 715599 - DNA, 25 bp, Mus musculus
gggctctagggatatgttagccaca

SEQ ID NO: 715600 - DNA, 25 bp, Mus musculus
gggctctcaagcactttacttcgag

SEQ ID NO: 715601 - DNA, 25 bp, Mus musculus
gggctctcaagctctttacttcgag

SEQ ID NO: 715602 - DNA, 25 bp, Mus musculus
gggctctcaatgctgccgaccctgg

SEQ ID NO: 715603 - DNA, 25 bp, Mus musculus
gggctctcaatggtgccgaccctgg

SEQ ID NO: 715604 - DNA, 25 bp, Mus musculus
gggctctcacgtatcctgctcaaat

SEQ ID NO: 715605 - DNA, 25 bp, Mus musculus
gggctctcacgtttcctgctcaaat

SEQ ID NO: 715606 - DNA, 25 bp, Mus musculus
gggctctccaacatcgctttcaact

SEQ ID NO: 715607 - DNA, 25 bp, Mus musculus
gggctctccaacttcgctttcaact

SEQ ID NO: 715608 - DNA, 25 bp, Mus musculus
gggctctcggagacctcatctacga

SEQ ID NO: 715609 - DNA, 25 bp, Mus musculus
gggctctcggagtcctcatctacga

SEQ ID NO: 715610 - DNA, 25 bp, Mus musculus
gggctctcggcccaggtcaagaacc

SEQ ID NO: 715611 - DNA, 25 bp, Mus musculus
gggctctcggccgaggtcaagaacc

SEQ ID NO: 715612 - DNA, 25 bp, Mus musculus
gggctctgaaccagtatccggcatt

SEQ ID NO: 715613 - DNA, 25 bp, Mus musculus
gggctctgaacctgtatccggcatt

SEQ ID NO: 715614 - DNA, 25 bp, Mus musculus
gggctctgaattccgaagtccccat

SEQ ID NO: 715615 - DNA, 25 bp, Mus musculus
gggctctgaattgcgaagtccccat

SEQ ID NO: 715616 - DNA, 25 bp, Mus musculus
gggctctgatagagctccctggcca

SEQ ID NO: 715617 - DNA, 25 bp, Mus musculus
gggctctgatagtgctccctggcca

SEQ ID NO: 715618 - DNA, 25 bp, Mus musculus
gggctctgcagaactaccgctccgg

SEQ ID NO: 715619 - DNA, 25 bp, Mus musculus
gggctctgcagatctaccgctccgg

SEQ ID NO: 715620 - DNA, 25 bp, Mus musculus
gggctctgcagtactcgctcatgct

SEQ ID NO: 715621 - DNA, 25 bp, Mus musculus
gggctctgcagttctcgctcatgct

SEQ ID NO: 715622 - DNA, 25 bp, Mus musculus
gggctctgccctcaaaatacaatgc

SEQ ID NO: 715623 - DNA, 25 bp, Mus musculus
gggctctgccctgaaaatacaatgc

SEQ ID NO: 715624 - DNA, 25 bp, Mus musculus
gggctctggacgaccatcaccatct

SEQ ID NO: 715625 - DNA, 25 bp, Mus musculus
gggctctggacgtccatcaccatct

SEQ ID NO: 715626 - DNA, 25 bp, Mus musculus
gggctctgggtactttgaccactat

SEQ ID NO: 715627 - DNA, 25 bp, Mus musculus
gggctctgggtagtttgaccactat

SEQ ID NO: 715628 - DNA, 25 bp, Mus musculus
gggctctggtagcttctttgtgcct

SEQ ID NO: 715629 - DNA, 25 bp, Mus musculus
gggctctggtaggttctttgtgcct

SEQ ID NO: 715630 - DNA, 25 bp, Mus musculus
gggctctgtacacggctacatggaa

SEQ ID NO: 715631 - DNA, 25 bp, Mus musculus
gggctctgtacagggctacatggaa

SEQ ID NO: 715632 - DNA, 25 bp, Mus musculus
gggctctgtcctcaatccacatgat

SEQ ID NO: 715633 - DNA, 25 bp, Mus musculus
gggctctgtcctgaatccacatgat

SEQ ID NO: 715634 - DNA, 25 bp, Mus musculus
gggctcttgtagacaccacaccaca

SEQ ID NO: 715635 - DNA, 25 bp, Mus musculus
gggctcttgtagtcaccacaccaca

SEQ ID NO: 715636 - DNA, 25 bp, Mus musculus
gggctctttgttaagtctcccagca

SEQ ID NO: 715637 - DNA, 25 bp, Mus musculus
gggctctttgtttagtctcccagca

SEQ ID NO: 715638 - DNA, 25 bp, Mus musculus
gggctgaagactcaccaagaggtcc

SEQ ID NO: 715639 - DNA, 25 bp, Mus musculus
gggctgaagactgaccaagaggtcc

SEQ ID NO: 715640 - DNA, 25 bp, Mus musculus
gggctgaagatgattgtccatcgat

SEQ ID NO: 715641 - DNA, 25 bp, Mus musculus
gggctgaagatgtttgtccatcgat

SEQ ID NO: 715642 - DNA, 25 bp, Mus musculus
gggctgaaggtgaacggcacacact

SEQ ID NO: 715643 - DNA, 25 bp, Mus musculus
gggctgaaggtgtacggcacacact

SEQ ID NO: 715644 - DNA, 25 bp, Mus musculus
gggctgaagttcctccagcaactga

SEQ ID NO: 715645 - DNA, 25 bp, Mus musculus
gggctgaagttcgtccagcaactga

SEQ ID NO: 715646 - DNA, 25 bp, Mus musculus
gggctgaatccgagaaacctaaccg

SEQ ID NO: 715647 - DNA, 25 bp, Mus musculus
gggctgaatccgtgaaacctaaccg

SEQ ID NO: 715648 - DNA, 25 bp, Mus musculus
gggctgaatgcgacccaccctgtga

SEQ ID NO: 715649 - DNA, 25 bp, Mus musculus
gggctgaatgcgtcccaccctgtga

SEQ ID NO: 715650 - DNA, 25 bp, Mus musculus
gggctgaatttgaacgcatcataca

SEQ ID NO: 715651 - DNA, 25 bp, Mus musculus
gggctgaatttgtacgcatcataca

SEQ ID NO: 715652 - DNA, 25 bp, Mus musculus
gggctgacaacaccatgcaaagaat

SEQ ID NO: 715653 - DNA, 25 bp, Mus musculus
gggctgacaacagcatgcaaagaat

SEQ ID NO: 715654 - DNA, 25 bp, Mus musculus
gggctgacacctacaatgagatgca

SEQ ID NO: 715655 - DNA, 25 bp, Mus musculus
gggctgacaccttcaatgagatgca

SEQ ID NO: 715656 - DNA, 25 bp, Mus musculus
gggctgacaggaagtccagctccca

SEQ ID NO: 715657 - DNA, 25 bp, Mus musculus
gggctgacaggatgtccagctccca

SEQ ID NO: 715658 - DNA, 25 bp, Mus musculus
gggctgacagtgattgctgtgggaa

SEQ ID NO: 715659 - DNA, 25 bp, Mus musculus
gggctgacagtgtttgctgtgggaa

SEQ ID NO: 715660 - DNA, 25 bp, Mus musculus
gggctgactgcaacactcccgggct

SEQ ID NO: 715661 - DNA, 25 bp, Mus musculus
gggctgactgcatcactcccgggct

SEQ ID NO: 715662 - DNA, 25 bp, Mus musculus
gggctgacttcaatgacccatcatc

SEQ ID NO: 715663 - DNA, 25 bp, Mus musculus
gggctgacttcattgacccatcatc

SEQ ID NO: 715664 - DNA, 25 bp, Mus musculus
gggctgagccctctgtaggtattct

SEQ ID NO: 715665 - DNA, 25 bp, Mus musculus
gggctgagccctgtgtaggtattct

SEQ ID NO: 715666 - DNA, 25 bp, Mus musculus
gggctgatccagcatgtcccttgct

SEQ ID NO: 715667 - DNA, 25 bp, Mus musculus
gggctgatccaggatgtcccttgct

SEQ ID NO: 715668 - DNA, 25 bp, Mus musculus
gggctgatcgatccccactccatga

SEQ ID NO: 715669 - DNA, 25 bp, Mus musculus
gggctgatcgatgcccactccatga

SEQ ID NO: 715670 - DNA, 25 bp, Mus musculus
gggctgatgattctacctcgggacc

SEQ ID NO: 715671 - DNA, 25 bp, Mus musculus
gggctgatgattgtacctcgggacc

SEQ ID NO: 715672 - DNA, 25 bp, Mus musculus
gggctgattgctctggactacaaaa

SEQ ID NO: 715673 - DNA, 25 bp, Mus musculus
gggctgattgctgtggactacaaaa

SEQ ID NO: 715674 - DNA, 25 bp, Mus musculus
gggctgattggcaattcattcctga

SEQ ID NO: 715675 - DNA, 25 bp, Mus musculus
gggctgattggctattcattcctga

SEQ ID NO: 715676 - DNA, 25 bp, Mus musculus
gggctgcaaaaacctgctcggtctg

SEQ ID NO: 715677 - DNA, 25 bp, Mus musculus
gggctgcaaaaagctgctcggtctg

SEQ ID NO: 715678 - DNA, 25 bp, Mus musculus
gggctgcaagatcggcccgtccatc

SEQ ID NO: 715679 - DNA, 25 bp, Mus musculus
gggctgcaagatgggcccgtccatc

SEQ ID NO: 715680 - DNA, 25 bp, Mus musculus
gggctgcagcatatgttcaatgtcc

SEQ ID NO: 715681 - DNA, 25 bp, Mus musculus
gggctgcagcatttgttcaatgtcc

SEQ ID NO: 715682 - DNA, 25 bp, Mus musculus
gggctgccacttcgacgtccgcctg

SEQ ID NO: 715683 - DNA, 25 bp, Mus musculus
gggctgccacttggacgtccgcctg

SEQ ID NO: 715684 - DNA, 25 bp, Mus musculus
gggctgccagcaagttctctcgaaa

SEQ ID NO: 715685 - DNA, 25 bp, Mus musculus
gggctgccagcatgttctctcgaaa

SEQ ID NO: 715686 - DNA, 25 bp, Mus musculus
gggctgccatccagctgtcagtcat

SEQ ID NO: 715687 - DNA, 25 bp, Mus musculus
gggctgccatcctgctgtcagtcat

SEQ ID NO: 715688 - DNA, 25 bp, Mus musculus
gggctgccctcaagatcggccaaat

SEQ ID NO: 715689 - DNA, 25 bp, Mus musculus
gggctgccctcatgatcggccaaat

SEQ ID NO: 715690 - DNA, 25 bp, Mus musculus
gggctgccctccaagaaagcatctt

SEQ ID NO: 715691 - DNA, 25 bp, Mus musculus
gggctgccctcctagaaagcatctt

SEQ ID NO: 715692 - DNA, 25 bp, Mus musculus
gggctgcccttcagccaagagccaa

SEQ ID NO: 715693 - DNA, 25 bp, Mus musculus
gggctgcccttctgccaagagccaa

SEQ ID NO: 715694 - DNA, 25 bp, Mus musculus
gggctgccgacaccgctgctttgta

SEQ ID NO: 715695 - DNA, 25 bp, Mus musculus
gggctgccgacagcgctgctttgta

SEQ ID NO: 715696 - DNA, 25 bp, Mus musculus
gggctgccggcaactgaactctttg

SEQ ID NO: 715697 - DNA, 25 bp, Mus musculus
gggctgccggcatctgaactctttg

SEQ ID NO: 715698 - DNA, 25 bp, Mus musculus
gggctgcctcagaatgtatgcagga

SEQ ID NO: 715699 - DNA, 25 bp, Mus musculus
gggctgcctcagtatgtatgcagga

SEQ ID NO: 715700 - DNA, 25 bp, Mus musculus
gggctgcgagtcaccattgttctca

SEQ ID NO: 715701 - DNA, 25 bp, Mus musculus
gggctgcgagtctccattgttctca

SEQ ID NO: 715702 - DNA, 25 bp, Mus musculus
gggctgcgcaccaagtgctcagtgt

SEQ ID NO: 715703 - DNA, 25 bp, Mus musculus
gggctgcgcacctagtgctcagtgt

SEQ ID NO: 715704 - DNA, 25 bp, Mus musculus
gggctgcgccttcgcatcactgagt

SEQ ID NO: 715705 - DNA, 25 bp, Mus musculus
gggctgcgccttggcatcactgagt

SEQ ID NO: 715706 - DNA, 25 bp, Mus musculus
gggctgcgtcagatcctctcccagt

SEQ ID NO: 715707 - DNA, 25 bp, Mus musculus
gggctgcgtcagttcctctcccagt

SEQ ID NO: 715708 - DNA, 25 bp, Mus musculus
gggctgctagtcctattcctggagt

SEQ ID NO: 715709 - DNA, 25 bp, Mus musculus
gggctgctagtcgtattcctggagt

SEQ ID NO: 715710 - DNA, 25 bp, Mus musculus
gggctgctcatcatgcctggactat

SEQ ID NO: 715711 - DNA, 25 bp, Mus musculus
gggctgctcatcttgcctggactat

SEQ ID NO: 715712 - DNA, 25 bp, Mus musculus
gggctgctcatgaaagtgatcttct

SEQ ID NO: 715713 - DNA, 25 bp, Mus musculus
gggctgctcatgtaagtgatcttct

SEQ ID NO: 715714 - DNA, 25 bp, Mus musculus
gggctgctctctacatcggatgggc

SEQ ID NO: 715715 - DNA, 25 bp, Mus musculus
gggctgctctctatgtcttctcgga

SEQ ID NO: 715716 - DNA, 25 bp, Mus musculus
gggctgctctcttcatcggatgggc

SEQ ID NO: 715717 - DNA, 25 bp, Mus musculus
gggctgctctctttgtcttctcgga

SEQ ID NO: 715718 - DNA, 25 bp, Mus musculus
gggctgctgaagaggcgttttcacc

SEQ ID NO: 715719 - DNA, 25 bp, Mus musculus
gggctgctgaagtggcgttttcacc

SEQ ID NO: 715720 - DNA, 25 bp, Mus musculus
gggctgctgtgtagagaattcctgt

SEQ ID NO: 715721 - DNA, 25 bp, Mus musculus
gggctgctgtgttgagaattcctgt

SEQ ID NO: 715722 - DNA, 25 bp, Mus musculus
gggctgcttctgactcatggactat

SEQ ID NO: 715723 - DNA, 25 bp, Mus musculus
gggctgcttctgtctcatggactat

SEQ ID NO: 715724 - DNA, 25 bp, Mus musculus
gggctgcttttgagagctccgatct

SEQ ID NO: 715725 - DNA, 25 bp, Mus musculus
gggctgcttttgtgagctccgatct

SEQ ID NO: 715726 - DNA, 25 bp, Mus musculus
gggctggacaaaacatgagaataaa

SEQ ID NO: 715727 - DNA, 25 bp, Mus musculus
gggctggacaaatcatgagaataaa

SEQ ID NO: 715728 - DNA, 25 bp, Mus musculus
gggctggagacaccttcaatgcctc

SEQ ID NO: 715729 - DNA, 25 bp, Mus musculus
gggctggagacagcttcaatgcctc

SEQ ID NO: 715730 - DNA, 25 bp, Mus musculus
gggctggagccaatatggcacgcat

SEQ ID NO: 715731 - DNA, 25 bp, Mus musculus
gggctggagccattatggcacgcat

SEQ ID NO: 715732 - DNA, 25 bp, Mus musculus
gggctggagtacctccacacacgca

SEQ ID NO: 715733 - DNA, 25 bp, Mus musculus
gggctggagtacgtccacacacgca

SEQ ID NO: 715734 - DNA, 25 bp, Mus musculus
gggctggcacgtcgtgtccaccaca

SEQ ID NO: 715735 - DNA, 25 bp, Mus musculus
gggctggcacgtggtgtccaccaca

SEQ ID NO: 715736 - DNA, 25 bp, Mus musculus
gggctggcatctctacacctttcta

SEQ ID NO: 715737 - DNA, 25 bp, Mus musculus
gggctggcatctgtacacctttcta

SEQ ID NO: 715738 - DNA, 25 bp, Mus musculus
gggctggcatttatccataaacacg

SEQ ID NO: 715739 - DNA, 25 bp, Mus musculus
gggctggcatttttccataaacacg

SEQ ID NO: 715740 - DNA, 25 bp, Mus musculus
gggctggccctacaaatcttagaac

SEQ ID NO: 715741 - DNA, 25 bp, Mus musculus
gggctggccctagaaatcttagaac

SEQ ID NO: 715742 - DNA, 25 bp, Mus musculus
gggctggctacgataagctctggca

SEQ ID NO: 715743 - DNA, 25 bp, Mus musculus
gggctggctacgttaagctctggca

SEQ ID NO: 715744 - DNA, 25 bp, Mus musculus
gggctggctccgaacacattgacaa

SEQ ID NO: 715745 - DNA, 25 bp, Mus musculus
gggctggctccgtacacattgacaa

SEQ ID NO: 715746 - DNA, 25 bp, Mus musculus
gggctggctgcaattcccagggcca

SEQ ID NO: 715747 - DNA, 25 bp, Mus musculus
gggctggctgcatttcccagggcca

SEQ ID NO: 715748 - DNA, 25 bp, Mus musculus
gggctggctgtacctgggctgctcc

SEQ ID NO: 715749 - DNA, 25 bp, Mus musculus
gggctggctgtagctgggctgctcc

SEQ ID NO: 715750 - DNA, 25 bp, Mus musculus
gggctggcttcaagccttcgggtca

SEQ ID NO: 715751 - DNA, 25 bp, Mus musculus
gggctggcttcatgccttcgggtca

SEQ ID NO: 715752 - DNA, 25 bp, Mus musculus
gggctgggatatcgtaccagaaaac

SEQ ID NO: 715753 - DNA, 25 bp, Mus musculus
gggctgggatatggtaccagaaaac

SEQ ID NO: 715754 - DNA, 25 bp, Mus musculus
gggctgggatgaaaatgtctactac

SEQ ID NO: 715755 - DNA, 25 bp, Mus musculus
gggctgggatgataatgtctactac

SEQ ID NO: 715756 - DNA, 25 bp, Mus musculus
gggctgggtccaacacagaccttgt

SEQ ID NO: 715757 - DNA, 25 bp, Mus musculus
gggctgggtccatcacagaccttgt

SEQ ID NO: 715758 - DNA, 25 bp, Mus musculus
gggctggtccttccataataaagct

SEQ ID NO: 715759 - DNA, 25 bp, Mus musculus
gggctggtccttgcataataaagct

SEQ ID NO: 715760 - DNA, 25 bp, Mus musculus
gggctggtgacccacctgcagtacc

SEQ ID NO: 715761 - DNA, 25 bp, Mus musculus
gggctggtgaccgacctgcagtacc

SEQ ID NO: 715762 - DNA, 25 bp, Mus musculus
gggctggtgcccctacttcctggct

SEQ ID NO: 715763 - DNA, 25 bp, Mus musculus
gggctggtgcccgtacttcctggct

SEQ ID NO: 715764 - DNA, 25 bp, Mus musculus
gggctggtgctccttatcatcctgg

SEQ ID NO: 715765 - DNA, 25 bp, Mus musculus
gggctggtgctcgttatcatcctgg

SEQ ID NO: 715766 - DNA, 25 bp, Mus musculus
gggctggtgcttaccgctccgtttc

SEQ ID NO: 715767 - DNA, 25 bp, Mus musculus
gggctggtgctttccgctccgtttc

SEQ ID NO: 715768 - DNA, 25 bp, Mus musculus
gggctggtggacaacactgtcagaa

SEQ ID NO: 715769 - DNA, 25 bp, Mus musculus
gggctggtggactacactgtcagaa

SEQ ID NO: 715770 - DNA, 25 bp, Mus musculus
gggctggttctgaatctgatatcat

SEQ ID NO: 715771 - DNA, 25 bp, Mus musculus
gggctggttctgtatctgatatcat

SEQ ID NO: 715772 - DNA, 25 bp, Mus musculus
gggctggttgtcaacgactgtcatg

SEQ ID NO: 715773 - DNA, 25 bp, Mus musculus
gggctggttgtctacgactgtcatg

SEQ ID NO: 715774 - DNA, 25 bp, Mus musculus
gggctgtacaaacctgacttactgt

SEQ ID NO: 715775 - DNA, 25 bp, Mus musculus
gggctgtacaaagctgacttactgt

SEQ ID NO: 715776 - DNA, 25 bp, Mus musculus
gggctgtaccgcatcagtgggaacc

SEQ ID NO: 715777 - DNA, 25 bp, Mus musculus
gggctgtaccgcttcagtgggaacc

SEQ ID NO: 715778 - DNA, 25 bp, Mus musculus
gggctgtacgccacgtccgcctata

SEQ ID NO: 715779 - DNA, 25 bp, Mus musculus
gggctgtacgcctcgtccgcctata

SEQ ID NO: 715780 - DNA, 25 bp, Mus musculus
gggctgtagaacaagaccgtcccaa

SEQ ID NO: 715781 - DNA, 25 bp, Mus musculus
gggctgtagaactagaccgtcccaa

SEQ ID NO: 715782 - DNA, 25 bp, Mus musculus
gggctgtaggccactgcttttatct

SEQ ID NO: 715783 - DNA, 25 bp, Mus musculus
gggctgtaggcctctgcttttatct

SEQ ID NO: 715784 - DNA, 25 bp, Mus musculus
gggctgtagtagagagctgcctcct

SEQ ID NO: 715785 - DNA, 25 bp, Mus musculus
gggctgtagtagtgagctgcctcct

SEQ ID NO: 715786 - DNA, 25 bp, Mus musculus
gggctgtcactacctcactgaagag

SEQ ID NO: 715787 - DNA, 25 bp, Mus musculus
gggctgtcactagctcactgaagag

SEQ ID NO: 715788 - DNA, 25 bp, Mus musculus
gggctgtcagagaatgccgaccaat

SEQ ID NO: 715789 - DNA, 25 bp, Mus musculus
gggctgtcagagtatgccgaccaat

SEQ ID NO: 715790 - DNA, 25 bp, Mus musculus
gggctgtcagcaccggcaaccttgt

SEQ ID NO: 715791 - DNA, 25 bp, Mus musculus
gggctgtcagcagcggcaaccttgt

SEQ ID NO: 715792 - DNA, 25 bp, Mus musculus
gggctgtcataaaagtccactcctc

SEQ ID NO: 715793 - DNA, 25 bp, Mus musculus
gggctgtcataatagtccactcctc

SEQ ID NO: 715794 - DNA, 25 bp, Mus musculus
gggctgtcatctcactatgggcaca

SEQ ID NO: 715795 - DNA, 25 bp, Mus musculus
gggctgtcatctgactatgggcaca

SEQ ID NO: 715796 - DNA, 25 bp, Mus musculus
gggctgtcattcagaaattcagtct

SEQ ID NO: 715797 - DNA, 25 bp, Mus musculus
gggctgtcattctgaaattcagtct

SEQ ID NO: 715798 - DNA, 25 bp, Mus musculus
gggctgtcgctcagtgcagcccgct

SEQ ID NO: 715799 - DNA, 25 bp, Mus musculus
gggctgtcgctctgtgcagcccgct

SEQ ID NO: 715800 - DNA, 25 bp, Mus musculus
gggctgtctgatagagatcctggcc

SEQ ID NO: 715801 - DNA, 25 bp, Mus musculus
gggctgtctgattgagatcctggcc

SEQ ID NO: 715802 - DNA, 25 bp, Mus musculus
gggctgtctgttcactctgcccaga

SEQ ID NO: 715803 - DNA, 25 bp, Mus musculus
gggctgtctgttgactctgcccaga

SEQ ID NO: 715804 - DNA, 25 bp, Mus musculus
gggctgtgaccactacagcctcaca

SEQ ID NO: 715805 - DNA, 25 bp, Mus musculus
gggctgtgaccagtacagcctcaca

SEQ ID NO: 715806 - DNA, 25 bp, Mus musculus
gggctgtgacccctatgggcatata

SEQ ID NO: 715807 - DNA, 25 bp, Mus musculus
gggctgtgacccgtatgggcatata

SEQ ID NO: 715808 - DNA, 25 bp, Mus musculus
gggctgtgcagacatcactaacctg

SEQ ID NO: 715809 - DNA, 25 bp, Mus musculus
gggctgtgcagagatcactaacctg

SEQ ID NO: 715810 - DNA, 25 bp, Mus musculus
gggctgtgtccaagactgcatcaac

SEQ ID NO: 715811 - DNA, 25 bp, Mus musculus
gggctgtgtccatgactgcatcaac

SEQ ID NO: 715812 - DNA, 25 bp, Mus musculus
gggctgtgtggtattccagagaatc

SEQ ID NO: 715813 - DNA, 25 bp, Mus musculus
gggctgtgtggttttccagagaatc

SEQ ID NO: 715814 - DNA, 25 bp, Mus musculus
gggctgttacgcatgctccgtggtg

SEQ ID NO: 715815 - DNA, 25 bp, Mus musculus
gggctgttacgcttgctccgtggtg

SEQ ID NO: 715816 - DNA, 25 bp, Mus musculus
gggctgttatttcggcaatacatac

SEQ ID NO: 715817 - DNA, 25 bp, Mus musculus
gggctgttatttgggcaatacatac

SEQ ID NO: 715818 - DNA, 25 bp, Mus musculus
gggctgttcaatctatctgtctcat

SEQ ID NO: 715819 - DNA, 25 bp, Mus musculus
gggctgttcaatgtatctgtctcat

SEQ ID NO: 715820 - DNA, 25 bp, Mus musculus
gggctgttcatcaacttcaggaacc

SEQ ID NO: 715821 - DNA, 25 bp, Mus musculus
gggctgttcatctacttcaggaacc

SEQ ID NO: 715822 - DNA, 25 bp, Mus musculus
gggctgttgtgtacactccagggca

SEQ ID NO: 715823 - DNA, 25 bp, Mus musculus
gggctgttgtgttcactccagggca

SEQ ID NO: 715824 - DNA, 25 bp, Mus musculus
gggcttaagggcatcagatgctcaa

SEQ ID NO: 715825 - DNA, 25 bp, Mus musculus
gggcttaagggccaggtcttctctt

SEQ ID NO: 715826 - DNA, 25 bp, Mus musculus
gggcttaagggcgaggtcttctctt

SEQ ID NO: 715827 - DNA, 25 bp, Mus musculus
gggcttaagggcttcagatgctcaa

SEQ ID NO: 715828 - DNA, 25 bp, Mus musculus
gggcttaccctcaagcgggacacac

SEQ ID NO: 715829 - DNA, 25 bp, Mus musculus
gggcttaccctctagcgggacacac

SEQ ID NO: 715830 - DNA, 25 bp, Mus musculus
gggcttacctgcatggctactagag

SEQ ID NO: 715831 - DNA, 25 bp, Mus musculus
gggcttacctgcttggctactagag

SEQ ID NO: 715832 - DNA, 25 bp, Mus musculus
gggcttactaatcaccactacagtg

SEQ ID NO: 715833 - DNA, 25 bp, Mus musculus
gggcttactaatgaccactacagtg

SEQ ID NO: 715834 - DNA, 25 bp, Mus musculus
gggcttactttccacaggatatgca

SEQ ID NO: 715835 - DNA, 25 bp, Mus musculus
gggcttactttcgacaggatatgca

SEQ ID NO: 715836 - DNA, 25 bp, Mus musculus
gggcttagggaactcctcctcactc

SEQ ID NO: 715837 - DNA, 25 bp, Mus musculus
gggcttagggaagtcctcctcactc

SEQ ID NO: 715838 - DNA, 25 bp, Mus musculus
gggcttatcgtactagtgatcaaag

SEQ ID NO: 715839 - DNA, 25 bp, Mus musculus
gggcttatcgtagtagtgatcaaag

SEQ ID NO: 715840 - DNA, 25 bp, Mus musculus
gggcttatggatatagaaggtaacc

SEQ ID NO: 715841 - DNA, 25 bp, Mus musculus
gggcttatggatttagaaggtaacc

SEQ ID NO: 715842 - DNA, 25 bp, Mus musculus
gggcttcaaatgaattgatcccatc

SEQ ID NO: 715843 - DNA, 25 bp, Mus musculus
gggcttcaaatgtattgatcccatc

SEQ ID NO: 715844 - DNA, 25 bp, Mus musculus
gggcttcaacctagacgcggaggcc

SEQ ID NO: 715845 - DNA, 25 bp, Mus musculus
gggcttcaaccttgacgcggaggcc

SEQ ID NO: 715846 - DNA, 25 bp, Mus musculus
gggcttcaagctcgtctccggtgac

SEQ ID NO: 715847 - DNA, 25 bp, Mus musculus
gggcttcaagctggtctccggtgac

SEQ ID NO: 715848 - DNA, 25 bp, Mus musculus
gggcttcagtctaacgcggctgacg

SEQ ID NO: 715849 - DNA, 25 bp, Mus musculus
gggcttcagtcttacgcggctgacg

SEQ ID NO: 715850 - DNA, 25 bp, Mus musculus
gggcttcataatcaccttctgttca

SEQ ID NO: 715851 - DNA, 25 bp, Mus musculus
gggcttcataatgaccttctgttca

SEQ ID NO: 715852 - DNA, 25 bp, Mus musculus
gggcttcatctgacagacccaagtc

SEQ ID NO: 715853 - DNA, 25 bp, Mus musculus
gggcttcatctgtcagacccaagtc

SEQ ID NO: 715854 - DNA, 25 bp, Mus musculus
gggcttccaggactgataccagctt

SEQ ID NO: 715855 - DNA, 25 bp, Mus musculus
gggcttccaggagtgataccagctt

SEQ ID NO: 715856 - DNA, 25 bp, Mus musculus
gggcttcccaaaagtgttctgtctg

SEQ ID NO: 715857 - DNA, 25 bp, Mus musculus
gggcttcccaaatgtgttctgtctg

SEQ ID NO: 715858 - DNA, 25 bp, Mus musculus
gggcttcccattatctctgggaggc

SEQ ID NO: 715859 - DNA, 25 bp, Mus musculus
gggcttcccattttctctgggaggc

SEQ ID NO: 715860 - DNA, 25 bp, Mus musculus
gggcttcctcccaatggactccgag

SEQ ID NO: 715861 - DNA, 25 bp, Mus musculus
gggcttcctccctatggactccgag

SEQ ID NO: 715862 - DNA, 25 bp, Mus musculus
gggcttcctcttcgcaggctgagaa

SEQ ID NO: 715863 - DNA, 25 bp, Mus musculus
gggcttcctcttggcaggctgagaa

SEQ ID NO: 715864 - DNA, 25 bp, Mus musculus
gggcttcctgccacttacatacaat

SEQ ID NO: 715865 - DNA, 25 bp, Mus musculus
gggcttcctgcctcttacatacaat

SEQ ID NO: 715866 - DNA, 25 bp, Mus musculus
gggcttcctgctcgcgttgcctgca

SEQ ID NO: 715867 - DNA, 25 bp, Mus musculus
gggcttcctgctggcgttgcctgca

SEQ ID NO: 715868 - DNA, 25 bp, Mus musculus
gggcttccttagcattaaattttgt

SEQ ID NO: 715869 - DNA, 25 bp, Mus musculus
gggcttccttaggattaaattttgt

SEQ ID NO: 715870 - DNA, 25 bp, Mus musculus
gggcttcggtgaagccgcactcatc

SEQ ID NO: 715871 - DNA, 25 bp, Mus musculus
gggcttcggtgactatataaagaga

SEQ ID NO: 715872 - DNA, 25 bp, Mus musculus
gggcttcggtgagtatataaagaga

SEQ ID NO: 715873 - DNA, 25 bp, Mus musculus
gggcttcggtgatgccgcactcatc

SEQ ID NO: 715874 - DNA, 25 bp, Mus musculus
gggcttcgtacacaacttccaggag

SEQ ID NO: 715875 - DNA, 25 bp, Mus musculus
gggcttcgtacagaacttccaggag

SEQ ID NO: 715876 - DNA, 25 bp, Mus musculus
gggcttctcctaacttcctagatgt

SEQ ID NO: 715877 - DNA, 25 bp, Mus musculus
gggcttctcctatcttcctagatgt

SEQ ID NO: 715878 - DNA, 25 bp, Mus musculus
gggcttctcgtgctccaagaactgc

SEQ ID NO: 715879 - DNA, 25 bp, Mus musculus
gggcttctcgtggtccaagaactgc

SEQ ID NO: 715880 - DNA, 25 bp, Mus musculus
gggcttctctggaccctctccaggt

SEQ ID NO: 715881 - DNA, 25 bp, Mus musculus
gggcttctctggtccctctccaggt

SEQ ID NO: 715882 - DNA, 25 bp, Mus musculus
gggcttctgctgatcattctgatcc

SEQ ID NO: 715883 - DNA, 25 bp, Mus musculus
gggcttctgctgttcattctgatcc

SEQ ID NO: 715884 - DNA, 25 bp, Mus musculus
gggcttctgcttcaacatcctgtgc

SEQ ID NO: 715885 - DNA, 25 bp, Mus musculus
gggcttctgcttgaacatcctgtgc

SEQ ID NO: 715886 - DNA, 25 bp, Mus musculus
gggcttcttacgatccttgaggacc

SEQ ID NO: 715887 - DNA, 25 bp, Mus musculus
gggcttcttacgttccttgaggacc

SEQ ID NO: 715888 - DNA, 25 bp, Mus musculus
gggcttcttactccggcgttgcaac

SEQ ID NO: 715889 - DNA, 25 bp, Mus musculus
gggcttcttactgcggcgttgcaac

SEQ ID NO: 715890 - DNA, 25 bp, Mus musculus
gggcttcttcacatgtcttggccgt

SEQ ID NO: 715891 - DNA, 25 bp, Mus musculus
gggcttcttcacttgtcttggccgt

SEQ ID NO: 715892 - DNA, 25 bp, Mus musculus
gggcttcttggaacgctgtcttacc

SEQ ID NO: 715893 - DNA, 25 bp, Mus musculus
gggcttcttggatcgctgtcttacc

SEQ ID NO: 715894 - DNA, 25 bp, Mus musculus
gggcttctttctcaagagtgtagag

SEQ ID NO: 715895 - DNA, 25 bp, Mus musculus
gggcttctttctgaagagtgtagag

SEQ ID NO: 715896 - DNA, 25 bp, Mus musculus
gggcttgaaatgatagcagttctga

SEQ ID NO: 715897 - DNA, 25 bp, Mus musculus
gggcttgaaatgttagcagttctga

SEQ ID NO: 715898 - DNA, 25 bp, Mus musculus
gggcttgaacagaatgctattaaga

SEQ ID NO: 715899 - DNA, 25 bp, Mus musculus
gggcttgaacagtatgctattaaga

SEQ ID NO: 715900 - DNA, 25 bp, Mus musculus
gggcttgaatgaaatcctggcttca

SEQ ID NO: 715901 - DNA, 25 bp, Mus musculus
gggcttgaatgatatcctggcttca

SEQ ID NO: 715902 - DNA, 25 bp, Mus musculus
gggcttgacttacaaggactccgga

SEQ ID NO: 715903 - DNA, 25 bp, Mus musculus
gggcttgacttagaaggactccgga

SEQ ID NO: 715904 - DNA, 25 bp, Mus musculus
gggcttgatagccagattggaaact

SEQ ID NO: 715905 - DNA, 25 bp, Mus musculus
gggcttgatagcgagattggaaact

SEQ ID NO: 715906 - DNA, 25 bp, Mus musculus
gggcttgccatcacctacgctgtgc

SEQ ID NO: 715907 - DNA, 25 bp, Mus musculus
gggcttgccatctcctacgctgtgc

SEQ ID NO: 715908 - DNA, 25 bp, Mus musculus
gggcttgctagaactcaagtccatg

SEQ ID NO: 715909 - DNA, 25 bp, Mus musculus
gggcttgctagatctcaagtccatg

SEQ ID NO: 715910 - DNA, 25 bp, Mus musculus
gggcttgctcggacgcctcgtcgct

SEQ ID NO: 715911 - DNA, 25 bp, Mus musculus
gggcttgctcggtcgcctcgtcgct

SEQ ID NO: 715912 - DNA, 25 bp, Mus musculus
gggcttgcttgcacactgtgtaaaa

SEQ ID NO: 715913 - DNA, 25 bp, Mus musculus
gggcttgcttgctcactgtgtaaaa

SEQ ID NO: 715914 - DNA, 25 bp, Mus musculus
gggcttggaagtagagaaccatgaa

SEQ ID NO: 715915 - DNA, 25 bp, Mus musculus
gggcttggaagttgagaaccatgaa

SEQ ID NO: 715916 - DNA, 25 bp, Mus musculus
gggcttggacctccctcctctaaag

SEQ ID NO: 715917 - DNA, 25 bp, Mus musculus
gggcttggacctgcctcctctaaag

SEQ ID NO: 715918 - DNA, 25 bp, Mus musculus
gggcttggctccatacacagttttc

SEQ ID NO: 715919 - DNA, 25 bp, Mus musculus
gggcttggctccttacacagttttc

SEQ ID NO: 715920 - DNA, 25 bp, Mus musculus
gggcttgggccacgttctgattata

SEQ ID NO: 715921 - DNA, 25 bp, Mus musculus
gggcttgggccaggttctgattata

SEQ ID NO: 715922 - DNA, 25 bp, Mus musculus
gggcttgtacatcaacactggaacc

SEQ ID NO: 715923 - DNA, 25 bp, Mus musculus
gggcttgtacatgaacactggaacc

SEQ ID NO: 715924 - DNA, 25 bp, Mus musculus
gggcttgtcccacgaagtctcgggt

SEQ ID NO: 715925 - DNA, 25 bp, Mus musculus
gggcttgtcccaggaagtctcgggt

SEQ ID NO: 715926 - DNA, 25 bp, Mus musculus
gggcttgtgcagaaaatcatggagc

SEQ ID NO: 715927 - DNA, 25 bp, Mus musculus
gggcttgtgcagtaaatcatggagc

SEQ ID NO: 715928 - DNA, 25 bp, Mus musculus
gggcttgttgccattcccctagatg

SEQ ID NO: 715929 - DNA, 25 bp, Mus musculus
gggcttgttgcctttcccctagatg

SEQ ID NO: 715930 - DNA, 25 bp, Mus musculus
gggcttgttttcactggtaatttgc

SEQ ID NO: 715931 - DNA, 25 bp, Mus musculus
gggcttgttttctctggtaatttgc

SEQ ID NO: 715932 - DNA, 25 bp, Mus musculus
gggctttaataaaaatctggatgtg

SEQ ID NO: 715933 - DNA, 25 bp, Mus musculus
gggctttaataataatctggatgtg

SEQ ID NO: 715934 - DNA, 25 bp, Mus musculus
gggctttccagcacagcgtctctgg

SEQ ID NO: 715935 - DNA, 25 bp, Mus musculus
gggctttccagctcagcgtctctgg

SEQ ID NO: 715936 - DNA, 25 bp, Mus musculus
gggctttcctttccgggcacttgct

SEQ ID NO: 715937 - DNA, 25 bp, Mus musculus
gggctttcctttgcgggcacttgct

SEQ ID NO: 715938 - DNA, 25 bp, Mus musculus
gggctttcgatcagcaggagagacc

SEQ ID NO: 715939 - DNA, 25 bp, Mus musculus
gggctttcgatctgcaggagagacc

SEQ ID NO: 715940 - DNA, 25 bp, Mus musculus
gggctttcggcacttccctggaaca

SEQ ID NO: 715941 - DNA, 25 bp, Mus musculus
gggctttcggcagttccctggaaca

SEQ ID NO: 715942 - DNA, 25 bp, Mus musculus
gggctttcggctccttgcttttcgt

SEQ ID NO: 715943 - DNA, 25 bp, Mus musculus
gggctttcggctgcttgcttttcgt

SEQ ID NO: 715944 - DNA, 25 bp, Mus musculus
gggctttctataacaatgtccttgg

SEQ ID NO: 715945 - DNA, 25 bp, Mus musculus
gggctttctatatcaatgtccttgg

SEQ ID NO: 715946 - DNA, 25 bp, Mus musculus
gggctttgactcaacagcattgaga

SEQ ID NO: 715947 - DNA, 25 bp, Mus musculus
gggctttgactctacagcattgaga

SEQ ID NO: 715948 - DNA, 25 bp, Mus musculus
gggctttgactgcatcgccaccaca

SEQ ID NO: 715949 - DNA, 25 bp, Mus musculus
gggctttgactggatcgccaccaca

SEQ ID NO: 715950 - DNA, 25 bp, Mus musculus
gggctttgagacacctgttgggaca

SEQ ID NO: 715951 - DNA, 25 bp, Mus musculus
gggctttgagactcctgttgggaca

SEQ ID NO: 715952 - DNA, 25 bp, Mus musculus
gggctttgccatcagctaacaaatg

SEQ ID NO: 715953 - DNA, 25 bp, Mus musculus
gggctttgccatgagctaacaaatg

SEQ ID NO: 715954 - DNA, 25 bp, Mus musculus
gggctttggagaaatttacgatgcc

SEQ ID NO: 715955 - DNA, 25 bp, Mus musculus
gggctttggagatatttacgatgcc

SEQ ID NO: 715956 - DNA, 25 bp, Mus musculus
gggcttttccaacaagagcgcaaag

SEQ ID NO: 715957 - DNA, 25 bp, Mus musculus
gggcttttccaagaagagcgcaaag

SEQ ID NO: 715958 - DNA, 25 bp, Mus musculus
gggcttttctagagcacatgtgtaa

SEQ ID NO: 715959 - DNA, 25 bp, Mus musculus
gggcttttctagtgcacatgtgtaa

SEQ ID NO: 715960 - DNA, 25 bp, Mus musculus
gggcttttctggcacagtaagaagc

SEQ ID NO: 715961 - DNA, 25 bp, Mus musculus
gggcttttctgggacagtaagaagc

SEQ ID NO: 715962 - DNA, 25 bp, Mus musculus
gggctttttcctctgctccgagtag

SEQ ID NO: 715963 - DNA, 25 bp, Mus musculus
gggctttttcctgtgctccgagtag

SEQ ID NO: 715964 - DNA, 25 bp, Mus musculus
ggggcaatgccaacttcctgaagga

SEQ ID NO: 715965 - DNA, 25 bp, Mus musculus
ggggcaatgccatcttcctgaagga

SEQ ID NO: 715966 - DNA, 25 bp, Mus musculus
gggtaaaaatctccacccagacgtg

SEQ ID NO: 715967 - DNA, 25 bp, Mus musculus
gggtaaaaatctgcacccagacgtg

SEQ ID NO: 715968 - DNA, 25 bp, Mus musculus
gggtaaacacagaaagcccattata

SEQ ID NO: 715969 - DNA, 25 bp, Mus musculus
gggtaaacacagtaagcccattata

SEQ ID NO: 715970 - DNA, 25 bp, Mus musculus
gggtaaacccaccaatgtcagcgtg

SEQ ID NO: 715971 - DNA, 25 bp, Mus musculus
gggtaaacccacgaatgtcagcgtg

SEQ ID NO: 715972 - DNA, 25 bp, Mus musculus
gggtaaagaagtcgcctcccagctt

SEQ ID NO: 715973 - DNA, 25 bp, Mus musculus
gggtaaagaagtggcctcccagctt

SEQ ID NO: 715974 - DNA, 25 bp, Mus musculus
gggtaaagaatcacctgatatgact

SEQ ID NO: 715975 - DNA, 25 bp, Mus musculus
gggtaaagaatctcctgatatgact

SEQ ID NO: 715976 - DNA, 25 bp, Mus musculus
gggtaaagcccacctagtccgctga

SEQ ID NO: 715977 - DNA, 25 bp, Mus musculus
gggtaaagcccagctagtccgctga

SEQ ID NO: 715978 - DNA, 25 bp, Mus musculus
gggtaaattctcatgctaagcaagc

SEQ ID NO: 715979 - DNA, 25 bp, Mus musculus
gggtaaattctcttgctaagcaagc

SEQ ID NO: 715980 - DNA, 25 bp, Mus musculus
gggtaacagcctcctcaaccagggt

SEQ ID NO: 715981 - DNA, 25 bp, Mus musculus
gggtaacagcctgctcaaccagggt

SEQ ID NO: 715982 - DNA, 25 bp, Mus musculus
gggtaacatatcactttcctattca

SEQ ID NO: 715983 - DNA, 25 bp, Mus musculus
gggtaacatatctctttcctattca

SEQ ID NO: 715984 - DNA, 25 bp, Mus musculus
gggtaaccaaacaccatagcagctg

SEQ ID NO: 715985 - DNA, 25 bp, Mus musculus
gggtaaccaaactccatagcagctg

SEQ ID NO: 715986 - DNA, 25 bp, Mus musculus
gggtaactctatcggactctcccat

SEQ ID NO: 715987 - DNA, 25 bp, Mus musculus
gggtaactctatgggactctcccat

SEQ ID NO: 715988 - DNA, 25 bp, Mus musculus
gggtaactgaggaccaccttgcagg

SEQ ID NO: 715989 - DNA, 25 bp, Mus musculus
gggtaactgaggtccaccttgcagg

SEQ ID NO: 715990 - DNA, 25 bp, Mus musculus
gggtaatacactacgatccttagac

SEQ ID NO: 715991 - DNA, 25 bp, Mus musculus
gggtaatacacttcgatccttagac

SEQ ID NO: 715992 - DNA, 25 bp, Mus musculus
gggtaatgctgcagaccgtctctga

SEQ ID NO: 715993 - DNA, 25 bp, Mus musculus
gggtaatgctgctgaccgtctctga

SEQ ID NO: 715994 - DNA, 25 bp, Mus musculus
gggtacaaaggcatggaatccatat

SEQ ID NO: 715995 - DNA, 25 bp, Mus musculus
gggtacaaaggcttggaatccatat

SEQ ID NO: 715996 - DNA, 25 bp, Mus musculus
gggtacaacacgcaatccgtcacag

SEQ ID NO: 715997 - DNA, 25 bp, Mus musculus
gggtacaacacggaatccgtcacag

SEQ ID NO: 715998 - DNA, 25 bp, Mus musculus
gggtacaatagtatgagaaatccat

SEQ ID NO: 715999 - DNA, 25 bp, Mus musculus
gggtacaatagtttgagaaatccat

SEQ ID NO: 716000 - DNA, 25 bp, Mus musculus
gggtacaatgcccaggtgggtgaca

SEQ ID NO: 716001 - DNA, 25 bp, Mus musculus
gggtacaatgccgaggtgggtgaca

SEQ ID NO: 716002 - DNA, 25 bp, Mus musculus
gggtacacaggacccacttgtcaca

SEQ ID NO: 716003 - DNA, 25 bp, Mus musculus
gggtacacaggagccacttgtcaca

SEQ ID NO: 716004 - DNA, 25 bp, Mus musculus
gggtacacccttctggatggcacct

SEQ ID NO: 716005 - DNA, 25 bp, Mus musculus
gggtacacccttgtggatggcacct

SEQ ID NO: 716006 - DNA, 25 bp, Mus musculus
gggtacactaccactatttcgccat

SEQ ID NO: 716007 - DNA, 25 bp, Mus musculus
gggtacactacctctatttcgccat

SEQ ID NO: 716008 - DNA, 25 bp, Mus musculus
gggtacactgggagggcatctccat

SEQ ID NO: 716009 - DNA, 25 bp, Mus musculus
gggtacactgggtgggcatctccat

SEQ ID NO: 716010 - DNA, 25 bp, Mus musculus
gggtacagcaatacatcctcaacct

SEQ ID NO: 716011 - DNA, 25 bp, Mus musculus
gggtacagcaattcatcctcaacct

SEQ ID NO: 716012 - DNA, 25 bp, Mus musculus
gggtacatatggactccgctgagaa

SEQ ID NO: 716013 - DNA, 25 bp, Mus musculus
gggtacatatggtctccgctgagaa

SEQ ID NO: 716014 - DNA, 25 bp, Mus musculus
gggtacatcaacagtatggctgtgc

SEQ ID NO: 716015 - DNA, 25 bp, Mus musculus
gggtacatcaactgtatggctgtgc

SEQ ID NO: 716016 - DNA, 25 bp, Mus musculus
gggtacatcgtgactgtgtttttca

SEQ ID NO: 716017 - DNA, 25 bp, Mus musculus
gggtacatcgtgtctgtgtttttca

SEQ ID NO: 716018 - DNA, 25 bp, Mus musculus
gggtacattggaaacccaagcttgg

SEQ ID NO: 716019 - DNA, 25 bp, Mus musculus
gggtacattggatacccaagcttgg

SEQ ID NO: 716020 - DNA, 25 bp, Mus musculus
gggtacccagttcttgagctcagtg

SEQ ID NO: 716021 - DNA, 25 bp, Mus musculus
gggtacccagttgttgagctcagtg

SEQ ID NO: 716022 - DNA, 25 bp, Mus musculus
gggtaccccaaacttatccaagatg

SEQ ID NO: 716023 - DNA, 25 bp, Mus musculus
gggtaccccaaagttatccaagatg

SEQ ID NO: 716024 - DNA, 25 bp, Mus musculus
gggtaccccagtctgcacgagatca

SEQ ID NO: 716025 - DNA, 25 bp, Mus musculus
gggtaccccagtgtgcacgagatca

SEQ ID NO: 716026 - DNA, 25 bp, Mus musculus
gggtacccttggacatggtcagtgt

SEQ ID NO: 716027 - DNA, 25 bp, Mus musculus
gggtacccttggtcatggtcagtgt

SEQ ID NO: 716028 - DNA, 25 bp, Mus musculus
gggtaccgaagccatccttcttgca

SEQ ID NO: 716029 - DNA, 25 bp, Mus musculus
gggtaccgaagcgatccttcttgca

SEQ ID NO: 716030 - DNA, 25 bp, Mus musculus
gggtaccgataaatagctctcaaca

SEQ ID NO: 716031 - DNA, 25 bp, Mus musculus
gggtaccgataattagctctcaaca

SEQ ID NO: 716032 - DNA, 25 bp, Mus musculus
gggtaccgcttgacaactgtacttg

SEQ ID NO: 716033 - DNA, 25 bp, Mus musculus
gggtaccgcttgtcaactgtacttg

SEQ ID NO: 716034 - DNA, 25 bp, Mus musculus
gggtaccgtcacatctgcaacaaac

SEQ ID NO: 716035 - DNA, 25 bp, Mus musculus
gggtaccgtcacttctgcaacaaac

SEQ ID NO: 716036 - DNA, 25 bp, Mus musculus
gggtacctccacactgctagtctgg

SEQ ID NO: 716037 - DNA, 25 bp, Mus musculus
gggtacctccactctgctagtctgg

SEQ ID NO: 716038 - DNA, 25 bp, Mus musculus
gggtacctgcatagatctgaccaac

SEQ ID NO: 716039 - DNA, 25 bp, Mus musculus
gggtacctgcattgatctgaccaac

SEQ ID NO: 716040 - DNA, 25 bp, Mus musculus
gggtacgctccacaacactgacgca

SEQ ID NO: 716041 - DNA, 25 bp, Mus musculus
gggtacgctccagaacactgacgca

SEQ ID NO: 716042 - DNA, 25 bp, Mus musculus
gggtactaatggaggcagccagcca

SEQ ID NO: 716043 - DNA, 25 bp, Mus musculus
gggtactaatggtggcagccagcca

SEQ ID NO: 716044 - DNA, 25 bp, Mus musculus
gggtactaccatcccaatgcggttt

SEQ ID NO: 716045 - DNA, 25 bp, Mus musculus
gggtactaccatgccaatgcggttt

SEQ ID NO: 716046 - DNA, 25 bp, Mus musculus
gggtactacctcatccctcgggcgt

SEQ ID NO: 716047 - DNA, 25 bp, Mus musculus
gggtactacctcttccctcgggcgt

SEQ ID NO: 716048 - DNA, 25 bp, Mus musculus
gggtactcaggtccccaagcgccta

SEQ ID NO: 716049 - DNA, 25 bp, Mus musculus
gggtactcaggtgcccaagcgccta

SEQ ID NO: 716050 - DNA, 25 bp, Mus musculus
gggtactccaatcgtgaaagacttc

SEQ ID NO: 716051 - DNA, 25 bp, Mus musculus
gggtactccaatggtgaaagacttc

SEQ ID NO: 716052 - DNA, 25 bp, Mus musculus
gggtactcctagcacttttatacag

SEQ ID NO: 716053 - DNA, 25 bp, Mus musculus
gggtactcctaggacttttatacag

SEQ ID NO: 716054 - DNA, 25 bp, Mus musculus
gggtactgctacaccattggtcaat

SEQ ID NO: 716055 - DNA, 25 bp, Mus musculus
gggtactgctactccattggtcaat

SEQ ID NO: 716056 - DNA, 25 bp, Mus musculus
gggtactgttatcaaacgatgctta

SEQ ID NO: 716057 - DNA, 25 bp, Mus musculus
gggtactgttatgaaacgatgctta

SEQ ID NO: 716058 - DNA, 25 bp, Mus musculus
gggtagaactcactgccacccgtaa

SEQ ID NO: 716059 - DNA, 25 bp, Mus musculus
gggtagaactcagtgccacccgtaa

SEQ ID NO: 716060 - DNA, 25 bp, Mus musculus
gggtagacgatcctgacccagctaa

SEQ ID NO: 716061 - DNA, 25 bp, Mus musculus
gggtagacgatcgtgacccagctaa

SEQ ID NO: 716062 - DNA, 25 bp, Mus musculus
gggtagactacaccctgagctccag

SEQ ID NO: 716063 - DNA, 25 bp, Mus musculus
gggtagactacagcctgagctccag

SEQ ID NO: 716064 - DNA, 25 bp, Mus musculus
gggtagactttgcaactacttgaat

SEQ ID NO: 716065 - DNA, 25 bp, Mus musculus
gggtagactttggaactacttgaat

SEQ ID NO: 716066 - DNA, 25 bp, Mus musculus
gggtagatctccacacactagagtg

SEQ ID NO: 716067 - DNA, 25 bp, Mus musculus
gggtagatctcctcacactagagtg

SEQ ID NO: 716068 - DNA, 25 bp, Mus musculus
gggtagcacacaccctaccacaagg

SEQ ID NO: 716069 - DNA, 25 bp, Mus musculus
gggtagcacacagcctaccacaagg

SEQ ID NO: 716070 - DNA, 25 bp, Mus musculus
gggtagcacattctcccaacggaga

SEQ ID NO: 716071 - DNA, 25 bp, Mus musculus
gggtagcacattgtcccaacggaga

SEQ ID NO: 716072 - DNA, 25 bp, Mus musculus
gggtagcagtgacctttcctgggag

SEQ ID NO: 716073 - DNA, 25 bp, Mus musculus
gggtagcagtgagctttcctgggag

SEQ ID NO: 716074 - DNA, 25 bp, Mus musculus
gggtagcccgtaaatccaagttcat

SEQ ID NO: 716075 - DNA, 25 bp, Mus musculus
gggtagcccgtatatccaagttcat

SEQ ID NO: 716076 - DNA, 25 bp, Mus musculus
gggtagctatccaaagaaacctatg

SEQ ID NO: 716077 - DNA, 25 bp, Mus musculus
gggtagctatcctaagaaacctatg

SEQ ID NO: 716078 - DNA, 25 bp, Mus musculus
gggtagctctctccctgatgagtct

SEQ ID NO: 716079 - DNA, 25 bp, Mus musculus
gggtagctctctgcctgatgagtct

SEQ ID NO: 716080 - DNA, 25 bp, Mus musculus
gggtaggactctcaccctgcctcgg

SEQ ID NO: 716081 - DNA, 25 bp, Mus musculus
gggtaggactctgaccctgcctcgg

SEQ ID NO: 716082 - DNA, 25 bp, Mus musculus
gggtaggatttcctgtactatagga

SEQ ID NO: 716083 - DNA, 25 bp, Mus musculus
gggtaggatttcgtgtactatagga

SEQ ID NO: 716084 - DNA, 25 bp, Mus musculus
gggtaggcgacaatcagagcactat

SEQ ID NO: 716085 - DNA, 25 bp, Mus musculus
gggtaggcgacattcagagcactat

SEQ ID NO: 716086 - DNA, 25 bp, Mus musculus
gggtagggtttaacactcgatcagt

SEQ ID NO: 716087 - DNA, 25 bp, Mus musculus
gggtagggtttatcactcgatcagt

SEQ ID NO: 716088 - DNA, 25 bp, Mus musculus
gggtagtccgagcaaaacttctcta

SEQ ID NO: 716089 - DNA, 25 bp, Mus musculus
gggtagtccgaggaaaacttctcta

SEQ ID NO: 716090 - DNA, 25 bp, Mus musculus
gggtagtctctaagacccgcagagg

SEQ ID NO: 716091 - DNA, 25 bp, Mus musculus
gggtagtctctatgacccgcagagg

SEQ ID NO: 716092 - DNA, 25 bp, Mus musculus
gggtatacagttctgagggctgcaa

SEQ ID NO: 716093 - DNA, 25 bp, Mus musculus
gggtatacagttgtgagggctgcaa

SEQ ID NO: 716094 - DNA, 25 bp, Mus musculus
gggtataggctgatattgcccctcc

SEQ ID NO: 716095 - DNA, 25 bp, Mus musculus
gggtataggctgttattgcccctcc

SEQ ID NO: 716096 - DNA, 25 bp, Mus musculus
gggtatcaccacagttcataactct

SEQ ID NO: 716097 - DNA, 25 bp, Mus musculus
gggtatcaccactgttcataactct

SEQ ID NO: 716098 - DNA, 25 bp, Mus musculus
gggtatcagaaccttcccaacactg

SEQ ID NO: 716099 - DNA, 25 bp, Mus musculus
gggtatcagaacgttcccaacactg

SEQ ID NO: 716100 - DNA, 25 bp, Mus musculus
gggtatcatcttaggtggccgtaga

SEQ ID NO: 716101 - DNA, 25 bp, Mus musculus
gggtatcatctttggtggccgtaga

SEQ ID NO: 716102 - DNA, 25 bp, Mus musculus
gggtatcccgaactctgagtctcaa

SEQ ID NO: 716103 - DNA, 25 bp, Mus musculus
gggtatcccgaagtctgagtctcaa

SEQ ID NO: 716104 - DNA, 25 bp, Mus musculus
gggtatcccgctattctacatcgag

SEQ ID NO: 716105 - DNA, 25 bp, Mus musculus
gggtatcccgcttttctacatcgag

SEQ ID NO: 716106 - DNA, 25 bp, Mus musculus
gggtatccgcaactcttaagcgtcg

SEQ ID NO: 716107 - DNA, 25 bp, Mus musculus
gggtatccgcaagtcttaagcgtcg

SEQ ID NO: 716108 - DNA, 25 bp, Mus musculus
gggtatcctgctcttcgagctgctg

SEQ ID NO: 716109 - DNA, 25 bp, Mus musculus
gggtatcctgctgttcgagctgctg

SEQ ID NO: 716110 - DNA, 25 bp, Mus musculus
gggtatctaaatcacctggaggtca

SEQ ID NO: 716111 - DNA, 25 bp, Mus musculus
gggtatctaaatgacctggaggtca

SEQ ID NO: 716112 - DNA, 25 bp, Mus musculus
gggtatctacaccagagttttaaat

SEQ ID NO: 716113 - DNA, 25 bp, Mus musculus
gggtatctacacgagagttttaaat

SEQ ID NO: 716114 - DNA, 25 bp, Mus musculus
gggtatctccctcgagtcagaggcc

SEQ ID NO: 716115 - DNA, 25 bp, Mus musculus
gggtatctccctggagtcagaggcc

SEQ ID NO: 716116 - DNA, 25 bp, Mus musculus
gggtatctgatccttatcacgaaga

SEQ ID NO: 716117 - DNA, 25 bp, Mus musculus
gggtatctgatcgttatcacgaaga

SEQ ID NO: 716118 - DNA, 25 bp, Mus musculus
gggtatgcaaggagtctgaagacta

SEQ ID NO: 716119 - DNA, 25 bp, Mus musculus
gggtatgcaaggtgtctgaagacta

SEQ ID NO: 716120 - DNA, 25 bp, Mus musculus
gggtatgcccaacctggacctggtt

SEQ ID NO: 716121 - DNA, 25 bp, Mus musculus
gggtatgcccaagctggacctggtt

SEQ ID NO: 716122 - DNA, 25 bp, Mus musculus
gggtatggaaggctacatcaaaata

SEQ ID NO: 716123 - DNA, 25 bp, Mus musculus
gggtatggaagggtacatcaaaata

SEQ ID NO: 716124 - DNA, 25 bp, Mus musculus
gggtatggacccatcatttctagtc

SEQ ID NO: 716125 - DNA, 25 bp, Mus musculus
gggtatggacccttcatttctagtc

SEQ ID NO: 716126 - DNA, 25 bp, Mus musculus
gggtattaacaaacagtccaacctg

SEQ ID NO: 716127 - DNA, 25 bp, Mus musculus
gggtattaacaatcagtccaacctg

SEQ ID NO: 716128 - DNA, 25 bp, Mus musculus
gggtattcacctccaagcttttgtc

SEQ ID NO: 716129 - DNA, 25 bp, Mus musculus
gggtattcacctgcaagcttttgtc

SEQ ID NO: 716130 - DNA, 25 bp, Mus musculus
gggtattcctttcaccttcttcaga

SEQ ID NO: 716131 - DNA, 25 bp, Mus musculus
gggtattcctttgaccttcttcaga

SEQ ID NO: 716132 - DNA, 25 bp, Mus musculus
gggtattgcatgatcaaccatctgg

SEQ ID NO: 716133 - DNA, 25 bp, Mus musculus
gggtattgcatgttcaaccatctgg

SEQ ID NO: 716134 - DNA, 25 bp, Mus musculus
gggtattgcttcagctctatgaatt

SEQ ID NO: 716135 - DNA, 25 bp, Mus musculus
gggtattgcttctgctctatgaatt

SEQ ID NO: 716136 - DNA, 25 bp, Mus musculus
gggtatttaagaagtccgatggttg

SEQ ID NO: 716137 - DNA, 25 bp, Mus musculus
gggtatttaagatgtccgatggttg

SEQ ID NO: 716138 - DNA, 25 bp, Mus musculus
gggtatttcctacttgcattatcta

SEQ ID NO: 716139 - DNA, 25 bp, Mus musculus
gggtatttcctagttgcattatcta

SEQ ID NO: 716140 - DNA, 25 bp, Mus musculus
gggtatttttagctccagcacctgc

SEQ ID NO: 716141 - DNA, 25 bp, Mus musculus
gggtatttttaggtccagcacctgc

SEQ ID NO: 716142 - DNA, 25 bp, Mus musculus
gggtcaaagcaaagaggtaaaaggc

SEQ ID NO: 716143 - DNA, 25 bp, Mus musculus
gggtcaaagcaatgaggtaaaaggc

SEQ ID NO: 716144 - DNA, 25 bp, Mus musculus
gggtcaaagccaacagccaaagaag

SEQ ID NO: 716145 - DNA, 25 bp, Mus musculus
gggtcaaagccatcagccaaagaag

SEQ ID NO: 716146 - DNA, 25 bp, Mus musculus
gggtcaaagcgtattctcagtgtgt

SEQ ID NO: 716147 - DNA, 25 bp, Mus musculus
gggtcaaagcgttttctcagtgtgt

SEQ ID NO: 716148 - DNA, 25 bp, Mus musculus
gggtcaaatcatacgtctcaccttt

SEQ ID NO: 716149 - DNA, 25 bp, Mus musculus
gggtcaaatcattcgtctcaccttt

SEQ ID NO: 716150 - DNA, 25 bp, Mus musculus
gggtcaaattatcggccaggccctg

SEQ ID NO: 716151 - DNA, 25 bp, Mus musculus
gggtcaaattatgggccaggccctg

SEQ ID NO: 716152 - DNA, 25 bp, Mus musculus
gggtcaaccagtacggcaacaagta

SEQ ID NO: 716153 - DNA, 25 bp, Mus musculus
gggtcaaccagttcggcaacaagta

SEQ ID NO: 716154 - DNA, 25 bp, Mus musculus
gggtcaactcgcacactcacatggt

SEQ ID NO: 716155 - DNA, 25 bp, Mus musculus
gggtcaactcgctcactcacatggt

SEQ ID NO: 716156 - DNA, 25 bp, Mus musculus
gggtcaactcttctgttggattttc

SEQ ID NO: 716157 - DNA, 25 bp, Mus musculus
gggtcaactcttgtgttggattttc

SEQ ID NO: 716158 - DNA, 25 bp, Mus musculus
gggtcaagaacaagatgccttctgg

SEQ ID NO: 716159 - DNA, 25 bp, Mus musculus
gggtcaagaacatgatgccttctgg

SEQ ID NO: 716160 - DNA, 25 bp, Mus musculus
gggtcaagccgaatctcatatttga

SEQ ID NO: 716161 - DNA, 25 bp, Mus musculus
gggtcaagccgattctcatatttga

SEQ ID NO: 716162 - DNA, 25 bp, Mus musculus
gggtcaagctctctgctctcaccat

SEQ ID NO: 716163 - DNA, 25 bp, Mus musculus
gggtcaagctctgtgctctcaccat

SEQ ID NO: 716164 - DNA, 25 bp, Mus musculus
gggtcaaggaacctcagtcaccgtc

SEQ ID NO: 716165 - DNA, 25 bp, Mus musculus
gggtcaaggaacgtcagtcaccgtc

SEQ ID NO: 716166 - DNA, 25 bp, Mus musculus
gggtcaagtcatctgcagttttgca

SEQ ID NO: 716167 - DNA, 25 bp, Mus musculus
gggtcaagtcatgtgcagttttgca

SEQ ID NO: 716168 - DNA, 25 bp, Mus musculus
gggtcacaagtgactcccacgtgtt

SEQ ID NO: 716169 - DNA, 25 bp, Mus musculus
gggtcacaagtgtctcccacgtgtt

SEQ ID NO: 716170 - DNA, 25 bp, Mus musculus
gggtcacaatgcatatagccagctg

SEQ ID NO: 716171 - DNA, 25 bp, Mus musculus
gggtcacaatgcttatagccagctg

SEQ ID NO: 716172 - DNA, 25 bp, Mus musculus
gggtcacactacagtgggtcaggaa

SEQ ID NO: 716173 - DNA, 25 bp, Mus musculus
gggtcacactactgtgggtcaggaa

SEQ ID NO: 716174 - DNA, 25 bp, Mus musculus
gggtcacactgccttcagattcctg

SEQ ID NO: 716175 - DNA, 25 bp, Mus musculus
gggtcacactgcgttcagattcctg

SEQ ID NO: 716176 - DNA, 25 bp, Mus musculus
gggtcacagtggatgtgctgatcct

SEQ ID NO: 716177 - DNA, 25 bp, Mus musculus
gggtcacagtggttgtgctgatcct

SEQ ID NO: 716178 - DNA, 25 bp, Mus musculus
gggtcacatcctatctacctggcac

SEQ ID NO: 716179 - DNA, 25 bp, Mus musculus
gggtcacatcctttctacctggcac

SEQ ID NO: 716180 - DNA, 25 bp, Mus musculus
gggtcaccatccatgggcatgtcca

SEQ ID NO: 716181 - DNA, 25 bp, Mus musculus
gggtcaccatccttgggcatgtcca

SEQ ID NO: 716182 - DNA, 25 bp, Mus musculus
gggtcaccctttccagacagcctgg

SEQ ID NO: 716183 - DNA, 25 bp, Mus musculus
gggtcaccctttgcagacagcctgg

SEQ ID NO: 716184 - DNA, 25 bp, Mus musculus
gggtcacctgcaatccatagcattg

SEQ ID NO: 716185 - DNA, 25 bp, Mus musculus
gggtcacctgcattccatagcattg

SEQ ID NO: 716186 - DNA, 25 bp, Mus musculus
gggtcacggattcacgactatgaca

SEQ ID NO: 716187 - DNA, 25 bp, Mus musculus
gggtcacggattgacgactatgaca

SEQ ID NO: 716188 - DNA, 25 bp, Mus musculus
gggtcactctcacacgacgctgcat

SEQ ID NO: 716189 - DNA, 25 bp, Mus musculus
gggtcactctcagacgacgctgcat

SEQ ID NO: 716190 - DNA, 25 bp, Mus musculus
gggtcactgcctacctgtgtggaca

SEQ ID NO: 716191 - DNA, 25 bp, Mus musculus
gggtcactgccttcctgtgtggaca

SEQ ID NO: 716192 - DNA, 25 bp, Mus musculus
gggtcactgctcaatatacaataag

SEQ ID NO: 716193 - DNA, 25 bp, Mus musculus
gggtcactgctctatatacaataag

SEQ ID NO: 716194 - DNA, 25 bp, Mus musculus
gggtcactggacaagtcccttctct

SEQ ID NO: 716195 - DNA, 25 bp, Mus musculus
gggtcactggactagtcccttctct

SEQ ID NO: 716196 - DNA, 25 bp, Mus musculus
gggtcactggcgagtctctacaagg

SEQ ID NO: 716197 - DNA, 25 bp, Mus musculus
gggtcactggcgtgtctctacaagg

SEQ ID NO: 716198 - DNA, 25 bp, Mus musculus
gggtcactgtccaaatcttgctcaa

SEQ ID NO: 716199 - DNA, 25 bp, Mus musculus
gggtcactgtcctaatcttgctcaa

SEQ ID NO: 716200 - DNA, 25 bp, Mus musculus
gggtcacttaccaccctgtgcagaa

SEQ ID NO: 716201 - DNA, 25 bp, Mus musculus
gggtcacttacctccctgtgcagaa

SEQ ID NO: 716202 - DNA, 25 bp, Mus musculus
gggtcagaaccacctgctataaccg

SEQ ID NO: 716203 - DNA, 25 bp, Mus musculus
gggtcagaaccagctgctataaccg

SEQ ID NO: 716204 - DNA, 25 bp, Mus musculus
gggtcagcaagtcatcacgatagtt

SEQ ID NO: 716205 - DNA, 25 bp, Mus musculus
gggtcagcaagtgatcacgatagtt

SEQ ID NO: 716206 - DNA, 25 bp, Mus musculus
gggtcagcatgtacagaagctcaac

SEQ ID NO: 716207 - DNA, 25 bp, Mus musculus
gggtcagcatgtaccttatccaggt

SEQ ID NO: 716208 - DNA, 25 bp, Mus musculus
gggtcagcatgttcagaagctcaac

SEQ ID NO: 716209 - DNA, 25 bp, Mus musculus
gggtcagcatgttccttatccaggt

SEQ ID NO: 716210 - DNA, 25 bp, Mus musculus
gggtcagcccctctcctatactaga

SEQ ID NO: 716211 - DNA, 25 bp, Mus musculus
gggtcagcccctgtcctatactaga

SEQ ID NO: 716212 - DNA, 25 bp, Mus musculus
gggtcagccgtcacctctggaggct

SEQ ID NO: 716213 - DNA, 25 bp, Mus musculus
gggtcagccgtctcctctggaggct

SEQ ID NO: 716214 - DNA, 25 bp, Mus musculus
gggtcagcctccataaacttcgtga

SEQ ID NO: 716215 - DNA, 25 bp, Mus musculus
gggtcagcctccttaaacttcgtga

SEQ ID NO: 716216 - DNA, 25 bp, Mus musculus
gggtcagcgctgcaccaactgtcct

SEQ ID NO: 716217 - DNA, 25 bp, Mus musculus
gggtcagcgctggaccaactgtcct

SEQ ID NO: 716218 - DNA, 25 bp, Mus musculus
gggtcagctagaaacaactttgcag

SEQ ID NO: 716219 - DNA, 25 bp, Mus musculus
gggtcagctagatacaactttgcag

SEQ ID NO: 716220 - DNA, 25 bp, Mus musculus
gggtcagctgatccattcttccctc

SEQ ID NO: 716221 - DNA, 25 bp, Mus musculus
gggtcagctgatgcattcttccctc

SEQ ID NO: 716222 - DNA, 25 bp, Mus musculus
gggtcagctttaagccagctcctcc

SEQ ID NO: 716223 - DNA, 25 bp, Mus musculus
gggtcagctttatgccagctcctcc

SEQ ID NO: 716224 - DNA, 25 bp, Mus musculus
gggtcaggatccaggcatgccttac

SEQ ID NO: 716225 - DNA, 25 bp, Mus musculus
gggtcaggatcctggcatgccttac

SEQ ID NO: 716226 - DNA, 25 bp, Mus musculus
gggtcaggcatgaagctgcaatcca

SEQ ID NO: 716227 - DNA, 25 bp, Mus musculus
gggtcaggcatgtagctgcaatcca

SEQ ID NO: 716228 - DNA, 25 bp, Mus musculus
gggtcaggctttctctgcctgtcac

SEQ ID NO: 716229 - DNA, 25 bp, Mus musculus
gggtcaggctttgtctgcctgtcac

SEQ ID NO: 716230 - DNA, 25 bp, Mus musculus
gggtcagggactcagccactaataa

SEQ ID NO: 716231 - DNA, 25 bp, Mus musculus
gggtcagggactgagccactaataa

SEQ ID NO: 716232 - DNA, 25 bp, Mus musculus
gggtcagggtctactttgtgccgcc

SEQ ID NO: 716233 - DNA, 25 bp, Mus musculus
gggtcagggtcttctttgtgccgcc

SEQ ID NO: 716234 - DNA, 25 bp, Mus musculus
gggtcagtcacacaatcccagcagc

SEQ ID NO: 716235 - DNA, 25 bp, Mus musculus
gggtcagtcacagaatcccagcagc

SEQ ID NO: 716236 - DNA, 25 bp, Mus musculus
gggtcagtggcaacctgtttaatga

SEQ ID NO: 716237 - DNA, 25 bp, Mus musculus
gggtcagtggcatcctgtttaatga

SEQ ID NO: 716238 - DNA, 25 bp, Mus musculus
gggtcagtgtccacgacatcaaaaa

SEQ ID NO: 716239 - DNA, 25 bp, Mus musculus
gggtcagtgtcctcgacatcaaaaa

SEQ ID NO: 716240 - DNA, 25 bp, Mus musculus
gggtcagtgtttctagatcacttgg

SEQ ID NO: 716241 - DNA, 25 bp, Mus musculus
gggtcagtgtttgtagatcacttgg

SEQ ID NO: 716242 - DNA, 25 bp, Mus musculus
gggtcagttgtcctatttaagttct

SEQ ID NO: 716243 - DNA, 25 bp, Mus musculus
gggtcagttgtcgtatttaagttct

SEQ ID NO: 716244 - DNA, 25 bp, Mus musculus
gggtcatcaggtcagcatgctcgct

SEQ ID NO: 716245 - DNA, 25 bp, Mus musculus
gggtcatcaggtgagcatgctcgct

SEQ ID NO: 716246 - DNA, 25 bp, Mus musculus
gggtcatctctacttggatccttcg

SEQ ID NO: 716247 - DNA, 25 bp, Mus musculus
gggtcatctctagttggatccttcg

SEQ ID NO: 716248 - DNA, 25 bp, Mus musculus
gggtcatctgcaaggaccagcgcct

SEQ ID NO: 716249 - DNA, 25 bp, Mus musculus
gggtcatctgcatggaccagcgcct

SEQ ID NO: 716250 - DNA, 25 bp, Mus musculus
gggtcatgatttacgtcaagattac

SEQ ID NO: 716251 - DNA, 25 bp, Mus musculus
gggtcatgattttcgtcaagattac

SEQ ID NO: 716252 - DNA, 25 bp, Mus musculus
gggtcatgccctaggcataagggct

SEQ ID NO: 716253 - DNA, 25 bp, Mus musculus
gggtcatgcccttggcataagggct

SEQ ID NO: 716254 - DNA, 25 bp, Mus musculus
gggtcatgcgtgataggaacgtcaa

SEQ ID NO: 716255 - DNA, 25 bp, Mus musculus
gggtcatgcgtgttaggaacgtcaa

SEQ ID NO: 716256 - DNA, 25 bp, Mus musculus
gggtcatggattctagaagcctcac

SEQ ID NO: 716257 - DNA, 25 bp, Mus musculus
gggtcatggattgtagaagcctcac

SEQ ID NO: 716258 - DNA, 25 bp, Mus musculus
gggtcattaccgctctggagactca

SEQ ID NO: 716259 - DNA, 25 bp, Mus musculus
gggtcattaccggtctggagactca

SEQ ID NO: 716260 - DNA, 25 bp, Mus musculus
gggtcattcggaagcccattctaat

SEQ ID NO: 716261 - DNA, 25 bp, Mus musculus
gggtcattcggatgcccattctaat

SEQ ID NO: 716262 - DNA, 25 bp, Mus musculus
gggtccaaagtgcttagctcctagg

SEQ ID NO: 716263 - DNA, 25 bp, Mus musculus
gggtccaaagtggttagctcctagg

SEQ ID NO: 716264 - DNA, 25 bp, Mus musculus
gggtccaactggagaacctccaaga

SEQ ID NO: 716265 - DNA, 25 bp, Mus musculus
gggtccaactggtgaacctccaaga

SEQ ID NO: 716266 - DNA, 25 bp, Mus musculus
gggtccaacttcattgctccgctgc

SEQ ID NO: 716267 - DNA, 25 bp, Mus musculus
gggtccaacttctttgctccgctgc

SEQ ID NO: 716268 - DNA, 25 bp, Mus musculus
gggtccacatgcatggcgtctaatg

SEQ ID NO: 716269 - DNA, 25 bp, Mus musculus
gggtccacatgcttggcgtctaatg

SEQ ID NO: 716270 - DNA, 25 bp, Mus musculus
gggtccacccctctatcttactagg

SEQ ID NO: 716271 - DNA, 25 bp, Mus musculus
gggtccacccctgtatcttactagg

SEQ ID NO: 716272 - DNA, 25 bp, Mus musculus
gggtccacctgaagaatcccatggt

SEQ ID NO: 716273 - DNA, 25 bp, Mus musculus
gggtccacctgatgaatcccatggt

SEQ ID NO: 716274 - DNA, 25 bp, Mus musculus
gggtccacttccatcttgtcttcat

SEQ ID NO: 716275 - DNA, 25 bp, Mus musculus
gggtccacttccttcttgtcttcat

SEQ ID NO: 716276 - DNA, 25 bp, Mus musculus
gggtccagagggagatgccgcctct

SEQ ID NO: 716277 - DNA, 25 bp, Mus musculus
gggtccagagggtgatgccgcctct

SEQ ID NO: 716278 - DNA, 25 bp, Mus musculus
gggtccagatcaagtgtgagctccg

SEQ ID NO: 716279 - DNA, 25 bp, Mus musculus
gggtccagatcatgtgtgagctccg

SEQ ID NO: 716280 - DNA, 25 bp, Mus musculus
gggtccaggcctctgatagtcctca

SEQ ID NO: 716281 - DNA, 25 bp, Mus musculus
gggtccaggcctgtgatagtcctca

SEQ ID NO: 716282 - DNA, 25 bp, Mus musculus
gggtccagtagtaaccttgcaagat

SEQ ID NO: 716283 - DNA, 25 bp, Mus musculus
gggtccagtagttaccttgcaagat

SEQ ID NO: 716284 - DNA, 25 bp, Mus musculus
gggtccagtgctccctaagcaaagt

SEQ ID NO: 716285 - DNA, 25 bp, Mus musculus
gggtccagtgctgcctaagcaaagt

SEQ ID NO: 716286 - DNA, 25 bp, Mus musculus
gggtccagtggcatctatcaaaatg

SEQ ID NO: 716287 - DNA, 25 bp, Mus musculus
gggtccagtggcttctatcaaaatg

SEQ ID NO: 716288 - DNA, 25 bp, Mus musculus
gggtccatcacacaccttgtgaaga

SEQ ID NO: 716289 - DNA, 25 bp, Mus musculus
gggtccatcacagaccttgtgaaga

SEQ ID NO: 716290 - DNA, 25 bp, Mus musculus
gggtccattcacatgactgtgggct

SEQ ID NO: 716291 - DNA, 25 bp, Mus musculus
gggtccattcacttgactgtgggct

SEQ ID NO: 716292 - DNA, 25 bp, Mus musculus
gggtccattctgagaacaatgcatg

SEQ ID NO: 716293 - DNA, 25 bp, Mus musculus
gggtccattctgtgaacaatgcatg

SEQ ID NO: 716294 - DNA, 25 bp, Mus musculus
gggtcccacttcaaaagatctggat

SEQ ID NO: 716295 - DNA, 25 bp, Mus musculus
gggtcccacttctaaagatctggat

SEQ ID NO: 716296 - DNA, 25 bp, Mus musculus
gggtcccagggcactgacagccaca

SEQ ID NO: 716297 - DNA, 25 bp, Mus musculus
gggtcccagggctctgacagccaca

SEQ ID NO: 716298 - DNA, 25 bp, Mus musculus
gggtccccaggccatttgagagaaa

SEQ ID NO: 716299 - DNA, 25 bp, Mus musculus
gggtccccaggcgatttgagagaaa

SEQ ID NO: 716300 - DNA, 25 bp, Mus musculus
gggtccccatctcagtcacgggcat

SEQ ID NO: 716301 - DNA, 25 bp, Mus musculus
gggtccccatctgagtcacgggcat

SEQ ID NO: 716302 - DNA, 25 bp, Mus musculus
gggtcccctgaactgcctctgctga

SEQ ID NO: 716303 - DNA, 25 bp, Mus musculus
gggtcccctgaagtgcctctgctga

SEQ ID NO: 716304 - DNA, 25 bp, Mus musculus
gggtcccgagacaagaccataaagt

SEQ ID NO: 716305 - DNA, 25 bp, Mus musculus
gggtcccgagactagaccataaagt

SEQ ID NO: 716306 - DNA, 25 bp, Mus musculus
gggtcccgagtgagccatacatagt

SEQ ID NO: 716307 - DNA, 25 bp, Mus musculus
gggtcccgagtgtgccatacatagt

SEQ ID NO: 716308 - DNA, 25 bp, Mus musculus
gggtcccgctcgaagcggccaacgt

SEQ ID NO: 716309 - DNA, 25 bp, Mus musculus
gggtcccgctcgtagcggccaacgt

SEQ ID NO: 716310 - DNA, 25 bp, Mus musculus
gggtcccggaacagaaggactgcat

SEQ ID NO: 716311 - DNA, 25 bp, Mus musculus
gggtcccggaactgaaggactgcat

SEQ ID NO: 716312 - DNA, 25 bp, Mus musculus
gggtcccggagcactaccaagagaa

SEQ ID NO: 716313 - DNA, 25 bp, Mus musculus
gggtcccggagctctaccaagagaa

SEQ ID NO: 716314 - DNA, 25 bp, Mus musculus
gggtccctcctgacgtcatgggcat

SEQ ID NO: 716315 - DNA, 25 bp, Mus musculus
gggtccctcctgtcgtcatgggcat

SEQ ID NO: 716316 - DNA, 25 bp, Mus musculus
gggtccctccttagcgaaaggcagc

SEQ ID NO: 716317 - DNA, 25 bp, Mus musculus
gggtccctcctttgcgaaaggcagc

SEQ ID NO: 716318 - DNA, 25 bp, Mus musculus
gggtccctgaccatggctcactagt

SEQ ID NO: 716319 - DNA, 25 bp, Mus musculus
gggtccctgaccttggctcactagt

SEQ ID NO: 716320 - DNA, 25 bp, Mus musculus
gggtccctgaggactcccaggcgct

SEQ ID NO: 716321 - DNA, 25 bp, Mus musculus
gggtccctgaggtctcccaggcgct

SEQ ID NO: 716322 - DNA, 25 bp, Mus musculus
gggtccctggccacagactatagta

SEQ ID NO: 716323 - DNA, 25 bp, Mus musculus
gggtccctggcctcagactatagta

SEQ ID NO: 716324 - DNA, 25 bp, Mus musculus
gggtccctgggacagagccatctca

SEQ ID NO: 716325 - DNA, 25 bp, Mus musculus
gggtccctgggagagagccatctca

SEQ ID NO: 716326 - DNA, 25 bp, Mus musculus
gggtccgacaggaaccctgctcttg

SEQ ID NO: 716327 - DNA, 25 bp, Mus musculus
gggtccgacaggtaccctgctcttg

SEQ ID NO: 716328 - DNA, 25 bp, Mus musculus
gggtccgcttccaccgagctgcggg

SEQ ID NO: 716329 - DNA, 25 bp, Mus musculus
gggtccgcttcctccgagctgcggg

SEQ ID NO: 716330 - DNA, 25 bp, Mus musculus
gggtccggagaaagcctctgcctca

SEQ ID NO: 716331 - DNA, 25 bp, Mus musculus
gggtccggagaatgcctctgcctca

SEQ ID NO: 716332 - DNA, 25 bp, Mus musculus
gggtccggccagaattccacactta

SEQ ID NO: 716333 - DNA, 25 bp, Mus musculus
gggtccggccagtattccacactta

SEQ ID NO: 716334 - DNA, 25 bp, Mus musculus
gggtcctacaagatactactacatg

SEQ ID NO: 716335 - DNA, 25 bp, Mus musculus
gggtcctacaagttactactacatg

SEQ ID NO: 716336 - DNA, 25 bp, Mus musculus
gggtcctagagaacactcttcactt

SEQ ID NO: 716337 - DNA, 25 bp, Mus musculus
gggtcctagagatcactcttcactt

SEQ ID NO: 716338 - DNA, 25 bp, Mus musculus
gggtcctaggcgataatgtctctca

SEQ ID NO: 716339 - DNA, 25 bp, Mus musculus
gggtcctaggcgttaatgtctctca

SEQ ID NO: 716340 - DNA, 25 bp, Mus musculus
gggtcctagttcatcaggcttccta

SEQ ID NO: 716341 - DNA, 25 bp, Mus musculus
gggtcctagttcttcaggcttccta

SEQ ID NO: 716342 - DNA, 25 bp, Mus musculus
gggtcctatctaaggaagcctttga

SEQ ID NO: 716343 - DNA, 25 bp, Mus musculus
gggtcctatctatggaagcctttga

SEQ ID NO: 716344 - DNA, 25 bp, Mus musculus
gggtcctatgcacagtagggcattc

SEQ ID NO: 716345 - DNA, 25 bp, Mus musculus
gggtcctatgcagagtagggcattc

SEQ ID NO: 716346 - DNA, 25 bp, Mus musculus
gggtcctcaacaaaatcctgaaagg

SEQ ID NO: 716347 - DNA, 25 bp, Mus musculus
gggtcctcaacataatcctgaaagg

SEQ ID NO: 716348 - DNA, 25 bp, Mus musculus
gggtcctcacccactagcatcagtg

SEQ ID NO: 716349 - DNA, 25 bp, Mus musculus
gggtcctcaccctctagcatcagtg

SEQ ID NO: 716350 - DNA, 25 bp, Mus musculus
gggtcctcctgtacgaaatgctcat

SEQ ID NO: 716351 - DNA, 25 bp, Mus musculus
gggtcctcctgttcgaaatgctcat

SEQ ID NO: 716352 - DNA, 25 bp, Mus musculus
gggtcctcgccaacaagtctctggg

SEQ ID NO: 716353 - DNA, 25 bp, Mus musculus
gggtcctcgccatcaagtctctggg

SEQ ID NO: 716354 - DNA, 25 bp, Mus musculus
gggtcctctgtgaacttgctcagga

SEQ ID NO: 716355 - DNA, 25 bp, Mus musculus
gggtcctctgtgtacttgctcagga

SEQ ID NO: 716356 - DNA, 25 bp, Mus musculus
gggtcctgaaccaccagaagaggtt

SEQ ID NO: 716357 - DNA, 25 bp, Mus musculus
gggtcctgaacctccagaagaggtt

SEQ ID NO: 716358 - DNA, 25 bp, Mus musculus
gggtcctgacctatgccctggatgg

SEQ ID NO: 716359 - DNA, 25 bp, Mus musculus
gggtcctgacctttgccctggatgg

SEQ ID NO: 716360 - DNA, 25 bp, Mus musculus
gggtcctgatgaaggcgttatcact

SEQ ID NO: 716361 - DNA, 25 bp, Mus musculus
gggtcctgatgatggcgttatcact

SEQ ID NO: 716362 - DNA, 25 bp, Mus musculus
gggtcctgcgacagaggcttcacaa

SEQ ID NO: 716363 - DNA, 25 bp, Mus musculus
gggtcctgcgactgaggcttcacaa

SEQ ID NO: 716364 - DNA, 25 bp, Mus musculus
gggtcctggcagagatcagcacact

SEQ ID NO: 716365 - DNA, 25 bp, Mus musculus
gggtcctggcagtgatcagcacact

SEQ ID NO: 716366 - DNA, 25 bp, Mus musculus
gggtcctgtacaagtccctgtttat

SEQ ID NO: 716367 - DNA, 25 bp, Mus musculus
gggtcctgtacatgtccctgtttat

SEQ ID NO: 716368 - DNA, 25 bp, Mus musculus
gggtcctgtgcccagcagtctaatg

SEQ ID NO: 716369 - DNA, 25 bp, Mus musculus
gggtcctgtgccgagcagtctaatg

SEQ ID NO: 716370 - DNA, 25 bp, Mus musculus
gggtccttcccaagtttatatcttt

SEQ ID NO: 716371 - DNA, 25 bp, Mus musculus
gggtccttcccatgtttatatcttt

SEQ ID NO: 716372 - DNA, 25 bp, Mus musculus
gggtccttgagaccagacgcctgct

SEQ ID NO: 716373 - DNA, 25 bp, Mus musculus
gggtccttgagagcagacgcctgct

SEQ ID NO: 716374 - DNA, 25 bp, Mus musculus
gggtcgaacactatctgcaatctcc

SEQ ID NO: 716375 - DNA, 25 bp, Mus musculus
gggtcgaacactttctgcaatctcc

SEQ ID NO: 716376 - DNA, 25 bp, Mus musculus
gggtcgactcctcctgtcactagag

SEQ ID NO: 716377 - DNA, 25 bp, Mus musculus
gggtcgactcctgctgtcactagag

SEQ ID NO: 716378 - DNA, 25 bp, Mus musculus
gggtcgagaggcagtcccgcactcc

SEQ ID NO: 716379 - DNA, 25 bp, Mus musculus
gggtcgagaggctgtcccgcactcc

SEQ ID NO: 716380 - DNA, 25 bp, Mus musculus
gggtcgagcggactctattgcttcc

SEQ ID NO: 716381 - DNA, 25 bp, Mus musculus
gggtcgagcggagtctattgcttcc

SEQ ID NO: 716382 - DNA, 25 bp, Mus musculus
gggtcgcaaggaaaaagagtccctg

SEQ ID NO: 716383 - DNA, 25 bp, Mus musculus
gggtcgcaaggataaagagtccctg

SEQ ID NO: 716384 - DNA, 25 bp, Mus musculus
gggtcgcatcccaggcagtttgagt

SEQ ID NO: 716385 - DNA, 25 bp, Mus musculus
gggtcgcatccctggcagtttgagt

SEQ ID NO: 716386 - DNA, 25 bp, Mus musculus
gggtcgcattcacctcttgccagat

SEQ ID NO: 716387 - DNA, 25 bp, Mus musculus
gggtcgcattcagctcttgccagat

SEQ ID NO: 716388 - DNA, 25 bp, Mus musculus
gggtcgcattgtcaatgacgacttc

SEQ ID NO: 716389 - DNA, 25 bp, Mus musculus
gggtcgcattgtgaatgacgacttc

SEQ ID NO: 716390 - DNA, 25 bp, Mus musculus
gggtcgcctagcctttcccgctggt

SEQ ID NO: 716391 - DNA, 25 bp, Mus musculus
gggtcgcctagcgtttcccgctggt

SEQ ID NO: 716392 - DNA, 25 bp, Mus musculus
gggtcgcctgccacgtttgtctagc

SEQ ID NO: 716393 - DNA, 25 bp, Mus musculus
gggtcgcctgcctcgtttgtctagc

SEQ ID NO: 716394 - DNA, 25 bp, Mus musculus
gggtcgcgctggacttcgaactgca

SEQ ID NO: 716395 - DNA, 25 bp, Mus musculus
gggtcgcgctggtcttcgaactgca

SEQ ID NO: 716396 - DNA, 25 bp, Mus musculus
gggtcgctctgtcctggtccctaga

SEQ ID NO: 716397 - DNA, 25 bp, Mus musculus
gggtcgctctgtgctggtccctaga

SEQ ID NO: 716398 - DNA, 25 bp, Mus musculus
gggtcgctttgaagccttccagttg

SEQ ID NO: 716399 - DNA, 25 bp, Mus musculus
gggtcgctttgatgccttccagttg

SEQ ID NO: 716400 - DNA, 25 bp, Mus musculus
gggtcggaagcgcttcatcactgac

SEQ ID NO: 716401 - DNA, 25 bp, Mus musculus
gggtcggaagcggttcatcactgac

SEQ ID NO: 716402 - DNA, 25 bp, Mus musculus
gggtcggacgtcacccacagcctgg

SEQ ID NO: 716403 - DNA, 25 bp, Mus musculus
gggtcggacgtctcccacagcctgg

SEQ ID NO: 716404 - DNA, 25 bp, Mus musculus
gggtcggagagacaactctcagttt

SEQ ID NO: 716405 - DNA, 25 bp, Mus musculus
gggtcggagagagaactctcagttt

SEQ ID NO: 716406 - DNA, 25 bp, Mus musculus
gggtcggcaaatcagccctgacgct

SEQ ID NO: 716407 - DNA, 25 bp, Mus musculus
gggtcggcaaatgagccctgacgct

SEQ ID NO: 716408 - DNA, 25 bp, Mus musculus
gggtcggccttcaattcttaaagag

SEQ ID NO: 716409 - DNA, 25 bp, Mus musculus
gggtcggccttctattcttaaagag

SEQ ID NO: 716410 - DNA, 25 bp, Mus musculus
gggtcgggctccatctggaaaccga

SEQ ID NO: 716411 - DNA, 25 bp, Mus musculus
gggtcgggctccttctggaaaccga

SEQ ID NO: 716412 - DNA, 25 bp, Mus musculus
gggtcggtcactctcttacaatgcg

SEQ ID NO: 716413 - DNA, 25 bp, Mus musculus
gggtcggtcactgtcttacaatgcg

SEQ ID NO: 716414 - DNA, 25 bp, Mus musculus
gggtcgtaaagccacactggatgaa

SEQ ID NO: 716415 - DNA, 25 bp, Mus musculus
gggtcgtaaagcgacactggatgaa

SEQ ID NO: 716416 - DNA, 25 bp, Mus musculus
gggtcgtacgaccttgcctgtgtct

SEQ ID NO: 716417 - DNA, 25 bp, Mus musculus
gggtcgtacgacgttgcctgtgtct

SEQ ID NO: 716418 - DNA, 25 bp, Mus musculus
gggtcgtctactcaagctggcaagt

SEQ ID NO: 716419 - DNA, 25 bp, Mus musculus
gggtcgtctactgaagctggcaagt

SEQ ID NO: 716420 - DNA, 25 bp, Mus musculus
gggtcgtcttctcatccgggctgaa

SEQ ID NO: 716421 - DNA, 25 bp, Mus musculus
gggtcgtcttctgatccgggctgaa

SEQ ID NO: 716422 - DNA, 25 bp, Mus musculus
gggtcgtgctaaccaccatggccat

SEQ ID NO: 716423 - DNA, 25 bp, Mus musculus
gggtcgtgctaagcaccatggccat

SEQ ID NO: 716424 - DNA, 25 bp, Mus musculus
gggtcgttgtgacccaatcacctcc

SEQ ID NO: 716425 - DNA, 25 bp, Mus musculus
gggtcgttgtgagccaatcacctcc

SEQ ID NO: 716426 - DNA, 25 bp, Mus musculus
gggtctaaactgagccatctatgca

SEQ ID NO: 716427 - DNA, 25 bp, Mus musculus
gggtctaaactgtgccatctatgca

SEQ ID NO: 716428 - DNA, 25 bp, Mus musculus
gggtctaaagacacctagccagcca

SEQ ID NO: 716429 - DNA, 25 bp, Mus musculus
gggtctaaagactcctagccagcca

SEQ ID NO: 716430 - DNA, 25 bp, Mus musculus
gggtctaaagatactacatacagtg

SEQ ID NO: 716431 - DNA, 25 bp, Mus musculus
gggtctaaagattctacatacagtg

SEQ ID NO: 716432 - DNA, 25 bp, Mus musculus
gggtctaaggcgaccagcagcacca

SEQ ID NO: 716433 - DNA, 25 bp, Mus musculus
gggtctaaggcgtccagcagcacca

SEQ ID NO: 716434 - DNA, 25 bp, Mus musculus
gggtctacacaaaagtcatcaacta

SEQ ID NO: 716435 - DNA, 25 bp, Mus musculus
gggtctacacaatagtcatcaacta

SEQ ID NO: 716436 - DNA, 25 bp, Mus musculus
gggtctacgagtcggttctatcaga

SEQ ID NO: 716437 - DNA, 25 bp, Mus musculus
gggtctacgagtgggttctatcaga

SEQ ID NO: 716438 - DNA, 25 bp, Mus musculus
gggtctacttcgacacatcctgtcc

SEQ ID NO: 716439 - DNA, 25 bp, Mus musculus
gggtctacttcgtcacatcctgtcc

SEQ ID NO: 716440 - DNA, 25 bp, Mus musculus
gggtctagactcatggatctgagag

SEQ ID NO: 716441 - DNA, 25 bp, Mus musculus
gggtctagactcttggatctgagag

SEQ ID NO: 716442 - DNA, 25 bp, Mus musculus
gggtctagcaggaacaccttctgag

SEQ ID NO: 716443 - DNA, 25 bp, Mus musculus
gggtctagcaggtacaccttctgag

SEQ ID NO: 716444 - DNA, 25 bp, Mus musculus
gggtctagctgtcccttcaaaataa

SEQ ID NO: 716445 - DNA, 25 bp, Mus musculus
gggtctagctgtgccttcaaaataa

SEQ ID NO: 716446 - DNA, 25 bp, Mus musculus
gggtctaggagcacatggccagcaa

SEQ ID NO: 716447 - DNA, 25 bp, Mus musculus
gggtctaggagctcatggccagcaa

SEQ ID NO: 716448 - DNA, 25 bp, Mus musculus
gggtctaggcagagcccttggccca

SEQ ID NO: 716449 - DNA, 25 bp, Mus musculus
gggtctaggcagtgcccttggccca

SEQ ID NO: 716450 - DNA, 25 bp, Mus musculus
gggtctatccttaccagttcagcaa

SEQ ID NO: 716451 - DNA, 25 bp, Mus musculus
gggtctatcctttccagttcagcaa

SEQ ID NO: 716452 - DNA, 25 bp, Mus musculus
gggtctatggagatttgagccccac

SEQ ID NO: 716453 - DNA, 25 bp, Mus musculus
gggtctatggagttttgagccccac

SEQ ID NO: 716454 - DNA, 25 bp, Mus musculus
gggtctatgtttctctaagacgttt

SEQ ID NO: 716455 - DNA, 25 bp, Mus musculus
gggtctatgtttgtctaagacgttt

SEQ ID NO: 716456 - DNA, 25 bp, Mus musculus
gggtctattaataggctccaacttc

SEQ ID NO: 716457 - DNA, 25 bp, Mus musculus
gggtctattaattggctccaacttc

SEQ ID NO: 716458 - DNA, 25 bp, Mus musculus
gggtctcagaatcgagcacagttct

SEQ ID NO: 716459 - DNA, 25 bp, Mus musculus
gggtctcagaatggagcacagttct

SEQ ID NO: 716460 - DNA, 25 bp, Mus musculus
gggtctcatcagactacctctggga

SEQ ID NO: 716461 - DNA, 25 bp, Mus musculus
gggtctcatcagtctacctctggga

SEQ ID NO: 716462 - DNA, 25 bp, Mus musculus
gggtctccaggcataccagggaaac

SEQ ID NO: 716463 - DNA, 25 bp, Mus musculus
gggtctccaggcttaccagggaaac

SEQ ID NO: 716464 - DNA, 25 bp, Mus musculus
gggtctccctcgacctagagctagt

SEQ ID NO: 716465 - DNA, 25 bp, Mus musculus
gggtctccctcgtcctagagctagt

SEQ ID NO: 716466 - DNA, 25 bp, Mus musculus
gggtctccgagtatgagttgccaga

SEQ ID NO: 716467 - DNA, 25 bp, Mus musculus
gggtctccgagtttgagttgccaga

SEQ ID NO: 716468 - DNA, 25 bp, Mus musculus
gggtctccttgaagcgcggcttccc

SEQ ID NO: 716469 - DNA, 25 bp, Mus musculus
gggtctccttgatgcgcggcttccc

SEQ ID NO: 716470 - DNA, 25 bp, Mus musculus
gggtctccttgtctgccctagcctt

SEQ ID NO: 716471 - DNA, 25 bp, Mus musculus
gggtctccttgtgtgccctagcctt

SEQ ID NO: 716472 - DNA, 25 bp, Mus musculus
gggtctcgactccagccctggtgca

SEQ ID NO: 716473 - DNA, 25 bp, Mus musculus
gggtctcgactcgagccctggtgca

SEQ ID NO: 716474 - DNA, 25 bp, Mus musculus
gggtctcgttgcagccctcagatgt

SEQ ID NO: 716475 - DNA, 25 bp, Mus musculus
gggtctcgttgctgccctcagatgt

SEQ ID NO: 716476 - DNA, 25 bp, Mus musculus
gggtctctatgaaatctgttcacag

SEQ ID NO: 716477 - DNA, 25 bp, Mus musculus
gggtctctatgatatctgttcacag

SEQ ID NO: 716478 - DNA, 25 bp, Mus musculus
gggtctctcatcagcaccaacatag

SEQ ID NO: 716479 - DNA, 25 bp, Mus musculus
gggtctctcatctgcaccaacatag

SEQ ID NO: 716480 - DNA, 25 bp, Mus musculus
gggtctctgactcaagatactggga

SEQ ID NO: 716481 - DNA, 25 bp, Mus musculus
gggtctctgactgaagatactggga

SEQ ID NO: 716482 - DNA, 25 bp, Mus musculus
gggtctctgctgatgagtctggatc

SEQ ID NO: 716483 - DNA, 25 bp, Mus musculus
gggtctctgctgttgagtctggatc

SEQ ID NO: 716484 - DNA, 25 bp, Mus musculus
gggtctctgtgaactgtccattcca

SEQ ID NO: 716485 - DNA, 25 bp, Mus musculus
gggtctctgtgatctgtccattcca

SEQ ID NO: 716486 - DNA, 25 bp, Mus musculus
gggtctcttcaccacagccaaagga

SEQ ID NO: 716487 - DNA, 25 bp, Mus musculus
gggtctcttcacgacagccaaagga

SEQ ID NO: 716488 - DNA, 25 bp, Mus musculus
gggtctcttgcaaactctgctccag

SEQ ID NO: 716489 - DNA, 25 bp, Mus musculus
gggtctcttgcatactctgctccag

SEQ ID NO: 716490 - DNA, 25 bp, Mus musculus
gggtctgagccaccatctgtgacag

SEQ ID NO: 716491 - DNA, 25 bp, Mus musculus
gggtctgagccagcatctgtgacag

SEQ ID NO: 716492 - DNA, 25 bp, Mus musculus
gggtctgaggacagttcacacacaa

SEQ ID NO: 716493 - DNA, 25 bp, Mus musculus
gggtctgaggactgttcacacacaa

SEQ ID NO: 716494 - DNA, 25 bp, Mus musculus
gggtctgccctcagttggctgctca

SEQ ID NO: 716495 - DNA, 25 bp, Mus musculus
gggtctgccctctgttggctgctca

SEQ ID NO: 716496 - DNA, 25 bp, Mus musculus
gggtctgcctctccgccatcttctg

SEQ ID NO: 716497 - DNA, 25 bp, Mus musculus
gggtctgcctctgcgccatcttctg

SEQ ID NO: 716498 - DNA, 25 bp, Mus musculus
gggtctgcgtacatgcagttctgcc

SEQ ID NO: 716499 - DNA, 25 bp, Mus musculus
gggtctgcgtacttgcagttctgcc

SEQ ID NO: 716500 - DNA, 25 bp, Mus musculus
gggtctgcgtgcagcacaactgtat

SEQ ID NO: 716501 - DNA, 25 bp, Mus musculus
gggtctgcgtgctgcacaactgtat

SEQ ID NO: 716502 - DNA, 25 bp, Mus musculus
gggtctgctgagcttttctgctcaa

SEQ ID NO: 716503 - DNA, 25 bp, Mus musculus
gggtctgctgaggttttctgctcaa

SEQ ID NO: 716504 - DNA, 25 bp, Mus musculus
gggtctggaaaaagaggctttaatt

SEQ ID NO: 716505 - DNA, 25 bp, Mus musculus
gggtctggaaaatgaggctttaatt

SEQ ID NO: 716506 - DNA, 25 bp, Mus musculus
gggtctggaggcacgacagttcatc

SEQ ID NO: 716507 - DNA, 25 bp, Mus musculus
gggtctggaggctcgacagttcatc

SEQ ID NO: 716508 - DNA, 25 bp, Mus musculus
gggtctggagtcacacttcccctct

SEQ ID NO: 716509 - DNA, 25 bp, Mus musculus
gggtctggagtctcacttcccctct

SEQ ID NO: 716510 - DNA, 25 bp, Mus musculus
gggtctggccgccaccgctgttcac

SEQ ID NO: 716511 - DNA, 25 bp, Mus musculus
gggtctggccgcgaccgctgttcac

SEQ ID NO: 716512 - DNA, 25 bp, Mus musculus
gggtctggccggactcctgacatga

SEQ ID NO: 716513 - DNA, 25 bp, Mus musculus
gggtctggccggtctcctgacatga

SEQ ID NO: 716514 - DNA, 25 bp, Mus musculus
gggtctggttcacgatcccacgaag

SEQ ID NO: 716515 - DNA, 25 bp, Mus musculus
gggtctggttcaggatcccacgaag

SEQ ID NO: 716516 - DNA, 25 bp, Mus musculus
gggtctgtccacaaccttagccttc

SEQ ID NO: 716517 - DNA, 25 bp, Mus musculus
gggtctgtccactaccttagccttc

SEQ ID NO: 716518 - DNA, 25 bp, Mus musculus
gggtctgtctgtccgcattctggta

SEQ ID NO: 716519 - DNA, 25 bp, Mus musculus
gggtctgtctgtgcgcattctggta

SEQ ID NO: 716520 - DNA, 25 bp, Mus musculus
gggtctgtgattaggtttctggtcc

SEQ ID NO: 716521 - DNA, 25 bp, Mus musculus
gggtctgtgatttggtttctggtcc

SEQ ID NO: 716522 - DNA, 25 bp, Mus musculus
gggtcttaggacctgggcattcttc

SEQ ID NO: 716523 - DNA, 25 bp, Mus musculus
gggtcttaggacgtgggcattcttc

SEQ ID NO: 716524 - DNA, 25 bp, Mus musculus
gggtcttatgacattggcatggcct

SEQ ID NO: 716525 - DNA, 25 bp, Mus musculus
gggtcttatgactttggcatggcct

SEQ ID NO: 716526 - DNA, 25 bp, Mus musculus
gggtcttatttgctcccgctgaccc

SEQ ID NO: 716527 - DNA, 25 bp, Mus musculus
gggtcttatttggtcccgctgaccc

SEQ ID NO: 716528 - DNA, 25 bp, Mus musculus
gggtcttcaaaacgattcaaggcac

SEQ ID NO: 716529 - DNA, 25 bp, Mus musculus
gggtcttcaaaaggattcaaggcac

SEQ ID NO: 716530 - DNA, 25 bp, Mus musculus
gggtcttccgtcactatggagatga

SEQ ID NO: 716531 - DNA, 25 bp, Mus musculus
gggtcttccgtctctatggagatga

SEQ ID NO: 716532 - DNA, 25 bp, Mus musculus
gggtcttcttaaacgcctgcatggt

SEQ ID NO: 716533 - DNA, 25 bp, Mus musculus
gggtcttcttaatcgcctgcatggt

SEQ ID NO: 716534 - DNA, 25 bp, Mus musculus
gggtcttgccaacacacaaaggttg

SEQ ID NO: 716535 - DNA, 25 bp, Mus musculus
gggtcttgccaagacacaaaggttg

SEQ ID NO: 716536 - DNA, 25 bp, Mus musculus
gggtcttggagactcatgcaaaacc

SEQ ID NO: 716537 - DNA, 25 bp, Mus musculus
gggtcttggagagtcatgcaaaacc

SEQ ID NO: 716538 - DNA, 25 bp, Mus musculus
gggtcttggtgcactccatttcact

SEQ ID NO: 716539 - DNA, 25 bp, Mus musculus
gggtcttggtgctctccatttcact

SEQ ID NO: 716540 - DNA, 25 bp, Mus musculus
gggtctttgcagcactgataaagca

SEQ ID NO: 716541 - DNA, 25 bp, Mus musculus
gggtctttgcaggactgataaagca

SEQ ID NO: 716542 - DNA, 25 bp, Mus musculus
gggtgaaaacagagagttctacagt

SEQ ID NO: 716543 - DNA, 25 bp, Mus musculus
gggtgaaaacagtgagttctacagt

SEQ ID NO: 716544 - DNA, 25 bp, Mus musculus
gggtgaaacccaaagtgaccccacg

SEQ ID NO: 716545 - DNA, 25 bp, Mus musculus
gggtgaaacccatagtgaccccacg

SEQ ID NO: 716546 - DNA, 25 bp, Mus musculus
gggtgaaactggatctactgtcata

SEQ ID NO: 716547 - DNA, 25 bp, Mus musculus
gggtgaaactggttctactgtcata

SEQ ID NO: 716548 - DNA, 25 bp, Mus musculus
gggtgaaagtctcgccattaccttg

SEQ ID NO: 716549 - DNA, 25 bp, Mus musculus
gggtgaaagtctggccattaccttg

SEQ ID NO: 716550 - DNA, 25 bp, Mus musculus
gggtgaaccttcagcggaaacatgc

SEQ ID NO: 716551 - DNA, 25 bp, Mus musculus
gggtgaaccttctgcggaaacatgc

SEQ ID NO: 716552 - DNA, 25 bp, Mus musculus
gggtgaaggtatccagtctttcaga

SEQ ID NO: 716553 - DNA, 25 bp, Mus musculus
gggtgaaggtatgcagtctttcaga

SEQ ID NO: 716554 - DNA, 25 bp, Mus musculus
gggtgaagtcataaaaagttcaact

SEQ ID NO: 716555 - DNA, 25 bp, Mus musculus
gggtgaagtcattaaaagttcaact

SEQ ID NO: 716556 - DNA, 25 bp, Mus musculus
gggtgaagttcaaggctcaaatcca

SEQ ID NO: 716557 - DNA, 25 bp, Mus musculus
gggtgaagttcatggctcaaatcca

SEQ ID NO: 716558 - DNA, 25 bp, Mus musculus
gggtgaatacccagagttcctctag

SEQ ID NO: 716559 - DNA, 25 bp, Mus musculus
gggtgaataccctgagttcctctag

SEQ ID NO: 716560 - DNA, 25 bp, Mus musculus
gggtgaatacttaactctgcctgca

SEQ ID NO: 716561 - DNA, 25 bp, Mus musculus
gggtgaatactttactctgcctgca

SEQ ID NO: 716562 - DNA, 25 bp, Mus musculus
gggtgaatatcgagactacgacagg

SEQ ID NO: 716563 - DNA, 25 bp, Mus musculus
gggtgaatatcgtgactacgacagg

SEQ ID NO: 716564 - DNA, 25 bp, Mus musculus
gggtgaatgcctcctcaagtatcag

SEQ ID NO: 716565 - DNA, 25 bp, Mus musculus
gggtgaatgcctgctcaagtatcag

SEQ ID NO: 716566 - DNA, 25 bp, Mus musculus
gggtgaattgccacaggctgcaaag

SEQ ID NO: 716567 - DNA, 25 bp, Mus musculus
gggtgaattgcctcaggctgcaaag

SEQ ID NO: 716568 - DNA, 25 bp, Mus musculus
gggtgacaagaaaaccatcactgtg

SEQ ID NO: 716569 - DNA, 25 bp, Mus musculus
gggtgacaagaataccatcactgtg

SEQ ID NO: 716570 - DNA, 25 bp, Mus musculus
gggtgacaagctctctgggcttcct

SEQ ID NO: 716571 - DNA, 25 bp, Mus musculus
gggtgacaagctgtctgggcttcct

SEQ ID NO: 716572 - DNA, 25 bp, Mus musculus
gggtgacaaggtccacaaccctgcg

SEQ ID NO: 716573 - DNA, 25 bp, Mus musculus
gggtgacaaggtgcacaaccctgcg

SEQ ID NO: 716574 - DNA, 25 bp, Mus musculus
gggtgacaagtcctataatttgatt

SEQ ID NO: 716575 - DNA, 25 bp, Mus musculus
gggtgacaagtcgtataatttgatt

SEQ ID NO: 716576 - DNA, 25 bp, Mus musculus
gggtgacaatgaccaaagtgacact

SEQ ID NO: 716577 - DNA, 25 bp, Mus musculus
gggtgacaatgagcaaagtgacact

SEQ ID NO: 716578 - DNA, 25 bp, Mus musculus
gggtgacaccaccaccttgtacagt

SEQ ID NO: 716579 - DNA, 25 bp, Mus musculus
gggtgacaccacgaccttgtacagt

SEQ ID NO: 716580 - DNA, 25 bp, Mus musculus
gggtgacaccccagatgtcagccgt

SEQ ID NO: 716581 - DNA, 25 bp, Mus musculus
gggtgacacccctgatgtcagccgt

SEQ ID NO: 716582 - DNA, 25 bp, Mus musculus
gggtgaccacgcaaactggaaagaa

SEQ ID NO: 716583 - DNA, 25 bp, Mus musculus
gggtgaccacgctaactggaaagaa

SEQ ID NO: 716584 - DNA, 25 bp, Mus musculus
gggtgaccctgtagcaattctgaaa

SEQ ID NO: 716585 - DNA, 25 bp, Mus musculus
gggtgaccctgttgcaattctgaaa

SEQ ID NO: 716586 - DNA, 25 bp, Mus musculus
gggtgacctccgaatactgcctgag

SEQ ID NO: 716587 - DNA, 25 bp, Mus musculus
gggtgacctccgtatactgcctgag

SEQ ID NO: 716588 - DNA, 25 bp, Mus musculus
gggtgacctctcacagatgatcaag

SEQ ID NO: 716589 - DNA, 25 bp, Mus musculus
gggtgacctctctcagatgatcaag

SEQ ID NO: 716590 - DNA, 25 bp, Mus musculus
gggtgacctgtgagtgcctcatcct

SEQ ID NO: 716591 - DNA, 25 bp, Mus musculus
gggtgacctgtgtgtgcctcatcct

SEQ ID NO: 716592 - DNA, 25 bp, Mus musculus
gggtgacgaagtaaggacacagcat

SEQ ID NO: 716593 - DNA, 25 bp, Mus musculus
gggtgacgaagttaggacacagcat

SEQ ID NO: 716594 - DNA, 25 bp, Mus musculus
gggtgacgccaaccaaaagtacaag

SEQ ID NO: 716595 - DNA, 25 bp, Mus musculus
gggtgacgccaagcaaaagtacaag

SEQ ID NO: 716596 - DNA, 25 bp, Mus musculus
gggtgactgtggctgatacctccct

SEQ ID NO: 716597 - DNA, 25 bp, Mus musculus
gggtgactgtgggtgatacctccct

SEQ ID NO: 716598 - DNA, 25 bp, Mus musculus
gggtgacttcaacccctacaagcct

SEQ ID NO: 716599 - DNA, 25 bp, Mus musculus
gggtgacttcaagccctacaagcct

SEQ ID NO: 716600 - DNA, 25 bp, Mus musculus
gggtgacttccgatgccgctgccca

SEQ ID NO: 716601 - DNA, 25 bp, Mus musculus
gggtgacttccgttgccgctgccca

SEQ ID NO: 716602 - DNA, 25 bp, Mus musculus
gggtgactttgaacttctcatcctc

SEQ ID NO: 716603 - DNA, 25 bp, Mus musculus
gggtgactttgacccaagaaaacac

SEQ ID NO: 716604 - DNA, 25 bp, Mus musculus
gggtgactttgagccaagaaaacac

SEQ ID NO: 716605 - DNA, 25 bp, Mus musculus
gggtgactttgatcttctcatcctc

SEQ ID NO: 716606 - DNA, 25 bp, Mus musculus
gggtgagccgccaggttgaacctct

SEQ ID NO: 716607 - DNA, 25 bp, Mus musculus
gggtgagccgcctggttgaacctct

SEQ ID NO: 716608 - DNA, 25 bp, Mus musculus
gggtgagcctccaggcttcctgcac

SEQ ID NO: 716609 - DNA, 25 bp, Mus musculus
gggtgagcctcctggcttcctgcac

SEQ ID NO: 716610 - DNA, 25 bp, Mus musculus
gggtgagcgggaccacatttccccc

SEQ ID NO: 716611 - DNA, 25 bp, Mus musculus
gggtgagcgggagcacatttccccc

SEQ ID NO: 716612 - DNA, 25 bp, Mus musculus
gggtgaggactcacacacgtacgcg

SEQ ID NO: 716613 - DNA, 25 bp, Mus musculus
gggtgaggactctcacacgtacgcg

SEQ ID NO: 716614 - DNA, 25 bp, Mus musculus
gggtgagggcctctcacatctcagc

SEQ ID NO: 716615 - DNA, 25 bp, Mus musculus
gggtgagggcctgtcacatctcagc

SEQ ID NO: 716616 - DNA, 25 bp, Mus musculus
gggtgagtcgctcaccctctctgag

SEQ ID NO: 716617 - DNA, 25 bp, Mus musculus
gggtgagtcgctgaccctctctgag

SEQ ID NO: 716618 - DNA, 25 bp, Mus musculus
gggtgataacgaaagcatttttcaa

SEQ ID NO: 716619 - DNA, 25 bp, Mus musculus
gggtgataacgatagcatttttcaa

SEQ ID NO: 716620 - DNA, 25 bp, Mus musculus
gggtgatagctcacatcagaagcca

SEQ ID NO: 716621 - DNA, 25 bp, Mus musculus
gggtgatagctctcatcagaagcca

SEQ ID NO: 716622 - DNA, 25 bp, Mus musculus
gggtgatcaacgacatgctgaatgg

SEQ ID NO: 716623 - DNA, 25 bp, Mus musculus
gggtgatcaacgtcatgctgaatgg

SEQ ID NO: 716624 - DNA, 25 bp, Mus musculus
gggtgatcaccactctacctctgac

SEQ ID NO: 716625 - DNA, 25 bp, Mus musculus
gggtgatcaccagtctacctctgac

SEQ ID NO: 716626 - DNA, 25 bp, Mus musculus
gggtgatccgcacggattccaaaat

SEQ ID NO: 716627 - DNA, 25 bp, Mus musculus
gggtgatccgcagggattccaaaat

SEQ ID NO: 716628 - DNA, 25 bp, Mus musculus
gggtgatcgttaatggctccttctt

SEQ ID NO: 716629 - DNA, 25 bp, Mus musculus
gggtgatcgttattggctccttctt

SEQ ID NO: 716630 - DNA, 25 bp, Mus musculus
gggtgatctgctatgcctgtttcct

SEQ ID NO: 716631 - DNA, 25 bp, Mus musculus
gggtgatctgctttgcctgtttcct

SEQ ID NO: 716632 - DNA, 25 bp, Mus musculus
gggtgatgatatccgcccagacact

SEQ ID NO: 716633 - DNA, 25 bp, Mus musculus
gggtgatgatatgcgcccagacact

SEQ ID NO: 716634 - DNA, 25 bp, Mus musculus
gggtgatgcctaagtcatcctaaag

SEQ ID NO: 716635 - DNA, 25 bp, Mus musculus
gggtgatgcctatgtcatcctaaag

SEQ ID NO: 716636 - DNA, 25 bp, Mus musculus
gggtgatggccgaacctgccgccca

SEQ ID NO: 716637 - DNA, 25 bp, Mus musculus
gggtgatggccgtacctgccgccca

SEQ ID NO: 716638 - DNA, 25 bp, Mus musculus
gggtgattctcaacatctcctcagc

SEQ ID NO: 716639 - DNA, 25 bp, Mus musculus
gggtgattctcatcatctcctcagc

SEQ ID NO: 716640 - DNA, 25 bp, Mus musculus
gggtgcaaattcatatggccagttg

SEQ ID NO: 716641 - DNA, 25 bp, Mus musculus
gggtgcaaattcttatggccagttg

SEQ ID NO: 716642 - DNA, 25 bp, Mus musculus
gggtgcaaccctcgaagcgcaagcc

SEQ ID NO: 716643 - DNA, 25 bp, Mus musculus
gggtgcaaccctggaagcgcaagcc

SEQ ID NO: 716644 - DNA, 25 bp, Mus musculus
gggtgcacaagaaccctctgggttt

SEQ ID NO: 716645 - DNA, 25 bp, Mus musculus
gggtgcacaagatccctctgggttt

SEQ ID NO: 716646 - DNA, 25 bp, Mus musculus
gggtgcacccatcgactctcagtta

SEQ ID NO: 716647 - DNA, 25 bp, Mus musculus
gggtgcacccatggactctcagtta

SEQ ID NO: 716648 - DNA, 25 bp, Mus musculus
gggtgcacgagcagcctgttcagca

SEQ ID NO: 716649 - DNA, 25 bp, Mus musculus
gggtgcacgagctgcctgttcagca

SEQ ID NO: 716650 - DNA, 25 bp, Mus musculus
gggtgcagacttccagcccagcctg

SEQ ID NO: 716651 - DNA, 25 bp, Mus musculus
gggtgcagacttgcagcccagcctg

SEQ ID NO: 716652 - DNA, 25 bp, Mus musculus
gggtgcagcggacaatacactgccc

SEQ ID NO: 716653 - DNA, 25 bp, Mus musculus
gggtgcagcggagaatacactgccc

SEQ ID NO: 716654 - DNA, 25 bp, Mus musculus
gggtgccaatgcagcgctcctggtt

SEQ ID NO: 716655 - DNA, 25 bp, Mus musculus
gggtgccaatgctgcgctcctggtt

SEQ ID NO: 716656 - DNA, 25 bp, Mus musculus
gggtgccagcaactccaagctatat

SEQ ID NO: 716657 - DNA, 25 bp, Mus musculus
gggtgccagcaagtccaagctatat

SEQ ID NO: 716658 - DNA, 25 bp, Mus musculus
gggtgccagcggagaccttgcccca

SEQ ID NO: 716659 - DNA, 25 bp, Mus musculus
gggtgccagcggtgaccttgcccca

SEQ ID NO: 716660 - DNA, 25 bp, Mus musculus
gggtgccaggttccccacctttggc

SEQ ID NO: 716661 - DNA, 25 bp, Mus musculus
gggtgccaggttgcccacctttggc

SEQ ID NO: 716662 - DNA, 25 bp, Mus musculus
gggtgccatccactataagatagag

SEQ ID NO: 716663 - DNA, 25 bp, Mus musculus
gggtgccatccagtataagatagag

SEQ ID NO: 716664 - DNA, 25 bp, Mus musculus
gggtgcccaactatgaccagagtga

SEQ ID NO: 716665 - DNA, 25 bp, Mus musculus
gggtgcccaactttgaccagagtga

SEQ ID NO: 716666 - DNA, 25 bp, Mus musculus
gggtgcccagtcaacccaggatgag

SEQ ID NO: 716667 - DNA, 25 bp, Mus musculus
gggtgcccagtctacccaggatgag

SEQ ID NO: 716668 - DNA, 25 bp, Mus musculus
gggtgcccattgagcagtgcctgcc

SEQ ID NO: 716669 - DNA, 25 bp, Mus musculus
gggtgcccattgtgcagtgcctgcc

SEQ ID NO: 716670 - DNA, 25 bp, Mus musculus
gggtgcccctagaccacatgtgggt

SEQ ID NO: 716671 - DNA, 25 bp, Mus musculus
gggtgcccctagtccacatgtgggt

SEQ ID NO: 716672 - DNA, 25 bp, Mus musculus
gggtgcccgcccaatcctaaggatg

SEQ ID NO: 716673 - DNA, 25 bp, Mus musculus
gggtgcccgccctatcctaaggatg

SEQ ID NO: 716674 - DNA, 25 bp, Mus musculus
gggtgcccgtgcaaaagccatcgga

SEQ ID NO: 716675 - DNA, 25 bp, Mus musculus
gggtgcccgtgctaaagccatcgga

SEQ ID NO: 716676 - DNA, 25 bp, Mus musculus
gggtgccctgcaagcccgactggaa

SEQ ID NO: 716677 - DNA, 25 bp, Mus musculus
gggtgccctgcatgcccgactggaa

SEQ ID NO: 716678 - DNA, 25 bp, Mus musculus
gggtgccgaaccaggccacttcggt

SEQ ID NO: 716679 - DNA, 25 bp, Mus musculus
gggtgccgaacctggccacttcggt

SEQ ID NO: 716680 - DNA, 25 bp, Mus musculus
gggtgccggtcaagccctttcctgc

SEQ ID NO: 716681 - DNA, 25 bp, Mus musculus
gggtgccggtcatgccctttcctgc

SEQ ID NO: 716682 - DNA, 25 bp, Mus musculus
gggtgcctactaatcacataactcc

SEQ ID NO: 716683 - DNA, 25 bp, Mus musculus
gggtgcctactattcacataactcc

SEQ ID NO: 716684 - DNA, 25 bp, Mus musculus
gggtgcctctttattccatttctct

SEQ ID NO: 716685 - DNA, 25 bp, Mus musculus
gggtgcctcttttttccatttctct

SEQ ID NO: 716686 - DNA, 25 bp, Mus musculus
gggtgcctgcccatggaccagagtc

SEQ ID NO: 716687 - DNA, 25 bp, Mus musculus
gggtgcctgcccttggaccagagtc

SEQ ID NO: 716688 - DNA, 25 bp, Mus musculus
gggtgcctgccgagggcctcactct

SEQ ID NO: 716689 - DNA, 25 bp, Mus musculus
gggtgcctgccgtgggcctcactct

SEQ ID NO: 716690 - DNA, 25 bp, Mus musculus
gggtgcctggttagactatgacttg

SEQ ID NO: 716691 - DNA, 25 bp, Mus musculus
gggtgcctggtttgactatgacttg

SEQ ID NO: 716692 - DNA, 25 bp, Mus musculus
gggtgccttacaactgtggcagttt

SEQ ID NO: 716693 - DNA, 25 bp, Mus musculus
gggtgccttacatctgtggcagttt

SEQ ID NO: 716694 - DNA, 25 bp, Mus musculus
gggtgccttctcctacctgcggcgt

SEQ ID NO: 716695 - DNA, 25 bp, Mus musculus
gggtgccttctcgtacctgcggcgt

SEQ ID NO: 716696 - DNA, 25 bp, Mus musculus
gggtgcctttgaaagccagtcaacc

SEQ ID NO: 716697 - DNA, 25 bp, Mus musculus
gggtgcctttgatagccagtcaacc

SEQ ID NO: 716698 - DNA, 25 bp, Mus musculus
gggtgcgacacaacatccttgttct

SEQ ID NO: 716699 - DNA, 25 bp, Mus musculus
gggtgcgacacatcatccttgttct

SEQ ID NO: 716700 - DNA, 25 bp, Mus musculus
gggtgcgcctttcctcgtctcctgt

SEQ ID NO: 716701 - DNA, 25 bp, Mus musculus
gggtgcgcctttgctcgtctcctgt

SEQ ID NO: 716702 - DNA, 25 bp, Mus musculus
gggtgcgtgtccagcctgcacatgc

SEQ ID NO: 716703 - DNA, 25 bp, Mus musculus
gggtgcgtgtcctgcctgcacatgc

SEQ ID NO: 716704 - DNA, 25 bp, Mus musculus
gggtgctaaagcagcaattgtctgt

SEQ ID NO: 716705 - DNA, 25 bp, Mus musculus
gggtgctaaagctgcaattgtctgt

SEQ ID NO: 716706 - DNA, 25 bp, Mus musculus
gggtgctagctcagtctccaccacg

SEQ ID NO: 716707 - DNA, 25 bp, Mus musculus
gggtgctagctctgtctccaccacg

SEQ ID NO: 716708 - DNA, 25 bp, Mus musculus
gggtgctcaggccaaccccacttgt

SEQ ID NO: 716709 - DNA, 25 bp, Mus musculus
gggtgctcaggcgaaccccacttgt

SEQ ID NO: 716710 - DNA, 25 bp, Mus musculus
gggtgctcggcacgtggcaagcggc

SEQ ID NO: 716711 - DNA, 25 bp, Mus musculus
gggtgctcggcaggtggcaagcggc

SEQ ID NO: 716712 - DNA, 25 bp, Mus musculus
gggtgctctggtccaagttccctag

SEQ ID NO: 716713 - DNA, 25 bp, Mus musculus
gggtgctctggtgcaagttccctag

SEQ ID NO: 716714 - DNA, 25 bp, Mus musculus
gggtgctcttctctttgtgggtttt

SEQ ID NO: 716715 - DNA, 25 bp, Mus musculus
gggtgctcttctgtttgtgggtttt

SEQ ID NO: 716716 - DNA, 25 bp, Mus musculus
gggtgctgatccattcctccgaata

SEQ ID NO: 716717 - DNA, 25 bp, Mus musculus
gggtgctgatcctttcctccgaata

SEQ ID NO: 716718 - DNA, 25 bp, Mus musculus
gggtgctgcactctaacgcggacac

SEQ ID NO: 716719 - DNA, 25 bp, Mus musculus
gggtgctgcactgtaacgcggacac

SEQ ID NO: 716720 - DNA, 25 bp, Mus musculus
gggtgctggctaacaccacagtatt

SEQ ID NO: 716721 - DNA, 25 bp, Mus musculus
gggtgctggctatcaccacagtatt

SEQ ID NO: 716722 - DNA, 25 bp, Mus musculus
gggtgctgtgtacccacctatgttt

SEQ ID NO: 716723 - DNA, 25 bp, Mus musculus
gggtgctgtgtagccacctatgttt

SEQ ID NO: 716724 - DNA, 25 bp, Mus musculus
gggtgctgtttgatcgtctctgcgt

SEQ ID NO: 716725 - DNA, 25 bp, Mus musculus
gggtgctgtttgttcgtctctgcgt

SEQ ID NO: 716726 - DNA, 25 bp, Mus musculus
gggtgcttccctaattccaacttca

SEQ ID NO: 716727 - DNA, 25 bp, Mus musculus
gggtgcttcccttattccaacttca

SEQ ID NO: 716728 - DNA, 25 bp, Mus musculus
gggtgctttgttccctcgccgtaag

SEQ ID NO: 716729 - DNA, 25 bp, Mus musculus
gggtgctttgttgcctcgccgtaag

SEQ ID NO: 716730 - DNA, 25 bp, Mus musculus
gggtggaaacttcagtcatctgatc

SEQ ID NO: 716731 - DNA, 25 bp, Mus musculus
gggtggaaacttgagtcatctgatc

SEQ ID NO: 716732 - DNA, 25 bp, Mus musculus
gggtggaaagacaatctgcctgagt

SEQ ID NO: 716733 - DNA, 25 bp, Mus musculus
gggtggaaagactatctgcctgagt

SEQ ID NO: 716734 - DNA, 25 bp, Mus musculus
gggtggaaatcaacagcctcaaagc

SEQ ID NO: 716735 - DNA, 25 bp, Mus musculus
gggtggaaatcatcagcctcaaagc

SEQ ID NO: 716736 - DNA, 25 bp, Mus musculus
gggtggaaccgcacttcgtcgccgc

SEQ ID NO: 716737 - DNA, 25 bp, Mus musculus
gggtggaaccgctcttcgtcgccgc

SEQ ID NO: 716738 - DNA, 25 bp, Mus musculus
gggtggaatcacagacatccctcct

SEQ ID NO: 716739 - DNA, 25 bp, Mus musculus
gggtggaatcactgacatccctcct

SEQ ID NO: 716740 - DNA, 25 bp, Mus musculus
gggtggaattttaactacctgcagt

SEQ ID NO: 716741 - DNA, 25 bp, Mus musculus
gggtggaatttttactacctgcagt

SEQ ID NO: 716742 - DNA, 25 bp, Mus musculus
gggtggactagacctttccaggctt

SEQ ID NO: 716743 - DNA, 25 bp, Mus musculus
gggtggactagagctttccaggctt

SEQ ID NO: 716744 - DNA, 25 bp, Mus musculus
gggtggattataacttcatttctgt

SEQ ID NO: 716745 - DNA, 25 bp, Mus musculus
gggtggattatatcttcatttctgt

SEQ ID NO: 716746 - DNA, 25 bp, Mus musculus
gggtggattctgacaccaccaatgc

SEQ ID NO: 716747 - DNA, 25 bp, Mus musculus
gggtggattctgtcaccaccaatgc

SEQ ID NO: 716748 - DNA, 25 bp, Mus musculus
gggtggcaacaccaacaacagcaac

SEQ ID NO: 716749 - DNA, 25 bp, Mus musculus
gggtggcaacaccaagactctgatg

SEQ ID NO: 716750 - DNA, 25 bp, Mus musculus
gggtggcaacacgaacaacagcaac

SEQ ID NO: 716751 - DNA, 25 bp, Mus musculus
gggtggcaacacgaagactctgatg

SEQ ID NO: 716752 - DNA, 25 bp, Mus musculus
gggtggcaacctactacaacaggaa

SEQ ID NO: 716753 - DNA, 25 bp, Mus musculus
gggtggcaaccttctacaacaggaa

SEQ ID NO: 716754 - DNA, 25 bp, Mus musculus
gggtggcaagagacagcgaccctct

SEQ ID NO: 716755 - DNA, 25 bp, Mus musculus
gggtggcaagagtcagcgaccctct

SEQ ID NO: 716756 - DNA, 25 bp, Mus musculus
gggtggcacaccacattccaggaag

SEQ ID NO: 716757 - DNA, 25 bp, Mus musculus
gggtggcacacctcattccaggaag

SEQ ID NO: 716758 - DNA, 25 bp, Mus musculus
gggtggcacatcagacccttatgtc

SEQ ID NO: 716759 - DNA, 25 bp, Mus musculus
gggtggcacatctgacccttatgtc

SEQ ID NO: 716760 - DNA, 25 bp, Mus musculus
gggtggccatgcagaccaagcgaat

SEQ ID NO: 716761 - DNA, 25 bp, Mus musculus
gggtggccatgctgaccaagcgaat

SEQ ID NO: 716762 - DNA, 25 bp, Mus musculus
gggtggccccgcaccaggccgtaat

SEQ ID NO: 716763 - DNA, 25 bp, Mus musculus
gggtggccccgctccaggccgtaat

SEQ ID NO: 716764 - DNA, 25 bp, Mus musculus
gggtggcctgagctctctgccatat

SEQ ID NO: 716765 - DNA, 25 bp, Mus musculus
gggtggcctgaggtctctgccatat

SEQ ID NO: 716766 - DNA, 25 bp, Mus musculus
gggtggcctgtcaaagaaacctgcc

SEQ ID NO: 716767 - DNA, 25 bp, Mus musculus
gggtggcctgtctaagaaacctgcc

SEQ ID NO: 716768 - DNA, 25 bp, Mus musculus
gggtggctgctgctttgcctatatc

SEQ ID NO: 716769 - DNA, 25 bp, Mus musculus
gggtggctgctggtttgcctatatc

SEQ ID NO: 716770 - DNA, 25 bp, Mus musculus
gggtggctgggcattaaacacagtt

SEQ ID NO: 716771 - DNA, 25 bp, Mus musculus
gggtggctgggctttaaacacagtt

SEQ ID NO: 716772 - DNA, 25 bp, Mus musculus
gggtggcttcagaggttgatctacc

SEQ ID NO: 716773 - DNA, 25 bp, Mus musculus
gggtggcttcagtggttgatctacc

SEQ ID NO: 716774 - DNA, 25 bp, Mus musculus
gggtgggatgccatcccaacggaat

SEQ ID NO: 716775 - DNA, 25 bp, Mus musculus
gggtgggatgccttcccaacggaat

SEQ ID NO: 716776 - DNA, 25 bp, Mus musculus
gggtggtaacggacattgtcatcct

SEQ ID NO: 716777 - DNA, 25 bp, Mus musculus
gggtggtaacggtcattgtcatcct

SEQ ID NO: 716778 - DNA, 25 bp, Mus musculus
gggtggtcatcaaacacccagagct

SEQ ID NO: 716779 - DNA, 25 bp, Mus musculus
gggtggtcatcatacacccagagct

SEQ ID NO: 716780 - DNA, 25 bp, Mus musculus
gggtggtccgctacctacagctatc

SEQ ID NO: 716781 - DNA, 25 bp, Mus musculus
gggtggtccgcttcctacagctatc

SEQ ID NO: 716782 - DNA, 25 bp, Mus musculus
gggtggtcctccacctgagaggcag

SEQ ID NO: 716783 - DNA, 25 bp, Mus musculus
gggtggtcctcctcctgagaggcag

SEQ ID NO: 716784 - DNA, 25 bp, Mus musculus
gggtggtgactgactccccaaggct

SEQ ID NO: 716785 - DNA, 25 bp, Mus musculus
gggtggtgactgtctccccaaggct

SEQ ID NO: 716786 - DNA, 25 bp, Mus musculus
gggtggtgagcgaccatgttaataa

SEQ ID NO: 716787 - DNA, 25 bp, Mus musculus
gggtggtgagcgtccatgttaataa

SEQ ID NO: 716788 - DNA, 25 bp, Mus musculus
gggtggtggatcagacccacttcta

SEQ ID NO: 716789 - DNA, 25 bp, Mus musculus
gggtggtggatctgacccacttcta

SEQ ID NO: 716790 - DNA, 25 bp, Mus musculus
gggtggtggcctccggactgagaca

SEQ ID NO: 716791 - DNA, 25 bp, Mus musculus
gggtggtggcctgcggactgagaca

SEQ ID NO: 716792 - DNA, 25 bp, Mus musculus
gggtggttatgccacatgtcatgac

SEQ ID NO: 716793 - DNA, 25 bp, Mus musculus
gggtggttatgcgacatgtcatgac

SEQ ID NO: 716794 - DNA, 25 bp, Mus musculus
gggtggttccttccctgtgcatcaa

SEQ ID NO: 716795 - DNA, 25 bp, Mus musculus
gggtggttccttgcctgtgcatcaa

SEQ ID NO: 716796 - DNA, 25 bp, Mus musculus
gggtgtacaagaccatctactggac

SEQ ID NO: 716797 - DNA, 25 bp, Mus musculus
gggtgtacaagagcatctactggac

SEQ ID NO: 716798 - DNA, 25 bp, Mus musculus
gggtgtacacgtactcccgagctgc

SEQ ID NO: 716799 - DNA, 25 bp, Mus musculus
gggtgtacacgttctcccgagctgc

SEQ ID NO: 716800 - DNA, 25 bp, Mus musculus
gggtgtacagaaccaagcagactag

SEQ ID NO: 716801 - DNA, 25 bp, Mus musculus
gggtgtacagaagcaagcagactag

SEQ ID NO: 716802 - DNA, 25 bp, Mus musculus
gggtgtaccggaagctgccacccct

SEQ ID NO: 716803 - DNA, 25 bp, Mus musculus
gggtgtaccggatgctgccacccct

SEQ ID NO: 716804 - DNA, 25 bp, Mus musculus
gggtgtatatgtcccaggctccaag

SEQ ID NO: 716805 - DNA, 25 bp, Mus musculus
gggtgtatatgtgccaggctccaag

SEQ ID NO: 716806 - DNA, 25 bp, Mus musculus
gggtgtcagcacacctgtgaagata

SEQ ID NO: 716807 - DNA, 25 bp, Mus musculus
gggtgtcagcactcctgtgaagata

SEQ ID NO: 716808 - DNA, 25 bp, Mus musculus
gggtgtcattacaccactattggac

SEQ ID NO: 716809 - DNA, 25 bp, Mus musculus
gggtgtcattactccactattggac

SEQ ID NO: 716810 - DNA, 25 bp, Mus musculus
gggtgtcattataatttcacaaacc

SEQ ID NO: 716811 - DNA, 25 bp, Mus musculus
gggtgtcattattatttcacaaacc

SEQ ID NO: 716812 - DNA, 25 bp, Mus musculus
gggtgtcattctccgagcaaaggaa

SEQ ID NO: 716813 - DNA, 25 bp, Mus musculus
gggtgtcattctgcgagcaaaggaa

SEQ ID NO: 716814 - DNA, 25 bp, Mus musculus
gggtgtcattgccagaaggcctcta

SEQ ID NO: 716815 - DNA, 25 bp, Mus musculus
gggtgtcattgcgagaaggcctcta

SEQ ID NO: 716816 - DNA, 25 bp, Mus musculus
gggtgtcccagtctataactttatg

SEQ ID NO: 716817 - DNA, 25 bp, Mus musculus
gggtgtcccagtgtataactttatg

SEQ ID NO: 716818 - DNA, 25 bp, Mus musculus
gggtgtccctctccaaacgtggctc

SEQ ID NO: 716819 - DNA, 25 bp, Mus musculus
gggtgtccctctgcaaacgtggctc

SEQ ID NO: 716820 - DNA, 25 bp, Mus musculus
gggtgtcctgtaaccctcaataaag

SEQ ID NO: 716821 - DNA, 25 bp, Mus musculus
gggtgtcctgtatccctcaataaag

SEQ ID NO: 716822 - DNA, 25 bp, Mus musculus
gggtgtcgcggcacactctgattct

SEQ ID NO: 716823 - DNA, 25 bp, Mus musculus
gggtgtcgcggctcactctgattct

SEQ ID NO: 716824 - DNA, 25 bp, Mus musculus
gggtgtcgctccctttcgctgatgc

SEQ ID NO: 716825 - DNA, 25 bp, Mus musculus
gggtgtcgctccgtttcgctgatgc

SEQ ID NO: 716826 - DNA, 25 bp, Mus musculus
gggtgtctacccagccagtctcttc

SEQ ID NO: 716827 - DNA, 25 bp, Mus musculus
gggtgtctaccctgccagtctcttc

SEQ ID NO: 716828 - DNA, 25 bp, Mus musculus
gggtgtctactaagaagaaaggcga

SEQ ID NO: 716829 - DNA, 25 bp, Mus musculus
gggtgtctactatgaagaaaggcga

SEQ ID NO: 716830 - DNA, 25 bp, Mus musculus
gggtgtctcagcagaaggtccctcc

SEQ ID NO: 716831 - DNA, 25 bp, Mus musculus
gggtgtctcagctgaaggtccctcc

SEQ ID NO: 716832 - DNA, 25 bp, Mus musculus
gggtgtctccctcttcgtgtcctgg

SEQ ID NO: 716833 - DNA, 25 bp, Mus musculus
gggtgtctccctgttcgtgtcctgg

SEQ ID NO: 716834 - DNA, 25 bp, Mus musculus
gggtgtctgcctcgccaaacagtca

SEQ ID NO: 716835 - DNA, 25 bp, Mus musculus
gggtgtctgcctggccaaacagtca

SEQ ID NO: 716836 - DNA, 25 bp, Mus musculus
gggtgtctgctcagaatggtgccca

SEQ ID NO: 716837 - DNA, 25 bp, Mus musculus
gggtgtctgctccagtgggtgctca

SEQ ID NO: 716838 - DNA, 25 bp, Mus musculus
gggtgtctgctcgagtgggtgctca

SEQ ID NO: 716839 - DNA, 25 bp, Mus musculus
gggtgtctgctctgaatggtgccca

SEQ ID NO: 716840 - DNA, 25 bp, Mus musculus
gggtgtctgggtagcacacagccta

SEQ ID NO: 716841 - DNA, 25 bp, Mus musculus
gggtgtctgggttgcacacagccta

SEQ ID NO: 716842 - DNA, 25 bp, Mus musculus
gggtgtcttcatcatgtgcatccca

SEQ ID NO: 716843 - DNA, 25 bp, Mus musculus
gggtgtcttcatgatgtgcatccca

SEQ ID NO: 716844 - DNA, 25 bp, Mus musculus
gggtgtcttccgattgccttgaact

SEQ ID NO: 716845 - DNA, 25 bp, Mus musculus
gggtgtcttccgtttgccttgaact

SEQ ID NO: 716846 - DNA, 25 bp, Mus musculus
gggtgtcttggtacccaatctaaag

SEQ ID NO: 716847 - DNA, 25 bp, Mus musculus
gggtgtcttggttcccaatctaaag

SEQ ID NO: 716848 - DNA, 25 bp, Mus musculus
gggtgtgaacgccaaggcttaccac

SEQ ID NO: 716849 - DNA, 25 bp, Mus musculus
gggtgtgaacgcgaaggcttaccac

SEQ ID NO: 716850 - DNA, 25 bp, Mus musculus
gggtgtgactgactgatatgacttc

SEQ ID NO: 716851 - DNA, 25 bp, Mus musculus
gggtgtgactgagtgatatgacttc

SEQ ID NO: 716852 - DNA, 25 bp, Mus musculus
gggtgtgcctagaacatggccctgt

SEQ ID NO: 716853 - DNA, 25 bp, Mus musculus
gggtgtgcctagtacatggccctgt

SEQ ID NO: 716854 - DNA, 25 bp, Mus musculus
gggtgtggattcatgcagacaagaa

SEQ ID NO: 716855 - DNA, 25 bp, Mus musculus
gggtgtggattcttgcagacaagaa

SEQ ID NO: 716856 - DNA, 25 bp, Mus musculus
gggtgtggtcaaccttttgctttag

SEQ ID NO: 716857 - DNA, 25 bp, Mus musculus
gggtgtggtcaagcttttgctttag

SEQ ID NO: 716858 - DNA, 25 bp, Mus musculus
gggtgtgtgtctaacataatgatct

SEQ ID NO: 716859 - DNA, 25 bp, Mus musculus
gggtgtgtgtcttacataatgatct

SEQ ID NO: 716860 - DNA, 25 bp, Mus musculus
gggtgtgttttactaagcatcgtct

SEQ ID NO: 716861 - DNA, 25 bp, Mus musculus
gggtgtgttttagtaagcatcgtct

SEQ ID NO: 716862 - DNA, 25 bp, Mus musculus
gggtgttgagtcagcatcagcatct

SEQ ID NO: 716863 - DNA, 25 bp, Mus musculus
gggtgttgagtctgcatcagcatct

SEQ ID NO: 716864 - DNA, 25 bp, Mus musculus
gggtgttggctaagtgcccattgca

SEQ ID NO: 716865 - DNA, 25 bp, Mus musculus
gggtgttggctatgtgcccattgca

SEQ ID NO: 716866 - DNA, 25 bp, Mus musculus
gggtgtttcccactgatcttgggac

SEQ ID NO: 716867 - DNA, 25 bp, Mus musculus
gggtgtttcccagtgatcttgggac

SEQ ID NO: 716868 - DNA, 25 bp, Mus musculus
gggtgtttcgctcaagtgtggcttg

SEQ ID NO: 716869 - DNA, 25 bp, Mus musculus
gggtgtttcgctgaagtgtggcttg

SEQ ID NO: 716870 - DNA, 25 bp, Mus musculus
gggtgtttcttaaggccccagagcc

SEQ ID NO: 716871 - DNA, 25 bp, Mus musculus
gggtgtttcttatggccccagagcc

SEQ ID NO: 716872 - DNA, 25 bp, Mus musculus
gggtgtttggtgacttgtgtttcct

SEQ ID NO: 716873 - DNA, 25 bp, Mus musculus
gggtgtttggtgtcttgtgtttcct

SEQ ID NO: 716874 - DNA, 25 bp, Mus musculus
gggttaaatctcatgaaactggagt

SEQ ID NO: 716875 - DNA, 25 bp, Mus musculus
gggttaaatctcttgaaactggagt

SEQ ID NO: 716876 - DNA, 25 bp, Mus musculus
gggttaatcaaccttactgtgctgg

SEQ ID NO: 716877 - DNA, 25 bp, Mus musculus
gggttaatcaacgttactgtgctgg

SEQ ID NO: 716878 - DNA, 25 bp, Mus musculus
gggttacaacaacctctgcgattgg

SEQ ID NO: 716879 - DNA, 25 bp, Mus musculus
gggttacaacaagctctgcgattgg

SEQ ID NO: 716880 - DNA, 25 bp, Mus musculus
gggttacagaagagcctcggcaagt

SEQ ID NO: 716881 - DNA, 25 bp, Mus musculus
gggttacagaagtgcctcggcaagt

SEQ ID NO: 716882 - DNA, 25 bp, Mus musculus
gggttacagcgcaaacatcgtcttc

SEQ ID NO: 716883 - DNA, 25 bp, Mus musculus
gggttacagcgctaacatcgtcttc

SEQ ID NO: 716884 - DNA, 25 bp, Mus musculus
gggttacaggtaactctgagatgtc

SEQ ID NO: 716885 - DNA, 25 bp, Mus musculus
gggttacaggtatctctgagatgtc

SEQ ID NO: 716886 - DNA, 25 bp, Mus musculus
gggttaccggcacatctcagccttg

SEQ ID NO: 716887 - DNA, 25 bp, Mus musculus
gggttaccggcagatctcagccttg

SEQ ID NO: 716888 - DNA, 25 bp, Mus musculus
gggttacctgcaccctaagcctgaa

SEQ ID NO: 716889 - DNA, 25 bp, Mus musculus
gggttacctgcagcctaagcctgaa

SEQ ID NO: 716890 - DNA, 25 bp, Mus musculus
gggttacggagacaacaagcctgtc

SEQ ID NO: 716891 - DNA, 25 bp, Mus musculus
gggttacggagagaacaagcctgtc

SEQ ID NO: 716892 - DNA, 25 bp, Mus musculus
gggttactgggcattctggaccgta

SEQ ID NO: 716893 - DNA, 25 bp, Mus musculus
gggttactgggctttctggaccgta

SEQ ID NO: 716894 - DNA, 25 bp, Mus musculus
gggttagaagctcccactcctcaag

SEQ ID NO: 716895 - DNA, 25 bp, Mus musculus
gggttagaagctgccactcctcaag

SEQ ID NO: 716896 - DNA, 25 bp, Mus musculus
gggttagagaaaacgcttcaccatc

SEQ ID NO: 716897 - DNA, 25 bp, Mus musculus
gggttagagaaatcgcttcaccatc

SEQ ID NO: 716898 - DNA, 25 bp, Mus musculus
gggttagaggatagctgagatcctc

SEQ ID NO: 716899 - DNA, 25 bp, Mus musculus
gggttagaggattgctgagatcctc

SEQ ID NO: 716900 - DNA, 25 bp, Mus musculus
gggttagccaagatccagcttttgg

SEQ ID NO: 716901 - DNA, 25 bp, Mus musculus
gggttagccaagttccagcttttgg

SEQ ID NO: 716902 - DNA, 25 bp, Mus musculus
gggttagctatcctgccatgatcct

SEQ ID NO: 716903 - DNA, 25 bp, Mus musculus
gggttagctatcgtgccatgatcct

SEQ ID NO: 716904 - DNA, 25 bp, Mus musculus
gggttaggttacaggccagcatcag

SEQ ID NO: 716905 - DNA, 25 bp, Mus musculus
gggttaggttactggccagcatcag

SEQ ID NO: 716906 - DNA, 25 bp, Mus musculus
gggttataataactcagggcaagta

SEQ ID NO: 716907 - DNA, 25 bp, Mus musculus
gggttataataagtcagggcaagta

SEQ ID NO: 716908 - DNA, 25 bp, Mus musculus
gggttatctcttcgccaatcaggga

SEQ ID NO: 716909 - DNA, 25 bp, Mus musculus
gggttatctcttggccaatcaggga

SEQ ID NO: 716910 - DNA, 25 bp, Mus musculus
gggttattgactctctttgctacca

SEQ ID NO: 716911 - DNA, 25 bp, Mus musculus
gggttattgactgtctttgctacca

SEQ ID NO: 716912 - DNA, 25 bp, Mus musculus
gggttcaagaagagtccgctctttg

SEQ ID NO: 716913 - DNA, 25 bp, Mus musculus
gggttcaagaagtgtccgctctttg

SEQ ID NO: 716914 - DNA, 25 bp, Mus musculus
gggttcaagcctagctccgagcagt

SEQ ID NO: 716915 - DNA, 25 bp, Mus musculus
gggttcaagccttgctccgagcagt

SEQ ID NO: 716916 - DNA, 25 bp, Mus musculus
gggttcaaggcaaccaatgactatg

SEQ ID NO: 716917 - DNA, 25 bp, Mus musculus
gggttcaaggcatccaatgactatg

SEQ ID NO: 716918 - DNA, 25 bp, Mus musculus
gggttcacagacagacttaatcggg

SEQ ID NO: 716919 - DNA, 25 bp, Mus musculus
gggttcacagactgacttaatcggg

SEQ ID NO: 716920 - DNA, 25 bp, Mus musculus
gggttcaccgcaaggagcttcacta

SEQ ID NO: 716921 - DNA, 25 bp, Mus musculus
gggttcaccgcatggagcttcacta

SEQ ID NO: 716922 - DNA, 25 bp, Mus musculus
gggttcacctacatctccaaagaca

SEQ ID NO: 716923 - DNA, 25 bp, Mus musculus
gggttcacctacttctccaaagaca

SEQ ID NO: 716924 - DNA, 25 bp, Mus musculus
gggttcacttccagtggaggtacct

SEQ ID NO: 716925 - DNA, 25 bp, Mus musculus
gggttcacttcctgtggaggtacct

SEQ ID NO: 716926 - DNA, 25 bp, Mus musculus
gggttcagcattcgccaacaccatc

SEQ ID NO: 716927 - DNA, 25 bp, Mus musculus
gggttcagcattggccaacaccatc

SEQ ID NO: 716928 - DNA, 25 bp, Mus musculus
gggttcagccttacccaagccactg

SEQ ID NO: 716929 - DNA, 25 bp, Mus musculus
gggttcagcctttcccaagccactg

SEQ ID NO: 716930 - DNA, 25 bp, Mus musculus
gggttcagctccagtccaataccta

SEQ ID NO: 716931 - DNA, 25 bp, Mus musculus
gggttcagctcctgtccaataccta

SEQ ID NO: 716932 - DNA, 25 bp, Mus musculus
gggttccagaccatcgtggccacac

SEQ ID NO: 716933 - DNA, 25 bp, Mus musculus
gggttccagaccttcgtggccacac

SEQ ID NO: 716934 - DNA, 25 bp, Mus musculus
gggttccagcacagctgtatcaatg

SEQ ID NO: 716935 - DNA, 25 bp, Mus musculus
gggttccagcactgctgtatcaatg

SEQ ID NO: 716936 - DNA, 25 bp, Mus musculus
gggttccaggccagttctcttccat

SEQ ID NO: 716937 - DNA, 25 bp, Mus musculus
gggttccaggcctgttctcttccat

SEQ ID NO: 716938 - DNA, 25 bp, Mus musculus
gggttccaggttccctatgtgacat

SEQ ID NO: 716939 - DNA, 25 bp, Mus musculus
gggttccaggttgcctatgtgacat

SEQ ID NO: 716940 - DNA, 25 bp, Mus musculus
gggttcccctctatggtcagccagg

SEQ ID NO: 716941 - DNA, 25 bp, Mus musculus
gggttcccctctttggtcagccagg

SEQ ID NO: 716942 - DNA, 25 bp, Mus musculus
gggttcccgctgctccggaccatgt

SEQ ID NO: 716943 - DNA, 25 bp, Mus musculus
gggttcccgctggtccggaccatgt

SEQ ID NO: 716944 - DNA, 25 bp, Mus musculus
gggttccctgggacaagtagtctag

SEQ ID NO: 716945 - DNA, 25 bp, Mus musculus
gggttccctgggtcaagtagtctag

SEQ ID NO: 716946 - DNA, 25 bp, Mus musculus
gggttccctggtcagacaggacctc

SEQ ID NO: 716947 - DNA, 25 bp, Mus musculus
gggttccctggtgagacaggacctc

SEQ ID NO: 716948 - DNA, 25 bp, Mus musculus
gggttccggctgaatttctatgagc

SEQ ID NO: 716949 - DNA, 25 bp, Mus musculus
gggttccggctgtatttctatgagc

SEQ ID NO: 716950 - DNA, 25 bp, Mus musculus
gggttcctatcgctgccactgttcg

SEQ ID NO: 716951 - DNA, 25 bp, Mus musculus
gggttcctatcggtgccactgttcg

SEQ ID NO: 716952 - DNA, 25 bp, Mus musculus
gggttcctccctcttatggttgctg

SEQ ID NO: 716953 - DNA, 25 bp, Mus musculus
gggttcctccctgttatggttgctg

SEQ ID NO: 716954 - DNA, 25 bp, Mus musculus
gggttcctgccgaacgccgtggctc

SEQ ID NO: 716955 - DNA, 25 bp, Mus musculus
gggttcctgccgtacgccgtggctc

SEQ ID NO: 716956 - DNA, 25 bp, Mus musculus
gggttcgacagcatgcctgaccagc

SEQ ID NO: 716957 - DNA, 25 bp, Mus musculus
gggttcgacagcttgcctgaccagc

SEQ ID NO: 716958 - DNA, 25 bp, Mus musculus
gggttcgcagccctctcaaccagtt

SEQ ID NO: 716959 - DNA, 25 bp, Mus musculus
gggttcgcagccgtctcaaccagtt

SEQ ID NO: 716960 - DNA, 25 bp, Mus musculus
gggttcgctcagagaaacgccagag

SEQ ID NO: 716961 - DNA, 25 bp, Mus musculus
gggttcgctcagtgaaacgccagag

SEQ ID NO: 716962 - DNA, 25 bp, Mus musculus
gggttcggaaggactgttgccaatt

SEQ ID NO: 716963 - DNA, 25 bp, Mus musculus
gggttcggaaggtctgttgccaatt

SEQ ID NO: 716964 - DNA, 25 bp, Mus musculus
gggttcggcacccaggcatctgcac

SEQ ID NO: 716965 - DNA, 25 bp, Mus musculus
gggttcggcaccgaggcatctgcac

SEQ ID NO: 716966 - DNA, 25 bp, Mus musculus
gggttcgtcaacagccacttgactt

SEQ ID NO: 716967 - DNA, 25 bp, Mus musculus
gggttcgtcaactgccacttgactt

SEQ ID NO: 716968 - DNA, 25 bp, Mus musculus
gggttctactacatgaaatgactat

SEQ ID NO: 716969 - DNA, 25 bp, Mus musculus
gggttctactacttgaaatgactat

SEQ ID NO: 716970 - DNA, 25 bp, Mus musculus
gggttctatgccagcccgctctgca

SEQ ID NO: 716971 - DNA, 25 bp, Mus musculus
gggttctatgcctgcccgctctgca

SEQ ID NO: 716972 - DNA, 25 bp, Mus musculus
gggttctcaatcatgaagatgtttc

SEQ ID NO: 716973 - DNA, 25 bp, Mus musculus
gggttctcaatcttgaagatgtttc

SEQ ID NO: 716974 - DNA, 25 bp, Mus musculus
gggttctcattcctacagagctaag

SEQ ID NO: 716975 - DNA, 25 bp, Mus musculus
gggttctcattcgtacagagctaag

SEQ ID NO: 716976 - DNA, 25 bp, Mus musculus
gggttctcctggatcggccctcacg

SEQ ID NO: 716977 - DNA, 25 bp, Mus musculus
gggttctcctggttcggccctcacg

SEQ ID NO: 716978 - DNA, 25 bp, Mus musculus
gggttctctcaaagcctgcgcaatt

SEQ ID NO: 716979 - DNA, 25 bp, Mus musculus
gggttctctcaatgcctgcgcaatt

SEQ ID NO: 716980 - DNA, 25 bp, Mus musculus
gggttctctgtaccacctataatga

SEQ ID NO: 716981 - DNA, 25 bp, Mus musculus
gggttctctgtagcacctataatga

SEQ ID NO: 716982 - DNA, 25 bp, Mus musculus
gggttctcttaaagagcagacaacg

SEQ ID NO: 716983 - DNA, 25 bp, Mus musculus
gggttctcttaatgagcagacaacg

SEQ ID NO: 716984 - DNA, 25 bp, Mus musculus
gggttctgttgaacgccctctgaaa

SEQ ID NO: 716985 - DNA, 25 bp, Mus musculus
gggttctgttgatcgccctctgaaa

SEQ ID NO: 716986 - DNA, 25 bp, Mus musculus
gggttcttacagacatcgagcagtt

SEQ ID NO: 716987 - DNA, 25 bp, Mus musculus
gggttcttacagtcatcgagcagtt

SEQ ID NO: 716988 - DNA, 25 bp, Mus musculus
gggttcttcattccggactcctcca

SEQ ID NO: 716989 - DNA, 25 bp, Mus musculus
gggttcttcattgcggactcctcca

SEQ ID NO: 716990 - DNA, 25 bp, Mus musculus
gggttgaaactcacaattgtgagca

SEQ ID NO: 716991 - DNA, 25 bp, Mus musculus
gggttgaaactctcaattgtgagca

SEQ ID NO: 716992 - DNA, 25 bp, Mus musculus
gggttgaccaaaacctcttcagagt

SEQ ID NO: 716993 - DNA, 25 bp, Mus musculus
gggttgaccaaatcctcttcagagt

SEQ ID NO: 716994 - DNA, 25 bp, Mus musculus
gggttgaccagaacgccaatggctt

SEQ ID NO: 716995 - DNA, 25 bp, Mus musculus
gggttgaccagatcgccaatggctt

SEQ ID NO: 716996 - DNA, 25 bp, Mus musculus
gggttgacccaaaatactgcagaga

SEQ ID NO: 716997 - DNA, 25 bp, Mus musculus
gggttgacccaatatactgcagaga

SEQ ID NO: 716998 - DNA, 25 bp, Mus musculus
gggttgactcgtcgaaaccctctct

SEQ ID NO: 716999 - DNA, 25 bp, Mus musculus
gggttgactcgtggaaaccctctct

SEQ ID NO: 717000 - DNA, 25 bp, Mus musculus
gggttgagacaactgttgcaagcct

SEQ ID NO: 717001 - DNA, 25 bp, Mus musculus
gggttgagacaagtgttgcaagcct

SEQ ID NO: 717002 - DNA, 25 bp, Mus musculus
gggttgagtactaatccttagagac

SEQ ID NO: 717003 - DNA, 25 bp, Mus musculus
gggttgagtacttatccttagagac

SEQ ID NO: 717004 - DNA, 25 bp, Mus musculus
gggttgattccaaactccactctat

SEQ ID NO: 717005 - DNA, 25 bp, Mus musculus
gggttgattccatactccactctat

SEQ ID NO: 717006 - DNA, 25 bp, Mus musculus
gggttgcattgcactcctcaatttc

SEQ ID NO: 717007 - DNA, 25 bp, Mus musculus
gggttgcattgctctcctcaatttc

SEQ ID NO: 717008 - DNA, 25 bp, Mus musculus
gggttgcccattacaaattgaacag

SEQ ID NO: 717009 - DNA, 25 bp, Mus musculus
gggttgcccatttcaaattgaacag

SEQ ID NO: 717010 - DNA, 25 bp, Mus musculus
gggttgcccctgaccctatcttagg

SEQ ID NO: 717011 - DNA, 25 bp, Mus musculus
gggttgcccctgtccctatcttagg

SEQ ID NO: 717012 - DNA, 25 bp, Mus musculus
gggttgccccttaggacagcgacgc

SEQ ID NO: 717013 - DNA, 25 bp, Mus musculus
gggttgcccctttggacagcgacgc

SEQ ID NO: 717014 - DNA, 25 bp, Mus musculus
gggttgcggcccatctgtgaattta

SEQ ID NO: 717015 - DNA, 25 bp, Mus musculus
gggttgcggcccttctgtgaattta

SEQ ID NO: 717016 - DNA, 25 bp, Mus musculus
gggttgctaatgactgttttctctg

SEQ ID NO: 717017 - DNA, 25 bp, Mus musculus
gggttgctaatgtctgttttctctg

SEQ ID NO: 717018 - DNA, 25 bp, Mus musculus
gggttgctcgggacacgtgacgggc

SEQ ID NO: 717019 - DNA, 25 bp, Mus musculus
gggttgctcgggtcacgtgacgggc

SEQ ID NO: 717020 - DNA, 25 bp, Mus musculus
gggttgctggagatggccaccacat

SEQ ID NO: 717021 - DNA, 25 bp, Mus musculus
gggttgctggagttggccaccacat

SEQ ID NO: 717022 - DNA, 25 bp, Mus musculus
gggttggaaagtcctgccttctcct

SEQ ID NO: 717023 - DNA, 25 bp, Mus musculus
gggttggaaagtgctgccttctcct

SEQ ID NO: 717024 - DNA, 25 bp, Mus musculus
gggttggaatgcaatttcggcgcca

SEQ ID NO: 717025 - DNA, 25 bp, Mus musculus
gggttggaatgctatttcggcgcca

SEQ ID NO: 717026 - DNA, 25 bp, Mus musculus
gggttggcaaaacaaccttgatcca

SEQ ID NO: 717027 - DNA, 25 bp, Mus musculus
gggttggcaaaagaaccttgatcca

SEQ ID NO: 717028 - DNA, 25 bp, Mus musculus
gggttggtgctaactatatccgccg

SEQ ID NO: 717029 - DNA, 25 bp, Mus musculus
gggttggtgctatctatatccgccg

SEQ ID NO: 717030 - DNA, 25 bp, Mus musculus
gggttggttcctcatacaggcatct

SEQ ID NO: 717031 - DNA, 25 bp, Mus musculus
gggttggttcctgatacaggcatct

SEQ ID NO: 717032 - DNA, 25 bp, Mus musculus
gggttgtaggccactctgaaaagct

SEQ ID NO: 717033 - DNA, 25 bp, Mus musculus
gggttgtaggcctctctgaaaagct

SEQ ID NO: 717034 - DNA, 25 bp, Mus musculus
gggttgtatctccaacaccgcgtcg

SEQ ID NO: 717035 - DNA, 25 bp, Mus musculus
gggttgtatctcgaacaccgcgtcg

SEQ ID NO: 717036 - DNA, 25 bp, Mus musculus
gggttgtcccttccgggatgcgcgc

SEQ ID NO: 717037 - DNA, 25 bp, Mus musculus
gggttgtcccttgcgggatgcgcgc

SEQ ID NO: 717038 - DNA, 25 bp, Mus musculus
gggttgtcttcaaagcctaaaacag

SEQ ID NO: 717039 - DNA, 25 bp, Mus musculus
gggttgtcttcatagcctaaaacag

SEQ ID NO: 717040 - DNA, 25 bp, Mus musculus
gggttgtgggcactcctacccacct

SEQ ID NO: 717041 - DNA, 25 bp, Mus musculus
gggttgtgggcagtcctacccacct

SEQ ID NO: 717042 - DNA, 25 bp, Mus musculus
gggttgttaggtccggaggatcccg

SEQ ID NO: 717043 - DNA, 25 bp, Mus musculus
gggttgttaggtgcggaggatcccg

SEQ ID NO: 717044 - DNA, 25 bp, Mus musculus
gggttgttgatcagagttttccatc

SEQ ID NO: 717045 - DNA, 25 bp, Mus musculus
gggttgttgatctgagttttccatc

SEQ ID NO: 717046 - DNA, 25 bp, Mus musculus
gggtttacaggaacaggagtacagc

SEQ ID NO: 717047 - DNA, 25 bp, Mus musculus
gggtttacaggatcaggagtacagc

SEQ ID NO: 717048 - DNA, 25 bp, Mus musculus
gggtttacccctactgtaagtgctg

SEQ ID NO: 717049 - DNA, 25 bp, Mus musculus
gggtttaccccttctgtaagtgctg

SEQ ID NO: 717050 - DNA, 25 bp, Mus musculus
gggtttatgctaaaactccacaagc

SEQ ID NO: 717051 - DNA, 25 bp, Mus musculus
gggtttatgctataactccacaagc

SEQ ID NO: 717052 - DNA, 25 bp, Mus musculus
gggtttcaaacactcacttctgatg

SEQ ID NO: 717053 - DNA, 25 bp, Mus musculus
gggtttcaaacagtcacttctgatg

SEQ ID NO: 717054 - DNA, 25 bp, Mus musculus
gggtttcaacatcttcgacattgaa

SEQ ID NO: 717055 - DNA, 25 bp, Mus musculus
gggtttcaacatgttcgacattgaa

SEQ ID NO: 717056 - DNA, 25 bp, Mus musculus
gggtttcacactcacccaggaccag

SEQ ID NO: 717057 - DNA, 25 bp, Mus musculus
gggtttcacactgacccaggaccag

SEQ ID NO: 717058 - DNA, 25 bp, Mus musculus
gggtttcaccaacagccttaatgcc

SEQ ID NO: 717059 - DNA, 25 bp, Mus musculus
gggtttcaccaagagccttaatgcc

SEQ ID NO: 717060 - DNA, 25 bp, Mus musculus
gggtttcaccgacttctctgtttga

SEQ ID NO: 717061 - DNA, 25 bp, Mus musculus
gggtttcaccgagttctctgtttga

SEQ ID NO: 717062 - DNA, 25 bp, Mus musculus
gggtttcacttgatggatgatactg

SEQ ID NO: 717063 - DNA, 25 bp, Mus musculus
gggtttcacttgttggatgatactg

SEQ ID NO: 717064 - DNA, 25 bp, Mus musculus
gggtttccagaactgtaagccatgt

SEQ ID NO: 717065 - DNA, 25 bp, Mus musculus
gggtttccagaagtgtaagccatgt

SEQ ID NO: 717066 - DNA, 25 bp, Mus musculus
gggtttccagtgcaatccgttaaca

SEQ ID NO: 717067 - DNA, 25 bp, Mus musculus
gggtttccagtggaatccgttaaca

SEQ ID NO: 717068 - DNA, 25 bp, Mus musculus
gggtttccctctacttagagcctgt

SEQ ID NO: 717069 - DNA, 25 bp, Mus musculus
gggtttccctcttcttagagcctgt

SEQ ID NO: 717070 - DNA, 25 bp, Mus musculus
gggtttctcgtcattaagaatctgg

SEQ ID NO: 717071 - DNA, 25 bp, Mus musculus
gggtttctcgtctttaagaatctgg

SEQ ID NO: 717072 - DNA, 25 bp, Mus musculus
gggtttctctcaataaccatagtac

SEQ ID NO: 717073 - DNA, 25 bp, Mus musculus
gggtttctctcattaaccatagtac

SEQ ID NO: 717074 - DNA, 25 bp, Mus musculus
gggtttctctctcgatgcacaatta

SEQ ID NO: 717075 - DNA, 25 bp, Mus musculus
gggtttctctctggatgcacaatta

SEQ ID NO: 717076 - DNA, 25 bp, Mus musculus
gggtttctgaccacaagctcccctt

SEQ ID NO: 717077 - DNA, 25 bp, Mus musculus
gggtttctgacctcaagctcccctt

SEQ ID NO: 717078 - DNA, 25 bp, Mus musculus
gggtttgaatggagtggacatccac

SEQ ID NO: 717079 - DNA, 25 bp, Mus musculus
gggtttgaatggtgtggacatccac

SEQ ID NO: 717080 - DNA, 25 bp, Mus musculus
gggtttgagctcacggccctgaacc

SEQ ID NO: 717081 - DNA, 25 bp, Mus musculus
gggtttgagctctcggccctgaacc

SEQ ID NO: 717082 - DNA, 25 bp, Mus musculus
gggtttgagggcaacaattcttatt

SEQ ID NO: 717083 - DNA, 25 bp, Mus musculus
gggtttgagggctacaattcttatt

SEQ ID NO: 717084 - DNA, 25 bp, Mus musculus
gggtttgatgacaatgagcccgagt

SEQ ID NO: 717085 - DNA, 25 bp, Mus musculus
gggtttgatgactatgagcccgagt

SEQ ID NO: 717086 - DNA, 25 bp, Mus musculus
gggtttgcaattcctgacagcccaa

SEQ ID NO: 717087 - DNA, 25 bp, Mus musculus
gggtttgcaattgctgacagcccaa

SEQ ID NO: 717088 - DNA, 25 bp, Mus musculus
gggtttgcacatccctccgctgact

SEQ ID NO: 717089 - DNA, 25 bp, Mus musculus
gggtttgcacatgcctccgctgact

SEQ ID NO: 717090 - DNA, 25 bp, Mus musculus
gggtttgccagcaacaaaatagaat

SEQ ID NO: 717091 - DNA, 25 bp, Mus musculus
gggtttgccagctacaaaatagaat

SEQ ID NO: 717092 - DNA, 25 bp, Mus musculus
gggtttgcccgaaatgcatttactg

SEQ ID NO: 717093 - DNA, 25 bp, Mus musculus
gggtttgcccgatatgcatttactg

SEQ ID NO: 717094 - DNA, 25 bp, Mus musculus
gggtttggaagcctcctctgcgaca

SEQ ID NO: 717095 - DNA, 25 bp, Mus musculus
gggtttggaagcgtcctctgcgaca

SEQ ID NO: 717096 - DNA, 25 bp, Mus musculus
gggtttggcagcacagatcctgtaa

SEQ ID NO: 717097 - DNA, 25 bp, Mus musculus
gggtttggcagctcagatcctgtaa

SEQ ID NO: 717098 - DNA, 25 bp, Mus musculus
gggtttggccgaatgcgtcttccca

SEQ ID NO: 717099 - DNA, 25 bp, Mus musculus
gggtttggccgattgcgtcttccca

SEQ ID NO: 717100 - DNA, 25 bp, Mus musculus
gggtttgggtttcagatcacccacg

SEQ ID NO: 717101 - DNA, 25 bp, Mus musculus
gggtttgggtttgagatcacccacg

SEQ ID NO: 717102 - DNA, 25 bp, Mus musculus
gggttttaactaatgcctgactttg

SEQ ID NO: 717103 - DNA, 25 bp, Mus musculus
gggttttaactattgcctgactttg

SEQ ID NO: 717104 - DNA, 25 bp, Mus musculus
gggttttctcagctgctaaacctaa

SEQ ID NO: 717105 - DNA, 25 bp, Mus musculus
gggttttctcaggtgctaaacctaa

SEQ ID NO: 717106 - DNA, 25 bp, Mus musculus
gggttttgctacagtcagaaggact

SEQ ID NO: 717107 - DNA, 25 bp, Mus musculus
gggttttgctactgtcagaaggact

SEQ ID NO: 717108 - DNA, 25 bp, Mus musculus
gggtttttatgtccagtgcgttccg

SEQ ID NO: 717109 - DNA, 25 bp, Mus musculus
gggtttttatgtgcagtgcgttccg

SEQ ID NO: 717110 - DNA, 25 bp, Mus musculus
ggtaaaacaggcagtgcacttctac

SEQ ID NO: 717111 - DNA, 25 bp, Mus musculus
ggtaaaacaggctgtgcacttctac

SEQ ID NO: 717112 - DNA, 25 bp, Mus musculus
ggtaaaacattcactctttggagaa

SEQ ID NO: 717113 - DNA, 25 bp, Mus musculus
ggtaaaacattctctctttggagaa

SEQ ID NO: 717114 - DNA, 25 bp, Mus musculus
ggtaaaaccagaagacactattcct

SEQ ID NO: 717115 - DNA, 25 bp, Mus musculus
ggtaaaaccagatgacactattcct

SEQ ID NO: 717116 - DNA, 25 bp, Mus musculus
ggtaaaacgcaaccccttgtcacgg

SEQ ID NO: 717117 - DNA, 25 bp, Mus musculus
ggtaaaacgcaagcccttgtcacgg

SEQ ID NO: 717118 - DNA, 25 bp, Mus musculus
ggtaaaactccaccagggattgctt

SEQ ID NO: 717119 - DNA, 25 bp, Mus musculus
ggtaaaactccagcagggattgctt

SEQ ID NO: 717120 - DNA, 25 bp, Mus musculus
ggtaaaactctcatggctcgacaga

SEQ ID NO: 717121 - DNA, 25 bp, Mus musculus
ggtaaaactctcttggctcgacaga

SEQ ID NO: 717122 - DNA, 25 bp, Mus musculus
ggtaaaagccaacggttatccagca

SEQ ID NO: 717123 - DNA, 25 bp, Mus musculus
ggtaaaagccaagggttatccagca

SEQ ID NO: 717124 - DNA, 25 bp, Mus musculus
ggtaaaaggtcacagatcttggtct

SEQ ID NO: 717125 - DNA, 25 bp, Mus musculus
ggtaaaaggtcagagatcttggtct

SEQ ID NO: 717126 - DNA, 25 bp, Mus musculus
ggtaaaataggcattgaccctcatg

SEQ ID NO: 717127 - DNA, 25 bp, Mus musculus
ggtaaaataggctttgaccctcatg

SEQ ID NO: 717128 - DNA, 25 bp, Mus musculus
ggtaaaatccccaaataatgcagcg

SEQ ID NO: 717129 - DNA, 25 bp, Mus musculus
ggtaaaatcccctaataatgcagcg

SEQ ID NO: 717130 - DNA, 25 bp, Mus musculus
ggtaaaattacacgactgacacatg

SEQ ID NO: 717131 - DNA, 25 bp, Mus musculus
ggtaaaattacaggactgacacatg

SEQ ID NO: 717132 - DNA, 25 bp, Mus musculus
ggtaaacaaccaagggctgactcca

SEQ ID NO: 717133 - DNA, 25 bp, Mus musculus
ggtaaacaaccatgggctgactcca

SEQ ID NO: 717134 - DNA, 25 bp, Mus musculus
ggtaaacaatgcagttgcactaggg

SEQ ID NO: 717135 - DNA, 25 bp, Mus musculus
ggtaaacaatgctgttgcactaggg

SEQ ID NO: 717136 - DNA, 25 bp, Mus musculus
ggtaaacctcccagagactcggtga

SEQ ID NO: 717137 - DNA, 25 bp, Mus musculus
ggtaaacctccctgagactcggtga

SEQ ID NO: 717138 - DNA, 25 bp, Mus musculus
ggtaaactctccaccaatgttcagt

SEQ ID NO: 717139 - DNA, 25 bp, Mus musculus
ggtaaactctcctccaatgttcagt

SEQ ID NO: 717140 - DNA, 25 bp, Mus musculus
ggtaaagaactcagcacaacattaa

SEQ ID NO: 717141 - DNA, 25 bp, Mus musculus
ggtaaagaactctgcacaacattaa

SEQ ID NO: 717142 - DNA, 25 bp, Mus musculus
ggtaaagaagatacatcatccactg

SEQ ID NO: 717143 - DNA, 25 bp, Mus musculus
ggtaaagaagattcatcatccactg

SEQ ID NO: 717144 - DNA, 25 bp, Mus musculus
ggtaaagaccgacacttcgggagca

SEQ ID NO: 717145 - DNA, 25 bp, Mus musculus
ggtaaagaccgagacttcgggagca

SEQ ID NO: 717146 - DNA, 25 bp, Mus musculus
ggtaaagagtgtctgcagcctgcca

SEQ ID NO: 717147 - DNA, 25 bp, Mus musculus
ggtaaagagtgtgtgcagcctgcca

SEQ ID NO: 717148 - DNA, 25 bp, Mus musculus
ggtaaagcacttacacctgcaagca

SEQ ID NO: 717149 - DNA, 25 bp, Mus musculus
ggtaaagcactttcacctgcaagca

SEQ ID NO: 717150 - DNA, 25 bp, Mus musculus
ggtaaagcagagaccaccctgattc

SEQ ID NO: 717151 - DNA, 25 bp, Mus musculus
ggtaaagcagagtccaccctgattc

SEQ ID NO: 717152 - DNA, 25 bp, Mus musculus
ggtaaagcccaccatacacattgat

SEQ ID NO: 717153 - DNA, 25 bp, Mus musculus
ggtaaagcccacctagtccgctgag

SEQ ID NO: 717154 - DNA, 25 bp, Mus musculus
ggtaaagcccacgatacacattgat

SEQ ID NO: 717155 - DNA, 25 bp, Mus musculus
ggtaaagcccacgtagtccgctgag

SEQ ID NO: 717156 - DNA, 25 bp, Mus musculus
ggtaaatagtcacctacggtcctag

SEQ ID NO: 717157 - DNA, 25 bp, Mus musculus
ggtaaatagtcagctacggtcctag

SEQ ID NO: 717158 - DNA, 25 bp, Mus musculus
ggtaaatcctgcaagccaatcccag

SEQ ID NO: 717159 - DNA, 25 bp, Mus musculus
ggtaaatcctgctagccaatcccag

SEQ ID NO: 717160 - DNA, 25 bp, Mus musculus
ggtaaatcgtatcaacgaaagcatt

SEQ ID NO: 717161 - DNA, 25 bp, Mus musculus
ggtaaatcgtatgaacgaaagcatt

SEQ ID NO: 717162 - DNA, 25 bp, Mus musculus
ggtaaatgatcccagtgtccttgga

SEQ ID NO: 717163 - DNA, 25 bp, Mus musculus
ggtaaatgatccgagtgtccttgga

SEQ ID NO: 717164 - DNA, 25 bp, Mus musculus
ggtaaatgctggattggcccatgaa

SEQ ID NO: 717165 - DNA, 25 bp, Mus musculus
ggtaaatgctggtttggcccatgaa

SEQ ID NO: 717166 - DNA, 25 bp, Mus musculus
ggtaaatgttgcatcagtgcatgtg

SEQ ID NO: 717167 - DNA, 25 bp, Mus musculus
ggtaaatgttgcttcagtgcatgtg

SEQ ID NO: 717168 - DNA, 25 bp, Mus musculus
ggtaaattctatatcaggctcggtg

SEQ ID NO: 717169 - DNA, 25 bp, Mus musculus
ggtaaattctatttcaggctcggtg

SEQ ID NO: 717170 - DNA, 25 bp, Mus musculus
ggtaacaacctgatctactatgtgc

SEQ ID NO: 717171 - DNA, 25 bp, Mus musculus
ggtaacaacctgttctactatgtgc

SEQ ID NO: 717172 - DNA, 25 bp, Mus musculus
ggtaacaacttcagcgcgggcagtc

SEQ ID NO: 717173 - DNA, 25 bp, Mus musculus
ggtaacaacttctgcgcgggcagtc

SEQ ID NO: 717174 - DNA, 25 bp, Mus musculus
ggtaacaatgcaccaagctcagaaa

SEQ ID NO: 717175 - DNA, 25 bp, Mus musculus
ggtaacaatgcagcaagctcagaaa

SEQ ID NO: 717176 - DNA, 25 bp, Mus musculus
ggtaacaccatcacttgccttttgt

SEQ ID NO: 717177 - DNA, 25 bp, Mus musculus
ggtaacaccatctcttgccttttgt

SEQ ID NO: 717178 - DNA, 25 bp, Mus musculus
ggtaacacgggtcctccaggaaagc

SEQ ID NO: 717179 - DNA, 25 bp, Mus musculus
ggtaacacgggtgctccaggaaagc

SEQ ID NO: 717180 - DNA, 25 bp, Mus musculus
ggtaacagagtgatttggtatgctg

SEQ ID NO: 717181 - DNA, 25 bp, Mus musculus
ggtaacagagtgttttggtatgctg

SEQ ID NO: 717182 - DNA, 25 bp, Mus musculus
ggtaacaggaacatggcctctgctg

SEQ ID NO: 717183 - DNA, 25 bp, Mus musculus
ggtaacaggaacttggcctctgctg

SEQ ID NO: 717184 - DNA, 25 bp, Mus musculus
ggtaacatctcactccacctgcgtg

SEQ ID NO: 717185 - DNA, 25 bp, Mus musculus
ggtaacatctcagtccacctgcgtg

SEQ ID NO: 717186 - DNA, 25 bp, Mus musculus
ggtaaccaaacccactatagaatat

SEQ ID NO: 717187 - DNA, 25 bp, Mus musculus
ggtaaccaaaccgactatagaatat

SEQ ID NO: 717188 - DNA, 25 bp, Mus musculus
ggtaaccaaccccaagaggattgct

SEQ ID NO: 717189 - DNA, 25 bp, Mus musculus
ggtaaccaacccgaagaggattgct

SEQ ID NO: 717190 - DNA, 25 bp, Mus musculus
ggtaaccacgagacaacacccaatg

SEQ ID NO: 717191 - DNA, 25 bp, Mus musculus
ggtaaccacgagtcaacacccaatg

SEQ ID NO: 717192 - DNA, 25 bp, Mus musculus
ggtaaccagaaaagtcacctcagca

SEQ ID NO: 717193 - DNA, 25 bp, Mus musculus
ggtaaccagaaatgtcacctcagca

SEQ ID NO: 717194 - DNA, 25 bp, Mus musculus
ggtaacccacccatgcaaagcagaa

SEQ ID NO: 717195 - DNA, 25 bp, Mus musculus
ggtaacccacccttgcaaagcagaa

SEQ ID NO: 717196 - DNA, 25 bp, Mus musculus
ggtaacccacgtcagcgggcttctc

SEQ ID NO: 717197 - DNA, 25 bp, Mus musculus
ggtaacccacgtgagcgggcttctc

SEQ ID NO: 717198 - DNA, 25 bp, Mus musculus
ggtaaccgaggtctatgaacagtgt

SEQ ID NO: 717199 - DNA, 25 bp, Mus musculus
ggtaaccgaggtgtatgaacagtgt

SEQ ID NO: 717200 - DNA, 25 bp, Mus musculus
ggtaacctagcgacccgagagcttt

SEQ ID NO: 717201 - DNA, 25 bp, Mus musculus
ggtaacctagcgtcccgagagcttt

SEQ ID NO: 717202 - DNA, 25 bp, Mus musculus
ggtaacctcaggaccttcgctcgga

SEQ ID NO: 717203 - DNA, 25 bp, Mus musculus
ggtaacctcaggtccttcgctcgga

SEQ ID NO: 717204 - DNA, 25 bp, Mus musculus
ggtaacctctatcactgggttgtca

SEQ ID NO: 717205 - DNA, 25 bp, Mus musculus
ggtaacctctatgactgggttgtca

SEQ ID NO: 717206 - DNA, 25 bp, Mus musculus
ggtaacgtggttcccacaaagccac

SEQ ID NO: 717207 - DNA, 25 bp, Mus musculus
ggtaacgtggttgccacaaagccac

SEQ ID NO: 717208 - DNA, 25 bp, Mus musculus
ggtaactccaaaatgatcccttgca

SEQ ID NO: 717209 - DNA, 25 bp, Mus musculus
ggtaactccaaattgatcccttgca

SEQ ID NO: 717210 - DNA, 25 bp, Mus musculus
ggtaactctaaacggacacgtgaag

SEQ ID NO: 717211 - DNA, 25 bp, Mus musculus
ggtaactctaaagggacacgtgaag

SEQ ID NO: 717212 - DNA, 25 bp, Mus musculus
ggtaactctcaaaccctgagcccag

SEQ ID NO: 717213 - DNA, 25 bp, Mus musculus
ggtaactctcaatccctgagcccag

SEQ ID NO: 717214 - DNA, 25 bp, Mus musculus
ggtaactctggccaacatcttggag

SEQ ID NO: 717215 - DNA, 25 bp, Mus musculus
ggtaactctggcgaacatcttggag

SEQ ID NO: 717216 - DNA, 25 bp, Mus musculus
ggtaactctgttctgtcacctcttc

SEQ ID NO: 717217 - DNA, 25 bp, Mus musculus
ggtaactctgttgtgtcacctcttc

SEQ ID NO: 717218 - DNA, 25 bp, Mus musculus
ggtaactgacaaagtgaaaaagcac

SEQ ID NO: 717219 - DNA, 25 bp, Mus musculus
ggtaactgacaatgtgaaaaagcac

SEQ ID NO: 717220 - DNA, 25 bp, Mus musculus
ggtaacttccagactctgtgaatgc

SEQ ID NO: 717221 - DNA, 25 bp, Mus musculus
ggtaacttccagtctctgtgaatgc

SEQ ID NO: 717222 - DNA, 25 bp, Mus musculus
ggtaacttctctatcaccctgcgca

SEQ ID NO: 717223 - DNA, 25 bp, Mus musculus
ggtaacttctctttcaccctgcgca

SEQ ID NO: 717224 - DNA, 25 bp, Mus musculus
ggtaacttgaagatggttcacatcc

SEQ ID NO: 717225 - DNA, 25 bp, Mus musculus
ggtaacttgaagttggttcacatcc

SEQ ID NO: 717226 - DNA, 25 bp, Mus musculus
ggtaagaacctaccgatgtgaaaga

SEQ ID NO: 717227 - DNA, 25 bp, Mus musculus
ggtaagaacctagcgatgtgaaaga

SEQ ID NO: 717228 - DNA, 25 bp, Mus musculus
ggtaagaagtatcgagaaacggcta

SEQ ID NO: 717229 - DNA, 25 bp, Mus musculus
ggtaagaagtatggagaaacggcta

SEQ ID NO: 717230 - DNA, 25 bp, Mus musculus
ggtaagaataaactcgccgcccaga

SEQ ID NO: 717231 - DNA, 25 bp, Mus musculus
ggtaagaataaagtcgccgcccaga

SEQ ID NO: 717232 - DNA, 25 bp, Mus musculus
ggtaagacaattactagtttcgtca

SEQ ID NO: 717233 - DNA, 25 bp, Mus musculus
ggtaagacaatttctagtttcgtca

SEQ ID NO: 717234 - DNA, 25 bp, Mus musculus
ggtaagactcgccttctatccagag

SEQ ID NO: 717235 - DNA, 25 bp, Mus musculus
ggtaagactcgcgttctatccagag

SEQ ID NO: 717236 - DNA, 25 bp, Mus musculus
ggtaagagcattcgccaagccttag

SEQ ID NO: 717237 - DNA, 25 bp, Mus musculus
ggtaagagcattggccaagccttag

SEQ ID NO: 717238 - DNA, 25 bp, Mus musculus
ggtaagagtaccatgcatgctgtat

SEQ ID NO: 717239 - DNA, 25 bp, Mus musculus
ggtaagagtaccttgcatgctgtat

SEQ ID NO: 717240 - DNA, 25 bp, Mus musculus
ggtaagatccacatcatgatgccac

SEQ ID NO: 717241 - DNA, 25 bp, Mus musculus
ggtaagatccacttcatgatgccac

SEQ ID NO: 717242 - DNA, 25 bp, Mus musculus
ggtaagatcttcaccaccaagtcct

SEQ ID NO: 717243 - DNA, 25 bp, Mus musculus
ggtaagatcttctccaccaagtcct

SEQ ID NO: 717244 - DNA, 25 bp, Mus musculus
ggtaagcccccactattcagcactg

SEQ ID NO: 717245 - DNA, 25 bp, Mus musculus
ggtaagcccccagtattcagcactg

SEQ ID NO: 717246 - DNA, 25 bp, Mus musculus
ggtaagccctttagcctggaacaca

SEQ ID NO: 717247 - DNA, 25 bp, Mus musculus
ggtaagcccttttgcctggaacaca

SEQ ID NO: 717248 - DNA, 25 bp, Mus musculus
ggtaaggatggaccccactaacctg

SEQ ID NO: 717249 - DNA, 25 bp, Mus musculus
ggtaaggatggagcccactaacctg

SEQ ID NO: 717250 - DNA, 25 bp, Mus musculus
ggtaagtagagaagtctccttaaga

SEQ ID NO: 717251 - DNA, 25 bp, Mus musculus
ggtaagtagagatgtctccttaaga

SEQ ID NO: 717252 - DNA, 25 bp, Mus musculus
ggtaagtaggacctctgtataatcc

SEQ ID NO: 717253 - DNA, 25 bp, Mus musculus
ggtaagtaggacgtctgtataatcc

SEQ ID NO: 717254 - DNA, 25 bp, Mus musculus
ggtaagtctagaaggaggcacattt

SEQ ID NO: 717255 - DNA, 25 bp, Mus musculus
ggtaagtctagatggaggcacattt

SEQ ID NO: 717256 - DNA, 25 bp, Mus musculus
ggtaagtgcagtcgcaaaaaaacag

SEQ ID NO: 717257 - DNA, 25 bp, Mus musculus
ggtaagtgcagtggcaaaaaaacag

SEQ ID NO: 717258 - DNA, 25 bp, Mus musculus
ggtaagttccatctgctgccagacg

SEQ ID NO: 717259 - DNA, 25 bp, Mus musculus
ggtaagttccatgtgctgccagacg

SEQ ID NO: 717260 - DNA, 25 bp, Mus musculus
ggtaataaccaacttgtaatcaaag

SEQ ID NO: 717261 - DNA, 25 bp, Mus musculus
ggtaataaccaagttgtaatcaaag

SEQ ID NO: 717262 - DNA, 25 bp, Mus musculus
ggtaatacggcacttccctgtcagg

SEQ ID NO: 717263 - DNA, 25 bp, Mus musculus
ggtaatacggcagttccctgtcagg

SEQ ID NO: 717264 - DNA, 25 bp, Mus musculus
ggtaatagctggcatgatctacaag

SEQ ID NO: 717265 - DNA, 25 bp, Mus musculus
ggtaatagctgggatgatctacaag

SEQ ID NO: 717266 - DNA, 25 bp, Mus musculus
ggtaatcatgtaagagatgctcatc

SEQ ID NO: 717267 - DNA, 25 bp, Mus musculus
ggtaatcatgtatgagatgctcatc

SEQ ID NO: 717268 - DNA, 25 bp, Mus musculus
ggtaatccgttcacgtgctcctgcg

SEQ ID NO: 717269 - DNA, 25 bp, Mus musculus
ggtaatccgttctcgtgctcctgcg

SEQ ID NO: 717270 - DNA, 25 bp, Mus musculus
ggtaatcctataatcgtgtcctctt

SEQ ID NO: 717271 - DNA, 25 bp, Mus musculus
ggtaatcctatattcgtgtcctctt

SEQ ID NO: 717272 - DNA, 25 bp, Mus musculus
ggtaatcctcgtcgggaacaagtgt

SEQ ID NO: 717273 - DNA, 25 bp, Mus musculus
ggtaatcctcgtggggaacaagtgt

SEQ ID NO: 717274 - DNA, 25 bp, Mus musculus
ggtaatcttcaccaaccaaatgggc

SEQ ID NO: 717275 - DNA, 25 bp, Mus musculus
ggtaatcttcacgaaccaaatgggc

SEQ ID NO: 717276 - DNA, 25 bp, Mus musculus
ggtaatgaactcagaagagaagact

SEQ ID NO: 717277 - DNA, 25 bp, Mus musculus
ggtaatgaactctgaagagaagact

SEQ ID NO: 717278 - DNA, 25 bp, Mus musculus
ggtaatgccaatcctcacaagtggg

SEQ ID NO: 717279 - DNA, 25 bp, Mus musculus
ggtaatgccaatgctcacaagtggg

SEQ ID NO: 717280 - DNA, 25 bp, Mus musculus
ggtaatggacctcatgccccataaa

SEQ ID NO: 717281 - DNA, 25 bp, Mus musculus
ggtaatggacctgatgccccataaa

SEQ ID NO: 717282 - DNA, 25 bp, Mus musculus
ggtaatggcaataggagttctctcc

SEQ ID NO: 717283 - DNA, 25 bp, Mus musculus
ggtaatggcaattggagttctctcc

SEQ ID NO: 717284 - DNA, 25 bp, Mus musculus
ggtaattccgaacattcatcccaac

SEQ ID NO: 717285 - DNA, 25 bp, Mus musculus
ggtaattccgaagattcatcccaac

SEQ ID NO: 717286 - DNA, 25 bp, Mus musculus
ggtaattgcaaccacagttctacag

SEQ ID NO: 717287 - DNA, 25 bp, Mus musculus
ggtaattgcaacgacagttctacag

SEQ ID NO: 717288 - DNA, 25 bp, Mus musculus
ggtaatttgtgaagaagtctctctc

SEQ ID NO: 717289 - DNA, 25 bp, Mus musculus
ggtaatttgtgatgaagtctctctc

SEQ ID NO: 717290 - DNA, 25 bp, Mus musculus
ggtacaaacattcctgctgggaaag

SEQ ID NO: 717291 - DNA, 25 bp, Mus musculus
ggtacaaacattgctgctgggaaag

SEQ ID NO: 717292 - DNA, 25 bp, Mus musculus
ggtacaaaccaaatatgacaggtgg

SEQ ID NO: 717293 - DNA, 25 bp, Mus musculus
ggtacaaaccaattatgacaggtgg

SEQ ID NO: 717294 - DNA, 25 bp, Mus musculus
ggtacaaattgcaatcctgtccatg

SEQ ID NO: 717295 - DNA, 25 bp, Mus musculus
ggtacaaattgctatcctgtccatg

SEQ ID NO: 717296 - DNA, 25 bp, Mus musculus
ggtacaaccacaataccgccactta

SEQ ID NO: 717297 - DNA, 25 bp, Mus musculus
ggtacaaccacattaccgccactta

SEQ ID NO: 717298 - DNA, 25 bp, Mus musculus
ggtacaaccagcacgcctatgatag

SEQ ID NO: 717299 - DNA, 25 bp, Mus musculus
ggtacaaccagctcgcctatgatag

SEQ ID NO: 717300 - DNA, 25 bp, Mus musculus
ggtacaacctgaaggaccagcatca

SEQ ID NO: 717301 - DNA, 25 bp, Mus musculus
ggtacaacctgatggaccagcatca

SEQ ID NO: 717302 - DNA, 25 bp, Mus musculus
ggtacaacgtaaatgtggcgtggac

SEQ ID NO: 717303 - DNA, 25 bp, Mus musculus
ggtacaacgtaattgtggcgtggac

SEQ ID NO: 717304 - DNA, 25 bp, Mus musculus
ggtacaagaacactctgcccttgca

SEQ ID NO: 717305 - DNA, 25 bp, Mus musculus
ggtacaagaacagtctgcccttgca

SEQ ID NO: 717306 - DNA, 25 bp, Mus musculus
ggtacaagataacagcccagcatgg

SEQ ID NO: 717307 - DNA, 25 bp, Mus musculus
ggtacaagataagagcccagcatgg

SEQ ID NO: 717308 - DNA, 25 bp, Mus musculus
ggtacaagatggaacaggccatcaa

SEQ ID NO: 717309 - DNA, 25 bp, Mus musculus
ggtacaagatggtacaggccatcaa

SEQ ID NO: 717310 - DNA, 25 bp, Mus musculus
ggtacaagggcaagaactaccccat

SEQ ID NO: 717311 - DNA, 25 bp, Mus musculus
ggtacaagggcatgaactaccccat

SEQ ID NO: 717312 - DNA, 25 bp, Mus musculus
ggtacaaggtgtatgacccttcttg

SEQ ID NO: 717313 - DNA, 25 bp, Mus musculus
ggtacaaggtgtttgacccttcttg

SEQ ID NO: 717314 - DNA, 25 bp, Mus musculus
ggtacaatctcgaagaaaatggacg

SEQ ID NO: 717315 - DNA, 25 bp, Mus musculus
ggtacaatctcgtagaaaatggacg

SEQ ID NO: 717316 - DNA, 25 bp, Mus musculus
ggtacaattaaccagaacccacagc

SEQ ID NO: 717317 - DNA, 25 bp, Mus musculus
ggtacaattaacgagaacccacagc

SEQ ID NO: 717318 - DNA, 25 bp, Mus musculus
ggtacaattcctctgatgtatcagg

SEQ ID NO: 717319 - DNA, 25 bp, Mus musculus
ggtacaattcctgtgatgtatcagg

SEQ ID NO: 717320 - DNA, 25 bp, Mus musculus
ggtacacaacgtcgcccagtgcgag

SEQ ID NO: 717321 - DNA, 25 bp, Mus musculus
ggtacacaacgtggcccagtgcgag

SEQ ID NO: 717322 - DNA, 25 bp, Mus musculus
ggtacacacactagcagagagctca

SEQ ID NO: 717323 - DNA, 25 bp, Mus musculus
ggtacacacacttgcagagagctca

SEQ ID NO: 717324 - DNA, 25 bp, Mus musculus
ggtacacagggcaaatgggaacact

SEQ ID NO: 717325 - DNA, 25 bp, Mus musculus
ggtacacagggctaatgggaacact

SEQ ID NO: 717326 - DNA, 25 bp, Mus musculus
ggtacaccattaagtcgggctgatt

SEQ ID NO: 717327 - DNA, 25 bp, Mus musculus
ggtacaccattatgtcgggctgatt

SEQ ID NO: 717328 - DNA, 25 bp, Mus musculus
ggtacacccactcacttaggctaaa

SEQ ID NO: 717329 - DNA, 25 bp, Mus musculus
ggtacacccactgacttaggctaaa

SEQ ID NO: 717330 - DNA, 25 bp, Mus musculus
ggtacacggtccatgcacagtgccg

SEQ ID NO: 717331 - DNA, 25 bp, Mus musculus
ggtacacggtccttgcacagtgccg

SEQ ID NO: 717332 - DNA, 25 bp, Mus musculus
ggtacacgttagataactatacaat

SEQ ID NO: 717333 - DNA, 25 bp, Mus musculus
ggtacacgttagttaactatacaat

SEQ ID NO: 717334 - DNA, 25 bp, Mus musculus
ggtacagaaagcagtcaacactgcc

SEQ ID NO: 717335 - DNA, 25 bp, Mus musculus
ggtacagaaagctgtcaacactgcc

SEQ ID NO: 717336 - DNA, 25 bp, Mus musculus
ggtacagacagacgtcaccttcctg

SEQ ID NO: 717337 - DNA, 25 bp, Mus musculus
ggtacagacagaggtcaccttcctg

SEQ ID NO: 717338 - DNA, 25 bp, Mus musculus
ggtacagacctgagagagactcatc

SEQ ID NO: 717339 - DNA, 25 bp, Mus musculus
ggtacagacctgtgagagactcatc

SEQ ID NO: 717340 - DNA, 25 bp, Mus musculus
ggtacagagcaaagggaacagccct

SEQ ID NO: 717341 - DNA, 25 bp, Mus musculus
ggtacagagcaatgggaacagccct

SEQ ID NO: 717342 - DNA, 25 bp, Mus musculus
ggtacagatcccaggaccttctctc

SEQ ID NO: 717343 - DNA, 25 bp, Mus musculus
ggtacagatccctggaccttctctc

SEQ ID NO: 717344 - DNA, 25 bp, Mus musculus
ggtacagccttcatggtcctcatgg

SEQ ID NO: 717345 - DNA, 25 bp, Mus musculus
ggtacagccttcttggtcctcatgg

SEQ ID NO: 717346 - DNA, 25 bp, Mus musculus
ggtacaggctatatcaggagggatt

SEQ ID NO: 717347 - DNA, 25 bp, Mus musculus
ggtacaggctatttcaggagggatt

SEQ ID NO: 717348 - DNA, 25 bp, Mus musculus
ggtacaggctgaatgactacgtgtg

SEQ ID NO: 717349 - DNA, 25 bp, Mus musculus
ggtacaggctgattgactacgtgtg

SEQ ID NO: 717350 - DNA, 25 bp, Mus musculus
ggtacagtgacaagactgacagcaa

SEQ ID NO: 717351 - DNA, 25 bp, Mus musculus
ggtacagtgacatgactgacagcaa

SEQ ID NO: 717352 - DNA, 25 bp, Mus musculus
ggtacagttcaacatcaagaggcac

SEQ ID NO: 717353 - DNA, 25 bp, Mus musculus
ggtacagttcaagatcaagaggcac

SEQ ID NO: 717354 - DNA, 25 bp, Mus musculus
ggtacatccacgatttcctcaaata

SEQ ID NO: 717355 - DNA, 25 bp, Mus musculus
ggtacatccacgttttcctcaaata

SEQ ID NO: 717356 - DNA, 25 bp, Mus musculus
ggtacatctgccatgaaatcattgg

SEQ ID NO: 717357 - DNA, 25 bp, Mus musculus
ggtacatctgccttgaaatcattgg

SEQ ID NO: 717358 - DNA, 25 bp, Mus musculus
ggtacatgacaaaggacaacctggc

SEQ ID NO: 717359 - DNA, 25 bp, Mus musculus
ggtacatgacaatggacaacctggc

SEQ ID NO: 717360 - DNA, 25 bp, Mus musculus
ggtacatgctagcaatgttgccagc

SEQ ID NO: 717361 - DNA, 25 bp, Mus musculus
ggtacatgctaggaatgttgccagc

SEQ ID NO: 717362 - DNA, 25 bp, Mus musculus
ggtacattcattctgaagactacag

SEQ ID NO: 717363 - DNA, 25 bp, Mus musculus
ggtacattcattgtgaagactacag

SEQ ID NO: 717364 - DNA, 25 bp, Mus musculus
ggtacattcctgagccagagatact

SEQ ID NO: 717365 - DNA, 25 bp, Mus musculus
ggtacattcctgtgccagagatact

SEQ ID NO: 717366 - DNA, 25 bp, Mus musculus
ggtacattccttcatcatttctaga

SEQ ID NO: 717367 - DNA, 25 bp, Mus musculus
ggtacattccttgatcatttctaga

SEQ ID NO: 717368 - DNA, 25 bp, Mus musculus
ggtaccaaaagccttggatttggat

SEQ ID NO: 717369 - DNA, 25 bp, Mus musculus
ggtaccaaaagcgttggatttggat

SEQ ID NO: 717370 - DNA, 25 bp, Mus musculus
ggtaccaacgacaatgtgcaactta

SEQ ID NO: 717371 - DNA, 25 bp, Mus musculus
ggtaccaacgactatgtgcaactta

SEQ ID NO: 717372 - DNA, 25 bp, Mus musculus
ggtaccaacgccagcagcggagcgc

SEQ ID NO: 717373 - DNA, 25 bp, Mus musculus
ggtaccaacgcctgcagcggagcgc

SEQ ID NO: 717374 - DNA, 25 bp, Mus musculus
ggtaccaacgctattaaagctgcgg

SEQ ID NO: 717375 - DNA, 25 bp, Mus musculus
ggtaccaacgcttttaaagctgcgg

SEQ ID NO: 717376 - DNA, 25 bp, Mus musculus
ggtaccaagcaccagcctgttagca

SEQ ID NO: 717377 - DNA, 25 bp, Mus musculus
ggtaccaagcacgagcctgttagca

SEQ ID NO: 717378 - DNA, 25 bp, Mus musculus
ggtaccactacgcagttcacgcatg

SEQ ID NO: 717379 - DNA, 25 bp, Mus musculus
ggtaccactacggagttcacgcatg

SEQ ID NO: 717380 - DNA, 25 bp, Mus musculus
ggtaccactcaaactgcaggcgctt

SEQ ID NO: 717381 - DNA, 25 bp, Mus musculus
ggtaccactcaatctgcaggcgctt

SEQ ID NO: 717382 - DNA, 25 bp, Mus musculus
ggtaccagaactctactgggcccca

SEQ ID NO: 717383 - DNA, 25 bp, Mus musculus
ggtaccagaactgtactgggcccca

SEQ ID NO: 717384 - DNA, 25 bp, Mus musculus
ggtaccagcaacaagacagccagga

SEQ ID NO: 717385 - DNA, 25 bp, Mus musculus
ggtaccagcaactagacagccagga

SEQ ID NO: 717386 - DNA, 25 bp, Mus musculus
ggtaccagcagtcgaaggacttcaa

SEQ ID NO: 717387 - DNA, 25 bp, Mus musculus
ggtaccagcagtggaaggacttcaa

SEQ ID NO: 717388 - DNA, 25 bp, Mus musculus
ggtaccagtgtaatggtgacacact

SEQ ID NO: 717389 - DNA, 25 bp, Mus musculus
ggtaccagtgtattggtgacacact

SEQ ID NO: 717390 - DNA, 25 bp, Mus musculus
ggtaccagtttacttctctgcggga

SEQ ID NO: 717391 - DNA, 25 bp, Mus musculus
ggtaccagtttagttctctgcggga

SEQ ID NO: 717392 - DNA, 25 bp, Mus musculus
ggtaccatatttacctcagtgtgtg

SEQ ID NO: 717393 - DNA, 25 bp, Mus musculus
ggtaccatattttcctcagtgtgtg

SEQ ID NO: 717394 - DNA, 25 bp, Mus musculus
ggtaccatcatgcatctttagtcta

SEQ ID NO: 717395 - DNA, 25 bp, Mus musculus
ggtaccatcatggatctttagtcta

SEQ ID NO: 717396 - DNA, 25 bp, Mus musculus
ggtaccatctccaaacagaggctgt

SEQ ID NO: 717397 - DNA, 25 bp, Mus musculus
ggtaccatctcctaacagaggctgt

SEQ ID NO: 717398 - DNA, 25 bp, Mus musculus
ggtacccaaagacccatccaaggaa

SEQ ID NO: 717399 - DNA, 25 bp, Mus musculus
ggtacccaaagagccatccaaggaa

SEQ ID NO: 717400 - DNA, 25 bp, Mus musculus
ggtacccaccagcaagcatgcagtt

SEQ ID NO: 717401 - DNA, 25 bp, Mus musculus
ggtacccaccaggaagcatgcagtt

SEQ ID NO: 717402 - DNA, 25 bp, Mus musculus
ggtacccaccatagtcgtgataggg

SEQ ID NO: 717403 - DNA, 25 bp, Mus musculus
ggtacccaccattgtcgtgataggg

SEQ ID NO: 717404 - DNA, 25 bp, Mus musculus
ggtacccgaccaacatctataacat

SEQ ID NO: 717405 - DNA, 25 bp, Mus musculus
ggtacccgaccatcatctataacat

SEQ ID NO: 717406 - DNA, 25 bp, Mus musculus
ggtacccgacggatgctgaatcgct

SEQ ID NO: 717407 - DNA, 25 bp, Mus musculus
ggtacccgacggttgctgaatcgct

SEQ ID NO: 717408 - DNA, 25 bp, Mus musculus
ggtaccctagaaaaaactgcactgc

SEQ ID NO: 717409 - DNA, 25 bp, Mus musculus
ggtaccctagaataaactgcactgc

SEQ ID NO: 717410 - DNA, 25 bp, Mus musculus
ggtaccgaagccatccttcttgcag

SEQ ID NO: 717411 - DNA, 25 bp, Mus musculus
ggtaccgaagccttccttcttgcag

SEQ ID NO: 717412 - DNA, 25 bp, Mus musculus
ggtaccgatgagcatttagcacact

SEQ ID NO: 717413 - DNA, 25 bp, Mus musculus
ggtaccgatgaggatttagcacact

SEQ ID NO: 717414 - DNA, 25 bp, Mus musculus
ggtaccgggcacaacctttgcaatg

SEQ ID NO: 717415 - DNA, 25 bp, Mus musculus
ggtaccgggcactacctttgcaatg

SEQ ID NO: 717416 - DNA, 25 bp, Mus musculus
ggtaccgtggaccatccatgcctct

SEQ ID NO: 717417 - DNA, 25 bp, Mus musculus
ggtaccgtggacgatccatgcctct

SEQ ID NO: 717418 - DNA, 25 bp, Mus musculus
ggtacctccaggcaccaagtgtgag

SEQ ID NO: 717419 - DNA, 25 bp, Mus musculus
ggtacctccagggaccaagtgtgag

SEQ ID NO: 717420 - DNA, 25 bp, Mus musculus
ggtacctccgtgacctcatcagcaa

SEQ ID NO: 717421 - DNA, 25 bp, Mus musculus
ggtacctccgtgtcctcatcagcaa

SEQ ID NO: 717422 - DNA, 25 bp, Mus musculus
ggtacctctcccagcagcttgtgtg

SEQ ID NO: 717423 - DNA, 25 bp, Mus musculus
ggtacctctccctgcagcttgtgtg

SEQ ID NO: 717424 - DNA, 25 bp, Mus musculus
ggtacctcttctcctaaagatgaag

SEQ ID NO: 717425 - DNA, 25 bp, Mus musculus
ggtacctcttctgctaaagatgaag

SEQ ID NO: 717426 - DNA, 25 bp, Mus musculus
ggtacctgaagcacagcgcacagct

SEQ ID NO: 717427 - DNA, 25 bp, Mus musculus
ggtacctgaagctcagcgcacagct

SEQ ID NO: 717428 - DNA, 25 bp, Mus musculus
ggtacctgacaaacgcctacagcag

SEQ ID NO: 717429 - DNA, 25 bp, Mus musculus
ggtacctgacaatcgcctacagcag

SEQ ID NO: 717430 - DNA, 25 bp, Mus musculus
ggtacctgcagaacatccgcttcct

SEQ ID NO: 717431 - DNA, 25 bp, Mus musculus
ggtacctgcagatcatccgcttcct

SEQ ID NO: 717432 - DNA, 25 bp, Mus musculus
ggtacctgccacatggtcctgggag

SEQ ID NO: 717433 - DNA, 25 bp, Mus musculus
ggtacctgccacttggtcctgggag

SEQ ID NO: 717434 - DNA, 25 bp, Mus musculus
ggtacctgcggcaacgccaagagct

SEQ ID NO: 717435 - DNA, 25 bp, Mus musculus
ggtacctgcggctacgccaagagct

SEQ ID NO: 717436 - DNA, 25 bp, Mus musculus
ggtacctggcgcacacagaacagga

SEQ ID NO: 717437 - DNA, 25 bp, Mus musculus
ggtacctggcgctcacagaacagga

SEQ ID NO: 717438 - DNA, 25 bp, Mus musculus
ggtacctggtgcagcacagctggct

SEQ ID NO: 717439 - DNA, 25 bp, Mus musculus
ggtacctggtgctgcacagctggct

SEQ ID NO: 717440 - DNA, 25 bp, Mus musculus
ggtacctgtgagcttggctcctcca

SEQ ID NO: 717441 - DNA, 25 bp, Mus musculus
ggtacctgtgaggttggctcctcca

SEQ ID NO: 717442 - DNA, 25 bp, Mus musculus
ggtacctgtgcaaattaagggccac

SEQ ID NO: 717443 - DNA, 25 bp, Mus musculus
ggtacctgtgcatattaagggccac

SEQ ID NO: 717444 - DNA, 25 bp, Mus musculus
ggtacctgtttgcaaagtctcgagc

SEQ ID NO: 717445 - DNA, 25 bp, Mus musculus
ggtacctgtttggaaagtctcgagc

SEQ ID NO: 717446 - DNA, 25 bp, Mus musculus
ggtaccttggccaaagacaccacag

SEQ ID NO: 717447 - DNA, 25 bp, Mus musculus
ggtaccttggcctaagacaccacag

SEQ ID NO: 717448 - DNA, 25 bp, Mus musculus
ggtacctttggcactcaccgtcctg

SEQ ID NO: 717449 - DNA, 25 bp, Mus musculus
ggtacctttggctctcaccgtcctg

SEQ ID NO: 717450 - DNA, 25 bp, Mus musculus
ggtacgaaattgagaagatcccagc

SEQ ID NO: 717451 - DNA, 25 bp, Mus musculus
ggtacgaaattgtgaagatcccagc

SEQ ID NO: 717452 - DNA, 25 bp, Mus musculus
ggtacgactccgctatgagcatcat

SEQ ID NO: 717453 - DNA, 25 bp, Mus musculus
ggtacgactccggtatgagcatcat

SEQ ID NO: 717454 - DNA, 25 bp, Mus musculus
ggtacgagacccagacctaagtgca

SEQ ID NO: 717455 - DNA, 25 bp, Mus musculus
ggtacgagaccctgacctaagtgca

SEQ ID NO: 717456 - DNA, 25 bp, Mus musculus
ggtacgagcaggacttcgcagtgct

SEQ ID NO: 717457 - DNA, 25 bp, Mus musculus
ggtacgagcaggtcttcgcagtgct

SEQ ID NO: 717458 - DNA, 25 bp, Mus musculus
ggtacgaggaacaaatacgcagttg

SEQ ID NO: 717459 - DNA, 25 bp, Mus musculus
ggtacgaggaactaatacgcagttg

SEQ ID NO: 717460 - DNA, 25 bp, Mus musculus
ggtacgagtgccagatctcacagga

SEQ ID NO: 717461 - DNA, 25 bp, Mus musculus
ggtacgagtgcctgatctcacagga

SEQ ID NO: 717462 - DNA, 25 bp, Mus musculus
ggtacgccaagaacccccttttcag

SEQ ID NO: 717463 - DNA, 25 bp, Mus musculus
ggtacgccaagatcccccttttcag

SEQ ID NO: 717464 - DNA, 25 bp, Mus musculus
ggtacgccacctcgatgcctgtgag

SEQ ID NO: 717465 - DNA, 25 bp, Mus musculus
ggtacgccacctggatgcctgtgag

SEQ ID NO: 717466 - DNA, 25 bp, Mus musculus
ggtacgccaggtcgcactgagacat

SEQ ID NO: 717467 - DNA, 25 bp, Mus musculus
ggtacgccaggtggcactgagacat

SEQ ID NO: 717468 - DNA, 25 bp, Mus musculus
ggtacgcctacaccccagtcatgga

SEQ ID NO: 717469 - DNA, 25 bp, Mus musculus
ggtacgcctacagcccagtcatgga

SEQ ID NO: 717470 - DNA, 25 bp, Mus musculus
ggtacgctccaacgtggctccgagc

SEQ ID NO: 717471 - DNA, 25 bp, Mus musculus
ggtacgctccaaggtggctccgagc

SEQ ID NO: 717472 - DNA, 25 bp, Mus musculus
ggtacgctgcatacgatttgataac

SEQ ID NO: 717473 - DNA, 25 bp, Mus musculus
ggtacgctgcattcgatttgataac

SEQ ID NO: 717474 - DNA, 25 bp, Mus musculus
ggtacggtgtatagtcagatgccaa

SEQ ID NO: 717475 - DNA, 25 bp, Mus musculus
ggtacggtgtattgtcagatgccaa

SEQ ID NO: 717476 - DNA, 25 bp, Mus musculus
ggtacgtgggcaagatcaaccgcac

SEQ ID NO: 717477 - DNA, 25 bp, Mus musculus
ggtacgtgggcatgatcaaccgcac

SEQ ID NO: 717478 - DNA, 25 bp, Mus musculus
ggtacgttcatacttggagcttgca

SEQ ID NO: 717479 - DNA, 25 bp, Mus musculus
ggtacgttcatagttggagcttgca

SEQ ID NO: 717480 - DNA, 25 bp, Mus musculus
ggtactaatggtcgcagccagccat

SEQ ID NO: 717481 - DNA, 25 bp, Mus musculus
ggtactaatggtggcagccagccat

SEQ ID NO: 717482 - DNA, 25 bp, Mus musculus
ggtactacatgtcaaggacctgtca

SEQ ID NO: 717483 - DNA, 25 bp, Mus musculus
ggtactacatgtgaaggacctgtca

SEQ ID NO: 717484 - DNA, 25 bp, Mus musculus
ggtactaccaccctggccatgtgga

SEQ ID NO: 717485 - DNA, 25 bp, Mus musculus
ggtactaccaccgtggccatgtgga

SEQ ID NO: 717486 - DNA, 25 bp, Mus musculus
ggtactacccagaggtgaacgagga

SEQ ID NO: 717487 - DNA, 25 bp, Mus musculus
ggtactacccagtggtgaacgagga

SEQ ID NO: 717488 - DNA, 25 bp, Mus musculus
ggtactaccctgaattagcagccca

SEQ ID NO: 717489 - DNA, 25 bp, Mus musculus
ggtactaccctgtattagcagccca

SEQ ID NO: 717490 - DNA, 25 bp, Mus musculus
ggtactacgcccatttcgccatgct

SEQ ID NO: 717491 - DNA, 25 bp, Mus musculus
ggtactacgcccttttcgccatgct

SEQ ID NO: 717492 - DNA, 25 bp, Mus musculus
ggtactagctccctggaccctgttt

SEQ ID NO: 717493 - DNA, 25 bp, Mus musculus
ggtactagctccgtggaccctgttt

SEQ ID NO: 717494 - DNA, 25 bp, Mus musculus
ggtactatataacttacatccacca

SEQ ID NO: 717495 - DNA, 25 bp, Mus musculus
ggtactatataagttacatccacca

SEQ ID NO: 717496 - DNA, 25 bp, Mus musculus
ggtactatggcaacgtgacacggca

SEQ ID NO: 717497 - DNA, 25 bp, Mus musculus
ggtactatggcatcgtgacacggca

SEQ ID NO: 717498 - DNA, 25 bp, Mus musculus
ggtactcagtggctcagctagaaac

SEQ ID NO: 717499 - DNA, 25 bp, Mus musculus
ggtactcagtgggtcagctagaaac

SEQ ID NO: 717500 - DNA, 25 bp, Mus musculus
ggtactccaatgctgaaagacttca

SEQ ID NO: 717501 - DNA, 25 bp, Mus musculus
ggtactccaatggtgaaagacttca

SEQ ID NO: 717502 - DNA, 25 bp, Mus musculus
ggtactccccatactatgagccaga

SEQ ID NO: 717503 - DNA, 25 bp, Mus musculus
ggtactccccattctatgagccaga

SEQ ID NO: 717504 - DNA, 25 bp, Mus musculus
ggtactcctgccctgctgacagtgt

SEQ ID NO: 717505 - DNA, 25 bp, Mus musculus
ggtactcctgccgtgctgacagtgt

SEQ ID NO: 717506 - DNA, 25 bp, Mus musculus
ggtactctacttcaccgtggacacc

SEQ ID NO: 717507 - DNA, 25 bp, Mus musculus
ggtactctacttgaccgtggacacc

SEQ ID NO: 717508 - DNA, 25 bp, Mus musculus
ggtactctgacacttcagtctggag

SEQ ID NO: 717509 - DNA, 25 bp, Mus musculus
ggtactctgacagttcagtctggag

SEQ ID NO: 717510 - DNA, 25 bp, Mus musculus
ggtactgaatttcgccgccacagga

SEQ ID NO: 717511 - DNA, 25 bp, Mus musculus
ggtactgaatttggccgccacagga

SEQ ID NO: 717512 - DNA, 25 bp, Mus musculus
ggtactgaccccatcagtcagacca

SEQ ID NO: 717513 - DNA, 25 bp, Mus musculus
ggtactgaccccttcagtcagacca

SEQ ID NO: 717514 - DNA, 25 bp, Mus musculus
ggtactgaccgaattcggcctttgc

SEQ ID NO: 717515 - DNA, 25 bp, Mus musculus
ggtactgaccgatttcggcctttgc

SEQ ID NO: 717516 - DNA, 25 bp, Mus musculus
ggtactgacttcagctccgccagaa

SEQ ID NO: 717517 - DNA, 25 bp, Mus musculus
ggtactgacttctgctccgccagaa

SEQ ID NO: 717518 - DNA, 25 bp, Mus musculus
ggtactgagcacactcaagtctgaa

SEQ ID NO: 717519 - DNA, 25 bp, Mus musculus
ggtactgagcactctcaagtctgaa

SEQ ID NO: 717520 - DNA, 25 bp, Mus musculus
ggtactgagggaaaatcgtgtgttc

SEQ ID NO: 717521 - DNA, 25 bp, Mus musculus
ggtactgagggataatcgtgtgttc

SEQ ID NO: 717522 - DNA, 25 bp, Mus musculus
ggtactgatcaacttcagtgcgcag

SEQ ID NO: 717523 - DNA, 25 bp, Mus musculus
ggtactgatcaagttcagtgcgcag

SEQ ID NO: 717524 - DNA, 25 bp, Mus musculus
ggtactgcaagaatgccagccccag

SEQ ID NO: 717525 - DNA, 25 bp, Mus musculus
ggtactgcaagattgccagccccag

SEQ ID NO: 717526 - DNA, 25 bp, Mus musculus
ggtactgccagtactccagcttcaa

SEQ ID NO: 717527 - DNA, 25 bp, Mus musculus
ggtactgccagttctccagcttcaa

SEQ ID NO: 717528 - DNA, 25 bp, Mus musculus
ggtactgcgcctagaaaacccattc

SEQ ID NO: 717529 - DNA, 25 bp, Mus musculus
ggtactgcgccttgaaaacccattc

SEQ ID NO: 717530 - DNA, 25 bp, Mus musculus
ggtactggagacaccagccgtagcc

SEQ ID NO: 717531 - DNA, 25 bp, Mus musculus
ggtactggagactccagccgtagcc

SEQ ID NO: 717532 - DNA, 25 bp, Mus musculus
ggtactggctaaagcttcctccgag

SEQ ID NO: 717533 - DNA, 25 bp, Mus musculus
ggtactggctaatgcttcctccgag

SEQ ID NO: 717534 - DNA, 25 bp, Mus musculus
ggtactgggctcatctgcacaccat

SEQ ID NO: 717535 - DNA, 25 bp, Mus musculus
ggtactgggctcttctgcacaccat

SEQ ID NO: 717536 - DNA, 25 bp, Mus musculus
ggtactgggtagatggttcacctct

SEQ ID NO: 717537 - DNA, 25 bp, Mus musculus
ggtactgggtagttggttcacctct

SEQ ID NO: 717538 - DNA, 25 bp, Mus musculus
ggtactggtgctcaagtggattatc

SEQ ID NO: 717539 - DNA, 25 bp, Mus musculus
ggtactggtgctgaagtggattatc

SEQ ID NO: 717540 - DNA, 25 bp, Mus musculus
ggtactgtaaatcaattgttgcaaa

SEQ ID NO: 717541 - DNA, 25 bp, Mus musculus
ggtactgtaaatgaattgttgcaaa

SEQ ID NO: 717542 - DNA, 25 bp, Mus musculus
ggtactgtggctaaggatggtccta

SEQ ID NO: 717543 - DNA, 25 bp, Mus musculus
ggtactgtggcttaggatggtccta

SEQ ID NO: 717544 - DNA, 25 bp, Mus musculus
ggtacttacccgcagaaggccgctg

SEQ ID NO: 717545 - DNA, 25 bp, Mus musculus
ggtacttacccggagaaggccgctg

SEQ ID NO: 717546 - DNA, 25 bp, Mus musculus
ggtacttacctcctgattggcaatg

SEQ ID NO: 717547 - DNA, 25 bp, Mus musculus
ggtacttacctcgtgattggcaatg

SEQ ID NO: 717548 - DNA, 25 bp, Mus musculus
ggtacttagaacatggaccaatgcg

SEQ ID NO: 717549 - DNA, 25 bp, Mus musculus
ggtacttagaacttggaccaatgcg

SEQ ID NO: 717550 - DNA, 25 bp, Mus musculus
ggtacttcactaactctcagccctt

SEQ ID NO: 717551 - DNA, 25 bp, Mus musculus
ggtacttcactatctctcagccctt

SEQ ID NO: 717552 - DNA, 25 bp, Mus musculus
ggtacttcccagaccgaaacatggc

SEQ ID NO: 717553 - DNA, 25 bp, Mus musculus
ggtacttcccagtccgaaacatggc

SEQ ID NO: 717554 - DNA, 25 bp, Mus musculus
ggtacttctgcaatgggatccccca

SEQ ID NO: 717555 - DNA, 25 bp, Mus musculus
ggtacttctgcattgggatccccca

SEQ ID NO: 717556 - DNA, 25 bp, Mus musculus
ggtacttgtggaaccaggaccctca

SEQ ID NO: 717557 - DNA, 25 bp, Mus musculus
ggtacttgtggatccaggaccctca

SEQ ID NO: 717558 - DNA, 25 bp, Mus musculus
ggtactttagccacaccaggactag

SEQ ID NO: 717559 - DNA, 25 bp, Mus musculus
ggtactttagcctcaccaggactag

SEQ ID NO: 717560 - DNA, 25 bp, Mus musculus
ggtactttaggaattttcatcgcaa

SEQ ID NO: 717561 - DNA, 25 bp, Mus musculus
ggtactttaggatttttcatcgcaa

SEQ ID NO: 717562 - DNA, 25 bp, Mus musculus
ggtagaaactagatgcccctgcttg

SEQ ID NO: 717563 - DNA, 25 bp, Mus musculus
ggtagaaactagttgcccctgcttg

SEQ ID NO: 717564 - DNA, 25 bp, Mus musculus
ggtagaaactgcaggccgagacctg

SEQ ID NO: 717565 - DNA, 25 bp, Mus musculus
ggtagaaactgctggccgagacctg

SEQ ID NO: 717566 - DNA, 25 bp, Mus musculus
ggtagaaatggacatcgcattgaag

SEQ ID NO: 717567 - DNA, 25 bp, Mus musculus
ggtagaaatggagatcgcattgaag

SEQ ID NO: 717568 - DNA, 25 bp, Mus musculus
ggtagaacacttcgagaaagctaag

SEQ ID NO: 717569 - DNA, 25 bp, Mus musculus
ggtagaacacttggagaaagctaag

SEQ ID NO: 717570 - DNA, 25 bp, Mus musculus
ggtagaacctccacctgactccagg

SEQ ID NO: 717571 - DNA, 25 bp, Mus musculus
ggtagaacctcctcctgactccagg

SEQ ID NO: 717572 - DNA, 25 bp, Mus musculus
ggtagaagaagaagggatacacagt

SEQ ID NO: 717573 - DNA, 25 bp, Mus musculus
ggtagaagaagatgggatacacagt

SEQ ID NO: 717574 - DNA, 25 bp, Mus musculus
ggtagaagagttaatcctttctggg

SEQ ID NO: 717575 - DNA, 25 bp, Mus musculus
ggtagaagagtttatcctttctggg

SEQ ID NO: 717576 - DNA, 25 bp, Mus musculus
ggtagaagccttatgatttggagtt

SEQ ID NO: 717577 - DNA, 25 bp, Mus musculus
ggtagaagccttttgatttggagtt

SEQ ID NO: 717578 - DNA, 25 bp, Mus musculus
ggtagaaggcatagagctgaagccc

SEQ ID NO: 717579 - DNA, 25 bp, Mus musculus
ggtagaaggcattgagctgaagccc

SEQ ID NO: 717580 - DNA, 25 bp, Mus musculus
ggtagaatcaataaaacactgcatt

SEQ ID NO: 717581 - DNA, 25 bp, Mus musculus
ggtagaatcaattaaacactgcatt

SEQ ID NO: 717582 - DNA, 25 bp, Mus musculus
ggtagaatcctcatcatcggctgca

SEQ ID NO: 717583 - DNA, 25 bp, Mus musculus
ggtagaatcctcttcatcggctgca

SEQ ID NO: 717584 - DNA, 25 bp, Mus musculus
ggtagaatccttccgggccatctct

SEQ ID NO: 717585 - DNA, 25 bp, Mus musculus
ggtagaatccttgcgggccatctct

SEQ ID NO: 717586 - DNA, 25 bp, Mus musculus
ggtagaatttcaaatgaactgctgg

SEQ ID NO: 717587 - DNA, 25 bp, Mus musculus
ggtagaatttcatatgaactgctgg

SEQ ID NO: 717588 - DNA, 25 bp, Mus musculus
ggtagacaattcactacatatgggc

SEQ ID NO: 717589 - DNA, 25 bp, Mus musculus
ggtagacaattctctacatatgggc

SEQ ID NO: 717590 - DNA, 25 bp, Mus musculus
ggtagacagtgaagtagagctaccc

SEQ ID NO: 717591 - DNA, 25 bp, Mus musculus
ggtagacagtgatgtagagctaccc

SEQ ID NO: 717592 - DNA, 25 bp, Mus musculus
ggtagacatcctcgtgcctctccta

SEQ ID NO: 717593 - DNA, 25 bp, Mus musculus
ggtagacatcctggtgcctctccta

SEQ ID NO: 717594 - DNA, 25 bp, Mus musculus
ggtagacatcgcacccggaagtgaa

SEQ ID NO: 717595 - DNA, 25 bp, Mus musculus
ggtagacatcgctcccggaagtgaa

SEQ ID NO: 717596 - DNA, 25 bp, Mus musculus
ggtagactagccaaacatctgcttg

SEQ ID NO: 717597 - DNA, 25 bp, Mus musculus
ggtagactagcctaacatctgcttg

SEQ ID NO: 717598 - DNA, 25 bp, Mus musculus
ggtagactaggcctgttcgtcttct

SEQ ID NO: 717599 - DNA, 25 bp, Mus musculus
ggtagactaggcgtgttcgtcttct

SEQ ID NO: 717600 - DNA, 25 bp, Mus musculus
ggtagactctgactttgacattgat

SEQ ID NO: 717601 - DNA, 25 bp, Mus musculus
ggtagactctgagtttgacattgat

SEQ ID NO: 717602 - DNA, 25 bp, Mus musculus
ggtagactgcaactccaatgctcca

SEQ ID NO: 717603 - DNA, 25 bp, Mus musculus
ggtagactgcaagtccaatgctcca

SEQ ID NO: 717604 - DNA, 25 bp, Mus musculus
ggtagactggttagcttcagccatc

SEQ ID NO: 717605 - DNA, 25 bp, Mus musculus
ggtagactggtttgcttcagccatc

SEQ ID NO: 717606 - DNA, 25 bp, Mus musculus
ggtagagatgtgacgactcagcccc

SEQ ID NO: 717607 - DNA, 25 bp, Mus musculus
ggtagagatgtgtcgactcagcccc

SEQ ID NO: 717608 - DNA, 25 bp, Mus musculus
ggtagagcctccctggtagaacaaa

SEQ ID NO: 717609 - DNA, 25 bp, Mus musculus
ggtagagcctccgtggtagaacaaa

SEQ ID NO: 717610 - DNA, 25 bp, Mus musculus
ggtagagcgcaacaaggcagccatt

SEQ ID NO: 717611 - DNA, 25 bp, Mus musculus
ggtagagcgcaagaaggcagccatt

SEQ ID NO: 717612 - DNA, 25 bp, Mus musculus
ggtagagcggcaacgccttgagctt

SEQ ID NO: 717613 - DNA, 25 bp, Mus musculus
ggtagagcggcatcgccttgagctt

SEQ ID NO: 717614 - DNA, 25 bp, Mus musculus
ggtagaggatttagaccgcatcctc

SEQ ID NO: 717615 - DNA, 25 bp, Mus musculus
ggtagaggattttgaccgcatcctc

SEQ ID NO: 717616 - DNA, 25 bp, Mus musculus
ggtagaggccacctttgcacctgca

SEQ ID NO: 717617 - DNA, 25 bp, Mus musculus
ggtagaggccacgtttgcacctgca

SEQ ID NO: 717618 - DNA, 25 bp, Mus musculus
ggtagagtcagacatcaacggcctg

SEQ ID NO: 717619 - DNA, 25 bp, Mus musculus
ggtagagtcagagatcaacggcctg

SEQ ID NO: 717620 - DNA, 25 bp, Mus musculus
ggtagagtgtccagatgaaggattc

SEQ ID NO: 717621 - DNA, 25 bp, Mus musculus
ggtagagtgtcctgatgaaggattc

SEQ ID NO: 717622 - DNA, 25 bp, Mus musculus
ggtagatacagcctaaaagtgcgtg

SEQ ID NO: 717623 - DNA, 25 bp, Mus musculus
ggtagatacagcgtaaaagtgcgtg

SEQ ID NO: 717624 - DNA, 25 bp, Mus musculus
ggtagatgaactcacatccttaaag

SEQ ID NO: 717625 - DNA, 25 bp, Mus musculus
ggtagatgaactgacatccttaaag

SEQ ID NO: 717626 - DNA, 25 bp, Mus musculus
ggtagatgagtcagagaagaactct

SEQ ID NO: 717627 - DNA, 25 bp, Mus musculus
ggtagatgagtctgagaagaactct

SEQ ID NO: 717628 - DNA, 25 bp, Mus musculus
ggtagatgccatagaccccaccagg

SEQ ID NO: 717629 - DNA, 25 bp, Mus musculus
ggtagatgccattgaccccaccagg

SEQ ID NO: 717630 - DNA, 25 bp, Mus musculus
ggtagatgtattcgacccagaagaa

SEQ ID NO: 717631 - DNA, 25 bp, Mus musculus
ggtagatgtattggacccagaagaa

SEQ ID NO: 717632 - DNA, 25 bp, Mus musculus
ggtagattcaagactcgcaaagagc

SEQ ID NO: 717633 - DNA, 25 bp, Mus musculus
ggtagattcaagtctcgcaaagagc

SEQ ID NO: 717634 - DNA, 25 bp, Mus musculus
ggtagattcacaacttcttcaacaa

SEQ ID NO: 717635 - DNA, 25 bp, Mus musculus
ggtagattcacatcttcttcaacaa

SEQ ID NO: 717636 - DNA, 25 bp, Mus musculus
ggtagcaagaccatccagtgtgaac

SEQ ID NO: 717637 - DNA, 25 bp, Mus musculus
ggtagcaagaccttccagtgtgaac

SEQ ID NO: 717638 - DNA, 25 bp, Mus musculus
ggtagcaatataaagaatctcatgg

SEQ ID NO: 717639 - DNA, 25 bp, Mus musculus
ggtagcaatatatagaatctcatgg

SEQ ID NO: 717640 - DNA, 25 bp, Mus musculus
ggtagcaatgctactacactcagcc

SEQ ID NO: 717641 - DNA, 25 bp, Mus musculus
ggtagcaatgcttctacactcagcc

SEQ ID NO: 717642 - DNA, 25 bp, Mus musculus
ggtagcacagctagtcctggaccca

SEQ ID NO: 717643 - DNA, 25 bp, Mus musculus
ggtagcacagcttgtcctggaccca

SEQ ID NO: 717644 - DNA, 25 bp, Mus musculus
ggtagcacatgtcaacagtgtcccc

SEQ ID NO: 717645 - DNA, 25 bp, Mus musculus
ggtagcacatgtgaacagtgtcccc

SEQ ID NO: 717646 - DNA, 25 bp, Mus musculus
ggtagcagaaagagacttcaccaac

SEQ ID NO: 717647 - DNA, 25 bp, Mus musculus
ggtagcagaaagtgacttcaccaac

SEQ ID NO: 717648 - DNA, 25 bp, Mus musculus
ggtagcagccttcaaggtcaccact

SEQ ID NO: 717649 - DNA, 25 bp, Mus musculus
ggtagcagccttgaaggtcaccact

SEQ ID NO: 717650 - DNA, 25 bp, Mus musculus
ggtagcaggcgtctctgtggacttg

SEQ ID NO: 717651 - DNA, 25 bp, Mus musculus
ggtagcaggcgtgtctgtggacttg

SEQ ID NO: 717652 - DNA, 25 bp, Mus musculus
ggtagcaggctcattgttcagtttt

SEQ ID NO: 717653 - DNA, 25 bp, Mus musculus
ggtagcaggctctttgttcagtttt

SEQ ID NO: 717654 - DNA, 25 bp, Mus musculus
ggtagcagtgagagtatccatcgca

SEQ ID NO: 717655 - DNA, 25 bp, Mus musculus
ggtagcagtgagtgtatccatcgca

SEQ ID NO: 717656 - DNA, 25 bp, Mus musculus
ggtagcagttgtattcccgtatgaa

SEQ ID NO: 717657 - DNA, 25 bp, Mus musculus
ggtagcagttgttttcccgtatgaa

SEQ ID NO: 717658 - DNA, 25 bp, Mus musculus
ggtagcatggaaacactggaattgc

SEQ ID NO: 717659 - DNA, 25 bp, Mus musculus
ggtagcatggaatcactggaattgc

SEQ ID NO: 717660 - DNA, 25 bp, Mus musculus
ggtagcattccccaaaagcagtttc

SEQ ID NO: 717661 - DNA, 25 bp, Mus musculus
ggtagcattcccgaaaagcagtttc

SEQ ID NO: 717662 - DNA, 25 bp, Mus musculus
ggtagccaacatcgagccactcttt

SEQ ID NO: 717663 - DNA, 25 bp, Mus musculus
ggtagccaacatggagccactcttt

SEQ ID NO: 717664 - DNA, 25 bp, Mus musculus
ggtagccaactgaccctgtcaagga

SEQ ID NO: 717665 - DNA, 25 bp, Mus musculus
ggtagccaactgtccctgtcaagga

SEQ ID NO: 717666 - DNA, 25 bp, Mus musculus
ggtagccaagaactccctcacagag

SEQ ID NO: 717667 - DNA, 25 bp, Mus musculus
ggtagccaagaagtccctcacagag

SEQ ID NO: 717668 - DNA, 25 bp, Mus musculus
ggtagccaggctcaacacaggagca

SEQ ID NO: 717669 - DNA, 25 bp, Mus musculus
ggtagccaggctgaacacaggagca

SEQ ID NO: 717670 - DNA, 25 bp, Mus musculus
ggtagccaggtcatctccatcaaag

SEQ ID NO: 717671 - DNA, 25 bp, Mus musculus
ggtagccaggtcttctccatcaaag

SEQ ID NO: 717672 - DNA, 25 bp, Mus musculus
ggtagccatacaccgacttccagat

SEQ ID NO: 717673 - DNA, 25 bp, Mus musculus
ggtagccatacagcgacttccagat

SEQ ID NO: 717674 - DNA, 25 bp, Mus musculus
ggtagccccattcaccagattctgc

SEQ ID NO: 717675 - DNA, 25 bp, Mus musculus
ggtagccccattgaccagattctgc

SEQ ID NO: 717676 - DNA, 25 bp, Mus musculus
ggtagccccgagcatcgactacagg

SEQ ID NO: 717677 - DNA, 25 bp, Mus musculus
ggtagccccgaggatcgactacagg

SEQ ID NO: 717678 - DNA, 25 bp, Mus musculus
ggtagcccttgtaggcagcaccaga

SEQ ID NO: 717679 - DNA, 25 bp, Mus musculus
ggtagcccttgttggcagcaccaga

SEQ ID NO: 717680 - DNA, 25 bp, Mus musculus
ggtagccgaagaagaacacccggtg

SEQ ID NO: 717681 - DNA, 25 bp, Mus musculus
ggtagccgaagatgaacacccggtg

SEQ ID NO: 717682 - DNA, 25 bp, Mus musculus
ggtagccgacctacgcgaagccatt

SEQ ID NO: 717683 - DNA, 25 bp, Mus musculus
ggtagccgaccttcgcgaagccatt

SEQ ID NO: 717684 - DNA, 25 bp, Mus musculus
ggtagcctgtgtaagggccctgccc

SEQ ID NO: 717685 - DNA, 25 bp, Mus musculus
ggtagcctgtgttagggccctgccc

SEQ ID NO: 717686 - DNA, 25 bp, Mus musculus
ggtagcctgttcaacgccaactatg

SEQ ID NO: 717687 - DNA, 25 bp, Mus musculus
ggtagcctgttctacgccaactatg

SEQ ID NO: 717688 - DNA, 25 bp, Mus musculus
ggtagcgccagtcccgattccgttt

SEQ ID NO: 717689 - DNA, 25 bp, Mus musculus
ggtagcgccagtgccgattccgttt

SEQ ID NO: 717690 - DNA, 25 bp, Mus musculus
ggtagcggctgactccaagatctgc

SEQ ID NO: 717691 - DNA, 25 bp, Mus musculus
ggtagcggctgagtccaagatctgc

SEQ ID NO: 717692 - DNA, 25 bp, Mus musculus
ggtagctagcatcgaaaaacaaagc

SEQ ID NO: 717693 - DNA, 25 bp, Mus musculus
ggtagctagcatggaaaaacaaagc

SEQ ID NO: 717694 - DNA, 25 bp, Mus musculus
ggtagctatcgacaacaaaatagag

SEQ ID NO: 717695 - DNA, 25 bp, Mus musculus
ggtagctatcgagaacaaaatagag

SEQ ID NO: 717696 - DNA, 25 bp, Mus musculus
ggtagctcacacacatctcctttat

SEQ ID NO: 717697 - DNA, 25 bp, Mus musculus
ggtagctcacactcatctcctttat

SEQ ID NO: 717698 - DNA, 25 bp, Mus musculus
ggtagctcactaatatgacctcagt

SEQ ID NO: 717699 - DNA, 25 bp, Mus musculus
ggtagctcactattatgacctcagt

SEQ ID NO: 717700 - DNA, 25 bp, Mus musculus
ggtagctcagcccaaaaaaccgtgc

SEQ ID NO: 717701 - DNA, 25 bp, Mus musculus
ggtagctcagccgaaaaaaccgtgc

SEQ ID NO: 717702 - DNA, 25 bp, Mus musculus
ggtagctccagccactgacaagcaa

SEQ ID NO: 717703 - DNA, 25 bp, Mus musculus
ggtagctccagcgactgacaagcaa

SEQ ID NO: 717704 - DNA, 25 bp, Mus musculus
ggtagctcccacaaacatttttcac

SEQ ID NO: 717705 - DNA, 25 bp, Mus musculus
ggtagctcccactaacatttttcac

SEQ ID NO: 717706 - DNA, 25 bp, Mus musculus
ggtagctccggcatgagtcccggcc

SEQ ID NO: 717707 - DNA, 25 bp, Mus musculus
ggtagctccggcttgagtcccggcc

SEQ ID NO: 717708 - DNA, 25 bp, Mus musculus
ggtagctgcacaaatgcccactgtg

SEQ ID NO: 717709 - DNA, 25 bp, Mus musculus
ggtagctgcacatatgcccactgtg

SEQ ID NO: 717710 - DNA, 25 bp, Mus musculus
ggtagctgccacagacaacgctcat

SEQ ID NO: 717711 - DNA, 25 bp, Mus musculus
ggtagctgccactgacaacgctcat

SEQ ID NO: 717712 - DNA, 25 bp, Mus musculus
ggtagctgggagaatggccacccta

SEQ ID NO: 717713 - DNA, 25 bp, Mus musculus
ggtagctgggagtatggccacccta

SEQ ID NO: 717714 - DNA, 25 bp, Mus musculus
ggtagcttcactaactccacctctg

SEQ ID NO: 717715 - DNA, 25 bp, Mus musculus
ggtagcttcacttactccacctctg

SEQ ID NO: 717716 - DNA, 25 bp, Mus musculus
ggtagcttcatgattcgagagagtg

SEQ ID NO: 717717 - DNA, 25 bp, Mus musculus
ggtagcttcatgtttcgagagagtg

SEQ ID NO: 717718 - DNA, 25 bp, Mus musculus
ggtagcttgctactctggaactcac

SEQ ID NO: 717719 - DNA, 25 bp, Mus musculus
ggtagcttgctagtctggaactcac

SEQ ID NO: 717720 - DNA, 25 bp, Mus musculus
ggtaggaacgctccaacctgggtat

SEQ ID NO: 717721 - DNA, 25 bp, Mus musculus
ggtaggaacgctgcaacctgggtat

SEQ ID NO: 717722 - DNA, 25 bp, Mus musculus
ggtaggactctgaccctgcctcggc

SEQ ID NO: 717723 - DNA, 25 bp, Mus musculus
ggtaggactctgtccctgcctcggc

SEQ ID NO: 717724 - DNA, 25 bp, Mus musculus
ggtaggaggatcctttttctcactg

SEQ ID NO: 717725 - DNA, 25 bp, Mus musculus
ggtaggaggatcgtttttctcactg

SEQ ID NO: 717726 - DNA, 25 bp, Mus musculus
ggtaggattttaaccccgctgccat

SEQ ID NO: 717727 - DNA, 25 bp, Mus musculus
ggtaggattttatccccgctgccat

SEQ ID NO: 717728 - DNA, 25 bp, Mus musculus
ggtaggcactgcagactcttgtcta

SEQ ID NO: 717729 - DNA, 25 bp, Mus musculus
ggtaggcactgctgactcttgtcta

SEQ ID NO: 717730 - DNA, 25 bp, Mus musculus
ggtaggcagcgtatttccagaccct

SEQ ID NO: 717731 - DNA, 25 bp, Mus musculus
ggtaggcagcgtttttccagaccct

SEQ ID NO: 717732 - DNA, 25 bp, Mus musculus
ggtaggcccggcaacaggtgctgct

SEQ ID NO: 717733 - DNA, 25 bp, Mus musculus
ggtaggcccggctacaggtgctgct

SEQ ID NO: 717734 - DNA, 25 bp, Mus musculus
ggtagggatatcatagctagagcaa

SEQ ID NO: 717735 - DNA, 25 bp, Mus musculus
ggtagggatatcttagctagagcaa

SEQ ID NO: 717736 - DNA, 25 bp, Mus musculus
ggtaggttagggagtaaactctgat

SEQ ID NO: 717737 - DNA, 25 bp, Mus musculus
ggtaggttagggtgtaaactctgat

SEQ ID NO: 717738 - DNA, 25 bp, Mus musculus
ggtagtaaccagatagtccacacac

SEQ ID NO: 717739 - DNA, 25 bp, Mus musculus
ggtagtaaccagttagtccacacac

SEQ ID NO: 717740 - DNA, 25 bp, Mus musculus
ggtagtactggcctcatccagactg

SEQ ID NO: 717741 - DNA, 25 bp, Mus musculus
ggtagtactggcgtcatccagactg

SEQ ID NO: 717742 - DNA, 25 bp, Mus musculus
ggtagtagctctcgaatttgacact

SEQ ID NO: 717743 - DNA, 25 bp, Mus musculus
ggtagtagctctggaatttgacact

SEQ ID NO: 717744 - DNA, 25 bp, Mus musculus
ggtagtccactgcacaggctacatc

SEQ ID NO: 717745 - DNA, 25 bp, Mus musculus
ggtagtccactggacaggctacatc

SEQ ID NO: 717746 - DNA, 25 bp, Mus musculus
ggtagtcctacgatccctcctgatg

SEQ ID NO: 717747 - DNA, 25 bp, Mus musculus
ggtagtcctacgttccctcctgatg

SEQ ID NO: 717748 - DNA, 25 bp, Mus musculus
ggtagtctctatcacccgcagaggg

SEQ ID NO: 717749 - DNA, 25 bp, Mus musculus
ggtagtctctatgacccgcagaggg

SEQ ID NO: 717750 - DNA, 25 bp, Mus musculus
ggtagtgagatcaaccgcatcttca

SEQ ID NO: 717751 - DNA, 25 bp, Mus musculus
ggtagtgagatctaccgcatcttca

SEQ ID NO: 717752 - DNA, 25 bp, Mus musculus
ggtagtgatcatataaccgattggg

SEQ ID NO: 717753 - DNA, 25 bp, Mus musculus
ggtagtgatcatttaaccgattggg

SEQ ID NO: 717754 - DNA, 25 bp, Mus musculus
ggtagtgatggcacaaaataactga

SEQ ID NO: 717755 - DNA, 25 bp, Mus musculus
ggtagtgatggctcaaaataactga

SEQ ID NO: 717756 - DNA, 25 bp, Mus musculus
ggtagtgattgtaagtaagtatcgc

SEQ ID NO: 717757 - DNA, 25 bp, Mus musculus
ggtagtgattgttagtaagtatcgc

SEQ ID NO: 717758 - DNA, 25 bp, Mus musculus
ggtagtgcacgccaacttgtttggc

SEQ ID NO: 717759 - DNA, 25 bp, Mus musculus
ggtagtgcacgcgaacttgtttggc

SEQ ID NO: 717760 - DNA, 25 bp, Mus musculus
ggtagtgcgcagacccaccttataa

SEQ ID NO: 717761 - DNA, 25 bp, Mus musculus
ggtagtgcgcagtcccaccttataa

SEQ ID NO: 717762 - DNA, 25 bp, Mus musculus
ggtagtggtggactacacacacgat

SEQ ID NO: 717763 - DNA, 25 bp, Mus musculus
ggtagtggtggagtacacacacgat

SEQ ID NO: 717764 - DNA, 25 bp, Mus musculus
ggtagtgtctgtctatagccagcag

SEQ ID NO: 717765 - DNA, 25 bp, Mus musculus
ggtagtgtctgtgtatagccagcag

SEQ ID NO: 717766 - DNA, 25 bp, Mus musculus
ggtagtgttcccactgcaaatgatc

SEQ ID NO: 717767 - DNA, 25 bp, Mus musculus
ggtagtgttccctctgcaaatgatc

SEQ ID NO: 717768 - DNA, 25 bp, Mus musculus
ggtagttaaagacatggcaactgga

SEQ ID NO: 717769 - DNA, 25 bp, Mus musculus
ggtagttaaagagatggcaactgga

SEQ ID NO: 717770 - DNA, 25 bp, Mus musculus
ggtagttctgatcctccctcaagtg

SEQ ID NO: 717771 - DNA, 25 bp, Mus musculus
ggtagttctgatgctccctcaagtg

SEQ ID NO: 717772 - DNA, 25 bp, Mus musculus
ggtagttttataacaccttgatgca

SEQ ID NO: 717773 - DNA, 25 bp, Mus musculus
ggtagttttatatcaccttgatgca

SEQ ID NO: 717774 - DNA, 25 bp, Mus musculus
ggtataaagtccaccaaagcgtctc

SEQ ID NO: 717775 - DNA, 25 bp, Mus musculus
ggtataaagtcctccaaagcgtctc

SEQ ID NO: 717776 - DNA, 25 bp, Mus musculus
ggtataaatgtgaaaccagtttaca

SEQ ID NO: 717777 - DNA, 25 bp, Mus musculus
ggtataaatgtgtaaccagtttaca

SEQ ID NO: 717778 - DNA, 25 bp, Mus musculus
ggtataaattttctcagcttaaagg

SEQ ID NO: 717779 - DNA, 25 bp, Mus musculus
ggtataaattttgtcagcttaaagg

SEQ ID NO: 717780 - DNA, 25 bp, Mus musculus
ggtataacagagacacactcccacc

SEQ ID NO: 717781 - DNA, 25 bp, Mus musculus
ggtataacagagtcacactcccacc

SEQ ID NO: 717782 - DNA, 25 bp, Mus musculus
ggtataactcaaatccagactcatg

SEQ ID NO: 717783 - DNA, 25 bp, Mus musculus
ggtataactcaattccagactcatg

SEQ ID NO: 717784 - DNA, 25 bp, Mus musculus
ggtatacaagcaactatggcgccct

SEQ ID NO: 717785 - DNA, 25 bp, Mus musculus
ggtatacaagcatctatggcgccct

SEQ ID NO: 717786 - DNA, 25 bp, Mus musculus
ggtatacagctgaccgagtttgcgc

SEQ ID NO: 717787 - DNA, 25 bp, Mus musculus
ggtatacagctgtccgagtttgcgc

SEQ ID NO: 717788 - DNA, 25 bp, Mus musculus
ggtataccagatcgccagaaccacc

SEQ ID NO: 717789 - DNA, 25 bp, Mus musculus
ggtataccagatggccagaaccacc

SEQ ID NO: 717790 - DNA, 25 bp, Mus musculus
ggtataccgcagatcacaacaggcc

SEQ ID NO: 717791 - DNA, 25 bp, Mus musculus
ggtataccgcagttcacaacaggcc

SEQ ID NO: 717792 - DNA, 25 bp, Mus musculus
ggtatacgccagagtacccactgcc

SEQ ID NO: 717793 - DNA, 25 bp, Mus musculus
ggtatacgccagtgtacccactgcc

SEQ ID NO: 717794 - DNA, 25 bp, Mus musculus
ggtatactcacaacctcttctttgt

SEQ ID NO: 717795 - DNA, 25 bp, Mus musculus
ggtatactcacatcctcttctttgt

SEQ ID NO: 717796 - DNA, 25 bp, Mus musculus
ggtatagccgtcaagaaaaccaggc

SEQ ID NO: 717797 - DNA, 25 bp, Mus musculus
ggtatagccgtctagaaaaccaggc

SEQ ID NO: 717798 - DNA, 25 bp, Mus musculus
ggtatagtacgaatgctgcccttca

SEQ ID NO: 717799 - DNA, 25 bp, Mus musculus
ggtatagtacgattgctgcccttca

SEQ ID NO: 717800 - DNA, 25 bp, Mus musculus
ggtatatagcaccaccctttactca

SEQ ID NO: 717801 - DNA, 25 bp, Mus musculus
ggtatatagcacgaccctttactca

SEQ ID NO: 717802 - DNA, 25 bp, Mus musculus
ggtatatcttcaccgtgacctgcaa

SEQ ID NO: 717803 - DNA, 25 bp, Mus musculus
ggtatatcttcagcgtgacctgcaa

SEQ ID NO: 717804 - DNA, 25 bp, Mus musculus
ggtatatgactaagactccagtgga

SEQ ID NO: 717805 - DNA, 25 bp, Mus musculus
ggtatatgactatgactccagtgga

SEQ ID NO: 717806 - DNA, 25 bp, Mus musculus
ggtatatggattacctggctccagc

SEQ ID NO: 717807 - DNA, 25 bp, Mus musculus
ggtatatggatttcctggctccagc

SEQ ID NO: 717808 - DNA, 25 bp, Mus musculus
ggtatattcggaaacctatcgacta

SEQ ID NO: 717809 - DNA, 25 bp, Mus musculus
ggtatattcggatacctatcgacta

SEQ ID NO: 717810 - DNA, 25 bp, Mus musculus
ggtatatttgttcaactcgtccagg

SEQ ID NO: 717811 - DNA, 25 bp, Mus musculus
ggtatatttgttgaactcgtccagg

SEQ ID NO: 717812 - DNA, 25 bp, Mus musculus
ggtatcaaaagtccccacatcaaat

SEQ ID NO: 717813 - DNA, 25 bp, Mus musculus
ggtatcaaaagtgcccacatcaaat

SEQ ID NO: 717814 - DNA, 25 bp, Mus musculus
ggtatcaaccaaaagctcttggctg

SEQ ID NO: 717815 - DNA, 25 bp, Mus musculus
ggtatcaaccaatagctcttggctg

SEQ ID NO: 717816 - DNA, 25 bp, Mus musculus
ggtatcaaccctctcagctatctgg

SEQ ID NO: 717817 - DNA, 25 bp, Mus musculus
ggtatcaaccctgtcagctatctgg

SEQ ID NO: 717818 - DNA, 25 bp, Mus musculus
ggtatcaactccctaaagtagtaag

SEQ ID NO: 717819 - DNA, 25 bp, Mus musculus
ggtatcaactccgtaaagtagtaag

SEQ ID NO: 717820 - DNA, 25 bp, Mus musculus
ggtatcaagtctccaagccagaggt

SEQ ID NO: 717821 - DNA, 25 bp, Mus musculus
ggtatcaagtctgcaagccagaggt

SEQ ID NO: 717822 - DNA, 25 bp, Mus musculus
ggtatcagaagccagactacaactt

SEQ ID NO: 717823 - DNA, 25 bp, Mus musculus
ggtatcagaagcgagactacaactt

SEQ ID NO: 717824 - DNA, 25 bp, Mus musculus
ggtatcagagcaacgccacagaatg

SEQ ID NO: 717825 - DNA, 25 bp, Mus musculus
ggtatcagagcatcgccacagaatg

SEQ ID NO: 717826 - DNA, 25 bp, Mus musculus
ggtatcagccaaccgcctttttgga

SEQ ID NO: 717827 - DNA, 25 bp, Mus musculus
ggtatcagccaagcgcctttttgga

SEQ ID NO: 717828 - DNA, 25 bp, Mus musculus
ggtatcatgctaatcctgggtgcca

SEQ ID NO: 717829 - DNA, 25 bp, Mus musculus
ggtatcatgctattcctgggtgcca

SEQ ID NO: 717830 - DNA, 25 bp, Mus musculus
ggtatcattgctcacgtcaaagccc

SEQ ID NO: 717831 - DNA, 25 bp, Mus musculus
ggtatcattgctgacgtcaaagccc

SEQ ID NO: 717832 - DNA, 25 bp, Mus musculus
ggtatccaggcaccgtgaactcaga

SEQ ID NO: 717833 - DNA, 25 bp, Mus musculus
ggtatccaggcagcgtgaactcaga

SEQ ID NO: 717834 - DNA, 25 bp, Mus musculus
ggtatccatcgactggcatcctctc

SEQ ID NO: 717835 - DNA, 25 bp, Mus musculus
ggtatccatcgagtggcatcctctc

SEQ ID NO: 717836 - DNA, 25 bp, Mus musculus
ggtatcccaacaaaaccatctggag

SEQ ID NO: 717837 - DNA, 25 bp, Mus musculus
ggtatcccaacataaccatctggag

SEQ ID NO: 717838 - DNA, 25 bp, Mus musculus
ggtatcccgaagactgagtctcaaa

SEQ ID NO: 717839 - DNA, 25 bp, Mus musculus
ggtatcccgaagtctgagtctcaaa

SEQ ID NO: 717840 - DNA, 25 bp, Mus musculus
ggtatccgatctcaagcagtttctg

SEQ ID NO: 717841 - DNA, 25 bp, Mus musculus
ggtatccgatctgaagcagtttctg

SEQ ID NO: 717842 - DNA, 25 bp, Mus musculus
ggtatcctagatcattcgccaaagg

SEQ ID NO: 717843 - DNA, 25 bp, Mus musculus
ggtatcctagatgattcgccaaagg

SEQ ID NO: 717844 - DNA, 25 bp, Mus musculus
ggtatcctgctcatcgagctgctga

SEQ ID NO: 717845 - DNA, 25 bp, Mus musculus
ggtatcctgctcttcgagctgctga

SEQ ID NO: 717846 - DNA, 25 bp, Mus musculus
ggtatccttaatcagttgccatcag

SEQ ID NO: 717847 - DNA, 25 bp, Mus musculus
ggtatccttaatgagttgccatcag

SEQ ID NO: 717848 - DNA, 25 bp, Mus musculus
ggtatccttagtccactctggaagt

SEQ ID NO: 717849 - DNA, 25 bp, Mus musculus
ggtatccttagtgcactctggaagt

SEQ ID NO: 717850 - DNA, 25 bp, Mus musculus
ggtatcctttgactgaagatggcac

SEQ ID NO: 717851 - DNA, 25 bp, Mus musculus
ggtatcctttgagtgaagatggcac

SEQ ID NO: 717852 - DNA, 25 bp, Mus musculus
ggtatctacagaatggagccactac

SEQ ID NO: 717853 - DNA, 25 bp, Mus musculus
ggtatctacagattggagccactac

SEQ ID NO: 717854 - DNA, 25 bp, Mus musculus
ggtatctagaaaaagtcaagactgt

SEQ ID NO: 717855 - DNA, 25 bp, Mus musculus
ggtatctagaaatagtcaagactgt

SEQ ID NO: 717856 - DNA, 25 bp, Mus musculus
ggtatctcggacaggtgaccactat

SEQ ID NO: 717857 - DNA, 25 bp, Mus musculus
ggtatctcggactggtgaccactat

SEQ ID NO: 717858 - DNA, 25 bp, Mus musculus
ggtatctctggcagtgcctatcggg

SEQ ID NO: 717859 - DNA, 25 bp, Mus musculus
ggtatctctggctgtgcctatcggg

SEQ ID NO: 717860 - DNA, 25 bp, Mus musculus
ggtatctcttgtagccgtccacccg

SEQ ID NO: 717861 - DNA, 25 bp, Mus musculus
ggtatctcttgttgccgtccacccg

SEQ ID NO: 717862 - DNA, 25 bp, Mus musculus
ggtatctgacccacacccacaattg

SEQ ID NO: 717863 - DNA, 25 bp, Mus musculus
ggtatctgaccctcacccacaattg

SEQ ID NO: 717864 - DNA, 25 bp, Mus musculus
ggtatctggatgaggagtcacccct

SEQ ID NO: 717865 - DNA, 25 bp, Mus musculus
ggtatctggatgtggagtcacccct

SEQ ID NO: 717866 - DNA, 25 bp, Mus musculus
ggtatctgtatacatggatgtacac

SEQ ID NO: 717867 - DNA, 25 bp, Mus musculus
ggtatctgtatagatggatgtacac

SEQ ID NO: 717868 - DNA, 25 bp, Mus musculus
ggtatcttaccaagcctcagcatga

SEQ ID NO: 717869 - DNA, 25 bp, Mus musculus
ggtatcttaccatgcctcagcatga

SEQ ID NO: 717870 - DNA, 25 bp, Mus musculus
ggtatctttcgacggctctgtgcgc

SEQ ID NO: 717871 - DNA, 25 bp, Mus musculus
ggtatctttcgagggctctgtgcgc

SEQ ID NO: 717872 - DNA, 25 bp, Mus musculus
ggtatgaatcccacagagggcactg

SEQ ID NO: 717873 - DNA, 25 bp, Mus musculus
ggtatgaatccctcagagggcactg

SEQ ID NO: 717874 - DNA, 25 bp, Mus musculus
ggtatgacagcccttctgcacgagc

SEQ ID NO: 717875 - DNA, 25 bp, Mus musculus
ggtatgacagccgttctgcacgagc

SEQ ID NO: 717876 - DNA, 25 bp, Mus musculus
ggtatgacatatataaggcctttcc

SEQ ID NO: 717877 - DNA, 25 bp, Mus musculus
ggtatgacatatttaaggcctttcc

SEQ ID NO: 717878 - DNA, 25 bp, Mus musculus
ggtatgacatcaagggctgcaacat

SEQ ID NO: 717879 - DNA, 25 bp, Mus musculus
ggtatgacatcatgggctgcaacat

SEQ ID NO: 717880 - DNA, 25 bp, Mus musculus
ggtatgcacaaacaccacgaagact

SEQ ID NO: 717881 - DNA, 25 bp, Mus musculus
ggtatgcacaaagaccacgaagact

SEQ ID NO: 717882 - DNA, 25 bp, Mus musculus
ggtatgcatcccctgatctcagcag

SEQ ID NO: 717883 - DNA, 25 bp, Mus musculus
ggtatgcatcccgtgatctcagcag

SEQ ID NO: 717884 - DNA, 25 bp, Mus musculus
ggtatgccaaccacatcgagagatg

SEQ ID NO: 717885 - DNA, 25 bp, Mus musculus
ggtatgccaacctcatcgagagatg

SEQ ID NO: 717886 - DNA, 25 bp, Mus musculus
ggtatgccgtcacaagaccctttca

SEQ ID NO: 717887 - DNA, 25 bp, Mus musculus
ggtatgccgtcagaagaccctttca

SEQ ID NO: 717888 - DNA, 25 bp, Mus musculus
ggtatgcctcatcaactgtgctgtt

SEQ ID NO: 717889 - DNA, 25 bp, Mus musculus
ggtatgcctcatgaactgtgctgtt

SEQ ID NO: 717890 - DNA, 25 bp, Mus musculus
ggtatgcctggtattagtacctcca

SEQ ID NO: 717891 - DNA, 25 bp, Mus musculus
ggtatgcctggttttagtacctcca

SEQ ID NO: 717892 - DNA, 25 bp, Mus musculus
ggtatgcggctccaacaaactgaag

SEQ ID NO: 717893 - DNA, 25 bp, Mus musculus
ggtatgcggctcgaacaaactgaag

SEQ ID NO: 717894 - DNA, 25 bp, Mus musculus
ggtatgcttgacattgtcaacaaag

SEQ ID NO: 717895 - DNA, 25 bp, Mus musculus
ggtatgcttgactttgtcaacaaag

SEQ ID NO: 717896 - DNA, 25 bp, Mus musculus
ggtatgctttagaccaagagcaaag

SEQ ID NO: 717897 - DNA, 25 bp, Mus musculus
ggtatgctttagtccaagagcaaag

SEQ ID NO: 717898 - DNA, 25 bp, Mus musculus
ggtatggaacacagtataagcaaga

SEQ ID NO: 717899 - DNA, 25 bp, Mus musculus
ggtatggaacactgtataagcaaga

SEQ ID NO: 717900 - DNA, 25 bp, Mus musculus
ggtatggaaggcaacatcaaaatag

SEQ ID NO: 717901 - DNA, 25 bp, Mus musculus
ggtatggaaggctacatcaaaatag

SEQ ID NO: 717902 - DNA, 25 bp, Mus musculus
ggtatggacactactgagcacagag

SEQ ID NO: 717903 - DNA, 25 bp, Mus musculus
ggtatggacacttctgagcacagag

SEQ ID NO: 717904 - DNA, 25 bp, Mus musculus
ggtatggagaccagagcactgacaa

SEQ ID NO: 717905 - DNA, 25 bp, Mus musculus
ggtatggagacctgagcactgacaa

SEQ ID NO: 717906 - DNA, 25 bp, Mus musculus
ggtatggcaacactccatttctgtt

SEQ ID NO: 717907 - DNA, 25 bp, Mus musculus
ggtatggcaacagtccatttctgtt

SEQ ID NO: 717908 - DNA, 25 bp, Mus musculus
ggtatggcaccaccgccatttataa

SEQ ID NO: 717909 - DNA, 25 bp, Mus musculus
ggtatggcaccagcgccatttataa

SEQ ID NO: 717910 - DNA, 25 bp, Mus musculus
ggtatggcagcacccggctcttcca

SEQ ID NO: 717911 - DNA, 25 bp, Mus musculus
ggtatggcagcagccggctcttcca

SEQ ID NO: 717912 - DNA, 25 bp, Mus musculus
ggtatggtagccaaacattcaaacc

SEQ ID NO: 717913 - DNA, 25 bp, Mus musculus
ggtatggtagcctaacattcaaacc

SEQ ID NO: 717914 - DNA, 25 bp, Mus musculus
ggtatggtctacctggcgtcccaac

SEQ ID NO: 717915 - DNA, 25 bp, Mus musculus
ggtatggtctacgtggcgtcccaac

SEQ ID NO: 717916 - DNA, 25 bp, Mus musculus
ggtatgtctggtcatccaccggagc

SEQ ID NO: 717917 - DNA, 25 bp, Mus musculus
ggtatgtctggtgatccaccggagc

SEQ ID NO: 717918 - DNA, 25 bp, Mus musculus
ggtatgtgtgccactccgagacagc

SEQ ID NO: 717919 - DNA, 25 bp, Mus musculus
ggtatgtgtgcctctccgagacagc

SEQ ID NO: 717920 - DNA, 25 bp, Mus musculus
ggtattaaattcaatgctgaagatc

SEQ ID NO: 717921 - DNA, 25 bp, Mus musculus
ggtattaaattctatgctgaagatc

SEQ ID NO: 717922 - DNA, 25 bp, Mus musculus
ggtattaacaaacaccaccctggct

SEQ ID NO: 717923 - DNA, 25 bp, Mus musculus
ggtattaacaaagaccaccctggct

SEQ ID NO: 717924 - DNA, 25 bp, Mus musculus
ggtattaagtccacaacgcctggag

SEQ ID NO: 717925 - DNA, 25 bp, Mus musculus
ggtattaagtcctcaacgcctggag

SEQ ID NO: 717926 - DNA, 25 bp, Mus musculus
ggtattacctgcacctggatatggg

SEQ ID NO: 717927 - DNA, 25 bp, Mus musculus
ggtattacctgctcctggatatggg

SEQ ID NO: 717928 - DNA, 25 bp, Mus musculus
ggtattactacaacggcgcttccat

SEQ ID NO: 717929 - DNA, 25 bp, Mus musculus
ggtattactacatcggcgcttccat

SEQ ID NO: 717930 - DNA, 25 bp, Mus musculus
ggtattactcagatacaaatgaaag

SEQ ID NO: 717931 - DNA, 25 bp, Mus musculus
ggtattactcagttacaaatgaaag

SEQ ID NO: 717932 - DNA, 25 bp, Mus musculus
ggtattagaagacgctcaaacacag

SEQ ID NO: 717933 - DNA, 25 bp, Mus musculus
ggtattagaagaggctcaaacacag

SEQ ID NO: 717934 - DNA, 25 bp, Mus musculus
ggtattcactaaccacctcaagttt

SEQ ID NO: 717935 - DNA, 25 bp, Mus musculus
ggtattcactaagcacctcaagttt

SEQ ID NO: 717936 - DNA, 25 bp, Mus musculus
ggtattcagtatagtcctgggtact

SEQ ID NO: 717937 - DNA, 25 bp, Mus musculus
ggtattcagtattgtcctgggtact

SEQ ID NO: 717938 - DNA, 25 bp, Mus musculus
ggtattcatcacaatccatcagtct

SEQ ID NO: 717939 - DNA, 25 bp, Mus musculus
ggtattcatcactatccatcagtct

SEQ ID NO: 717940 - DNA, 25 bp, Mus musculus
ggtattcttccactactgtatcatg

SEQ ID NO: 717941 - DNA, 25 bp, Mus musculus
ggtattcttccagtactgtatcatg

SEQ ID NO: 717942 - DNA, 25 bp, Mus musculus
ggtattctttagctaacataacgcc

SEQ ID NO: 717943 - DNA, 25 bp, Mus musculus
ggtattctttaggtaacataacgcc

SEQ ID NO: 717944 - DNA, 25 bp, Mus musculus
ggtattgagacccacttcgacgaac

SEQ ID NO: 717945 - DNA, 25 bp, Mus musculus
ggtattgagaccgacttcgacgaac

SEQ ID NO: 717946 - DNA, 25 bp, Mus musculus
ggtattgcaggcacttcttgtgtta

SEQ ID NO: 717947 - DNA, 25 bp, Mus musculus
ggtattgcaggctcttcttgtgtta

SEQ ID NO: 717948 - DNA, 25 bp, Mus musculus
ggtattgcccgtcttgccaacagtg

SEQ ID NO: 717949 - DNA, 25 bp, Mus musculus
ggtattgcccgtgttgccaacagtg

SEQ ID NO: 717950 - DNA, 25 bp, Mus musculus
ggtattggagcgagaagagcctaaa

SEQ ID NO: 717951 - DNA, 25 bp, Mus musculus
ggtattggagcgtgaagagcctaaa

SEQ ID NO: 717952 - DNA, 25 bp, Mus musculus
ggtattggcaagagacagtttctgt

SEQ ID NO: 717953 - DNA, 25 bp, Mus musculus
ggtattggcaagtgacagtttctgt

SEQ ID NO: 717954 - DNA, 25 bp, Mus musculus
ggtattgggattcctcttctggcca

SEQ ID NO: 717955 - DNA, 25 bp, Mus musculus
ggtattgggattgctcttctggcca

SEQ ID NO: 717956 - DNA, 25 bp, Mus musculus
ggtatttccacaccgtcgtatcccg

SEQ ID NO: 717957 - DNA, 25 bp, Mus musculus
ggtatttccacagcgtcgtatcccg

SEQ ID NO: 717958 - DNA, 25 bp, Mus musculus
ggtatttgcagcataccagttggct

SEQ ID NO: 717959 - DNA, 25 bp, Mus musculus
ggtatttgcagcttaccagttggct

SEQ ID NO: 717960 - DNA, 25 bp, Mus musculus
ggtatttggtcacatagtgtagtaa

SEQ ID NO: 717961 - DNA, 25 bp, Mus musculus
ggtatttggtcagatagtgtagtaa

SEQ ID NO: 717962 - DNA, 25 bp, Mus musculus
ggtatttgtgcaaccctcgaaccaa

SEQ ID NO: 717963 - DNA, 25 bp, Mus musculus
ggtatttgtgcatccctcgaaccaa

SEQ ID NO: 717964 - DNA, 25 bp, Mus musculus
ggtattttgattcagaaaaactgcc

SEQ ID NO: 717965 - DNA, 25 bp, Mus musculus
ggtattttgattgagaaaaactgcc

SEQ ID NO: 717966 - DNA, 25 bp, Mus musculus
ggtatttttagcaccagcacctgcc

SEQ ID NO: 717967 - DNA, 25 bp, Mus musculus
ggtatttttagctccagcacctgcc

SEQ ID NO: 717968 - DNA, 25 bp, Mus musculus
ggtcaaaaagctccccaatccatgc

SEQ ID NO: 717969 - DNA, 25 bp, Mus musculus
ggtcaaaaagctgcccaatccatgc

SEQ ID NO: 717970 - DNA, 25 bp, Mus musculus
ggtcaaaaggcaagcatggtccaga

SEQ ID NO: 717971 - DNA, 25 bp, Mus musculus
ggtcaaaaggcatgcatggtccaga

SEQ ID NO: 717972 - DNA, 25 bp, Mus musculus
ggtcaaacaataaccatcagccgag

SEQ ID NO: 717973 - DNA, 25 bp, Mus musculus
ggtcaaacaatatccatcagccgag

SEQ ID NO: 717974 - DNA, 25 bp, Mus musculus
ggtcaaactgtccattggtatcaat

SEQ ID NO: 717975 - DNA, 25 bp, Mus musculus
ggtcaaactgtcgattggtatcaat

SEQ ID NO: 717976 - DNA, 25 bp, Mus musculus
ggtcaaacttgaattctccttcaag

SEQ ID NO: 717977 - DNA, 25 bp, Mus musculus
ggtcaaacttgatttctccttcaag

SEQ ID NO: 717978 - DNA, 25 bp, Mus musculus
ggtcaaagcgagagtcatcctcaga

SEQ ID NO: 717979 - DNA, 25 bp, Mus musculus
ggtcaaagcgagtgtcatcctcaga

SEQ ID NO: 717980 - DNA, 25 bp, Mus musculus
ggtcaaaggactaacgacactaaag

SEQ ID NO: 717981 - DNA, 25 bp, Mus musculus
ggtcaaaggacttacgacactaaag

SEQ ID NO: 717982 - DNA, 25 bp, Mus musculus
ggtcaaaggataatctctaaacatt

SEQ ID NO: 717983 - DNA, 25 bp, Mus musculus
ggtcaaaggatattctctaaacatt

SEQ ID NO: 717984 - DNA, 25 bp, Mus musculus
ggtcaaagggccaaataagcatact

SEQ ID NO: 717985 - DNA, 25 bp, Mus musculus
ggtcaaagggcctaataagcatact

SEQ ID NO: 717986 - DNA, 25 bp, Mus musculus
ggtcaaatatgaagctccccaaacc

SEQ ID NO: 717987 - DNA, 25 bp, Mus musculus
ggtcaaatatgatgctccccaaacc

SEQ ID NO: 717988 - DNA, 25 bp, Mus musculus
ggtcaaattaacagctccattaagg

SEQ ID NO: 717989 - DNA, 25 bp, Mus musculus
ggtcaaattaactgctccattaagg

SEQ ID NO: 717990 - DNA, 25 bp, Mus musculus
ggtcaaattgcaaattcactgttgt

SEQ ID NO: 717991 - DNA, 25 bp, Mus musculus
ggtcaaattgcatattcactgttgt

SEQ ID NO: 717992 - DNA, 25 bp, Mus musculus
ggtcaacaacttccgcatgatcgag

SEQ ID NO: 717993 - DNA, 25 bp, Mus musculus
ggtcaacaacttgcgcatgatcgag

SEQ ID NO: 717994 - DNA, 25 bp, Mus musculus
ggtcaacagtgtattatttcccagg

SEQ ID NO: 717995 - DNA, 25 bp, Mus musculus
ggtcaacagtgttttatttcccagg

SEQ ID NO: 717996 - DNA, 25 bp, Mus musculus
ggtcaacatcatagccgtgctcaac

SEQ ID NO: 717997 - DNA, 25 bp, Mus musculus
ggtcaacatcattgccgtgctcaac

SEQ ID NO: 717998 - DNA, 25 bp, Mus musculus
ggtcaacccctgagggacgtgaaca

SEQ ID NO: 717999 - DNA, 25 bp, Mus musculus
ggtcaacccctgtgggacgtgaaca

SEQ ID NO: 718000 - DNA, 25 bp, Mus musculus
ggtcaaccgcctccaggagctcata

SEQ ID NO: 718001 - DNA, 25 bp, Mus musculus
ggtcaaccgcctgcaggagctcata

SEQ ID NO: 718002 - DNA, 25 bp, Mus musculus
ggtcaacctacaccgacgaccggat

SEQ ID NO: 718003 - DNA, 25 bp, Mus musculus
ggtcaacctacagcgacgaccggat

SEQ ID NO: 718004 - DNA, 25 bp, Mus musculus
ggtcaacgaataaggcgctcggcag

SEQ ID NO: 718005 - DNA, 25 bp, Mus musculus
ggtcaacgaatatggcgctcggcag

SEQ ID NO: 718006 - DNA, 25 bp, Mus musculus
ggtcaacgccatagccatcaacagc

SEQ ID NO: 718007 - DNA, 25 bp, Mus musculus
ggtcaacgccattgccatcaacagc

SEQ ID NO: 718008 - DNA, 25 bp, Mus musculus
ggtcaacgtcatagccccatgcatc

SEQ ID NO: 718009 - DNA, 25 bp, Mus musculus
ggtcaacgtcattgccccatgcatc

SEQ ID NO: 718010 - DNA, 25 bp, Mus musculus
ggtcaacgtgtccatcactctctgt

SEQ ID NO: 718011 - DNA, 25 bp, Mus musculus
ggtcaacgtgtcgatcactctctgt

SEQ ID NO: 718012 - DNA, 25 bp, Mus musculus
ggtcaagaacctataactgcttcca

SEQ ID NO: 718013 - DNA, 25 bp, Mus musculus
ggtcaagaacctttaactgcttcca

SEQ ID NO: 718014 - DNA, 25 bp, Mus musculus
ggtcaagagctcagcgaggccgcct

SEQ ID NO: 718015 - DNA, 25 bp, Mus musculus
ggtcaagagctctgcgaggccgcct

SEQ ID NO: 718016 - DNA, 25 bp, Mus musculus
ggtcaagatcgccacaaccagagct

SEQ ID NO: 718017 - DNA, 25 bp, Mus musculus
ggtcaagatcgcgacaaccagagct

SEQ ID NO: 718018 - DNA, 25 bp, Mus musculus
ggtcaagatgtcattatgagcatcc

SEQ ID NO: 718019 - DNA, 25 bp, Mus musculus
ggtcaagatgtctttatgagcatcc

SEQ ID NO: 718020 - DNA, 25 bp, Mus musculus
ggtcaagattgtccccgtgttcttg

SEQ ID NO: 718021 - DNA, 25 bp, Mus musculus
ggtcaagattgtcgatttgaacatc

SEQ ID NO: 718022 - DNA, 25 bp, Mus musculus
ggtcaagattgtgcccgtgttcttg

SEQ ID NO: 718023 - DNA, 25 bp, Mus musculus
ggtcaagattgtggatttgaacatc

SEQ ID NO: 718024 - DNA, 25 bp, Mus musculus
ggtcaagcataaccagtgctttctc

SEQ ID NO: 718025 - DNA, 25 bp, Mus musculus
ggtcaagcataagcagtgctttctc

SEQ ID NO: 718026 - DNA, 25 bp, Mus musculus
ggtcaaggaacacagccctcagatc

SEQ ID NO: 718027 - DNA, 25 bp, Mus musculus
ggtcaaggaacagagccctcagatc

SEQ ID NO: 718028 - DNA, 25 bp, Mus musculus
ggtcaaggaaccacagtcaccgtct

SEQ ID NO: 718029 - DNA, 25 bp, Mus musculus
ggtcaaggaacctcagtcaccgtct

SEQ ID NO: 718030 - DNA, 25 bp, Mus musculus
ggtcaaggatacagcttttctgctt

SEQ ID NO: 718031 - DNA, 25 bp, Mus musculus
ggtcaaggatactgcttttctgctt

SEQ ID NO: 718032 - DNA, 25 bp, Mus musculus
ggtcaaggttacatcccagtggaag

SEQ ID NO: 718033 - DNA, 25 bp, Mus musculus
ggtcaaggttacttcccagtggaag

SEQ ID NO: 718034 - DNA, 25 bp, Mus musculus
ggtcaagtctctcttagaccggtac

SEQ ID NO: 718035 - DNA, 25 bp, Mus musculus
ggtcaagtctctgttagaccggtac

SEQ ID NO: 718036 - DNA, 25 bp, Mus musculus
ggtcaagttcggcaacaagacgttg

SEQ ID NO: 718037 - DNA, 25 bp, Mus musculus
ggtcaagttcgggaacaagacgttg

SEQ ID NO: 718038 - DNA, 25 bp, Mus musculus
ggtcaagttcttccgtgccctgaga

SEQ ID NO: 718039 - DNA, 25 bp, Mus musculus
ggtcaagttcttgcgtgccctgaga

SEQ ID NO: 718040 - DNA, 25 bp, Mus musculus
ggtcaatactatcttcactgtagtt

SEQ ID NO: 718041 - DNA, 25 bp, Mus musculus
ggtcaatactatgttcactgtagtt

SEQ ID NO: 718042 - DNA, 25 bp, Mus musculus
ggtcaatagaagaactggattgcag

SEQ ID NO: 718043 - DNA, 25 bp, Mus musculus
ggtcaatagaagtactggattgcag

SEQ ID NO: 718044 - DNA, 25 bp, Mus musculus
ggtcaataggctccttggcttgcag

SEQ ID NO: 718045 - DNA, 25 bp, Mus musculus
ggtcaataggctgcttggcttgcag

SEQ ID NO: 718046 - DNA, 25 bp, Mus musculus
ggtcaatcttttccgaagccattca

SEQ ID NO: 718047 - DNA, 25 bp, Mus musculus
ggtcaatcttttgcgaagccattca

SEQ ID NO: 718048 - DNA, 25 bp, Mus musculus
ggtcaatgagtgcacctctaatccc

SEQ ID NO: 718049 - DNA, 25 bp, Mus musculus
ggtcaatgagtggacctctaatccc

SEQ ID NO: 718050 - DNA, 25 bp, Mus musculus
ggtcaatgagttatacggcctgaac

SEQ ID NO: 718051 - DNA, 25 bp, Mus musculus
ggtcaatgagttttacggcctgaac

SEQ ID NO: 718052 - DNA, 25 bp, Mus musculus
ggtcaatgcacaagtacgccaagaa

SEQ ID NO: 718053 - DNA, 25 bp, Mus musculus
ggtcaatgcacatgtacgccaagaa

SEQ ID NO: 718054 - DNA, 25 bp, Mus musculus
ggtcaatggcatcgttcacagtctt

SEQ ID NO: 718055 - DNA, 25 bp, Mus musculus
ggtcaatggcatggttcacagtctt

SEQ ID NO: 718056 - DNA, 25 bp, Mus musculus
ggtcaatgggccagaaatccttaac

SEQ ID NO: 718057 - DNA, 25 bp, Mus musculus
ggtcaatgggcctgaaatccttaac

SEQ ID NO: 718058 - DNA, 25 bp, Mus musculus
ggtcaatggtgaccccaacacccta

SEQ ID NO: 718059 - DNA, 25 bp, Mus musculus
ggtcaatggtgagcccaacacccta

SEQ ID NO: 718060 - DNA, 25 bp, Mus musculus
ggtcaatgtaacataagataggtgg

SEQ ID NO: 718061 - DNA, 25 bp, Mus musculus
ggtcaatgtaacttaagataggtgg

SEQ ID NO: 718062 - DNA, 25 bp, Mus musculus
ggtcaattcattctgcctggcctgg

SEQ ID NO: 718063 - DNA, 25 bp, Mus musculus
ggtcaattcattgtgcctggcctgg

SEQ ID NO: 718064 - DNA, 25 bp, Mus musculus
ggtcaattctaacccgatttctgaa

SEQ ID NO: 718065 - DNA, 25 bp, Mus musculus
ggtcaattctaagccgatttctgaa

SEQ ID NO: 718066 - DNA, 25 bp, Mus musculus
ggtcaattctgtactgtccccacgg

SEQ ID NO: 718067 - DNA, 25 bp, Mus musculus
ggtcaattctgttctgtccccacgg

SEQ ID NO: 718068 - DNA, 25 bp, Mus musculus
ggtcaatttacaccgcaagatacat

SEQ ID NO: 718069 - DNA, 25 bp, Mus musculus
ggtcaatttacagcgcaagatacat

SEQ ID NO: 718070 - DNA, 25 bp, Mus musculus
ggtcacaaactcaatggccctaaag

SEQ ID NO: 718071 - DNA, 25 bp, Mus musculus
ggtcacaaactctatggccctaaag

SEQ ID NO: 718072 - DNA, 25 bp, Mus musculus
ggtcacaaatggcaccttggtagca

SEQ ID NO: 718073 - DNA, 25 bp, Mus musculus
ggtcacaaatgggaccttggtagca

SEQ ID NO: 718074 - DNA, 25 bp, Mus musculus
ggtcacaaatgtcagcctgcagcca

SEQ ID NO: 718075 - DNA, 25 bp, Mus musculus
ggtcacaaatgtgagcctgcagcca

SEQ ID NO: 718076 - DNA, 25 bp, Mus musculus
ggtcacaacccaaaccacaatgctg

SEQ ID NO: 718077 - DNA, 25 bp, Mus musculus
ggtcacaacccataccacaatgctg

SEQ ID NO: 718078 - DNA, 25 bp, Mus musculus
ggtcacaactctcccagcagtacca

SEQ ID NO: 718079 - DNA, 25 bp, Mus musculus
ggtcacaactctgccagcagtacca

SEQ ID NO: 718080 - DNA, 25 bp, Mus musculus
ggtcacacatccaagtggccgagac

SEQ ID NO: 718081 - DNA, 25 bp, Mus musculus
ggtcacacatcctagtggccgagac

SEQ ID NO: 718082 - DNA, 25 bp, Mus musculus
ggtcacaccctgacttcagccatat

SEQ ID NO: 718083 - DNA, 25 bp, Mus musculus
ggtcacaccctgtcttcagccatat

SEQ ID NO: 718084 - DNA, 25 bp, Mus musculus
ggtcacactctacgacaatgaagag

SEQ ID NO: 718085 - DNA, 25 bp, Mus musculus
ggtcacactctaggacaatgaagag

SEQ ID NO: 718086 - DNA, 25 bp, Mus musculus
ggtcacactggtcgctgttattgaa

SEQ ID NO: 718087 - DNA, 25 bp, Mus musculus
ggtcacactggtggctgttattgaa

SEQ ID NO: 718088 - DNA, 25 bp, Mus musculus
ggtcacagagccatcttccttactt

SEQ ID NO: 718089 - DNA, 25 bp, Mus musculus
ggtcacagagccttcttccttactt

SEQ ID NO: 718090 - DNA, 25 bp, Mus musculus
ggtcacagccccagcgctggtgcag

SEQ ID NO: 718091 - DNA, 25 bp, Mus musculus
ggtcacagcccctgcgctggtgcag

SEQ ID NO: 718092 - DNA, 25 bp, Mus musculus
ggtcacagccttacttaaaccctgg

SEQ ID NO: 718093 - DNA, 25 bp, Mus musculus
ggtcacagcctttcttaaaccctgg

SEQ ID NO: 718094 - DNA, 25 bp, Mus musculus
ggtcacagtccaccagagtctagat

SEQ ID NO: 718095 - DNA, 25 bp, Mus musculus
ggtcacagtccagcagagtctagat

SEQ ID NO: 718096 - DNA, 25 bp, Mus musculus
ggtcacatatgcatccttgctattg

SEQ ID NO: 718097 - DNA, 25 bp, Mus musculus
ggtcacatatgcttccttgctattg

SEQ ID NO: 718098 - DNA, 25 bp, Mus musculus
ggtcacatggctagctcgaggcccc

SEQ ID NO: 718099 - DNA, 25 bp, Mus musculus
ggtcacatggcttgctcgaggcccc

SEQ ID NO: 718100 - DNA, 25 bp, Mus musculus
ggtcacattctcaactcagtgctct

SEQ ID NO: 718101 - DNA, 25 bp, Mus musculus
ggtcacattctctactcagtgctct

SEQ ID NO: 718102 - DNA, 25 bp, Mus musculus
ggtcaccaacttcctctttacgaga

SEQ ID NO: 718103 - DNA, 25 bp, Mus musculus
ggtcaccaacttgctctttacgaga

SEQ ID NO: 718104 - DNA, 25 bp, Mus musculus
ggtcaccaatgcctgcctcataaag

SEQ ID NO: 718105 - DNA, 25 bp, Mus musculus
ggtcaccaatgcgtgcctcataaag

SEQ ID NO: 718106 - DNA, 25 bp, Mus musculus
ggtcaccaccaactctgaaggctct

SEQ ID NO: 718107 - DNA, 25 bp, Mus musculus
ggtcaccaccaagtctgaaggctct

SEQ ID NO: 718108 - DNA, 25 bp, Mus musculus
ggtcaccatggaccactctgcgaag

SEQ ID NO: 718109 - DNA, 25 bp, Mus musculus
ggtcaccatggagcactctgcgaag

SEQ ID NO: 718110 - DNA, 25 bp, Mus musculus
ggtcacccaccgacagatttacaga

SEQ ID NO: 718111 - DNA, 25 bp, Mus musculus
ggtcacccaccgtcagatttacaga

SEQ ID NO: 718112 - DNA, 25 bp, Mus musculus
ggtcacccagaaccgagtgcttaag

SEQ ID NO: 718113 - DNA, 25 bp, Mus musculus
ggtcacccagaagcgagtgcttaag

SEQ ID NO: 718114 - DNA, 25 bp, Mus musculus
ggtcacccaggaagccacgacttgt

SEQ ID NO: 718115 - DNA, 25 bp, Mus musculus
ggtcacccaggatgccacgacttgt

SEQ ID NO: 718116 - DNA, 25 bp, Mus musculus
ggtcacccgaaacctaagaagatgt

SEQ ID NO: 718117 - DNA, 25 bp, Mus musculus
ggtcacccgaaagctaagaagatgt

SEQ ID NO: 718118 - DNA, 25 bp, Mus musculus
ggtcacccgttcctcatgctcaggg

SEQ ID NO: 718119 - DNA, 25 bp, Mus musculus
ggtcacccgttcgtcatgctcaggg

SEQ ID NO: 718120 - DNA, 25 bp, Mus musculus
ggtcaccctacacgagatgctgaag

SEQ ID NO: 718121 - DNA, 25 bp, Mus musculus
ggtcaccctacaggagatgctgaag

SEQ ID NO: 718122 - DNA, 25 bp, Mus musculus
ggtcaccctaccagtgccggatcag

SEQ ID NO: 718123 - DNA, 25 bp, Mus musculus
ggtcaccctacctgtgccggatcag

SEQ ID NO: 718124 - DNA, 25 bp, Mus musculus
ggtcaccctgtgcttgaaagcctcc

SEQ ID NO: 718125 - DNA, 25 bp, Mus musculus
ggtcaccctgtggttgaaagcctcc

SEQ ID NO: 718126 - DNA, 25 bp, Mus musculus
ggtcaccgcattcccatgaagacag

SEQ ID NO: 718127 - DNA, 25 bp, Mus musculus
ggtcaccgcattgccatgaagacag

SEQ ID NO: 718128 - DNA, 25 bp, Mus musculus
ggtcaccgccatcctttgcttgata

SEQ ID NO: 718129 - DNA, 25 bp, Mus musculus
ggtcaccgccatgctttgcttgata

SEQ ID NO: 718130 - DNA, 25 bp, Mus musculus
ggtcaccggtgacaatatcaacaca

SEQ ID NO: 718131 - DNA, 25 bp, Mus musculus
ggtcaccggtgagaatatcaacaca

SEQ ID NO: 718132 - DNA, 25 bp, Mus musculus
ggtcacctccagcaatcggaccttg

SEQ ID NO: 718133 - DNA, 25 bp, Mus musculus
ggtcacctccaggaatcggaccttg

SEQ ID NO: 718134 - DNA, 25 bp, Mus musculus
ggtcacctgcagaaccagccaaaaa

SEQ ID NO: 718135 - DNA, 25 bp, Mus musculus
ggtcacctgcagtaccagccaaaaa

SEQ ID NO: 718136 - DNA, 25 bp, Mus musculus
ggtcacgaggtgagtctacggctca

SEQ ID NO: 718137 - DNA, 25 bp, Mus musculus
ggtcacgaggtgtgtctacggctca

SEQ ID NO: 718138 - DNA, 25 bp, Mus musculus
ggtcacgatccaaatctcggtctcg

SEQ ID NO: 718139 - DNA, 25 bp, Mus musculus
ggtcacgatccatatctcggtctcg

SEQ ID NO: 718140 - DNA, 25 bp, Mus musculus
ggtcacggatgaatggacttccaag

SEQ ID NO: 718141 - DNA, 25 bp, Mus musculus
ggtcacggatgattggacttccaag

SEQ ID NO: 718142 - DNA, 25 bp, Mus musculus
ggtcacggtgtgacatcttcaggag

SEQ ID NO: 718143 - DNA, 25 bp, Mus musculus
ggtcacggtgtgtcatcttcaggag

SEQ ID NO: 718144 - DNA, 25 bp, Mus musculus
ggtcacgtacaacgaccaggcacct

SEQ ID NO: 718145 - DNA, 25 bp, Mus musculus
ggtcacgtacaaggaccaggcacct

SEQ ID NO: 718146 - DNA, 25 bp, Mus musculus
ggtcacgtcagtcgcaaatatgcac

SEQ ID NO: 718147 - DNA, 25 bp, Mus musculus
ggtcacgtcagtggcaaatatgcac

SEQ ID NO: 718148 - DNA, 25 bp, Mus musculus
ggtcacgtcctgctaccggaagcgt

SEQ ID NO: 718149 - DNA, 25 bp, Mus musculus
ggtcacgtcctggtaccggaagcgt

SEQ ID NO: 718150 - DNA, 25 bp, Mus musculus
ggtcacgtggcccactgcttacatg

SEQ ID NO: 718151 - DNA, 25 bp, Mus musculus
ggtcacgtggccgactgcttacatg

SEQ ID NO: 718152 - DNA, 25 bp, Mus musculus
ggtcacgtggtactgaccgatttcg

SEQ ID NO: 718153 - DNA, 25 bp, Mus musculus
ggtcacgtggtagtgaccgatttcg

SEQ ID NO: 718154 - DNA, 25 bp, Mus musculus
ggtcactaagccattactgctgaag

SEQ ID NO: 718155 - DNA, 25 bp, Mus musculus
ggtcactaagcctttactgctgaag

SEQ ID NO: 718156 - DNA, 25 bp, Mus musculus
ggtcactagaatcctgcagccagat

SEQ ID NO: 718157 - DNA, 25 bp, Mus musculus
ggtcactagaatgctgcagccagat

SEQ ID NO: 718158 - DNA, 25 bp, Mus musculus
ggtcactcaagtataagactcctga

SEQ ID NO: 718159 - DNA, 25 bp, Mus musculus
ggtcactcaagtttaagactcctga

SEQ ID NO: 718160 - DNA, 25 bp, Mus musculus
ggtcactcagaaatccccctgcaga

SEQ ID NO: 718161 - DNA, 25 bp, Mus musculus
ggtcactcagaattccccctgcaga

SEQ ID NO: 718162 - DNA, 25 bp, Mus musculus
ggtcactcatgcctgtttttctcag

SEQ ID NO: 718163 - DNA, 25 bp, Mus musculus
ggtcactcatgcgtgtttttctcag

SEQ ID NO: 718164 - DNA, 25 bp, Mus musculus
ggtcactcgcaacgatatcccaggg

SEQ ID NO: 718165 - DNA, 25 bp, Mus musculus
ggtcactcgcaaggatatcccaggg

SEQ ID NO: 718166 - DNA, 25 bp, Mus musculus
ggtcactctccaattatgatggaag

SEQ ID NO: 718167 - DNA, 25 bp, Mus musculus
ggtcactctccatttatgatggaag

SEQ ID NO: 718168 - DNA, 25 bp, Mus musculus
ggtcactgaatcctgaaaatcctgt

SEQ ID NO: 718169 - DNA, 25 bp, Mus musculus
ggtcactgaatcgtgaaaatcctgt

SEQ ID NO: 718170 - DNA, 25 bp, Mus musculus
ggtcactgatagagattttcccgcg

SEQ ID NO: 718171 - DNA, 25 bp, Mus musculus
ggtcactgatagtgattttcccgcg

SEQ ID NO: 718172 - DNA, 25 bp, Mus musculus
ggtcactggagaacaactagggccc

SEQ ID NO: 718173 - DNA, 25 bp, Mus musculus
ggtcactggagatcaactagggccc

SEQ ID NO: 718174 - DNA, 25 bp, Mus musculus
ggtcactggaggaattcaatgacgt

SEQ ID NO: 718175 - DNA, 25 bp, Mus musculus
ggtcactggaggtattcaatgacgt

SEQ ID NO: 718176 - DNA, 25 bp, Mus musculus
ggtcactggcttcgctgtgagccca

SEQ ID NO: 718177 - DNA, 25 bp, Mus musculus
ggtcactggcttggctgtgagccca

SEQ ID NO: 718178 - DNA, 25 bp, Mus musculus
ggtcactgtcataaaacaagctgta

SEQ ID NO: 718179 - DNA, 25 bp, Mus musculus
ggtcactgtcattaaacaagctgta

SEQ ID NO: 718180 - DNA, 25 bp, Mus musculus
ggtcactgtgcaagcttccttatgg

SEQ ID NO: 718181 - DNA, 25 bp, Mus musculus
ggtcactgtgcatgcttccttatgg

SEQ ID NO: 718182 - DNA, 25 bp, Mus musculus
ggtcactgtgccaatggaaccaact

SEQ ID NO: 718183 - DNA, 25 bp, Mus musculus
ggtcactgtgcctatggaaccaact

SEQ ID NO: 718184 - DNA, 25 bp, Mus musculus
ggtcactgttagaacgattgagtag

SEQ ID NO: 718185 - DNA, 25 bp, Mus musculus
ggtcactgttagtacgattgagtag

SEQ ID NO: 718186 - DNA, 25 bp, Mus musculus
ggtcacttcagcaggtagctcggag

SEQ ID NO: 718187 - DNA, 25 bp, Mus musculus
ggtcacttcagctggtagctcggag

SEQ ID NO: 718188 - DNA, 25 bp, Mus musculus
ggtcacttcattccagcagctgcat

SEQ ID NO: 718189 - DNA, 25 bp, Mus musculus
ggtcacttcattgcagcagctgcat

SEQ ID NO: 718190 - DNA, 25 bp, Mus musculus
ggtcacttggatcgtgtatttatgc

SEQ ID NO: 718191 - DNA, 25 bp, Mus musculus
ggtcacttggatggtgtatttatgc

SEQ ID NO: 718192 - DNA, 25 bp, Mus musculus
ggtcacttgggccaaaactctttgg

SEQ ID NO: 718193 - DNA, 25 bp, Mus musculus
ggtcacttgggcgaaaactctttgg

SEQ ID NO: 718194 - DNA, 25 bp, Mus musculus
ggtcactttaaacccgcataactca

SEQ ID NO: 718195 - DNA, 25 bp, Mus musculus
ggtcactttaaagccgcataactca

SEQ ID NO: 718196 - DNA, 25 bp, Mus musculus
ggtcactttctcattgcctgcaggg

SEQ ID NO: 718197 - DNA, 25 bp, Mus musculus
ggtcactttctctttgcctgcaggg

SEQ ID NO: 718198 - DNA, 25 bp, Mus musculus
ggtcactttgatcttctccccactg

SEQ ID NO: 718199 - DNA, 25 bp, Mus musculus
ggtcactttgatgttctccccactg

SEQ ID NO: 718200 - DNA, 25 bp, Mus musculus
ggtcagaaagcaaggatagagaaga

SEQ ID NO: 718201 - DNA, 25 bp, Mus musculus
ggtcagaaagcatggatagagaaga

SEQ ID NO: 718202 - DNA, 25 bp, Mus musculus
ggtcagaaccagctgctataaccgg

SEQ ID NO: 718203 - DNA, 25 bp, Mus musculus
ggtcagaaccaggtgctataaccgg

SEQ ID NO: 718204 - DNA, 25 bp, Mus musculus
ggtcagaagataacattccacggtg

SEQ ID NO: 718205 - DNA, 25 bp, Mus musculus
ggtcagaagatatcattccacggtg

SEQ ID NO: 718206 - DNA, 25 bp, Mus musculus
ggtcagacctgtccgcggccttgac

SEQ ID NO: 718207 - DNA, 25 bp, Mus musculus
ggtcagacctgtgcgcggccttgac

SEQ ID NO: 718208 - DNA, 25 bp, Mus musculus
ggtcagacgacacggatcacttaaa

SEQ ID NO: 718209 - DNA, 25 bp, Mus musculus
ggtcagacgacagggatcacttaaa

SEQ ID NO: 718210 - DNA, 25 bp, Mus musculus
ggtcagacggcgagctctagagaaa

SEQ ID NO: 718211 - DNA, 25 bp, Mus musculus
ggtcagacggcgtgctctagagaaa

SEQ ID NO: 718212 - DNA, 25 bp, Mus musculus
ggtcagagccgcagaagacaagcac

SEQ ID NO: 718213 - DNA, 25 bp, Mus musculus
ggtcagagccgctgaagacaagcac

SEQ ID NO: 718214 - DNA, 25 bp, Mus musculus
ggtcagaggccactgactccgtgtc

SEQ ID NO: 718215 - DNA, 25 bp, Mus musculus
ggtcagaggccagtgactccgtgtc

SEQ ID NO: 718216 - DNA, 25 bp, Mus musculus
ggtcagaggtcaccagctccctaga

SEQ ID NO: 718217 - DNA, 25 bp, Mus musculus
ggtcagaggtcagcagctccctaga

SEQ ID NO: 718218 - DNA, 25 bp, Mus musculus
ggtcagagtcacatttccccctggg

SEQ ID NO: 718219 - DNA, 25 bp, Mus musculus
ggtcagagtcacttttccccctggg

SEQ ID NO: 718220 - DNA, 25 bp, Mus musculus
ggtcagagtttcatccgggctctgg

SEQ ID NO: 718221 - DNA, 25 bp, Mus musculus
ggtcagagtttcttccgggctctgg

SEQ ID NO: 718222 - DNA, 25 bp, Mus musculus
ggtcagatatatcgctgtgacaacc

SEQ ID NO: 718223 - DNA, 25 bp, Mus musculus
ggtcagatatatggctgtgacaacc

SEQ ID NO: 718224 - DNA, 25 bp, Mus musculus
ggtcagatctctcctgatgccagct

SEQ ID NO: 718225 - DNA, 25 bp, Mus musculus
ggtcagatctctgctgatgccagct

SEQ ID NO: 718226 - DNA, 25 bp, Mus musculus
ggtcagatctttcaagcttacaata

SEQ ID NO: 718227 - DNA, 25 bp, Mus musculus
ggtcagatctttgaagcttacaata

SEQ ID NO: 718228 - DNA, 25 bp, Mus musculus
ggtcagatgggaatccgtggtctcc

SEQ ID NO: 718229 - DNA, 25 bp, Mus musculus
ggtcagatgggattccgtggtctcc

SEQ ID NO: 718230 - DNA, 25 bp, Mus musculus
ggtcagcaaacacaagatgagatgg

SEQ ID NO: 718231 - DNA, 25 bp, Mus musculus
ggtcagcaaacagaagatgagatgg

SEQ ID NO: 718232 - DNA, 25 bp, Mus musculus
ggtcagcaagatctcgagatggcaa

SEQ ID NO: 718233 - DNA, 25 bp, Mus musculus
ggtcagcaagatgtcgagatggcaa

SEQ ID NO: 718234 - DNA, 25 bp, Mus musculus
ggtcagcaagcccttcagcctcttt

SEQ ID NO: 718235 - DNA, 25 bp, Mus musculus
ggtcagcaagccgttcagcctcttt

SEQ ID NO: 718236 - DNA, 25 bp, Mus musculus
ggtcagcaaggcaatacagcaaata

SEQ ID NO: 718237 - DNA, 25 bp, Mus musculus
ggtcagcaaggcaatgcagcaacca

SEQ ID NO: 718238 - DNA, 25 bp, Mus musculus
ggtcagcaaggctatacagcaaata

SEQ ID NO: 718239 - DNA, 25 bp, Mus musculus
ggtcagcaaggctatgcagcaacca

SEQ ID NO: 718240 - DNA, 25 bp, Mus musculus
ggtcagcagattaacccatgtcaca

SEQ ID NO: 718241 - DNA, 25 bp, Mus musculus
ggtcagcagatttacccatgtcaca

SEQ ID NO: 718242 - DNA, 25 bp, Mus musculus
ggtcagcagccgaccaggacggcct

SEQ ID NO: 718243 - DNA, 25 bp, Mus musculus
ggtcagcagccgtccaggacggcct

SEQ ID NO: 718244 - DNA, 25 bp, Mus musculus
ggtcagcataccctgaggaaccgta

SEQ ID NO: 718245 - DNA, 25 bp, Mus musculus
ggtcagcataccgtgaggaaccgta

SEQ ID NO: 718246 - DNA, 25 bp, Mus musculus
ggtcagccaaggctttttgcctgtt

SEQ ID NO: 718247 - DNA, 25 bp, Mus musculus
ggtcagccaagggtttttgcctgtt

SEQ ID NO: 718248 - DNA, 25 bp, Mus musculus
ggtcagccacgacagcacagtgtct

SEQ ID NO: 718249 - DNA, 25 bp, Mus musculus
ggtcagccacgagagcacagtgtct

SEQ ID NO: 718250 - DNA, 25 bp, Mus musculus
ggtcagccactgcccctggttagct

SEQ ID NO: 718251 - DNA, 25 bp, Mus musculus
ggtcagccactggccctggttagct

SEQ ID NO: 718252 - DNA, 25 bp, Mus musculus
ggtcagcccaccagcccaggatgag

SEQ ID NO: 718253 - DNA, 25 bp, Mus musculus
ggtcagcccacctgcccaggatgag

SEQ ID NO: 718254 - DNA, 25 bp, Mus musculus
ggtcagcctgctcctcattgggatt

SEQ ID NO: 718255 - DNA, 25 bp, Mus musculus
ggtcagcctgctgctcattgggatt

SEQ ID NO: 718256 - DNA, 25 bp, Mus musculus
ggtcagcctggcagcgctaacggtc

SEQ ID NO: 718257 - DNA, 25 bp, Mus musculus
ggtcagcctggctgcgctaacggtc

SEQ ID NO: 718258 - DNA, 25 bp, Mus musculus
ggtcagcgcacgcaaaaagctcaga

SEQ ID NO: 718259 - DNA, 25 bp, Mus musculus
ggtcagcgcacggaaaaagctcaga

SEQ ID NO: 718260 - DNA, 25 bp, Mus musculus
ggtcagcgcctaattactgctaccg

SEQ ID NO: 718261 - DNA, 25 bp, Mus musculus
ggtcagcgcctacatgtacccaaca

SEQ ID NO: 718262 - DNA, 25 bp, Mus musculus
ggtcagcgcctagatgtacccaaca

SEQ ID NO: 718263 - DNA, 25 bp, Mus musculus
ggtcagcgcctatttactgctaccg

SEQ ID NO: 718264 - DNA, 25 bp, Mus musculus
ggtcagcgctggaccaactgtcctc

SEQ ID NO: 718265 - DNA, 25 bp, Mus musculus
ggtcagcgctggtccaactgtcctc

SEQ ID NO: 718266 - DNA, 25 bp, Mus musculus
ggtcagcgtatccagcactctcttc

SEQ ID NO: 718267 - DNA, 25 bp, Mus musculus
ggtcagcgtatcgagcactctcttc

SEQ ID NO: 718268 - DNA, 25 bp, Mus musculus
ggtcagcgtcgtctcccgagaacgc

SEQ ID NO: 718269 - DNA, 25 bp, Mus musculus
ggtcagcgtcgtgtcccgagaacgc

SEQ ID NO: 718270 - DNA, 25 bp, Mus musculus
ggtcagctacatacgctgggaaggt

SEQ ID NO: 718271 - DNA, 25 bp, Mus musculus
ggtcagctacattcgctgggaaggt

SEQ ID NO: 718272 - DNA, 25 bp, Mus musculus
ggtcagctaccgcatcaaggagatt

SEQ ID NO: 718273 - DNA, 25 bp, Mus musculus
ggtcagctaccggatcaaggagatt

SEQ ID NO: 718274 - DNA, 25 bp, Mus musculus
ggtcagctcataaagcaaatgggct

SEQ ID NO: 718275 - DNA, 25 bp, Mus musculus
ggtcagctcatatagcaaatgggct

SEQ ID NO: 718276 - DNA, 25 bp, Mus musculus
ggtcagctgagtacatggccccaga

SEQ ID NO: 718277 - DNA, 25 bp, Mus musculus
ggtcagctgagttcatggccccaga

SEQ ID NO: 718278 - DNA, 25 bp, Mus musculus
ggtcagctggacaacacaatcggta

SEQ ID NO: 718279 - DNA, 25 bp, Mus musculus
ggtcagctggactacacaatcggta

SEQ ID NO: 718280 - DNA, 25 bp, Mus musculus
ggtcagctgggccaagttcttcctg

SEQ ID NO: 718281 - DNA, 25 bp, Mus musculus
ggtcagctgggcgaagttcttcctg

SEQ ID NO: 718282 - DNA, 25 bp, Mus musculus
ggtcaggaacgtatccgtagcctca

SEQ ID NO: 718283 - DNA, 25 bp, Mus musculus
ggtcaggaacgtttccgtagcctca

SEQ ID NO: 718284 - DNA, 25 bp, Mus musculus
ggtcaggatgctaatccaatcctca

SEQ ID NO: 718285 - DNA, 25 bp, Mus musculus
ggtcaggatgcttatccaatcctca

SEQ ID NO: 718286 - DNA, 25 bp, Mus musculus
ggtcaggccaagcaccaaccaacag

SEQ ID NO: 718287 - DNA, 25 bp, Mus musculus
ggtcaggccaaggaccaaccaacag

SEQ ID NO: 718288 - DNA, 25 bp, Mus musculus
ggtcaggcgaggaccaactccacct

SEQ ID NO: 718289 - DNA, 25 bp, Mus musculus
ggtcaggcgaggtccaactccacct

SEQ ID NO: 718290 - DNA, 25 bp, Mus musculus
ggtcagggaaacagtcatactcttc

SEQ ID NO: 718291 - DNA, 25 bp, Mus musculus
ggtcagggaaactgtcatactcttc

SEQ ID NO: 718292 - DNA, 25 bp, Mus musculus
ggtcagggacccacacttaggaagt

SEQ ID NO: 718293 - DNA, 25 bp, Mus musculus
ggtcagggaccctcacttaggaagt

SEQ ID NO: 718294 - DNA, 25 bp, Mus musculus
ggtcaggtcgaaatacctccagcag

SEQ ID NO: 718295 - DNA, 25 bp, Mus musculus
ggtcaggtcgaattacctccagcag

SEQ ID NO: 718296 - DNA, 25 bp, Mus musculus
ggtcagtagatcagtgacagtgccc

SEQ ID NO: 718297 - DNA, 25 bp, Mus musculus
ggtcagtagatctgtgacagtgccc

SEQ ID NO: 718298 - DNA, 25 bp, Mus musculus
ggtcagtatggaccagtgacccctg

SEQ ID NO: 718299 - DNA, 25 bp, Mus musculus
ggtcagtatggagcagtgacccctg

SEQ ID NO: 718300 - DNA, 25 bp, Mus musculus
ggtcagtcactactcatctctgctt

SEQ ID NO: 718301 - DNA, 25 bp, Mus musculus
ggtcagtcactagtcatctctgctt

SEQ ID NO: 718302 - DNA, 25 bp, Mus musculus
ggtcagtcagagcttcaaattttag

SEQ ID NO: 718303 - DNA, 25 bp, Mus musculus
ggtcagtcagaggttcaaattttag

SEQ ID NO: 718304 - DNA, 25 bp, Mus musculus
ggtcagtcagcacttgccagcagtt

SEQ ID NO: 718305 - DNA, 25 bp, Mus musculus
ggtcagtcagcagttgccagcagtt

SEQ ID NO: 718306 - DNA, 25 bp, Mus musculus
ggtcagtcctgaagagtcgaaagct

SEQ ID NO: 718307 - DNA, 25 bp, Mus musculus
ggtcagtcctgatgagtcgaaagct

SEQ ID NO: 718308 - DNA, 25 bp, Mus musculus
ggtcagtctactcggtctacatcca

SEQ ID NO: 718309 - DNA, 25 bp, Mus musculus
ggtcagtctactgggtctacatcca

SEQ ID NO: 718310 - DNA, 25 bp, Mus musculus
ggtcagtctggtctataggtccagc

SEQ ID NO: 718311 - DNA, 25 bp, Mus musculus
ggtcagtctggtgtataggtccagc

SEQ ID NO: 718312 - DNA, 25 bp, Mus musculus
ggtcagtgactaagcttctggagaa

SEQ ID NO: 718313 - DNA, 25 bp, Mus musculus
ggtcagtgactatgcttctggagaa

SEQ ID NO: 718314 - DNA, 25 bp, Mus musculus
ggtcagtgccaaaagaggctctcgt

SEQ ID NO: 718315 - DNA, 25 bp, Mus musculus
ggtcagtgccaatagaggctctcgt

SEQ ID NO: 718316 - DNA, 25 bp, Mus musculus
ggtcagtgggcacaggtacccaggg

SEQ ID NO: 718317 - DNA, 25 bp, Mus musculus
ggtcagtgggcagaggtacccaggg

SEQ ID NO: 718318 - DNA, 25 bp, Mus musculus
ggtcagtgtcccctagcttccgcag

SEQ ID NO: 718319 - DNA, 25 bp, Mus musculus
ggtcagtgtcccgtagcttccgcag

SEQ ID NO: 718320 - DNA, 25 bp, Mus musculus
ggtcagttcctacccagtggctctc

SEQ ID NO: 718321 - DNA, 25 bp, Mus musculus
ggtcagttcctagccagtggctctc

SEQ ID NO: 718322 - DNA, 25 bp, Mus musculus
ggtcagttctgcctgcgtagtaaag

SEQ ID NO: 718323 - DNA, 25 bp, Mus musculus
ggtcagttctgcgtgcgtagtaaag

SEQ ID NO: 718324 - DNA, 25 bp, Mus musculus
ggtcagttgcctcggagacaaacaa

SEQ ID NO: 718325 - DNA, 25 bp, Mus musculus
ggtcagttgcctgggagacaaacaa

SEQ ID NO: 718326 - DNA, 25 bp, Mus musculus
ggtcagttggacagcgaatctggca

SEQ ID NO: 718327 - DNA, 25 bp, Mus musculus
ggtcagttggactgcgaatctggca

SEQ ID NO: 718328 - DNA, 25 bp, Mus musculus
ggtcagtttctcagccagtgggaac

SEQ ID NO: 718329 - DNA, 25 bp, Mus musculus
ggtcagtttctctgccagtgggaac

SEQ ID NO: 718330 - DNA, 25 bp, Mus musculus
ggtcagtttggaaccaggctgcatg

SEQ ID NO: 718331 - DNA, 25 bp, Mus musculus
ggtcagtttggatccaggctgcatg

SEQ ID NO: 718332 - DNA, 25 bp, Mus musculus
ggtcagttttgcagatactccacca

SEQ ID NO: 718333 - DNA, 25 bp, Mus musculus
ggtcagttttgctgatactccacca

SEQ ID NO: 718334 - DNA, 25 bp, Mus musculus
ggtcataaatacaaacgtgggcaag

SEQ ID NO: 718335 - DNA, 25 bp, Mus musculus
ggtcataaatactaacgtgggcaag

SEQ ID NO: 718336 - DNA, 25 bp, Mus musculus
ggtcataaggcacccaccgttgggt

SEQ ID NO: 718337 - DNA, 25 bp, Mus musculus
ggtcataaggcagccaccgttgggt

SEQ ID NO: 718338 - DNA, 25 bp, Mus musculus
ggtcataatcagcagagttctctct

SEQ ID NO: 718339 - DNA, 25 bp, Mus musculus
ggtcataatcaggagagttctctct

SEQ ID NO: 718340 - DNA, 25 bp, Mus musculus
ggtcatacattcctagccagccggg

SEQ ID NO: 718341 - DNA, 25 bp, Mus musculus
ggtcatacattcgtagccagccggg

SEQ ID NO: 718342 - DNA, 25 bp, Mus musculus
ggtcataccaccaattgcttcctgc

SEQ ID NO: 718343 - DNA, 25 bp, Mus musculus
ggtcataccacctattgcttcctgc

SEQ ID NO: 718344 - DNA, 25 bp, Mus musculus
ggtcatacccagacacaccagcttt

SEQ ID NO: 718345 - DNA, 25 bp, Mus musculus
ggtcatacccagtcacaccagcttt

SEQ ID NO: 718346 - DNA, 25 bp, Mus musculus
ggtcatacgaaaataatataggccc

SEQ ID NO: 718347 - DNA, 25 bp, Mus musculus
ggtcatacgaaattaatataggccc

SEQ ID NO: 718348 - DNA, 25 bp, Mus musculus
ggtcatagctttctatgactttgag

SEQ ID NO: 718349 - DNA, 25 bp, Mus musculus
ggtcatagctttgtatgactttgag

SEQ ID NO: 718350 - DNA, 25 bp, Mus musculus
ggtcatagtcagaatcagccaaggc

SEQ ID NO: 718351 - DNA, 25 bp, Mus musculus
ggtcatagtcagtatcagccaaggc

SEQ ID NO: 718352 - DNA, 25 bp, Mus musculus
ggtcatagtgttacataaaacccta

SEQ ID NO: 718353 - DNA, 25 bp, Mus musculus
ggtcatagtgtttcataaaacccta

SEQ ID NO: 718354 - DNA, 25 bp, Mus musculus
ggtcatatcctacgaccccagagga

SEQ ID NO: 718355 - DNA, 25 bp, Mus musculus
ggtcatatcctaggaccccagagga

SEQ ID NO: 718356 - DNA, 25 bp, Mus musculus
ggtcatcaaagaagccaacttatac

SEQ ID NO: 718357 - DNA, 25 bp, Mus musculus
ggtcatcaaagatgccaacttatac

SEQ ID NO: 718358 - DNA, 25 bp, Mus musculus
ggtcatcaatctcctcactgtgtat

SEQ ID NO: 718359 - DNA, 25 bp, Mus musculus
ggtcatcaatctgctcactgtgtat

SEQ ID NO: 718360 - DNA, 25 bp, Mus musculus
ggtcatcactggatatcagctgcct

SEQ ID NO: 718361 - DNA, 25 bp, Mus musculus
ggtcatcactggttatcagctgcct

SEQ ID NO: 718362 - DNA, 25 bp, Mus musculus
ggtcatcagctccaaatgcacactg

SEQ ID NO: 718363 - DNA, 25 bp, Mus musculus
ggtcatcagctcgaaatgcacactg

SEQ ID NO: 718364 - DNA, 25 bp, Mus musculus
ggtcatcaggtaagcagtctgtcgg

SEQ ID NO: 718365 - DNA, 25 bp, Mus musculus
ggtcatcaggtatgcagtctgtcgg

SEQ ID NO: 718366 - DNA, 25 bp, Mus musculus
ggtcatccacttcccgggcttgttt

SEQ ID NO: 718367 - DNA, 25 bp, Mus musculus
ggtcatccacttgccgggcttgttt

SEQ ID NO: 718368 - DNA, 25 bp, Mus musculus
ggtcatccctaaaggtgtcctgaaa

SEQ ID NO: 718369 - DNA, 25 bp, Mus musculus
ggtcatccctaatggtgtcctgaaa

SEQ ID NO: 718370 - DNA, 25 bp, Mus musculus
ggtcatccgcccatcagtataaatg

SEQ ID NO: 718371 - DNA, 25 bp, Mus musculus
ggtcatccgcccttcagtataaatg

SEQ ID NO: 718372 - DNA, 25 bp, Mus musculus
ggtcatcctccgcatcaatcgagct

SEQ ID NO: 718373 - DNA, 25 bp, Mus musculus
ggtcatcctccggatcaatcgagct

SEQ ID NO: 718374 - DNA, 25 bp, Mus musculus
ggtcatcctggacgccgtcaaccag

SEQ ID NO: 718375 - DNA, 25 bp, Mus musculus
ggtcatcctggaggccgtcaaccag

SEQ ID NO: 718376 - DNA, 25 bp, Mus musculus
ggtcatcctgttcttaaacttctat

SEQ ID NO: 718377 - DNA, 25 bp, Mus musculus
ggtcatcctgttgttaaacttctat

SEQ ID NO: 718378 - DNA, 25 bp, Mus musculus
ggtcatcgaatgcacaagcccagta

SEQ ID NO: 718379 - DNA, 25 bp, Mus musculus
ggtcatcgaatggacaagcccagta

SEQ ID NO: 718380 - DNA, 25 bp, Mus musculus
ggtcatcgtgctccccaaggacgac

SEQ ID NO: 718381 - DNA, 25 bp, Mus musculus
ggtcatcgtgctgcccaaggacgac

SEQ ID NO: 718382 - DNA, 25 bp, Mus musculus
ggtcatctaattcggcacgaaggtc

SEQ ID NO: 718383 - DNA, 25 bp, Mus musculus
ggtcatctaattgggcacgaaggtc

SEQ ID NO: 718384 - DNA, 25 bp, Mus musculus
ggtcatctacctcatgccgctgctg

SEQ ID NO: 718385 - DNA, 25 bp, Mus musculus
ggtcatctacctgatgccgctgctg

SEQ ID NO: 718386 - DNA, 25 bp, Mus musculus
ggtcatctcagaccaggcatgatgc

SEQ ID NO: 718387 - DNA, 25 bp, Mus musculus
ggtcatctcagagcaggcatgatgc

SEQ ID NO: 718388 - DNA, 25 bp, Mus musculus
ggtcatctccaaaccctccaaaaag

SEQ ID NO: 718389 - DNA, 25 bp, Mus musculus
ggtcatctccaatccctccaaaaag

SEQ ID NO: 718390 - DNA, 25 bp, Mus musculus
ggtcatctctggagactccctggag

SEQ ID NO: 718391 - DNA, 25 bp, Mus musculus
ggtcatctctggtgactccctggag

SEQ ID NO: 718392 - DNA, 25 bp, Mus musculus
ggtcatcttcaacctcctggtacag

SEQ ID NO: 718393 - DNA, 25 bp, Mus musculus
ggtcatcttcaagctcctggtacag

SEQ ID NO: 718394 - DNA, 25 bp, Mus musculus
ggtcatcttggcatagccatcaact

SEQ ID NO: 718395 - DNA, 25 bp, Mus musculus
ggtcatcttggcttagccatcaact

SEQ ID NO: 718396 - DNA, 25 bp, Mus musculus
ggtcatctttggcagcctccccatt

SEQ ID NO: 718397 - DNA, 25 bp, Mus musculus
ggtcatctttgggagcctccccatt

SEQ ID NO: 718398 - DNA, 25 bp, Mus musculus
ggtcatgaaccccagtgaggtcttc

SEQ ID NO: 718399 - DNA, 25 bp, Mus musculus
ggtcatgaacccgagtgaggtcttc

SEQ ID NO: 718400 - DNA, 25 bp, Mus musculus
ggtcatgaagaactcgtatctgttc

SEQ ID NO: 718401 - DNA, 25 bp, Mus musculus
ggtcatgaagaagtcgtatctgttc

SEQ ID NO: 718402 - DNA, 25 bp, Mus musculus
ggtcatgatctccacatgcccagag

SEQ ID NO: 718403 - DNA, 25 bp, Mus musculus
ggtcatgatctcgacatgcccagag

SEQ ID NO: 718404 - DNA, 25 bp, Mus musculus
ggtcatgcaggtccggccgacctct

SEQ ID NO: 718405 - DNA, 25 bp, Mus musculus
ggtcatgcaggtgcggccgacctct

SEQ ID NO: 718406 - DNA, 25 bp, Mus musculus
ggtcatgctgcacatctctaggatc

SEQ ID NO: 718407 - DNA, 25 bp, Mus musculus
ggtcatgctgcagatctctaggatc

SEQ ID NO: 718408 - DNA, 25 bp, Mus musculus
ggtcatggacacacgaattcagatg

SEQ ID NO: 718409 - DNA, 25 bp, Mus musculus
ggtcatggacactcgaattcagatg

SEQ ID NO: 718410 - DNA, 25 bp, Mus musculus
ggtcatggctggaattcttcctcac

SEQ ID NO: 718411 - DNA, 25 bp, Mus musculus
ggtcatggctggtattcttcctcac

SEQ ID NO: 718412 - DNA, 25 bp, Mus musculus
ggtcatgggtgtactggacatttat

SEQ ID NO: 718413 - DNA, 25 bp, Mus musculus
ggtcatgggtgttctggacatttat

SEQ ID NO: 718414 - DNA, 25 bp, Mus musculus
ggtcatggtcctcgagaagtccctg

SEQ ID NO: 718415 - DNA, 25 bp, Mus musculus
ggtcatggtcctggagaagtccctg

SEQ ID NO: 718416 - DNA, 25 bp, Mus musculus
ggtcatggtgaacattgcacattat

SEQ ID NO: 718417 - DNA, 25 bp, Mus musculus
ggtcatggtgaagattgcacattat

SEQ ID NO: 718418 - DNA, 25 bp, Mus musculus
ggtcatggtggaacacttcttccga

SEQ ID NO: 718419 - DNA, 25 bp, Mus musculus
ggtcatggtggatcacttcttccga

SEQ ID NO: 718420 - DNA, 25 bp, Mus musculus
ggtcatggttggctatccagacttc

SEQ ID NO: 718421 - DNA, 25 bp, Mus musculus
ggtcatggttgggtatccagacttc

SEQ ID NO: 718422 - DNA, 25 bp, Mus musculus
ggtcatgtgggtacaactgcaacta

SEQ ID NO: 718423 - DNA, 25 bp, Mus musculus
ggtcatgtgggttcaactgcaacta

SEQ ID NO: 718424 - DNA, 25 bp, Mus musculus
ggtcatgtggtgaagcgtacgcccc

SEQ ID NO: 718425 - DNA, 25 bp, Mus musculus
ggtcatgtggtgtagcgtacgcccc

SEQ ID NO: 718426 - DNA, 25 bp, Mus musculus
ggtcatgtttctaggcgctctctgg

SEQ ID NO: 718427 - DNA, 25 bp, Mus musculus
ggtcatgtttcttggcgctctctgg

SEQ ID NO: 718428 - DNA, 25 bp, Mus musculus
ggtcattagtgtacccagaggcaga

SEQ ID NO: 718429 - DNA, 25 bp, Mus musculus
ggtcattagtgttcccagaggcaga

SEQ ID NO: 718430 - DNA, 25 bp, Mus musculus
ggtcattatcgtaattgtgatgctc

SEQ ID NO: 718431 - DNA, 25 bp, Mus musculus
ggtcattatcgttattgtgatgctc

SEQ ID NO: 718432 - DNA, 25 bp, Mus musculus
ggtcattcccaacaagaacatttgt

SEQ ID NO: 718433 - DNA, 25 bp, Mus musculus
ggtcattcccaagaagaacatttgt

SEQ ID NO: 718434 - DNA, 25 bp, Mus musculus
ggtcattctcaacgctgcaccatag

SEQ ID NO: 718435 - DNA, 25 bp, Mus musculus
ggtcattctcaaggctgcaccatag

SEQ ID NO: 718436 - DNA, 25 bp, Mus musculus
ggtcattgacagctactattacggg

SEQ ID NO: 718437 - DNA, 25 bp, Mus musculus
ggtcattgacaggtactattacggg

SEQ ID NO: 718438 - DNA, 25 bp, Mus musculus
ggtcattgaccgaatcttcctctgg

SEQ ID NO: 718439 - DNA, 25 bp, Mus musculus
ggtcattgaccgtatcttcctctgg

SEQ ID NO: 718440 - DNA, 25 bp, Mus musculus
ggtcattgctgtcggcatcttcctg

SEQ ID NO: 718441 - DNA, 25 bp, Mus musculus
ggtcattgctgtgggcatcttcctg

SEQ ID NO: 718442 - DNA, 25 bp, Mus musculus
ggtcatttgtgcactgttcagtttc

SEQ ID NO: 718443 - DNA, 25 bp, Mus musculus
ggtcatttgtgctctgttcagtttc

SEQ ID NO: 718444 - DNA, 25 bp, Mus musculus
ggtccaaacttgctcaacacggtga

SEQ ID NO: 718445 - DNA, 25 bp, Mus musculus
ggtccaaacttggtcaacacggtga

SEQ ID NO: 718446 - DNA, 25 bp, Mus musculus
ggtccaacaagacgtccagagctag

SEQ ID NO: 718447 - DNA, 25 bp, Mus musculus
ggtccaacaagaggtccagagctag

SEQ ID NO: 718448 - DNA, 25 bp, Mus musculus
ggtccaacgagcagaatctcagcgg

SEQ ID NO: 718449 - DNA, 25 bp, Mus musculus
ggtccaacgagctgaatctcagcgg

SEQ ID NO: 718450 - DNA, 25 bp, Mus musculus
ggtccaagaactctgaccacctgct

SEQ ID NO: 718451 - DNA, 25 bp, Mus musculus
ggtccaagaactgtgaccacctgct

SEQ ID NO: 718452 - DNA, 25 bp, Mus musculus
ggtccaagaaggattacctacacgg

SEQ ID NO: 718453 - DNA, 25 bp, Mus musculus
ggtccaagaaggtttacctacacgg

SEQ ID NO: 718454 - DNA, 25 bp, Mus musculus
ggtccaagaattagcgatcgtgccc

SEQ ID NO: 718455 - DNA, 25 bp, Mus musculus
ggtccaagaatttgcgatcgtgccc

SEQ ID NO: 718456 - DNA, 25 bp, Mus musculus
ggtccaagacgccatgaagcatctg

SEQ ID NO: 718457 - DNA, 25 bp, Mus musculus
ggtccaagacgcgatgaagcatctg

SEQ ID NO: 718458 - DNA, 25 bp, Mus musculus
ggtccaagcgttcgcctgaagtcaa

SEQ ID NO: 718459 - DNA, 25 bp, Mus musculus
ggtccaagcgttggcctgaagtcaa

SEQ ID NO: 718460 - DNA, 25 bp, Mus musculus
ggtccaagcttcctagtagccaagg

SEQ ID NO: 718461 - DNA, 25 bp, Mus musculus
ggtccaagcttcgtagtagccaagg

SEQ ID NO: 718462 - DNA, 25 bp, Mus musculus
ggtccaaggagaaaacctgtgatcg

SEQ ID NO: 718463 - DNA, 25 bp, Mus musculus
ggtccaaggagataacctgtgatcg

SEQ ID NO: 718464 - DNA, 25 bp, Mus musculus
ggtccaaggcttctcccctgtcttt

SEQ ID NO: 718465 - DNA, 25 bp, Mus musculus
ggtccaaggcttgtcccctgtcttt

SEQ ID NO: 718466 - DNA, 25 bp, Mus musculus
ggtccaagtggactgctaatctgct

SEQ ID NO: 718467 - DNA, 25 bp, Mus musculus
ggtccaagtggagtgctaatctgct

SEQ ID NO: 718468 - DNA, 25 bp, Mus musculus
ggtccaatcgacaacactaaaattg

SEQ ID NO: 718469 - DNA, 25 bp, Mus musculus
ggtccaatcgactacactaaaattg

SEQ ID NO: 718470 - DNA, 25 bp, Mus musculus
ggtccaattgcgaccgcttggtggc

SEQ ID NO: 718471 - DNA, 25 bp, Mus musculus
ggtccaattgcgtccgcttggtggc

SEQ ID NO: 718472 - DNA, 25 bp, Mus musculus
ggtccacaaggcactccaggtttgc

SEQ ID NO: 718473 - DNA, 25 bp, Mus musculus
ggtccacaaggctctccaggtttgc

SEQ ID NO: 718474 - DNA, 25 bp, Mus musculus
ggtccacagagcaagcggtaacctg

SEQ ID NO: 718475 - DNA, 25 bp, Mus musculus
ggtccacagagctagcggtaacctg

SEQ ID NO: 718476 - DNA, 25 bp, Mus musculus
ggtccacatgcaaggcgtctaatga

SEQ ID NO: 718477 - DNA, 25 bp, Mus musculus
ggtccacatgcatggcgtctaatga

SEQ ID NO: 718478 - DNA, 25 bp, Mus musculus
ggtccaccagcgcttttgtttctgt

SEQ ID NO: 718479 - DNA, 25 bp, Mus musculus
ggtccaccagcggttttgtttctgt

SEQ ID NO: 718480 - DNA, 25 bp, Mus musculus
ggtccacctcggagtcctcttgctg

SEQ ID NO: 718481 - DNA, 25 bp, Mus musculus
ggtccacctcggtgtcctcttgctg

SEQ ID NO: 718482 - DNA, 25 bp, Mus musculus
ggtccacgcttcatgacttctgaat

SEQ ID NO: 718483 - DNA, 25 bp, Mus musculus
ggtccacgcttcttgacttctgaat

SEQ ID NO: 718484 - DNA, 25 bp, Mus musculus
ggtccacgtgcaagggcggatcaaa

SEQ ID NO: 718485 - DNA, 25 bp, Mus musculus
ggtccacgtgcatgggcggatcaaa

SEQ ID NO: 718486 - DNA, 25 bp, Mus musculus
ggtccactgcaccacagtaactggg

SEQ ID NO: 718487 - DNA, 25 bp, Mus musculus
ggtccactgcacgacagtaactggg

SEQ ID NO: 718488 - DNA, 25 bp, Mus musculus
ggtccactgtggatcctattaacat

SEQ ID NO: 718489 - DNA, 25 bp, Mus musculus
ggtccactgtggttcctattaacat

SEQ ID NO: 718490 - DNA, 25 bp, Mus musculus
ggtccacttccaacttgtcttcatc

SEQ ID NO: 718491 - DNA, 25 bp, Mus musculus
ggtccacttccatcttgtcttcatc

SEQ ID NO: 718492 - DNA, 25 bp, Mus musculus
ggtccagaaagaacctaaagaagca

SEQ ID NO: 718493 - DNA, 25 bp, Mus musculus
ggtccagaaagatcctaaagaagca

SEQ ID NO: 718494 - DNA, 25 bp, Mus musculus
ggtccagaagctaatgaaaataagg

SEQ ID NO: 718495 - DNA, 25 bp, Mus musculus
ggtccagaagcttatgaaaataagg
